United States Patent 6,821,724 (METHODS OF GENETIC ANALYSIS USING NUCLEIC ACID ARRAYS) - sequence listing, part 3

SEQ ID NO: 65567 - DNA, 25 bp, mus musculus
ttcttgataggctggtagcagagcc

SEQ ID NO: 65568 - DNA, 25 bp, mus musculus
cagagccagctggaacctatggcag

SEQ ID NO: 65569 - DNA, 25 bp, mus musculus
cagctggaacctatggcagcacacg

SEQ ID NO: 65570 - DNA, 25 bp, mus musculus
gaacctatggcagcacacggatttc

SEQ ID NO: 65571 - DNA, 25 bp, mus musculus
atggcagcacacggatttccacaga

SEQ ID NO: 65572 - DNA, 25 bp, mus musculus
ccacagatgacccagaaccagacag

SEQ ID NO: 65573 - DNA, 25 bp, mus musculus
atgacccagaaccagacagcctggt

SEQ ID NO: 65574 - DNA, 25 bp, mus musculus
cagaaccagacagcctggtctagcc

SEQ ID NO: 65575 - DNA, 25 bp, mus musculus
aaccatgccaaccatttactgagct

SEQ ID NO: 65576 - DNA, 25 bp, mus musculus
gccaaccatttactgagctctaaaa

SEQ ID NO: 65577 - DNA, 25 bp, mus musculus
cgtccccaagaagctgcagtgtaac

SEQ ID NO: 65578 - DNA, 25 bp, mus musculus
ccccaagaagctgcagtgtaacggc

SEQ ID NO: 65579 - DNA, 25 bp, mus musculus
tgatgactggagcgacgaggcgcat

SEQ ID NO: 65580 - DNA, 25 bp, mus musculus
gcattgcaactgcagcaaggatctg

SEQ ID NO: 65581 - DNA, 25 bp, mus musculus
ttgcaactgcagcaaggatctgttt

SEQ ID NO: 65582 - DNA, 25 bp, mus musculus
caactgcagcaaggatctgtttcac

SEQ ID NO: 65583 - DNA, 25 bp, mus musculus
caaggatctgtttcactgtggcaca

SEQ ID NO: 65584 - DNA, 25 bp, mus musculus
ggatctgtttcactgtggcacaggc

SEQ ID NO: 65585 - DNA, 25 bp, mus musculus
tctgtttcactgtggcacaggcaag

SEQ ID NO: 65586 - DNA, 25 bp, mus musculus
gtttcactgtggcacaggcaagtgc

SEQ ID NO: 65587 - DNA, 25 bp, mus musculus
catttactgagctctaaaacgatga

SEQ ID NO: 65588 - DNA, 25 bp, mus musculus
tcactgtggcacaggcaagtgcctc

SEQ ID NO: 65589 - DNA, 25 bp, mus musculus
ttactgagctctaaaacgatgagtt

SEQ ID NO: 65590 - DNA, 25 bp, mus musculus
acgatgagttctcacctctgcatcc

SEQ ID NO: 65591 - DNA, 25 bp, mus musculus
tctcacctctgcatccttcggaagg

SEQ ID NO: 65592 - DNA, 25 bp, mus musculus
cacctctgcatccttcggaagggaa

SEQ ID NO: 65593 - DNA, 25 bp, mus musculus
ctctgcatccttcggaagggaagat

SEQ ID NO: 65594 - DNA, 25 bp, mus musculus
atccttcggaagggaagatgaagct

SEQ ID NO: 65595 - DNA, 25 bp, mus musculus
agacttcctgtgtaccagcgggctc

SEQ ID NO: 65596 - DNA, 25 bp, mus musculus
ccacaacagtctttgtggactgcac

SEQ ID NO: 65597 - DNA, 25 bp, mus musculus
tcccacaaagcactatgggaatgct

SEQ ID NO: 65598 - DNA, 25 bp, mus musculus
ttggtccccaagggctcagctgctg

SEQ ID NO: 65599 - DNA, 25 bp, mus musculus
tagagatgctggcacacccaacgaa

SEQ ID NO: 65600 - DNA, 25 bp, mus musculus
tgctggcacacccaacgaactatgg

SEQ ID NO: 65601 - DNA, 25 bp, mus musculus
attctgagtctctcagagcaagaaa

SEQ ID NO: 65602 - DNA, 25 bp, mus musculus
atggcccagatgctgagccaggcat

SEQ ID NO: 65603 - DNA, 25 bp, mus musculus
tcacctctcaggagggctgagacta

SEQ ID NO: 65604 - DNA, 25 bp, mus musculus
actctagacccatttctaactatgc

SEQ ID NO: 65605 - DNA, 25 bp, mus musculus
gacccatttctaactatgctgtcaa

SEQ ID NO: 65606 - DNA, 25 bp, mus musculus
actatgctgtcaaccatcgtattaa

SEQ ID NO: 65607 - DNA, 25 bp, mus musculus
ctgtcaaccatcgtattaagagata

SEQ ID NO: 65608 - DNA, 25 bp, mus musculus
ttccgtatccaggaagattctggag

SEQ ID NO: 65609 - DNA, 25 bp, mus musculus
ttccgagctagcgtgtgtggaaagt

SEQ ID NO: 65610 - DNA, 25 bp, mus musculus
ttgctgtttcttctgggaacgtcag

SEQ ID NO: 65611 - DNA, 25 bp, mus musculus
acgtcaggcaaactctcaggggaag

SEQ ID NO: 65612 - DNA, 25 bp, mus musculus
ttttggtggcaccttgtgggatggc

SEQ ID NO: 65613 - DNA, 25 bp, mus musculus
tggcaccttgtgggatggcacccac

SEQ ID NO: 65614 - DNA, 25 bp, mus musculus
cacccacaaggactgttgtggccat

SEQ ID NO: 65615 - DNA, 25 bp, mus musculus
tggccatctgagaccaccaggaggc

SEQ ID NO: 65616 - DNA, 25 bp, mus musculus
ttttcgatcacatctatactactca

SEQ ID NO: 65617 - DNA, 25 bp, mus musculus
atcacatctatactactcaaagtga

SEQ ID NO: 65618 - DNA, 25 bp, mus musculus
agccagacaagaggccagtgtttgc

SEQ ID NO: 65619 - DNA, 25 bp, mus musculus
ctgacatcagcaaggatctggagaa

SEQ ID NO: 65620 - DNA, 25 bp, mus musculus
gagactacttggacctggctgcatc

SEQ ID NO: 65621 - DNA, 25 bp, mus musculus
acttggacctggctgcatccacacc

SEQ ID NO: 65622 - DNA, 25 bp, mus musculus
cttcggactcactgctgtatgacga

SEQ ID NO: 65623 - DNA, 25 bp, mus musculus
tctatggcatgtcagacccgaactg

SEQ ID NO: 65624 - DNA, 25 bp, mus musculus
gcatgtcagacccgaactggcctgg

SEQ ID NO: 65625 - DNA, 25 bp, mus musculus
cagacccgaactggcctggagagag

SEQ ID NO: 65626 - DNA, 25 bp, mus musculus
taccactcacgagagccgatggcac

SEQ ID NO: 65627 - DNA, 25 bp, mus musculus
ctagcactgggttcccaagatatgc

SEQ ID NO: 65628 - DNA, 25 bp, mus musculus
tgctgctctgggagattgtgaccct

SEQ ID NO: 65629 - DNA, 25 bp, mus musculus
gactcttcaaccttctgaagacagg

SEQ ID NO: 65630 - DNA, 25 bp, mus musculus
tcaaccttctgaagacaggccacag

SEQ ID NO: 65631 - DNA, 25 bp, mus musculus
ttctgaagacaggccacaggatgga

SEQ ID NO: 65632 - DNA, 25 bp, mus musculus
agaggccagacaactgcagcgagga

SEQ ID NO: 65633 - DNA, 25 bp, mus musculus
cagacaactgcagcgaggaaatgta

SEQ ID NO: 65634 - DNA, 25 bp, mus musculus
aaatgtaccgtctgatgctgcagtg

SEQ ID NO: 65635 - DNA, 25 bp, mus musculus
accgtctgatgctgcagtgctggaa

SEQ ID NO: 65636 - DNA, 25 bp, mus musculus
aatgttgtccaccagctgtcagtaa

SEQ ID NO: 65637 - DNA, 25 bp, mus musculus
ttgtccaccagctgtcagtaactct

SEQ ID NO: 65638 - DNA, 25 bp, mus musculus
aggtccacatccagcagattgggcc

SEQ ID NO: 65639 - DNA, 25 bp, mus musculus
agcagatccagactgtgtgcatcga

SEQ ID NO: 65640 - DNA, 25 bp, mus musculus
cagatccagactgtgtgcatcgagt

SEQ ID NO: 65641 - DNA, 25 bp, mus musculus
ggcgagcgcatcaaccccaaggacc

SEQ ID NO: 65642 - DNA, 25 bp, mus musculus
agcgcatcaaccccaaggaccgctg

SEQ ID NO: 65643 - DNA, 25 bp, mus musculus
tcaaccccaaggaccgctgtgagaa

SEQ ID NO: 65644 - DNA, 25 bp, mus musculus
ccccaaggaccgctgtgagaactgc

SEQ ID NO: 65645 - DNA, 25 bp, mus musculus
ccaaggaccgctgtgagaactgcag

SEQ ID NO: 65646 - DNA, 25 bp, mus musculus
gagaactgcagcggacgcaaggtta

SEQ ID NO: 65647 - DNA, 25 bp, mus musculus
actgcagcggacgcaaggttacccg

SEQ ID NO: 65648 - DNA, 25 bp, mus musculus
gtccaccagctgtcagtaactctgg

SEQ ID NO: 65649 - DNA, 25 bp, mus musculus
ccaccagctgtcagtaactctggaa

SEQ ID NO: 65650 - DNA, 25 bp, mus musculus
accagctgtcagtaactctggaaga

SEQ ID NO: 65651 - DNA, 25 bp, mus musculus
gctgtcagtaactctggaagactta

SEQ ID NO: 65652 - DNA, 25 bp, mus musculus
atcactaagaaactggccctccaga

SEQ ID NO: 65653 - DNA, 25 bp, mus musculus
ggatgcaggtccacatccagcagat

SEQ ID NO: 65654 - DNA, 25 bp, mus musculus
atgcaggtccacatccagcagattg

SEQ ID NO: 65655 - DNA, 25 bp, mus musculus
gcaggtccacatccagcagattggg

SEQ ID NO: 65656 - DNA, 25 bp, mus musculus
gcttctgaactccactcctcaacta

SEQ ID NO: 65657 - DNA, 25 bp, mus musculus
ctccactcctcaactatggctacag

SEQ ID NO: 65658 - DNA, 25 bp, mus musculus
gaaatctctgtgagttccaggccag

SEQ ID NO: 65659 - DNA, 25 bp, mus musculus
aggccagcctggtctacgctgggag

SEQ ID NO: 65660 - DNA, 25 bp, mus musculus
gcctggtctacgctgggagttctaa

SEQ ID NO: 65661 - DNA, 25 bp, mus musculus
tggtctacgctgggagttctaacca

SEQ ID NO: 65662 - DNA, 25 bp, mus musculus
tctacgctgggagttctaaccagcc

SEQ ID NO: 65663 - DNA, 25 bp, mus musculus
ggagttctaaccagccagagctaca

SEQ ID NO: 65664 - DNA, 25 bp, mus musculus
gttctaaccagccagagctacatag

SEQ ID NO: 65665 - DNA, 25 bp, mus musculus
ctaaccagccagagctacatagaga

SEQ ID NO: 65666 - DNA, 25 bp, mus musculus
agatcctatctcaacaaggaaaaat

SEQ ID NO: 65667 - DNA, 25 bp, mus musculus
tcctatctcaacaaggaaaaatgaa

SEQ ID NO: 65668 - DNA, 25 bp, mus musculus
cactcctcaactatggctacagctg

SEQ ID NO: 65669 - DNA, 25 bp, mus musculus
tcctcaactatggctacagctgaca

SEQ ID NO: 65670 - DNA, 25 bp, mus musculus
actatggctacagctgacattccat

SEQ ID NO: 65671 - DNA, 25 bp, mus musculus
gctacagctgacattccattccttc

SEQ ID NO: 65672 - DNA, 25 bp, mus musculus
acagctgacattccattccttcatc

SEQ ID NO: 65673 - DNA, 25 bp, mus musculus
gacattccattccttcatccactgt

SEQ ID NO: 65674 - DNA, 25 bp, mus musculus
ccattccttcatccactgtgttcct

SEQ ID NO: 65675 - DNA, 25 bp, mus musculus
catccactgtgttcctcaattaaaa

SEQ ID NO: 65676 - DNA, 25 bp, mus musculus
ggagtctccggctgatgattttgga

SEQ ID NO: 65677 - DNA, 25 bp, mus musculus
gtctccggctgatgattttggaagt

SEQ ID NO: 65678 - DNA, 25 bp, mus musculus
atgttcaaccaccaaagcagcagcc

SEQ ID NO: 65679 - DNA, 25 bp, mus musculus
ttcaaccaccaaagcagcagccaat

SEQ ID NO: 65680 - DNA, 25 bp, mus musculus
caccaaagcagcagccaatgatata

SEQ ID NO: 65681 - DNA, 25 bp, mus musculus
caaagcagcagccaatgatatatat

SEQ ID NO: 65682 - DNA, 25 bp, mus musculus
agtgtcacaccgaaaatgagataaa

SEQ ID NO: 65683 - DNA, 25 bp, mus musculus
taaagtccagggatcccatcagatg

SEQ ID NO: 65684 - DNA, 25 bp, mus musculus
agtccagggatcccatcagatgcag

SEQ ID NO: 65685 - DNA, 25 bp, mus musculus
ccagggatcccatcagatgcagaga

SEQ ID NO: 65686 - DNA, 25 bp, mus musculus
gggatcccatcagatgcagagaatg

SEQ ID NO: 65687 - DNA, 25 bp, mus musculus
atcccatcagatgcagagaatgtgg

SEQ ID NO: 65688 - DNA, 25 bp, mus musculus
gaggtagcacactcctgccatttga

SEQ ID NO: 65689 - DNA, 25 bp, mus musculus
gtagcacactcctgccatttgagcg

SEQ ID NO: 65690 - DNA, 25 bp, mus musculus
gcacactcctgccatttgagcgctt

SEQ ID NO: 65691 - DNA, 25 bp, mus musculus
cactcctgccatttgagcgcttgga

SEQ ID NO: 65692 - DNA, 25 bp, mus musculus
tcctgccatttgagcgcttggaagc

SEQ ID NO: 65693 - DNA, 25 bp, mus musculus
tgccatttgagcgcttggaagcaga

SEQ ID NO: 65694 - DNA, 25 bp, mus musculus
catttgagcgcttggaagcagaggc

SEQ ID NO: 65695 - DNA, 25 bp, mus musculus
aagatgttcaaccaccaaagcagca

SEQ ID NO: 65696 - DNA, 25 bp, mus musculus
gcctgcgaacctggagaaccgcttg

SEQ ID NO: 65697 - DNA, 25 bp, mus musculus
ctgcgaacctggagaaccgcttgca

SEQ ID NO: 65698 - DNA, 25 bp, mus musculus
cttgacggtcctgtattccattgag

SEQ ID NO: 65699 - DNA, 25 bp, mus musculus
tgacggtcctgtattccattgagcg

SEQ ID NO: 65700 - DNA, 25 bp, mus musculus
acggtcctgtattccattgagcgag

SEQ ID NO: 65701 - DNA, 25 bp, mus musculus
tcctgtattccattgagcgagaggt

SEQ ID NO: 65702 - DNA, 25 bp, mus musculus
ctgtattccattgagcgagaggtgg

SEQ ID NO: 65703 - DNA, 25 bp, mus musculus
gtattccattgagcgagaggtggtt

SEQ ID NO: 65704 - DNA, 25 bp, mus musculus
attccattgagcgagaggtggttgc

SEQ ID NO: 65705 - DNA, 25 bp, mus musculus
gaggactttgccgtgaatgagctag

SEQ ID NO: 65706 - DNA, 25 bp, mus musculus
ggactttgccgtgaatgagctagac

SEQ ID NO: 65707 - DNA, 25 bp, mus musculus
actttgccgtgaatgagctagacta

SEQ ID NO: 65708 - DNA, 25 bp, mus musculus
agaaccgcttgcacgcgtggtacga

SEQ ID NO: 65709 - DNA, 25 bp, mus musculus
aaccgcttgcacgcgtggtacgacg

SEQ ID NO: 65710 - DNA, 25 bp, mus musculus
ccgcttgcacgcgtggtacgacgcc

SEQ ID NO: 65711 - DNA, 25 bp, mus musculus
gcttgcacgcgtggtacgacgccga

SEQ ID NO: 65712 - DNA, 25 bp, mus musculus
ttgcacgcgtggtacgacgccgacc

SEQ ID NO: 65713 - DNA, 25 bp, mus musculus
acgcgtggtacgacgccgacctgag

SEQ ID NO: 65714 - DNA, 25 bp, mus musculus
acctcttgacggtcctgtattccat

SEQ ID NO: 65715 - DNA, 25 bp, mus musculus
ctcttgacggtcctgtattccattg

SEQ ID NO: 65716 - DNA, 25 bp, mus musculus
gcaaacagattccctccttcgagcg

SEQ ID NO: 65717 - DNA, 25 bp, mus musculus
ccttcgagcgctacatggcccgact

SEQ ID NO: 65718 - DNA, 25 bp, mus musculus
agtcagcctatatgcaccagctcct

SEQ ID NO: 65719 - DNA, 25 bp, mus musculus
cctatatgcaccagctcctgggcct

SEQ ID NO: 65720 - DNA, 25 bp, mus musculus
atatgcaccagctcctgggcctcaa

SEQ ID NO: 65721 - DNA, 25 bp, mus musculus
tgcaccagctcctgggcctcaatct

SEQ ID NO: 65722 - DNA, 25 bp, mus musculus
agctcctgggcctcaatctcctctt

SEQ ID NO: 65723 - DNA, 25 bp, mus musculus
tacctgccaaggacatccagacgac

SEQ ID NO: 65724 - DNA, 25 bp, mus musculus
ctgccaaggacatccagacgactgt

SEQ ID NO: 65725 - DNA, 25 bp, mus musculus
aggacatccagacgactgtctgcat

SEQ ID NO: 65726 - DNA, 25 bp, mus musculus
acatccagacgactgtctgcatcaa

SEQ ID NO: 65727 - DNA, 25 bp, mus musculus
tccagacgactgtctgcatcaaaca

SEQ ID NO: 65728 - DNA, 25 bp, mus musculus
gctacatggcccgactcaaatgcta

SEQ ID NO: 65729 - DNA, 25 bp, mus musculus
ccagacgactgtctgcatcaaacac

SEQ ID NO: 65730 - DNA, 25 bp, mus musculus
acatggcccgactcaaatgctacta

SEQ ID NO: 65731 - DNA, 25 bp, mus musculus
tggcccgactcaaatgctactactg

SEQ ID NO: 65732 - DNA, 25 bp, mus musculus
gactcaaatgctactactgtgatga

SEQ ID NO: 65733 - DNA, 25 bp, mus musculus
tcaaatgctactactgtgatgacaa

SEQ ID NO: 65734 - DNA, 25 bp, mus musculus
aatgctactactgtgatgacaaaga

SEQ ID NO: 65735 - DNA, 25 bp, mus musculus
agcagcttcctgagtcagcctatat

SEQ ID NO: 65736 - DNA, 25 bp, mus musculus
ctgagtcagcctatatgcaccagct

SEQ ID NO: 65737 - DNA, 25 bp, mus musculus
tgacgctgcagcagcagaactcact

SEQ ID NO: 65738 - DNA, 25 bp, mus musculus
agcagaactcactggagcaatgggc

SEQ ID NO: 65739 - DNA, 25 bp, mus musculus
tggccacctcactgaatcccttgga

SEQ ID NO: 65740 - DNA, 25 bp, mus musculus
cctcactgaatcccttggaccctga

SEQ ID NO: 65741 - DNA, 25 bp, mus musculus
ccttggaccctgacaaagatgaaga

SEQ ID NO: 65742 - DNA, 25 bp, mus musculus
ccgcactaggccctgaagctctgga

SEQ ID NO: 65743 - DNA, 25 bp, mus musculus
ctgaagctctggagccaccagcgaa

SEQ ID NO: 65744 - DNA, 25 bp, mus musculus
agccaccagcgaaactggcgcggac

SEQ ID NO: 65745 - DNA, 25 bp, mus musculus
cagcgaaactggcgcggactgacac

SEQ ID NO: 65746 - DNA, 25 bp, mus musculus
aactggcgcggactgacactcgtgg

SEQ ID NO: 65747 - DNA, 25 bp, mus musculus
cgcggactgacactcgtggcctctt

SEQ ID NO: 65748 - DNA, 25 bp, mus musculus
ctcgtggcctctttgtgcaggccct

SEQ ID NO: 65749 - DNA, 25 bp, mus musculus
gccaggtgctcaagccctaccaggg

SEQ ID NO: 65750 - DNA, 25 bp, mus musculus
tgctcaagccctaccagggcagttc

SEQ ID NO: 65751 - DNA, 25 bp, mus musculus
aggcggccaagctcttcctcctcaa

SEQ ID NO: 65752 - DNA, 25 bp, mus musculus
acctgatcgagcacagagtggccca

SEQ ID NO: 65753 - DNA, 25 bp, mus musculus
tcgagcacagagtggcccaggccaa

SEQ ID NO: 65754 - DNA, 25 bp, mus musculus
acagagtggcccaggccaagggcga

SEQ ID NO: 65755 - DNA, 25 bp, mus musculus
agaccccaatcgcagtcatgggaga

SEQ ID NO: 65756 - DNA, 25 bp, mus musculus
caatcgcagtcatgggagagtttgc

SEQ ID NO: 65757 - DNA, 25 bp, mus musculus
atgcatctaatggcctctcatggac

SEQ ID NO: 65758 - DNA, 25 bp, mus musculus
ccaggcacacaccctggatacatgc

SEQ ID NO: 65759 - DNA, 25 bp, mus musculus
caagtagccacaggggtcagcacca

SEQ ID NO: 65760 - DNA, 25 bp, mus musculus
gccacaggggtcagcaccatatcca

SEQ ID NO: 65761 - DNA, 25 bp, mus musculus
ggggtcagcaccatatccacgcctc

SEQ ID NO: 65762 - DNA, 25 bp, mus musculus
gcagtgcctgagcccctgcagtctt

SEQ ID NO: 65763 - DNA, 25 bp, mus musculus
ccccaaactagccatgcttgctgct

SEQ ID NO: 65764 - DNA, 25 bp, mus musculus
ccctagaccatgagatctctgcaga

SEQ ID NO: 65765 - DNA, 25 bp, mus musculus
agatctctgcagacaaatgaacacc

SEQ ID NO: 65766 - DNA, 25 bp, mus musculus
caatgcctattgggccctgagttct

SEQ ID NO: 65767 - DNA, 25 bp, mus musculus
ctattgggccctgagttctagaggc

SEQ ID NO: 65768 - DNA, 25 bp, mus musculus
ccctaacatgttacaccttgctgct

SEQ ID NO: 65769 - DNA, 25 bp, mus musculus
ctaacggcatctcatctcatcctgg

SEQ ID NO: 65770 - DNA, 25 bp, mus musculus
gctgctgtcgtcatgttgagaattc

SEQ ID NO: 65771 - DNA, 25 bp, mus musculus
gcatctcatctcatcctggacaggt

SEQ ID NO: 65772 - DNA, 25 bp, mus musculus
ctccaagcagggccagtcaagccca

SEQ ID NO: 65773 - DNA, 25 bp, mus musculus
ccagtcaagcccagatgatcgaccc

SEQ ID NO: 65774 - DNA, 25 bp, mus musculus
agatgatcgacccatctgcttgact

SEQ ID NO: 65775 - DNA, 25 bp, mus musculus
tcgacccatctgcttgactatagac

SEQ ID NO: 65776 - DNA, 25 bp, mus musculus
catctgcttgactatagactttctg

SEQ ID NO: 65777 - DNA, 25 bp, mus musculus
cttgactatagactttctgtccaat

SEQ ID NO: 65778 - DNA, 25 bp, mus musculus
ttatatttccagatagagagttcag

SEQ ID NO: 65779 - DNA, 25 bp, mus musculus
agttcagaacaccatgctctaaagc

SEQ ID NO: 65780 - DNA, 25 bp, mus musculus
cattttctggtctccctgcaacacg

SEQ ID NO: 65781 - DNA, 25 bp, mus musculus
gtctccctgcaacacgtccatcgga

SEQ ID NO: 65782 - DNA, 25 bp, mus musculus
tccctgcaacacgtccatcggaaaa

SEQ ID NO: 65783 - DNA, 25 bp, mus musculus
aaagtctggtgcttagagagggtgc

SEQ ID NO: 65784 - DNA, 25 bp, mus musculus
agggtgccattgtctcttgtatata

SEQ ID NO: 65785 - DNA, 25 bp, mus musculus
gtgccattgtctcttgtatatacgg

SEQ ID NO: 65786 - DNA, 25 bp, mus musculus
ccattgtctcttgtatatacggtca

SEQ ID NO: 65787 - DNA, 25 bp, mus musculus
ttgtaaatgcctgtccaacaataaa

SEQ ID NO: 65788 - DNA, 25 bp, mus musculus
taaatgcctgtccaacaataaaagt

SEQ ID NO: 65789 - DNA, 25 bp, mus musculus
atgcctgtccaacaataaaagtact

SEQ ID NO: 65790 - DNA, 25 bp, mus musculus
tctatgccctttgtaccactgcact

SEQ ID NO: 65791 - DNA, 25 bp, mus musculus
ccctttgtaccactgcactgttcgt

SEQ ID NO: 65792 - DNA, 25 bp, mus musculus
ccactgcactgttcgtaacatctcg

SEQ ID NO: 65793 - DNA, 25 bp, mus musculus
tgttcgtaacatctcggggtcgatt

SEQ ID NO: 65794 - DNA, 25 bp, mus musculus
gtcgattgcgtccggatgggaaact

SEQ ID NO: 65795 - DNA, 25 bp, mus musculus
tgcgtccggatgggaaactgaagca

SEQ ID NO: 65796 - DNA, 25 bp, mus musculus
tagtcacattttctggtctccctgc

SEQ ID NO: 65797 - DNA, 25 bp, mus musculus
tcacattttctggtctccctgcaac

SEQ ID NO: 65798 - DNA, 25 bp, mus musculus
gcatcagccatgtgctgcggggctc

SEQ ID NO: 65799 - DNA, 25 bp, mus musculus
tcctctaccaggccctgggctggca

SEQ ID NO: 65800 - DNA, 25 bp, mus musculus
tgccagaagccttgcttgacatcat

SEQ ID NO: 65801 - DNA, 25 bp, mus musculus
cagaagccttgcttgacatcatcac

SEQ ID NO: 65802 - DNA, 25 bp, mus musculus
aagccttgcttgacatcatcaccaa

SEQ ID NO: 65803 - DNA, 25 bp, mus musculus
ccttgcttgacatcatcaccaactg

SEQ ID NO: 65804 - DNA, 25 bp, mus musculus
tgcttgacatcatcaccaactgtgg

SEQ ID NO: 65805 - DNA, 25 bp, mus musculus
ttgacatcatcaccaactgtggctc

SEQ ID NO: 65806 - DNA, 25 bp, mus musculus
ggaccctgccggagctgattacaca

SEQ ID NO: 65807 - DNA, 25 bp, mus musculus
accctgccggagctgattacacagt

SEQ ID NO: 65808 - DNA, 25 bp, mus musculus
ccctgccggagctgattacacagtt

SEQ ID NO: 65809 - DNA, 25 bp, mus musculus
cctgccggagctgattacacagttt

SEQ ID NO: 65810 - DNA, 25 bp, mus musculus
ctcgatttgctcatctgcccctgct

SEQ ID NO: 65811 - DNA, 25 bp, mus musculus
tgattacacagtttgacctgacgcg

SEQ ID NO: 65812 - DNA, 25 bp, mus musculus
tcctcaacagggatggtagcaagct

SEQ ID NO: 65813 - DNA, 25 bp, mus musculus
gtagcaagctgtctaagaggcaagg

SEQ ID NO: 65814 - DNA, 25 bp, mus musculus
acattttcctggaacattttgctgc

SEQ ID NO: 65815 - DNA, 25 bp, mus musculus
ttttcctggaacattttgctgccac

SEQ ID NO: 65816 - DNA, 25 bp, mus musculus
ttgctgccaccggttttctgccaga

SEQ ID NO: 65817 - DNA, 25 bp, mus musculus
gttttctgccagaagccttgcttga

SEQ ID NO: 65818 - DNA, 25 bp, mus musculus
ttctgccagaagccttgcttgacat

SEQ ID NO: 65819 - DNA, 25 bp, mus musculus
gttactcatgccttgaggacaacag

SEQ ID NO: 65820 - DNA, 25 bp, mus musculus
catgccttgaggacaacagagtacc

SEQ ID NO: 65821 - DNA, 25 bp, mus musculus
tacagtcgcttaaatctcaacaaca

SEQ ID NO: 65822 - DNA, 25 bp, mus musculus
agtcgcttaaatctcaacaacaccg

SEQ ID NO: 65823 - DNA, 25 bp, mus musculus
cgcttaaatctcaacaacaccgtgc

SEQ ID NO: 65824 - DNA, 25 bp, mus musculus
ttaaatctcaacaacaccgtgctgt

SEQ ID NO: 65825 - DNA, 25 bp, mus musculus
aatctcaacaacaccgtgctgtcca

SEQ ID NO: 65826 - DNA, 25 bp, mus musculus
ctcaacaacaccgtgctgtccaaaa

SEQ ID NO: 65827 - DNA, 25 bp, mus musculus
aagctcacgtggtttgtcaatgaag

SEQ ID NO: 65828 - DNA, 25 bp, mus musculus
tttcctacagttcgtggagttctga

SEQ ID NO: 65829 - DNA, 25 bp, mus musculus
cctacagttcgtggagttctgagaa

SEQ ID NO: 65830 - DNA, 25 bp, mus musculus
acagttcgtggagttctgagaagag

SEQ ID NO: 65831 - DNA, 25 bp, mus musculus
acaacagagtaccacgaccgagatg

SEQ ID NO: 65832 - DNA, 25 bp, mus musculus
acagagtaccacgaccgagatgaac

SEQ ID NO: 65833 - DNA, 25 bp, mus musculus
gagtaccacgaccgagatgaacaat

SEQ ID NO: 65834 - DNA, 25 bp, mus musculus
taccacgaccgagatgaacaatttt

SEQ ID NO: 65835 - DNA, 25 bp, mus musculus
ataaggaaaccatacatctgggagt

SEQ ID NO: 65836 - DNA, 25 bp, mus musculus
aggaaaccatacatctgggagtaca

SEQ ID NO: 65837 - DNA, 25 bp, mus musculus
aaaccatacatctgggagtacagtc

SEQ ID NO: 65838 - DNA, 25 bp, mus musculus
ccatacatctgggagtacagtcgct

SEQ ID NO: 65839 - DNA, 25 bp, mus musculus
tcgccagccgtcagcatgatgagct

SEQ ID NO: 65840 - DNA, 25 bp, mus musculus
cgccagccgtcagcatgatgagctg

SEQ ID NO: 65841 - DNA, 25 bp, mus musculus
tgatgagctgccgggacctcgtgag

SEQ ID NO: 65842 - DNA, 25 bp, mus musculus
ggagctgttctccgagatctaggag

SEQ ID NO: 65843 - DNA, 25 bp, mus musculus
gctgttctccgagatctaggagatg

SEQ ID NO: 65844 - DNA, 25 bp, mus musculus
ctgttctccgagatctaggagatgc

SEQ ID NO: 65845 - DNA, 25 bp, mus musculus
tgttctccgagatctaggagatgcg

SEQ ID NO: 65846 - DNA, 25 bp, mus musculus
gttctccgagatctaggagatgcgg

SEQ ID NO: 65847 - DNA, 25 bp, mus musculus
ttctccgagatctaggagatgcggc

SEQ ID NO: 65848 - DNA, 25 bp, mus musculus
tctccgagatctaggagatgcggcg

SEQ ID NO: 65849 - DNA, 25 bp, mus musculus
tggtcacccgtgtggagattgtcat

SEQ ID NO: 65850 - DNA, 25 bp, mus musculus
ggtcacccgtgtggagattgtcatg

SEQ ID NO: 65851 - DNA, 25 bp, mus musculus
ccagccgtcagcatgatgagctgcc

SEQ ID NO: 65852 - DNA, 25 bp, mus musculus
cagccgtcagcatgatgagctgccg

SEQ ID NO: 65853 - DNA, 25 bp, mus musculus
agccgtcagcatgatgagctgccgg

SEQ ID NO: 65854 - DNA, 25 bp, mus musculus
gccgtcagcatgatgagctgccggg

SEQ ID NO: 65855 - DNA, 25 bp, mus musculus
tcagcatgatgagctgccgggacct

SEQ ID NO: 65856 - DNA, 25 bp, mus musculus
cagcatgatgagctgccgggacctc

SEQ ID NO: 65857 - DNA, 25 bp, mus musculus
agcatgatgagctgccgggacctcg

SEQ ID NO: 65858 - DNA, 25 bp, mus musculus
atgatgagctgccgggacctcgtga

SEQ ID NO: 65859 - DNA, 25 bp, mus musculus
tgaagttgtgccatccttcatcaac

SEQ ID NO: 65860 - DNA, 25 bp, mus musculus
tgtgccatccttcatcaacaaagat

SEQ ID NO: 65861 - DNA, 25 bp, mus musculus
ttctgttgttagcttggaaggcttt

SEQ ID NO: 65862 - DNA, 25 bp, mus musculus
aactctccatgatagactgggtgaa

SEQ ID NO: 65863 - DNA, 25 bp, mus musculus
cagtcctccagggcttaaatacttg

SEQ ID NO: 65864 - DNA, 25 bp, mus musculus
gagccagcaatgttgccacgtcggt

SEQ ID NO: 65865 - DNA, 25 bp, mus musculus
ttgccacgtcggttgtagcagaaga

SEQ ID NO: 65866 - DNA, 25 bp, mus musculus
tgctaaactctattgctgatacgga

SEQ ID NO: 65867 - DNA, 25 bp, mus musculus
actctattgctgatacggagctaat

SEQ ID NO: 65868 - DNA, 25 bp, mus musculus
agtccagtgttcacatgcattcttg

SEQ ID NO: 65869 - DNA, 25 bp, mus musculus
gtgttcacatgcattcttgctacct

SEQ ID NO: 65870 - DNA, 25 bp, mus musculus
attcttgctacctggttgatggcct

SEQ ID NO: 65871 - DNA, 25 bp, mus musculus
atccttcatcaacaaagatgcagag

SEQ ID NO: 65872 - DNA, 25 bp, mus musculus
gacgctgaaatgccttccaaatttg

SEQ ID NO: 65873 - DNA, 25 bp, mus musculus
agagctcaaggcagtactgtctgag

SEQ ID NO: 65874 - DNA, 25 bp, mus musculus
agtactgtctgaggctcaggcctcg

SEQ ID NO: 65875 - DNA, 25 bp, mus musculus
agagctacaacacgcacctgtgttg

SEQ ID NO: 65876 - DNA, 25 bp, mus musculus
acaacacgcacctgtgttgagcgat

SEQ ID NO: 65877 - DNA, 25 bp, mus musculus
cgcacctgtgttgagcgattctgtt

SEQ ID NO: 65878 - DNA, 25 bp, mus musculus
tgtgttgagcgattctgttgttagc

SEQ ID NO: 65879 - DNA, 25 bp, mus musculus
tgagctgagccttcacggtgcgctt

SEQ ID NO: 65880 - DNA, 25 bp, mus musculus
agctgagccttcacggtgcgcttcc

SEQ ID NO: 65881 - DNA, 25 bp, mus musculus
cgaagccccactgatggcgtggaat

SEQ ID NO: 65882 - DNA, 25 bp, mus musculus
gaagccccactgatggcgtggaatg

SEQ ID NO: 65883 - DNA, 25 bp, mus musculus
aagacctgtgaggctcaacgtgaga

SEQ ID NO: 65884 - DNA, 25 bp, mus musculus
agacctgtgaggctcaacgtgagag

SEQ ID NO: 65885 - DNA, 25 bp, mus musculus
gacctgtgaggctcaacgtgagagt

SEQ ID NO: 65886 - DNA, 25 bp, mus musculus
acctgtgaggctcaacgtgagagtg

SEQ ID NO: 65887 - DNA, 25 bp, mus musculus
cctgtgaggctcaacgtgagagtga

SEQ ID NO: 65888 - DNA, 25 bp, mus musculus
tgtgaggctcaacgtgagagtgaag

SEQ ID NO: 65889 - DNA, 25 bp, mus musculus
atggagaccgctgctccctgctgac

SEQ ID NO: 65890 - DNA, 25 bp, mus musculus
gtctgttgcgcggtgactggcatgc

SEQ ID NO: 65891 - DNA, 25 bp, mus musculus
ctgagccttcacggtgcgcttcctg

SEQ ID NO: 65892 - DNA, 25 bp, mus musculus
tgagccttcacggtgcgcttcctgg

SEQ ID NO: 65893 - DNA, 25 bp, mus musculus
gagccttcacggtgcgcttcctgga

SEQ ID NO: 65894 - DNA, 25 bp, mus musculus
ctggacagcctgcgaagccccactg

SEQ ID NO: 65895 - DNA, 25 bp, mus musculus
ggacagcctgcgaagccccactgat

SEQ ID NO: 65896 - DNA, 25 bp, mus musculus
gacagcctgcgaagccccactgatg

SEQ ID NO: 65897 - DNA, 25 bp, mus musculus
acagcctgcgaagccccactgatgg

SEQ ID NO: 65898 - DNA, 25 bp, mus musculus
cctgcgaagccccactgatggcgtg

SEQ ID NO: 65899 - DNA, 25 bp, mus musculus
cagtctgccatggactcctgttgtg

SEQ ID NO: 65900 - DNA, 25 bp, mus musculus
gtctgccatggactcctgttgtgat

SEQ ID NO: 65901 - DNA, 25 bp, mus musculus
atcttgcacatcgcaggacgtctag

SEQ ID NO: 65902 - DNA, 25 bp, mus musculus
cttgcacatcgcaggacgtctagcg

SEQ ID NO: 65903 - DNA, 25 bp, mus musculus
tgcacatcgcaggacgtctagcggt

SEQ ID NO: 65904 - DNA, 25 bp, mus musculus
cacatcgcaggacgtctagcggtca

SEQ ID NO: 65905 - DNA, 25 bp, mus musculus
tcgcaggacgtctagcggtcagcag

SEQ ID NO: 65906 - DNA, 25 bp, mus musculus
aggacgtctagcggtcagcaggaca

SEQ ID NO: 65907 - DNA, 25 bp, mus musculus
gactgaccttcggcgtaagtatcgc

SEQ ID NO: 65908 - DNA, 25 bp, mus musculus
ctgaccttcggcgtaagtatcgctg

SEQ ID NO: 65909 - DNA, 25 bp, mus musculus
gcgtaagtatcgctgctctgtttga

SEQ ID NO: 65910 - DNA, 25 bp, mus musculus
gtaagtatcgctgctctgtttgacg

SEQ ID NO: 65911 - DNA, 25 bp, mus musculus
ctgccatggactcctgttgtgatct

SEQ ID NO: 65912 - DNA, 25 bp, mus musculus
taagtatcgctgctctgtttgacgg

SEQ ID NO: 65913 - DNA, 25 bp, mus musculus
catggactcctgttgtgatctacta

SEQ ID NO: 65914 - DNA, 25 bp, mus musculus
tggactcctgttgtgatctactagg

SEQ ID NO: 65915 - DNA, 25 bp, mus musculus
gactcctgttgtgatctactaggat

SEQ ID NO: 65916 - DNA, 25 bp, mus musculus
ctcctgttgtgatctactaggatta

SEQ ID NO: 65917 - DNA, 25 bp, mus musculus
aggccggcatcttgcacatcgcagg

SEQ ID NO: 65918 - DNA, 25 bp, mus musculus
gccggcatcttgcacatcgcaggac

SEQ ID NO: 65919 - DNA, 25 bp, mus musculus
cggcatcttgcacatcgcaggacgt

SEQ ID NO: 65920 - DNA, 25 bp, mus musculus
cactgccaaggggatgctgccagac

SEQ ID NO: 65921 - DNA, 25 bp, mus musculus
attatcgtgagctggatgattgcgc

SEQ ID NO: 65922 - DNA, 25 bp, mus musculus
tcccacagaaaacaggctagcttat

SEQ ID NO: 65923 - DNA, 25 bp, mus musculus
caggctagcttatcatacttgttca

SEQ ID NO: 65924 - DNA, 25 bp, mus musculus
gctagcttatcatacttgttcacct

SEQ ID NO: 65925 - DNA, 25 bp, mus musculus
tagcttatcatacttgttcacctga

SEQ ID NO: 65926 - DNA, 25 bp, mus musculus
cttatcatacttgttcacctgatta

SEQ ID NO: 65927 - DNA, 25 bp, mus musculus
atcatacttgttcacctgattaact

SEQ ID NO: 65928 - DNA, 25 bp, mus musculus
tacttgttcacctgattaactgaag

SEQ ID NO: 65929 - DNA, 25 bp, mus musculus
cttgttcacctgattaactgaagaa

SEQ ID NO: 65930 - DNA, 25 bp, mus musculus
gttcacctgattaactgaagaactg

SEQ ID NO: 65931 - DNA, 25 bp, mus musculus
ttcacctgattaactgaagaactga

SEQ ID NO: 65932 - DNA, 25 bp, mus musculus
tatcgtgagctggatgattgcgcag

SEQ ID NO: 65933 - DNA, 25 bp, mus musculus
tttaacagactattcttgaggaaag

SEQ ID NO: 65934 - DNA, 25 bp, mus musculus
taacagactattcttgaggaaagaa

SEQ ID NO: 65935 - DNA, 25 bp, mus musculus
agtattcattaaaccacagaagtat

SEQ ID NO: 65936 - DNA, 25 bp, mus musculus
gtattcattaaaccacagaagtatt

SEQ ID NO: 65937 - DNA, 25 bp, mus musculus
ttcattaaaccacagaagtattttg

SEQ ID NO: 65938 - DNA, 25 bp, mus musculus
catttagattcccacagaaaacagg

SEQ ID NO: 65939 - DNA, 25 bp, mus musculus
tttagattcccacagaaaacaggct

SEQ ID NO: 65940 - DNA, 25 bp, mus musculus
agactggattcccagctgatggaat

SEQ ID NO: 65941 - DNA, 25 bp, mus musculus
ctggattcccagctgatggaatgtt

SEQ ID NO: 65942 - DNA, 25 bp, mus musculus
gactgtgatgtctgtgttggtagtg

SEQ ID NO: 65943 - DNA, 25 bp, mus musculus
ctgtgatgtctgtgttggtagtgag

SEQ ID NO: 65944 - DNA, 25 bp, mus musculus
tgtgatgtctgtgttggtagtgagt

SEQ ID NO: 65945 - DNA, 25 bp, mus musculus
tagtgagttcttccagaagggcgca

SEQ ID NO: 65946 - DNA, 25 bp, mus musculus
tgagttcttccagaagggcgcagag

SEQ ID NO: 65947 - DNA, 25 bp, mus musculus
gagttcttccagaagggcgcagagg

SEQ ID NO: 65948 - DNA, 25 bp, mus musculus
gttcttccagaagggcgcagaggag

SEQ ID NO: 65949 - DNA, 25 bp, mus musculus
ttcttccagaagggcgcagaggagt

SEQ ID NO: 65950 - DNA, 25 bp, mus musculus
tcttccagaagggcgcagaggagtg

SEQ ID NO: 65951 - DNA, 25 bp, mus musculus
ttccagaagggcgcagaggagtgtc

SEQ ID NO: 65952 - DNA, 25 bp, mus musculus
tggattcccagctgatggaatgttg

SEQ ID NO: 65953 - DNA, 25 bp, mus musculus
gattcccagctgatggaatgttgac

SEQ ID NO: 65954 - DNA, 25 bp, mus musculus
attcccagctgatggaatgttgact

SEQ ID NO: 65955 - DNA, 25 bp, mus musculus
ttcccagctgatggaatgttgactg

SEQ ID NO: 65956 - DNA, 25 bp, mus musculus
aatgttgactgtgatgtctgtgttg

SEQ ID NO: 65957 - DNA, 25 bp, mus musculus
atgttgactgtgatgtctgtgttgg

SEQ ID NO: 65958 - DNA, 25 bp, mus musculus
tgttgactgtgatgtctgtgttggt

SEQ ID NO: 65959 - DNA, 25 bp, mus musculus
tgactgtgatgtctgtgttggtagt

SEQ ID NO: 65960 - DNA, 25 bp, mus musculus
caagtgtcctgggtgatcgctgtct

SEQ ID NO: 65961 - DNA, 25 bp, mus musculus
aagtgtcctgggtgatcgctgtctt

SEQ ID NO: 65962 - DNA, 25 bp, mus musculus
atgttaagcactggctctgagcagg

SEQ ID NO: 65963 - DNA, 25 bp, mus musculus
tgttaagcactggctctgagcaggt

SEQ ID NO: 65964 - DNA, 25 bp, mus musculus
aggtcatggacttcacgccagcgcg

SEQ ID NO: 65965 - DNA, 25 bp, mus musculus
tcatggacttcacgccagcgcggag

SEQ ID NO: 65966 - DNA, 25 bp, mus musculus
catggacttcacgccagcgcggagg

SEQ ID NO: 65967 - DNA, 25 bp, mus musculus
tggacttcacgccagcgcggaggag

SEQ ID NO: 65968 - DNA, 25 bp, mus musculus
ggacttcacgccagcgcggaggaga

SEQ ID NO: 65969 - DNA, 25 bp, mus musculus
gacttcacgccagcgcggaggagaa

SEQ ID NO: 65970 - DNA, 25 bp, mus musculus
cttcacgccagcgcggaggagaagg

SEQ ID NO: 65971 - DNA, 25 bp, mus musculus
ttcacgccagcgcggaggagaagga

SEQ ID NO: 65972 - DNA, 25 bp, mus musculus
gtgtcctgggtgatcgctgtcttct

SEQ ID NO: 65973 - DNA, 25 bp, mus musculus
tcgctgtcttctgtgggtctgactg

SEQ ID NO: 65974 - DNA, 25 bp, mus musculus
cgctgtcttctgtgggtctgactgt

SEQ ID NO: 65975 - DNA, 25 bp, mus musculus
ctgtcttctgtgggtctgactgtgg

SEQ ID NO: 65976 - DNA, 25 bp, mus musculus
agtcattgacctagtaagctcagtg

SEQ ID NO: 65977 - DNA, 25 bp, mus musculus
tcattgacctagtaagctcagtggt

SEQ ID NO: 65978 - DNA, 25 bp, mus musculus
cattgacctagtaagctcagtggtt

SEQ ID NO: 65979 - DNA, 25 bp, mus musculus
attgacctagtaagctcagtggttg

SEQ ID NO: 65980 - DNA, 25 bp, mus musculus
tggcatctttggagtggccacagtt

SEQ ID NO: 65981 - DNA, 25 bp, mus musculus
agtggccacagttctctgtgatctc

SEQ ID NO: 65982 - DNA, 25 bp, mus musculus
aggctttcctgcaaggcagatacca

SEQ ID NO: 65983 - DNA, 25 bp, mus musculus
cctctggttcagccaagacattgga

SEQ ID NO: 65984 - DNA, 25 bp, mus musculus
gttcagccaagacattggaatccag

SEQ ID NO: 65985 - DNA, 25 bp, mus musculus
cattggaatccagagctctgggtcc

SEQ ID NO: 65986 - DNA, 25 bp, mus musculus
taccctagcttcgtgcttatggctc

SEQ ID NO: 65987 - DNA, 25 bp, mus musculus
agcttcgtgcttatggctcaggctg

SEQ ID NO: 65988 - DNA, 25 bp, mus musculus
tggctttgggctcttccacatggta

SEQ ID NO: 65989 - DNA, 25 bp, mus musculus
tgggctcttccacatggtagccact

SEQ ID NO: 65990 - DNA, 25 bp, mus musculus
agccactagccagatgtgtcagttt

SEQ ID NO: 65991 - DNA, 25 bp, mus musculus
tagccagatgtgtcagtttgaactt

SEQ ID NO: 65992 - DNA, 25 bp, mus musculus
tgatctcttattgctccacatcctg

SEQ ID NO: 65993 - DNA, 25 bp, mus musculus
gctccacatcctgcctaagaggcac

SEQ ID NO: 65994 - DNA, 25 bp, mus musculus
catcctgcctaagaggcactactac

SEQ ID NO: 65995 - DNA, 25 bp, mus musculus
gaggcactactacaagcagaagaag

SEQ ID NO: 65996 - DNA, 25 bp, mus musculus
tctgggcctgcaggagaacatgagg

SEQ ID NO: 65997 - DNA, 25 bp, mus musculus
ttccagcaagggctggtggctttga

SEQ ID NO: 65998 - DNA, 25 bp, mus musculus
gctttgagccagggcagaggtcatt

SEQ ID NO: 65999 - DNA, 25 bp, mus musculus
ggtcattgccagaggctttcctgca

SEQ ID NO: 66000 - DNA, 25 bp, mus musculus
acgtccacacaagtgccttccaggc

SEQ ID NO: 66001 - DNA, 25 bp, mus musculus
acacaagtgccttccaggccctgtc

SEQ ID NO: 66002 - DNA, 25 bp, mus musculus
cctcagcctggccaatctcttgtca

SEQ ID NO: 66003 - DNA, 25 bp, mus musculus
cttgtcatctccacagccaggccaa

SEQ ID NO: 66004 - DNA, 25 bp, mus musculus
atctccacagccaggccaaaatctg

SEQ ID NO: 66005 - DNA, 25 bp, mus musculus
acagccaggccaaaatctgtcttca

SEQ ID NO: 66006 - DNA, 25 bp, mus musculus
aggccaaaatctgtcttcattggta

SEQ ID NO: 66007 - DNA, 25 bp, mus musculus
cctgctgccacactctggtgactct

SEQ ID NO: 66008 - DNA, 25 bp, mus musculus
gccacactctggtgactcttgagcc

SEQ ID NO: 66009 - DNA, 25 bp, mus musculus
cccagacttattgcttccattcagt

SEQ ID NO: 66010 - DNA, 25 bp, mus musculus
cttattgcttccattcagtgtgatt

SEQ ID NO: 66011 - DNA, 25 bp, mus musculus
gcttccattcagtgtgattcttgct

SEQ ID NO: 66012 - DNA, 25 bp, mus musculus
acctgccggagtccatgtgcagggc

SEQ ID NO: 66013 - DNA, 25 bp, mus musculus
gtgattcttgctgcagtcatggtgg

SEQ ID NO: 66014 - DNA, 25 bp, mus musculus
cggagtccatgtgcagggctgagtc

SEQ ID NO: 66015 - DNA, 25 bp, mus musculus
tacggcccaggttcccaatgtatca

SEQ ID NO: 66016 - DNA, 25 bp, mus musculus
ccaggttcccaatgtatcatccact

SEQ ID NO: 66017 - DNA, 25 bp, mus musculus
tcccaatgtatcatccactccatga

SEQ ID NO: 66018 - DNA, 25 bp, mus musculus
tgtatcatccactccatgaaccatg

SEQ ID NO: 66019 - DNA, 25 bp, mus musculus
tccatgaaccatggagaagagagcc

SEQ ID NO: 66020 - DNA, 25 bp, mus musculus
ctcacagcaggagccgggaagagtt

SEQ ID NO: 66021 - DNA, 25 bp, mus musculus
atagaaccagtctgccgtggaagga

SEQ ID NO: 66022 - DNA, 25 bp, mus musculus
gaaccagtctgccgtggaaggactg

SEQ ID NO: 66023 - DNA, 25 bp, mus musculus
tcgtgggctgcgctttgaggaagct

SEQ ID NO: 66024 - DNA, 25 bp, mus musculus
ggaagctccggattacatgtatctg

SEQ ID NO: 66025 - DNA, 25 bp, mus musculus
agctccggattacatgtatctgagg

SEQ ID NO: 66026 - DNA, 25 bp, mus musculus
ttacatgtatctgaggcagctattc

SEQ ID NO: 66027 - DNA, 25 bp, mus musculus
catgtatctgaggcagctattccgc

SEQ ID NO: 66028 - DNA, 25 bp, mus musculus
tctgaggcagctattccgcatcctt

SEQ ID NO: 66029 - DNA, 25 bp, mus musculus
gcagctattccgcatccttttcagg

SEQ ID NO: 66030 - DNA, 25 bp, mus musculus
gctattccgcatccttttcaggacc

SEQ ID NO: 66031 - DNA, 25 bp, mus musculus
attccgcatccttttcaggaccctg

SEQ ID NO: 66032 - DNA, 25 bp, mus musculus
tttcaggaccctgaaccaccaatat

SEQ ID NO: 66033 - DNA, 25 bp, mus musculus
gaagatgtccactcctgttgaggtg

SEQ ID NO: 66034 - DNA, 25 bp, mus musculus
caggaccctgaaccaccaatatgac

SEQ ID NO: 66035 - DNA, 25 bp, mus musculus
gatgtccactcctgttgaggtgttg

SEQ ID NO: 66036 - DNA, 25 bp, mus musculus
gtttcctgcagaatttgccatgtac

SEQ ID NO: 66037 - DNA, 25 bp, mus musculus
tcctgcagaatttgccatgtactta

SEQ ID NO: 66038 - DNA, 25 bp, mus musculus
atttgccatgtacttaaattactgt

SEQ ID NO: 66039 - DNA, 25 bp, mus musculus
cttaaattactgtcgtgggctgcgc

SEQ ID NO: 66040 - DNA, 25 bp, mus musculus
aaattactgtcgtgggctgcgcttt

SEQ ID NO: 66041 - DNA, 25 bp, mus musculus
ctgtcgtgggctgcgctttgaggaa

SEQ ID NO: 66042 - DNA, 25 bp, mus musculus
gaagacccttagcactgtccgagtg

SEQ ID NO: 66043 - DNA, 25 bp, mus musculus
agacccttagcactgtccgagtgat

SEQ ID NO: 66044 - DNA, 25 bp, mus musculus
tgcctgcagatggtactgtaattga

SEQ ID NO: 66045 - DNA, 25 bp, mus musculus
cagtaattcagctacaggctgacag

SEQ ID NO: 66046 - DNA, 25 bp, mus musculus
gtaattcagctacaggctgacagcg

SEQ ID NO: 66047 - DNA, 25 bp, mus musculus
gctacaggctgacagcgcaagaaga

SEQ ID NO: 66048 - DNA, 25 bp, mus musculus
caggctgacagcgcaagaagatatg

SEQ ID NO: 66049 - DNA, 25 bp, mus musculus
atatgccagtcctgatacagattgg

SEQ ID NO: 66050 - DNA, 25 bp, mus musculus
atgccagtcctgatacagattggcc

SEQ ID NO: 66051 - DNA, 25 bp, mus musculus
gccagtcctgatacagattggcctg

SEQ ID NO: 66052 - DNA, 25 bp, mus musculus
cagtcctgatacagattggcctggg

SEQ ID NO: 66053 - DNA, 25 bp, mus musculus
atacagattggcctgggtccggcgg

SEQ ID NO: 66054 - DNA, 25 bp, mus musculus
acccttagcactgtccgagtgatcg

SEQ ID NO: 66055 - DNA, 25 bp, mus musculus
ggttttacgtcctcttgctctctga

SEQ ID NO: 66056 - DNA, 25 bp, mus musculus
ccttagcactgtccgagtgatcgct

SEQ ID NO: 66057 - DNA, 25 bp, mus musculus
ttagcactgtccgagtgatcgctga

SEQ ID NO: 66058 - DNA, 25 bp, mus musculus
agcactgtccgagtgatcgctgatg

SEQ ID NO: 66059 - DNA, 25 bp, mus musculus
ctgtccgagtgatcgctgatgatta

SEQ ID NO: 66060 - DNA, 25 bp, mus musculus
gtccgagtgatcgctgatgattacg

SEQ ID NO: 66061 - DNA, 25 bp, mus musculus
ttacgataccgagaaactagtgaag

SEQ ID NO: 66062 - DNA, 25 bp, mus musculus
aatgtgcctgcagatggtactgtaa

SEQ ID NO: 66063 - DNA, 25 bp, mus musculus
cttcgccacatggaaagcatggaaa

SEQ ID NO: 66064 - DNA, 25 bp, mus musculus
acagttatggcatcccagaacctgc

SEQ ID NO: 66065 - DNA, 25 bp, mus musculus
gggcagcgatcaaccctttgccatc

SEQ ID NO: 66066 - DNA, 25 bp, mus musculus
accctttgccatccacacagaatgg

SEQ ID NO: 66067 - DNA, 25 bp, mus musculus
agaatggacctgtctttgcaaaagc

SEQ ID NO: 66068 - DNA, 25 bp, mus musculus
gacctgtctttgcaaaagcaatcca

SEQ ID NO: 66069 - DNA, 25 bp, mus musculus
tctttgcaaaagcaatccagaagag

SEQ ID NO: 66070 - DNA, 25 bp, mus musculus
gagtaccttgtgcttatgacaagac

SEQ ID NO: 66071 - DNA, 25 bp, mus musculus
acaagactgccttggcattggaggt

SEQ ID NO: 66072 - DNA, 25 bp, mus musculus
tccccttcacacatgttaaaatctt

SEQ ID NO: 66073 - DNA, 25 bp, mus musculus
ctcagaaccccgatgacaacgagtg

SEQ ID NO: 66074 - DNA, 25 bp, mus musculus
accccgatgacaacgagtgattgct

SEQ ID NO: 66075 - DNA, 25 bp, mus musculus
atggcatcccagaacctgctcatgc

SEQ ID NO: 66076 - DNA, 25 bp, mus musculus
aacctgctcatgcgtatgctcaacc

SEQ ID NO: 66077 - DNA, 25 bp, mus musculus
ctcatgcgtatgctcaacctcagac

SEQ ID NO: 66078 - DNA, 25 bp, mus musculus
cgtatgctcaacctcagaccacaac

SEQ ID NO: 66079 - DNA, 25 bp, mus musculus
ctcctctacctacagttgccagtac

SEQ ID NO: 66080 - DNA, 25 bp, mus musculus
tacctacagttgccagtactcctgg

SEQ ID NO: 66081 - DNA, 25 bp, mus musculus
cagttgccagtactcctggggcagc

SEQ ID NO: 66082 - DNA, 25 bp, mus musculus
ctcctggggcagcgatcaacccttt

SEQ ID NO: 66083 - DNA, 25 bp, mus musculus
tagccacttcgaatactcttcacca

SEQ ID NO: 66084 - DNA, 25 bp, mus musculus
ccacttcgaatactcttcaccagac

SEQ ID NO: 66085 - DNA, 25 bp, mus musculus
cagccaccagcaagaatgttcttcc

SEQ ID NO: 66086 - DNA, 25 bp, mus musculus
agaatgttcttcctgagcgaatatt

SEQ ID NO: 66087 - DNA, 25 bp, mus musculus
atgttcttcctgagcgaatattgct

SEQ ID NO: 66088 - DNA, 25 bp, mus musculus
tgctatagtgtccacgcagcgctgg

SEQ ID NO: 66089 - DNA, 25 bp, mus musculus
tatagtgtccacgcagcgctgggta

SEQ ID NO: 66090 - DNA, 25 bp, mus musculus
gtccacgcagcgctgggtatggata

SEQ ID NO: 66091 - DNA, 25 bp, mus musculus
tgaattattcccacagcccacagtt

SEQ ID NO: 66092 - DNA, 25 bp, mus musculus
gatgcagccaagaatcggggactct

SEQ ID NO: 66093 - DNA, 25 bp, mus musculus
ctctgtcgttggcatgccggggatg

SEQ ID NO: 66094 - DNA, 25 bp, mus musculus
tggcatgccggggatgttttccagt

SEQ ID NO: 66095 - DNA, 25 bp, mus musculus
cgaatactcttcaccagacaagcag

SEQ ID NO: 66096 - DNA, 25 bp, mus musculus
gatgttttccagtctgtgtagttag

SEQ ID NO: 66097 - DNA, 25 bp, mus musculus
ctcttcaccagacaagcaggagaag

SEQ ID NO: 66098 - DNA, 25 bp, mus musculus
gataagtcccaagacctccacaaga

SEQ ID NO: 66099 - DNA, 25 bp, mus musculus
caagacctccacaagagcaattccc

SEQ ID NO: 66100 - DNA, 25 bp, mus musculus
gacctccacaagagcaattcccagg

SEQ ID NO: 66101 - DNA, 25 bp, mus musculus
aagagcaattcccagggccggatgc

SEQ ID NO: 66102 - DNA, 25 bp, mus musculus
agcaattcccagggccggatgcagc

SEQ ID NO: 66103 - DNA, 25 bp, mus musculus
atgcagccaccagcaagaatgttct

SEQ ID NO: 66104 - DNA, 25 bp, mus musculus
atccctctttgagtctcttaaatct

SEQ ID NO: 66105 - DNA, 25 bp, mus musculus
cctctttgagtctcttaaatctcga

SEQ ID NO: 66106 - DNA, 25 bp, mus musculus
cagaaacacagaccggccggatgcc

SEQ ID NO: 66107 - DNA, 25 bp, mus musculus
tgcctcggctgtctacctgcaggac

SEQ ID NO: 66108 - DNA, 25 bp, mus musculus
ctcggctgtctacctgcaggacttc

SEQ ID NO: 66109 - DNA, 25 bp, mus musculus
ggctgtctacctgcaggacttccaa

SEQ ID NO: 66110 - DNA, 25 bp, mus musculus
tgtctacctgcaggacttccaaagg

SEQ ID NO: 66111 - DNA, 25 bp, mus musculus
gacaaagtgcttccctggatgcctg

SEQ ID NO: 66112 - DNA, 25 bp, mus musculus
gtgcttccctggatgcctgctgtca

SEQ ID NO: 66113 - DNA, 25 bp, mus musculus
cttccctggatgcctgctgtcatag

SEQ ID NO: 66114 - DNA, 25 bp, mus musculus
ccctggatgcctgctgtcatagaat

SEQ ID NO: 66115 - DNA, 25 bp, mus musculus
tggatgcctgctgtcatagaatagc

SEQ ID NO: 66116 - DNA, 25 bp, mus musculus
tgagtctcttaaatctcgacttcga

SEQ ID NO: 66117 - DNA, 25 bp, mus musculus
atgcctgctgtcatagaatagctgt

SEQ ID NO: 66118 - DNA, 25 bp, mus musculus
gtctcttaaatctcgacttcgaggg

SEQ ID NO: 66119 - DNA, 25 bp, mus musculus
tcttaaatctcgacttcgagggtca

SEQ ID NO: 66120 - DNA, 25 bp, mus musculus
taaatctcgacttcgagggtcagtg

SEQ ID NO: 66121 - DNA, 25 bp, mus musculus
tctaaccaccctgtgtcatttctct

SEQ ID NO: 66122 - DNA, 25 bp, mus musculus
caccctgtgtcatttctctgaggac

SEQ ID NO: 66123 - DNA, 25 bp, mus musculus
cctgtgtcatttctctgaggacaga

SEQ ID NO: 66124 - DNA, 25 bp, mus musculus
tcatttctctgaggacagaaacaca

SEQ ID NO: 66125 - DNA, 25 bp, mus musculus
ccagctgtctgacatccgctgtgac

SEQ ID NO: 66126 - DNA, 25 bp, mus musculus
gtctgacatccgctgtgacctggag

SEQ ID NO: 66127 - DNA, 25 bp, mus musculus
caatcctgagaccaagacaagagtg

SEQ ID NO: 66128 - DNA, 25 bp, mus musculus
gttggccctgaccagaaccaggaag

SEQ ID NO: 66129 - DNA, 25 bp, mus musculus
cctgaccagaaccaggaagtgacac

SEQ ID NO: 66130 - DNA, 25 bp, mus musculus
gtgacactagcaacatgtcctgata

SEQ ID NO: 66131 - DNA, 25 bp, mus musculus
ctagcaacatgtcctgataatacat

SEQ ID NO: 66132 - DNA, 25 bp, mus musculus
aatacattgcttcagcgctgcctcc

SEQ ID NO: 66133 - DNA, 25 bp, mus musculus
ttgcttcagcgctgcctcctctatt

SEQ ID NO: 66134 - DNA, 25 bp, mus musculus
cagcgctgcctcctctatttccttg

SEQ ID NO: 66135 - DNA, 25 bp, mus musculus
ggttgtctctgctttctcagagtgc

SEQ ID NO: 66136 - DNA, 25 bp, mus musculus
tttctcagagtgcatgtgttttcgg

SEQ ID NO: 66137 - DNA, 25 bp, mus musculus
catccgctgtgacctggagagacag

SEQ ID NO: 66138 - DNA, 25 bp, mus musculus
ccacactgtttgtgtgccttgttca

SEQ ID NO: 66139 - DNA, 25 bp, mus musculus
tgtttgtgtgccttgttcaccctgc

SEQ ID NO: 66140 - DNA, 25 bp, mus musculus
ctactgaagcctctgagcatctctc

SEQ ID NO: 66141 - DNA, 25 bp, mus musculus
aagcctctgagcatctctcagtgtg

SEQ ID NO: 66142 - DNA, 25 bp, mus musculus
cctggtgcctcgtcacaccaagtct

SEQ ID NO: 66143 - DNA, 25 bp, mus musculus
tcacaccaagtctgaccacaatcct

SEQ ID NO: 66144 - DNA, 25 bp, mus musculus
tgaccacaatcctgagaccaagaca

SEQ ID NO: 66145 - DNA, 25 bp, mus musculus
ctcagcgatctctgatccagacctt

SEQ ID NO: 66146 - DNA, 25 bp, mus musculus
ctctgatccagaccttccaaaagga

SEQ ID NO: 66147 - DNA, 25 bp, mus musculus
ctggacttctctgccaaggtcatcc

SEQ ID NO: 66148 - DNA, 25 bp, mus musculus
ttctctgccaaggtcatccagggca

SEQ ID NO: 66149 - DNA, 25 bp, mus musculus
gccaaggtcatccagggcagcctcg

SEQ ID NO: 66150 - DNA, 25 bp, mus musculus
aaggtcatccagggcagcctcgaca

SEQ ID NO: 66151 - DNA, 25 bp, mus musculus
gcaatgctcagctgtgccagccgga

SEQ ID NO: 66152 - DNA, 25 bp, mus musculus
atgctcagctgtgccagccggagta

SEQ ID NO: 66153 - DNA, 25 bp, mus musculus
tgtgccagccggagtatatccacat

SEQ ID NO: 66154 - DNA, 25 bp, mus musculus
agtatatccacatctgcgatggctc

SEQ ID NO: 66155 - DNA, 25 bp, mus musculus
atatccacatctgcgatggctccga

SEQ ID NO: 66156 - DNA, 25 bp, mus musculus
tccacatctgcgatggctccgagga

SEQ ID NO: 66157 - DNA, 25 bp, mus musculus
tgatccagaccttccaaaaggaaga

SEQ ID NO: 66158 - DNA, 25 bp, mus musculus
tctctccacaccattgcaattatgc

SEQ ID NO: 66159 - DNA, 25 bp, mus musculus
gcaattatgcctcctcagctgcata

SEQ ID NO: 66160 - DNA, 25 bp, mus musculus
atgcctcctcagctgcataacggtc

SEQ ID NO: 66161 - DNA, 25 bp, mus musculus
cctcctcagctgcataacggtctgg

SEQ ID NO: 66162 - DNA, 25 bp, mus musculus
cctcagctgcataacggtctggact

SEQ ID NO: 66163 - DNA, 25 bp, mus musculus
cataacggtctggacttctctgcca

SEQ ID NO: 66164 - DNA, 25 bp, mus musculus
aacggtctggacttctctgccaagg

SEQ ID NO: 66165 - DNA, 25 bp, mus musculus
ctccacacctatgaatccggtactg

SEQ ID NO: 66166 - DNA, 25 bp, mus musculus
cacacctatgaatccggtactgctg

SEQ ID NO: 66167 - DNA, 25 bp, mus musculus
cgtttccagcttctggacctcattc

SEQ ID NO: 66168 - DNA, 25 bp, mus musculus
cagcttctggacctcattcttccct

SEQ ID NO: 66169 - DNA, 25 bp, mus musculus
cttctggacctcattcttccctttg

SEQ ID NO: 66170 - DNA, 25 bp, mus musculus
ctggacctcattcttccctttgatt

SEQ ID NO: 66171 - DNA, 25 bp, mus musculus
tctttaccgtgtctggctaataagg

SEQ ID NO: 66172 - DNA, 25 bp, mus musculus
gagccaagatgccctgggcaccagt

SEQ ID NO: 66173 - DNA, 25 bp, mus musculus
ccaagatgccctgggcaccagttgc

SEQ ID NO: 66174 - DNA, 25 bp, mus musculus
cctgggcaccagttgctagcaccaa

SEQ ID NO: 66175 - DNA, 25 bp, mus musculus
ttgctagcaccaaggactgaatctt

SEQ ID NO: 66176 - DNA, 25 bp, mus musculus
ctagcaccaaggactgaatctttaa

SEQ ID NO: 66177 - DNA, 25 bp, mus musculus
gaatccggtactgctgctcagtcag

SEQ ID NO: 66178 - DNA, 25 bp, mus musculus
gctcagtcagaattcacgagtgatc

SEQ ID NO: 66179 - DNA, 25 bp, mus musculus
cgcttcacagaggggcactgaccgc

SEQ ID NO: 66180 - DNA, 25 bp, mus musculus
agaagtcacctgcagactacaacca

SEQ ID NO: 66181 - DNA, 25 bp, mus musculus
agtcacctgcagactacaaccacac

SEQ ID NO: 66182 - DNA, 25 bp, mus musculus
cagactacaaccacacaagccactg

SEQ ID NO: 66183 - DNA, 25 bp, mus musculus
acaaccacacaagccactgaggggt

SEQ ID NO: 66184 - DNA, 25 bp, mus musculus
acacaagccactgaggggtcgaggc

SEQ ID NO: 66185 - DNA, 25 bp, mus musculus
gtgcctactcaagaactctacaaca

SEQ ID NO: 66186 - DNA, 25 bp, mus musculus
cctactcaagaactctacaacaagc

SEQ ID NO: 66187 - DNA, 25 bp, mus musculus
tccaagaagacaaccgtgtggacag

SEQ ID NO: 66188 - DNA, 25 bp, mus musculus
aagacaaccgtgtggacagctgcca

SEQ ID NO: 66189 - DNA, 25 bp, mus musculus
accgtgtggacagctgccagggaga

SEQ ID NO: 66190 - DNA, 25 bp, mus musculus
gaggaccactcatgtgtgaaaagcc

SEQ ID NO: 66191 - DNA, 25 bp, mus musculus
gaccactcatgtgtgaaaagcctga

SEQ ID NO: 66192 - DNA, 25 bp, mus musculus
agcctgatgagtcctgggttgtgta

SEQ ID NO: 66193 - DNA, 25 bp, mus musculus
ctgatgagtcctgggttgtgtatgg

SEQ ID NO: 66194 - DNA, 25 bp, mus musculus
gagtcaaagacactcctggagttta

SEQ ID NO: 66195 - DNA, 25 bp, mus musculus
tcaaagacactcctggagtttatac

SEQ ID NO: 66196 - DNA, 25 bp, mus musculus
aagacactcctggagtttataccag

SEQ ID NO: 66197 - DNA, 25 bp, mus musculus
actcaagaactctacaacaagctgc

SEQ ID NO: 66198 - DNA, 25 bp, mus musculus
caagaactctacaacaagctgctgt

SEQ ID NO: 66199 - DNA, 25 bp, mus musculus
gaactctacaacaagctgctgtgcc

SEQ ID NO: 66200 - DNA, 25 bp, mus musculus
ctctacaacaagctgctgtgcctct

SEQ ID NO: 66201 - DNA, 25 bp, mus musculus
aagctgctgtgcctctgttacccaa

SEQ ID NO: 66202 - DNA, 25 bp, mus musculus
ctgctgtgcctctgttacccaagag

SEQ ID NO: 66203 - DNA, 25 bp, mus musculus
ctgtgcctctgttacccaagaggtt

SEQ ID NO: 66204 - DNA, 25 bp, mus musculus
tgctctgtgctgggaacctccaaga

SEQ ID NO: 66205 - DNA, 25 bp, mus musculus
tcttcctttgcaaaggtgacttgct

SEQ ID NO: 66206 - DNA, 25 bp, mus musculus
aaggtgacttgctggtgatgtattt

SEQ ID NO: 66207 - DNA, 25 bp, mus musculus
acctgtactgcaatcctctaacaga

SEQ ID NO: 66208 - DNA, 25 bp, mus musculus
actgcaatcctctaacagaagtcac

SEQ ID NO: 66209 - DNA, 25 bp, mus musculus
atcctctaacagaagtcactaggaa

SEQ ID NO: 66210 - DNA, 25 bp, mus musculus
aagtcactaggaacacatctaatgt

SEQ ID NO: 66211 - DNA, 25 bp, mus musculus
cttgcaacaacacttaaaatgaact

SEQ ID NO: 66212 - DNA, 25 bp, mus musculus
ggcttacctgtgtgttcagcaatct

SEQ ID NO: 66213 - DNA, 25 bp, mus musculus
tgttcagcaatctcagccccacatt

SEQ ID NO: 66214 - DNA, 25 bp, mus musculus
ggagaactcttctctaatgaatgta

SEQ ID NO: 66215 - DNA, 25 bp, mus musculus
ctcttctctaatgaatgtagtaaca

SEQ ID NO: 66216 - DNA, 25 bp, mus musculus
ttacagtgcgtactgaagcatgttt

SEQ ID NO: 66217 - DNA, 25 bp, mus musculus
ttgccccaggtcgtgtgtattcagt

SEQ ID NO: 66218 - DNA, 25 bp, mus musculus
tagaggcttcagcatctcatgaagg

SEQ ID NO: 66219 - DNA, 25 bp, mus musculus
cttcagcatctcatgaaggatactt

SEQ ID NO: 66220 - DNA, 25 bp, mus musculus
tttgtatcccagtcaaacaacacat

SEQ ID NO: 66221 - DNA, 25 bp, mus musculus
tcccagtcaaacaacacatatgtca

SEQ ID NO: 66222 - DNA, 25 bp, mus musculus
tcaaacaacacatatgtcaagcaca

SEQ ID NO: 66223 - DNA, 25 bp, mus musculus
aacacatatgtcaagcacaggacaa

SEQ ID NO: 66224 - DNA, 25 bp, mus musculus
taacatacctgtactgcaatcctct

SEQ ID NO: 66225 - DNA, 25 bp, mus musculus
tgaagccacttaaaaacaccacagt

SEQ ID NO: 66226 - DNA, 25 bp, mus musculus
ccacagttctggtagtttgaacata

SEQ ID NO: 66227 - DNA, 25 bp, mus musculus
tggcaaacagacttccatcctggta

SEQ ID NO: 66228 - DNA, 25 bp, mus musculus
ttccatcctggtacctgtttgcagc

SEQ ID NO: 66229 - DNA, 25 bp, mus musculus
cctggtacctgtttgcagcattttt

SEQ ID NO: 66230 - DNA, 25 bp, mus musculus
tttgattcaatatacacatgaattt

SEQ ID NO: 66231 - DNA, 25 bp, mus musculus
tcaatatacacatgaatttggattg

SEQ ID NO: 66232 - DNA, 25 bp, mus musculus
gcagttttctgatctgggtgtcttc

SEQ ID NO: 66233 - DNA, 25 bp, mus musculus
ttctgatctgggtgtcttctatcta

SEQ ID NO: 66234 - DNA, 25 bp, mus musculus
agggcatacatacatctccatgtgt

SEQ ID NO: 66235 - DNA, 25 bp, mus musculus
tacatacatctccatgtgtatgtgt

SEQ ID NO: 66236 - DNA, 25 bp, mus musculus
atttctcctatgctatggttgttac

SEQ ID NO: 66237 - DNA, 25 bp, mus musculus
atccaatggctgctttgagtgtcaa

SEQ ID NO: 66238 - DNA, 25 bp, mus musculus
gtgtcaactcagcaaatctgtgccc

SEQ ID NO: 66239 - DNA, 25 bp, mus musculus
caaatctgtgccccgaaagatcaag

SEQ ID NO: 66240 - DNA, 25 bp, mus musculus
tgacacagatccctatatttaggat

SEQ ID NO: 66241 - DNA, 25 bp, mus musculus
ttaggatcccgggagctctgagaga

SEQ ID NO: 66242 - DNA, 25 bp, mus musculus
tcacttattgggcatttgcatttct

SEQ ID NO: 66243 - DNA, 25 bp, mus musculus
catttgcatttctatctgactgccc

SEQ ID NO: 66244 - DNA, 25 bp, mus musculus
catttctatctgactgcccacaggt

SEQ ID NO: 66245 - DNA, 25 bp, mus musculus
gctcctggacactacacctacagca

SEQ ID NO: 66246 - DNA, 25 bp, mus musculus
tcctggacactacacctacagcagc

SEQ ID NO: 66247 - DNA, 25 bp, mus musculus
gagtacgctctgctattcagcagag

SEQ ID NO: 66248 - DNA, 25 bp, mus musculus
acgctctgctattcagcagaggcac

SEQ ID NO: 66249 - DNA, 25 bp, mus musculus
tctgctattcagcagaggcaccaag

SEQ ID NO: 66250 - DNA, 25 bp, mus musculus
tgctattcagcagaggcaccaaggg

SEQ ID NO: 66251 - DNA, 25 bp, mus musculus
ctattcagcagaggcaccaagggcc

SEQ ID NO: 66252 - DNA, 25 bp, mus musculus
cagaggcaccaagggcccaggccag

SEQ ID NO: 66253 - DNA, 25 bp, mus musculus
aggccaggacttccgcatggccacc

SEQ ID NO: 66254 - DNA, 25 bp, mus musculus
cagcagaacccagactctgaaggac

SEQ ID NO: 66255 - DNA, 25 bp, mus musculus
gcagaacccagactctgaaggacga

SEQ ID NO: 66256 - DNA, 25 bp, mus musculus
agaacccagactctgaaggacgagc

SEQ ID NO: 66257 - DNA, 25 bp, mus musculus
cactcgggcagcatccactccgtgt

SEQ ID NO: 66258 - DNA, 25 bp, mus musculus
ctcgggcagcatccactccgtgtca

SEQ ID NO: 66259 - DNA, 25 bp, mus musculus
ggcagcatccactccgtgtcagtgg

SEQ ID NO: 66260 - DNA, 25 bp, mus musculus
cagcatccactccgtgtcagtggtg

SEQ ID NO: 66261 - DNA, 25 bp, mus musculus
gcatccactccgtgtcagtggtgga

SEQ ID NO: 66262 - DNA, 25 bp, mus musculus
actatgacgagtacgctctgctatt

SEQ ID NO: 66263 - DNA, 25 bp, mus musculus
tatgacgagtacgctctgctattca

SEQ ID NO: 66264 - DNA, 25 bp, mus musculus
acgagtacgctctgctattcagcag

SEQ ID NO: 66265 - DNA, 25 bp, mus musculus
catgatgacgtgctacctgttccac

SEQ ID NO: 66266 - DNA, 25 bp, mus musculus
ggacccggccggcgatgaatatgaa

SEQ ID NO: 66267 - DNA, 25 bp, mus musculus
ccacactctagaagagcacaaccta

SEQ ID NO: 66268 - DNA, 25 bp, mus musculus
agagcacaacctagccaattacatg

SEQ ID NO: 66269 - DNA, 25 bp, mus musculus
gcacactggtcaggagtcgtatgtc

SEQ ID NO: 66270 - DNA, 25 bp, mus musculus
cactggtcaggagtcgtatgtctgg

SEQ ID NO: 66271 - DNA, 25 bp, mus musculus
agactgtttccgcaagcagtatgag

SEQ ID NO: 66272 - DNA, 25 bp, mus musculus
ggaccagcttagctgaggtctgcag

SEQ ID NO: 66273 - DNA, 25 bp, mus musculus
tcaagtgccttctccactgcgagct

SEQ ID NO: 66274 - DNA, 25 bp, mus musculus
atgatcctgaactagaccaataaat

SEQ ID NO: 66275 - DNA, 25 bp, mus musculus
aactagaccaataaatcctgtgcta

SEQ ID NO: 66276 - DNA, 25 bp, mus musculus
tagaccaataaatcctgtgctacac

SEQ ID NO: 66277 - DNA, 25 bp, mus musculus
cttcttcgttatcgtcattctgctg

SEQ ID NO: 66278 - DNA, 25 bp, mus musculus
cttcgttatcgtcattctgctggct

SEQ ID NO: 66279 - DNA, 25 bp, mus musculus
cgttatcgtcattctgctggctatc

SEQ ID NO: 66280 - DNA, 25 bp, mus musculus
cgtcattctgctggctatcattcag

SEQ ID NO: 66281 - DNA, 25 bp, mus musculus
cattctgctggctatcattcagggt

SEQ ID NO: 66282 - DNA, 25 bp, mus musculus
tctgctggctatcattcagggtctg

SEQ ID NO: 66283 - DNA, 25 bp, mus musculus
gtgcttcatctgtggaataggcagt

SEQ ID NO: 66284 - DNA, 25 bp, mus musculus
tgagacccacactctagaagagcac

SEQ ID NO: 66285 - DNA, 25 bp, mus musculus
tagctcctgtttcgagcccaacagc

SEQ ID NO: 66286 - DNA, 25 bp, mus musculus
ctcctgtttcgagcccaacagccag

SEQ ID NO: 66287 - DNA, 25 bp, mus musculus
cattgctgccatcaagaccaagaga

SEQ ID NO: 66288 - DNA, 25 bp, mus musculus
tgctgccatcaagaccaagagaact

SEQ ID NO: 66289 - DNA, 25 bp, mus musculus
tgccatcaagaccaagagaactatt

SEQ ID NO: 66290 - DNA, 25 bp, mus musculus
tattcagtttgttgactggtgtcca

SEQ ID NO: 66291 - DNA, 25 bp, mus musculus
tgttgactggtgtccacaggtttca

SEQ ID NO: 66292 - DNA, 25 bp, mus musculus
tgactggtgtccacaggtttcaggt

SEQ ID NO: 66293 - DNA, 25 bp, mus musculus
gtgtccacaggtttcaggtgggcat

SEQ ID NO: 66294 - DNA, 25 bp, mus musculus
tccacaggtttcaggtgggcatcaa

SEQ ID NO: 66295 - DNA, 25 bp, mus musculus
accagccacctactgtcgtgccagg

SEQ ID NO: 66296 - DNA, 25 bp, mus musculus
agccacctactgtcgtgccaggagg

SEQ ID NO: 66297 - DNA, 25 bp, mus musculus
ctgtttcgagcccaacagccagatg

SEQ ID NO: 66298 - DNA, 25 bp, mus musculus
tttcgagcccaacagccagatggtg

SEQ ID NO: 66299 - DNA, 25 bp, mus musculus
gcccaacagccagatggtgaagtgt

SEQ ID NO: 66300 - DNA, 25 bp, mus musculus
gaagtgtgacccacgtcatggcaaa

SEQ ID NO: 66301 - DNA, 25 bp, mus musculus
ctgctgcatgctctaccgcggtgat

SEQ ID NO: 66302 - DNA, 25 bp, mus musculus
ctaccgcggtgatgtggtacccaag

SEQ ID NO: 66303 - DNA, 25 bp, mus musculus
tgatgtggtacccaaggacgtgaat

SEQ ID NO: 66304 - DNA, 25 bp, mus musculus
tgtggtacccaaggacgtgaatgtc

SEQ ID NO: 66305 - DNA, 25 bp, mus musculus
attacatccgtagtaacaaagctgt

SEQ ID NO: 66306 - DNA, 25 bp, mus musculus
aagctgtgggcttcctcatatttct

SEQ ID NO: 66307 - DNA, 25 bp, mus musculus
cacctgtgatcagtcattggttaag

SEQ ID NO: 66308 - DNA, 25 bp, mus musculus
tgatcagtcattggttaaggaccct

SEQ ID NO: 66309 - DNA, 25 bp, mus musculus
ggacccttgacaggccatcttttga

SEQ ID NO: 66310 - DNA, 25 bp, mus musculus
ttgacaggccatcttttgatatcca

SEQ ID NO: 66311 - DNA, 25 bp, mus musculus
ggccatcttttgatatccaacgtga

SEQ ID NO: 66312 - DNA, 25 bp, mus musculus
atatccaacgtgaagcaatatccat

SEQ ID NO: 66313 - DNA, 25 bp, mus musculus
aagcaatatccattcagagatttca

SEQ ID NO: 66314 - DNA, 25 bp, mus musculus
tatccattcagagatttcattggtt

SEQ ID NO: 66315 - DNA, 25 bp, mus musculus
tgaccatgtacatcgattcattttt

SEQ ID NO: 66316 - DNA, 25 bp, mus musculus
cattctgcgaacattggagatcttt

SEQ ID NO: 66317 - DNA, 25 bp, mus musculus
tgggcttcctcatatttctggagtc

SEQ ID NO: 66318 - DNA, 25 bp, mus musculus
tcctcatatttctggagtcagtgtc

SEQ ID NO: 66319 - DNA, 25 bp, mus musculus
tatttctggagtcagtgtcatccac

SEQ ID NO: 66320 - DNA, 25 bp, mus musculus
cagtgtcatccaccgacagttggaa

SEQ ID NO: 66321 - DNA, 25 bp, mus musculus
catccaccgacagttggaaccatcg

SEQ ID NO: 66322 - DNA, 25 bp, mus musculus
gttggaaccatcgccaatgtgacag

SEQ ID NO: 66323 - DNA, 25 bp, mus musculus
accatcgccaatgtgacagtagtct

SEQ ID NO: 66324 - DNA, 25 bp, mus musculus
tttggccacctgtgatcagtcattg

SEQ ID NO: 66325 - DNA, 25 bp, mus musculus
tattagagctgctgccgcgtctcct

SEQ ID NO: 66326 - DNA, 25 bp, mus musculus
ttagagctgctgccgcgtctcctgg

SEQ ID NO: 66327 - DNA, 25 bp, mus musculus
actgcctcaccagcgaggcgtgcct

SEQ ID NO: 66328 - DNA, 25 bp, mus musculus
ggcattctgctcagagcggaggagc

SEQ ID NO: 66329 - DNA, 25 bp, mus musculus
cattctgctcagagcggaggagctc

SEQ ID NO: 66330 - DNA, 25 bp, mus musculus
tctgctcagagcggaggagctcatc

SEQ ID NO: 66331 - DNA, 25 bp, mus musculus
ctgctcagagcggaggagctcatct

SEQ ID NO: 66332 - DNA, 25 bp, mus musculus
ttgaagaagccgcggagagactcgt

SEQ ID NO: 66333 - DNA, 25 bp, mus musculus
aagccgcggagagactcgtggtttg

SEQ ID NO: 66334 - DNA, 25 bp, mus musculus
agagactcgtggtttgagggtcaga

SEQ ID NO: 66335 - DNA, 25 bp, mus musculus
ctcgtggtttgagggtcagaggcat

SEQ ID NO: 66336 - DNA, 25 bp, mus musculus
tcagaggcatcggcacggaacttgg

SEQ ID NO: 66337 - DNA, 25 bp, mus musculus
tagagctgctgccgcgtctcctggg

SEQ ID NO: 66338 - DNA, 25 bp, mus musculus
aggcatcggcacggaacttggaccg

SEQ ID NO: 66339 - DNA, 25 bp, mus musculus
agctgctgccgcgtctcctgggctc

SEQ ID NO: 66340 - DNA, 25 bp, mus musculus
acgcccagaggatcccgaactgcct

SEQ ID NO: 66341 - DNA, 25 bp, mus musculus
aggatcccgaactgcctcaccagcg

SEQ ID NO: 66342 - DNA, 25 bp, mus musculus
ggatcccgaactgcctcaccagcga

SEQ ID NO: 66343 - DNA, 25 bp, mus musculus
atcccgaactgcctcaccagcgagg

SEQ ID NO: 66344 - DNA, 25 bp, mus musculus
ccgaactgcctcaccagcgaggcgt

SEQ ID NO: 66345 - DNA, 25 bp, mus musculus
aactgcctcaccagcgaggcgtgcc

SEQ ID NO: 66346 - DNA, 25 bp, mus musculus
caatccccaaacagctgaattactt

SEQ ID NO: 66347 - DNA, 25 bp, mus musculus
atccccaaacagctgaattactttg

SEQ ID NO: 66348 - DNA, 25 bp, mus musculus
aaggcaatcctgcagtctgtgtacg

SEQ ID NO: 66349 - DNA, 25 bp, mus musculus
ggcaatcctgcagtctgtgtacgag

SEQ ID NO: 66350 - DNA, 25 bp, mus musculus
caatcctgcagtctgtgtacgagtg

SEQ ID NO: 66351 - DNA, 25 bp, mus musculus
tgagaaactcggacagcagagcatt

SEQ ID NO: 66352 - DNA, 25 bp, mus musculus
aaactcggacagcagagcattgata

SEQ ID NO: 66353 - DNA, 25 bp, mus musculus
actcggacagcagagcattgatatt

SEQ ID NO: 66354 - DNA, 25 bp, mus musculus
ccaacataaaagctatcggtgtcac

SEQ ID NO: 66355 - DNA, 25 bp, mus musculus
aaagctatcggtgtcaccaaccagc

SEQ ID NO: 66356 - DNA, 25 bp, mus musculus
agctatcggtgtcaccaaccagcgg

SEQ ID NO: 66357 - DNA, 25 bp, mus musculus
ctatcggtgtcaccaaccagcggga

SEQ ID NO: 66358 - DNA, 25 bp, mus musculus
ccaaacagctgaattactttgtcat

SEQ ID NO: 66359 - DNA, 25 bp, mus musculus
gaattactttgtcatcatcaagtgg

SEQ ID NO: 66360 - DNA, 25 bp, mus musculus
attactttgtcatcatcaagtggaa

SEQ ID NO: 66361 - DNA, 25 bp, mus musculus
ttgtcatcatcaagtggaaatagcc

SEQ ID NO: 66362 - DNA, 25 bp, mus musculus
gagcaagacccaaaggcaatcctgc

SEQ ID NO: 66363 - DNA, 25 bp, mus musculus
gcaagacccaaaggcaatcctgcag

SEQ ID NO: 66364 - DNA, 25 bp, mus musculus
cccaaaggcaatcctgcagtctgtg

SEQ ID NO: 66365 - DNA, 25 bp, mus musculus
caaaggcaatcctgcagtctgtgta

SEQ ID NO: 66366 - DNA, 25 bp, mus musculus
ctctatatcactgaacagccatctg

SEQ ID NO: 66367 - DNA, 25 bp, mus musculus
atcactgaacagccatctgaggatg

SEQ ID NO: 66368 - DNA, 25 bp, mus musculus
tttctctaccttgcctggtacacaa

SEQ ID NO: 66369 - DNA, 25 bp, mus musculus
tacacaaccatgtctgtcctgggcc

SEQ ID NO: 66370 - DNA, 25 bp, mus musculus
accatgtctgtcctgggccactaca

SEQ ID NO: 66371 - DNA, 25 bp, mus musculus
tctgtcctgggccactacaacaact

SEQ ID NO: 66372 - DNA, 25 bp, mus musculus
tttgctgctcatctgttggatattg

SEQ ID NO: 66373 - DNA, 25 bp, mus musculus
acgatcctgtcatctgtaactcaca

SEQ ID NO: 66374 - DNA, 25 bp, mus musculus
actcacaatggcaaacagctggttc

SEQ ID NO: 66375 - DNA, 25 bp, mus musculus
ctggttctgaccgttggcctcctgg

SEQ ID NO: 66376 - DNA, 25 bp, mus musculus
ctcctggctgtggttgtttacctct

SEQ ID NO: 66377 - DNA, 25 bp, mus musculus
tacctctatactgtggtggctttca

SEQ ID NO: 66378 - DNA, 25 bp, mus musculus
gaacagccatctgaggatgacatca

SEQ ID NO: 66379 - DNA, 25 bp, mus musculus
ttggtaatcaacacgccatcttttc

SEQ ID NO: 66380 - DNA, 25 bp, mus musculus
cgcatcgctgaactcctgggtttgg

SEQ ID NO: 66381 - DNA, 25 bp, mus musculus
aatgcccttgactttagcccagtag

SEQ ID NO: 66382 - DNA, 25 bp, mus musculus
gcagcatctctggtgtcatggctaa

SEQ ID NO: 66383 - DNA, 25 bp, mus musculus
tggctaagttccatcgacatgaagt

SEQ ID NO: 66384 - DNA, 25 bp, mus musculus
gttttcactgacaactcctttctct

SEQ ID NO: 66385 - DNA, 25 bp, mus musculus
actgacaactcctttctctaccttg

SEQ ID NO: 66386 - DNA, 25 bp, mus musculus
gaccatcagcaccgagaaccccaaa

SEQ ID NO: 66387 - DNA, 25 bp, mus musculus
gactggctttggtcagtagttcact

SEQ ID NO: 66388 - DNA, 25 bp, mus musculus
gttgctgtgccatgggggccttctt

SEQ ID NO: 66389 - DNA, 25 bp, mus musculus
tcccgttgtcacctgtgccagtctg

SEQ ID NO: 66390 - DNA, 25 bp, mus musculus
ctgtgccagtctgacctagctgcac

SEQ ID NO: 66391 - DNA, 25 bp, mus musculus
gacctagctgcacagagagaaggtc

SEQ ID NO: 66392 - DNA, 25 bp, mus musculus
tatctctggcagcatgggctgcccg

SEQ ID NO: 66393 - DNA, 25 bp, mus musculus
acacctacctcagggagccagtgtg

SEQ ID NO: 66394 - DNA, 25 bp, mus musculus
gggaactccacagcatgcctgttag

SEQ ID NO: 66395 - DNA, 25 bp, mus musculus
tccacagcatgcctgttagtcaagg

SEQ ID NO: 66396 - DNA, 25 bp, mus musculus
gcatgcctgttagtcaaggcctgga

SEQ ID NO: 66397 - DNA, 25 bp, mus musculus
ctgttagtcaaggcctggaggacag

SEQ ID NO: 66398 - DNA, 25 bp, mus musculus
ctttggtcagtagttcactgtggag

SEQ ID NO: 66399 - DNA, 25 bp, mus musculus
tcagtagttcactgtggagacaatg

SEQ ID NO: 66400 - DNA, 25 bp, mus musculus
gacagtattctctgtgccagtgtcg

SEQ ID NO: 66401 - DNA, 25 bp, mus musculus
attctctgtgccagtgtcgctgatg

SEQ ID NO: 66402 - DNA, 25 bp, mus musculus
tgtgccagtgtcgctgatggagctc

SEQ ID NO: 66403 - DNA, 25 bp, mus musculus
agggctgccattaccagaccacggc

SEQ ID NO: 66404 - DNA, 25 bp, mus musculus
tcctgtctgctgatgctgcccgcct

SEQ ID NO: 66405 - DNA, 25 bp, mus musculus
gtgcccatcagggcgagttctcagg

SEQ ID NO: 66406 - DNA, 25 bp, mus musculus
acatcaaaccgtcaaacttcgccat

SEQ ID NO: 66407 - DNA, 25 bp, mus musculus
gtttcatgcttgattttggcttggc

SEQ ID NO: 66408 - DNA, 25 bp, mus musculus
tcgttatgcatcaatcaatgctcat

SEQ ID NO: 66409 - DNA, 25 bp, mus musculus
catcaatcaatgctcatcggaacag

SEQ ID NO: 66410 - DNA, 25 bp, mus musculus
tcaatcaatgctcatcggaacaggg

SEQ ID NO: 66411 - DNA, 25 bp, mus musculus
catgatgacctttggtctttattct

SEQ ID NO: 66412 - DNA, 25 bp, mus musculus
tgatgacctttggtctttattctac

SEQ ID NO: 66413 - DNA, 25 bp, mus musculus
atgacctttggtctttattctacat

SEQ ID NO: 66414 - DNA, 25 bp, mus musculus
gacctttggtctttattctacatgt

SEQ ID NO: 66415 - DNA, 25 bp, mus musculus
attctacatgttggtggagtttgtg

SEQ ID NO: 66416 - DNA, 25 bp, mus musculus
gtggttggccaactgccttggagaa

SEQ ID NO: 66417 - DNA, 25 bp, mus musculus
ttggccaactgccttggagaaaaat

SEQ ID NO: 66418 - DNA, 25 bp, mus musculus
tgcttgattttggcttggctcgaca

SEQ ID NO: 66419 - DNA, 25 bp, mus musculus
tgattttggcttggctcgacaattt

SEQ ID NO: 66420 - DNA, 25 bp, mus musculus
tggcttggctcgacaatttactaat

SEQ ID NO: 66421 - DNA, 25 bp, mus musculus
gcttggctcgacaatttactaattc

SEQ ID NO: 66422 - DNA, 25 bp, mus musculus
tactaattcctgtggtgacgtcaga

SEQ ID NO: 66423 - DNA, 25 bp, mus musculus
ctaattcctgtggtgacgtcagacc

SEQ ID NO: 66424 - DNA, 25 bp, mus musculus
ttcctgtggtgacgtcagaccacct

SEQ ID NO: 66425 - DNA, 25 bp, mus musculus
tgtggcaggctttcgagggacagtt

SEQ ID NO: 66426 - DNA, 25 bp, mus musculus
tatgacactgcaggagcggagcaat

SEQ ID NO: 66427 - DNA, 25 bp, mus musculus
tgacactgcaggagcggagcaattc

SEQ ID NO: 66428 - DNA, 25 bp, mus musculus
caagacaatcgtctggtattatcac

SEQ ID NO: 66429 - DNA, 25 bp, mus musculus
acaatcgtctggtattatcacatgc

SEQ ID NO: 66430 - DNA, 25 bp, mus musculus
ggtattatcacatgcaacacggtcg

SEQ ID NO: 66431 - DNA, 25 bp, mus musculus
ggcatttcgaaacttaccagatctc

SEQ ID NO: 66432 - DNA, 25 bp, mus musculus
catttcgaaacttaccagatctcga

SEQ ID NO: 66433 - DNA, 25 bp, mus musculus
tttcgaaacttaccagatctcgaga

SEQ ID NO: 66434 - DNA, 25 bp, mus musculus
tcgaaacttaccagatctcgagaga

SEQ ID NO: 66435 - DNA, 25 bp, mus musculus
gaaacttaccagatctcgagagaca

SEQ ID NO: 66436 - DNA, 25 bp, mus musculus
aacttaccagatctcgagagacaga

SEQ ID NO: 66437 - DNA, 25 bp, mus musculus
cttaccagatctcgagagacagatt

SEQ ID NO: 66438 - DNA, 25 bp, mus musculus
acactgcaggagcggagcaattcgc

SEQ ID NO: 66439 - DNA, 25 bp, mus musculus
cggagcaattcgcagccatgaagga

SEQ ID NO: 66440 - DNA, 25 bp, mus musculus
gagcaattcgcagccatgaaggacc

SEQ ID NO: 66441 - DNA, 25 bp, mus musculus
gcaattcgcagccatgaaggacctg

SEQ ID NO: 66442 - DNA, 25 bp, mus musculus
aattcgcagccatgaaggacctgta

SEQ ID NO: 66443 - DNA, 25 bp, mus musculus
ttcgcagccatgaaggacctgtaca

SEQ ID NO: 66444 - DNA, 25 bp, mus musculus
cgcagccatgaaggacctgtacatg

SEQ ID NO: 66445 - DNA, 25 bp, mus musculus
tgaaggacctgtacatggagaacgg

SEQ ID NO: 66446 - DNA, 25 bp, mus musculus
gcacccagttcgctacgtggtgatc

SEQ ID NO: 66447 - DNA, 25 bp, mus musculus
ggtgatctcacacacagccggcagc

SEQ ID NO: 66448 - DNA, 25 bp, mus musculus
gtctattggcatcaccttcatgggg

SEQ ID NO: 66449 - DNA, 25 bp, mus musculus
tggcatcaccttcatggggaacttc

SEQ ID NO: 66450 - DNA, 25 bp, mus musculus
gtgctgccctaaatcttctggaatc

SEQ ID NO: 66451 - DNA, 25 bp, mus musculus
tgtctcggggcttcctgagatccaa

SEQ ID NO: 66452 - DNA, 25 bp, mus musculus
ggggcttcctgagatccaactatga

SEQ ID NO: 66453 - DNA, 25 bp, mus musculus
aaggacaccgggatgtgcaaagcac

SEQ ID NO: 66454 - DNA, 25 bp, mus musculus
atgtgcaaagcactctctctccagg

SEQ ID NO: 66455 - DNA, 25 bp, mus musculus
ctccaggtgaccaactctatcaggt

SEQ ID NO: 66456 - DNA, 25 bp, mus musculus
aactctatcaggtcatccaaagctg

SEQ ID NO: 66457 - DNA, 25 bp, mus musculus
tcatccaaagctgggaacactaccg

SEQ ID NO: 66458 - DNA, 25 bp, mus musculus
cggcagcttctgcaacagcccggac

SEQ ID NO: 66459 - DNA, 25 bp, mus musculus
tgacccccaataaagactcagcacc

SEQ ID NO: 66460 - DNA, 25 bp, mus musculus
cttctgcaacagcccggactcctgt

SEQ ID NO: 66461 - DNA, 25 bp, mus musculus
ctcctgtgaacagcaggcccgcaat

SEQ ID NO: 66462 - DNA, 25 bp, mus musculus
tcatgtctatgaaggccgaggctgg

SEQ ID NO: 66463 - DNA, 25 bp, mus musculus
ctatgaaggccgaggctggaacatc

SEQ ID NO: 66464 - DNA, 25 bp, mus musculus
tgaccacacagggcccatctggaat

SEQ ID NO: 66465 - DNA, 25 bp, mus musculus
cacagggcccatctggaatcccatg

SEQ ID NO: 66466 - DNA, 25 bp, mus musculus
ctggaatcccatgtctattggcatc

SEQ ID NO: 66467 - DNA, 25 bp, mus musculus
ggaggcatccattgcaccgatgtaa

SEQ ID NO: 66468 - DNA, 25 bp, mus musculus
aggcatccattgcaccgatgtaaca

SEQ ID NO: 66469 - DNA, 25 bp, mus musculus
tgagcatcctcccaaatgtatgcag

SEQ ID NO: 66470 - DNA, 25 bp, mus musculus
agcatcctcccaaatgtatgcagtt

SEQ ID NO: 66471 - DNA, 25 bp, mus musculus
tcctcccaaatgtatgcagttctgc

SEQ ID NO: 66472 - DNA, 25 bp, mus musculus
ctcccaaatgtatgcagttctgctg

SEQ ID NO: 66473 - DNA, 25 bp, mus musculus
tgtatgcagttctgctgagatctat

SEQ ID NO: 66474 - DNA, 25 bp, mus musculus
gatctatggcctgatgacatcacgg

SEQ ID NO: 66475 - DNA, 25 bp, mus musculus
tctatggcctgatgacatcacgggg

SEQ ID NO: 66476 - DNA, 25 bp, mus musculus
tatggcctgatgacatcacggggcc

SEQ ID NO: 66477 - DNA, 25 bp, mus musculus
tggcctgatgacatcacggggcctt

SEQ ID NO: 66478 - DNA, 25 bp, mus musculus
gatgacatcacggggccttggaagg

SEQ ID NO: 66479 - DNA, 25 bp, mus musculus
gcatccattgcaccgatgtaacaaa

SEQ ID NO: 66480 - DNA, 25 bp, mus musculus
atccattgcaccgatgtaacaaatg

SEQ ID NO: 66481 - DNA, 25 bp, mus musculus
attgcaccgatgtaacaaatgcatg

SEQ ID NO: 66482 - DNA, 25 bp, mus musculus
taaagatctctgtgacttttttgaa

SEQ ID NO: 66483 - DNA, 25 bp, mus musculus
aattccaatgagcatcctcccaaat

SEQ ID NO: 66484 - DNA, 25 bp, mus musculus
ttccaatgagcatcctcccaaatgt

SEQ ID NO: 66485 - DNA, 25 bp, mus musculus
ccaatgagcatcctcccaaatgtat

SEQ ID NO: 66486 - DNA, 25 bp, mus musculus
aatgagcatcctcccaaatgtatgc

SEQ ID NO: 66487 - DNA, 25 bp, mus musculus
cattctcgcagacgtctctagggcc

SEQ ID NO: 66488 - DNA, 25 bp, mus musculus
gagtgtttccagagggccgcttgga

SEQ ID NO: 66489 - DNA, 25 bp, mus musculus
atggcccgtttccatggtatggaga

SEQ ID NO: 66490 - DNA, 25 bp, mus musculus
gcccgtttccatggtatggagatgc

SEQ ID NO: 66491 - DNA, 25 bp, mus musculus
cgtttccatggtatggagatgccct

SEQ ID NO: 66492 - DNA, 25 bp, mus musculus
atggagatgcccttcactaaggagc

SEQ ID NO: 66493 - DNA, 25 bp, mus musculus
gagatgcccttcactaaggagcccc

SEQ ID NO: 66494 - DNA, 25 bp, mus musculus
atgcccttcactaaggagccccgat

SEQ ID NO: 66495 - DNA, 25 bp, mus musculus
ttcactaaggagccccgatggttgt

SEQ ID NO: 66496 - DNA, 25 bp, mus musculus
gtttgggaccatggagcggtacctg

SEQ ID NO: 66497 - DNA, 25 bp, mus musculus
tttgggaccatggagcggtacctga

SEQ ID NO: 66498 - DNA, 25 bp, mus musculus
gtacctgaagcagatccaggacttg

SEQ ID NO: 66499 - DNA, 25 bp, mus musculus
cagagggccgcttggaacagtacct

SEQ ID NO: 66500 - DNA, 25 bp, mus musculus
cagagccggccgttgaaaactcaag

SEQ ID NO: 66501 - DNA, 25 bp, mus musculus
actcaagagctccgggacccagtgt

SEQ ID NO: 66502 - DNA, 25 bp, mus musculus
caagagctccgggacccagtgttgt

SEQ ID NO: 66503 - DNA, 25 bp, mus musculus
gagctccgggacccagtgttgtcgg

SEQ ID NO: 66504 - DNA, 25 bp, mus musculus
gacccagtgttgtcgggagccattg

SEQ ID NO: 66505 - DNA, 25 bp, mus musculus
ccagtgttgtcgggagccattgcaa

SEQ ID NO: 66506 - DNA, 25 bp, mus musculus
ttgtcgggagccattgcaacgagga

SEQ ID NO: 66507 - DNA, 25 bp, mus musculus
gcctatcttgctgctcagaggcctg

SEQ ID NO: 66508 - DNA, 25 bp, mus musculus
ctatcttgctgctcagaggcctgcc

SEQ ID NO: 66509 - DNA, 25 bp, mus musculus
ttcactgacctgcaagaacagggtc

SEQ ID NO: 66510 - DNA, 25 bp, mus musculus
cactgacctgcaagaacagggtcca

SEQ ID NO: 66511 - DNA, 25 bp, mus musculus
gtccagaacatggctctttatgccg

SEQ ID NO: 66512 - DNA, 25 bp, mus musculus
agaacatggctctttatgccgacgt

SEQ ID NO: 66513 - DNA, 25 bp, mus musculus
tggctctttatgccgacgttagtgg

SEQ ID NO: 66514 - DNA, 25 bp, mus musculus
gctctttatgccgacgttagtggaa

SEQ ID NO: 66515 - DNA, 25 bp, mus musculus
tatgccgacgttagtggaaaacaat

SEQ ID NO: 66516 - DNA, 25 bp, mus musculus
tttcctgtaacccgcggccaggatg

SEQ ID NO: 66517 - DNA, 25 bp, mus musculus
tcctgtaacccgcggccaggatgtg

SEQ ID NO: 66518 - DNA, 25 bp, mus musculus
ctgtaacccgcggccaggatgtggg

SEQ ID NO: 66519 - DNA, 25 bp, mus musculus
atcttgctgctcagaggcctgcctg

SEQ ID NO: 66520 - DNA, 25 bp, mus musculus
ctgctcagaggcctgcctggaacca

SEQ ID NO: 66521 - DNA, 25 bp, mus musculus
gctcagaggcctgcctggaaccaca

SEQ ID NO: 66522 - DNA, 25 bp, mus musculus
agactgtattcatcgtggagatttc

SEQ ID NO: 66523 - DNA, 25 bp, mus musculus
actgtattcatcgtggagatttcac

SEQ ID NO: 66524 - DNA, 25 bp, mus musculus
tattcatcgtggagatttcactgac

SEQ ID NO: 66525 - DNA, 25 bp, mus musculus
ggagatttcactgacctgcaagaac

SEQ ID NO: 66526 - DNA, 25 bp, mus musculus
agatttcactgacctgcaagaacag

SEQ ID NO: 66527 - DNA, 25 bp, mus musculus
tacatagttcctccagcatatacac

SEQ ID NO: 66528 - DNA, 25 bp, mus musculus
gttcctccagcatatacacacacag

SEQ ID NO: 66529 - DNA, 25 bp, mus musculus
ctgttgttgccctgcagagaaatgt

SEQ ID NO: 66530 - DNA, 25 bp, mus musculus
tgtccatgtgtgacccttagcagaa

SEQ ID NO: 66531 - DNA, 25 bp, mus musculus
gctaatgaaaccgcccatatactgc

SEQ ID NO: 66532 - DNA, 25 bp, mus musculus
gaaaccgcccatatactgctgtcta

SEQ ID NO: 66533 - DNA, 25 bp, mus musculus
acgttggtgccactcagcaatcttc

SEQ ID NO: 66534 - DNA, 25 bp, mus musculus
gtgccactcagcaatcttctgtctc

SEQ ID NO: 66535 - DNA, 25 bp, mus musculus
ctcagcaatcttctgtctcccgaga

SEQ ID NO: 66536 - DNA, 25 bp, mus musculus
cccgagaactctcagacatgatttc

SEQ ID NO: 66537 - DNA, 25 bp, mus musculus
aactctcagacatgatttctgtggc

SEQ ID NO: 66538 - DNA, 25 bp, mus musculus
tgatttctgtggcactattagaagg

SEQ ID NO: 66539 - DNA, 25 bp, mus musculus
tgctggagcatcctccaaaaggaga

SEQ ID NO: 66540 - DNA, 25 bp, mus musculus
agcatcctccaaaaggagaagtgca

SEQ ID NO: 66541 - DNA, 25 bp, mus musculus
gaagctctagctctgcaagccccaa

SEQ ID NO: 66542 - DNA, 25 bp, mus musculus
atttccctgtgttccttctagctgt

SEQ ID NO: 66543 - DNA, 25 bp, mus musculus
ctgtgttccttctagctgttcccat

SEQ ID NO: 66544 - DNA, 25 bp, mus musculus
tccttctagctgttcccatactcag

SEQ ID NO: 66545 - DNA, 25 bp, mus musculus
tagctgttcccatactcaggctgtc

SEQ ID NO: 66546 - DNA, 25 bp, mus musculus
ggctgtctgttgttgccctgcagag

SEQ ID NO: 66547 - DNA, 25 bp, mus musculus
tccgcgatgtgactcacgaatcctt

SEQ ID NO: 66548 - DNA, 25 bp, mus musculus
cgatgtgactcacgaatccttgggt

SEQ ID NO: 66549 - DNA, 25 bp, mus musculus
tacattacttacattgtgtacctct

SEQ ID NO: 66550 - DNA, 25 bp, mus musculus
cattacttacattgtgtacctctgt

SEQ ID NO: 66551 - DNA, 25 bp, mus musculus
ttacttacattgtgtacctctgtga

SEQ ID NO: 66552 - DNA, 25 bp, mus musculus
ttacattgtgtacctctgtgacatc

SEQ ID NO: 66553 - DNA, 25 bp, mus musculus
acattgtgtacctctgtgacatcat

SEQ ID NO: 66554 - DNA, 25 bp, mus musculus
attgtgtacctctgtgacatcatcg

SEQ ID NO: 66555 - DNA, 25 bp, mus musculus
tgtgtacctctgtgacatcatcgtt

SEQ ID NO: 66556 - DNA, 25 bp, mus musculus
tacctctgtgacatcatcgttaacg

SEQ ID NO: 66557 - DNA, 25 bp, mus musculus
cctctgtgacatcatcgttaacgag

SEQ ID NO: 66558 - DNA, 25 bp, mus musculus
acatcatcgttaacgaggacaagac

SEQ ID NO: 66559 - DNA, 25 bp, mus musculus
gtgactcacgaatccttgggtgtac

SEQ ID NO: 66560 - DNA, 25 bp, mus musculus
tgggtgtacccgtcaatcctatcga

SEQ ID NO: 66561 - DNA, 25 bp, mus musculus
tgtacccgtcaatcctatcgactga

SEQ ID NO: 66562 - DNA, 25 bp, mus musculus
tacccgtcaatcctatcgactgagg

SEQ ID NO: 66563 - DNA, 25 bp, mus musculus
cccgtcaatcctatcgactgaggct

SEQ ID NO: 66564 - DNA, 25 bp, mus musculus
cgtcaatcctatcgactgaggctca

SEQ ID NO: 66565 - DNA, 25 bp, mus musculus
atcgactgaggctcagtacattact

SEQ ID NO: 66566 - DNA, 25 bp, mus musculus
gctcagtacattacttacattgtgt

SEQ ID NO: 66567 - DNA, 25 bp, mus musculus
cgccagcgaacacacacactttaaa

SEQ ID NO: 66568 - DNA, 25 bp, mus musculus
gatgtactactctttagccatggct

SEQ ID NO: 66569 - DNA, 25 bp, mus musculus
tgtcgtaaactctccacaccacagt

SEQ ID NO: 66570 - DNA, 25 bp, mus musculus
gagtgacacatgcccgctggcccag

SEQ ID NO: 66571 - DNA, 25 bp, mus musculus
taggaaacctctcagaggcatgtcg

SEQ ID NO: 66572 - DNA, 25 bp, mus musculus
caatgattccagatccagtcagact

SEQ ID NO: 66573 - DNA, 25 bp, mus musculus
tgattccagatccagtcagactgct

SEQ ID NO: 66574 - DNA, 25 bp, mus musculus
atccagtcagactgcttccttagtt

SEQ ID NO: 66575 - DNA, 25 bp, mus musculus
cagtcagactgcttccttagttcca

SEQ ID NO: 66576 - DNA, 25 bp, mus musculus
tcagactgcttccttagttccacgg

SEQ ID NO: 66577 - DNA, 25 bp, mus musculus
tccacgggcgacccaggatcctgtg

SEQ ID NO: 66578 - DNA, 25 bp, mus musculus
ggatcctgtgcccaactttgagttg

SEQ ID NO: 66579 - DNA, 25 bp, mus musculus
gtactactctttagccatggctaag

SEQ ID NO: 66580 - DNA, 25 bp, mus musculus
tttagccatggctaagcagaaacta

SEQ ID NO: 66581 - DNA, 25 bp, mus musculus
gaagcatattccgcggccaccacag

SEQ ID NO: 66582 - DNA, 25 bp, mus musculus
tccgcggccaccacagctgggatct

SEQ ID NO: 66583 - DNA, 25 bp, mus musculus
gccaccacagctgggatctcccaat

SEQ ID NO: 66584 - DNA, 25 bp, mus musculus
acagctgggatctcccaattattgt

SEQ ID NO: 66585 - DNA, 25 bp, mus musculus
gctgggatctcccaattattgtaaa

SEQ ID NO: 66586 - DNA, 25 bp, mus musculus
taaatctgtcgtaaactctccacac

SEQ ID NO: 66587 - DNA, 25 bp, mus musculus
tgaagtgccttcgggcctctgaaga

SEQ ID NO: 66588 - DNA, 25 bp, mus musculus
gaagtgccttcgggcctctgaagaa

SEQ ID NO: 66589 - DNA, 25 bp, mus musculus
acctgaagcagcattacatcgacct

SEQ ID NO: 66590 - DNA, 25 bp, mus musculus
cctgaagcagcattacatcgacctg

SEQ ID NO: 66591 - DNA, 25 bp, mus musculus
agcagcattacatcgacctgaaaga

SEQ ID NO: 66592 - DNA, 25 bp, mus musculus
gcagcattacatcgacctgaaagac

SEQ ID NO: 66593 - DNA, 25 bp, mus musculus
agcattacatcgacctgaaagacgg

SEQ ID NO: 66594 - DNA, 25 bp, mus musculus
gcattacatcgacctgaaagacggt

SEQ ID NO: 66595 - DNA, 25 bp, mus musculus
ttacatcgacctgaaagacggtcct

SEQ ID NO: 66596 - DNA, 25 bp, mus musculus
acatcgacctgaaagacggtcctgc

SEQ ID NO: 66597 - DNA, 25 bp, mus musculus
tttgcccatggtctgggaaggtctc

SEQ ID NO: 66598 - DNA, 25 bp, mus musculus
ttgcccatggtctgggaaggtctca

SEQ ID NO: 66599 - DNA, 25 bp, mus musculus
gccttcgggcctctgaagaacacct

SEQ ID NO: 66600 - DNA, 25 bp, mus musculus
ccttcgggcctctgaagaacacctg

SEQ ID NO: 66601 - DNA, 25 bp, mus musculus
gggcctctgaagaacacctgaagca

SEQ ID NO: 66602 - DNA, 25 bp, mus musculus
ggcctctgaagaacacctgaagcag

SEQ ID NO: 66603 - DNA, 25 bp, mus musculus
cctctgaagaacacctgaagcagca

SEQ ID NO: 66604 - DNA, 25 bp, mus musculus
ctgaagaacacctgaagcagcatta

SEQ ID NO: 66605 - DNA, 25 bp, mus musculus
agaacacctgaagcagcattacatc

SEQ ID NO: 66606 - DNA, 25 bp, mus musculus
acacctgaagcagcattacatcgac

SEQ ID NO: 66607 - DNA, 25 bp, mus musculus
gattcactgtatcacgtgatgcttc

SEQ ID NO: 66608 - DNA, 25 bp, mus musculus
ctgtatcacgtgatgcttcgatgct

SEQ ID NO: 66609 - DNA, 25 bp, mus musculus
tgagtaggccacaggcactagatct

SEQ ID NO: 66610 - DNA, 25 bp, mus musculus
tagatctgctaagtggccttgagca

SEQ ID NO: 66611 - DNA, 25 bp, mus musculus
tgctaagtggccttgagcaaattac

SEQ ID NO: 66612 - DNA, 25 bp, mus musculus
aaattacaagctgcctctgggccta

SEQ ID NO: 66613 - DNA, 25 bp, mus musculus
caagctgcctctgggcctaggacaa

SEQ ID NO: 66614 - DNA, 25 bp, mus musculus
agcatggaaaacctccactctttag

SEQ ID NO: 66615 - DNA, 25 bp, mus musculus
atttgagcccctcgttccagcatga

SEQ ID NO: 66616 - DNA, 25 bp, mus musculus
cgttccagcatgagccagtgacatt

SEQ ID NO: 66617 - DNA, 25 bp, mus musculus
tttgtacctgtttcggaatacagag

SEQ ID NO: 66618 - DNA, 25 bp, mus musculus
ggatccagcagtgatcacagagata

SEQ ID NO: 66619 - DNA, 25 bp, mus musculus
ttcagagccctagtgctggaagtaa

SEQ ID NO: 66620 - DNA, 25 bp, mus musculus
gtagtggcctcactgcttggggacc

SEQ ID NO: 66621 - DNA, 25 bp, mus musculus
cactatgtgcagctgacagcagctt

SEQ ID NO: 66622 - DNA, 25 bp, mus musculus
gtgcagctgacagcagcttatgtga

SEQ ID NO: 66623 - DNA, 25 bp, mus musculus
cctcagcattgcaggagcacgtcaa

SEQ ID NO: 66624 - DNA, 25 bp, mus musculus
cattgcaggagcacgtcaaagcccc

SEQ ID NO: 66625 - DNA, 25 bp, mus musculus
cccacttgaccaaagccctgagtag

SEQ ID NO: 66626 - DNA, 25 bp, mus musculus
aagccctgagtaggccacaggcact

SEQ ID NO: 66627 - DNA, 25 bp, mus musculus
gaatcctgctagcagattagcaaag

SEQ ID NO: 66628 - DNA, 25 bp, mus musculus
tgaagaagctcacaaccctggagaa

SEQ ID NO: 66629 - DNA, 25 bp, mus musculus
tgcgaactcagagtacgctaaacac

SEQ ID NO: 66630 - DNA, 25 bp, mus musculus
gtacgctaaacaccagagcatctgt

SEQ ID NO: 66631 - DNA, 25 bp, mus musculus
cgctaaacaccagagcatctgtcca

SEQ ID NO: 66632 - DNA, 25 bp, mus musculus
taaacaccagagcatctgtccaggg

SEQ ID NO: 66633 - DNA, 25 bp, mus musculus
ccagagcatctgtccagggagaaaa

SEQ ID NO: 66634 - DNA, 25 bp, mus musculus
gagcatctgtccagggagaaaagtg

SEQ ID NO: 66635 - DNA, 25 bp, mus musculus
gagttttactcagcactcgcgcctc

SEQ ID NO: 66636 - DNA, 25 bp, mus musculus
ttttactcagcactcgcgcctcata

SEQ ID NO: 66637 - DNA, 25 bp, mus musculus
ctcgcgcctcatagagcacaagaga

SEQ ID NO: 66638 - DNA, 25 bp, mus musculus
agacaggccctacaaatgtgaagta

SEQ ID NO: 66639 - DNA, 25 bp, mus musculus
agctcacaaccctggagaagagtct

SEQ ID NO: 66640 - DNA, 25 bp, mus musculus
tcacaaccctggagaagagtcttct

SEQ ID NO: 66641 - DNA, 25 bp, mus musculus
tatttcccatgaagacagccagcct

SEQ ID NO: 66642 - DNA, 25 bp, mus musculus
ccatgaagacagccagcctctgcgt

SEQ ID NO: 66643 - DNA, 25 bp, mus musculus
agacagccagcctctgcgtaatgaa

SEQ ID NO: 66644 - DNA, 25 bp, mus musculus
ccagcctctgcgtaatgaaaatggt

SEQ ID NO: 66645 - DNA, 25 bp, mus musculus
tgtaaattctcctgcgaactcagag

SEQ ID NO: 66646 - DNA, 25 bp, mus musculus
aaattctcctgcgaactcagagtac

SEQ ID NO: 66647 - DNA, 25 bp, mus musculus
cagcacagctggctggtcagcatcc

SEQ ID NO: 66648 - DNA, 25 bp, mus musculus
cagactcttccagtctcctgtgagg

SEQ ID NO: 66649 - DNA, 25 bp, mus musculus
tgctgagatgcgctgcacatggtta

SEQ ID NO: 66650 - DNA, 25 bp, mus musculus
tgagatgcgctgcacatggttacac

SEQ ID NO: 66651 - DNA, 25 bp, mus musculus
gcgctgcacatggttacacttcaat

SEQ ID NO: 66652 - DNA, 25 bp, mus musculus
ctgcacatggttacacttcaatagg

SEQ ID NO: 66653 - DNA, 25 bp, mus musculus
cacatggttacacttcaataggttc

SEQ ID NO: 66654 - DNA, 25 bp, mus musculus
gttacacttcaataggttctgcaac

SEQ ID NO: 66655 - DNA, 25 bp, mus musculus
acacttcaataggttctgcaacagg

SEQ ID NO: 66656 - DNA, 25 bp, mus musculus
attgatctttggcacgacgttcatc

SEQ ID NO: 66657 - DNA, 25 bp, mus musculus
ctttggcacgacgttcatcaagggt

SEQ ID NO: 66658 - DNA, 25 bp, mus musculus
tggcacgacgttcatcaagggtgtt

SEQ ID NO: 66659 - DNA, 25 bp, mus musculus
actcttccagtctcctgtgaggtag

SEQ ID NO: 66660 - DNA, 25 bp, mus musculus
cttccagtctcctgtgaggtaggct

SEQ ID NO: 66661 - DNA, 25 bp, mus musculus
gtctcctgtgaggtaggcttaaaca

SEQ ID NO: 66662 - DNA, 25 bp, mus musculus
agcctcgatcgtggtgattcagata

SEQ ID NO: 66663 - DNA, 25 bp, mus musculus
ctcgatcgtggtgattcagatagcc

SEQ ID NO: 66664 - DNA, 25 bp, mus musculus
gattcagatagccgatggggtacag

SEQ ID NO: 66665 - DNA, 25 bp, mus musculus
ggcctcctctgctgagatgcgctgc

SEQ ID NO: 66666 - DNA, 25 bp, mus musculus
ctctgctgagatgcgctgcacatgg

SEQ ID NO: 66667 - DNA, 25 bp, mus musculus
cctgctcgatcaggcccgaatagat

SEQ ID NO: 66668 - DNA, 25 bp, mus musculus
ctcgatcaggcccgaatagatgaaa

SEQ ID NO: 66669 - DNA, 25 bp, mus musculus
ccaccaaggcacggatggcgcccgt

SEQ ID NO: 66670 - DNA, 25 bp, mus musculus
cagcgtgacgacggcgccttcggcc

SEQ ID NO: 66671 - DNA, 25 bp, mus musculus
cgtctggctgacctgccactgcttg

SEQ ID NO: 66672 - DNA, 25 bp, mus musculus
tctggctgacctgccactgcttgtt

SEQ ID NO: 66673 - DNA, 25 bp, mus musculus
gctgacctgccactgcttgttggac

SEQ ID NO: 66674 - DNA, 25 bp, mus musculus
tgacctgccactgcttgttggactc

SEQ ID NO: 66675 - DNA, 25 bp, mus musculus
acctgccactgcttgttggactcca

SEQ ID NO: 66676 - DNA, 25 bp, mus musculus
ctgccactgcttgttggactccagc

SEQ ID NO: 66677 - DNA, 25 bp, mus musculus
cactgcttgttggactccagcaccc

SEQ ID NO: 66678 - DNA, 25 bp, mus musculus
ccgcttgaggttctgcaccgggcgc

SEQ ID NO: 66679 - DNA, 25 bp, mus musculus
cgatcaggcccgaatagatgaaagg

SEQ ID NO: 66680 - DNA, 25 bp, mus musculus
aggcttgaaggccgatcctggttgg

SEQ ID NO: 66681 - DNA, 25 bp, mus musculus
gcttgaaggccgatcctggttggcg

SEQ ID NO: 66682 - DNA, 25 bp, mus musculus
aggccgatcctggttggcgccaggc

SEQ ID NO: 66683 - DNA, 25 bp, mus musculus
cgatcctggttggcgccaggcctgg

SEQ ID NO: 66684 - DNA, 25 bp, mus musculus
tgaactggttgcgcgtgaagtcgaa

SEQ ID NO: 66685 - DNA, 25 bp, mus musculus
aactggttgcgcgtgaagtcgaagc

SEQ ID NO: 66686 - DNA, 25 bp, mus musculus
ctggttgcgcgtgaagtcgaagcca

SEQ ID NO: 66687 - DNA, 25 bp, mus musculus
tgtgtacttcaaactgtctccacag

SEQ ID NO: 66688 - DNA, 25 bp, mus musculus
gtacttcaaactgtctccacagagt

SEQ ID NO: 66689 - DNA, 25 bp, mus musculus
gtaaatcttgtacccatctgtgtgg

SEQ ID NO: 66690 - DNA, 25 bp, mus musculus
gtggttctcagacaacacatgctct

SEQ ID NO: 66691 - DNA, 25 bp, mus musculus
gttctcagacaacacatgctctctt

SEQ ID NO: 66692 - DNA, 25 bp, mus musculus
caacacatgctctcttttaatgcag

SEQ ID NO: 66693 - DNA, 25 bp, mus musculus
cacatgctctcttttaatgcagctt

SEQ ID NO: 66694 - DNA, 25 bp, mus musculus
atgctctcttttaatgcagctttga

SEQ ID NO: 66695 - DNA, 25 bp, mus musculus
tgggcacatcaacttctgaactgca

SEQ ID NO: 66696 - DNA, 25 bp, mus musculus
catcaacttctgaactgcaaactaa

SEQ ID NO: 66697 - DNA, 25 bp, mus musculus
caacttctgaactgcaaactaagct

SEQ ID NO: 66698 - DNA, 25 bp, mus musculus
cttctgaactgcaaactaagcttta

SEQ ID NO: 66699 - DNA, 25 bp, mus musculus
cttcaaactgtctccacagagttgt

SEQ ID NO: 66700 - DNA, 25 bp, mus musculus
actgtctccacagagttgttgggga

SEQ ID NO: 66701 - DNA, 25 bp, mus musculus
tccacagagttgttggggagacact

SEQ ID NO: 66702 - DNA, 25 bp, mus musculus
taatgtttcaaactcatatataaca

SEQ ID NO: 66703 - DNA, 25 bp, mus musculus
ttcaaactcatatataacaatgctg

SEQ ID NO: 66704 - DNA, 25 bp, mus musculus
ttaactttttatagcactagctatt

SEQ ID NO: 66705 - DNA, 25 bp, mus musculus
tcattcaacttcatgttgtgaagac

SEQ ID NO: 66706 - DNA, 25 bp, mus musculus
aacttcatgttgtgaagacgagctg

SEQ ID NO: 66707 - DNA, 25 bp, mus musculus
aggcgcacaggacacgctgatggga

SEQ ID NO: 66708 - DNA, 25 bp, mus musculus
gcgcacaggacacgctgatgggaca

SEQ ID NO: 66709 - DNA, 25 bp, mus musculus
ctgctctcctgtcagtgcgtctggt

SEQ ID NO: 66710 - DNA, 25 bp, mus musculus
tcagtgcgtctggtgctcgcctgct

SEQ ID NO: 66711 - DNA, 25 bp, mus musculus
cagacgctcgcagaggttgtgcaag

SEQ ID NO: 66712 - DNA, 25 bp, mus musculus
agacgctcgcagaggttgtgcaaga

SEQ ID NO: 66713 - DNA, 25 bp, mus musculus
gacgctcgcagaggttgtgcaagat

SEQ ID NO: 66714 - DNA, 25 bp, mus musculus
cgctcgcagaggttgtgcaagatca

SEQ ID NO: 66715 - DNA, 25 bp, mus musculus
gctcgcagaggttgtgcaagatcac

SEQ ID NO: 66716 - DNA, 25 bp, mus musculus
ttgtgcaagatcacctcaaagattg

SEQ ID NO: 66717 - DNA, 25 bp, mus musculus
tgtgcaagatcacctcaaagattgc

SEQ ID NO: 66718 - DNA, 25 bp, mus musculus
gtgcaagatcacctcaaagattgca

SEQ ID NO: 66719 - DNA, 25 bp, mus musculus
aggacacgctgatgggacagctaaa

SEQ ID NO: 66720 - DNA, 25 bp, mus musculus
acacgctgatgggacagctaaaaca

SEQ ID NO: 66721 - DNA, 25 bp, mus musculus
tccagggctgtccgcaggaattgtg

SEQ ID NO: 66722 - DNA, 25 bp, mus musculus
ccagggctgtccgcaggaattgtgg

SEQ ID NO: 66723 - DNA, 25 bp, mus musculus
cagggctgtccgcaggaattgtggc

SEQ ID NO: 66724 - DNA, 25 bp, mus musculus
gctgtccgcaggaattgtggctggt

SEQ ID NO: 66725 - DNA, 25 bp, mus musculus
tgtccgcaggaattgtggctggtgc

SEQ ID NO: 66726 - DNA, 25 bp, mus musculus
tccgcaggaattgtggctggtgcaa

SEQ ID NO: 66727 - DNA, 25 bp, mus musculus
attatgctgcagcctattgcactgg

SEQ ID NO: 66728 - DNA, 25 bp, mus musculus
gcagcctattgcactggcctgctgc

SEQ ID NO: 66729 - DNA, 25 bp, mus musculus
gcaggtcttgcccgaactacaactg

SEQ ID NO: 66730 - DNA, 25 bp, mus musculus
gtcttgcccgaactacaactggcaa

SEQ ID NO: 66731 - DNA, 25 bp, mus musculus
tgcccgaactacaactggcaataaa

SEQ ID NO: 66732 - DNA, 25 bp, mus musculus
gaggcttgtctatccctcatagtac

SEQ ID NO: 66733 - DNA, 25 bp, mus musculus
ggcttgtctatccctcatagtacca

SEQ ID NO: 66734 - DNA, 25 bp, mus musculus
cttgtctatccctcatagtaccaaa

SEQ ID NO: 66735 - DNA, 25 bp, mus musculus
tgtctatccctcatagtaccaaacg

SEQ ID NO: 66736 - DNA, 25 bp, mus musculus
tatccctcatagtaccaaacgattc

SEQ ID NO: 66737 - DNA, 25 bp, mus musculus
cctcatagtaccaaacgattccctg

SEQ ID NO: 66738 - DNA, 25 bp, mus musculus
tcatagtaccaaacgattccctggt

SEQ ID NO: 66739 - DNA, 25 bp, mus musculus
agcctattgcactggcctgctgctg

SEQ ID NO: 66740 - DNA, 25 bp, mus musculus
acgattccctggttatgactctgaa

SEQ ID NO: 66741 - DNA, 25 bp, mus musculus
tgctggcccgcagcttctgaatagg

SEQ ID NO: 66742 - DNA, 25 bp, mus musculus
ggcccgcagcttctgaataggtttg

SEQ ID NO: 66743 - DNA, 25 bp, mus musculus
cccgcagcttctgaataggtttggc

SEQ ID NO: 66744 - DNA, 25 bp, mus musculus
aaagcattgacggtcagcctggtgc

SEQ ID NO: 66745 - DNA, 25 bp, mus musculus
agcattgacggtcagcctggtgcct

SEQ ID NO: 66746 - DNA, 25 bp, mus musculus
ctatctggatgcaggtcttgcccga

SEQ ID NO: 66747 - DNA, 25 bp, mus musculus
atgcaggtcttgcccgaactacaac

SEQ ID NO: 66748 - DNA, 25 bp, mus musculus
gattaacatctcgggtgtcagggac

SEQ ID NO: 66749 - DNA, 25 bp, mus musculus
gaagtttgtcaccggcagcaatttt

SEQ ID NO: 66750 - DNA, 25 bp, mus musculus
tgcttttcacacgcgttctgtgctg

SEQ ID NO: 66751 - DNA, 25 bp, mus musculus
ttttcacacgcgttctgtgctggcg

SEQ ID NO: 66752 - DNA, 25 bp, mus musculus
tcacacgcgttctgtgctggcgata

SEQ ID NO: 66753 - DNA, 25 bp, mus musculus
ttctgtgctggcgatacacgttttg

SEQ ID NO: 66754 - DNA, 25 bp, mus musculus
tgtgctggcgatacacgttttgcca

SEQ ID NO: 66755 - DNA, 25 bp, mus musculus
acacgttttgccatgttcatgctca

SEQ ID NO: 66756 - DNA, 25 bp, mus musculus
cgttttgccatgttcatgctcatat

SEQ ID NO: 66757 - DNA, 25 bp, mus musculus
tttgccatgttcatgctcatatgcc

SEQ ID NO: 66758 - DNA, 25 bp, mus musculus
gccatgttcatgctcatatgcctta

SEQ ID NO: 66759 - DNA, 25 bp, mus musculus
atgttcatgctcatatgccttaaga

SEQ ID NO: 66760 - DNA, 25 bp, mus musculus
gtttgtcaccggcagcaattttcac

SEQ ID NO: 66761 - DNA, 25 bp, mus musculus
tgtcaccggcagcaattttcactag

SEQ ID NO: 66762 - DNA, 25 bp, mus musculus
caccggcagcaattttcactagatg

SEQ ID NO: 66763 - DNA, 25 bp, mus musculus
caattttcactagatgtcctgtagc

SEQ ID NO: 66764 - DNA, 25 bp, mus musculus
tcactagatgtcctgtagctatgtc

SEQ ID NO: 66765 - DNA, 25 bp, mus musculus
gatgtcctgtagctatgtctttagc

SEQ ID NO: 66766 - DNA, 25 bp, mus musculus
gtcctgtagctatgtctttagctgt

SEQ ID NO: 66767 - DNA, 25 bp, mus musculus
tagctgtattgcttttcacacgcgt

SEQ ID NO: 66768 - DNA, 25 bp, mus musculus
gcgcctcggtgcaaaaggggttctg

SEQ ID NO: 66769 - DNA, 25 bp, mus musculus
accaacaagttgccgcagcaacggg

SEQ ID NO: 66770 - DNA, 25 bp, mus musculus
taaactggtgttttgcctgctgtcc

SEQ ID NO: 66771 - DNA, 25 bp, mus musculus
ttttgcctgctgtccgattgcctga

SEQ ID NO: 66772 - DNA, 25 bp, mus musculus
ttgcctgctgtccgattgcctgaca

SEQ ID NO: 66773 - DNA, 25 bp, mus musculus
cctgctgtccgattgcctgacatta

SEQ ID NO: 66774 - DNA, 25 bp, mus musculus
ctgctgtccgattgcctgacattag

SEQ ID NO: 66775 - DNA, 25 bp, mus musculus
gctgtccgattgcctgacattagcc

SEQ ID NO: 66776 - DNA, 25 bp, mus musculus
gtccgattgcctgacattagcccgg

SEQ ID NO: 66777 - DNA, 25 bp, mus musculus
tccgattgcctgacattagcccgga

SEQ ID NO: 66778 - DNA, 25 bp, mus musculus
gattgcctgacattagcccggaccg

SEQ ID NO: 66779 - DNA, 25 bp, mus musculus
tgcctgacattagcccggaccgggt

SEQ ID NO: 66780 - DNA, 25 bp, mus musculus
ccaacaagttgccgcagcaacggga

SEQ ID NO: 66781 - DNA, 25 bp, mus musculus
agttgccgcagcaacgggaaagccg

SEQ ID NO: 66782 - DNA, 25 bp, mus musculus
ttgccgcagcaacgggaaagccgga

SEQ ID NO: 66783 - DNA, 25 bp, mus musculus
cgcagcaacgggaaagccggaacag

SEQ ID NO: 66784 - DNA, 25 bp, mus musculus
aacagtacatcgaattcaaattgtt

SEQ ID NO: 66785 - DNA, 25 bp, mus musculus
tcaaattgttcccggaccagctcat

SEQ ID NO: 66786 - DNA, 25 bp, mus musculus
caaattgttcccggaccagctcatg

SEQ ID NO: 66787 - DNA, 25 bp, mus musculus
acagcatcggcaagattcgttgttc

SEQ ID NO: 66788 - DNA, 25 bp, mus musculus
ccgatgtgtccggactcttgctaca

SEQ ID NO: 66789 - DNA, 25 bp, mus musculus
gatgtgtccggactcttgctacacg

SEQ ID NO: 66790 - DNA, 25 bp, mus musculus
atacagctttcggactacagaggag

SEQ ID NO: 66791 - DNA, 25 bp, mus musculus
acagctttcggactacagaggagag

SEQ ID NO: 66792 - DNA, 25 bp, mus musculus
ctatttctaaacactggacttcaat

SEQ ID NO: 66793 - DNA, 25 bp, mus musculus
atatctgtagactcatcagttcacc

SEQ ID NO: 66794 - DNA, 25 bp, mus musculus
atctgtagactcatcagttcaccac

SEQ ID NO: 66795 - DNA, 25 bp, mus musculus
ctgtagactcatcagttcaccacca

SEQ ID NO: 66796 - DNA, 25 bp, mus musculus
gtagactcatcagttcaccaccagg

SEQ ID NO: 66797 - DNA, 25 bp, mus musculus
agactcatcagttcaccaccaggca

SEQ ID NO: 66798 - DNA, 25 bp, mus musculus
actcatcagttcaccaccaggcatg

SEQ ID NO: 66799 - DNA, 25 bp, mus musculus
atcagttcaccaccaggcatggata

SEQ ID NO: 66800 - DNA, 25 bp, mus musculus
tgtgtccggactcttgctacacgca

SEQ ID NO: 66801 - DNA, 25 bp, mus musculus
cttgctacacgcagtcaatgagcat

SEQ ID NO: 66802 - DNA, 25 bp, mus musculus
tgctacacgcagtcaatgagcatcc

SEQ ID NO: 66803 - DNA, 25 bp, mus musculus
gcagtcaatgagcatccggaaacgc

SEQ ID NO: 66804 - DNA, 25 bp, mus musculus
agtcaatgagcatccggaaacgcgc

SEQ ID NO: 66805 - DNA, 25 bp, mus musculus
tcaatgagcatccggaaacgcgcaa

SEQ ID NO: 66806 - DNA, 25 bp, mus musculus
aatgagcatccggaaacgcgcaaaa

SEQ ID NO: 66807 - DNA, 25 bp, mus musculus
agcatccggaaacgcgcaaaatcgg

SEQ ID NO: 66808 - DNA, 25 bp, mus musculus
ttcggatccatgcttgcgcggaggc

SEQ ID NO: 66809 - DNA, 25 bp, mus musculus
cacgtggcatacgcgaactgccaaa

SEQ ID NO: 66810 - DNA, 25 bp, mus musculus
gccaaagccttagacaagtacgtgt

SEQ ID NO: 66811 - DNA, 25 bp, mus musculus
agacaagtacgtgtctcagtctcaa

SEQ ID NO: 66812 - DNA, 25 bp, mus musculus
caagtacgtgtctcagtctcaatac

SEQ ID NO: 66813 - DNA, 25 bp, mus musculus
aagtacgtgtctcagtctcaatact

SEQ ID NO: 66814 - DNA, 25 bp, mus musculus
tacgtgtctcagtctcaatactgtg

SEQ ID NO: 66815 - DNA, 25 bp, mus musculus
cgtgtctcagtctcaatactgtggg

SEQ ID NO: 66816 - DNA, 25 bp, mus musculus
gtgtctcagtctcaatactgtgggg

SEQ ID NO: 66817 - DNA, 25 bp, mus musculus
aagactgcagcagccaagggaagag

SEQ ID NO: 66818 - DNA, 25 bp, mus musculus
agactgcagcagccaagggaagaga

SEQ ID NO: 66819 - DNA, 25 bp, mus musculus
actgcagcagccaagggaagagagc

SEQ ID NO: 66820 - DNA, 25 bp, mus musculus
gtggcatacgcgaactgccaaagcc

SEQ ID NO: 66821 - DNA, 25 bp, mus musculus
tggcatacgcgaactgccaaagcct

SEQ ID NO: 66822 - DNA, 25 bp, mus musculus
catacgcgaactgccaaagccttag

SEQ ID NO: 66823 - DNA, 25 bp, mus musculus
tacgcgaactgccaaagccttagac

SEQ ID NO: 66824 - DNA, 25 bp, mus musculus
acgcgaactgccaaagccttagaca

SEQ ID NO: 66825 - DNA, 25 bp, mus musculus
gcgaactgccaaagccttagacaag

SEQ ID NO: 66826 - DNA, 25 bp, mus musculus
cgaactgccaaagccttagacaagt

SEQ ID NO: 66827 - DNA, 25 bp, mus musculus
tgccaaagccttagacaagtacgtg

SEQ ID NO: 66828 - DNA, 25 bp, mus musculus
gaggactccaaggacacaattgaaa

SEQ ID NO: 66829 - DNA, 25 bp, mus musculus
agagcatatgacctgttctgtgggc

SEQ ID NO: 66830 - DNA, 25 bp, mus musculus
tataggcttgctggaggaaagtgat

SEQ ID NO: 66831 - DNA, 25 bp, mus musculus
ttacattgctgtgaacttatgcatt

SEQ ID NO: 66832 - DNA, 25 bp, mus musculus
catttgaagccagtgtgccacactc

SEQ ID NO: 66833 - DNA, 25 bp, mus musculus
ttgaagccagtgtgccacactcatc

SEQ ID NO: 66834 - DNA, 25 bp, mus musculus
aagccagtgtgccacactcatctgc

SEQ ID NO: 66835 - DNA, 25 bp, mus musculus
ccagtgtgccacactcatctgccat

SEQ ID NO: 66836 - DNA, 25 bp, mus musculus
tgccacactcatctgccatgccaga

SEQ ID NO: 66837 - DNA, 25 bp, mus musculus
cacactcatctgccatgccagagct

SEQ ID NO: 66838 - DNA, 25 bp, mus musculus
actcatctgccatgccagagcttta

SEQ ID NO: 66839 - DNA, 25 bp, mus musculus
catctgccatgccagagctttagaa

SEQ ID NO: 66840 - DNA, 25 bp, mus musculus
gcatatgacctgttctgtgggctgg

SEQ ID NO: 66841 - DNA, 25 bp, mus musculus
ctgccatgccagagctttagaagtg

SEQ ID NO: 66842 - DNA, 25 bp, mus musculus
tatgacctgttctgtgggctggacc

SEQ ID NO: 66843 - DNA, 25 bp, mus musculus
ttctgtgggctggaccaggataaag

SEQ ID NO: 66844 - DNA, 25 bp, mus musculus
atgtccacttgtaaatttcacgcat

SEQ ID NO: 66845 - DNA, 25 bp, mus musculus
acttgtaaatttcacgcattcggat

SEQ ID NO: 66846 - DNA, 25 bp, mus musculus
tgtaaatttcacgcattcggataaa

SEQ ID NO: 66847 - DNA, 25 bp, mus musculus
tttcacgcattcggataaaaggtgt

SEQ ID NO: 66848 - DNA, 25 bp, mus musculus
tgtgattataggcttgctggaggaa

SEQ ID NO: 66849 - DNA, 25 bp, mus musculus
gcggccttcctactcgtgtggtctt

SEQ ID NO: 66850 - DNA, 25 bp, mus musculus
ggccttcctactcgtgtggtctttg

SEQ ID NO: 66851 - DNA, 25 bp, mus musculus
tggtgcagccatcaaccttatcttc

SEQ ID NO: 66852 - DNA, 25 bp, mus musculus
ggtgcagccatcaaccttatcttca

SEQ ID NO: 66853 - DNA, 25 bp, mus musculus
gtgcagccatcaaccttatcttcag

SEQ ID NO: 66854 - DNA, 25 bp, mus musculus
tgcagccatcaaccttatcttcaga

SEQ ID NO: 66855 - DNA, 25 bp, mus musculus
gcagccatcaaccttatcttcagat

SEQ ID NO: 66856 - DNA, 25 bp, mus musculus
cagccatcaaccttatcttcagata

SEQ ID NO: 66857 - DNA, 25 bp, mus musculus
gccttcctactcgtgtggtctttgt

SEQ ID NO: 66858 - DNA, 25 bp, mus musculus
ccttcctactcgtgtggtctttgtg

SEQ ID NO: 66859 - DNA, 25 bp, mus musculus
cttcctactcgtgtggtctttgtga

SEQ ID NO: 66860 - DNA, 25 bp, mus musculus
ttcctactcgtgtggtctttgtgac

SEQ ID NO: 66861 - DNA, 25 bp, mus musculus
tcctactcgtgtggtctttgtgact

SEQ ID NO: 66862 - DNA, 25 bp, mus musculus
ctactcgtgtggtctttgtgacttc

SEQ ID NO: 66863 - DNA, 25 bp, mus musculus
tactcgtgtggtctttgtgacttcc

SEQ ID NO: 66864 - DNA, 25 bp, mus musculus
tgacttccaccatggcgtacccggc

SEQ ID NO: 66865 - DNA, 25 bp, mus musculus
gacacacacactggtttctggcctc

SEQ ID NO: 66866 - DNA, 25 bp, mus musculus
cacactggtttctggcctccttctc

SEQ ID NO: 66867 - DNA, 25 bp, mus musculus
tttccttaaaatctgcaaaggcaga

SEQ ID NO: 66868 - DNA, 25 bp, mus musculus
aagctctcattctcctgcaaattcc

SEQ ID NO: 66869 - DNA, 25 bp, mus musculus
tcctgcaaattccatggtaggcaca

SEQ ID NO: 66870 - DNA, 25 bp, mus musculus
cagtcccttgaataaacgtcacaag

SEQ ID NO: 66871 - DNA, 25 bp, mus musculus
taaacgtcacaaggctgcttattat

SEQ ID NO: 66872 - DNA, 25 bp, mus musculus
tcacaaggctgcttattatcaaaaa

SEQ ID NO: 66873 - DNA, 25 bp, mus musculus
catgtaaccgcttaaatgtcacagt

SEQ ID NO: 66874 - DNA, 25 bp, mus musculus
tcacagttaacacttttcattcttt

SEQ ID NO: 66875 - DNA, 25 bp, mus musculus
tattcatataactcattattgtgcc

SEQ ID NO: 66876 - DNA, 25 bp, mus musculus
tataactcattattgtgccttatta

SEQ ID NO: 66877 - DNA, 25 bp, mus musculus
ctctgtcctgcaaatgaatacagcg

SEQ ID NO: 66878 - DNA, 25 bp, mus musculus
aatgaatacagcgtgctggtgccta

SEQ ID NO: 66879 - DNA, 25 bp, mus musculus
tacagcgtgctggtgcctacttttc

SEQ ID NO: 66880 - DNA, 25 bp, mus musculus
cctcccggtgcttgaacgcagcctg

SEQ ID NO: 66881 - DNA, 25 bp, mus musculus
tgaacgcagcctgacttttgcacct

SEQ ID NO: 66882 - DNA, 25 bp, mus musculus
cagcctgacttttgcacctttgaaa

SEQ ID NO: 66883 - DNA, 25 bp, mus musculus
tgcacctttgaaatacttgtggtag

SEQ ID NO: 66884 - DNA, 25 bp, mus musculus
aagtcttacattccttctcatttgt

SEQ ID NO: 66885 - DNA, 25 bp, mus musculus
ttgcctacactgggaacatccacag

SEQ ID NO: 66886 - DNA, 25 bp, mus musculus
acactgggaacatccacagaagcct

SEQ ID NO: 66887 - DNA, 25 bp, mus musculus
ctcacatcaaacattgttcctacta

SEQ ID NO: 66888 - DNA, 25 bp, mus musculus
cctactatactcatgaagaggaggt

SEQ ID NO: 66889 - DNA, 25 bp, mus musculus
ttcacaaagtcaaaacacaaagtgt

SEQ ID NO: 66890 - DNA, 25 bp, mus musculus
ggtatatccaaatttctctggactc

SEQ ID NO: 66891 - DNA, 25 bp, mus musculus
gcaactttaattgcttctatagcgg

SEQ ID NO: 66892 - DNA, 25 bp, mus musculus
ttaattgcttctatagcggttctac

SEQ ID NO: 66893 - DNA, 25 bp, mus musculus
gcttctatagcggttctactcaagc

SEQ ID NO: 66894 - DNA, 25 bp, mus musculus
atagcggttctactcaagcagccaa

SEQ ID NO: 66895 - DNA, 25 bp, mus musculus
ctcaagcagccaacgttagcagctt

SEQ ID NO: 66896 - DNA, 25 bp, mus musculus
agagctgtgtacccctgttccttgt

SEQ ID NO: 66897 - DNA, 25 bp, mus musculus
tccacagaagccttaatgaggctac

SEQ ID NO: 66898 - DNA, 25 bp, mus musculus
gcagcttactcttgctgagccgtag

SEQ ID NO: 66899 - DNA, 25 bp, mus musculus
attactacttaacaagagctcttca

SEQ ID NO: 66900 - DNA, 25 bp, mus musculus
agcttttgagtgaccagggttgtcg

SEQ ID NO: 66901 - DNA, 25 bp, mus musculus
tgagtgaccagggttgtcgttcagt

SEQ ID NO: 66902 - DNA, 25 bp, mus musculus
ttgggcatttcgcatcctcttcttt

SEQ ID NO: 66903 - DNA, 25 bp, mus musculus
tagctacttctagtccatttttcaa

SEQ ID NO: 66904 - DNA, 25 bp, mus musculus
cttctagtccatttttcaatggaca

SEQ ID NO: 66905 - DNA, 25 bp, mus musculus
ttatcatcaaaacctgcttgggggc

SEQ ID NO: 66906 - DNA, 25 bp, mus musculus
tcgccagcggcagtttccactgtag

SEQ ID NO: 66907 - DNA, 25 bp, mus musculus
cgccagcggcagtttccactgtagt

SEQ ID NO: 66908 - DNA, 25 bp, mus musculus
tcagcatttcttgcctgccacacat

SEQ ID NO: 66909 - DNA, 25 bp, mus musculus
cagcatttcttgcctgccacacatc

SEQ ID NO: 66910 - DNA, 25 bp, mus musculus
agcatttcttgcctgccacacatcc

SEQ ID NO: 66911 - DNA, 25 bp, mus musculus
gcatttcttgcctgccacacatcca

SEQ ID NO: 66912 - DNA, 25 bp, mus musculus
atttcttgcctgccacacatccacg

SEQ ID NO: 66913 - DNA, 25 bp, mus musculus
tttcttgcctgccacacatccacga

SEQ ID NO: 66914 - DNA, 25 bp, mus musculus
ttcttgcctgccacacatccacgag

SEQ ID NO: 66915 - DNA, 25 bp, mus musculus
tgcctgccacacatccacgagttgc

SEQ ID NO: 66916 - DNA, 25 bp, mus musculus
cctgccacacatccacgagttgcat

SEQ ID NO: 66917 - DNA, 25 bp, mus musculus
tgccacacatccacgagttgcattg

SEQ ID NO: 66918 - DNA, 25 bp, mus musculus
ccagcggcagtttccactgtagtca

SEQ ID NO: 66919 - DNA, 25 bp, mus musculus
gccacacatccacgagttgcattgg

SEQ ID NO: 66920 - DNA, 25 bp, mus musculus
cagcggcagtttccactgtagtcag

SEQ ID NO: 66921 - DNA, 25 bp, mus musculus
agcggcagtttccactgtagtcagc

SEQ ID NO: 66922 - DNA, 25 bp, mus musculus
gcggcagtttccactgtagtcagca

SEQ ID NO: 66923 - DNA, 25 bp, mus musculus
ggcagtttccactgtagtcagcagg

SEQ ID NO: 66924 - DNA, 25 bp, mus musculus
gcagtttccactgtagtcagcagga

SEQ ID NO: 66925 - DNA, 25 bp, mus musculus
tcagcaggagctgtgtctttggctt

SEQ ID NO: 66926 - DNA, 25 bp, mus musculus
ggagctgtgtctttggctttggttc

SEQ ID NO: 66927 - DNA, 25 bp, mus musculus
agagctccagatcatgagaaagcta

SEQ ID NO: 66928 - DNA, 25 bp, mus musculus
gctagaccactgtaacatagtccga

SEQ ID NO: 66929 - DNA, 25 bp, mus musculus
cgagccaagcagacactccctgtga

SEQ ID NO: 66930 - DNA, 25 bp, mus musculus
gccaagcagacactccctgtgatct

SEQ ID NO: 66931 - DNA, 25 bp, mus musculus
aagcagacactccctgtgatctatg

SEQ ID NO: 66932 - DNA, 25 bp, mus musculus
atgtatcagctgttcagaagtctag

SEQ ID NO: 66933 - DNA, 25 bp, mus musculus
ctgttcagaagtctagcctatatcc

SEQ ID NO: 66934 - DNA, 25 bp, mus musculus
agtctagcctatatccattcctttg

SEQ ID NO: 66935 - DNA, 25 bp, mus musculus
ctagcctatatccattcctttggaa

SEQ ID NO: 66936 - DNA, 25 bp, mus musculus
gcctatatccattcctttggaatct

SEQ ID NO: 66937 - DNA, 25 bp, mus musculus
atccattcctttggaatctgccatc

SEQ ID NO: 66938 - DNA, 25 bp, mus musculus
tcctttggaatctgccatcgagaca

SEQ ID NO: 66939 - DNA, 25 bp, mus musculus
taacatagtccgactgcggtatttc

SEQ ID NO: 66940 - DNA, 25 bp, mus musculus
catagtccgactgcggtatttcttc

SEQ ID NO: 66941 - DNA, 25 bp, mus musculus
gcggtatttcttctactcgagtggt

SEQ ID NO: 66942 - DNA, 25 bp, mus musculus
tgaggtctaccttaacctggtgctg

SEQ ID NO: 66943 - DNA, 25 bp, mus musculus
ccttaacctggtgctggactatgtt

SEQ ID NO: 66944 - DNA, 25 bp, mus musculus
taacctggtgctggactatgttccg

SEQ ID NO: 66945 - DNA, 25 bp, mus musculus
ctatgttccggagacagtgtacaga

SEQ ID NO: 66946 - DNA, 25 bp, mus musculus
agtcgccagaactatagtcgagcca

SEQ ID NO: 66947 - DNA, 25 bp, mus musculus
ggctcgctgttaccggtactgtaag

SEQ ID NO: 66948 - DNA, 25 bp, mus musculus
gaagatccgcatctttgacctgggt

SEQ ID NO: 66949 - DNA, 25 bp, mus musculus
ttggaagcccttgatggcggatcga

SEQ ID NO: 66950 - DNA, 25 bp, mus musculus
tggaagcccttgatggcggatcgaa

SEQ ID NO: 66951 - DNA, 25 bp, mus musculus
gaagcccttgatggcggatcgaatc

SEQ ID NO: 66952 - DNA, 25 bp, mus musculus
aagcccttgatggcggatcgaatct

SEQ ID NO: 66953 - DNA, 25 bp, mus musculus
cccttgatggcggatcgaatctgcg

SEQ ID NO: 66954 - DNA, 25 bp, mus musculus
gatcgaatctgcgcaacaaggttca

SEQ ID NO: 66955 - DNA, 25 bp, mus musculus
tcgaatctgcgcaacaaggttcatg

SEQ ID NO: 66956 - DNA, 25 bp, mus musculus
cgaatctgcgcaacaaggttcatgg

SEQ ID NO: 66957 - DNA, 25 bp, mus musculus
aatctgcgcaacaaggttcatgggt

SEQ ID NO: 66958 - DNA, 25 bp, mus musculus
atctgcgcaacaaggttcatgggta

SEQ ID NO: 66959 - DNA, 25 bp, mus musculus
tgagtttccactctgccggcacatg

SEQ ID NO: 66960 - DNA, 25 bp, mus musculus
ttccactctgccggcacatggtgtc

SEQ ID NO: 66961 - DNA, 25 bp, mus musculus
cactctgccggcacatggtgtcgga

SEQ ID NO: 66962 - DNA, 25 bp, mus musculus
ggcacatggtgtcggacgagtatga

SEQ ID NO: 66963 - DNA, 25 bp, mus musculus
gcacatggtgtcggacgagtatgaa

SEQ ID NO: 66964 - DNA, 25 bp, mus musculus
catggtgtcggacgagtatgaacaa

SEQ ID NO: 66965 - DNA, 25 bp, mus musculus
tccttggaagcccttgatggcggat

SEQ ID NO: 66966 - DNA, 25 bp, mus musculus
ccttggaagcccttgatggcggatc

SEQ ID NO: 66967 - DNA, 25 bp, mus musculus
cagggtctcacatctatgcaggaat

SEQ ID NO: 66968 - DNA, 25 bp, mus musculus
ttcagaggccttctacaggaggcac

SEQ ID NO: 66969 - DNA, 25 bp, mus musculus
ctgtccttgagtatgctctactgat

SEQ ID NO: 66970 - DNA, 25 bp, mus musculus
atgctctactgatccaattactttg

SEQ ID NO: 66971 - DNA, 25 bp, mus musculus
cagctttgctgagttggtctcgaga

SEQ ID NO: 66972 - DNA, 25 bp, mus musculus
ctcgagaactcaccaagaaactcac

SEQ ID NO: 66973 - DNA, 25 bp, mus musculus
aactcacagccaagagccggcaggc

SEQ ID NO: 66974 - DNA, 25 bp, mus musculus
cagccaagagccggcaggcccttca

SEQ ID NO: 66975 - DNA, 25 bp, mus musculus
agagccggcaggcccttcaggaacg

SEQ ID NO: 66976 - DNA, 25 bp, mus musculus
cccttcaggaacgtgatgctgcaat

SEQ ID NO: 66977 - DNA, 25 bp, mus musculus
gtcaaatcgaacaactgaagttgga

SEQ ID NO: 66978 - DNA, 25 bp, mus musculus
aactgttgatctgcttgctgtgtgg

SEQ ID NO: 66979 - DNA, 25 bp, mus musculus
gaggcacagacccaactgatagggc

SEQ ID NO: 66980 - DNA, 25 bp, mus musculus
atagggcttcacacagaacaaaagg

SEQ ID NO: 66981 - DNA, 25 bp, mus musculus
gagctggctcagcagacagtgagtc

SEQ ID NO: 66982 - DNA, 25 bp, mus musculus
ctgagttctgccttgcagcaggact

SEQ ID NO: 66983 - DNA, 25 bp, mus musculus
tctgccttgcagcaggactggacat

SEQ ID NO: 66984 - DNA, 25 bp, mus musculus
tggacatcagtccaattgaatgtga

SEQ ID NO: 66985 - DNA, 25 bp, mus musculus
tcccttagaggcaatttcctgtcct

SEQ ID NO: 66986 - DNA, 25 bp, mus musculus
aatttcctgtccttgagtatgctct

SEQ ID NO: 66987 - DNA, 25 bp, mus musculus
ccatatccattctggctaccacctt

SEQ ID NO: 66988 - DNA, 25 bp, mus musculus
caccactgagttctaacccagacat

SEQ ID NO: 66989 - DNA, 25 bp, mus musculus
cccttgtggtcacaggcagtgaccc

SEQ ID NO: 66990 - DNA, 25 bp, mus musculus
cactcttttcacagactcccatctt

SEQ ID NO: 66991 - DNA, 25 bp, mus musculus
agactcccatcttgctgactccgag

SEQ ID NO: 66992 - DNA, 25 bp, mus musculus
tttggagcactctcagtccgtttgc

SEQ ID NO: 66993 - DNA, 25 bp, mus musculus
tcagtccgtttgctcccttgagccc

SEQ ID NO: 66994 - DNA, 25 bp, mus musculus
ttccctctgtactcaacagtcatgg

SEQ ID NO: 66995 - DNA, 25 bp, mus musculus
ctgtactcaacagtcatgggccgct

SEQ ID NO: 66996 - DNA, 25 bp, mus musculus
tcaacagtcatgggccgctcactct

SEQ ID NO: 66997 - DNA, 25 bp, mus musculus
tcactctttcaggactggagggacc

SEQ ID NO: 66998 - DNA, 25 bp, mus musculus
tttcccccagactgcagaagacata

SEQ ID NO: 66999 - DNA, 25 bp, mus musculus
tgagttctaacccagacattgacac

SEQ ID NO: 67000 - DNA, 25 bp, mus musculus
ctaacccagacattgacacagacat

SEQ ID NO: 67001 - DNA, 25 bp, mus musculus
ttgagtcagtggcttctcagccaat

SEQ ID NO: 67002 - DNA, 25 bp, mus musculus
cttctcagccaatggaacttccaga

SEQ ID NO: 67003 - DNA, 25 bp, mus musculus
tggaacttccagagaacttatcact

SEQ ID NO: 67004 - DNA, 25 bp, mus musculus
tatcactggagcctaaaaatgagga

SEQ ID NO: 67005 - DNA, 25 bp, mus musculus
attcagctttggcagaaaaggacaa

SEQ ID NO: 67006 - DNA, 25 bp, mus musculus
ataactcatcaagatctaagaagcc

SEQ ID NO: 67007 - DNA, 25 bp, mus musculus
aacttggctctgcctttgtttagct

SEQ ID NO: 67008 - DNA, 25 bp, mus musculus
tttagcttttctgcacctctggctc

SEQ ID NO: 67009 - DNA, 25 bp, mus musculus
aagtcacttgtgtttgagctgtgct

SEQ ID NO: 67010 - DNA, 25 bp, mus musculus
ctgtgctgcaacagtgacagtggag

SEQ ID NO: 67011 - DNA, 25 bp, mus musculus
gttccttatgtacgatacatcatcc

SEQ ID NO: 67012 - DNA, 25 bp, mus musculus
tatgtacgatacatcatccgctgat

SEQ ID NO: 67013 - DNA, 25 bp, mus musculus
cgatacatcatccgctgatctcttt

SEQ ID NO: 67014 - DNA, 25 bp, mus musculus
tcttactgactccgttctttcagat

SEQ ID NO: 67015 - DNA, 25 bp, mus musculus
cgttctttcagatctctcagtctat

SEQ ID NO: 67016 - DNA, 25 bp, mus musculus
ttcagatctctcagtctatatcaaa

SEQ ID NO: 67017 - DNA, 25 bp, mus musculus
tctctcagtctatatcaaaaccttt

SEQ ID NO: 67018 - DNA, 25 bp, mus musculus
tatcaaaacctttctagttatgagg

SEQ ID NO: 67019 - DNA, 25 bp, mus musculus
gcacctctggctccagagtgtcatc

SEQ ID NO: 67020 - DNA, 25 bp, mus musculus
ctggctccagagtgtcatcagttct

SEQ ID NO: 67021 - DNA, 25 bp, mus musculus
tgtcatcagttctatgatcaagagt

SEQ ID NO: 67022 - DNA, 25 bp, mus musculus
ggactgcaacctagcggtgaggaga

SEQ ID NO: 67023 - DNA, 25 bp, mus musculus
caacctagcggtgaggagatgacct

SEQ ID NO: 67024 - DNA, 25 bp, mus musculus
tattctgtctttatgccagccagca

SEQ ID NO: 67025 - DNA, 25 bp, mus musculus
gtctttatgccagccagcaagctca

SEQ ID NO: 67026 - DNA, 25 bp, mus musculus
atgccagccagcaagctcaaagaac

SEQ ID NO: 67027 - DNA, 25 bp, mus musculus
cttgtggaaggcctagctggttgag

SEQ ID NO: 67028 - DNA, 25 bp, mus musculus
tggaaggcctagctggttgagacct

SEQ ID NO: 67029 - DNA, 25 bp, mus musculus
caacagaagcgctcggagcccagtg

SEQ ID NO: 67030 - DNA, 25 bp, mus musculus
aacagaagcgctcggagcccagtgt

SEQ ID NO: 67031 - DNA, 25 bp, mus musculus
cagaagcgctcggagcccagtgtga

SEQ ID NO: 67032 - DNA, 25 bp, mus musculus
gtgataacatgcttatctgggaaca

SEQ ID NO: 67033 - DNA, 25 bp, mus musculus
tgataacatgcttatctgggaacac

SEQ ID NO: 67034 - DNA, 25 bp, mus musculus
gataacatgcttatctgggaacaca

SEQ ID NO: 67035 - DNA, 25 bp, mus musculus
ataacatgcttatctgggaacacaa

SEQ ID NO: 67036 - DNA, 25 bp, mus musculus
taacatgcttatctgggaacacaaa

SEQ ID NO: 67037 - DNA, 25 bp, mus musculus
aacatgcttatctgggaacacaaat

SEQ ID NO: 67038 - DNA, 25 bp, mus musculus
catgcttatctgggaacacaaatcc

SEQ ID NO: 67039 - DNA, 25 bp, mus musculus
ggaaggcctagctggttgagaccta

SEQ ID NO: 67040 - DNA, 25 bp, mus musculus
gaaggcctagctggttgagacctag

SEQ ID NO: 67041 - DNA, 25 bp, mus musculus
aaggcctagctggttgagacctagc

SEQ ID NO: 67042 - DNA, 25 bp, mus musculus
aggcctagctggttgagacctagca

SEQ ID NO: 67043 - DNA, 25 bp, mus musculus
cctagctggttgagacctagcagat

SEQ ID NO: 67044 - DNA, 25 bp, mus musculus
ttgagacctagcagatttggttgaa

SEQ ID NO: 67045 - DNA, 25 bp, mus musculus
agacctagcagatttggttgaaaga

SEQ ID NO: 67046 - DNA, 25 bp, mus musculus
gcaacagaagcgctcggagcccagt

SEQ ID NO: 67047 - DNA, 25 bp, mus musculus
gtgatacttgcggcaaagcttcagc

SEQ ID NO: 67048 - DNA, 25 bp, mus musculus
tgatacttgcggcaaagcttcagcc

SEQ ID NO: 67049 - DNA, 25 bp, mus musculus
ttcagtgactgttcagctctggtcc

SEQ ID NO: 67050 - DNA, 25 bp, mus musculus
cagtgactgttcagctctggtccgg

SEQ ID NO: 67051 - DNA, 25 bp, mus musculus
agtgactgttcagctctggtccggc

SEQ ID NO: 67052 - DNA, 25 bp, mus musculus
gactgttcagctctggtccggcacc

SEQ ID NO: 67053 - DNA, 25 bp, mus musculus
ctgttcagctctggtccggcacctg

SEQ ID NO: 67054 - DNA, 25 bp, mus musculus
tgttcagctctggtccggcacctga

SEQ ID NO: 67055 - DNA, 25 bp, mus musculus
ttcagctctggtccggcacctgaga

SEQ ID NO: 67056 - DNA, 25 bp, mus musculus
tcagctctggtccggcacctgagag

SEQ ID NO: 67057 - DNA, 25 bp, mus musculus
ccggcacctgagagtccactctgga

SEQ ID NO: 67058 - DNA, 25 bp, mus musculus
cggcacctgagagtccactctggag

SEQ ID NO: 67059 - DNA, 25 bp, mus musculus
tacttgcggcaaagcttcagccaga

SEQ ID NO: 67060 - DNA, 25 bp, mus musculus
ttgcggcaaagcttcagccagagca

SEQ ID NO: 67061 - DNA, 25 bp, mus musculus
gcaaagcttcagccagagcacccac

SEQ ID NO: 67062 - DNA, 25 bp, mus musculus
gaaagccttcagtgactgttcagct

SEQ ID NO: 67063 - DNA, 25 bp, mus musculus
aaagccttcagtgactgttcagctc

SEQ ID NO: 67064 - DNA, 25 bp, mus musculus
agccttcagtgactgttcagctctg

SEQ ID NO: 67065 - DNA, 25 bp, mus musculus
gccttcagtgactgttcagctctgg

SEQ ID NO: 67066 - DNA, 25 bp, mus musculus
cttcagtgactgttcagctctggtc

SEQ ID NO: 67067 - DNA, 25 bp, mus musculus
agtctttcactcagagacagcacct

SEQ ID NO: 67068 - DNA, 25 bp, mus musculus
ctttcactcagagacagcacctgcc

SEQ ID NO: 67069 - DNA, 25 bp, mus musculus
accttgcaagagggcctgcagttgc

SEQ ID NO: 67070 - DNA, 25 bp, mus musculus
ttgcaagagggcctgcagttgccat

SEQ ID NO: 67071 - DNA, 25 bp, mus musculus
ctgcagttgccatcactcactgcaa

SEQ ID NO: 67072 - DNA, 25 bp, mus musculus
cagctcccgctcgaatctgatggtg

SEQ ID NO: 67073 - DNA, 25 bp, mus musculus
ctcgaatctgatggtgtggaatgct

SEQ ID NO: 67074 - DNA, 25 bp, mus musculus
tataaacggacgtcgactttcattg

SEQ ID NO: 67075 - DNA, 25 bp, mus musculus
acgtcgactttcattgcgacgtgga

SEQ ID NO: 67076 - DNA, 25 bp, mus musculus
actttcattgcgacgtggagactgt

SEQ ID NO: 67077 - DNA, 25 bp, mus musculus
ttcattgcgacgtggagactgtttg

SEQ ID NO: 67078 - DNA, 25 bp, mus musculus
ctgtttgactgatcacgagtatgcg

SEQ ID NO: 67079 - DNA, 25 bp, mus musculus
agagacagcacctgccctcgagcgc

SEQ ID NO: 67080 - DNA, 25 bp, mus musculus
tgatcacgagtatgcgcaggacgaa

SEQ ID NO: 67081 - DNA, 25 bp, mus musculus
acctgccctcgagcgcatactgagt

SEQ ID NO: 67082 - DNA, 25 bp, mus musculus
tgccctcgagcgcatactgagtatc

SEQ ID NO: 67083 - DNA, 25 bp, mus musculus
cctcgagcgcatactgagtatcagt

SEQ ID NO: 67084 - DNA, 25 bp, mus musculus
gaagaaaatcatcctaccttgcaag

SEQ ID NO: 67085 - DNA, 25 bp, mus musculus
aatcatcctaccttgcaagagggcc

SEQ ID NO: 67086 - DNA, 25 bp, mus musculus
catcctaccttgcaagagggcctgc

SEQ ID NO: 67087 - DNA, 25 bp, mus musculus
cctaccttgcaagagggcctgcagt

SEQ ID NO: 67088 - DNA, 25 bp, mus musculus
atgctacaaacttctcataactacc

SEQ ID NO: 67089 - DNA, 25 bp, mus musculus
caaacttctcataactaccttatgg

SEQ ID NO: 67090 - DNA, 25 bp, mus musculus
ttcgcccaggaaaacgacatccagc

SEQ ID NO: 67091 - DNA, 25 bp, mus musculus
atccagctttggcatcttgttctca

SEQ ID NO: 67092 - DNA, 25 bp, mus musculus
catcttgttctcagctgcactgagg

SEQ ID NO: 67093 - DNA, 25 bp, mus musculus
cttgttctcagctgcactgaggaat

SEQ ID NO: 67094 - DNA, 25 bp, mus musculus
tgtgctgtctcgaggcaccagctct

SEQ ID NO: 67095 - DNA, 25 bp, mus musculus
gctgtctcgaggcaccagctctgca

SEQ ID NO: 67096 - DNA, 25 bp, mus musculus
aggcaccagctctgcagagcccttg

SEQ ID NO: 67097 - DNA, 25 bp, mus musculus
agagcccttgctcccaaactccttg

SEQ ID NO: 67098 - DNA, 25 bp, mus musculus
atacgtatttccatatttcattcct

SEQ ID NO: 67099 - DNA, 25 bp, mus musculus
ccgctgcatccgtgtggcagcaagt

SEQ ID NO: 67100 - DNA, 25 bp, mus musculus
gattctggtatctcagcctcacagc

SEQ ID NO: 67101 - DNA, 25 bp, mus musculus
tctggtatctcagcctcacagccct

SEQ ID NO: 67102 - DNA, 25 bp, mus musculus
tcagcctcacagcccttcctgttga

SEQ ID NO: 67103 - DNA, 25 bp, mus musculus
attacataagcgcttggaagaaaat

SEQ ID NO: 67104 - DNA, 25 bp, mus musculus
tctcttctgccggtttttgaggcaa

SEQ ID NO: 67105 - DNA, 25 bp, mus musculus
acacgacaaaacacctgcacctgaa

SEQ ID NO: 67106 - DNA, 25 bp, mus musculus
cgacaaaacacctgcacctgaacag

SEQ ID NO: 67107 - DNA, 25 bp, mus musculus
atgtgtcaagtccccttcgcccagg

SEQ ID NO: 67108 - DNA, 25 bp, mus musculus
aaaccatttctaatgagcagagagc

SEQ ID NO: 67109 - DNA, 25 bp, mus musculus
ttacaaatctaactttagctctgtg

SEQ ID NO: 67110 - DNA, 25 bp, mus musculus
cctgcaattaccgagccacaaagtc

SEQ ID NO: 67111 - DNA, 25 bp, mus musculus
ccatgtaccagagcccaatgaggct

SEQ ID NO: 67112 - DNA, 25 bp, mus musculus
accagagcccaatgaggctccgatg

SEQ ID NO: 67113 - DNA, 25 bp, mus musculus
tgaggctccgatgttcaaccattca

SEQ ID NO: 67114 - DNA, 25 bp, mus musculus
gttcaaccattcagtcctcatcaat

SEQ ID NO: 67115 - DNA, 25 bp, mus musculus
agtcctcatcaatcatcctcctcga

SEQ ID NO: 67116 - DNA, 25 bp, mus musculus
tcctcgatacccttctcactgaaaa

SEQ ID NO: 67117 - DNA, 25 bp, mus musculus
atacccttctcactgaaaacgatgg

SEQ ID NO: 67118 - DNA, 25 bp, mus musculus
aggtcagctacatattgcaggaacg

SEQ ID NO: 67119 - DNA, 25 bp, mus musculus
tattgcaggaacgggccggcctcat

SEQ ID NO: 67120 - DNA, 25 bp, mus musculus
atctaactttagctctgtgtgattc

SEQ ID NO: 67121 - DNA, 25 bp, mus musculus
cgcaccatggcaggttcaagagtga

SEQ ID NO: 67122 - DNA, 25 bp, mus musculus
gtgattcctgcaatcagaccactct

SEQ ID NO: 67123 - DNA, 25 bp, mus musculus
cctgcaatcagaccactctcaaaac

SEQ ID NO: 67124 - DNA, 25 bp, mus musculus
atcagaccactctcaaaacactcct

SEQ ID NO: 67125 - DNA, 25 bp, mus musculus
atcctctgatctatacactcttcaa

SEQ ID NO: 67126 - DNA, 25 bp, mus musculus
atacactcttcaataagacatttcg

SEQ ID NO: 67127 - DNA, 25 bp, mus musculus
tcttcaataagacatttcgggaagc

SEQ ID NO: 67128 - DNA, 25 bp, mus musculus
acatcacctgcaattaccgagccac

SEQ ID NO: 67129 - DNA, 25 bp, mus musculus
tgaagaccctcactgtgaagttggc

SEQ ID NO: 67130 - DNA, 25 bp, mus musculus
agaccctcactgtgaagttggcctc

SEQ ID NO: 67131 - DNA, 25 bp, mus musculus
ggatgacctgcgcacagtgtttgac

SEQ ID NO: 67132 - DNA, 25 bp, mus musculus
tgacctgcgcacagtgtttgacgtc

SEQ ID NO: 67133 - DNA, 25 bp, mus musculus
cctgcgcacagtgtttgacgtcgct

SEQ ID NO: 67134 - DNA, 25 bp, mus musculus
gcgcacagtgtttgacgtcgctgtg

SEQ ID NO: 67135 - DNA, 25 bp, mus musculus
cacagtgtttgacgtcgctgtggac

SEQ ID NO: 67136 - DNA, 25 bp, mus musculus
gtttgacgtcgctgtggacgagctc

SEQ ID NO: 67137 - DNA, 25 bp, mus musculus
tgacgtcgctgtggacgagctctct

SEQ ID NO: 67138 - DNA, 25 bp, mus musculus
ctctctcaaccctggcaaacagagg

SEQ ID NO: 67139 - DNA, 25 bp, mus musculus
tctcaaccctggcaaacagaggttt

SEQ ID NO: 67140 - DNA, 25 bp, mus musculus
caaccctggcaaacagaggtttgag

SEQ ID NO: 67141 - DNA, 25 bp, mus musculus
tgaagttggcctcattgttggcact

SEQ ID NO: 67142 - DNA, 25 bp, mus musculus
agttggcctcattgttggcactgga

SEQ ID NO: 67143 - DNA, 25 bp, mus musculus
tggcctcattgttggcactggaagc

SEQ ID NO: 67144 - DNA, 25 bp, mus musculus
cctcattgttggcactggaagcaat

SEQ ID NO: 67145 - DNA, 25 bp, mus musculus
ggacaacggctgcctggatgacctg

SEQ ID NO: 67146 - DNA, 25 bp, mus musculus
caacggctgcctggatgacctgcgc

SEQ ID NO: 67147 - DNA, 25 bp, mus musculus
ctgcctggatgacctgcgcacagtg

SEQ ID NO: 67148 - DNA, 25 bp, mus musculus
cctggatgacctgcgcacagtgttt

SEQ ID NO: 67149 - DNA, 25 bp, mus musculus
aacagacagtacctggatgaagata

SEQ ID NO: 67150 - DNA, 25 bp, mus musculus
gatatgctcctgaaagtgctggagt

SEQ ID NO: 67151 - DNA, 25 bp, mus musculus
tgatctctatcctgttgacagtgta

SEQ ID NO: 67152 - DNA, 25 bp, mus musculus
ctatcctgttgacagtgtaatatct

SEQ ID NO: 67153 - DNA, 25 bp, mus musculus
cagatgactccaggtcattttgggg

SEQ ID NO: 67154 - DNA, 25 bp, mus musculus
actccaggtcattttgggggatctg

SEQ ID NO: 67155 - DNA, 25 bp, mus musculus
ggatctgcttcacttattctgagct

SEQ ID NO: 67156 - DNA, 25 bp, mus musculus
gcttcacttattctgagctgttacg

SEQ ID NO: 67157 - DNA, 25 bp, mus musculus
tcacttattctgagctgttacgttg

SEQ ID NO: 67158 - DNA, 25 bp, mus musculus
cttattctgagctgttacgttgtgt

SEQ ID NO: 67159 - DNA, 25 bp, mus musculus
atgatgctcacatatgataaagagt

SEQ ID NO: 67160 - DNA, 25 bp, mus musculus
tacttataaggccttttctattgtg

SEQ ID NO: 67161 - DNA, 25 bp, mus musculus
atgctcctgaaagtgctggagtacc

SEQ ID NO: 67162 - DNA, 25 bp, mus musculus
gagtacctcaaccaagagcaggcag

SEQ ID NO: 67163 - DNA, 25 bp, mus musculus
tacctcaaccaagagcaggcagagc

SEQ ID NO: 67164 - DNA, 25 bp, mus musculus
gagcatcttgccaagcgggccatgg

SEQ ID NO: 67165 - DNA, 25 bp, mus musculus
catcttgccaagcgggccatggaaa

SEQ ID NO: 67166 - DNA, 25 bp, mus musculus
cttgccaagcgggccatggaaaaca

SEQ ID NO: 67167 - DNA, 25 bp, mus musculus
catttctcttaagtgtgttgatctc

SEQ ID NO: 67168 - DNA, 25 bp, mus musculus
tgttgatctctatcctgttgacagt

SEQ ID NO: 67169 - DNA, 25 bp, mus musculus
tcttctacgtgatcgagacgctgga

SEQ ID NO: 67170 - DNA, 25 bp, mus musculus
acgtgatcgagacgctggagccgcg

SEQ ID NO: 67171 - DNA, 25 bp, mus musculus
cagcgcaatctgcaacggaagcgag

SEQ ID NO: 67172 - DNA, 25 bp, mus musculus
agccgactgcgggcatccactggta

SEQ ID NO: 67173 - DNA, 25 bp, mus musculus
gcatccactggtactcgcagctgct

SEQ ID NO: 67174 - DNA, 25 bp, mus musculus
tccactggtactcgcagctgctcta

SEQ ID NO: 67175 - DNA, 25 bp, mus musculus
cgcagctgctctaccacattggcac

SEQ ID NO: 67176 - DNA, 25 bp, mus musculus
agctgctctaccacattggcacctg

SEQ ID NO: 67177 - DNA, 25 bp, mus musculus
acattggcacctggctgttggacag

SEQ ID NO: 67178 - DNA, 25 bp, mus musculus
gcacctggctgttggacagcgagac

SEQ ID NO: 67179 - DNA, 25 bp, mus musculus
acagcgagaccatgcatcccttggg

SEQ ID NO: 67180 - DNA, 25 bp, mus musculus
gcgagaccatgcatcccttgggaat

SEQ ID NO: 67181 - DNA, 25 bp, mus musculus
tgctcttcgtggcgccgcacaacga

SEQ ID NO: 67182 - DNA, 25 bp, mus musculus
tgcacagcgtgacgctgcgagagga

SEQ ID NO: 67183 - DNA, 25 bp, mus musculus
gcaccattctcatcaaccgggtgct

SEQ ID NO: 67184 - DNA, 25 bp, mus musculus
ccattctcatcaaccgggtgctcgc

SEQ ID NO: 67185 - DNA, 25 bp, mus musculus
tcgcctcgtgctacgctgtcatcga

SEQ ID NO: 67186 - DNA, 25 bp, mus musculus
ctgtcatcgaggagcacagctgggc

SEQ ID NO: 67187 - DNA, 25 bp, mus musculus
tcatcgaggagcacagctgggcaca

SEQ ID NO: 67188 - DNA, 25 bp, mus musculus
gcatccctgcagcgcaatctgcaac

SEQ ID NO: 67189 - DNA, 25 bp, mus musculus
tttccccttgtgagtcaacacatag

SEQ ID NO: 67190 - DNA, 25 bp, mus musculus
ccccttgtgagtcaacacatagtgc

SEQ ID NO: 67191 - DNA, 25 bp, mus musculus
tcaggtcaggctgactcttagaaag

SEQ ID NO: 67192 - DNA, 25 bp, mus musculus
caggctgactcttagaaagggtagg

SEQ ID NO: 67193 - DNA, 25 bp, mus musculus
aatcaggcttttcctctcttcaaat

SEQ ID NO: 67194 - DNA, 25 bp, mus musculus
gcttttcctctcttcaaatgtctgg

SEQ ID NO: 67195 - DNA, 25 bp, mus musculus
tttcctctcttcaaatgtctggggc

SEQ ID NO: 67196 - DNA, 25 bp, mus musculus
cctctcttcaaatgtctggggcaaa

SEQ ID NO: 67197 - DNA, 25 bp, mus musculus
ctcttcaaatgtctggggcaaatca

SEQ ID NO: 67198 - DNA, 25 bp, mus musculus
agtgcagcatcatacacagtatttg

SEQ ID NO: 67199 - DNA, 25 bp, mus musculus
gcagcatcatacacagtatttgtaa

SEQ ID NO: 67200 - DNA, 25 bp, mus musculus
gcatcatacacagtatttgtaatta

SEQ ID NO: 67201 - DNA, 25 bp, mus musculus
agtcaacacatagtgctgctgtggg

SEQ ID NO: 67202 - DNA, 25 bp, mus musculus
caacacatagtgctgctgtgggttt

SEQ ID NO: 67203 - DNA, 25 bp, mus musculus
cacatagtgctgctgtgggtttgtt

SEQ ID NO: 67204 - DNA, 25 bp, mus musculus
aggatgctcttgtctctctcggtga

SEQ ID NO: 67205 - DNA, 25 bp, mus musculus
atgctcttgtctctctcggtgactg

SEQ ID NO: 67206 - DNA, 25 bp, mus musculus
actgtcccatggagccacacgtcag

SEQ ID NO: 67207 - DNA, 25 bp, mus musculus
agccacacgtcaggtcaggctgact

SEQ ID NO: 67208 - DNA, 25 bp, mus musculus
cacacgtcaggtcaggctgactctt

SEQ ID NO: 67209 - DNA, 25 bp, mus musculus
cctcattcccaggcaccagcaagta

SEQ ID NO: 67210 - DNA, 25 bp, mus musculus
cattcccaggcaccagcaagtattt

SEQ ID NO: 67211 - DNA, 25 bp, mus musculus
ctactctgcactgggcttcttaaaa

SEQ ID NO: 67212 - DNA, 25 bp, mus musculus
ctctgcactgggcttcttaaaaggc

SEQ ID NO: 67213 - DNA, 25 bp, mus musculus
cttcttaaaaggctgcctcacattg

SEQ ID NO: 67214 - DNA, 25 bp, mus musculus
cttaaaaggctgcctcacattgatc

SEQ ID NO: 67215 - DNA, 25 bp, mus musculus
aggctgcctcacattgatctgctga

SEQ ID NO: 67216 - DNA, 25 bp, mus musculus
ctgcctcacattgatctgctgataa

SEQ ID NO: 67217 - DNA, 25 bp, mus musculus
cctcacattgatctgctgataagct

SEQ ID NO: 67218 - DNA, 25 bp, mus musculus
cacattgatctgctgataagctaca

SEQ ID NO: 67219 - DNA, 25 bp, mus musculus
aaacttttgcagcatcatattttga

SEQ ID NO: 67220 - DNA, 25 bp, mus musculus
cttttgcagcatcatattttgacag

SEQ ID NO: 67221 - DNA, 25 bp, mus musculus
tcccaggcaccagcaagtatttagc

SEQ ID NO: 67222 - DNA, 25 bp, mus musculus
caggcaccagcaagtatttagcatg

SEQ ID NO: 67223 - DNA, 25 bp, mus musculus
tcaatacttcagtcgggtgaaaatt

SEQ ID NO: 67224 - DNA, 25 bp, mus musculus
aattccagaccctgaagacatggaa

SEQ ID NO: 67225 - DNA, 25 bp, mus musculus
gaaatgtccaaacatctcctactct

SEQ ID NO: 67226 - DNA, 25 bp, mus musculus
tccaaacatctcctactctgcactg

SEQ ID NO: 67227 - DNA, 25 bp, mus musculus
catctcctactctgcactgggcttc

SEQ ID NO: 67228 - DNA, 25 bp, mus musculus
ctcctactctgcactgggcttctta

SEQ ID NO: 67229 - DNA, 25 bp, mus musculus
agtactcatctccaacacagagcta

SEQ ID NO: 67230 - DNA, 25 bp, mus musculus
catctccaacacagagctagagaat

SEQ ID NO: 67231 - DNA, 25 bp, mus musculus
ttctcacagttagttgttgctcacc

SEQ ID NO: 67232 - DNA, 25 bp, mus musculus
gctcaccatagtacggatgacttgt

SEQ ID NO: 67233 - DNA, 25 bp, mus musculus
tttacatatggcttcccttggaagc

SEQ ID NO: 67234 - DNA, 25 bp, mus musculus
tggaagccctccttgactgtaactg

SEQ ID NO: 67235 - DNA, 25 bp, mus musculus
ccctccttgactgtaactgatgtga

SEQ ID NO: 67236 - DNA, 25 bp, mus musculus
ataaccagtgtcacatgcttgccat

SEQ ID NO: 67237 - DNA, 25 bp, mus musculus
aagcatgtgtcagttgtgtgggttt

SEQ ID NO: 67238 - DNA, 25 bp, mus musculus
tttttatctttacatacgcgcacac

SEQ ID NO: 67239 - DNA, 25 bp, mus musculus
tctttacatacgcgcacacacatac

SEQ ID NO: 67240 - DNA, 25 bp, mus musculus
cgcacacacatacacatacacttta

SEQ ID NO: 67241 - DNA, 25 bp, mus musculus
gagttgagcaacctcctcatctcag

SEQ ID NO: 67242 - DNA, 25 bp, mus musculus
ctcctcatctcagagtttgaggatt

SEQ ID NO: 67243 - DNA, 25 bp, mus musculus
ttgtgggcaagggtccaggatctaa

SEQ ID NO: 67244 - DNA, 25 bp, mus musculus
ggcgtcctctgctgacactgttggt

SEQ ID NO: 67245 - DNA, 25 bp, mus musculus
ctctgctgacactgttggtctctac

SEQ ID NO: 67246 - DNA, 25 bp, mus musculus
tgcacacaccacatggagaccagaa

SEQ ID NO: 67247 - DNA, 25 bp, mus musculus
accagaactctaaatccatggggat

SEQ ID NO: 67248 - DNA, 25 bp, mus musculus
ttcaggcgctcagtgagttgagagt

SEQ ID NO: 67249 - DNA, 25 bp, mus musculus
tctgagacggactcagccatgttgc

SEQ ID NO: 67250 - DNA, 25 bp, mus musculus
acggactcagccatgttgcccacgt

SEQ ID NO: 67251 - DNA, 25 bp, mus musculus
ctaacagagactcaatacagtgacc

SEQ ID NO: 67252 - DNA, 25 bp, mus musculus
caatacagtgaccacagcatgacag

SEQ ID NO: 67253 - DNA, 25 bp, mus musculus
atcagaatccttcttgcttgatttt

SEQ ID NO: 67254 - DNA, 25 bp, mus musculus
cttgcttgattttctccattcccca

SEQ ID NO: 67255 - DNA, 25 bp, mus musculus
tgattttctccattccccaagtgtt

SEQ ID NO: 67256 - DNA, 25 bp, mus musculus
tctccattccccaagtgttgccttt

SEQ ID NO: 67257 - DNA, 25 bp, mus musculus
tcaggtaactgcagtgcccatggac

SEQ ID NO: 67258 - DNA, 25 bp, mus musculus
agtgcccatggaccctacagggaga

SEQ ID NO: 67259 - DNA, 25 bp, mus musculus
catggaccctacagggagaaggaag

SEQ ID NO: 67260 - DNA, 25 bp, mus musculus
cttctcatccgctagaaactggtca

SEQ ID NO: 67261 - DNA, 25 bp, mus musculus
ttgcctttctcttcaaagctcacct

SEQ ID NO: 67262 - DNA, 25 bp, mus musculus
tggtcacataaacataccatgctga

SEQ ID NO: 67263 - DNA, 25 bp, mus musculus
ttctcttcaaagctcaccttggact

SEQ ID NO: 67264 - DNA, 25 bp, mus musculus
tcaaagctcaccttggactttcttg

SEQ ID NO: 67265 - DNA, 25 bp, mus musculus
ccagtttctcacagactttctaaga

SEQ ID NO: 67266 - DNA, 25 bp, mus musculus
tctaagacggtctgtaccagccagg

SEQ ID NO: 67267 - DNA, 25 bp, mus musculus
tgtaccagccaggatatcagtcagg

SEQ ID NO: 67268 - DNA, 25 bp, mus musculus
gatatcagtcaggttgctctaacag

SEQ ID NO: 67269 - DNA, 25 bp, mus musculus
agtcaggttgctctaacagagactc

SEQ ID NO: 67270 - DNA, 25 bp, mus musculus
cagtagcccagcaggagtttgattc

SEQ ID NO: 67271 - DNA, 25 bp, mus musculus
ttgattctgtttctgaaaggtgagt

SEQ ID NO: 67272 - DNA, 25 bp, mus musculus
caggtcatcggaagctcttttgtca

SEQ ID NO: 67273 - DNA, 25 bp, mus musculus
gtcatcggaagctcttttgtcagat

SEQ ID NO: 67274 - DNA, 25 bp, mus musculus
atcggaagctcttttgtcagatagt

SEQ ID NO: 67275 - DNA, 25 bp, mus musculus
agctcttttgtcagatagtgcccag

SEQ ID NO: 67276 - DNA, 25 bp, mus musculus
tttgtcagatagtgcccagaaaaat

SEQ ID NO: 67277 - DNA, 25 bp, mus musculus
tagtgcccagaaaaatcccaggaat

SEQ ID NO: 67278 - DNA, 25 bp, mus musculus
tgcccagaaaaatcccaggaatcaa

SEQ ID NO: 67279 - DNA, 25 bp, mus musculus
ctccatgatctttcgctggggcaaa

SEQ ID NO: 67280 - DNA, 25 bp, mus musculus
catgatctttcgctggggcaaaatg

SEQ ID NO: 67281 - DNA, 25 bp, mus musculus
gatctttcgctggggcaaaatgatg

SEQ ID NO: 67282 - DNA, 25 bp, mus musculus
attctgtttctgaaaggtgagttgt

SEQ ID NO: 67283 - DNA, 25 bp, mus musculus
ttgtgtattgctgtcaccgggccta

SEQ ID NO: 67284 - DNA, 25 bp, mus musculus
tgtattgctgtcaccgggcctattt

SEQ ID NO: 67285 - DNA, 25 bp, mus musculus
ttttgaagtctgtcacccgaaacag

SEQ ID NO: 67286 - DNA, 25 bp, mus musculus
tttaccactgtttcttctccacagc

SEQ ID NO: 67287 - DNA, 25 bp, mus musculus
actgtttcttctccacagccttcat

SEQ ID NO: 67288 - DNA, 25 bp, mus musculus
tcttctccacagccttcatatgtta

SEQ ID NO: 67289 - DNA, 25 bp, mus musculus
ctgtgacagcaaacctaatttatct

SEQ ID NO: 67290 - DNA, 25 bp, mus musculus
cttcaccatgtacaccacctgtatt

SEQ ID NO: 67291 - DNA, 25 bp, mus musculus
caccatgtacaccacctgtattatc

SEQ ID NO: 67292 - DNA, 25 bp, mus musculus
catcttctttggcaccgccagtcag

SEQ ID NO: 67293 - DNA, 25 bp, mus musculus
cttctttggcaccgccagtcagctg

SEQ ID NO: 67294 - DNA, 25 bp, mus musculus
caccgccagtcagctgagaagatct

SEQ ID NO: 67295 - DNA, 25 bp, mus musculus
aagatctacatccaaacgaccacac

SEQ ID NO: 67296 - DNA, 25 bp, mus musculus
atctacatccaaacgaccacactga

SEQ ID NO: 67297 - DNA, 25 bp, mus musculus
caaacgaccacactgactgtgtccc

SEQ ID NO: 67298 - DNA, 25 bp, mus musculus
acgaccacactgactgtgtccctga

SEQ ID NO: 67299 - DNA, 25 bp, mus musculus
accacactgactgtgtccctgagcc

SEQ ID NO: 67300 - DNA, 25 bp, mus musculus
acactgactgtgtccctgagcctga

SEQ ID NO: 67301 - DNA, 25 bp, mus musculus
ctgagcctgagcgcgtcggtgtccc

SEQ ID NO: 67302 - DNA, 25 bp, mus musculus
catgtacaccacctgtattatctgg

SEQ ID NO: 67303 - DNA, 25 bp, mus musculus
gtacaccacctgtattatctggctg

SEQ ID NO: 67304 - DNA, 25 bp, mus musculus
caccacctgtattatctggctggct

SEQ ID NO: 67305 - DNA, 25 bp, mus musculus
cacctgtattatctggctggctttc

SEQ ID NO: 67306 - DNA, 25 bp, mus musculus
ctgtattatctggctggctttcgtc

SEQ ID NO: 67307 - DNA, 25 bp, mus musculus
tattatctggctggctttcgtcccc

SEQ ID NO: 67308 - DNA, 25 bp, mus musculus
tatctggctggctttcgtccccatc

SEQ ID NO: 67309 - DNA, 25 bp, mus musculus
gctggctttcgtccccatcttcttt

SEQ ID NO: 67310 - DNA, 25 bp, mus musculus
ttctcacattgtatccccagtcttt

SEQ ID NO: 67311 - DNA, 25 bp, mus musculus
agtctttcttccttctggtgtcatc

SEQ ID NO: 67312 - DNA, 25 bp, mus musculus
tgccagcttctgactaacaaatgag

SEQ ID NO: 67313 - DNA, 25 bp, mus musculus
aaggctgcaccccagaagcacctga

SEQ ID NO: 67314 - DNA, 25 bp, mus musculus
gcaccccagaagcacctgaattctc

SEQ ID NO: 67315 - DNA, 25 bp, mus musculus
cagaagcacctgaattctcatttct

SEQ ID NO: 67316 - DNA, 25 bp, mus musculus
cacctgaattctcatttctctctct

SEQ ID NO: 67317 - DNA, 25 bp, mus musculus
gccgcagacttgcctgttccatttt

SEQ ID NO: 67318 - DNA, 25 bp, mus musculus
cctgttccattttacgccctcatgt

SEQ ID NO: 67319 - DNA, 25 bp, mus musculus
ccattttacgccctcatgtgaatgt

SEQ ID NO: 67320 - DNA, 25 bp, mus musculus
tacgccctcatgtgaatgttcgtcg

SEQ ID NO: 67321 - DNA, 25 bp, mus musculus
tgaatgttcgtcgggagatatttct

SEQ ID NO: 67322 - DNA, 25 bp, mus musculus
ttctggtgtcatctatttgagttcc

SEQ ID NO: 67323 - DNA, 25 bp, mus musculus
caactttctaagagtccgacgtgat

SEQ ID NO: 67324 - DNA, 25 bp, mus musculus
tctaagagtccgacgtgatgtgaac

SEQ ID NO: 67325 - DNA, 25 bp, mus musculus
agtccgacgtgatgtgaacggaggt

SEQ ID NO: 67326 - DNA, 25 bp, mus musculus
tagacattctgggtcttcggtcctc

SEQ ID NO: 67327 - DNA, 25 bp, mus musculus
gtcttcggtcctcaaagacatctcc

SEQ ID NO: 67328 - DNA, 25 bp, mus musculus
cctcctctcagtgtgagcctaaggt

SEQ ID NO: 67329 - DNA, 25 bp, mus musculus
ctcagtgtgagcctaaggtgccagc

SEQ ID NO: 67330 - DNA, 25 bp, mus musculus
atggctcggagaccagcgacttcac

SEQ ID NO: 67331 - DNA, 25 bp, mus musculus
cggagaccagcgacttcaccgttag

SEQ ID NO: 67332 - DNA, 25 bp, mus musculus
cattttgtgctggcttaggaggaag

SEQ ID NO: 67333 - DNA, 25 bp, mus musculus
cttattcctatagatgaggaggcac

SEQ ID NO: 67334 - DNA, 25 bp, mus musculus
agcatggaagccggtgacgctttac

SEQ ID NO: 67335 - DNA, 25 bp, mus musculus
ggtgacgctttacctgtaagctctt

SEQ ID NO: 67336 - DNA, 25 bp, mus musculus
ttgtgtccatacctcatgttctatc

SEQ ID NO: 67337 - DNA, 25 bp, mus musculus
ctcatgttctatcaaaatagaggca

SEQ ID NO: 67338 - DNA, 25 bp, mus musculus
gtatggtgggtccctgttagtagag

SEQ ID NO: 67339 - DNA, 25 bp, mus musculus
gcatttctgatagcagccttgtgaa

SEQ ID NO: 67340 - DNA, 25 bp, mus musculus
ctgatagcagccttgtgaactggcc

SEQ ID NO: 67341 - DNA, 25 bp, mus musculus
gaataaagtctcctgcctttcctct

SEQ ID NO: 67342 - DNA, 25 bp, mus musculus
ccagcgacttcaccgttagtgtgtt

SEQ ID NO: 67343 - DNA, 25 bp, mus musculus
gtgtgttcatcccagaggaggagtt

SEQ ID NO: 67344 - DNA, 25 bp, mus musculus
tcatcccagaggaggagttgaggaa

SEQ ID NO: 67345 - DNA, 25 bp, mus musculus
ccatcatgctgctgtcgtgaaaagg

SEQ ID NO: 67346 - DNA, 25 bp, mus musculus
tgctgctgtcgtgaaaaggattggg

SEQ ID NO: 67347 - DNA, 25 bp, mus musculus
acgatgaaatcctccaggaggctcc

SEQ ID NO: 67348 - DNA, 25 bp, mus musculus
aaatcctccaggaggctccattttg

SEQ ID NO: 67349 - DNA, 25 bp, mus musculus
tccaggaggctccattttgtgctgg

SEQ ID NO: 67350 - DNA, 25 bp, mus musculus
tgatgccagtgctggatcagtctgt

SEQ ID NO: 67351 - DNA, 25 bp, mus musculus
agtctgttctctgccacatcaatgc

SEQ ID NO: 67352 - DNA, 25 bp, mus musculus
agagacttacaccagagttgtttga

SEQ ID NO: 67353 - DNA, 25 bp, mus musculus
tgtttgacagccaacctgacctcct

SEQ ID NO: 67354 - DNA, 25 bp, mus musculus
tgcaccaacttgtcactctgatgaa

SEQ ID NO: 67355 - DNA, 25 bp, mus musculus
aacttgtcactctgatgaatcctaa

SEQ ID NO: 67356 - DNA, 25 bp, mus musculus
tcactctgatgaatcctaacactct

SEQ ID NO: 67357 - DNA, 25 bp, mus musculus
tgatgaatcctaacactctcatgtc

SEQ ID NO: 67358 - DNA, 25 bp, mus musculus
tctgactattgacagaccatcacat

SEQ ID NO: 67359 - DNA, 25 bp, mus musculus
atcacatatgtagttctcttacagt

SEQ ID NO: 67360 - DNA, 25 bp, mus musculus
tatgtagttctcttacagtgcttct

SEQ ID NO: 67361 - DNA, 25 bp, mus musculus
gttctcttacagtgcttctagcaaa

SEQ ID NO: 67362 - DNA, 25 bp, mus musculus
ttctctgccacatcaatgcagacat

SEQ ID NO: 67363 - DNA, 25 bp, mus musculus
tacagtgcttctagcaaagttatag

SEQ ID NO: 67364 - DNA, 25 bp, mus musculus
gccacatcaatgcagacatctcagg

SEQ ID NO: 67365 - DNA, 25 bp, mus musculus
aagtgccctggttatatgtgggcat

SEQ ID NO: 67366 - DNA, 25 bp, mus musculus
tttcagcattttgttggcatattga

SEQ ID NO: 67367 - DNA, 25 bp, mus musculus
cattttgttggcatattgaggatca

SEQ ID NO: 67368 - DNA, 25 bp, mus musculus
gttattccattaactacctgcactg

SEQ ID NO: 67369 - DNA, 25 bp, mus musculus
gagtaccttcgctagcagcagaaca

SEQ ID NO: 67370 - DNA, 25 bp, mus musculus
cttcgctagcagcagaacacttaga

SEQ ID NO: 67371 - DNA, 25 bp, mus musculus
ttgaccgacacttgtttgctctacg

SEQ ID NO: 67372 - DNA, 25 bp, mus musculus
gacacttgtttgctctacggtatct

SEQ ID NO: 67373 - DNA, 25 bp, mus musculus
atggctttggcattgcgtatgctgt

SEQ ID NO: 67374 - DNA, 25 bp, mus musculus
ttggcattgcgtatgctgttcacga

SEQ ID NO: 67375 - DNA, 25 bp, mus musculus
atgctgttcacgatgactggatagg

SEQ ID NO: 67376 - DNA, 25 bp, mus musculus
gctgcaatgtctcctcctactcagg

SEQ ID NO: 67377 - DNA, 25 bp, mus musculus
gacgcaatgcccgagagtttctcca

SEQ ID NO: 67378 - DNA, 25 bp, mus musculus
gagagtttctccactgtgtccagaa

SEQ ID NO: 67379 - DNA, 25 bp, mus musculus
actgtgtccagaagtgcttggaaga

SEQ ID NO: 67380 - DNA, 25 bp, mus musculus
tcgatgccctcgaaggcaaagccat

SEQ ID NO: 67381 - DNA, 25 bp, mus musculus
tggtgcttgagcagccagtgctgca

SEQ ID NO: 67382 - DNA, 25 bp, mus musculus
ttgagcagccagtgctgcaggtgtg

SEQ ID NO: 67383 - DNA, 25 bp, mus musculus
ctctacggtatctggcagcagccag

SEQ ID NO: 67384 - DNA, 25 bp, mus musculus
tggcagcagccagaggggtcaccct

SEQ ID NO: 67385 - DNA, 25 bp, mus musculus
atcaggaccctgcataccagcggat

SEQ ID NO: 67386 - DNA, 25 bp, mus musculus
cataccagcggataaaccacaacat

SEQ ID NO: 67387 - DNA, 25 bp, mus musculus
agcggataaaccacaacatcctgtc

SEQ ID NO: 67388 - DNA, 25 bp, mus musculus
taaaccacaacatcctgtccaccag

SEQ ID NO: 67389 - DNA, 25 bp, mus musculus
gcactctgagcagcccagcagtgag

SEQ ID NO: 67390 - DNA, 25 bp, mus musculus
ttgcccctgtggtccctgatggctt

SEQ ID NO: 67391 - DNA, 25 bp, mus musculus
cctcctaaagatactggcattgctc

SEQ ID NO: 67392 - DNA, 25 bp, mus musculus
gatactggcattgctcgtgtgcctc

SEQ ID NO: 67393 - DNA, 25 bp, mus musculus
gctgctactgctagcattgcaggag

SEQ ID NO: 67394 - DNA, 25 bp, mus musculus
actgctagcattgcaggagccccaa

SEQ ID NO: 67395 - DNA, 25 bp, mus musculus
ggtatgagaccacccatgggcccac

SEQ ID NO: 67396 - DNA, 25 bp, mus musculus
gctcgtgggacacctataggcatgc

SEQ ID NO: 67397 - DNA, 25 bp, mus musculus
gttgataaatctcagcccttctctt

SEQ ID NO: 67398 - DNA, 25 bp, mus musculus
acaatgcttcttgtgaaattgtgta

SEQ ID NO: 67399 - DNA, 25 bp, mus musculus
aagcttttgacccctcttactgcat

SEQ ID NO: 67400 - DNA, 25 bp, mus musculus
ttgacccctcttactgcattaacta

SEQ ID NO: 67401 - DNA, 25 bp, mus musculus
cctcttactgcattaactatagata

SEQ ID NO: 67402 - DNA, 25 bp, mus musculus
cttactgcattaactatagataata

SEQ ID NO: 67403 - DNA, 25 bp, mus musculus
gctcgtgtgcctcttgctggcgctg

SEQ ID NO: 67404 - DNA, 25 bp, mus musculus
cctcttgctggcgctgcaggtggcc

SEQ ID NO: 67405 - DNA, 25 bp, mus musculus
ccccaagctcctgctggattagcag

SEQ ID NO: 67406 - DNA, 25 bp, mus musculus
cctgtccgaggagttggaggcccat

SEQ ID NO: 67407 - DNA, 25 bp, mus musculus
tcccagcaggtcatgaccccacagg

SEQ ID NO: 67408 - DNA, 25 bp, mus musculus
caggtcatgaccccacagggaagag

SEQ ID NO: 67409 - DNA, 25 bp, mus musculus
gctgctgttgctgctactgctagca

SEQ ID NO: 67410 - DNA, 25 bp, mus musculus
gctgttgctgctactgctagcattg

SEQ ID NO: 67411 - DNA, 25 bp, mus musculus
gaaactgattgcacctggaaatcac

SEQ ID NO: 67412 - DNA, 25 bp, mus musculus
gattgcacctggaaatcacgtgaag

SEQ ID NO: 67413 - DNA, 25 bp, mus musculus
acaagcccatatgttgacagttttt

SEQ ID NO: 67414 - DNA, 25 bp, mus musculus
gctttactcttctactttagaatat

SEQ ID NO: 67415 - DNA, 25 bp, mus musculus
ttattcagaggactgtgagaaaagg

SEQ ID NO: 67416 - DNA, 25 bp, mus musculus
gctgtggtacctgaccttgttgaaa

SEQ ID NO: 67417 - DNA, 25 bp, mus musculus
gtggtacctgaccttgttgaaatca

SEQ ID NO: 67418 - DNA, 25 bp, mus musculus
gtacctgaccttgttgaaatcaagg

SEQ ID NO: 67419 - DNA, 25 bp, mus musculus
atcaaggcccagcactgtactacag

SEQ ID NO: 67420 - DNA, 25 bp, mus musculus
aaggcccagcactgtactacagtcc

SEQ ID NO: 67421 - DNA, 25 bp, mus musculus
gcccagcactgtactacagtcctgt

SEQ ID NO: 67422 - DNA, 25 bp, mus musculus
acagtcctgtttacagattattaca

SEQ ID NO: 67423 - DNA, 25 bp, mus musculus
gggacttttctggccattgggcaga

SEQ ID NO: 67424 - DNA, 25 bp, mus musculus
tttctggccattgggcagagtcctc

SEQ ID NO: 67425 - DNA, 25 bp, mus musculus
cagagtcctcatattgtgaagtgat

SEQ ID NO: 67426 - DNA, 25 bp, mus musculus
agtcctcatattgtgaagtgatctt

SEQ ID NO: 67427 - DNA, 25 bp, mus musculus
tgatctttatcattaaagggatgga

SEQ ID NO: 67428 - DNA, 25 bp, mus musculus
acagtctaatgtccaacaagcccat

SEQ ID NO: 67429 - DNA, 25 bp, mus musculus
gtctaatgtccaacaagcccatatg

SEQ ID NO: 67430 - DNA, 25 bp, mus musculus
ccaacaagcccatatgttgacagtt

SEQ ID NO: 67431 - DNA, 25 bp, mus musculus
tgatttgcctattatttgggaagac

SEQ ID NO: 67432 - DNA, 25 bp, mus musculus
taatgctaataacctctataaatgt

SEQ ID NO: 67433 - DNA, 25 bp, mus musculus
gatactatcattcaaagtgatcaag

SEQ ID NO: 67434 - DNA, 25 bp, mus musculus
ccacgttgtttatctactggtctgt

SEQ ID NO: 67435 - DNA, 25 bp, mus musculus
tgtttatctactggtctgtggcctt

SEQ ID NO: 67436 - DNA, 25 bp, mus musculus
ttatctactggtctgtggcctttta

SEQ ID NO: 67437 - DNA, 25 bp, mus musculus
tctactggtctgtggccttttactg

SEQ ID NO: 67438 - DNA, 25 bp, mus musculus
ggtctgtggccttttactgtgcttt

SEQ ID NO: 67439 - DNA, 25 bp, mus musculus
ctgtggccttttactgtgctttgta

SEQ ID NO: 67440 - DNA, 25 bp, mus musculus
tggccttttactgtgctttgtatca

SEQ ID NO: 67441 - DNA, 25 bp, mus musculus
tttactgtgctttgtatcagagttc

SEQ ID NO: 67442 - DNA, 25 bp, mus musculus
actgtgctttgtatcagagttctta

SEQ ID NO: 67443 - DNA, 25 bp, mus musculus
taataacctctataaatgtaagtga

SEQ ID NO: 67444 - DNA, 25 bp, mus musculus
taatacaatctgctatttgactaat

SEQ ID NO: 67445 - DNA, 25 bp, mus musculus
tacaatctgctatttgactaatttg

SEQ ID NO: 67446 - DNA, 25 bp, mus musculus
gcataagaaccaactgccattgtca

SEQ ID NO: 67447 - DNA, 25 bp, mus musculus
gaaccaactgccattgtcaaaccta

SEQ ID NO: 67448 - DNA, 25 bp, mus musculus
actgccattgtcaaacctattaact

SEQ ID NO: 67449 - DNA, 25 bp, mus musculus
tgtctttaatctcgtgttaactgaa

SEQ ID NO: 67450 - DNA, 25 bp, mus musculus
ctttgccatttggatactatcattc

SEQ ID NO: 67451 - DNA, 25 bp, mus musculus
cactcgagcgtgtccagcagcccgg

SEQ ID NO: 67452 - DNA, 25 bp, mus musculus
agcgtgtccagcagcccggagcccg

SEQ ID NO: 67453 - DNA, 25 bp, mus musculus
cccagtggccaagcacattaactct

SEQ ID NO: 67454 - DNA, 25 bp, mus musculus
ggccaagcacattaactctctcata

SEQ ID NO: 67455 - DNA, 25 bp, mus musculus
gcacattaactctctcatacactga

SEQ ID NO: 67456 - DNA, 25 bp, mus musculus
taactctctcatacactgactgtta

SEQ ID NO: 67457 - DNA, 25 bp, mus musculus
ctgacaaatagacctcagcctcaaa

SEQ ID NO: 67458 - DNA, 25 bp, mus musculus
aatagacctcagcctcaaaaggctc

SEQ ID NO: 67459 - DNA, 25 bp, mus musculus
cctcagcctcaaaaggctcggaaag

SEQ ID NO: 67460 - DNA, 25 bp, mus musculus
ttaaacagtgccagtaactcagctg

SEQ ID NO: 67461 - DNA, 25 bp, mus musculus
agtgccagtaactcagctgctacac

SEQ ID NO: 67462 - DNA, 25 bp, mus musculus
tcagctgctacaccccagcactgaa

SEQ ID NO: 67463 - DNA, 25 bp, mus musculus
gagcccgggatgcccgtgatccaga

SEQ ID NO: 67464 - DNA, 25 bp, mus musculus
gggatgcccgtgatccagagcactt

SEQ ID NO: 67465 - DNA, 25 bp, mus musculus
cccgtgatccagagcacttacggcg

SEQ ID NO: 67466 - DNA, 25 bp, mus musculus
gagccccacatcaaggaagagatcc

SEQ ID NO: 67467 - DNA, 25 bp, mus musculus
cacattgcgggacaagccaactgat

SEQ ID NO: 67468 - DNA, 25 bp, mus musculus
taagggccaacagactgtggtgagc

SEQ ID NO: 67469 - DNA, 25 bp, mus musculus
cggttcatccttcccagtggccaag

SEQ ID NO: 67470 - DNA, 25 bp, mus musculus
atccttcccagtggccaagcacatt

SEQ ID NO: 67471 - DNA, 25 bp, mus musculus
ttctctctctgattcagggcagaaa

SEQ ID NO: 67472 - DNA, 25 bp, mus musculus
ctctctctgattcagggcagaaaca

SEQ ID NO: 67473 - DNA, 25 bp, mus musculus
atctagtgcacagatctaggatgat

SEQ ID NO: 67474 - DNA, 25 bp, mus musculus
catctataaaatcagccccaagcag

SEQ ID NO: 67475 - DNA, 25 bp, mus musculus
ctataaaatcagccccaagcaggca

SEQ ID NO: 67476 - DNA, 25 bp, mus musculus
tataaaatcagccccaagcaggcaa

SEQ ID NO: 67477 - DNA, 25 bp, mus musculus
aatcagccccaagcaggcaagtggg

SEQ ID NO: 67478 - DNA, 25 bp, mus musculus
atcagccccaagcaggcaagtggga

SEQ ID NO: 67479 - DNA, 25 bp, mus musculus
cagccccaagcaggcaagtgggaca

SEQ ID NO: 67480 - DNA, 25 bp, mus musculus
agccccaagcaggcaagtgggacag

SEQ ID NO: 67481 - DNA, 25 bp, mus musculus
ccccaagcaggcaagtgggacagtg

SEQ ID NO: 67482 - DNA, 25 bp, mus musculus
ggtaatggccgcagagggcgatccc

SEQ ID NO: 67483 - DNA, 25 bp, mus musculus
tctctctgattcagggcagaaacag

SEQ ID NO: 67484 - DNA, 25 bp, mus musculus
tctctgattcagggcagaaacagcg

SEQ ID NO: 67485 - DNA, 25 bp, mus musculus
tccagcaaaccctcctgaatctagt

SEQ ID NO: 67486 - DNA, 25 bp, mus musculus
caaaccctcctgaatctagtgcaca

SEQ ID NO: 67487 - DNA, 25 bp, mus musculus
aaaccctcctgaatctagtgcacag

SEQ ID NO: 67488 - DNA, 25 bp, mus musculus
accctcctgaatctagtgcacagat

SEQ ID NO: 67489 - DNA, 25 bp, mus musculus
ccctcctgaatctagtgcacagatc

SEQ ID NO: 67490 - DNA, 25 bp, mus musculus
ctcctgaatctagtgcacagatcta

SEQ ID NO: 67491 - DNA, 25 bp, mus musculus
cctaagcgtttcatgaggagtgatc

SEQ ID NO: 67492 - DNA, 25 bp, mus musculus
cacctgtcaaagcatatcaagactc

SEQ ID NO: 67493 - DNA, 25 bp, mus musculus
aacagtggcatcaacgtcatgcagg

SEQ ID NO: 67494 - DNA, 25 bp, mus musculus
agtggcatcaacgtcatgcaggtga

SEQ ID NO: 67495 - DNA, 25 bp, mus musculus
aacgtcatgcaggtgacagagctgc

SEQ ID NO: 67496 - DNA, 25 bp, mus musculus
acagagctgcagtccattaatatca

SEQ ID NO: 67497 - DNA, 25 bp, mus musculus
attaatatcagtggcaatggtttct

SEQ ID NO: 67498 - DNA, 25 bp, mus musculus
ttctaagattagacacccagtgcca

SEQ ID NO: 67499 - DNA, 25 bp, mus musculus
acacccagtgccagagacatatggg

SEQ ID NO: 67500 - DNA, 25 bp, mus musculus
cccagtgccagagacatatgggcca

SEQ ID NO: 67501 - DNA, 25 bp, mus musculus
gacatatgggccaatacccactaag

SEQ ID NO: 67502 - DNA, 25 bp, mus musculus
cactaagcccgggatgcaaggtagc

SEQ ID NO: 67503 - DNA, 25 bp, mus musculus
tcagaaggcactgccactccttcag

SEQ ID NO: 67504 - DNA, 25 bp, mus musculus
gcccttattaccaccaatatggtag

SEQ ID NO: 67505 - DNA, 25 bp, mus musculus
gaggccatctgtccagagggtattg

SEQ ID NO: 67506 - DNA, 25 bp, mus musculus
gccatctgtccagagggtattgccc

SEQ ID NO: 67507 - DNA, 25 bp, mus musculus
atctgtccagagggtattgcccgtc

SEQ ID NO: 67508 - DNA, 25 bp, mus musculus
ggtattgcccgtcttgccaacagtg

SEQ ID NO: 67509 - DNA, 25 bp, mus musculus
gcccgtcttgccaacagtggcatca

SEQ ID NO: 67510 - DNA, 25 bp, mus musculus
cttgccaacagtggcatcaacgtca

SEQ ID NO: 67511 - DNA, 25 bp, mus musculus
tagcttctcgttcatacttctcaag

SEQ ID NO: 67512 - DNA, 25 bp, mus musculus
ctcgttcatacttctcaagtgtcct

SEQ ID NO: 67513 - DNA, 25 bp, mus musculus
catcaacatgtccgatgaacactac

SEQ ID NO: 67514 - DNA, 25 bp, mus musculus
caacatgtccgatgaacactacatt

SEQ ID NO: 67515 - DNA, 25 bp, mus musculus
gtccgatgaacactacatttacatg

SEQ ID NO: 67516 - DNA, 25 bp, mus musculus
tgaacactacatttacatgttcctt

SEQ ID NO: 67517 - DNA, 25 bp, mus musculus
ctacatttacatgttccttcttggg

SEQ ID NO: 67518 - DNA, 25 bp, mus musculus
catttacatgttccttcttgggagc

SEQ ID NO: 67519 - DNA, 25 bp, mus musculus
cacctggtggtgcaccgctgactta

SEQ ID NO: 67520 - DNA, 25 bp, mus musculus
ctccatcatttcttgggtgctttcc

SEQ ID NO: 67521 - DNA, 25 bp, mus musculus
catcatttcttgggtgctttcctct

SEQ ID NO: 67522 - DNA, 25 bp, mus musculus
ttcttgggtgctttcctctggtggc

SEQ ID NO: 67523 - DNA, 25 bp, mus musculus
catacttctcaagtgtccttttgtc

SEQ ID NO: 67524 - DNA, 25 bp, mus musculus
tctcaagtgtccttttgtcgaccat

SEQ ID NO: 67525 - DNA, 25 bp, mus musculus
ttttgtcgaccattccagtcaaata

SEQ ID NO: 67526 - DNA, 25 bp, mus musculus
cgaccattccagtcaaatacattat

SEQ ID NO: 67527 - DNA, 25 bp, mus musculus
aatacattatttgtcctccaatggt

SEQ ID NO: 67528 - DNA, 25 bp, mus musculus
ctccaatggttgacttgcctgcatc

SEQ ID NO: 67529 - DNA, 25 bp, mus musculus
ttgacttgcctgcatcaacatgtcc

SEQ ID NO: 67530 - DNA, 25 bp, mus musculus
acttgcctgcatcaacatgtccgat

SEQ ID NO: 67531 - DNA, 25 bp, mus musculus
caattctttccgaggagatgtcgat

SEQ ID NO: 67532 - DNA, 25 bp, mus musculus
gaaatcttcttgaagggctgacacg

SEQ ID NO: 67533 - DNA, 25 bp, mus musculus
ccagctttgatccagcagaatgggg

SEQ ID NO: 67534 - DNA, 25 bp, mus musculus
gcttctataacaaccacgcattcaa

SEQ ID NO: 67535 - DNA, 25 bp, mus musculus
ataacaaccacgcattcaaggaaca

SEQ ID NO: 67536 - DNA, 25 bp, mus musculus
acaaccacgcattcaaggaacaaga

SEQ ID NO: 67537 - DNA, 25 bp, mus musculus
cagtcactcccttcgaggagtctac

SEQ ID NO: 67538 - DNA, 25 bp, mus musculus
tcactcccttcgaggagtctactga

SEQ ID NO: 67539 - DNA, 25 bp, mus musculus
ctcccttcgaggagtctactgagga

SEQ ID NO: 67540 - DNA, 25 bp, mus musculus
ctgctctcaaaatccagtccctctt

SEQ ID NO: 67541 - DNA, 25 bp, mus musculus
tcttccggggacacgtggctagaga

SEQ ID NO: 67542 - DNA, 25 bp, mus musculus
tccggggacacgtggctagagaaga

SEQ ID NO: 67543 - DNA, 25 bp, mus musculus
atcttcttgaagggctgacacggga

SEQ ID NO: 67544 - DNA, 25 bp, mus musculus
ttcttgaagggctgacacgggagat

SEQ ID NO: 67545 - DNA, 25 bp, mus musculus
agcaaccggacaatataccagcttt

SEQ ID NO: 67546 - DNA, 25 bp, mus musculus
acaatataccagcttttgccgcagc

SEQ ID NO: 67547 - DNA, 25 bp, mus musculus
atataccagcttttgccgcagcgta

SEQ ID NO: 67548 - DNA, 25 bp, mus musculus
taccagcttttgccgcagcgtattt

SEQ ID NO: 67549 - DNA, 25 bp, mus musculus
cttttgccgcagcgtattttgagaa

SEQ ID NO: 67550 - DNA, 25 bp, mus musculus
ttgccgcagcgtattttgagaacct

SEQ ID NO: 67551 - DNA, 25 bp, mus musculus
tgagctgtaacttctgtaagtacat

SEQ ID NO: 67552 - DNA, 25 bp, mus musculus
ttgttcatgaccactgtgccatgaa

SEQ ID NO: 67553 - DNA, 25 bp, mus musculus
gaggctgtcattccgggcgttgtga

SEQ ID NO: 67554 - DNA, 25 bp, mus musculus
gttgtgaccgctgccagaaaaagat

SEQ ID NO: 67555 - DNA, 25 bp, mus musculus
tccggacctaccacagcctaacagg

SEQ ID NO: 67556 - DNA, 25 bp, mus musculus
acagcctaacaggactgcactgtgt

SEQ ID NO: 67557 - DNA, 25 bp, mus musculus
taacaggactgcactgtgtgtggtg

SEQ ID NO: 67558 - DNA, 25 bp, mus musculus
actgtgtgtggtgccacctggagat

SEQ ID NO: 67559 - DNA, 25 bp, mus musculus
tgtggtgccacctggagatccatga

SEQ ID NO: 67560 - DNA, 25 bp, mus musculus
gccacctggagatccatgatgactg

SEQ ID NO: 67561 - DNA, 25 bp, mus musculus
atgactgtctgcaggctgtaggtcc

SEQ ID NO: 67562 - DNA, 25 bp, mus musculus
aggctgtaggtcctgagtgtgactg

SEQ ID NO: 67563 - DNA, 25 bp, mus musculus
atgaccactgtgccatgaaggccca

SEQ ID NO: 67564 - DNA, 25 bp, mus musculus
ctgagtgtgactgtgggttgctccg

SEQ ID NO: 67565 - DNA, 25 bp, mus musculus
actgtgccatgaaggcccagccttg

SEQ ID NO: 67566 - DNA, 25 bp, mus musculus
ccatgaaggcccagccttgtgaagt

SEQ ID NO: 67567 - DNA, 25 bp, mus musculus
tcagcacctatgccaagtctcggaa

SEQ ID NO: 67568 - DNA, 25 bp, mus musculus
cctatgccaagtctcggaaagacat

SEQ ID NO: 67569 - DNA, 25 bp, mus musculus
ttggtgtccagtcacacttatgggt

SEQ ID NO: 67570 - DNA, 25 bp, mus musculus
tccagtcacacttatgggttcgagg

SEQ ID NO: 67571 - DNA, 25 bp, mus musculus
cacacttatgggttcgaggaggctg

SEQ ID NO: 67572 - DNA, 25 bp, mus musculus
ttgggactgcatgctctggtagagg

SEQ ID NO: 67573 - DNA, 25 bp, mus musculus
ccgggcatcaccagtgagcagtgct

SEQ ID NO: 67574 - DNA, 25 bp, mus musculus
tgtgccagtcgaaactgctgctttt

SEQ ID NO: 67575 - DNA, 25 bp, mus musculus
aactgctgcttttccaacctgatct

SEQ ID NO: 67576 - DNA, 25 bp, mus musculus
ctgatctttgaagtgccctggtgtt

SEQ ID NO: 67577 - DNA, 25 bp, mus musculus
gtgccctggtgtttcttcccacagt

SEQ ID NO: 67578 - DNA, 25 bp, mus musculus
tgtcactactgagagttgctactgc

SEQ ID NO: 67579 - DNA, 25 bp, mus musculus
gagttgctactgccgagccacccgt

SEQ ID NO: 67580 - DNA, 25 bp, mus musculus
ttccctgggagctggcaagccagaa

SEQ ID NO: 67581 - DNA, 25 bp, mus musculus
ccagacttcatcaatctctggggtt

SEQ ID NO: 67582 - DNA, 25 bp, mus musculus
ttcatcaatctctggggtttctaaa

SEQ ID NO: 67583 - DNA, 25 bp, mus musculus
cttgacccttagcagtggctagaca

SEQ ID NO: 67584 - DNA, 25 bp, mus musculus
atcaccagtgagcagtgctttgatc

SEQ ID NO: 67585 - DNA, 25 bp, mus musculus
cagtgctttgatcttggatgctgct

SEQ ID NO: 67586 - DNA, 25 bp, mus musculus
tttgatcttggatgctgctttgact

SEQ ID NO: 67587 - DNA, 25 bp, mus musculus
tctagcgtcgctggggtcccttggt

SEQ ID NO: 67588 - DNA, 25 bp, mus musculus
cttccaaaccaagaatcggagcagt

SEQ ID NO: 67589 - DNA, 25 bp, mus musculus
gtgtcagctcgcaagaattgtgggt

SEQ ID NO: 67590 - DNA, 25 bp, mus musculus
tgtgggtacccgggcatcagtcccg

SEQ ID NO: 67591 - DNA, 25 bp, mus musculus
tacccgggcatcagtcccgaggact

SEQ ID NO: 67592 - DNA, 25 bp, mus musculus
taaagtatccggctcacctataagc

SEQ ID NO: 67593 - DNA, 25 bp, mus musculus
ctcacctataagcagagatgtcagg

SEQ ID NO: 67594 - DNA, 25 bp, mus musculus
ttaatctgggcaatggtagaaactc

SEQ ID NO: 67595 - DNA, 25 bp, mus musculus
actcatgcaggctgccactgaggag

SEQ ID NO: 67596 - DNA, 25 bp, mus musculus
catgcaggctgccactgaggaggtc

SEQ ID NO: 67597 - DNA, 25 bp, mus musculus
ggctgccactgaggaggtctgcact

SEQ ID NO: 67598 - DNA, 25 bp, mus musculus
tgccactgaggaggtctgcacttta

SEQ ID NO: 67599 - DNA, 25 bp, mus musculus
ggtctgcactttatacagagtcctt

SEQ ID NO: 67600 - DNA, 25 bp, mus musculus
ctgaattgtatacccctactccctg

SEQ ID NO: 67601 - DNA, 25 bp, mus musculus
cccctactccctgtatcatgtacaa

SEQ ID NO: 67602 - DNA, 25 bp, mus musculus
ctactccctgtatcatgtacaaaaa

SEQ ID NO: 67603 - DNA, 25 bp, mus musculus
ctccctgtatcatgtacaaaaacat

SEQ ID NO: 67604 - DNA, 25 bp, mus musculus
gtggccagtgactcacaaaagcatt

SEQ ID NO: 67605 - DNA, 25 bp, mus musculus
agtgactcacaaaagcatttgctgc

SEQ ID NO: 67606 - DNA, 25 bp, mus musculus
ttgctgctagacttcttttacatga

SEQ ID NO: 67607 - DNA, 25 bp, mus musculus
ctgctagacttcttttacatgaaac

SEQ ID NO: 67608 - DNA, 25 bp, mus musculus
ctagacttcttttacatgaaacaag

SEQ ID NO: 67609 - DNA, 25 bp, mus musculus
cactcttgaatgctagacatgctct

SEQ ID NO: 67610 - DNA, 25 bp, mus musculus
gacatgctctctctcttaatctggg

SEQ ID NO: 67611 - DNA, 25 bp, mus musculus
tctctcttaatctgggcaatggtag

SEQ ID NO: 67612 - DNA, 25 bp, mus musculus
ggcaacgacatcagcagtgggaacg

SEQ ID NO: 67613 - DNA, 25 bp, mus musculus
caacgacatcagcagtgggaacgtc

SEQ ID NO: 67614 - DNA, 25 bp, mus musculus
ctcaccaaccggtctggagaccatc

SEQ ID NO: 67615 - DNA, 25 bp, mus musculus
ccggtctggagaccatcgtgggaag

SEQ ID NO: 67616 - DNA, 25 bp, mus musculus
ggtctggagaccatcgtgggaagtt

SEQ ID NO: 67617 - DNA, 25 bp, mus musculus
aagttcaaaactgcagctttccgca

SEQ ID NO: 67618 - DNA, 25 bp, mus musculus
ctgcagctttccgcaagaagtatca

SEQ ID NO: 67619 - DNA, 25 bp, mus musculus
agctttccgcaagaagtatcacctg

SEQ ID NO: 67620 - DNA, 25 bp, mus musculus
cgtgttaccaggcggaatgggacag

SEQ ID NO: 67621 - DNA, 25 bp, mus musculus
tgttaccaggcggaatgggacagct

SEQ ID NO: 67622 - DNA, 25 bp, mus musculus
ttaccaggcggaatgggacagctat

SEQ ID NO: 67623 - DNA, 25 bp, mus musculus
cagctatgtaccaaagctgtacaaa

SEQ ID NO: 67624 - DNA, 25 bp, mus musculus
gacatcagcagtgggaacgtcctct

SEQ ID NO: 67625 - DNA, 25 bp, mus musculus
tggtgtaccagcaggacaagccact

SEQ ID NO: 67626 - DNA, 25 bp, mus musculus
gtaccagcaggacaagccactgaga

SEQ ID NO: 67627 - DNA, 25 bp, mus musculus
cagcaggacaagccactgagatgtg

SEQ ID NO: 67628 - DNA, 25 bp, mus musculus
aggacaagccactgagatgtgacga

SEQ ID NO: 67629 - DNA, 25 bp, mus musculus
gacaagccactgagatgtgacgaac

SEQ ID NO: 67630 - DNA, 25 bp, mus musculus
atgtgacgaacccatcctcaccaac

SEQ ID NO: 67631 - DNA, 25 bp, mus musculus
tcctcaccaaccggtctggagacca

SEQ ID NO: 67632 - DNA, 25 bp, mus musculus
ggatccatgccatgctcaagagcat

SEQ ID NO: 67633 - DNA, 25 bp, mus musculus
ctcaagagcatctgtgtagaagtgg

SEQ ID NO: 67634 - DNA, 25 bp, mus musculus
tggacctagaagcccagttccacct

SEQ ID NO: 67635 - DNA, 25 bp, mus musculus
gacctagaagcccagttccacctgc

SEQ ID NO: 67636 - DNA, 25 bp, mus musculus
tagaagcccagttccacctgcactt

SEQ ID NO: 67637 - DNA, 25 bp, mus musculus
gaagcccagttccacctgcacttct

SEQ ID NO: 67638 - DNA, 25 bp, mus musculus
cacctgacccggaaagcacaggagg

SEQ ID NO: 67639 - DNA, 25 bp, mus musculus
agcacaggaggtgacgcggaaatac

SEQ ID NO: 67640 - DNA, 25 bp, mus musculus
aatgacagggcaggtcctgtaggtc

SEQ ID NO: 67641 - DNA, 25 bp, mus musculus
ggcaggtcctgtaggtctttgactc

SEQ ID NO: 67642 - DNA, 25 bp, mus musculus
caggtcctgtaggtctttgactctt

SEQ ID NO: 67643 - DNA, 25 bp, mus musculus
ggtcctgtaggtctttgactcttct

SEQ ID NO: 67644 - DNA, 25 bp, mus musculus
ctggcaacgaaaccagcgaggctga

SEQ ID NO: 67645 - DNA, 25 bp, mus musculus
tcctgtaggtctttgactcttctga

SEQ ID NO: 67646 - DNA, 25 bp, mus musculus
caacgaaaccagcgaggctgagaac

SEQ ID NO: 67647 - DNA, 25 bp, mus musculus
acgaaaccagcgaggctgagaacga

SEQ ID NO: 67648 - DNA, 25 bp, mus musculus
gaaaccagcgaggctgagaacgacg

SEQ ID NO: 67649 - DNA, 25 bp, mus musculus
aaccagcgaggctgagaacgacgct

SEQ ID NO: 67650 - DNA, 25 bp, mus musculus
gctgagaacgacgctgctgaaacgg

SEQ ID NO: 67651 - DNA, 25 bp, mus musculus
gatctcggaggagctggacctagaa

SEQ ID NO: 67652 - DNA, 25 bp, mus musculus
gctggacctagaagcccagttccac

SEQ ID NO: 67653 - DNA, 25 bp, mus musculus
gctgactttggcctggccgggtctt

SEQ ID NO: 67654 - DNA, 25 bp, mus musculus
tctctccggatggtggtcgcctcta

SEQ ID NO: 67655 - DNA, 25 bp, mus musculus
actcctgtatggcgctcggcagtat

SEQ ID NO: 67656 - DNA, 25 bp, mus musculus
tcctgtatggcgctcggcagtatga

SEQ ID NO: 67657 - DNA, 25 bp, mus musculus
gtatggcgctcggcagtatgaccag

SEQ ID NO: 67658 - DNA, 25 bp, mus musculus
atggcgctcggcagtatgaccagcg

SEQ ID NO: 67659 - DNA, 25 bp, mus musculus
cgctcggcagtatgaccagcgcgtt

SEQ ID NO: 67660 - DNA, 25 bp, mus musculus
gcagtatgaccagcgcgttgaccta

SEQ ID NO: 67661 - DNA, 25 bp, mus musculus
agtatgaccagcgcgttgacctatg

SEQ ID NO: 67662 - DNA, 25 bp, mus musculus
tatgaccagcgcgttgacctatggg

SEQ ID NO: 67663 - DNA, 25 bp, mus musculus
accagcgcgttgacctatgggctgt

SEQ ID NO: 67664 - DNA, 25 bp, mus musculus
cagcgcgttgacctatgggctgtgg

SEQ ID NO: 67665 - DNA, 25 bp, mus musculus
tctccggatggtggtcgcctctaca

SEQ ID NO: 67666 - DNA, 25 bp, mus musculus
ctacacacatcaggtggccaccagg

SEQ ID NO: 67667 - DNA, 25 bp, mus musculus
taccgagctcctgaactcctgtatg

SEQ ID NO: 67668 - DNA, 25 bp, mus musculus
ccgagctcctgaactcctgtatggc

SEQ ID NO: 67669 - DNA, 25 bp, mus musculus
gagctcctgaactcctgtatggcgc

SEQ ID NO: 67670 - DNA, 25 bp, mus musculus
gctcctgaactcctgtatggcgctc

SEQ ID NO: 67671 - DNA, 25 bp, mus musculus
ctgaactcctgtatggcgctcggca

SEQ ID NO: 67672 - DNA, 25 bp, mus musculus
gaactcctgtatggcgctcggcagt

SEQ ID NO: 67673 - DNA, 25 bp, mus musculus
aagtcttcttggagagcggtgagaa

SEQ ID NO: 67674 - DNA, 25 bp, mus musculus
ttaaactggtctccacatcctacat

SEQ ID NO: 67675 - DNA, 25 bp, mus musculus
tctcaggcaccagagaacgcaaagc

SEQ ID NO: 67676 - DNA, 25 bp, mus musculus
caggcaccagagaacgcaaagcagc

SEQ ID NO: 67677 - DNA, 25 bp, mus musculus
cagccactaccctgggattgatctt

SEQ ID NO: 67678 - DNA, 25 bp, mus musculus
tgtcaaactttttggcatggcttgg

SEQ ID NO: 67679 - DNA, 25 bp, mus musculus
ttttggcatggcttggttacctgaa

SEQ ID NO: 67680 - DNA, 25 bp, mus musculus
tgaattcccttataaatccactgat

SEQ ID NO: 67681 - DNA, 25 bp, mus musculus
atccactgatttataccatctttaa

SEQ ID NO: 67682 - DNA, 25 bp, mus musculus
cactgatttataccatctttaatga

SEQ ID NO: 67683 - DNA, 25 bp, mus musculus
tttataccatctttaatgaagactt

SEQ ID NO: 67684 - DNA, 25 bp, mus musculus
aacttgtacgatgccgatattagga

SEQ ID NO: 67685 - DNA, 25 bp, mus musculus
aactggtctccacatcctacatgtt

SEQ ID NO: 67686 - DNA, 25 bp, mus musculus
tggtctccacatcctacatgttaga

SEQ ID NO: 67687 - DNA, 25 bp, mus musculus
ccttgtccgatccatcaacggactt

SEQ ID NO: 67688 - DNA, 25 bp, mus musculus
tgtccgatccatcaacggactttga

SEQ ID NO: 67689 - DNA, 25 bp, mus musculus
catcaacggactttgatagaattca

SEQ ID NO: 67690 - DNA, 25 bp, mus musculus
atagaattcacagcaccgtgaaaag

SEQ ID NO: 67691 - DNA, 25 bp, mus musculus
gaattcacagcaccgtgaaaagtcc

SEQ ID NO: 67692 - DNA, 25 bp, mus musculus
aaagtcccagatcggaactgaagca

SEQ ID NO: 67693 - DNA, 25 bp, mus musculus
caggcattcatgttgttctgaagta

SEQ ID NO: 67694 - DNA, 25 bp, mus musculus
gcattcatgttgttctgaagtatgt

SEQ ID NO: 67695 - DNA, 25 bp, mus musculus
gactatgcattggttctggtatgtg

SEQ ID NO: 67696 - DNA, 25 bp, mus musculus
gtatgtgcacgcatctcatcatcat

SEQ ID NO: 67697 - DNA, 25 bp, mus musculus
gcacgcatctcatcatcatgatccg

SEQ ID NO: 67698 - DNA, 25 bp, mus musculus
atctcatcatcatgatccgggaaga

SEQ ID NO: 67699 - DNA, 25 bp, mus musculus
agtatcgtaaccggatcatgtgtac

SEQ ID NO: 67700 - DNA, 25 bp, mus musculus
atcgtaaccggatcatgtgtaccgt

SEQ ID NO: 67701 - DNA, 25 bp, mus musculus
tcatgtgtaccgtgagtatagtgcc

SEQ ID NO: 67702 - DNA, 25 bp, mus musculus
tagagccctacaattgcagtctgtc

SEQ ID NO: 67703 - DNA, 25 bp, mus musculus
acaattgcagtctgtctatacatag

SEQ ID NO: 67704 - DNA, 25 bp, mus musculus
attgcagtctgtctatacataggta

SEQ ID NO: 67705 - DNA, 25 bp, mus musculus
gctttgatcagcttcatgcttgtta

SEQ ID NO: 67706 - DNA, 25 bp, mus musculus
tcgaaaacgatgctctctatgacat

SEQ ID NO: 67707 - DNA, 25 bp, mus musculus
atcagcttcatgcttgttaggtgac

SEQ ID NO: 67708 - DNA, 25 bp, mus musculus
ttcatgcttgttaggtgacccagtc

SEQ ID NO: 67709 - DNA, 25 bp, mus musculus
atgcttgttaggtgacccagtctct

SEQ ID NO: 67710 - DNA, 25 bp, mus musculus
aggtgacccagtctctgggactatg

SEQ ID NO: 67711 - DNA, 25 bp, mus musculus
tgacccagtctctgggactatgcat

SEQ ID NO: 67712 - DNA, 25 bp, mus musculus
cccagtctctgggactatgcattgg

SEQ ID NO: 67713 - DNA, 25 bp, mus musculus
ctctgggactatgcattggttctgg

SEQ ID NO: 67714 - DNA, 25 bp, mus musculus
tttgtgacccagtatcagcactcaa

SEQ ID NO: 67715 - DNA, 25 bp, mus musculus
cactcaagtggccagagacgcatcc

SEQ ID NO: 67716 - DNA, 25 bp, mus musculus
ctcatggccaggctggcaatataca

SEQ ID NO: 67717 - DNA, 25 bp, mus musculus
gacagacaactcattcgactgtgtc

SEQ ID NO: 67718 - DNA, 25 bp, mus musculus
caactcattcgactgtgtcaaaaat

SEQ ID NO: 67719 - DNA, 25 bp, mus musculus
catactatcgtcaccatttcatgcg

SEQ ID NO: 67720 - DNA, 25 bp, mus musculus
accatttcatgcgtcaggatctgac

SEQ ID NO: 67721 - DNA, 25 bp, mus musculus
gtcaggatctgacccagtctctgat

SEQ ID NO: 67722 - DNA, 25 bp, mus musculus
ctctgatcatgattcagcccattct

SEQ ID NO: 67723 - DNA, 25 bp, mus musculus
tcatgattcagcccattctgtacgc

SEQ ID NO: 67724 - DNA, 25 bp, mus musculus
ttcagcccattctgtacgcctactc

SEQ ID NO: 67725 - DNA, 25 bp, mus musculus
ccattctgtacgcctactccttcag

SEQ ID NO: 67726 - DNA, 25 bp, mus musculus
cagagacgcatccgagtgaccacaa

SEQ ID NO: 67727 - DNA, 25 bp, mus musculus
cgagtgaccacaattgctaggaact

SEQ ID NO: 67728 - DNA, 25 bp, mus musculus
accacaattgctaggaactgggcag

SEQ ID NO: 67729 - DNA, 25 bp, mus musculus
gatgctcaaactcaaatccaaaata

SEQ ID NO: 67730 - DNA, 25 bp, mus musculus
caaactcaaatccaaaatattgctc

SEQ ID NO: 67731 - DNA, 25 bp, mus musculus
caaatccaaaatattgctcgatctt

SEQ ID NO: 67732 - DNA, 25 bp, mus musculus
cgatcttttgaccaggaagcagctc

SEQ ID NO: 67733 - DNA, 25 bp, mus musculus
gcagctccgattctcatggccaggc

SEQ ID NO: 67734 - DNA, 25 bp, mus musculus
ttgtgctctcctgcctcatagctgt

SEQ ID NO: 67735 - DNA, 25 bp, mus musculus
tctcctgcctcatagctgtcctcga

SEQ ID NO: 67736 - DNA, 25 bp, mus musculus
cagagcagatccagactcttagccg

SEQ ID NO: 67737 - DNA, 25 bp, mus musculus
agatccagactcttagccgcacact

SEQ ID NO: 67738 - DNA, 25 bp, mus musculus
agactcttagccgcacactctcagc

SEQ ID NO: 67739 - DNA, 25 bp, mus musculus
gcacactctcagcaaaagctgcctc

SEQ ID NO: 67740 - DNA, 25 bp, mus musculus
tctcagcaaaagctgcctctggctt

SEQ ID NO: 67741 - DNA, 25 bp, mus musculus
ctgagcaccgaactggcccttttag

SEQ ID NO: 67742 - DNA, 25 bp, mus musculus
cttttaggcacagggctcctaatgg

SEQ ID NO: 67743 - DNA, 25 bp, mus musculus
ctatcaaaacaatgtcatctattcc

SEQ ID NO: 67744 - DNA, 25 bp, mus musculus
ctctggggctcaatctgggcaatga

SEQ ID NO: 67745 - DNA, 25 bp, mus musculus
ggctcaatctgggcaatgaccccga

SEQ ID NO: 67746 - DNA, 25 bp, mus musculus
gcctcatagctgtcctcgagacgtg

SEQ ID NO: 67747 - DNA, 25 bp, mus musculus
ttgacctggagcacctccatagacg

SEQ ID NO: 67748 - DNA, 25 bp, mus musculus
tggagcacctccatagacgtgtaaa

SEQ ID NO: 67749 - DNA, 25 bp, mus musculus
cgtcaattgacttgacccctctgga

SEQ ID NO: 67750 - DNA, 25 bp, mus musculus
tgacccctctggacattgacacttt

SEQ ID NO: 67751 - DNA, 25 bp, mus musculus
acattgacactttgccaacacgcca

SEQ ID NO: 67752 - DNA, 25 bp, mus musculus
cacgccaagccctggagcagatcag

SEQ ID NO: 67753 - DNA, 25 bp, mus musculus
aagccctggagcagatcagtgattt

SEQ ID NO: 67754 - DNA, 25 bp, mus musculus
cctttcgagactgctcaaacacgaa

SEQ ID NO: 67755 - DNA, 25 bp, mus musculus
acagaaagcagccactaccttgggg

SEQ ID NO: 67756 - DNA, 25 bp, mus musculus
ctatcgtagcctactccagtgccag

SEQ ID NO: 67757 - DNA, 25 bp, mus musculus
actccagtgccagtaccggaatatc

SEQ ID NO: 67758 - DNA, 25 bp, mus musculus
gtgccagtaccggaatatcaaccgg

SEQ ID NO: 67759 - DNA, 25 bp, mus musculus
gaatatcaaccggaagctctctgct

SEQ ID NO: 67760 - DNA, 25 bp, mus musculus
gaagctctctgctgcaggcatgcac

SEQ ID NO: 67761 - DNA, 25 bp, mus musculus
tcatgatacatgatccagagcggaa

SEQ ID NO: 67762 - DNA, 25 bp, mus musculus
tacatgatccagagcggaaccctgg

SEQ ID NO: 67763 - DNA, 25 bp, mus musculus
ggaaacaacgaaaccattggctgag

SEQ ID NO: 67764 - DNA, 25 bp, mus musculus
aacgaaaccattggctgagactgca

SEQ ID NO: 67765 - DNA, 25 bp, mus musculus
accattggctgagactgcacaacag

SEQ ID NO: 67766 - DNA, 25 bp, mus musculus
gatcatcgtgggagccttcacggtg

SEQ ID NO: 67767 - DNA, 25 bp, mus musculus
gtttttcctcttgtccacagcaagg

SEQ ID NO: 67768 - DNA, 25 bp, mus musculus
agcaaggccctttatctgtggcacc

SEQ ID NO: 67769 - DNA, 25 bp, mus musculus
gccctttatctgtggcacctcctgt

SEQ ID NO: 67770 - DNA, 25 bp, mus musculus
tggcacctcctgtagctgcatcccg

SEQ ID NO: 67771 - DNA, 25 bp, mus musculus
atgtctgtggctgggctatgcaaac

SEQ ID NO: 67772 - DNA, 25 bp, mus musculus
gggctatgcaaactctctcattaac

SEQ ID NO: 67773 - DNA, 25 bp, mus musculus
gaccacctatcgtagcctactccag

SEQ ID NO: 67774 - DNA, 25 bp, mus musculus
aatgatggacccacgagttcttcat

SEQ ID NO: 67775 - DNA, 25 bp, mus musculus
gatggacccacgagttcttcatcac

SEQ ID NO: 67776 - DNA, 25 bp, mus musculus
ccttcagtcaatgatgcggcagttt

SEQ ID NO: 67777 - DNA, 25 bp, mus musculus
tcagtcaatgatgcggcagtttcag

SEQ ID NO: 67778 - DNA, 25 bp, mus musculus
aatgatgcggcagtttcagcagggt

SEQ ID NO: 67779 - DNA, 25 bp, mus musculus
atgatgtcatctgctgagacctcac

SEQ ID NO: 67780 - DNA, 25 bp, mus musculus
atgtcatctgctgagacctcacact

SEQ ID NO: 67781 - DNA, 25 bp, mus musculus
tcatctgctgagacctcacactttc

SEQ ID NO: 67782 - DNA, 25 bp, mus musculus
tctgctgagacctcacactttctct

SEQ ID NO: 67783 - DNA, 25 bp, mus musculus
tcccttctgaagttcgggaagagtg

SEQ ID NO: 67784 - DNA, 25 bp, mus musculus
cttctgaagttcgggaagagtgcct

SEQ ID NO: 67785 - DNA, 25 bp, mus musculus
aagtcatcatttctgctttaaatct

SEQ ID NO: 67786 - DNA, 25 bp, mus musculus
ggacccacgagttcttcatcacatg

SEQ ID NO: 67787 - DNA, 25 bp, mus musculus
cccacgagttcttcatcacatgggt

SEQ ID NO: 67788 - DNA, 25 bp, mus musculus
acgagttcttcatcacatgggtggc

SEQ ID NO: 67789 - DNA, 25 bp, mus musculus
agttcttcatcacatgggtggcatg

SEQ ID NO: 67790 - DNA, 25 bp, mus musculus
tcttcatcacatgggtggcatggcc

SEQ ID NO: 67791 - DNA, 25 bp, mus musculus
catggccggccttcagtcaatgatg

SEQ ID NO: 67792 - DNA, 25 bp, mus musculus
ggccggccttcagtcaatgatgcgg

SEQ ID NO: 67793 - DNA, 25 bp, mus musculus
cggccttcagtcaatgatgcggcag

SEQ ID NO: 67794 - DNA, 25 bp, mus musculus
catcgtgggtacctccgagttgagt

SEQ ID NO: 67795 - DNA, 25 bp, mus musculus
atcgtgggtacctccgagttgagtg

SEQ ID NO: 67796 - DNA, 25 bp, mus musculus
tagtgttcgcgttcagagtgtacgg

SEQ ID NO: 67797 - DNA, 25 bp, mus musculus
agtgttcgcgttcagagtgtacggc

SEQ ID NO: 67798 - DNA, 25 bp, mus musculus
gtgttcgcgttcagagtgtacggca

SEQ ID NO: 67799 - DNA, 25 bp, mus musculus
tgttcgcgttcagagtgtacggcat

SEQ ID NO: 67800 - DNA, 25 bp, mus musculus
gttcgcgttcagagtgtacggcatg

SEQ ID NO: 67801 - DNA, 25 bp, mus musculus
ttcgcgttcagagtgtacggcatgg

SEQ ID NO: 67802 - DNA, 25 bp, mus musculus
tcgcgttcagagtgtacggcatgga

SEQ ID NO: 67803 - DNA, 25 bp, mus musculus
cgttcagagtgtacggcatggatga

SEQ ID NO: 67804 - DNA, 25 bp, mus musculus
tgggtacctccgagttgagtgtcaa

SEQ ID NO: 67805 - DNA, 25 bp, mus musculus
gggtacctccgagttgagtgtcaat

SEQ ID NO: 67806 - DNA, 25 bp, mus musculus
ggtacctccgagttgagtgtcaatg

SEQ ID NO: 67807 - DNA, 25 bp, mus musculus
gtacctccgagttgagtgtcaatgg

SEQ ID NO: 67808 - DNA, 25 bp, mus musculus
tacctccgagttgagtgtcaatggt

SEQ ID NO: 67809 - DNA, 25 bp, mus musculus
ggctagtgttcgcgttcagagtgta

SEQ ID NO: 67810 - DNA, 25 bp, mus musculus
gctagtgttcgcgttcagagtgtac

SEQ ID NO: 67811 - DNA, 25 bp, mus musculus
ctagtgttcgcgttcagagtgtacg

SEQ ID NO: 67812 - DNA, 25 bp, mus musculus
gagaaattccacagtcagttaatgc

SEQ ID NO: 67813 - DNA, 25 bp, mus musculus
gaaattccacagtcagttaatgcga

SEQ ID NO: 67814 - DNA, 25 bp, mus musculus
gaatcccgcaatgtcactatggaaa

SEQ ID NO: 67815 - DNA, 25 bp, mus musculus
atcccgcaatgtcactatggaaaca

SEQ ID NO: 67816 - DNA, 25 bp, mus musculus
cccgcaatgtcactatggaaacaga

SEQ ID NO: 67817 - DNA, 25 bp, mus musculus
tgaagacgactgttccgttattggg

SEQ ID NO: 67818 - DNA, 25 bp, mus musculus
tgtcaaagccgagagaccagcctgc

SEQ ID NO: 67819 - DNA, 25 bp, mus musculus
aaagccgagagaccagcctgcgtcc

SEQ ID NO: 67820 - DNA, 25 bp, mus musculus
agccgagagaccagcctgcgtccta

SEQ ID NO: 67821 - DNA, 25 bp, mus musculus
gagagaccagcctgcgtcctaaagt

SEQ ID NO: 67822 - DNA, 25 bp, mus musculus
gaccagcctgcgtcctaaagtttgc

SEQ ID NO: 67823 - DNA, 25 bp, mus musculus
tctcttagaaacttttgcagataat

SEQ ID NO: 67824 - DNA, 25 bp, mus musculus
aattccacagtcagttaatgcgact

SEQ ID NO: 67825 - DNA, 25 bp, mus musculus
ttccacagtcagttaatgcgactta

SEQ ID NO: 67826 - DNA, 25 bp, mus musculus
tcagttaatgcgacttatggtggcc

SEQ ID NO: 67827 - DNA, 25 bp, mus musculus
agttaatgcgacttatggtggccaa

SEQ ID NO: 67828 - DNA, 25 bp, mus musculus
ttaatgcgacttatggtggccaagg

SEQ ID NO: 67829 - DNA, 25 bp, mus musculus
aatgcgacttatggtggccaaggaa

SEQ ID NO: 67830 - DNA, 25 bp, mus musculus
tggccaaggaatcccgcaatgtcac

SEQ ID NO: 67831 - DNA, 25 bp, mus musculus
gccaaggaatcccgcaatgtcacta

SEQ ID NO: 67832 - DNA, 25 bp, mus musculus
atgctgtcatggtcacctgccaaca

SEQ ID NO: 67833 - DNA, 25 bp, mus musculus
tcatggtcacctgccaacaattgtc

SEQ ID NO: 67834 - DNA, 25 bp, mus musculus
cctgctaagcaactggaccagtatc

SEQ ID NO: 67835 - DNA, 25 bp, mus musculus
ctggaccagtatctttcctggtaag

SEQ ID NO: 67836 - DNA, 25 bp, mus musculus
ctttcctggtaagtcagctctggag

SEQ ID NO: 67837 - DNA, 25 bp, mus musculus
tgatcatattctggcaggtgattca

SEQ ID NO: 67838 - DNA, 25 bp, mus musculus
agacaagtgcttcctggaactcagg

SEQ ID NO: 67839 - DNA, 25 bp, mus musculus
acagccagccaaggaggcagctgct

SEQ ID NO: 67840 - DNA, 25 bp, mus musculus
ttcctcccagagacacggaacctca

SEQ ID NO: 67841 - DNA, 25 bp, mus musculus
ttctggggccctcttcctagcacag

SEQ ID NO: 67842 - DNA, 25 bp, mus musculus
cttcctagcacaggtaccctctaag

SEQ ID NO: 67843 - DNA, 25 bp, mus musculus
ggtaccctctaagccatgtacatgt

SEQ ID NO: 67844 - DNA, 25 bp, mus musculus
tcacctgccaacaattgtctcagac

SEQ ID NO: 67845 - DNA, 25 bp, mus musculus
gccaacaattgtctcagactaggca

SEQ ID NO: 67846 - DNA, 25 bp, mus musculus
atttcagctaccaataatccacagt

SEQ ID NO: 67847 - DNA, 25 bp, mus musculus
tggttgcccaaggtctccatctctg

SEQ ID NO: 67848 - DNA, 25 bp, mus musculus
cccacacaaactcaggaatcacctg

SEQ ID NO: 67849 - DNA, 25 bp, mus musculus
caaactcaggaatcacctgcaatga

SEQ ID NO: 67850 - DNA, 25 bp, mus musculus
tcacctgcaatgaggttcctgttgg

SEQ ID NO: 67851 - DNA, 25 bp, mus musculus
gctgcccctgctaagcaactggacc

SEQ ID NO: 67852 - DNA, 25 bp, mus musculus
tcagtgccgtgaactagtgctggag

SEQ ID NO: 67853 - DNA, 25 bp, mus musculus
agtgccgtgaactagtgctggagca

SEQ ID NO: 67854 - DNA, 25 bp, mus musculus
gagaactcacggtgctccatgggct

SEQ ID NO: 67855 - DNA, 25 bp, mus musculus
gaactcacggtgctccatgggctca

SEQ ID NO: 67856 - DNA, 25 bp, mus musculus
tcacggtgctccatgggctcaggcg

SEQ ID NO: 67857 - DNA, 25 bp, mus musculus
ccatgggctcaggcgcgtacgagtg

SEQ ID NO: 67858 - DNA, 25 bp, mus musculus
gggctcaggcgcgtacgagtgcaca

SEQ ID NO: 67859 - DNA, 25 bp, mus musculus
gctcaggcgcgtacgagtgcacagg

SEQ ID NO: 67860 - DNA, 25 bp, mus musculus
aggcgcgtacgagtgcacaggcgca

SEQ ID NO: 67861 - DNA, 25 bp, mus musculus
gagtgcacaggcgcacgcttgggat

SEQ ID NO: 67862 - DNA, 25 bp, mus musculus
gtgcacaggcgcacgcttgggatac

SEQ ID NO: 67863 - DNA, 25 bp, mus musculus
acaggcgcacgcttgggatacatga

SEQ ID NO: 67864 - DNA, 25 bp, mus musculus
actagtgctggagcagtttgacgag

SEQ ID NO: 67865 - DNA, 25 bp, mus musculus
ggcttagtagtgctcgccttcttgg

SEQ ID NO: 67866 - DNA, 25 bp, mus musculus
cttagtagtgctcgccttcttggtg

SEQ ID NO: 67867 - DNA, 25 bp, mus musculus
tagtagtgctcgccttcttggtgcc

SEQ ID NO: 67868 - DNA, 25 bp, mus musculus
cgccttcttggtgccgctcggcctt

SEQ ID NO: 67869 - DNA, 25 bp, mus musculus
gagcctcctcatgatcctgctctgg

SEQ ID NO: 67870 - DNA, 25 bp, mus musculus
cctcatgatcctgctctggggcagc

SEQ ID NO: 67871 - DNA, 25 bp, mus musculus
cagagaactcacggtgctccatggg

SEQ ID NO: 67872 - DNA, 25 bp, mus musculus
actgctcattggtccagctgctgat

SEQ ID NO: 67873 - DNA, 25 bp, mus musculus
tgctcattggtccagctgctgattc

SEQ ID NO: 67874 - DNA, 25 bp, mus musculus
gggccccgatctaagcaggcttcct

SEQ ID NO: 67875 - DNA, 25 bp, mus musculus
cccctgtccaggtggcccgactgag

SEQ ID NO: 67876 - DNA, 25 bp, mus musculus
cctgtccaggtggcccgactgagag

SEQ ID NO: 67877 - DNA, 25 bp, mus musculus
tccaggtggcccgactgagagtgcc

SEQ ID NO: 67878 - DNA, 25 bp, mus musculus
caggtggcccgactgagagtgccag

SEQ ID NO: 67879 - DNA, 25 bp, mus musculus
tggcccgactgagagtgccagagcg

SEQ ID NO: 67880 - DNA, 25 bp, mus musculus
gcccgactgagagtgccagagcggt

SEQ ID NO: 67881 - DNA, 25 bp, mus musculus
cgattgcacagtgtttgggagcgtg

SEQ ID NO: 67882 - DNA, 25 bp, mus musculus
attgcacagtgtttgggagcgtgat

SEQ ID NO: 67883 - DNA, 25 bp, mus musculus
tgcacagtgtttgggagcgtgattg

SEQ ID NO: 67884 - DNA, 25 bp, mus musculus
ctcattggtccagctgctgattcgc

SEQ ID NO: 67885 - DNA, 25 bp, mus musculus
cattggtccagctgctgattcgcgc

SEQ ID NO: 67886 - DNA, 25 bp, mus musculus
ttggtccagctgctgattcgcgcct

SEQ ID NO: 67887 - DNA, 25 bp, mus musculus
ggtccagctgctgattcgcgcctgt

SEQ ID NO: 67888 - DNA, 25 bp, mus musculus
tccagctgctgattcgcgcctgtag

SEQ ID NO: 67889 - DNA, 25 bp, mus musculus
cagctgctgattcgcgcctgtagca

SEQ ID NO: 67890 - DNA, 25 bp, mus musculus
gctgctgattcgcgcctgtagcagg

SEQ ID NO: 67891 - DNA, 25 bp, mus musculus
cgcgcctgtagcaggggtctagtga

SEQ ID NO: 67892 - DNA, 25 bp, mus musculus
gccgtacccagacaccaggctcatg

SEQ ID NO: 67893 - DNA, 25 bp, mus musculus
cgccatctacaggccaagaagaagt

SEQ ID NO: 67894 - DNA, 25 bp, mus musculus
atttattgctgccttaaccacaggt

SEQ ID NO: 67895 - DNA, 25 bp, mus musculus
tgctgccttaaccacaggtttcgct

SEQ ID NO: 67896 - DNA, 25 bp, mus musculus
cttaaccacaggtttcgctctggat

SEQ ID NO: 67897 - DNA, 25 bp, mus musculus
gtcaaccggtgtcacaccaaggaga

SEQ ID NO: 67898 - DNA, 25 bp, mus musculus
cggtgtcacaccaaggagactttgt

SEQ ID NO: 67899 - DNA, 25 bp, mus musculus
cacaccaaggagactttgttcatga

SEQ ID NO: 67900 - DNA, 25 bp, mus musculus
actttgttcatgacaggggatatga

SEQ ID NO: 67901 - DNA, 25 bp, mus musculus
gatatgacccactctgaggctacca

SEQ ID NO: 67902 - DNA, 25 bp, mus musculus
tctgaggctaccaatgggcaggttg

SEQ ID NO: 67903 - DNA, 25 bp, mus musculus
gctggaccctgaagtcttgagcttg

SEQ ID NO: 67904 - DNA, 25 bp, mus musculus
taccacctctacttcatcctgggga

SEQ ID NO: 67905 - DNA, 25 bp, mus musculus
ttcatcctggggaccttccaagagg

SEQ ID NO: 67906 - DNA, 25 bp, mus musculus
gacatctactaccgcaagtttatcc

SEQ ID NO: 67907 - DNA, 25 bp, mus musculus
tactaccgcaagtttatccagcagg

SEQ ID NO: 67908 - DNA, 25 bp, mus musculus
cgcaagtttatccagcaggtctacc

SEQ ID NO: 67909 - DNA, 25 bp, mus musculus
cagcaggtctacctggcactcttct

SEQ ID NO: 67910 - DNA, 25 bp, mus musculus
ctggcactcttctggctggccatga

SEQ ID NO: 67911 - DNA, 25 bp, mus musculus
ctcttctggctggccatgagttcca

SEQ ID NO: 67912 - DNA, 25 bp, mus musculus
tctgaccgttaccatgagcaagtct

SEQ ID NO: 67913 - DNA, 25 bp, mus musculus
cgttaccatgagcaagtctctgcca

SEQ ID NO: 67914 - DNA, 25 bp, mus musculus
tacaaggtcagccgcctggagacca

SEQ ID NO: 67915 - DNA, 25 bp, mus musculus
gtcagccgcctggagaccaccatct

SEQ ID NO: 67916 - DNA, 25 bp, mus musculus
acctccaatggctcctctcgaagca

SEQ ID NO: 67917 - DNA, 25 bp, mus musculus
aatggctcctctcgaagcaactcga

SEQ ID NO: 67918 - DNA, 25 bp, mus musculus
cgaagcaactcgaagaccatgacag

SEQ ID NO: 67919 - DNA, 25 bp, mus musculus
aactcgaagaccatgacagaaagct

SEQ ID NO: 67920 - DNA, 25 bp, mus musculus
tccagcttctactctaacattctgg

SEQ ID NO: 67921 - DNA, 25 bp, mus musculus
ttctactctaacattctggcctaag

SEQ ID NO: 67922 - DNA, 25 bp, mus musculus
tctaacattctggcctaagcagcaa

SEQ ID NO: 67923 - DNA, 25 bp, mus musculus
attctggcctaagcagcaagacaca

SEQ ID NO: 67924 - DNA, 25 bp, mus musculus
atgatgatcgtggttgtgtgtacct

SEQ ID NO: 67925 - DNA, 25 bp, mus musculus
tactgctgcctcaatgacaggttcc

SEQ ID NO: 67926 - DNA, 25 bp, mus musculus
cgtctgggcttcaagcatgcctttc

SEQ ID NO: 67927 - DNA, 25 bp, mus musculus
gcctttcgctgctgccctttcatca

SEQ ID NO: 67928 - DNA, 25 bp, mus musculus
cgctgctgccctttcatcagtgctg

SEQ ID NO: 67929 - DNA, 25 bp, mus musculus
tgccctttcatcagtgctggtgatt

SEQ ID NO: 67930 - DNA, 25 bp, mus musculus
tacctccagacccagagcagcgtgt

SEQ ID NO: 67931 - DNA, 25 bp, mus musculus
cagacccagagcagcgtgtacaagg

SEQ ID NO: 67932 - DNA, 25 bp, mus musculus
gagctgtttgtcatggcccgagaac

SEQ ID NO: 67933 - DNA, 25 bp, mus musculus
ctgtttgtcatggcccgagaacatg

SEQ ID NO: 67934 - DNA, 25 bp, mus musculus
aatcagctggatggctttgaggcca

SEQ ID NO: 67935 - DNA, 25 bp, mus musculus
ggctttgaggccaccaagaatatca

SEQ ID NO: 67936 - DNA, 25 bp, mus musculus
gaggccaccaagaatatcaaggtta

SEQ ID NO: 67937 - DNA, 25 bp, mus musculus
attgatatcctggactctgccctgc

SEQ ID NO: 67938 - DNA, 25 bp, mus musculus
atcctggactctgccctgcttcgtc

SEQ ID NO: 67939 - DNA, 25 bp, mus musculus
ctgcttcgtcctgggaggattgaca

SEQ ID NO: 67940 - DNA, 25 bp, mus musculus
cggcgtgtccacgtcactcaggagg

SEQ ID NO: 67941 - DNA, 25 bp, mus musculus
cacgtcactcaggaggactttgaga

SEQ ID NO: 67942 - DNA, 25 bp, mus musculus
gtcactcaggaggactttgagatgg

SEQ ID NO: 67943 - DNA, 25 bp, mus musculus
aacatgtccatcaagaagctatgga

SEQ ID NO: 67944 - DNA, 25 bp, mus musculus
atggcccgagaacatgctccatcca

SEQ ID NO: 67945 - DNA, 25 bp, mus musculus
gcccgagaacatgctccatccatca

SEQ ID NO: 67946 - DNA, 25 bp, mus musculus
gaacatgctccatccatcatcttca

SEQ ID NO: 67947 - DNA, 25 bp, mus musculus
gctccatccatcatcttcatggacg

SEQ ID NO: 67948 - DNA, 25 bp, mus musculus
gactctattggctcctcacggctgg

SEQ ID NO: 67949 - DNA, 25 bp, mus musculus
tctattggctcctcacggctggagg

SEQ ID NO: 67950 - DNA, 25 bp, mus musculus
gtacagcgcacgatgctggaactgc

SEQ ID NO: 67951 - DNA, 25 bp, mus musculus
ctcaatcagctggatggctttgagg

SEQ ID NO: 67952 - DNA, 25 bp, mus musculus
tttcatgggaagccagtttgacagg

SEQ ID NO: 67953 - DNA, 25 bp, mus musculus
agtttgacaggcattactgtggcaa

SEQ ID NO: 67954 - DNA, 25 bp, mus musculus
taacgcatacacaactacttgtctt

SEQ ID NO: 67955 - DNA, 25 bp, mus musculus
acgcatacacaactacttgtcttct

SEQ ID NO: 67956 - DNA, 25 bp, mus musculus
cgcatacacaactacttgtcttctg

SEQ ID NO: 67957 - DNA, 25 bp, mus musculus
gcatacacaactacttgtcttctgg

SEQ ID NO: 67958 - DNA, 25 bp, mus musculus
catacacaactacttgtcttctggt

SEQ ID NO: 67959 - DNA, 25 bp, mus musculus
tgaagcagtaagcgccgccgaggac

SEQ ID NO: 67960 - DNA, 25 bp, mus musculus
aagcagtaagcgccgccgaggactc

SEQ ID NO: 67961 - DNA, 25 bp, mus musculus
agcagtaagcgccgccgaggactca

SEQ ID NO: 67962 - DNA, 25 bp, mus musculus
cagtaagcgccgccgaggactcagc

SEQ ID NO: 67963 - DNA, 25 bp, mus musculus
agtaagcgccgccgaggactcagct

SEQ ID NO: 67964 - DNA, 25 bp, mus musculus
gtttgacaggcattactgtggcaag

SEQ ID NO: 67965 - DNA, 25 bp, mus musculus
aggcattactgtggcaagtgttgtc

SEQ ID NO: 67966 - DNA, 25 bp, mus musculus
cattactgtggcaagtgttgtctga

SEQ ID NO: 67967 - DNA, 25 bp, mus musculus
actgtggcaagtgttgtctgacttc

SEQ ID NO: 67968 - DNA, 25 bp, mus musculus
tttattaacgcatacacaactactt

SEQ ID NO: 67969 - DNA, 25 bp, mus musculus
tattaacgcatacacaactacttgt

SEQ ID NO: 67970 - DNA, 25 bp, mus musculus
attaacgcatacacaactacttgtc

SEQ ID NO: 67971 - DNA, 25 bp, mus musculus
ttaacgcatacacaactacttgtct

SEQ ID NO: 67972 - DNA, 25 bp, mus musculus
ctcagtcggcggaagacccttctag

SEQ ID NO: 67973 - DNA, 25 bp, mus musculus
cggaagacccttctagtagtcacat

SEQ ID NO: 67974 - DNA, 25 bp, mus musculus
gccattttggtctcaaaatgagagg

SEQ ID NO: 67975 - DNA, 25 bp, mus musculus
tcaaataacgtgttccctggccatc

SEQ ID NO: 67976 - DNA, 25 bp, mus musculus
aacgtgttccctggccatctgaaga

SEQ ID NO: 67977 - DNA, 25 bp, mus musculus
ttccctggccatctgaagactagag

SEQ ID NO: 67978 - DNA, 25 bp, mus musculus
actagagccagtatgcaggtgtcac

SEQ ID NO: 67979 - DNA, 25 bp, mus musculus
aagccggtgatgtcttcaggattca

SEQ ID NO: 67980 - DNA, 25 bp, mus musculus
atgtcttcaggattcaagtttccat

SEQ ID NO: 67981 - DNA, 25 bp, mus musculus
gatccctaaacctgacaatattcaa

SEQ ID NO: 67982 - DNA, 25 bp, mus musculus
taaacctgacaatattcaaattcca

SEQ ID NO: 67983 - DNA, 25 bp, mus musculus
tattcaaattccatcttttcaataa

SEQ ID NO: 67984 - DNA, 25 bp, mus musculus
aagacccttctagtagtcacatggg

SEQ ID NO: 67985 - DNA, 25 bp, mus musculus
caggttctgccatggaggaatacag

SEQ ID NO: 67986 - DNA, 25 bp, mus musculus
actttaaatcaaagcatccgagcag

SEQ ID NO: 67987 - DNA, 25 bp, mus musculus
aatcaaagcatccgagcagcatcag

SEQ ID NO: 67988 - DNA, 25 bp, mus musculus
agcatccgagcagcatcagcagcga

SEQ ID NO: 67989 - DNA, 25 bp, mus musculus
cgagcagcatcagcagcgaaagctt

SEQ ID NO: 67990 - DNA, 25 bp, mus musculus
gcatcagcagcgaaagcttccacga

SEQ ID NO: 67991 - DNA, 25 bp, mus musculus
gcggccattttggtctcaaaatgag

SEQ ID NO: 67992 - DNA, 25 bp, mus musculus
aagaggaagcccattctgtaatggg

SEQ ID NO: 67993 - DNA, 25 bp, mus musculus
aggaagcccattctgtaatggggca

SEQ ID NO: 67994 - DNA, 25 bp, mus musculus
cactgggaggctggctctggagccc

SEQ ID NO: 67995 - DNA, 25 bp, mus musculus
ccaatcctggaccctctgctgtgtc

SEQ ID NO: 67996 - DNA, 25 bp, mus musculus
ctgctgtgtctgtgacgttggtagt

SEQ ID NO: 67997 - DNA, 25 bp, mus musculus
ctgtgtctgtgacgttggtagtgcc

SEQ ID NO: 67998 - DNA, 25 bp, mus musculus
tgacgttggtagtgcctgtgatcgt

SEQ ID NO: 67999 - DNA, 25 bp, mus musculus
ctgtgatcgtgtgttgccattttgt

SEQ ID NO: 68000 - DNA, 25 bp, mus musculus
tcgtgtgttgccattttgtctgact

SEQ ID NO: 68001 - DNA, 25 bp, mus musculus
gccattttgtctgactgtggcccct

SEQ ID NO: 68002 - DNA, 25 bp, mus musculus
ctactttcctgtgccttcggtattg

SEQ ID NO: 68003 - DNA, 25 bp, mus musculus
tgtgccttcggtattgtttgaagac

SEQ ID NO: 68004 - DNA, 25 bp, mus musculus
cccattctgtaatggggcagaaaag

SEQ ID NO: 68005 - DNA, 25 bp, mus musculus
gaaatgtcccttactgactccctca

SEQ ID NO: 68006 - DNA, 25 bp, mus musculus
atgtcccttactgactccctcagaa

SEQ ID NO: 68007 - DNA, 25 bp, mus musculus
tcccttactgactccctcagaagag

SEQ ID NO: 68008 - DNA, 25 bp, mus musculus
cttactgactccctcagaagagggc

SEQ ID NO: 68009 - DNA, 25 bp, mus musculus
gactccctcagaagagggctagata

SEQ ID NO: 68010 - DNA, 25 bp, mus musculus
tccctcagaagagggctagataatc

SEQ ID NO: 68011 - DNA, 25 bp, mus musculus
tctgtcccggagcactgggaggctg

SEQ ID NO: 68012 - DNA, 25 bp, mus musculus
ctgatggaccactccaggaccactc

SEQ ID NO: 68013 - DNA, 25 bp, mus musculus
accactctccagcgggagatccacg

SEQ ID NO: 68014 - DNA, 25 bp, mus musculus
gttgtcaaccccattgtctatgcct

SEQ ID NO: 68015 - DNA, 25 bp, mus musculus
attgtctatgcctacaggaaccgag

SEQ ID NO: 68016 - DNA, 25 bp, mus musculus
cgctacagtttccacaagatcatct

SEQ ID NO: 68017 - DNA, 25 bp, mus musculus
cacaagatcatctccagatatgttc

SEQ ID NO: 68018 - DNA, 25 bp, mus musculus
atcatctccagatatgttctctgcc

SEQ ID NO: 68019 - DNA, 25 bp, mus musculus
tccagatatgttctctgccaggccg

SEQ ID NO: 68020 - DNA, 25 bp, mus musculus
tatgttctctgccaggccgagacca

SEQ ID NO: 68021 - DNA, 25 bp, mus musculus
gcgcagtctactctcagtctgggct

SEQ ID NO: 68022 - DNA, 25 bp, mus musculus
tctactctcagtctgggcttatgac

SEQ ID NO: 68023 - DNA, 25 bp, mus musculus
ctcagtctgggcttatgacctaggc

SEQ ID NO: 68024 - DNA, 25 bp, mus musculus
ctccagcgggagatccacgcagcca

SEQ ID NO: 68025 - DNA, 25 bp, mus musculus
cgggagatccacgcagccaagtcac

SEQ ID NO: 68026 - DNA, 25 bp, mus musculus
gcagccaagtcactggctatgatcg

SEQ ID NO: 68027 - DNA, 25 bp, mus musculus
atgatcgtgggcatttttgctctgt

SEQ ID NO: 68028 - DNA, 25 bp, mus musculus
atttttgctctgtgttggctcccag

SEQ ID NO: 68029 - DNA, 25 bp, mus musculus
gctctgtgttggctcccagtgcatg

SEQ ID NO: 68030 - DNA, 25 bp, mus musculus
ctcccagtgcatgccatcaactgta

SEQ ID NO: 68031 - DNA, 25 bp, mus musculus
gacaagcccaagtgggtgatgaatg

SEQ ID NO: 68032 - DNA, 25 bp, mus musculus
cagagcctaacgcagaggaagggac

SEQ ID NO: 68033 - DNA, 25 bp, mus musculus
gagcctaacgcagaggaagggacct

SEQ ID NO: 68034 - DNA, 25 bp, mus musculus
actcggatccacgaagcccaccgag

SEQ ID NO: 68035 - DNA, 25 bp, mus musculus
tcggatccacgaagcccaccgagct

SEQ ID NO: 68036 - DNA, 25 bp, mus musculus
ccgccggtctgggcagcatgagacg

SEQ ID NO: 68037 - DNA, 25 bp, mus musculus
cgccggtctgggcagcatgagacgc

SEQ ID NO: 68038 - DNA, 25 bp, mus musculus
catgagacgcgcggcgctctggctc

SEQ ID NO: 68039 - DNA, 25 bp, mus musculus
ggcgaaacctacagccctcgctcga

SEQ ID NO: 68040 - DNA, 25 bp, mus musculus
gcgaaacctacagccctcgctcgag

SEQ ID NO: 68041 - DNA, 25 bp, mus musculus
agagcaatcagcagagccggcccgg

SEQ ID NO: 68042 - DNA, 25 bp, mus musculus
aatcagcagagccggcccggagctc

SEQ ID NO: 68043 - DNA, 25 bp, mus musculus
atcagcagagccggcccggagctcc

SEQ ID NO: 68044 - DNA, 25 bp, mus musculus
caaccggcaactcggatccacgaag

SEQ ID NO: 68045 - DNA, 25 bp, mus musculus
cggcaactcggatccacgaagccca

SEQ ID NO: 68046 - DNA, 25 bp, mus musculus
ggcaactcggatccacgaagcccac

SEQ ID NO: 68047 - DNA, 25 bp, mus musculus
gagcctaacgcagaggaagggacct

SEQ ID NO: 68048 - DNA, 25 bp, mus musculus
cggcgaaacctacagccctcgctcg

SEQ ID NO: 68049 - DNA, 25 bp, mus musculus
gcaactcggatccacgaagcccacc

SEQ ID NO: 68050 - DNA, 25 bp, mus musculus
caactcggatccacgaagcccaccg

SEQ ID NO: 68051 - DNA, 25 bp, mus musculus
actcggatccacgaagcccaccgag

SEQ ID NO: 68052 - DNA, 25 bp, mus musculus
tcggatccacgaagcccaccgagct

SEQ ID NO: 68053 - DNA, 25 bp, mus musculus
cggatccacgaagcccaccgagctc

SEQ ID NO: 68054 - DNA, 25 bp, mus musculus
ggatccacgaagcccaccgagctcc

SEQ ID NO: 68055 - DNA, 25 bp, mus musculus
gatccacgaagcccaccgagctccc

SEQ ID NO: 68056 - DNA, 25 bp, mus musculus
ccgccggtctgggcagcatgagacg

SEQ ID NO: 68057 - DNA, 25 bp, mus musculus
cgccggtctgggcagcatgagacgc

SEQ ID NO: 68058 - DNA, 25 bp, mus musculus
catgagacgcgcggcgctctggctc

SEQ ID NO: 68059 - DNA, 25 bp, mus musculus
ggcgaaacctacagccctcgctcga

SEQ ID NO: 68060 - DNA, 25 bp, mus musculus
gcgaaacctacagccctcgctcgag

SEQ ID NO: 68061 - DNA, 25 bp, mus musculus
agagcaatcagcagagccggcccgg

SEQ ID NO: 68062 - DNA, 25 bp, mus musculus
aatcagcagagccggcccggagctc

SEQ ID NO: 68063 - DNA, 25 bp, mus musculus
atcagcagagccggcccggagctcc

SEQ ID NO: 68064 - DNA, 25 bp, mus musculus
caaccggcaactcggatccacgaag

SEQ ID NO: 68065 - DNA, 25 bp, mus musculus
cggcaactcggatccacgaagccca

SEQ ID NO: 68066 - DNA, 25 bp, mus musculus
ggcaactcggatccacgaagcccac

SEQ ID NO: 68067 - DNA, 25 bp, mus musculus
cattgactccctgcgaaaactgtca

SEQ ID NO: 68068 - DNA, 25 bp, mus musculus
ctccctgcgaaaactgtcaaaacat

SEQ ID NO: 68069 - DNA, 25 bp, mus musculus
agttgaccagtccctccataccaat

SEQ ID NO: 68070 - DNA, 25 bp, mus musculus
cctccataccaatgcgtcgctggat

SEQ ID NO: 68071 - DNA, 25 bp, mus musculus
caatgcgtcgctggatgccgcgagc

SEQ ID NO: 68072 - DNA, 25 bp, mus musculus
ggatgccgcgagcgaatacgctaaa

SEQ ID NO: 68073 - DNA, 25 bp, mus musculus
atacgctaaatactgcacagaaatt

SEQ ID NO: 68074 - DNA, 25 bp, mus musculus
cgctaaatactgcacagaaattttg

SEQ ID NO: 68075 - DNA, 25 bp, mus musculus
tgcagctacgccaggcacaaatatg

SEQ ID NO: 68076 - DNA, 25 bp, mus musculus
tacgccaggcacaaatatgccagct

SEQ ID NO: 68077 - DNA, 25 bp, mus musculus
gccagctacctttggacatttggca

SEQ ID NO: 68078 - DNA, 25 bp, mus musculus
agctacctttggacatttggcagga

SEQ ID NO: 68079 - DNA, 25 bp, mus musculus
ttatagagacggacaccctatcaca

SEQ ID NO: 68080 - DNA, 25 bp, mus musculus
agacggacaccctatcacagacgag

SEQ ID NO: 68081 - DNA, 25 bp, mus musculus
tatcacagacgagctgctggagaag

SEQ ID NO: 68082 - DNA, 25 bp, mus musculus
cacagacgagctgctggagaagctt

SEQ ID NO: 68083 - DNA, 25 bp, mus musculus
gcttgtggcttcgagactggtcaac

SEQ ID NO: 68084 - DNA, 25 bp, mus musculus
cacaggtcttctgacgcttcgccaa

SEQ ID NO: 68085 - DNA, 25 bp, mus musculus
tcttctgacgcttcgccaaattgtt

SEQ ID NO: 68086 - DNA, 25 bp, mus musculus
gcttcgccaaattgttttgagcaaa

SEQ ID NO: 68087 - DNA, 25 bp, mus musculus
cacggccactctgcaggtctgtggc

SEQ ID NO: 68088 - DNA, 25 bp, mus musculus
cactctgcaggtctgtggctcagcc

SEQ ID NO: 68089 - DNA, 25 bp, mus musculus
cgtttgggcagtgggtctcatccat

SEQ ID NO: 68090 - DNA, 25 bp, mus musculus
tgttcggtggttcttcatatacgag

SEQ ID NO: 68091 - DNA, 25 bp, mus musculus
atacgaggaccctgtgtgcattttc

SEQ ID NO: 68092 - DNA, 25 bp, mus musculus
ggaccctgtgtgcattttctcagtc

SEQ ID NO: 68093 - DNA, 25 bp, mus musculus
cattttctcagtcctgtagtgtgga

SEQ ID NO: 68094 - DNA, 25 bp, mus musculus
cctgtagtgtggaccctgggatctc

SEQ ID NO: 68095 - DNA, 25 bp, mus musculus
gtgtggaccctgggatctcttagac

SEQ ID NO: 68096 - DNA, 25 bp, mus musculus
cttgcccaggattgtgggttctgag

SEQ ID NO: 68097 - DNA, 25 bp, mus musculus
gcaagacatcttcaaccagtcccgt

SEQ ID NO: 68098 - DNA, 25 bp, mus musculus
tcccattgcccttgttatggtatac

SEQ ID NO: 68099 - DNA, 25 bp, mus musculus
ctgatttgtgtcctcatactcagct

SEQ ID NO: 68100 - DNA, 25 bp, mus musculus
tgtgtcctcatactcagctcagggt

SEQ ID NO: 68101 - DNA, 25 bp, mus musculus
tctctctttgtaccaatggagaacg

SEQ ID NO: 68102 - DNA, 25 bp, mus musculus
cctgggtatgccgtatgtgaacaca

SEQ ID NO: 68103 - DNA, 25 bp, mus musculus
gaacacacagacctgtttgttgctc

SEQ ID NO: 68104 - DNA, 25 bp, mus musculus
ctgtttgttgctcaaccccactgcc

SEQ ID NO: 68105 - DNA, 25 bp, mus musculus
cactgccactgtgtgcacctgactg

SEQ ID NO: 68106 - DNA, 25 bp, mus musculus
gtgcacctgactgatgagtaggatc

SEQ ID NO: 68107 - DNA, 25 bp, mus musculus
gattatcgcagcacaggaagagatg

SEQ ID NO: 68108 - DNA, 25 bp, mus musculus
gtacaagttcttgccttcagagctt

SEQ ID NO: 68109 - DNA, 25 bp, mus musculus
tgactcccaagtgcctttgcaccct

SEQ ID NO: 68110 - DNA, 25 bp, mus musculus
ctcccaagtgcctttgcaccctagg

SEQ ID NO: 68111 - DNA, 25 bp, mus musculus
agtattaacgctccaagagtattat

SEQ ID NO: 68112 - DNA, 25 bp, mus musculus
ttattaatgctgccgtacctcagtt

SEQ ID NO: 68113 - DNA, 25 bp, mus musculus
ttaatgctgccgtacctcagtttga

SEQ ID NO: 68114 - DNA, 25 bp, mus musculus
ctgccgtacctcagtttgaacctgc

SEQ ID NO: 68115 - DNA, 25 bp, mus musculus
ttgaacctgccagggccccagctgc

SEQ ID NO: 68116 - DNA, 25 bp, mus musculus
gctcaactcatccctttttgatact

SEQ ID NO: 68117 - DNA, 25 bp, mus musculus
caactcatccctttttgatactata

SEQ ID NO: 68118 - DNA, 25 bp, mus musculus
ccagctacctatggggcttgagggt

SEQ ID NO: 68119 - DNA, 25 bp, mus musculus
cttgccttcagagcttcgagacgag

SEQ ID NO: 68120 - DNA, 25 bp, mus musculus
cgagcactaaaaaagccctgtgtat

SEQ ID NO: 68121 - DNA, 25 bp, mus musculus
ctgtgcctgccactaccaaagcctt

SEQ ID NO: 68122 - DNA, 25 bp, mus musculus
tgcctgccactaccaaagccttctg

SEQ ID NO: 68123 - DNA, 25 bp, mus musculus
ctgccactaccaaagccttctgggc

SEQ ID NO: 68124 - DNA, 25 bp, mus musculus
ccaaagccttctgggctgctcagga

SEQ ID NO: 68125 - DNA, 25 bp, mus musculus
aagccttctgggctgctcaggaccc

SEQ ID NO: 68126 - DNA, 25 bp, mus musculus
gtgcctgccaaaccctgggcctggc

SEQ ID NO: 68127 - DNA, 25 bp, mus musculus
accgaagatgttcctcggaagctgc

SEQ ID NO: 68128 - DNA, 25 bp, mus musculus
gatgttcctcggaagctgctgagcc

SEQ ID NO: 68129 - DNA, 25 bp, mus musculus
cagctggacagtggcttgctgcttg

SEQ ID NO: 68130 - DNA, 25 bp, mus musculus
ttgctgcttgtgactgggcctcttg

SEQ ID NO: 68131 - DNA, 25 bp, mus musculus
ctgcttgtgactgggcctcttgtca

SEQ ID NO: 68132 - DNA, 25 bp, mus musculus
cttgtgactgggcctcttgtcatca

SEQ ID NO: 68133 - DNA, 25 bp, mus musculus
gggcctcttgtcatcaacagagttc

SEQ ID NO: 68134 - DNA, 25 bp, mus musculus
ctgcgcaagcccaggcatcaggagg

SEQ ID NO: 68135 - DNA, 25 bp, mus musculus
gagatcttcgacacagagaaggaga

SEQ ID NO: 68136 - DNA, 25 bp, mus musculus
atgtatcctcacaaactggtcttct

SEQ ID NO: 68137 - DNA, 25 bp, mus musculus
tatcctcacaaactggtcttctaaa

SEQ ID NO: 68138 - DNA, 25 bp, mus musculus
cctcacaaactggtcttctaaattg

SEQ ID NO: 68139 - DNA, 25 bp, mus musculus
ggcaagaagcccttcagccagcacg

SEQ ID NO: 68140 - DNA, 25 bp, mus musculus
aagcccttcagccagcacgtgagaa

SEQ ID NO: 68141 - DNA, 25 bp, mus musculus
cccttcagccagcacgtgagaaggc

SEQ ID NO: 68142 - DNA, 25 bp, mus musculus
agaaggctacgctccagcatcactc

SEQ ID NO: 68143 - DNA, 25 bp, mus musculus
ctgatcatcctcactgggcgccaca

SEQ ID NO: 68144 - DNA, 25 bp, mus musculus
atcatcctcactgggcgccacaggg

SEQ ID NO: 68145 - DNA, 25 bp, mus musculus
gttttcctgaagcagctggacagtg

SEQ ID NO: 68146 - DNA, 25 bp, mus musculus
ttcctgaagcagctggacagtggct

SEQ ID NO: 68147 - DNA, 25 bp, mus musculus
ctgcaggtggcaggtggttttcaag

SEQ ID NO: 68148 - DNA, 25 bp, mus musculus
tttcttgatacctgtgtaactggca

SEQ ID NO: 68149 - DNA, 25 bp, mus musculus
ttcctactgatcatttcaggaaata

SEQ ID NO: 68150 - DNA, 25 bp, mus musculus
ctactgatcatttcaggaaatatga

SEQ ID NO: 68151 - DNA, 25 bp, mus musculus
atagttcagctgttggtcttttcag

SEQ ID NO: 68152 - DNA, 25 bp, mus musculus
gttcagctgttggtcttttcagtta

SEQ ID NO: 68153 - DNA, 25 bp, mus musculus
cagctgttggtcttttcagttaagg

SEQ ID NO: 68154 - DNA, 25 bp, mus musculus
gtgatgacttctcaccatgtgattt

SEQ ID NO: 68155 - DNA, 25 bp, mus musculus
tctcaccatgtgatttgatatctgt

SEQ ID NO: 68156 - DNA, 25 bp, mus musculus
tgactgattacctcatgttcctggg

SEQ ID NO: 68157 - DNA, 25 bp, mus musculus
ctgattacctcatgttcctgggtaa

SEQ ID NO: 68158 - DNA, 25 bp, mus musculus
tgagatgcggtttctctgtgtagcc

SEQ ID NO: 68159 - DNA, 25 bp, mus musculus
cttgatacctgtgtaactggcatac

SEQ ID NO: 68160 - DNA, 25 bp, mus musculus
gtaactggcatactggggctagacc

SEQ ID NO: 68161 - DNA, 25 bp, mus musculus
ctagacctgcatgtggcagtgcaga

SEQ ID NO: 68162 - DNA, 25 bp, mus musculus
aaatgtttgtcagttctggagtagt

SEQ ID NO: 68163 - DNA, 25 bp, mus musculus
tgtttgtcagttctggagtagtctc

SEQ ID NO: 68164 - DNA, 25 bp, mus musculus
ttgtcagttctggagtagtctcgtt

SEQ ID NO: 68165 - DNA, 25 bp, mus musculus
gatgttgtagccttcctactgatca

SEQ ID NO: 68166 - DNA, 25 bp, mus musculus
gccttcctactgatcatttcaggaa

SEQ ID NO: 68167 - DNA, 25 bp, mus musculus
gattgagcaggcggcagcagcccta

SEQ ID NO: 68168 - DNA, 25 bp, mus musculus
ggcagcagccctagagattgagcta

SEQ ID NO: 68169 - DNA, 25 bp, mus musculus
ttcaagcacgagttaactgcccggt

SEQ ID NO: 68170 - DNA, 25 bp, mus musculus
cacgagttaactgcccggtcaatgt

SEQ ID NO: 68171 - DNA, 25 bp, mus musculus
gagttaactgcccggtcaatgtggt

SEQ ID NO: 68172 - DNA, 25 bp, mus musculus
cccgctcttccatcctttagcagga

SEQ ID NO: 68173 - DNA, 25 bp, mus musculus
ctcccgcacacatgttgtggagtta

SEQ ID NO: 68174 - DNA, 25 bp, mus musculus
ccgcacacatgttgtggagttaaat

SEQ ID NO: 68175 - DNA, 25 bp, mus musculus
tgtgtgtctgtagtcagtgtatgca

SEQ ID NO: 68176 - DNA, 25 bp, mus musculus
tctgtagtcagtgtatgcagacttc

SEQ ID NO: 68177 - DNA, 25 bp, mus musculus
tgcagacttcttgtgctcaccttgt

SEQ ID NO: 68178 - DNA, 25 bp, mus musculus
gtgctcaccttgttttccagattaa

SEQ ID NO: 68179 - DNA, 25 bp, mus musculus
agcagccctagagattgagctagaa

SEQ ID NO: 68180 - DNA, 25 bp, mus musculus
agaagaacgtcggcgacagaagcag

SEQ ID NO: 68181 - DNA, 25 bp, mus musculus
tgtgctggcctccaggaatatcgag

SEQ ID NO: 68182 - DNA, 25 bp, mus musculus
gctggcctccaggaatatcgagtct

SEQ ID NO: 68183 - DNA, 25 bp, mus musculus
tatcgagtctgcgctgagctgcctg

SEQ ID NO: 68184 - DNA, 25 bp, mus musculus
tgcgctgagctgcctgtctaggcag

SEQ ID NO: 68185 - DNA, 25 bp, mus musculus
accaccacagccaggttcaagcacg

SEQ ID NO: 68186 - DNA, 25 bp, mus musculus
accacagccaggttcaagcacgagt

SEQ ID NO: 68187 - DNA, 25 bp, mus musculus
acgtgttcattacaatactgagcac

SEQ ID NO: 68188 - DNA, 25 bp, mus musculus
gttcattacaatactgagcactagg

SEQ ID NO: 68189 - DNA, 25 bp, mus musculus
atactgagcactaggagcagttctc

SEQ ID NO: 68190 - DNA, 25 bp, mus musculus
tactgagcactaggagcagttctcc

SEQ ID NO: 68191 - DNA, 25 bp, mus musculus
actaggagcagttctcctcttctcc

SEQ ID NO: 68192 - DNA, 25 bp, mus musculus
ctaggagcagttctcctcttctccg

SEQ ID NO: 68193 - DNA, 25 bp, mus musculus
taggagcagttctcctcttctccga

SEQ ID NO: 68194 - DNA, 25 bp, mus musculus
aggagcagttctcctcttctccgaa

SEQ ID NO: 68195 - DNA, 25 bp, mus musculus
ggagcagttctcctcttctccgaaa

SEQ ID NO: 68196 - DNA, 25 bp, mus musculus
gagcagttctcctcttctccgaaag

SEQ ID NO: 68197 - DNA, 25 bp, mus musculus
agcagttctcctcttctccgaaagt

SEQ ID NO: 68198 - DNA, 25 bp, mus musculus
gcagttctcctcttctccgaaagtt

SEQ ID NO: 68199 - DNA, 25 bp, mus musculus
tcattacaatactgagcactaggag

SEQ ID NO: 68200 - DNA, 25 bp, mus musculus
cattacaatactgagcactaggagc

SEQ ID NO: 68201 - DNA, 25 bp, mus musculus
attacaatactgagcactaggagca

SEQ ID NO: 68202 - DNA, 25 bp, mus musculus
ttacaatactgagcactaggagcag

SEQ ID NO: 68203 - DNA, 25 bp, mus musculus
tacaatactgagcactaggagcagt

SEQ ID NO: 68204 - DNA, 25 bp, mus musculus
acaatactgagcactaggagcagtt

SEQ ID NO: 68205 - DNA, 25 bp, mus musculus
caatactgagcactaggagcagttc

SEQ ID NO: 68206 - DNA, 25 bp, mus musculus
aatactgagcactaggagcagttct

SEQ ID NO: 68207 - DNA, 25 bp, mus musculus
agctcttgaaatttcactctacgta

SEQ ID NO: 68208 - DNA, 25 bp, mus musculus
ttcactctacgtattattcgtccaa

SEQ ID NO: 68209 - DNA, 25 bp, mus musculus
tgagttccctgagcaccctttccag

SEQ ID NO: 68210 - DNA, 25 bp, mus musculus
ccctgagcaccctttccaggaagag

SEQ ID NO: 68211 - DNA, 25 bp, mus musculus
gcaccctttccaggaagagcatctc

SEQ ID NO: 68212 - DNA, 25 bp, mus musculus
agagcatctcaggcaactttataaa

SEQ ID NO: 68213 - DNA, 25 bp, mus musculus
ctttatgtgacatttccataccaga

SEQ ID NO: 68214 - DNA, 25 bp, mus musculus
gtgacatttccataccagaccttca

SEQ ID NO: 68215 - DNA, 25 bp, mus musculus
acatttccataccagaccttcagca

SEQ ID NO: 68216 - DNA, 25 bp, mus musculus
tttccataccagaccttcagcagta

SEQ ID NO: 68217 - DNA, 25 bp, mus musculus
cagaccttcagcagtactacaaatc

SEQ ID NO: 68218 - DNA, 25 bp, mus musculus
accttcagcagtactacaaatccaa

SEQ ID NO: 68219 - DNA, 25 bp, mus musculus
ctacgtattattcgtccaatctgat

SEQ ID NO: 68220 - DNA, 25 bp, mus musculus
agcagtactacaaatccaatcctgg

SEQ ID NO: 68221 - DNA, 25 bp, mus musculus
cgtattattcgtccaatctgatggc

SEQ ID NO: 68222 - DNA, 25 bp, mus musculus
attattcgtccaatctgatggcgat

SEQ ID NO: 68223 - DNA, 25 bp, mus musculus
cgtccaatctgatggcgatttgtgt

SEQ ID NO: 68224 - DNA, 25 bp, mus musculus
ccaatctgatggcgatttgtgtttt

SEQ ID NO: 68225 - DNA, 25 bp, mus musculus
tagacgacctcactaacctggtggt

SEQ ID NO: 68226 - DNA, 25 bp, mus musculus
caagaacgttcctctgcctgagttc

SEQ ID NO: 68227 - DNA, 25 bp, mus musculus
cgttcctctgcctgagttccctgag

SEQ ID NO: 68228 - DNA, 25 bp, mus musculus
cgatgccgtttccagttacaacgca

SEQ ID NO: 68229 - DNA, 25 bp, mus musculus
tgccgtttccagttacaacgcaggg

SEQ ID NO: 68230 - DNA, 25 bp, mus musculus
atggcattacctctcctatcagctt

SEQ ID NO: 68231 - DNA, 25 bp, mus musculus
agactgactgcctactcacacagaa

SEQ ID NO: 68232 - DNA, 25 bp, mus musculus
actgcctactcacacagaagctcat

SEQ ID NO: 68233 - DNA, 25 bp, mus musculus
gcctactcacacagaagctcatcga

SEQ ID NO: 68234 - DNA, 25 bp, mus musculus
tactcacacagaagctcatcgagac

SEQ ID NO: 68235 - DNA, 25 bp, mus musculus
cacagaagctcatcgagacgctgtt

SEQ ID NO: 68236 - DNA, 25 bp, mus musculus
agaagctcatcgagacgctgttgcc

SEQ ID NO: 68237 - DNA, 25 bp, mus musculus
agctcatcgagacgctgttgccctt

SEQ ID NO: 68238 - DNA, 25 bp, mus musculus
tcgagacgctgttgccctttggggt

SEQ ID NO: 68239 - DNA, 25 bp, mus musculus
aggaactgcagcgcaggattttaat

SEQ ID NO: 68240 - DNA, 25 bp, mus musculus
ttccagttacaacgcagggatcaca

SEQ ID NO: 68241 - DNA, 25 bp, mus musculus
cagttacaacgcagggatcacaaca

SEQ ID NO: 68242 - DNA, 25 bp, mus musculus
ttacaacgcagggatcacaacaaac

SEQ ID NO: 68243 - DNA, 25 bp, mus musculus
agggatcacaacaaacgcagccacc

SEQ ID NO: 68244 - DNA, 25 bp, mus musculus
gatcacaacaaacgcagccaccaca

SEQ ID NO: 68245 - DNA, 25 bp, mus musculus
cgcagccaccacagaggcactatgg

SEQ ID NO: 68246 - DNA, 25 bp, mus musculus
caccacagaggcactatggcattac

SEQ ID NO: 68247 - DNA, 25 bp, mus musculus
actatggcattacctctcctatcag

SEQ ID NO: 68248 - DNA, 25 bp, mus musculus
gtggatgacactcctgcagaacaga

SEQ ID NO: 68249 - DNA, 25 bp, mus musculus
ggatgacactcctgcagaacagatg

SEQ ID NO: 68250 - DNA, 25 bp, mus musculus
agtcctgttgcctgcgagcaaaaat

SEQ ID NO: 68251 - DNA, 25 bp, mus musculus
tcctgttgcctgcgagcaaaaattg

SEQ ID NO: 68252 - DNA, 25 bp, mus musculus
ctgttgcctgcgagcaaaaattgac

SEQ ID NO: 68253 - DNA, 25 bp, mus musculus
cgaccctttaccgatgcagaatcca

SEQ ID NO: 68254 - DNA, 25 bp, mus musculus
accctttaccgatgcagaatccagg

SEQ ID NO: 68255 - DNA, 25 bp, mus musculus
cctttaccgatgcagaatccaggcc

SEQ ID NO: 68256 - DNA, 25 bp, mus musculus
tttaccgatgcagaatccaggccca

SEQ ID NO: 68257 - DNA, 25 bp, mus musculus
taccgatgcagaatccaggcccacc

SEQ ID NO: 68258 - DNA, 25 bp, mus musculus
tacaatgtttatccaacatatgact

SEQ ID NO: 68259 - DNA, 25 bp, mus musculus
gtttatccaacatatgactttgcct

SEQ ID NO: 68260 - DNA, 25 bp, mus musculus
atgacactcctgcagaacagatgaa

SEQ ID NO: 68261 - DNA, 25 bp, mus musculus
cactcctgcagaacagatgaaggcg

SEQ ID NO: 68262 - DNA, 25 bp, mus musculus
ctcctgcagaacagatgaaggcgga

SEQ ID NO: 68263 - DNA, 25 bp, mus musculus
agaatccaaacacaggaagaactct

SEQ ID NO: 68264 - DNA, 25 bp, mus musculus
aatccaaacacaggaagaactctgt

SEQ ID NO: 68265 - DNA, 25 bp, mus musculus
gccagtttggtcagtcctgttgcct

SEQ ID NO: 68266 - DNA, 25 bp, mus musculus
ttggtcagtcctgttgcctgcgagc

SEQ ID NO: 68267 - DNA, 25 bp, mus musculus
tcagtcctgttgcctgcgagcaaaa

SEQ ID NO: 68268 - DNA, 25 bp, mus musculus
ccagagctcacaggccagtggtgag

SEQ ID NO: 68269 - DNA, 25 bp, mus musculus
agcccagctggccttcatgcgagtg

SEQ ID NO: 68270 - DNA, 25 bp, mus musculus
tgctgcccgcaatgaaaagggctac

SEQ ID NO: 68271 - DNA, 25 bp, mus musculus
tgccacacaagtgaggtggttgcaa

SEQ ID NO: 68272 - DNA, 25 bp, mus musculus
agacagctctggcaccaagccagcc

SEQ ID NO: 68273 - DNA, 25 bp, mus musculus
ctctggcaccaagccagccagcaag

SEQ ID NO: 68274 - DNA, 25 bp, mus musculus
cagcaagcggcccatgtcgtctcca

SEQ ID NO: 68275 - DNA, 25 bp, mus musculus
gcggcccatgtcgtctccagaaatg

SEQ ID NO: 68276 - DNA, 25 bp, mus musculus
catgtcgtctccagaaatgaaatct

SEQ ID NO: 68277 - DNA, 25 bp, mus musculus
gaaatctgctccaaagaagtctaag

SEQ ID NO: 68278 - DNA, 25 bp, mus musculus
tgctccaaagaagtctaaggctgat

SEQ ID NO: 68279 - DNA, 25 bp, mus musculus
aagctggccagcaactggatcctcc

SEQ ID NO: 68280 - DNA, 25 bp, mus musculus
gctggccttcatgcgagtgtactgt

SEQ ID NO: 68281 - DNA, 25 bp, mus musculus
ttcctgcctagtgcagtcctccagc

SEQ ID NO: 68282 - DNA, 25 bp, mus musculus
caacgcccacattgactatactaca

SEQ ID NO: 68283 - DNA, 25 bp, mus musculus
ccacattgactatactacaaagcct

SEQ ID NO: 68284 - DNA, 25 bp, mus musculus
tactacaaagcctgccatcatcttc

SEQ ID NO: 68285 - DNA, 25 bp, mus musculus
aaagcctgccatcatcttccgcatt

SEQ ID NO: 68286 - DNA, 25 bp, mus musculus
tgccatcatcttccgcattgctgcc

SEQ ID NO: 68287 - DNA, 25 bp, mus musculus
catcttccgcattgctgcccgcaat

SEQ ID NO: 68288 - DNA, 25 bp, mus musculus
gaactcaagcatccagtgtgtcagc

SEQ ID NO: 68289 - DNA, 25 bp, mus musculus
aagcatccagtgtgtcagcaataca

SEQ ID NO: 68290 - DNA, 25 bp, mus musculus
caggacaaatcccattggtatgaaa

SEQ ID NO: 68291 - DNA, 25 bp, mus musculus
gacaaatcccattggtatgaaaggc

SEQ ID NO: 68292 - DNA, 25 bp, mus musculus
aatgttatggcgatttggtgcaaga

SEQ ID NO: 68293 - DNA, 25 bp, mus musculus
taaagctccggtggaccatagcaaa

SEQ ID NO: 68294 - DNA, 25 bp, mus musculus
agctccggtggaccatagcaaaata

SEQ ID NO: 68295 - DNA, 25 bp, mus musculus
atgctcccaggtttaatggattcca

SEQ ID NO: 68296 - DNA, 25 bp, mus musculus
ttaatggattccagcaacaagactc

SEQ ID NO: 68297 - DNA, 25 bp, mus musculus
gattccagcaacaagactcccaaga

SEQ ID NO: 68298 - DNA, 25 bp, mus musculus
tccagcaacaagactcccaagaact

SEQ ID NO: 68299 - DNA, 25 bp, mus musculus
tggctttcctcttggatggtcttca

SEQ ID NO: 68300 - DNA, 25 bp, mus musculus
catccagtgtgtcagcaatacacaa

SEQ ID NO: 68301 - DNA, 25 bp, mus musculus
tcctcttggatggtcttcatgaaga

SEQ ID NO: 68302 - DNA, 25 bp, mus musculus
cagcaatacacaaccactgacacag

SEQ ID NO: 68303 - DNA, 25 bp, mus musculus
caatacacaaccactgacacagtac

SEQ ID NO: 68304 - DNA, 25 bp, mus musculus
acaaccactgacacagtactttatc

SEQ ID NO: 68305 - DNA, 25 bp, mus musculus
actgacacagtactttatctcaggg

SEQ ID NO: 68306 - DNA, 25 bp, mus musculus
acagtactttatctcagggaggcat

SEQ ID NO: 68307 - DNA, 25 bp, mus musculus
gtactttatctcagggaggcatctt

SEQ ID NO: 68308 - DNA, 25 bp, mus musculus
ttatgaactcaacaggacaaatccc

SEQ ID NO: 68309 - DNA, 25 bp, mus musculus
ctgcacagccaggagtgtacaacaa

SEQ ID NO: 68310 - DNA, 25 bp, mus musculus
acaacaacatgagcatcaccgtgtc

SEQ ID NO: 68311 - DNA, 25 bp, mus musculus
ttctcaaaacagacgcagatggaaa

SEQ ID NO: 68312 - DNA, 25 bp, mus musculus
tcttctctgtggtgactacagacta

SEQ ID NO: 68313 - DNA, 25 bp, mus musculus
gttcaggtgtttgctgacgtccagt

SEQ ID NO: 68314 - DNA, 25 bp, mus musculus
gtgtttgctgacgtccagtgtacag

SEQ ID NO: 68315 - DNA, 25 bp, mus musculus
cagcagaagagcctccttcagcagc

SEQ ID NO: 68316 - DNA, 25 bp, mus musculus
ctccttcagcagctactgactgaat

SEQ ID NO: 68317 - DNA, 25 bp, mus musculus
tttttgatatctcaatctgcagcca

SEQ ID NO: 68318 - DNA, 25 bp, mus musculus
atatctcaatctgcagccattcttc

SEQ ID NO: 68319 - DNA, 25 bp, mus musculus
caatctgcagccattcttcagatcg

SEQ ID NO: 68320 - DNA, 25 bp, mus musculus
gcagccattcttcagatcgtagcat

SEQ ID NO: 68321 - DNA, 25 bp, mus musculus
atccaatgatgggccagatgcaaat

SEQ ID NO: 68322 - DNA, 25 bp, mus musculus
ttcttcagatcgtagcatttggagc

SEQ ID NO: 68323 - DNA, 25 bp, mus musculus
tgcaaatgagctctctgcagatgcc

SEQ ID NO: 68324 - DNA, 25 bp, mus musculus
tgagctctctgcagatgccagggat

SEQ ID NO: 68325 - DNA, 25 bp, mus musculus
tgaatactgtgtgctctgagcagat

SEQ ID NO: 68326 - DNA, 25 bp, mus musculus
ctgtgtgctctgagcagatgaatga

SEQ ID NO: 68327 - DNA, 25 bp, mus musculus
atccagcactgagacacacaggcct

SEQ ID NO: 68328 - DNA, 25 bp, mus musculus
cactgagacacacaggcctctactg

SEQ ID NO: 68329 - DNA, 25 bp, mus musculus
gacacacaggcctctactgcaacca

SEQ ID NO: 68330 - DNA, 25 bp, mus musculus
tggttctttctgtcaccagagacat

SEQ ID NO: 68331 - DNA, 25 bp, mus musculus
tcaccagagacatttccctctgaca

SEQ ID NO: 68332 - DNA, 25 bp, mus musculus
gtcttgtctgctgtaccagctggga

SEQ ID NO: 68333 - DNA, 25 bp, mus musculus
tctgctgtaccagctgggaagaaac

SEQ ID NO: 68334 - DNA, 25 bp, mus musculus
ttcatctgtcagctttggctaagct

SEQ ID NO: 68335 - DNA, 25 bp, mus musculus
tgtcagctttggctaagctctgaac

SEQ ID NO: 68336 - DNA, 25 bp, mus musculus
ctaagctctgaacatcttttgcttc

SEQ ID NO: 68337 - DNA, 25 bp, mus musculus
tctgaacatcttttgcttcctgtaa

SEQ ID NO: 68338 - DNA, 25 bp, mus musculus
aaaccaccatgcttgtttcttgctc

SEQ ID NO: 68339 - DNA, 25 bp, mus musculus
ccatgcttgtttcttgctctcacaa

SEQ ID NO: 68340 - DNA, 25 bp, mus musculus
ttgtttcttgctctcacaataaatt

SEQ ID NO: 68341 - DNA, 25 bp, mus musculus
cttgctctcacaataaattccacat

SEQ ID NO: 68342 - DNA, 25 bp, mus musculus
gagacatttccctctgacatctact

SEQ ID NO: 68343 - DNA, 25 bp, mus musculus
tcacaataaattccacattcatagc

SEQ ID NO: 68344 - DNA, 25 bp, mus musculus
tctgacatctactttaaagggagat

SEQ ID NO: 68345 - DNA, 25 bp, mus musculus
tctcaatatacacagtgcaagttgc

SEQ ID NO: 68346 - DNA, 25 bp, mus musculus
tatacacagtgcaagttgcaagggc

SEQ ID NO: 68347 - DNA, 25 bp, mus musculus
ttacacaatgatttgtccttgaaac

SEQ ID NO: 68348 - DNA, 25 bp, mus musculus
ttgtccttgaaactctcagaataag

SEQ ID NO: 68349 - DNA, 25 bp, mus musculus
cggtttttccacagcgcattctgca

SEQ ID NO: 68350 - DNA, 25 bp, mus musculus
atcatgcttccatggaggataatag

SEQ ID NO: 68351 - DNA, 25 bp, mus musculus
ttcccaacatcatagtctccaaaag

SEQ ID NO: 68352 - DNA, 25 bp, mus musculus
tcccaacatcatagtctccaaaagc

SEQ ID NO: 68353 - DNA, 25 bp, mus musculus
cccgctctccaatacataagagaac

SEQ ID NO: 68354 - DNA, 25 bp, mus musculus
ccgctctccaatacataagagaaca

SEQ ID NO: 68355 - DNA, 25 bp, mus musculus
gctctccaatacataagagaacaca

SEQ ID NO: 68356 - DNA, 25 bp, mus musculus
ctctccaatacataagagaacacat

SEQ ID NO: 68357 - DNA, 25 bp, mus musculus
aatcaatgtgccaaagtcttttcca

SEQ ID NO: 68358 - DNA, 25 bp, mus musculus
atcaatgtgccaaagtcttttccag

SEQ ID NO: 68359 - DNA, 25 bp, mus musculus
atgtgccaaagtcttttccaggcct

SEQ ID NO: 68360 - DNA, 25 bp, mus musculus
tgtgccaaagtcttttccaggccta

SEQ ID NO: 68361 - DNA, 25 bp, mus musculus
gtgccaaagtcttttccaggcctag

SEQ ID NO: 68362 - DNA, 25 bp, mus musculus
tgccaaagtcttttccaggcctagt

SEQ ID NO: 68363 - DNA, 25 bp, mus musculus
ccaacatcatagtctccaaaagcat

SEQ ID NO: 68364 - DNA, 25 bp, mus musculus
aaagcagtgatctccagaagcatag

SEQ ID NO: 68365 - DNA, 25 bp, mus musculus
agcagtgatctccagaagcatagaa

SEQ ID NO: 68366 - DNA, 25 bp, mus musculus
cagtgatctccagaagcatagaaga

SEQ ID NO: 68367 - DNA, 25 bp, mus musculus
agtgatctccagaagcatagaagaa

SEQ ID NO: 68368 - DNA, 25 bp, mus musculus
gtgatctccagaagcatagaagaat

SEQ ID NO: 68369 - DNA, 25 bp, mus musculus
tgatctccagaagcatagaagaata

SEQ ID NO: 68370 - DNA, 25 bp, mus musculus
acccgctctccaatacataagagaa

SEQ ID NO: 68371 - DNA, 25 bp, mus musculus
tgcacagtctgtcaccttggtcgct

SEQ ID NO: 68372 - DNA, 25 bp, mus musculus
caccttggtcgctggcctgacttcc

SEQ ID NO: 68373 - DNA, 25 bp, mus musculus
ataccatatcttgaacattctggac

SEQ ID NO: 68374 - DNA, 25 bp, mus musculus
tatcttgaacattctggacagattc

SEQ ID NO: 68375 - DNA, 25 bp, mus musculus
gcttgtctgttttatcagtggcaac

SEQ ID NO: 68376 - DNA, 25 bp, mus musculus
tggcaactatttaccagttgaaaag

SEQ ID NO: 68377 - DNA, 25 bp, mus musculus
aatattcatctgaccagttttctct

SEQ ID NO: 68378 - DNA, 25 bp, mus musculus
catctgaccagttttctcttaaagc

SEQ ID NO: 68379 - DNA, 25 bp, mus musculus
tttctcttaaagccatttccataat

SEQ ID NO: 68380 - DNA, 25 bp, mus musculus
ttaaagccatttccataatgacaat

SEQ ID NO: 68381 - DNA, 25 bp, mus musculus
ccatttccataatgacaataatgat

SEQ ID NO: 68382 - DNA, 25 bp, mus musculus
tttatttcagtcactcctgataata

SEQ ID NO: 68383 - DNA, 25 bp, mus musculus
cacggttcgccgtcgtatgatgatg

SEQ ID NO: 68384 - DNA, 25 bp, mus musculus
tatcatgtacacaggcacgcttgac

SEQ ID NO: 68385 - DNA, 25 bp, mus musculus
aggcacgcttgactgctggcggaag

SEQ ID NO: 68386 - DNA, 25 bp, mus musculus
gcttgactgctggcggaagatcgcg

SEQ ID NO: 68387 - DNA, 25 bp, mus musculus
tttcaagggcgcatggtccaacgtt

SEQ ID NO: 68388 - DNA, 25 bp, mus musculus
atggtccaacgttctcagaggcatg

SEQ ID NO: 68389 - DNA, 25 bp, mus musculus
cgcctttgtgcttgtcttgtatgat

SEQ ID NO: 68390 - DNA, 25 bp, mus musculus
tgtgcttgtcttgtatgatgagatc

SEQ ID NO: 68391 - DNA, 25 bp, mus musculus
ttatttcattgtcttctccaaatac

SEQ ID NO: 68392 - DNA, 25 bp, mus musculus
cattgtcttctccaaatacaaagta

SEQ ID NO: 68393 - DNA, 25 bp, mus musculus
tacagtgcccttttcattttagctt

SEQ ID NO: 68394 - DNA, 25 bp, mus musculus
ctattcttcaaatccctcgcttgtc

SEQ ID NO: 68395 - DNA, 25 bp, mus musculus
ttcttcaaatccctcgcttgtcatt

SEQ ID NO: 68396 - DNA, 25 bp, mus musculus
aaatccctcgcttgtcattggctct

SEQ ID NO: 68397 - DNA, 25 bp, mus musculus
tgtcattggctcttgcgtgtcagtt

SEQ ID NO: 68398 - DNA, 25 bp, mus musculus
tgtcagctctgttaaggttgaactt

SEQ ID NO: 68399 - DNA, 25 bp, mus musculus
aaagcacttttgttattccatcaat

SEQ ID NO: 68400 - DNA, 25 bp, mus musculus
gcacttttgttattccatcaataaa

SEQ ID NO: 68401 - DNA, 25 bp, mus musculus
cttttgttattccatcaataaatgc

SEQ ID NO: 68402 - DNA, 25 bp, mus musculus
ttattccatcaataaatgcttcatt

SEQ ID NO: 68403 - DNA, 25 bp, mus musculus
tgtcttctccaaatacaaagtaaat

SEQ ID NO: 68404 - DNA, 25 bp, mus musculus
tattccatcaataaatgcttcattt

SEQ ID NO: 68405 - DNA, 25 bp, mus musculus
atcttgtattcattctttgacatgc

SEQ ID NO: 68406 - DNA, 25 bp, mus musculus
tcattctttgacatgcattgttggc

SEQ ID NO: 68407 - DNA, 25 bp, mus musculus
ttctttgacatgcattgttggctat

SEQ ID NO: 68408 - DNA, 25 bp, mus musculus
tacagttcctttccatcattttaca

SEQ ID NO: 68409 - DNA, 25 bp, mus musculus
agttcctttccatcattttacagtg

SEQ ID NO: 68410 - DNA, 25 bp, mus musculus
tttccatcattttacagtgcccttt

SEQ ID NO: 68411 - DNA, 25 bp, mus musculus
ccatcattttacagtgcccttttca

SEQ ID NO: 68412 - DNA, 25 bp, mus musculus
tgccttaaccctactaaagcatgat

SEQ ID NO: 68413 - DNA, 25 bp, mus musculus
cttaaccctactaaagcatgatgct

SEQ ID NO: 68414 - DNA, 25 bp, mus musculus
gactgccattcaggatattgtcttt

SEQ ID NO: 68415 - DNA, 25 bp, mus musculus
aaatctaagatgctcccagcaaaga

SEQ ID NO: 68416 - DNA, 25 bp, mus musculus
tctaagatgctcccagcaaagaaga

SEQ ID NO: 68417 - DNA, 25 bp, mus musculus
aagatgctcccagcaaagaagaaag

SEQ ID NO: 68418 - DNA, 25 bp, mus musculus
atgctcccagcaaagaagaaagaac

SEQ ID NO: 68419 - DNA, 25 bp, mus musculus
gaaatgctgtgccaggcatctctaa

SEQ ID NO: 68420 - DNA, 25 bp, mus musculus
caggcatctctaagctctaccctta

SEQ ID NO: 68421 - DNA, 25 bp, mus musculus
gcatctctaagctctacccttactc

SEQ ID NO: 68422 - DNA, 25 bp, mus musculus
tctctaagctctacccttactctgt

SEQ ID NO: 68423 - DNA, 25 bp, mus musculus
ctaagctctacccttactctgtgtg

SEQ ID NO: 68424 - DNA, 25 bp, mus musculus
aaccctactaaagcatgatgctttt

SEQ ID NO: 68425 - DNA, 25 bp, mus musculus
cctactaaagcatgatgcttttcaa

SEQ ID NO: 68426 - DNA, 25 bp, mus musculus
ctacttcctgagaagactccaactt

SEQ ID NO: 68427 - DNA, 25 bp, mus musculus
cttcctgagaagactccaactttga

SEQ ID NO: 68428 - DNA, 25 bp, mus musculus
cctgagaagactccaactttgaaat

SEQ ID NO: 68429 - DNA, 25 bp, mus musculus
ttgaaataaacctgcgactgccatt

SEQ ID NO: 68430 - DNA, 25 bp, mus musculus
acctgcgactgccattcaggatatt

SEQ ID NO: 68431 - DNA, 25 bp, mus musculus
tgcgactgccattcaggatattgtc

SEQ ID NO: 68432 - DNA, 25 bp, mus musculus
aaacccttctatgttatcatagctc

SEQ ID NO: 68433 - DNA, 25 bp, mus musculus
ttctatgttatcatagctcagacag

SEQ ID NO: 68434 - DNA, 25 bp, mus musculus
gggctctctgcaccattcattgtgg

SEQ ID NO: 68435 - DNA, 25 bp, mus musculus
ccattcattgtggcagttgggacat

SEQ ID NO: 68436 - DNA, 25 bp, mus musculus
acagacacatacacttagatcaatg

SEQ ID NO: 68437 - DNA, 25 bp, mus musculus
acttagatcaatgcatcgctgtact

SEQ ID NO: 68438 - DNA, 25 bp, mus musculus
atcaatgcatcgctgtactccttga

SEQ ID NO: 68439 - DNA, 25 bp, mus musculus
gcatcgctgtactccttgaaatcag

SEQ ID NO: 68440 - DNA, 25 bp, mus musculus
ctgtactccttgaaatcagagctag

SEQ ID NO: 68441 - DNA, 25 bp, mus musculus
aaatcagagctagcttgttagaaaa

SEQ ID NO: 68442 - DNA, 25 bp, mus musculus
tgcatgtcattaatcccagcgctaa

SEQ ID NO: 68443 - DNA, 25 bp, mus musculus
aatctctgtgagttcaaggccacat

SEQ ID NO: 68444 - DNA, 25 bp, mus musculus
atagctcagacaggggcaatgggag

SEQ ID NO: 68445 - DNA, 25 bp, mus musculus
gccacttcctgctaaaattctggtc

SEQ ID NO: 68446 - DNA, 25 bp, mus musculus
ctttcccagttcctctgtccttcat

SEQ ID NO: 68447 - DNA, 25 bp, mus musculus
cagttcctctgtccttcatggggtt

SEQ ID NO: 68448 - DNA, 25 bp, mus musculus
gcacacagcatcccagagctatgct

SEQ ID NO: 68449 - DNA, 25 bp, mus musculus
agcatcccagagctatgctaactga

SEQ ID NO: 68450 - DNA, 25 bp, mus musculus
tcagcactgaaggcccacatgagga

SEQ ID NO: 68451 - DNA, 25 bp, mus musculus
ttctaaactagatgatctgggctct

SEQ ID NO: 68452 - DNA, 25 bp, mus musculus
gagacctacaatgacacactttcag

SEQ ID NO: 68453 - DNA, 25 bp, mus musculus
gacctacaatgacacactttcagta

SEQ ID NO: 68454 - DNA, 25 bp, mus musculus
acatgaaccatctagtatgcaccac

SEQ ID NO: 68455 - DNA, 25 bp, mus musculus
gaaccatctagtatgcaccacaata

SEQ ID NO: 68456 - DNA, 25 bp, mus musculus
accatctagtatgcaccacaataag

SEQ ID NO: 68457 - DNA, 25 bp, mus musculus
catctagtatgcaccacaataagtg

SEQ ID NO: 68458 - DNA, 25 bp, mus musculus
tctagtatgcaccacaataagtgag

SEQ ID NO: 68459 - DNA, 25 bp, mus musculus
tagtatgcaccacaataagtgaggt

SEQ ID NO: 68460 - DNA, 25 bp, mus musculus
gtatgcaccacaataagtgaggtaa

SEQ ID NO: 68461 - DNA, 25 bp, mus musculus
taaacacttgcatgagatgtaatgg

SEQ ID NO: 68462 - DNA, 25 bp, mus musculus
atatggtacccttagctagacggca

SEQ ID NO: 68463 - DNA, 25 bp, mus musculus
cccttagctagacggcactgatata

SEQ ID NO: 68464 - DNA, 25 bp, mus musculus
cctacaatgacacactttcagtaga

SEQ ID NO: 68465 - DNA, 25 bp, mus musculus
cttagctagacggcactgatatatg

SEQ ID NO: 68466 - DNA, 25 bp, mus musculus
caatgacacactttcagtagagcat

SEQ ID NO: 68467 - DNA, 25 bp, mus musculus
atgacacactttcagtagagcatct

SEQ ID NO: 68468 - DNA, 25 bp, mus musculus
gacacactttcagtagagcatctaa

SEQ ID NO: 68469 - DNA, 25 bp, mus musculus
cacactttcagtagagcatctaatt

SEQ ID NO: 68470 - DNA, 25 bp, mus musculus
cactttcagtagagcatctaattaa

SEQ ID NO: 68471 - DNA, 25 bp, mus musculus
acccacttacggtgacatgaaccat

SEQ ID NO: 68472 - DNA, 25 bp, mus musculus
tgacatgaaccatctagtatgcacc

SEQ ID NO: 68473 - DNA, 25 bp, mus musculus
aagatacatccgcgatatggctagt

SEQ ID NO: 68474 - DNA, 25 bp, mus musculus
gatacatccgcgatatggctagtgg

SEQ ID NO: 68475 - DNA, 25 bp, mus musculus
tccttctgagaggcaactatcatgg

SEQ ID NO: 68476 - DNA, 25 bp, mus musculus
ggcaactatcatggtgccagttcga

SEQ ID NO: 68477 - DNA, 25 bp, mus musculus
gcaactatcatggtgccagttcgac

SEQ ID NO: 68478 - DNA, 25 bp, mus musculus
caactatcatggtgccagttcgacc

SEQ ID NO: 68479 - DNA, 25 bp, mus musculus
actatcatggtgccagttcgaccac

SEQ ID NO: 68480 - DNA, 25 bp, mus musculus
ctatcatggtgccagttcgaccacg

SEQ ID NO: 68481 - DNA, 25 bp, mus musculus
tatcatggtgccagttcgaccacgc

SEQ ID NO: 68482 - DNA, 25 bp, mus musculus
tcatggtgccagttcgaccacgcac

SEQ ID NO: 68483 - DNA, 25 bp, mus musculus
atggtgccagttcgaccacgcacac

SEQ ID NO: 68484 - DNA, 25 bp, mus musculus
ggtgccagttcgaccacgcacacat

SEQ ID NO: 68485 - DNA, 25 bp, mus musculus
atacatccgcgatatggctagtggg

SEQ ID NO: 68486 - DNA, 25 bp, mus musculus
tacatccgcgatatggctagtgggt

SEQ ID NO: 68487 - DNA, 25 bp, mus musculus
gtggaatttccttctgagaggcaac

SEQ ID NO: 68488 - DNA, 25 bp, mus musculus
tggaatttccttctgagaggcaact

SEQ ID NO: 68489 - DNA, 25 bp, mus musculus
gaatttccttctgagaggcaactat

SEQ ID NO: 68490 - DNA, 25 bp, mus musculus
aatttccttctgagaggcaactatc

SEQ ID NO: 68491 - DNA, 25 bp, mus musculus
atttccttctgagaggcaactatca

SEQ ID NO: 68492 - DNA, 25 bp, mus musculus
ttccttctgagaggcaactatcatg

SEQ ID NO: 68493 - DNA, 25 bp, mus musculus
atatgatcatctggatcctgctgaa

SEQ ID NO: 68494 - DNA, 25 bp, mus musculus
tcatctggatcctgctgaaatggaa

SEQ ID NO: 68495 - DNA, 25 bp, mus musculus
atgttatccaagcagtgggttaact

SEQ ID NO: 68496 - DNA, 25 bp, mus musculus
taaagggcccattcatcctttatgc

SEQ ID NO: 68497 - DNA, 25 bp, mus musculus
tcatcctttatgcccggtacacaca

SEQ ID NO: 68498 - DNA, 25 bp, mus musculus
tttatgcccggtacacacaacatat

SEQ ID NO: 68499 - DNA, 25 bp, mus musculus
cccggtacacacaacatatgttcag

SEQ ID NO: 68500 - DNA, 25 bp, mus musculus
gagtacactattgctgtccattgct

SEQ ID NO: 68501 - DNA, 25 bp, mus musculus
actattgctgtccattgctgctgtg

SEQ ID NO: 68502 - DNA, 25 bp, mus musculus
cattgctgctgtgaagccctagctg

SEQ ID NO: 68503 - DNA, 25 bp, mus musculus
tgctgtgaagccctagctgaatata

SEQ ID NO: 68504 - DNA, 25 bp, mus musculus
gaagccctagctgaatatagatgta

SEQ ID NO: 68505 - DNA, 25 bp, mus musculus
gtacatcagtgactccatgaactgg

SEQ ID NO: 68506 - DNA, 25 bp, mus musculus
cagtgactccatgaactggctaaac

SEQ ID NO: 68507 - DNA, 25 bp, mus musculus
ctccatgaactggctaaacagtaag

SEQ ID NO: 68508 - DNA, 25 bp, mus musculus
attaagtctcactcaagatcccgtg

SEQ ID NO: 68509 - DNA, 25 bp, mus musculus
tctcactcaagatcccgtggtaaaa

SEQ ID NO: 68510 - DNA, 25 bp, mus musculus
tcaagatcccgtggtaaaagtgtca

SEQ ID NO: 68511 - DNA, 25 bp, mus musculus
tccacccaaaggaagctcacagcac

SEQ ID NO: 68512 - DNA, 25 bp, mus musculus
aagctcacagcacaccgactccgga

SEQ ID NO: 68513 - DNA, 25 bp, mus musculus
cgttgccctgcagtcccaggcagga

SEQ ID NO: 68514 - DNA, 25 bp, mus musculus
gttgccctgcagtcccaggcaggat

SEQ ID NO: 68515 - DNA, 25 bp, mus musculus
attcagtaagctcgtgtccttccaa

SEQ ID NO: 68516 - DNA, 25 bp, mus musculus
cagtaagctcgtgtccttccaactt

SEQ ID NO: 68517 - DNA, 25 bp, mus musculus
agtaagctcgtgtccttccaacttg

SEQ ID NO: 68518 - DNA, 25 bp, mus musculus
gtaagctcgtgtccttccaacttgg

SEQ ID NO: 68519 - DNA, 25 bp, mus musculus
taagctcgtgtccttccaacttggc

SEQ ID NO: 68520 - DNA, 25 bp, mus musculus
tcgtgtccttccaacttggccgaag

SEQ ID NO: 68521 - DNA, 25 bp, mus musculus
gtgtccttccaacttggccgaagag

SEQ ID NO: 68522 - DNA, 25 bp, mus musculus
tgtccttccaacttggccgaagagc

SEQ ID NO: 68523 - DNA, 25 bp, mus musculus
gtccttccaacttggccgaagagca

SEQ ID NO: 68524 - DNA, 25 bp, mus musculus
tccttccaacttggccgaagagcaa

SEQ ID NO: 68525 - DNA, 25 bp, mus musculus
ttgccctgcagtcccaggcaggatg

SEQ ID NO: 68526 - DNA, 25 bp, mus musculus
tgccctgcagtcccaggcaggatgg

SEQ ID NO: 68527 - DNA, 25 bp, mus musculus
gccctgcagtcccaggcaggatgga

SEQ ID NO: 68528 - DNA, 25 bp, mus musculus
tagttcatgagattccgggattcag

SEQ ID NO: 68529 - DNA, 25 bp, mus musculus
agttcatgagattccgggattcagt

SEQ ID NO: 68530 - DNA, 25 bp, mus musculus
catgagattccgggattcagtaagc

SEQ ID NO: 68531 - DNA, 25 bp, mus musculus
atgagattccgggattcagtaagct

SEQ ID NO: 68532 - DNA, 25 bp, mus musculus
tgagattccgggattcagtaagctc

SEQ ID NO: 68533 - DNA, 25 bp, mus musculus
cacccctaaaccattttgacatgtg

SEQ ID NO: 68534 - DNA, 25 bp, mus musculus
taaaccattttgacatgtgcgcatg

SEQ ID NO: 68535 - DNA, 25 bp, mus musculus
tgatctacgaacgcatgaaaccagt

SEQ ID NO: 68536 - DNA, 25 bp, mus musculus
tctacgaacgcatgaaaccagtctc

SEQ ID NO: 68537 - DNA, 25 bp, mus musculus
gcatgaaaccagtctcctgttcctg

SEQ ID NO: 68538 - DNA, 25 bp, mus musculus
tgaaaccagtctcctgttcctgctc

SEQ ID NO: 68539 - DNA, 25 bp, mus musculus
aaccagtctcctgttcctgctctac

SEQ ID NO: 68540 - DNA, 25 bp, mus musculus
cctgttcctgctctacgaatgtccc

SEQ ID NO: 68541 - DNA, 25 bp, mus musculus
gttcctgctctacgaatgtcccttc

SEQ ID NO: 68542 - DNA, 25 bp, mus musculus
cctgctctacgaatgtcccttcggt

SEQ ID NO: 68543 - DNA, 25 bp, mus musculus
gctctacgaatgtcccttcggttgc

SEQ ID NO: 68544 - DNA, 25 bp, mus musculus
atgtcccttcggttgctaagaagat

SEQ ID NO: 68545 - DNA, 25 bp, mus musculus
accattttgacatgtgcgcatggtg

SEQ ID NO: 68546 - DNA, 25 bp, mus musculus
ccccaagaaagcctgctcaggatcc

SEQ ID NO: 68547 - DNA, 25 bp, mus musculus
gaaagcctgctcaggatccggtccc

SEQ ID NO: 68548 - DNA, 25 bp, mus musculus
agcctgctcaggatccggtcccagg

SEQ ID NO: 68549 - DNA, 25 bp, mus musculus
caggtttatgaccacacttcgttgt

SEQ ID NO: 68550 - DNA, 25 bp, mus musculus
gtttatgaccacacttcgttgtgat

SEQ ID NO: 68551 - DNA, 25 bp, mus musculus
cacacttcgttgtgatctacgaacg

SEQ ID NO: 68552 - DNA, 25 bp, mus musculus
acttcgttgtgatctacgaacgcat

SEQ ID NO: 68553 - DNA, 25 bp, mus musculus
ggctgcaacatagacctgcggtaag

SEQ ID NO: 68554 - DNA, 25 bp, mus musculus
gctgcaacatagacctgcggtaagg

SEQ ID NO: 68555 - DNA, 25 bp, mus musculus
tagacctgcggtaaggcaaggtgct

SEQ ID NO: 68556 - DNA, 25 bp, mus musculus
acctgcggtaaggcaaggtgctggt

SEQ ID NO: 68557 - DNA, 25 bp, mus musculus
tagcacaggggccaccaattaggca

SEQ ID NO: 68558 - DNA, 25 bp, mus musculus
agcacaggggccaccaattaggcaa

SEQ ID NO: 68559 - DNA, 25 bp, mus musculus
gcacaggggccaccaattaggcaag

SEQ ID NO: 68560 - DNA, 25 bp, mus musculus
cacaggggccaccaattaggcaagg

SEQ ID NO: 68561 - DNA, 25 bp, mus musculus
ggccaccaattaggcaaggtcgttg

SEQ ID NO: 68562 - DNA, 25 bp, mus musculus
gccaccaattaggcaaggtcgttgg

SEQ ID NO: 68563 - DNA, 25 bp, mus musculus
ctgcaacatagacctgcggtaaggc

SEQ ID NO: 68564 - DNA, 25 bp, mus musculus
tgcaacatagacctgcggtaaggca

SEQ ID NO: 68565 - DNA, 25 bp, mus musculus
gcaacatagacctgcggtaaggcaa

SEQ ID NO: 68566 - DNA, 25 bp, mus musculus
caacatagacctgcggtaaggcaag

SEQ ID NO: 68567 - DNA, 25 bp, mus musculus
aacatagacctgcggtaaggcaagg

SEQ ID NO: 68568 - DNA, 25 bp, mus musculus
acatagacctgcggtaaggcaaggt

SEQ ID NO: 68569 - DNA, 25 bp, mus musculus
catagacctgcggtaaggcaaggtg

SEQ ID NO: 68570 - DNA, 25 bp, mus musculus
atagacctgcggtaaggcaaggtgc

SEQ ID NO: 68571 - DNA, 25 bp, mus musculus
aacagccacgagatttctgtactat

SEQ ID NO: 68572 - DNA, 25 bp, mus musculus
atttctgtactatgaaatgggctac

SEQ ID NO: 68573 - DNA, 25 bp, mus musculus
tgttcagcgtgtcctagagagtatc

SEQ ID NO: 68574 - DNA, 25 bp, mus musculus
ggacgaaaacacactgcatgaaatt

SEQ ID NO: 68575 - DNA, 25 bp, mus musculus
tgaaattctctgcgaagtagatttg

SEQ ID NO: 68576 - DNA, 25 bp, mus musculus
gcacgagtttctgcagctgatgagc

SEQ ID NO: 68577 - DNA, 25 bp, mus musculus
gtttctgcagctgatgagcgcagtt

SEQ ID NO: 68578 - DNA, 25 bp, mus musculus
ggtctctggaagccgacttgccatc

SEQ ID NO: 68579 - DNA, 25 bp, mus musculus
ccgacttgccatcctgatgaaaact

SEQ ID NO: 68580 - DNA, 25 bp, mus musculus
tgccatcctgatgaaaactgccgag

SEQ ID NO: 68581 - DNA, 25 bp, mus musculus
aggacagccagcgctatgtacaacc

SEQ ID NO: 68582 - DNA, 25 bp, mus musculus
agtggatctcgtagctgcctttttt

SEQ ID NO: 68583 - DNA, 25 bp, mus musculus
gggctacaagtctcgaacagaacaa

SEQ ID NO: 68584 - DNA, 25 bp, mus musculus
tcgaacagaacaacttacagatagc

SEQ ID NO: 68585 - DNA, 25 bp, mus musculus
agaacaacttacagatagcactgaa

SEQ ID NO: 68586 - DNA, 25 bp, mus musculus
cactgaaatcagcctgctgccttca

SEQ ID NO: 68587 - DNA, 25 bp, mus musculus
aatcagcctgctgccttcagacatc

SEQ ID NO: 68588 - DNA, 25 bp, mus musculus
cctgctgccttcagacatcgatagg

SEQ ID NO: 68589 - DNA, 25 bp, mus musculus
gccttcagacatcgataggtacaag

SEQ ID NO: 68590 - DNA, 25 bp, mus musculus
cttcattaccattgttgatgttcag

SEQ ID NO: 68591 - DNA, 25 bp, mus musculus
cccagagcacggcgaggtacccgtg

SEQ ID NO: 68592 - DNA, 25 bp, mus musculus
attaccccagttgaactgggcatca

SEQ ID NO: 68593 - DNA, 25 bp, mus musculus
accaagctgggacgacatcgatgag

SEQ ID NO: 68594 - DNA, 25 bp, mus musculus
atgagatctggcaccaaccttctac

SEQ ID NO: 68595 - DNA, 25 bp, mus musculus
agatctggcaccaaccttctacaat

SEQ ID NO: 68596 - DNA, 25 bp, mus musculus
gatctggcaccaaccttctacaatg

SEQ ID NO: 68597 - DNA, 25 bp, mus musculus
ctggcaccaaccttctacaatgagc

SEQ ID NO: 68598 - DNA, 25 bp, mus musculus
ggcaccaaccttctacaatgagctg

SEQ ID NO: 68599 - DNA, 25 bp, mus musculus
gcaccaaccttctacaatgagctgc

SEQ ID NO: 68600 - DNA, 25 bp, mus musculus
ctgcgtgtgtccccggtagtagcac

SEQ ID NO: 68601 - DNA, 25 bp, mus musculus
caccgtgcctggcatggtttgtggc

SEQ ID NO: 68602 - DNA, 25 bp, mus musculus
tgcctggcatggtttgtggctatcc

SEQ ID NO: 68603 - DNA, 25 bp, mus musculus
ttaccccagttgaactgggcatcat

SEQ ID NO: 68604 - DNA, 25 bp, mus musculus
cagttgaactgggcatcatgcacca

SEQ ID NO: 68605 - DNA, 25 bp, mus musculus
aactgggcatcatgcaccaagctgg

SEQ ID NO: 68606 - DNA, 25 bp, mus musculus
atcatgcaccaagctgggacgacat

SEQ ID NO: 68607 - DNA, 25 bp, mus musculus
tcatgcaccaagctgggacgacatc

SEQ ID NO: 68608 - DNA, 25 bp, mus musculus
atgcaccaagctgggacgacatcga

SEQ ID NO: 68609 - DNA, 25 bp, mus musculus
tgcaccaagctgggacgacatcgat

SEQ ID NO: 68610 - DNA, 25 bp, mus musculus
caccaagctgggacgacatcgatga

SEQ ID NO: 68611 - DNA, 25 bp, mus musculus
tttgtgcctttgatatcagctgacc

SEQ ID NO: 68612 - DNA, 25 bp, mus musculus
atatcagctgaccataatgaattgt

SEQ ID NO: 68613 - DNA, 25 bp, mus musculus
ttctgatctgacactggatctgctt

SEQ ID NO: 68614 - DNA, 25 bp, mus musculus
tctgacactggatctgcttatccca

SEQ ID NO: 68615 - DNA, 25 bp, mus musculus
tctgcttatcccatttagtgtgaat

SEQ ID NO: 68616 - DNA, 25 bp, mus musculus
tatcccatttagtgtgaatattcat

SEQ ID NO: 68617 - DNA, 25 bp, mus musculus
caggctctcttgaaggttgatgtag

SEQ ID NO: 68618 - DNA, 25 bp, mus musculus
cgtatgcactgaattacctttctaa

SEQ ID NO: 68619 - DNA, 25 bp, mus musculus
cactgaattacctttctaaaatctg

SEQ ID NO: 68620 - DNA, 25 bp, mus musculus
gaacagttctcattctgaaacatct

SEQ ID NO: 68621 - DNA, 25 bp, mus musculus
ttctcattctgaaacatctagactt

SEQ ID NO: 68622 - DNA, 25 bp, mus musculus
ttctgaaacatctagacttaagggt

SEQ ID NO: 68623 - DNA, 25 bp, mus musculus
ttaaacaatcttttatgtcttgtca

SEQ ID NO: 68624 - DNA, 25 bp, mus musculus
aatcttttatgtcttgtcatacaaa

SEQ ID NO: 68625 - DNA, 25 bp, mus musculus
ttatgtcttgtcatacaaattccaa

SEQ ID NO: 68626 - DNA, 25 bp, mus musculus
aagggtctgcattcctttatctgta

SEQ ID NO: 68627 - DNA, 25 bp, mus musculus
tcctttatctgtaattacagtctca

SEQ ID NO: 68628 - DNA, 25 bp, mus musculus
aattacagtctcagaatccaagttc

SEQ ID NO: 68629 - DNA, 25 bp, mus musculus
agtctcagaatccaagttctgaaaa

SEQ ID NO: 68630 - DNA, 25 bp, mus musculus
tatctattctgatctgacactggat

SEQ ID NO: 68631 - DNA, 25 bp, mus musculus
gcccgtcgccatggctgcctacaag

SEQ ID NO: 68632 - DNA, 25 bp, mus musculus
cgtcgccatggctgcctacaagctg

SEQ ID NO: 68633 - DNA, 25 bp, mus musculus
tggagaaccgcttcaggcaatggta

SEQ ID NO: 68634 - DNA, 25 bp, mus musculus
ggagaaccgcttcaggcaatggtac

SEQ ID NO: 68635 - DNA, 25 bp, mus musculus
gagaaccgcttcaggcaatggtacg

SEQ ID NO: 68636 - DNA, 25 bp, mus musculus
agaaccgcttcaggcaatggtacga

SEQ ID NO: 68637 - DNA, 25 bp, mus musculus
gaaccgcttcaggcaatggtacgac

SEQ ID NO: 68638 - DNA, 25 bp, mus musculus
aaccgcttcaggcaatggtacgacg

SEQ ID NO: 68639 - DNA, 25 bp, mus musculus
accgcttcaggcaatggtacgacgc

SEQ ID NO: 68640 - DNA, 25 bp, mus musculus
ccgcttcaggcaatggtacgacgcc

SEQ ID NO: 68641 - DNA, 25 bp, mus musculus
cgcttcaggcaatggtacgacgccg

SEQ ID NO: 68642 - DNA, 25 bp, mus musculus
cttcaggcaatggtacgacgccgac

SEQ ID NO: 68643 - DNA, 25 bp, mus musculus
gtcgccatggctgcctacaagctgg

SEQ ID NO: 68644 - DNA, 25 bp, mus musculus
tcgccatggctgcctacaagctggt

SEQ ID NO: 68645 - DNA, 25 bp, mus musculus
gccatggctgcctacaagctggtgc

SEQ ID NO: 68646 - DNA, 25 bp, mus musculus
atccggcatggcgagacggcctgga

SEQ ID NO: 68647 - DNA, 25 bp, mus musculus
catggcgagacggcctggaacctgg

SEQ ID NO: 68648 - DNA, 25 bp, mus musculus
aacctggagaaccgcttcaggcaat

SEQ ID NO: 68649 - DNA, 25 bp, mus musculus
acctggagaaccgcttcaggcaatg

SEQ ID NO: 68650 - DNA, 25 bp, mus musculus
ctggagaaccgcttcaggcaatggt

SEQ ID NO: 68651 - DNA, 25 bp, mus musculus
aactagtcagttgcaccaagtgaac

SEQ ID NO: 68652 - DNA, 25 bp, mus musculus
gcaccaagtgaactccgacctactt

SEQ ID NO: 68653 - DNA, 25 bp, mus musculus
tcataccttatttggcattgctggg

SEQ ID NO: 68654 - DNA, 25 bp, mus musculus
cttatttggcattgctgggttgtca

SEQ ID NO: 68655 - DNA, 25 bp, mus musculus
tggcattgctgggttgtcacttctg

SEQ ID NO: 68656 - DNA, 25 bp, mus musculus
gatcaagcctgttagccctgtcttc

SEQ ID NO: 68657 - DNA, 25 bp, mus musculus
gcctgttagccctgtcttctgtatg

SEQ ID NO: 68658 - DNA, 25 bp, mus musculus
tagccctgtcttctgtatgccagaa

SEQ ID NO: 68659 - DNA, 25 bp, mus musculus
tgtcttctgtatgccagaagaggtg

SEQ ID NO: 68660 - DNA, 25 bp, mus musculus
gaatgtccagcctgagctagtgagc

SEQ ID NO: 68661 - DNA, 25 bp, mus musculus
ccagcctgagctagtgagctagtca

SEQ ID NO: 68662 - DNA, 25 bp, mus musculus
ttatcaaacctagacgtgacttaat

SEQ ID NO: 68663 - DNA, 25 bp, mus musculus
cctacttggttggtggctttgtgag

SEQ ID NO: 68664 - DNA, 25 bp, mus musculus
ttgtgaggcgcagttgccctcaggc

SEQ ID NO: 68665 - DNA, 25 bp, mus musculus
ctcaggcgcactcaatggaagacgc

SEQ ID NO: 68666 - DNA, 25 bp, mus musculus
cgcactcaatggaagacgcgagaag

SEQ ID NO: 68667 - DNA, 25 bp, mus musculus
gttggcctccctaaagatcatcggg

SEQ ID NO: 68668 - DNA, 25 bp, mus musculus
ctccctaaagatcatcgggagactt

SEQ ID NO: 68669 - DNA, 25 bp, mus musculus
atttgcagacagaccaggagatatg

SEQ ID NO: 68670 - DNA, 25 bp, mus musculus
tccctttcataccttatttggcatt

SEQ ID NO: 68671 - DNA, 25 bp, mus musculus
gaattgcaatccgggaccgcctggg

SEQ ID NO: 68672 - DNA, 25 bp, mus musculus
tgcaatccgggaccgcctggggctc

SEQ ID NO: 68673 - DNA, 25 bp, mus musculus
ccaagtcgccaacgcactgtcaaac

SEQ ID NO: 68674 - DNA, 25 bp, mus musculus
caagtcgccaacgcactgtcaaacc

SEQ ID NO: 68675 - DNA, 25 bp, mus musculus
agtcgccaacgcactgtcaaaccta

SEQ ID NO: 68676 - DNA, 25 bp, mus musculus
gtcgccaacgcactgtcaaacctaa

SEQ ID NO: 68677 - DNA, 25 bp, mus musculus
tcgccaacgcactgtcaaacctaag

SEQ ID NO: 68678 - DNA, 25 bp, mus musculus
gccaacgcactgtcaaacctaagcg

SEQ ID NO: 68679 - DNA, 25 bp, mus musculus
ccaacgcactgtcaaacctaagcgc

SEQ ID NO: 68680 - DNA, 25 bp, mus musculus
caacgcactgtcaaacctaagcgct

SEQ ID NO: 68681 - DNA, 25 bp, mus musculus
acgcactgtcaaacctaagcgctgg

SEQ ID NO: 68682 - DNA, 25 bp, mus musculus
cgcactgtcaaacctaagcgctggg

SEQ ID NO: 68683 - DNA, 25 bp, mus musculus
cgcctggggctctggttgaaccaag

SEQ ID NO: 68684 - DNA, 25 bp, mus musculus
gcctggggctctggttgaaccaagt

SEQ ID NO: 68685 - DNA, 25 bp, mus musculus
tggttgaaccaagtcgccaacgcac

SEQ ID NO: 68686 - DNA, 25 bp, mus musculus
ggttgaaccaagtcgccaacgcact

SEQ ID NO: 68687 - DNA, 25 bp, mus musculus
ttgaaccaagtcgccaacgcactgt

SEQ ID NO: 68688 - DNA, 25 bp, mus musculus
tgaaccaagtcgccaacgcactgtc

SEQ ID NO: 68689 - DNA, 25 bp, mus musculus
gaaccaagtcgccaacgcactgtca

SEQ ID NO: 68690 - DNA, 25 bp, mus musculus
accaagtcgccaacgcactgtcaaa

SEQ ID NO: 68691 - DNA, 25 bp, mus musculus
ccagttcaagctcgtcctaggtggg

SEQ ID NO: 68692 - DNA, 25 bp, mus musculus
cagttcaagctcgtcctaggtgggc

SEQ ID NO: 68693 - DNA, 25 bp, mus musculus
ctgtcgtctaggccacttgtccatt

SEQ ID NO: 68694 - DNA, 25 bp, mus musculus
tgtcgtctaggccacttgtccatta

SEQ ID NO: 68695 - DNA, 25 bp, mus musculus
gtcgtctaggccacttgtccattat

SEQ ID NO: 68696 - DNA, 25 bp, mus musculus
tcgtctaggccacttgtccattata

SEQ ID NO: 68697 - DNA, 25 bp, mus musculus
cgtctaggccacttgtccattataa

SEQ ID NO: 68698 - DNA, 25 bp, mus musculus
gtctaggccacttgtccattataaa

SEQ ID NO: 68699 - DNA, 25 bp, mus musculus
tctaggccacttgtccattataaac

SEQ ID NO: 68700 - DNA, 25 bp, mus musculus
ttttggataccaacagaggggccat

SEQ ID NO: 68701 - DNA, 25 bp, mus musculus
tttggataccaacagaggggccatc

SEQ ID NO: 68702 - DNA, 25 bp, mus musculus
gggccatcaaagtcaacgtgtgtga

SEQ ID NO: 68703 - DNA, 25 bp, mus musculus
ggccatcaaagtcaacgtgtgtgac

SEQ ID NO: 68704 - DNA, 25 bp, mus musculus
aagtcaacgtgtgtgacacgggcgg

SEQ ID NO: 68705 - DNA, 25 bp, mus musculus
ggactgtcgtctaggccacttgtcc

SEQ ID NO: 68706 - DNA, 25 bp, mus musculus
gactgtcgtctaggccacttgtcca

SEQ ID NO: 68707 - DNA, 25 bp, mus musculus
actgtcgtctaggccacttgtccat

SEQ ID NO: 68708 - DNA, 25 bp, mus musculus
gaggcagtcccggagaattgaccgc

SEQ ID NO: 68709 - DNA, 25 bp, mus musculus
aaagccagcgcacgccgtggaaatc

SEQ ID NO: 68710 - DNA, 25 bp, mus musculus
caaacttctcctgctgggcaccaca

SEQ ID NO: 68711 - DNA, 25 bp, mus musculus
aaacttctcctgctgggcaccacaa

SEQ ID NO: 68712 - DNA, 25 bp, mus musculus
tctcctgctgggcaccacaacgtcg

SEQ ID NO: 68713 - DNA, 25 bp, mus musculus
ctcctgctgggcaccacaacgtcgg

SEQ ID NO: 68714 - DNA, 25 bp, mus musculus
ctgctgggcaccacaacgtcgggca

SEQ ID NO: 68715 - DNA, 25 bp, mus musculus
gctgggcaccacaacgtcgggcaag

SEQ ID NO: 68716 - DNA, 25 bp, mus musculus
ctgggcaccacaacgtcgggcaaga

SEQ ID NO: 68717 - DNA, 25 bp, mus musculus
gggcaccacaacgtcgggcaagagc

SEQ ID NO: 68718 - DNA, 25 bp, mus musculus
ggcaccacaacgtcgggcaagagca

SEQ ID NO: 68719 - DNA, 25 bp, mus musculus
accacaacgtcgggcaagagcacca

SEQ ID NO: 68720 - DNA, 25 bp, mus musculus
gccagcgcacgccgtggaaatcaaa

SEQ ID NO: 68721 - DNA, 25 bp, mus musculus
ccagcgcacgccgtggaaatcaaac

SEQ ID NO: 68722 - DNA, 25 bp, mus musculus
agcgcacgccgtggaaatcaaactt

SEQ ID NO: 68723 - DNA, 25 bp, mus musculus
gcgcacgccgtggaaatcaaacttc

SEQ ID NO: 68724 - DNA, 25 bp, mus musculus
ggaaatcaaacttctcctgctgggc

SEQ ID NO: 68725 - DNA, 25 bp, mus musculus
gaaatcaaacttctcctgctgggca

SEQ ID NO: 68726 - DNA, 25 bp, mus musculus
aatcaaacttctcctgctgggcacc

SEQ ID NO: 68727 - DNA, 25 bp, mus musculus
atcaaacttctcctgctgggcacca

SEQ ID NO: 68728 - DNA, 25 bp, mus musculus
atgctccagaatttctgacgccaac

SEQ ID NO: 68729 - DNA, 25 bp, mus musculus
tgactttgctgggtcatttcaagga

SEQ ID NO: 68730 - DNA, 25 bp, mus musculus
catgaacgccatggctaacagagat

SEQ ID NO: 68731 - DNA, 25 bp, mus musculus
caaacagctcaagtgggaagctgag

SEQ ID NO: 68732 - DNA, 25 bp, mus musculus
tgactggctgcacaacagagatgtg

SEQ ID NO: 68733 - DNA, 25 bp, mus musculus
gaagtgacatcttcagggtgacaat

SEQ ID NO: 68734 - DNA, 25 bp, mus musculus
tcaaccatttttcctcatctttctc

SEQ ID NO: 68735 - DNA, 25 bp, mus musculus
ctttctctctaactccatacattcc

SEQ ID NO: 68736 - DNA, 25 bp, mus musculus
ctctaactccatacattccagactg

SEQ ID NO: 68737 - DNA, 25 bp, mus musculus
ctccatacattccagactgttcaat

SEQ ID NO: 68738 - DNA, 25 bp, mus musculus
acattccagactgttcaatggattt

SEQ ID NO: 68739 - DNA, 25 bp, mus musculus
ttccagactgttcaatggatttgta

SEQ ID NO: 68740 - DNA, 25 bp, mus musculus
aagtttcaatgactccagcctgttt

SEQ ID NO: 68741 - DNA, 25 bp, mus musculus
caatgactccagcctgtttgtctct

SEQ ID NO: 68742 - DNA, 25 bp, mus musculus
cctgtttgtctctgctgaggagttt

SEQ ID NO: 68743 - DNA, 25 bp, mus musculus
tgtctctgctgaggagtttggccat

SEQ ID NO: 68744 - DNA, 25 bp, mus musculus
ggagtttggccatctgctggatgag

SEQ ID NO: 68745 - DNA, 25 bp, mus musculus
tggccatctgctggatgagaatatg

SEQ ID NO: 68746 - DNA, 25 bp, mus musculus
gaatatgggctccaagtttgatact

SEQ ID NO: 68747 - DNA, 25 bp, mus musculus
tattggcatgaacgccatggctaac

SEQ ID NO: 68748 - DNA, 25 bp, mus musculus
atgagaacaccgtggacgtgtatgg

SEQ ID NO: 68749 - DNA, 25 bp, mus musculus
agaacaccgtggacgtgtatgggat

SEQ ID NO: 68750 - DNA, 25 bp, mus musculus
tctatcagaacacaacggcaatgac

SEQ ID NO: 68751 - DNA, 25 bp, mus musculus
atcagaacacaacggcaatgacaat

SEQ ID NO: 68752 - DNA, 25 bp, mus musculus
caatctatgaaaacctcgagccagt

SEQ ID NO: 68753 - DNA, 25 bp, mus musculus
acctcgagccagtgagcatgtttgg

SEQ ID NO: 68754 - DNA, 25 bp, mus musculus
atggttacatcgcctagttccaaag

SEQ ID NO: 68755 - DNA, 25 bp, mus musculus
tcacacccacagtgaaggagagcgc

SEQ ID NO: 68756 - DNA, 25 bp, mus musculus
agagcgccctgacgggacatgtttt

SEQ ID NO: 68757 - DNA, 25 bp, mus musculus
gcgccctgacgggacatgttttata

SEQ ID NO: 68758 - DNA, 25 bp, mus musculus
gaaatcagctgccttcctgatcact

SEQ ID NO: 68759 - DNA, 25 bp, mus musculus
atcagctgccttcctgatcactaat

SEQ ID NO: 68760 - DNA, 25 bp, mus musculus
acaccgtggacgtgtatgggattgt

SEQ ID NO: 68761 - DNA, 25 bp, mus musculus
ttgtctatgaccttcggatgcacag

SEQ ID NO: 68762 - DNA, 25 bp, mus musculus
tctatgaccttcggatgcacaggcc

SEQ ID NO: 68763 - DNA, 25 bp, mus musculus
accttcggatgcacaggcctctgat

SEQ ID NO: 68764 - DNA, 25 bp, mus musculus
ggatgcacaggcctctgatggtgca

SEQ ID NO: 68765 - DNA, 25 bp, mus musculus
acaggcctctgatggtgcagacaga

SEQ ID NO: 68766 - DNA, 25 bp, mus musculus
tcctcaatcagtgtgttttggatat

SEQ ID NO: 68767 - DNA, 25 bp, mus musculus
aagttgatctcatctatcagaacac

SEQ ID NO: 68768 - DNA, 25 bp, mus musculus
atcgagggcaccttaggatcgtctt

SEQ ID NO: 68769 - DNA, 25 bp, mus musculus
aagcaaaatctctctgtatgtctga

SEQ ID NO: 68770 - DNA, 25 bp, mus musculus
acatgcttcctagtcttttgacaaa

SEQ ID NO: 68771 - DNA, 25 bp, mus musculus
gcttcctagtcttttgacaaactgt

SEQ ID NO: 68772 - DNA, 25 bp, mus musculus
tgacaaactgtacatagcggacgcc

SEQ ID NO: 68773 - DNA, 25 bp, mus musculus
actgtacatagcggacgccttcctt

SEQ ID NO: 68774 - DNA, 25 bp, mus musculus
tgtacatagcggacgccttcctttt

SEQ ID NO: 68775 - DNA, 25 bp, mus musculus
ttaacggcttattggcttattggtg

SEQ ID NO: 68776 - DNA, 25 bp, mus musculus
cggcttattggcttattggtggata

SEQ ID NO: 68777 - DNA, 25 bp, mus musculus
gcttattggcttattggtggataga

SEQ ID NO: 68778 - DNA, 25 bp, mus musculus
ttattggcttattggtggatagaag

SEQ ID NO: 68779 - DNA, 25 bp, mus musculus
tgtgttccttttaaatgaggcaact

SEQ ID NO: 68780 - DNA, 25 bp, mus musculus
gcaaaatctctctgtatgtctgaaa

SEQ ID NO: 68781 - DNA, 25 bp, mus musculus
aatctctctgtatgtctgaaactga

SEQ ID NO: 68782 - DNA, 25 bp, mus musculus
tctctgtatgtctgaaactgaaaac

SEQ ID NO: 68783 - DNA, 25 bp, mus musculus
taaatcccacaaaatatcgagccaa

SEQ ID NO: 68784 - DNA, 25 bp, mus musculus
tcccacaaaatatcgagccaaactt

SEQ ID NO: 68785 - DNA, 25 bp, mus musculus
tccttcccacatgcttcctagtctt

SEQ ID NO: 68786 - DNA, 25 bp, mus musculus
tcccacatgcttcctagtcttttga

SEQ ID NO: 68787 - DNA, 25 bp, mus musculus
ccacatgcttcctagtcttttgaca

SEQ ID NO: 68788 - DNA, 25 bp, mus musculus
tccttggttggtgagtaggcctctt

SEQ ID NO: 68789 - DNA, 25 bp, mus musculus
ccactctaaagcaatggtcagagtt

SEQ ID NO: 68790 - DNA, 25 bp, mus musculus
tatgatcttggtgtctgagacaact

SEQ ID NO: 68791 - DNA, 25 bp, mus musculus
tgagacaactgctgttccagcatac

SEQ ID NO: 68792 - DNA, 25 bp, mus musculus
gacaactgctgttccagcatacctc

SEQ ID NO: 68793 - DNA, 25 bp, mus musculus
aactgctgttccagcatacctctgt

SEQ ID NO: 68794 - DNA, 25 bp, mus musculus
tgctgttccagcatacctctgttta

SEQ ID NO: 68795 - DNA, 25 bp, mus musculus
tccagcatacctctgtttaacctga

SEQ ID NO: 68796 - DNA, 25 bp, mus musculus
agcatacctctgtttaacctgaatg

SEQ ID NO: 68797 - DNA, 25 bp, mus musculus
atacctctgtttaacctgaatgagg

SEQ ID NO: 68798 - DNA, 25 bp, mus musculus
cctctgtttaacctgaatgaggctg

SEQ ID NO: 68799 - DNA, 25 bp, mus musculus
tttaacctgaatgaggctgttgcat

SEQ ID NO: 68800 - DNA, 25 bp, mus musculus
tgctagttcaaacttctgggctgaa

SEQ ID NO: 68801 - DNA, 25 bp, mus musculus
ttcaaacttctgggctgaaattcct

SEQ ID NO: 68802 - DNA, 25 bp, mus musculus
cttctgggctgaaattcctgccagg

SEQ ID NO: 68803 - DNA, 25 bp, mus musculus
tgaaattcctgccaggaatggctct

SEQ ID NO: 68804 - DNA, 25 bp, mus musculus
aattcctgccaggaatggctctttc

SEQ ID NO: 68805 - DNA, 25 bp, mus musculus
tcctgccaggaatggctctttccat

SEQ ID NO: 68806 - DNA, 25 bp, mus musculus
ctctttccatatgatcttggtgtct

SEQ ID NO: 68807 - DNA, 25 bp, mus musculus
tttccatatgatcttggtgtctgag

SEQ ID NO: 68808 - DNA, 25 bp, mus musculus
ggatgtttaccttggctgcttccag

SEQ ID NO: 68809 - DNA, 25 bp, mus musculus
tgtttaccttggctgcttccaggac

SEQ ID NO: 68810 - DNA, 25 bp, mus musculus
tggatcatctctggacagcagctgc

SEQ ID NO: 68811 - DNA, 25 bp, mus musculus
atcatctctggacagcagctgccga

SEQ ID NO: 68812 - DNA, 25 bp, mus musculus
tctggacagcagctgccgaagtcaa

SEQ ID NO: 68813 - DNA, 25 bp, mus musculus
cagctgccgaagtcaataagaataa

SEQ ID NO: 68814 - DNA, 25 bp, mus musculus
attctatcgtggaccccaaggtgat

SEQ ID NO: 68815 - DNA, 25 bp, mus musculus
ctatcgtggaccccaaggtgatagt

SEQ ID NO: 68816 - DNA, 25 bp, mus musculus
tcgtggaccccaaggtgatagtgga

SEQ ID NO: 68817 - DNA, 25 bp, mus musculus
tggaccccaaggtgatagtggagat

SEQ ID NO: 68818 - DNA, 25 bp, mus musculus
atgtggccagccgtcagacagcagt

SEQ ID NO: 68819 - DNA, 25 bp, mus musculus
ccagccgtcagacagcagttattac

SEQ ID NO: 68820 - DNA, 25 bp, mus musculus
ttaccttggctgcttccaggacaat

SEQ ID NO: 68821 - DNA, 25 bp, mus musculus
tggctgcttccaggacaatggaggt

SEQ ID NO: 68822 - DNA, 25 bp, mus musculus
ctgcttccaggacaatggaggttgt

SEQ ID NO: 68823 - DNA, 25 bp, mus musculus
tgtgctgaaaccggccttcctgaga

SEQ ID NO: 68824 - DNA, 25 bp, mus musculus
gctgaaaccggccttcctgagagac

SEQ ID NO: 68825 - DNA, 25 bp, mus musculus
gagagaccctgacaccaccttcaac

SEQ ID NO: 68826 - DNA, 25 bp, mus musculus
cttcaactcacgggccctgactcag

SEQ ID NO: 68827 - DNA, 25 bp, mus musculus
aagctccgagtctggatcatctctg

SEQ ID NO: 68828 - DNA, 25 bp, mus musculus
tgacaatgcagttgaccacgtcctg

SEQ ID NO: 68829 - DNA, 25 bp, mus musculus
tgaccacgtcctggaagagttctct

SEQ ID NO: 68830 - DNA, 25 bp, mus musculus
ctttgtcgctgaagatgtagatgcc

SEQ ID NO: 68831 - DNA, 25 bp, mus musculus
cggacaaatcatcctgcaggaagct

SEQ ID NO: 68832 - DNA, 25 bp, mus musculus
tgacactgtggcaacgctgtctgaa

SEQ ID NO: 68833 - DNA, 25 bp, mus musculus
tgtggcaacgctgtctgaacgggtc

SEQ ID NO: 68834 - DNA, 25 bp, mus musculus
acataagatctttcctgccgctctt

SEQ ID NO: 68835 - DNA, 25 bp, mus musculus
agatggcaagatccactgggccaag

SEQ ID NO: 68836 - DNA, 25 bp, mus musculus
caagatccactgggccaaggagcag

SEQ ID NO: 68837 - DNA, 25 bp, mus musculus
ccactgggccaaggagcagtgaccg

SEQ ID NO: 68838 - DNA, 25 bp, mus musculus
ttcatcatgaccatggccaaactga

SEQ ID NO: 68839 - DNA, 25 bp, mus musculus
atgaccatggccaaactgaaatacc

SEQ ID NO: 68840 - DNA, 25 bp, mus musculus
cgtcctggaagagttctctgtagac

SEQ ID NO: 68841 - DNA, 25 bp, mus musculus
gttctctgtagacatcgtctgtctt

SEQ ID NO: 68842 - DNA, 25 bp, mus musculus
gttcatgaggatcctctctgggccc

SEQ ID NO: 68843 - DNA, 25 bp, mus musculus
tgcccacgagcaagtcctggaagct

SEQ ID NO: 68844 - DNA, 25 bp, mus musculus
agtcctggaagctggagtcacaatc

SEQ ID NO: 68845 - DNA, 25 bp, mus musculus
tggagtcacaatcactgggtgtacc

SEQ ID NO: 68846 - DNA, 25 bp, mus musculus
cacaatcactgggtgtaccgtacac

SEQ ID NO: 68847 - DNA, 25 bp, mus musculus
gtgtaccgtacactttgtcgctgaa

SEQ ID NO: 68848 - DNA, 25 bp, mus musculus
ctgatcaattcacttagtggccatg

SEQ ID NO: 68849 - DNA, 25 bp, mus musculus
aattcacttagtggccatgacatct

SEQ ID NO: 68850 - DNA, 25 bp, mus musculus
acagtgcttctcatggttaaagtgc

SEQ ID NO: 68851 - DNA, 25 bp, mus musculus
cttctgtttgtgagccggaatcgtc

SEQ ID NO: 68852 - DNA, 25 bp, mus musculus
aatcgtcagttctctcacttaattg

SEQ ID NO: 68853 - DNA, 25 bp, mus musculus
cagttctctcacttaattgagacta

SEQ ID NO: 68854 - DNA, 25 bp, mus musculus
tacttcaagggtggcttgctgacta

SEQ ID NO: 68855 - DNA, 25 bp, mus musculus
cgcctaccagacctcatcatcttgg

SEQ ID NO: 68856 - DNA, 25 bp, mus musculus
ccagacctcatcatcttggatgcat

SEQ ID NO: 68857 - DNA, 25 bp, mus musculus
ctcatcatcttggatgcatccctca

SEQ ID NO: 68858 - DNA, 25 bp, mus musculus
tccctcacagccacatggggttcaa

SEQ ID NO: 68859 - DNA, 25 bp, mus musculus
acagccacatggggttcaaagacat

SEQ ID NO: 68860 - DNA, 25 bp, mus musculus
gacatctcaatcttgtacttcaaag

SEQ ID NO: 68861 - DNA, 25 bp, mus musculus
tcatatacctatatgtttgtatcta

SEQ ID NO: 68862 - DNA, 25 bp, mus musculus
tacctaatctgcctatcaaatctat

SEQ ID NO: 68863 - DNA, 25 bp, mus musculus
ctatcaaatctatttagcttcaaag

SEQ ID NO: 68864 - DNA, 25 bp, mus musculus
aatctatttagcttcaaaggatagc

SEQ ID NO: 68865 - DNA, 25 bp, mus musculus
cacacctctgaaatgccaatgacca

SEQ ID NO: 68866 - DNA, 25 bp, mus musculus
atgaccaaggccagttgaacagtgc

SEQ ID NO: 68867 - DNA, 25 bp, mus musculus
agttgaacagtgcttctcatggtta

SEQ ID NO: 68868 - DNA, 25 bp, mus musculus
atatcacaaatgcatccaaggacag

SEQ ID NO: 68869 - DNA, 25 bp, mus musculus
caaatgcatccaaggacaggcgtcc

SEQ ID NO: 68870 - DNA, 25 bp, mus musculus
atgcatatcaccttattttgattaa

SEQ ID NO: 68871 - DNA, 25 bp, mus musculus
ttccaattttgcaaacactacagtc

SEQ ID NO: 68872 - DNA, 25 bp, mus musculus
tacagtctcctgcaacatgggagat

SEQ ID NO: 68873 - DNA, 25 bp, mus musculus
agtctcctgcaacatgggagatttt

SEQ ID NO: 68874 - DNA, 25 bp, mus musculus
ctcctgcaacatgggagattttatc

SEQ ID NO: 68875 - DNA, 25 bp, mus musculus
ctgtaaacacaaagcccttcatcta

SEQ ID NO: 68876 - DNA, 25 bp, mus musculus
acacaaagcccttcatctaatattt

SEQ ID NO: 68877 - DNA, 25 bp, mus musculus
tattgctattgccaatttttcaatg

SEQ ID NO: 68878 - DNA, 25 bp, mus musculus
tgctattgccaatttttcaatgaaa

SEQ ID NO: 68879 - DNA, 25 bp, mus musculus
tattgccaatttttcaatgaaatga

SEQ ID NO: 68880 - DNA, 25 bp, mus musculus
catccaaggacaggcgtcccaagtg

SEQ ID NO: 68881 - DNA, 25 bp, mus musculus
aggacaggcgtcccaagtgacttca

SEQ ID NO: 68882 - DNA, 25 bp, mus musculus
ccaagtgacttcaccctggacaagg

SEQ ID NO: 68883 - DNA, 25 bp, mus musculus
agtgacttcaccctggacaaggatg

SEQ ID NO: 68884 - DNA, 25 bp, mus musculus
tcgggactctttcactgactcttgt

SEQ ID NO: 68885 - DNA, 25 bp, mus musculus
ctctttcactgactcttgtatatta

SEQ ID NO: 68886 - DNA, 25 bp, mus musculus
tttcactgactcttgtatattagca

SEQ ID NO: 68887 - DNA, 25 bp, mus musculus
tgatgcatgcatatcaccttatttt

SEQ ID NO: 68888 - DNA, 25 bp, mus musculus
gaaatcacccacattgtaataaagg

SEQ ID NO: 68889 - DNA, 25 bp, mus musculus
aacatggaactcaagctctcttctc

SEQ ID NO: 68890 - DNA, 25 bp, mus musculus
ccactgattgtccacaatatacaga

SEQ ID NO: 68891 - DNA, 25 bp, mus musculus
ctgattgtccacaatatacagaacg

SEQ ID NO: 68892 - DNA, 25 bp, mus musculus
gtccacaatatacagaacggctgcc

SEQ ID NO: 68893 - DNA, 25 bp, mus musculus
aatatacagaacggctgccacggtc

SEQ ID NO: 68894 - DNA, 25 bp, mus musculus
aacggctgccacggtccaatctgca

SEQ ID NO: 68895 - DNA, 25 bp, mus musculus
cacggtccaatctgcacagaatatg

SEQ ID NO: 68896 - DNA, 25 bp, mus musculus
ggtccaatctgcacagaatatgcca

SEQ ID NO: 68897 - DNA, 25 bp, mus musculus
ccaatctgcacagaatatgccatca

SEQ ID NO: 68898 - DNA, 25 bp, mus musculus
acagaatatgccatcaataagctgc

SEQ ID NO: 68899 - DNA, 25 bp, mus musculus
gaatatgccatcaataagctgcggc

SEQ ID NO: 68900 - DNA, 25 bp, mus musculus
tcttctcgagaggaagccttgtcct

SEQ ID NO: 68901 - DNA, 25 bp, mus musculus
gccatcaataagctgcggcaggaag

SEQ ID NO: 68902 - DNA, 25 bp, mus musculus
gaagccttgtcctttgtgtccctgg

SEQ ID NO: 68903 - DNA, 25 bp, mus musculus
gtgtccctggtggatggctacttcc

SEQ ID NO: 68904 - DNA, 25 bp, mus musculus
gatggctacttccggctcactgcag

SEQ ID NO: 68905 - DNA, 25 bp, mus musculus
ggctacttccggctcactgcagatg

SEQ ID NO: 68906 - DNA, 25 bp, mus musculus
gcagatgcccaccattacctctgta

SEQ ID NO: 68907 - DNA, 25 bp, mus musculus
gatgcccaccattacctctgtactg

SEQ ID NO: 68908 - DNA, 25 bp, mus musculus
cattacctctgtactgatgtggctc

SEQ ID NO: 68909 - DNA, 25 bp, mus musculus
agaggatctgccactgcttctctaa

SEQ ID NO: 68910 - DNA, 25 bp, mus musculus
ggatctgccactgcttctctaagga

SEQ ID NO: 68911 - DNA, 25 bp, mus musculus
aagcccagcggttactgaagcagtc

SEQ ID NO: 68912 - DNA, 25 bp, mus musculus
tagcactgcagtggcatccagataa

SEQ ID NO: 68913 - DNA, 25 bp, mus musculus
cactgcagtggcatccagataattt

SEQ ID NO: 68914 - DNA, 25 bp, mus musculus
ggcatccagataatttccagaatga

SEQ ID NO: 68915 - DNA, 25 bp, mus musculus
acatagcagctgctaaagaagtcct

SEQ ID NO: 68916 - DNA, 25 bp, mus musculus
ctaaagaagtcctctcagacccaga

SEQ ID NO: 68917 - DNA, 25 bp, mus musculus
aagtcctctcagacccagaaatgag

SEQ ID NO: 68918 - DNA, 25 bp, mus musculus
tctcagacccagaaatgagaaagaa

SEQ ID NO: 68919 - DNA, 25 bp, mus musculus
aagatcctcttgatgcagagagtca

SEQ ID NO: 68920 - DNA, 25 bp, mus musculus
ccttccacagaagttggaactcatg

SEQ ID NO: 68921 - DNA, 25 bp, mus musculus
gccactgcttctctaaggatgagaa

SEQ ID NO: 68922 - DNA, 25 bp, mus musculus
actgcttctctaaggatgagaagcc

SEQ ID NO: 68923 - DNA, 25 bp, mus musculus
agatggagcccgacaatgtgaatgc

SEQ ID NO: 68924 - DNA, 25 bp, mus musculus
ctctgaaagaccgagccgaggccta

SEQ ID NO: 68925 - DNA, 25 bp, mus musculus
tgaaagaccgagccgaggcctactt

SEQ ID NO: 68926 - DNA, 25 bp, mus musculus
gagccgaggcctacttaatagagga

SEQ ID NO: 68927 - DNA, 25 bp, mus musculus
attatgaagctgctcaggagcacaa

SEQ ID NO: 68928 - DNA, 25 bp, mus musculus
atgaagctgctcaggagcacaatga

SEQ ID NO: 68929 - DNA, 25 bp, mus musculus
tttctcaagtccagaactgcgatgg

SEQ ID NO: 68930 - DNA, 25 bp, mus musculus
ttctcaagtccagaactgcgatgga

SEQ ID NO: 68931 - DNA, 25 bp, mus musculus
actgcgatggagctccagaggaggt

SEQ ID NO: 68932 - DNA, 25 bp, mus musculus
atggagctccagaggaggtgtaata

SEQ ID NO: 68933 - DNA, 25 bp, mus musculus
tggagctccagaggaggtgtaatac

SEQ ID NO: 68934 - DNA, 25 bp, mus musculus
tgtaataccttaattactttgattg

SEQ ID NO: 68935 - DNA, 25 bp, mus musculus
accttccacacagaaacgtaagatg

SEQ ID NO: 68936 - DNA, 25 bp, mus musculus
ccttccacacagaaacgtaagatgg

SEQ ID NO: 68937 - DNA, 25 bp, mus musculus
cttccacacagaaacgtaagatgga

SEQ ID NO: 68938 - DNA, 25 bp, mus musculus
ttccacacagaaacgtaagatggac

SEQ ID NO: 68939 - DNA, 25 bp, mus musculus
tccacacagaaacgtaagatggacg

SEQ ID NO: 68940 - DNA, 25 bp, mus musculus
taagatggacggtgcccctgatggc

SEQ ID NO: 68941 - DNA, 25 bp, mus musculus
tctcaagtccagaactgcgatggag

SEQ ID NO: 68942 - DNA, 25 bp, mus musculus
ctcaagtccagaactgcgatggagc

SEQ ID NO: 68943 - DNA, 25 bp, mus musculus
tcaagtccagaactgcgatggagct

SEQ ID NO: 68944 - DNA, 25 bp, mus musculus
caagtccagaactgcgatggagctc

SEQ ID NO: 68945 - DNA, 25 bp, mus musculus
agtccagaactgcgatggagctcca

SEQ ID NO: 68946 - DNA, 25 bp, mus musculus
gtccagaactgcgatggagctccag

SEQ ID NO: 68947 - DNA, 25 bp, mus musculus
tccagaactgcgatggagctccaga

SEQ ID NO: 68948 - DNA, 25 bp, mus musculus
aactgcgatggagctccagaggagg

SEQ ID NO: 68949 - DNA, 25 bp, mus musculus
tatcctgacctaatgccttagcagc

SEQ ID NO: 68950 - DNA, 25 bp, mus musculus
ctaatgccttagcagccataagaag

SEQ ID NO: 68951 - DNA, 25 bp, mus musculus
ctacgcaggacagccttctacggac

SEQ ID NO: 68952 - DNA, 25 bp, mus musculus
cgcaggacagccttctacggacttc

SEQ ID NO: 68953 - DNA, 25 bp, mus musculus
ttctacggacttcttcattccactg

SEQ ID NO: 68954 - DNA, 25 bp, mus musculus
cttcattccactgtaacttggtggc

SEQ ID NO: 68955 - DNA, 25 bp, mus musculus
ctgccccttctccgaaatggcaggt

SEQ ID NO: 68956 - DNA, 25 bp, mus musculus
cttctccgaaatggcaggtgtgagc

SEQ ID NO: 68957 - DNA, 25 bp, mus musculus
ctccgaaatggcaggtgtgagcagc

SEQ ID NO: 68958 - DNA, 25 bp, mus musculus
cttcaacttcttgttctgggtatgt

SEQ ID NO: 68959 - DNA, 25 bp, mus musculus
caacttcttgttctgggtatgtggt

SEQ ID NO: 68960 - DNA, 25 bp, mus musculus
tacactgatcttgggactggccata

SEQ ID NO: 68961 - DNA, 25 bp, mus musculus
ccttagcagccataagaaggaaaag

SEQ ID NO: 68962 - DNA, 25 bp, mus musculus
gatcatcacgtcaggagactctagc

SEQ ID NO: 68963 - DNA, 25 bp, mus musculus
gaatctgcaggcacacggatctctg

SEQ ID NO: 68964 - DNA, 25 bp, mus musculus
gcaggcacacggatctctgcaggca

SEQ ID NO: 68965 - DNA, 25 bp, mus musculus
acacggatctctgcaggcaaaatcc

SEQ ID NO: 68966 - DNA, 25 bp, mus musculus
atctctgcaggcaaaatccgtcaga

SEQ ID NO: 68967 - DNA, 25 bp, mus musculus
tctgcaggcaaaatccgtcagagcc

SEQ ID NO: 68968 - DNA, 25 bp, mus musculus
atccgtcagagcctacgcaggacag

SEQ ID NO: 68969 - DNA, 25 bp, mus musculus
agcctacgcaggacagccttctacg

SEQ ID NO: 68970 - DNA, 25 bp, mus musculus
tccgtgccaagcttatcaagtcccg

SEQ ID NO: 68971 - DNA, 25 bp, mus musculus
ccaagcttatcaagtcccggcagac

SEQ ID NO: 68972 - DNA, 25 bp, mus musculus
aggtgctctggggtcaccgattcac

SEQ ID NO: 68973 - DNA, 25 bp, mus musculus
gtcaccgattcacaccagttctcac

SEQ ID NO: 68974 - DNA, 25 bp, mus musculus
tggactacaacacttttcatgacac

SEQ ID NO: 68975 - DNA, 25 bp, mus musculus
acaacacttttcatgacacctatga

SEQ ID NO: 68976 - DNA, 25 bp, mus musculus
cttttcatgacacctatgagaccaa

SEQ ID NO: 68977 - DNA, 25 bp, mus musculus
cctatgagaccaacacacccagttg

SEQ ID NO: 68978 - DNA, 25 bp, mus musculus
agaccaacacacccagttgctgtgc

SEQ ID NO: 68979 - DNA, 25 bp, mus musculus
acacacccagttgctgtgccaagga

SEQ ID NO: 68980 - DNA, 25 bp, mus musculus
ccagttgctgtgccaaggagctggc

SEQ ID NO: 68981 - DNA, 25 bp, mus musculus
gtgagcccaatggactgagtgtgtc

SEQ ID NO: 68982 - DNA, 25 bp, mus musculus
ttatcaagtcccggcagaccaaaga

SEQ ID NO: 68983 - DNA, 25 bp, mus musculus
ccaggccaccaggggctcaatgtga

SEQ ID NO: 68984 - DNA, 25 bp, mus musculus
tctcccacgagatcaacgagaagag

SEQ ID NO: 68985 - DNA, 25 bp, mus musculus
agatgtctcgtgctcaactggaaca

SEQ ID NO: 68986 - DNA, 25 bp, mus musculus
ctcgtgctcaactggaacaggaaga

SEQ ID NO: 68987 - DNA, 25 bp, mus musculus
tgacttgccaagcacggagctctta

SEQ ID NO: 68988 - DNA, 25 bp, mus musculus
gccaagcacggagctcttacatgga

SEQ ID NO: 68989 - DNA, 25 bp, mus musculus
cacggagctcttacatggatacaga

SEQ ID NO: 68990 - DNA, 25 bp, mus musculus
gctcttacatggatacagaggtgct

SEQ ID NO: 68991 - DNA, 25 bp, mus musculus
ccaaacatccgggagcagctatcta

SEQ ID NO: 68992 - DNA, 25 bp, mus musculus
gagcagctatctatcacttgaggtc

SEQ ID NO: 68993 - DNA, 25 bp, mus musculus
tcccatgtgctacaccgtcattacg

SEQ ID NO: 68994 - DNA, 25 bp, mus musculus
gtgctacaccgtcattacgttcaag

SEQ ID NO: 68995 - DNA, 25 bp, mus musculus
gggcaccacatgttatgttcttctt

SEQ ID NO: 68996 - DNA, 25 bp, mus musculus
cacatgttatgttcttcttgctcta

SEQ ID NO: 68997 - DNA, 25 bp, mus musculus
gtaatctgcattgcattccattagc

SEQ ID NO: 68998 - DNA, 25 bp, mus musculus
gcattccattagcatctgctgtttc

SEQ ID NO: 68999 - DNA, 25 bp, mus musculus
catctgctgtttccaaatggagacc

SEQ ID NO: 69000 - DNA, 25 bp, mus musculus
tttctggatctttcgagttatcagc

SEQ ID NO: 69001 - DNA, 25 bp, mus musculus
gatctttcgagttatcagctgtatc

SEQ ID NO: 69002 - DNA, 25 bp, mus musculus
ttatagcttttcacatgtatattgg

SEQ ID NO: 69003 - DNA, 25 bp, mus musculus
ctatctatcacttgaggtcctgatt

SEQ ID NO: 69004 - DNA, 25 bp, mus musculus
cctgattgcagatcttgtgagtgct

SEQ ID NO: 69005 - DNA, 25 bp, mus musculus
tcaaacttcattgcagaaagacatt

SEQ ID NO: 69006 - DNA, 25 bp, mus musculus
gcagctaaggcgcctacaagaggag

SEQ ID NO: 69007 - DNA, 25 bp, mus musculus
ttttgttccttgtggacatctggtc

SEQ ID NO: 69008 - DNA, 25 bp, mus musculus
tccttgtggacatctggtcacttgt

SEQ ID NO: 69009 - DNA, 25 bp, mus musculus
tctggtcacttgtaaacagtgtgca

SEQ ID NO: 69010 - DNA, 25 bp, mus musculus
caaatgtcccatgtgctacaccgtc

SEQ ID NO: 69011 - DNA, 25 bp, mus musculus
tcacaatatgctacccagaatatgc

SEQ ID NO: 69012 - DNA, 25 bp, mus musculus
cacaatatgctacccagaatatgca

SEQ ID NO: 69013 - DNA, 25 bp, mus musculus
tatgcaggctcaaacacatatgaag

SEQ ID NO: 69014 - DNA, 25 bp, mus musculus
atgcaggctcaaacacatatgaaga

SEQ ID NO: 69015 - DNA, 25 bp, mus musculus
gcaggctcaaacacatatgaagaag

SEQ ID NO: 69016 - DNA, 25 bp, mus musculus
aggctcaaacacatatgaagaagcg

SEQ ID NO: 69017 - DNA, 25 bp, mus musculus
ggctcaaacacatatgaagaagcgg

SEQ ID NO: 69018 - DNA, 25 bp, mus musculus
tatgaagaagcggccgcgtatattc

SEQ ID NO: 69019 - DNA, 25 bp, mus musculus
agaagcggccgcgtatattcagtgt

SEQ ID NO: 69020 - DNA, 25 bp, mus musculus
aagcggccgcgtatattcagtgtca

SEQ ID NO: 69021 - DNA, 25 bp, mus musculus
agcggccgcgtatattcagtgtcag

SEQ ID NO: 69022 - DNA, 25 bp, mus musculus
cggccgcgtatattcagtgtcagtt

SEQ ID NO: 69023 - DNA, 25 bp, mus musculus
caatatgctacccagaatatgcagg

SEQ ID NO: 69024 - DNA, 25 bp, mus musculus
aatatgctacccagaatatgcaggc

SEQ ID NO: 69025 - DNA, 25 bp, mus musculus
atatgctacccagaatatgcaggct

SEQ ID NO: 69026 - DNA, 25 bp, mus musculus
tatgctacccagaatatgcaggctc

SEQ ID NO: 69027 - DNA, 25 bp, mus musculus
tgctacccagaatatgcaggctcaa

SEQ ID NO: 69028 - DNA, 25 bp, mus musculus
gctacccagaatatgcaggctcaaa

SEQ ID NO: 69029 - DNA, 25 bp, mus musculus
ctacccagaatatgcaggctcaaac

SEQ ID NO: 69030 - DNA, 25 bp, mus musculus
aatatgcaggctcaaacacatatga

SEQ ID NO: 69031 - DNA, 25 bp, mus musculus
tcctgctccctgtacagtcagtcta

SEQ ID NO: 69032 - DNA, 25 bp, mus musculus
tgctccctgtacagtcagtctactc

SEQ ID NO: 69033 - DNA, 25 bp, mus musculus
agatgttccacaagagcctcgagag

SEQ ID NO: 69034 - DNA, 25 bp, mus musculus
tccacaagagcctcgagagcgctga

SEQ ID NO: 69035 - DNA, 25 bp, mus musculus
acaagagcctcgagagcgctgacgc

SEQ ID NO: 69036 - DNA, 25 bp, mus musculus
tcgagagcgctgacgcacgggataa

SEQ ID NO: 69037 - DNA, 25 bp, mus musculus
gggataacctgcgtgctctggtccg

SEQ ID NO: 69038 - DNA, 25 bp, mus musculus
ataacctgcgtgctctggtccgagg

SEQ ID NO: 69039 - DNA, 25 bp, mus musculus
gtgctctggtccgaggcttaaaccg

SEQ ID NO: 69040 - DNA, 25 bp, mus musculus
taaaccgcgaagatttgacgcgtgg

SEQ ID NO: 69041 - DNA, 25 bp, mus musculus
aagatttgacgcgtggcttgctcat

SEQ ID NO: 69042 - DNA, 25 bp, mus musculus
atttgacgcgtggcttgctcatcgg

SEQ ID NO: 69043 - DNA, 25 bp, mus musculus
tccctgtacagtcagtctactctat

SEQ ID NO: 69044 - DNA, 25 bp, mus musculus
tttgacgcgtggcttgctcatcggt

SEQ ID NO: 69045 - DNA, 25 bp, mus musculus
tacagtcagtctactctattcctgg

SEQ ID NO: 69046 - DNA, 25 bp, mus musculus
agtcagtctactctattcctggccg

SEQ ID NO: 69047 - DNA, 25 bp, mus musculus
atcagtgtgagttgctgggacataa

SEQ ID NO: 69048 - DNA, 25 bp, mus musculus
ataacaagaacatgcgcactgtggt

SEQ ID NO: 69049 - DNA, 25 bp, mus musculus
agaacatgcgcactgtggtgacagg

SEQ ID NO: 69050 - DNA, 25 bp, mus musculus
acatgcgcactgtggtgacaggcat

SEQ ID NO: 69051 - DNA, 25 bp, mus musculus
tgcgcactgtggtgacaggcattga

SEQ ID NO: 69052 - DNA, 25 bp, mus musculus
gcgcatcctgcgcagagtcattagc

SEQ ID NO: 69053 - DNA, 25 bp, mus musculus
gcatcctgcgcagagtcattagcgg

SEQ ID NO: 69054 - DNA, 25 bp, mus musculus
gcgccacagaactcatgaactatct

SEQ ID NO: 69055 - DNA, 25 bp, mus musculus
gccacagaactcatgaactatctca

SEQ ID NO: 69056 - DNA, 25 bp, mus musculus
cagaactcatgaactatctcagcaa

SEQ ID NO: 69057 - DNA, 25 bp, mus musculus
gaactcatgaactatctcagcaagg

SEQ ID NO: 69058 - DNA, 25 bp, mus musculus
actcatgaactatctcagcaaggtc

SEQ ID NO: 69059 - DNA, 25 bp, mus musculus
tcatgaactatctcagcaaggtcgt

SEQ ID NO: 69060 - DNA, 25 bp, mus musculus
atgaactatctcagcaaggtcgtga

SEQ ID NO: 69061 - DNA, 25 bp, mus musculus
gaactatctcagcaaggtcgtgacc

SEQ ID NO: 69062 - DNA, 25 bp, mus musculus
actatctcagcaaggtcgtgacccg

SEQ ID NO: 69063 - DNA, 25 bp, mus musculus
tatctcagcaaggtcgtgacccgac

SEQ ID NO: 69064 - DNA, 25 bp, mus musculus
atcctgcgcagagtcattagcggca

SEQ ID NO: 69065 - DNA, 25 bp, mus musculus
cctgcgcagagtcattagcggcatc

SEQ ID NO: 69066 - DNA, 25 bp, mus musculus
cattagcggcatcagcgaggctgct

SEQ ID NO: 69067 - DNA, 25 bp, mus musculus
ttagcggcatcagcgaggctgctgc

SEQ ID NO: 69068 - DNA, 25 bp, mus musculus
cacctccgtgagtgcaggaaactcc

SEQ ID NO: 69069 - DNA, 25 bp, mus musculus
aaactccttgtccagctggctcggg

SEQ ID NO: 69070 - DNA, 25 bp, mus musculus
actccttgtccagctggctcgggac

SEQ ID NO: 69071 - DNA, 25 bp, mus musculus
cagcgccacagaactcatgaactat

SEQ ID NO: 69072 - DNA, 25 bp, mus musculus
agtcggagcagtggctccaaccgaa

SEQ ID NO: 69073 - DNA, 25 bp, mus musculus
agcagtggctccaaccgaagtggca

SEQ ID NO: 69074 - DNA, 25 bp, mus musculus
agccaccgcagtcaccattcgctga

SEQ ID NO: 69075 - DNA, 25 bp, mus musculus
cgcagtcaccattcgctgaccagca

SEQ ID NO: 69076 - DNA, 25 bp, mus musculus
agtcaccattcgctgaccagcagcc

SEQ ID NO: 69077 - DNA, 25 bp, mus musculus
cattcgctgaccagcagcctgcgca

SEQ ID NO: 69078 - DNA, 25 bp, mus musculus
ccggaactgacggccagcagacagt

SEQ ID NO: 69079 - DNA, 25 bp, mus musculus
gaactgacggccagcagacagtcct

SEQ ID NO: 69080 - DNA, 25 bp, mus musculus
agacagtccttccgcatggcaatgg

SEQ ID NO: 69081 - DNA, 25 bp, mus musculus
tccttccgcatggcaatgggaaacc

SEQ ID NO: 69082 - DNA, 25 bp, mus musculus
ttctttgtggatgtgatgtgatcag

SEQ ID NO: 69083 - DNA, 25 bp, mus musculus
tgatcagggcccctgtccagctctt

SEQ ID NO: 69084 - DNA, 25 bp, mus musculus
agtggctccaaccgaagtggcagcg

SEQ ID NO: 69085 - DNA, 25 bp, mus musculus
ggctccaaccgaagtggcagcgacc

SEQ ID NO: 69086 - DNA, 25 bp, mus musculus
agcgagtcagaccacactacacgca

SEQ ID NO: 69087 - DNA, 25 bp, mus musculus
tcagaccacactacacgcagcagtc

SEQ ID NO: 69088 - DNA, 25 bp, mus musculus
gaccacactacacgcagcagtctga

SEQ ID NO: 69089 - DNA, 25 bp, mus musculus
cacactacacgcagcagtctgaggg

SEQ ID NO: 69090 - DNA, 25 bp, mus musculus
gcaccaagcgagcgatcaggcccag

SEQ ID NO: 69091 - DNA, 25 bp, mus musculus
gagcacagccaccgcagtcaccatt

SEQ ID NO: 69092 - DNA, 25 bp, mus musculus
aagttctcaattgctacagagaagt

SEQ ID NO: 69093 - DNA, 25 bp, mus musculus
gttctcaattgctacagagaagtgg

SEQ ID NO: 69094 - DNA, 25 bp, mus musculus
actagtattcatccaaaaatggcca

SEQ ID NO: 69095 - DNA, 25 bp, mus musculus
tagtattcatccaaaaatggccaat

SEQ ID NO: 69096 - DNA, 25 bp, mus musculus
attcatccaaaaatggccaattagc

SEQ ID NO: 69097 - DNA, 25 bp, mus musculus
atccaaaaatggccaattagcggtg

SEQ ID NO: 69098 - DNA, 25 bp, mus musculus
tatgtatcgcatatttctgttcagg

SEQ ID NO: 69099 - DNA, 25 bp, mus musculus
tgtatcgcatatttctgttcaggcc

SEQ ID NO: 69100 - DNA, 25 bp, mus musculus
tatcgcatatttctgttcaggccat

SEQ ID NO: 69101 - DNA, 25 bp, mus musculus
atatttctgttcaggccatcaagaa

SEQ ID NO: 69102 - DNA, 25 bp, mus musculus
atttctgttcaggccatcaagaact

SEQ ID NO: 69103 - DNA, 25 bp, mus musculus
ttctgttcaggccatcaagaacttt

SEQ ID NO: 69104 - DNA, 25 bp, mus musculus
acccataggcttttcaggagacatc

SEQ ID NO: 69105 - DNA, 25 bp, mus musculus
gcttttcaggagacatcctcacata

SEQ ID NO: 69106 - DNA, 25 bp, mus musculus
ttttcaggagacatcctcacatact

SEQ ID NO: 69107 - DNA, 25 bp, mus musculus
caggagacatcctcacatactagta

SEQ ID NO: 69108 - DNA, 25 bp, mus musculus
agacatcctcacatactagtattca

SEQ ID NO: 69109 - DNA, 25 bp, mus musculus
acatcctcacatactagtattcatc

SEQ ID NO: 69110 - DNA, 25 bp, mus musculus
atcctcacatactagtattcatcca

SEQ ID NO: 69111 - DNA, 25 bp, mus musculus
acatactagtattcatccaaaaatg

SEQ ID NO: 69112 - DNA, 25 bp, mus musculus
ttgtgcacacattatccattttgca

SEQ ID NO: 69113 - DNA, 25 bp, mus musculus
gtgcacacattatccattttgcaca

SEQ ID NO: 69114 - DNA, 25 bp, mus musculus
tttaggtaacatctgcccctgcggt

SEQ ID NO: 69115 - DNA, 25 bp, mus musculus
taggtaacatctgcccctgcggttc

SEQ ID NO: 69116 - DNA, 25 bp, mus musculus
ggtaacatctgcccctgcggttcct

SEQ ID NO: 69117 - DNA, 25 bp, mus musculus
atctgcccctgcggttcctctcatt

SEQ ID NO: 69118 - DNA, 25 bp, mus musculus
attgcacagcctgtgcgatggatag

SEQ ID NO: 69119 - DNA, 25 bp, mus musculus
tgcacagcctgtgcgatggatagta

SEQ ID NO: 69120 - DNA, 25 bp, mus musculus
cagcctgtgcgatggatagtaggta

SEQ ID NO: 69121 - DNA, 25 bp, mus musculus
agaactggcagcgggcgttattggt

SEQ ID NO: 69122 - DNA, 25 bp, mus musculus
ctggcagcgggcgttattggtacac

SEQ ID NO: 69123 - DNA, 25 bp, mus musculus
tattggtacacgttttctgacaggt

SEQ ID NO: 69124 - DNA, 25 bp, mus musculus
acattatccattttgcacagcctca

SEQ ID NO: 69125 - DNA, 25 bp, mus musculus
cattttgcacagcctcagtgagtat

SEQ ID NO: 69126 - DNA, 25 bp, mus musculus
ttttgcacagcctcagtgagtatcc

SEQ ID NO: 69127 - DNA, 25 bp, mus musculus
gcacagcctcagtgagtatccagag

SEQ ID NO: 69128 - DNA, 25 bp, mus musculus
agcctcagtgagtatccagagatgc

SEQ ID NO: 69129 - DNA, 25 bp, mus musculus
gtattctcgttggagatccattgga

SEQ ID NO: 69130 - DNA, 25 bp, mus musculus
attctcgttggagatccattggagg

SEQ ID NO: 69131 - DNA, 25 bp, mus musculus
tctcgttggagatccattggaggaa

SEQ ID NO: 69132 - DNA, 25 bp, mus musculus
cggcgacttcagcccagatcgagat

SEQ ID NO: 69133 - DNA, 25 bp, mus musculus
cttcagcccagatcgagatgaacaa

SEQ ID NO: 69134 - DNA, 25 bp, mus musculus
cagcagccaccctgaggaagaagca

SEQ ID NO: 69135 - DNA, 25 bp, mus musculus
agcagccaccctgaggaagaagcat

SEQ ID NO: 69136 - DNA, 25 bp, mus musculus
cagccaccctgaggaagaagcatgc

SEQ ID NO: 69137 - DNA, 25 bp, mus musculus
agccaccctgaggaagaagcatgcg

SEQ ID NO: 69138 - DNA, 25 bp, mus musculus
tcgacaacctgcagcggtggaatgc

SEQ ID NO: 69139 - DNA, 25 bp, mus musculus
cgacaacctgcagcggtggaatgcg

SEQ ID NO: 69140 - DNA, 25 bp, mus musculus
acaacctgcagcggtggaatgcgga

SEQ ID NO: 69141 - DNA, 25 bp, mus musculus
caacctgcagcggtggaatgcggaa

SEQ ID NO: 69142 - DNA, 25 bp, mus musculus
acctgcagcggtggaatgcggaagc

SEQ ID NO: 69143 - DNA, 25 bp, mus musculus
cctgcagcggtggaatgcggaagct

SEQ ID NO: 69144 - DNA, 25 bp, mus musculus
ttcagcccagatcgagatgaacaag

SEQ ID NO: 69145 - DNA, 25 bp, mus musculus
gttccagagaatgcgcagggacctg

SEQ ID NO: 69146 - DNA, 25 bp, mus musculus
agcatgaagccacagcagccaccct

SEQ ID NO: 69147 - DNA, 25 bp, mus musculus
atgaagccacagcagccaccctgag

SEQ ID NO: 69148 - DNA, 25 bp, mus musculus
tgaagccacagcagccaccctgagg

SEQ ID NO: 69149 - DNA, 25 bp, mus musculus
agccacagcagccaccctgaggaag

SEQ ID NO: 69150 - DNA, 25 bp, mus musculus
ccacagcagccaccctgaggaagaa

SEQ ID NO: 69151 - DNA, 25 bp, mus musculus
cacagcagccaccctgaggaagaag

SEQ ID NO: 69152 - DNA, 25 bp, mus musculus
gcacacatgagggccaggagctctg

SEQ ID NO: 69153 - DNA, 25 bp, mus musculus
ataatgcaactcttgcagtttcctt

SEQ ID NO: 69154 - DNA, 25 bp, mus musculus
cacacaccttagtcacagcactcag

SEQ ID NO: 69155 - DNA, 25 bp, mus musculus
aggtagctctcttgaatttgagacc

SEQ ID NO: 69156 - DNA, 25 bp, mus musculus
tgagaccagcctggtctacagagct

SEQ ID NO: 69157 - DNA, 25 bp, mus musculus
ggtctacagagctagctccaggaca

SEQ ID NO: 69158 - DNA, 25 bp, mus musculus
tagctccaggacataacatacatct

SEQ ID NO: 69159 - DNA, 25 bp, mus musculus
ataacatacatctctgctacacaga

SEQ ID NO: 69160 - DNA, 25 bp, mus musculus
tacatctctgctacacagagaatcc

SEQ ID NO: 69161 - DNA, 25 bp, mus musculus
tctgctacacagagaatcccttatt

SEQ ID NO: 69162 - DNA, 25 bp, mus musculus
aatagaattgcctttttctcacatt

SEQ ID NO: 69163 - DNA, 25 bp, mus musculus
tctttctttcctttagagcacactg

SEQ ID NO: 69164 - DNA, 25 bp, mus musculus
gttagatcatatttctctggaaatg

SEQ ID NO: 69165 - DNA, 25 bp, mus musculus
tcatatttctctggaaatgatcagc

SEQ ID NO: 69166 - DNA, 25 bp, mus musculus
agccctggaggtgctgcctcgttgg

SEQ ID NO: 69167 - DNA, 25 bp, mus musculus
ctcctcagaaacccgcagagtcact

SEQ ID NO: 69168 - DNA, 25 bp, mus musculus
ccgcagagtcactgtctactctgtg

SEQ ID NO: 69169 - DNA, 25 bp, mus musculus
tgtctactctgtgagaaagtgcggg

SEQ ID NO: 69170 - DNA, 25 bp, mus musculus
atcattactttagccagcagtagtg

SEQ ID NO: 69171 - DNA, 25 bp, mus musculus
tggtgccacacaccttagtcacagc

SEQ ID NO: 69172 - DNA, 25 bp, mus musculus
gattactaccgctacctggcagagg

SEQ ID NO: 69173 - DNA, 25 bp, mus musculus
taccgctacctggcagaggtggctt

SEQ ID NO: 69174 - DNA, 25 bp, mus musculus
tcctataaggactccactctcatca

SEQ ID NO: 69175 - DNA, 25 bp, mus musculus
cccattatcactgattcttccttgc

SEQ ID NO: 69176 - DNA, 25 bp, mus musculus
atcactgattcttccttgccacaat

SEQ ID NO: 69177 - DNA, 25 bp, mus musculus
gattcttccttgccacaatcactat

SEQ ID NO: 69178 - DNA, 25 bp, mus musculus
ccacaatcactatatctagtgctaa

SEQ ID NO: 69179 - DNA, 25 bp, mus musculus
tcactatatctagtgctaaacctat

SEQ ID NO: 69180 - DNA, 25 bp, mus musculus
gtgctaaacctatctgtattggcag

SEQ ID NO: 69181 - DNA, 25 bp, mus musculus
tctgtattggcagcacagctattca

SEQ ID NO: 69182 - DNA, 25 bp, mus musculus
ttggcagcacagctattcagatctg

SEQ ID NO: 69183 - DNA, 25 bp, mus musculus
gcacagctattcagatctgccctcc

SEQ ID NO: 69184 - DNA, 25 bp, mus musculus
gagatccagaatgcaccagagcaag

SEQ ID NO: 69185 - DNA, 25 bp, mus musculus
ttcagataaaccttcatgggcattt

SEQ ID NO: 69186 - DNA, 25 bp, mus musculus
gcaccagagcaagcctgcctcttag

SEQ ID NO: 69187 - DNA, 25 bp, mus musculus
gagcaagcctgcctcttagccaaac

SEQ ID NO: 69188 - DNA, 25 bp, mus musculus
gcctgcctcttagccaaacaagcct

SEQ ID NO: 69189 - DNA, 25 bp, mus musculus
ctcttagccaaacaagccttcgatg

SEQ ID NO: 69190 - DNA, 25 bp, mus musculus
caagccttcgatgatgctatagctg

SEQ ID NO: 69191 - DNA, 25 bp, mus musculus
gatgctatagctgagctggacacat

SEQ ID NO: 69192 - DNA, 25 bp, mus musculus
atagctgagctggacacattaaacg

SEQ ID NO: 69193 - DNA, 25 bp, mus musculus
acacacatctccatgaaccacttga

SEQ ID NO: 69194 - DNA, 25 bp, mus musculus
cacatctccatgaaccacttgaagg

SEQ ID NO: 69195 - DNA, 25 bp, mus musculus
tggatgatgtgccccttcttgtcca

SEQ ID NO: 69196 - DNA, 25 bp, mus musculus
atgtgccccttcttgtccagcatga

SEQ ID NO: 69197 - DNA, 25 bp, mus musculus
cccttcttgtccagcatgatgttgc

SEQ ID NO: 69198 - DNA, 25 bp, mus musculus
agcatgatgttgccattgtgcctgt

SEQ ID NO: 69199 - DNA, 25 bp, mus musculus
atgttgccattgtgcctgtccttga

SEQ ID NO: 69200 - DNA, 25 bp, mus musculus
ccattgtgcctgtccttgatctgca

SEQ ID NO: 69201 - DNA, 25 bp, mus musculus
ttgtgcctgtccttgatctgcagca

SEQ ID NO: 69202 - DNA, 25 bp, mus musculus
ttgatctgcagcaggaacagcagga

SEQ ID NO: 69203 - DNA, 25 bp, mus musculus
atctgcagcaggaacagcaggaggc

SEQ ID NO: 69204 - DNA, 25 bp, mus musculus
gcggccatgcttctgataaagttgt

SEQ ID NO: 69205 - DNA, 25 bp, mus musculus
atctccatgaaccacttgaagggtg

SEQ ID NO: 69206 - DNA, 25 bp, mus musculus
cccataatcatcaccatctcgtctg

SEQ ID NO: 69207 - DNA, 25 bp, mus musculus
ataatcatcaccatctcgtctgtca

SEQ ID NO: 69208 - DNA, 25 bp, mus musculus
atcatcaccatctcgtctgtcagct

SEQ ID NO: 69209 - DNA, 25 bp, mus musculus
accatctcgtctgtcagcttgatgt

SEQ ID NO: 69210 - DNA, 25 bp, mus musculus
atctcgtctgtcagcttgatgtctg

SEQ ID NO: 69211 - DNA, 25 bp, mus musculus
tcgtctgtcagcttgatgtctggtt

SEQ ID NO: 69212 - DNA, 25 bp, mus musculus
agcttgatgtctggttcccagccaa

SEQ ID NO: 69213 - DNA, 25 bp, mus musculus
acattatggcccaggcacctactca

SEQ ID NO: 69214 - DNA, 25 bp, mus musculus
ttatggcccaggcacctactcagaa

SEQ ID NO: 69215 - DNA, 25 bp, mus musculus
ttccatcatccagtggggcaatgag

SEQ ID NO: 69216 - DNA, 25 bp, mus musculus
ggcaaccagcagcccaggcaggtgt

SEQ ID NO: 69217 - DNA, 25 bp, mus musculus
cagcagcccaggcaggtgtttcaca

SEQ ID NO: 69218 - DNA, 25 bp, mus musculus
cccaggcaggtgtttcacagggtca

SEQ ID NO: 69219 - DNA, 25 bp, mus musculus
tttcacagggtcaggtacctggagc

SEQ ID NO: 69220 - DNA, 25 bp, mus musculus
tccctaaccctctgaacatgctggc

SEQ ID NO: 69221 - DNA, 25 bp, mus musculus
tgaacatgctggcaccccaggccag

SEQ ID NO: 69222 - DNA, 25 bp, mus musculus
tgccttgcccaccagtgacacagtc

SEQ ID NO: 69223 - DNA, 25 bp, mus musculus
gcccaccagtgacacagtcaccatt

SEQ ID NO: 69224 - DNA, 25 bp, mus musculus
tgacacagtcaccattgcacccgac

SEQ ID NO: 69225 - DNA, 25 bp, mus musculus
tggcccaggcacctactcagaacca

SEQ ID NO: 69226 - DNA, 25 bp, mus musculus
aggcacctactcagaaccagtttct

SEQ ID NO: 69227 - DNA, 25 bp, mus musculus
cacctactcagaaccagtttctgcc

SEQ ID NO: 69228 - DNA, 25 bp, mus musculus
ctactcagaaccagtttctgccaca

SEQ ID NO: 69229 - DNA, 25 bp, mus musculus
accagtttctgccacagaaccagtt

SEQ ID NO: 69230 - DNA, 25 bp, mus musculus
tgccacagaaccagtttccatcatc

SEQ ID NO: 69231 - DNA, 25 bp, mus musculus
agaaccagtttccatcatccagtgg

SEQ ID NO: 69232 - DNA, 25 bp, mus musculus
agtttccatcatccagtggggcaat

SEQ ID NO: 69233 - DNA, 25 bp, mus musculus
gaccgagctgatccagaaggccaag

SEQ ID NO: 69234 - DNA, 25 bp, mus musculus
caagctggcgtgcagcgagcgctac

SEQ ID NO: 69235 - DNA, 25 bp, mus musculus
ctgcatgaaagccgtgacggagcag

SEQ ID NO: 69236 - DNA, 25 bp, mus musculus
cgccgagctgtccaacgaggagcgc

SEQ ID NO: 69237 - DNA, 25 bp, mus musculus
cgagctgtccaacgaggagcgcaac

SEQ ID NO: 69238 - DNA, 25 bp, mus musculus
gctgtccaacgaggagcgcaacctg

SEQ ID NO: 69239 - DNA, 25 bp, mus musculus
caacctgctgtcggtggcctacaaa

SEQ ID NO: 69240 - DNA, 25 bp, mus musculus
tccgcctggagggtcatctcgagca

SEQ ID NO: 69241 - DNA, 25 bp, mus musculus
agggtcatctcgagcattgagcaga

SEQ ID NO: 69242 - DNA, 25 bp, mus musculus
gtcatctcgagcattgagcagaaga

SEQ ID NO: 69243 - DNA, 25 bp, mus musculus
atctcgagcattgagcagaagaccg

SEQ ID NO: 69244 - DNA, 25 bp, mus musculus
cagaagaccgacacctctgacaaga

SEQ ID NO: 69245 - DNA, 25 bp, mus musculus
cagcgagcgctacgacgacatggcc

SEQ ID NO: 69246 - DNA, 25 bp, mus musculus
gcgctacgacgacatggccacctgc

SEQ ID NO: 69247 - DNA, 25 bp, mus musculus
ctacgacgacatggccacctgcatg

SEQ ID NO: 69248 - DNA, 25 bp, mus musculus
cgacgacatggccacctgcatgaaa

SEQ ID NO: 69249 - DNA, 25 bp, mus musculus
cgacatggccacctgcatgaaagcc

SEQ ID NO: 69250 - DNA, 25 bp, mus musculus
catggccacctgcatgaaagccgtg

SEQ ID NO: 69251 - DNA, 25 bp, mus musculus
ggccacctgcatgaaagccgtgacg

SEQ ID NO: 69252 - DNA, 25 bp, mus musculus
cacctgcatgaaagccgtgacggag

SEQ ID NO: 69253 - DNA, 25 bp, mus musculus
actcgcgtcgcgctgcgagactaga

SEQ ID NO: 69254 - DNA, 25 bp, mus musculus
cgtcgcgctgcgagactagaaggag

SEQ ID NO: 69255 - DNA, 25 bp, mus musculus
tcgcgctgcgagactagaaggagga

SEQ ID NO: 69256 - DNA, 25 bp, mus musculus
caagctggcgtgcagcgagcgctac

SEQ ID NO: 69257 - DNA, 25 bp, mus musculus
aagctggcgtgcagcgagcgctacg

SEQ ID NO: 69258 - DNA, 25 bp, mus musculus
cagcgagcgctacgacgacatggcc

SEQ ID NO: 69259 - DNA, 25 bp, mus musculus
agcgagcgctacgacgacatggcca

SEQ ID NO: 69260 - DNA, 25 bp, mus musculus
gcgagcgctacgacgacatggccac

SEQ ID NO: 69261 - DNA, 25 bp, mus musculus
actcgcgtcgcgctgcgagactaga

SEQ ID NO: 69262 - DNA, 25 bp, mus musculus
cgtcgcgctgcgagactagaaggag

SEQ ID NO: 69263 - DNA, 25 bp, mus musculus
tcgcgctgcgagactagaaggagga

SEQ ID NO: 69264 - DNA, 25 bp, mus musculus
caagctggcgtgcagcgagcgctac

SEQ ID NO: 69265 - DNA, 25 bp, mus musculus
aagctggcgtgcagcgagcgctacg

SEQ ID NO: 69266 - DNA, 25 bp, mus musculus
cagcgagcgctacgacgacatggcc

SEQ ID NO: 69267 - DNA, 25 bp, mus musculus
agcgagcgctacgacgacatggcca

SEQ ID NO: 69268 - DNA, 25 bp, mus musculus
gcgagcgctacgacgacatggccac

SEQ ID NO: 69269 - DNA, 25 bp, mus musculus
cacatcactggtctgctctcgctag

SEQ ID NO: 69270 - DNA, 25 bp, mus musculus
acatcactggtctgctctcgctagc

SEQ ID NO: 69271 - DNA, 25 bp, mus musculus
gccattgcctcgggcgctgttttct

SEQ ID NO: 69272 - DNA, 25 bp, mus musculus
ctgttttctgagacctcgcctcgcc

SEQ ID NO: 69273 - DNA, 25 bp, mus musculus
gccgttacgcgtgcctcaggcccag

SEQ ID NO: 69274 - DNA, 25 bp, mus musculus
ccgttacgcgtgcctcaggcccagt

SEQ ID NO: 69275 - DNA, 25 bp, mus musculus
cgacgccggcaggtgatgcccaata

SEQ ID NO: 69276 - DNA, 25 bp, mus musculus
acgccggcaggtgatgcccaataca

SEQ ID NO: 69277 - DNA, 25 bp, mus musculus
cgccggcaggtgatgcccaatacag

SEQ ID NO: 69278 - DNA, 25 bp, mus musculus
ggtgatgcccaatacagccatgaag

SEQ ID NO: 69279 - DNA, 25 bp, mus musculus
gtgatgcccaatacagccatgaaga

SEQ ID NO: 69280 - DNA, 25 bp, mus musculus
tgatgcccaatacagccatgaagaa

SEQ ID NO: 69281 - DNA, 25 bp, mus musculus
ctgctctcgctagctcggagcggct

SEQ ID NO: 69282 - DNA, 25 bp, mus musculus
gctctcgctagctcggagcggctgt

SEQ ID NO: 69283 - DNA, 25 bp, mus musculus
ctctcgctagctcggagcggctgtg

SEQ ID NO: 69284 - DNA, 25 bp, mus musculus
tcgctagctcggagcggctgtggcc

SEQ ID NO: 69285 - DNA, 25 bp, mus musculus
cgctagctcggagcggctgtggcca

SEQ ID NO: 69286 - DNA, 25 bp, mus musculus
tagctcggagcggctgtggccattg

SEQ ID NO: 69287 - DNA, 25 bp, mus musculus
tggccattgcctcgggcgctgtttt

SEQ ID NO: 69288 - DNA, 25 bp, mus musculus
ggccattgcctcgggcgctgttttc

SEQ ID NO: 69289 - DNA, 25 bp, mus musculus
taaacttgattcagcagcaaggaat

SEQ ID NO: 69290 - DNA, 25 bp, mus musculus
ttcagtacctaacagacaaaagtgt

SEQ ID NO: 69291 - DNA, 25 bp, mus musculus
tttcctgaattatacacagaacaat

SEQ ID NO: 69292 - DNA, 25 bp, mus musculus
atactcagacaatcactcacattct

SEQ ID NO: 69293 - DNA, 25 bp, mus musculus
agacaatcactcacattcttaatta

SEQ ID NO: 69294 - DNA, 25 bp, mus musculus
tcactcacattcttaattatcacta

SEQ ID NO: 69295 - DNA, 25 bp, mus musculus
acattcttaattatcactaggataa

SEQ ID NO: 69296 - DNA, 25 bp, mus musculus
atccatttctataacctgttgctct

SEQ ID NO: 69297 - DNA, 25 bp, mus musculus
ttctataacctgttgctctgaaatc

SEQ ID NO: 69298 - DNA, 25 bp, mus musculus
ttgctctgaaatcacttaagaacca

SEQ ID NO: 69299 - DNA, 25 bp, mus musculus
tgaaatcacttaagaaccaggatgc

SEQ ID NO: 69300 - DNA, 25 bp, mus musculus
cagttgctgtttgttagttggttgg

SEQ ID NO: 69301 - DNA, 25 bp, mus musculus
acctaacagacaaaagtgtgcatat

SEQ ID NO: 69302 - DNA, 25 bp, mus musculus
tctaagttcattttctacagaagag

SEQ ID NO: 69303 - DNA, 25 bp, mus musculus
taaattccctattccagggagctgt

SEQ ID NO: 69304 - DNA, 25 bp, mus musculus
tccagggagctgtgccaagggaaga

SEQ ID NO: 69305 - DNA, 25 bp, mus musculus
ttgacaacagacttaacagagcaga

SEQ ID NO: 69306 - DNA, 25 bp, mus musculus
agaatggacactctttgctctaagc

SEQ ID NO: 69307 - DNA, 25 bp, mus musculus
ctttgctctaagctttgaagaatca

SEQ ID NO: 69308 - DNA, 25 bp, mus musculus
agaatcactctgtttcctgaattat

SEQ ID NO: 69309 - DNA, 25 bp, mus musculus
tgaaaactccgcatgcctatgcggg

SEQ ID NO: 69310 - DNA, 25 bp, mus musculus
cagcctatgagatgcctgcgtttac

SEQ ID NO: 69311 - DNA, 25 bp, mus musculus
ttgcttatcatgttcactgcaaggg

SEQ ID NO: 69312 - DNA, 25 bp, mus musculus
atcatgttcactgcaagggaggcaa

SEQ ID NO: 69313 - DNA, 25 bp, mus musculus
tcaagaacaacgagcccatgatgta

SEQ ID NO: 69314 - DNA, 25 bp, mus musculus
acaacgagcccatgatgtacacata

SEQ ID NO: 69315 - DNA, 25 bp, mus musculus
tgatgtacacatacgacgagtacaa

SEQ ID NO: 69316 - DNA, 25 bp, mus musculus
gcttcctggaccaagcatctggaag

SEQ ID NO: 69317 - DNA, 25 bp, mus musculus
ccttcgaacaggctgctggactcta

SEQ ID NO: 69318 - DNA, 25 bp, mus musculus
aacaggctgctggactctatgccgg

SEQ ID NO: 69319 - DNA, 25 bp, mus musculus
ctgctggactctatgccgggcaata

SEQ ID NO: 69320 - DNA, 25 bp, mus musculus
ggcaatatgtccactcctccttttc

SEQ ID NO: 69321 - DNA, 25 bp, mus musculus
tgcctgcgtttactgccgagctgac

SEQ ID NO: 69322 - DNA, 25 bp, mus musculus
ttgacaagctgctctacaacggcag

SEQ ID NO: 69323 - DNA, 25 bp, mus musculus
tctacaacggcagacagaactacaa

SEQ ID NO: 69324 - DNA, 25 bp, mus musculus
gacagaactacaatccgcagacagg

SEQ ID NO: 69325 - DNA, 25 bp, mus musculus
actacaatccgcagacaggcatctt

SEQ ID NO: 69326 - DNA, 25 bp, mus musculus
agacaggcatcttcacctgtgaagt

SEQ ID NO: 69327 - DNA, 25 bp, mus musculus
gggtctactactttgcttatcatgt

SEQ ID NO: 69328 - DNA, 25 bp, mus musculus
actactttgcttatcatgttcactg

SEQ ID NO: 69329 - DNA, 25 bp, mus musculus
gattgatttcccactttgtgcccat

SEQ ID NO: 69330 - DNA, 25 bp, mus musculus
attgatttcccactttgtgcccata

SEQ ID NO: 69331 - DNA, 25 bp, mus musculus
aaccattgaaggcttgccgtaattg

SEQ ID NO: 69332 - DNA, 25 bp, mus musculus
accattgaaggcttgccgtaattgg

SEQ ID NO: 69333 - DNA, 25 bp, mus musculus
ccattgaaggcttgccgtaattggt

SEQ ID NO: 69334 - DNA, 25 bp, mus musculus
ttgaaggcttgccgtaattggttgc

SEQ ID NO: 69335 - DNA, 25 bp, mus musculus
tgaaggcttgccgtaattggttgca

SEQ ID NO: 69336 - DNA, 25 bp, mus musculus
gaaggcttgccgtaattggttgcaa

SEQ ID NO: 69337 - DNA, 25 bp, mus musculus
cttgccgtaattggttgcaaacaat

SEQ ID NO: 69338 - DNA, 25 bp, mus musculus
tcccactttgtgcccatattgtggt

SEQ ID NO: 69339 - DNA, 25 bp, mus musculus
cccactttgtgcccatattgtggta

SEQ ID NO: 69340 - DNA, 25 bp, mus musculus
ccactttgtgcccatattgtggtag

SEQ ID NO: 69341 - DNA, 25 bp, mus musculus
cactttgtgcccatattgtggtaga

SEQ ID NO: 69342 - DNA, 25 bp, mus musculus
actttgtgcccatattgtggtagaa

SEQ ID NO: 69343 - DNA, 25 bp, mus musculus
taggcaaatctcctttggaaaccat

SEQ ID NO: 69344 - DNA, 25 bp, mus musculus
ggcaaatctcctttggaaaccattg

SEQ ID NO: 69345 - DNA, 25 bp, mus musculus
tctcctttggaaaccattgaaggct

SEQ ID NO: 69346 - DNA, 25 bp, mus musculus
gacagaactagccaaaacgatgcct

SEQ ID NO: 69347 - DNA, 25 bp, mus musculus
tttgtgactgacaaccagacccttc

SEQ ID NO: 69348 - DNA, 25 bp, mus musculus
acgtcaacagcagactttttggatc

SEQ ID NO: 69349 - DNA, 25 bp, mus musculus
caagtcacttctcagaagaaagctg

SEQ ID NO: 69350 - DNA, 25 bp, mus musculus
tccaccaggcttaccaaatgagctc

SEQ ID NO: 69351 - DNA, 25 bp, mus musculus
accaaatgagctcctttgagcagcc

SEQ ID NO: 69352 - DNA, 25 bp, mus musculus
ccttccgtgctccatatcatggatc

SEQ ID NO: 69353 - DNA, 25 bp, mus musculus
gtgctccatatcatggatccagagc

SEQ ID NO: 69354 - DNA, 25 bp, mus musculus
tagcaactcagtttagcactgccaa

SEQ ID NO: 69355 - DNA, 25 bp, mus musculus
gatgacatcttcaccagatgccaca

SEQ ID NO: 69356 - DNA, 25 bp, mus musculus
atcttcaccagatgccacaactggc

SEQ ID NO: 69357 - DNA, 25 bp, mus musculus
accagatgccacaactggccagact

SEQ ID NO: 69358 - DNA, 25 bp, mus musculus
ccgccagcattctcttccatagaca

SEQ ID NO: 69359 - DNA, 25 bp, mus musculus
tcttccatagacaagcaagtctatg

SEQ ID NO: 69360 - DNA, 25 bp, mus musculus
aagcaagtctatgcagccatgccca

SEQ ID NO: 69361 - DNA, 25 bp, mus musculus
gtctatgcagccatgcccatcaata

SEQ ID NO: 69362 - DNA, 25 bp, mus musculus
gcagccatgcccatcaatagctttc

SEQ ID NO: 69363 - DNA, 25 bp, mus musculus
atgcccatcaatagctttcgatcag

SEQ ID NO: 69364 - DNA, 25 bp, mus musculus
ctaatagtcggtgactcacagcacc

SEQ ID NO: 69365 - DNA, 25 bp, mus musculus
tctgccacgtcaacagcagactttt

SEQ ID NO: 69366 - DNA, 25 bp, mus musculus
tgccaagcctaaaaaagcagcaaag

SEQ ID NO: 69367 - DNA, 25 bp, mus musculus
taagaccgctaagcctaaggctgcc

SEQ ID NO: 69368 - DNA, 25 bp, mus musculus
tggtctgtctcgattgggacagtta

SEQ ID NO: 69369 - DNA, 25 bp, mus musculus
aactggaacccttatctgccacgat

SEQ ID NO: 69370 - DNA, 25 bp, mus musculus
aacccttatctgccacgattcctgt

SEQ ID NO: 69371 - DNA, 25 bp, mus musculus
tatctgccacgattcctgtgctcac

SEQ ID NO: 69372 - DNA, 25 bp, mus musculus
ttcctgtgctcacaatctacaaggt

SEQ ID NO: 69373 - DNA, 25 bp, mus musculus
tgctcacaatctacaaggtaagact

SEQ ID NO: 69374 - DNA, 25 bp, mus musculus
taagactccgttacgatggctgtta

SEQ ID NO: 69375 - DNA, 25 bp, mus musculus
tccgttacgatggctgttaggtact

SEQ ID NO: 69376 - DNA, 25 bp, mus musculus
tatggtcacctggtgacctttgtac

SEQ ID NO: 69377 - DNA, 25 bp, mus musculus
gtgacctttgtacgtgagccataac

SEQ ID NO: 69378 - DNA, 25 bp, mus musculus
cgctaagcctaaggctgccaaggcc

SEQ ID NO: 69379 - DNA, 25 bp, mus musculus
cataactgcacacattcatttccct

SEQ ID NO: 69380 - DNA, 25 bp, mus musculus
ttgcttgcgacagcaacaaagcccc

SEQ ID NO: 69381 - DNA, 25 bp, mus musculus
gcgacagcaacaaagccccaaaggc

SEQ ID NO: 69382 - DNA, 25 bp, mus musculus
ctcttttcagagccacctagagagc

SEQ ID NO: 69383 - DNA, 25 bp, mus musculus
tcagagccacctagagagctctgtg

SEQ ID NO: 69384 - DNA, 25 bp, mus musculus
ccacctagagagctctgtgaatgta

SEQ ID NO: 69385 - DNA, 25 bp, mus musculus
agctgtacacacttatgctttccat

SEQ ID NO: 69386 - DNA, 25 bp, mus musculus
acacacttatgctttccatggtctg

SEQ ID NO: 69387 - DNA, 25 bp, mus musculus
aagatatcagcaccttggagccgtt

SEQ ID NO: 69388 - DNA, 25 bp, mus musculus
gatatcagcaccttggagccgttga

SEQ ID NO: 69389 - DNA, 25 bp, mus musculus
ccccagctgtcctatctggatggct

SEQ ID NO: 69390 - DNA, 25 bp, mus musculus
ccagctgtcctatctggatggctat

SEQ ID NO: 69391 - DNA, 25 bp, mus musculus
agctgtcctatctggatggctatga

SEQ ID NO: 69392 - DNA, 25 bp, mus musculus
ctgtcctatctggatggctatgacc

SEQ ID NO: 69393 - DNA, 25 bp, mus musculus
tatctggatggctatgaccgagagg

SEQ ID NO: 69394 - DNA, 25 bp, mus musculus
ccaggaagcacctgactcagatgtg

SEQ ID NO: 69395 - DNA, 25 bp, mus musculus
aggaagcacctgactcagatgtgga

SEQ ID NO: 69396 - DNA, 25 bp, mus musculus
gaagcacctgactcagatgtggagg

SEQ ID NO: 69397 - DNA, 25 bp, mus musculus
aagcacctgactcagatgtggaggt

SEQ ID NO: 69398 - DNA, 25 bp, mus musculus
agcacctgactcagatgtggaggtg

SEQ ID NO: 69399 - DNA, 25 bp, mus musculus
tatcagcaccttggagccgttgaaa

SEQ ID NO: 69400 - DNA, 25 bp, mus musculus
tcagcaccttggagccgttgaaaag

SEQ ID NO: 69401 - DNA, 25 bp, mus musculus
tctgaaaagcctggatctgtttggc

SEQ ID NO: 69402 - DNA, 25 bp, mus musculus
gcctggatctgtttggctgtgaggt

SEQ ID NO: 69403 - DNA, 25 bp, mus musculus
ctgtttggctgtgaggtcactaacc

SEQ ID NO: 69404 - DNA, 25 bp, mus musculus
tcactaaccggagtgattaccgaga

SEQ ID NO: 69405 - DNA, 25 bp, mus musculus
ttaccgagaaactgtcttcaggctc

SEQ ID NO: 69406 - DNA, 25 bp, mus musculus
accgagaaactgtcttcaggctcct

SEQ ID NO: 69407 - DNA, 25 bp, mus musculus
ggtagccaacggttgtggagcatca

SEQ ID NO: 69408 - DNA, 25 bp, mus musculus
tggagcatcatgcccaagttttatc

SEQ ID NO: 69409 - DNA, 25 bp, mus musculus
acccacgattctccatctgtgagga

SEQ ID NO: 69410 - DNA, 25 bp, mus musculus
aggaagacacactgcagtggtcgga

SEQ ID NO: 69411 - DNA, 25 bp, mus musculus
aagacacactgcagtggtcggaaac

SEQ ID NO: 69412 - DNA, 25 bp, mus musculus
acacactgcagtggtcggaaacaca

SEQ ID NO: 69413 - DNA, 25 bp, mus musculus
gagcaggcccagagcctgattgaca

SEQ ID NO: 69414 - DNA, 25 bp, mus musculus
gcccagagcctgattgacaagacaa

SEQ ID NO: 69415 - DNA, 25 bp, mus musculus
gacaagacaacggctgcatttcaac

SEQ ID NO: 69416 - DNA, 25 bp, mus musculus
aagacaacggctgcatttcaacaag

SEQ ID NO: 69417 - DNA, 25 bp, mus musculus
acaacggctgcatttcaacaaggga

SEQ ID NO: 69418 - DNA, 25 bp, mus musculus
acggctgcatttcaacaagggaaga

SEQ ID NO: 69419 - DNA, 25 bp, mus musculus
agcatcatgcccaagttttatcttg

SEQ ID NO: 69420 - DNA, 25 bp, mus musculus
atgcccaagttttatcttgactact

SEQ ID NO: 69421 - DNA, 25 bp, mus musculus
aagttttatcttgactactgtgata

SEQ ID NO: 69422 - DNA, 25 bp, mus musculus
ttttatcttgactactgtgatacgt

SEQ ID NO: 69423 - DNA, 25 bp, mus musculus
cttgactactgtgatacgtatctta

SEQ ID NO: 69424 - DNA, 25 bp, mus musculus
acgtatcttacccacgattctccat

SEQ ID NO: 69425 - DNA, 25 bp, mus musculus
tatcttacccacgattctccatctg

SEQ ID NO: 69426 - DNA, 25 bp, mus musculus
cttacccacgattctccatctgtga

SEQ ID NO: 69427 - DNA, 25 bp, mus musculus
ggcctcttctgtagcgtctttacca

SEQ ID NO: 69428 - DNA, 25 bp, mus musculus
agcgtctttaccatcagcatgtacc

SEQ ID NO: 69429 - DNA, 25 bp, mus musculus
cttttctgcaagtaccctccagagc

SEQ ID NO: 69430 - DNA, 25 bp, mus musculus
tgcaagtaccctccagagcaagaca

SEQ ID NO: 69431 - DNA, 25 bp, mus musculus
cagagctcctgtttctgctggtcct

SEQ ID NO: 69432 - DNA, 25 bp, mus musculus
tggtccttgtgaccagttccatgga

SEQ ID NO: 69433 - DNA, 25 bp, mus musculus
ttgtgaccagttccatggatgcaat

SEQ ID NO: 69434 - DNA, 25 bp, mus musculus
gaccaaagatctttccttagatcag

SEQ ID NO: 69435 - DNA, 25 bp, mus musculus
agatctttccttagatcagatagga

SEQ ID NO: 69436 - DNA, 25 bp, mus musculus
aaatcacatttttacaggagatcat

SEQ ID NO: 69437 - DNA, 25 bp, mus musculus
agatcatcttttctcatttcggagg

SEQ ID NO: 69438 - DNA, 25 bp, mus musculus
tcttttctcatttcggaggctgagg

SEQ ID NO: 69439 - DNA, 25 bp, mus musculus
ccactggctgatttggccaagatcg

SEQ ID NO: 69440 - DNA, 25 bp, mus musculus
gttcagactaaatcaacccagcgcc

SEQ ID NO: 69441 - DNA, 25 bp, mus musculus
tttcgcctccgagacccatacatcg

SEQ ID NO: 69442 - DNA, 25 bp, mus musculus
ctccgagacccatacatcgcggtgc

SEQ ID NO: 69443 - DNA, 25 bp, mus musculus
tacatcgcggtgcccaaccttccag

SEQ ID NO: 69444 - DNA, 25 bp, mus musculus
cttccaggaatcctcaccagcttaa

SEQ ID NO: 69445 - DNA, 25 bp, mus musculus
ggaatcctcaccagcttaatccgcc

SEQ ID NO: 69446 - DNA, 25 bp, mus musculus
atccgcctcgggcttttctgcaagt

SEQ ID NO: 69447 - DNA, 25 bp, mus musculus
ctggctttgtgcaccgggcagcaga

SEQ ID NO: 69448 - DNA, 25 bp, mus musculus
ttgtgcaccgggcagcagacactgc

SEQ ID NO: 69449 - DNA, 25 bp, mus musculus
gcttggctgcaccatggagttcagc

SEQ ID NO: 69450 - DNA, 25 bp, mus musculus
ggctcacttctggaagcccaaaggg

SEQ ID NO: 69451 - DNA, 25 bp, mus musculus
tcacttctggaagcccaaaggggtg

SEQ ID NO: 69452 - DNA, 25 bp, mus musculus
gatcatcgccatagtggcccagtac

SEQ ID NO: 69453 - DNA, 25 bp, mus musculus
catcgccatagtggcccagtacggt

SEQ ID NO: 69454 - DNA, 25 bp, mus musculus
catagtggcccagtacggtatcatg

SEQ ID NO: 69455 - DNA, 25 bp, mus musculus
ggcccagtacggtatcatgcccctc

SEQ ID NO: 69456 - DNA, 25 bp, mus musculus
gtacggtatcatgcccctcagtgct

SEQ ID NO: 69457 - DNA, 25 bp, mus musculus
tttccttctgggcaaggtctttcat

SEQ ID NO: 69458 - DNA, 25 bp, mus musculus
ccttctgggcaaggtctttcatctg

SEQ ID NO: 69459 - DNA, 25 bp, mus musculus
cagcagacactgcgctcaggtcatt

SEQ ID NO: 69460 - DNA, 25 bp, mus musculus
caaggtctttcatctgaccagcatt

SEQ ID NO: 69461 - DNA, 25 bp, mus musculus
acactgcgctcaggtcattctggta

SEQ ID NO: 69462 - DNA, 25 bp, mus musculus
cgctcaggtcattctggtagttatg

SEQ ID NO: 69463 - DNA, 25 bp, mus musculus
agttatgttgctgctcatcatgctc

SEQ ID NO: 69464 - DNA, 25 bp, mus musculus
gttgctgctcatcatgctctcgctt

SEQ ID NO: 69465 - DNA, 25 bp, mus musculus
gctcatcatgctctcgcttggctgc

SEQ ID NO: 69466 - DNA, 25 bp, mus musculus
catcatgctctcgcttggctgcacc

SEQ ID NO: 69467 - DNA, 25 bp, mus musculus
catgctctcgcttggctgcaccatg

SEQ ID NO: 69468 - DNA, 25 bp, mus musculus
agagttccaggtttctgatgaacag

SEQ ID NO: 69469 - DNA, 25 bp, mus musculus
atgaacagtatcctgatccacggat

SEQ ID NO: 69470 - DNA, 25 bp, mus musculus
tctggaaacgcgcagacttgagcgg

SEQ ID NO: 69471 - DNA, 25 bp, mus musculus
tggaaacgcgcagacttgagcggtc

SEQ ID NO: 69472 - DNA, 25 bp, mus musculus
aaacgcgcagacttgagcggtccaa

SEQ ID NO: 69473 - DNA, 25 bp, mus musculus
aacgcgcagacttgagcggtccaaa

SEQ ID NO: 69474 - DNA, 25 bp, mus musculus
cagacttgagcggtccaaagatacc

SEQ ID NO: 69475 - DNA, 25 bp, mus musculus
gacttgagcggtccaaagataccca

SEQ ID NO: 69476 - DNA, 25 bp, mus musculus
agcggtccaaagatacccaggatag

SEQ ID NO: 69477 - DNA, 25 bp, mus musculus
gcggtccaaagatacccaggatagt

SEQ ID NO: 69478 - DNA, 25 bp, mus musculus
ggtccaaagatacccaggatagtgc

SEQ ID NO: 69479 - DNA, 25 bp, mus musculus
gtccaaagatacccaggatagtgcc

SEQ ID NO: 69480 - DNA, 25 bp, mus musculus
tgaacagtatcctgatccacggatg

SEQ ID NO: 69481 - DNA, 25 bp, mus musculus
aacagtatcctgatccacggatgag

SEQ ID NO: 69482 - DNA, 25 bp, mus musculus
acagtatcctgatccacggatgagg

SEQ ID NO: 69483 - DNA, 25 bp, mus musculus
agtatcctgatccacggatgaggac

SEQ ID NO: 69484 - DNA, 25 bp, mus musculus
gtatcctgatccacggatgaggacc

SEQ ID NO: 69485 - DNA, 25 bp, mus musculus
tcctgatccacggatgaggacctca

SEQ ID NO: 69486 - DNA, 25 bp, mus musculus
tgatccacggatgaggacctcacct

SEQ ID NO: 69487 - DNA, 25 bp, mus musculus
ccctctgatcaggagaagagacgaa

SEQ ID NO: 69488 - DNA, 25 bp, mus musculus
ggccttgcacaaacacagaacaatc

SEQ ID NO: 69489 - DNA, 25 bp, mus musculus
acacagaacaatcacgagagcagca

SEQ ID NO: 69490 - DNA, 25 bp, mus musculus
ggttcagccctcgatgccaacagac

SEQ ID NO: 69491 - DNA, 25 bp, mus musculus
cgactattcggaggagtctgacacg

SEQ ID NO: 69492 - DNA, 25 bp, mus musculus
tgacacggatctcagccaaaagtcc

SEQ ID NO: 69493 - DNA, 25 bp, mus musculus
ctgccccaaggacagtggtctgacc

SEQ ID NO: 69494 - DNA, 25 bp, mus musculus
cagtggtctgaccagtgtaggaacg

SEQ ID NO: 69495 - DNA, 25 bp, mus musculus
tctgaccagtgtaggaacggacacc

SEQ ID NO: 69496 - DNA, 25 bp, mus musculus
ggacaccttcagattgtaagctttg

SEQ ID NO: 69497 - DNA, 25 bp, mus musculus
tttcaaaactagactaactgcaatt

SEQ ID NO: 69498 - DNA, 25 bp, mus musculus
aactagactaactgcaattccaaag

SEQ ID NO: 69499 - DNA, 25 bp, mus musculus
tgcaattccaaagcttctaaccaaa

SEQ ID NO: 69500 - DNA, 25 bp, mus musculus
tttattacctcactctgcctgcttc

SEQ ID NO: 69501 - DNA, 25 bp, mus musculus
ccacgcctccaggaagtcttggccg

SEQ ID NO: 69502 - DNA, 25 bp, mus musculus
ctccaggaagtcttggccgccagtg

SEQ ID NO: 69503 - DNA, 25 bp, mus musculus
tctctcctcatcttcaacggttacc

SEQ ID NO: 69504 - DNA, 25 bp, mus musculus
ttcaacggttacctcaagttcatgc

SEQ ID NO: 69505 - DNA, 25 bp, mus musculus
ggttacctcaagttcatgcagcacc

SEQ ID NO: 69506 - DNA, 25 bp, mus musculus
ctcaagttcatgcagcacctcaggg

SEQ ID NO: 69507 - DNA, 25 bp, mus musculus
ttcatgcagcacctcaggggttcag

SEQ ID NO: 69508 - DNA, 25 bp, mus musculus
ttcaatgccacacttctcgagtccg

SEQ ID NO: 69509 - DNA, 25 bp, mus musculus
caatgccacacttctcgagtccgat

SEQ ID NO: 69510 - DNA, 25 bp, mus musculus
ccatcctgtccatccagaacgatgt

SEQ ID NO: 69511 - DNA, 25 bp, mus musculus
tcctgtccatccagaacgatgtgga

SEQ ID NO: 69512 - DNA, 25 bp, mus musculus
cctgtccatccagaacgatgtggag

SEQ ID NO: 69513 - DNA, 25 bp, mus musculus
tgtccatccagaacgatgtggagaa

SEQ ID NO: 69514 - DNA, 25 bp, mus musculus
cactgtcaccattgatgatctgcga

SEQ ID NO: 69515 - DNA, 25 bp, mus musculus
actgtcaccattgatgatctgcgaa

SEQ ID NO: 69516 - DNA, 25 bp, mus musculus
tgtcaccattgatgatctgcgaaca

SEQ ID NO: 69517 - DNA, 25 bp, mus musculus
gtcaccattgatgatctgcgaacaa

SEQ ID NO: 69518 - DNA, 25 bp, mus musculus
tcaccattgatgatctgcgaacaag

SEQ ID NO: 69519 - DNA, 25 bp, mus musculus
tgatgatctgcgaacaagtggtaca

SEQ ID NO: 69520 - DNA, 25 bp, mus musculus
aatgccacacttctcgagtccgatg

SEQ ID NO: 69521 - DNA, 25 bp, mus musculus
atgccacacttctcgagtccgatgg

SEQ ID NO: 69522 - DNA, 25 bp, mus musculus
cacacttctcgagtccgatggggat

SEQ ID NO: 69523 - DNA, 25 bp, mus musculus
tctcgagtccgatggggatcggcag

SEQ ID NO: 69524 - DNA, 25 bp, mus musculus
ctcgagtccgatggggatcggcagt

SEQ ID NO: 69525 - DNA, 25 bp, mus musculus
tcgagtccgatggggatcggcagtc

SEQ ID NO: 69526 - DNA, 25 bp, mus musculus
gtccatcctgtccatccagaacgat

SEQ ID NO: 69527 - DNA, 25 bp, mus musculus
tccatcctgtccatccagaacgatg

SEQ ID NO: 69528 - DNA, 25 bp, mus musculus
atgctttctaaggcctcttatgcag

SEQ ID NO: 69529 - DNA, 25 bp, mus musculus
gcctcttatgcaggagcgtagagtg

SEQ ID NO: 69530 - DNA, 25 bp, mus musculus
acatttagtccagtcctgtagaatc

SEQ ID NO: 69531 - DNA, 25 bp, mus musculus
agtccagtcctgtagaatccgctcc

SEQ ID NO: 69532 - DNA, 25 bp, mus musculus
ccgctcctcctgaaagatgtgtatg

SEQ ID NO: 69533 - DNA, 25 bp, mus musculus
ctgtgcgctgggagtgacgattgat

SEQ ID NO: 69534 - DNA, 25 bp, mus musculus
gtaacctgaatctcggtgcattatg

SEQ ID NO: 69535 - DNA, 25 bp, mus musculus
tgaatctcggtgcattatgcggcaa

SEQ ID NO: 69536 - DNA, 25 bp, mus musculus
cattatgcggcaactgcgcctgttg

SEQ ID NO: 69537 - DNA, 25 bp, mus musculus
actgcgcctgttggttagagctgct

SEQ ID NO: 69538 - DNA, 25 bp, mus musculus
agctgctgtgcgcactcacaggatc

SEQ ID NO: 69539 - DNA, 25 bp, mus musculus
atcactgtaaccaactaatgccaaa

SEQ ID NO: 69540 - DNA, 25 bp, mus musculus
catctcttgcctgtgcgctaaagct

SEQ ID NO: 69541 - DNA, 25 bp, mus musculus
ttgcctgtgcgctaaagctgtccag

SEQ ID NO: 69542 - DNA, 25 bp, mus musculus
gtatgactcctgtgtgctgacgctg

SEQ ID NO: 69543 - DNA, 25 bp, mus musculus
tgtgctgacgctgttcagacgagct

SEQ ID NO: 69544 - DNA, 25 bp, mus musculus
acgagctctaagaatccattttcta

SEQ ID NO: 69545 - DNA, 25 bp, mus musculus
tctaagaatccattttctaaagcaa

SEQ ID NO: 69546 - DNA, 25 bp, mus musculus
aatccattttctaaagcaaagtcat

SEQ ID NO: 69547 - DNA, 25 bp, mus musculus
ttcccaacatttagtccagtcctgt

SEQ ID NO: 69548 - DNA, 25 bp, mus musculus
taaccttggcactggcagtctagat

SEQ ID NO: 69549 - DNA, 25 bp, mus musculus
aaccttggcactggcagtctagatc

SEQ ID NO: 69550 - DNA, 25 bp, mus musculus
caagtgtctgttctcctgaactgga

SEQ ID NO: 69551 - DNA, 25 bp, mus musculus
gtgtctgttctcctgaactggagac

SEQ ID NO: 69552 - DNA, 25 bp, mus musculus
aagacccgaggatctatgcatctgg

SEQ ID NO: 69553 - DNA, 25 bp, mus musculus
agacccgaggatctatgcatctgga

SEQ ID NO: 69554 - DNA, 25 bp, mus musculus
tctatgcatctggactgtgctaaat

SEQ ID NO: 69555 - DNA, 25 bp, mus musculus
ctatgcatctggactgtgctaaata

SEQ ID NO: 69556 - DNA, 25 bp, mus musculus
atgcatctggactgtgctaaatagg

SEQ ID NO: 69557 - DNA, 25 bp, mus musculus
tgcatctggactgtgctaaataggg

SEQ ID NO: 69558 - DNA, 25 bp, mus musculus
catctggactgtgctaaatagggaa

SEQ ID NO: 69559 - DNA, 25 bp, mus musculus
atctggactgtgctaaatagggaat

SEQ ID NO: 69560 - DNA, 25 bp, mus musculus
ggcactggcagtctagatcagcaca

SEQ ID NO: 69561 - DNA, 25 bp, mus musculus
agggaatccaacgactagcttcaag

SEQ ID NO: 69562 - DNA, 25 bp, mus musculus
cactggcagtctagatcagcacatt

SEQ ID NO: 69563 - DNA, 25 bp, mus musculus
ctcgattcaccaagtgtctgttctc

SEQ ID NO: 69564 - DNA, 25 bp, mus musculus
gattcaccaagtgtctgttctcctg

SEQ ID NO: 69565 - DNA, 25 bp, mus musculus
attcaccaagtgtctgttctcctga

SEQ ID NO: 69566 - DNA, 25 bp, mus musculus
tcaccaagtgtctgttctcctgaac

SEQ ID NO: 69567 - DNA, 25 bp, mus musculus
caccaagtgtctgttctcctgaact

SEQ ID NO: 69568 - DNA, 25 bp, mus musculus
ccaagtgtctgttctcctgaactgg

SEQ ID NO: 69569 - DNA, 25 bp, mus musculus
tgtgctcacacagctggtggcacct

SEQ ID NO: 69570 - DNA, 25 bp, mus musculus
cacacagctggtggcacctggatgg

SEQ ID NO: 69571 - DNA, 25 bp, mus musculus
ttctagcaaactgtagtgcacccag

SEQ ID NO: 69572 - DNA, 25 bp, mus musculus
gtagtgcacccagctatgaagtgtt

SEQ ID NO: 69573 - DNA, 25 bp, mus musculus
cacccagctatgaagtgttcctcgt

SEQ ID NO: 69574 - DNA, 25 bp, mus musculus
gctatgaagtgttcctcgtgtccac

SEQ ID NO: 69575 - DNA, 25 bp, mus musculus
aagtgttcctcgtgtccacagacct

SEQ ID NO: 69576 - DNA, 25 bp, mus musculus
tgtccacagaccttggattaccaga

SEQ ID NO: 69577 - DNA, 25 bp, mus musculus
atgtggctgcgaccatcctgtgtta

SEQ ID NO: 69578 - DNA, 25 bp, mus musculus
caccatgaagcctcaatggcaagga

SEQ ID NO: 69579 - DNA, 25 bp, mus musculus
gaagcctcaatggcaaggagtggtg

SEQ ID NO: 69580 - DNA, 25 bp, mus musculus
caagaatcaaccacttgcatcttac

SEQ ID NO: 69581 - DNA, 25 bp, mus musculus
gcacgtttagccggcaggacaagcc

SEQ ID NO: 69582 - DNA, 25 bp, mus musculus
cttgcatcttacaaaattactctta

SEQ ID NO: 69583 - DNA, 25 bp, mus musculus
ttagccggcaggacaagccgggagc

SEQ ID NO: 69584 - DNA, 25 bp, mus musculus
gaacagcttgcagcacaaggcctca

SEQ ID NO: 69585 - DNA, 25 bp, mus musculus
gcacaaggcctcacctggggagctt

SEQ ID NO: 69586 - DNA, 25 bp, mus musculus
ggcctcacctggggagcttaggact

SEQ ID NO: 69587 - DNA, 25 bp, mus musculus
tgctctcagaatgtcgtatagcgca

SEQ ID NO: 69588 - DNA, 25 bp, mus musculus
gtcgtatagcgcaacaactgactac

SEQ ID NO: 69589 - DNA, 25 bp, mus musculus
tagcgcaacaactgactacatttag

SEQ ID NO: 69590 - DNA, 25 bp, mus musculus
ctttctgtgtccacaagagatgctg

SEQ ID NO: 69591 - DNA, 25 bp, mus musculus
gtgtccacaagagatgctgtagaat

SEQ ID NO: 69592 - DNA, 25 bp, mus musculus
ttcagtctgcctgcatcagtcttct

SEQ ID NO: 69593 - DNA, 25 bp, mus musculus
ctgcctgcatcagtcttctcctctg

SEQ ID NO: 69594 - DNA, 25 bp, mus musculus
tcctctgtatacgtctgtcttcaac

SEQ ID NO: 69595 - DNA, 25 bp, mus musculus
gtatacgtctgtcttcaacaaatgt

SEQ ID NO: 69596 - DNA, 25 bp, mus musculus
gtctgtcttcaacaaatgtaaggac

SEQ ID NO: 69597 - DNA, 25 bp, mus musculus
cccgatcacatccattatcaaggat

SEQ ID NO: 69598 - DNA, 25 bp, mus musculus
cacatccattatcaaggatttgaag

SEQ ID NO: 69599 - DNA, 25 bp, mus musculus
tttgaagccactccatgtactgggt

SEQ ID NO: 69600 - DNA, 25 bp, mus musculus
gccactccatgtactgggttataaa

SEQ ID NO: 69601 - DNA, 25 bp, mus musculus
tgttctcatgaactttcatgaagtt

SEQ ID NO: 69602 - DNA, 25 bp, mus musculus
attgtatgactcctatgttggcttt

SEQ ID NO: 69603 - DNA, 25 bp, mus musculus
tgactcctatgttggctttattaag

SEQ ID NO: 69604 - DNA, 25 bp, mus musculus
taccaattctctttgcctctatgtt

SEQ ID NO: 69605 - DNA, 25 bp, mus musculus
ttctctttgcctctatgttataacc

SEQ ID NO: 69606 - DNA, 25 bp, mus musculus
ttgcctctatgttataacccctaag

SEQ ID NO: 69607 - DNA, 25 bp, mus musculus
agtggccattctatctgactactat

SEQ ID NO: 69608 - DNA, 25 bp, mus musculus
cattctatctgactactatgacttt

SEQ ID NO: 69609 - DNA, 25 bp, mus musculus
ctgctttgggttttcagtctgcctg

SEQ ID NO: 69610 - DNA, 25 bp, mus musculus
taatacacactttaatggggagact

SEQ ID NO: 69611 - DNA, 25 bp, mus musculus
cagacatatcatgttctctgtggtg

SEQ ID NO: 69612 - DNA, 25 bp, mus musculus
gttactttatcttttaagagatcat

SEQ ID NO: 69613 - DNA, 25 bp, mus musculus
tatacctataatttctacatttcaa

SEQ ID NO: 69614 - DNA, 25 bp, mus musculus
ttctacatttcaaaattacacatgt

SEQ ID NO: 69615 - DNA, 25 bp, mus musculus
acatttcaaaattacacatgtgact

SEQ ID NO: 69616 - DNA, 25 bp, mus musculus
atttcaaaattacacatgtgactta

SEQ ID NO: 69617 - DNA, 25 bp, mus musculus
attacacatgtgacttacagagtta

SEQ ID NO: 69618 - DNA, 25 bp, mus musculus
tacacatgtgacttacagagttatt

SEQ ID NO: 69619 - DNA, 25 bp, mus musculus
tatttttgctacaggtaatattcct

SEQ ID NO: 69620 - DNA, 25 bp, mus musculus
atcaatcattagttgcccagggaaa

SEQ ID NO: 69621 - DNA, 25 bp, mus musculus
atttttactgtgtgtatagatgcat

SEQ ID NO: 69622 - DNA, 25 bp, mus musculus
gacatatcatgttctctgtggtggt

SEQ ID NO: 69623 - DNA, 25 bp, mus musculus
tcatgttctctgtggtggttttgga

SEQ ID NO: 69624 - DNA, 25 bp, mus musculus
ctagagaacgctttctcgtgagcca

SEQ ID NO: 69625 - DNA, 25 bp, mus musculus
agagaacgctttctcgtgagccaaa

SEQ ID NO: 69626 - DNA, 25 bp, mus musculus
aacgctttctcgtgagccaaatgta

SEQ ID NO: 69627 - DNA, 25 bp, mus musculus
cgctttctcgtgagccaaatgtaag

SEQ ID NO: 69628 - DNA, 25 bp, mus musculus
ctttctcgtgagccaaatgtaagat

SEQ ID NO: 69629 - DNA, 25 bp, mus musculus
ttctcgtgagccaaatgtaagattg

SEQ ID NO: 69630 - DNA, 25 bp, mus musculus
gtacacgtgtcatggatgtggaaag

SEQ ID NO: 69631 - DNA, 25 bp, mus musculus
acagaaatcccatctcacgtcacat

SEQ ID NO: 69632 - DNA, 25 bp, mus musculus
aagcctgaccagtcatcagaatatt

SEQ ID NO: 69633 - DNA, 25 bp, mus musculus
cctgaccagtcatcagaatattcat

SEQ ID NO: 69634 - DNA, 25 bp, mus musculus
gaatattcattactatgtggttaat

SEQ ID NO: 69635 - DNA, 25 bp, mus musculus
tattcattactatgtggttaatgct

SEQ ID NO: 69636 - DNA, 25 bp, mus musculus
tcattactatgtggttaatgctggc

SEQ ID NO: 69637 - DNA, 25 bp, mus musculus
ttgtcattcaaatcttagtcgccat

SEQ ID NO: 69638 - DNA, 25 bp, mus musculus
tcattcaaatcttagtcgccatcag

SEQ ID NO: 69639 - DNA, 25 bp, mus musculus
ttcaaatcttagtcgccatcagaaa

SEQ ID NO: 69640 - DNA, 25 bp, mus musculus
aaatcttagtcgccatcagaaaatc

SEQ ID NO: 69641 - DNA, 25 bp, mus musculus
tagtcgccatcagaaaatccatgct

SEQ ID NO: 69642 - DNA, 25 bp, mus musculus
atcccatctcacgtcacatcagaaa

SEQ ID NO: 69643 - DNA, 25 bp, mus musculus
ccatctcacgtcacatcagaaaatt

SEQ ID NO: 69644 - DNA, 25 bp, mus musculus
tctcacgtcacatcagaaaattcac

SEQ ID NO: 69645 - DNA, 25 bp, mus musculus
cacgtcacatcagaaaattcacacc

SEQ ID NO: 69646 - DNA, 25 bp, mus musculus
gtcacatcagaaaattcacaccgga

SEQ ID NO: 69647 - DNA, 25 bp, mus musculus
tgtctgtggagtctgtggaaaagct

SEQ ID NO: 69648 - DNA, 25 bp, mus musculus
tcgcggctcaagcctgaccagtcat

SEQ ID NO: 69649 - DNA, 25 bp, mus musculus
ctcaagcctgaccagtcatcagaat

SEQ ID NO: 69650 - DNA, 25 bp, mus musculus
tcacctctgcatgcacttaactttg

SEQ ID NO: 69651 - DNA, 25 bp, mus musculus
ctgcatgcacttaactttggcattg

SEQ ID NO: 69652 - DNA, 25 bp, mus musculus
gatgcagaccctgggtttgtgcatt

SEQ ID NO: 69653 - DNA, 25 bp, mus musculus
gaccctgggtttgtgcattctgatg

SEQ ID NO: 69654 - DNA, 25 bp, mus musculus
gggtttgtgcattctgatggcacca

SEQ ID NO: 69655 - DNA, 25 bp, mus musculus
tctgatggcaccataagtcaccatg

SEQ ID NO: 69656 - DNA, 25 bp, mus musculus
ggcaccataagtcaccatgacatgt

SEQ ID NO: 69657 - DNA, 25 bp, mus musculus
tatgattacctacacctgagccgcc

SEQ ID NO: 69658 - DNA, 25 bp, mus musculus
tacctacacctgagccgcctggggt

SEQ ID NO: 69659 - DNA, 25 bp, mus musculus
ttgcttcttcgtctcttggcccaag

SEQ ID NO: 69660 - DNA, 25 bp, mus musculus
gcccaagatcagggccaaggcatcc

SEQ ID NO: 69661 - DNA, 25 bp, mus musculus
cctctgccagagacagcatcctaag

SEQ ID NO: 69662 - DNA, 25 bp, mus musculus
gacagcacacagcatgtactctggc

SEQ ID NO: 69663 - DNA, 25 bp, mus musculus
tattaaatgcttcttctcctcaaaa

SEQ ID NO: 69664 - DNA, 25 bp, mus musculus
acacagcatgtactctggcggcttg

SEQ ID NO: 69665 - DNA, 25 bp, mus musculus
cacatccggcccaagattgtggtgg

SEQ ID NO: 69666 - DNA, 25 bp, mus musculus
accaacaaccatagccacacagcag

SEQ ID NO: 69667 - DNA, 25 bp, mus musculus
aaccatagccacacagcagaacaag

SEQ ID NO: 69668 - DNA, 25 bp, mus musculus
agccacacagcagaacaagtgacag

SEQ ID NO: 69669 - DNA, 25 bp, mus musculus
gtggttgtgctgggcctgcttccga

SEQ ID NO: 69670 - DNA, 25 bp, mus musculus
ccccgagcccacttcttagatgcag

SEQ ID NO: 69671 - DNA, 25 bp, mus musculus
cgcacaggccaagatcattgtgctg

SEQ ID NO: 69672 - DNA, 25 bp, mus musculus
tgtgctgggtctgttacctcgaggt

SEQ ID NO: 69673 - DNA, 25 bp, mus musculus
catgcagttgctggaggaaacaccc

SEQ ID NO: 69674 - DNA, 25 bp, mus musculus
gaagcagaccaccattgcttgactg

SEQ ID NO: 69675 - DNA, 25 bp, mus musculus
gaccaccattgcttgactggcccat

SEQ ID NO: 69676 - DNA, 25 bp, mus musculus
ttgactggcccatcagtgttacagc

SEQ ID NO: 69677 - DNA, 25 bp, mus musculus
tcagtgttacagcatcccgcttcct

SEQ ID NO: 69678 - DNA, 25 bp, mus musculus
ttacagcatcccgcttcctcagatc

SEQ ID NO: 69679 - DNA, 25 bp, mus musculus
gcttcctcagatcagttagaccact

SEQ ID NO: 69680 - DNA, 25 bp, mus musculus
cagttagaccactggcactacagaa

SEQ ID NO: 69681 - DNA, 25 bp, mus musculus
tggcactacagaatcctttcttaag

SEQ ID NO: 69682 - DNA, 25 bp, mus musculus
tacagaatcctttcttaaggcactt

SEQ ID NO: 69683 - DNA, 25 bp, mus musculus
gggtctgttacctcgaggtgagaag

SEQ ID NO: 69684 - DNA, 25 bp, mus musculus
ccagcttctcaaggtttccctgccg

SEQ ID NO: 69685 - DNA, 25 bp, mus musculus
tctcaaggtttccctgccgaagctt

SEQ ID NO: 69686 - DNA, 25 bp, mus musculus
cctgccgaagcttgccaatgtgcag

SEQ ID NO: 69687 - DNA, 25 bp, mus musculus
gaagcttgccaatgtgcagctcctt

SEQ ID NO: 69688 - DNA, 25 bp, mus musculus
tgccaatgtgcagctccttgatata

SEQ ID NO: 69689 - DNA, 25 bp, mus musculus
tgtgcagctccttgatatagacggg

SEQ ID NO: 69690 - DNA, 25 bp, mus musculus
catctcctgccacgacatgtttgat

SEQ ID NO: 69691 - DNA, 25 bp, mus musculus
aactgtacacggttgttcagtgtcg

SEQ ID NO: 69692 - DNA, 25 bp, mus musculus
actcatccccagcagggcttagaaa

SEQ ID NO: 69693 - DNA, 25 bp, mus musculus
gatattctaccactggggcattgtg

SEQ ID NO: 69694 - DNA, 25 bp, mus musculus
ctaccactggggcattgtggagtca

SEQ ID NO: 69695 - DNA, 25 bp, mus musculus
ggagtcacattcacgaaacacgaag

SEQ ID NO: 69696 - DNA, 25 bp, mus musculus
gtcacattcacgaaacacgaagcct

SEQ ID NO: 69697 - DNA, 25 bp, mus musculus
acattcacgaaacacgaagccttgt

SEQ ID NO: 69698 - DNA, 25 bp, mus musculus
cacgaagccttgtacttctctagaa

SEQ ID NO: 69699 - DNA, 25 bp, mus musculus
taccgctcgagttattccttatacg

SEQ ID NO: 69700 - DNA, 25 bp, mus musculus
cgctcgagttattccttatacgtat

SEQ ID NO: 69701 - DNA, 25 bp, mus musculus
aatcattttcaaaatctcaattcca

SEQ ID NO: 69702 - DNA, 25 bp, mus musculus
ctcaattccacaaataaagttctat

SEQ ID NO: 69703 - DNA, 25 bp, mus musculus
cctccttcacactcattttcctttg

SEQ ID NO: 69704 - DNA, 25 bp, mus musculus
ccttcacactcattttcctttggat

SEQ ID NO: 69705 - DNA, 25 bp, mus musculus
tgattcagtgacatcacagaacctg

SEQ ID NO: 69706 - DNA, 25 bp, mus musculus
agtgacatcacagaacctggtgtcc

SEQ ID NO: 69707 - DNA, 25 bp, mus musculus
ccctccatcccaggtgtgtagtaat

SEQ ID NO: 69708 - DNA, 25 bp, mus musculus
tccatcccaggtgtgtagtaatggt

SEQ ID NO: 69709 - DNA, 25 bp, mus musculus
atcccaggtgtgtagtaatggtccg

SEQ ID NO: 69710 - DNA, 25 bp, mus musculus
ctcgttgatattctaccactggggc

SEQ ID NO: 69711 - DNA, 25 bp, mus musculus
tgacacacaaaacacagagcagacc

SEQ ID NO: 69712 - DNA, 25 bp, mus musculus
gaagtctctgaactctgccggtgag

SEQ ID NO: 69713 - DNA, 25 bp, mus musculus
cctgttgcaggccgctcaggataag

SEQ ID NO: 69714 - DNA, 25 bp, mus musculus
caaagcggcccagctggatgggctg

SEQ ID NO: 69715 - DNA, 25 bp, mus musculus
agccaggatgcgcagtgtgctccag

SEQ ID NO: 69716 - DNA, 25 bp, mus musculus
tgtgctccaggccatcaacttgcag

SEQ ID NO: 69717 - DNA, 25 bp, mus musculus
ggccatcaacttgcaggtccagatc

SEQ ID NO: 69718 - DNA, 25 bp, mus musculus
catcaacttgcaggtccagatctac

SEQ ID NO: 69719 - DNA, 25 bp, mus musculus
cttgcaggtccagatctacaacacc

SEQ ID NO: 69720 - DNA, 25 bp, mus musculus
gatctacaacacctgccagtgacca

SEQ ID NO: 69721 - DNA, 25 bp, mus musculus
taggcctagccttgtcgccaagcac

SEQ ID NO: 69722 - DNA, 25 bp, mus musculus
tagccttgtcgccaagcactgttct

SEQ ID NO: 69723 - DNA, 25 bp, mus musculus
tagcctggcagcatctacagcggaa

SEQ ID NO: 69724 - DNA, 25 bp, mus musculus
agccttgtcgccaagcactgttctg

SEQ ID NO: 69725 - DNA, 25 bp, mus musculus
cctggcagcatctacagcggaagaa

SEQ ID NO: 69726 - DNA, 25 bp, mus musculus
agcatctacagcggaagaaacagca

SEQ ID NO: 69727 - DNA, 25 bp, mus musculus
aggtgaccaataccaaacagtgagg

SEQ ID NO: 69728 - DNA, 25 bp, mus musculus
ccaataccaaacagtgagggcgttg

SEQ ID NO: 69729 - DNA, 25 bp, mus musculus
ccaaacagtgagggcgttggcagag

SEQ ID NO: 69730 - DNA, 25 bp, mus musculus
aggtgttctggctgcacaagccagg

SEQ ID NO: 69731 - DNA, 25 bp, mus musculus
tgcacaagccagggcagaacaactg

SEQ ID NO: 69732 - DNA, 25 bp, mus musculus
gtgccttccgttcagtattcggaca

SEQ ID NO: 69733 - DNA, 25 bp, mus musculus
tcggacaaggcttccctgggatctg

SEQ ID NO: 69734 - DNA, 25 bp, mus musculus
ctgtgtcgataggctgttgtgctat

SEQ ID NO: 69735 - DNA, 25 bp, mus musculus
gtgctatctagcacctcagtttctg

SEQ ID NO: 69736 - DNA, 25 bp, mus musculus
tctagcacctcagtttctgtcccca

SEQ ID NO: 69737 - DNA, 25 bp, mus musculus
acctcagtttctgtccccagatgtg

SEQ ID NO: 69738 - DNA, 25 bp, mus musculus
acgtggtcatttcagcccgaatctc

SEQ ID NO: 69739 - DNA, 25 bp, mus musculus
cagcccgaatctctgtgtggagcac

SEQ ID NO: 69740 - DNA, 25 bp, mus musculus
gaatctctgtgtggagcacagttat

SEQ ID NO: 69741 - DNA, 25 bp, mus musculus
cccagccaggggatccagtcagcag

SEQ ID NO: 69742 - DNA, 25 bp, mus musculus
tggaatcatggccctggggattatt

SEQ ID NO: 69743 - DNA, 25 bp, mus musculus
catggccctggggattatttgactt

SEQ ID NO: 69744 - DNA, 25 bp, mus musculus
aaggcttccctgggatctgatgata

SEQ ID NO: 69745 - DNA, 25 bp, mus musculus
tccctgggatctgatgatagcacac

SEQ ID NO: 69746 - DNA, 25 bp, mus musculus
aagctcaatgtctcaaagagtgtgt

SEQ ID NO: 69747 - DNA, 25 bp, mus musculus
agcgccgagagctgccaaggtgctc

SEQ ID NO: 69748 - DNA, 25 bp, mus musculus
tgccaaggtgctctgcgtgtccaaa

SEQ ID NO: 69749 - DNA, 25 bp, mus musculus
gtccaaacacagtaacatctgtgtc

SEQ ID NO: 69750 - DNA, 25 bp, mus musculus
acacagtaacatctgtgtcgatagg

SEQ ID NO: 69751 - DNA, 25 bp, mus musculus
taacatctgtgtcgataggctgttg

SEQ ID NO: 69752 - DNA, 25 bp, mus musculus
ccttcagcccaactctgggccaaat

SEQ ID NO: 69753 - DNA, 25 bp, mus musculus
tatctgtttcttaccgaaatggcac

SEQ ID NO: 69754 - DNA, 25 bp, mus musculus
aacttcaactgagtgtactcagtgc

SEQ ID NO: 69755 - DNA, 25 bp, mus musculus
tcagtgcagaatcactgcgggagaa

SEQ ID NO: 69756 - DNA, 25 bp, mus musculus
cagaatcactgcgggagaatttctt

SEQ ID NO: 69757 - DNA, 25 bp, mus musculus
taaccctgccactgaaagatttcaa

SEQ ID NO: 69758 - DNA, 25 bp, mus musculus
atttcaacttgagcaaagagacagt

SEQ ID NO: 69759 - DNA, 25 bp, mus musculus
ggtatcagctgactgcggcaacgta

SEQ ID NO: 69760 - DNA, 25 bp, mus musculus
agctgactgcggcaacgtatctata

SEQ ID NO: 69761 - DNA, 25 bp, mus musculus
ccgacttctgagctttggaaacaag

SEQ ID NO: 69762 - DNA, 25 bp, mus musculus
gcatgcgcacatacacacacttggg

SEQ ID NO: 69763 - DNA, 25 bp, mus musculus
gcacatacacacacttgggaacttt

SEQ ID NO: 69764 - DNA, 25 bp, mus musculus
accgaaatggcaccctcttcatcat

SEQ ID NO: 69765 - DNA, 25 bp, mus musculus
atggcaccctcttcatcatggtgat

SEQ ID NO: 69766 - DNA, 25 bp, mus musculus
ccctcttcatcatggtgatgcacat

SEQ ID NO: 69767 - DNA, 25 bp, mus musculus
tgcacatcaaagatcttgtgactga

SEQ ID NO: 69768 - DNA, 25 bp, mus musculus
atcttgtgactgaagatggggctga

SEQ ID NO: 69769 - DNA, 25 bp, mus musculus
atccctatgtcaaaacatacctgct

SEQ ID NO: 69770 - DNA, 25 bp, mus musculus
atgtcaaaacatacctgcttccaga

SEQ ID NO: 69771 - DNA, 25 bp, mus musculus
ggaacccaacattcaatgaaatgct

SEQ ID NO: 69772 - DNA, 25 bp, mus musculus
atgtttacagaccagcctgccttgc

SEQ ID NO: 69773 - DNA, 25 bp, mus musculus
tcagtggccccagtcccaacctgga

SEQ ID NO: 69774 - DNA, 25 bp, mus musculus
aactgggctctaggtccagcactgt

SEQ ID NO: 69775 - DNA, 25 bp, mus musculus
gctctaggtccagcactgtggggca

SEQ ID NO: 69776 - DNA, 25 bp, mus musculus
ctaggtccagcactgtggggcacca

SEQ ID NO: 69777 - DNA, 25 bp, mus musculus
ccactggactaggacggaaggctgg

SEQ ID NO: 69778 - DNA, 25 bp, mus musculus
ccctcttaagttgtggctatcatgg

SEQ ID NO: 69779 - DNA, 25 bp, mus musculus
gctggctaggattcccctaagcgct

SEQ ID NO: 69780 - DNA, 25 bp, mus musculus
taggattcccctaagcgcttcctgg

SEQ ID NO: 69781 - DNA, 25 bp, mus musculus
aactggaacaactctgccctatctg

SEQ ID NO: 69782 - DNA, 25 bp, mus musculus
tggaacaactctgccctatctgcct

SEQ ID NO: 69783 - DNA, 25 bp, mus musculus
gtgatcccaatatcaaccattaaag

SEQ ID NO: 69784 - DNA, 25 bp, mus musculus
accttttccctggatgctgcccctg

SEQ ID NO: 69785 - DNA, 25 bp, mus musculus
cccaaatccagaggtttctacagca

SEQ ID NO: 69786 - DNA, 25 bp, mus musculus
ttctacagcaaaagccagctcggcc

SEQ ID NO: 69787 - DNA, 25 bp, mus musculus
agcaaaagccagctcggcccatggc

SEQ ID NO: 69788 - DNA, 25 bp, mus musculus
agccagctcggcccatggctccagt

SEQ ID NO: 69789 - DNA, 25 bp, mus musculus
ccatggctccagtccccagtgtgag

SEQ ID NO: 69790 - DNA, 25 bp, mus musculus
ccagcaacaggatctggccaagaaa

SEQ ID NO: 69791 - DNA, 25 bp, mus musculus
aaggacaactgggctctaggtccag

SEQ ID NO: 69792 - DNA, 25 bp, mus musculus
gcagcgctgcctggagtctttctgg

SEQ ID NO: 69793 - DNA, 25 bp, mus musculus
ctgcctggagtctttctggagcctt

SEQ ID NO: 69794 - DNA, 25 bp, mus musculus
ctctaccctcaagaacattccaggc

SEQ ID NO: 69795 - DNA, 25 bp, mus musculus
gaacattccaggcacccttctggta

SEQ ID NO: 69796 - DNA, 25 bp, mus musculus
tccaggcacccttctggtagatctc

SEQ ID NO: 69797 - DNA, 25 bp, mus musculus
tgaactccttgaagacatgcttttg

SEQ ID NO: 69798 - DNA, 25 bp, mus musculus
agacatgcttttgctgaggtgaccc

SEQ ID NO: 69799 - DNA, 25 bp, mus musculus
ctcggacttccttgctttggataca

SEQ ID NO: 69800 - DNA, 25 bp, mus musculus
cttccttgctttggatacagtgtac

SEQ ID NO: 69801 - DNA, 25 bp, mus musculus
agtgtacactactaactgtccagca

SEQ ID NO: 69802 - DNA, 25 bp, mus musculus
taactgtccagcaagcccttgatga

SEQ ID NO: 69803 - DNA, 25 bp, mus musculus
gctgtactttcaagccagaatccct

SEQ ID NO: 69804 - DNA, 25 bp, mus musculus
gagccttgagctgggtcccaaggag

SEQ ID NO: 69805 - DNA, 25 bp, mus musculus
gtatgcgtacctgaagggcacgatc

SEQ ID NO: 69806 - DNA, 25 bp, mus musculus
cacgatcctcttcaacccagatgtg

SEQ ID NO: 69807 - DNA, 25 bp, mus musculus
agatgtgccaggcctccgtgcctcc

SEQ ID NO: 69808 - DNA, 25 bp, mus musculus
catcgcacacctgcaacaggaggct

SEQ ID NO: 69809 - DNA, 25 bp, mus musculus
acacctgcaacaggaggctcactgg

SEQ ID NO: 69810 - DNA, 25 bp, mus musculus
tcactgggcactgtgtgaagtcttg

SEQ ID NO: 69811 - DNA, 25 bp, mus musculus
catggcctctaccctcaagaacatt

SEQ ID NO: 69812 - DNA, 25 bp, mus musculus
acgtgctcattgtggtgttgaccat

SEQ ID NO: 69813 - DNA, 25 bp, mus musculus
ggtgttgaccatatggcttgtggca

SEQ ID NO: 69814 - DNA, 25 bp, mus musculus
ggccattacatccgagagcaaagaa

SEQ ID NO: 69815 - DNA, 25 bp, mus musculus
aaactgtacaggcgtccaggtggct

SEQ ID NO: 69816 - DNA, 25 bp, mus musculus
actgtacaggcgtccaggtggctga

SEQ ID NO: 69817 - DNA, 25 bp, mus musculus
ctgtacaggcgtccaggtggctgaa

SEQ ID NO: 69818 - DNA, 25 bp, mus musculus
gtacaggcgtccaggtggctgaata

SEQ ID NO: 69819 - DNA, 25 bp, mus musculus
tacaggcgtccaggtggctgaatag

SEQ ID NO: 69820 - DNA, 25 bp, mus musculus
caggcgtccaggtggctgaatagcg

SEQ ID NO: 69821 - DNA, 25 bp, mus musculus
aggcgtccaggtggctgaatagcgc

SEQ ID NO: 69822 - DNA, 25 bp, mus musculus
gcgtccaggtggctgaatagcgctg

SEQ ID NO: 69823 - DNA, 25 bp, mus musculus
tgaatagcgctggctctgggctccg

SEQ ID NO: 69824 - DNA, 25 bp, mus musculus
tgttgaccatatggcttgtggcaga

SEQ ID NO: 69825 - DNA, 25 bp, mus musculus
tgaccatatggcttgtggcagagat

SEQ ID NO: 69826 - DNA, 25 bp, mus musculus
ctcagaatacctggccattacatcc

SEQ ID NO: 69827 - DNA, 25 bp, mus musculus
cagaatacctggccattacatccga

SEQ ID NO: 69828 - DNA, 25 bp, mus musculus
agaatacctggccattacatccgag

SEQ ID NO: 69829 - DNA, 25 bp, mus musculus
aatacctggccattacatccgagag

SEQ ID NO: 69830 - DNA, 25 bp, mus musculus
acctggccattacatccgagagcaa

SEQ ID NO: 69831 - DNA, 25 bp, mus musculus
cctggccattacatccgagagcaaa

SEQ ID NO: 69832 - DNA, 25 bp, mus musculus
cttccagagccaatcctataacctc

SEQ ID NO: 69833 - DNA, 25 bp, mus musculus
gagccaatcctataacctcccttgg

SEQ ID NO: 69834 - DNA, 25 bp, mus musculus
acagcagaaggcctgtgtcgccacc

SEQ ID NO: 69835 - DNA, 25 bp, mus musculus
tatcattgtacccaccttgtactct

SEQ ID NO: 69836 - DNA, 25 bp, mus musculus
tgtacccaccttgtactctgttcag

SEQ ID NO: 69837 - DNA, 25 bp, mus musculus
caccttgtactctgttcaggaggct

SEQ ID NO: 69838 - DNA, 25 bp, mus musculus
ccagatgaaggctcccactacccga

SEQ ID NO: 69839 - DNA, 25 bp, mus musculus
tcccactacccgatgcagttgagtc

SEQ ID NO: 69840 - DNA, 25 bp, mus musculus
tacccgatgcagttgagtcccatcc

SEQ ID NO: 69841 - DNA, 25 bp, mus musculus
tcctgctgctattctagtgcctcaa

SEQ ID NO: 69842 - DNA, 25 bp, mus musculus
tgctattctagtgcctcaaataaac

SEQ ID NO: 69843 - DNA, 25 bp, mus musculus
tctagtgcctcaaataaaccgttca

SEQ ID NO: 69844 - DNA, 25 bp, mus musculus
gaagatctccttggagtctcaagag

SEQ ID NO: 69845 - DNA, 25 bp, mus musculus
ctccttggagtctcaagagtaccag

SEQ ID NO: 69846 - DNA, 25 bp, mus musculus
gagtcagcgccgaatcttgtggaca

SEQ ID NO: 69847 - DNA, 25 bp, mus musculus
aatcttgtggacacactgacaagga

SEQ ID NO: 69848 - DNA, 25 bp, mus musculus
atgtctaatccaaatagatgtatat

SEQ ID NO: 69849 - DNA, 25 bp, mus musculus
tctgtgtgctcagtgtatccctgtg

SEQ ID NO: 69850 - DNA, 25 bp, mus musculus
tgctcagtgtatccctgtgtgaatg

SEQ ID NO: 69851 - DNA, 25 bp, mus musculus
gattctacagcagaaggcctgtgtc

SEQ ID NO: 69852 - DNA, 25 bp, mus musculus
tttgactagttgcagtcatggggtt

SEQ ID NO: 69853 - DNA, 25 bp, mus musculus
tagttgcagtcatggggttcttcca

SEQ ID NO: 69854 - DNA, 25 bp, mus musculus
agcctacattctgggcctgacagga

SEQ ID NO: 69855 - DNA, 25 bp, mus musculus
cattctgggcctgacaggaaatgtt

SEQ ID NO: 69856 - DNA, 25 bp, mus musculus
ctatctttgaggccattcagatctt

SEQ ID NO: 69857 - DNA, 25 bp, mus musculus
ttgaggccattcagatcttaaccat

SEQ ID NO: 69858 - DNA, 25 bp, mus musculus
agatcttaaccatcactgtccgtcc

SEQ ID NO: 69859 - DNA, 25 bp, mus musculus
taaccatcactgtccgtccttcttg

SEQ ID NO: 69860 - DNA, 25 bp, mus musculus
gtttcttccggtgaaatctgtgcta

SEQ ID NO: 69861 - DNA, 25 bp, mus musculus
gaaatctgtgctaccaagtgcctat

SEQ ID NO: 69862 - DNA, 25 bp, mus musculus
tgtgctaccaagtgcctatgaattg

SEQ ID NO: 69863 - DNA, 25 bp, mus musculus
accaagtgcctatgaattgactcta

SEQ ID NO: 69864 - DNA, 25 bp, mus musculus
tggggttcttccactgaaatggaat

SEQ ID NO: 69865 - DNA, 25 bp, mus musculus
ccttggtgccttggagcaacatctt

SEQ ID NO: 69866 - DNA, 25 bp, mus musculus
cttagactcattccctcaggtcttc

SEQ ID NO: 69867 - DNA, 25 bp, mus musculus
ctcattccctcaggtcttctgaaaa

SEQ ID NO: 69868 - DNA, 25 bp, mus musculus
ggggcctacagatgcacccaagggc

SEQ ID NO: 69869 - DNA, 25 bp, mus musculus
tacagatgcacccaagggcagcagc

SEQ ID NO: 69870 - DNA, 25 bp, mus musculus
gcctcgagccttagcctacattctg

SEQ ID NO: 69871 - DNA, 25 bp, mus musculus
agccttagcctacattctgggcctg

SEQ ID NO: 69872 - DNA, 25 bp, mus musculus
tgcttgacctacaacaacggcaggt

SEQ ID NO: 69873 - DNA, 25 bp, mus musculus
ttacagaacctcatttcaagttcta

SEQ ID NO: 69874 - DNA, 25 bp, mus musculus
gcccagaactctgatcgacagtcaa

SEQ ID NO: 69875 - DNA, 25 bp, mus musculus
ttttccacagccacttctgttcact

SEQ ID NO: 69876 - DNA, 25 bp, mus musculus
acagccacttctgttcacttccatt

SEQ ID NO: 69877 - DNA, 25 bp, mus musculus
tataacccaaagtactcaggagact

SEQ ID NO: 69878 - DNA, 25 bp, mus musculus
aattctgagcctctctgggactcca

SEQ ID NO: 69879 - DNA, 25 bp, mus musculus
gccttactttagggtggttatcatg

SEQ ID NO: 69880 - DNA, 25 bp, mus musculus
tatcatgccagaagccagcattcca

SEQ ID NO: 69881 - DNA, 25 bp, mus musculus
gccagaagccagcattccagcttgt

SEQ ID NO: 69882 - DNA, 25 bp, mus musculus
agcttgtgtgcgtctcttatgcaga

SEQ ID NO: 69883 - DNA, 25 bp, mus musculus
tgtgcgtctcttatgcagaaattaa

SEQ ID NO: 69884 - DNA, 25 bp, mus musculus
aacctcatttcaagttctatgaggg

SEQ ID NO: 69885 - DNA, 25 bp, mus musculus
atttcaagttctatgagggccaaga

SEQ ID NO: 69886 - DNA, 25 bp, mus musculus
gccaagatcacttcgtatgcgatta

SEQ ID NO: 69887 - DNA, 25 bp, mus musculus
atcacttcgtatgcgattatacttg

SEQ ID NO: 69888 - DNA, 25 bp, mus musculus
atacttgccctgcacataaataact

SEQ ID NO: 69889 - DNA, 25 bp, mus musculus
gccctgcacataaataacttccagg

SEQ ID NO: 69890 - DNA, 25 bp, mus musculus
gttgacctgacagcgttgcagaagg

SEQ ID NO: 69891 - DNA, 25 bp, mus musculus
ctgggcactctgtctgtcccactgc

SEQ ID NO: 69892 - DNA, 25 bp, mus musculus
tgaaacttccagaatattctccatt

SEQ ID NO: 69893 - DNA, 25 bp, mus musculus
aatattctccattctaccctccatt

SEQ ID NO: 69894 - DNA, 25 bp, mus musculus
gatggtcgtttctcagctaactgca

SEQ ID NO: 69895 - DNA, 25 bp, mus musculus
agagctaactcaaaacacaaggcat

SEQ ID NO: 69896 - DNA, 25 bp, mus musculus
aactcaaaacacaaggcattattca

SEQ ID NO: 69897 - DNA, 25 bp, mus musculus
cccacattgttttcattccagatac

SEQ ID NO: 69898 - DNA, 25 bp, mus musculus
ttgttttcattccagatacgttgca

SEQ ID NO: 69899 - DNA, 25 bp, mus musculus
tcattccagatacgttgcagctgtt

SEQ ID NO: 69900 - DNA, 25 bp, mus musculus
cagatacgttgcagctgtttgaccc

SEQ ID NO: 69901 - DNA, 25 bp, mus musculus
agctgtttgaccctgatgacattat

SEQ ID NO: 69902 - DNA, 25 bp, mus musculus
acattatgccctacattttccttga

SEQ ID NO: 69903 - DNA, 25 bp, mus musculus
acattttccttgaagatcctgattt

SEQ ID NO: 69904 - DNA, 25 bp, mus musculus
tttacccttaatatcacactgcctt

SEQ ID NO: 69905 - DNA, 25 bp, mus musculus
ctgccttgagtcaatgtccaaatac

SEQ ID NO: 69906 - DNA, 25 bp, mus musculus
caaatactcatagctctcaaagtca

SEQ ID NO: 69907 - DNA, 25 bp, mus musculus
gcggcctaaacctaaagcatcctat

SEQ ID NO: 69908 - DNA, 25 bp, mus musculus
taagacaccttgcttcctatgtcca

SEQ ID NO: 69909 - DNA, 25 bp, mus musculus
accttgcttcctatgtccactcagg

SEQ ID NO: 69910 - DNA, 25 bp, mus musculus
cttcctatgtccactcagggagaat

SEQ ID NO: 69911 - DNA, 25 bp, mus musculus
aagcaagactaacttctcaaatcca

SEQ ID NO: 69912 - DNA, 25 bp, mus musculus
atagctcctctacccaggattctat

SEQ ID NO: 69913 - DNA, 25 bp, mus musculus
tgtcttcctcaacaacttcttcctc

SEQ ID NO: 69914 - DNA, 25 bp, mus musculus
caacataccaattttctgctaatac

SEQ ID NO: 69915 - DNA, 25 bp, mus musculus
tttctgctaatacaggtcctgcaca

SEQ ID NO: 69916 - DNA, 25 bp, mus musculus
ctaatacaggtcctgcacattacat

SEQ ID NO: 69917 - DNA, 25 bp, mus musculus
ctgcacattacatgactgaaggaca

SEQ ID NO: 69918 - DNA, 25 bp, mus musculus
ctcccatgacaggagtttgtgtgca

SEQ ID NO: 69919 - DNA, 25 bp, mus musculus
aacagagtcctgtagctagctcgtg

SEQ ID NO: 69920 - DNA, 25 bp, mus musculus
gtcctgtagctagctcgtgactaca

SEQ ID NO: 69921 - DNA, 25 bp, mus musculus
tagctagctcgtgactacattgaaa

SEQ ID NO: 69922 - DNA, 25 bp, mus musculus
gagattaacacactgaaccgctaca

SEQ ID NO: 69923 - DNA, 25 bp, mus musculus
aacacactgaaccgctacaagaggg

SEQ ID NO: 69924 - DNA, 25 bp, mus musculus
cttcctcctctactggtaatcaagg

SEQ ID NO: 69925 - DNA, 25 bp, mus musculus
cctctactggtaatcaaggcaatca

SEQ ID NO: 69926 - DNA, 25 bp, mus musculus
atcaaggcaatcaggcctatcagaa

SEQ ID NO: 69927 - DNA, 25 bp, mus musculus
accgcccagtggctgctaacacctt

SEQ ID NO: 69928 - DNA, 25 bp, mus musculus
cagtggctgctaacaccttggactt

SEQ ID NO: 69929 - DNA, 25 bp, mus musculus
acaccttggactttggacagaatgg

SEQ ID NO: 69930 - DNA, 25 bp, mus musculus
cccgccaagagactggcatagctgg

SEQ ID NO: 69931 - DNA, 25 bp, mus musculus
tagctggacatccaacataccaatt

SEQ ID NO: 69932 - DNA, 25 bp, mus musculus
ctaagtccatcaacctggctgagtg

SEQ ID NO: 69933 - DNA, 25 bp, mus musculus
aagtccatcaacctggctgagtgcg

SEQ ID NO: 69934 - DNA, 25 bp, mus musculus
cagcggctctgagggtcaaaaccag

SEQ ID NO: 69935 - DNA, 25 bp, mus musculus
cccaagagccctgcacttcttgaca

SEQ ID NO: 69936 - DNA, 25 bp, mus musculus
caagagccctgcacttcttgacacg

SEQ ID NO: 69937 - DNA, 25 bp, mus musculus
agagccctgcacttcttgacacgtt

SEQ ID NO: 69938 - DNA, 25 bp, mus musculus
agccctgcacttcttgacacgtttc

SEQ ID NO: 69939 - DNA, 25 bp, mus musculus
ctgcacttcttgacacgtttcttcc

SEQ ID NO: 69940 - DNA, 25 bp, mus musculus
gcacttcttgacacgtttcttcctg

SEQ ID NO: 69941 - DNA, 25 bp, mus musculus
acttcttgacacgtttcttcctgag

SEQ ID NO: 69942 - DNA, 25 bp, mus musculus
ttcttgacacgtttcttcctgagaa

SEQ ID NO: 69943 - DNA, 25 bp, mus musculus
tcctgagaagggcccgcaggccctg

SEQ ID NO: 69944 - DNA, 25 bp, mus musculus
ctggctgagtgcgcaggagatgcta

SEQ ID NO: 69945 - DNA, 25 bp, mus musculus
gatgctatctccatggcaacactgg

SEQ ID NO: 69946 - DNA, 25 bp, mus musculus
tgctatctccatggcaacactggca

SEQ ID NO: 69947 - DNA, 25 bp, mus musculus
ctatctccatggcaacactggcaga

SEQ ID NO: 69948 - DNA, 25 bp, mus musculus
ctccatggcaacactggcagagatc

SEQ ID NO: 69949 - DNA, 25 bp, mus musculus
ccatggcaacactggcagagatcta

SEQ ID NO: 69950 - DNA, 25 bp, mus musculus
atggcaacactggcagagatctatg

SEQ ID NO: 69951 - DNA, 25 bp, mus musculus
agatctatgtggcagcggctctgag

SEQ ID NO: 69952 - DNA, 25 bp, mus musculus
gtaatcttcttcattgtcctcagcg

SEQ ID NO: 69953 - DNA, 25 bp, mus musculus
ttcttcattgtcctcagcgtgcttc

SEQ ID NO: 69954 - DNA, 25 bp, mus musculus
tcttttacataccttgaactagcaa

SEQ ID NO: 69955 - DNA, 25 bp, mus musculus
tttacataccttgaactagcaatac

SEQ ID NO: 69956 - DNA, 25 bp, mus musculus
acataccttgaactagcaatacaat

SEQ ID NO: 69957 - DNA, 25 bp, mus musculus
aatcaccaactgaattttgtatcta

SEQ ID NO: 69958 - DNA, 25 bp, mus musculus
taattgataccagtttccactggaa

SEQ ID NO: 69959 - DNA, 25 bp, mus musculus
ttgataccagtttccactggaacac

SEQ ID NO: 69960 - DNA, 25 bp, mus musculus
ccagtttccactggaacacttatca

SEQ ID NO: 69961 - DNA, 25 bp, mus musculus
gtttccactggaacacttatcagct

SEQ ID NO: 69962 - DNA, 25 bp, mus musculus
tccactggaacacttatcagctgat

SEQ ID NO: 69963 - DNA, 25 bp, mus musculus
actggaacacttatcagctgataat

SEQ ID NO: 69964 - DNA, 25 bp, mus musculus
ttcattgtcctcagcgtgcttcagt

SEQ ID NO: 69965 - DNA, 25 bp, mus musculus
attgtcctcagcgtgcttcagtaat

SEQ ID NO: 69966 - DNA, 25 bp, mus musculus
gtcctcagcgtgcttcagtaatgcc

SEQ ID NO: 69967 - DNA, 25 bp, mus musculus
cttcagtaatgccaactaatactaa

SEQ ID NO: 69968 - DNA, 25 bp, mus musculus
agtcatatttgctcaagacaatcaa

SEQ ID NO: 69969 - DNA, 25 bp, mus musculus
catatttgctcaagacaatcaaccc

SEQ ID NO: 69970 - DNA, 25 bp, mus musculus
atttgctcaagacaatcaacccttc

SEQ ID NO: 69971 - DNA, 25 bp, mus musculus
tcaagacaatcaacccttctctttt

SEQ ID NO: 69972 - DNA, 25 bp, mus musculus
gcttaatatggcctatggcgtaaag

SEQ ID NO: 69973 - DNA, 25 bp, mus musculus
taatatggcctatggcgtaaagaga

SEQ ID NO: 69974 - DNA, 25 bp, mus musculus
caacaaagcccacaaatcctgaatt

SEQ ID NO: 69975 - DNA, 25 bp, mus musculus
agcccacaaatcctgaatttctcac

SEQ ID NO: 69976 - DNA, 25 bp, mus musculus
ccacaaatcctgaatttctcaccct

SEQ ID NO: 69977 - DNA, 25 bp, mus musculus
acgaacaaaacatgcgcgcacacac

SEQ ID NO: 69978 - DNA, 25 bp, mus musculus
tgcgcgcacacacatacacaaaaga

SEQ ID NO: 69979 - DNA, 25 bp, mus musculus
gcgcacacacatacacaaaagagag

SEQ ID NO: 69980 - DNA, 25 bp, mus musculus
gagacaaactttccaaggcttatat

SEQ ID NO: 69981 - DNA, 25 bp, mus musculus
tttccaaggcttatattcaaccatg

SEQ ID NO: 69982 - DNA, 25 bp, mus musculus
ttcaaccatggactttataagcccg

SEQ ID NO: 69983 - DNA, 25 bp, mus musculus
attggattatcctgaggtgtaccag

SEQ ID NO: 69984 - DNA, 25 bp, mus musculus
cccaatcaccattgacgggatgaca

SEQ ID NO: 69985 - DNA, 25 bp, mus musculus
aatgaacatccctggtcacacaggg

SEQ ID NO: 69986 - DNA, 25 bp, mus musculus
catccctggtcacacagggacaggc

SEQ ID NO: 69987 - DNA, 25 bp, mus musculus
gtcccctgattctgatgagagtgtc

SEQ ID NO: 69988 - DNA, 25 bp, mus musculus
ccctgattctgatgagagtgtcctc

SEQ ID NO: 69989 - DNA, 25 bp, mus musculus
gagtgtcctctggcagctctttggc

SEQ ID NO: 69990 - DNA, 25 bp, mus musculus
tggcccctttggcgcagtgaacaac

SEQ ID NO: 69991 - DNA, 25 bp, mus musculus
ctatcgcctgggagacagagtgttg

SEQ ID NO: 69992 - DNA, 25 bp, mus musculus
tctgaaaagttcgccttccaagctg

SEQ ID NO: 69993 - DNA, 25 bp, mus musculus
ttcgccttccaagctgaactgaaca

SEQ ID NO: 69994 - DNA, 25 bp, mus musculus
aggctcatcgccctaactgatgaaa

SEQ ID NO: 69995 - DNA, 25 bp, mus musculus
ctcatcgccctaactgatgaaaatg

SEQ ID NO: 69996 - DNA, 25 bp, mus musculus
atcgccctaactgatgaaaatgcac

SEQ ID NO: 69997 - DNA, 25 bp, mus musculus
gatgaaaatgcactcgctggaaatg

SEQ ID NO: 69998 - DNA, 25 bp, mus musculus
aatgcactcgctggaaatgaggagt

SEQ ID NO: 69999 - DNA, 25 bp, mus musculus
gacctgctgcatgtcacagacacga

SEQ ID NO: 70000 - DNA, 25 bp, mus musculus
ctgctgcatgtcacagacacgagtg

SEQ ID NO: 70001 - DNA, 25 bp, mus musculus
ctgcatgtcacagacacgagtgtag

SEQ ID NO: 70002 - DNA, 25 bp, mus musculus
catgtcacagacacgagtgtaggaa

SEQ ID NO: 70003 - DNA, 25 bp, mus musculus
gtcacagacacgagtgtaggaatga

SEQ ID NO: 70004 - DNA, 25 bp, mus musculus
ttccaagctgaactgaacaggatga

SEQ ID NO: 70005 - DNA, 25 bp, mus musculus
atgaaacttatcatcaattctttgt

SEQ ID NO: 70006 - DNA, 25 bp, mus musculus
atcatcaattctttgtataacgata

SEQ ID NO: 70007 - DNA, 25 bp, mus musculus
atcaattctttgtataacgataaag

SEQ ID NO: 70008 - DNA, 25 bp, mus musculus
attttcctgagagaactgatttcaa

SEQ ID NO: 70009 - DNA, 25 bp, mus musculus
ctgatttcaaatgcttctgatgctt

SEQ ID NO: 70010 - DNA, 25 bp, mus musculus
atttcaaatgcttctgatgctttag

SEQ ID NO: 70011 - DNA, 25 bp, mus musculus
gcttctgatgctttagacaagataa

SEQ ID NO: 70012 - DNA, 25 bp, mus musculus
cggattcccaggcagctggtggcaa

SEQ ID NO: 70013 - DNA, 25 bp, mus musculus
agaccgatcgcgactgctccgggac

SEQ ID NO: 70014 - DNA, 25 bp, mus musculus
gtccaaaggctgctttggcctcaag

SEQ ID NO: 70015 - DNA, 25 bp, mus musculus
ccaaaggctgctttggcctcaagct

SEQ ID NO: 70016 - DNA, 25 bp, mus musculus
aaaggctgctttggcctcaagctgg

SEQ ID NO: 70017 - DNA, 25 bp, mus musculus
aggctgctttggcctcaagctggac

SEQ ID NO: 70018 - DNA, 25 bp, mus musculus
tgctttggcctcaagctggaccgga

SEQ ID NO: 70019 - DNA, 25 bp, mus musculus
ctttggcctcaagctggaccggatc

SEQ ID NO: 70020 - DNA, 25 bp, mus musculus
ttggcctcaagctggaccggatcgg

SEQ ID NO: 70021 - DNA, 25 bp, mus musculus
tcaagctggaccggatcggctccat

SEQ ID NO: 70022 - DNA, 25 bp, mus musculus
aagctggaccggatcggctccatga

SEQ ID NO: 70023 - DNA, 25 bp, mus musculus
tggaccggatcggctccatgagcgg

SEQ ID NO: 70024 - DNA, 25 bp, mus musculus
accgatcgcgactgctccgggacct

SEQ ID NO: 70025 - DNA, 25 bp, mus musculus
ctccatgagcggtctgggatgttag

SEQ ID NO: 70026 - DNA, 25 bp, mus musculus
ctccgggacctgcgtgtggacacca

SEQ ID NO: 70027 - DNA, 25 bp, mus musculus
tgtggacaccaagtcccgggctgct

SEQ ID NO: 70028 - DNA, 25 bp, mus musculus
tggacaccaagtcccgggctgcttg

SEQ ID NO: 70029 - DNA, 25 bp, mus musculus
gacaccaagtcccgggctgcttggg

SEQ ID NO: 70030 - DNA, 25 bp, mus musculus
ccaacgcgcgcaaatacaaaggcgg

SEQ ID NO: 70031 - DNA, 25 bp, mus musculus
aacgcgcgcaaatacaaaggcggca

SEQ ID NO: 70032 - DNA, 25 bp, mus musculus
aagggcttgtccaaaggctgctttg

SEQ ID NO: 70033 - DNA, 25 bp, mus musculus
cagcggcacagcgatccacagcggg

SEQ ID NO: 70034 - DNA, 25 bp, mus musculus
agcggcacagcgatccacagcggga

SEQ ID NO: 70035 - DNA, 25 bp, mus musculus
ccagcagcagcggctcatctacagt

SEQ ID NO: 70036 - DNA, 25 bp, mus musculus
agcggctcatctacagtggcaagca

SEQ ID NO: 70037 - DNA, 25 bp, mus musculus
gcggctcatctacagtggcaagcaa

SEQ ID NO: 70038 - DNA, 25 bp, mus musculus
gcggcacagcgatccacagcgggag

SEQ ID NO: 70039 - DNA, 25 bp, mus musculus
cggcacagcgatccacagcgggaga

SEQ ID NO: 70040 - DNA, 25 bp, mus musculus
gcacagcgatccacagcgggagaag

SEQ ID NO: 70041 - DNA, 25 bp, mus musculus
cagcgatccacagcgggagaagcag

SEQ ID NO: 70042 - DNA, 25 bp, mus musculus
agcgatccacagcgggagaagcagc

SEQ ID NO: 70043 - DNA, 25 bp, mus musculus
gcgatccacagcgggagaagcagca

SEQ ID NO: 70044 - DNA, 25 bp, mus musculus
cgatccacagcgggagaagcagcac

SEQ ID NO: 70045 - DNA, 25 bp, mus musculus
cccagcagcagcggctcatctacag

SEQ ID NO: 70046 - DNA, 25 bp, mus musculus
cagcggcacagcgatccacagcggg

SEQ ID NO: 70047 - DNA, 25 bp, mus musculus
agcggcacagcgatccacagcggga

SEQ ID NO: 70048 - DNA, 25 bp, mus musculus
ccccagcagcagcggctcatctaca

SEQ ID NO: 70049 - DNA, 25 bp, mus musculus
cccagcagcagcggctcatctacag

SEQ ID NO: 70050 - DNA, 25 bp, mus musculus
ccagcagcagcggctcatctacagt

SEQ ID NO: 70051 - DNA, 25 bp, mus musculus
agcggctcatctacagtggcaagca

SEQ ID NO: 70052 - DNA, 25 bp, mus musculus
gcggctcatctacagtggcaagcaa

SEQ ID NO: 70053 - DNA, 25 bp, mus musculus
gcggcacagcgatccacagcgggag

SEQ ID NO: 70054 - DNA, 25 bp, mus musculus
cggcacagcgatccacagcgggaga

SEQ ID NO: 70055 - DNA, 25 bp, mus musculus
gcacagcgatccacagcgggagaag

SEQ ID NO: 70056 - DNA, 25 bp, mus musculus
cagcgatccacagcgggagaagcag

SEQ ID NO: 70057 - DNA, 25 bp, mus musculus
agcgatccacagcgggagaagcagc

SEQ ID NO: 70058 - DNA, 25 bp, mus musculus
gcgatccacagcgggagaagcagca

SEQ ID NO: 70059 - DNA, 25 bp, mus musculus
cgatccacagcgggagaagcagcac

SEQ ID NO: 70060 - DNA, 25 bp, mus musculus
cccccagcagcagcggctcatctac

SEQ ID NO: 70061 - DNA, 25 bp, mus musculus
cagcggcacagcgatccacagcggg

SEQ ID NO: 70062 - DNA, 25 bp, mus musculus
agcggcacagcgatccacagcggga

SEQ ID NO: 70063 - DNA, 25 bp, mus musculus
ccccagcagcagcggctcatctaca

SEQ ID NO: 70064 - DNA, 25 bp, mus musculus
cccagcagcagcggctcatctacag

SEQ ID NO: 70065 - DNA, 25 bp, mus musculus
ccagcagcagcggctcatctacagt

SEQ ID NO: 70066 - DNA, 25 bp, mus musculus
agcggctcatctacagtggcaagca

SEQ ID NO: 70067 - DNA, 25 bp, mus musculus
gcggctcatctacagtggcaagcaa

SEQ ID NO: 70068 - DNA, 25 bp, mus musculus
gcggcacagcgatccacagcgggag

SEQ ID NO: 70069 - DNA, 25 bp, mus musculus
cggcacagcgatccacagcgggaga

SEQ ID NO: 70070 - DNA, 25 bp, mus musculus
gcacagcgatccacagcgggagaag

SEQ ID NO: 70071 - DNA, 25 bp, mus musculus
cagcgatccacagcgggagaagcag

SEQ ID NO: 70072 - DNA, 25 bp, mus musculus
agcgatccacagcgggagaagcagc

SEQ ID NO: 70073 - DNA, 25 bp, mus musculus
gcgatccacagcgggagaagcagca

SEQ ID NO: 70074 - DNA, 25 bp, mus musculus
cgatccacagcgggagaagcagcac

SEQ ID NO: 70075 - DNA, 25 bp, mus musculus
cccccagcagcagcggctcatctac

SEQ ID NO: 70076 - DNA, 25 bp, mus musculus
gttctgcagaagccagctctgttct

SEQ ID NO: 70077 - DNA, 25 bp, mus musculus
gccctcatgcattgttttagagtca

SEQ ID NO: 70078 - DNA, 25 bp, mus musculus
tagtgttccaatgctgctcagtttg

SEQ ID NO: 70079 - DNA, 25 bp, mus musculus
tccaatgctgctcagtttgactgat

SEQ ID NO: 70080 - DNA, 25 bp, mus musculus
gctgctcagtttgactgataaatca

SEQ ID NO: 70081 - DNA, 25 bp, mus musculus
taaatcatttaaaccccatcttcat

SEQ ID NO: 70082 - DNA, 25 bp, mus musculus
atttaaaccccatcttcatatgtat

SEQ ID NO: 70083 - DNA, 25 bp, mus musculus
taaaccccatcttcatatgtatgag

SEQ ID NO: 70084 - DNA, 25 bp, mus musculus
accccatcttcatatgtatgagtac

SEQ ID NO: 70085 - DNA, 25 bp, mus musculus
agaatccttcacctactaaccagat

SEQ ID NO: 70086 - DNA, 25 bp, mus musculus
ctaaccagatcaagcagcaacaaac

SEQ ID NO: 70087 - DNA, 25 bp, mus musculus
tcaagcagcaacaaaccagccagcc

SEQ ID NO: 70088 - DNA, 25 bp, mus musculus
ctcatgcattgttttagagtcattt

SEQ ID NO: 70089 - DNA, 25 bp, mus musculus
atttgccattttccactcacttatc

SEQ ID NO: 70090 - DNA, 25 bp, mus musculus
tgccattttccactcacttatctta

SEQ ID NO: 70091 - DNA, 25 bp, mus musculus
cccctgtgtagcttccacagagaaa

SEQ ID NO: 70092 - DNA, 25 bp, mus musculus
ctgtgtagcttccacagagaaatta

SEQ ID NO: 70093 - DNA, 25 bp, mus musculus
tgtagcttccacagagaaattatgc

SEQ ID NO: 70094 - DNA, 25 bp, mus musculus
atttcataaaaccaatctttgtcat

SEQ ID NO: 70095 - DNA, 25 bp, mus musculus
tcataaaaccaatctttgtcatatt

SEQ ID NO: 70096 - DNA, 25 bp, mus musculus
aaggcatgcacaactttgcatggag

SEQ ID NO: 70097 - DNA, 25 bp, mus musculus
tgcacaactttgcatggagcagtaa

SEQ ID NO: 70098 - DNA, 25 bp, mus musculus
acaatctgctaatctttagtcatat

SEQ ID NO: 70099 - DNA, 25 bp, mus musculus
tgctaatctttagtcatatagaaac

SEQ ID NO: 70100 - DNA, 25 bp, mus musculus
tagaaacataaatctctcatgtgag

SEQ ID NO: 70101 - DNA, 25 bp, mus musculus
cctctggcccacttacataggcaac

SEQ ID NO: 70102 - DNA, 25 bp, mus musculus
gcccacttacataggcaacttccct

SEQ ID NO: 70103 - DNA, 25 bp, mus musculus
ttacataggcaacttcccttacaca

SEQ ID NO: 70104 - DNA, 25 bp, mus musculus
ttacacattttggggaacagtctgt

SEQ ID NO: 70105 - DNA, 25 bp, mus musculus
tatttactcaactgaagtctatttc

SEQ ID NO: 70106 - DNA, 25 bp, mus musculus
taatttctctatatatcccaacctg

SEQ ID NO: 70107 - DNA, 25 bp, mus musculus
ctctatatatcccaacctggggaga

SEQ ID NO: 70108 - DNA, 25 bp, mus musculus
aagcctgtggggctatatgaccaga

SEQ ID NO: 70109 - DNA, 25 bp, mus musculus
ctatatgaccagagacagagaatta

SEQ ID NO: 70110 - DNA, 25 bp, mus musculus
cttgtctcatctgaatgaacaatct

SEQ ID NO: 70111 - DNA, 25 bp, mus musculus
acaatcttaaaccaatggctcagag

SEQ ID NO: 70112 - DNA, 25 bp, mus musculus
ttaaaccaatggctcagagagttga

SEQ ID NO: 70113 - DNA, 25 bp, mus musculus
ttcttctgttcaaacttcgacaagc

SEQ ID NO: 70114 - DNA, 25 bp, mus musculus
tgttcaaacttcgacaagctgtaga

SEQ ID NO: 70115 - DNA, 25 bp, mus musculus
aacttcgacaagctgtagacaatct

SEQ ID NO: 70116 - DNA, 25 bp, mus musculus
acggttatgcgtccctgtgtccaca

SEQ ID NO: 70117 - DNA, 25 bp, mus musculus
tgcacaacgagctggagaagcgcag

SEQ ID NO: 70118 - DNA, 25 bp, mus musculus
agctccaggggctgccaggagctag

SEQ ID NO: 70119 - DNA, 25 bp, mus musculus
cagacagcttggactcttcaggcct

SEQ ID NO: 70120 - DNA, 25 bp, mus musculus
acagcttggactcttcaggcctgtc

SEQ ID NO: 70121 - DNA, 25 bp, mus musculus
gcttggactcttcaggcctgtcctc

SEQ ID NO: 70122 - DNA, 25 bp, mus musculus
cctctgagcgctcagactcagacca

SEQ ID NO: 70123 - DNA, 25 bp, mus musculus
ctgagcgctcagactcagaccaaga

SEQ ID NO: 70124 - DNA, 25 bp, mus musculus
gctcagactcagaccaagaggatct

SEQ ID NO: 70125 - DNA, 25 bp, mus musculus
tggagaacctggtgtttgggactga

SEQ ID NO: 70126 - DNA, 25 bp, mus musculus
agctcctacagagcttcagcgctgg

SEQ ID NO: 70127 - DNA, 25 bp, mus musculus
agcacagctactcacacagcacctg

SEQ ID NO: 70128 - DNA, 25 bp, mus musculus
cccagctgaagcggtgcttagagca

SEQ ID NO: 70129 - DNA, 25 bp, mus musculus
acacagcacctgcgcctggctatga

SEQ ID NO: 70130 - DNA, 25 bp, mus musculus
agctgaagcggtgcttagagcaact

SEQ ID NO: 70131 - DNA, 25 bp, mus musculus
tgaggcagcagatgcccctgggagt

SEQ ID NO: 70132 - DNA, 25 bp, mus musculus
agatgcccctgggagttgactgtac

SEQ ID NO: 70133 - DNA, 25 bp, mus musculus
gatacactacactaagcctcctgcg

SEQ ID NO: 70134 - DNA, 25 bp, mus musculus
ttcgcagcaaacagcagagcctgca

SEQ ID NO: 70135 - DNA, 25 bp, mus musculus
agcagcagctggagcagctccaggg

SEQ ID NO: 70136 - DNA, 25 bp, mus musculus
agcagctccaggggctgccaggagc

SEQ ID NO: 70137 - DNA, 25 bp, mus musculus
tctggagccttaggcagcctattca

SEQ ID NO: 70138 - DNA, 25 bp, mus musculus
ggagccttaggcagcctattcagga

SEQ ID NO: 70139 - DNA, 25 bp, mus musculus
tctcaaccgagtctggtatctatgt

SEQ ID NO: 70140 - DNA, 25 bp, mus musculus
caaccgagtctggtatctatgtttg

SEQ ID NO: 70141 - DNA, 25 bp, mus musculus
tttgcgtaatatcccttggacataa

SEQ ID NO: 70142 - DNA, 25 bp, mus musculus
gcgtaatatcccttggacataatat

SEQ ID NO: 70143 - DNA, 25 bp, mus musculus
taatatcccttggacataatatgtg

SEQ ID NO: 70144 - DNA, 25 bp, mus musculus
tatcccttggacataatatgtgagc

SEQ ID NO: 70145 - DNA, 25 bp, mus musculus
ataatatgtgagcacacgggacata

SEQ ID NO: 70146 - DNA, 25 bp, mus musculus
atatgtgagcacacgggacatatat

SEQ ID NO: 70147 - DNA, 25 bp, mus musculus
ggacatatatttccactttgaatgt

SEQ ID NO: 70148 - DNA, 25 bp, mus musculus
tggagacccaaggagccgagaaaga

SEQ ID NO: 70149 - DNA, 25 bp, mus musculus
ggcagcctattcaggacaccaacga

SEQ ID NO: 70150 - DNA, 25 bp, mus musculus
agcctattcaggacaccaacgatgg

SEQ ID NO: 70151 - DNA, 25 bp, mus musculus
ctattcaggacaccaacgatggcaa

SEQ ID NO: 70152 - DNA, 25 bp, mus musculus
aggacaccaacgatggcaaattctg

SEQ ID NO: 70153 - DNA, 25 bp, mus musculus
acaccaacgatggcaaattctggca

SEQ ID NO: 70154 - DNA, 25 bp, mus musculus
ttattgattccacggacccagtctc

SEQ ID NO: 70155 - DNA, 25 bp, mus musculus
ttgattccacggacccagtctcaac

SEQ ID NO: 70156 - DNA, 25 bp, mus musculus
acccagtctcaaccgagtctggtat

SEQ ID NO: 70157 - DNA, 25 bp, mus musculus
aagacgacctggaagtcattcatct

SEQ ID NO: 70158 - DNA, 25 bp, mus musculus
acctggaagtcattcatctgattga

SEQ ID NO: 70159 - DNA, 25 bp, mus musculus
caggaaatgccccttactgcgctcc

SEQ ID NO: 70160 - DNA, 25 bp, mus musculus
ggaaatgccccttactgcgctcctg

SEQ ID NO: 70161 - DNA, 25 bp, mus musculus
aaatgccccttactgcgctcctgag

SEQ ID NO: 70162 - DNA, 25 bp, mus musculus
ctgcgctcctgaggaacctgggaaa

SEQ ID NO: 70163 - DNA, 25 bp, mus musculus
atgactgctaattcagtgcttgaac

SEQ ID NO: 70164 - DNA, 25 bp, mus musculus
gactgctaattcagtgcttgaacca

SEQ ID NO: 70165 - DNA, 25 bp, mus musculus
ctgctaattcagtgcttgaaccagg

SEQ ID NO: 70166 - DNA, 25 bp, mus musculus
taattcagtgcttgaaccaggaaac

SEQ ID NO: 70167 - DNA, 25 bp, mus musculus
attcagtgcttgaaccaggaaactc

SEQ ID NO: 70168 - DNA, 25 bp, mus musculus
cttgaaccaggaaactctgaagtat

SEQ ID NO: 70169 - DNA, 25 bp, mus musculus
ggaagtcattcatctgattgaagag

SEQ ID NO: 70170 - DNA, 25 bp, mus musculus
gtcattcatctgattgaagagcatc

SEQ ID NO: 70171 - DNA, 25 bp, mus musculus
tagggaacacctgctgacaaatcac

SEQ ID NO: 70172 - DNA, 25 bp, mus musculus
gggaacacctgctgacaaatcactt

SEQ ID NO: 70173 - DNA, 25 bp, mus musculus
gaacacctgctgacaaatcacttga

SEQ ID NO: 70174 - DNA, 25 bp, mus musculus
acctgctgacaaatcacttgaagtc

SEQ ID NO: 70175 - DNA, 25 bp, mus musculus
ctgctgacaaatcacttgaagtcta

SEQ ID NO: 70176 - DNA, 25 bp, mus musculus
gttacaggaaatgccccttactgcg

SEQ ID NO: 70177 - DNA, 25 bp, mus musculus
tgctgcccttcgacggcgacttcgc

SEQ ID NO: 70178 - DNA, 25 bp, mus musculus
acaggtcttcacacaacgaactaga

SEQ ID NO: 70179 - DNA, 25 bp, mus musculus
gtcacactactctgagccttctgaa

SEQ ID NO: 70180 - DNA, 25 bp, mus musculus
aggaacagcttcagcgggaacatcg

SEQ ID NO: 70181 - DNA, 25 bp, mus musculus
agcttcagcgggaacatcgcttcct

SEQ ID NO: 70182 - DNA, 25 bp, mus musculus
agcgggaacatcgcttcctaaagag

SEQ ID NO: 70183 - DNA, 25 bp, mus musculus
ctgctgtgtccacagatgactcaga

SEQ ID NO: 70184 - DNA, 25 bp, mus musculus
tgtccacagatgactcagagcaaga

SEQ ID NO: 70185 - DNA, 25 bp, mus musculus
agctggacagtgctggcagcagcag

SEQ ID NO: 70186 - DNA, 25 bp, mus musculus
accactacagcctacagagcagtgg

SEQ ID NO: 70187 - DNA, 25 bp, mus musculus
tacagagcagtggctgcagcgacag

SEQ ID NO: 70188 - DNA, 25 bp, mus musculus
gctgcagcgacagcagctatgggca

SEQ ID NO: 70189 - DNA, 25 bp, mus musculus
cttcacacaacgaactagaaaagca

SEQ ID NO: 70190 - DNA, 25 bp, mus musculus
gagctaaactcaggctctacttgga

SEQ ID NO: 70191 - DNA, 25 bp, mus musculus
aactcaggctctacttggagcagct

SEQ ID NO: 70192 - DNA, 25 bp, mus musculus
ggctctacttggagcagctcaagca

SEQ ID NO: 70193 - DNA, 25 bp, mus musculus
agcagctcaagcagcttggtcccct

SEQ ID NO: 70194 - DNA, 25 bp, mus musculus
tcaagcagcttggtcccctgggccc

SEQ ID NO: 70195 - DNA, 25 bp, mus musculus
ctgacagcacacgtcacactactct

SEQ ID NO: 70196 - DNA, 25 bp, mus musculus
gcacacgtcacactactctgagcct

SEQ ID NO: 70197 - DNA, 25 bp, mus musculus
attctaaaatccaaggtagatagag

SEQ ID NO: 70198 - DNA, 25 bp, mus musculus
ggacatcatttcatgttctttataa

SEQ ID NO: 70199 - DNA, 25 bp, mus musculus
tgttttaacaccaacactgtaacat

SEQ ID NO: 70200 - DNA, 25 bp, mus musculus
cagttttactgcattttcacaacat

SEQ ID NO: 70201 - DNA, 25 bp, mus musculus
ttttactgcattttcacaacatatc

SEQ ID NO: 70202 - DNA, 25 bp, mus musculus
attttcacaacatatcagatttcac

SEQ ID NO: 70203 - DNA, 25 bp, mus musculus
acaacatatcagatttcaccaaata

SEQ ID NO: 70204 - DNA, 25 bp, mus musculus
cagatttcaccaaatatatgcctta

SEQ ID NO: 70205 - DNA, 25 bp, mus musculus
atttcaccaaatatatgccttacta

SEQ ID NO: 70206 - DNA, 25 bp, mus musculus
ccaaatatatgccttactattgtat

SEQ ID NO: 70207 - DNA, 25 bp, mus musculus
tattactgctttactgtgtatctca

SEQ ID NO: 70208 - DNA, 25 bp, mus musculus
tactgctttactgtgtatctcaata

SEQ ID NO: 70209 - DNA, 25 bp, mus musculus
ttcatgttctttataaccatcaagt

SEQ ID NO: 70210 - DNA, 25 bp, mus musculus
atgttctttataaccatcaagtatt

SEQ ID NO: 70211 - DNA, 25 bp, mus musculus
atcatcacatggcatgtatcatcat

SEQ ID NO: 70212 - DNA, 25 bp, mus musculus
catgtatcatcattgtctccaggta

SEQ ID NO: 70213 - DNA, 25 bp, mus musculus
gtatcatcattgtctccaggtactg

SEQ ID NO: 70214 - DNA, 25 bp, mus musculus
ttgtctccaggtactggactcttac

SEQ ID NO: 70215 - DNA, 25 bp, mus musculus
tctccaggtactggactcttacttg

SEQ ID NO: 70216 - DNA, 25 bp, mus musculus
ggtactggactcttacttgagtatc

SEQ ID NO: 70217 - DNA, 25 bp, mus musculus
gcttgtatacactacaaacgataga

SEQ ID NO: 70218 - DNA, 25 bp, mus musculus
tgtatacactacaaacgatagacag

SEQ ID NO: 70219 - DNA, 25 bp, mus musculus
tcaaccttgccagctcgaaatccag

SEQ ID NO: 70220 - DNA, 25 bp, mus musculus
attgtcagtcaccagtcatgtacca

SEQ ID NO: 70221 - DNA, 25 bp, mus musculus
agtcaccagtcatgtaccaccagca

SEQ ID NO: 70222 - DNA, 25 bp, mus musculus
caccagtcatgtaccaccagcatgg

SEQ ID NO: 70223 - DNA, 25 bp, mus musculus
cagtcatgtaccaccagcatggtgc

SEQ ID NO: 70224 - DNA, 25 bp, mus musculus
tgtaccaccagcatggtgctcatgc

SEQ ID NO: 70225 - DNA, 25 bp, mus musculus
accaccagcatggtgctcatgcctg

SEQ ID NO: 70226 - DNA, 25 bp, mus musculus
atggtgctcatgcctgtagttctga

SEQ ID NO: 70227 - DNA, 25 bp, mus musculus
gtgctcatgcctgtagttctgacat

SEQ ID NO: 70228 - DNA, 25 bp, mus musculus
gaacaggccatcattttaagtgaga

SEQ ID NO: 70229 - DNA, 25 bp, mus musculus
aagcacacgtgcaaatccaagtgaa

SEQ ID NO: 70230 - DNA, 25 bp, mus musculus
cacacgtgcaaatccaagtgaacaa

SEQ ID NO: 70231 - DNA, 25 bp, mus musculus
ctgtgacacagcccttcatgagagt

SEQ ID NO: 70232 - DNA, 25 bp, mus musculus
agcccttcatgagagtcacagacag

SEQ ID NO: 70233 - DNA, 25 bp, mus musculus
catcaaaatgccaactacgtataaa

SEQ ID NO: 70234 - DNA, 25 bp, mus musculus
gccaactacgtataaatcctgtcag

SEQ ID NO: 70235 - DNA, 25 bp, mus musculus
tacgtataaatcctgtcaggaaaga

SEQ ID NO: 70236 - DNA, 25 bp, mus musculus
aggtcttcaaccttgccagctcgaa

SEQ ID NO: 70237 - DNA, 25 bp, mus musculus
tatgaacacttggatgctgctgacg

SEQ ID NO: 70238 - DNA, 25 bp, mus musculus
gaacacttggatgctgctgacgtga

SEQ ID NO: 70239 - DNA, 25 bp, mus musculus
tcccaggctgctgagcacggtgcag

SEQ ID NO: 70240 - DNA, 25 bp, mus musculus
gctgctgagcacggtgcagacacag

SEQ ID NO: 70241 - DNA, 25 bp, mus musculus
gcagacacagctgtgccttctgatg

SEQ ID NO: 70242 - DNA, 25 bp, mus musculus
gacacagctgtgccttctgatggcg

SEQ ID NO: 70243 - DNA, 25 bp, mus musculus
acagctgtgccttctgatggcgaca

SEQ ID NO: 70244 - DNA, 25 bp, mus musculus
gctgtgccttctgatggcgacaaga

SEQ ID NO: 70245 - DNA, 25 bp, mus musculus
gtgccttctgatggcgacaagaagc

SEQ ID NO: 70246 - DNA, 25 bp, mus musculus
aagcttcctgagatggacattgatt

SEQ ID NO: 70247 - DNA, 25 bp, mus musculus
attgattgattccaacacttgttta

SEQ ID NO: 70248 - DNA, 25 bp, mus musculus
gattgattccaacacttgtttatat

SEQ ID NO: 70249 - DNA, 25 bp, mus musculus
cacttggatgctgctgacgtgacaa

SEQ ID NO: 70250 - DNA, 25 bp, mus musculus
gatgctgctgacgtgacaaaggtag

SEQ ID NO: 70251 - DNA, 25 bp, mus musculus
agcaccaatgaggcgatggagtgga

SEQ ID NO: 70252 - DNA, 25 bp, mus musculus
agtatttgcagtcctataatttcaa

SEQ ID NO: 70253 - DNA, 25 bp, mus musculus
tgcagtcctataatttcaaaaccca

SEQ ID NO: 70254 - DNA, 25 bp, mus musculus
gaaccaaaacatgctgagcagaatg

SEQ ID NO: 70255 - DNA, 25 bp, mus musculus
ccaggctcccaggctgctgagcacg

SEQ ID NO: 70256 - DNA, 25 bp, mus musculus
ggctcccaggctgctgagcacggtg

SEQ ID NO: 70257 - DNA, 25 bp, mus musculus
ccaacagcagaaacgacaaggcact

SEQ ID NO: 70258 - DNA, 25 bp, mus musculus
aggcacttcatgattctctgggacc

SEQ ID NO: 70259 - DNA, 25 bp, mus musculus
tgcatgctcctggagtgagctacct

SEQ ID NO: 70260 - DNA, 25 bp, mus musculus
ctcctggagtgagctacctaacagg

SEQ ID NO: 70261 - DNA, 25 bp, mus musculus
gtagcacactggctactgtgtgcag

SEQ ID NO: 70262 - DNA, 25 bp, mus musculus
cactggctactgtgtgcaggcatca

SEQ ID NO: 70263 - DNA, 25 bp, mus musculus
ggcatcatcctttctctgtagtaaa

SEQ ID NO: 70264 - DNA, 25 bp, mus musculus
ttttcttcaaagtgctcatctcaaa

SEQ ID NO: 70265 - DNA, 25 bp, mus musculus
tggtatgctccaatgtaaagacaga

SEQ ID NO: 70266 - DNA, 25 bp, mus musculus
tttgtgccaacacatcctggcttta

SEQ ID NO: 70267 - DNA, 25 bp, mus musculus
ccaacacatcctggctttagagcac

SEQ ID NO: 70268 - DNA, 25 bp, mus musculus
catcctggctttagagcacaatgga

SEQ ID NO: 70269 - DNA, 25 bp, mus musculus
gtgttagctttttggcgtgttctga

SEQ ID NO: 70270 - DNA, 25 bp, mus musculus
gctttttggcgtgttctgaatgcca

SEQ ID NO: 70271 - DNA, 25 bp, mus musculus
aatgccaaatgcctctctttgctgc

SEQ ID NO: 70272 - DNA, 25 bp, mus musculus
ttgctgcatttgttatgtcagttac

SEQ ID NO: 70273 - DNA, 25 bp, mus musculus
ctgtcgtgttgcagcagatgatggc

SEQ ID NO: 70274 - DNA, 25 bp, mus musculus
gcgagcgtgctcagcttcaggggca

SEQ ID NO: 70275 - DNA, 25 bp, mus musculus
gtgctcagcttcaggggcacatgaa

SEQ ID NO: 70276 - DNA, 25 bp, mus musculus
agcttcaggggcacatgaagtgaac

SEQ ID NO: 70277 - DNA, 25 bp, mus musculus
agaacatccagcgtgtggctgcggg

SEQ ID NO: 70278 - DNA, 25 bp, mus musculus
aggctgccgacgccattgatgcgga

SEQ ID NO: 70279 - DNA, 25 bp, mus musculus
tcaccaattccctcttcaagcatga

SEQ ID NO: 70280 - DNA, 25 bp, mus musculus
attccctcttcaagcatgacccagc

SEQ ID NO: 70281 - DNA, 25 bp, mus musculus
ctgcctgggaggctgcccagagtat

SEQ ID NO: 70282 - DNA, 25 bp, mus musculus
tgatcccgatcaacgaaccctatgc

SEQ ID NO: 70283 - DNA, 25 bp, mus musculus
acgaaccctatgcagacgacatgga

SEQ ID NO: 70284 - DNA, 25 bp, mus musculus
ccagcgatgtgcctctggaccctct

SEQ ID NO: 70285 - DNA, 25 bp, mus musculus
atgtgcctctggaccctctggacat

SEQ ID NO: 70286 - DNA, 25 bp, mus musculus
tggacatgcacatggacctggatgg

SEQ ID NO: 70287 - DNA, 25 bp, mus musculus
tggacacctacagtgacggcctgag

SEQ ID NO: 70288 - DNA, 25 bp, mus musculus
ccactgcagaccacatgctggccta

SEQ ID NO: 70289 - DNA, 25 bp, mus musculus
tccattcccgcaatgagggcaccgc

SEQ ID NO: 70290 - DNA, 25 bp, mus musculus
cccgcaatgagggcaccgcgaccta

SEQ ID NO: 70291 - DNA, 25 bp, mus musculus
atgagggcaccgcgacctacgctgc

SEQ ID NO: 70292 - DNA, 25 bp, mus musculus
gcaccgcgacctacgctgctgctgt

SEQ ID NO: 70293 - DNA, 25 bp, mus musculus
tccgcatctctgaggacaagaaccc

SEQ ID NO: 70294 - DNA, 25 bp, mus musculus
cagattaccgtaagcgagtgtctgt

SEQ ID NO: 70295 - DNA, 25 bp, mus musculus
tgtctgtggagctcaccaattccct

SEQ ID NO: 70296 - DNA, 25 bp, mus musculus
tggagctcaccaattccctcttcaa

SEQ ID NO: 70297 - DNA, 25 bp, mus musculus
gcccgtaccagtctgtggcagcggc

SEQ ID NO: 70298 - DNA, 25 bp, mus musculus
cgtaccagtctgtggcagcggcacg

SEQ ID NO: 70299 - DNA, 25 bp, mus musculus
ctggagctgcgtggtttccaacatg

SEQ ID NO: 70300 - DNA, 25 bp, mus musculus
cgtggtttccaacatgacctgagca

SEQ ID NO: 70301 - DNA, 25 bp, mus musculus
ttccaacatgacctgagcagcctgc

SEQ ID NO: 70302 - DNA, 25 bp, mus musculus
catgacctgagcagcctgcgcgggt

SEQ ID NO: 70303 - DNA, 25 bp, mus musculus
ttggcacagagcttccggcctgcta

SEQ ID NO: 70304 - DNA, 25 bp, mus musculus
gcacagagcttccggcctgctatga

SEQ ID NO: 70305 - DNA, 25 bp, mus musculus
cagagcttccggcctgctatgagga

SEQ ID NO: 70306 - DNA, 25 bp, mus musculus
caccagctcctggatcgcagtctga

SEQ ID NO: 70307 - DNA, 25 bp, mus musculus
gcaggttccagtggcaaaggaggca

SEQ ID NO: 70308 - DNA, 25 bp, mus musculus
ggttccagtggcaaaggaggcactg

SEQ ID NO: 70309 - DNA, 25 bp, mus musculus
accagtctgtggcagcggcacgagt

SEQ ID NO: 70310 - DNA, 25 bp, mus musculus
gagtcaccagcttcagtccaggtag

SEQ ID NO: 70311 - DNA, 25 bp, mus musculus
tcaccagcttcagtccaggtagctc

SEQ ID NO: 70312 - DNA, 25 bp, mus musculus
gcttcagtccaggtagctcacggta

SEQ ID NO: 70313 - DNA, 25 bp, mus musculus
gtccaggtagctcacggtaccagca

SEQ ID NO: 70314 - DNA, 25 bp, mus musculus
gtagctcacggtaccagcaatggac

SEQ ID NO: 70315 - DNA, 25 bp, mus musculus
aatggaccccaggcctctgctctgg

SEQ ID NO: 70316 - DNA, 25 bp, mus musculus
caggcctctgctctggagctgcgtg

SEQ ID NO: 70317 - DNA, 25 bp, mus musculus
tacgtggtggccagtatgcgtatta

SEQ ID NO: 70318 - DNA, 25 bp, mus musculus
atgcgtattatgacccgcctgggga

SEQ ID NO: 70319 - DNA, 25 bp, mus musculus
tttccccagtgcctgtggcaagacc

SEQ ID NO: 70320 - DNA, 25 bp, mus musculus
ccccagtgcctgtggcaagaccaat

SEQ ID NO: 70321 - DNA, 25 bp, mus musculus
ctgtggcaagaccaatctggccatg

SEQ ID NO: 70322 - DNA, 25 bp, mus musculus
tggcaagaccaatctggccatgatg

SEQ ID NO: 70323 - DNA, 25 bp, mus musculus
gaccaatctggccatgatgaggcct

SEQ ID NO: 70324 - DNA, 25 bp, mus musculus
caatctggccatgatgaggcctgca

SEQ ID NO: 70325 - DNA, 25 bp, mus musculus
tctggccatgatgaggcctgcattg

SEQ ID NO: 70326 - DNA, 25 bp, mus musculus
ggatgacatcgcctggatgaggttt

SEQ ID NO: 70327 - DNA, 25 bp, mus musculus
tgacatcgcctggatgaggtttgac

SEQ ID NO: 70328 - DNA, 25 bp, mus musculus
catcgcctggatgaggtttgacagt

SEQ ID NO: 70329 - DNA, 25 bp, mus musculus
attatgacccgcctggggacacctg

SEQ ID NO: 70330 - DNA, 25 bp, mus musculus
acacctgtacttcaggccctgggag

SEQ ID NO: 70331 - DNA, 25 bp, mus musculus
gacttcatcaagtgtctgcattcag

SEQ ID NO: 70332 - DNA, 25 bp, mus musculus
atcaagtgtctgcattcagtgggcc

SEQ ID NO: 70333 - DNA, 25 bp, mus musculus
cagcccctgactggacatgattttg

SEQ ID NO: 70334 - DNA, 25 bp, mus musculus
tttgggcatcaccaaccctgcaggg

SEQ ID NO: 70335 - DNA, 25 bp, mus musculus
gggcatcaccaaccctgcagggaaa

SEQ ID NO: 70336 - DNA, 25 bp, mus musculus
tgctttccccagtgcctgtggcaag

SEQ ID NO: 70337 - DNA, 25 bp, mus musculus
atgaagagccccaggcaccccagga

SEQ ID NO: 70338 - DNA, 25 bp, mus musculus
aggcaccccaggagagcactccagc

SEQ ID NO: 70339 - DNA, 25 bp, mus musculus
agccagagctcctgagagctatagt

SEQ ID NO: 70340 - DNA, 25 bp, mus musculus
cagagctcctgagagctatagttga

SEQ ID NO: 70341 - DNA, 25 bp, mus musculus
agctcctgagagctatagttgactg

SEQ ID NO: 70342 - DNA, 25 bp, mus musculus
ctatagttgactgtggctttgagca

SEQ ID NO: 70343 - DNA, 25 bp, mus musculus
ttgactgtggctttgagcatccttc

SEQ ID NO: 70344 - DNA, 25 bp, mus musculus
gctttgagcatccttcagaggtcca

SEQ ID NO: 70345 - DNA, 25 bp, mus musculus
ttgagcatccttcagaggtccagca

SEQ ID NO: 70346 - DNA, 25 bp, mus musculus
agcatccttcagaggtccagcatga

SEQ ID NO: 70347 - DNA, 25 bp, mus musculus
cttcagaggtccagcatgattgtat

SEQ ID NO: 70348 - DNA, 25 bp, mus musculus
agcatgattgtattccccaggccat

SEQ ID NO: 70349 - DNA, 25 bp, mus musculus
tctccatccacagttctggcttccg

SEQ ID NO: 70350 - DNA, 25 bp, mus musculus
atgattgtattccccaggccattct

SEQ ID NO: 70351 - DNA, 25 bp, mus musculus
tccacagttctggcttccgggactt

SEQ ID NO: 70352 - DNA, 25 bp, mus musculus
tccgggactttctactgaagccaga

SEQ ID NO: 70353 - DNA, 25 bp, mus musculus
gggactttctactgaagccagagct

SEQ ID NO: 70354 - DNA, 25 bp, mus musculus
actttctactgaagccagagctcct

SEQ ID NO: 70355 - DNA, 25 bp, mus musculus
ttctactgaagccagagctcctgag

SEQ ID NO: 70356 - DNA, 25 bp, mus musculus
tactgaagccagagctcctgagagc

SEQ ID NO: 70357 - DNA, 25 bp, mus musculus
tgaagccagagctcctgagagctat

SEQ ID NO: 70358 - DNA, 25 bp, mus musculus
acctgcccactgagcactgcaaagc

SEQ ID NO: 70359 - DNA, 25 bp, mus musculus
ccactgagcactgcaaagccaatgg

SEQ ID NO: 70360 - DNA, 25 bp, mus musculus
gagacccacttctggcttcaggagc

SEQ ID NO: 70361 - DNA, 25 bp, mus musculus
ttcaggctatacacgcatcaagctg

SEQ ID NO: 70362 - DNA, 25 bp, mus musculus
ctatacacgcatcaagctgagcagg

SEQ ID NO: 70363 - DNA, 25 bp, mus musculus
acgcatcaagctgagcaggcagcaa

SEQ ID NO: 70364 - DNA, 25 bp, mus musculus
taaacttctccctgcttgaaagtgg

SEQ ID NO: 70365 - DNA, 25 bp, mus musculus
ctgatcgtctcaggccaaccagagg

SEQ ID NO: 70366 - DNA, 25 bp, mus musculus
gctccgcctctgaggattggctgct

SEQ ID NO: 70367 - DNA, 25 bp, mus musculus
attggctgctgggatggaagtcagc

SEQ ID NO: 70368 - DNA, 25 bp, mus musculus
acgccagcaattgctcttttggaaa

SEQ ID NO: 70369 - DNA, 25 bp, mus musculus
aaatctaccagtcccactgtgggtg

SEQ ID NO: 70370 - DNA, 25 bp, mus musculus
agcactgcaaagccaatggggtaga

SEQ ID NO: 70371 - DNA, 25 bp, mus musculus
attaagtagcttttcgcaggccact

SEQ ID NO: 70372 - DNA, 25 bp, mus musculus
tagcttttcgcaggccactggggac

SEQ ID NO: 70373 - DNA, 25 bp, mus musculus
ttcgcaggccactggggacgaggct

SEQ ID NO: 70374 - DNA, 25 bp, mus musculus
acctctgtctatcccaggcaaagac

SEQ ID NO: 70375 - DNA, 25 bp, mus musculus
gtctatcccaggcaaagacatcgtc

SEQ ID NO: 70376 - DNA, 25 bp, mus musculus
caaagacatcgtccttgcctctgta

SEQ ID NO: 70377 - DNA, 25 bp, mus musculus
catcgtccttgcctctgtaccggct

SEQ ID NO: 70378 - DNA, 25 bp, mus musculus
ggcttcaacatgaaagccacttgtg

SEQ ID NO: 70379 - DNA, 25 bp, mus musculus
gcttcaacatgaaagccacttgtga

SEQ ID NO: 70380 - DNA, 25 bp, mus musculus
acttcaaggcaaggttcatggtgag

SEQ ID NO: 70381 - DNA, 25 bp, mus musculus
cttcaaggcaaggttcatggtgagg

SEQ ID NO: 70382 - DNA, 25 bp, mus musculus
gccaaccggaggttcctggcaagtg

SEQ ID NO: 70383 - DNA, 25 bp, mus musculus
ccggaggttcctggcaagtgccatg

SEQ ID NO: 70384 - DNA, 25 bp, mus musculus
tcctggcaagtgccatggaatcatc

SEQ ID NO: 70385 - DNA, 25 bp, mus musculus
gccatggaatcatcagccggctggg

SEQ ID NO: 70386 - DNA, 25 bp, mus musculus
ccatggaatcatcagccggctgggt

SEQ ID NO: 70387 - DNA, 25 bp, mus musculus
catggaatcatcagccggctgggta

SEQ ID NO: 70388 - DNA, 25 bp, mus musculus
cttcaacatgaaagccacttgtgaa

SEQ ID NO: 70389 - DNA, 25 bp, mus musculus
ttcaacatgaaagccacttgtgaag

SEQ ID NO: 70390 - DNA, 25 bp, mus musculus
tcaacatgaaagccacttgtgaaga

SEQ ID NO: 70391 - DNA, 25 bp, mus musculus
caacatgaaagccacttgtgaagat

SEQ ID NO: 70392 - DNA, 25 bp, mus musculus
aacatgaaagccacttgtgaagatt

SEQ ID NO: 70393 - DNA, 25 bp, mus musculus
acatgaaagccacttgtgaagatta

SEQ ID NO: 70394 - DNA, 25 bp, mus musculus
catgaaagccacttgtgaagattag

SEQ ID NO: 70395 - DNA, 25 bp, mus musculus
atgaaagccacttgtgaagattaga

SEQ ID NO: 70396 - DNA, 25 bp, mus musculus
aggcccagtgtcttggcattcttgt

SEQ ID NO: 70397 - DNA, 25 bp, mus musculus
agtgtcttggcattcttgtagaatc

SEQ ID NO: 70398 - DNA, 25 bp, mus musculus
gcagtccagaattcctgcctgacaa

SEQ ID NO: 70399 - DNA, 25 bp, mus musculus
cagaattcctgcctgacaacccgtg

SEQ ID NO: 70400 - DNA, 25 bp, mus musculus
tcaacaaataaagccattatgttaa

SEQ ID NO: 70401 - DNA, 25 bp, mus musculus
caggggcctacagctcctagggaat

SEQ ID NO: 70402 - DNA, 25 bp, mus musculus
cctacagctcctagggaatggagaa

SEQ ID NO: 70403 - DNA, 25 bp, mus musculus
ctaatggccactctttagtgtttgt

SEQ ID NO: 70404 - DNA, 25 bp, mus musculus
gccactctttagtgtttgtgtctaa

SEQ ID NO: 70405 - DNA, 25 bp, mus musculus
caggacccccatgtagcttcctctg

SEQ ID NO: 70406 - DNA, 25 bp, mus musculus
ccccatgtagcttcctctgacttgg

SEQ ID NO: 70407 - DNA, 25 bp, mus musculus
gtagcttcctctgacttggtttgta

SEQ ID NO: 70408 - DNA, 25 bp, mus musculus
atgtgtgatgccttttcaggcaata

SEQ ID NO: 70409 - DNA, 25 bp, mus musculus
gatgccttttcaggcaataggaaag

SEQ ID NO: 70410 - DNA, 25 bp, mus musculus
gcatatgctgacgcctgagaacaga

SEQ ID NO: 70411 - DNA, 25 bp, mus musculus
gagctgagcttcctctgcttcccct

SEQ ID NO: 70412 - DNA, 25 bp, mus musculus
ggaactgcagcacacactgcactcc

SEQ ID NO: 70413 - DNA, 25 bp, mus musculus
gctcttgccgccagcattgcaccag

SEQ ID NO: 70414 - DNA, 25 bp, mus musculus
agcattgcaccagcagtccagaatt

SEQ ID NO: 70415 - DNA, 25 bp, mus musculus
gcaccagcagtccagaattcctgcc

SEQ ID NO: 70416 - DNA, 25 bp, mus musculus
cggcactgccatgggcaccgacagc

SEQ ID NO: 70417 - DNA, 25 bp, mus musculus
gcactgccatgggcaccgacagccg

SEQ ID NO: 70418 - DNA, 25 bp, mus musculus
gtatccaaaagaccttgaatgaatg

SEQ ID NO: 70419 - DNA, 25 bp, mus musculus
atccaaaagaccttgaatgaatgga

SEQ ID NO: 70420 - DNA, 25 bp, mus musculus
cccaaatcagccccgatttagtcag

SEQ ID NO: 70421 - DNA, 25 bp, mus musculus
caaatcagccccgatttagtcaggg

SEQ ID NO: 70422 - DNA, 25 bp, mus musculus
tcagccccgatttagtcagggagtt

SEQ ID NO: 70423 - DNA, 25 bp, mus musculus
tggaatgcaccatgtcccatgcagt

SEQ ID NO: 70424 - DNA, 25 bp, mus musculus
gaatgcaccatgtcccatgcagtgg

SEQ ID NO: 70425 - DNA, 25 bp, mus musculus
gcaccatgtcccatgcagtggagaa

SEQ ID NO: 70426 - DNA, 25 bp, mus musculus
accatgtcccatgcagtggagaaga

SEQ ID NO: 70427 - DNA, 25 bp, mus musculus
tgtcccatgcagtggagaagataaa

SEQ ID NO: 70428 - DNA, 25 bp, mus musculus
tgcacctgcagaccgggaacctgct

SEQ ID NO: 70429 - DNA, 25 bp, mus musculus
cacctgcagaccgggaacctgctca

SEQ ID NO: 70430 - DNA, 25 bp, mus musculus
tgcagaccgggaacctgctcaactg

SEQ ID NO: 70431 - DNA, 25 bp, mus musculus
cagaccgggaacctgctcaactggg

SEQ ID NO: 70432 - DNA, 25 bp, mus musculus
acctgctcaactggggccgcctgcg

SEQ ID NO: 70433 - DNA, 25 bp, mus musculus
cgtccacgcacagcgaggagcttcg

SEQ ID NO: 70434 - DNA, 25 bp, mus musculus
tccacgcacagcgaggagcttcggg

SEQ ID NO: 70435 - DNA, 25 bp, mus musculus
gactgtatccaaaagaccttgaatg

SEQ ID NO: 70436 - DNA, 25 bp, mus musculus
tttgtaagctcttttgtgaagctgg

SEQ ID NO: 70437 - DNA, 25 bp, mus musculus
ttgtaagctcttttgtgaagctggt

SEQ ID NO: 70438 - DNA, 25 bp, mus musculus
tactgtgcttcggtacttcgcatcc

SEQ ID NO: 70439 - DNA, 25 bp, mus musculus
actgtgcttcggtacttcgcatccg

SEQ ID NO: 70440 - DNA, 25 bp, mus musculus
tgtgcttcggtacttcgcatccgac

SEQ ID NO: 70441 - DNA, 25 bp, mus musculus
gtgcttcggtacttcgcatccgacc

SEQ ID NO: 70442 - DNA, 25 bp, mus musculus
tgcttcggtacttcgcatccgacct

SEQ ID NO: 70443 - DNA, 25 bp, mus musculus
gcttcggtacttcgcatccgacctt

SEQ ID NO: 70444 - DNA, 25 bp, mus musculus
ttcggtacttcgcatccgaccttca

SEQ ID NO: 70445 - DNA, 25 bp, mus musculus
tcggtacttcgcatccgaccttcac

SEQ ID NO: 70446 - DNA, 25 bp, mus musculus
cggtacttcgcatccgaccttcacg

SEQ ID NO: 70447 - DNA, 25 bp, mus musculus
ggtacttcgcatccgaccttcacgg

SEQ ID NO: 70448 - DNA, 25 bp, mus musculus
tgtaagctcttttgtgaagctggtt

SEQ ID NO: 70449 - DNA, 25 bp, mus musculus
gtacttcgcatccgaccttcacgga

SEQ ID NO: 70450 - DNA, 25 bp, mus musculus
caccggtgactactgtgcttcggta

SEQ ID NO: 70451 - DNA, 25 bp, mus musculus
cggtgactactgtgcttcggtactt

SEQ ID NO: 70452 - DNA, 25 bp, mus musculus
ggtgactactgtgcttcggtacttc

SEQ ID NO: 70453 - DNA, 25 bp, mus musculus
gtgactactgtgcttcggtacttcg

SEQ ID NO: 70454 - DNA, 25 bp, mus musculus
tgactactgtgcttcggtacttcgc

SEQ ID NO: 70455 - DNA, 25 bp, mus musculus
actactgtgcttcggtacttcgcat

SEQ ID NO: 70456 - DNA, 25 bp, mus musculus
ctactgtgcttcggtacttcgcatc

SEQ ID NO: 70457 - DNA, 25 bp, mus musculus
gatgacctttcctgctgccctgagt

SEQ ID NO: 70458 - DNA, 25 bp, mus musculus
tgctgccctgagtgtgacccaaggc

SEQ ID NO: 70459 - DNA, 25 bp, mus musculus
accatccgcaatgacatcaccaaaa

SEQ ID NO: 70460 - DNA, 25 bp, mus musculus
gacatcaccaaaacctgcctggacg

SEQ ID NO: 70461 - DNA, 25 bp, mus musculus
acctgcctggacgagatgaacgtgg

SEQ ID NO: 70462 - DNA, 25 bp, mus musculus
ttcaccgggtcttcctggatcaagc

SEQ ID NO: 70463 - DNA, 25 bp, mus musculus
atcaagcacggcacggagtgtaccc

SEQ ID NO: 70464 - DNA, 25 bp, mus musculus
tgtaccctctgccagtgcaagaatg

SEQ ID NO: 70465 - DNA, 25 bp, mus musculus
ggccatttgtgctgctcagtggatc

SEQ ID NO: 70466 - DNA, 25 bp, mus musculus
ttgtgctgctcagtggatccacagt

SEQ ID NO: 70467 - DNA, 25 bp, mus musculus
agttaactgcctcatgggagatatc

SEQ ID NO: 70468 - DNA, 25 bp, mus musculus
tgcaactttgttagcagctggatag

SEQ ID NO: 70469 - DNA, 25 bp, mus musculus
agtcagtgcctgcatcaaaacgggg

SEQ ID NO: 70470 - DNA, 25 bp, mus musculus
ttcgtggggcctgaggaacatctct

SEQ ID NO: 70471 - DNA, 25 bp, mus musculus
gtgtacaacagcggcgacacctggg

SEQ ID NO: 70472 - DNA, 25 bp, mus musculus
cgtcagtgccgctgcttgcaaggag

SEQ ID NO: 70473 - DNA, 25 bp, mus musculus
tgccgctgcttgcaaggagaagttg

SEQ ID NO: 70474 - DNA, 25 bp, mus musculus
gactgttggcccctggcttgcccag

SEQ ID NO: 70475 - DNA, 25 bp, mus musculus
tgcccacgctgtgtcaccgatcctt

SEQ ID NO: 70476 - DNA, 25 bp, mus musculus
gatccttgtcaggccgacaccatcc

SEQ ID NO: 70477 - DNA, 25 bp, mus musculus
gccgacaccatccgcaatgacatca

SEQ ID NO: 70478 - DNA, 25 bp, mus musculus
ccgcattggcatctttgggcaggat

SEQ ID NO: 70479 - DNA, 25 bp, mus musculus
cattggcatctttgggcaggatgag

SEQ ID NO: 70480 - DNA, 25 bp, mus musculus
tcgagttgaaccttcccacaagtct

SEQ ID NO: 70481 - DNA, 25 bp, mus musculus
ttcccacaagtctaagattgttgag

SEQ ID NO: 70482 - DNA, 25 bp, mus musculus
tgttgagttccttcagtcctttgat

SEQ ID NO: 70483 - DNA, 25 bp, mus musculus
gttccttcagtcctttgatgagatc

SEQ ID NO: 70484 - DNA, 25 bp, mus musculus
agctatgactggtgatggtgtgaat

SEQ ID NO: 70485 - DNA, 25 bp, mus musculus
gaatgatgctcctgctctgaagaaa

SEQ ID NO: 70486 - DNA, 25 bp, mus musculus
tgatgctcctgctctgaagaaatct

SEQ ID NO: 70487 - DNA, 25 bp, mus musculus
tgctcctgctctgaagaaatctgaa

SEQ ID NO: 70488 - DNA, 25 bp, mus musculus
aatcgggattgccatgggctcaggg

SEQ ID NO: 70489 - DNA, 25 bp, mus musculus
gattgccatgggctcagggactgca

SEQ ID NO: 70490 - DNA, 25 bp, mus musculus
tggcatctttgggcaggatgaggat

SEQ ID NO: 70491 - DNA, 25 bp, mus musculus
ctcagggactgcagtggctaagact

SEQ ID NO: 70492 - DNA, 25 bp, mus musculus
tgatgaattaagcccttcagcccag

SEQ ID NO: 70493 - DNA, 25 bp, mus musculus
tgaattaagcccttcagcccagaga

SEQ ID NO: 70494 - DNA, 25 bp, mus musculus
aagcccttcagcccagagagatgcc

SEQ ID NO: 70495 - DNA, 25 bp, mus musculus
ttcagcccagagagatgcctgctta

SEQ ID NO: 70496 - DNA, 25 bp, mus musculus
cttaaatgcccgctgttttgctcga

SEQ ID NO: 70497 - DNA, 25 bp, mus musculus
aaatgcccgctgttttgctcgagtt

SEQ ID NO: 70498 - DNA, 25 bp, mus musculus
ccgctgttttgctcgagttgaacct

SEQ ID NO: 70499 - DNA, 25 bp, mus musculus
tatcattacttactttcatgagtgc

SEQ ID NO: 70500 - DNA, 25 bp, mus musculus
tcattacttactttcatgagtgcac

SEQ ID NO: 70501 - DNA, 25 bp, mus musculus
ttattcagaccttaatgtgaaattt

SEQ ID NO: 70502 - DNA, 25 bp, mus musculus
agaattcaatctttgttcttcacag

SEQ ID NO: 70503 - DNA, 25 bp, mus musculus
aattcaatctttgttcttcacagag

SEQ ID NO: 70504 - DNA, 25 bp, mus musculus
ttcaatctttgttcttcacagagac

SEQ ID NO: 70505 - DNA, 25 bp, mus musculus
ctttgttcttcacagagaccctggg

SEQ ID NO: 70506 - DNA, 25 bp, mus musculus
ttgttcttcacagagaccctgggag

SEQ ID NO: 70507 - DNA, 25 bp, mus musculus
gttcttcacagagaccctgggagaa

SEQ ID NO: 70508 - DNA, 25 bp, mus musculus
tcttcacagagaccctgggagaagg

SEQ ID NO: 70509 - DNA, 25 bp, mus musculus
tctggtaaatacaccacagggtctg

SEQ ID NO: 70510 - DNA, 25 bp, mus musculus
tggtaaatacaccacagggtctgtt

SEQ ID NO: 70511 - DNA, 25 bp, mus musculus
attacttactttcatgagtgcacat

SEQ ID NO: 70512 - DNA, 25 bp, mus musculus
cttactttcatgagtgcacattgtc

SEQ ID NO: 70513 - DNA, 25 bp, mus musculus
tactttcatgagtgcacattgtcaa

SEQ ID NO: 70514 - DNA, 25 bp, mus musculus
ctttcatgagtgcacattgtcaaga

SEQ ID NO: 70515 - DNA, 25 bp, mus musculus
cacattgtcaagattcctggtatca

SEQ ID NO: 70516 - DNA, 25 bp, mus musculus
caagattcctggtatcattttgctt

SEQ ID NO: 70517 - DNA, 25 bp, mus musculus
agattcctggtatcattttgcttta

SEQ ID NO: 70518 - DNA, 25 bp, mus musculus
atttcatctttgaattattcagacc

SEQ ID NO: 70519 - DNA, 25 bp, mus musculus
agttacacatcaccagatggtcaga

SEQ ID NO: 70520 - DNA, 25 bp, mus musculus
acatcaccagatggtcagacaacta

SEQ ID NO: 70521 - DNA, 25 bp, mus musculus
taattttgctccaagcatgtaatcc

SEQ ID NO: 70522 - DNA, 25 bp, mus musculus
ttttgctccaagcatgtaatccttc

SEQ ID NO: 70523 - DNA, 25 bp, mus musculus
tgctccaagcatgtaatccttcaaa

SEQ ID NO: 70524 - DNA, 25 bp, mus musculus
catgtaatccttcaaagtttgtgct

SEQ ID NO: 70525 - DNA, 25 bp, mus musculus
gtaatccttcaaagtttgtgctcct

SEQ ID NO: 70526 - DNA, 25 bp, mus musculus
atccttcaaagtttgtgctcctatg

SEQ ID NO: 70527 - DNA, 25 bp, mus musculus
caaagtttgtgctcctatgtttgta

SEQ ID NO: 70528 - DNA, 25 bp, mus musculus
tgctcctatgtttgtattgaactaa

SEQ ID NO: 70529 - DNA, 25 bp, mus musculus
tatagcacttgtgtctgataagatt

SEQ ID NO: 70530 - DNA, 25 bp, mus musculus
agcacttgtgtctgataagatttct

SEQ ID NO: 70531 - DNA, 25 bp, mus musculus
ttacctgaatacatcaaacagaaat

SEQ ID NO: 70532 - DNA, 25 bp, mus musculus
cctgaatacatcaaacagaaattac

SEQ ID NO: 70533 - DNA, 25 bp, mus musculus
ttacagtgtctttcttccatccttc

SEQ ID NO: 70534 - DNA, 25 bp, mus musculus
tgactttttggctggctttcaagta

SEQ ID NO: 70535 - DNA, 25 bp, mus musculus
tttggctggctttcaagtaagtgat

SEQ ID NO: 70536 - DNA, 25 bp, mus musculus
tcagaaagcctttctattaaacaga

SEQ ID NO: 70537 - DNA, 25 bp, mus musculus
ttcagttacctaatatagtggtcat

SEQ ID NO: 70538 - DNA, 25 bp, mus musculus
atctaattttgctccaagcatgtaa

SEQ ID NO: 70539 - DNA, 25 bp, mus musculus
aaagtggcacaggccacctgcaagc

SEQ ID NO: 70540 - DNA, 25 bp, mus musculus
gcacaggccacctgcaagctctgag

SEQ ID NO: 70541 - DNA, 25 bp, mus musculus
gctgtgcctaagcacttgcttggga

SEQ ID NO: 70542 - DNA, 25 bp, mus musculus
cctaagcacttgcttgggatggccc

SEQ ID NO: 70543 - DNA, 25 bp, mus musculus
atggccctgggtgagtctgcctgcc

SEQ ID NO: 70544 - DNA, 25 bp, mus musculus
gagtctgcctgccagcagagctgat

SEQ ID NO: 70545 - DNA, 25 bp, mus musculus
ctttgttctacctctgaggacagag

SEQ ID NO: 70546 - DNA, 25 bp, mus musculus
tctacctctgaggacagagagcagt

SEQ ID NO: 70547 - DNA, 25 bp, mus musculus
cttatgccagcagagcatttgctgg

SEQ ID NO: 70548 - DNA, 25 bp, mus musculus
ttgatctgcgtctgtggtcatctgc

SEQ ID NO: 70549 - DNA, 25 bp, mus musculus
tgcgtctgtggtcatctgccaacga

SEQ ID NO: 70550 - DNA, 25 bp, mus musculus
ccaacgaaatctccactctgtgcgt

SEQ ID NO: 70551 - DNA, 25 bp, mus musculus
ctctgagacccatgttcgcctgaac

SEQ ID NO: 70552 - DNA, 25 bp, mus musculus
gacccatgttcgcctgaaccagaac

SEQ ID NO: 70553 - DNA, 25 bp, mus musculus
tgttcgcctgaaccagaacggaggg

SEQ ID NO: 70554 - DNA, 25 bp, mus musculus
agccggcatcacagaggtccctgtc

SEQ ID NO: 70555 - DNA, 25 bp, mus musculus
agaggtccctgtccctcatgataag

SEQ ID NO: 70556 - DNA, 25 bp, mus musculus
ccctgtccctcatgataagggctag

SEQ ID NO: 70557 - DNA, 25 bp, mus musculus
cagctccccagagctgtgcctaagc

SEQ ID NO: 70558 - DNA, 25 bp, mus musculus
cccagagctgtgcctaagcacttgc

SEQ ID NO: 70559 - DNA, 25 bp, mus musculus
atggaccacttgtgtcccagcaaac

SEQ ID NO: 70560 - DNA, 25 bp, mus musculus
gaccacttgtgtcccagcaaaccca

SEQ ID NO: 70561 - DNA, 25 bp, mus musculus
tcatgtacattgcactttgatctgt

SEQ ID NO: 70562 - DNA, 25 bp, mus musculus
acattgcactttgatctgtaactga

SEQ ID NO: 70563 - DNA, 25 bp, mus musculus
ttgcactttgatctgtaactgagcg

SEQ ID NO: 70564 - DNA, 25 bp, mus musculus
cactttgatctgtaactgagcgacc

SEQ ID NO: 70565 - DNA, 25 bp, mus musculus
ctgtaactgagcgaccctggggtct

SEQ ID NO: 70566 - DNA, 25 bp, mus musculus
taactgagcgaccctggggtctgct

SEQ ID NO: 70567 - DNA, 25 bp, mus musculus
agcgaccctggggtctgctatagag

SEQ ID NO: 70568 - DNA, 25 bp, mus musculus
gaccctggggtctgctatagagctg

SEQ ID NO: 70569 - DNA, 25 bp, mus musculus
gctgtttctttctgtggaaagtagt

SEQ ID NO: 70570 - DNA, 25 bp, mus musculus
gaaactgtggctcctcaatctcgtg

SEQ ID NO: 70571 - DNA, 25 bp, mus musculus
ttgtgtcccagcaaacccagctttg

SEQ ID NO: 70572 - DNA, 25 bp, mus musculus
tggctcctcaatctcgtgccgaatt

SEQ ID NO: 70573 - DNA, 25 bp, mus musculus
attttcattgtcatagcaagggggc

SEQ ID NO: 70574 - DNA, 25 bp, mus musculus
atagcaagggggccacgtgatcagg

SEQ ID NO: 70575 - DNA, 25 bp, mus musculus
aagtttcagaccaactgtcttctgt

SEQ ID NO: 70576 - DNA, 25 bp, mus musculus
tttcagaccaactgtcttctgtgaa

SEQ ID NO: 70577 - DNA, 25 bp, mus musculus
tttccttcagtagactgtaaccata

SEQ ID NO: 70578 - DNA, 25 bp, mus musculus
gactgtaaccataacttcaattatt

SEQ ID NO: 70579 - DNA, 25 bp, mus musculus
tatctgtcatgtacattgcactttg

SEQ ID NO: 70580 - DNA, 25 bp, mus musculus
agtcaaacactgcaatggccaccac

SEQ ID NO: 70581 - DNA, 25 bp, mus musculus
agagcagcagactccagccagcaag

SEQ ID NO: 70582 - DNA, 25 bp, mus musculus
cggacgtgccagaccaggtgacttg

SEQ ID NO: 70583 - DNA, 25 bp, mus musculus
tgccagaccaggtgacttggccatc

SEQ ID NO: 70584 - DNA, 25 bp, mus musculus
accaggtgacttggccatctagcca

SEQ ID NO: 70585 - DNA, 25 bp, mus musculus
ggccatctagccatagtcattccag

SEQ ID NO: 70586 - DNA, 25 bp, mus musculus
ctagccatagtcattccagatacct

SEQ ID NO: 70587 - DNA, 25 bp, mus musculus
atagtcattccagatacctttataa

SEQ ID NO: 70588 - DNA, 25 bp, mus musculus
cactcaaaaagcatttctaatcaac

SEQ ID NO: 70589 - DNA, 25 bp, mus musculus
atttctaatcaacaggtagaaagag

SEQ ID NO: 70590 - DNA, 25 bp, mus musculus
ggattcccctgagggaaacactgag

SEQ ID NO: 70591 - DNA, 25 bp, mus musculus
atgcttgctgttcttgtccctgtgg

SEQ ID NO: 70592 - DNA, 25 bp, mus musculus
ttcagcagcatccagccctgatggc

SEQ ID NO: 70593 - DNA, 25 bp, mus musculus
agcatccagccctgatggccgcaag

SEQ ID NO: 70594 - DNA, 25 bp, mus musculus
cagccctgatggccgcaaggggctc

SEQ ID NO: 70595 - DNA, 25 bp, mus musculus
tgatggccgcaaggggctcattgac

SEQ ID NO: 70596 - DNA, 25 bp, mus musculus
cattgacagcagtggcagcagctta

SEQ ID NO: 70597 - DNA, 25 bp, mus musculus
tggcagcagcttacaggagagtgcc

SEQ ID NO: 70598 - DNA, 25 bp, mus musculus
ggccaccacagtggagatgtactcg

SEQ ID NO: 70599 - DNA, 25 bp, mus musculus
caagtccagtaacggacgtgccaga

SEQ ID NO: 70600 - DNA, 25 bp, mus musculus
cctaagccatgctcagcagtaccga

SEQ ID NO: 70601 - DNA, 25 bp, mus musculus
tcagcagtaccgatggtaccagatg

SEQ ID NO: 70602 - DNA, 25 bp, mus musculus
cagtgacaagcaccgagagtttgcc

SEQ ID NO: 70603 - DNA, 25 bp, mus musculus
caagcaccgagagtttgccatggaa

SEQ ID NO: 70604 - DNA, 25 bp, mus musculus
gtttgccatggaagctgcctgtatc

SEQ ID NO: 70605 - DNA, 25 bp, mus musculus
agctgcctgtatctctgacaccttg

SEQ ID NO: 70606 - DNA, 25 bp, mus musculus
gctcgacacacactgatctgcaggc

SEQ ID NO: 70607 - DNA, 25 bp, mus musculus
ctgatctgcaggcacatgagcagat

SEQ ID NO: 70608 - DNA, 25 bp, mus musculus
cacatgagcagatcacacatcttcg

SEQ ID NO: 70609 - DNA, 25 bp, mus musculus
agcagatcacacatcttcgagctct

SEQ ID NO: 70610 - DNA, 25 bp, mus musculus
atcttcgagctctgccacagccttt

SEQ ID NO: 70611 - DNA, 25 bp, mus musculus
cctgagctggcctcagagttttctc

SEQ ID NO: 70612 - DNA, 25 bp, mus musculus
ccagatgctataccaggctggtgtg

SEQ ID NO: 70613 - DNA, 25 bp, mus musculus
cctgctggcagatgtctgcttgaac

SEQ ID NO: 70614 - DNA, 25 bp, mus musculus
tgtctgcttgaacttcttgcccagc

SEQ ID NO: 70615 - DNA, 25 bp, mus musculus
cctcatcttcatcatcattctgtac

SEQ ID NO: 70616 - DNA, 25 bp, mus musculus
catcattctgtacgaagggctcctg

SEQ ID NO: 70617 - DNA, 25 bp, mus musculus
gaataccttccacaacattgctctg

SEQ ID NO: 70618 - DNA, 25 bp, mus musculus
cttccacaacattgctctggagacc

SEQ ID NO: 70619 - DNA, 25 bp, mus musculus
tgctctggagaccagtgacaagcac

SEQ ID NO: 70620 - DNA, 25 bp, mus musculus
gtgaacggcacagtcacatcaaacg

SEQ ID NO: 70621 - DNA, 25 bp, mus musculus
gaacggcacagtcacatcaaacgga

SEQ ID NO: 70622 - DNA, 25 bp, mus musculus
ttgtccccaaagaatctgctttctg

SEQ ID NO: 70623 - DNA, 25 bp, mus musculus
gtccccaaagaatctgctttctgct

SEQ ID NO: 70624 - DNA, 25 bp, mus musculus
ccccaaagaatctgctttctgctct

SEQ ID NO: 70625 - DNA, 25 bp, mus musculus
agaatctgctttctgctctatcttt

SEQ ID NO: 70626 - DNA, 25 bp, mus musculus
aatctgctttctgctctatctttca

SEQ ID NO: 70627 - DNA, 25 bp, mus musculus
ctgctctatctttcagcactagcaa

SEQ ID NO: 70628 - DNA, 25 bp, mus musculus
gctctatctttcagcactagcaatt

SEQ ID NO: 70629 - DNA, 25 bp, mus musculus
tctatctttcagcactagcaatttt

SEQ ID NO: 70630 - DNA, 25 bp, mus musculus
tatctttcagcactagcaatttttc

SEQ ID NO: 70631 - DNA, 25 bp, mus musculus
aatacagtttatgctctttgatttc

SEQ ID NO: 70632 - DNA, 25 bp, mus musculus
acggcacagtcacatcaaacggagc

SEQ ID NO: 70633 - DNA, 25 bp, mus musculus
gtcacatcaaacggagcagactccc

SEQ ID NO: 70634 - DNA, 25 bp, mus musculus
cacatcaaacggagcagactcccct

SEQ ID NO: 70635 - DNA, 25 bp, mus musculus
aagtcttcgtaatggatcggaagct

SEQ ID NO: 70636 - DNA, 25 bp, mus musculus
tgactgattattgtccccaaagaat

SEQ ID NO: 70637 - DNA, 25 bp, mus musculus
tgattattgtccccaaagaatctgc

SEQ ID NO: 70638 - DNA, 25 bp, mus musculus
attattgtccccaaagaatctgctt

SEQ ID NO: 70639 - DNA, 25 bp, mus musculus
tattgtccccaaagaatctgctttc

SEQ ID NO: 70640 - DNA, 25 bp, mus musculus
agattttatcgtgctccggagatca

SEQ ID NO: 70641 - DNA, 25 bp, mus musculus
tatgactacggtatcgatatgtggt

SEQ ID NO: 70642 - DNA, 25 bp, mus musculus
ctaatgttggacccagctaagcgaa

SEQ ID NO: 70643 - DNA, 25 bp, mus musculus
gacccagctaagcgaattagcatca

SEQ ID NO: 70644 - DNA, 25 bp, mus musculus
cgaattagcatcaaccaggccctgc

SEQ ID NO: 70645 - DNA, 25 bp, mus musculus
attagcatcaaccaggccctgcagc

SEQ ID NO: 70646 - DNA, 25 bp, mus musculus
agcatcaaccaggccctgcagcatg

SEQ ID NO: 70647 - DNA, 25 bp, mus musculus
aaccaggccctgcagcatgcattca

SEQ ID NO: 70648 - DNA, 25 bp, mus musculus
ctgcagcatgcattcatccaggaaa

SEQ ID NO: 70649 - DNA, 25 bp, mus musculus
tgcagcatgcattcatccaggaaaa

SEQ ID NO: 70650 - DNA, 25 bp, mus musculus
cagcatgcattcatccaggaaaaaa

SEQ ID NO: 70651 - DNA, 25 bp, mus musculus
agcatgcattcatccaggaaaaaat

SEQ ID NO: 70652 - DNA, 25 bp, mus musculus
atcgatatgtggtctgtaggttgta

SEQ ID NO: 70653 - DNA, 25 bp, mus musculus
ttggctgacttgattgggtgccagc

SEQ ID NO: 70654 - DNA, 25 bp, mus musculus
gacttgattgggtgccagcgacttc

SEQ ID NO: 70655 - DNA, 25 bp, mus musculus
tgccagcgacttcctgaagatcaac

SEQ ID NO: 70656 - DNA, 25 bp, mus musculus
gtacaccagctaaaggacttgttgg

SEQ ID NO: 70657 - DNA, 25 bp, mus musculus
ttgttggaccagatcctaatgttgg

SEQ ID NO: 70658 - DNA, 25 bp, mus musculus
ttggaccagatcctaatgttggacc

SEQ ID NO: 70659 - DNA, 25 bp, mus musculus
gaccagatcctaatgttggacccag

SEQ ID NO: 70660 - DNA, 25 bp, mus musculus
gaagccaaagcgcattgttattcga

SEQ ID NO: 70661 - DNA, 25 bp, mus musculus
aaagcgcattgttattcgaggccat

SEQ ID NO: 70662 - DNA, 25 bp, mus musculus
cattctctctcaggatgctgcctgc

SEQ ID NO: 70663 - DNA, 25 bp, mus musculus
tctctctcaggatgctgcctgcagt

SEQ ID NO: 70664 - DNA, 25 bp, mus musculus
ggatgctgcctgcagtcagagaaac

SEQ ID NO: 70665 - DNA, 25 bp, mus musculus
tgctgcctgcagtcagagaaacatg

SEQ ID NO: 70666 - DNA, 25 bp, mus musculus
ccgtgtcgtgccaatgacctctaga

SEQ ID NO: 70667 - DNA, 25 bp, mus musculus
tgtcgtgccaatgacctctagatta

SEQ ID NO: 70668 - DNA, 25 bp, mus musculus
cgtgccaatgacctctagattagga

SEQ ID NO: 70669 - DNA, 25 bp, mus musculus
gccaatgacctctagattaggatta

SEQ ID NO: 70670 - DNA, 25 bp, mus musculus
aatgacctctagattaggattaatt

SEQ ID NO: 70671 - DNA, 25 bp, mus musculus
tactatgaccttgaaggatcttctt

SEQ ID NO: 70672 - DNA, 25 bp, mus musculus
ggacctccgtcaagaccagcgcatt

SEQ ID NO: 70673 - DNA, 25 bp, mus musculus
cctccgtcaagaccagcgcattgag

SEQ ID NO: 70674 - DNA, 25 bp, mus musculus
ccgtcaagaccagcgcattgagcag

SEQ ID NO: 70675 - DNA, 25 bp, mus musculus
tcaagaccagcgcattgagcagatc

SEQ ID NO: 70676 - DNA, 25 bp, mus musculus
agaccagcgcattgagcagatcttt

SEQ ID NO: 70677 - DNA, 25 bp, mus musculus
catgaatgccattctctctcaggat

SEQ ID NO: 70678 - DNA, 25 bp, mus musculus
gaatgccattctctctcaggatgct

SEQ ID NO: 70679 - DNA, 25 bp, mus musculus
tgccattctctctcaggatgctgcc

SEQ ID NO: 70680 - DNA, 25 bp, mus musculus
acaagccgagaccgggccatgcgcg

SEQ ID NO: 70681 - DNA, 25 bp, mus musculus
caagccgagaccgggccatgcgcgc

SEQ ID NO: 70682 - DNA, 25 bp, mus musculus
ccattcttttacggcggatgtggcg

SEQ ID NO: 70683 - DNA, 25 bp, mus musculus
caactttgacacggaagagtactgc

SEQ ID NO: 70684 - DNA, 25 bp, mus musculus
aactttgacacggaagagtactgca

SEQ ID NO: 70685 - DNA, 25 bp, mus musculus
tggcagcgtgtcaacccaaagttta

SEQ ID NO: 70686 - DNA, 25 bp, mus musculus
tttactcaagactaccagtgaacct

SEQ ID NO: 70687 - DNA, 25 bp, mus musculus
ttactcaagactaccagtgaacctc

SEQ ID NO: 70688 - DNA, 25 bp, mus musculus
actcaagactaccagtgaacctctt

SEQ ID NO: 70689 - DNA, 25 bp, mus musculus
ctcaagactaccagtgaacctcttc

SEQ ID NO: 70690 - DNA, 25 bp, mus musculus
taccagtgaacctcttccccaagat

SEQ ID NO: 70691 - DNA, 25 bp, mus musculus
tcttccccaagatcctgataaactt

SEQ ID NO: 70692 - DNA, 25 bp, mus musculus
ccatgcgcgcaatgatctcccgctg

SEQ ID NO: 70693 - DNA, 25 bp, mus musculus
atctcccgctggtacttttgatgtc

SEQ ID NO: 70694 - DNA, 25 bp, mus musculus
tcccgctggtacttttgatgtcact

SEQ ID NO: 70695 - DNA, 25 bp, mus musculus
cccgctggtacttttgatgtcactg

SEQ ID NO: 70696 - DNA, 25 bp, mus musculus
tacttttgatgtcactgaagggaag

SEQ ID NO: 70697 - DNA, 25 bp, mus musculus
ttttgatgtcactgaagggaagtgt

SEQ ID NO: 70698 - DNA, 25 bp, mus musculus
tgtcccattcttttacggcggatgt

SEQ ID NO: 70699 - DNA, 25 bp, mus musculus
gtcccattcttttacggcggatgtg

SEQ ID NO: 70700 - DNA, 25 bp, mus musculus
accagaacctcaaggagaactgcgc

SEQ ID NO: 70701 - DNA, 25 bp, mus musculus
aggagaactgcgctccaatctgcaa

SEQ ID NO: 70702 - DNA, 25 bp, mus musculus
ccgggcctgatgcctacgaagaagt

SEQ ID NO: 70703 - DNA, 25 bp, mus musculus
ctgatgcctacgaagaagtaacaga

SEQ ID NO: 70704 - DNA, 25 bp, mus musculus
gcttcaacttgcgcatcggaaggcc

SEQ ID NO: 70705 - DNA, 25 bp, mus musculus
acttgcgcatcggaaggcccaaagg

SEQ ID NO: 70706 - DNA, 25 bp, mus musculus
aacgagtgctgtgccagttatagcc

SEQ ID NO: 70707 - DNA, 25 bp, mus musculus
tgctgtgccagttatagcctgcact

SEQ ID NO: 70708 - DNA, 25 bp, mus musculus
gccagttatagcctgcactcggtgg

SEQ ID NO: 70709 - DNA, 25 bp, mus musculus
ggactcctggaaccaccatattacg

SEQ ID NO: 70710 - DNA, 25 bp, mus musculus
ccaccatattacgctgtgcagtgtg

SEQ ID NO: 70711 - DNA, 25 bp, mus musculus
tattacgctgtgcagtgtgttatgt

SEQ ID NO: 70712 - DNA, 25 bp, mus musculus
ctccaatctgcaaggaagccttctc

SEQ ID NO: 70713 - DNA, 25 bp, mus musculus
gggttctcaggagcatctcggtgcc

SEQ ID NO: 70714 - DNA, 25 bp, mus musculus
tcaggagcatctcggtgcctgcgcc

SEQ ID NO: 70715 - DNA, 25 bp, mus musculus
ctgacacttacgctgtggtgcagaa

SEQ ID NO: 70716 - DNA, 25 bp, mus musculus
cttacgctgtggtgcagaagcgtgg

SEQ ID NO: 70717 - DNA, 25 bp, mus musculus
cacgtgcccagcgaccggtggcaca

SEQ ID NO: 70718 - DNA, 25 bp, mus musculus
cccagcgaccggtggcacacacgga

SEQ ID NO: 70719 - DNA, 25 bp, mus musculus
aggacgcacaggggacaacggcact

SEQ ID NO: 70720 - DNA, 25 bp, mus musculus
agaccacacagccagacacagccaa

SEQ ID NO: 70721 - DNA, 25 bp, mus musculus
cacagccagacacagccaatgaagt

SEQ ID NO: 70722 - DNA, 25 bp, mus musculus
tggtcacgttgctcatctaccgcat

SEQ ID NO: 70723 - DNA, 25 bp, mus musculus
cgttgctcatctaccgcatgaagaa

SEQ ID NO: 70724 - DNA, 25 bp, mus musculus
tcatctaccgcatgaagaagaagga

SEQ ID NO: 70725 - DNA, 25 bp, mus musculus
acgaaggcagctacaccttggaaga

SEQ ID NO: 70726 - DNA, 25 bp, mus musculus
gcagctacaccttggaagagcccaa

SEQ ID NO: 70727 - DNA, 25 bp, mus musculus
agcccaagcaggcaagcgtcacata

SEQ ID NO: 70728 - DNA, 25 bp, mus musculus
caagcgtcacataccagaagcccga

SEQ ID NO: 70729 - DNA, 25 bp, mus musculus
accagaagcccgacaagcaggagga

SEQ ID NO: 70730 - DNA, 25 bp, mus musculus
gagagccacagtgcctcctgcagcc

SEQ ID NO: 70731 - DNA, 25 bp, mus musculus
ggcccaatcctgggcctgggcctgg

SEQ ID NO: 70732 - DNA, 25 bp, mus musculus
cagacacagccaatgaagtggtggc

SEQ ID NO: 70733 - DNA, 25 bp, mus musculus
gccttggcctccacgacaatgccat

SEQ ID NO: 70734 - DNA, 25 bp, mus musculus
acgacaatgccatcgactcgggcag

SEQ ID NO: 70735 - DNA, 25 bp, mus musculus
atgccatcgactcgggcagctctgc

SEQ ID NO: 70736 - DNA, 25 bp, mus musculus
tcgactcgggcagctctgctgccca

SEQ ID NO: 70737 - DNA, 25 bp, mus musculus
ctgcccagctccttcagaagagcat

SEQ ID NO: 70738 - DNA, 25 bp, mus musculus
agctccttcagaagagcatactaga

SEQ ID NO: 70739 - DNA, 25 bp, mus musculus
ccttcctggtcacgttgctcatcta

SEQ ID NO: 70740 - DNA, 25 bp, mus musculus
gtatacaatgatgcccatatcctgg

SEQ ID NO: 70741 - DNA, 25 bp, mus musculus
atacaatgatgcccatatcctggag

SEQ ID NO: 70742 - DNA, 25 bp, mus musculus
catggcttctcccaaacttaaattg

SEQ ID NO: 70743 - DNA, 25 bp, mus musculus
ttctcctaagaaatcaaagtacatg

SEQ ID NO: 70744 - DNA, 25 bp, mus musculus
aagtacatgactccaatgcagcaga

SEQ ID NO: 70745 - DNA, 25 bp, mus musculus
gtacatgactccaatgcagcagaga

SEQ ID NO: 70746 - DNA, 25 bp, mus musculus
acatgactccaatgcagcagagact

SEQ ID NO: 70747 - DNA, 25 bp, mus musculus
atgactccaatgcagcagagactga

SEQ ID NO: 70748 - DNA, 25 bp, mus musculus
ctccaatgcagcagagactgaatga

SEQ ID NO: 70749 - DNA, 25 bp, mus musculus
ggtcgccgccttagtgctatatttc

SEQ ID NO: 70750 - DNA, 25 bp, mus musculus
ccttagtgctatatttctgagactc

SEQ ID NO: 70751 - DNA, 25 bp, mus musculus
cccctctagatcagagctgcctgac

SEQ ID NO: 70752 - DNA, 25 bp, mus musculus
acaatgatgcccatatcctggagaa

SEQ ID NO: 70753 - DNA, 25 bp, mus musculus
tctagatcagagctgcctgactact

SEQ ID NO: 70754 - DNA, 25 bp, mus musculus
tgatgcccatatcctggagaagtta

SEQ ID NO: 70755 - DNA, 25 bp, mus musculus
atgcccatatcctggagaagttact

SEQ ID NO: 70756 - DNA, 25 bp, mus musculus
gcccatatcctggagaagttactca

SEQ ID NO: 70757 - DNA, 25 bp, mus musculus
gccctctgcctgatgatgatgacat

SEQ ID NO: 70758 - DNA, 25 bp, mus musculus
cctctgcctgatgatgatgacatgg

SEQ ID NO: 70759 - DNA, 25 bp, mus musculus
tgatgacatggcttctcccaaactt

SEQ ID NO: 70760 - DNA, 25 bp, mus musculus
gacatggcttctcccaaacttaaat

SEQ ID NO: 70761 - DNA, 25 bp, mus musculus
acgcttaccctcaagagcatttgta

SEQ ID NO: 70762 - DNA, 25 bp, mus musculus
cttaccctcaagagcatttgtatgt

SEQ ID NO: 70763 - DNA, 25 bp, mus musculus
agtgccaggccttgcatccagaccc

SEQ ID NO: 70764 - DNA, 25 bp, mus musculus
gccaggccttgcatccagaccctga

SEQ ID NO: 70765 - DNA, 25 bp, mus musculus
aggccttgcatccagaccctgagga

SEQ ID NO: 70766 - DNA, 25 bp, mus musculus
ccttgcatccagaccctgaggatga

SEQ ID NO: 70767 - DNA, 25 bp, mus musculus
atgaagactcggacgactatgatgg

SEQ ID NO: 70768 - DNA, 25 bp, mus musculus
aagactcggacgactatgatggaga

SEQ ID NO: 70769 - DNA, 25 bp, mus musculus
actcggacgactatgatggagagga

SEQ ID NO: 70770 - DNA, 25 bp, mus musculus
acatccctacattttatacctatga

SEQ ID NO: 70771 - DNA, 25 bp, mus musculus
tccctacattttatacctatgaaga

SEQ ID NO: 70772 - DNA, 25 bp, mus musculus
cattttatacctatgaagaaggact

SEQ ID NO: 70773 - DNA, 25 bp, mus musculus
accctcaagagcatttgtatgttat

SEQ ID NO: 70774 - DNA, 25 bp, mus musculus
tgaatgccaagcttggagaagaatc

SEQ ID NO: 70775 - DNA, 25 bp, mus musculus
ctccctctgatgaagatgaggaaga

SEQ ID NO: 70776 - DNA, 25 bp, mus musculus
ccatttctgaatttcgatttgtgcc

SEQ ID NO: 70777 - DNA, 25 bp, mus musculus
ttgtgcccagtgataagtcagcatt

SEQ ID NO: 70778 - DNA, 25 bp, mus musculus
ataagtcagcattggaggcgatgtt

SEQ ID NO: 70779 - DNA, 25 bp, mus musculus
agtcagcattggaggcgatgttcac

SEQ ID NO: 70780 - DNA, 25 bp, mus musculus
cgatgttcacagcaatgtgtgagtg

SEQ ID NO: 70781 - DNA, 25 bp, mus musculus
tttcctgcagggagacaaagaagct

SEQ ID NO: 70782 - DNA, 25 bp, mus musculus
ttctccactttgtgatcggaagtca

SEQ ID NO: 70783 - DNA, 25 bp, mus musculus
tgctgactctctgaggcggtcaaat

SEQ ID NO: 70784 - DNA, 25 bp, mus musculus
tacaaaaggctccgtgtgtgatggg

SEQ ID NO: 70785 - DNA, 25 bp, mus musculus
gagctatgccccagactactcgctc

SEQ ID NO: 70786 - DNA, 25 bp, mus musculus
agactactcgctctcagctgtggat

SEQ ID NO: 70787 - DNA, 25 bp, mus musculus
ctcagctgtggatctgaagagtttc

SEQ ID NO: 70788 - DNA, 25 bp, mus musculus
catcattcagcagaacaaagagagg

SEQ ID NO: 70789 - DNA, 25 bp, mus musculus
agagttggctgcccaaggtgaactt

SEQ ID NO: 70790 - DNA, 25 bp, mus musculus
aaagcatgctgacacacgtccatag

SEQ ID NO: 70791 - DNA, 25 bp, mus musculus
cacacgtccataggtgtgaacaaac

SEQ ID NO: 70792 - DNA, 25 bp, mus musculus
tgaaaaacacacaaagaccttgatt

SEQ ID NO: 70793 - DNA, 25 bp, mus musculus
tttcatagtggagccaacgttttct

SEQ ID NO: 70794 - DNA, 25 bp, mus musculus
gttttctctcctgacggactcaaca

SEQ ID NO: 70795 - DNA, 25 bp, mus musculus
aattgtcattcctcttatagaggaa

SEQ ID NO: 70796 - DNA, 25 bp, mus musculus
agcttcaaagtcacagtcttcaaac

SEQ ID NO: 70797 - DNA, 25 bp, mus musculus
ttcaaactacggggcaagcagctcg

SEQ ID NO: 70798 - DNA, 25 bp, mus musculus
ggcaagcagctcgtccaccatgatt

SEQ ID NO: 70799 - DNA, 25 bp, mus musculus
cagctcgtccaccatgattgggttc

SEQ ID NO: 70800 - DNA, 25 bp, mus musculus
tgggttccatgttgctgactctctg

SEQ ID NO: 70801 - DNA, 25 bp, mus musculus
agtttgctttctaccatcagggcta

SEQ ID NO: 70802 - DNA, 25 bp, mus musculus
tctaccatcagggctacgcagccgg

SEQ ID NO: 70803 - DNA, 25 bp, mus musculus
gccaaatgtactgccccaaagagca

SEQ ID NO: 70804 - DNA, 25 bp, mus musculus
actgccccaaagagcagacgcagcc

SEQ ID NO: 70805 - DNA, 25 bp, mus musculus
acctctggaagtccactctgcccga

SEQ ID NO: 70806 - DNA, 25 bp, mus musculus
agaagcgcgtgccttacactaaggt

SEQ ID NO: 70807 - DNA, 25 bp, mus musculus
gcgtgccttacactaaggtgcagtt

SEQ ID NO: 70808 - DNA, 25 bp, mus musculus
tgccttacactaaggtgcagttgaa

SEQ ID NO: 70809 - DNA, 25 bp, mus musculus
tcattaccaaggacaaacggaggag

SEQ ID NO: 70810 - DNA, 25 bp, mus musculus
ggatatcagccacgacaaacctctc

SEQ ID NO: 70811 - DNA, 25 bp, mus musculus
tcatcaataaactcaagaccactag

SEQ ID NO: 70812 - DNA, 25 bp, mus musculus
tcaagaccactagttaatggattaa

SEQ ID NO: 70813 - DNA, 25 bp, mus musculus
agcccgtgcccggctacctggatat

SEQ ID NO: 70814 - DNA, 25 bp, mus musculus
ccggctacctggatatgccagtagt

SEQ ID NO: 70815 - DNA, 25 bp, mus musculus
atatgccagtagttccggggctcgg

SEQ ID NO: 70816 - DNA, 25 bp, mus musculus
ggcttcccatggaaagctatcagcc

SEQ ID NO: 70817 - DNA, 25 bp, mus musculus
ttcccatggaaagctatcagccctg

SEQ ID NO: 70818 - DNA, 25 bp, mus musculus
gctatcagccctgggctctgcccaa

SEQ ID NO: 70819 - DNA, 25 bp, mus musculus
atcagccctgggctctgcccaacgg

SEQ ID NO: 70820 - DNA, 25 bp, mus musculus
ctctgcccaacggctggaacggcca

SEQ ID NO: 70821 - DNA, 25 bp, mus musculus
tattctcaggtctgaatcctcatca

SEQ ID NO: 70822 - DNA, 25 bp, mus musculus
caggtctgaatcctcatcatcttcc

SEQ ID NO: 70823 - DNA, 25 bp, mus musculus
cagtctgtctgagcatgctaccaag

SEQ ID NO: 70824 - DNA, 25 bp, mus musculus
gtctgagcatgctaccaagccccca

SEQ ID NO: 70825 - DNA, 25 bp, mus musculus
ccacatgatgacccttaggtctacc

SEQ ID NO: 70826 - DNA, 25 bp, mus musculus
cctcctctctaaatggacatcctcg

SEQ ID NO: 70827 - DNA, 25 bp, mus musculus
ctctaaatggacatcctcgtttgtc

SEQ ID NO: 70828 - DNA, 25 bp, mus musculus
atggacatcctcgtttgtcccaagt

SEQ ID NO: 70829 - DNA, 25 bp, mus musculus
atcctcgtttgtcccaagtctccag

SEQ ID NO: 70830 - DNA, 25 bp, mus musculus
gtttgtcccaagtctccagagagac

SEQ ID NO: 70831 - DNA, 25 bp, mus musculus
cccaagtctccagagagactactga

SEQ ID NO: 70832 - DNA, 25 bp, mus musculus
ctactgatggctgatgtgggtaaga

SEQ ID NO: 70833 - DNA, 25 bp, mus musculus
tgaatcctcatcatcttcctgattc

SEQ ID NO: 70834 - DNA, 25 bp, mus musculus
cctgcaaaggcctggaactggctgt

SEQ ID NO: 70835 - DNA, 25 bp, mus musculus
tctgacgcatgctggaaggacaaaa

SEQ ID NO: 70836 - DNA, 25 bp, mus musculus
cagagatccgacttcaaaaggcagg

SEQ ID NO: 70837 - DNA, 25 bp, mus musculus
tccgacttcaaaaggcagggtctga

SEQ ID NO: 70838 - DNA, 25 bp, mus musculus
tggcccaggagtcaggcatttcagg

SEQ ID NO: 70839 - DNA, 25 bp, mus musculus
tccaagcttctacagtctgtctgag

SEQ ID NO: 70840 - DNA, 25 bp, mus musculus
cttctacagtctgtctgagcatgct

SEQ ID NO: 70841 - DNA, 25 bp, mus musculus
ccatccactacaagtccatgtctcg

SEQ ID NO: 70842 - DNA, 25 bp, mus musculus
catccactacaagtccatgtctcgc

SEQ ID NO: 70843 - DNA, 25 bp, mus musculus
catgtctcgctagctcttgcatggg

SEQ ID NO: 70844 - DNA, 25 bp, mus musculus
atgtctcgctagctcttgcatgggg

SEQ ID NO: 70845 - DNA, 25 bp, mus musculus
ctattctcatctaccacctaatact

SEQ ID NO: 70846 - DNA, 25 bp, mus musculus
tattctcatctaccacctaatactt

SEQ ID NO: 70847 - DNA, 25 bp, mus musculus
attctcatctaccacctaatacttc

SEQ ID NO: 70848 - DNA, 25 bp, mus musculus
ttctcatctaccacctaatacttct

SEQ ID NO: 70849 - DNA, 25 bp, mus musculus
tctcatctaccacctaatacttctc

SEQ ID NO: 70850 - DNA, 25 bp, mus musculus
atctaccacctaatacttctcccat

SEQ ID NO: 70851 - DNA, 25 bp, mus musculus
accattatacaacctccctactcat

SEQ ID NO: 70852 - DNA, 25 bp, mus musculus
cattatacaacctccctactcatca

SEQ ID NO: 70853 - DNA, 25 bp, mus musculus
atccactacaagtccatgtctcgct

SEQ ID NO: 70854 - DNA, 25 bp, mus musculus
tccactacaagtccatgtctcgcta

SEQ ID NO: 70855 - DNA, 25 bp, mus musculus
ccactacaagtccatgtctcgctag

SEQ ID NO: 70856 - DNA, 25 bp, mus musculus
cactacaagtccatgtctcgctagc

SEQ ID NO: 70857 - DNA, 25 bp, mus musculus
actacaagtccatgtctcgctagct

SEQ ID NO: 70858 - DNA, 25 bp, mus musculus
ctacaagtccatgtctcgctagctc

SEQ ID NO: 70859 - DNA, 25 bp, mus musculus
tccatgtctcgctagctcttgcatg

SEQ ID NO: 70860 - DNA, 25 bp, mus musculus
ccatgtctcgctagctcttgcatgg

SEQ ID NO: 70861 - DNA, 25 bp, mus musculus
tctttctgaaatgccaagtagcaag

SEQ ID NO: 70862 - DNA, 25 bp, mus musculus
tctttctgatcctgtctagcaggca

SEQ ID NO: 70863 - DNA, 25 bp, mus musculus
tcacacaacctttttccttatgtct

SEQ ID NO: 70864 - DNA, 25 bp, mus musculus
tttccttatgtctgtgcctttggaa

SEQ ID NO: 70865 - DNA, 25 bp, mus musculus
acagatatcttccaccttttgctaa

SEQ ID NO: 70866 - DNA, 25 bp, mus musculus
atcttccaccttttgctaatgtcct

SEQ ID NO: 70867 - DNA, 25 bp, mus musculus
caccttttgctaatgtcctggacaa

SEQ ID NO: 70868 - DNA, 25 bp, mus musculus
tttaatgtcaccagaaatgcttatt

SEQ ID NO: 70869 - DNA, 25 bp, mus musculus
gcttattaccatacaatttcagagc

SEQ ID NO: 70870 - DNA, 25 bp, mus musculus
taccatacaatttcagagcaaaaca

SEQ ID NO: 70871 - DNA, 25 bp, mus musculus
aagaggtcacacattactggaaaga

SEQ ID NO: 70872 - DNA, 25 bp, mus musculus
tacataaataacttctttcaatatt

SEQ ID NO: 70873 - DNA, 25 bp, mus musculus
aattccatcccaaggatacatactc

SEQ ID NO: 70874 - DNA, 25 bp, mus musculus
atcccaaggatacatactcacttaa

SEQ ID NO: 70875 - DNA, 25 bp, mus musculus
aggatacatactcacttaaagatca

SEQ ID NO: 70876 - DNA, 25 bp, mus musculus
catactcacttaaagatcacaactg

SEQ ID NO: 70877 - DNA, 25 bp, mus musculus
cacttaaagatcacaactgattcct

SEQ ID NO: 70878 - DNA, 25 bp, mus musculus
aagatcacaactgattcctgctgtt

SEQ ID NO: 70879 - DNA, 25 bp, mus musculus
acaactgattcctgctgttctggac

SEQ ID NO: 70880 - DNA, 25 bp, mus musculus
ctcctgtgagctgtagaatcacaca

SEQ ID NO: 70881 - DNA, 25 bp, mus musculus
aatcgtatgcagagtctgtgggagc

SEQ ID NO: 70882 - DNA, 25 bp, mus musculus
tcgtatgcagagtctgtgggagcca

SEQ ID NO: 70883 - DNA, 25 bp, mus musculus
tgatagagacagcccaggtggatga

SEQ ID NO: 70884 - DNA, 25 bp, mus musculus
atagagacagcccaggtggatgaga

SEQ ID NO: 70885 - DNA, 25 bp, mus musculus
agacagcccaggtggatgagagagc

SEQ ID NO: 70886 - DNA, 25 bp, mus musculus
acagcccaggtggatgagagagcaa

SEQ ID NO: 70887 - DNA, 25 bp, mus musculus
ctgcaaggcgaggtgtgcagatcat

SEQ ID NO: 70888 - DNA, 25 bp, mus musculus
gtgcagatcatcgacgacgagcctc

SEQ ID NO: 70889 - DNA, 25 bp, mus musculus
gcagatcatcgacgacgagcctcaa

SEQ ID NO: 70890 - DNA, 25 bp, mus musculus
agatcatcgacgacgagcctcaagc

SEQ ID NO: 70891 - DNA, 25 bp, mus musculus
gacgacgagcctcaagctcagagca

SEQ ID NO: 70892 - DNA, 25 bp, mus musculus
gctgttcctccggctaactgctcag

SEQ ID NO: 70893 - DNA, 25 bp, mus musculus
gtatgcagagtctgtgggagccaag

SEQ ID NO: 70894 - DNA, 25 bp, mus musculus
ttcctccggctaactgctcagcctg

SEQ ID NO: 70895 - DNA, 25 bp, mus musculus
ggagccaagcattaccatacttccg

SEQ ID NO: 70896 - DNA, 25 bp, mus musculus
agccaagcattaccatacttccgct

SEQ ID NO: 70897 - DNA, 25 bp, mus musculus
ccaagcattaccatacttccgctaa

SEQ ID NO: 70898 - DNA, 25 bp, mus musculus
gcattaccatacttccgctaaacag

SEQ ID NO: 70899 - DNA, 25 bp, mus musculus
taccatacttccgctaaacagaaca

SEQ ID NO: 70900 - DNA, 25 bp, mus musculus
ttccgctaaacagaacaaaggcatt

SEQ ID NO: 70901 - DNA, 25 bp, mus musculus
tctcgacctttgtaaaagaatgata

SEQ ID NO: 70902 - DNA, 25 bp, mus musculus
tctaccagctacattgggagtatgc

SEQ ID NO: 70903 - DNA, 25 bp, mus musculus
accagctacattgggagtatgccaa

SEQ ID NO: 70904 - DNA, 25 bp, mus musculus
ttgccatggaggaccggcagtacat

SEQ ID NO: 70905 - DNA, 25 bp, mus musculus
ggcagtacatgttcatcgtgcacac

SEQ ID NO: 70906 - DNA, 25 bp, mus musculus
tcgtgcacaccatcgaggagatcga

SEQ ID NO: 70907 - DNA, 25 bp, mus musculus
tgcacaccatcgaggagatcgaggg

SEQ ID NO: 70908 - DNA, 25 bp, mus musculus
gcacaccatcgaggagatcgagggc

SEQ ID NO: 70909 - DNA, 25 bp, mus musculus
agatcgagggcctgatctcagccca

SEQ ID NO: 70910 - DNA, 25 bp, mus musculus
agggcctgatctcagcccatgacca

SEQ ID NO: 70911 - DNA, 25 bp, mus musculus
gggcctgatctcagcccatgaccag

SEQ ID NO: 70912 - DNA, 25 bp, mus musculus
gcctgatctcagcccatgaccaggt

SEQ ID NO: 70913 - DNA, 25 bp, mus musculus
cctgatctcagcccatgaccaggtc

SEQ ID NO: 70914 - DNA, 25 bp, mus musculus
ccagctacattgggagtatgccaag

SEQ ID NO: 70915 - DNA, 25 bp, mus musculus
tgaggccatcctggccgatccacaa

SEQ ID NO: 70916 - DNA, 25 bp, mus musculus
agtatgccaagcgggctgcaccctg

SEQ ID NO: 70917 - DNA, 25 bp, mus musculus
gtatgccaagcgggctgcaccctgc

SEQ ID NO: 70918 - DNA, 25 bp, mus musculus
tgccaagcgggctgcaccctgcaac

SEQ ID NO: 70919 - DNA, 25 bp, mus musculus
accctgcaacaactggatggagatt

SEQ ID NO: 70920 - DNA, 25 bp, mus musculus
cctgcaacaactggatggagattgc

SEQ ID NO: 70921 - DNA, 25 bp, mus musculus
agattgccatggaggaccggcagta

SEQ ID NO: 70922 - DNA, 25 bp, mus musculus
gattgccatggaggaccggcagtac

SEQ ID NO: 70923 - DNA, 25 bp, mus musculus
ttttattccatgtgaaatgtgtcac

SEQ ID NO: 70924 - DNA, 25 bp, mus musculus
tgataattgccatttcctaggtaga

SEQ ID NO: 70925 - DNA, 25 bp, mus musculus
aacagctgtatcagtgcttcataat

SEQ ID NO: 70926 - DNA, 25 bp, mus musculus
agctgtatcagtgcttcataatatt

SEQ ID NO: 70927 - DNA, 25 bp, mus musculus
aatattctctatgcattaagtccat

SEQ ID NO: 70928 - DNA, 25 bp, mus musculus
tatgcattaagtccatcgatattca

SEQ ID NO: 70929 - DNA, 25 bp, mus musculus
ttaagtccatcgatattcaccattt

SEQ ID NO: 70930 - DNA, 25 bp, mus musculus
ccatcgatattcaccatttgaattt

SEQ ID NO: 70931 - DNA, 25 bp, mus musculus
tcgatattcaccatttgaatttctg

SEQ ID NO: 70932 - DNA, 25 bp, mus musculus
atattcaccatttgaatttctggaa

SEQ ID NO: 70933 - DNA, 25 bp, mus musculus
taacattaagctatgctctggttcc

SEQ ID NO: 70934 - DNA, 25 bp, mus musculus
atttttagactcaagtactgataat

SEQ ID NO: 70935 - DNA, 25 bp, mus musculus
ttgccatttcctaggtagatctgga

SEQ ID NO: 70936 - DNA, 25 bp, mus musculus
agtcaagtggcccagtatgagacgg

SEQ ID NO: 70937 - DNA, 25 bp, mus musculus
acggtcagccacactctgggataaa

SEQ ID NO: 70938 - DNA, 25 bp, mus musculus
aatgtttctctactgggttcagctt

SEQ ID NO: 70939 - DNA, 25 bp, mus musculus
ctgggttcagcttgtctctatgtat

SEQ ID NO: 70940 - DNA, 25 bp, mus musculus
tcagcttgtctctatgtatatatga

SEQ ID NO: 70941 - DNA, 25 bp, mus musculus
aattaaaacatccatgattcataga

SEQ ID NO: 70942 - DNA, 25 bp, mus musculus
cattctaacagctgtatcagtgctt

SEQ ID NO: 70943 - DNA, 25 bp, mus musculus
ggtgatctcctagatcagatcttca

SEQ ID NO: 70944 - DNA, 25 bp, mus musculus
gatcagatcttcattcaccgtgaca

SEQ ID NO: 70945 - DNA, 25 bp, mus musculus
catcctccatggttccactgtactt

SEQ ID NO: 70946 - DNA, 25 bp, mus musculus
ttccactgtacttctgcctaccttg

SEQ ID NO: 70947 - DNA, 25 bp, mus musculus
taccttgtgcggaaggagcatacat

SEQ ID NO: 70948 - DNA, 25 bp, mus musculus
ctcagttccttgcttccaggatgaa

SEQ ID NO: 70949 - DNA, 25 bp, mus musculus
tccttgcttccaggatgaatgagtc

SEQ ID NO: 70950 - DNA, 25 bp, mus musculus
ttttctaatgagtgcagatgaccta

SEQ ID NO: 70951 - DNA, 25 bp, mus musculus
accaagtctaggtatcagcgtatgc

SEQ ID NO: 70952 - DNA, 25 bp, mus musculus
tatcagcgtatgcagactttctgag

SEQ ID NO: 70953 - DNA, 25 bp, mus musculus
cgtatgcagactttctgaggcttct

SEQ ID NO: 70954 - DNA, 25 bp, mus musculus
ttctgaggcttctgagggcccaagc

SEQ ID NO: 70955 - DNA, 25 bp, mus musculus
atcttcattcaccgtgacaccatcc

SEQ ID NO: 70956 - DNA, 25 bp, mus musculus
gagaagctcttctaggctgaacaga

SEQ ID NO: 70957 - DNA, 25 bp, mus musculus
aagctgatgatccccagctgtattt

SEQ ID NO: 70958 - DNA, 25 bp, mus musculus
tgtatttggctgtccagttgaccca

SEQ ID NO: 70959 - DNA, 25 bp, mus musculus
tggctgtccagttgacccaaattgt

SEQ ID NO: 70960 - DNA, 25 bp, mus musculus
tccagttgacccaaattgttggctc

SEQ ID NO: 70961 - DNA, 25 bp, mus musculus
tgacccaaattgttggctcctcgtc

SEQ ID NO: 70962 - DNA, 25 bp, mus musculus
cacttacatcctccatggttccact

SEQ ID NO: 70963 - DNA, 25 bp, mus musculus
gagcctctttcctctggtgcctcat

SEQ ID NO: 70964 - DNA, 25 bp, mus musculus
ctttcctctggtgcctcatagaaga

SEQ ID NO: 70965 - DNA, 25 bp, mus musculus
gcacttagatggccccagaaatgag

SEQ ID NO: 70966 - DNA, 25 bp, mus musculus
agatggccccagaaatgagtctggc

SEQ ID NO: 70967 - DNA, 25 bp, mus musculus
gtctggccagacaattacctttcag

SEQ ID NO: 70968 - DNA, 25 bp, mus musculus
ccagacaattacctttcagacagat

SEQ ID NO: 70969 - DNA, 25 bp, mus musculus
ctttcagacagatgacatttgttag

SEQ ID NO: 70970 - DNA, 25 bp, mus musculus
ttcctcaggcagagggtgtagctca

SEQ ID NO: 70971 - DNA, 25 bp, mus musculus
tgcccaagctcagacaggagaaagt

SEQ ID NO: 70972 - DNA, 25 bp, mus musculus
tagcctttccagcccatgactggtg

SEQ ID NO: 70973 - DNA, 25 bp, mus musculus
ttccagcccatgactggtgagtatg

SEQ ID NO: 70974 - DNA, 25 bp, mus musculus
gatatcactcacacacacacataca

SEQ ID NO: 70975 - DNA, 25 bp, mus musculus
aagacatggcctctttgtgccactc

SEQ ID NO: 70976 - DNA, 25 bp, mus musculus
ctttgtgccactcctatccactgtc

SEQ ID NO: 70977 - DNA, 25 bp, mus musculus
cctatccactgtctcaatacctaca

SEQ ID NO: 70978 - DNA, 25 bp, mus musculus
cactgtctcaatacctacagtttct

SEQ ID NO: 70979 - DNA, 25 bp, mus musculus
acctacagtttctctgctaatccct

SEQ ID NO: 70980 - DNA, 25 bp, mus musculus
agtttctctgctaatccctttcatg

SEQ ID NO: 70981 - DNA, 25 bp, mus musculus
tctgctaatccctttcatggaaccc

SEQ ID NO: 70982 - DNA, 25 bp, mus musculus
ggaacccattgtgtgctgataacag

SEQ ID NO: 70983 - DNA, 25 bp, mus musculus
agtttacgggaggcattgtgtggct

SEQ ID NO: 70984 - DNA, 25 bp, mus musculus
tgtggctgctcacttaatgtgccaa

SEQ ID NO: 70985 - DNA, 25 bp, mus musculus
tccttcccagacgtcatatctgcag

SEQ ID NO: 70986 - DNA, 25 bp, mus musculus
ccagacgtcatatctgcagcatcca

SEQ ID NO: 70987 - DNA, 25 bp, mus musculus
gacgtcatatctgcagcatccaaag

SEQ ID NO: 70988 - DNA, 25 bp, mus musculus
gtcatatctgcagcatccaaagaga

SEQ ID NO: 70989 - DNA, 25 bp, mus musculus
atatctgcagcatccaaagagatcc

SEQ ID NO: 70990 - DNA, 25 bp, mus musculus
tctgcagcatccaaagagatcctga

SEQ ID NO: 70991 - DNA, 25 bp, mus musculus
gcatccaaagagatcctgaggaagc

SEQ ID NO: 70992 - DNA, 25 bp, mus musculus
ctccctgcctcctaggatgagaaga

SEQ ID NO: 70993 - DNA, 25 bp, mus musculus
cctgcctcctaggatgagaagaacc

SEQ ID NO: 70994 - DNA, 25 bp, mus musculus
aaccttgctatccatagtttgataa

SEQ ID NO: 70995 - DNA, 25 bp, mus musculus
ggctgctcacttaatgtgccaacaa

SEQ ID NO: 70996 - DNA, 25 bp, mus musculus
cttgctatccatagtttgataagac

SEQ ID NO: 70997 - DNA, 25 bp, mus musculus
tgctcacttaatgtgccaacaatgg

SEQ ID NO: 70998 - DNA, 25 bp, mus musculus
aacctacctatgtcagtcactgata

SEQ ID NO: 70999 - DNA, 25 bp, mus musculus
ctacctatgtcagtcactgatattg

SEQ ID NO: 71000 - DNA, 25 bp, mus musculus
atgtcagtcactgatattgtgaaac

SEQ ID NO: 71001 - DNA, 25 bp, mus musculus
attgtgaaacctgggatgaggagaa

SEQ ID NO: 71002 - DNA, 25 bp, mus musculus
gatgtgtccttcccagacgtcatat

SEQ ID NO: 71003 - DNA, 25 bp, mus musculus
gtgtccttcccagacgtcatatctg

SEQ ID NO: 71004 - DNA, 25 bp, mus musculus
tggatcccctcaagttgcctggggt

SEQ ID NO: 71005 - DNA, 25 bp, mus musculus
gggtcttccagttcaccaagagatt

SEQ ID NO: 71006 - DNA, 25 bp, mus musculus
tctgctatctactgcccacaagtag

SEQ ID NO: 71007 - DNA, 25 bp, mus musculus
gctatctactgcccacaagtagctg

SEQ ID NO: 71008 - DNA, 25 bp, mus musculus
tgcccacaagtagctggcaactatt

SEQ ID NO: 71009 - DNA, 25 bp, mus musculus
ttattaagcacctacgatgtgccgg

SEQ ID NO: 71010 - DNA, 25 bp, mus musculus
acctacgatgtgccgggtgttgtgt

SEQ ID NO: 71011 - DNA, 25 bp, mus musculus
tacgatgtgccgggtgttgtgtaga

SEQ ID NO: 71012 - DNA, 25 bp, mus musculus
aagtaaccagtggcccatccagctg

SEQ ID NO: 71013 - DNA, 25 bp, mus musculus
ccagtggcccatccagctgatgact

SEQ ID NO: 71014 - DNA, 25 bp, mus musculus
gcccatccagctgatgactccttgc

SEQ ID NO: 71015 - DNA, 25 bp, mus musculus
catccagctgatgactccttgccct

SEQ ID NO: 71016 - DNA, 25 bp, mus musculus
tccagttcaccaagagattccctta

SEQ ID NO: 71017 - DNA, 25 bp, mus musculus
tccccacaaggacactggtgcaggg

SEQ ID NO: 71018 - DNA, 25 bp, mus musculus
tcaccaagagattcccttaaactcg

SEQ ID NO: 71019 - DNA, 25 bp, mus musculus
cccccatagagtatgcacagcaatg

SEQ ID NO: 71020 - DNA, 25 bp, mus musculus
gtttaggatgtccggttgagataga

SEQ ID NO: 71021 - DNA, 25 bp, mus musculus
ctaaactctggaaccaagaactgtg

SEQ ID NO: 71022 - DNA, 25 bp, mus musculus
ttcccaaaaggagcctctgctatct

SEQ ID NO: 71023 - DNA, 25 bp, mus musculus
ccaaaaggagcctctgctatctact

SEQ ID NO: 71024 - DNA, 25 bp, mus musculus
aaaggagcctctgctatctactgcc

SEQ ID NO: 71025 - DNA, 25 bp, mus musculus
catactcagcagcccttcttggtcc

SEQ ID NO: 71026 - DNA, 25 bp, mus musculus
cagcagcccttcttggtcctgtctg

SEQ ID NO: 71027 - DNA, 25 bp, mus musculus
aggcacaggctgcttctagaacctt

SEQ ID NO: 71028 - DNA, 25 bp, mus musculus
cacaggctgcttctagaaccttcct

SEQ ID NO: 71029 - DNA, 25 bp, mus musculus
aggctgcttctagaaccttcctggt

SEQ ID NO: 71030 - DNA, 25 bp, mus musculus
tggtcacccttacgcaggccaccag

SEQ ID NO: 71031 - DNA, 25 bp, mus musculus
cccttacgcaggccaccaggctgtg

SEQ ID NO: 71032 - DNA, 25 bp, mus musculus
ttacgcaggccaccaggctgtgtgt

SEQ ID NO: 71033 - DNA, 25 bp, mus musculus
tccacataattttggcttttgtgga

SEQ ID NO: 71034 - DNA, 25 bp, mus musculus
ttccttctgggtaaatgtgagctgg

SEQ ID NO: 71035 - DNA, 25 bp, mus musculus
aaatgtgagctgggctgttttgtta

SEQ ID NO: 71036 - DNA, 25 bp, mus musculus
tgcacacaaactcaggtaaaagtga

SEQ ID NO: 71037 - DNA, 25 bp, mus musculus
cagttgccccattaggccttcgcat

SEQ ID NO: 71038 - DNA, 25 bp, mus musculus
ttgccccattaggccttcgcatggg

SEQ ID NO: 71039 - DNA, 25 bp, mus musculus
gttggcacccatgcagactggagtg

SEQ ID NO: 71040 - DNA, 25 bp, mus musculus
gttactgtccacctggtacctcagg

SEQ ID NO: 71041 - DNA, 25 bp, mus musculus
actgtccacctggtacctcagggct

SEQ ID NO: 71042 - DNA, 25 bp, mus musculus
gtccacctggtacctcagggcttgg

SEQ ID NO: 71043 - DNA, 25 bp, mus musculus
cacctggtacctcagggcttggcgt

SEQ ID NO: 71044 - DNA, 25 bp, mus musculus
aggtgagacacccaaactcagggca

SEQ ID NO: 71045 - DNA, 25 bp, mus musculus
atggcatgcttctcaatgaccgtaa

SEQ ID NO: 71046 - DNA, 25 bp, mus musculus
tctcaatgaccgtaaagtgttcgtg

SEQ ID NO: 71047 - DNA, 25 bp, mus musculus
gtctcgcaaagagcgggaagcggac

SEQ ID NO: 71048 - DNA, 25 bp, mus musculus
gacttcggagccaaggccaaggaat

SEQ ID NO: 71049 - DNA, 25 bp, mus musculus
ttcggagccaaggccaaggaattca

SEQ ID NO: 71050 - DNA, 25 bp, mus musculus
gaaagagctcttcagccagtttggt

SEQ ID NO: 71051 - DNA, 25 bp, mus musculus
aagagctcttcagccagtttggtaa

SEQ ID NO: 71052 - DNA, 25 bp, mus musculus
agagctcttcagccagtttggtaag

SEQ ID NO: 71053 - DNA, 25 bp, mus musculus
agctcttcagccagtttggtaagac

SEQ ID NO: 71054 - DNA, 25 bp, mus musculus
gctcttcagccagtttggtaagacc

SEQ ID NO: 71055 - DNA, 25 bp, mus musculus
tcttcagccagtttggtaagaccct

SEQ ID NO: 71056 - DNA, 25 bp, mus musculus
gtaagaccctaagtgtcaaggtgat

SEQ ID NO: 71057 - DNA, 25 bp, mus musculus
gtagattcaagtctcgcaaagagcg

SEQ ID NO: 71058 - DNA, 25 bp, mus musculus
tagattcaagtctcgcaaagagcgg

SEQ ID NO: 71059 - DNA, 25 bp, mus musculus
agattcaagtctcgcaaagagcggg

SEQ ID NO: 71060 - DNA, 25 bp, mus musculus
attcaagtctcgcaaagagcgggaa

SEQ ID NO: 71061 - DNA, 25 bp, mus musculus
ttcaagtctcgcaaagagcgggaag

SEQ ID NO: 71062 - DNA, 25 bp, mus musculus
tcaagtctcgcaaagagcgggaagc

SEQ ID NO: 71063 - DNA, 25 bp, mus musculus
caagtctcgcaaagagcgggaagcg

SEQ ID NO: 71064 - DNA, 25 bp, mus musculus
agtctcgcaaagagcgggaagcgga

SEQ ID NO: 71065 - DNA, 25 bp, mus musculus
atctttatgcgctgagacaggcgta

SEQ ID NO: 71066 - DNA, 25 bp, mus musculus
tttatgcgctgagacaggcgtacag

SEQ ID NO: 71067 - DNA, 25 bp, mus musculus
tgtactggtcaggatgtgggacact

SEQ ID NO: 71068 - DNA, 25 bp, mus musculus
ggacactcttccactgtgctactca

SEQ ID NO: 71069 - DNA, 25 bp, mus musculus
cactcttccactgtgctactcataa

SEQ ID NO: 71070 - DNA, 25 bp, mus musculus
tcttccactgtgctactcataatta

SEQ ID NO: 71071 - DNA, 25 bp, mus musculus
actgtgctactcataattatctgaa

SEQ ID NO: 71072 - DNA, 25 bp, mus musculus
gtgctactcataattatctgaaatg

SEQ ID NO: 71073 - DNA, 25 bp, mus musculus
tactgtgttgcttttgatgtcatac

SEQ ID NO: 71074 - DNA, 25 bp, mus musculus
cacatgaaaccagtgtgctaaaaca

SEQ ID NO: 71075 - DNA, 25 bp, mus musculus
tgctaaaacatgctcatgtccagta

SEQ ID NO: 71076 - DNA, 25 bp, mus musculus
atgctcatgtccagtaataaagatg

SEQ ID NO: 71077 - DNA, 25 bp, mus musculus
cgctgagacaggcgtacaggttaac

SEQ ID NO: 71078 - DNA, 25 bp, mus musculus
cagtgccaatatctacggtagactg

SEQ ID NO: 71079 - DNA, 25 bp, mus musculus
caatatctacggtagactgaggcat

SEQ ID NO: 71080 - DNA, 25 bp, mus musculus
ctacggtagactgaggcatgtgtaa

SEQ ID NO: 71081 - DNA, 25 bp, mus musculus
tgtgtaacacttggctgtatttatt

SEQ ID NO: 71082 - DNA, 25 bp, mus musculus
atttgctcttgtgggcaaatatgta

SEQ ID NO: 71083 - DNA, 25 bp, mus musculus
agttgtcagtgttgtactggtcagg

SEQ ID NO: 71084 - DNA, 25 bp, mus musculus
cagtgttgtactggtcaggatgtgg

SEQ ID NO: 71085 - DNA, 25 bp, mus musculus
gtcactgcctctgccaagtccactg

SEQ ID NO: 71086 - DNA, 25 bp, mus musculus
gagactgcagcagacccaggcccag

SEQ ID NO: 71087 - DNA, 25 bp, mus musculus
catcatcatcatcgtttacttcagc

SEQ ID NO: 71088 - DNA, 25 bp, mus musculus
catcatcatcgtttacttcagcact

SEQ ID NO: 71089 - DNA, 25 bp, mus musculus
catcatcgtttacttcagcacttaa

SEQ ID NO: 71090 - DNA, 25 bp, mus musculus
catcgtttacttcagcacttaaatc

SEQ ID NO: 71091 - DNA, 25 bp, mus musculus
ttacttcagcacttaaatccctgag

SEQ ID NO: 71092 - DNA, 25 bp, mus musculus
cttcagcacttaaatccctgaggag

SEQ ID NO: 71093 - DNA, 25 bp, mus musculus
cagcacttaaatccctgaggagtct

SEQ ID NO: 71094 - DNA, 25 bp, mus musculus
cacttaaatccctgaggagtctgcc

SEQ ID NO: 71095 - DNA, 25 bp, mus musculus
ttaaatccctgaggagtctgccctg

SEQ ID NO: 71096 - DNA, 25 bp, mus musculus
aatccctgaggagtctgccctgcct

SEQ ID NO: 71097 - DNA, 25 bp, mus musculus
aagtgcagccaagctcaagcgcaaa

SEQ ID NO: 71098 - DNA, 25 bp, mus musculus
agtctgccctgcctaagaagggcct

SEQ ID NO: 71099 - DNA, 25 bp, mus musculus
tgcagccaagctcaagcgcaaatac

SEQ ID NO: 71100 - DNA, 25 bp, mus musculus
agccaagctcaagcgcaaatactgg

SEQ ID NO: 71101 - DNA, 25 bp, mus musculus
caagctcaagcgcaaatactggtgg

SEQ ID NO: 71102 - DNA, 25 bp, mus musculus
agtgatctgcgccatcatcctcatc

SEQ ID NO: 71103 - DNA, 25 bp, mus musculus
gatctgcgccatcatcctcatcatc

SEQ ID NO: 71104 - DNA, 25 bp, mus musculus
catcctcatcatcatcatcgtttac

SEQ ID NO: 71105 - DNA, 25 bp, mus musculus
cctcatcatcatcatcgtttacttc

SEQ ID NO: 71106 - DNA, 25 bp, mus musculus
taactggccatcgctggttcttcag

SEQ ID NO: 71107 - DNA, 25 bp, mus musculus
ttctgtacattccacgggaacttgc

SEQ ID NO: 71108 - DNA, 25 bp, mus musculus
ctttcctataggaaatgtgatcaga

SEQ ID NO: 71109 - DNA, 25 bp, mus musculus
gacacttgatcgttgggagtcagcc

SEQ ID NO: 71110 - DNA, 25 bp, mus musculus
ggcctggcgacttccaggatcttgg

SEQ ID NO: 71111 - DNA, 25 bp, mus musculus
tagttatgccctataggcggcatga

SEQ ID NO: 71112 - DNA, 25 bp, mus musculus
tgccctataggcggcatgagagaca

SEQ ID NO: 71113 - DNA, 25 bp, mus musculus
tcagtttacctgccaactcctaccg

SEQ ID NO: 71114 - DNA, 25 bp, mus musculus
tcaggaatccaggccagggtgattg

SEQ ID NO: 71115 - DNA, 25 bp, mus musculus
actgtatatgtctctccagggcagt

SEQ ID NO: 71116 - DNA, 25 bp, mus musculus
tatgtctctccagggcagtttctta

SEQ ID NO: 71117 - DNA, 25 bp, mus musculus
tctccagggcagtttcttaataaga

SEQ ID NO: 71118 - DNA, 25 bp, mus musculus
cctgctgactgggtttgtagcattg

SEQ ID NO: 71119 - DNA, 25 bp, mus musculus
gtttgtagcattggcctcttaagca

SEQ ID NO: 71120 - DNA, 25 bp, mus musculus
agcattggcctcttaagcaatgcca

SEQ ID NO: 71121 - DNA, 25 bp, mus musculus
agcctaatgcccatgctccatacta

SEQ ID NO: 71122 - DNA, 25 bp, mus musculus
atgcccatgctccatactactgcct

SEQ ID NO: 71123 - DNA, 25 bp, mus musculus
atgctccatactactgccttttgat

SEQ ID NO: 71124 - DNA, 25 bp, mus musculus
catactactgccttttgattcttac

SEQ ID NO: 71125 - DNA, 25 bp, mus musculus
ttttgattcttactgtggctaacct

SEQ ID NO: 71126 - DNA, 25 bp, mus musculus
tgaagaacaccgagggttgaattct

SEQ ID NO: 71127 - DNA, 25 bp, mus musculus
tgaattctctaagcagccgtaatta

SEQ ID NO: 71128 - DNA, 25 bp, mus musculus
cctcatttctgcacaggaaatctgc

SEQ ID NO: 71129 - DNA, 25 bp, mus musculus
catttctgcacaggaaatctgcaaa

SEQ ID NO: 71130 - DNA, 25 bp, mus musculus
tttctgcacaggaaatctgcaaagc

SEQ ID NO: 71131 - DNA, 25 bp, mus musculus
ttctgcacaggaaatctgcaaagcg

SEQ ID NO: 71132 - DNA, 25 bp, mus musculus
aaatctgcaaagcggtgtaaagcca

SEQ ID NO: 71133 - DNA, 25 bp, mus musculus
tgtaaagccacatagtacgaatggc

SEQ ID NO: 71134 - DNA, 25 bp, mus musculus
gtaaagccacatagtacgaatggct

SEQ ID NO: 71135 - DNA, 25 bp, mus musculus
aaagccacatagtacgaatggctgg

SEQ ID NO: 71136 - DNA, 25 bp, mus musculus
aatcgatggtcccgagaagagggag

SEQ ID NO: 71137 - DNA, 25 bp, mus musculus
atcgatggtcccgagaagagggaga

SEQ ID NO: 71138 - DNA, 25 bp, mus musculus
gaattctctaagcagccgtaattaa

SEQ ID NO: 71139 - DNA, 25 bp, mus musculus
tggaaaaacccgtggtctatgattg

SEQ ID NO: 71140 - DNA, 25 bp, mus musculus
aacccgtggtctatgattgcctcat

SEQ ID NO: 71141 - DNA, 25 bp, mus musculus
tggtctatgattgcctcatttctgc

SEQ ID NO: 71142 - DNA, 25 bp, mus musculus
ggtctatgattgcctcatttctgca

SEQ ID NO: 71143 - DNA, 25 bp, mus musculus
ctatgattgcctcatttctgcacag

SEQ ID NO: 71144 - DNA, 25 bp, mus musculus
atgattgcctcatttctgcacagga

SEQ ID NO: 71145 - DNA, 25 bp, mus musculus
attgcctcatttctgcacaggaaat

SEQ ID NO: 71146 - DNA, 25 bp, mus musculus
ctgcatagcctggacccacgaaggc

SEQ ID NO: 71147 - DNA, 25 bp, mus musculus
catagcctggacccacgaaggcagg

SEQ ID NO: 71148 - DNA, 25 bp, mus musculus
aatgagtgcttctctggaaaacact

SEQ ID NO: 71149 - DNA, 25 bp, mus musculus
ttctctggaaaacactgcacagtgt

SEQ ID NO: 71150 - DNA, 25 bp, mus musculus
cactgcacagtgtctattaaccttc

SEQ ID NO: 71151 - DNA, 25 bp, mus musculus
gtgtctattaaccttcaaggatgtg

SEQ ID NO: 71152 - DNA, 25 bp, mus musculus
tctattaaccttcaaggatgtgttt

SEQ ID NO: 71153 - DNA, 25 bp, mus musculus
tttggacttctcatcggaggaatgg

SEQ ID NO: 71154 - DNA, 25 bp, mus musculus
atgtctcaattttgctcagaggaca

SEQ ID NO: 71155 - DNA, 25 bp, mus musculus
tctcaattttgctcagaggacattg

SEQ ID NO: 71156 - DNA, 25 bp, mus musculus
caattttgctcagaggacattgtac

SEQ ID NO: 71157 - DNA, 25 bp, mus musculus
ttttgctcagaggacattgtacatg

SEQ ID NO: 71158 - DNA, 25 bp, mus musculus
agcctggacccacgaaggcaggaat

SEQ ID NO: 71159 - DNA, 25 bp, mus musculus
ttactagaggccaggttcactggag

SEQ ID NO: 71160 - DNA, 25 bp, mus musculus
ctagaggccaggttcactggagttg

SEQ ID NO: 71161 - DNA, 25 bp, mus musculus
gccaggttcactggagttggtaact

SEQ ID NO: 71162 - DNA, 25 bp, mus musculus
ttgaatgtttgctcctcaccaagaa

SEQ ID NO: 71163 - DNA, 25 bp, mus musculus
aatgtttgctcctcaccaagaatct

SEQ ID NO: 71164 - DNA, 25 bp, mus musculus
gtttgctcctcaccaagaatctggg

SEQ ID NO: 71165 - DNA, 25 bp, mus musculus
tgctcctcaccaagaatctgggaga

SEQ ID NO: 71166 - DNA, 25 bp, mus musculus
tgggctgtacagggtgccagataga

SEQ ID NO: 71167 - DNA, 25 bp, mus musculus
ctcctgaagttcctgagaatggcga

SEQ ID NO: 71168 - DNA, 25 bp, mus musculus
gatcagtgctgtacttcactggaga

SEQ ID NO: 71169 - DNA, 25 bp, mus musculus
tgctgtacttcactggagaggctat

SEQ ID NO: 71170 - DNA, 25 bp, mus musculus
tcactggagaggctatcgaggacga

SEQ ID NO: 71171 - DNA, 25 bp, mus musculus
acgatccagactatgacccaaagaa

SEQ ID NO: 71172 - DNA, 25 bp, mus musculus
atccagactatgacccaaagaagga

SEQ ID NO: 71173 - DNA, 25 bp, mus musculus
cagactatgacccaaagaaggatca

SEQ ID NO: 71174 - DNA, 25 bp, mus musculus
agaacccagccgagtgcaagcagca

SEQ ID NO: 71175 - DNA, 25 bp, mus musculus
cagccgagtgcaagcagcagtgagc

SEQ ID NO: 71176 - DNA, 25 bp, mus musculus
cagtgactggccttgaggacggccg

SEQ ID NO: 71177 - DNA, 25 bp, mus musculus
tgactggccttgaggacggccgccc

SEQ ID NO: 71178 - DNA, 25 bp, mus musculus
cgatactggctgcagactttgaaat

SEQ ID NO: 71179 - DNA, 25 bp, mus musculus
tactggctgcagactttgaaattgg

SEQ ID NO: 71180 - DNA, 25 bp, mus musculus
gtcactttttacgtgagcgcataat

SEQ ID NO: 71181 - DNA, 25 bp, mus musculus
ttttacgtgagcgcataatcccaag

SEQ ID NO: 71182 - DNA, 25 bp, mus musculus
tacgtgagcgcataatcccaagatc

SEQ ID NO: 71183 - DNA, 25 bp, mus musculus
gcataatcccaagatcagtgctgta

SEQ ID NO: 71184 - DNA, 25 bp, mus musculus
taatcccaagatcagtgctgtactt

SEQ ID NO: 71185 - DNA, 25 bp, mus musculus
tcccaagatcagtgctgtacttcac

SEQ ID NO: 71186 - DNA, 25 bp, mus musculus
agagcttgtcgtctttttcgctata

SEQ ID NO: 71187 - DNA, 25 bp, mus musculus
tgtcgtctttttcgctatattagac

SEQ ID NO: 71188 - DNA, 25 bp, mus musculus
tctagcataccatgtagttcctatg

SEQ ID NO: 71189 - DNA, 25 bp, mus musculus
agcataccatgtagttcctatggag

SEQ ID NO: 71190 - DNA, 25 bp, mus musculus
agttcctatggagtattgtgagagc

SEQ ID NO: 71191 - DNA, 25 bp, mus musculus
agtttccattgttggtttattgcag

SEQ ID NO: 71192 - DNA, 25 bp, mus musculus
tattctgtgtcaaattcaaggtatt

SEQ ID NO: 71193 - DNA, 25 bp, mus musculus
tattgataaaccttttcaaccagca

SEQ ID NO: 71194 - DNA, 25 bp, mus musculus
tgataaaccttttcaaccagcagca

SEQ ID NO: 71195 - DNA, 25 bp, mus musculus
taaaccttttcaaccagcagcaaga

SEQ ID NO: 71196 - DNA, 25 bp, mus musculus
accttttcaaccagcagcaagaagt

SEQ ID NO: 71197 - DNA, 25 bp, mus musculus
tcaaccagcagcaagaagttcaaat

SEQ ID NO: 71198 - DNA, 25 bp, mus musculus
ctttttcgctatattagactttgca

SEQ ID NO: 71199 - DNA, 25 bp, mus musculus
tttcgctatattagactttgcagta

SEQ ID NO: 71200 - DNA, 25 bp, mus musculus
ctttgcagtatgcccagaagctttc

SEQ ID NO: 71201 - DNA, 25 bp, mus musculus
agtatgcccagaagctttccttcat

SEQ ID NO: 71202 - DNA, 25 bp, mus musculus
taccataacctgttcattaatatca

SEQ ID NO: 71203 - DNA, 25 bp, mus musculus
cataacctgttcattaatatcagaa

SEQ ID NO: 71204 - DNA, 25 bp, mus musculus
aacctgttcattaatatcagaaatt

SEQ ID NO: 71205 - DNA, 25 bp, mus musculus
ggttctagcataccatgtagttcct

SEQ ID NO: 71206 - DNA, 25 bp, mus musculus
attgacatctactggctgttcgatg

SEQ ID NO: 71207 - DNA, 25 bp, mus musculus
atctactggctgttcgatgatggag

SEQ ID NO: 71208 - DNA, 25 bp, mus musculus
tgtccctggaagatctcagatgaag

SEQ ID NO: 71209 - DNA, 25 bp, mus musculus
tcccttcggcaggtgagactgagtg

SEQ ID NO: 71210 - DNA, 25 bp, mus musculus
ctgctggattactctcgggatgctg

SEQ ID NO: 71211 - DNA, 25 bp, mus musculus
tctcgggatgctgctctgatcatcc

SEQ ID NO: 71212 - DNA, 25 bp, mus musculus
gatgctgctctgatcatccttaccc

SEQ ID NO: 71213 - DNA, 25 bp, mus musculus
agttcgctgtacatggcctggctgg

SEQ ID NO: 71214 - DNA, 25 bp, mus musculus
ctgtacatggcctggctggagaccc

SEQ ID NO: 71215 - DNA, 25 bp, mus musculus
atggcctggctggagaccctgtccc

SEQ ID NO: 71216 - DNA, 25 bp, mus musculus
ctcatccgaggcaaccaggagaatg

SEQ ID NO: 71217 - DNA, 25 bp, mus musculus
gagaatgtgctcaccttttactgcc

SEQ ID NO: 71218 - DNA, 25 bp, mus musculus
ctcctgcaccgcaagaagagatggg

SEQ ID NO: 71219 - DNA, 25 bp, mus musculus
tgctcaccttttactgccagtgatg

SEQ ID NO: 71220 - DNA, 25 bp, mus musculus
aaggcgatcatctctctgttgagca

SEQ ID NO: 71221 - DNA, 25 bp, mus musculus
atcatctctctgttgagcaagttca

SEQ ID NO: 71222 - DNA, 25 bp, mus musculus
catgaagttcacgtccttcccgaca

SEQ ID NO: 71223 - DNA, 25 bp, mus musculus
cacaccaagcggtttgaggacatga

SEQ ID NO: 71224 - DNA, 25 bp, mus musculus
gacatgattgcacccttccgcctca

SEQ ID NO: 71225 - DNA, 25 bp, mus musculus
cgcctcaatgatggcttcaaggacg

SEQ ID NO: 71226 - DNA, 25 bp, mus musculus
gaggccaccgtcactgagatgagga

SEQ ID NO: 71227 - DNA, 25 bp, mus musculus
ccactttcacgggaggctgtcaact

SEQ ID NO: 71228 - DNA, 25 bp, mus musculus
cactttcacgggaggctgtcaactt

SEQ ID NO: 71229 - DNA, 25 bp, mus musculus
ctaatggttcggcttccagcatttc

SEQ ID NO: 71230 - DNA, 25 bp, mus musculus
taatggttcggcttccagcatttcc

SEQ ID NO: 71231 - DNA, 25 bp, mus musculus
atggttcggcttccagcatttccac

SEQ ID NO: 71232 - DNA, 25 bp, mus musculus
tggttcggcttccagcatttccacc

SEQ ID NO: 71233 - DNA, 25 bp, mus musculus
gttcggcttccagcatttccaccag

SEQ ID NO: 71234 - DNA, 25 bp, mus musculus
ttcggcttccagcatttccaccagg

SEQ ID NO: 71235 - DNA, 25 bp, mus musculus
cggcttccagcatttccaccaggaa

SEQ ID NO: 71236 - DNA, 25 bp, mus musculus
ggcttccagcatttccaccaggaac

SEQ ID NO: 71237 - DNA, 25 bp, mus musculus
cttccagcatttccaccaggaacct

SEQ ID NO: 71238 - DNA, 25 bp, mus musculus
ttccagcatttccaccaggaaccta

SEQ ID NO: 71239 - DNA, 25 bp, mus musculus
ctttcacgggaggctgtcaacttca

SEQ ID NO: 71240 - DNA, 25 bp, mus musculus
cagcatttccaccaggaacctagcc

SEQ ID NO: 71241 - DNA, 25 bp, mus musculus
tttcacgggaggctgtcaacttcaa

SEQ ID NO: 71242 - DNA, 25 bp, mus musculus
aggctgtcaacttcaaagtgctcac

SEQ ID NO: 71243 - DNA, 25 bp, mus musculus
gtgctcaccttaggctgaccaccgg

SEQ ID NO: 71244 - DNA, 25 bp, mus musculus
ttaggctgaccaccggcaaaattag

SEQ ID NO: 71245 - DNA, 25 bp, mus musculus
taggctgaccaccggcaaaattagg

SEQ ID NO: 71246 - DNA, 25 bp, mus musculus
atttggctaatggttcggcttccag

SEQ ID NO: 71247 - DNA, 25 bp, mus musculus
tttggctaatggttcggcttccagc

SEQ ID NO: 71248 - DNA, 25 bp, mus musculus
tctacaggtgtgccttcggggtcaa

SEQ ID NO: 71249 - DNA, 25 bp, mus musculus
gggtcaagtgctgccactggcagta

SEQ ID NO: 71250 - DNA, 25 bp, mus musculus
atcagtgtcctggtgatcattgtca

SEQ ID NO: 71251 - DNA, 25 bp, mus musculus
agtgtcctggtgatcattgtcatca

SEQ ID NO: 71252 - DNA, 25 bp, mus musculus
atcatcatcatcgtgtggtgtgtct

SEQ ID NO: 71253 - DNA, 25 bp, mus musculus
atcgtgtggtgtgtctcttaatgaa

SEQ ID NO: 71254 - DNA, 25 bp, mus musculus
actgaagcccgatattcaggatctt

SEQ ID NO: 71255 - DNA, 25 bp, mus musculus
tattcaggatcttcttcaagacttt

SEQ ID NO: 71256 - DNA, 25 bp, mus musculus
tcaggatcttcttcaagactttcta

SEQ ID NO: 71257 - DNA, 25 bp, mus musculus
tcaagactttctacttagaacctgc

SEQ ID NO: 71258 - DNA, 25 bp, mus musculus
tctacttagaacctgccgtgttatc

SEQ ID NO: 71259 - DNA, 25 bp, mus musculus
acttagaacctgccgtgttatcgag

SEQ ID NO: 71260 - DNA, 25 bp, mus musculus
agtgctgccactggcagtaatcgaa

SEQ ID NO: 71261 - DNA, 25 bp, mus musculus
tagaacctgccgtgttatcgagctt

SEQ ID NO: 71262 - DNA, 25 bp, mus musculus
gccactggcagtaatcgaagactcc

SEQ ID NO: 71263 - DNA, 25 bp, mus musculus
agtaatcgaagactccagcagacac

SEQ ID NO: 71264 - DNA, 25 bp, mus musculus
agactccagcagacacaaaatcaag

SEQ ID NO: 71265 - DNA, 25 bp, mus musculus
ctccagcagacacaaaatcaagtag

SEQ ID NO: 71266 - DNA, 25 bp, mus musculus
agagaccagaagctctcggagctag

SEQ ID NO: 71267 - DNA, 25 bp, mus musculus
ctctcggagctagatgaccgcgcag

SEQ ID NO: 71268 - DNA, 25 bp, mus musculus
ctagatgaccgcgcagatgcactgc

SEQ ID NO: 71269 - DNA, 25 bp, mus musculus
ctgcttcagccgcagtgtctccctg

SEQ ID NO: 71270 - DNA, 25 bp, mus musculus
ccaacatgaccagtaacaggcggtt

SEQ ID NO: 71271 - DNA, 25 bp, mus musculus
tgatcatgctgggagctatctgtgc

SEQ ID NO: 71272 - DNA, 25 bp, mus musculus
catgctgggagctatctgtgccatc

SEQ ID NO: 71273 - DNA, 25 bp, mus musculus
gctatctgtgccatcatcgtggtag

SEQ ID NO: 71274 - DNA, 25 bp, mus musculus
tatctgtgccatcatcgtggtagtg

SEQ ID NO: 71275 - DNA, 25 bp, mus musculus
tctgtgccatcatcgtggtagtgat

SEQ ID NO: 71276 - DNA, 25 bp, mus musculus
tgtgccatcatcgtggtagtgattg

SEQ ID NO: 71277 - DNA, 25 bp, mus musculus
ccatcatcgtggtagtgattgtaat

SEQ ID NO: 71278 - DNA, 25 bp, mus musculus
atcatcgtggtagtgattgtaatct

SEQ ID NO: 71279 - DNA, 25 bp, mus musculus
tacttttttacttgagaatgtgcca

SEQ ID NO: 71280 - DNA, 25 bp, mus musculus
cttttttacttgagaatgtgccatc

SEQ ID NO: 71281 - DNA, 25 bp, mus musculus
catgaccagtaacaggcggttacag

SEQ ID NO: 71282 - DNA, 25 bp, mus musculus
acgccttgcaggccggagcatcaca

SEQ ID NO: 71283 - DNA, 25 bp, mus musculus
gccttgcaggccggagcatcacaat

SEQ ID NO: 71284 - DNA, 25 bp, mus musculus
cttgcaggccggagcatcacaattt

SEQ ID NO: 71285 - DNA, 25 bp, mus musculus
caggccggagcatcacaatttgaga

SEQ ID NO: 71286 - DNA, 25 bp, mus musculus
agagcagtgctgccaagctaaaaag

SEQ ID NO: 71287 - DNA, 25 bp, mus musculus
agcagtgctgccaagctaaaaagga

SEQ ID NO: 71288 - DNA, 25 bp, mus musculus
atgatgatcatgctgggagctatct

SEQ ID NO: 71289 - DNA, 25 bp, mus musculus
tgtggttcccaagcatgtgatggac

SEQ ID NO: 71290 - DNA, 25 bp, mus musculus
tcccaagcatgtgatggacgtggtg

SEQ ID NO: 71291 - DNA, 25 bp, mus musculus
ctacggcatggaggatgtgaagaag

SEQ ID NO: 71292 - DNA, 25 bp, mus musculus
gaagcgtgtcctggagttcattgca

SEQ ID NO: 71293 - DNA, 25 bp, mus musculus
tgtcctggagttcattgcagtcagc

SEQ ID NO: 71294 - DNA, 25 bp, mus musculus
gttcattgcagtcagccagctcaga

SEQ ID NO: 71295 - DNA, 25 bp, mus musculus
agtcagccagctcagaggctccaca

SEQ ID NO: 71296 - DNA, 25 bp, mus musculus
cagccagctcagaggctccacacaa

SEQ ID NO: 71297 - DNA, 25 bp, mus musculus
ccagctcagaggctccacacaaggc

SEQ ID NO: 71298 - DNA, 25 bp, mus musculus
cagaggctccacacaaggcaagatc

SEQ ID NO: 71299 - DNA, 25 bp, mus musculus
aggctccacacaaggcaagatcctc

SEQ ID NO: 71300 - DNA, 25 bp, mus musculus
ctccacacaaggcaagatcctctgc

SEQ ID NO: 71301 - DNA, 25 bp, mus musculus
gagcaagcttgctctactggacaac

SEQ ID NO: 71302 - DNA, 25 bp, mus musculus
acaaggcaagatcctctgcttccac

SEQ ID NO: 71303 - DNA, 25 bp, mus musculus
actggacaaccactcctctgagttc

SEQ ID NO: 71304 - DNA, 25 bp, mus musculus
ccactcctctgagttcaatgtcact

SEQ ID NO: 71305 - DNA, 25 bp, mus musculus
tgtcactcgaaactacctggactgg

SEQ ID NO: 71306 - DNA, 25 bp, mus musculus
tcgaaactacctggactggctgaca

SEQ ID NO: 71307 - DNA, 25 bp, mus musculus
ctacctggactggctgacatccatc

SEQ ID NO: 71308 - DNA, 25 bp, mus musculus
ctggctgacatccatcccatggggc

SEQ ID NO: 71309 - DNA, 25 bp, mus musculus
ggaggaccactacggcatggaggat

SEQ ID NO: 71310 - DNA, 25 bp, mus musculus
tcccatcctttgaactactacacaa

SEQ ID NO: 71311 - DNA, 25 bp, mus musculus
cctttgaactactacacaaggagat

SEQ ID NO: 71312 - DNA, 25 bp, mus musculus
ctcgtttctactttgggctcaacat

SEQ ID NO: 71313 - DNA, 25 bp, mus musculus
gtttctactttgggctcaacatcga

SEQ ID NO: 71314 - DNA, 25 bp, mus musculus
actttgggctcaacatcgagacagg

SEQ ID NO: 71315 - DNA, 25 bp, mus musculus
ttgggctcaacatcgagacaggttt

SEQ ID NO: 71316 - DNA, 25 bp, mus musculus
ggctcaacatcgagacaggtttact

SEQ ID NO: 71317 - DNA, 25 bp, mus musculus
agcccacggtgttgaggagattccg

SEQ ID NO: 71318 - DNA, 25 bp, mus musculus
gtgctctgtctaccaccgacgtctt

SEQ ID NO: 71319 - DNA, 25 bp, mus musculus
ctgaccggcccactgtcatctatag

SEQ ID NO: 71320 - DNA, 25 bp, mus musculus
accggcccactgtcatctatagcag

SEQ ID NO: 71321 - DNA, 25 bp, mus musculus
ggcccactgtcatctatagcagcaa

SEQ ID NO: 71322 - DNA, 25 bp, mus musculus
ttgaactactacacaaggagatgct

SEQ ID NO: 71323 - DNA, 25 bp, mus musculus
ctgtcatctatagcagcaatcacaa

SEQ ID NO: 71324 - DNA, 25 bp, mus musculus
aactactacacaaggagatgctggg

SEQ ID NO: 71325 - DNA, 25 bp, mus musculus
agatcattcctcgatccatcctgat

SEQ ID NO: 71326 - DNA, 25 bp, mus musculus
tcattcctcgatccatcctgatgac

SEQ ID NO: 71327 - DNA, 25 bp, mus musculus
ttcctcgatccatcctgatgaccac

SEQ ID NO: 71328 - DNA, 25 bp, mus musculus
gatccatcctgatgaccacttttga

SEQ ID NO: 71329 - DNA, 25 bp, mus musculus
tcctgatgaccacttttgagaggag

SEQ ID NO: 71330 - DNA, 25 bp, mus musculus
tgaccacttttgagaggagccacta

SEQ ID NO: 71331 - DNA, 25 bp, mus musculus
ctgtccaacagagattacgtctaca

SEQ ID NO: 71332 - DNA, 25 bp, mus musculus
cagcgccgagacctggatgtggaca

SEQ ID NO: 71333 - DNA, 25 bp, mus musculus
tgtcagaactaccacaagaaaacct

SEQ ID NO: 71334 - DNA, 25 bp, mus musculus
tgggactccgtcatccatgaaggac

SEQ ID NO: 71335 - DNA, 25 bp, mus musculus
tccgtcatccatgaaggacatctct

SEQ ID NO: 71336 - DNA, 25 bp, mus musculus
tggctgtgctacaccacctgaggct

SEQ ID NO: 71337 - DNA, 25 bp, mus musculus
tccattcatacttccatcttcaagc

SEQ ID NO: 71338 - DNA, 25 bp, mus musculus
catacttccatcttcaagcgcatcc

SEQ ID NO: 71339 - DNA, 25 bp, mus musculus
tccatcttcaagcgcatcctattcc

SEQ ID NO: 71340 - DNA, 25 bp, mus musculus
ctattccagcactgctctgcagctc

SEQ ID NO: 71341 - DNA, 25 bp, mus musculus
cagcactgctctgcagctcatcgct

SEQ ID NO: 71342 - DNA, 25 bp, mus musculus
tgctctgcagctcatcgctcatgct

SEQ ID NO: 71343 - DNA, 25 bp, mus musculus
tacgtggtcctggcccagagtatct

SEQ ID NO: 71344 - DNA, 25 bp, mus musculus
cagctcatcgctcatgctgcttctt

SEQ ID NO: 71345 - DNA, 25 bp, mus musculus
agtatctcggcacctcagtttcccg

SEQ ID NO: 71346 - DNA, 25 bp, mus musculus
tctggggtcatccgagtgaaacagt

SEQ ID NO: 71347 - DNA, 25 bp, mus musculus
cagagcctggcgatcgagagtgacg

SEQ ID NO: 71348 - DNA, 25 bp, mus musculus
ggccaaattccgtcctggctcatta

SEQ ID NO: 71349 - DNA, 25 bp, mus musculus
attccgtcctggctcattaactggg

SEQ ID NO: 71350 - DNA, 25 bp, mus musculus
ctcattaactgggcagccaagaatg

SEQ ID NO: 71351 - DNA, 25 bp, mus musculus
aactgggcagccaagaatggagttc

SEQ ID NO: 71352 - DNA, 25 bp, mus musculus
ggtactacggtgctttggactactg

SEQ ID NO: 71353 - DNA, 25 bp, mus musculus
cggacattgagctcacccagtctcc

SEQ ID NO: 71354 - DNA, 25 bp, mus musculus
tctatcttacatccaacctagaatc

SEQ ID NO: 71355 - DNA, 25 bp, mus musculus
atcttacatccaacctagaatctgg

SEQ ID NO: 71356 - DNA, 25 bp, mus musculus
ttacatccaacctagaatctggggt

SEQ ID NO: 71357 - DNA, 25 bp, mus musculus
acctagaatctggggtccctgccag

SEQ ID NO: 71358 - DNA, 25 bp, mus musculus
tagaatctggggtccctgccaggtt

SEQ ID NO: 71359 - DNA, 25 bp, mus musculus
ggacagacttcaccctcaacatccg

SEQ ID NO: 71360 - DNA, 25 bp, mus musculus
ctgcaacctattactgtcagcacag

SEQ ID NO: 71361 - DNA, 25 bp, mus musculus
caacctattactgtcagcacagtag

SEQ ID NO: 71362 - DNA, 25 bp, mus musculus
cctattactgtcagcacagtaggga

SEQ ID NO: 71363 - DNA, 25 bp, mus musculus
attactgtcagcacagtagggagct

SEQ ID NO: 71364 - DNA, 25 bp, mus musculus
ttgagctcacccagtctccagcttc

SEQ ID NO: 71365 - DNA, 25 bp, mus musculus
ccaccatctcatgcagggccagcaa

SEQ ID NO: 71366 - DNA, 25 bp, mus musculus
ccatctcatgcagggccagcaaaag

SEQ ID NO: 71367 - DNA, 25 bp, mus musculus
aatatatacactggtaccaacagaa

SEQ ID NO: 71368 - DNA, 25 bp, mus musculus
tacactggtaccaacagaaaccagg

SEQ ID NO: 71369 - DNA, 25 bp, mus musculus
ccaaactcctcatctatcttacatc

SEQ ID NO: 71370 - DNA, 25 bp, mus musculus
aactcctcatctatcttacatccaa

SEQ ID NO: 71371 - DNA, 25 bp, mus musculus
tcctcatctatcttacatccaacct

SEQ ID NO: 71372 - DNA, 25 bp, mus musculus
caagtggtcagcctgcccaacatga

SEQ ID NO: 71373 - DNA, 25 bp, mus musculus
ctgcccaacatgagggtgcagacct

SEQ ID NO: 71374 - DNA, 25 bp, mus musculus
ttcctctgaagtagcctcatcccta

SEQ ID NO: 71375 - DNA, 25 bp, mus musculus
tggcccctggaggcgctctgaccca

SEQ ID NO: 71376 - DNA, 25 bp, mus musculus
ctctgtccttcatattgttcactgc

SEQ ID NO: 71377 - DNA, 25 bp, mus musculus
ccttcatattgttcactgcactgta

SEQ ID NO: 71378 - DNA, 25 bp, mus musculus
tattgttcactgcactgtatgcgaa

SEQ ID NO: 71379 - DNA, 25 bp, mus musculus
atgcgaagcacttacatgtatagat

SEQ ID NO: 71380 - DNA, 25 bp, mus musculus
ttaatttgtcgctgaatctgggctg

SEQ ID NO: 71381 - DNA, 25 bp, mus musculus
tgggctgagtcccagtcttgactct

SEQ ID NO: 71382 - DNA, 25 bp, mus musculus
tgggcaaacatgtccaacctaggca

SEQ ID NO: 71383 - DNA, 25 bp, mus musculus
aatactggctttgctagatgtgaat

SEQ ID NO: 71384 - DNA, 25 bp, mus musculus
ggggcgctcatacccaggaggctgc

SEQ ID NO: 71385 - DNA, 25 bp, mus musculus
ctcatacccaggaggctgcagccat

SEQ ID NO: 71386 - DNA, 25 bp, mus musculus
tccccaaggatgtgcctttcatgca

SEQ ID NO: 71387 - DNA, 25 bp, mus musculus
aggatgtgcctttcatgcaaatctg

SEQ ID NO: 71388 - DNA, 25 bp, mus musculus
gaagtgctcattatactgggagagc

SEQ ID NO: 71389 - DNA, 25 bp, mus musculus
taatgggcaatccctgtgtgtgctc

SEQ ID NO: 71390 - DNA, 25 bp, mus musculus
gcaatccctgtgtgtgctctttgct

SEQ ID NO: 71391 - DNA, 25 bp, mus musculus
tgtgctctttgcttcctctgaagta

SEQ ID NO: 71392 - DNA, 25 bp, mus musculus
ggataataagcttaccctctgatca

SEQ ID NO: 71393 - DNA, 25 bp, mus musculus
taagcttaccctctgatcacatgta

SEQ ID NO: 71394 - DNA, 25 bp, mus musculus
tgttccacttacatgaaatagagtc

SEQ ID NO: 71395 - DNA, 25 bp, mus musculus
tccacttacatgaaatagagtctta

SEQ ID NO: 71396 - DNA, 25 bp, mus musculus
atatctattgtcttcctggctaaat

SEQ ID NO: 71397 - DNA, 25 bp, mus musculus
tttctctctctaagtgggatgcata

SEQ ID NO: 71398 - DNA, 25 bp, mus musculus
atttcacaggtttccaatccactat

SEQ ID NO: 71399 - DNA, 25 bp, mus musculus
atgtatccagatcctacatttattt

SEQ ID NO: 71400 - DNA, 25 bp, mus musculus
aatggcttgcttttggtttgtgtca

SEQ ID NO: 71401 - DNA, 25 bp, mus musculus
gtcatttcttggcatattttgactg

SEQ ID NO: 71402 - DNA, 25 bp, mus musculus
atttcttggcatattttgactgggg

SEQ ID NO: 71403 - DNA, 25 bp, mus musculus
tcttggcatattttgactgggggat

SEQ ID NO: 71404 - DNA, 25 bp, mus musculus
taccctctgatcacatgtagcttac

SEQ ID NO: 71405 - DNA, 25 bp, mus musculus
cctctgatcacatgtagcttacact

SEQ ID NO: 71406 - DNA, 25 bp, mus musculus
acatgtagcttacacttgctgctag

SEQ ID NO: 71407 - DNA, 25 bp, mus musculus
tgtagcttacacttgctgctagctg

SEQ ID NO: 71408 - DNA, 25 bp, mus musculus
agcttacacttgctgctagctggag

SEQ ID NO: 71409 - DNA, 25 bp, mus musculus
cacttgctgctagctggaggtatat

SEQ ID NO: 71410 - DNA, 25 bp, mus musculus
ttgctgctagctggaggtatattag

SEQ ID NO: 71411 - DNA, 25 bp, mus musculus
agagacccatgttccacttacatga

SEQ ID NO: 71412 - DNA, 25 bp, mus musculus
tccaagaatgccacacacctttccg

SEQ ID NO: 71413 - DNA, 25 bp, mus musculus
aatgccacacacctttccgtagata

SEQ ID NO: 71414 - DNA, 25 bp, mus musculus
gctggcttccttgttcattgttcca

SEQ ID NO: 71415 - DNA, 25 bp, mus musculus
ttccttgttcattgttccaagagat

SEQ ID NO: 71416 - DNA, 25 bp, mus musculus
cttgttcattgttccaagagatggg

SEQ ID NO: 71417 - DNA, 25 bp, mus musculus
tgaagcctgtgtaatcctgttacag

SEQ ID NO: 71418 - DNA, 25 bp, mus musculus
tgtaatcctgttacaggttgtgttg

SEQ ID NO: 71419 - DNA, 25 bp, mus musculus
ttttcttgcattgacattattgacg

SEQ ID NO: 71420 - DNA, 25 bp, mus musculus
gaggacctcatcagatcaatttaaa

SEQ ID NO: 71421 - DNA, 25 bp, mus musculus
tgcctctgtctagcatgccaacaag

SEQ ID NO: 71422 - DNA, 25 bp, mus musculus
ctctgtctagcatgccaacaagaat

SEQ ID NO: 71423 - DNA, 25 bp, mus musculus
tgtctagcatgccaacaagaatgca

SEQ ID NO: 71424 - DNA, 25 bp, mus musculus
acacacctttccgtagatatgccga

SEQ ID NO: 71425 - DNA, 25 bp, mus musculus
cacctttccgtagatatgccgatgg

SEQ ID NO: 71426 - DNA, 25 bp, mus musculus
ctttccgtagatatgccgatggtaa

SEQ ID NO: 71427 - DNA, 25 bp, mus musculus
tcctaccttcttcaggctgtcaagc

SEQ ID NO: 71428 - DNA, 25 bp, mus musculus
cttcttcaggctgtcaagcacggga

SEQ ID NO: 71429 - DNA, 25 bp, mus musculus
cttcaggctgtcaagcacgggagag

SEQ ID NO: 71430 - DNA, 25 bp, mus musculus
tgctgttaagcattagctggcttcc

SEQ ID NO: 71431 - DNA, 25 bp, mus musculus
gcattagctggcttccttgttcatt

SEQ ID NO: 71432 - DNA, 25 bp, mus musculus
atgagcatttcagctctacacacag

SEQ ID NO: 71433 - DNA, 25 bp, mus musculus
gagcatttcagctctacacacagac

SEQ ID NO: 71434 - DNA, 25 bp, mus musculus
tacttcctcgaatctcactgtacac

SEQ ID NO: 71435 - DNA, 25 bp, mus musculus
ctcgaatctcactgtacaccagaga

SEQ ID NO: 71436 - DNA, 25 bp, mus musculus
cgaatctcactgtacaccagagaat

SEQ ID NO: 71437 - DNA, 25 bp, mus musculus
tctcactgtacaccagagaattcat

SEQ ID NO: 71438 - DNA, 25 bp, mus musculus
cctacaagtgcaacctttgtgacaa

SEQ ID NO: 71439 - DNA, 25 bp, mus musculus
tacaagtgcaacctttgtgacaaat

SEQ ID NO: 71440 - DNA, 25 bp, mus musculus
agtgcaacctttgtgacaaatcttt

SEQ ID NO: 71441 - DNA, 25 bp, mus musculus
gacaaatctttttcccagagcacaa

SEQ ID NO: 71442 - DNA, 25 bp, mus musculus
tctttttcccagagcacaactctta

SEQ ID NO: 71443 - DNA, 25 bp, mus musculus
tcccagagcacaactcttaaaacac

SEQ ID NO: 71444 - DNA, 25 bp, mus musculus
gcatttcagctctacacacagactg

SEQ ID NO: 71445 - DNA, 25 bp, mus musculus
atttcagctctacacacagactgat

SEQ ID NO: 71446 - DNA, 25 bp, mus musculus
cagctctacacacagactgatgcaa

SEQ ID NO: 71447 - DNA, 25 bp, mus musculus
tacacacagactgatgcaacaaata

SEQ ID NO: 71448 - DNA, 25 bp, mus musculus
aatgcttcagtacttcctcgaatct

SEQ ID NO: 71449 - DNA, 25 bp, mus musculus
tgcttcagtacttcctcgaatctca

SEQ ID NO: 71450 - DNA, 25 bp, mus musculus
tcagtacttcctcgaatctcactgt

SEQ ID NO: 71451 - DNA, 25 bp, mus musculus
agtacttcctcgaatctcactgtac

SEQ ID NO: 71452 - DNA, 25 bp, mus musculus
cattcttaaagcccaagtcttcaga

SEQ ID NO: 71453 - DNA, 25 bp, mus musculus
ttcttaaagcccaagtcttcagaag

SEQ ID NO: 71454 - DNA, 25 bp, mus musculus
gctcttctgcaacgtgctccttgct

SEQ ID NO: 71455 - DNA, 25 bp, mus musculus
tcttctgcaacgtgctccttgcttg

SEQ ID NO: 71456 - DNA, 25 bp, mus musculus
aacgtgctccttgcttgagggaatg

SEQ ID NO: 71457 - DNA, 25 bp, mus musculus
cgtgctccttgcttgagggaatgca

SEQ ID NO: 71458 - DNA, 25 bp, mus musculus
tgctccttgcttgagggaatgcaat

SEQ ID NO: 71459 - DNA, 25 bp, mus musculus
ataggtcctgatgacttctgtaagc

SEQ ID NO: 71460 - DNA, 25 bp, mus musculus
aggtcctgatgacttctgtaagccc

SEQ ID NO: 71461 - DNA, 25 bp, mus musculus
gtcctgatgacttctgtaagccccc

SEQ ID NO: 71462 - DNA, 25 bp, mus musculus
cccatctggcagacaaggcctttaa

SEQ ID NO: 71463 - DNA, 25 bp, mus musculus
catctggcagacaaggcctttaaaa

SEQ ID NO: 71464 - DNA, 25 bp, mus musculus
taaagcccaagtcttcagaagaaag

SEQ ID NO: 71465 - DNA, 25 bp, mus musculus
gattcaaaagccctgggactgggat

SEQ ID NO: 71466 - DNA, 25 bp, mus musculus
caagtccccctgaagctcttctgca

SEQ ID NO: 71467 - DNA, 25 bp, mus musculus
agtccccctgaagctcttctgcaac

SEQ ID NO: 71468 - DNA, 25 bp, mus musculus
tccccctgaagctcttctgcaacgt

SEQ ID NO: 71469 - DNA, 25 bp, mus musculus
cccctgaagctcttctgcaacgtgc

SEQ ID NO: 71470 - DNA, 25 bp, mus musculus
tgaagctcttctgcaacgtgctcct

SEQ ID NO: 71471 - DNA, 25 bp, mus musculus
aagctcttctgcaacgtgctccttg

SEQ ID NO: 71472 - DNA, 25 bp, mus musculus
tggcctggcatgtggtggctcacac

SEQ ID NO: 71473 - DNA, 25 bp, mus musculus
ctcacactgggggccagggtacaca

SEQ ID NO: 71474 - DNA, 25 bp, mus musculus
ctcttccactccatataatacttcc

SEQ ID NO: 71475 - DNA, 25 bp, mus musculus
ttccactccatataatacttccctt

SEQ ID NO: 71476 - DNA, 25 bp, mus musculus
tccatataatacttcccttgctgga

SEQ ID NO: 71477 - DNA, 25 bp, mus musculus
atataatacttcccttgctggatcc

SEQ ID NO: 71478 - DNA, 25 bp, mus musculus
tgctggatcccccatgccagtaacc

SEQ ID NO: 71479 - DNA, 25 bp, mus musculus
catgccagtaacccacctttaactg

SEQ ID NO: 71480 - DNA, 25 bp, mus musculus
ctacagatctccaaggaaccagaat

SEQ ID NO: 71481 - DNA, 25 bp, mus musculus
cagatctccaaggaaccagaatgca

SEQ ID NO: 71482 - DNA, 25 bp, mus musculus
gaatgcacactaaacacaattttgt

SEQ ID NO: 71483 - DNA, 25 bp, mus musculus
tgcacactaaacacaattttgtaca

SEQ ID NO: 71484 - DNA, 25 bp, mus musculus
caactattcgacagcctacctgcct

SEQ ID NO: 71485 - DNA, 25 bp, mus musculus
ctattcgacagcctacctgcctggc

SEQ ID NO: 71486 - DNA, 25 bp, mus musculus
gacagcctacctgcctggcagttac

SEQ ID NO: 71487 - DNA, 25 bp, mus musculus
agcctacctgcctggcagttacacc

SEQ ID NO: 71488 - DNA, 25 bp, mus musculus
ctacctgcctggcagttacacctct

SEQ ID NO: 71489 - DNA, 25 bp, mus musculus
tggcagttacacctcttcccactgc

SEQ ID NO: 71490 - DNA, 25 bp, mus musculus
caccttccctcagagtgatcccagg

SEQ ID NO: 71491 - DNA, 25 bp, mus musculus
cttccctcagagtgatcccaggctc

SEQ ID NO: 71492 - DNA, 25 bp, mus musculus
ttcaatcccaaaaaggacattcatt

SEQ ID NO: 71493 - DNA, 25 bp, mus musculus
gacattcattttatgccgtgctcag

SEQ ID NO: 71494 - DNA, 25 bp, mus musculus
ttaccatttattccatatctggata

SEQ ID NO: 71495 - DNA, 25 bp, mus musculus
ccatttattccatatctggataatt

SEQ ID NO: 71496 - DNA, 25 bp, mus musculus
tttattccatatctggataatttgc

SEQ ID NO: 71497 - DNA, 25 bp, mus musculus
attccatatctggataatttgccaa

SEQ ID NO: 71498 - DNA, 25 bp, mus musculus
gataatttgccaaacttcaatagat

SEQ ID NO: 71499 - DNA, 25 bp, mus musculus
ttgccaaacttcaatagatcagttg

SEQ ID NO: 71500 - DNA, 25 bp, mus musculus
ccaaacttcaatagatcagttgatg

SEQ ID NO: 71501 - DNA, 25 bp, mus musculus
ccaatcaggctgccaattgtcgata

SEQ ID NO: 71502 - DNA, 25 bp, mus musculus
atcaggctgccaattgtcgataagt

SEQ ID NO: 71503 - DNA, 25 bp, mus musculus
actgtggtcctgggaaagctggaat

SEQ ID NO: 71504 - DNA, 25 bp, mus musculus
attcattttatgccgtgctcaggac

SEQ ID NO: 71505 - DNA, 25 bp, mus musculus
cattttatgccgtgctcaggactga

SEQ ID NO: 71506 - DNA, 25 bp, mus musculus
tcagatttctgtccttggtacattg

SEQ ID NO: 71507 - DNA, 25 bp, mus musculus
gatttctgtccttggtacattggct

SEQ ID NO: 71508 - DNA, 25 bp, mus musculus
tgtccttggtacattggcttaccat

SEQ ID NO: 71509 - DNA, 25 bp, mus musculus
tggtacattggcttaccatttattc

SEQ ID NO: 71510 - DNA, 25 bp, mus musculus
attggcttaccatttattccatatc

SEQ ID NO: 71511 - DNA, 25 bp, mus musculus
ggcttaccatttattccatatctgg

SEQ ID NO: 71512 - DNA, 25 bp, mus musculus
ctcaccatgttcctcagagtatcta

SEQ ID NO: 71513 - DNA, 25 bp, mus musculus
atgttcctcagagtatctacttcag

SEQ ID NO: 71514 - DNA, 25 bp, mus musculus
cacactcttatgcattcccaccagg

SEQ ID NO: 71515 - DNA, 25 bp, mus musculus
cttatgcattcccaccagggctgta

SEQ ID NO: 71516 - DNA, 25 bp, mus musculus
cattcccaccagggctgtactacat

SEQ ID NO: 71517 - DNA, 25 bp, mus musculus
tagtatgcttttcgctgtgacacaa

SEQ ID NO: 71518 - DNA, 25 bp, mus musculus
aggaataactccccatttagctgct

SEQ ID NO: 71519 - DNA, 25 bp, mus musculus
ctgatacagtgcacacagatcctcc

SEQ ID NO: 71520 - DNA, 25 bp, mus musculus
cagtgcacacagatcctccgtacac

SEQ ID NO: 71521 - DNA, 25 bp, mus musculus
acacagatcctccgtacacagaatt

SEQ ID NO: 71522 - DNA, 25 bp, mus musculus
acatgtagcttctacctttgatata

SEQ ID NO: 71523 - DNA, 25 bp, mus musculus
tcattatctctcatgaaacattgtt

SEQ ID NO: 71524 - DNA, 25 bp, mus musculus
gtatctacttcagatcagtgcggca

SEQ ID NO: 71525 - DNA, 25 bp, mus musculus
cattaaatgcctcatctgtacagta

SEQ ID NO: 71526 - DNA, 25 bp, mus musculus
agatgcctcaggtgtgtttgatgga

SEQ ID NO: 71527 - DNA, 25 bp, mus musculus
cacaagaattcatgccccagaactt

SEQ ID NO: 71528 - DNA, 25 bp, mus musculus
tgccccagaacttagccttgacctg

SEQ ID NO: 71529 - DNA, 25 bp, mus musculus
agaacttagccttgacctgtgaaat

SEQ ID NO: 71530 - DNA, 25 bp, mus musculus
tagccttgacctgtgaaatattagc

SEQ ID NO: 71531 - DNA, 25 bp, mus musculus
tattagcacactcttatgcattccc

SEQ ID NO: 71532 - DNA, 25 bp, mus musculus
gttacactctaaagtgtcaaacgca

SEQ ID NO: 71533 - DNA, 25 bp, mus musculus
agtgtcaaacgcagtctgattttgg

SEQ ID NO: 71534 - DNA, 25 bp, mus musculus
catcttcaagaccaatgtatttttg

SEQ ID NO: 71535 - DNA, 25 bp, mus musculus
tactttgtggctgaatccaaggcaa

SEQ ID NO: 71536 - DNA, 25 bp, mus musculus
aaggcaactgttctgtcattatcaa

SEQ ID NO: 71537 - DNA, 25 bp, mus musculus
actgttctgtcattatcaattactc

SEQ ID NO: 71538 - DNA, 25 bp, mus musculus
ctgtcattatcaattactctctgtt

SEQ ID NO: 71539 - DNA, 25 bp, mus musculus
attactctctgttttaatcatgggc

SEQ ID NO: 71540 - DNA, 25 bp, mus musculus
atattcacttccatcaggggatgcc

SEQ ID NO: 71541 - DNA, 25 bp, mus musculus
ggatgccagctcttcactgtgactc

SEQ ID NO: 71542 - DNA, 25 bp, mus musculus
cagctcttcactgtgactcattttg

SEQ ID NO: 71543 - DNA, 25 bp, mus musculus
ttcactgtgactcattttgatgtac

SEQ ID NO: 71544 - DNA, 25 bp, mus musculus
gtgatgcctgggtttacaagagatt

SEQ ID NO: 71545 - DNA, 25 bp, mus musculus
aacctcgaatggcttcctgactgtt

SEQ ID NO: 71546 - DNA, 25 bp, mus musculus
aagatatcttgtctggctgcaagat

SEQ ID NO: 71547 - DNA, 25 bp, mus musculus
cgatgacagtgtccgtctgcccgga

SEQ ID NO: 71548 - DNA, 25 bp, mus musculus
ccgtctgcccggatgaatgtgggtg

SEQ ID NO: 71549 - DNA, 25 bp, mus musculus
ttgcacacaggaagactgtgagatt

SEQ ID NO: 71550 - DNA, 25 bp, mus musculus
tggttccatttgggggccattggat

SEQ ID NO: 71551 - DNA, 25 bp, mus musculus
catttgggggccattggatctatgg

SEQ ID NO: 71552 - DNA, 25 bp, mus musculus
aatagccatcttcaagaccaatgta

SEQ ID NO: 71553 - DNA, 25 bp, mus musculus
cttatctattgcactatcccaacct

SEQ ID NO: 71554 - DNA, 25 bp, mus musculus
atctattgcactatcccaacctacc

SEQ ID NO: 71555 - DNA, 25 bp, mus musculus
aacttctagttctgcaaaacagtca

SEQ ID NO: 71556 - DNA, 25 bp, mus musculus
tgcaaaacagtcacctcagtagagc

SEQ ID NO: 71557 - DNA, 25 bp, mus musculus
acagtcacctcagtagagcctctga

SEQ ID NO: 71558 - DNA, 25 bp, mus musculus
gtcacctcagtagagcctctgaatg

SEQ ID NO: 71559 - DNA, 25 bp, mus musculus
tgtgcaaactcatgcaggtcggact

SEQ ID NO: 71560 - DNA, 25 bp, mus musculus
aactcatgcaggtcggactatagcc

SEQ ID NO: 71561 - DNA, 25 bp, mus musculus
aatgtcagcagtggttcagaggtca

SEQ ID NO: 71562 - DNA, 25 bp, mus musculus
gaatgctgccagacttacctatgga

SEQ ID NO: 71563 - DNA, 25 bp, mus musculus
tgccagacttacctatggaacgaga

SEQ ID NO: 71564 - DNA, 25 bp, mus musculus
cagacttacctatggaacgagaggc

SEQ ID NO: 71565 - DNA, 25 bp, mus musculus
ccaacctaccaacttcaatatcaca

SEQ ID NO: 71566 - DNA, 25 bp, mus musculus
caacttcaatatcacatgttcacta

SEQ ID NO: 71567 - DNA, 25 bp, mus musculus
cttcaatatcacatgttcactaaca

SEQ ID NO: 71568 - DNA, 25 bp, mus musculus
tatcacatgttcactaacattgcca

SEQ ID NO: 71569 - DNA, 25 bp, mus musculus
atgttcactaacattgccaactata

SEQ ID NO: 71570 - DNA, 25 bp, mus musculus
cacatctactcgtccaacttctagt

SEQ ID NO: 71571 - DNA, 25 bp, mus musculus
atctactcgtccaacttctagttct

SEQ ID NO: 71572 - DNA, 25 bp, mus musculus
tccaacttctagttctgcaaaacag

SEQ ID NO: 71573 - DNA, 25 bp, mus musculus
agaattcaacaggttctaggagctt

SEQ ID NO: 71574 - DNA, 25 bp, mus musculus
gttctaggagcttctggcagctctt

SEQ ID NO: 71575 - DNA, 25 bp, mus musculus
aattgcatggctttctacagtacac

SEQ ID NO: 71576 - DNA, 25 bp, mus musculus
atggctttctacagtacacatgctt

SEQ ID NO: 71577 - DNA, 25 bp, mus musculus
catgctttctgttcttccggaagcg

SEQ ID NO: 71578 - DNA, 25 bp, mus musculus
ttctagttcagctgcagactctgtt

SEQ ID NO: 71579 - DNA, 25 bp, mus musculus
ttcagctgcagactctgttgtgtgt

SEQ ID NO: 71580 - DNA, 25 bp, mus musculus
tgcagactctgttgtgtgtctcagt

SEQ ID NO: 71581 - DNA, 25 bp, mus musculus
tttgaccatcctcattactcccctt

SEQ ID NO: 71582 - DNA, 25 bp, mus musculus
catcctcattactcccctttacaga

SEQ ID NO: 71583 - DNA, 25 bp, mus musculus
aaagtgttccacggcactactgtgc

SEQ ID NO: 71584 - DNA, 25 bp, mus musculus
ttccacggcactactgtgcaagtta

SEQ ID NO: 71585 - DNA, 25 bp, mus musculus
ggagcttctggcagctcttacccat

SEQ ID NO: 71586 - DNA, 25 bp, mus musculus
tctggcagctcttacccatgatgca

SEQ ID NO: 71587 - DNA, 25 bp, mus musculus
agctcttacccatgatgcaactgtg

SEQ ID NO: 71588 - DNA, 25 bp, mus musculus
aactgtgtgacttcactgcagcctt

SEQ ID NO: 71589 - DNA, 25 bp, mus musculus
gtgacttcactgcagccttcctcag

SEQ ID NO: 71590 - DNA, 25 bp, mus musculus
tcactgcagccttcctcagaacaca

SEQ ID NO: 71591 - DNA, 25 bp, mus musculus
gcccagcctctctgctcagggtcgg

SEQ ID NO: 71592 - DNA, 25 bp, mus musculus
cctctctgctcagggtcggcgttgt

SEQ ID NO: 71593 - DNA, 25 bp, mus musculus
ggatccatgagaccggggaatcaag

SEQ ID NO: 71594 - DNA, 25 bp, mus musculus
gtatttccacttcatagggcggtca

SEQ ID NO: 71595 - DNA, 25 bp, mus musculus
agtgatcagcagcccagacccttcc

SEQ ID NO: 71596 - DNA, 25 bp, mus musculus
gatcagcagcccagacccttccaga

SEQ ID NO: 71597 - DNA, 25 bp, mus musculus
cccagacccttccagaggagaggtg

SEQ ID NO: 71598 - DNA, 25 bp, mus musculus
agacccttccagaggagaggtggtg

SEQ ID NO: 71599 - DNA, 25 bp, mus musculus
attcctgtcccatgaccgagaccag

SEQ ID NO: 71600 - DNA, 25 bp, mus musculus
tgaccgagaccagctcactaaggtg

SEQ ID NO: 71601 - DNA, 25 bp, mus musculus
agaccagctcactaaggtgcttcag

SEQ ID NO: 71602 - DNA, 25 bp, mus musculus
ccagctcactaaggtgcttcaggag

SEQ ID NO: 71603 - DNA, 25 bp, mus musculus
taaggtgcttcaggagcacgtgaag

SEQ ID NO: 71604 - DNA, 25 bp, mus musculus
gcttcaggagcacgtgaagtcagtg

SEQ ID NO: 71605 - DNA, 25 bp, mus musculus
ccacttcatagggcggtcagacgat

SEQ ID NO: 71606 - DNA, 25 bp, mus musculus
gtcagtgacagcaccctacaagtac

SEQ ID NO: 71607 - DNA, 25 bp, mus musculus
cttcatagggcggtcagacgatatc

SEQ ID NO: 71608 - DNA, 25 bp, mus musculus
tatcattaattccagtgggtaccgg

SEQ ID NO: 71609 - DNA, 25 bp, mus musculus
accttccgaggtggaaaatgcactg

SEQ ID NO: 71610 - DNA, 25 bp, mus musculus
actgatggagcatcctgccgtaagc

SEQ ID NO: 71611 - DNA, 25 bp, mus musculus
gatggagcatcctgccgtaagcgaa

SEQ ID NO: 71612 - DNA, 25 bp, mus musculus
gcatcctgccgtaagcgaaacagca

SEQ ID NO: 71613 - DNA, 25 bp, mus musculus
tcctgccgtaagcgaaacagcagtg

SEQ ID NO: 71614 - DNA, 25 bp, mus musculus
aagccttcagccagaagtccagtct

SEQ ID NO: 71615 - DNA, 25 bp, mus musculus
agaagtccagtctccaagtccatca

SEQ ID NO: 71616 - DNA, 25 bp, mus musculus
atatttgctgtaggggctatagtca

SEQ ID NO: 71617 - DNA, 25 bp, mus musculus
agagatcacatcttgtcttccacca

SEQ ID NO: 71618 - DNA, 25 bp, mus musculus
cacatcttgtcttccaccagagaat

SEQ ID NO: 71619 - DNA, 25 bp, mus musculus
agagaatccacactgcatggaatct

SEQ ID NO: 71620 - DNA, 25 bp, mus musculus
tccacactgcatggaatctttagtt

SEQ ID NO: 71621 - DNA, 25 bp, mus musculus
gtgggctcttggctgatgattgtta

SEQ ID NO: 71622 - DNA, 25 bp, mus musculus
atccccaacacgcagagtcttcagg

SEQ ID NO: 71623 - DNA, 25 bp, mus musculus
aacacgcagagtcttcaggagactt

SEQ ID NO: 71624 - DNA, 25 bp, mus musculus
ttattctcctactgtactcattatg

SEQ ID NO: 71625 - DNA, 25 bp, mus musculus
tcctactgtactcattatgcaaagg

SEQ ID NO: 71626 - DNA, 25 bp, mus musculus
cgtgtcagcagtgtgggaaaggttt

SEQ ID NO: 71627 - DNA, 25 bp, mus musculus
aaggtttcagtcaggcctcatattt

SEQ ID NO: 71628 - DNA, 25 bp, mus musculus
tcagtcaggcctcatatttccatat

SEQ ID NO: 71629 - DNA, 25 bp, mus musculus
aggcctcatatttccatatgcacca

SEQ ID NO: 71630 - DNA, 25 bp, mus musculus
catatttccatatgcaccagagggt

SEQ ID NO: 71631 - DNA, 25 bp, mus musculus
tgcaccagagggtccacactatata

SEQ ID NO: 71632 - DNA, 25 bp, mus musculus
agagggtccacactatatagagacc

SEQ ID NO: 71633 - DNA, 25 bp, mus musculus
agagaccttaaatcggccatatttg

SEQ ID NO: 71634 - DNA, 25 bp, mus musculus
cgactgacagcgtggagtcacgcca

SEQ ID NO: 71635 - DNA, 25 bp, mus musculus
actgacagcgtggagtcacgccatg

SEQ ID NO: 71636 - DNA, 25 bp, mus musculus
gttcctgcaggctgtcaccaatttg

SEQ ID NO: 71637 - DNA, 25 bp, mus musculus
ttcctgcaggctgtcaccaatttgg

SEQ ID NO: 71638 - DNA, 25 bp, mus musculus
cctgcaggctgtcaccaatttgggc

SEQ ID NO: 71639 - DNA, 25 bp, mus musculus
ctgcaggctgtcaccaatttgggct

SEQ ID NO: 71640 - DNA, 25 bp, mus musculus
caggctgtcaccaatttgggctggt

SEQ ID NO: 71641 - DNA, 25 bp, mus musculus
ggctgtcaccaatttgggctggtcc

SEQ ID NO: 71642 - DNA, 25 bp, mus musculus
gctgtcaccaatttgggctggtccg

SEQ ID NO: 71643 - DNA, 25 bp, mus musculus
tgtcaccaatttgggctggtccgaa

SEQ ID NO: 71644 - DNA, 25 bp, mus musculus
tggtccgaaccaacgttgatccaga

SEQ ID NO: 71645 - DNA, 25 bp, mus musculus
aggaccgcagctaaggctatgccga

SEQ ID NO: 71646 - DNA, 25 bp, mus musculus
tggagtcacgccatggaggaccaag

SEQ ID NO: 71647 - DNA, 25 bp, mus musculus
gaccgcagctaaggctatgccgatc

SEQ ID NO: 71648 - DNA, 25 bp, mus musculus
gagtcacgccatggaggaccaagaa

SEQ ID NO: 71649 - DNA, 25 bp, mus musculus
agtcacgccatggaggaccaagaag

SEQ ID NO: 71650 - DNA, 25 bp, mus musculus
tcacgccatggaggaccaagaagcg

SEQ ID NO: 71651 - DNA, 25 bp, mus musculus
cacgccatggaggaccaagaagcgc

SEQ ID NO: 71652 - DNA, 25 bp, mus musculus
cctggatcccgggttcctgcaggct

SEQ ID NO: 71653 - DNA, 25 bp, mus musculus
cgggttcctgcaggctgtcaccaat

SEQ ID NO: 71654 - DNA, 25 bp, mus musculus
gggttcctgcaggctgtcaccaatt

SEQ ID NO: 71655 - DNA, 25 bp, mus musculus
gaaacctgccgagatatgaccccat

SEQ ID NO: 71656 - DNA, 25 bp, mus musculus
acctgccgagatatgaccccatcta

SEQ ID NO: 71657 - DNA, 25 bp, mus musculus
aaatgctgcgcctctgtgatctaac

SEQ ID NO: 71658 - DNA, 25 bp, mus musculus
ggcgatttgtcgcacacacgaagta

SEQ ID NO: 71659 - DNA, 25 bp, mus musculus
gatttgtcgcacacacgaagtattt

SEQ ID NO: 71660 - DNA, 25 bp, mus musculus
ttgtcgcacacacgaagtatttatt

SEQ ID NO: 71661 - DNA, 25 bp, mus musculus
atttattgagcgtggcctcctcgtc

SEQ ID NO: 71662 - DNA, 25 bp, mus musculus
tattgagcgtggcctcctcgtctaa

SEQ ID NO: 71663 - DNA, 25 bp, mus musculus
tggcctcctcgtctaacaagcggca

SEQ ID NO: 71664 - DNA, 25 bp, mus musculus
cctcctcgtctaacaagcggcagat

SEQ ID NO: 71665 - DNA, 25 bp, mus musculus
ctaacaagcggcagattctctgtgg

SEQ ID NO: 71666 - DNA, 25 bp, mus musculus
agcggcagattctctgtgggtcgag

SEQ ID NO: 71667 - DNA, 25 bp, mus musculus
gatatgaccccatctatggcatacc

SEQ ID NO: 71668 - DNA, 25 bp, mus musculus
agattctctgtgggtcgagagacaa

SEQ ID NO: 71669 - DNA, 25 bp, mus musculus
atgaccccatctatggcataccaga

SEQ ID NO: 71670 - DNA, 25 bp, mus musculus
accccatctatggcataccagagtg

SEQ ID NO: 71671 - DNA, 25 bp, mus musculus
gacattttgccctctggtgctcctg

SEQ ID NO: 71672 - DNA, 25 bp, mus musculus
attttgccctctggtgctcctggga

SEQ ID NO: 71673 - DNA, 25 bp, mus musculus
ttgccctctggtgctcctgggacga

SEQ ID NO: 71674 - DNA, 25 bp, mus musculus
tctggtgctcctgggacgaaatgct

SEQ ID NO: 71675 - DNA, 25 bp, mus musculus
ggtgctcctgggacgaaatgctgcg

SEQ ID NO: 71676 - DNA, 25 bp, mus musculus
gcacagccatcttgatttacctgag

SEQ ID NO: 71677 - DNA, 25 bp, mus musculus
tgatttacctgagttccaagtacca

SEQ ID NO: 71678 - DNA, 25 bp, mus musculus
ccttccttgttggccagcaggtgac

SEQ ID NO: 71679 - DNA, 25 bp, mus musculus
ttgttggccagcaggtgacgctagc

SEQ ID NO: 71680 - DNA, 25 bp, mus musculus
tgtttgagggacggcctcagctgac

SEQ ID NO: 71681 - DNA, 25 bp, mus musculus
ggcctcagctgacagcatggcgaga

SEQ ID NO: 71682 - DNA, 25 bp, mus musculus
gcaccatcctgagcatcctgggaca

SEQ ID NO: 71683 - DNA, 25 bp, mus musculus
aggtccatgccagcatgcagcttcg

SEQ ID NO: 71684 - DNA, 25 bp, mus musculus
atgccagcatgcagcttcgaattgc

SEQ ID NO: 71685 - DNA, 25 bp, mus musculus
gcatgcagcttcgaattgctaggat

SEQ ID NO: 71686 - DNA, 25 bp, mus musculus
ctaggattccttgagtggtctgacc

SEQ ID NO: 71687 - DNA, 25 bp, mus musculus
ttccttgagtggtctgaccagcaat

SEQ ID NO: 71688 - DNA, 25 bp, mus musculus
gttccaagtaccaggtggcagacca

SEQ ID NO: 71689 - DNA, 25 bp, mus musculus
agtaccaggtggcagaccactggta

SEQ ID NO: 71690 - DNA, 25 bp, mus musculus
cccaagtccacgaatacctgggctg

SEQ ID NO: 71691 - DNA, 25 bp, mus musculus
tccacgaatacctgggctggcatgc

SEQ ID NO: 71692 - DNA, 25 bp, mus musculus
ggcatgccgacaacatccgtggtac

SEQ ID NO: 71693 - DNA, 25 bp, mus musculus
atagaatggtcctggttctgcaaca

SEQ ID NO: 71694 - DNA, 25 bp, mus musculus
tggttctgcaacagctggaggacaa

SEQ ID NO: 71695 - DNA, 25 bp, mus musculus
tgcaacagctggaggacaagttcct

SEQ ID NO: 71696 - DNA, 25 bp, mus musculus
accggccgcagtgtcacttcgacat

SEQ ID NO: 71697 - DNA, 25 bp, mus musculus
ccggccgcagtgtcacttcgacatc

SEQ ID NO: 71698 - DNA, 25 bp, mus musculus
tcgacatcgagatcaaccgggaacc

SEQ ID NO: 71699 - DNA, 25 bp, mus musculus
tatgtttcagctcttctcagacata

SEQ ID NO: 71700 - DNA, 25 bp, mus musculus
tgtttcagctcttctcagacatatg

SEQ ID NO: 71701 - DNA, 25 bp, mus musculus
gtttcagctcttctcagacatatgt

SEQ ID NO: 71702 - DNA, 25 bp, mus musculus
ttcagctcttctcagacatatgtcc

SEQ ID NO: 71703 - DNA, 25 bp, mus musculus
tcagctcttctcagacatatgtcca

SEQ ID NO: 71704 - DNA, 25 bp, mus musculus
agctcttctcagacatatgtccaaa

SEQ ID NO: 71705 - DNA, 25 bp, mus musculus
tcttctcagacatatgtccaaaaac

SEQ ID NO: 71706 - DNA, 25 bp, mus musculus
cttctcagacatatgtccaaaaaca

SEQ ID NO: 71707 - DNA, 25 bp, mus musculus
tctcagacatatgtccaaaaacatg

SEQ ID NO: 71708 - DNA, 25 bp, mus musculus
ggccgcagtgtcacttcgacatcga

SEQ ID NO: 71709 - DNA, 25 bp, mus musculus
ctcagacatatgtccaaaaacatgc

SEQ ID NO: 71710 - DNA, 25 bp, mus musculus
cgcagtgtcacttcgacatcgagat

SEQ ID NO: 71711 - DNA, 25 bp, mus musculus
gcagtgtcacttcgacatcgagatc

SEQ ID NO: 71712 - DNA, 25 bp, mus musculus
gtgtcacttcgacatcgagatcaac

SEQ ID NO: 71713 - DNA, 25 bp, mus musculus
gtcacttcgacatcgagatcaaccg

SEQ ID NO: 71714 - DNA, 25 bp, mus musculus
tcacttcgacatcgagatcaaccgg

SEQ ID NO: 71715 - DNA, 25 bp, mus musculus
acttcgacatcgagatcaaccggga

SEQ ID NO: 71716 - DNA, 25 bp, mus musculus
cttcgacatcgagatcaaccgggaa

SEQ ID NO: 71717 - DNA, 25 bp, mus musculus
gtattcggtgtcagtcctgtcttac

SEQ ID NO: 71718 - DNA, 25 bp, mus musculus
agtcctgtcttaccaaagatgaatg

SEQ ID NO: 71719 - DNA, 25 bp, mus musculus
ccctcactggagcagagaaagtaga

SEQ ID NO: 71720 - DNA, 25 bp, mus musculus
acaacacaagtcagggcacctggtt

SEQ ID NO: 71721 - DNA, 25 bp, mus musculus
cctggttctgggcagctcagcagag

SEQ ID NO: 71722 - DNA, 25 bp, mus musculus
ggctgtctgcatctcaaatctgtca

SEQ ID NO: 71723 - DNA, 25 bp, mus musculus
ctgcatctcaaatctgtcaggcctg

SEQ ID NO: 71724 - DNA, 25 bp, mus musculus
actccatgggaaagtccttgagctg

SEQ ID NO: 71725 - DNA, 25 bp, mus musculus
agtccttgagctgccacaaccgtgt

SEQ ID NO: 71726 - DNA, 25 bp, mus musculus
accgtgtccaaagccaccagctgtg

SEQ ID NO: 71727 - DNA, 25 bp, mus musculus
tccaaagccaccagctgtgttcctc

SEQ ID NO: 71728 - DNA, 25 bp, mus musculus
gacctgtccacttgtcatcaacctc

SEQ ID NO: 71729 - DNA, 25 bp, mus musculus
agacccagtcttgtcaatgcaattg

SEQ ID NO: 71730 - DNA, 25 bp, mus musculus
agtcttgtcaatgcaattgtctctg

SEQ ID NO: 71731 - DNA, 25 bp, mus musculus
gtctctgttttacaagttggagtca

SEQ ID NO: 71732 - DNA, 25 bp, mus musculus
ttgccctctgagctctggagaccca

SEQ ID NO: 71733 - DNA, 25 bp, mus musculus
tctgagctctggagacccatgtggg

SEQ ID NO: 71734 - DNA, 25 bp, mus musculus
ctctggagacccatgtgggcttagg

SEQ ID NO: 71735 - DNA, 25 bp, mus musculus
gcttaggcttggactggatggaaga

SEQ ID NO: 71736 - DNA, 25 bp, mus musculus
tctgttccctcactggagcagagaa

SEQ ID NO: 71737 - DNA, 25 bp, mus musculus
cgaaaacgatcttcggcaggatcat

SEQ ID NO: 71738 - DNA, 25 bp, mus musculus
aacgatcttcggcaggatcatcggc

SEQ ID NO: 71739 - DNA, 25 bp, mus musculus
tcaggcaccaagacacttcctggtg

SEQ ID NO: 71740 - DNA, 25 bp, mus musculus
aggcaccaagacacttcctggtgat

SEQ ID NO: 71741 - DNA, 25 bp, mus musculus
caagacacttcctggtgatacccag

SEQ ID NO: 71742 - DNA, 25 bp, mus musculus
agacacttcctggtgatacccagga

SEQ ID NO: 71743 - DNA, 25 bp, mus musculus
aaagtcttctaggacatttaatgat

SEQ ID NO: 71744 - DNA, 25 bp, mus musculus
gaaatgtgctgcagatctgggccta

SEQ ID NO: 71745 - DNA, 25 bp, mus musculus
aatgtgctgcagatctgggcctaaa

SEQ ID NO: 71746 - DNA, 25 bp, mus musculus
tgtgctgcagatctgggcctaaagc

SEQ ID NO: 71747 - DNA, 25 bp, mus musculus
tgctgcagatctgggcctaaagcgc

SEQ ID NO: 71748 - DNA, 25 bp, mus musculus
ctgcagatctgggcctaaagcgcgg

SEQ ID NO: 71749 - DNA, 25 bp, mus musculus
cgatcttcggcaggatcatcggcaa

SEQ ID NO: 71750 - DNA, 25 bp, mus musculus
ggacagtctgtctatcacatcacct

SEQ ID NO: 71751 - DNA, 25 bp, mus musculus
caaggaattcccggccaagatcatc

SEQ ID NO: 71752 - DNA, 25 bp, mus musculus
aggaattcccggccaagatcatctt

SEQ ID NO: 71753 - DNA, 25 bp, mus musculus
gaattcccggccaagatcatcttgg

SEQ ID NO: 71754 - DNA, 25 bp, mus musculus
attcccggccaagatcatcttggag

SEQ ID NO: 71755 - DNA, 25 bp, mus musculus
ccggccaagatcatcttggaggaca

SEQ ID NO: 71756 - DNA, 25 bp, mus musculus
tcatcttggaggacaacggttgtct

SEQ ID NO: 71757 - DNA, 25 bp, mus musculus
acaacggttgtcttgcttttcatga

SEQ ID NO: 71758 - DNA, 25 bp, mus musculus
ggtgaattccggcaatcctgaaagg

SEQ ID NO: 71759 - DNA, 25 bp, mus musculus
gaattccggcaatcctgaaaggtcg

SEQ ID NO: 71760 - DNA, 25 bp, mus musculus
tgcttcacatcttgcagaagctttc

SEQ ID NO: 71761 - DNA, 25 bp, mus musculus
ttcacatcttgcagaagctttctga

SEQ ID NO: 71762 - DNA, 25 bp, mus musculus
agctttctgagagctctaatggaat

SEQ ID NO: 71763 - DNA, 25 bp, mus musculus
tttctgagagctctaatggaatctt

SEQ ID NO: 71764 - DNA, 25 bp, mus musculus
tatcagatatcgcagggcatttcgg

SEQ ID NO: 71765 - DNA, 25 bp, mus musculus
accacgtcagtttgggtgaagtgca

SEQ ID NO: 71766 - DNA, 25 bp, mus musculus
acgtcagtttgggtgaagtgcacag

SEQ ID NO: 71767 - DNA, 25 bp, mus musculus
tgcacagtgtgtctcaggcgctgga

SEQ ID NO: 71768 - DNA, 25 bp, mus musculus
gtgtgtctcaggcgctggagctctc

SEQ ID NO: 71769 - DNA, 25 bp, mus musculus
gtgtctcaggcgctggagctctctt

SEQ ID NO: 71770 - DNA, 25 bp, mus musculus
cggcaatcctgaaaggtcgggactg

SEQ ID NO: 71771 - DNA, 25 bp, mus musculus
tgaaaggtcgggactgcttggcctt

SEQ ID NO: 71772 - DNA, 25 bp, mus musculus
gcaagacagcagcctttgtgcttca

SEQ ID NO: 71773 - DNA, 25 bp, mus musculus
agacagcagcctttgtgcttcacat

SEQ ID NO: 71774 - DNA, 25 bp, mus musculus
cagcagcctttgtgcttcacatctt

SEQ ID NO: 71775 - DNA, 25 bp, mus musculus
cagcctttgtgcttcacatcttgca

SEQ ID NO: 71776 - DNA, 25 bp, mus musculus
cctttgtgcttcacatcttgcagaa

SEQ ID NO: 71777 - DNA, 25 bp, mus musculus
ttgtgcttcacatcttgcagaagct

SEQ ID NO: 71778 - DNA, 25 bp, mus musculus
ctgtctctcaggcacaggaatgaag

SEQ ID NO: 71779 - DNA, 25 bp, mus musculus
gtctgtcacaggcacgccatactgg

SEQ ID NO: 71780 - DNA, 25 bp, mus musculus
gccacctcatgtctcagactatact

SEQ ID NO: 71781 - DNA, 25 bp, mus musculus
acctcatgtctcagactatactcgg

SEQ ID NO: 71782 - DNA, 25 bp, mus musculus
agaggccaaacttcgaccttcagcg

SEQ ID NO: 71783 - DNA, 25 bp, mus musculus
caaacttcgaccttcagcggaggag

SEQ ID NO: 71784 - DNA, 25 bp, mus musculus
acttcgaccttcagcggaggagctc

SEQ ID NO: 71785 - DNA, 25 bp, mus musculus
tcgaccttcagcggaggagctcttg

SEQ ID NO: 71786 - DNA, 25 bp, mus musculus
ttcagcggaggagctcttgcggcac

SEQ ID NO: 71787 - DNA, 25 bp, mus musculus
gctcttgcggcacatgtttgtgcat

SEQ ID NO: 71788 - DNA, 25 bp, mus musculus
cttgcggcacatgtttgtgcattat

SEQ ID NO: 71789 - DNA, 25 bp, mus musculus
tgtgcattatcactagcagcggcgg

SEQ ID NO: 71790 - DNA, 25 bp, mus musculus
gctaactgaaaagccaccttgggct

SEQ ID NO: 71791 - DNA, 25 bp, mus musculus
agcaatggctgccatctttaagatc

SEQ ID NO: 71792 - DNA, 25 bp, mus musculus
catctttaagatcgccactcagcca

SEQ ID NO: 71793 - DNA, 25 bp, mus musculus
ctttaagatcgccactcagccaacg

SEQ ID NO: 71794 - DNA, 25 bp, mus musculus
taagatcgccactcagccaacgaac

SEQ ID NO: 71795 - DNA, 25 bp, mus musculus
aacgaacccaaagctgccacctcat

SEQ ID NO: 71796 - DNA, 25 bp, mus musculus
gaacccaaagctgccacctcatgtc

SEQ ID NO: 71797 - DNA, 25 bp, mus musculus
gctgccacctcatgtctcagactat

SEQ ID NO: 71798 - DNA, 25 bp, mus musculus
ttacatcgacctgccttattcttct

SEQ ID NO: 71799 - DNA, 25 bp, mus musculus
ttccccaagtcgcagtgccactgtg

SEQ ID NO: 71800 - DNA, 25 bp, mus musculus
gtttgttggcacttcgagaaggacg

SEQ ID NO: 71801 - DNA, 25 bp, mus musculus
catcattcatgaactggtctcttta

SEQ ID NO: 71802 - DNA, 25 bp, mus musculus
ttgaaacccattgtgtatcagggat

SEQ ID NO: 71803 - DNA, 25 bp, mus musculus
ttaactatctgctgaagacatctgt

SEQ ID NO: 71804 - DNA, 25 bp, mus musculus
atctgctgaagacatctgtatttac

SEQ ID NO: 71805 - DNA, 25 bp, mus musculus
catgactgcttctgggagctgctct

SEQ ID NO: 71806 - DNA, 25 bp, mus musculus
tgcttctgggagctgctctagcccc

SEQ ID NO: 71807 - DNA, 25 bp, mus musculus
ccgctgcttggggaatctgatctgg

SEQ ID NO: 71808 - DNA, 25 bp, mus musculus
gaatctgatctggagcatgtccatg

SEQ ID NO: 71809 - DNA, 25 bp, mus musculus
gatctggagcatgtccatgagcaac

SEQ ID NO: 71810 - DNA, 25 bp, mus musculus
aagtcgcagtgccactgtgagccca

SEQ ID NO: 71811 - DNA, 25 bp, mus musculus
agcatgtccatgagcaacattagcc

SEQ ID NO: 71812 - DNA, 25 bp, mus musculus
cactgtgagcccacagcaacctcaa

SEQ ID NO: 71813 - DNA, 25 bp, mus musculus
acctcaagcccagcagcgaagagtc

SEQ ID NO: 71814 - DNA, 25 bp, mus musculus
aagagtcaccccagacaggagtcag

SEQ ID NO: 71815 - DNA, 25 bp, mus musculus
gccctcactggatttgtgtagctac

SEQ ID NO: 71816 - DNA, 25 bp, mus musculus
tttgtgtagctaccaagcgttatat

SEQ ID NO: 71817 - DNA, 25 bp, mus musculus
tagttatgtgccacagaacgatgat

SEQ ID NO: 71818 - DNA, 25 bp, mus musculus
tgtgccacagaacgatgatgagttg

SEQ ID NO: 71819 - DNA, 25 bp, mus musculus
atcttgacccaagtcagactagccc

SEQ ID NO: 71820 - DNA, 25 bp, mus musculus
ctagcccgtgagttttgagacagca

SEQ ID NO: 71821 - DNA, 25 bp, mus musculus
ctgtatttgcatcgtacctgagtgt

SEQ ID NO: 71822 - DNA, 25 bp, mus musculus
ttgcatcgtacctgagtgtgtacat

SEQ ID NO: 71823 - DNA, 25 bp, mus musculus
cacatatgtgccctcagactctgtt

SEQ ID NO: 71824 - DNA, 25 bp, mus musculus
ctcagactctgtttagcctcctaca

SEQ ID NO: 71825 - DNA, 25 bp, mus musculus
ctctgtttagcctcctacaggaagt

SEQ ID NO: 71826 - DNA, 25 bp, mus musculus
atggtgcatgcctgcaatctcagca

SEQ ID NO: 71827 - DNA, 25 bp, mus musculus
tgcaatctcagcatcacagggaggc

SEQ ID NO: 71828 - DNA, 25 bp, mus musculus
gatccctgagttcaaggccatgagc

SEQ ID NO: 71829 - DNA, 25 bp, mus musculus
cctagcctggtgttcacagttcctg

SEQ ID NO: 71830 - DNA, 25 bp, mus musculus
ttcacagttcctggacagccggggt

SEQ ID NO: 71831 - DNA, 25 bp, mus musculus
ttctctccgtgtctcctgtggaagg

SEQ ID NO: 71832 - DNA, 25 bp, mus musculus
attcaaagacgtcatgtggttcatc

SEQ ID NO: 71833 - DNA, 25 bp, mus musculus
agacgtcatgtggttcatctattgc

SEQ ID NO: 71834 - DNA, 25 bp, mus musculus
gttcatctattgcgtgctataccct

SEQ ID NO: 71835 - DNA, 25 bp, mus musculus
ctattgcgtgctataccctggctca

SEQ ID NO: 71836 - DNA, 25 bp, mus musculus
cgtgctataccctggctcagcccat

SEQ ID NO: 71837 - DNA, 25 bp, mus musculus
agcccatccatgtctgataaacgaa

SEQ ID NO: 71838 - DNA, 25 bp, mus musculus
taggctctgtatttgcatcgtacct

SEQ ID NO: 71839 - DNA, 25 bp, mus musculus
ctggcacctgctgctcatgaagaag

SEQ ID NO: 71840 - DNA, 25 bp, mus musculus
cctgctgctcatgaagaagtgcaca

SEQ ID NO: 71841 - DNA, 25 bp, mus musculus
cacaggcagctggcaggtccttttt

SEQ ID NO: 71842 - DNA, 25 bp, mus musculus
ttcaaccagcaggctaggctggcca

SEQ ID NO: 71843 - DNA, 25 bp, mus musculus
cagcaggctaggctggccatagacc

SEQ ID NO: 71844 - DNA, 25 bp, mus musculus
gccatgttccagtaatggaggcctc

SEQ ID NO: 71845 - DNA, 25 bp, mus musculus
taatggaggcctccagcctgggctc

SEQ ID NO: 71846 - DNA, 25 bp, mus musculus
aggcctccagcctgggctctattac

SEQ ID NO: 71847 - DNA, 25 bp, mus musculus
tgggctctattacattcttctctac

SEQ ID NO: 71848 - DNA, 25 bp, mus musculus
cattcttctctacagctgccccata

SEQ ID NO: 71849 - DNA, 25 bp, mus musculus
gataggcaacactgtcctgctccag

SEQ ID NO: 71850 - DNA, 25 bp, mus musculus
caacactgtcctgctccagcctgtg

SEQ ID NO: 71851 - DNA, 25 bp, mus musculus
caaatgtgtacacttcccatgggac

SEQ ID NO: 71852 - DNA, 25 bp, mus musculus
tgtacacttcccatgggaccacaga

SEQ ID NO: 71853 - DNA, 25 bp, mus musculus
ccacagacccagctcagctctgttg

SEQ ID NO: 71854 - DNA, 25 bp, mus musculus
acccagctcagctctgttgaagacc

SEQ ID NO: 71855 - DNA, 25 bp, mus musculus
caagcacaaaggccttgaagagtgg

SEQ ID NO: 71856 - DNA, 25 bp, mus musculus
tcccttgagccagctccattgctac

SEQ ID NO: 71857 - DNA, 25 bp, mus musculus
gctccattgctacttattcatgtga

SEQ ID NO: 71858 - DNA, 25 bp, mus musculus
gctgaccacaggcagctggcaggtc

SEQ ID NO: 71859 - DNA, 25 bp, mus musculus
cttggtcgctttcctccttgggcag

SEQ ID NO: 71860 - DNA, 25 bp, mus musculus
ttggtcgctttcctccttgggcagg

SEQ ID NO: 71861 - DNA, 25 bp, mus musculus
cagagattcgcttatgtgggttaaa

SEQ ID NO: 71862 - DNA, 25 bp, mus musculus
agagattcgcttatgtgggttaaag

SEQ ID NO: 71863 - DNA, 25 bp, mus musculus
gagattcgcttatgtgggttaaagg

SEQ ID NO: 71864 - DNA, 25 bp, mus musculus
ttcgcttatgtgggttaaaggtcag

SEQ ID NO: 71865 - DNA, 25 bp, mus musculus
tcagcattgtcagtagcaagtgtgg

SEQ ID NO: 71866 - DNA, 25 bp, mus musculus
agcattgtcagtagcaagtgtggct

SEQ ID NO: 71867 - DNA, 25 bp, mus musculus
attgtcagtagcaagtgtggctcag

SEQ ID NO: 71868 - DNA, 25 bp, mus musculus
tggtcgctttcctccttgggcaggt

SEQ ID NO: 71869 - DNA, 25 bp, mus musculus
gtcgctttcctccttgggcaggtag

SEQ ID NO: 71870 - DNA, 25 bp, mus musculus
tcgctttcctccttgggcaggtagg

SEQ ID NO: 71871 - DNA, 25 bp, mus musculus
agtgctgcaaggctcggaatgcaga

SEQ ID NO: 71872 - DNA, 25 bp, mus musculus
gtgctgcaaggctcggaatgcagag

SEQ ID NO: 71873 - DNA, 25 bp, mus musculus
tgctgcaaggctcggaatgcagaga

SEQ ID NO: 71874 - DNA, 25 bp, mus musculus
ctgcaaggctcggaatgcagagatt

SEQ ID NO: 71875 - DNA, 25 bp, mus musculus
tgcaaggctcggaatgcagagattc

SEQ ID NO: 71876 - DNA, 25 bp, mus musculus
caaggtctccagttctccatttaca

SEQ ID NO: 71877 - DNA, 25 bp, mus musculus
cagttctccatttacagaggagaaa

SEQ ID NO: 71878 - DNA, 25 bp, mus musculus
cctttgttcactaatatctatctat

SEQ ID NO: 71879 - DNA, 25 bp, mus musculus
ttgttcactaatatctatctatcta

SEQ ID NO: 71880 - DNA, 25 bp, mus musculus
ctatctatcatctattatctatcta

SEQ ID NO: 71881 - DNA, 25 bp, mus musculus
atctatctatctccctcatacttct

SEQ ID NO: 71882 - DNA, 25 bp, mus musculus
tcatacttctgagacatggccagtt

SEQ ID NO: 71883 - DNA, 25 bp, mus musculus
ttctgagacatggccagttttcttc

SEQ ID NO: 71884 - DNA, 25 bp, mus musculus
tccctgctgttaagcacttggcaga

SEQ ID NO: 71885 - DNA, 25 bp, mus musculus
ctgctgttaagcacttggcagatga

SEQ ID NO: 71886 - DNA, 25 bp, mus musculus
gtcccatttatttctgagtgagatg

SEQ ID NO: 71887 - DNA, 25 bp, mus musculus
ccatttatttctgagtgagatggtg

SEQ ID NO: 71888 - DNA, 25 bp, mus musculus
ttctccatttacagaggagaaagtc

SEQ ID NO: 71889 - DNA, 25 bp, mus musculus
ttcccttcctaaatatgtgagtcac

SEQ ID NO: 71890 - DNA, 25 bp, mus musculus
ctcaccagcaagatgtctgctggtt

SEQ ID NO: 71891 - DNA, 25 bp, mus musculus
ttaagcaacttggtctcttgatgcc

SEQ ID NO: 71892 - DNA, 25 bp, mus musculus
aacttggtctcttgatgccattagc

SEQ ID NO: 71893 - DNA, 25 bp, mus musculus
ttgtccaaagcacctttgttcacta

SEQ ID NO: 71894 - DNA, 25 bp, mus musculus
tccaaagcacctttgttcactaata

SEQ ID NO: 71895 - DNA, 25 bp, mus musculus
aaagcacctttgttcactaatatct

SEQ ID NO: 71896 - DNA, 25 bp, mus musculus
cacagcctattctttggtggcccca

SEQ ID NO: 71897 - DNA, 25 bp, mus musculus
ctattctttggtggccccagacgag

SEQ ID NO: 71898 - DNA, 25 bp, mus musculus
ggagccttcagtggcagatgcggtt

SEQ ID NO: 71899 - DNA, 25 bp, mus musculus
cgtgccccagagtgtagtggatgat

SEQ ID NO: 71900 - DNA, 25 bp, mus musculus
tgaggacagcagcctgcagactgcc

SEQ ID NO: 71901 - DNA, 25 bp, mus musculus
ggacagcagcctgcagactgccatg

SEQ ID NO: 71902 - DNA, 25 bp, mus musculus
cagcagcctgcagactgccatgggg

SEQ ID NO: 71903 - DNA, 25 bp, mus musculus
atccctggatcttcagggcctgcac

SEQ ID NO: 71904 - DNA, 25 bp, mus musculus
cctggatcttcagggcctgcaccgc

SEQ ID NO: 71905 - DNA, 25 bp, mus musculus
ccgcgtggccaacaacgctcagcag

SEQ ID NO: 71906 - DNA, 25 bp, mus musculus
cgtggccaacaacgctcagcagcag

SEQ ID NO: 71907 - DNA, 25 bp, mus musculus
ggccaacaacgctcagcagcagtat

SEQ ID NO: 71908 - DNA, 25 bp, mus musculus
ctacctgcttgacctacacctgttc

SEQ ID NO: 71909 - DNA, 25 bp, mus musculus
cctgcttgacctacacctgttcctg

SEQ ID NO: 71910 - DNA, 25 bp, mus musculus
tgacctacacctgttcctgggccgc

SEQ ID NO: 71911 - DNA, 25 bp, mus musculus
acacctgttcctgggccgctctgtc

SEQ ID NO: 71912 - DNA, 25 bp, mus musculus
ggcccgtccttgtgaggagccttca

SEQ ID NO: 71913 - DNA, 25 bp, mus musculus
ccgtccttgtgaggagccttcagtg

SEQ ID NO: 71914 - DNA, 25 bp, mus musculus
ttgtgaggagccttcagtggcagat

SEQ ID NO: 71915 - DNA, 25 bp, mus musculus
tgaggagccttcagtggcagatgcg

SEQ ID NO: 71916 - DNA, 25 bp, mus musculus
actggtcaatcggcactatgccaag

SEQ ID NO: 71917 - DNA, 25 bp, mus musculus
tgccaagatcagcgactttggcctg

SEQ ID NO: 71918 - DNA, 25 bp, mus musculus
ctatggccagaagccctacaagaaa

SEQ ID NO: 71919 - DNA, 25 bp, mus musculus
cctggacttcatcaagcagggtaag

SEQ ID NO: 71920 - DNA, 25 bp, mus musculus
cttcatcaagcagggtaagaggatg

SEQ ID NO: 71921 - DNA, 25 bp, mus musculus
ggagtgtcctcctgagatgtatgca

SEQ ID NO: 71922 - DNA, 25 bp, mus musculus
tcctcctgagatgtatgcacttatg

SEQ ID NO: 71923 - DNA, 25 bp, mus musculus
cgacttcctgactgtggaacaacgt

SEQ ID NO: 71924 - DNA, 25 bp, mus musculus
gaactattactacagcccggccagc

SEQ ID NO: 71925 - DNA, 25 bp, mus musculus
cgaggctgcatgtggctgagcccaa

SEQ ID NO: 71926 - DNA, 25 bp, mus musculus
ctgtgttcaggagccctatcgactg

SEQ ID NO: 71927 - DNA, 25 bp, mus musculus
tcaggagccctatcgactgtcccat

SEQ ID NO: 71928 - DNA, 25 bp, mus musculus
tgacgacagctattacacagcccgg

SEQ ID NO: 71929 - DNA, 25 bp, mus musculus
ccctatcgactgtcccatgtgattc

SEQ ID NO: 71930 - DNA, 25 bp, mus musculus
cagctattacacagcccggtctgca

SEQ ID NO: 71931 - DNA, 25 bp, mus musculus
ttacacagcccggtctgcagggaag

SEQ ID NO: 71932 - DNA, 25 bp, mus musculus
agcccggtctgcagggaagtggcct

SEQ ID NO: 71933 - DNA, 25 bp, mus musculus
gtggcctctgaagtggtacgcgcca

SEQ ID NO: 71934 - DNA, 25 bp, mus musculus
agagtgcatcaactttcggaagttc

SEQ ID NO: 71935 - DNA, 25 bp, mus musculus
catcaactttcggaagttctccagc

SEQ ID NO: 71936 - DNA, 25 bp, mus musculus
gaagttctccagccgcagtgacgtc

SEQ ID NO: 71937 - DNA, 25 bp, mus musculus
tcgtggtctctatgactttgagcca

SEQ ID NO: 71938 - DNA, 25 bp, mus musculus
tctctatgactttgagccagaaaat

SEQ ID NO: 71939 - DNA, 25 bp, mus musculus
gtatttgcttcctgttgctaaaacg

SEQ ID NO: 71940 - DNA, 25 bp, mus musculus
gagtaaattgcgcccattcgaatgg

SEQ ID NO: 71941 - DNA, 25 bp, mus musculus
attgcgcccattcgaatggcctggg

SEQ ID NO: 71942 - DNA, 25 bp, mus musculus
cgaatggcctgggtagtccttgact

SEQ ID NO: 71943 - DNA, 25 bp, mus musculus
gtagtccttgactgcagtgggaacg

SEQ ID NO: 71944 - DNA, 25 bp, mus musculus
attattgatggcctctggtcttttc

SEQ ID NO: 71945 - DNA, 25 bp, mus musculus
gatggcctctggtcttttcctgttt

SEQ ID NO: 71946 - DNA, 25 bp, mus musculus
ttaagcttacctgtgaacagcccaa

SEQ ID NO: 71947 - DNA, 25 bp, mus musculus
ttacctgtgaacagcccaataaaca

SEQ ID NO: 71948 - DNA, 25 bp, mus musculus
gtgaacagcccaataaacatgacac

SEQ ID NO: 71949 - DNA, 25 bp, mus musculus
catcattacattaaccaatcagata

SEQ ID NO: 71950 - DNA, 25 bp, mus musculus
gcccaataaacatgacacactgtaa

SEQ ID NO: 71951 - DNA, 25 bp, mus musculus
tacattaaccaatcagatagatgaa

SEQ ID NO: 71952 - DNA, 25 bp, mus musculus
tgtgcctttacctccgtaaatgtgt

SEQ ID NO: 71953 - DNA, 25 bp, mus musculus
tcttttggacctaacttcagaactg

SEQ ID NO: 71954 - DNA, 25 bp, mus musculus
ggacctaacttcagaactgaaatga

SEQ ID NO: 71955 - DNA, 25 bp, mus musculus
ctcagtgtggtgttctgtgacatcc

SEQ ID NO: 71956 - DNA, 25 bp, mus musculus
ctctggcccacttaatcacttttgt

SEQ ID NO: 71957 - DNA, 25 bp, mus musculus
actgatttctttgtcctaactcata

SEQ ID NO: 71958 - DNA, 25 bp, mus musculus
ggttctgtttactcagccgaatgtg

SEQ ID NO: 71959 - DNA, 25 bp, mus musculus
gtttactcagccgaatgtggagctg

SEQ ID NO: 71960 - DNA, 25 bp, mus musculus
cgaggactacctcgatgacgaagac

SEQ ID NO: 71961 - DNA, 25 bp, mus musculus
ctacctcgatgacgaagactcagac

SEQ ID NO: 71962 - DNA, 25 bp, mus musculus
gccgctttgattgttgcctaaactt

SEQ ID NO: 71963 - DNA, 25 bp, mus musculus
gagcctgggttgtttgccagaagag

SEQ ID NO: 71964 - DNA, 25 bp, mus musculus
atgagcgcgacactgctgcactgtg

SEQ ID NO: 71965 - DNA, 25 bp, mus musculus
gcgacactgctgcactgtgatctgt

SEQ ID NO: 71966 - DNA, 25 bp, mus musculus
acactgctgcactgtgatctgtgag

SEQ ID NO: 71967 - DNA, 25 bp, mus musculus
ctgctgcactgtgatctgtgaggag

SEQ ID NO: 71968 - DNA, 25 bp, mus musculus
cgccttgccaataagtgaagagata

SEQ ID NO: 71969 - DNA, 25 bp, mus musculus
atacatatatgctcaccagggtaaa

SEQ ID NO: 71970 - DNA, 25 bp, mus musculus
tcagccgaatgtggagctgaaccag

SEQ ID NO: 71971 - DNA, 25 bp, mus musculus
tgcagacattgtccagttgctactg

SEQ ID NO: 71972 - DNA, 25 bp, mus musculus
agacattgtccagttgctactggca

SEQ ID NO: 71973 - DNA, 25 bp, mus musculus
tgtccagttgctactggcaaaaggt

SEQ ID NO: 71974 - DNA, 25 bp, mus musculus
ggacatggccaccaacgctgcctgt

SEQ ID NO: 71975 - DNA, 25 bp, mus musculus
caacgctgcctgtgcatcgctcctg

SEQ ID NO: 71976 - DNA, 25 bp, mus musculus
tgcctgtgcatcgctcctgaagaag

SEQ ID NO: 71977 - DNA, 25 bp, mus musculus
tgcatcgctcctgaagaagaagcag

SEQ ID NO: 71978 - DNA, 25 bp, mus musculus
gatcccaaacccagagtctcaatac

SEQ ID NO: 71979 - DNA, 25 bp, mus musculus
caaacacagagatacactggactcc

SEQ ID NO: 71980 - DNA, 25 bp, mus musculus
tctcccggcgaactcagaaatttgg

SEQ ID NO: 71981 - DNA, 25 bp, mus musculus
ttgggacattccctggaaattatgt

SEQ ID NO: 71982 - DNA, 25 bp, mus musculus
ggacattccctggaaattatgtagc

SEQ ID NO: 71983 - DNA, 25 bp, mus musculus
gaaattatgtagccccagtgtgagt

SEQ ID NO: 71984 - DNA, 25 bp, mus musculus
cagtttggagccaacgaggatcggg

SEQ ID NO: 71985 - DNA, 25 bp, mus musculus
tgtgctcccagcttctgcagagacc

SEQ ID NO: 71986 - DNA, 25 bp, mus musculus
tgcagagaccccagcaactttccct

SEQ ID NO: 71987 - DNA, 25 bp, mus musculus
tccaagcctccttgaagtccgattc

SEQ ID NO: 71988 - DNA, 25 bp, mus musculus
ccgcaagtcacaggcattcctttga

SEQ ID NO: 71989 - DNA, 25 bp, mus musculus
gtcacaggcattcctttgacagccc

SEQ ID NO: 71990 - DNA, 25 bp, mus musculus
cagagatacactggactccgtaccg

SEQ ID NO: 71991 - DNA, 25 bp, mus musculus
tacagacatctgctttcatgtgggc

SEQ ID NO: 71992 - DNA, 25 bp, mus musculus
tacactggactccgtaccgggccat

SEQ ID NO: 71993 - DNA, 25 bp, mus musculus
cgtaccgggccatgtaccagtacag

SEQ ID NO: 71994 - DNA, 25 bp, mus musculus
tgtaccagtacaggccccagaatga

SEQ ID NO: 71995 - DNA, 25 bp, mus musculus
accagtacaggccccagaatgagga

SEQ ID NO: 71996 - DNA, 25 bp, mus musculus
agtacaggccccagaatgaggacga

SEQ ID NO: 71997 - DNA, 25 bp, mus musculus
acgatggctggtttgtgggtgtctc

SEQ ID NO: 71998 - DNA, 25 bp, mus musculus
gtgtctcccggcgaactcagaaatt

SEQ ID NO: 71999 - DNA, 25 bp, mus musculus
atctttgtgcagagccccaactgta

SEQ ID NO: 72000 - DNA, 25 bp, mus musculus
gtgcagagccccaactgtaaccaga

SEQ ID NO: 72001 - DNA, 25 bp, mus musculus
ttaactcagatgggatccccttcag

SEQ ID NO: 72002 - DNA, 25 bp, mus musculus
agcatgtcgtaaacccatcaaagac

SEQ ID NO: 72003 - DNA, 25 bp, mus musculus
tcgtaaacccatcaaagactcgctg

SEQ ID NO: 72004 - DNA, 25 bp, mus musculus
caaagactcgctgtaacagctcctc

SEQ ID NO: 72005 - DNA, 25 bp, mus musculus
ctcgctgtaacagctcctccgtcgt

SEQ ID NO: 72006 - DNA, 25 bp, mus musculus
gctcctccgtcgtagtattcatgta

SEQ ID NO: 72007 - DNA, 25 bp, mus musculus
atgatcccgtggactgtttgctatc

SEQ ID NO: 72008 - DNA, 25 bp, mus musculus
cacttgaggtctcatcagttaaagc

SEQ ID NO: 72009 - DNA, 25 bp, mus musculus
aggtctcatcagttaaagcaccttg

SEQ ID NO: 72010 - DNA, 25 bp, mus musculus
ttaaagcaccttgtggaatctgttt

SEQ ID NO: 72011 - DNA, 25 bp, mus musculus
agatacggctggcaccctgcaacag

SEQ ID NO: 72012 - DNA, 25 bp, mus musculus
aagatcccaccaggctgtaacctga

SEQ ID NO: 72013 - DNA, 25 bp, mus musculus
ccaccaggctgtaacctgaagatct

SEQ ID NO: 72014 - DNA, 25 bp, mus musculus
ttcaacaaccaagaatttgctgctc

SEQ ID NO: 72015 - DNA, 25 bp, mus musculus
gctcagtctgtcaaccagggttttg

SEQ ID NO: 72016 - DNA, 25 bp, mus musculus
tctgtcaaccagggttttgaagccg

SEQ ID NO: 72017 - DNA, 25 bp, mus musculus
cagctaacccgaatgtgcaccataa

SEQ ID NO: 72018 - DNA, 25 bp, mus musculus
agtactccttgctggattgaacttc

SEQ ID NO: 72019 - DNA, 25 bp, mus musculus
gcatctctcccgtggattctgctcg

SEQ ID NO: 72020 - DNA, 25 bp, mus musculus
ccgtggattctgctcggagcctgcc

SEQ ID NO: 72021 - DNA, 25 bp, mus musculus
tgctgcaaactcttcaggactgcca

SEQ ID NO: 72022 - DNA, 25 bp, mus musculus
aaactcttcaggactgccaagcaga

SEQ ID NO: 72023 - DNA, 25 bp, mus musculus
ttcaggactgccaagcagaacccac

SEQ ID NO: 72024 - DNA, 25 bp, mus musculus
gccaagcagaacccactgaccgaga

SEQ ID NO: 72025 - DNA, 25 bp, mus musculus
aacacgatcatcctcatcatcggcg

SEQ ID NO: 72026 - DNA, 25 bp, mus musculus
atcttgtgcttcacgccctaccacg

SEQ ID NO: 72027 - DNA, 25 bp, mus musculus
ttgtgcttcacgccctaccacgtgg

SEQ ID NO: 72028 - DNA, 25 bp, mus musculus
ccctaccacgtggccattatgcagc

SEQ ID NO: 72029 - DNA, 25 bp, mus musculus
taccacgtggccattatgcagcaca

SEQ ID NO: 72030 - DNA, 25 bp, mus musculus
attatgcagcacatggtgaagactc

SEQ ID NO: 72031 - DNA, 25 bp, mus musculus
tggattctgctcggagcctgcctgc

SEQ ID NO: 72032 - DNA, 25 bp, mus musculus
gcctgcctgctaggctacgtgctgc

SEQ ID NO: 72033 - DNA, 25 bp, mus musculus
gccatcattctcctgtgctactctc

SEQ ID NO: 72034 - DNA, 25 bp, mus musculus
atcattctcctgtgctactctcaga

SEQ ID NO: 72035 - DNA, 25 bp, mus musculus
attctcctgtgctactctcagatct

SEQ ID NO: 72036 - DNA, 25 bp, mus musculus
tgctactctcagatctgctgcaaac

SEQ ID NO: 72037 - DNA, 25 bp, mus musculus
tactctcagatctgctgcaaactct

SEQ ID NO: 72038 - DNA, 25 bp, mus musculus
atctgctgcaaactcttcaggactg

SEQ ID NO: 72039 - DNA, 25 bp, mus musculus
ctttcagatctacccgacaacagcc

SEQ ID NO: 72040 - DNA, 25 bp, mus musculus
gatctacccgacaacagccttctag

SEQ ID NO: 72041 - DNA, 25 bp, mus musculus
accacatactgacttcacagctgaa

SEQ ID NO: 72042 - DNA, 25 bp, mus musculus
tactgacttcacagctgaagatgtt

SEQ ID NO: 72043 - DNA, 25 bp, mus musculus
agccatttcctagcccaatgataag

SEQ ID NO: 72044 - DNA, 25 bp, mus musculus
ttcctagcccaatgataaggagatt

SEQ ID NO: 72045 - DNA, 25 bp, mus musculus
tgcagctcttcttagcctttaacct

SEQ ID NO: 72046 - DNA, 25 bp, mus musculus
ttattgtctggggctgctctgccat

SEQ ID NO: 72047 - DNA, 25 bp, mus musculus
gctgctctgccatatcgagaacatt

SEQ ID NO: 72048 - DNA, 25 bp, mus musculus
ctgccatatcgagaacattaacttc

SEQ ID NO: 72049 - DNA, 25 bp, mus musculus
gaacattaacttcctgacagaactg

SEQ ID NO: 72050 - DNA, 25 bp, mus musculus
gctaaaatcccattcttaaatgatg

SEQ ID NO: 72051 - DNA, 25 bp, mus musculus
tagcccctaagaattactcagagac

SEQ ID NO: 72052 - DNA, 25 bp, mus musculus
ttcctaccaattccagggctgatca

SEQ ID NO: 72053 - DNA, 25 bp, mus musculus
ccaattccagggctgatcaaaggtg

SEQ ID NO: 72054 - DNA, 25 bp, mus musculus
gcacaacatctagcaaacggatgtc

SEQ ID NO: 72055 - DNA, 25 bp, mus musculus
atgacgatgaccctttcatgagcag

SEQ ID NO: 72056 - DNA, 25 bp, mus musculus
atgaccctttcatgagcagtagttg

SEQ ID NO: 72057 - DNA, 25 bp, mus musculus
ctttcatgagcagtagttgcccaag

SEQ ID NO: 72058 - DNA, 25 bp, mus musculus
caaagcaccacatactgacttcaca

SEQ ID NO: 72059 - DNA, 25 bp, mus musculus
atgccaagtggcgactccggctggg

SEQ ID NO: 72060 - DNA, 25 bp, mus musculus
ctccggctgggcgtcattgaataca

SEQ ID NO: 72061 - DNA, 25 bp, mus musculus
atgctatccgtgaggctgccaccag

SEQ ID NO: 72062 - DNA, 25 bp, mus musculus
gctatccgtgaggctgccaccagca

SEQ ID NO: 72063 - DNA, 25 bp, mus musculus
tatccgtgaggctgccaccagcaac

SEQ ID NO: 72064 - DNA, 25 bp, mus musculus
tgaggctgccaccagcaacgttaag

SEQ ID NO: 72065 - DNA, 25 bp, mus musculus
aggctgccaccagcaacgttaagag

SEQ ID NO: 72066 - DNA, 25 bp, mus musculus
gctgccaccagcaacgttaagagat

SEQ ID NO: 72067 - DNA, 25 bp, mus musculus
ccaccagcaacgttaagagattagt

SEQ ID NO: 72068 - DNA, 25 bp, mus musculus
ggagacccgagctacctgcaccgaa

SEQ ID NO: 72069 - DNA, 25 bp, mus musculus
acccgagctacctgcaccgaatgac

SEQ ID NO: 72070 - DNA, 25 bp, mus musculus
ccgagctacctgcaccgaatgacta

SEQ ID NO: 72071 - DNA, 25 bp, mus musculus
aaacgctttgtgtatggcctggcta

SEQ ID NO: 72072 - DNA, 25 bp, mus musculus
gaatgactacactcgtctgcatcga

SEQ ID NO: 72073 - DNA, 25 bp, mus musculus
tgtgtatggcctggctagtggatca

SEQ ID NO: 72074 - DNA, 25 bp, mus musculus
tgtatggcctggctagtggatcatg

SEQ ID NO: 72075 - DNA, 25 bp, mus musculus
tatggcctggctagtggatcatgtc

SEQ ID NO: 72076 - DNA, 25 bp, mus musculus
gatcatgtctatgctatccgtgagg

SEQ ID NO: 72077 - DNA, 25 bp, mus musculus
tcatgtctatgctatccgtgaggct

SEQ ID NO: 72078 - DNA, 25 bp, mus musculus
atgtctatgctatccgtgaggctgc

SEQ ID NO: 72079 - DNA, 25 bp, mus musculus
ctatgctatccgtgaggctgccacc

SEQ ID NO: 72080 - DNA, 25 bp, mus musculus
ccttggagctcaggcacactctcgc

SEQ ID NO: 72081 - DNA, 25 bp, mus musculus
agctcaggcacactctcgcatctaa

SEQ ID NO: 72082 - DNA, 25 bp, mus musculus
cccaccaggaccacaaatgctgaga

SEQ ID NO: 72083 - DNA, 25 bp, mus musculus
acagacttgccagtaggacctgacc

SEQ ID NO: 72084 - DNA, 25 bp, mus musculus
cctgaccatgaccttagtggactga

SEQ ID NO: 72085 - DNA, 25 bp, mus musculus
ggactgactactattcttcctggac

SEQ ID NO: 72086 - DNA, 25 bp, mus musculus
actactattcttcctggacaacatt

SEQ ID NO: 72087 - DNA, 25 bp, mus musculus
attcttcctggacaacatttctctg

SEQ ID NO: 72088 - DNA, 25 bp, mus musculus
ttctctgagctgcatttccccaatc

SEQ ID NO: 72089 - DNA, 25 bp, mus musculus
catttccccaatctgtgttctactc

SEQ ID NO: 72090 - DNA, 25 bp, mus musculus
tctggacttcctaagctcctgattt

SEQ ID NO: 72091 - DNA, 25 bp, mus musculus
cttgctctgagacccctctgaatcc

SEQ ID NO: 72092 - DNA, 25 bp, mus musculus
ggcacactctcgcatctaagggaga

SEQ ID NO: 72093 - DNA, 25 bp, mus musculus
ctctcgcatctaagggagagtgcat

SEQ ID NO: 72094 - DNA, 25 bp, mus musculus
gtgccttttggggccatactctctt

SEQ ID NO: 72095 - DNA, 25 bp, mus musculus
tttggggccatactctcttctatat

SEQ ID NO: 72096 - DNA, 25 bp, mus musculus
actgtgaaagccatccgtttcagaa

SEQ ID NO: 72097 - DNA, 25 bp, mus musculus
aattcatacagcataaaggatttct

SEQ ID NO: 72098 - DNA, 25 bp, mus musculus
ggtgtattcccatacatgacagtgc

SEQ ID NO: 72099 - DNA, 25 bp, mus musculus
ttcccatacatgacagtgcccacca

SEQ ID NO: 72100 - DNA, 25 bp, mus musculus
atttcaagcattgctgttatgtctc

SEQ ID NO: 72101 - DNA, 25 bp, mus musculus
agcattgctgttatgtctcagaaaa

SEQ ID NO: 72102 - DNA, 25 bp, mus musculus
catatgacacctagtgagcttttaa

SEQ ID NO: 72103 - DNA, 25 bp, mus musculus
gaacactgctggtttcattttcgta

SEQ ID NO: 72104 - DNA, 25 bp, mus musculus
cactgctggtttcattttcgtaatc

SEQ ID NO: 72105 - DNA, 25 bp, mus musculus
tgctggtttcattttcgtaatcacc

SEQ ID NO: 72106 - DNA, 25 bp, mus musculus
tttcattttcgtaatcaccagtggg

SEQ ID NO: 72107 - DNA, 25 bp, mus musculus
ggcgtctgatcatcctggttgttat

SEQ ID NO: 72108 - DNA, 25 bp, mus musculus
gtctgatcatcctggttgttatgtg

SEQ ID NO: 72109 - DNA, 25 bp, mus musculus
tgatcatcctggttgttatgtgata

SEQ ID NO: 72110 - DNA, 25 bp, mus musculus
tcatcctggttgttatgtgatagat

SEQ ID NO: 72111 - DNA, 25 bp, mus musculus
agatggctcacattgatttgtgatt

SEQ ID NO: 72112 - DNA, 25 bp, mus musculus
attgctgttatgtctcagaaaagca

SEQ ID NO: 72113 - DNA, 25 bp, mus musculus
cattataaacgcttattgtaagaat

SEQ ID NO: 72114 - DNA, 25 bp, mus musculus
cgtaaagcagtaccttgccaaagag

SEQ ID NO: 72115 - DNA, 25 bp, mus musculus
gcagtaccttgccaaagagataaga

SEQ ID NO: 72116 - DNA, 25 bp, mus musculus
gtaccttgccaaagagataagagcc

SEQ ID NO: 72117 - DNA, 25 bp, mus musculus
aaatctcttcatatgacacctagtg

SEQ ID NO: 72118 - DNA, 25 bp, mus musculus
tctcttcatatgacacctagtgagc

SEQ ID NO: 72119 - DNA, 25 bp, mus musculus
cttcatatgacacctagtgagcttt

SEQ ID NO: 72120 - DNA, 25 bp, mus musculus
ctgggtctcctctaccagaaggcct

SEQ ID NO: 72121 - DNA, 25 bp, mus musculus
ctcctctaccagaaggcctgctcag

SEQ ID NO: 72122 - DNA, 25 bp, mus musculus
ctggtcctggacttcaatgtccgag

SEQ ID NO: 72123 - DNA, 25 bp, mus musculus
gtccgagaggccttctccagcagag

SEQ ID NO: 72124 - DNA, 25 bp, mus musculus
ttctccagcagagcctcactccttg

SEQ ID NO: 72125 - DNA, 25 bp, mus musculus
gcctcactccttgggccaggatttg

SEQ ID NO: 72126 - DNA, 25 bp, mus musculus
atatggattccagctctgctcccag

SEQ ID NO: 72127 - DNA, 25 bp, mus musculus
attccagctctgctcccagctttaa

SEQ ID NO: 72128 - DNA, 25 bp, mus musculus
gctctgctcccagctttaaggctga

SEQ ID NO: 72129 - DNA, 25 bp, mus musculus
ctcctggtcccagctctactggggc

SEQ ID NO: 72130 - DNA, 25 bp, mus musculus
gctctactggggccctcttgaccag

SEQ ID NO: 72131 - DNA, 25 bp, mus musculus
actcttgaactcaataaacagtggc

SEQ ID NO: 72132 - DNA, 25 bp, mus musculus
taccagaaggcctgctcagccttcc

SEQ ID NO: 72133 - DNA, 25 bp, mus musculus
ctcagccagcacaatgtgagcatgg

SEQ ID NO: 72134 - DNA, 25 bp, mus musculus
agcatggacatagccactttcaaga

SEQ ID NO: 72135 - DNA, 25 bp, mus musculus
ttcaagaggctgcaggtggattccc

SEQ ID NO: 72136 - DNA, 25 bp, mus musculus
attgtggacctgaagaccgaggagg

SEQ ID NO: 72137 - DNA, 25 bp, mus musculus
gataaaagccctgtccgtgactggc

SEQ ID NO: 72138 - DNA, 25 bp, mus musculus
ggcatccccaatggctacctggtcc

SEQ ID NO: 72139 - DNA, 25 bp, mus musculus
ggctacctggtcctggacttcaatg

SEQ ID NO: 72140 - DNA, 25 bp, mus musculus
acattgatgcacagacggagagtaa

SEQ ID NO: 72141 - DNA, 25 bp, mus musculus
ttgatgcacagacggagagtaacca

SEQ ID NO: 72142 - DNA, 25 bp, mus musculus
ctccgctcatcttggctgctacagc

SEQ ID NO: 72143 - DNA, 25 bp, mus musculus
cgctcatcttggctgctacagctgg

SEQ ID NO: 72144 - DNA, 25 bp, mus musculus
tcttggctgctacagctggtcatgt

SEQ ID NO: 72145 - DNA, 25 bp, mus musculus
tggctgctacagctggtcatgttgg

SEQ ID NO: 72146 - DNA, 25 bp, mus musculus
cagctggtcatgttggtgttgtaga

SEQ ID NO: 72147 - DNA, 25 bp, mus musculus
acattgaagcccaatcagaaagaac

SEQ ID NO: 72148 - DNA, 25 bp, mus musculus
ttgaagcccaatcagaaagaaccaa

SEQ ID NO: 72149 - DNA, 25 bp, mus musculus
aggacacaccactgtccttggcttg

SEQ ID NO: 72150 - DNA, 25 bp, mus musculus
acacaccactgtccttggcttgttc

SEQ ID NO: 72151 - DNA, 25 bp, mus musculus
cactgtccttggcttgttctggggg

SEQ ID NO: 72152 - DNA, 25 bp, mus musculus
gtaaccatgataccgcactgacact

SEQ ID NO: 72153 - DNA, 25 bp, mus musculus
accatgataccgcactgacacttgc

SEQ ID NO: 72154 - DNA, 25 bp, mus musculus
atgataccgcactgacacttgcctg

SEQ ID NO: 72155 - DNA, 25 bp, mus musculus
tgacacttgcctgtgcaggtggcca

SEQ ID NO: 72156 - DNA, 25 bp, mus musculus
ttgcctgtgcaggtggccatgagga

SEQ ID NO: 72157 - DNA, 25 bp, mus musculus
aactggtgcagacactgctagaaag

SEQ ID NO: 72158 - DNA, 25 bp, mus musculus
tgcagacactgctagaaagaggagc

SEQ ID NO: 72159 - DNA, 25 bp, mus musculus
ttactccgctcatcttggctgctac

SEQ ID NO: 72160 - DNA, 25 bp, mus musculus
tcgagcttctcagatctctcgtgtt

SEQ ID NO: 72161 - DNA, 25 bp, mus musculus
tcagatctctcgtgttctttacgaa

SEQ ID NO: 72162 - DNA, 25 bp, mus musculus
agcaaaggggctcttcctgtacagt

SEQ ID NO: 72163 - DNA, 25 bp, mus musculus
cctgtacagtgtggcttgcagctct

SEQ ID NO: 72164 - DNA, 25 bp, mus musculus
ccgactgtcaactcaaccgtggctg

SEQ ID NO: 72165 - DNA, 25 bp, mus musculus
gtcaactcaaccgtggctgatcatc

SEQ ID NO: 72166 - DNA, 25 bp, mus musculus
gtggctgatcatcgcatcgtttgaa

SEQ ID NO: 72167 - DNA, 25 bp, mus musculus
gctgatcatcgcatcgtttgaatga

SEQ ID NO: 72168 - DNA, 25 bp, mus musculus
gatcatcgcatcgtttgaatgaact

SEQ ID NO: 72169 - DNA, 25 bp, mus musculus
aaaccatgaaagtcacttgtatcac

SEQ ID NO: 72170 - DNA, 25 bp, mus musculus
tgaaagtcacttgtatcacggctca

SEQ ID NO: 72171 - DNA, 25 bp, mus musculus
tcacttgtatcacggctcaaagagt

SEQ ID NO: 72172 - DNA, 25 bp, mus musculus
gatctctcgtgttctttacgaaatg

SEQ ID NO: 72173 - DNA, 25 bp, mus musculus
ctctcgtgttctttacgaaatgaat

SEQ ID NO: 72174 - DNA, 25 bp, mus musculus
gaatgcaattggccctggtaacaag

SEQ ID NO: 72175 - DNA, 25 bp, mus musculus
tgcaattggccctggtaacaaggtg

SEQ ID NO: 72176 - DNA, 25 bp, mus musculus
gtttcagtgcttggttggaaatatt

SEQ ID NO: 72177 - DNA, 25 bp, mus musculus
ctgactcggcagtatttatagggct

SEQ ID NO: 72178 - DNA, 25 bp, mus musculus
tgtctgtggtccagaggaagttatt

SEQ ID NO: 72179 - DNA, 25 bp, mus musculus
atctccagcaaaggggctcttcctg

SEQ ID NO: 72180 - DNA, 25 bp, mus musculus
aacttaatccctgatgacagagcca

SEQ ID NO: 72181 - DNA, 25 bp, mus musculus
gatgacagagccaacttctacccac

SEQ ID NO: 72182 - DNA, 25 bp, mus musculus
cttgctgcctagccagtaagggtcc

SEQ ID NO: 72183 - DNA, 25 bp, mus musculus
ccagtaagggtcccatctggcttca

SEQ ID NO: 72184 - DNA, 25 bp, mus musculus
ccatctggcttcaagaaaagctctg

SEQ ID NO: 72185 - DNA, 25 bp, mus musculus
agctctggctgtcattgaccatggg

SEQ ID NO: 72186 - DNA, 25 bp, mus musculus
ggctgtcattgaccatgggagagag

SEQ ID NO: 72187 - DNA, 25 bp, mus musculus
ggctggcacatggctgcagatccag

SEQ ID NO: 72188 - DNA, 25 bp, mus musculus
cacatggctgcagatccagctcagc

SEQ ID NO: 72189 - DNA, 25 bp, mus musculus
gctgcagatccagctcagcccaggt

SEQ ID NO: 72190 - DNA, 25 bp, mus musculus
gctcagcccaggtctcatggtctcc

SEQ ID NO: 72191 - DNA, 25 bp, mus musculus
tgccatgtctgagctgtggacctat

SEQ ID NO: 72192 - DNA, 25 bp, mus musculus
agagccaacttctacccactgcagc

SEQ ID NO: 72193 - DNA, 25 bp, mus musculus
tacccactgcagcagaccaatgtgt

SEQ ID NO: 72194 - DNA, 25 bp, mus musculus
ctgcagcagaccaatgtgtatacaa

SEQ ID NO: 72195 - DNA, 25 bp, mus musculus
gcctcacctggacagcgctgtttcc

SEQ ID NO: 72196 - DNA, 25 bp, mus musculus
cagcgctgtttccccaacagctgat

SEQ ID NO: 72197 - DNA, 25 bp, mus musculus
cttcccgaggcagagaagagtggaa

SEQ ID NO: 72198 - DNA, 25 bp, mus musculus
tctgcactgggccaagaacttgctg

SEQ ID NO: 72199 - DNA, 25 bp, mus musculus
caagaacttgctgcctagccagtaa

SEQ ID NO: 72200 - DNA, 25 bp, mus musculus
gtccaagacacctcagggacctact

SEQ ID NO: 72201 - DNA, 25 bp, mus musculus
tccaagacacctcagggacctacta

SEQ ID NO: 72202 - DNA, 25 bp, mus musculus
ctactactggcacatcccaacaggg

SEQ ID NO: 72203 - DNA, 25 bp, mus musculus
tactactggcacatcccaacaggga

SEQ ID NO: 72204 - DNA, 25 bp, mus musculus
tactggcacatcccaacagggacca

SEQ ID NO: 72205 - DNA, 25 bp, mus musculus
actggcacatcccaacagggaccac

SEQ ID NO: 72206 - DNA, 25 bp, mus musculus
acatcccaacagggaccacccagtg

SEQ ID NO: 72207 - DNA, 25 bp, mus musculus
catcccaacagggaccacccagtgg

SEQ ID NO: 72208 - DNA, 25 bp, mus musculus
gaacagtccccaagaagagtcccag

SEQ ID NO: 72209 - DNA, 25 bp, mus musculus
acagtccccaagaagagtcccagct

SEQ ID NO: 72210 - DNA, 25 bp, mus musculus
cagtccccaagaagagtcccagctc

SEQ ID NO: 72211 - DNA, 25 bp, mus musculus
agtccccaagaagagtcccagctca

SEQ ID NO: 72212 - DNA, 25 bp, mus musculus
acacctcagggacctactactggca

SEQ ID NO: 72213 - DNA, 25 bp, mus musculus
acctcagggacctactactggcaca

SEQ ID NO: 72214 - DNA, 25 bp, mus musculus
ctcagggacctactactggcacatc

SEQ ID NO: 72215 - DNA, 25 bp, mus musculus
tcagggacctactactggcacatcc

SEQ ID NO: 72216 - DNA, 25 bp, mus musculus
gggacctactactggcacatcccaa

SEQ ID NO: 72217 - DNA, 25 bp, mus musculus
ggacctactactggcacatcccaac

SEQ ID NO: 72218 - DNA, 25 bp, mus musculus
gacctactactggcacatcccaaca

SEQ ID NO: 72219 - DNA, 25 bp, mus musculus
cctactactggcacatcccaacagg

SEQ ID NO: 72220 - DNA, 25 bp, mus musculus
ctgacctgttgctgtgactagctag

SEQ ID NO: 72221 - DNA, 25 bp, mus musculus
tgttgctgtgactagctagatgggt

SEQ ID NO: 72222 - DNA, 25 bp, mus musculus
agcatgacctgacattgacaccaaa

SEQ ID NO: 72223 - DNA, 25 bp, mus musculus
acctgacattgacaccaaatacaaa

SEQ ID NO: 72224 - DNA, 25 bp, mus musculus
atacaaatacgatttctttgcagtg

SEQ ID NO: 72225 - DNA, 25 bp, mus musculus
tttctttgcagtgaacttgggttgt

SEQ ID NO: 72226 - DNA, 25 bp, mus musculus
tcctgtgcttttcttgtgttgggag

SEQ ID NO: 72227 - DNA, 25 bp, mus musculus
gtcttcctcttaggcctcttacatg

SEQ ID NO: 72228 - DNA, 25 bp, mus musculus
ctcttaggcctcttacatgagagtg

SEQ ID NO: 72229 - DNA, 25 bp, mus musculus
ggcctcttacatgagagtgttgagc

SEQ ID NO: 72230 - DNA, 25 bp, mus musculus
gttgagcccacaatgaacagtggtt

SEQ ID NO: 72231 - DNA, 25 bp, mus musculus
ttactttgctagaacaacaaactat

SEQ ID NO: 72232 - DNA, 25 bp, mus musculus
aaaccagagattccacacatgctag

SEQ ID NO: 72233 - DNA, 25 bp, mus musculus
gagattccacacatgctagcaagca

SEQ ID NO: 72234 - DNA, 25 bp, mus musculus
ccacacatgctagcaagcaagcaag

SEQ ID NO: 72235 - DNA, 25 bp, mus musculus
aagcaagctgtcactgggctgcagc

SEQ ID NO: 72236 - DNA, 25 bp, mus musculus
ctgcagccccaacaagactgacatt

SEQ ID NO: 72237 - DNA, 25 bp, mus musculus
ccccaacaagactgacatttctgga

SEQ ID NO: 72238 - DNA, 25 bp, mus musculus
tgacatttctggatgcatctgtatt

SEQ ID NO: 72239 - DNA, 25 bp, mus musculus
aaccaaagcatgacctgacattgac

SEQ ID NO: 72240 - DNA, 25 bp, mus musculus
tctcatacagatcaaggacgcctta

SEQ ID NO: 72241 - DNA, 25 bp, mus musculus
acagatcaaggacgccttaagagat

SEQ ID NO: 72242 - DNA, 25 bp, mus musculus
agacctgaacacaggggagccgatg

SEQ ID NO: 72243 - DNA, 25 bp, mus musculus
ttgcacggtgattgccaccaacatc

SEQ ID NO: 72244 - DNA, 25 bp, mus musculus
caacatcctcctggttgatgaaatt

SEQ ID NO: 72245 - DNA, 25 bp, mus musculus
gatgtcttctcttagagactgattg

SEQ ID NO: 72246 - DNA, 25 bp, mus musculus
gaattccaaatcaattcatctggaa

SEQ ID NO: 72247 - DNA, 25 bp, mus musculus
caaatcaattcatctggaagacaag

SEQ ID NO: 72248 - DNA, 25 bp, mus musculus
aattcatctggaagacaagatttta

SEQ ID NO: 72249 - DNA, 25 bp, mus musculus
atacgtgtcatacccagcagcgtca

SEQ ID NO: 72250 - DNA, 25 bp, mus musculus
gtcatacccagcagcgtcacatggc

SEQ ID NO: 72251 - DNA, 25 bp, mus musculus
cccagcagcgtcacatggccttaac

SEQ ID NO: 72252 - DNA, 25 bp, mus musculus
tggactccgtgcggtcaaaaatgct

SEQ ID NO: 72253 - DNA, 25 bp, mus musculus
agaagctcttgttaactacaagcac

SEQ ID NO: 72254 - DNA, 25 bp, mus musculus
taactacaagcaccgtgtgcaggga

SEQ ID NO: 72255 - DNA, 25 bp, mus musculus
caagcaccgtgtgcagggaagagtt

SEQ ID NO: 72256 - DNA, 25 bp, mus musculus
ggggatccaagcctttgctgatgcc

SEQ ID NO: 72257 - DNA, 25 bp, mus musculus
cccgaaggttcttgctcagaattct

SEQ ID NO: 72258 - DNA, 25 bp, mus musculus
aattcaaactaaacatgccgaatca

SEQ ID NO: 72259 - DNA, 25 bp, mus musculus
actcctgggcatagacctgaacaca

SEQ ID NO: 72260 - DNA, 25 bp, mus musculus
aaattgactgtgtccagggcaagga

SEQ ID NO: 72261 - DNA, 25 bp, mus musculus
tgactgtgtccagggcaaggaagat

SEQ ID NO: 72262 - DNA, 25 bp, mus musculus
acagccattccaggttgctgaggtc

SEQ ID NO: 72263 - DNA, 25 bp, mus musculus
agccattccaggttgctgaggtctt

SEQ ID NO: 72264 - DNA, 25 bp, mus musculus
attccaggttgctgaggtcttcaca

SEQ ID NO: 72265 - DNA, 25 bp, mus musculus
ggttgctgaggtcttcacaggtcac

SEQ ID NO: 72266 - DNA, 25 bp, mus musculus
ttgctgaggtcttcacaggtcacat

SEQ ID NO: 72267 - DNA, 25 bp, mus musculus
tgaggtcttcacaggtcacatggga

SEQ ID NO: 72268 - DNA, 25 bp, mus musculus
aggtcttcacaggtcacatgggaaa

SEQ ID NO: 72269 - DNA, 25 bp, mus musculus
gtcttcacaggtcacatgggaaagc

SEQ ID NO: 72270 - DNA, 25 bp, mus musculus
cttcacaggtcacatgggaaagctg

SEQ ID NO: 72271 - DNA, 25 bp, mus musculus
tcacaggtcacatgggaaagctggt

SEQ ID NO: 72272 - DNA, 25 bp, mus musculus
actgtgtccagggcaaggaagatac

SEQ ID NO: 72273 - DNA, 25 bp, mus musculus
aagatacagcgcttcttgtcacagc

SEQ ID NO: 72274 - DNA, 25 bp, mus musculus
gatacagcgcttcttgtcacagcca

SEQ ID NO: 72275 - DNA, 25 bp, mus musculus
tacagcgcttcttgtcacagccatt

SEQ ID NO: 72276 - DNA, 25 bp, mus musculus
cagcgcttcttgtcacagccattcc

SEQ ID NO: 72277 - DNA, 25 bp, mus musculus
gcttcttgtcacagccattccaggt

SEQ ID NO: 72278 - DNA, 25 bp, mus musculus
cttgtcacagccattccaggttgct

SEQ ID NO: 72279 - DNA, 25 bp, mus musculus
tgtcacagccattccaggttgctga

SEQ ID NO: 72280 - DNA, 25 bp, mus musculus
atggctgcgctcacccggaacccgg

SEQ ID NO: 72281 - DNA, 25 bp, mus musculus
aacccggagttccagaagctgctgg

SEQ ID NO: 72282 - DNA, 25 bp, mus musculus
gagcgcttcaaccacttcagcttga

SEQ ID NO: 72283 - DNA, 25 bp, mus musculus
cgcttcaaccacttcagcttgaacc

SEQ ID NO: 72284 - DNA, 25 bp, mus musculus
ttcaaccacttcagcttgaacctca

SEQ ID NO: 72285 - DNA, 25 bp, mus musculus
cacttcagcttgaacctcaacacca

SEQ ID NO: 72286 - DNA, 25 bp, mus musculus
agcttgaacctcaacaccaaccatg

SEQ ID NO: 72287 - DNA, 25 bp, mus musculus
ctcaacaccaaccatggacatattc

SEQ ID NO: 72288 - DNA, 25 bp, mus musculus
aacaccaaccatggacatattctgt

SEQ ID NO: 72289 - DNA, 25 bp, mus musculus
ttggattactccaagaaccttgtga

SEQ ID NO: 72290 - DNA, 25 bp, mus musculus
tactccaagaaccttgtgaacaagg

SEQ ID NO: 72291 - DNA, 25 bp, mus musculus
atgctggtggacctggccaagtcca

SEQ ID NO: 72292 - DNA, 25 bp, mus musculus
gagttccagaagctgctggagtggc

SEQ ID NO: 72293 - DNA, 25 bp, mus musculus
tggcaccgggcgaactctgccaacc

SEQ ID NO: 72294 - DNA, 25 bp, mus musculus
gcgaactctgccaacctcaagctgc

SEQ ID NO: 72295 - DNA, 25 bp, mus musculus
aacctcaagctgcgcgaactttttg

SEQ ID NO: 72296 - DNA, 25 bp, mus musculus
ctcaagctgcgcgaactttttgagg

SEQ ID NO: 72297 - DNA, 25 bp, mus musculus
aagctgcgcgaactttttgaggcag

SEQ ID NO: 72298 - DNA, 25 bp, mus musculus
ctttttgaggcagatccggagcgct

SEQ ID NO: 72299 - DNA, 25 bp, mus musculus
gcagatccggagcgcttcaaccact

SEQ ID NO: 72300 - DNA, 25 bp, mus musculus
tgcaaaaagcgcctcaatgaccgga

SEQ ID NO: 72301 - DNA, 25 bp, mus musculus
gctccagcagatggcttctctgatc

SEQ ID NO: 72302 - DNA, 25 bp, mus musculus
cagctgcccttgcagcgtcggcagc

SEQ ID NO: 72303 - DNA, 25 bp, mus musculus
cccttgcagcgtcggcagctggctg

SEQ ID NO: 72304 - DNA, 25 bp, mus musculus
cagcgtcggcagctggctgctttgg

SEQ ID NO: 72305 - DNA, 25 bp, mus musculus
gaaggtttacctgcctgtagacaat

SEQ ID NO: 72306 - DNA, 25 bp, mus musculus
ttacctgcctgtagacaattctgtc

SEQ ID NO: 72307 - DNA, 25 bp, mus musculus
agacaattctgtcatacctacagaa

SEQ ID NO: 72308 - DNA, 25 bp, mus musculus
tacagaactgctggtacttccagac

SEQ ID NO: 72309 - DNA, 25 bp, mus musculus
actgctggtacttccagaccgactc

SEQ ID NO: 72310 - DNA, 25 bp, mus musculus
ggtacttccagaccgactcacctga

SEQ ID NO: 72311 - DNA, 25 bp, mus musculus
cacctgacctgcaactcaaattttt

SEQ ID NO: 72312 - DNA, 25 bp, mus musculus
ccctcaaagaactacatcctgtctg

SEQ ID NO: 72313 - DNA, 25 bp, mus musculus
tacatcctgtctgtgatcagcggga

SEQ ID NO: 72314 - DNA, 25 bp, mus musculus
ctgtctgtgatcagcgggagcatct

SEQ ID NO: 72315 - DNA, 25 bp, mus musculus
ctcttcctgattggcctgatgtgtg

SEQ ID NO: 72316 - DNA, 25 bp, mus musculus
cgcaggcctgaccaccaaggagcca

SEQ ID NO: 72317 - DNA, 25 bp, mus musculus
tacagccgtcctgtatagtgtaccc

SEQ ID NO: 72318 - DNA, 25 bp, mus musculus
cgtcctgtatagtgtaccctctcac

SEQ ID NO: 72319 - DNA, 25 bp, mus musculus
acacccacagtagagcagcatcagg

SEQ ID NO: 72320 - DNA, 25 bp, mus musculus
tgtgctcattgtctcttccatcctt

SEQ ID NO: 72321 - DNA, 25 bp, mus musculus
tgtgtccactgaaggccagaagaaa

SEQ ID NO: 72322 - DNA, 25 bp, mus musculus
tgtctacagcctcaggaacaaagaa

SEQ ID NO: 72323 - DNA, 25 bp, mus musculus
agatgctctatgcagagctgtgggc

SEQ ID NO: 72324 - DNA, 25 bp, mus musculus
tctatgcagagctgtgggcagaaac

SEQ ID NO: 72325 - DNA, 25 bp, mus musculus
actttagctcaagtatgtctactca

SEQ ID NO: 72326 - DNA, 25 bp, mus musculus
gtatgtctactcatcaataagacat

SEQ ID NO: 72327 - DNA, 25 bp, mus musculus
aagacatgatctacatgctcatcaa

SEQ ID NO: 72328 - DNA, 25 bp, mus musculus
acatgctcatcaaatacggtgtcta

SEQ ID NO: 72329 - DNA, 25 bp, mus musculus
tttgggctctaatgtttggttctca

SEQ ID NO: 72330 - DNA, 25 bp, mus musculus
gttctcagatccaagaatcatttta

SEQ ID NO: 72331 - DNA, 25 bp, mus musculus
gcttacttctttaagttctggatgg

SEQ ID NO: 72332 - DNA, 25 bp, mus musculus
ctgtgcctctcatctcactgtggtc

SEQ ID NO: 72333 - DNA, 25 bp, mus musculus
ctctcatctcactgtggtcattgtc

SEQ ID NO: 72334 - DNA, 25 bp, mus musculus
ccactatggctgtgcctccattgcc

SEQ ID NO: 72335 - DNA, 25 bp, mus musculus
agaccttcttctctctgtgacctac

SEQ ID NO: 72336 - DNA, 25 bp, mus musculus
tcttctctctgtgacctacactatc

SEQ ID NO: 72337 - DNA, 25 bp, mus musculus
ctctgtgacctacactatcatcact

SEQ ID NO: 72338 - DNA, 25 bp, mus musculus
cactatcatcactcccttgctgaac

SEQ ID NO: 72339 - DNA, 25 bp, mus musculus
tcccttgctgaaccctgttgtctac

SEQ ID NO: 72340 - DNA, 25 bp, mus musculus
caccggtgactactgtgctttcggt

SEQ ID NO: 72341 - DNA, 25 bp, mus musculus
ggtgactactgtgctttcggtacct

SEQ ID NO: 72342 - DNA, 25 bp, mus musculus
gcggacgatttccaccgatgagcga

SEQ ID NO: 72343 - DNA, 25 bp, mus musculus
ggacgatttccaccgatgagcgagc

SEQ ID NO: 72344 - DNA, 25 bp, mus musculus
gacgatttccaccgatgagcgagct

SEQ ID NO: 72345 - DNA, 25 bp, mus musculus
acgatttccaccgatgagcgagcta

SEQ ID NO: 72346 - DNA, 25 bp, mus musculus
gatttccaccgatgagcgagctacg

SEQ ID NO: 72347 - DNA, 25 bp, mus musculus
atttccaccgatgagcgagctacga

SEQ ID NO: 72348 - DNA, 25 bp, mus musculus
tttccaccgatgagcgagctacgat

SEQ ID NO: 72349 - DNA, 25 bp, mus musculus
tccaccgatgagcgagctacgatgg

SEQ ID NO: 72350 - DNA, 25 bp, mus musculus
ccaccgatgagcgagctacgatggc

SEQ ID NO: 72351 - DNA, 25 bp, mus musculus
caccgatgagcgagctacgatggca

SEQ ID NO: 72352 - DNA, 25 bp, mus musculus
gtgactactgtgctttcggtacctt

SEQ ID NO: 72353 - DNA, 25 bp, mus musculus
tgactactgtgctttcggtaccttc

SEQ ID NO: 72354 - DNA, 25 bp, mus musculus
tgtgctttcggtaccttcgcctccg

SEQ ID NO: 72355 - DNA, 25 bp, mus musculus
ttcgcctccggaccttcagcggacg

SEQ ID NO: 72356 - DNA, 25 bp, mus musculus
ccttcagcggacgatttccaccgat

SEQ ID NO: 72357 - DNA, 25 bp, mus musculus
cttcagcggacgatttccaccgatg

SEQ ID NO: 72358 - DNA, 25 bp, mus musculus
ttcagcggacgatttccaccgatga

SEQ ID NO: 72359 - DNA, 25 bp, mus musculus
cagcggacgatttccaccgatgagc

SEQ ID NO: 72360 - DNA, 25 bp, mus musculus
caagtgcatttcaaaccaggacttt

SEQ ID NO: 72361 - DNA, 25 bp, mus musculus
tcccatcgctaccaaaaaagtgcac

SEQ ID NO: 72362 - DNA, 25 bp, mus musculus
aaatgtctctttgtatctgccctag

SEQ ID NO: 72363 - DNA, 25 bp, mus musculus
ctctttgtatctgccctagacacat

SEQ ID NO: 72364 - DNA, 25 bp, mus musculus
gtatctgccctagacacattcagga

SEQ ID NO: 72365 - DNA, 25 bp, mus musculus
gccctagacacattcaggacaatgt

SEQ ID NO: 72366 - DNA, 25 bp, mus musculus
gacacattcaggacaatgtctccac

SEQ ID NO: 72367 - DNA, 25 bp, mus musculus
ggtcctgcattttgccaagagcaca

SEQ ID NO: 72368 - DNA, 25 bp, mus musculus
gcattttgccaagagcacagcattg

SEQ ID NO: 72369 - DNA, 25 bp, mus musculus
gctcatcgtctctctgccaacgttt

SEQ ID NO: 72370 - DNA, 25 bp, mus musculus
atagtttgccttgttcagttgtatg

SEQ ID NO: 72371 - DNA, 25 bp, mus musculus
tgccttgttcagttgtatgtgagta

SEQ ID NO: 72372 - DNA, 25 bp, mus musculus
agtgcacacccttaaatgcctaaat

SEQ ID NO: 72373 - DNA, 25 bp, mus musculus
aacatttggttgttgcgaagtgagc

SEQ ID NO: 72374 - DNA, 25 bp, mus musculus
attttgtattgtgctcatcctaaac

SEQ ID NO: 72375 - DNA, 25 bp, mus musculus
tattgtgctcatcctaaactctaac

SEQ ID NO: 72376 - DNA, 25 bp, mus musculus
ctctaactggtctactgtttttcag

SEQ ID NO: 72377 - DNA, 25 bp, mus musculus
cataaatgtgccaaccatattgaaa

SEQ ID NO: 72378 - DNA, 25 bp, mus musculus
tgtgccaaccatattgaaaagtgtc

SEQ ID NO: 72379 - DNA, 25 bp, mus musculus
agcatcgtcatgcttttgagtgtag

SEQ ID NO: 72380 - DNA, 25 bp, mus musculus
gctatttgatcccgcggagtgccgg

SEQ ID NO: 72381 - DNA, 25 bp, mus musculus
ctatttgatcccgcggagtgccgga

SEQ ID NO: 72382 - DNA, 25 bp, mus musculus
aactatggcggacgcagccaacaca

SEQ ID NO: 72383 - DNA, 25 bp, mus musculus
actatggcggacgcagccaacacaa

SEQ ID NO: 72384 - DNA, 25 bp, mus musculus
ggcggacgcagccaacacaacacag

SEQ ID NO: 72385 - DNA, 25 bp, mus musculus
gcggacgcagccaacacaacacagt

SEQ ID NO: 72386 - DNA, 25 bp, mus musculus
cggacgcagccaacacaacacagtg

SEQ ID NO: 72387 - DNA, 25 bp, mus musculus
ggacgcagccaacacaacacagtga

SEQ ID NO: 72388 - DNA, 25 bp, mus musculus
gacgcagccaacacaacacagtgaa

SEQ ID NO: 72389 - DNA, 25 bp, mus musculus
acgcagccaacacaacacagtgaag

SEQ ID NO: 72390 - DNA, 25 bp, mus musculus
cgcagccaacacaacacagtgaagc

SEQ ID NO: 72391 - DNA, 25 bp, mus musculus
gcagccaacacaacacagtgaagct

SEQ ID NO: 72392 - DNA, 25 bp, mus musculus
tatttgatcccgcggagtgccggag

SEQ ID NO: 72393 - DNA, 25 bp, mus musculus
cgttggctcaactatggcggacgca

SEQ ID NO: 72394 - DNA, 25 bp, mus musculus
ttggctcaactatggcggacgcagc

SEQ ID NO: 72395 - DNA, 25 bp, mus musculus
tggctcaactatggcggacgcagcc

SEQ ID NO: 72396 - DNA, 25 bp, mus musculus
ggctcaactatggcggacgcagcca

SEQ ID NO: 72397 - DNA, 25 bp, mus musculus
gctcaactatggcggacgcagccaa

SEQ ID NO: 72398 - DNA, 25 bp, mus musculus
ctcaactatggcggacgcagccaac

SEQ ID NO: 72399 - DNA, 25 bp, mus musculus
tcaactatggcggacgcagccaaca

SEQ ID NO: 72400 - DNA, 25 bp, mus musculus
tgctttagtctacttcaaaagaatg

SEQ ID NO: 72401 - DNA, 25 bp, mus musculus
caaatttactcaaagttgcagttag

SEQ ID NO: 72402 - DNA, 25 bp, mus musculus
tcaatgccctgtcccaaaggaacat

SEQ ID NO: 72403 - DNA, 25 bp, mus musculus
ccctgtcccaaaggaacatccatgt

SEQ ID NO: 72404 - DNA, 25 bp, mus musculus
cccaaaggaacatccatgtattcaa

SEQ ID NO: 72405 - DNA, 25 bp, mus musculus
acagacagacccccatggtccctat

SEQ ID NO: 72406 - DNA, 25 bp, mus musculus
ccatggtccctatctgtagtcagac

SEQ ID NO: 72407 - DNA, 25 bp, mus musculus
tccctatctgtagtcagactgtgct

SEQ ID NO: 72408 - DNA, 25 bp, mus musculus
tctgtagtcagactgtgctggctgg

SEQ ID NO: 72409 - DNA, 25 bp, mus musculus
gtcagactgtgctggctgggtctct

SEQ ID NO: 72410 - DNA, 25 bp, mus musculus
aatacagtgcgcttgtgtgatggac

SEQ ID NO: 72411 - DNA, 25 bp, mus musculus
agcagcccttcctgaagctgtggta

SEQ ID NO: 72412 - DNA, 25 bp, mus musculus
ccccacagaggtggccgcagcactg

SEQ ID NO: 72413 - DNA, 25 bp, mus musculus
gacaacgtttcctgtgccaacactg

SEQ ID NO: 72414 - DNA, 25 bp, mus musculus
gtttcctgtgccaacactgcctgtg

SEQ ID NO: 72415 - DNA, 25 bp, mus musculus
tgtgccaacactgcctgtgggtaat

SEQ ID NO: 72416 - DNA, 25 bp, mus musculus
aacactgcctgtgggtaatgagtag

SEQ ID NO: 72417 - DNA, 25 bp, mus musculus
gcaccccattccagcttagtgatgt

SEQ ID NO: 72418 - DNA, 25 bp, mus musculus
cattccagcttagtgatgtcttcaa

SEQ ID NO: 72419 - DNA, 25 bp, mus musculus
acagtatcaatgccctgtcccaaag

SEQ ID NO: 72420 - DNA, 25 bp, mus musculus
ggccctcattacctcctgcatcgat

SEQ ID NO: 72421 - DNA, 25 bp, mus musculus
cattacctcctgcatcgatggcttc

SEQ ID NO: 72422 - DNA, 25 bp, mus musculus
cgagaacccgggcatcaaccagcgg

SEQ ID NO: 72423 - DNA, 25 bp, mus musculus
gaaggcgtctgactggcagtacaac

SEQ ID NO: 72424 - DNA, 25 bp, mus musculus
ctggcagtacaacatcaccgtcagc

SEQ ID NO: 72425 - DNA, 25 bp, mus musculus
gcagtacaacatcaccgtcagcgca

SEQ ID NO: 72426 - DNA, 25 bp, mus musculus
gtacaacatcaccgtcagcgcacta

SEQ ID NO: 72427 - DNA, 25 bp, mus musculus
caacatcaccgtcagcgcactagta

SEQ ID NO: 72428 - DNA, 25 bp, mus musculus
ttacaatgaagtcctcagggacctg

SEQ ID NO: 72429 - DNA, 25 bp, mus musculus
cctcagggacctgctggggaaagag

SEQ ID NO: 72430 - DNA, 25 bp, mus musculus
cagggacctgctggggaaagagcct

SEQ ID NO: 72431 - DNA, 25 bp, mus musculus
agagcctcaggagaagctggagatc

SEQ ID NO: 72432 - DNA, 25 bp, mus musculus
tacctcctgcatcgatggcttcaat

SEQ ID NO: 72433 - DNA, 25 bp, mus musculus
ctgcatcgatggcttcaatgtctgt

SEQ ID NO: 72434 - DNA, 25 bp, mus musculus
cgatggcttcaatgtctgtatcttt

SEQ ID NO: 72435 - DNA, 25 bp, mus musculus
tggcttcaatgtctgtatctttgct

SEQ ID NO: 72436 - DNA, 25 bp, mus musculus
caatgtctgtatctttgcttacggc

SEQ ID NO: 72437 - DNA, 25 bp, mus musculus
tatctttgcttacggccagacaggt

SEQ ID NO: 72438 - DNA, 25 bp, mus musculus
cggccagacaggtgccggcaagaca

SEQ ID NO: 72439 - DNA, 25 bp, mus musculus
ccagacaggtgccggcaagacatat

SEQ ID NO: 72440 - DNA, 25 bp, mus musculus
ccttgttcacttttgccatcagtgt

SEQ ID NO: 72441 - DNA, 25 bp, mus musculus
tgttcacttttgccatcagtgtcaa

SEQ ID NO: 72442 - DNA, 25 bp, mus musculus
tacagcagctgctgccacgatttcg

SEQ ID NO: 72443 - DNA, 25 bp, mus musculus
acagcagctgctgccacgatttcga

SEQ ID NO: 72444 - DNA, 25 bp, mus musculus
agcagctgctgccacgatttcgatg

SEQ ID NO: 72445 - DNA, 25 bp, mus musculus
agctgctgccacgatttcgatgagc

SEQ ID NO: 72446 - DNA, 25 bp, mus musculus
gctgctgccacgatttcgatgagct

SEQ ID NO: 72447 - DNA, 25 bp, mus musculus
gctgccacgatttcgatgagctctg

SEQ ID NO: 72448 - DNA, 25 bp, mus musculus
tgccacgatttcgatgagctctgtt

SEQ ID NO: 72449 - DNA, 25 bp, mus musculus
gatttcgatgagctctgtttgaaaa

SEQ ID NO: 72450 - DNA, 25 bp, mus musculus
ttcgatgagctctgtttgaaaacag

SEQ ID NO: 72451 - DNA, 25 bp, mus musculus
tcgatgagctctgtttgaaaacagc

SEQ ID NO: 72452 - DNA, 25 bp, mus musculus
ttcacttttgccatcagtgtcaata

SEQ ID NO: 72453 - DNA, 25 bp, mus musculus
tcacttttgccatcagtgtcaatat

SEQ ID NO: 72454 - DNA, 25 bp, mus musculus
acttttgccatcagtgtcaatatct

SEQ ID NO: 72455 - DNA, 25 bp, mus musculus
cttttgccatcagtgtcaatatctg

SEQ ID NO: 72456 - DNA, 25 bp, mus musculus
tttgccatcagtgtcaatatctgct

SEQ ID NO: 72457 - DNA, 25 bp, mus musculus
agagctacagcagctgctgccacga

SEQ ID NO: 72458 - DNA, 25 bp, mus musculus
agctacagcagctgctgccacgatt

SEQ ID NO: 72459 - DNA, 25 bp, mus musculus
gctacagcagctgctgccacgattt

SEQ ID NO: 72460 - DNA, 25 bp, mus musculus
gagcctgaacttctggcctagggga

SEQ ID NO: 72461 - DNA, 25 bp, mus musculus
gaacttctggcctaggggacacaga

SEQ ID NO: 72462 - DNA, 25 bp, mus musculus
ctcttggacttaagcagcttgttaa

SEQ ID NO: 72463 - DNA, 25 bp, mus musculus
gcacatccagaggagcctggaagaa

SEQ ID NO: 72464 - DNA, 25 bp, mus musculus
catccagaggagcctggaagaaccg

SEQ ID NO: 72465 - DNA, 25 bp, mus musculus
gtttcagataccgttccacccagct

SEQ ID NO: 72466 - DNA, 25 bp, mus musculus
accgttccacccagctgtgctgctg

SEQ ID NO: 72467 - DNA, 25 bp, mus musculus
ggatccaatgtccttgcctggtctc

SEQ ID NO: 72468 - DNA, 25 bp, mus musculus
tccaatgtccttgcctggtctctgt

SEQ ID NO: 72469 - DNA, 25 bp, mus musculus
aatgtccttgcctggtctctgtgac

SEQ ID NO: 72470 - DNA, 25 bp, mus musculus
ctgtgaccaccaggcacaaatgtgc

SEQ ID NO: 72471 - DNA, 25 bp, mus musculus
ccaccaggcacaaatgtgcacagac

SEQ ID NO: 72472 - DNA, 25 bp, mus musculus
catcacagggttggcctgtagacct

SEQ ID NO: 72473 - DNA, 25 bp, mus musculus
atgatctttaagcatcttcttcgca

SEQ ID NO: 72474 - DNA, 25 bp, mus musculus
ttgttctcctggcttgtggacccag

SEQ ID NO: 72475 - DNA, 25 bp, mus musculus
tcctggcttgtggacccagcctttc

SEQ ID NO: 72476 - DNA, 25 bp, mus musculus
gtggacccagcctttcctgcgcagt

SEQ ID NO: 72477 - DNA, 25 bp, mus musculus
tttcctgcgcagttactcttggact

SEQ ID NO: 72478 - DNA, 25 bp, mus musculus
cctgcgcagttactcttggacttaa

SEQ ID NO: 72479 - DNA, 25 bp, mus musculus
cagttactcttggacttaagcagct

SEQ ID NO: 72480 - DNA, 25 bp, mus musculus
cagcctatttattcaaccgatagca

SEQ ID NO: 72481 - DNA, 25 bp, mus musculus
atttattcaaccgatagcactagca

SEQ ID NO: 72482 - DNA, 25 bp, mus musculus
attaatgcatctaatcggaggagct

SEQ ID NO: 72483 - DNA, 25 bp, mus musculus
aggagctactctagtacttatagac

SEQ ID NO: 72484 - DNA, 25 bp, mus musculus
agctactctagtacttatagacatc

SEQ ID NO: 72485 - DNA, 25 bp, mus musculus
tactctagtacttatagacatcagc

SEQ ID NO: 72486 - DNA, 25 bp, mus musculus
acttatagacatcagcccaccaacc

SEQ ID NO: 72487 - DNA, 25 bp, mus musculus
tatagacatcagcccaccaaccgct

SEQ ID NO: 72488 - DNA, 25 bp, mus musculus
tctacttcatacttacagtacttga

SEQ ID NO: 72489 - DNA, 25 bp, mus musculus
tcatacttacagtacttgaatttgc

SEQ ID NO: 72490 - DNA, 25 bp, mus musculus
tacttgaatttgccgtagccttaat

SEQ ID NO: 72491 - DNA, 25 bp, mus musculus
ttgccgtagccttaattcaagccta

SEQ ID NO: 72492 - DNA, 25 bp, mus musculus
tcaaccgatagcactagcagtacga

SEQ ID NO: 72493 - DNA, 25 bp, mus musculus
gccgtagccttaattcaagcctatg

SEQ ID NO: 72494 - DNA, 25 bp, mus musculus
accgatagcactagcagtacgacta

SEQ ID NO: 72495 - DNA, 25 bp, mus musculus
actagcagtacgactaacagcaaac

SEQ ID NO: 72496 - DNA, 25 bp, mus musculus
agcagtacgactaacagcaaacatt

SEQ ID NO: 72497 - DNA, 25 bp, mus musculus
actaacagcaaacattacagcaggc

SEQ ID NO: 72498 - DNA, 25 bp, mus musculus
aacagcaaacattacagcaggccat

SEQ ID NO: 72499 - DNA, 25 bp, mus musculus
agcaaacattacagcaggccatcta

SEQ ID NO: 72500 - DNA, 25 bp, mus musculus
ccatctattaatgcatctaatcgga

SEQ ID NO: 72501 - DNA, 25 bp, mus musculus
atcaccagtgtagaagctgttctct

SEQ ID NO: 72502 - DNA, 25 bp, mus musculus
gaagctgttctcttgcagcaggtgg

SEQ ID NO: 72503 - DNA, 25 bp, mus musculus
agactggccttggtgttatacttca

SEQ ID NO: 72504 - DNA, 25 bp, mus musculus
gtgttatacttcatggttggaggct

SEQ ID NO: 72505 - DNA, 25 bp, mus musculus
ggctgacctaccctacaagagtgtc

SEQ ID NO: 72506 - DNA, 25 bp, mus musculus
ctacaagagtgtcccttgctgaaga

SEQ ID NO: 72507 - DNA, 25 bp, mus musculus
caagagtgtcccttgctgaagacat

SEQ ID NO: 72508 - DNA, 25 bp, mus musculus
acctgtgtcctgtcacccaagtcac

SEQ ID NO: 72509 - DNA, 25 bp, mus musculus
cccctctggtatttggagatgccaa

SEQ ID NO: 72510 - DNA, 25 bp, mus musculus
gagatgccaacactgccaggagtct

SEQ ID NO: 72511 - DNA, 25 bp, mus musculus
agtgatttttatgccacctgaataa

SEQ ID NO: 72512 - DNA, 25 bp, mus musculus
gatttttatgccacctgaataaaga

SEQ ID NO: 72513 - DNA, 25 bp, mus musculus
tttgtgggctggcacttgtggacac

SEQ ID NO: 72514 - DNA, 25 bp, mus musculus
cacttgtggacacagttttggctag

SEQ ID NO: 72515 - DNA, 25 bp, mus musculus
catttgtaagcagaggctggagagg

SEQ ID NO: 72516 - DNA, 25 bp, mus musculus
tttagacatattccagacaccctgg

SEQ ID NO: 72517 - DNA, 25 bp, mus musculus
agacatattccagacaccctgggtg

SEQ ID NO: 72518 - DNA, 25 bp, mus musculus
tggtctcccaagcttagactggcct

SEQ ID NO: 72519 - DNA, 25 bp, mus musculus
tctcccaagcttagactggccttgg

SEQ ID NO: 72520 - DNA, 25 bp, mus musculus
cttagactggccttggtgttatact

SEQ ID NO: 72521 - DNA, 25 bp, mus musculus
caaatcatgtagtcactcaatgcca

SEQ ID NO: 72522 - DNA, 25 bp, mus musculus
tcactcaatgccacaactcaaactg

SEQ ID NO: 72523 - DNA, 25 bp, mus musculus
cgtagcagtcctgagccacaccatc

SEQ ID NO: 72524 - DNA, 25 bp, mus musculus
caccatccttctcatggacatccgg

SEQ ID NO: 72525 - DNA, 25 bp, mus musculus
catggacatccggaggactgcccct

SEQ ID NO: 72526 - DNA, 25 bp, mus musculus
tgcccctagagacacaacctgctgc

SEQ ID NO: 72527 - DNA, 25 bp, mus musculus
tagagacacaacctgctgcctgtct

SEQ ID NO: 72528 - DNA, 25 bp, mus musculus
cacaacctgctgcctgtctgtccag

SEQ ID NO: 72529 - DNA, 25 bp, mus musculus
cctgtctgtccagccaagtgcgcat

SEQ ID NO: 72530 - DNA, 25 bp, mus musculus
tgtccagccaagtgcgcatgtgccg

SEQ ID NO: 72531 - DNA, 25 bp, mus musculus
tgtgtacacttaacctgcttgagct

SEQ ID NO: 72532 - DNA, 25 bp, mus musculus
cacttaacctgcttgagcttctgtg

SEQ ID NO: 72533 - DNA, 25 bp, mus musculus
aatgccacaactcaaactgcttcag

SEQ ID NO: 72534 - DNA, 25 bp, mus musculus
caaactgcttcagtgggaagtacag

SEQ ID NO: 72535 - DNA, 25 bp, mus musculus
agtacagagacccagtgcattgcgt

SEQ ID NO: 72536 - DNA, 25 bp, mus musculus
gagacccagtgcattgcgtgtgcag

SEQ ID NO: 72537 - DNA, 25 bp, mus musculus
cagtgcattgcgtgtgcaggagcgt

SEQ ID NO: 72538 - DNA, 25 bp, mus musculus
cataccttgtggtccactgggctgc

SEQ ID NO: 72539 - DNA, 25 bp, mus musculus
ttgtggtccactgggctgcaggttt

SEQ ID NO: 72540 - DNA, 25 bp, mus musculus
ttcctccagggaccagtcaactggc

SEQ ID NO: 72541 - DNA, 25 bp, mus musculus
ggtgcaaactccctgcgaatgtgcc

SEQ ID NO: 72542 - DNA, 25 bp, mus musculus
cattctgtggcagcagattcacgtc

SEQ ID NO: 72543 - DNA, 25 bp, mus musculus
gttatggctgggccacactgaggtc

SEQ ID NO: 72544 - DNA, 25 bp, mus musculus
ccacactgaggtccttgggccaaca

SEQ ID NO: 72545 - DNA, 25 bp, mus musculus
tgaggtccttgggccaacagagaca

SEQ ID NO: 72546 - DNA, 25 bp, mus musculus
cataggccctggccaaagggtagct

SEQ ID NO: 72547 - DNA, 25 bp, mus musculus
agcctcaaagagtggcctaagctca

SEQ ID NO: 72548 - DNA, 25 bp, mus musculus
tggcctaagctcaattcaggatcta

SEQ ID NO: 72549 - DNA, 25 bp, mus musculus
aagctcaattcaggatctaaccagg

SEQ ID NO: 72550 - DNA, 25 bp, mus musculus
gggttccagagtggaccaggaccag

SEQ ID NO: 72551 - DNA, 25 bp, mus musculus
agtggaccaggaccagagagttgtc

SEQ ID NO: 72552 - DNA, 25 bp, mus musculus
gcagcaagcgcaagctgtgaacaga

SEQ ID NO: 72553 - DNA, 25 bp, mus musculus
gcagattcacgtcgtaagggtcgca

SEQ ID NO: 72554 - DNA, 25 bp, mus musculus
tcacgtcgtaagggtcgcaacagac

SEQ ID NO: 72555 - DNA, 25 bp, mus musculus
catgtctctgagctccgtgctgagc

SEQ ID NO: 72556 - DNA, 25 bp, mus musculus
cgtggaccacgtagtgcagctcact

SEQ ID NO: 72557 - DNA, 25 bp, mus musculus
ccacgtagtgcagctcactggtgac

SEQ ID NO: 72558 - DNA, 25 bp, mus musculus
gctcactggtgactcggctgtcccc

SEQ ID NO: 72559 - DNA, 25 bp, mus musculus
tgtccccacaatgggacgaggctga

SEQ ID NO: 72560 - DNA, 25 bp, mus musculus
acactccaaagaggggcagacagat

SEQ ID NO: 72561 - DNA, 25 bp, mus musculus
aaacctcggggatactgtctgatca

SEQ ID NO: 72562 - DNA, 25 bp, mus musculus
tactgtctgatcatcaacaatcatg

SEQ ID NO: 72563 - DNA, 25 bp, mus musculus
gtatcttacgacgactgcactgcaa

SEQ ID NO: 72564 - DNA, 25 bp, mus musculus
tcttacgacgactgcactgcaaatg

SEQ ID NO: 72565 - DNA, 25 bp, mus musculus
tacgacgactgcactgcaaatgaaa

SEQ ID NO: 72566 - DNA, 25 bp, mus musculus
gacgactgcactgcaaatgaaatcc

SEQ ID NO: 72567 - DNA, 25 bp, mus musculus
attctagaaggctaccaaagcgcag

SEQ ID NO: 72568 - DNA, 25 bp, mus musculus
gaaggctaccaaagcgcagaccaca

SEQ ID NO: 72569 - DNA, 25 bp, mus musculus
ggctaccaaagcgcagaccacaaga

SEQ ID NO: 72570 - DNA, 25 bp, mus musculus
taccaaagcgcagaccacaagaaca

SEQ ID NO: 72571 - DNA, 25 bp, mus musculus
agcgcagaccacaagaacaaagact

SEQ ID NO: 72572 - DNA, 25 bp, mus musculus
gcagaccacaagaacaaagactgct

SEQ ID NO: 72573 - DNA, 25 bp, mus musculus
tgtctgatcatcaacaatcatgatt

SEQ ID NO: 72574 - DNA, 25 bp, mus musculus
ctgatcatcaacaatcatgatttca

SEQ ID NO: 72575 - DNA, 25 bp, mus musculus
atcatcaacaatcatgatttcagca

SEQ ID NO: 72576 - DNA, 25 bp, mus musculus
atcaacaatcatgatttcagcaagg

SEQ ID NO: 72577 - DNA, 25 bp, mus musculus
catgatttcagcaaggcccgggaag

SEQ ID NO: 72578 - DNA, 25 bp, mus musculus
gatttcagcaaggcccgggaagaca

SEQ ID NO: 72579 - DNA, 25 bp, mus musculus
ttcagcaaggcccgggaagacataa

SEQ ID NO: 72580 - DNA, 25 bp, mus musculus
atagtatcttacgacgactgcactg

SEQ ID NO: 72581 - DNA, 25 bp, mus musculus
caagagccctgcctgtaacaaacgt

SEQ ID NO: 72582 - DNA, 25 bp, mus musculus
ccctgcctgtaacaaacgtgctcca

SEQ ID NO: 72583 - DNA, 25 bp, mus musculus
gctgctgctttgaacaccagcccac

SEQ ID NO: 72584 - DNA, 25 bp, mus musculus
ttcccaagagtctctatggagttgg

SEQ ID NO: 72585 - DNA, 25 bp, mus musculus
tcctttaccagtcgggccatactgt

SEQ ID NO: 72586 - DNA, 25 bp, mus musculus
cgggccatactgtttgggaagtcat

SEQ ID NO: 72587 - DNA, 25 bp, mus musculus
aagtcatctctgaagtctaaccacc

SEQ ID NO: 72588 - DNA, 25 bp, mus musculus
tctctgaagtctaaccaccttcctt

SEQ ID NO: 72589 - DNA, 25 bp, mus musculus
tcttggttcagtttggacagattgt

SEQ ID NO: 72590 - DNA, 25 bp, mus musculus
ttattattgtctctgccctggctag

SEQ ID NO: 72591 - DNA, 25 bp, mus musculus
ttgtctctgccctggctagaatggg

SEQ ID NO: 72592 - DNA, 25 bp, mus musculus
gttcccttgtccagtgtggctgacc

SEQ ID NO: 72593 - DNA, 25 bp, mus musculus
ctgtaacaaacgtgctccaggagac

SEQ ID NO: 72594 - DNA, 25 bp, mus musculus
caaacctaagcatccgagcaagctg

SEQ ID NO: 72595 - DNA, 25 bp, mus musculus
tccgagcaagctggggctattcctg

SEQ ID NO: 72596 - DNA, 25 bp, mus musculus
caagctggggctattcctgcaaact

SEQ ID NO: 72597 - DNA, 25 bp, mus musculus
ggggctattcctgcaaactccatcc

SEQ ID NO: 72598 - DNA, 25 bp, mus musculus
tccatcctgaacgctgtcactctag

SEQ ID NO: 72599 - DNA, 25 bp, mus musculus
ctgaacgctgtcactctagaagcag

SEQ ID NO: 72600 - DNA, 25 bp, mus musculus
gctgtcactctagaagcagctgctg

SEQ ID NO: 72601 - DNA, 25 bp, mus musculus
ctatggattacagccaccaagcaag

SEQ ID NO: 72602 - DNA, 25 bp, mus musculus
tggattacagccaccaagcaagggg

SEQ ID NO: 72603 - DNA, 25 bp, mus musculus
aggccttcagtttatgccttctact

SEQ ID NO: 72604 - DNA, 25 bp, mus musculus
ccttcagtttatgccttctactccg

SEQ ID NO: 72605 - DNA, 25 bp, mus musculus
tcagtttatgccttctactccgagc

SEQ ID NO: 72606 - DNA, 25 bp, mus musculus
gccttctactccgagcagcctgatt

SEQ ID NO: 72607 - DNA, 25 bp, mus musculus
tccgagcagcctgatttttctggac

SEQ ID NO: 72608 - DNA, 25 bp, mus musculus
cagcctgatttttctggacacaagt

SEQ ID NO: 72609 - DNA, 25 bp, mus musculus
tacggcccttttggccctgagatga

SEQ ID NO: 72610 - DNA, 25 bp, mus musculus
tttggccctgagatgacaaatcctc

SEQ ID NO: 72611 - DNA, 25 bp, mus musculus
atgacaaatcctctgagggagattg

SEQ ID NO: 72612 - DNA, 25 bp, mus musculus
gacaagaccgtggggcagttaatgg

SEQ ID NO: 72613 - DNA, 25 bp, mus musculus
attacagccaccaagcaaggggtga

SEQ ID NO: 72614 - DNA, 25 bp, mus musculus
acattcttttggtctgtgagcatcc

SEQ ID NO: 72615 - DNA, 25 bp, mus musculus
tggtctgtgagcatccctcacgagc

SEQ ID NO: 72616 - DNA, 25 bp, mus musculus
tctgtgagcatccctcacgagcgga

SEQ ID NO: 72617 - DNA, 25 bp, mus musculus
atccctcacgagcggagaatcctaa

SEQ ID NO: 72618 - DNA, 25 bp, mus musculus
cctcacgagcggagaatcctaacta

SEQ ID NO: 72619 - DNA, 25 bp, mus musculus
actatccttcagtggctttccctgc

SEQ ID NO: 72620 - DNA, 25 bp, mus musculus
ctttccctgccagacaatgagaggc

SEQ ID NO: 72621 - DNA, 25 bp, mus musculus
tgacaatcctgaccaaaacacagag

SEQ ID NO: 72622 - DNA, 25 bp, mus musculus
tcctgaccaaaacacagaggattat

SEQ ID NO: 72623 - DNA, 25 bp, mus musculus
taatgaaccagtccagctcactcca

SEQ ID NO: 72624 - DNA, 25 bp, mus musculus
ccagctcactccagatgatgatgac

SEQ ID NO: 72625 - DNA, 25 bp, mus musculus
cctcttgatgtctgcagaagagtgt

SEQ ID NO: 72626 - DNA, 25 bp, mus musculus
attctgcttgccgccattcagtgca

SEQ ID NO: 72627 - DNA, 25 bp, mus musculus
cttgccgccattcagtgcatggata

SEQ ID NO: 72628 - DNA, 25 bp, mus musculus
ccgtcagcctgctcacagttagcat

SEQ ID NO: 72629 - DNA, 25 bp, mus musculus
gcctgctcacagttagcattttatg

SEQ ID NO: 72630 - DNA, 25 bp, mus musculus
gttgcccctgcagaagtcgctctcg

SEQ ID NO: 72631 - DNA, 25 bp, mus musculus
cctgcagaagtcgctctcggtatcc

SEQ ID NO: 72632 - DNA, 25 bp, mus musculus
acagaagctagcttcctgacaatca

SEQ ID NO: 72633 - DNA, 25 bp, mus musculus
ggattatctattccaagtcattttg

SEQ ID NO: 72634 - DNA, 25 bp, mus musculus
ctagcttcctgacaatcatgtcgac

SEQ ID NO: 72635 - DNA, 25 bp, mus musculus
tctattccaagtcattttggaaaag

SEQ ID NO: 72636 - DNA, 25 bp, mus musculus
gcagatccgcatcccgcgttctctg

SEQ ID NO: 72637 - DNA, 25 bp, mus musculus
cccgcgttctctgtctgtaaaagca

SEQ ID NO: 72638 - DNA, 25 bp, mus musculus
ttctctgtctgtaaaagcagcaagt

SEQ ID NO: 72639 - DNA, 25 bp, mus musculus
tcaccctcaaactggatttgctgac

SEQ ID NO: 72640 - DNA, 25 bp, mus musculus
aggacatccattcttcagaaatgtg

SEQ ID NO: 72641 - DNA, 25 bp, mus musculus
tccattcttcagaaatgtggactgg

SEQ ID NO: 72642 - DNA, 25 bp, mus musculus
acacatcacgagtgagtgcaccggc

SEQ ID NO: 72643 - DNA, 25 bp, mus musculus
atgaattcctggtgatgtgtactct

SEQ ID NO: 72644 - DNA, 25 bp, mus musculus
ttgaccaccgaggctaccaggctct

SEQ ID NO: 72645 - DNA, 25 bp, mus musculus
accgaggctaccaggctctgtcgga

SEQ ID NO: 72646 - DNA, 25 bp, mus musculus
gctaccaggctctgtcggatagctc

SEQ ID NO: 72647 - DNA, 25 bp, mus musculus
atagctccccagggcccagagtctt

SEQ ID NO: 72648 - DNA, 25 bp, mus musculus
ggccactgagcatccaggacagctt

SEQ ID NO: 72649 - DNA, 25 bp, mus musculus
tccaggacagctttgtagaggtgtc

SEQ ID NO: 72650 - DNA, 25 bp, mus musculus
cccgagttcgactgggctctgagat

SEQ ID NO: 72651 - DNA, 25 bp, mus musculus
ttcgactgggctctgagatccgaga

SEQ ID NO: 72652 - DNA, 25 bp, mus musculus
ctgagatccgagactctgtggtatg

SEQ ID NO: 72653 - DNA, 25 bp, mus musculus
tggtcaccctgacctcagggttgtg

SEQ ID NO: 72654 - DNA, 25 bp, mus musculus
tgtttctgttctttctctaccgaca

SEQ ID NO: 72655 - DNA, 25 bp, mus musculus
ttctctaccgacatcgggatggcat

SEQ ID NO: 72656 - DNA, 25 bp, mus musculus
atggcatgaaactcttcctaaagca

SEQ ID NO: 72657 - DNA, 25 bp, mus musculus
tgaaactcttcctaaagcagggcga

SEQ ID NO: 72658 - DNA, 25 bp, mus musculus
tgcaccccaagactcgccctatagt

SEQ ID NO: 72659 - DNA, 25 bp, mus musculus
ctcgccctatagtgctaccacctga

SEQ ID NO: 72660 - DNA, 25 bp, mus musculus
cacctgagacccgaccgctgaatgg

SEQ ID NO: 72661 - DNA, 25 bp, mus musculus
gaccgctgaatggtgtcggccctcc

SEQ ID NO: 72662 - DNA, 25 bp, mus musculus
ctcccaagtctccacaggcatctat

SEQ ID NO: 72663 - DNA, 25 bp, mus musculus
agtctccacaggcatctatcaagtg

SEQ ID NO: 72664 - DNA, 25 bp, mus musculus
gcttcaaacagaccatagccaagat

SEQ ID NO: 72665 - DNA, 25 bp, mus musculus
ccatagccaagatcaacttcaaagt

SEQ ID NO: 72666 - DNA, 25 bp, mus musculus
ccccgtggacatgggctggctctgt

SEQ ID NO: 72667 - DNA, 25 bp, mus musculus
tcagccactcggaaatgcagctcat

SEQ ID NO: 72668 - DNA, 25 bp, mus musculus
agctcatcaatcagtactgcaaaga

SEQ ID NO: 72669 - DNA, 25 bp, mus musculus
agtactgcaaagacacccggcagca

SEQ ID NO: 72670 - DNA, 25 bp, mus musculus
gcaaagacacccggcagcagcagca

SEQ ID NO: 72671 - DNA, 25 bp, mus musculus
ggaatcagcttccagagtcataaaa

SEQ ID NO: 72672 - DNA, 25 bp, mus musculus
ttgcttccaggaacaaatgctctgt

SEQ ID NO: 72673 - DNA, 25 bp, mus musculus
gctctgtcttcactagtcaactatt

SEQ ID NO: 72674 - DNA, 25 bp, mus musculus
cacaggcatctatcaagtggttgct

SEQ ID NO: 72675 - DNA, 25 bp, mus musculus
cccaaggactactgattcgctctgt

SEQ ID NO: 72676 - DNA, 25 bp, mus musculus
gactactgattcgctctgttcaaga

SEQ ID NO: 72677 - DNA, 25 bp, mus musculus
tgattcgctctgttcaagattctga

SEQ ID NO: 72678 - DNA, 25 bp, mus musculus
accaaggactctaccactgcattgc

SEQ ID NO: 72679 - DNA, 25 bp, mus musculus
gactctaccactgcattgccactga

SEQ ID NO: 72680 - DNA, 25 bp, mus musculus
gcattgccactgagaacagcttcaa

SEQ ID NO: 72681 - DNA, 25 bp, mus musculus
agaacagcttcaaacagaccatagc

SEQ ID NO: 72682 - DNA, 25 bp, mus musculus
cagacagttacttcacactctggct

SEQ ID NO: 72683 - DNA, 25 bp, mus musculus
gttacttcacactctggctgaatct

SEQ ID NO: 72684 - DNA, 25 bp, mus musculus
tttacaacagaacatctcggaatac

SEQ ID NO: 72685 - DNA, 25 bp, mus musculus
acaacagaacatctcggaataccca

SEQ ID NO: 72686 - DNA, 25 bp, mus musculus
catctcggaatacccagtttcctga

SEQ ID NO: 72687 - DNA, 25 bp, mus musculus
ggaatacccagtttcctgatggtgt

SEQ ID NO: 72688 - DNA, 25 bp, mus musculus
atacccagtttcctgatggtgtaga

SEQ ID NO: 72689 - DNA, 25 bp, mus musculus
agtttcctgatggtgtagatgtgcg

SEQ ID NO: 72690 - DNA, 25 bp, mus musculus
atgtgcgtgatcctgactttgggga

SEQ ID NO: 72691 - DNA, 25 bp, mus musculus
tgcgtgatcctgactttggggaaac

SEQ ID NO: 72692 - DNA, 25 bp, mus musculus
gtgatcctgactttggggaaacatt

SEQ ID NO: 72693 - DNA, 25 bp, mus musculus
ctctggaattcctagacccaagcaa

SEQ ID NO: 72694 - DNA, 25 bp, mus musculus
cactctggctgaatcttgaactgct

SEQ ID NO: 72695 - DNA, 25 bp, mus musculus
tctggaattcctagacccaagcaaa

SEQ ID NO: 72696 - DNA, 25 bp, mus musculus
tgaatcttgaactgctcctgacagt

SEQ ID NO: 72697 - DNA, 25 bp, mus musculus
atcttgaactgctcctgacagttat

SEQ ID NO: 72698 - DNA, 25 bp, mus musculus
ttgaactgctcctgacagttatcat

SEQ ID NO: 72699 - DNA, 25 bp, mus musculus
tgctcctgacagttatcattgactg

SEQ ID NO: 72700 - DNA, 25 bp, mus musculus
cagttatcattgactgctggattga

SEQ ID NO: 72701 - DNA, 25 bp, mus musculus
tcattgactgctggattgacaatat

SEQ ID NO: 72702 - DNA, 25 bp, mus musculus
atatcaggctggtttacaacagaac

SEQ ID NO: 72703 - DNA, 25 bp, mus musculus
gcatgacttcacttcacagatcttc

SEQ ID NO: 72704 - DNA, 25 bp, mus musculus
gacttcacttcacagatcttctctt

SEQ ID NO: 72705 - DNA, 25 bp, mus musculus
ctaaagtttgcttattgtggcaaat

SEQ ID NO: 72706 - DNA, 25 bp, mus musculus
ggaaaagataacctcctcaatgctt

SEQ ID NO: 72707 - DNA, 25 bp, mus musculus
agataacctcctcaatgcttggcgg

SEQ ID NO: 72708 - DNA, 25 bp, mus musculus
gataacctcctcaatgcttggcgga

SEQ ID NO: 72709 - DNA, 25 bp, mus musculus
cctcaatgcttggcggaccccctat

SEQ ID NO: 72710 - DNA, 25 bp, mus musculus
caatgcttggcggaccccctatgga

SEQ ID NO: 72711 - DNA, 25 bp, mus musculus
gcggaccccctatggagccagcata

SEQ ID NO: 72712 - DNA, 25 bp, mus musculus
cggaccccctatggagccagcatat

SEQ ID NO: 72713 - DNA, 25 bp, mus musculus
agtcatctactgaaaacattatgtg

SEQ ID NO: 72714 - DNA, 25 bp, mus musculus
gtcatctactgaaaacattatgtgg

SEQ ID NO: 72715 - DNA, 25 bp, mus musculus
cttcacttcacagatcttctctttg

SEQ ID NO: 72716 - DNA, 25 bp, mus musculus
tcatctactgaaaacattatgtggt

SEQ ID NO: 72717 - DNA, 25 bp, mus musculus
ttcacttcacagatcttctctttgg

SEQ ID NO: 72718 - DNA, 25 bp, mus musculus
cacttcacagatcttctctttggga

SEQ ID NO: 72719 - DNA, 25 bp, mus musculus
acttcacagatcttctctttgggat

SEQ ID NO: 72720 - DNA, 25 bp, mus musculus
ttcacagatcttctctttgggatac

SEQ ID NO: 72721 - DNA, 25 bp, mus musculus
acagatcttctctttgggatactgc

SEQ ID NO: 72722 - DNA, 25 bp, mus musculus
atcttctctttgggatactgcccaa

SEQ ID NO: 72723 - DNA, 25 bp, mus musculus
tctgcatgtgaacaagcctgacaag

SEQ ID NO: 72724 - DNA, 25 bp, mus musculus
acctgctgtgtgcataacatcatcg

SEQ ID NO: 72725 - DNA, 25 bp, mus musculus
gtgtgcataacatcatcgtgggcaa

SEQ ID NO: 72726 - DNA, 25 bp, mus musculus
ggcaaactctggatcgaacagtatg

SEQ ID NO: 72727 - DNA, 25 bp, mus musculus
gcaaactctggatcgaacagtatgg

SEQ ID NO: 72728 - DNA, 25 bp, mus musculus
aaactctggatcgaacagtatggca

SEQ ID NO: 72729 - DNA, 25 bp, mus musculus
gaaatcataaaccacaagacagggg

SEQ ID NO: 72730 - DNA, 25 bp, mus musculus
taaaccacaagacaggggacaagtg

SEQ ID NO: 72731 - DNA, 25 bp, mus musculus
tttaagccatgtggtctttttggca

SEQ ID NO: 72732 - DNA, 25 bp, mus musculus
ttaagccatgtggtctttttggcaa

SEQ ID NO: 72733 - DNA, 25 bp, mus musculus
aagccatgtggtctttttggcaagg

SEQ ID NO: 72734 - DNA, 25 bp, mus musculus
ccatgtggtctttttggcaaggaat

SEQ ID NO: 72735 - DNA, 25 bp, mus musculus
catgtggtctttttggcaaggaatt

SEQ ID NO: 72736 - DNA, 25 bp, mus musculus
gtgcataacatcatcgtgggcaaac

SEQ ID NO: 72737 - DNA, 25 bp, mus musculus
tgcataacatcatcgtgggcaaact

SEQ ID NO: 72738 - DNA, 25 bp, mus musculus
cataacatcatcgtgggcaaactct

SEQ ID NO: 72739 - DNA, 25 bp, mus musculus
ataacatcatcgtgggcaaactctg

SEQ ID NO: 72740 - DNA, 25 bp, mus musculus
aacatcatcgtgggcaaactctgga

SEQ ID NO: 72741 - DNA, 25 bp, mus musculus
atcatcgtgggcaaactctggatcg

SEQ ID NO: 72742 - DNA, 25 bp, mus musculus
tcatcgtgggcaaactctggatcga

SEQ ID NO: 72743 - DNA, 25 bp, mus musculus
tgggcaaactctggatcgaacagta

SEQ ID NO: 72744 - DNA, 25 bp, mus musculus
acaaccctgacaccatgctctgaca

SEQ ID NO: 72745 - DNA, 25 bp, mus musculus
ccatgctctgacactatgtgggctc

SEQ ID NO: 72746 - DNA, 25 bp, mus musculus
tattcttactcagccgtgacagagc

SEQ ID NO: 72747 - DNA, 25 bp, mus musculus
tactcagccgtgacagagccgggcc

SEQ ID NO: 72748 - DNA, 25 bp, mus musculus
ccaggagttcctgcattttttgcca

SEQ ID NO: 72749 - DNA, 25 bp, mus musculus
gttcctgcattttttgccagtggct

SEQ ID NO: 72750 - DNA, 25 bp, mus musculus
gcattttttgccagtggctttgtag

SEQ ID NO: 72751 - DNA, 25 bp, mus musculus
tttgccagtggctttgtagataacc

SEQ ID NO: 72752 - DNA, 25 bp, mus musculus
tttgtagataaccagcccttcatcc

SEQ ID NO: 72753 - DNA, 25 bp, mus musculus
cagcccttcatccactatgacagta

SEQ ID NO: 72754 - DNA, 25 bp, mus musculus
ttcatccactatgacagtaggaaga

SEQ ID NO: 72755 - DNA, 25 bp, mus musculus
ccttgtgctgactggctgagggaaa

SEQ ID NO: 72756 - DNA, 25 bp, mus musculus
tctgacactatgtgggctctgatct

SEQ ID NO: 72757 - DNA, 25 bp, mus musculus
actatgtgggctctgatcttctgct

SEQ ID NO: 72758 - DNA, 25 bp, mus musculus
ctgatcttctgcttcctgagtcacc

SEQ ID NO: 72759 - DNA, 25 bp, mus musculus
gacactggagcccgatcacactctc

SEQ ID NO: 72760 - DNA, 25 bp, mus musculus
ggagcccgatcacactctctgcact

SEQ ID NO: 72761 - DNA, 25 bp, mus musculus
cgatcacactctctgcactattctt

SEQ ID NO: 72762 - DNA, 25 bp, mus musculus
cactctctgcactattcttactcag

SEQ ID NO: 72763 - DNA, 25 bp, mus musculus
ctgcactattcttactcagccgtga

SEQ ID NO: 72764 - DNA, 25 bp, mus musculus
tgacttcacctctcagatcttttca

SEQ ID NO: 72765 - DNA, 25 bp, mus musculus
tcagatcttttcacttggctattgc

SEQ ID NO: 72766 - DNA, 25 bp, mus musculus
gtcactcaagtttgcccactgtggc

SEQ ID NO: 72767 - DNA, 25 bp, mus musculus
tgcccactgtggcaaatggtttgta

SEQ ID NO: 72768 - DNA, 25 bp, mus musculus
cttcgtgcaaactggactcctcctc

SEQ ID NO: 72769 - DNA, 25 bp, mus musculus
gcaaactggactcctcctcatagca

SEQ ID NO: 72770 - DNA, 25 bp, mus musculus
catagcactttgcgctgttgtactt

SEQ ID NO: 72771 - DNA, 25 bp, mus musculus
caaggatttccaatactcattgcag

SEQ ID NO: 72772 - DNA, 25 bp, mus musculus
tttccaatactcattgcagttgtgg

SEQ ID NO: 72773 - DNA, 25 bp, mus musculus
atactcattgcagttgtggagttta

SEQ ID NO: 72774 - DNA, 25 bp, mus musculus
gagtttaatccttccatagcccact

SEQ ID NO: 72775 - DNA, 25 bp, mus musculus
ttcctccttgctattgaattgtgaa

SEQ ID NO: 72776 - DNA, 25 bp, mus musculus
cttttcacttggctattgcccaact

SEQ ID NO: 72777 - DNA, 25 bp, mus musculus
acttggctattgcccaactggagag

SEQ ID NO: 72778 - DNA, 25 bp, mus musculus
agtattgcatgtcaccaaaccagac

SEQ ID NO: 72779 - DNA, 25 bp, mus musculus
gcatgtcaccaaaccagacaaatac

SEQ ID NO: 72780 - DNA, 25 bp, mus musculus
caccaaaccagacaaataccagttg

SEQ ID NO: 72781 - DNA, 25 bp, mus musculus
accagacaaataccagttgcatctt

SEQ ID NO: 72782 - DNA, 25 bp, mus musculus
caaataccagttgcatcttcatgag

SEQ ID NO: 72783 - DNA, 25 bp, mus musculus
tgtgctgtcactcaagtttgcccac

SEQ ID NO: 72784 - DNA, 25 bp, mus musculus
agggctcggttcacagcaggctgaa

SEQ ID NO: 72785 - DNA, 25 bp, mus musculus
actcacggccgggctctacaggcag

SEQ ID NO: 72786 - DNA, 25 bp, mus musculus
gattctaaaagactatcctcactct

SEQ ID NO: 72787 - DNA, 25 bp, mus musculus
tctaaaagactatcctcactctgca

SEQ ID NO: 72788 - DNA, 25 bp, mus musculus
tcctcactctgcattcaccttggaa

SEQ ID NO: 72789 - DNA, 25 bp, mus musculus
tcactctgcattcaccttggaaaag

SEQ ID NO: 72790 - DNA, 25 bp, mus musculus
aacagagcctgaagactcaagatag

SEQ ID NO: 72791 - DNA, 25 bp, mus musculus
atagctgagatgctcctactgtttc

SEQ ID NO: 72792 - DNA, 25 bp, mus musculus
gctgagatgctcctactgtttctct

SEQ ID NO: 72793 - DNA, 25 bp, mus musculus
atgctcctactgtttctctggaaat

SEQ ID NO: 72794 - DNA, 25 bp, mus musculus
taagccttaataaccagtgttgcct

SEQ ID NO: 72795 - DNA, 25 bp, mus musculus
cccacacagtagtctgtggacatca

SEQ ID NO: 72796 - DNA, 25 bp, mus musculus
ttctgatagctctgatggacaagga

SEQ ID NO: 72797 - DNA, 25 bp, mus musculus
gaatctccgaattccgagtgtgcag

SEQ ID NO: 72798 - DNA, 25 bp, mus musculus
aattccgagtgtgcagaaccgacag

SEQ ID NO: 72799 - DNA, 25 bp, mus musculus
tgtgcagaaccgacagccccatcat

SEQ ID NO: 72800 - DNA, 25 bp, mus musculus
acagccccatcattttgtggtggat

SEQ ID NO: 72801 - DNA, 25 bp, mus musculus
gctttactccagtgaggccaagtcc

SEQ ID NO: 72802 - DNA, 25 bp, mus musculus
ttactccagtgaggccaagtcccac

SEQ ID NO: 72803 - DNA, 25 bp, mus musculus
ccactcctcagagagccttgggatt

SEQ ID NO: 72804 - DNA, 25 bp, mus musculus
ctttctcaggcctctagctgggtct

SEQ ID NO: 72805 - DNA, 25 bp, mus musculus
tctcaggcctctagctgggtctgtc

SEQ ID NO: 72806 - DNA, 25 bp, mus musculus
ctctgtcacctggaccatgtcagat

SEQ ID NO: 72807 - DNA, 25 bp, mus musculus
tgtcacctggaccatgtcagatacc

SEQ ID NO: 72808 - DNA, 25 bp, mus musculus
cacctggaccatgtcagataccgga

SEQ ID NO: 72809 - DNA, 25 bp, mus musculus
agagtccggtgtcgagttagcagac

SEQ ID NO: 72810 - DNA, 25 bp, mus musculus
gtccggtgtcgagttagcagaccgg

SEQ ID NO: 72811 - DNA, 25 bp, mus musculus
gataggcgacacgcactccaaagac

SEQ ID NO: 72812 - DNA, 25 bp, mus musculus
aggcgacacgcactccaaagacctg

SEQ ID NO: 72813 - DNA, 25 bp, mus musculus
cgacacgcactccaaagacctggag

SEQ ID NO: 72814 - DNA, 25 bp, mus musculus
cacgcactccaaagacctggagatc

SEQ ID NO: 72815 - DNA, 25 bp, mus musculus
ctccaaagacctggagatctggatg

SEQ ID NO: 72816 - DNA, 25 bp, mus musculus
agctgggtctgtcctgtacttcacc

SEQ ID NO: 72817 - DNA, 25 bp, mus musculus
gtctgtcctgtacttcaccagagga

SEQ ID NO: 72818 - DNA, 25 bp, mus musculus
aacgttcttgggagagcttgtcagg

SEQ ID NO: 72819 - DNA, 25 bp, mus musculus
agagcttgtcaggtgtggaacctca

SEQ ID NO: 72820 - DNA, 25 bp, mus musculus
ctcagccatggtggccttcttgttc

SEQ ID NO: 72821 - DNA, 25 bp, mus musculus
catggtggccttcttgttctgcaac

SEQ ID NO: 72822 - DNA, 25 bp, mus musculus
gttctgcaacctgctactggtggcc

SEQ ID NO: 72823 - DNA, 25 bp, mus musculus
caacctgctactggtggcctgtggc

SEQ ID NO: 72824 - DNA, 25 bp, mus musculus
cacatattctccaggtggccagcag

SEQ ID NO: 72825 - DNA, 25 bp, mus musculus
ttctccaggtggccagcagtggtgt

SEQ ID NO: 72826 - DNA, 25 bp, mus musculus
accttcactctgagactgggggctt

SEQ ID NO: 72827 - DNA, 25 bp, mus musculus
catccccatttttcgtgcttctagt

SEQ ID NO: 72828 - DNA, 25 bp, mus musculus
atttaacaagtgctgcagtttgccc

SEQ ID NO: 72829 - DNA, 25 bp, mus musculus
ggcctcctcaaccggcaggactgca

SEQ ID NO: 72830 - DNA, 25 bp, mus musculus
ctcctcaaccggcaggactgcagca

SEQ ID NO: 72831 - DNA, 25 bp, mus musculus
aaccggcaggactgcagcacctgtc

SEQ ID NO: 72832 - DNA, 25 bp, mus musculus
cggcaggactgcagcacctgtcgga

SEQ ID NO: 72833 - DNA, 25 bp, mus musculus
caggactgcagcacctgtcggacac

SEQ ID NO: 72834 - DNA, 25 bp, mus musculus
gactgcagcacctgtcggacactta

SEQ ID NO: 72835 - DNA, 25 bp, mus musculus
acctgtcggacacttagcgtgtctt

SEQ ID NO: 72836 - DNA, 25 bp, mus musculus
tgagcaactgaactacttcacttgg

SEQ ID NO: 72837 - DNA, 25 bp, mus musculus
gcaactgaactacttcacttggaca

SEQ ID NO: 72838 - DNA, 25 bp, mus musculus
actgaactacttcacttggacacgg

SEQ ID NO: 72839 - DNA, 25 bp, mus musculus
ctacttcacttggacacggagaaag

SEQ ID NO: 72840 - DNA, 25 bp, mus musculus
ggtctagcgacttacagtggaacct

SEQ ID NO: 72841 - DNA, 25 bp, mus musculus
acttacagtggaaccttcactctga

SEQ ID NO: 72842 - DNA, 25 bp, mus musculus
tacagtggaaccttcactctgagac

SEQ ID NO: 72843 - DNA, 25 bp, mus musculus
agtggaaccttcactctgagactgg

SEQ ID NO: 72844 - DNA, 25 bp, mus musculus
tctgcgtgctagatgtcgacctaca

SEQ ID NO: 72845 - DNA, 25 bp, mus musculus
tgctagatgtcgacctacaaggtgt

SEQ ID NO: 72846 - DNA, 25 bp, mus musculus
gcttgtttgacctggtgatcatcaa

SEQ ID NO: 72847 - DNA, 25 bp, mus musculus
ttgacctggtgatcatcaatgacga

SEQ ID NO: 72848 - DNA, 25 bp, mus musculus
tcatcaatgacgacctggataaagc

SEQ ID NO: 72849 - DNA, 25 bp, mus musculus
cctatgcaaccctgaagcaggcgct

SEQ ID NO: 72850 - DNA, 25 bp, mus musculus
caaccctgaagcaggcgctctctga

SEQ ID NO: 72851 - DNA, 25 bp, mus musculus
aggcgctctctgaggaaatcaagaa

SEQ ID NO: 72852 - DNA, 25 bp, mus musculus
ctggccacgcctgaaggcctgcttc

SEQ ID NO: 72853 - DNA, 25 bp, mus musculus
acgcctgaaggcctgcttcattcca

SEQ ID NO: 72854 - DNA, 25 bp, mus musculus
gaaggcctgcttcattccacagagt

SEQ ID NO: 72855 - DNA, 25 bp, mus musculus
cattccacagagtgatgtctgtggt

SEQ ID NO: 72856 - DNA, 25 bp, mus musculus
atgtcgacctacaaggtgtgcgcag

SEQ ID NO: 72857 - DNA, 25 bp, mus musculus
acctacaaggtgtgcgcagcatcaa

SEQ ID NO: 72858 - DNA, 25 bp, mus musculus
ctgatctgtgtcccatctacatctt

SEQ ID NO: 72859 - DNA, 25 bp, mus musculus
ccatctacatctttgtgcagcctcc

SEQ ID NO: 72860 - DNA, 25 bp, mus musculus
agcaacgactgcgactgcgcaacac

SEQ ID NO: 72861 - DNA, 25 bp, mus musculus
tggcagctgcacggacagacatgga

SEQ ID NO: 72862 - DNA, 25 bp, mus musculus
gcaaggagcctggcttgtttgacct

SEQ ID NO: 72863 - DNA, 25 bp, mus musculus
agcctggcttgtttgacctggtgat

SEQ ID NO: 72864 - DNA, 25 bp, mus musculus
atatgcaactggatgttttgtggca

SEQ ID NO: 72865 - DNA, 25 bp, mus musculus
acccacacaggtgaaaagagatttg

SEQ ID NO: 72866 - DNA, 25 bp, mus musculus
ggctctccacggattgtcacggttg

SEQ ID NO: 72867 - DNA, 25 bp, mus musculus
ccacggattgtcacggttgccgcca

SEQ ID NO: 72868 - DNA, 25 bp, mus musculus
tcgaatccagcaactcccaatgttt

SEQ ID NO: 72869 - DNA, 25 bp, mus musculus
ccagcaactcccaatgtttcaacaa

SEQ ID NO: 72870 - DNA, 25 bp, mus musculus
aatgtttcaacaaacatggaagaat

SEQ ID NO: 72871 - DNA, 25 bp, mus musculus
atttataacaaagacctctagtgct

SEQ ID NO: 72872 - DNA, 25 bp, mus musculus
gacctctagtgctgcacttaagttt

SEQ ID NO: 72873 - DNA, 25 bp, mus musculus
tgcacttaagtttacacacctttga

SEQ ID NO: 72874 - DNA, 25 bp, mus musculus
tacacacctttgaaaatctggaaat

SEQ ID NO: 72875 - DNA, 25 bp, mus musculus
gtttgtatccttggcatctttaagt

SEQ ID NO: 72876 - DNA, 25 bp, mus musculus
cggagtgatcacctatccaagcatg

SEQ ID NO: 72877 - DNA, 25 bp, mus musculus
gatcacctatccaagcatgtcaaaa

SEQ ID NO: 72878 - DNA, 25 bp, mus musculus
ctatccaagcatgtcaaaactcacc

SEQ ID NO: 72879 - DNA, 25 bp, mus musculus
gggacagctcttgccattgttacct

SEQ ID NO: 72880 - DNA, 25 bp, mus musculus
gccattgttacctccggagaactgg

SEQ ID NO: 72881 - DNA, 25 bp, mus musculus
gttacctccggagaactggactcat

SEQ ID NO: 72882 - DNA, 25 bp, mus musculus
gaactggactcatctgttacagagg

SEQ ID NO: 72883 - DNA, 25 bp, mus musculus
gactcatctgttacagaggtgcttg

SEQ ID NO: 72884 - DNA, 25 bp, mus musculus
cctcctagctctgattgagctttat

SEQ ID NO: 72885 - DNA, 25 bp, mus musculus
agctctgattgagctttatgtcgaa

SEQ ID NO: 72886 - DNA, 25 bp, mus musculus
aacgattctctcgatcattgcaaac

SEQ ID NO: 72887 - DNA, 25 bp, mus musculus
tctctcgatcattgcaaacattctt

SEQ ID NO: 72888 - DNA, 25 bp, mus musculus
gatcattgcaaacattcttctcccg

SEQ ID NO: 72889 - DNA, 25 bp, mus musculus
cgggctacagtttcatcactcggcg

SEQ ID NO: 72890 - DNA, 25 bp, mus musculus
acagtttcatcactcggcggagcta

SEQ ID NO: 72891 - DNA, 25 bp, mus musculus
tcatcactcggcggagctatggaag

SEQ ID NO: 72892 - DNA, 25 bp, mus musculus
ctcggcggagctatggaaggcgttc

SEQ ID NO: 72893 - DNA, 25 bp, mus musculus
ttcctactggagaagacggaatcct

SEQ ID NO: 72894 - DNA, 25 bp, mus musculus
actcagtttcgactcggtattgatg

SEQ ID NO: 72895 - DNA, 25 bp, mus musculus
tttcgactcggtattgatggagagc

SEQ ID NO: 72896 - DNA, 25 bp, mus musculus
ggtacctaacgacgcgatcattccg

SEQ ID NO: 72897 - DNA, 25 bp, mus musculus
taacgacgcgatcattccggtcctg

SEQ ID NO: 72898 - DNA, 25 bp, mus musculus
cacgatgacaactacgccaggcgca

SEQ ID NO: 72899 - DNA, 25 bp, mus musculus
aggcgcagcaaaccggtggcagaga

SEQ ID NO: 72900 - DNA, 25 bp, mus musculus
agcaaaccggtggcagagagctgag

SEQ ID NO: 72901 - DNA, 25 bp, mus musculus
gcgtagcatcggactggtcgtttcc

SEQ ID NO: 72902 - DNA, 25 bp, mus musculus
catcggactggtcgtttccatcaaa

SEQ ID NO: 72903 - DNA, 25 bp, mus musculus
actgcccggccgtcgtctgtggaca

SEQ ID NO: 72904 - DNA, 25 bp, mus musculus
ccttacttgcatcgctgttgtgggg

SEQ ID NO: 72905 - DNA, 25 bp, mus musculus
tacttgcatcgctgttgtggggatt

SEQ ID NO: 72906 - DNA, 25 bp, mus musculus
cacagctcgggccattgctaccaaa

SEQ ID NO: 72907 - DNA, 25 bp, mus musculus
tcgggccattgctaccaaatgcggt

SEQ ID NO: 72908 - DNA, 25 bp, mus musculus
tgctaccaaatgcggtattttacac

SEQ ID NO: 72909 - DNA, 25 bp, mus musculus
ggaagatttcctgtgcttagaaggt

SEQ ID NO: 72910 - DNA, 25 bp, mus musculus
tttcctgtgcttagaaggtaaagat

SEQ ID NO: 72911 - DNA, 25 bp, mus musculus
gatttggccaaagcttcgagtgctt

SEQ ID NO: 72912 - DNA, 25 bp, mus musculus
ttggccaaagcttcgagtgcttgca

SEQ ID NO: 72913 - DNA, 25 bp, mus musculus
gccaaagcttcgagtgcttgcaaga

SEQ ID NO: 72914 - DNA, 25 bp, mus musculus
aaagcttcgagtgcttgcaagatca

SEQ ID NO: 72915 - DNA, 25 bp, mus musculus
gcttcgagtgcttgcaagatcatct

SEQ ID NO: 72916 - DNA, 25 bp, mus musculus
tgaagatcctgtgaggcctgaggta

SEQ ID NO: 72917 - DNA, 25 bp, mus musculus
agatcctgtgaggcctgaggtacca

SEQ ID NO: 72918 - DNA, 25 bp, mus musculus
tcctgtgaggcctgaggtaccagag

SEQ ID NO: 72919 - DNA, 25 bp, mus musculus
tggaattaccgtgcgcatggtcact

SEQ ID NO: 72920 - DNA, 25 bp, mus musculus
aattaccgtgcgcatggtcactggt

SEQ ID NO: 72921 - DNA, 25 bp, mus musculus
cgtgcgcatggtcactggtgataat

SEQ ID NO: 72922 - DNA, 25 bp, mus musculus
tattaacacagctcgggccattgct

SEQ ID NO: 72923 - DNA, 25 bp, mus musculus
taacacagctcgggccattgctacc

SEQ ID NO: 72924 - DNA, 25 bp, mus musculus
catagctgtagcgcagacactcact

SEQ ID NO: 72925 - DNA, 25 bp, mus musculus
agctgtagcgcagacactcactcac

SEQ ID NO: 72926 - DNA, 25 bp, mus musculus
gcccgttcagctggagagacccgaa

SEQ ID NO: 72927 - DNA, 25 bp, mus musculus
gagacccgaatcgctcaggtcggcc

SEQ ID NO: 72928 - DNA, 25 bp, mus musculus
acccgaatcgctcaggtcggcctct

SEQ ID NO: 72929 - DNA, 25 bp, mus musculus
tgctcgggaagccgggagaaacaca

SEQ ID NO: 72930 - DNA, 25 bp, mus musculus
cacacgtagcactgcgccggcgtag

SEQ ID NO: 72931 - DNA, 25 bp, mus musculus
acgtagcactgcgccggcgtagtga

SEQ ID NO: 72932 - DNA, 25 bp, mus musculus
cactgcgccggcgtagtgacgtctc

SEQ ID NO: 72933 - DNA, 25 bp, mus musculus
gtagtgacgtctctgcgtgaagagc

SEQ ID NO: 72934 - DNA, 25 bp, mus musculus
gtgacgtctctgcgtgaagagccaa

SEQ ID NO: 72935 - DNA, 25 bp, mus musculus
tctctgcgtgaagagccaattgaaa

SEQ ID NO: 72936 - DNA, 25 bp, mus musculus
agcgcagacactcactcactaacta

SEQ ID NO: 72937 - DNA, 25 bp, mus musculus
gcagacactcactcactaactaact

SEQ ID NO: 72938 - DNA, 25 bp, mus musculus
cactcactaactaactagcgacact

SEQ ID NO: 72939 - DNA, 25 bp, mus musculus
ctaactaactagcgacacttcgtgg

SEQ ID NO: 72940 - DNA, 25 bp, mus musculus
tagcgacacttcgtggatttacgtt

SEQ ID NO: 72941 - DNA, 25 bp, mus musculus
cgacacttcgtggatttacgttgag

SEQ ID NO: 72942 - DNA, 25 bp, mus musculus
ttcgtggatttacgttgaggctgct

SEQ ID NO: 72943 - DNA, 25 bp, mus musculus
gatttacgttgaggctgctggagag

SEQ ID NO: 72944 - DNA, 25 bp, mus musculus
attgttaagcctggatcatgaagct

SEQ ID NO: 72945 - DNA, 25 bp, mus musculus
gttaagcctggatcatgaagctgtt

SEQ ID NO: 72946 - DNA, 25 bp, mus musculus
ttatgcactttgtcgctattaacat

SEQ ID NO: 72947 - DNA, 25 bp, mus musculus
atgcactttgtcgctattaacatcc

SEQ ID NO: 72948 - DNA, 25 bp, mus musculus
tgcactttgtcgctattaacatcct

SEQ ID NO: 72949 - DNA, 25 bp, mus musculus
acatccttttttcatatagatttca

SEQ ID NO: 72950 - DNA, 25 bp, mus musculus
cactaactgtactgttttgttatat

SEQ ID NO: 72951 - DNA, 25 bp, mus musculus
ttatatcaaataaacatcttctgtg

SEQ ID NO: 72952 - DNA, 25 bp, mus musculus
atatcaaataaacatcttctgtgga

SEQ ID NO: 72953 - DNA, 25 bp, mus musculus
tatcaaataaacatcttctgtggac

SEQ ID NO: 72954 - DNA, 25 bp, mus musculus
tcaaataaacatcttctgtggacca

SEQ ID NO: 72955 - DNA, 25 bp, mus musculus
caaataaacatcttctgtggaccag

SEQ ID NO: 72956 - DNA, 25 bp, mus musculus
agcctggatcatgaagctgttgatc

SEQ ID NO: 72957 - DNA, 25 bp, mus musculus
aattctcaattcagagaagttatct

SEQ ID NO: 72958 - DNA, 25 bp, mus musculus
tatctggtgtttcttgactttacca

SEQ ID NO: 72959 - DNA, 25 bp, mus musculus
actcaaaacagcccctctgtagttg

SEQ ID NO: 72960 - DNA, 25 bp, mus musculus
aacagcccctctgtagttgtggaag

SEQ ID NO: 72961 - DNA, 25 bp, mus musculus
cagcccctctgtagttgtggaagct

SEQ ID NO: 72962 - DNA, 25 bp, mus musculus
cccctctgtagttgtggaagcttat

SEQ ID NO: 72963 - DNA, 25 bp, mus musculus
ggttttatgcactttgtcgctatta

SEQ ID NO: 72964 - DNA, 25 bp, mus musculus
cagcaagatggcggctgctgaacga

SEQ ID NO: 72965 - DNA, 25 bp, mus musculus
aagatggcggctgctgaacgaggtt

SEQ ID NO: 72966 - DNA, 25 bp, mus musculus
gctctatttgcctctcacgagaaat

SEQ ID NO: 72967 - DNA, 25 bp, mus musculus
tctatttgcctctcacgagaaattt

SEQ ID NO: 72968 - DNA, 25 bp, mus musculus
tatttgcctctcacgagaaattttc

SEQ ID NO: 72969 - DNA, 25 bp, mus musculus
ttttcccaggaattgtcggacactg

SEQ ID NO: 72970 - DNA, 25 bp, mus musculus
ttcccaggaattgtcggacactgag

SEQ ID NO: 72971 - DNA, 25 bp, mus musculus
aattgtcggacactgagatggcttc

SEQ ID NO: 72972 - DNA, 25 bp, mus musculus
gcttcccaagtcacggcagagtttg

SEQ ID NO: 72973 - DNA, 25 bp, mus musculus
ttcccaagtcacggcagagtttgag

SEQ ID NO: 72974 - DNA, 25 bp, mus musculus
caagtcacggcagagtttgagaagg

SEQ ID NO: 72975 - DNA, 25 bp, mus musculus
agtcacggcagagtttgagaaggaa

SEQ ID NO: 72976 - DNA, 25 bp, mus musculus
agcaccctgtactaacatctcggcc

SEQ ID NO: 72977 - DNA, 25 bp, mus musculus
tgcttaagggccccagaagagatcg

SEQ ID NO: 72978 - DNA, 25 bp, mus musculus
gagatcgccaggagacattgcaaac

SEQ ID NO: 72979 - DNA, 25 bp, mus musculus
agacattgcaaaccatgctctattt

SEQ ID NO: 72980 - DNA, 25 bp, mus musculus
acattgcaaaccatgctctatttgc

SEQ ID NO: 72981 - DNA, 25 bp, mus musculus
tgcaaaccatgctctatttgcctct

SEQ ID NO: 72982 - DNA, 25 bp, mus musculus
caaaccatgctctatttgcctctca

SEQ ID NO: 72983 - DNA, 25 bp, mus musculus
aaccatgctctatttgcctctcacg

SEQ ID NO: 72984 - DNA, 25 bp, mus musculus
tggtcctcgtcacagccttcaatga

SEQ ID NO: 72985 - DNA, 25 bp, mus musculus
tcctcgtcacagccttcaatgattg

SEQ ID NO: 72986 - DNA, 25 bp, mus musculus
acattgcccagatcaaatacggtga

SEQ ID NO: 72987 - DNA, 25 bp, mus musculus
ttgcccagatcaaatacggtgacct

SEQ ID NO: 72988 - DNA, 25 bp, mus musculus
ttcctgctgatggcctcttcatcca

SEQ ID NO: 72989 - DNA, 25 bp, mus musculus
ctgctgatggcctcttcatccaggg

SEQ ID NO: 72990 - DNA, 25 bp, mus musculus
ctgatggcctcttcatccagggcaa

SEQ ID NO: 72991 - DNA, 25 bp, mus musculus
atggcctcttcatccagggcaatga

SEQ ID NO: 72992 - DNA, 25 bp, mus musculus
gcctcttcatccagggcaatgacct

SEQ ID NO: 72993 - DNA, 25 bp, mus musculus
tcttcatccagggcaatgacctcaa

SEQ ID NO: 72994 - DNA, 25 bp, mus musculus
tcatccagggcaatgacctcaagat

SEQ ID NO: 72995 - DNA, 25 bp, mus musculus
tccagggcaatgacctcaagatcga

SEQ ID NO: 72996 - DNA, 25 bp, mus musculus
tcgtcacagccttcaatgattggag

SEQ ID NO: 72997 - DNA, 25 bp, mus musculus
gcaatgacctcaagatcgatgaaag

SEQ ID NO: 72998 - DNA, 25 bp, mus musculus
tcacagccttcaatgattggagtaa

SEQ ID NO: 72999 - DNA, 25 bp, mus musculus
cagccttcaatgattggagtaaaga

SEQ ID NO: 73000 - DNA, 25 bp, mus musculus
gcctgcagagccgaattgagcagga

SEQ ID NO: 73001 - DNA, 25 bp, mus musculus
tcaccgtagtccgggctggccaggt

SEQ ID NO: 73002 - DNA, 25 bp, mus musculus
aggtggtccagatccctgtggccga

SEQ ID NO: 73003 - DNA, 25 bp, mus musculus
agatccctgtggccgagattgtggt

SEQ ID NO: 73004 - DNA, 25 bp, mus musculus
gggacattgcccagatcaaatacgg

SEQ ID NO: 73005 - DNA, 25 bp, mus musculus
caactgagccggaattgaaggaatt

SEQ ID NO: 73006 - DNA, 25 bp, mus musculus
aactgagccggaattgaaggaattg

SEQ ID NO: 73007 - DNA, 25 bp, mus musculus
gacttccagaattccttgacaatga

SEQ ID NO: 73008 - DNA, 25 bp, mus musculus
acttccagaattccttgacaatgat

SEQ ID NO: 73009 - DNA, 25 bp, mus musculus
cttccagaattccttgacaatgatg

SEQ ID NO: 73010 - DNA, 25 bp, mus musculus
ttccagaattccttgacaatgatgg

SEQ ID NO: 73011 - DNA, 25 bp, mus musculus
tccagaattccttgacaatgatggc

SEQ ID NO: 73012 - DNA, 25 bp, mus musculus
ccagaattccttgacaatgatggca

SEQ ID NO: 73013 - DNA, 25 bp, mus musculus
agaattccttgacaatgatggcaag

SEQ ID NO: 73014 - DNA, 25 bp, mus musculus
gaattccttgacaatgatggcaaga

SEQ ID NO: 73015 - DNA, 25 bp, mus musculus
aattccttgacaatgatggcaagaa

SEQ ID NO: 73016 - DNA, 25 bp, mus musculus
attccttgacaatgatggcaagaag

SEQ ID NO: 73017 - DNA, 25 bp, mus musculus
ttgaatcttgttgcaattgggacaa

SEQ ID NO: 73018 - DNA, 25 bp, mus musculus
tgaatcttgttgcaattgggacaat

SEQ ID NO: 73019 - DNA, 25 bp, mus musculus
gaatcttgttgcaattgggacaatg

SEQ ID NO: 73020 - DNA, 25 bp, mus musculus
aatcttgttgcaattgggacaatgg

SEQ ID NO: 73021 - DNA, 25 bp, mus musculus
atcttgttgcaattgggacaatgga

SEQ ID NO: 73022 - DNA, 25 bp, mus musculus
aatggacttccagaattccttgaca

SEQ ID NO: 73023 - DNA, 25 bp, mus musculus
atggacttccagaattccttgacaa

SEQ ID NO: 73024 - DNA, 25 bp, mus musculus
tggacttccagaattccttgacaat

SEQ ID NO: 73025 - DNA, 25 bp, mus musculus
tccagacaaggcacaagtgagactg

SEQ ID NO: 73026 - DNA, 25 bp, mus musculus
gatcgaatccaaagtcggcatattc

SEQ ID NO: 73027 - DNA, 25 bp, mus musculus
cttgggtgccaatgtccagtatatg

SEQ ID NO: 73028 - DNA, 25 bp, mus musculus
tgccaatgtccagtatatgagagtc

SEQ ID NO: 73029 - DNA, 25 bp, mus musculus
atgggtctgagtggcctcagctgga

SEQ ID NO: 73030 - DNA, 25 bp, mus musculus
taattccagatgtacagcacatctc

SEQ ID NO: 73031 - DNA, 25 bp, mus musculus
cagatgtacagcacatctctggaga

SEQ ID NO: 73032 - DNA, 25 bp, mus musculus
tacagcacatctctggagagtctcc

SEQ ID NO: 73033 - DNA, 25 bp, mus musculus
acatctctggagagtctccaaaata

SEQ ID NO: 73034 - DNA, 25 bp, mus musculus
cctcactgacttctccaggaagggc

SEQ ID NO: 73035 - DNA, 25 bp, mus musculus
aattcaccatctgaccttcatgttt

SEQ ID NO: 73036 - DNA, 25 bp, mus musculus
ggcactttgtaggtcctcaataccg

SEQ ID NO: 73037 - DNA, 25 bp, mus musculus
atccaaagtcggcatattcaatgtg

SEQ ID NO: 73038 - DNA, 25 bp, mus musculus
gcactttgtaggtcctcaataccgg

SEQ ID NO: 73039 - DNA, 25 bp, mus musculus
cctctaccctgatgtcaatgctgag

SEQ ID NO: 73040 - DNA, 25 bp, mus musculus
aaggcatattcagctccacgacctc

SEQ ID NO: 73041 - DNA, 25 bp, mus musculus
cgacctcgacttccagatccgcaag

SEQ ID NO: 73042 - DNA, 25 bp, mus musculus
cgacttccagatccgcaaggacttc

SEQ ID NO: 73043 - DNA, 25 bp, mus musculus
ccagatccgcaaggacttcttatac

SEQ ID NO: 73044 - DNA, 25 bp, mus musculus
ggacttcttatacttgggtgccaat

SEQ ID NO: 73045 - DNA, 25 bp, mus musculus
cttatacttgggtgccaatgtccag

SEQ ID NO: 73046 - DNA, 25 bp, mus musculus
tcattgagcccaccgtgttctccaa

SEQ ID NO: 73047 - DNA, 25 bp, mus musculus
agatctttggtcctgttcaagaaat

SEQ ID NO: 73048 - DNA, 25 bp, mus musculus
acatcaacaaggctctcatggtatc

SEQ ID NO: 73049 - DNA, 25 bp, mus musculus
tcaacaaggctctcatggtatcctc

SEQ ID NO: 73050 - DNA, 25 bp, mus musculus
ctctcatggtatcctccgcaatgca

SEQ ID NO: 73051 - DNA, 25 bp, mus musculus
tcatggtatcctccgcaatgcaagc

SEQ ID NO: 73052 - DNA, 25 bp, mus musculus
tggtatcctccgcaatgcaagctgg

SEQ ID NO: 73053 - DNA, 25 bp, mus musculus
cctccgcaatgcaagctgggacagt

SEQ ID NO: 73054 - DNA, 25 bp, mus musculus
tcaattgttacaatgccttaaatgc

SEQ ID NO: 73055 - DNA, 25 bp, mus musculus
gttacaatgccttaaatgcgcagag

SEQ ID NO: 73056 - DNA, 25 bp, mus musculus
acaatgccttaaatgcgcagagccc

SEQ ID NO: 73057 - DNA, 25 bp, mus musculus
actcctaagaggccgaggctgaaga

SEQ ID NO: 73058 - DNA, 25 bp, mus musculus
gagccaataactcagactttggact

SEQ ID NO: 73059 - DNA, 25 bp, mus musculus
ccaataactcagactttggacttgt

SEQ ID NO: 73060 - DNA, 25 bp, mus musculus
ataactcagactttggacttgtagc

SEQ ID NO: 73061 - DNA, 25 bp, mus musculus
actttggacttgtagcagctgtctt

SEQ ID NO: 73062 - DNA, 25 bp, mus musculus
tagcagctgtcttcactaatgacat

SEQ ID NO: 73063 - DNA, 25 bp, mus musculus
cagctgtcttcactaatgacatcaa

SEQ ID NO: 73064 - DNA, 25 bp, mus musculus
tcttcactaatgacatcaacaaggc

SEQ ID NO: 73065 - DNA, 25 bp, mus musculus
ctaatgacatcaacaaggctctcat

SEQ ID NO: 73066 - DNA, 25 bp, mus musculus
caggccagcttaacctgttcacaca

SEQ ID NO: 73067 - DNA, 25 bp, mus musculus
agcttaacctgttcacacaaatgat

SEQ ID NO: 73068 - DNA, 25 bp, mus musculus
tctctctggggaagtgctgaatagt

SEQ ID NO: 73069 - DNA, 25 bp, mus musculus
gaatagtctccaaattcaagaaact

SEQ ID NO: 73070 - DNA, 25 bp, mus musculus
tctccaaattcaagaaactcaccat

SEQ ID NO: 73071 - DNA, 25 bp, mus musculus
aattcaagaaactcaccatgtctta

SEQ ID NO: 73072 - DNA, 25 bp, mus musculus
tgtgtgcagccatcttccaaatgac

SEQ ID NO: 73073 - DNA, 25 bp, mus musculus
aaatgactgcctggatgtttcttag

SEQ ID NO: 73074 - DNA, 25 bp, mus musculus
ctgcctggatgtttcttagtccagt

SEQ ID NO: 73075 - DNA, 25 bp, mus musculus
ttcttagtccagttactactgctgc

SEQ ID NO: 73076 - DNA, 25 bp, mus musculus
gtccagttactactgctgctgctat

SEQ ID NO: 73077 - DNA, 25 bp, mus musculus
ttactactgctgctgctattggtct

SEQ ID NO: 73078 - DNA, 25 bp, mus musculus
acctgttcacacaaatgattttgtg

SEQ ID NO: 73079 - DNA, 25 bp, mus musculus
ttttgtgaccacttcattgtatctg

SEQ ID NO: 73080 - DNA, 25 bp, mus musculus
gaccacttcattgtatctgtatctt

SEQ ID NO: 73081 - DNA, 25 bp, mus musculus
ttcattgtatctgtatcttgagaag

SEQ ID NO: 73082 - DNA, 25 bp, mus musculus
aatgcagttaatccctagatatcgg

SEQ ID NO: 73083 - DNA, 25 bp, mus musculus
gttaatccctagatatcggataata

SEQ ID NO: 73084 - DNA, 25 bp, mus musculus
atatcggataatacccagttcacta

SEQ ID NO: 73085 - DNA, 25 bp, mus musculus
ttcactagtaaactcatttctctct

SEQ ID NO: 73086 - DNA, 25 bp, mus musculus
tgttgatgtgcaattccgtgaggga

SEQ ID NO: 73087 - DNA, 25 bp, mus musculus
ttgatgtgcaattccgtgagggatt

SEQ ID NO: 73088 - DNA, 25 bp, mus musculus
caactatcctaaattgcttggaaat

SEQ ID NO: 73089 - DNA, 25 bp, mus musculus
aactatcctaaattgcttggaaatg

SEQ ID NO: 73090 - DNA, 25 bp, mus musculus
ctatcctaaattgcttggaaatgca

SEQ ID NO: 73091 - DNA, 25 bp, mus musculus
tatcctaaattgcttggaaatgcaa

SEQ ID NO: 73092 - DNA, 25 bp, mus musculus
ggcctgagaccttgggcagaatgtt

SEQ ID NO: 73093 - DNA, 25 bp, mus musculus
gcctgagaccttgggcagaatgttg

SEQ ID NO: 73094 - DNA, 25 bp, mus musculus
agaccttgggcagaatgttgatgtc

SEQ ID NO: 73095 - DNA, 25 bp, mus musculus
atgtcatttgagagctcttggtgtg

SEQ ID NO: 73096 - DNA, 25 bp, mus musculus
tcatttgagagctcttggtgtgaga

SEQ ID NO: 73097 - DNA, 25 bp, mus musculus
catttgagagctcttggtgtgagag

SEQ ID NO: 73098 - DNA, 25 bp, mus musculus
gatgtgcaattccgtgagggattaa

SEQ ID NO: 73099 - DNA, 25 bp, mus musculus
atgtgcaattccgtgagggattaac

SEQ ID NO: 73100 - DNA, 25 bp, mus musculus
tgtgcaattccgtgagggattaaca

SEQ ID NO: 73101 - DNA, 25 bp, mus musculus
tgcaattccgtgagggattaacaac

SEQ ID NO: 73102 - DNA, 25 bp, mus musculus
ggattaacaactatcctaaattgct

SEQ ID NO: 73103 - DNA, 25 bp, mus musculus
attaacaactatcctaaattgcttg

SEQ ID NO: 73104 - DNA, 25 bp, mus musculus
ttaacaactatcctaaattgcttgg

SEQ ID NO: 73105 - DNA, 25 bp, mus musculus
taacaactatcctaaattgcttgga

SEQ ID NO: 73106 - DNA, 25 bp, mus musculus
ctgagctctacggggcagccaacca

SEQ ID NO: 73107 - DNA, 25 bp, mus musculus
tctacggggcagccaaccaggactc

SEQ ID NO: 73108 - DNA, 25 bp, mus musculus
tgattgccacagccttcaccaatgg

SEQ ID NO: 73109 - DNA, 25 bp, mus musculus
ccacagccttcaccaatgggtacca

SEQ ID NO: 73110 - DNA, 25 bp, mus musculus
tcaccaatgggtaccactgaaacag

SEQ ID NO: 73111 - DNA, 25 bp, mus musculus
cccagcctgcagctgactgaggacc

SEQ ID NO: 73112 - DNA, 25 bp, mus musculus
gaccagactgagccagcaaggggat

SEQ ID NO: 73113 - DNA, 25 bp, mus musculus
cagactgagccagcaaggggattgg

SEQ ID NO: 73114 - DNA, 25 bp, mus musculus
ctgccacttggaccgctactgcctg

SEQ ID NO: 73115 - DNA, 25 bp, mus musculus
tcatgtctggctcccctactaacct

SEQ ID NO: 73116 - DNA, 25 bp, mus musculus
tcctgttcagaccttgtctcttctc

SEQ ID NO: 73117 - DNA, 25 bp, mus musculus
cccccagaaaggcatagctggaggg

SEQ ID NO: 73118 - DNA, 25 bp, mus musculus
cagccaaccaggactccggggtcag

SEQ ID NO: 73119 - DNA, 25 bp, mus musculus
aggactccggggtcagcagttacat

SEQ ID NO: 73120 - DNA, 25 bp, mus musculus
actccggggtcagcagttacatcag

SEQ ID NO: 73121 - DNA, 25 bp, mus musculus
tcagcagttacatcagcgccgccag

SEQ ID NO: 73122 - DNA, 25 bp, mus musculus
ccagcactggtttcggccacagtct

SEQ ID NO: 73123 - DNA, 25 bp, mus musculus
gcactggtttcggccacagtcttgg

SEQ ID NO: 73124 - DNA, 25 bp, mus musculus
gtcccttgattgccacagccttcac

SEQ ID NO: 73125 - DNA, 25 bp, mus musculus
ccttgattgccacagccttcaccaa

SEQ ID NO: 73126 - DNA, 25 bp, mus musculus
agtgcctcaggagactgcacagact

SEQ ID NO: 73127 - DNA, 25 bp, mus musculus
cccatgccttaggggtgcatggaag

SEQ ID NO: 73128 - DNA, 25 bp, mus musculus
gcaaggccccagagggacaggctcc

SEQ ID NO: 73129 - DNA, 25 bp, mus musculus
ttcccaggactgccttgccactctt

SEQ ID NO: 73130 - DNA, 25 bp, mus musculus
gatactgtacattgtctcaatgcct

SEQ ID NO: 73131 - DNA, 25 bp, mus musculus
tgtctcaatgcctgtttttacatat

SEQ ID NO: 73132 - DNA, 25 bp, mus musculus
tttggtcaggttggcattgatcctt

SEQ ID NO: 73133 - DNA, 25 bp, mus musculus
ggcattgatcctttcttaagatgct

SEQ ID NO: 73134 - DNA, 25 bp, mus musculus
gatcctttcttaagatgctgtgaga

SEQ ID NO: 73135 - DNA, 25 bp, mus musculus
tgtgagaaccatttcatccaatgcc

SEQ ID NO: 73136 - DNA, 25 bp, mus musculus
aaccatttcatccaatgccaaataa

SEQ ID NO: 73137 - DNA, 25 bp, mus musculus
ttcatccaatgccaaataaacttgt

SEQ ID NO: 73138 - DNA, 25 bp, mus musculus
ccttaggggtgcatggaaggcctct

SEQ ID NO: 73139 - DNA, 25 bp, mus musculus
tttagactattgctattccagttcc

SEQ ID NO: 73140 - DNA, 25 bp, mus musculus
ctattccagttccaagcactggagt

SEQ ID NO: 73141 - DNA, 25 bp, mus musculus
cagttccaagcactggagtctgcca

SEQ ID NO: 73142 - DNA, 25 bp, mus musculus
caagcactggagtctgccagatctc

SEQ ID NO: 73143 - DNA, 25 bp, mus musculus
agatctcactggtgaataatcccaa

SEQ ID NO: 73144 - DNA, 25 bp, mus musculus
tgaataatcccaaatccaagatttg

SEQ ID NO: 73145 - DNA, 25 bp, mus musculus
atcccaaatccaagatttgatgagg

SEQ ID NO: 73146 - DNA, 25 bp, mus musculus
tttcggctcgacattgtaagaacag

SEQ ID NO: 73147 - DNA, 25 bp, mus musculus
ttgtggctgtccacagaacactggg

SEQ ID NO: 73148 - DNA, 25 bp, mus musculus
ctattctcactgatccgaacatctc

SEQ ID NO: 73149 - DNA, 25 bp, mus musculus
ttctcactgatccgaacatctctct

SEQ ID NO: 73150 - DNA, 25 bp, mus musculus
tcactgatccgaacatctctcttcg

SEQ ID NO: 73151 - DNA, 25 bp, mus musculus
ctgatccgaacatctctcttcgctg

SEQ ID NO: 73152 - DNA, 25 bp, mus musculus
ctcttcgctggtaggaagaaggtga

SEQ ID NO: 73153 - DNA, 25 bp, mus musculus
tcctgcccgtgaggactaagagatc

SEQ ID NO: 73154 - DNA, 25 bp, mus musculus
ttcttcctagggcccttccattgct

SEQ ID NO: 73155 - DNA, 25 bp, mus musculus
ctagggcccttccattgctcctgtg

SEQ ID NO: 73156 - DNA, 25 bp, mus musculus
gggcccttccattgctcctgtgtta

SEQ ID NO: 73157 - DNA, 25 bp, mus musculus
cccttccattgctcctgtgttacca

SEQ ID NO: 73158 - DNA, 25 bp, mus musculus
tggctgtccacagaacactggggat

SEQ ID NO: 73159 - DNA, 25 bp, mus musculus
tccacagaacactggggatccaaac

SEQ ID NO: 73160 - DNA, 25 bp, mus musculus
ggatccaaaccactgctagctaggt

SEQ ID NO: 73161 - DNA, 25 bp, mus musculus
aaaccactgctagctaggtgaagcc

SEQ ID NO: 73162 - DNA, 25 bp, mus musculus
ccactgctagctaggtgaagcctcg

SEQ ID NO: 73163 - DNA, 25 bp, mus musculus
agtgaggtctcgcggaagtgctccg

SEQ ID NO: 73164 - DNA, 25 bp, mus musculus
ccaagcagcccggggcttgggctat

SEQ ID NO: 73165 - DNA, 25 bp, mus musculus
cttgggctattctcactgatccgaa

SEQ ID NO: 73166 - DNA, 25 bp, mus musculus
ggcttcctcaaggactgtccgagcg

SEQ ID NO: 73167 - DNA, 25 bp, mus musculus
gagttccagcagctctatgtgaagt

SEQ ID NO: 73168 - DNA, 25 bp, mus musculus
atggtgggcaccgtgatcatgatga

SEQ ID NO: 73169 - DNA, 25 bp, mus musculus
gatggcctgacgcctgaacagcggg

SEQ ID NO: 73170 - DNA, 25 bp, mus musculus
attgtattacttctgcagtgtgaca

SEQ ID NO: 73171 - DNA, 25 bp, mus musculus
ttacttctgcagtgtgacattcaga

SEQ ID NO: 73172 - DNA, 25 bp, mus musculus
gctatggactgcacacaagtcttga

SEQ ID NO: 73173 - DNA, 25 bp, mus musculus
gactgcacacaagtcttgatgttcc

SEQ ID NO: 73174 - DNA, 25 bp, mus musculus
gtcttgatgttccattcagtctgca

SEQ ID NO: 73175 - DNA, 25 bp, mus musculus
atgttccattcagtctgcagctaca

SEQ ID NO: 73176 - DNA, 25 bp, mus musculus
cattcagtctgcagctacacacaca

SEQ ID NO: 73177 - DNA, 25 bp, mus musculus
gtctgcagctacacacacacacaca

SEQ ID NO: 73178 - DNA, 25 bp, mus musculus
aagttcgcgcagcacgccttccgca

SEQ ID NO: 73179 - DNA, 25 bp, mus musculus
ttccgcaccttcgacaagaacggtg

SEQ ID NO: 73180 - DNA, 25 bp, mus musculus
accttcgacaagaacggtgatggca

SEQ ID NO: 73181 - DNA, 25 bp, mus musculus
ttcatctgtgccctgtccatcacct

SEQ ID NO: 73182 - DNA, 25 bp, mus musculus
tgtgccctgtccatcacctccagag

SEQ ID NO: 73183 - DNA, 25 bp, mus musculus
atcacctccagaggtagctttgagc

SEQ ID NO: 73184 - DNA, 25 bp, mus musculus
atgtatgatctggacggtgacggca

SEQ ID NO: 73185 - DNA, 25 bp, mus musculus
aagatcacccgagtggagatgctgg

SEQ ID NO: 73186 - DNA, 25 bp, mus musculus
ctgtgagcttcctaagttagagaaa

SEQ ID NO: 73187 - DNA, 25 bp, mus musculus
acggcttagagctactgcagaaaga

SEQ ID NO: 73188 - DNA, 25 bp, mus musculus
gtaaacgctatcagcaagaagtaga

SEQ ID NO: 73189 - DNA, 25 bp, mus musculus
aaacgctatcagcaagaagtagacc

SEQ ID NO: 73190 - DNA, 25 bp, mus musculus
tctgcccagattgcaaagcctatcc

SEQ ID NO: 73191 - DNA, 25 bp, mus musculus
tgcccagattgcaaagcctatccgc

SEQ ID NO: 73192 - DNA, 25 bp, mus musculus
cagattgcaaagcctatccgccctg

SEQ ID NO: 73193 - DNA, 25 bp, mus musculus
gattgcaaagcctatccgccctgga

SEQ ID NO: 73194 - DNA, 25 bp, mus musculus
ttgcaaagcctatccgccctggaca

SEQ ID NO: 73195 - DNA, 25 bp, mus musculus
aaagcctatccgccctggacagcat

SEQ ID NO: 73196 - DNA, 25 bp, mus musculus
tatccgccctggacagcatccagcg

SEQ ID NO: 73197 - DNA, 25 bp, mus musculus
caactcacccaggcacagttcgtgg

SEQ ID NO: 73198 - DNA, 25 bp, mus musculus
agctttggagtcagccctgaaagaa

SEQ ID NO: 73199 - DNA, 25 bp, mus musculus
atttgttcagaacaaccagccagtg

SEQ ID NO: 73200 - DNA, 25 bp, mus musculus
tcagccctgaaagaagccaaagaaa

SEQ ID NO: 73201 - DNA, 25 bp, mus musculus
tgcatctcgagaccgtaaacgctat

SEQ ID NO: 73202 - DNA, 25 bp, mus musculus
catctcgagaccgtaaacgctatca

SEQ ID NO: 73203 - DNA, 25 bp, mus musculus
tctcgagaccgtaaacgctatcagc

SEQ ID NO: 73204 - DNA, 25 bp, mus musculus
gagaccgtaaacgctatcagcaaga

SEQ ID NO: 73205 - DNA, 25 bp, mus musculus
gaccgtaaacgctatcagcaagaag

SEQ ID NO: 73206 - DNA, 25 bp, mus musculus
ccgtaaacgctatcagcaagaagta

SEQ ID NO: 73207 - DNA, 25 bp, mus musculus
gaattcatctcagaatactgtgggg

SEQ ID NO: 73208 - DNA, 25 bp, mus musculus
atgtgcagctttctgttcaacttga

SEQ ID NO: 73209 - DNA, 25 bp, mus musculus
cttctctctgaaacagctgccttag

SEQ ID NO: 73210 - DNA, 25 bp, mus musculus
ctctctgaaacagctgccttagctt

SEQ ID NO: 73211 - DNA, 25 bp, mus musculus
tctgaaacagctgccttagcttcag

SEQ ID NO: 73212 - DNA, 25 bp, mus musculus
acagctgccttagcttcaggaacct

SEQ ID NO: 73213 - DNA, 25 bp, mus musculus
gctgccttagcttcaggaaccttga

SEQ ID NO: 73214 - DNA, 25 bp, mus musculus
gccttagcttcaggaaccttgagta

SEQ ID NO: 73215 - DNA, 25 bp, mus musculus
ggaaccttgagtactgtgggcaatt

SEQ ID NO: 73216 - DNA, 25 bp, mus musculus
ttattgccttctcaccagctgcaaa

SEQ ID NO: 73217 - DNA, 25 bp, mus musculus
ccttctcaccagctgcaaagtgttt

SEQ ID NO: 73218 - DNA, 25 bp, mus musculus
tctcaccagctgcaaagtgttttgt

SEQ ID NO: 73219 - DNA, 25 bp, mus musculus
tgcagctttctgttcaacttgaaca

SEQ ID NO: 73220 - DNA, 25 bp, mus musculus
agctttctgttcaacttgaacaatg

SEQ ID NO: 73221 - DNA, 25 bp, mus musculus
gtggatgcaacccgaaagggcaaca

SEQ ID NO: 73222 - DNA, 25 bp, mus musculus
attcgttttgctaatcattcagtaa

SEQ ID NO: 73223 - DNA, 25 bp, mus musculus
tcagtaaatccaaactgctatgcaa

SEQ ID NO: 73224 - DNA, 25 bp, mus musculus
gtaaatccaaactgctatgcaaaag

SEQ ID NO: 73225 - DNA, 25 bp, mus musculus
aatccaaactgctatgcaaaagtta

SEQ ID NO: 73226 - DNA, 25 bp, mus musculus
aatggtgaccacaggataggcatct

SEQ ID NO: 73227 - DNA, 25 bp, mus musculus
ttctttatcaatcaccttctgcccc

SEQ ID NO: 73228 - DNA, 25 bp, mus musculus
caacatggcctgctcctgcttaaga

SEQ ID NO: 73229 - DNA, 25 bp, mus musculus
tcctctgcttcttgagcccacacat

SEQ ID NO: 73230 - DNA, 25 bp, mus musculus
taccctaccaggcacaatgctctac

SEQ ID NO: 73231 - DNA, 25 bp, mus musculus
aagattttggctgtagcctttgata

SEQ ID NO: 73232 - DNA, 25 bp, mus musculus
ctacagaccatttctgtgctaactt

SEQ ID NO: 73233 - DNA, 25 bp, mus musculus
tctgtgctaactttagaatgattag

SEQ ID NO: 73234 - DNA, 25 bp, mus musculus
ttcttttgggacccacagtctcagt

SEQ ID NO: 73235 - DNA, 25 bp, mus musculus
ccacagtctcagtgctgcaagtcca

SEQ ID NO: 73236 - DNA, 25 bp, mus musculus
aatcccaactgcctcttgactggct

SEQ ID NO: 73237 - DNA, 25 bp, mus musculus
aactgcctcttgactggctcaagat

SEQ ID NO: 73238 - DNA, 25 bp, mus musculus
ctcttgactggctcaagatttaggt

SEQ ID NO: 73239 - DNA, 25 bp, mus musculus
gcagctctgtgagccacaaacctag

SEQ ID NO: 73240 - DNA, 25 bp, mus musculus
ctgtgagccacaaacctaggtgttt

SEQ ID NO: 73241 - DNA, 25 bp, mus musculus
gccacaaacctaggtgttttagcag

SEQ ID NO: 73242 - DNA, 25 bp, mus musculus
cagccttaccctagagtctgtgtta

SEQ ID NO: 73243 - DNA, 25 bp, mus musculus
aggcccagcctctattgctgatgcc

SEQ ID NO: 73244 - DNA, 25 bp, mus musculus
agcctctattgctgatgcctcgtcc

SEQ ID NO: 73245 - DNA, 25 bp, mus musculus
tattgctgatgcctcgtccagccca

SEQ ID NO: 73246 - DNA, 25 bp, mus musculus
cagcccaggacgtggaagtctgcta

SEQ ID NO: 73247 - DNA, 25 bp, mus musculus
acccagatgttctcactgaagttcc

SEQ ID NO: 73248 - DNA, 25 bp, mus musculus
cagatgttctcactgaagttccagc

SEQ ID NO: 73249 - DNA, 25 bp, mus musculus
catccggggcttttatggcattgaa

SEQ ID NO: 73250 - DNA, 25 bp, mus musculus
acatgtgttggccttggacatcttg

SEQ ID NO: 73251 - DNA, 25 bp, mus musculus
catcttgatccggaaaccctgtgta

SEQ ID NO: 73252 - DNA, 25 bp, mus musculus
gctgctcaagtttgaccggaagcag

SEQ ID NO: 73253 - DNA, 25 bp, mus musculus
tgaccggaagcagcttcgatccgtt

SEQ ID NO: 73254 - DNA, 25 bp, mus musculus
gaagcagcttcgatccgttttgaat

SEQ ID NO: 73255 - DNA, 25 bp, mus musculus
caaattcatcaaatgcagaatgagg

SEQ ID NO: 73256 - DNA, 25 bp, mus musculus
agagactgctgcagatgggaagacc

SEQ ID NO: 73257 - DNA, 25 bp, mus musculus
ccataactactacttcatcaattac

SEQ ID NO: 73258 - DNA, 25 bp, mus musculus
taactactacttcatcaattaccgc

SEQ ID NO: 73259 - DNA, 25 bp, mus musculus
atgttctcactgaagttccagcagc

SEQ ID NO: 73260 - DNA, 25 bp, mus musculus
ttctcactgaagttccagcagcatt

SEQ ID NO: 73261 - DNA, 25 bp, mus musculus
ctgaagttccagcagcattgaagcg

SEQ ID NO: 73262 - DNA, 25 bp, mus musculus
aagttccagcagcattgaagcgggt

SEQ ID NO: 73263 - DNA, 25 bp, mus musculus
ttccagcagcattgaagcgggtagc

SEQ ID NO: 73264 - DNA, 25 bp, mus musculus
caagtatgtcatccggggcttttat

SEQ ID NO: 73265 - DNA, 25 bp, mus musculus
gtatgtcatccggggcttttatggc

SEQ ID NO: 73266 - DNA, 25 bp, mus musculus
tgtcatccggggcttttatggcatt

SEQ ID NO: 73267 - DNA, 25 bp, mus musculus
cccatctctctgcaaggaggcagaa

SEQ ID NO: 73268 - DNA, 25 bp, mus musculus
atctctctgcaaggaggcagaagct

SEQ ID NO: 73269 - DNA, 25 bp, mus musculus
gacaagagctggtgctgtggataga

SEQ ID NO: 73270 - DNA, 25 bp, mus musculus
gtgatatttgctccgctttttgcaa

SEQ ID NO: 73271 - DNA, 25 bp, mus musculus
atatttgctccgctttttgcaatct

SEQ ID NO: 73272 - DNA, 25 bp, mus musculus
gctccgctttttgcaatctttgcat

SEQ ID NO: 73273 - DNA, 25 bp, mus musculus
ccgctttttgcaatctttgcatttg

SEQ ID NO: 73274 - DNA, 25 bp, mus musculus
ctttttgcaatctttgcatttgcaa

SEQ ID NO: 73275 - DNA, 25 bp, mus musculus
atctttgcatttgcaacatgtggcg

SEQ ID NO: 73276 - DNA, 25 bp, mus musculus
gcatttgcaacatgtggcggctatt

SEQ ID NO: 73277 - DNA, 25 bp, mus musculus
tttgcaacatgtggcggctattccg

SEQ ID NO: 73278 - DNA, 25 bp, mus musculus
acatgtggcggctattccggaggcc

SEQ ID NO: 73279 - DNA, 25 bp, mus musculus
tctctgcaaggaggcagaagctgct

SEQ ID NO: 73280 - DNA, 25 bp, mus musculus
agaagctgctatctgattggtatag

SEQ ID NO: 73281 - DNA, 25 bp, mus musculus
agctgctatctgattggtatagcat

SEQ ID NO: 73282 - DNA, 25 bp, mus musculus
atagcatctgactttccctctgcat

SEQ ID NO: 73283 - DNA, 25 bp, mus musculus
gcatctgactttccctctgcattga

SEQ ID NO: 73284 - DNA, 25 bp, mus musculus
gactttccctctgcattgatttctg

SEQ ID NO: 73285 - DNA, 25 bp, mus musculus
tttccctctgcattgatttctggtc

SEQ ID NO: 73286 - DNA, 25 bp, mus musculus
ccctctgcattgatttctggtcctc

SEQ ID NO: 73287 - DNA, 25 bp, mus musculus
ggccagacaggtgaccccagatggt

SEQ ID NO: 73288 - DNA, 25 bp, mus musculus
ccagacaggtgaccccagatggtga

SEQ ID NO: 73289 - DNA, 25 bp, mus musculus
gagatccctgacgacatgggatcaa

SEQ ID NO: 73290 - DNA, 25 bp, mus musculus
atcaaaaggcctgaagcacgtaact

SEQ ID NO: 73291 - DNA, 25 bp, mus musculus
gcctgaagcacgtaacttctaatgc

SEQ ID NO: 73292 - DNA, 25 bp, mus musculus
ctgaagcacgtaacttctaatgcca

SEQ ID NO: 73293 - DNA, 25 bp, mus musculus
gaagcacgtaacttctaatgccagc

SEQ ID NO: 73294 - DNA, 25 bp, mus musculus
cacgtaacttctaatgccagcgata

SEQ ID NO: 73295 - DNA, 25 bp, mus musculus
cgtaacttctaatgccagcgatagt

SEQ ID NO: 73296 - DNA, 25 bp, mus musculus
agttaccgtggtcaagaagaatatg

SEQ ID NO: 73297 - DNA, 25 bp, mus musculus
gttttatcgtatgagccggtgaatc

SEQ ID NO: 73298 - DNA, 25 bp, mus musculus
tatcgtatgagccggtgaatcagca

SEQ ID NO: 73299 - DNA, 25 bp, mus musculus
agacaggtgaccccagatggtgaga

SEQ ID NO: 73300 - DNA, 25 bp, mus musculus
aggtgaccccagatggtgagagtga

SEQ ID NO: 73301 - DNA, 25 bp, mus musculus
gtgaccccagatggtgagagtgacg

SEQ ID NO: 73302 - DNA, 25 bp, mus musculus
gaccccagatggtgagagtgacgag

SEQ ID NO: 73303 - DNA, 25 bp, mus musculus
gtaattcctagtaaacgcagagttg

SEQ ID NO: 73304 - DNA, 25 bp, mus musculus
aattcctagtaaacgcagagttgag

SEQ ID NO: 73305 - DNA, 25 bp, mus musculus
cagtcaaattcaattctaaaacaag

SEQ ID NO: 73306 - DNA, 25 bp, mus musculus
gggagatccctgacgacatgggatc

SEQ ID NO: 73307 - DNA, 25 bp, mus musculus
gtccacatgttccctaccgagcata

SEQ ID NO: 73308 - DNA, 25 bp, mus musculus
atgttccctaccgagcatacccctg

SEQ ID NO: 73309 - DNA, 25 bp, mus musculus
tgaccctgtctggaagatttggctc

SEQ ID NO: 73310 - DNA, 25 bp, mus musculus
gatttggctctagctgaggaaggag

SEQ ID NO: 73311 - DNA, 25 bp, mus musculus
ttggctctagctgaggaaggagtct

SEQ ID NO: 73312 - DNA, 25 bp, mus musculus
cactttcaggggcacctctcagatg

SEQ ID NO: 73313 - DNA, 25 bp, mus musculus
gggcacctctcagatggccatgctc

SEQ ID NO: 73314 - DNA, 25 bp, mus musculus
cacctctcagatggccatgctcagt

SEQ ID NO: 73315 - DNA, 25 bp, mus musculus
tcagatggccatgctcagtatccct

SEQ ID NO: 73316 - DNA, 25 bp, mus musculus
gatggccatgctcagtatcccttcc

SEQ ID NO: 73317 - DNA, 25 bp, mus musculus
ggccatgctcagtatcccttccaga

SEQ ID NO: 73318 - DNA, 25 bp, mus musculus
gctcagtatcccttccagacaggcc

SEQ ID NO: 73319 - DNA, 25 bp, mus musculus
gagcatacccctggaagcctggcgg

SEQ ID NO: 73320 - DNA, 25 bp, mus musculus
catacccctggaagcctggcggcac

SEQ ID NO: 73321 - DNA, 25 bp, mus musculus
caccacgcctgtgcaagacactcaa

SEQ ID NO: 73322 - DNA, 25 bp, mus musculus
cacgcctgtgcaagacactcaacgg

SEQ ID NO: 73323 - DNA, 25 bp, mus musculus
gcctgtgcaagacactcaacggggc

SEQ ID NO: 73324 - DNA, 25 bp, mus musculus
gcaagacactcaacggggctccgtg

SEQ ID NO: 73325 - DNA, 25 bp, mus musculus
cactcaacggggctccgtgtcccag

SEQ ID NO: 73326 - DNA, 25 bp, mus musculus
tccttggctctctggggttagttca

SEQ ID NO: 73327 - DNA, 25 bp, mus musculus
cccaaggctcggtcagaggactcgg

SEQ ID NO: 73328 - DNA, 25 bp, mus musculus
ttggagcatgttaccccaaagccag

SEQ ID NO: 73329 - DNA, 25 bp, mus musculus
catagtccagtgagtggagatagtg

SEQ ID NO: 73330 - DNA, 25 bp, mus musculus
ggctttactggcctcgtcaacttag

SEQ ID NO: 73331 - DNA, 25 bp, mus musculus
gtcaacttagggaacacctgcttca

SEQ ID NO: 73332 - DNA, 25 bp, mus musculus
ttagggaacacctgcttcatgaata

SEQ ID NO: 73333 - DNA, 25 bp, mus musculus
gggaacacctgcttcatgaatagtg

SEQ ID NO: 73334 - DNA, 25 bp, mus musculus
acctgcttcatgaatagtgtcattc

SEQ ID NO: 73335 - DNA, 25 bp, mus musculus
agtgtcattcagtctctgtccaaca

SEQ ID NO: 73336 - DNA, 25 bp, mus musculus
gtcattcagtctctgtccaacactc

SEQ ID NO: 73337 - DNA, 25 bp, mus musculus
attcagtctctgtccaacactcggg

SEQ ID NO: 73338 - DNA, 25 bp, mus musculus
cagtctctgtccaacactcgggagc

SEQ ID NO: 73339 - DNA, 25 bp, mus musculus
tcgcccaaacccacatgtatggtgc

SEQ ID NO: 73340 - DNA, 25 bp, mus musculus
cccaaacccacatgtatggtgcctc

SEQ ID NO: 73341 - DNA, 25 bp, mus musculus
aaacccacatgtatggtgcctccaa

SEQ ID NO: 73342 - DNA, 25 bp, mus musculus
acatgtatggtgcctccaatgcctc

SEQ ID NO: 73343 - DNA, 25 bp, mus musculus
tgtatggtgcctccaatgcctcata

SEQ ID NO: 73344 - DNA, 25 bp, mus musculus
atggtgcctccaatgcctcatagtc

SEQ ID NO: 73345 - DNA, 25 bp, mus musculus
gtgcctccaatgcctcatagtccag

SEQ ID NO: 73346 - DNA, 25 bp, mus musculus
cctcatagtccagtgagtggagata

SEQ ID NO: 73347 - DNA, 25 bp, mus musculus
gttacagacatcatcatcaaagaaa

SEQ ID NO: 73348 - DNA, 25 bp, mus musculus
tcagttcctcgaatatacattctat

SEQ ID NO: 73349 - DNA, 25 bp, mus musculus
gatgcagaagtcccagtctgtatga

SEQ ID NO: 73350 - DNA, 25 bp, mus musculus
gaagtcccagtctgtatgatgaagg

SEQ ID NO: 73351 - DNA, 25 bp, mus musculus
cctacttcacagggtcactctgaag

SEQ ID NO: 73352 - DNA, 25 bp, mus musculus
tcacagggtcactctgaagagcaca

SEQ ID NO: 73353 - DNA, 25 bp, mus musculus
gagcacagacctaactgaaggggag

SEQ ID NO: 73354 - DNA, 25 bp, mus musculus
ctggctgctgtggttggccacagaa

SEQ ID NO: 73355 - DNA, 25 bp, mus musculus
ccatgacagctgcctgatggactac

SEQ ID NO: 73356 - DNA, 25 bp, mus musculus
cagctgcctgatggactaccatact

SEQ ID NO: 73357 - DNA, 25 bp, mus musculus
taacagcaagccttccttacgttga

SEQ ID NO: 73358 - DNA, 25 bp, mus musculus
caagccttccttacgttgagcgata

SEQ ID NO: 73359 - DNA, 25 bp, mus musculus
atatacattctataagcaagcttag

SEQ ID NO: 73360 - DNA, 25 bp, mus musculus
tccttacgttgagcgataaagtatt

SEQ ID NO: 73361 - DNA, 25 bp, mus musculus
gaatctgaggcttcatgcagaaaat

SEQ ID NO: 73362 - DNA, 25 bp, mus musculus
ttagttcgcatgtaccagaatgtgt

SEQ ID NO: 73363 - DNA, 25 bp, mus musculus
aatgtgtcaaatcagcccatcctgt

SEQ ID NO: 73364 - DNA, 25 bp, mus musculus
cagcccatcctgttggtgatagaga

SEQ ID NO: 73365 - DNA, 25 bp, mus musculus
tgctcaggactgttagcagtgtggc

SEQ ID NO: 73366 - DNA, 25 bp, mus musculus
gtgtggccagttcactgtaacgaag

SEQ ID NO: 73367 - DNA, 25 bp, mus musculus
cttcatttctccgatgcagaagtcc

SEQ ID NO: 73368 - DNA, 25 bp, mus musculus
atcttgtcagttacagcatccaaaa

SEQ ID NO: 73369 - DNA, 25 bp, mus musculus
tcagttacagcatccaaaaggtcat

SEQ ID NO: 73370 - DNA, 25 bp, mus musculus
ggcacaccctggagctgatcgaacc

SEQ ID NO: 73371 - DNA, 25 bp, mus musculus
tgctcatggccatctgcattgtctc

SEQ ID NO: 73372 - DNA, 25 bp, mus musculus
aggaccgcctatccaacacgctgca

SEQ ID NO: 73373 - DNA, 25 bp, mus musculus
gcctatccaacacgctgcagaccta

SEQ ID NO: 73374 - DNA, 25 bp, mus musculus
gccaccagctctacgccaagatgat

SEQ ID NO: 73375 - DNA, 25 bp, mus musculus
agctctacgccaagatgatccagaa

SEQ ID NO: 73376 - DNA, 25 bp, mus musculus
tccagaagctggctgacctgcgaag

SEQ ID NO: 73377 - DNA, 25 bp, mus musculus
agctggctgacctgcgaagcctcaa

SEQ ID NO: 73378 - DNA, 25 bp, mus musculus
ctgacctgcgaagcctcaatgagga

SEQ ID NO: 73379 - DNA, 25 bp, mus musculus
tctccttccagccggagaacagcat

SEQ ID NO: 73380 - DNA, 25 bp, mus musculus
gggacctcacctctgatgaccagat

SEQ ID NO: 73381 - DNA, 25 bp, mus musculus
ctgatgaccagattgtcctgcttaa

SEQ ID NO: 73382 - DNA, 25 bp, mus musculus
agtcaagtgccattgaggtgatcat

SEQ ID NO: 73383 - DNA, 25 bp, mus musculus
cttttaccatggatgacatgtcctg

SEQ ID NO: 73384 - DNA, 25 bp, mus musculus
tgtcctgggactgtggcagccaaga

SEQ ID NO: 73385 - DNA, 25 bp, mus musculus
gtggcagccaagactacaaatatga

SEQ ID NO: 73386 - DNA, 25 bp, mus musculus
actacaaatatgacatcactgatgt

SEQ ID NO: 73387 - DNA, 25 bp, mus musculus
aatatgacatcactgatgtctccag

SEQ ID NO: 73388 - DNA, 25 bp, mus musculus
tctgctgttcgagtcgggattgcag

SEQ ID NO: 73389 - DNA, 25 bp, mus musculus
gctgttcgagtcgggattgcagacg

SEQ ID NO: 73390 - DNA, 25 bp, mus musculus
atgcattcccatagtatcaatgccc

SEQ ID NO: 73391 - DNA, 25 bp, mus musculus
cattcccatagtatcaatgcccttc

SEQ ID NO: 73392 - DNA, 25 bp, mus musculus
tcccatagtatcaatgcccttctga

SEQ ID NO: 73393 - DNA, 25 bp, mus musculus
agtatcaatgcccttctgatcattg

SEQ ID NO: 73394 - DNA, 25 bp, mus musculus
aatgcccttctgatcattggaggat

SEQ ID NO: 73395 - DNA, 25 bp, mus musculus
cttctgatcattggaggatttgagg

SEQ ID NO: 73396 - DNA, 25 bp, mus musculus
tttgaggcctacctaggactcctag

SEQ ID NO: 73397 - DNA, 25 bp, mus musculus
gcctacctaggactcctagagctgg

SEQ ID NO: 73398 - DNA, 25 bp, mus musculus
tacctaggactcctagagctggcag

SEQ ID NO: 73399 - DNA, 25 bp, mus musculus
ctaggactcctagagctggcagctg

SEQ ID NO: 73400 - DNA, 25 bp, mus musculus
gttcgagtcgggattgcagacggcc

SEQ ID NO: 73401 - DNA, 25 bp, mus musculus
attgcagacggccacaagatgtttg

SEQ ID NO: 73402 - DNA, 25 bp, mus musculus
atgtttgcaatctatgacggctttg

SEQ ID NO: 73403 - DNA, 25 bp, mus musculus
tttgcaatctatgacggctttgaag

SEQ ID NO: 73404 - DNA, 25 bp, mus musculus
gcaatctatgacggctttgaaggat

SEQ ID NO: 73405 - DNA, 25 bp, mus musculus
ggattcgccaatggccaaatcaaag

SEQ ID NO: 73406 - DNA, 25 bp, mus musculus
ttcgccaatggccaaatcaaagaaa

SEQ ID NO: 73407 - DNA, 25 bp, mus musculus
gagcagatgcattcccatagtatca

SEQ ID NO: 73408 - DNA, 25 bp, mus musculus
ggccccctaatgatgtacatctcca

SEQ ID NO: 73409 - DNA, 25 bp, mus musculus
atgatgtacatctccaagatggtgc

SEQ ID NO: 73410 - DNA, 25 bp, mus musculus
ttctatgccttcggtagagtgttct

SEQ ID NO: 73411 - DNA, 25 bp, mus musculus
tatgccttcggtagagtgttctctg

SEQ ID NO: 73412 - DNA, 25 bp, mus musculus
gtgtccacaggtctgaaggtccgga

SEQ ID NO: 73413 - DNA, 25 bp, mus musculus
aagcctatccagaggaccattctga

SEQ ID NO: 73414 - DNA, 25 bp, mus musculus
cctatccagaggaccattctgatga

SEQ ID NO: 73415 - DNA, 25 bp, mus musculus
atccagaggaccattctgatgatgg

SEQ ID NO: 73416 - DNA, 25 bp, mus musculus
ctgatgatgggccgctatgtggaac

SEQ ID NO: 73417 - DNA, 25 bp, mus musculus
atgatgggccgctatgtggaaccca

SEQ ID NO: 73418 - DNA, 25 bp, mus musculus
ggccgctatgtggaacccattgagg

SEQ ID NO: 73419 - DNA, 25 bp, mus musculus
cccattgaggatgtgccctgtggca

SEQ ID NO: 73420 - DNA, 25 bp, mus musculus
atgtacatctccaagatggtgccaa

SEQ ID NO: 73421 - DNA, 25 bp, mus musculus
tacatctccaagatggtgccaacat

SEQ ID NO: 73422 - DNA, 25 bp, mus musculus
atctccaagatggtgccaacatctg

SEQ ID NO: 73423 - DNA, 25 bp, mus musculus
aagatggtgccaacatctgacaaag

SEQ ID NO: 73424 - DNA, 25 bp, mus musculus
gtgccaacatctgacaaaggccgct

SEQ ID NO: 73425 - DNA, 25 bp, mus musculus
ccaacatctgacaaaggccgcttct

SEQ ID NO: 73426 - DNA, 25 bp, mus musculus
tctgacaaaggccgcttctatgcct

SEQ ID NO: 73427 - DNA, 25 bp, mus musculus
gacaaaggccgcttctatgccttcg

SEQ ID NO: 73428 - DNA, 25 bp, mus musculus
gtgccgttttgaggctttggagaag

SEQ ID NO: 73429 - DNA, 25 bp, mus musculus
gaagattgctgcattcctgcagtct

SEQ ID NO: 73430 - DNA, 25 bp, mus musculus
cttatgctgagccagagctcgctgc

SEQ ID NO: 73431 - DNA, 25 bp, mus musculus
agctcgctgctgctgagccatcttg

SEQ ID NO: 73432 - DNA, 25 bp, mus musculus
ctgagccatcttgccctgaggggcc

SEQ ID NO: 73433 - DNA, 25 bp, mus musculus
agccatcttgccctgaggggcccac

SEQ ID NO: 73434 - DNA, 25 bp, mus musculus
tagctcactgtcagtcttgttccat

SEQ ID NO: 73435 - DNA, 25 bp, mus musculus
ctcactgtcagtcttgttccatcct

SEQ ID NO: 73436 - DNA, 25 bp, mus musculus
actgtcagtcttgttccatcctgtc

SEQ ID NO: 73437 - DNA, 25 bp, mus musculus
gtctcctctgctctttctaataaac

SEQ ID NO: 73438 - DNA, 25 bp, mus musculus
tcctctgctctttctaataaacagc

SEQ ID NO: 73439 - DNA, 25 bp, mus musculus
tctgctctttctaataaacagcagt

SEQ ID NO: 73440 - DNA, 25 bp, mus musculus
gattgctgcattcctgcagtctgac

SEQ ID NO: 73441 - DNA, 25 bp, mus musculus
tgcattcctgcagtctgaccgcttc

SEQ ID NO: 73442 - DNA, 25 bp, mus musculus
gtctgaccgcttcttcaagatgcca

SEQ ID NO: 73443 - DNA, 25 bp, mus musculus
tgaccgcttcttcaagatgccaatc

SEQ ID NO: 73444 - DNA, 25 bp, mus musculus
ccgcttcttcaagatgccaatcaat

SEQ ID NO: 73445 - DNA, 25 bp, mus musculus
cttcaagatgccaatcaataacaag

SEQ ID NO: 73446 - DNA, 25 bp, mus musculus
gatgccaatcaataacaagatggcc

SEQ ID NO: 73447 - DNA, 25 bp, mus musculus
taacaagtgcttatgctgagccaga

SEQ ID NO: 73448 - DNA, 25 bp, mus musculus
tttccttaggtatcattacaatggc

SEQ ID NO: 73449 - DNA, 25 bp, mus musculus
atggcacgcttctggatggcaccct

SEQ ID NO: 73450 - DNA, 25 bp, mus musculus
gaaccacacctttgacacgtacatt

SEQ ID NO: 73451 - DNA, 25 bp, mus musculus
accacacctttgacacgtacattgg

SEQ ID NO: 73452 - DNA, 25 bp, mus musculus
cacacctttgacacgtacattgggc

SEQ ID NO: 73453 - DNA, 25 bp, mus musculus
gctatgtgattcctgggatggatga

SEQ ID NO: 73454 - DNA, 25 bp, mus musculus
tgattcctgggatggatgaaggctt

SEQ ID NO: 73455 - DNA, 25 bp, mus musculus
attcctgggatggatgaaggcttac

SEQ ID NO: 73456 - DNA, 25 bp, mus musculus
tgaaggcttactgggtgtctgcatt

SEQ ID NO: 73457 - DNA, 25 bp, mus musculus
ggcttactgggtgtctgcattggag

SEQ ID NO: 73458 - DNA, 25 bp, mus musculus
cttactgggtgtctgcattggagag

SEQ ID NO: 73459 - DNA, 25 bp, mus musculus
tcacctgggctatggagaagaagga

SEQ ID NO: 73460 - DNA, 25 bp, mus musculus
cacgcttctggatggcaccctcttt

SEQ ID NO: 73461 - DNA, 25 bp, mus musculus
cgcttctggatggcaccctctttga

SEQ ID NO: 73462 - DNA, 25 bp, mus musculus
cttctggatggcaccctctttgact

SEQ ID NO: 73463 - DNA, 25 bp, mus musculus
tttgactccagctattcacggaacc

SEQ ID NO: 73464 - DNA, 25 bp, mus musculus
actccagctattcacggaaccacac

SEQ ID NO: 73465 - DNA, 25 bp, mus musculus
cagctattcacggaaccacaccttt

SEQ ID NO: 73466 - DNA, 25 bp, mus musculus
gctattcacggaaccacacctttga

SEQ ID NO: 73467 - DNA, 25 bp, mus musculus
ttcacggaaccacacctttgacacg

SEQ ID NO: 73468 - DNA, 25 bp, mus musculus
ctctgcctcatgatgaaacatactg

SEQ ID NO: 73469 - DNA, 25 bp, mus musculus
catactgtgaccctgcatctcggtt

SEQ ID NO: 73470 - DNA, 25 bp, mus musculus
atgattactcattcattcgatatta

SEQ ID NO: 73471 - DNA, 25 bp, mus musculus
attactcattcattcgatattacac

SEQ ID NO: 73472 - DNA, 25 bp, mus musculus
actcattcattcgatattacacagg

SEQ ID NO: 73473 - DNA, 25 bp, mus musculus
cattcattcgatattacacagggac

SEQ ID NO: 73474 - DNA, 25 bp, mus musculus
tcattcgatattacacagggaccat

SEQ ID NO: 73475 - DNA, 25 bp, mus musculus
gatattacacagggaccattttcaa

SEQ ID NO: 73476 - DNA, 25 bp, mus musculus
tcaaattccaatttcaagaagctct

SEQ ID NO: 73477 - DNA, 25 bp, mus musculus
aattccaatttcaagaagctctttg

SEQ ID NO: 73478 - DNA, 25 bp, mus musculus
tccaatttcaagaagctctttgtaa

SEQ ID NO: 73479 - DNA, 25 bp, mus musculus
gaatccaaaattccagtgaaactgg

SEQ ID NO: 73480 - DNA, 25 bp, mus musculus
actgtgaccctgcatctcggttcca

SEQ ID NO: 73481 - DNA, 25 bp, mus musculus
gtgaccctgcatctcggttccaagt

SEQ ID NO: 73482 - DNA, 25 bp, mus musculus
ctgcatctcggttccaagtccctaa

SEQ ID NO: 73483 - DNA, 25 bp, mus musculus
catctcggttccaagtccctaatga

SEQ ID NO: 73484 - DNA, 25 bp, mus musculus
tccaagtccctaatgattactcatt

SEQ ID NO: 73485 - DNA, 25 bp, mus musculus
aagtccctaatgattactcattcat

SEQ ID NO: 73486 - DNA, 25 bp, mus musculus
tccctaatgattactcattcattcg

SEQ ID NO: 73487 - DNA, 25 bp, mus musculus
ctaatgattactcattcattcgata

SEQ ID NO: 73488 - DNA, 25 bp, mus musculus
tgtgcaacgccctcaacagcgtctc

SEQ ID NO: 73489 - DNA, 25 bp, mus musculus
acgccctcaacagcgtctctgagaa

SEQ ID NO: 73490 - DNA, 25 bp, mus musculus
acatggatggtgttctcgggacatt

SEQ ID NO: 73491 - DNA, 25 bp, mus musculus
ttctcgggacatttatgcaggctcg

SEQ ID NO: 73492 - DNA, 25 bp, mus musculus
ggacatttatgcaggctcggagtag

SEQ ID NO: 73493 - DNA, 25 bp, mus musculus
ggcagctgccgactacttccaggac

SEQ ID NO: 73494 - DNA, 25 bp, mus musculus
ggccctcagactgagagcatccagg

SEQ ID NO: 73495 - DNA, 25 bp, mus musculus
atccaggcatttgtcctgttcccac

SEQ ID NO: 73496 - DNA, 25 bp, mus musculus
ccgtctcctggaccctgctgaacat

SEQ ID NO: 73497 - DNA, 25 bp, mus musculus
cctggaccctgctgaacataacagg

SEQ ID NO: 73498 - DNA, 25 bp, mus musculus
ccctgctgaacataacaggccttaa

SEQ ID NO: 73499 - DNA, 25 bp, mus musculus
tgaacataacaggccttaaacagga

SEQ ID NO: 73500 - DNA, 25 bp, mus musculus
gcgtctctgagaaccagtcactgct

SEQ ID NO: 73501 - DNA, 25 bp, mus musculus
tgccaccctggctgaacccttggct

SEQ ID NO: 73502 - DNA, 25 bp, mus musculus
cctggctgaacccttggctgctggg

SEQ ID NO: 73503 - DNA, 25 bp, mus musculus
tggtcatgtccatggctctgcattt

SEQ ID NO: 73504 - DNA, 25 bp, mus musculus
tgtccatggctctgcattttcttat

SEQ ID NO: 73505 - DNA, 25 bp, mus musculus
ttcagatgtctctgcctgtcatcct

SEQ ID NO: 73506 - DNA, 25 bp, mus musculus
tcatcctgctcgatgaggccctcaa

SEQ ID NO: 73507 - DNA, 25 bp, mus musculus
atgaggccctcaagtatctgtccag

SEQ ID NO: 73508 - DNA, 25 bp, mus musculus
aaattcctcaggaatcagcccaaga

SEQ ID NO: 73509 - DNA, 25 bp, mus musculus
ttcctcaggaatcagcccaagacgt

SEQ ID NO: 73510 - DNA, 25 bp, mus musculus
tagcttgtactttctatccaaagaa

SEQ ID NO: 73511 - DNA, 25 bp, mus musculus
gtactttctatccaaagaaatatat

SEQ ID NO: 73512 - DNA, 25 bp, mus musculus
ctttctatccaaagaaatatatgtg

SEQ ID NO: 73513 - DNA, 25 bp, mus musculus
aatatatgtgattaccccagagacc

SEQ ID NO: 73514 - DNA, 25 bp, mus musculus
atatgtgattaccccagagacctat

SEQ ID NO: 73515 - DNA, 25 bp, mus musculus
tgtgattaccccagagacctatctc

SEQ ID NO: 73516 - DNA, 25 bp, mus musculus
taccccagagacctatctctaccat

SEQ ID NO: 73517 - DNA, 25 bp, mus musculus
cccagagacctatctctaccatatc

SEQ ID NO: 73518 - DNA, 25 bp, mus musculus
agagacctatctctaccatatcagt

SEQ ID NO: 73519 - DNA, 25 bp, mus musculus
gacctatctctaccatatcagtagt

SEQ ID NO: 73520 - DNA, 25 bp, mus musculus
ttttcctccatattcaggaagagta

SEQ ID NO: 73521 - DNA, 25 bp, mus musculus
tcctccatattcaggaagagtacgt

SEQ ID NO: 73522 - DNA, 25 bp, mus musculus
agtacgtcttgggctgattcctgag

SEQ ID NO: 73523 - DNA, 25 bp, mus musculus
acgtcttgggctgattcctgaggaa

SEQ ID NO: 73524 - DNA, 25 bp, mus musculus
tcttgggctgattcctgaggaattt

SEQ ID NO: 73525 - DNA, 25 bp, mus musculus
tgtaacaggaccctacgtgcttgga

SEQ ID NO: 73526 - DNA, 25 bp, mus musculus
ctacgtgcttggaactgggcttagc

SEQ ID NO: 73527 - DNA, 25 bp, mus musculus
gcttagcttgtactttctatccaaa

SEQ ID NO: 73528 - DNA, 25 bp, mus musculus
ggccttccggagccatggaggacga

SEQ ID NO: 73529 - DNA, 25 bp, mus musculus
gtggttcgcattgccaagaagatgg

SEQ ID NO: 73530 - DNA, 25 bp, mus musculus
tcaatgctattcgcaagcagagtac

SEQ ID NO: 73531 - DNA, 25 bp, mus musculus
tgctattcgcaagcagagtacagat

SEQ ID NO: 73532 - DNA, 25 bp, mus musculus
ctattcgcaagcagagtacagatga

SEQ ID NO: 73533 - DNA, 25 bp, mus musculus
attcgcaagcagagtacagatgaag

SEQ ID NO: 73534 - DNA, 25 bp, mus musculus
tgaagaagtcacatctctagccaaa

SEQ ID NO: 73535 - DNA, 25 bp, mus musculus
agtcacatctctagccaaatcactc

SEQ ID NO: 73536 - DNA, 25 bp, mus musculus
tcacatctctagccaaatcactcat

SEQ ID NO: 73537 - DNA, 25 bp, mus musculus
acatctctagccaaatcactcatca

SEQ ID NO: 73538 - DNA, 25 bp, mus musculus
atctctagccaaatcactcatcaaa

SEQ ID NO: 73539 - DNA, 25 bp, mus musculus
ccaaatcactcatcaaatcctggaa

SEQ ID NO: 73540 - DNA, 25 bp, mus musculus
ggttcgcattgccaagaagatggac

SEQ ID NO: 73541 - DNA, 25 bp, mus musculus
ttcgcattgccaagaagatggacaa

SEQ ID NO: 73542 - DNA, 25 bp, mus musculus
cccatgaccctggaattattacagt

SEQ ID NO: 73543 - DNA, 25 bp, mus musculus
gaattattacagtccacgagaattg

SEQ ID NO: 73544 - DNA, 25 bp, mus musculus
attattacagtccacgagaattgga

SEQ ID NO: 73545 - DNA, 25 bp, mus musculus
tattacagtccacgagaattggaat

SEQ ID NO: 73546 - DNA, 25 bp, mus musculus
acagtccacgagaattggaatgtct

SEQ ID NO: 73547 - DNA, 25 bp, mus musculus
tgtcaatgctattcgcaagcagagt

SEQ ID NO: 73548 - DNA, 25 bp, mus musculus
ctgctacccctgagatcagagtgaa

SEQ ID NO: 73549 - DNA, 25 bp, mus musculus
ctacccctgagatcagagtgaacca

SEQ ID NO: 73550 - DNA, 25 bp, mus musculus
agcatgattacacggccactgacac

SEQ ID NO: 73551 - DNA, 25 bp, mus musculus
attacacggccactgacactgatga

SEQ ID NO: 73552 - DNA, 25 bp, mus musculus
acacggccactgacactgatgagct

SEQ ID NO: 73553 - DNA, 25 bp, mus musculus
cggccactgacactgatgagctgca

SEQ ID NO: 73554 - DNA, 25 bp, mus musculus
agctgcaactcaaagctggcgatgt

SEQ ID NO: 73555 - DNA, 25 bp, mus musculus
aactcaaagctggcgatgtggtgtt

SEQ ID NO: 73556 - DNA, 25 bp, mus musculus
ttcctttccagaacccagaggagca

SEQ ID NO: 73557 - DNA, 25 bp, mus musculus
ctttccagaacccagaggagcagga

SEQ ID NO: 73558 - DNA, 25 bp, mus musculus
tccagaacccagaggagcaggatga

SEQ ID NO: 73559 - DNA, 25 bp, mus musculus
atgaaggctggctcatgggtgtgaa

SEQ ID NO: 73560 - DNA, 25 bp, mus musculus
ctcagccagcagaggcctccgaggt

SEQ ID NO: 73561 - DNA, 25 bp, mus musculus
agccagcagaggcctccgaggtggt

SEQ ID NO: 73562 - DNA, 25 bp, mus musculus
agacagcagccagtgaagcaacctc

SEQ ID NO: 73563 - DNA, 25 bp, mus musculus
ccagtgaagcaacctccagctctct

SEQ ID NO: 73564 - DNA, 25 bp, mus musculus
tggagaccttctccgcaactgtgaa

SEQ ID NO: 73565 - DNA, 25 bp, mus musculus
tcaaggttcaagcccagcatgatta

SEQ ID NO: 73566 - DNA, 25 bp, mus musculus
aggttcaagcccagcatgattacac

SEQ ID NO: 73567 - DNA, 25 bp, mus musculus
aagcccagcatgattacacggccac

SEQ ID NO: 73568 - DNA, 25 bp, mus musculus
atgtaagcacccaagattagcagct

SEQ ID NO: 73569 - DNA, 25 bp, mus musculus
gcacccaagattagcagctgacgga

SEQ ID NO: 73570 - DNA, 25 bp, mus musculus
cagtgctggacctttgaagtctggg

SEQ ID NO: 73571 - DNA, 25 bp, mus musculus
gaaatacaagtttctgctggctctg

SEQ ID NO: 73572 - DNA, 25 bp, mus musculus
tactgactcagcagggcaaggatgt

SEQ ID NO: 73573 - DNA, 25 bp, mus musculus
tgaagacgccacattaaagtgatgg

SEQ ID NO: 73574 - DNA, 25 bp, mus musculus
cagagtcattcccacattctgttgg

SEQ ID NO: 73575 - DNA, 25 bp, mus musculus
aggatgttcactacttggtgcatac

SEQ ID NO: 73576 - DNA, 25 bp, mus musculus
acttggtgcatacaggcatgcacac

SEQ ID NO: 73577 - DNA, 25 bp, mus musculus
tgcatacaggcatgcacacggacag

SEQ ID NO: 73578 - DNA, 25 bp, mus musculus
cacacacaaacacaggtttgctgat

SEQ ID NO: 73579 - DNA, 25 bp, mus musculus
caaacacaggtttgctgatggaaca

SEQ ID NO: 73580 - DNA, 25 bp, mus musculus
acgaggcagctgcagccctactgtg

SEQ ID NO: 73581 - DNA, 25 bp, mus musculus
cagctgcagccctactgtgctcctt

SEQ ID NO: 73582 - DNA, 25 bp, mus musculus
cagccctactgtgctccttgacctt

SEQ ID NO: 73583 - DNA, 25 bp, mus musculus
ccagaaacaccaggcggtctgccat

SEQ ID NO: 73584 - DNA, 25 bp, mus musculus
ggcggtctgccatcaccgtttgcct

SEQ ID NO: 73585 - DNA, 25 bp, mus musculus
tcaccgtttgcctgtcagctctctg

SEQ ID NO: 73586 - DNA, 25 bp, mus musculus
ctctctgacctccagtgctggacct

SEQ ID NO: 73587 - DNA, 25 bp, mus musculus
gacctccagtgctggacctttgaag

SEQ ID NO: 73588 - DNA, 25 bp, mus musculus
cagccgagcagggcagccgatcaga

SEQ ID NO: 73589 - DNA, 25 bp, mus musculus
tgtcccgcggagtttcaggtccatg

SEQ ID NO: 73590 - DNA, 25 bp, mus musculus
gggcccaaagcttggcccaagctct

SEQ ID NO: 73591 - DNA, 25 bp, mus musculus
ccaaagcttggcccaagctctctca

SEQ ID NO: 73592 - DNA, 25 bp, mus musculus
agcttggcccaagctctctcagttc

SEQ ID NO: 73593 - DNA, 25 bp, mus musculus
cttggcccaagctctctcagttcaa

SEQ ID NO: 73594 - DNA, 25 bp, mus musculus
tctcagttcaaaccccttctcagga

SEQ ID NO: 73595 - DNA, 25 bp, mus musculus
gtgaaactctgcacataaattcccg

SEQ ID NO: 73596 - DNA, 25 bp, mus musculus
gaaactctgcacataaattcccggc

SEQ ID NO: 73597 - DNA, 25 bp, mus musculus
aactctgcacataaattcccggcat

SEQ ID NO: 73598 - DNA, 25 bp, mus musculus
ctctgcacataaattcccggcattg

SEQ ID NO: 73599 - DNA, 25 bp, mus musculus
gcacataaattcccggcattggtcg

SEQ ID NO: 73600 - DNA, 25 bp, mus musculus
gtccatgatgctactggctctaggg

SEQ ID NO: 73601 - DNA, 25 bp, mus musculus
ccatgatgctactggctctagggcc

SEQ ID NO: 73602 - DNA, 25 bp, mus musculus
atgatgctactggctctagggccca

SEQ ID NO: 73603 - DNA, 25 bp, mus musculus
gatgctactggctctagggcccaaa

SEQ ID NO: 73604 - DNA, 25 bp, mus musculus
ctactggctctagggcccaaagctt

SEQ ID NO: 73605 - DNA, 25 bp, mus musculus
actggctctagggcccaaagcttgg

SEQ ID NO: 73606 - DNA, 25 bp, mus musculus
gctctagggcccaaagcttggccca

SEQ ID NO: 73607 - DNA, 25 bp, mus musculus
tagggcccaaagcttggcccaagct

SEQ ID NO: 73608 - DNA, 25 bp, mus musculus
aatggagtctcctgagaaagagacg

SEQ ID NO: 73609 - DNA, 25 bp, mus musculus
aagtctcaatcagactgtgacacag

SEQ ID NO: 73610 - DNA, 25 bp, mus musculus
tagactactgacttaaagagaaaca

SEQ ID NO: 73611 - DNA, 25 bp, mus musculus
agccaactctgtagacaccttcaga

SEQ ID NO: 73612 - DNA, 25 bp, mus musculus
tgtagacaccttcagagtttagttt

SEQ ID NO: 73613 - DNA, 25 bp, mus musculus
tagacctttacattcctaaagatga

SEQ ID NO: 73614 - DNA, 25 bp, mus musculus
gttgtacactgctttacttaacatt

SEQ ID NO: 73615 - DNA, 25 bp, mus musculus
gtacactgctttacttaacatttgg

SEQ ID NO: 73616 - DNA, 25 bp, mus musculus
agaagccgcctctgacatcaactca

SEQ ID NO: 73617 - DNA, 25 bp, mus musculus
agccgcctctgacatcaactcaagg

SEQ ID NO: 73618 - DNA, 25 bp, mus musculus
cgcctctgacatcaactcaaggaaa

SEQ ID NO: 73619 - DNA, 25 bp, mus musculus
catcaactcaaggaaacactttttg

SEQ ID NO: 73620 - DNA, 25 bp, mus musculus
caatcagactgtgacacagttacag

SEQ ID NO: 73621 - DNA, 25 bp, mus musculus
gttacagcaattgcttcaggaagta

SEQ ID NO: 73622 - DNA, 25 bp, mus musculus
acaactcacaaaggagacataatcc

SEQ ID NO: 73623 - DNA, 25 bp, mus musculus
tttctactttgtcagacactggaca

SEQ ID NO: 73624 - DNA, 25 bp, mus musculus
ctactttgtcagacactggacagtt

SEQ ID NO: 73625 - DNA, 25 bp, mus musculus
ctttgtcagacactggacagttttg

SEQ ID NO: 73626 - DNA, 25 bp, mus musculus
ttttctaatccttggtagactactg

SEQ ID NO: 73627 - DNA, 25 bp, mus musculus
tctaatccttggtagactactgact

SEQ ID NO: 73628 - DNA, 25 bp, mus musculus
tcatctgatctgcagcggcacaggc

SEQ ID NO: 73629 - DNA, 25 bp, mus musculus
gatctgcagcggcacaggcactgaa

SEQ ID NO: 73630 - DNA, 25 bp, mus musculus
tcgagtgaccgggacctctgggctc

SEQ ID NO: 73631 - DNA, 25 bp, mus musculus
tgtggccgacacacatgagggtcat

SEQ ID NO: 73632 - DNA, 25 bp, mus musculus
tggccgacacacatgagggtcatat

SEQ ID NO: 73633 - DNA, 25 bp, mus musculus
gtcatattaccagcgatatgcagct

SEQ ID NO: 73634 - DNA, 25 bp, mus musculus
catattaccagcgatatgcagcttt

SEQ ID NO: 73635 - DNA, 25 bp, mus musculus
tattaccagcgatatgcagctttct

SEQ ID NO: 73636 - DNA, 25 bp, mus musculus
gatatgcagctttctacctacttag

SEQ ID NO: 73637 - DNA, 25 bp, mus musculus
tatgcagctttctacctacttagac

SEQ ID NO: 73638 - DNA, 25 bp, mus musculus
tgcagctttctacctacttagaccc

SEQ ID NO: 73639 - DNA, 25 bp, mus musculus
cagctttctacctacttagaccctg

SEQ ID NO: 73640 - DNA, 25 bp, mus musculus
tatgatggcggcaacagtggtatct

SEQ ID NO: 73641 - DNA, 25 bp, mus musculus
tatctcggatacgaaccgggacacg

SEQ ID NO: 73642 - DNA, 25 bp, mus musculus
ctccagtcctgtggctgcttctgtc

SEQ ID NO: 73643 - DNA, 25 bp, mus musculus
ccagtcctgtggctgcttctgtcgt

SEQ ID NO: 73644 - DNA, 25 bp, mus musculus
tcctgtggctgcttctgtcgttggt

SEQ ID NO: 73645 - DNA, 25 bp, mus musculus
gccactggtactgtggtcgagtgac

SEQ ID NO: 73646 - DNA, 25 bp, mus musculus
cactggtactgtggtcgagtgaccg

SEQ ID NO: 73647 - DNA, 25 bp, mus musculus
ctgtggtcgagtgaccgggacctct

SEQ ID NO: 73648 - DNA, 25 bp, mus musculus
ttattacttatttgtgcgaagtgcc

SEQ ID NO: 73649 - DNA, 25 bp, mus musculus
aagtgccttatgctacaagaccatt

SEQ ID NO: 73650 - DNA, 25 bp, mus musculus
gtccaagaatttcacctctagcggc

SEQ ID NO: 73651 - DNA, 25 bp, mus musculus
gaatttcacctctagcggcgcaata

SEQ ID NO: 73652 - DNA, 25 bp, mus musculus
cacctctagcggcgcaatacgaatg

SEQ ID NO: 73653 - DNA, 25 bp, mus musculus
taatcatggcctcagttccgaaaac

SEQ ID NO: 73654 - DNA, 25 bp, mus musculus
ggtcctattccattattcctagctg

SEQ ID NO: 73655 - DNA, 25 bp, mus musculus
attccattattcctagctgcggtat

SEQ ID NO: 73656 - DNA, 25 bp, mus musculus
ttattcctagctgcggtatccaggc

SEQ ID NO: 73657 - DNA, 25 bp, mus musculus
ctagctgcggtatccaggcggctcg

SEQ ID NO: 73658 - DNA, 25 bp, mus musculus
gggcctgctttgaacactctaattt

SEQ ID NO: 73659 - DNA, 25 bp, mus musculus
acactcagctaagagcatcgagggg

SEQ ID NO: 73660 - DNA, 25 bp, mus musculus
cttatgctacaagaccattaagaat

SEQ ID NO: 73661 - DNA, 25 bp, mus musculus
ctgttctaccagtactcagcccagg

SEQ ID NO: 73662 - DNA, 25 bp, mus musculus
cagccgtcggcatcgtttatggtcg

SEQ ID NO: 73663 - DNA, 25 bp, mus musculus
tcggcatcgtttatggtcggaacta

SEQ ID NO: 73664 - DNA, 25 bp, mus musculus
atggtcggaactacgacggtatctg

SEQ ID NO: 73665 - DNA, 25 bp, mus musculus
gtatctgatcgtcttcgaacctccg

SEQ ID NO: 73666 - DNA, 25 bp, mus musculus
aatgctttcgctctggtccgtcttg

SEQ ID NO: 73667 - DNA, 25 bp, mus musculus
ttcgctctggtccgtcttgcgccgg

SEQ ID NO: 73668 - DNA, 25 bp, mus musculus
tacggaactctccttcaggacctga

SEQ ID NO: 73669 - DNA, 25 bp, mus musculus
actctccttcaggacctgaccaaca

SEQ ID NO: 73670 - DNA, 25 bp, mus musculus
gcctggtttagcttcctggagagcc

SEQ ID NO: 73671 - DNA, 25 bp, mus musculus
ttcctggagagccacaacaagctgg

SEQ ID NO: 73672 - DNA, 25 bp, mus musculus
gagagccacaacaagctggacaaag

SEQ ID NO: 73673 - DNA, 25 bp, mus musculus
gacaaagacaacctctcctacatag

SEQ ID NO: 73674 - DNA, 25 bp, mus musculus
ctctcctacatagagcacatctttg

SEQ ID NO: 73675 - DNA, 25 bp, mus musculus
tacatagagcacatctttgagatat

SEQ ID NO: 73676 - DNA, 25 bp, mus musculus
gacctcctcactatggtggttgact

SEQ ID NO: 73677 - DNA, 25 bp, mus musculus
ctcactatggtggttgactacagaa

SEQ ID NO: 73678 - DNA, 25 bp, mus musculus
gttgactacagaacccgtgtgctga

SEQ ID NO: 73679 - DNA, 25 bp, mus musculus
tacagaacccgtgtgctgaagatct

SEQ ID NO: 73680 - DNA, 25 bp, mus musculus
cttcaggacctgaccaacaacatca

SEQ ID NO: 73681 - DNA, 25 bp, mus musculus
gacctgaccaacaacatcacccttg

SEQ ID NO: 73682 - DNA, 25 bp, mus musculus
aacatcacccttgaagatctggaac

SEQ ID NO: 73683 - DNA, 25 bp, mus musculus
cagctcaagtcagcctgcaaggagg

SEQ ID NO: 73684 - DNA, 25 bp, mus musculus
aagtcagcctgcaaggaggacatcc

SEQ ID NO: 73685 - DNA, 25 bp, mus musculus
gacatccccagtgagaagagtgagg

SEQ ID NO: 73686 - DNA, 25 bp, mus musculus
accacaggcagcgcctggtttagct

SEQ ID NO: 73687 - DNA, 25 bp, mus musculus
ggcagcgcctggtttagcttcctgg

SEQ ID NO: 73688 - DNA, 25 bp, mus musculus
gacctcacaagttcttccaagtttg

SEQ ID NO: 73689 - DNA, 25 bp, mus musculus
cctcacaagttcttccaagtttgca

SEQ ID NO: 73690 - DNA, 25 bp, mus musculus
ttcttccaagtttgcagcatgatcc

SEQ ID NO: 73691 - DNA, 25 bp, mus musculus
ttccaagtttgcagcatgatcccat

SEQ ID NO: 73692 - DNA, 25 bp, mus musculus
aagtttgcagcatgatcccattgct

SEQ ID NO: 73693 - DNA, 25 bp, mus musculus
agtttgcagcatgatcccattgctt

SEQ ID NO: 73694 - DNA, 25 bp, mus musculus
gtttgcagcatgatcccattgcttc

SEQ ID NO: 73695 - DNA, 25 bp, mus musculus
tttgcagcatgatcccattgcttct

SEQ ID NO: 73696 - DNA, 25 bp, mus musculus
ttgcagcatgatcccattgcttctg

SEQ ID NO: 73697 - DNA, 25 bp, mus musculus
gcatttccccgagtcaaatggacct

SEQ ID NO: 73698 - DNA, 25 bp, mus musculus
ctcacaagttcttccaagtttgcag

SEQ ID NO: 73699 - DNA, 25 bp, mus musculus
tcacaagttcttccaagtttgcagc

SEQ ID NO: 73700 - DNA, 25 bp, mus musculus
cacaagttcttccaagtttgcagca

SEQ ID NO: 73701 - DNA, 25 bp, mus musculus
acaagttcttccaagtttgcagcat

SEQ ID NO: 73702 - DNA, 25 bp, mus musculus
caagttcttccaagtttgcagcatg

SEQ ID NO: 73703 - DNA, 25 bp, mus musculus
aagttcttccaagtttgcagcatga

SEQ ID NO: 73704 - DNA, 25 bp, mus musculus
agttcttccaagtttgcagcatgat

SEQ ID NO: 73705 - DNA, 25 bp, mus musculus
gttcttccaagtttgcagcatgatc

SEQ ID NO: 73706 - DNA, 25 bp, mus musculus
gcccgccaggcacgagacatcctgg

SEQ ID NO: 73707 - DNA, 25 bp, mus musculus
caggcacgagacatcctgggaggaa

SEQ ID NO: 73708 - DNA, 25 bp, mus musculus
atactttgccctgagtctgctgaag

SEQ ID NO: 73709 - DNA, 25 bp, mus musculus
ttcaggacatttctttctggaagac

SEQ ID NO: 73710 - DNA, 25 bp, mus musculus
acatttctttctggaagacattcag

SEQ ID NO: 73711 - DNA, 25 bp, mus musculus
cattcagatatgctctatagaaaga

SEQ ID NO: 73712 - DNA, 25 bp, mus musculus
attctctgtatggccctcagccctt

SEQ ID NO: 73713 - DNA, 25 bp, mus musculus
gccctcagccctttttaactggatg

SEQ ID NO: 73714 - DNA, 25 bp, mus musculus
tacagtttaccttcttgcctctatc

SEQ ID NO: 73715 - DNA, 25 bp, mus musculus
ttaccttcttgcctctatcccaggg

SEQ ID NO: 73716 - DNA, 25 bp, mus musculus
ggcagtgccttctatgtgcactgaa

SEQ ID NO: 73717 - DNA, 25 bp, mus musculus
gccttctatgtgcactgaacagata

SEQ ID NO: 73718 - DNA, 25 bp, mus musculus
cgagacatcctgggaggaaatggga

SEQ ID NO: 73719 - DNA, 25 bp, mus musculus
atttctgatgagtaccatgtcatcc

SEQ ID NO: 73720 - DNA, 25 bp, mus musculus
gtcatccggcatgctatgaatctgg

SEQ ID NO: 73721 - DNA, 25 bp, mus musculus
acacatgacattcatgctctgatcc

SEQ ID NO: 73722 - DNA, 25 bp, mus musculus
gacattcatgctctgatccttggga

SEQ ID NO: 73723 - DNA, 25 bp, mus musculus
catgctctgatccttgggagagcaa

SEQ ID NO: 73724 - DNA, 25 bp, mus musculus
ctgatccttgggagagcaattactg

SEQ ID NO: 73725 - DNA, 25 bp, mus musculus
caggcattcacggttggcaagtgaa

SEQ ID NO: 73726 - DNA, 25 bp, mus musculus
cgaggaaacaaccgcagctgcccca

SEQ ID NO: 73727 - DNA, 25 bp, mus musculus
ggaaacaaccgcagctgccccagct

SEQ ID NO: 73728 - DNA, 25 bp, mus musculus
agtactcaaatgacgacaccctatg

SEQ ID NO: 73729 - DNA, 25 bp, mus musculus
actcaaatgacgacaccctatgctg

SEQ ID NO: 73730 - DNA, 25 bp, mus musculus
caaatgacgacaccctatgctgtgg

SEQ ID NO: 73731 - DNA, 25 bp, mus musculus
atgacgacaccctatgctgtggcac

SEQ ID NO: 73732 - DNA, 25 bp, mus musculus
acgacaccctatgctgtggcactgc

SEQ ID NO: 73733 - DNA, 25 bp, mus musculus
acaccctatgctgtggcactgcata

SEQ ID NO: 73734 - DNA, 25 bp, mus musculus
ccctatgctgtggcactgcatattt

SEQ ID NO: 73735 - DNA, 25 bp, mus musculus
tatgctgtggcactgcatatttttg

SEQ ID NO: 73736 - DNA, 25 bp, mus musculus
gcactgcatatttttgggagcacct

SEQ ID NO: 73737 - DNA, 25 bp, mus musculus
tttgggagcacctttgataaagatg

SEQ ID NO: 73738 - DNA, 25 bp, mus musculus
cccagctccctgaggaagagatgca

SEQ ID NO: 73739 - DNA, 25 bp, mus musculus
agctccctgaggaagagatgcatga

SEQ ID NO: 73740 - DNA, 25 bp, mus musculus
cattggctgctgagctcaagggcaa

SEQ ID NO: 73741 - DNA, 25 bp, mus musculus
tggctgctgagctcaagggcaacga

SEQ ID NO: 73742 - DNA, 25 bp, mus musculus
tcgctcacctgcccaagagtagctt

SEQ ID NO: 73743 - DNA, 25 bp, mus musculus
acctgcccaagagtagctttgtgct

SEQ ID NO: 73744 - DNA, 25 bp, mus musculus
tgcccaagagtagctttgtgctgga

SEQ ID NO: 73745 - DNA, 25 bp, mus musculus
gtagctttgtgctggatgagtttaa

SEQ ID NO: 73746 - DNA, 25 bp, mus musculus
cctcggtctccccatagggagcatc

SEQ ID NO: 73747 - DNA, 25 bp, mus musculus
ccccatagggagcatccagcgagtg

SEQ ID NO: 73748 - DNA, 25 bp, mus musculus
gcactgaccatttcagaaatgggtt

SEQ ID NO: 73749 - DNA, 25 bp, mus musculus
tattccacaagagaccaaaagctag

SEQ ID NO: 73750 - DNA, 25 bp, mus musculus
tccacaagagaccaaaagctagagg

SEQ ID NO: 73751 - DNA, 25 bp, mus musculus
ggttaagccctagctgctggcaaga

SEQ ID NO: 73752 - DNA, 25 bp, mus musculus
taagccctagctgctggcaagatta

SEQ ID NO: 73753 - DNA, 25 bp, mus musculus
ctttacagacacatccgacacgcgc

SEQ ID NO: 73754 - DNA, 25 bp, mus musculus
agacacatccgacacgcgctgtctg

SEQ ID NO: 73755 - DNA, 25 bp, mus musculus
cgacacgcgctgtctgagaatgaga

SEQ ID NO: 73756 - DNA, 25 bp, mus musculus
ggtagccaggctgaacacaggagca

SEQ ID NO: 73757 - DNA, 25 bp, mus musculus
tatttcgtagctcaaataaagtcca

SEQ ID NO: 73758 - DNA, 25 bp, mus musculus
gagcatccagcgagtgcatgtgcta

SEQ ID NO: 73759 - DNA, 25 bp, mus musculus
agtgcatgtgctatgctgctacagg

SEQ ID NO: 73760 - DNA, 25 bp, mus musculus
gcatgtgctatgctgctacaggcca

SEQ ID NO: 73761 - DNA, 25 bp, mus musculus
tgtgctatgctgctacaggccactg

SEQ ID NO: 73762 - DNA, 25 bp, mus musculus
ctgctacaggccactgtctgtctat

SEQ ID NO: 73763 - DNA, 25 bp, mus musculus
agagcacagcatccatgagatgcag

SEQ ID NO: 73764 - DNA, 25 bp, mus musculus
cagcatccatgagatgcaggggttc

SEQ ID NO: 73765 - DNA, 25 bp, mus musculus
agggcactgaccatttcagaaatgg

SEQ ID NO: 73766 - DNA, 25 bp, mus musculus
cagtgactccaagtagctccacggg

SEQ ID NO: 73767 - DNA, 25 bp, mus musculus
gtgactccaagtagctccacggggg

SEQ ID NO: 73768 - DNA, 25 bp, mus musculus
gaacggcatactggcagggtgcaca

SEQ ID NO: 73769 - DNA, 25 bp, mus musculus
acggcatactggcagggtgcacatg

SEQ ID NO: 73770 - DNA, 25 bp, mus musculus
catactggcagggtgcacatggacc

SEQ ID NO: 73771 - DNA, 25 bp, mus musculus
gctgaccctgtacaagggatgcctg

SEQ ID NO: 73772 - DNA, 25 bp, mus musculus
tgaccctgtacaagggatgcctgtg

SEQ ID NO: 73773 - DNA, 25 bp, mus musculus
accctgtacaagggatgcctgtgaa

SEQ ID NO: 73774 - DNA, 25 bp, mus musculus
ggatgcctgtgaagctcttgtggac

SEQ ID NO: 73775 - DNA, 25 bp, mus musculus
atgcctgtgaagctcttgtggacac

SEQ ID NO: 73776 - DNA, 25 bp, mus musculus
agctcttgtggacacagggacactc

SEQ ID NO: 73777 - DNA, 25 bp, mus musculus
ctcttgtggacacagggacactctc

SEQ ID NO: 73778 - DNA, 25 bp, mus musculus
gggatctgtcctacctggagcgtca

SEQ ID NO: 73779 - DNA, 25 bp, mus musculus
tctgtcctacctggagcgtcactcg

SEQ ID NO: 73780 - DNA, 25 bp, mus musculus
tgtcctacctggagcgtcactcgaa

SEQ ID NO: 73781 - DNA, 25 bp, mus musculus
tcctacctggagcgtcactcgaacg

SEQ ID NO: 73782 - DNA, 25 bp, mus musculus
ctacctggagcgtcactcgaacggc

SEQ ID NO: 73783 - DNA, 25 bp, mus musculus
acctggagcgtcactcgaacggcat

SEQ ID NO: 73784 - DNA, 25 bp, mus musculus
actcgaacggcatactggcagggtg

SEQ ID NO: 73785 - DNA, 25 bp, mus musculus
tcgaacggcatactggcagggtgca

SEQ ID NO: 73786 - DNA, 25 bp, mus musculus
cccccatgtgaggagctgaaaccag

SEQ ID NO: 73787 - DNA, 25 bp, mus musculus
ctgaaaccagaagctgcagagacgt

SEQ ID NO: 73788 - DNA, 25 bp, mus musculus
cactctgtgagctgataccccaggc

SEQ ID NO: 73789 - DNA, 25 bp, mus musculus
agctgataccccaggctggaactcc

SEQ ID NO: 73790 - DNA, 25 bp, mus musculus
tgataccccaggctggaactcctgg

SEQ ID NO: 73791 - DNA, 25 bp, mus musculus
taccccaggctggaactcctggctc

SEQ ID NO: 73792 - DNA, 25 bp, mus musculus
gaactcctggctctgcactttcaac

SEQ ID NO: 73793 - DNA, 25 bp, mus musculus
ctgcactttcaaccttgctaatatc

SEQ ID NO: 73794 - DNA, 25 bp, mus musculus
caaccttgctaatatccacatagaa

SEQ ID NO: 73795 - DNA, 25 bp, mus musculus
taatatccacatagaagctaggact

SEQ ID NO: 73796 - DNA, 25 bp, mus musculus
tatccacatagaagctaggactaag

SEQ ID NO: 73797 - DNA, 25 bp, mus musculus
taggactaagcccagaggttcctct

SEQ ID NO: 73798 - DNA, 25 bp, mus musculus
cctaagcagccgaaccccatatcgt

SEQ ID NO: 73799 - DNA, 25 bp, mus musculus
aagcagccgaaccccatatcgtctg

SEQ ID NO: 73800 - DNA, 25 bp, mus musculus
cagccgaaccccatatcgtctgaaa

SEQ ID NO: 73801 - DNA, 25 bp, mus musculus
cccatatcgtctgaaactcctaact

SEQ ID NO: 73802 - DNA, 25 bp, mus musculus
atatcgtctgaaactcctaactttg

SEQ ID NO: 73803 - DNA, 25 bp, mus musculus
tgctatctttgggcaatctgggcac

SEQ ID NO: 73804 - DNA, 25 bp, mus musculus
gagagcacctctgagtctggggatg

SEQ ID NO: 73805 - DNA, 25 bp, mus musculus
tcctggtgcccatgcatcctgttgc

SEQ ID NO: 73806 - DNA, 25 bp, mus musculus
tattccctctacgactcattcttct

SEQ ID NO: 73807 - DNA, 25 bp, mus musculus
gactcattcttctgattctccagcc

SEQ ID NO: 73808 - DNA, 25 bp, mus musculus
gcccactgcagatcatcactgcaga

SEQ ID NO: 73809 - DNA, 25 bp, mus musculus
tgcagatcatcactgcagaacgata

SEQ ID NO: 73810 - DNA, 25 bp, mus musculus
tcatcactgcagaacgataaataac

SEQ ID NO: 73811 - DNA, 25 bp, mus musculus
gctgatcattcttccatgttttgtg

SEQ ID NO: 73812 - DNA, 25 bp, mus musculus
tccatgttttgtgatcgagtagctc

SEQ ID NO: 73813 - DNA, 25 bp, mus musculus
gtagctcacgagttcacatgctttt

SEQ ID NO: 73814 - DNA, 25 bp, mus musculus
tttttcaatagctctacccacctgc

SEQ ID NO: 73815 - DNA, 25 bp, mus musculus
taatgacttaactgttggtgcctga

SEQ ID NO: 73816 - DNA, 25 bp, mus musculus
cttaactgttggtgcctgatgttga

SEQ ID NO: 73817 - DNA, 25 bp, mus musculus
tgttggtgcctgatgttgatacaat

SEQ ID NO: 73818 - DNA, 25 bp, mus musculus
cgtctcctgttccgactatggctgc

SEQ ID NO: 73819 - DNA, 25 bp, mus musculus
ctgttccgactatggctgcacacct

SEQ ID NO: 73820 - DNA, 25 bp, mus musculus
tggctgcacaccttacgtttatgct

SEQ ID NO: 73821 - DNA, 25 bp, mus musculus
ttatgcttccaccctggatttcaat

SEQ ID NO: 73822 - DNA, 25 bp, mus musculus
tttcaataccacgctacacaggtcc

SEQ ID NO: 73823 - DNA, 25 bp, mus musculus
taccacgctacacaggtcctctctg

SEQ ID NO: 73824 - DNA, 25 bp, mus musculus
ctctctgaatagcctgcaaacgaaa

SEQ ID NO: 73825 - DNA, 25 bp, mus musculus
gaatagcctgcaaacgaaactctgg

SEQ ID NO: 73826 - DNA, 25 bp, mus musculus
gtgcagacatcatccagaatgcaga

SEQ ID NO: 73827 - DNA, 25 bp, mus musculus
tcatccagaatgcagactggaccaa

SEQ ID NO: 73828 - DNA, 25 bp, mus musculus
agggatcccagtacgatgccaagtc

SEQ ID NO: 73829 - DNA, 25 bp, mus musculus
agtacgatgccaagtcagatatgta

SEQ ID NO: 73830 - DNA, 25 bp, mus musculus
atatgtatagcttgggtgtgatcct

SEQ ID NO: 73831 - DNA, 25 bp, mus musculus
atagcttgggtgtgatcctgctcga

SEQ ID NO: 73832 - DNA, 25 bp, mus musculus
tgatcctgctcgagctctttcagcc

SEQ ID NO: 73833 - DNA, 25 bp, mus musculus
tcctgctcgagctctttcagccatt

SEQ ID NO: 73834 - DNA, 25 bp, mus musculus
tgctcgagctctttcagccattcgg

SEQ ID NO: 73835 - DNA, 25 bp, mus musculus
agctctttcagccattcgggacaga

SEQ ID NO: 73836 - DNA, 25 bp, mus musculus
tctttcagccattcgggacagaaat

SEQ ID NO: 73837 - DNA, 25 bp, mus musculus
ttcagccattcgggacagaaatgga

SEQ ID NO: 73838 - DNA, 25 bp, mus musculus
aaggaacacggacacacacatccag

SEQ ID NO: 73839 - DNA, 25 bp, mus musculus
agtatatccagctcctaaccgggag

SEQ ID NO: 73840 - DNA, 25 bp, mus musculus
gaacacggacacacacatccagagt

SEQ ID NO: 73841 - DNA, 25 bp, mus musculus
cacggacacacacatccagagtggg

SEQ ID NO: 73842 - DNA, 25 bp, mus musculus
ggacttgtctctacgcgtcaccgga

SEQ ID NO: 73843 - DNA, 25 bp, mus musculus
gtctctacgcgtcaccggaacagct

SEQ ID NO: 73844 - DNA, 25 bp, mus musculus
tctacgcgtcaccggaacagctgga

SEQ ID NO: 73845 - DNA, 25 bp, mus musculus
caccggaacagctggagggatccca

SEQ ID NO: 73846 - DNA, 25 bp, mus musculus
aacagctggagggatcccagtacga

SEQ ID NO: 73847 - DNA, 25 bp, mus musculus
tgacatctttgagcgcatagcaaac

SEQ ID NO: 73848 - DNA, 25 bp, mus musculus
agcaaacgaggcttctcgcctggcg

SEQ ID NO: 73849 - DNA, 25 bp, mus musculus
caagtacaccagcgccaagtagagg

SEQ ID NO: 73850 - DNA, 25 bp, mus musculus
cttttagtgagtcacccgctcaaat

SEQ ID NO: 73851 - DNA, 25 bp, mus musculus
gtgagtcacccgctcaaatcagaag

SEQ ID NO: 73852 - DNA, 25 bp, mus musculus
cacccgctcaaatcagaagagagct

SEQ ID NO: 73853 - DNA, 25 bp, mus musculus
gagagctttgcccacttgcattagt

SEQ ID NO: 73854 - DNA, 25 bp, mus musculus
tttgcccacttgcattagtttctag

SEQ ID NO: 73855 - DNA, 25 bp, mus musculus
cacttgcattagtttctagttccta

SEQ ID NO: 73856 - DNA, 25 bp, mus musculus
ctgtttgcagtttgctgcaccctac

SEQ ID NO: 73857 - DNA, 25 bp, mus musculus
gcagtttgctgcaccctacttagct

SEQ ID NO: 73858 - DNA, 25 bp, mus musculus
tgctgcaccctacttagcttcttgg

SEQ ID NO: 73859 - DNA, 25 bp, mus musculus
caacaagcggtctacaatcacatcg

SEQ ID NO: 73860 - DNA, 25 bp, mus musculus
gcggtctacaatcacatcgcgggag

SEQ ID NO: 73861 - DNA, 25 bp, mus musculus
tacaatcacatcgcgggagatccag

SEQ ID NO: 73862 - DNA, 25 bp, mus musculus
gatccagacctcggtgcgccttcta

SEQ ID NO: 73863 - DNA, 25 bp, mus musculus
ggtgcgccttctactgcccggagaa

SEQ ID NO: 73864 - DNA, 25 bp, mus musculus
actgcccggagaactggccaagcac

SEQ ID NO: 73865 - DNA, 25 bp, mus musculus
actggccaagcacgccgtgtcggag

SEQ ID NO: 73866 - DNA, 25 bp, mus musculus
caagcacgccgtgtcggagggcacc

SEQ ID NO: 73867 - DNA, 25 bp, mus musculus
cctgaactccgatccctgctggaag

SEQ ID NO: 73868 - DNA, 25 bp, mus musculus
tgaactccgatccctgctggaaggt

SEQ ID NO: 73869 - DNA, 25 bp, mus musculus
cccacgtggcgaggtgaatggagct

SEQ ID NO: 73870 - DNA, 25 bp, mus musculus
gagctgacgctttcgacattggctc

SEQ ID NO: 73871 - DNA, 25 bp, mus musculus
gctgacgctttcgacattggctcct

SEQ ID NO: 73872 - DNA, 25 bp, mus musculus
tgacgctttcgacattggctccttt

SEQ ID NO: 73873 - DNA, 25 bp, mus musculus
gctttcgacattggctcctttgatg

SEQ ID NO: 73874 - DNA, 25 bp, mus musculus
cattggctcctttgatgaggaggac

SEQ ID NO: 73875 - DNA, 25 bp, mus musculus
ttggctcctttgatgaggaggacac

SEQ ID NO: 73876 - DNA, 25 bp, mus musculus
ggctcctttgatgaggaggacacaa

SEQ ID NO: 73877 - DNA, 25 bp, mus musculus
aatcaagttactggacagtgaccag

SEQ ID NO: 73878 - DNA, 25 bp, mus musculus
gttactggacagtgaccaggaaatt

SEQ ID NO: 73879 - DNA, 25 bp, mus musculus
ccgatccctgctggaaggtttgttg

SEQ ID NO: 73880 - DNA, 25 bp, mus musculus
gatccctgctggaaggtttgttgca

SEQ ID NO: 73881 - DNA, 25 bp, mus musculus
tccctgctggaaggtttgttgcaga

SEQ ID NO: 73882 - DNA, 25 bp, mus musculus
ttctttcgttccctggactggcaga

SEQ ID NO: 73883 - DNA, 25 bp, mus musculus
ctttcgttccctggactggcagatg

SEQ ID NO: 73884 - DNA, 25 bp, mus musculus
ttcgttccctggactggcagatggt

SEQ ID NO: 73885 - DNA, 25 bp, mus musculus
cgttccctggactggcagatggtct

SEQ ID NO: 73886 - DNA, 25 bp, mus musculus
ccctggactggcagatggtcttctt

SEQ ID NO: 73887 - DNA, 25 bp, mus musculus
ggaaaatgccggatccagcgaagtc

SEQ ID NO: 73888 - DNA, 25 bp, mus musculus
aatgccggatccagcgaagtctgct

SEQ ID NO: 73889 - DNA, 25 bp, mus musculus
ggcatctcatctaaggctatgggaa

SEQ ID NO: 73890 - DNA, 25 bp, mus musculus
catctcatctaaggctatgggaatc

SEQ ID NO: 73891 - DNA, 25 bp, mus musculus
tctcatctaaggctatgggaatcat

SEQ ID NO: 73892 - DNA, 25 bp, mus musculus
ctgctgccgggagagttggctaaac

SEQ ID NO: 73893 - DNA, 25 bp, mus musculus
tggctaaacacgctgtgtcggaagg

SEQ ID NO: 73894 - DNA, 25 bp, mus musculus
gctaaacacgctgtgtcggaaggca

SEQ ID NO: 73895 - DNA, 25 bp, mus musculus
taaacacgctgtgtcggaaggcacc

SEQ ID NO: 73896 - DNA, 25 bp, mus musculus
tacaccagctccaagtgaagtgcag

SEQ ID NO: 73897 - DNA, 25 bp, mus musculus
caccagctccaagtgaagtgcagca

SEQ ID NO: 73898 - DNA, 25 bp, mus musculus
ccagctccaagtgaagtgcagcaga

SEQ ID NO: 73899 - DNA, 25 bp, mus musculus
tgccggatccagcgaagtctgctcc

SEQ ID NO: 73900 - DNA, 25 bp, mus musculus
ccggatccagcgaagtctgctcctg

SEQ ID NO: 73901 - DNA, 25 bp, mus musculus
ggatccagcgaagtctgctcctgcc

SEQ ID NO: 73902 - DNA, 25 bp, mus musculus
tattctgtctacgtgtacaaggtcc

SEQ ID NO: 73903 - DNA, 25 bp, mus musculus
ttctgtctacgtgtacaaggtcctg

SEQ ID NO: 73904 - DNA, 25 bp, mus musculus
gacacgggcatctcatctaaggcta

SEQ ID NO: 73905 - DNA, 25 bp, mus musculus
cacgggcatctcatctaaggctatg

SEQ ID NO: 73906 - DNA, 25 bp, mus musculus
cgggcatctcatctaaggctatggg

SEQ ID NO: 73907 - DNA, 25 bp, mus musculus
atgccctgacgtcttttccacgctt

SEQ ID NO: 73908 - DNA, 25 bp, mus musculus
tgacgtcttttccacgcttccttct

SEQ ID NO: 73909 - DNA, 25 bp, mus musculus
acatccgcaaagagccctatggcca

SEQ ID NO: 73910 - DNA, 25 bp, mus musculus
catccgcaaagagccctatggccac

SEQ ID NO: 73911 - DNA, 25 bp, mus musculus
atccgcaaagagccctatggccaca

SEQ ID NO: 73912 - DNA, 25 bp, mus musculus
tccgcaaagagccctatggccacac

SEQ ID NO: 73913 - DNA, 25 bp, mus musculus
cgcaaagagccctatggccacacag

SEQ ID NO: 73914 - DNA, 25 bp, mus musculus
gcaaagagccctatggccacacagt

SEQ ID NO: 73915 - DNA, 25 bp, mus musculus
caaagagccctatggccacacagtg

SEQ ID NO: 73916 - DNA, 25 bp, mus musculus
gagccctatggccacacagtgccct

SEQ ID NO: 73917 - DNA, 25 bp, mus musculus
ctatggccacacagtgccctctcgg

SEQ ID NO: 73918 - DNA, 25 bp, mus musculus
tatggccacacagtgccctctcggg

SEQ ID NO: 73919 - DNA, 25 bp, mus musculus
tctgacgttgacatccgcaaagagc

SEQ ID NO: 73920 - DNA, 25 bp, mus musculus
ctgacgttgacatccgcaaagagcc

SEQ ID NO: 73921 - DNA, 25 bp, mus musculus
tgacgttgacatccgcaaagagccc

SEQ ID NO: 73922 - DNA, 25 bp, mus musculus
gacgttgacatccgcaaagagccct

SEQ ID NO: 73923 - DNA, 25 bp, mus musculus
cgttgacatccgcaaagagccctat

SEQ ID NO: 73924 - DNA, 25 bp, mus musculus
gttgacatccgcaaagagccctatg

SEQ ID NO: 73925 - DNA, 25 bp, mus musculus
ttgacatccgcaaagagccctatgg

SEQ ID NO: 73926 - DNA, 25 bp, mus musculus
tgacatccgcaaagagccctatggc

SEQ ID NO: 73927 - DNA, 25 bp, mus musculus
caagagacacgaccgacagtaccac

SEQ ID NO: 73928 - DNA, 25 bp, mus musculus
cgttcgatcacaaaaggtcaagcgg

SEQ ID NO: 73929 - DNA, 25 bp, mus musculus
ttacctcgagctcgagaactaccgc

SEQ ID NO: 73930 - DNA, 25 bp, mus musculus
tcttatcctctttgatgcaaccagg

SEQ ID NO: 73931 - DNA, 25 bp, mus musculus
cctctttgatgcaaccaggaagttt

SEQ ID NO: 73932 - DNA, 25 bp, mus musculus
tccttcaggatattctcgatgagag

SEQ ID NO: 73933 - DNA, 25 bp, mus musculus
atccgatttcaaacgtccagcatga

SEQ ID NO: 73934 - DNA, 25 bp, mus musculus
tttcaaacgtccagcatgagctctg

SEQ ID NO: 73935 - DNA, 25 bp, mus musculus
acgtccagcatgagctctggcaaga

SEQ ID NO: 73936 - DNA, 25 bp, mus musculus
agcatgagctctggcaagaccaaga

SEQ ID NO: 73937 - DNA, 25 bp, mus musculus
cctaaatggtccgcaaagcacgcca

SEQ ID NO: 73938 - DNA, 25 bp, mus musculus
tggtccgcaaagcacgccagatcta

SEQ ID NO: 73939 - DNA, 25 bp, mus musculus
cagtgtagacggttctcgggtgatt

SEQ ID NO: 73940 - DNA, 25 bp, mus musculus
caggccatgcagacatccagtcgat

SEQ ID NO: 73941 - DNA, 25 bp, mus musculus
atgcagacatccagtcgatccaaga

SEQ ID NO: 73942 - DNA, 25 bp, mus musculus
acatccagtcgatccaagagacagc

SEQ ID NO: 73943 - DNA, 25 bp, mus musculus
tcaaatgggcacagcggcgtggagc

SEQ ID NO: 73944 - DNA, 25 bp, mus musculus
cgattgcactcatcgttggtgataa

SEQ ID NO: 73945 - DNA, 25 bp, mus musculus
cactcatcgttggtgataaccagaa

SEQ ID NO: 73946 - DNA, 25 bp, mus musculus
tgattcaaatgtccgcacgcgggaa

SEQ ID NO: 73947 - DNA, 25 bp, mus musculus
cgaagctgtatcgcattcgttcttt

SEQ ID NO: 73948 - DNA, 25 bp, mus musculus
aagctgtatcgcattcgttctttct

SEQ ID NO: 73949 - DNA, 25 bp, mus musculus
cctaccatcgatgacacactcggaa

SEQ ID NO: 73950 - DNA, 25 bp, mus musculus
taccatcgatgacacactcggaacg

SEQ ID NO: 73951 - DNA, 25 bp, mus musculus
atgacacactcggaacgcatcactg

SEQ ID NO: 73952 - DNA, 25 bp, mus musculus
gacacactcggaacgcatcactggc

SEQ ID NO: 73953 - DNA, 25 bp, mus musculus
cactcggaacgcatcactggcaatc

SEQ ID NO: 73954 - DNA, 25 bp, mus musculus
gcatcactggcaatctctttgcacg

SEQ ID NO: 73955 - DNA, 25 bp, mus musculus
cactggcaatctctttgcacgcgta

SEQ ID NO: 73956 - DNA, 25 bp, mus musculus
ggcaatctctttgcacgcgtatacc

SEQ ID NO: 73957 - DNA, 25 bp, mus musculus
caatctctttgcacgcgtatacccc

SEQ ID NO: 73958 - DNA, 25 bp, mus musculus
ttgcacgcgtatacccctaacgccg

SEQ ID NO: 73959 - DNA, 25 bp, mus musculus
tatcgcattcgttctttctcatcac

SEQ ID NO: 73960 - DNA, 25 bp, mus musculus
tcgcattcgttctttctcatcacac

SEQ ID NO: 73961 - DNA, 25 bp, mus musculus
gcattcgttctttctcatcacacgt

SEQ ID NO: 73962 - DNA, 25 bp, mus musculus
ttcggaataacctgcgactctcgct

SEQ ID NO: 73963 - DNA, 25 bp, mus musculus
tgcgactctcgctaggagatgtcat

SEQ ID NO: 73964 - DNA, 25 bp, mus musculus
actctcgctaggagatgtcatcagc

SEQ ID NO: 73965 - DNA, 25 bp, mus musculus
cacgttcctaccatcgatgacacac

SEQ ID NO: 73966 - DNA, 25 bp, mus musculus
cgttcctaccatcgatgacacactc

SEQ ID NO: 73967 - DNA, 25 bp, mus musculus
attgcactgaaccacacttgagagc

SEQ ID NO: 73968 - DNA, 25 bp, mus musculus
gcactgaaccacacttgagagcata

SEQ ID NO: 73969 - DNA, 25 bp, mus musculus
ataatccttaagctctggaacccat

SEQ ID NO: 73970 - DNA, 25 bp, mus musculus
atccttaagctctggaacccataca

SEQ ID NO: 73971 - DNA, 25 bp, mus musculus
cttaagctctggaacccatacaagt

SEQ ID NO: 73972 - DNA, 25 bp, mus musculus
aagctctggaacccatacaagtgat

SEQ ID NO: 73973 - DNA, 25 bp, mus musculus
tggaacccatacaagtgataagaag

SEQ ID NO: 73974 - DNA, 25 bp, mus musculus
cacaaaagcaatccatgtgaatgac

SEQ ID NO: 73975 - DNA, 25 bp, mus musculus
tgacttcaactgtatgagtattaca

SEQ ID NO: 73976 - DNA, 25 bp, mus musculus
tcttttccattttactgtaacatga

SEQ ID NO: 73977 - DNA, 25 bp, mus musculus
tcttacttttgtcagaattctacat

SEQ ID NO: 73978 - DNA, 25 bp, mus musculus
ttttgtcagaattctacatgtaact

SEQ ID NO: 73979 - DNA, 25 bp, mus musculus
ctgaaccacacttgagagcatacgt

SEQ ID NO: 73980 - DNA, 25 bp, mus musculus
aaccacacttgagagcatacgtaca

SEQ ID NO: 73981 - DNA, 25 bp, mus musculus
catacgtacattcatataatgttcg

SEQ ID NO: 73982 - DNA, 25 bp, mus musculus
gattctgttcatactaagctatttg

SEQ ID NO: 73983 - DNA, 25 bp, mus musculus
tctgttcatactaagctatttgaag

SEQ ID NO: 73984 - DNA, 25 bp, mus musculus
aaatcagctattttcagaatacatg

SEQ ID NO: 73985 - DNA, 25 bp, mus musculus
taatttaccataatccttaagctct

SEQ ID NO: 73986 - DNA, 25 bp, mus musculus
tttaccataatccttaagctctgga

SEQ ID NO: 73987 - DNA, 25 bp, mus musculus
aggacattctgccttgtcaataaag

SEQ ID NO: 73988 - DNA, 25 bp, mus musculus
tgccttgtcaataaagcctatacca

SEQ ID NO: 73989 - DNA, 25 bp, mus musculus
cattgttagcctttagctgagggta

SEQ ID NO: 73990 - DNA, 25 bp, mus musculus
tgactacagtgttgaggatgaatag

SEQ ID NO: 73991 - DNA, 25 bp, mus musculus
cacctgcagtttccagctcgatgaa

SEQ ID NO: 73992 - DNA, 25 bp, mus musculus
ctgcagtttccagctcgatgaaaca

SEQ ID NO: 73993 - DNA, 25 bp, mus musculus
tttccagctcgatgaaacaggagag

SEQ ID NO: 73994 - DNA, 25 bp, mus musculus
ccagtttgacttgactgtggaagat

SEQ ID NO: 73995 - DNA, 25 bp, mus musculus
gtttgacttgactgtggaagatgat

SEQ ID NO: 73996 - DNA, 25 bp, mus musculus
tgacttgactgtggaagatgatggt

SEQ ID NO: 73997 - DNA, 25 bp, mus musculus
ttgcatgcttctcaattgtacgttt

SEQ ID NO: 73998 - DNA, 25 bp, mus musculus
tctcaattgtacgtttccatcttgg

SEQ ID NO: 73999 - DNA, 25 bp, mus musculus
aaagcctataccagcttctcgtctt

SEQ ID NO: 74000 - DNA, 25 bp, mus musculus
gcctataccagcttctcgtcttgtt

SEQ ID NO: 74001 - DNA, 25 bp, mus musculus
tataccagcttctcgtcttgtttat

SEQ ID NO: 74002 - DNA, 25 bp, mus musculus
gcctctcagacttgtttgatagaaa

SEQ ID NO: 74003 - DNA, 25 bp, mus musculus
gaaagtacactgtcttgtctgagca

SEQ ID NO: 74004 - DNA, 25 bp, mus musculus
caaacactaaggagcttttggacat

SEQ ID NO: 74005 - DNA, 25 bp, mus musculus
gcaagagccaagtgccattgttagc

SEQ ID NO: 74006 - DNA, 25 bp, mus musculus
agagccaagtgccattgttagcctt

SEQ ID NO: 74007 - DNA, 25 bp, mus musculus
cggcactaggtagctgctgagccgc

SEQ ID NO: 74008 - DNA, 25 bp, mus musculus
cactaggtagctgctgagccgcgtt

SEQ ID NO: 74009 - DNA, 25 bp, mus musculus
cagcgggctcctaatggccagcgtc

SEQ ID NO: 74010 - DNA, 25 bp, mus musculus
ggctcctaatggccagcgtccggtg

SEQ ID NO: 74011 - DNA, 25 bp, mus musculus
gctcctaatggccagcgtccggtgg

SEQ ID NO: 74012 - DNA, 25 bp, mus musculus
tcctaatggccagcgtccggtggac

SEQ ID NO: 74013 - DNA, 25 bp, mus musculus
taatggccagcgtccggtggaccgc

SEQ ID NO: 74014 - DNA, 25 bp, mus musculus
aatggccagcgtccggtggaccgca

SEQ ID NO: 74015 - DNA, 25 bp, mus musculus
ggtggaccgcaacctactggagctg

SEQ ID NO: 74016 - DNA, 25 bp, mus musculus
gtggaccgcaacctactggagctga

SEQ ID NO: 74017 - DNA, 25 bp, mus musculus
ggaccgcaacctactggagctgaaa

SEQ ID NO: 74018 - DNA, 25 bp, mus musculus
gaccgcaacctactggagctgaaaa

SEQ ID NO: 74019 - DNA, 25 bp, mus musculus
actaggtagctgctgagccgcgttg

SEQ ID NO: 74020 - DNA, 25 bp, mus musculus
taggtagctgctgagccgcgttgcc

SEQ ID NO: 74021 - DNA, 25 bp, mus musculus
aggtagctgctgagccgcgttgcct

SEQ ID NO: 74022 - DNA, 25 bp, mus musculus
gtagctgctgagccgcgttgcctgc

SEQ ID NO: 74023 - DNA, 25 bp, mus musculus
tagctgctgagccgcgttgcctgcg

SEQ ID NO: 74024 - DNA, 25 bp, mus musculus
ctgctgagccgcgttgcctgcggac

SEQ ID NO: 74025 - DNA, 25 bp, mus musculus
tgggtgtcctgacctcgctggctta

SEQ ID NO: 74026 - DNA, 25 bp, mus musculus
tggcttactgcttccaccagcggcg

SEQ ID NO: 74027 - DNA, 25 bp, mus musculus
agctcttagttacgtctagtagaga

SEQ ID NO: 74028 - DNA, 25 bp, mus musculus
tagttacgtctagtagagagaatgg

SEQ ID NO: 74029 - DNA, 25 bp, mus musculus
tacccttgttattctgcatgttaaa

SEQ ID NO: 74030 - DNA, 25 bp, mus musculus
tgttattctgcatgttaaagctgga

SEQ ID NO: 74031 - DNA, 25 bp, mus musculus
agctggaattcttgggcgtgtatgg

SEQ ID NO: 74032 - DNA, 25 bp, mus musculus
aattcttgggcgtgtatggcagact

SEQ ID NO: 74033 - DNA, 25 bp, mus musculus
gcagactaccctgctacatcctcaa

SEQ ID NO: 74034 - DNA, 25 bp, mus musculus
taccctgctacatcctcaatatgtg

SEQ ID NO: 74035 - DNA, 25 bp, mus musculus
gctacatcctcaatatgtgaacatt

SEQ ID NO: 74036 - DNA, 25 bp, mus musculus
ttctcaagtgtttttgacagatcat

SEQ ID NO: 74037 - DNA, 25 bp, mus musculus
ttagatattaccaccatatgtttta

SEQ ID NO: 74038 - DNA, 25 bp, mus musculus
tatatcgcatgtgcctctttgggtt

SEQ ID NO: 74039 - DNA, 25 bp, mus musculus
agaatggtctctagcattcaaagga

SEQ ID NO: 74040 - DNA, 25 bp, mus musculus
gtctctagcattcaaaggaggttca

SEQ ID NO: 74041 - DNA, 25 bp, mus musculus
ttaatacatgtctggtgcctttctt

SEQ ID NO: 74042 - DNA, 25 bp, mus musculus
tggtgcctttcttgtgttgtgaaag

SEQ ID NO: 74043 - DNA, 25 bp, mus musculus
ctttcttgtgttgtgaaaggcaagt

SEQ ID NO: 74044 - DNA, 25 bp, mus musculus
aattgcacactgaccttaactctct

SEQ ID NO: 74045 - DNA, 25 bp, mus musculus
acactgaccttaactctctgtatgt

SEQ ID NO: 74046 - DNA, 25 bp, mus musculus
tgtatgtacccttgttattctgcat

SEQ ID NO: 74047 - DNA, 25 bp, mus musculus
ttggagccaatgtctccaacttcac

SEQ ID NO: 74048 - DNA, 25 bp, mus musculus
ccaatgtctccaacttcacatttgc

SEQ ID NO: 74049 - DNA, 25 bp, mus musculus
ccagattgtctgtccctttgtcttg

SEQ ID NO: 74050 - DNA, 25 bp, mus musculus
tgtctgtccctttgtcttgatgcct

SEQ ID NO: 74051 - DNA, 25 bp, mus musculus
ctgtccctttgtcttgatgcctggc

SEQ ID NO: 74052 - DNA, 25 bp, mus musculus
tgtcttgatgcctggcaagatgctg

SEQ ID NO: 74053 - DNA, 25 bp, mus musculus
cttgatgcctggcaagatgctgtga

SEQ ID NO: 74054 - DNA, 25 bp, mus musculus
atcccaggctacccagatgttgtat

SEQ ID NO: 74055 - DNA, 25 bp, mus musculus
ggctacccagatgttgtatttgaaa

SEQ ID NO: 74056 - DNA, 25 bp, mus musculus
gtaattcatcatcagctttggaata

SEQ ID NO: 74057 - DNA, 25 bp, mus musculus
attcatcatcagctttggaataaag

SEQ ID NO: 74058 - DNA, 25 bp, mus musculus
catcatcagctttggaataaagaga

SEQ ID NO: 74059 - DNA, 25 bp, mus musculus
catttgctcctagcacagttatctt

SEQ ID NO: 74060 - DNA, 25 bp, mus musculus
ttgctcctagcacagttatcttcca

SEQ ID NO: 74061 - DNA, 25 bp, mus musculus
cgatgctgggcctcaagtacctggc

SEQ ID NO: 74062 - DNA, 25 bp, mus musculus
ctcactttttgcttcacagagcaga

SEQ ID NO: 74063 - DNA, 25 bp, mus musculus
ttttgcttcacagagcagacatgtt

SEQ ID NO: 74064 - DNA, 25 bp, mus musculus
tgcttcacagagcagacatgtttgg

SEQ ID NO: 74065 - DNA, 25 bp, mus musculus
cagacatgtttgggcccagattgtc

SEQ ID NO: 74066 - DNA, 25 bp, mus musculus
acatgtttgggcccagattgtctgt

SEQ ID NO: 74067 - DNA, 25 bp, mus musculus
tcagcaacaggtttcatgaggacag

SEQ ID NO: 74068 - DNA, 25 bp, mus musculus
ctgacatgcagtgcaaacagaggac

SEQ ID NO: 74069 - DNA, 25 bp, mus musculus
gctaaaatatcccatccaagtgaac

SEQ ID NO: 74070 - DNA, 25 bp, mus musculus
atcccatccaagtgaactggaacca

SEQ ID NO: 74071 - DNA, 25 bp, mus musculus
cccatccaagtgaactggaaccact

SEQ ID NO: 74072 - DNA, 25 bp, mus musculus
ctggaaccactggatacatgggact

SEQ ID NO: 74073 - DNA, 25 bp, mus musculus
ggaaccactggatacatgggactgt

SEQ ID NO: 74074 - DNA, 25 bp, mus musculus
ccactggatacatgggactgtcctg

SEQ ID NO: 74075 - DNA, 25 bp, mus musculus
tacatgggactgtcctgaggagttc

SEQ ID NO: 74076 - DNA, 25 bp, mus musculus
actgtcctgaggagttctggggtca

SEQ ID NO: 74077 - DNA, 25 bp, mus musculus
ggtcacaggcaactgtgtagtactt

SEQ ID NO: 74078 - DNA, 25 bp, mus musculus
tcacaggcaactgtgtagtacttca

SEQ ID NO: 74079 - DNA, 25 bp, mus musculus
gttcttcccaaatctagaatctggg

SEQ ID NO: 74080 - DNA, 25 bp, mus musculus
ttcccaaatctagaatctggggcag

SEQ ID NO: 74081 - DNA, 25 bp, mus musculus
cccaaatctagaatctggggcagta

SEQ ID NO: 74082 - DNA, 25 bp, mus musculus
aatctagaatctggggcagtacccg

SEQ ID NO: 74083 - DNA, 25 bp, mus musculus
ggcagtacccgatgaatgaaggtac

SEQ ID NO: 74084 - DNA, 25 bp, mus musculus
cagtacccgatgaatgaaggtacaa

SEQ ID NO: 74085 - DNA, 25 bp, mus musculus
aagtgctggcactggagctaaaata

SEQ ID NO: 74086 - DNA, 25 bp, mus musculus
gagctaaaatatcccatccaagtga

SEQ ID NO: 74087 - DNA, 25 bp, mus musculus
agtgccaggagaccatccgccgtga

SEQ ID NO: 74088 - DNA, 25 bp, mus musculus
caggagaccatccgccgtgacttag

SEQ ID NO: 74089 - DNA, 25 bp, mus musculus
gacttagccctgcaacttcaaggac

SEQ ID NO: 74090 - DNA, 25 bp, mus musculus
cttagccctgcaacttcaaggacca

SEQ ID NO: 74091 - DNA, 25 bp, mus musculus
agccctgcaacttcaaggaccaagt

SEQ ID NO: 74092 - DNA, 25 bp, mus musculus
gccctgcaacttcaaggaccaagtc

SEQ ID NO: 74093 - DNA, 25 bp, mus musculus
cctgcaacttcaaggaccaagtcaa

SEQ ID NO: 74094 - DNA, 25 bp, mus musculus
ctgcaacttcaaggaccaagtcaaa

SEQ ID NO: 74095 - DNA, 25 bp, mus musculus
tgcaacttcaaggaccaagtcaaag

SEQ ID NO: 74096 - DNA, 25 bp, mus musculus
cctcggccctggagcctgaacggag

SEQ ID NO: 74097 - DNA, 25 bp, mus musculus
gagcctgaacggagcccttccttct

SEQ ID NO: 74098 - DNA, 25 bp, mus musculus
tccttctccaacaggccccaagatt

SEQ ID NO: 74099 - DNA, 25 bp, mus musculus
ggagaccatccgccgtgacttagcc

SEQ ID NO: 74100 - DNA, 25 bp, mus musculus
gagaccatccgccgtgacttagccc

SEQ ID NO: 74101 - DNA, 25 bp, mus musculus
agaccatccgccgtgacttagccct

SEQ ID NO: 74102 - DNA, 25 bp, mus musculus
catccgccgtgacttagccctgcaa

SEQ ID NO: 74103 - DNA, 25 bp, mus musculus
tccgccgtgacttagccctgcaact

SEQ ID NO: 74104 - DNA, 25 bp, mus musculus
ccgccgtgacttagccctgcaactt

SEQ ID NO: 74105 - DNA, 25 bp, mus musculus
cgccgtgacttagccctgcaacttc

SEQ ID NO: 74106 - DNA, 25 bp, mus musculus
ccgtgacttagccctgcaacttcaa

SEQ ID NO: 74107 - DNA, 25 bp, mus musculus
gcagcagcagcagcagcaaacctct

SEQ ID NO: 74108 - DNA, 25 bp, mus musculus
tatttttcctaacatgcagggtcaa

SEQ ID NO: 74109 - DNA, 25 bp, mus musculus
ttctaaccagcaattccagcctgtt

SEQ ID NO: 74110 - DNA, 25 bp, mus musculus
taaccagcaattccagcctgttatg

SEQ ID NO: 74111 - DNA, 25 bp, mus musculus
gcaattccagcctgttatggctaac

SEQ ID NO: 74112 - DNA, 25 bp, mus musculus
attccagcctgttatggctaactaa

SEQ ID NO: 74113 - DNA, 25 bp, mus musculus
aaggacacattcaggcttggttaca

SEQ ID NO: 74114 - DNA, 25 bp, mus musculus
gcatcatttttcatttgccaaccaa

SEQ ID NO: 74115 - DNA, 25 bp, mus musculus
tttttcatttgccaaccaagcacaa

SEQ ID NO: 74116 - DNA, 25 bp, mus musculus
tgccaaccaagcacaaagttatttt

SEQ ID NO: 74117 - DNA, 25 bp, mus musculus
aagttattttctactgactgactgt

SEQ ID NO: 74118 - DNA, 25 bp, mus musculus
tatactttcagatatggcctcttac

SEQ ID NO: 74119 - DNA, 25 bp, mus musculus
ttttcctaacatgcagggtcaaggt

SEQ ID NO: 74120 - DNA, 25 bp, mus musculus
tcagatatggcctcttacagtattt

SEQ ID NO: 74121 - DNA, 25 bp, mus musculus
taacatgcagggtcaaggtagtagt

SEQ ID NO: 74122 - DNA, 25 bp, mus musculus
tggaatgttcccaggtgacagcccc

SEQ ID NO: 74123 - DNA, 25 bp, mus musculus
gtacagcaatgcctttgatgtgttt

SEQ ID NO: 74124 - DNA, 25 bp, mus musculus
cagcaatgcctttgatgtgtttgcg

SEQ ID NO: 74125 - DNA, 25 bp, mus musculus
tgcctttgatgtgtttgcggcctac

SEQ ID NO: 74126 - DNA, 25 bp, mus musculus
tgcggcctacggaggcctcaacgag

SEQ ID NO: 74127 - DNA, 25 bp, mus musculus
gtattctaaccagcaattccagcct

SEQ ID NO: 74128 - DNA, 25 bp, mus musculus
aagctctgtgtggaccaagctgaag

SEQ ID NO: 74129 - DNA, 25 bp, mus musculus
gctctgtgtggaccaagctgaagaa

SEQ ID NO: 74130 - DNA, 25 bp, mus musculus
tccatcagcacgcgttggggacttc

SEQ ID NO: 74131 - DNA, 25 bp, mus musculus
catcagcacgcgttggggacttctg

SEQ ID NO: 74132 - DNA, 25 bp, mus musculus
gttggcattcaggagcggagtccat

SEQ ID NO: 74133 - DNA, 25 bp, mus musculus
ttggcattcaggagcggagtccata

SEQ ID NO: 74134 - DNA, 25 bp, mus musculus
attcaggagcggagtccatagggtg

SEQ ID NO: 74135 - DNA, 25 bp, mus musculus
ttcaggagcggagtccatagggtgc

SEQ ID NO: 74136 - DNA, 25 bp, mus musculus
ggccttcctcatcagtcagttcggg

SEQ ID NO: 74137 - DNA, 25 bp, mus musculus
ctcatcagtcagttcgggagagaac

SEQ ID NO: 74138 - DNA, 25 bp, mus musculus
catcagtcagttcgggagagaacgg

SEQ ID NO: 74139 - DNA, 25 bp, mus musculus
atcagtcagttcgggagagaacggt

SEQ ID NO: 74140 - DNA, 25 bp, mus musculus
ctctgtgtggaccaagctgaagaat

SEQ ID NO: 74141 - DNA, 25 bp, mus musculus
gagcagtgtaccttcgacttggttt

SEQ ID NO: 74142 - DNA, 25 bp, mus musculus
aaggcgcttctccatcagcacgcgt

SEQ ID NO: 74143 - DNA, 25 bp, mus musculus
aggcgcttctccatcagcacgcgtt

SEQ ID NO: 74144 - DNA, 25 bp, mus musculus
gcgcttctccatcagcacgcgttgg

SEQ ID NO: 74145 - DNA, 25 bp, mus musculus
cttctccatcagcacgcgttgggga

SEQ ID NO: 74146 - DNA, 25 bp, mus musculus
ttctccatcagcacgcgttggggac

SEQ ID NO: 74147 - DNA, 25 bp, mus musculus
ctccatcagcacgcgttggggactt

SEQ ID NO: 74148 - DNA, 25 bp, mus musculus
ttcgctgacatcctgcgagactaca

SEQ ID NO: 74149 - DNA, 25 bp, mus musculus
taccctgacattcccaaagacaaag

SEQ ID NO: 74150 - DNA, 25 bp, mus musculus
agcgattccacggagccacaatctc

SEQ ID NO: 74151 - DNA, 25 bp, mus musculus
tccacggagccacaatctccttcag

SEQ ID NO: 74152 - DNA, 25 bp, mus musculus
ctccccatgtctccaagtgcatatg

SEQ ID NO: 74153 - DNA, 25 bp, mus musculus
atgtctccaagtgcatatgctgtgc

SEQ ID NO: 74154 - DNA, 25 bp, mus musculus
ctgagcccaacgacaattgaaactg

SEQ ID NO: 74155 - DNA, 25 bp, mus musculus
gcaatgaattccccatattctgctg

SEQ ID NO: 74156 - DNA, 25 bp, mus musculus
aattccccatattctgctgaatgac

SEQ ID NO: 74157 - DNA, 25 bp, mus musculus
ccatattctgctgaatgacggtgca

SEQ ID NO: 74158 - DNA, 25 bp, mus musculus
gttctttaccatagatcacaattta

SEQ ID NO: 74159 - DNA, 25 bp, mus musculus
ggaagctctcttctcacttggtgcc

SEQ ID NO: 74160 - DNA, 25 bp, mus musculus
gacattcccaaagacaaagcctttg

SEQ ID NO: 74161 - DNA, 25 bp, mus musculus
gcctttggcaaacactacagctccc

SEQ ID NO: 74162 - DNA, 25 bp, mus musculus
ggcaaacactacagctcccagccgt

SEQ ID NO: 74163 - DNA, 25 bp, mus musculus
agctcccagccgtgcgaagtctcaa

SEQ ID NO: 74164 - DNA, 25 bp, mus musculus
cagccgtgcgaagtctcaagaccaa

SEQ ID NO: 74165 - DNA, 25 bp, mus musculus
cccatttcaacaatccgaagcgatt

SEQ ID NO: 74166 - DNA, 25 bp, mus musculus
tcaacaatccgaagcgattccacgg

SEQ ID NO: 74167 - DNA, 25 bp, mus musculus
atccgaagcgattccacggagccac

SEQ ID NO: 74168 - DNA, 25 bp, mus musculus
aggtgaacttgcttatccagcaggc

SEQ ID NO: 74169 - DNA, 25 bp, mus musculus
acttgcttatccagcaggccatgga

SEQ ID NO: 74170 - DNA, 25 bp, mus musculus
tcttctgttagaggtaatggtcact

SEQ ID NO: 74171 - DNA, 25 bp, mus musculus
ggtcactcaagatccattcgtagga

SEQ ID NO: 74172 - DNA, 25 bp, mus musculus
tcaagatccattcgtaggatacgtg

SEQ ID NO: 74173 - DNA, 25 bp, mus musculus
atacgtgctgactcttaggtcatgc

SEQ ID NO: 74174 - DNA, 25 bp, mus musculus
gtcatgcttgtgctactgcagcaag

SEQ ID NO: 74175 - DNA, 25 bp, mus musculus
ctactgcagcaagaccgccgcatac

SEQ ID NO: 74176 - DNA, 25 bp, mus musculus
cagcaagaccgccgcatacacactg

SEQ ID NO: 74177 - DNA, 25 bp, mus musculus
gaccgccgcatacacactgaactgc

SEQ ID NO: 74178 - DNA, 25 bp, mus musculus
cgcatacacactgaactgcaaatgg

SEQ ID NO: 74179 - DNA, 25 bp, mus musculus
gctttactgctggtgtacatgaaga

SEQ ID NO: 74180 - DNA, 25 bp, mus musculus
agcaggccatggatcccaaaaatct

SEQ ID NO: 74181 - DNA, 25 bp, mus musculus
ccatggatcccaaaaatctcagccg

SEQ ID NO: 74182 - DNA, 25 bp, mus musculus
taaactcgaacttcagaaatgacat

SEQ ID NO: 74183 - DNA, 25 bp, mus musculus
ccaccatatttggacaggaattact

SEQ ID NO: 74184 - DNA, 25 bp, mus musculus
caattttctacttgactgatcacca

SEQ ID NO: 74185 - DNA, 25 bp, mus musculus
tctacttgactgatcaccacctaaa

SEQ ID NO: 74186 - DNA, 25 bp, mus musculus
gtatttctactctcttctgttagag

SEQ ID NO: 74187 - DNA, 25 bp, mus musculus
ctactctcttctgttagaggtaatg

SEQ ID NO: 74188 - DNA, 25 bp, mus musculus
actggatactgctcccaatggacgc

SEQ ID NO: 74189 - DNA, 25 bp, mus musculus
tactgctcccaatggacgctatggg

SEQ ID NO: 74190 - DNA, 25 bp, mus musculus
gcatcggttctcctatgagaagcat

SEQ ID NO: 74191 - DNA, 25 bp, mus musculus
tcggttctcctatgagaagcattgg

SEQ ID NO: 74192 - DNA, 25 bp, mus musculus
ttgggcttcactatcacacggtgat

SEQ ID NO: 74193 - DNA, 25 bp, mus musculus
ggcttcactatcacacggtgatctc

SEQ ID NO: 74194 - DNA, 25 bp, mus musculus
ttcactatcacacggtgatctcagg

SEQ ID NO: 74195 - DNA, 25 bp, mus musculus
acacggtgatctcaggtgtccatgg

SEQ ID NO: 74196 - DNA, 25 bp, mus musculus
cggtgatctcaggtgtccatggcta

SEQ ID NO: 74197 - DNA, 25 bp, mus musculus
tctcaggtgtccatggctatgatct

SEQ ID NO: 74198 - DNA, 25 bp, mus musculus
gtgtccatggctatgatctttaatc

SEQ ID NO: 74199 - DNA, 25 bp, mus musculus
gctatgatctttaatcccaacagtt

SEQ ID NO: 74200 - DNA, 25 bp, mus musculus
tgctcccaatggacgctatgggatt

SEQ ID NO: 74201 - DNA, 25 bp, mus musculus
ttcaagaacagcaatcctcagttta

SEQ ID NO: 74202 - DNA, 25 bp, mus musculus
tggacgctatgggattgggtatttg

SEQ ID NO: 74203 - DNA, 25 bp, mus musculus
agacatgccagatatgccagagtct

SEQ ID NO: 74204 - DNA, 25 bp, mus musculus
gccagatatgccagagtctgacttg

SEQ ID NO: 74205 - DNA, 25 bp, mus musculus
tatgccagagtctgacttgtagctg

SEQ ID NO: 74206 - DNA, 25 bp, mus musculus
agagtctgacttgtagctgaacgaa

SEQ ID NO: 74207 - DNA, 25 bp, mus musculus
gtctgacttgtagctgaacgaaagc

SEQ ID NO: 74208 - DNA, 25 bp, mus musculus
ttttatcagtgagcatcggttctcc

SEQ ID NO: 74209 - DNA, 25 bp, mus musculus
aatcttttacacagaaaggcaatct

SEQ ID NO: 74210 - DNA, 25 bp, mus musculus
atcttttacacagaaaggcaatctt

SEQ ID NO: 74211 - DNA, 25 bp, mus musculus
cacccagaaagacattcttagaaga

SEQ ID NO: 74212 - DNA, 25 bp, mus musculus
gacaaatgtttcactcagaaaggcg

SEQ ID NO: 74213 - DNA, 25 bp, mus musculus
caaatgtttcactcagaaaggcgac

SEQ ID NO: 74214 - DNA, 25 bp, mus musculus
aatgtttcactcagaaaggcgacct

SEQ ID NO: 74215 - DNA, 25 bp, mus musculus
atgtttcactcagaaaggcgacctt

SEQ ID NO: 74216 - DNA, 25 bp, mus musculus
tgtttcactcagaaaggcgacctta

SEQ ID NO: 74217 - DNA, 25 bp, mus musculus
gtttcactcagaaaggcgaccttag

SEQ ID NO: 74218 - DNA, 25 bp, mus musculus
tttcactcagaaaggcgaccttaga

SEQ ID NO: 74219 - DNA, 25 bp, mus musculus
ttcactcagaaaggcgaccttagaa

SEQ ID NO: 74220 - DNA, 25 bp, mus musculus
cactcagaaaggcgaccttagaaga

SEQ ID NO: 74221 - DNA, 25 bp, mus musculus
tcttttacacagaaaggcaatctta

SEQ ID NO: 74222 - DNA, 25 bp, mus musculus
caaatgtttcacccagaaagacatt

SEQ ID NO: 74223 - DNA, 25 bp, mus musculus
aatgtttcacccagaaagacattct

SEQ ID NO: 74224 - DNA, 25 bp, mus musculus
atgtttcacccagaaagacattctt

SEQ ID NO: 74225 - DNA, 25 bp, mus musculus
tgtttcacccagaaagacattctta

SEQ ID NO: 74226 - DNA, 25 bp, mus musculus
gtttcacccagaaagacattcttag

SEQ ID NO: 74227 - DNA, 25 bp, mus musculus
tttcacccagaaagacattcttaga

SEQ ID NO: 74228 - DNA, 25 bp, mus musculus
ttcacccagaaagacattcttagaa

SEQ ID NO: 74229 - DNA, 25 bp, mus musculus
cattgctattcagttcacttggatc

SEQ ID NO: 74230 - DNA, 25 bp, mus musculus
tattcagttcacttggatcaaaacc

SEQ ID NO: 74231 - DNA, 25 bp, mus musculus
attttgcgtcgagatgactttattt

SEQ ID NO: 74232 - DNA, 25 bp, mus musculus
atgcctaatctaagacatttctgaa

SEQ ID NO: 74233 - DNA, 25 bp, mus musculus
cctaatctaagacatttctgaatgt

SEQ ID NO: 74234 - DNA, 25 bp, mus musculus
agtattcccaggacattctcataaa

SEQ ID NO: 74235 - DNA, 25 bp, mus musculus
attcccaggacattctcataaagtc

SEQ ID NO: 74236 - DNA, 25 bp, mus musculus
cccaggacattctcataaagtcgac

SEQ ID NO: 74237 - DNA, 25 bp, mus musculus
acattctcataaagtcgactctttc

SEQ ID NO: 74238 - DNA, 25 bp, mus musculus
ttctcataaagtcgactctttcatt

SEQ ID NO: 74239 - DNA, 25 bp, mus musculus
taaagtcgactctttcattgtattt

SEQ ID NO: 74240 - DNA, 25 bp, mus musculus
agtcgactctttcattgtatttgaa

SEQ ID NO: 74241 - DNA, 25 bp, mus musculus
tcagttcacttggatcaaaaccaac

SEQ ID NO: 74242 - DNA, 25 bp, mus musculus
ccgcgcctgatcaagtagtttggac

SEQ ID NO: 74243 - DNA, 25 bp, mus musculus
acggataacgcgcgcttgcagttcc

SEQ ID NO: 74244 - DNA, 25 bp, mus musculus
gataacgcgcgcttgcagttccctc

SEQ ID NO: 74245 - DNA, 25 bp, mus musculus
gcgcgcttgcagttccctcgtagtt

SEQ ID NO: 74246 - DNA, 25 bp, mus musculus
cctcgtagttttctgcataatgttc

SEQ ID NO: 74247 - DNA, 25 bp, mus musculus
tttctgcataatgttcatcacagtt

SEQ ID NO: 74248 - DNA, 25 bp, mus musculus
gttcatcacagttgcaggaagcaga

SEQ ID NO: 74249 - DNA, 25 bp, mus musculus
ttctcccaagtaggtccaggaagtg

SEQ ID NO: 74250 - DNA, 25 bp, mus musculus
ctgaaaaccatgcctgaaagacatt

SEQ ID NO: 74251 - DNA, 25 bp, mus musculus
atggcaaatcactgcaagagcacac

SEQ ID NO: 74252 - DNA, 25 bp, mus musculus
gcaaatcactgcaagagcacacgtc

SEQ ID NO: 74253 - DNA, 25 bp, mus musculus
aatcactgcaagagcacacgtcata

SEQ ID NO: 74254 - DNA, 25 bp, mus musculus
tgcaagagcacacgtcataaacaaa

SEQ ID NO: 74255 - DNA, 25 bp, mus musculus
agaagctctaggtgatggaggaaag

SEQ ID NO: 74256 - DNA, 25 bp, mus musculus
catttagggtccagttgatttgtgt

SEQ ID NO: 74257 - DNA, 25 bp, mus musculus
ttctgattgcccttgatgtagagaa

SEQ ID NO: 74258 - DNA, 25 bp, mus musculus
tgattgcccttgatgtagagaaact

SEQ ID NO: 74259 - DNA, 25 bp, mus musculus
atatcaaatcatcaggcatggataa

SEQ ID NO: 74260 - DNA, 25 bp, mus musculus
tcaaatcatcaggcatggataatac

SEQ ID NO: 74261 - DNA, 25 bp, mus musculus
accatgcctgaaagacatttggcag

SEQ ID NO: 74262 - DNA, 25 bp, mus musculus
caagactcttctgtaggcaaatcaa

SEQ ID NO: 74263 - DNA, 25 bp, mus musculus
gactcttctgtaggcaaatcaatga

SEQ ID NO: 74264 - DNA, 25 bp, mus musculus
aaatcaatgacatctgatgtccctg

SEQ ID NO: 74265 - DNA, 25 bp, mus musculus
tctgatgtccctggagatttggact

SEQ ID NO: 74266 - DNA, 25 bp, mus musculus
ttggactttcttgttccgaaggctg

SEQ ID NO: 74267 - DNA, 25 bp, mus musculus
tgctccctcttctactcaggtgaaa

SEQ ID NO: 74268 - DNA, 25 bp, mus musculus
ctcttctactcaggtgaaaaagcaa

SEQ ID NO: 74269 - DNA, 25 bp, mus musculus
tgaatctagagccttggctgaaatc

SEQ ID NO: 74270 - DNA, 25 bp, mus musculus
atctagagccttggctgaaatcgcc

SEQ ID NO: 74271 - DNA, 25 bp, mus musculus
cacacacgctgcagccctgtctgtt

SEQ ID NO: 74272 - DNA, 25 bp, mus musculus
acacgctgcagccctgtctgttcga

SEQ ID NO: 74273 - DNA, 25 bp, mus musculus
tgcagccctgtctgttcgaaatctc

SEQ ID NO: 74274 - DNA, 25 bp, mus musculus
agccctgtctgttcgaaatctctct

SEQ ID NO: 74275 - DNA, 25 bp, mus musculus
cctgtctgttcgaaatctctctcct

SEQ ID NO: 74276 - DNA, 25 bp, mus musculus
gtctgttcgaaatctctctccttat

SEQ ID NO: 74277 - DNA, 25 bp, mus musculus
tgttcgaaatctctctccttatgtt

SEQ ID NO: 74278 - DNA, 25 bp, mus musculus
tcgaaatctctctccttatgtttcc

SEQ ID NO: 74279 - DNA, 25 bp, mus musculus
tctctctccttatgtttccaacgaa

SEQ ID NO: 74280 - DNA, 25 bp, mus musculus
tagccagtttggtcctattgaaagg

SEQ ID NO: 74281 - DNA, 25 bp, mus musculus
tgaaatcgccaaagctgagcttgat

SEQ ID NO: 74282 - DNA, 25 bp, mus musculus
aatcgccaaagctgagcttgatgat

SEQ ID NO: 74283 - DNA, 25 bp, mus musculus
cgccaaagctgagcttgatgatact

SEQ ID NO: 74284 - DNA, 25 bp, mus musculus
tgatgatactcccatgagaggtaga

SEQ ID NO: 74285 - DNA, 25 bp, mus musculus
tactcccatgagaggtagacagctt

SEQ ID NO: 74286 - DNA, 25 bp, mus musculus
ggttcgatttgccacacacgctgca

SEQ ID NO: 74287 - DNA, 25 bp, mus musculus
tcgatttgccacacacgctgcagcc

SEQ ID NO: 74288 - DNA, 25 bp, mus musculus
atttgccacacacgctgcagccctg

SEQ ID NO: 74289 - DNA, 25 bp, mus musculus
caaatgctgggcgtacactggacaa

SEQ ID NO: 74290 - DNA, 25 bp, mus musculus
gtacactggacaaggcccactggac

SEQ ID NO: 74291 - DNA, 25 bp, mus musculus
catgctgcagctagaacttcgcaaa

SEQ ID NO: 74292 - DNA, 25 bp, mus musculus
gcagctagaacttcgcaaagcctct

SEQ ID NO: 74293 - DNA, 25 bp, mus musculus
agaacttcgcaaagcctctatgttt

SEQ ID NO: 74294 - DNA, 25 bp, mus musculus
tcgcaaagcctctatgtttctgtgg

SEQ ID NO: 74295 - DNA, 25 bp, mus musculus
agcctctatgtttctgtggagtaaa

SEQ ID NO: 74296 - DNA, 25 bp, mus musculus
ctattgtagctaccacattggtttt

SEQ ID NO: 74297 - DNA, 25 bp, mus musculus
tataatcacgcggggtttgtacatt

SEQ ID NO: 74298 - DNA, 25 bp, mus musculus
tttttacactaatatatggacctag

SEQ ID NO: 74299 - DNA, 25 bp, mus musculus
tatatggacctagcttaaggcgatt

SEQ ID NO: 74300 - DNA, 25 bp, mus musculus
gattttaatcccctgtcctaggcag

SEQ ID NO: 74301 - DNA, 25 bp, mus musculus
tggacaaggcccactggacttcact

SEQ ID NO: 74302 - DNA, 25 bp, mus musculus
actggacttcactggttcctgggag

SEQ ID NO: 74303 - DNA, 25 bp, mus musculus
ctttcttcttgtcacacactggacg

SEQ ID NO: 74304 - DNA, 25 bp, mus musculus
cctgacacactgacctgggcgatcc

SEQ ID NO: 74305 - DNA, 25 bp, mus musculus
acactgacctgggcgatccctgccg

SEQ ID NO: 74306 - DNA, 25 bp, mus musculus
gcgatccctgccgtgatcctcagtc

SEQ ID NO: 74307 - DNA, 25 bp, mus musculus
cttctcacctgccatgctgcagcta

SEQ ID NO: 74308 - DNA, 25 bp, mus musculus
acctgccatgctgcagctagaactt

SEQ ID NO: 74309 - DNA, 25 bp, mus musculus
ttactgcctccattaaatccattta

SEQ ID NO: 74310 - DNA, 25 bp, mus musculus
ccgaaagctgcgaggcgttactatg

SEQ ID NO: 74311 - DNA, 25 bp, mus musculus
tgagtcaaagcttcccagtggctct

SEQ ID NO: 74312 - DNA, 25 bp, mus musculus
aaagcttcccagtggctctgctaag

SEQ ID NO: 74313 - DNA, 25 bp, mus musculus
tggctctgctaagcccctctgttaa

SEQ ID NO: 74314 - DNA, 25 bp, mus musculus
atgtttatggcctatgaggttgtat

SEQ ID NO: 74315 - DNA, 25 bp, mus musculus
tccatgccaaatgttaactgccaag

SEQ ID NO: 74316 - DNA, 25 bp, mus musculus
ctaaagcctttttcagagcatggct

SEQ ID NO: 74317 - DNA, 25 bp, mus musculus
cctttttcagagcatggctagattt

SEQ ID NO: 74318 - DNA, 25 bp, mus musculus
aagccacagtgtcggttgtcacaaa

SEQ ID NO: 74319 - DNA, 25 bp, mus musculus
aatgacatgctgccattcctggttg

SEQ ID NO: 74320 - DNA, 25 bp, mus musculus
ctggttgctgctcggatgcaatgga

SEQ ID NO: 74321 - DNA, 25 bp, mus musculus
tactatgactgagctgatcaggcag

SEQ ID NO: 74322 - DNA, 25 bp, mus musculus
gctgatcaggcagtttctgttctca

SEQ ID NO: 74323 - DNA, 25 bp, mus musculus
ttagtgcctgagctgttctgtatgt

SEQ ID NO: 74324 - DNA, 25 bp, mus musculus
cctgagctgttctgtatgtagaaat

SEQ ID NO: 74325 - DNA, 25 bp, mus musculus
tcgttcccactctaagaactgtcgg

SEQ ID NO: 74326 - DNA, 25 bp, mus musculus
ccactctaagaactgtcggggctgt

SEQ ID NO: 74327 - DNA, 25 bp, mus musculus
taagaactgtcggggctgtgagtca

SEQ ID NO: 74328 - DNA, 25 bp, mus musculus
ctgtcggggctgtgagtcaaagctt

SEQ ID NO: 74329 - DNA, 25 bp, mus musculus
ctcctgctgctgcggttcagctcaa

SEQ ID NO: 74330 - DNA, 25 bp, mus musculus
cctgctgctgcggttcagctcaact

SEQ ID NO: 74331 - DNA, 25 bp, mus musculus
tagagttcacttcatgcaatgaaac

SEQ ID NO: 74332 - DNA, 25 bp, mus musculus
gttcacttcatgcaatgaaactgtg

SEQ ID NO: 74333 - DNA, 25 bp, mus musculus
tcacttcatgcaatgaaactgtggt

SEQ ID NO: 74334 - DNA, 25 bp, mus musculus
ggtcatcccttgcatcgtccgtaat

SEQ ID NO: 74335 - DNA, 25 bp, mus musculus
tcatcccttgcatcgtccgtaatgt

SEQ ID NO: 74336 - DNA, 25 bp, mus musculus
atcccttgcatcgtccgtaatgtgg

SEQ ID NO: 74337 - DNA, 25 bp, mus musculus
cttgcatcgtccgtaatgtggaggc

SEQ ID NO: 74338 - DNA, 25 bp, mus musculus
tgcatcgtccgtaatgtggaggcgc

SEQ ID NO: 74339 - DNA, 25 bp, mus musculus
catcgtccgtaatgtggaggcgcaa

SEQ ID NO: 74340 - DNA, 25 bp, mus musculus
tcgtccgtaatgtggaggcgcaaag

SEQ ID NO: 74341 - DNA, 25 bp, mus musculus
ctgctgcggttcagctcaactactg

SEQ ID NO: 74342 - DNA, 25 bp, mus musculus
gctgcggttcagctcaactactgtt

SEQ ID NO: 74343 - DNA, 25 bp, mus musculus
cggttcagctcaactactgtttagt

SEQ ID NO: 74344 - DNA, 25 bp, mus musculus
gtttagtaacgtcaactccatagag

SEQ ID NO: 74345 - DNA, 25 bp, mus musculus
ttagtaacgtcaactccatagagtt

SEQ ID NO: 74346 - DNA, 25 bp, mus musculus
caactccatagagttcacttcatgc

SEQ ID NO: 74347 - DNA, 25 bp, mus musculus
actccatagagttcacttcatgcaa

SEQ ID NO: 74348 - DNA, 25 bp, mus musculus
catagagttcacttcatgcaatgaa

SEQ ID NO: 74349 - DNA, 25 bp, mus musculus
gatccagatgtgctcaaccagagga

SEQ ID NO: 74350 - DNA, 25 bp, mus musculus
gatgtgctcaaccagaggaagaccg

SEQ ID NO: 74351 - DNA, 25 bp, mus musculus
ccactgtctgctggaaacttccaga

SEQ ID NO: 74352 - DNA, 25 bp, mus musculus
agttcccacaagatacatttctaat

SEQ ID NO: 74353 - DNA, 25 bp, mus musculus
ttttttccacatccttggatatgct

SEQ ID NO: 74354 - DNA, 25 bp, mus musculus
ccacatccttggatatgcttttcag

SEQ ID NO: 74355 - DNA, 25 bp, mus musculus
ccttggatatgcttttcagggacgc

SEQ ID NO: 74356 - DNA, 25 bp, mus musculus
gggacgctttacctcagcgtattct

SEQ ID NO: 74357 - DNA, 25 bp, mus musculus
ctttacctcagcgtattcttccatg

SEQ ID NO: 74358 - DNA, 25 bp, mus musculus
ctcagcgtattcttccatggaccac

SEQ ID NO: 74359 - DNA, 25 bp, mus musculus
gtattcttccatggaccacaaacct

SEQ ID NO: 74360 - DNA, 25 bp, mus musculus
ggaccacaaacctaggtgcagagaa

SEQ ID NO: 74361 - DNA, 25 bp, mus musculus
gccctggagttctgtggggaatctt

SEQ ID NO: 74362 - DNA, 25 bp, mus musculus
tggagctccatttgcacattcttcc

SEQ ID NO: 74363 - DNA, 25 bp, mus musculus
tccatttgcacattcttcctcaaca

SEQ ID NO: 74364 - DNA, 25 bp, mus musculus
tgcacattcttcctcaacatgttac

SEQ ID NO: 74365 - DNA, 25 bp, mus musculus
ttcttcctcaacatgttacaggcga

SEQ ID NO: 74366 - DNA, 25 bp, mus musculus
atgttacaggcgacatcatgctaat

SEQ ID NO: 74367 - DNA, 25 bp, mus musculus
caggcgacatcatgctaatgaagtc

SEQ ID NO: 74368 - DNA, 25 bp, mus musculus
agagccccactgtctgctggaaact

SEQ ID NO: 74369 - DNA, 25 bp, mus musculus
ggattattcctccatgctataaaaa

SEQ ID NO: 74370 - DNA, 25 bp, mus musculus
tccatagcctaagtttactgtgagc

SEQ ID NO: 74371 - DNA, 25 bp, mus musculus
atagtggctgttgctgtcctcattt

SEQ ID NO: 74372 - DNA, 25 bp, mus musculus
gctgttgctgtcctcatttatgaca

SEQ ID NO: 74373 - DNA, 25 bp, mus musculus
gctgtcctcatttatgacaagtact

SEQ ID NO: 74374 - DNA, 25 bp, mus musculus
agaatcagtcagtcttaggcacact

SEQ ID NO: 74375 - DNA, 25 bp, mus musculus
agtcagtcttaggcacactgtccag

SEQ ID NO: 74376 - DNA, 25 bp, mus musculus
gcacactgtccagtctcatagccac

SEQ ID NO: 74377 - DNA, 25 bp, mus musculus
tgtccagtctcatagccaccagcca

SEQ ID NO: 74378 - DNA, 25 bp, mus musculus
tagccaccagccacttagggctgaa

SEQ ID NO: 74379 - DNA, 25 bp, mus musculus
ccagccacttagggctgaacagtta

SEQ ID NO: 74380 - DNA, 25 bp, mus musculus
acagttactatgtggcttgtctgaa

SEQ ID NO: 74381 - DNA, 25 bp, mus musculus
gtttactgtgagcatctttagcatg

SEQ ID NO: 74382 - DNA, 25 bp, mus musculus
catctttagcatgccatttagcgag

SEQ ID NO: 74383 - DNA, 25 bp, mus musculus
tagcatgccatttagcgagggtttt

SEQ ID NO: 74384 - DNA, 25 bp, mus musculus
tgaaggctgatcacaccgagattct

SEQ ID NO: 74385 - DNA, 25 bp, mus musculus
ttttggctagactactgtagggtgg

SEQ ID NO: 74386 - DNA, 25 bp, mus musculus
gccatctcttgtattaatcagcaca

SEQ ID NO: 74387 - DNA, 25 bp, mus musculus
attaatcagcacatagtggctgttg

SEQ ID NO: 74388 - DNA, 25 bp, mus musculus
cagcacatagtggctgttgctgtcc

SEQ ID NO: 74389 - DNA, 25 bp, mus musculus
ggaccaatgagccttggagagaaaa

SEQ ID NO: 74390 - DNA, 25 bp, mus musculus
ccaatgagccttggagagaaaataa

SEQ ID NO: 74391 - DNA, 25 bp, mus musculus
aacatgttgcacaagcttagcctct

SEQ ID NO: 74392 - DNA, 25 bp, mus musculus
atgttgcacaagcttagcctctttc

SEQ ID NO: 74393 - DNA, 25 bp, mus musculus
ttgcacaagcttagcctctttccgt

SEQ ID NO: 74394 - DNA, 25 bp, mus musculus
agcctctttccgttctgttgtgtgt

SEQ ID NO: 74395 - DNA, 25 bp, mus musculus
tggctgtaaacccgatgctttgtga

SEQ ID NO: 74396 - DNA, 25 bp, mus musculus
taaacccgatgctttgtgaaatgag

SEQ ID NO: 74397 - DNA, 25 bp, mus musculus
acccgatgctttgtgaaatgagaat

SEQ ID NO: 74398 - DNA, 25 bp, mus musculus
gaatcttgacattttacttgtgaaa

SEQ ID NO: 74399 - DNA, 25 bp, mus musculus
tgaccgattgaaatccaccgtgttt

SEQ ID NO: 74400 - DNA, 25 bp, mus musculus
caccgtgttttgtgttctctatgtc

SEQ ID NO: 74401 - DNA, 25 bp, mus musculus
ttatgtaaaagcaccccaattccag

SEQ ID NO: 74402 - DNA, 25 bp, mus musculus
agacacaagcagcggctcgaccaca

SEQ ID NO: 74403 - DNA, 25 bp, mus musculus
cacaagcagcggctcgaccacagaa

SEQ ID NO: 74404 - DNA, 25 bp, mus musculus
ctcgaccacagaacacaagtcatca

SEQ ID NO: 74405 - DNA, 25 bp, mus musculus
cacagaacacaagtcatcaccctga

SEQ ID NO: 74406 - DNA, 25 bp, mus musculus
agaacacaagtcatcaccctgaatg

SEQ ID NO: 74407 - DNA, 25 bp, mus musculus
acacaagtcatcaccctgaatgcac

SEQ ID NO: 74408 - DNA, 25 bp, mus musculus
gtcatcaccctgaatgcacgggctc

SEQ ID NO: 74409 - DNA, 25 bp, mus musculus
gtcagtgatgccgctgcaagacacc

SEQ ID NO: 74410 - DNA, 25 bp, mus musculus
agacaccgactgctggcggaacaag

SEQ ID NO: 74411 - DNA, 25 bp, mus musculus
gagaccacactggcagccaaccagc

SEQ ID NO: 74412 - DNA, 25 bp, mus musculus
tccagggcttccaggctcaagtgga

SEQ ID NO: 74413 - DNA, 25 bp, mus musculus
gcttccaggctcaagtggatgacaa

SEQ ID NO: 74414 - DNA, 25 bp, mus musculus
tccaagttggaccctacctcagtca

SEQ ID NO: 74415 - DNA, 25 bp, mus musculus
ttggaccctacctcagtcacactga

SEQ ID NO: 74416 - DNA, 25 bp, mus musculus
tcagtcacactgaagcctatggaaa

SEQ ID NO: 74417 - DNA, 25 bp, mus musculus
accttcctggcctctgtacaatggc

SEQ ID NO: 74418 - DNA, 25 bp, mus musculus
cgccttctcttgctgtaaccattca

SEQ ID NO: 74419 - DNA, 25 bp, mus musculus
ctgtaaccattcacaaaaatcatta

SEQ ID NO: 74420 - DNA, 25 bp, mus musculus
atcattaaaaagctccgactgagaa

SEQ ID NO: 74421 - DNA, 25 bp, mus musculus
cgactgctggcggaacaagaagtcc

SEQ ID NO: 74422 - DNA, 25 bp, mus musculus
ctgcgcttggagcaccagttcgctc

SEQ ID NO: 74423 - DNA, 25 bp, mus musculus
ttggagcaccagttcgctctgaaag

SEQ ID NO: 74424 - DNA, 25 bp, mus musculus
caccagttcgctctgaaagaagatt

SEQ ID NO: 74425 - DNA, 25 bp, mus musculus
gttcagaacctgttccagaccttca

SEQ ID NO: 74426 - DNA, 25 bp, mus musculus
ttccagaccttcactatcaactacc

SEQ ID NO: 74427 - DNA, 25 bp, mus musculus
accttcactatcaactacctgcagg

SEQ ID NO: 74428 - DNA, 25 bp, mus musculus
aactacctgcaggagaccacactgg

SEQ ID NO: 74429 - DNA, 25 bp, mus musculus
gcagcgattgtcctgtgggagccac

SEQ ID NO: 74430 - DNA, 25 bp, mus musculus
cgattgtcctgtgggagccacggcc

SEQ ID NO: 74431 - DNA, 25 bp, mus musculus
gcatgccccggatcttgtccagcag

SEQ ID NO: 74432 - DNA, 25 bp, mus musculus
atgccccggatcttgtccagcaggc

SEQ ID NO: 74433 - DNA, 25 bp, mus musculus
gccccggatcttgtccagcaggcca

SEQ ID NO: 74434 - DNA, 25 bp, mus musculus
cccggatcttgtccagcaggccaga

SEQ ID NO: 74435 - DNA, 25 bp, mus musculus
gatcttgtccagcaggccagagatg

SEQ ID NO: 74436 - DNA, 25 bp, mus musculus
tcttgtccagcaggccagagatgaa

SEQ ID NO: 74437 - DNA, 25 bp, mus musculus
ttgtccagcaggccagagatgaagg

SEQ ID NO: 74438 - DNA, 25 bp, mus musculus
gtccagcaggccagagatgaaggcc

SEQ ID NO: 74439 - DNA, 25 bp, mus musculus
agatgaaggcctcagtgggtttgta

SEQ ID NO: 74440 - DNA, 25 bp, mus musculus
gaaggcctcagtgggtttgtaacag

SEQ ID NO: 74441 - DNA, 25 bp, mus musculus
attgtcctgtgggagccacggccgt

SEQ ID NO: 74442 - DNA, 25 bp, mus musculus
tgtcctgtgggagccacggccgtct

SEQ ID NO: 74443 - DNA, 25 bp, mus musculus
cgtctgagtcaggaccctcatttct

SEQ ID NO: 74444 - DNA, 25 bp, mus musculus
tctgagtcaggaccctcatttcttc

SEQ ID NO: 74445 - DNA, 25 bp, mus musculus
agtcaggaccctcatttcttctggg

SEQ ID NO: 74446 - DNA, 25 bp, mus musculus
tcaggaccctcatttcttctggggt

SEQ ID NO: 74447 - DNA, 25 bp, mus musculus
cagcttctgcatgccccggatcttg

SEQ ID NO: 74448 - DNA, 25 bp, mus musculus
ttctgcatgccccggatcttgtcca

SEQ ID NO: 74449 - DNA, 25 bp, mus musculus
ccaaaatgtcccaacggccatcaga

SEQ ID NO: 74450 - DNA, 25 bp, mus musculus
ggccatcagaacccggagaattctg

SEQ ID NO: 74451 - DNA, 25 bp, mus musculus
gctttagcaactttcaccctatctg

SEQ ID NO: 74452 - DNA, 25 bp, mus musculus
ttagcaactttcaccctatctgtgg

SEQ ID NO: 74453 - DNA, 25 bp, mus musculus
ttcaccctatctgtgggacgccctg

SEQ ID NO: 74454 - DNA, 25 bp, mus musculus
accctatctgtgggacgccctgtag

SEQ ID NO: 74455 - DNA, 25 bp, mus musculus
ggacgccctgtagctagatacttgc

SEQ ID NO: 74456 - DNA, 25 bp, mus musculus
atcaggtgcgtctcgaataaggccc

SEQ ID NO: 74457 - DNA, 25 bp, mus musculus
cagttttgtctcctcttctgaacta

SEQ ID NO: 74458 - DNA, 25 bp, mus musculus
tgtctcctcttctgaactaacccga

SEQ ID NO: 74459 - DNA, 25 bp, mus musculus
ctcttctgaactaacccgacctgag

SEQ ID NO: 74460 - DNA, 25 bp, mus musculus
ccgacctgaggtcttatagtatcgg

SEQ ID NO: 74461 - DNA, 25 bp, mus musculus
gattctgcagaaccttctaaactgg

SEQ ID NO: 74462 - DNA, 25 bp, mus musculus
tctgcagaaccttctaaactggctg

SEQ ID NO: 74463 - DNA, 25 bp, mus musculus
gcagaaccttctaaactggctgaat

SEQ ID NO: 74464 - DNA, 25 bp, mus musculus
ccttctaaactggctgaatgcccca

SEQ ID NO: 74465 - DNA, 25 bp, mus musculus
aaactggctgaatgccccagaggtg

SEQ ID NO: 74466 - DNA, 25 bp, mus musculus
gaatgccccagaggtggcttcatgg

SEQ ID NO: 74467 - DNA, 25 bp, mus musculus
tgccccagaggtggcttcatggctt

SEQ ID NO: 74468 - DNA, 25 bp, mus musculus
ggcttcatggctttagcaactttca

SEQ ID NO: 74469 - DNA, 25 bp, mus musculus
ctcattaagaacgacctgctgtgcc

SEQ ID NO: 74470 - DNA, 25 bp, mus musculus
cgagaacgcgctctgctcaaggacc

SEQ ID NO: 74471 - DNA, 25 bp, mus musculus
attcgcaactacaaagtcatggctg

SEQ ID NO: 74472 - DNA, 25 bp, mus musculus
aaagtcatggctgccgagaacatac

SEQ ID NO: 74473 - DNA, 25 bp, mus musculus
ctgaagtatctgtaccccaatattg

SEQ ID NO: 74474 - DNA, 25 bp, mus musculus
tatctgtaccccaatattgacaaag

SEQ ID NO: 74475 - DNA, 25 bp, mus musculus
gaagcaccagaaccgatggagcttg

SEQ ID NO: 74476 - DNA, 25 bp, mus musculus
gagcttgacgaccctaagcgaactg

SEQ ID NO: 74477 - DNA, 25 bp, mus musculus
ttgatttctgtgtctgaagtccacc

SEQ ID NO: 74478 - DNA, 25 bp, mus musculus
ccttctagacttcagaccacagaca

SEQ ID NO: 74479 - DNA, 25 bp, mus musculus
acagacaacctgcttcccatgtctc

SEQ ID NO: 74480 - DNA, 25 bp, mus musculus
aacctgcttcccatgtctccagagg

SEQ ID NO: 74481 - DNA, 25 bp, mus musculus
cgcgctctgctcaaggaccagcagc

SEQ ID NO: 74482 - DNA, 25 bp, mus musculus
acgttcctgcttagattcagtgaga

SEQ ID NO: 74483 - DNA, 25 bp, mus musculus
agattcagtgagagctcccgggaag

SEQ ID NO: 74484 - DNA, 25 bp, mus musculus
ggtgaacctgacttccatgccgtgg

SEQ ID NO: 74485 - DNA, 25 bp, mus musculus
cctgacttccatgccgtggagccct

SEQ ID NO: 74486 - DNA, 25 bp, mus musculus
ttccatgccgtggagccctacacga

SEQ ID NO: 74487 - DNA, 25 bp, mus musculus
ttcccagatattattcgcaactaca

SEQ ID NO: 74488 - DNA, 25 bp, mus musculus
gatattattcgcaactacaaagtca

SEQ ID NO: 74489 - DNA, 25 bp, mus musculus
aggacctggcagctcgagcgatgaa

SEQ ID NO: 74490 - DNA, 25 bp, mus musculus
tggcagctcgagcgatgaatgtgga

SEQ ID NO: 74491 - DNA, 25 bp, mus musculus
aggcacgcactggcagtagtccgcc

SEQ ID NO: 74492 - DNA, 25 bp, mus musculus
gtccgcccattgtcagcttggacaa

SEQ ID NO: 74493 - DNA, 25 bp, mus musculus
ccattgtcagcttggacaaagcgag

SEQ ID NO: 74494 - DNA, 25 bp, mus musculus
gccggccattcgcgaggttcattga

SEQ ID NO: 74495 - DNA, 25 bp, mus musculus
aagtccactgcagagttggacgtca

SEQ ID NO: 74496 - DNA, 25 bp, mus musculus
tggaccccacatgcctaggctctca

SEQ ID NO: 74497 - DNA, 25 bp, mus musculus
gcctaggctctcattaatacttaat

SEQ ID NO: 74498 - DNA, 25 bp, mus musculus
gctctcattaatacttaatacccac

SEQ ID NO: 74499 - DNA, 25 bp, mus musculus
tctgcaccgtgtggctgctgcaggg

SEQ ID NO: 74500 - DNA, 25 bp, mus musculus
ttgactcttctgaaggtaagaactc

SEQ ID NO: 74501 - DNA, 25 bp, mus musculus
ggaaccagtacgccgctgccatcac

SEQ ID NO: 74502 - DNA, 25 bp, mus musculus
ccatcaccaacgggctggccatgaa

SEQ ID NO: 74503 - DNA, 25 bp, mus musculus
ccaacgggctggccatgaagaacaa

SEQ ID NO: 74504 - DNA, 25 bp, mus musculus
atgagatctctgtcatccagaacgg

SEQ ID NO: 74505 - DNA, 25 bp, mus musculus
tctctgtcatccagaacggaggcat

SEQ ID NO: 74506 - DNA, 25 bp, mus musculus
tcatccagaacggaggcatccctca

SEQ ID NO: 74507 - DNA, 25 bp, mus musculus
agaacggaggcatccctcagctccc

SEQ ID NO: 74508 - DNA, 25 bp, mus musculus
tcccgcctttgggtgccatggccag

SEQ ID NO: 74509 - DNA, 25 bp, mus musculus
cgaagctccgaaaccaggagtagat

SEQ ID NO: 74510 - DNA, 25 bp, mus musculus
ctggacatcatggcagcagagaagc

SEQ ID NO: 74511 - DNA, 25 bp, mus musculus
atctgactcaggtgtggctcacctt

SEQ ID NO: 74512 - DNA, 25 bp, mus musculus
tctgactcaggtgtggctcacctta

SEQ ID NO: 74513 - DNA, 25 bp, mus musculus
ctgactcaggtgtggctcaccttag

SEQ ID NO: 74514 - DNA, 25 bp, mus musculus
actcaggtgtggctcaccttagagg

SEQ ID NO: 74515 - DNA, 25 bp, mus musculus
ctcaggtgtggctcaccttagagga

SEQ ID NO: 74516 - DNA, 25 bp, mus musculus
tcaggtgtggctcaccttagaggaa

SEQ ID NO: 74517 - DNA, 25 bp, mus musculus
aggtgtggctcaccttagaggaatc

SEQ ID NO: 74518 - DNA, 25 bp, mus musculus
gtgtggctcaccttagaggaatcct

SEQ ID NO: 74519 - DNA, 25 bp, mus musculus
tgtggctcaccttagaggaatcctg

SEQ ID NO: 74520 - DNA, 25 bp, mus musculus
ctcaccttagaggaatcctgcgaaa

SEQ ID NO: 74521 - DNA, 25 bp, mus musculus
tggacatcatggcagcagagaagcg

SEQ ID NO: 74522 - DNA, 25 bp, mus musculus
ggacatcatggcagcagagaagcga

SEQ ID NO: 74523 - DNA, 25 bp, mus musculus
acatcatggcagcagagaagcgacg

SEQ ID NO: 74524 - DNA, 25 bp, mus musculus
tgggcaatctgactcaggtgtggct

SEQ ID NO: 74525 - DNA, 25 bp, mus musculus
gggcaatctgactcaggtgtggctc

SEQ ID NO: 74526 - DNA, 25 bp, mus musculus
ggcaatctgactcaggtgtggctca

SEQ ID NO: 74527 - DNA, 25 bp, mus musculus
gcaatctgactcaggtgtggctcac

SEQ ID NO: 74528 - DNA, 25 bp, mus musculus
aatctgactcaggtgtggctcacct

SEQ ID NO: 74529 - DNA, 25 bp, mus musculus
acttgcttagcttagaggtggccat

SEQ ID NO: 74530 - DNA, 25 bp, mus musculus
aggtggccatcagacaactggagga

SEQ ID NO: 74531 - DNA, 25 bp, mus musculus
ctcagacaggcctttcatgaagaga

SEQ ID NO: 74532 - DNA, 25 bp, mus musculus
agacaggcctttcatgaagagaaga

SEQ ID NO: 74533 - DNA, 25 bp, mus musculus
cttgatagcagacctgctcgggtcc

SEQ ID NO: 74534 - DNA, 25 bp, mus musculus
gatagcagacctgctcgggtccctg

SEQ ID NO: 74535 - DNA, 25 bp, mus musculus
tgccttctgcttggggaactcaggg

SEQ ID NO: 74536 - DNA, 25 bp, mus musculus
cttctgcttggggaactcagggctt

SEQ ID NO: 74537 - DNA, 25 bp, mus musculus
cacttttcaggccgtctcagtattg

SEQ ID NO: 74538 - DNA, 25 bp, mus musculus
ggccgtctcagtattgcctatgggg

SEQ ID NO: 74539 - DNA, 25 bp, mus musculus
taccccaagtgcctttgctatgttt

SEQ ID NO: 74540 - DNA, 25 bp, mus musculus
tttatatcctggactggaggtttat

SEQ ID NO: 74541 - DNA, 25 bp, mus musculus
tggccatcagacaactggaggagtt

SEQ ID NO: 74542 - DNA, 25 bp, mus musculus
ccatcagacaactggaggagttgga

SEQ ID NO: 74543 - DNA, 25 bp, mus musculus
tggctgcacctgaacgctctgctca

SEQ ID NO: 74544 - DNA, 25 bp, mus musculus
ctgcacctgaacgctctgctcagac

SEQ ID NO: 74545 - DNA, 25 bp, mus musculus
cacctgaacgctctgctcagacagg

SEQ ID NO: 74546 - DNA, 25 bp, mus musculus
ctgaacgctctgctcagacaggcct

SEQ ID NO: 74547 - DNA, 25 bp, mus musculus
aacgctctgctcagacaggcctttc

SEQ ID NO: 74548 - DNA, 25 bp, mus musculus
gctctgctcagacaggcctttcatg

SEQ ID NO: 74549 - DNA, 25 bp, mus musculus
ttagtccgtgttactccacaagcgg

SEQ ID NO: 74550 - DNA, 25 bp, mus musculus
tccgtgttactccacaagcggcaat

SEQ ID NO: 74551 - DNA, 25 bp, mus musculus
tcagaacagaccttgcttacccatc

SEQ ID NO: 74552 - DNA, 25 bp, mus musculus
agaacagaccttgcttacccatctt

SEQ ID NO: 74553 - DNA, 25 bp, mus musculus
aacagaccttgcttacccatcttgc

SEQ ID NO: 74554 - DNA, 25 bp, mus musculus
atcttgcctcctcatattcaaaatt

SEQ ID NO: 74555 - DNA, 25 bp, mus musculus
cttgcctcctcatattcaaaattta

SEQ ID NO: 74556 - DNA, 25 bp, mus musculus
cctcctcatattcaaaatttagaga

SEQ ID NO: 74557 - DNA, 25 bp, mus musculus
tcctcatattcaaaatttagagata

SEQ ID NO: 74558 - DNA, 25 bp, mus musculus
tgtactagagtccaagctgaaggat

SEQ ID NO: 74559 - DNA, 25 bp, mus musculus
tactagagtccaagctgaaggattc

SEQ ID NO: 74560 - DNA, 25 bp, mus musculus
ctgaaggattcccgttgacgcgagt

SEQ ID NO: 74561 - DNA, 25 bp, mus musculus
cgtgttactccacaagcggcaatta

SEQ ID NO: 74562 - DNA, 25 bp, mus musculus
tgttactccacaagcggcaattatt

SEQ ID NO: 74563 - DNA, 25 bp, mus musculus
ttactccacaagcggcaattattgg

SEQ ID NO: 74564 - DNA, 25 bp, mus musculus
tccacaagcggcaattattggggag

SEQ ID NO: 74565 - DNA, 25 bp, mus musculus
gagtcgccaacaagcaaaattcaga

SEQ ID NO: 74566 - DNA, 25 bp, mus musculus
gtcgccaacaagcaaaattcagaac

SEQ ID NO: 74567 - DNA, 25 bp, mus musculus
cgccaacaagcaaaattcagaacag

SEQ ID NO: 74568 - DNA, 25 bp, mus musculus
attcagaacagaccttgcttaccca

SEQ ID NO: 74569 - DNA, 25 bp, mus musculus
tttctccaacagcgctgatgatatt

SEQ ID NO: 74570 - DNA, 25 bp, mus musculus
tgatatcgctcggggctttgagaga

SEQ ID NO: 74571 - DNA, 25 bp, mus musculus
cgcatatccagaggatgcggaaaac

SEQ ID NO: 74572 - DNA, 25 bp, mus musculus
gcagtctctgtcgtttctctttgta

SEQ ID NO: 74573 - DNA, 25 bp, mus musculus
tcctaaacgcatccataaaccactg

SEQ ID NO: 74574 - DNA, 25 bp, mus musculus
taaacgcatccataaaccactgcgc

SEQ ID NO: 74575 - DNA, 25 bp, mus musculus
actgcgctcatcacttgtgctccac

SEQ ID NO: 74576 - DNA, 25 bp, mus musculus
gcgctcatcacttgtgctccacggg

SEQ ID NO: 74577 - DNA, 25 bp, mus musculus
tcttgattccctaaagttgtagctc

SEQ ID NO: 74578 - DNA, 25 bp, mus musculus
ttccctaaagttgtagctcttgtga

SEQ ID NO: 74579 - DNA, 25 bp, mus musculus
gttgtagctcttgtgaacggtcagg

SEQ ID NO: 74580 - DNA, 25 bp, mus musculus
gtagctcttgtgaacggtcaggcat

SEQ ID NO: 74581 - DNA, 25 bp, mus musculus
tatcgctcggggctttgagagagga

SEQ ID NO: 74582 - DNA, 25 bp, mus musculus
agcaacagattcctgcggtgactta

SEQ ID NO: 74583 - DNA, 25 bp, mus musculus
ttcctgcggtgacttaatgttctta

SEQ ID NO: 74584 - DNA, 25 bp, mus musculus
agctgacctggttcttgcaaaagaa

SEQ ID NO: 74585 - DNA, 25 bp, mus musculus
tgacctggttcttgcaaaagaagct

SEQ ID NO: 74586 - DNA, 25 bp, mus musculus
actgacgtggcacgcatatccagag

SEQ ID NO: 74587 - DNA, 25 bp, mus musculus
gacgtggcacgcatatccagaggat

SEQ ID NO: 74588 - DNA, 25 bp, mus musculus
gtggcacgcatatccagaggatgcg

SEQ ID NO: 74589 - DNA, 25 bp, mus musculus
gtatgaccgacagatccgcctgtgg

SEQ ID NO: 74590 - DNA, 25 bp, mus musculus
atgaccgacagatccgcctgtgggg

SEQ ID NO: 74591 - DNA, 25 bp, mus musculus
gagtcaaagggctcaccatgctgga

SEQ ID NO: 74592 - DNA, 25 bp, mus musculus
gtcaaagggctcaccatgctggacc

SEQ ID NO: 74593 - DNA, 25 bp, mus musculus
caaagggctcaccatgctggaccac

SEQ ID NO: 74594 - DNA, 25 bp, mus musculus
aagggctcaccatgctggaccacga

SEQ ID NO: 74595 - DNA, 25 bp, mus musculus
gggctcaccatgctggaccacgaac

SEQ ID NO: 74596 - DNA, 25 bp, mus musculus
tcaccatgctggaccacgaacaggt

SEQ ID NO: 74597 - DNA, 25 bp, mus musculus
attcagactgggtctgtgggccgca

SEQ ID NO: 74598 - DNA, 25 bp, mus musculus
tcagactgggtctgtgggccgcaat

SEQ ID NO: 74599 - DNA, 25 bp, mus musculus
agactgggtctgtgggccgcaatag

SEQ ID NO: 74600 - DNA, 25 bp, mus musculus
tgggccgcaatagggccgaggctct

SEQ ID NO: 74601 - DNA, 25 bp, mus musculus
gaccgacagatccgcctgtggggac

SEQ ID NO: 74602 - DNA, 25 bp, mus musculus
gacagatccgcctgtggggactgga

SEQ ID NO: 74603 - DNA, 25 bp, mus musculus
tccgcctgtggggactggaggccca

SEQ ID NO: 74604 - DNA, 25 bp, mus musculus
gactggaggcccagaagcggcttcg

SEQ ID NO: 74605 - DNA, 25 bp, mus musculus
aggcccagaagcggcttcgagcttc

SEQ ID NO: 74606 - DNA, 25 bp, mus musculus
gcccagaagcggcttcgagcttccc

SEQ ID NO: 74607 - DNA, 25 bp, mus musculus
tcttatcctggcaggagtcaaaggg

SEQ ID NO: 74608 - DNA, 25 bp, mus musculus
atcctggcaggagtcaaagggctca

SEQ ID NO: 74609 - DNA, 25 bp, mus musculus
cgctcaagcacgcgggttgccagcc

SEQ ID NO: 74610 - DNA, 25 bp, mus musculus
ctcaagcacgcgggttgccagcctg

SEQ ID NO: 74611 - DNA, 25 bp, mus musculus
tgaattcctcaccagcagcattgct

SEQ ID NO: 74612 - DNA, 25 bp, mus musculus
aattcctcaccagcagcattgctac

SEQ ID NO: 74613 - DNA, 25 bp, mus musculus
ttcctcaccagcagcattgctactc

SEQ ID NO: 74614 - DNA, 25 bp, mus musculus
cctcaccagcagcattgctactctg

SEQ ID NO: 74615 - DNA, 25 bp, mus musculus
accagcagcattgctactctggatc

SEQ ID NO: 74616 - DNA, 25 bp, mus musculus
cagcagcattgctactctggatcta

SEQ ID NO: 74617 - DNA, 25 bp, mus musculus
gcagcattgctactctggatctaga

SEQ ID NO: 74618 - DNA, 25 bp, mus musculus
tcgtcggcgccagatatttctgtcc

SEQ ID NO: 74619 - DNA, 25 bp, mus musculus
gtcggcgccagatatttctgtcccg

SEQ ID NO: 74620 - DNA, 25 bp, mus musculus
ccaggccgcggctctttctgcgaac

SEQ ID NO: 74621 - DNA, 25 bp, mus musculus
ttgccagcctgggtgcaccgtgcgg

SEQ ID NO: 74622 - DNA, 25 bp, mus musculus
ggttgttcgcaagtcttgcggcgcg

SEQ ID NO: 74623 - DNA, 25 bp, mus musculus
gagacgtcaagcacgcactctgcgg

SEQ ID NO: 74624 - DNA, 25 bp, mus musculus
gacgtcaagcacgcactctgcgggt

SEQ ID NO: 74625 - DNA, 25 bp, mus musculus
tcaagcacgcactctgcgggtgaat

SEQ ID NO: 74626 - DNA, 25 bp, mus musculus
aagcacgcactctgcgggtgaattc

SEQ ID NO: 74627 - DNA, 25 bp, mus musculus
gcacgcactctgcgggtgaattcct

SEQ ID NO: 74628 - DNA, 25 bp, mus musculus
acgcactctgcgggtgaattcctca

SEQ ID NO: 74629 - DNA, 25 bp, mus musculus
actctgcgggtgaattcctcaccag

SEQ ID NO: 74630 - DNA, 25 bp, mus musculus
agagattgtcagctcgttagaaaag

SEQ ID NO: 74631 - DNA, 25 bp, mus musculus
agattgtcagctcgttagaaaagtc

SEQ ID NO: 74632 - DNA, 25 bp, mus musculus
gccttgaacttgatctgtcactgtg

SEQ ID NO: 74633 - DNA, 25 bp, mus musculus
aacttgatctgtcactgtgcctatg

SEQ ID NO: 74634 - DNA, 25 bp, mus musculus
cactgtgcctatgcctgtgttcttc

SEQ ID NO: 74635 - DNA, 25 bp, mus musculus
ctgtgcctatgcctgtgttcttcga

SEQ ID NO: 74636 - DNA, 25 bp, mus musculus
gcctatgcctgtgttcttcgaccga

SEQ ID NO: 74637 - DNA, 25 bp, mus musculus
ctatgcctgtgttcttcgaccgagc

SEQ ID NO: 74638 - DNA, 25 bp, mus musculus
atgcctgtgttcttcgaccgagcaa

SEQ ID NO: 74639 - DNA, 25 bp, mus musculus
gttcttcgaccgagcaaccagatct

SEQ ID NO: 74640 - DNA, 25 bp, mus musculus
ttcgaccgagcaaccagatctcggt

SEQ ID NO: 74641 - DNA, 25 bp, mus musculus
ttcatagcctctcctgctgtgtaca

SEQ ID NO: 74642 - DNA, 25 bp, mus musculus
agaactaggactcccatccttgctc

SEQ ID NO: 74643 - DNA, 25 bp, mus musculus
tagcctctcctgctgtgtacatcct

SEQ ID NO: 74644 - DNA, 25 bp, mus musculus
catccttgctcagccaggacttcat

SEQ ID NO: 74645 - DNA, 25 bp, mus musculus
tccttgctcagccaggacttcatgg

SEQ ID NO: 74646 - DNA, 25 bp, mus musculus
cttgctcagccaggacttcatggca

SEQ ID NO: 74647 - DNA, 25 bp, mus musculus
tgctcagccaggacttcatggcaac

SEQ ID NO: 74648 - DNA, 25 bp, mus musculus
cagccaggacttcatggcaacaacc

SEQ ID NO: 74649 - DNA, 25 bp, mus musculus
ggacttcatggcaacaaccgtttcg

SEQ ID NO: 74650 - DNA, 25 bp, mus musculus
ttcatggcaacaaccgtttcgtcgg

SEQ ID NO: 74651 - DNA, 25 bp, mus musculus
ggtcaaattgctggctgcgggaagc

SEQ ID NO: 74652 - DNA, 25 bp, mus musculus
gtcaaattgctggctgcgggaagcc

SEQ ID NO: 74653 - DNA, 25 bp, mus musculus
gagaattctgctgacggtagcgtga

SEQ ID NO: 74654 - DNA, 25 bp, mus musculus
agaattctgctgacggtagcgtgat

SEQ ID NO: 74655 - DNA, 25 bp, mus musculus
ttctgctgacggtagcgtgatcgtc

SEQ ID NO: 74656 - DNA, 25 bp, mus musculus
gtcaacgagctgtgctgaagtgtgg

SEQ ID NO: 74657 - DNA, 25 bp, mus musculus
tcaacgagctgtgctgaagtgtggt

SEQ ID NO: 74658 - DNA, 25 bp, mus musculus
tggtgcacgggagcagtccgattgt

SEQ ID NO: 74659 - DNA, 25 bp, mus musculus
tgcacgggagcagtccgattgttgg

SEQ ID NO: 74660 - DNA, 25 bp, mus musculus
gagcagtccgattgttgggcggtta

SEQ ID NO: 74661 - DNA, 25 bp, mus musculus
agcagtccgattgttgggcggttag

SEQ ID NO: 74662 - DNA, 25 bp, mus musculus
gcagtccgattgttgggcggttaga

SEQ ID NO: 74663 - DNA, 25 bp, mus musculus
aaattgctggctgcgggaagccagt

SEQ ID NO: 74664 - DNA, 25 bp, mus musculus
ttgctggctgcgggaagccagttag

SEQ ID NO: 74665 - DNA, 25 bp, mus musculus
agccagttaggtgggaccaggcttg

SEQ ID NO: 74666 - DNA, 25 bp, mus musculus
tcgtagctcgagctagtgtggcgat

SEQ ID NO: 74667 - DNA, 25 bp, mus musculus
cgtagctcgagctagtgtggcgatc

SEQ ID NO: 74668 - DNA, 25 bp, mus musculus
gtagctcgagctagtgtggcgatcg

SEQ ID NO: 74669 - DNA, 25 bp, mus musculus
tagctcgagctagtgtggcgatcga

SEQ ID NO: 74670 - DNA, 25 bp, mus musculus
cgagaattctgctgacggtagcgtg

SEQ ID NO: 74671 - DNA, 25 bp, mus musculus
gaattcttcatcaacaccactcagg

SEQ ID NO: 74672 - DNA, 25 bp, mus musculus
attcttcatcaacaccactcaggca

SEQ ID NO: 74673 - DNA, 25 bp, mus musculus
acattatctgtcaccattgaaggac

SEQ ID NO: 74674 - DNA, 25 bp, mus musculus
tatctgtcaccattgaaggaccatc

SEQ ID NO: 74675 - DNA, 25 bp, mus musculus
cattgaaggaccatccaaggtcaga

SEQ ID NO: 74676 - DNA, 25 bp, mus musculus
aggaccatccaaggtcagaatggat

SEQ ID NO: 74677 - DNA, 25 bp, mus musculus
gaccatccaaggtcagaatggattg

SEQ ID NO: 74678 - DNA, 25 bp, mus musculus
ccatccaaggtcagaatggattgcc

SEQ ID NO: 74679 - DNA, 25 bp, mus musculus
gattgccaggaaatcccagaggggt

SEQ ID NO: 74680 - DNA, 25 bp, mus musculus
caaagtcatgtacactcccatggct

SEQ ID NO: 74681 - DNA, 25 bp, mus musculus
aaattacctgattggtgtcaaatat

SEQ ID NO: 74682 - DNA, 25 bp, mus musculus
attacctgattggtgtcaaatatgg

SEQ ID NO: 74683 - DNA, 25 bp, mus musculus
tcttcatcaacaccactcaggcagg

SEQ ID NO: 74684 - DNA, 25 bp, mus musculus
ttcatcaacaccactcaggcaggcc

SEQ ID NO: 74685 - DNA, 25 bp, mus musculus
caccactcaggcaggcccagggaca

SEQ ID NO: 74686 - DNA, 25 bp, mus musculus
ccactcaggcaggcccagggacatt

SEQ ID NO: 74687 - DNA, 25 bp, mus musculus
tcaggcaggcccagggacattatct

SEQ ID NO: 74688 - DNA, 25 bp, mus musculus
aggcaggcccagggacattatctgt

SEQ ID NO: 74689 - DNA, 25 bp, mus musculus
aggcccagggacattatctgtcacc

SEQ ID NO: 74690 - DNA, 25 bp, mus musculus
ggacattatctgtcaccattgaagg

SEQ ID NO: 74691 - DNA, 25 bp, mus musculus
gtgcaaactcctcagtagcccaaag

SEQ ID NO: 74692 - DNA, 25 bp, mus musculus
caaactcctcagtagcccaaaggca

SEQ ID NO: 74693 - DNA, 25 bp, mus musculus
atgtgaggccagcatttgtgagcaa

SEQ ID NO: 74694 - DNA, 25 bp, mus musculus
actgctagctacacaggcccagagg

SEQ ID NO: 74695 - DNA, 25 bp, mus musculus
gctagctacacaggcccagaggaca

SEQ ID NO: 74696 - DNA, 25 bp, mus musculus
agctacacaggcccagaggacacaa

SEQ ID NO: 74697 - DNA, 25 bp, mus musculus
acaggcccagaggacacaagtaggt

SEQ ID NO: 74698 - DNA, 25 bp, mus musculus
ggagctagctcccctgagagctaga

SEQ ID NO: 74699 - DNA, 25 bp, mus musculus
gctagctcccctgagagctagataa

SEQ ID NO: 74700 - DNA, 25 bp, mus musculus
atatatctgcagtctgtgagtctat

SEQ ID NO: 74701 - DNA, 25 bp, mus musculus
tctgtgagtctattcctcagaactt

SEQ ID NO: 74702 - DNA, 25 bp, mus musculus
aaagtagctgttgtgcttgtaaatt

SEQ ID NO: 74703 - DNA, 25 bp, mus musculus
actcctcagtagcccaaaggcatca

SEQ ID NO: 74704 - DNA, 25 bp, mus musculus
cagtagcccaaaggcatcaggtgtg

SEQ ID NO: 74705 - DNA, 25 bp, mus musculus
ggctcactctggcaaaggagagagg

SEQ ID NO: 74706 - DNA, 25 bp, mus musculus
tcactctggcaaaggagagagggca

SEQ ID NO: 74707 - DNA, 25 bp, mus musculus
agtggaccctgctgttctcagaatg

SEQ ID NO: 74708 - DNA, 25 bp, mus musculus
gtgaacacagacagggccagccaaa

SEQ ID NO: 74709 - DNA, 25 bp, mus musculus
acagacagggccagccaaagaactt

SEQ ID NO: 74710 - DNA, 25 bp, mus musculus
agggccagccaaagaacttgataga

SEQ ID NO: 74711 - DNA, 25 bp, mus musculus
tccagctcagccatgccaaccgtat

SEQ ID NO: 74712 - DNA, 25 bp, mus musculus
agctcagccatgccaaccgtatggc

SEQ ID NO: 74713 - DNA, 25 bp, mus musculus
gtatggctgctgaggcccagaaaca

SEQ ID NO: 74714 - DNA, 25 bp, mus musculus
atggctgctgaggcccagaaacaag

SEQ ID NO: 74715 - DNA, 25 bp, mus musculus
tggctgctgaggcccagaaacaagt

SEQ ID NO: 74716 - DNA, 25 bp, mus musculus
ctgaggcccagaaacaagtgaagag

SEQ ID NO: 74717 - DNA, 25 bp, mus musculus
tgaagagcctccagagtctgctgaa

SEQ ID NO: 74718 - DNA, 25 bp, mus musculus
aagagcctccagagtctgctgaagg

SEQ ID NO: 74719 - DNA, 25 bp, mus musculus
agagcctccagagtctgctgaagga

SEQ ID NO: 74720 - DNA, 25 bp, mus musculus
agcctccagagtctgctgaaggaca

SEQ ID NO: 74721 - DNA, 25 bp, mus musculus
gcctccagagtctgctgaaggacac

SEQ ID NO: 74722 - DNA, 25 bp, mus musculus
ctccagagtctgctgaaggacactc

SEQ ID NO: 74723 - DNA, 25 bp, mus musculus
ctcagccatgccaaccgtatggctg

SEQ ID NO: 74724 - DNA, 25 bp, mus musculus
tcagccatgccaaccgtatggctgc

SEQ ID NO: 74725 - DNA, 25 bp, mus musculus
gccatgccaaccgtatggctgctga

SEQ ID NO: 74726 - DNA, 25 bp, mus musculus
catgccaaccgtatggctgctgagg

SEQ ID NO: 74727 - DNA, 25 bp, mus musculus
gccaaccgtatggctgctgaggccc

SEQ ID NO: 74728 - DNA, 25 bp, mus musculus
ccaaccgtatggctgctgaggccca

SEQ ID NO: 74729 - DNA, 25 bp, mus musculus
accgtatggctgctgaggcccagaa

SEQ ID NO: 74730 - DNA, 25 bp, mus musculus
cgtatggctgctgaggcccagaaac

SEQ ID NO: 74731 - DNA, 25 bp, mus musculus
aattaaaccctgtggctacaggatg

SEQ ID NO: 74732 - DNA, 25 bp, mus musculus
accctgtggctacaggatggcctgc

SEQ ID NO: 74733 - DNA, 25 bp, mus musculus
ttaccagactctgttgctcaactct

SEQ ID NO: 74734 - DNA, 25 bp, mus musculus
ccagactctgttgctcaactctgat

SEQ ID NO: 74735 - DNA, 25 bp, mus musculus
gttgctcaactctgatagagtcatt

SEQ ID NO: 74736 - DNA, 25 bp, mus musculus
gctcaactctgatagagtcattttt

SEQ ID NO: 74737 - DNA, 25 bp, mus musculus
ccacaagtctgaactcagctaccct

SEQ ID NO: 74738 - DNA, 25 bp, mus musculus
tcccatacaagactggcgtgaggat

SEQ ID NO: 74739 - DNA, 25 bp, mus musculus
catacaagactggcgtgaggatctg

SEQ ID NO: 74740 - DNA, 25 bp, mus musculus
agactggcgtgaggatctgaaagac

SEQ ID NO: 74741 - DNA, 25 bp, mus musculus
atagatcgctggacactggccctgc

SEQ ID NO: 74742 - DNA, 25 bp, mus musculus
gatcgctggacactggccctgccag

SEQ ID NO: 74743 - DNA, 25 bp, mus musculus
tggctacaggatggcctgcttgtct

SEQ ID NO: 74744 - DNA, 25 bp, mus musculus
acactggccctgccagagaacacat

SEQ ID NO: 74745 - DNA, 25 bp, mus musculus
ctgcttgtctgctataacgttactt

SEQ ID NO: 74746 - DNA, 25 bp, mus musculus
cttgtctgctataacgttacttgtc

SEQ ID NO: 74747 - DNA, 25 bp, mus musculus
tgctataacgttacttgtcaaggat

SEQ ID NO: 74748 - DNA, 25 bp, mus musculus
aacgttacttgtcaaggatgtagat

SEQ ID NO: 74749 - DNA, 25 bp, mus musculus
ggtgcacaccctagaaaatatggat

SEQ ID NO: 74750 - DNA, 25 bp, mus musculus
ggatcagccctgatggatgagtcat

SEQ ID NO: 74751 - DNA, 25 bp, mus musculus
tcattaccagactctgttgctcaac

SEQ ID NO: 74752 - DNA, 25 bp, mus musculus
gtctcaaaattctgtgacagatttt

SEQ ID NO: 74753 - DNA, 25 bp, mus musculus
taataacttaaaactgccacacaca

SEQ ID NO: 74754 - DNA, 25 bp, mus musculus
cttccaccactgattaagactgggg

SEQ ID NO: 74755 - DNA, 25 bp, mus musculus
aatattcatttagccttctgagctt

SEQ ID NO: 74756 - DNA, 25 bp, mus musculus
ttcatttagccttctgagctttctg

SEQ ID NO: 74757 - DNA, 25 bp, mus musculus
catttagccttctgagctttctgtg

SEQ ID NO: 74758 - DNA, 25 bp, mus musculus
tagccttctgagctttctgtgcaga

SEQ ID NO: 74759 - DNA, 25 bp, mus musculus
gccttctgagctttctgtgcagaca

SEQ ID NO: 74760 - DNA, 25 bp, mus musculus
cttctgagctttctgtgcagacatg

SEQ ID NO: 74761 - DNA, 25 bp, mus musculus
tctgagctttctgtgcagacatggt

SEQ ID NO: 74762 - DNA, 25 bp, mus musculus
tgagctttctgtgcagacatggtga

SEQ ID NO: 74763 - DNA, 25 bp, mus musculus
agctttctgtgcagacatggtgaca

SEQ ID NO: 74764 - DNA, 25 bp, mus musculus
aacttaaaactgccacacacataga

SEQ ID NO: 74765 - DNA, 25 bp, mus musculus
cttaaaactgccacacacatagaaa

SEQ ID NO: 74766 - DNA, 25 bp, mus musculus
gtccacaacattctttccttctgaa

SEQ ID NO: 74767 - DNA, 25 bp, mus musculus
ccacaacattctttccttctgaagg

SEQ ID NO: 74768 - DNA, 25 bp, mus musculus
ttccttctgaaggttttacgatgca

SEQ ID NO: 74769 - DNA, 25 bp, mus musculus
ttatcattaaccagtcttttactat

SEQ ID NO: 74770 - DNA, 25 bp, mus musculus
gttctgagaccgttcttccaccact

SEQ ID NO: 74771 - DNA, 25 bp, mus musculus
ttcttccaccactgattaagactgg

SEQ ID NO: 74772 - DNA, 25 bp, mus musculus
cactgcaagcgattgtccaattcta

SEQ ID NO: 74773 - DNA, 25 bp, mus musculus
aattctactttaattgacattgctt

SEQ ID NO: 74774 - DNA, 25 bp, mus musculus
tctttattatgttcaactctcctga

SEQ ID NO: 74775 - DNA, 25 bp, mus musculus
ttatgttcaactctcctgatttcag

SEQ ID NO: 74776 - DNA, 25 bp, mus musculus
acatttttgcatttctatcaggtgc

SEQ ID NO: 74777 - DNA, 25 bp, mus musculus
ttctatcaggtgctgtgtaacgaat

SEQ ID NO: 74778 - DNA, 25 bp, mus musculus
tgtaatgattctttctcactgatat

SEQ ID NO: 74779 - DNA, 25 bp, mus musculus
gattctttctcactgatatctgtat

SEQ ID NO: 74780 - DNA, 25 bp, mus musculus
ttctcactgatatctgtattgtgaa

SEQ ID NO: 74781 - DNA, 25 bp, mus musculus
ttgtgaaatccacagaactgtacag

SEQ ID NO: 74782 - DNA, 25 bp, mus musculus
aatccacagaactgtacaggtgctg

SEQ ID NO: 74783 - DNA, 25 bp, mus musculus
tatgaattctacaaccctataataa

SEQ ID NO: 74784 - DNA, 25 bp, mus musculus
actttaattgacattgcttgctgtt

SEQ ID NO: 74785 - DNA, 25 bp, mus musculus
gaatgtgtcatcttaccatcctgac

SEQ ID NO: 74786 - DNA, 25 bp, mus musculus
gtcatcttaccatcctgacaataaa

SEQ ID NO: 74787 - DNA, 25 bp, mus musculus
ttaccatcctgacaataaagcccat

SEQ ID NO: 74788 - DNA, 25 bp, mus musculus
tcctgacaataaagcccatcctctg

SEQ ID NO: 74789 - DNA, 25 bp, mus musculus
agcaagctctttccaacatcacttg

SEQ ID NO: 74790 - DNA, 25 bp, mus musculus
ctctttccaacatcacttggctaga

SEQ ID NO: 74791 - DNA, 25 bp, mus musculus
tcacttggctagagcatgctttaaa

SEQ ID NO: 74792 - DNA, 25 bp, mus musculus
tctaatcatcaggcgagcatatgag

SEQ ID NO: 74793 - DNA, 25 bp, mus musculus
ttaagcatatgcggctgtaatgata

SEQ ID NO: 74794 - DNA, 25 bp, mus musculus
tggcttcacatggctttctctcagt

SEQ ID NO: 74795 - DNA, 25 bp, mus musculus
cacatggctttctctcagtactccc

SEQ ID NO: 74796 - DNA, 25 bp, mus musculus
gctttctctcagtactccctttatg

SEQ ID NO: 74797 - DNA, 25 bp, mus musculus
tctcagtactccctttatgcccacg

SEQ ID NO: 74798 - DNA, 25 bp, mus musculus
gaccctgtgtatacaccaaatgatg

SEQ ID NO: 74799 - DNA, 25 bp, mus musculus
caggtctaccctctgcttgtcccag

SEQ ID NO: 74800 - DNA, 25 bp, mus musculus
ctgcttgtcccagaacgccattgac

SEQ ID NO: 74801 - DNA, 25 bp, mus musculus
gtcccagaacgccattgacattgac

SEQ ID NO: 74802 - DNA, 25 bp, mus musculus
ttttatcttgaccacactgtacagt

SEQ ID NO: 74803 - DNA, 25 bp, mus musculus
cttgaccacactgtacagtaacatc

SEQ ID NO: 74804 - DNA, 25 bp, mus musculus
aatgataaccacttgcttaggcagg

SEQ ID NO: 74805 - DNA, 25 bp, mus musculus
acactgtacagtaacatccaagagc

SEQ ID NO: 74806 - DNA, 25 bp, mus musculus
aaccacttgcttaggcaggcactga

SEQ ID NO: 74807 - DNA, 25 bp, mus musculus
ttgcttaggcaggcactgagctgag

SEQ ID NO: 74808 - DNA, 25 bp, mus musculus
tgattctgttactctaattctacaa

SEQ ID NO: 74809 - DNA, 25 bp, mus musculus
tcttactaacattcctgtgacatcc

SEQ ID NO: 74810 - DNA, 25 bp, mus musculus
gggttcattgtctgccatatgacta

SEQ ID NO: 74811 - DNA, 25 bp, mus musculus
attgtctgccatatgactatgtttc

SEQ ID NO: 74812 - DNA, 25 bp, mus musculus
ctacagatattctcagcatgaggat

SEQ ID NO: 74813 - DNA, 25 bp, mus musculus
tccaacagtgcccatggactactct

SEQ ID NO: 74814 - DNA, 25 bp, mus musculus
aacagtgcccatggactactcttgg

SEQ ID NO: 74815 - DNA, 25 bp, mus musculus
catgaccagcatctgtgatgagcga

SEQ ID NO: 74816 - DNA, 25 bp, mus musculus
catttatgcgggcatgccatcaccg

SEQ ID NO: 74817 - DNA, 25 bp, mus musculus
ctctggttccagagaaggttgccca

SEQ ID NO: 74818 - DNA, 25 bp, mus musculus
aagtattcctgccagttcattgaga

SEQ ID NO: 74819 - DNA, 25 bp, mus musculus
tattcctgccagttcattgagatgt

SEQ ID NO: 74820 - DNA, 25 bp, mus musculus
atgtgtctgatggtcacagctgatc

SEQ ID NO: 74821 - DNA, 25 bp, mus musculus
tgtctgatggtcacagctgatcacg

SEQ ID NO: 74822 - DNA, 25 bp, mus musculus
atggtcacagctgatcacgggccag

SEQ ID NO: 74823 - DNA, 25 bp, mus musculus
gtcacagctgatcacgggccagctg

SEQ ID NO: 74824 - DNA, 25 bp, mus musculus
acagctgatcacgggccagctgtct

SEQ ID NO: 74825 - DNA, 25 bp, mus musculus
agtgcccatggactactcttgggcc

SEQ ID NO: 74826 - DNA, 25 bp, mus musculus
gctgatcacgggccagctgtctctg

SEQ ID NO: 74827 - DNA, 25 bp, mus musculus
catggactactcttgggccagagag

SEQ ID NO: 74828 - DNA, 25 bp, mus musculus
ggactactcttgggccagagagctg

SEQ ID NO: 74829 - DNA, 25 bp, mus musculus
ctactcttgggccagagagctgggt

SEQ ID NO: 74830 - DNA, 25 bp, mus musculus
tttgatccgaaaacctgcctcattc

SEQ ID NO: 74831 - DNA, 25 bp, mus musculus
ccgaaaacctgcctcattcatgacc

SEQ ID NO: 74832 - DNA, 25 bp, mus musculus
ctcattcatgaccagcatctgtgat

SEQ ID NO: 74833 - DNA, 25 bp, mus musculus
attcatgaccagcatctgtgatgag

SEQ ID NO: 74834 - DNA, 25 bp, mus musculus
atccagaagggcatcgctgagaaga

SEQ ID NO: 74835 - DNA, 25 bp, mus musculus
ctaatgaatcctgaagcccagctgc

SEQ ID NO: 74836 - DNA, 25 bp, mus musculus
ctgcagcagcagagccctgagcata

SEQ ID NO: 74837 - DNA, 25 bp, mus musculus
acccatcctgagctcactgttgctg

SEQ ID NO: 74838 - DNA, 25 bp, mus musculus
cctgagctcactgttgctgtggaga

SEQ ID NO: 74839 - DNA, 25 bp, mus musculus
tcatccgtggccctcatcaacaggg

SEQ ID NO: 74840 - DNA, 25 bp, mus musculus
ctcatcaacagggcgctggagtcag

SEQ ID NO: 74841 - DNA, 25 bp, mus musculus
gacatgaccactgtgtggaagcagc

SEQ ID NO: 74842 - DNA, 25 bp, mus musculus
atgaccactgtgtggaagcagctga

SEQ ID NO: 74843 - DNA, 25 bp, mus musculus
cagctgagcagctcagttacgggcc

SEQ ID NO: 74844 - DNA, 25 bp, mus musculus
ctgagcagctcagttacgggcctta

SEQ ID NO: 74845 - DNA, 25 bp, mus musculus
tcagttacgggccttaccaacatcg

SEQ ID NO: 74846 - DNA, 25 bp, mus musculus
atgaatcctgaagcccagctgcccc

SEQ ID NO: 74847 - DNA, 25 bp, mus musculus
cctgaagcccagctgccccaggtgt

SEQ ID NO: 74848 - DNA, 25 bp, mus musculus
gcccagctgccccaggtgtatccat

SEQ ID NO: 74849 - DNA, 25 bp, mus musculus
ctgccccaggtgtatccatttgcag

SEQ ID NO: 74850 - DNA, 25 bp, mus musculus
ccccaggtgtatccatttgcagccg

SEQ ID NO: 74851 - DNA, 25 bp, mus musculus
tatccatttgcagccgatctctatc

SEQ ID NO: 74852 - DNA, 25 bp, mus musculus
ccatttgcagccgatctctatcaga

SEQ ID NO: 74853 - DNA, 25 bp, mus musculus
gccgatctctatcagaaggagttgg

SEQ ID NO: 74854 - DNA, 25 bp, mus musculus
acctgaccggaactccttcatgata

SEQ ID NO: 74855 - DNA, 25 bp, mus musculus
cctgaccggaactccttcatgatag

SEQ ID NO: 74856 - DNA, 25 bp, mus musculus
cttcatgatagactctcgttctttg

SEQ ID NO: 74857 - DNA, 25 bp, mus musculus
ttcatgatagactctcgttctttgt

SEQ ID NO: 74858 - DNA, 25 bp, mus musculus
catgatagactctcgttctttgtgg

SEQ ID NO: 74859 - DNA, 25 bp, mus musculus
atgatagactctcgttctttgtggg

SEQ ID NO: 74860 - DNA, 25 bp, mus musculus
gatagactctcgttctttgtggggc

SEQ ID NO: 74861 - DNA, 25 bp, mus musculus
atagactctcgttctttgtggggca

SEQ ID NO: 74862 - DNA, 25 bp, mus musculus
agactctcgttctttgtggggcatg

SEQ ID NO: 74863 - DNA, 25 bp, mus musculus
gactctcgttctttgtggggcatgt

SEQ ID NO: 74864 - DNA, 25 bp, mus musculus
ctctcgttctttgtggggcatgtct

SEQ ID NO: 74865 - DNA, 25 bp, mus musculus
tctcgttctttgtggggcatgtctc

SEQ ID NO: 74866 - DNA, 25 bp, mus musculus
tgaccggaactccttcatgatagac

SEQ ID NO: 74867 - DNA, 25 bp, mus musculus
ctcgttctttgtggggcatgtctcc

SEQ ID NO: 74868 - DNA, 25 bp, mus musculus
gaccggaactccttcatgatagact

SEQ ID NO: 74869 - DNA, 25 bp, mus musculus
ccggaactccttcatgatagactct

SEQ ID NO: 74870 - DNA, 25 bp, mus musculus
cggaactccttcatgatagactctc

SEQ ID NO: 74871 - DNA, 25 bp, mus musculus
gaactccttcatgatagactctcgt

SEQ ID NO: 74872 - DNA, 25 bp, mus musculus
aactccttcatgatagactctcgtt

SEQ ID NO: 74873 - DNA, 25 bp, mus musculus
ctccttcatgatagactctcgttct

SEQ ID NO: 74874 - DNA, 25 bp, mus musculus
tccttcatgatagactctcgttctt

SEQ ID NO: 74875 - DNA, 25 bp, mus musculus
caagtcttctatccacagctactga

SEQ ID NO: 74876 - DNA, 25 bp, mus musculus
tatccacagctactgaggcctcagc

SEQ ID NO: 74877 - DNA, 25 bp, mus musculus
ggcctcttcccgatgcataggtgtg

SEQ ID NO: 74878 - DNA, 25 bp, mus musculus
ccatagctttcttgtccttgtaaga

SEQ ID NO: 74879 - DNA, 25 bp, mus musculus
tagctttcttgtccttgtaagaggt

SEQ ID NO: 74880 - DNA, 25 bp, mus musculus
tcttgtccttgtaagaggtggataa

SEQ ID NO: 74881 - DNA, 25 bp, mus musculus
aagatacccaggacagcaaatctac

SEQ ID NO: 74882 - DNA, 25 bp, mus musculus
atacccaggacagcaaatctactca

SEQ ID NO: 74883 - DNA, 25 bp, mus musculus
acagcaaatctactcaagaatgacc

SEQ ID NO: 74884 - DNA, 25 bp, mus musculus
gcaaatctactcaagaatgacccca

SEQ ID NO: 74885 - DNA, 25 bp, mus musculus
aatctactcaagaatgaccccatgg

SEQ ID NO: 74886 - DNA, 25 bp, mus musculus
gtgggactcactctgagtcaaataa

SEQ ID NO: 74887 - DNA, 25 bp, mus musculus
ccacagctactgaggcctcagccag

SEQ ID NO: 74888 - DNA, 25 bp, mus musculus
aggcctcagccagagctctgaccct

SEQ ID NO: 74889 - DNA, 25 bp, mus musculus
cagccagagctctgaccctgatctc

SEQ ID NO: 74890 - DNA, 25 bp, mus musculus
tgaccctgatctcagcctattccta

SEQ ID NO: 74891 - DNA, 25 bp, mus musculus
cagcctattcctaagcttggccctc

SEQ ID NO: 74892 - DNA, 25 bp, mus musculus
tctgtatccagtcctgctctgcatg

SEQ ID NO: 74893 - DNA, 25 bp, mus musculus
gtatccagtcctgctctgcatgcca

SEQ ID NO: 74894 - DNA, 25 bp, mus musculus
agcgccagcctgatccagaggctgg

SEQ ID NO: 74895 - DNA, 25 bp, mus musculus
ctctcccagcatatgctggcatctc

SEQ ID NO: 74896 - DNA, 25 bp, mus musculus
atgctggcatctcagggaatcccaa

SEQ ID NO: 74897 - DNA, 25 bp, mus musculus
aatagccgtgagcccagtccgctgc

SEQ ID NO: 74898 - DNA, 25 bp, mus musculus
tcgcccagcggctcagccaaagagg

SEQ ID NO: 74899 - DNA, 25 bp, mus musculus
cccagcggctcagccaaagaggcgg

SEQ ID NO: 74900 - DNA, 25 bp, mus musculus
agcggctcagccaaagaggcggcca

SEQ ID NO: 74901 - DNA, 25 bp, mus musculus
agtgaactgcagcgcatccagagac

SEQ ID NO: 74902 - DNA, 25 bp, mus musculus
ctgcagcgcatccagagactggtga

SEQ ID NO: 74903 - DNA, 25 bp, mus musculus
cgcatccagagactggtgagtgggc

SEQ ID NO: 74904 - DNA, 25 bp, mus musculus
ctctgcctcggctgtctaggacgtg

SEQ ID NO: 74905 - DNA, 25 bp, mus musculus
ctcggctgtctaggacgtgtacagc

SEQ ID NO: 74906 - DNA, 25 bp, mus musculus
cgtgtacagcacagaatgggtattt

SEQ ID NO: 74907 - DNA, 25 bp, mus musculus
gcatctcagggaatcccaatgccca

SEQ ID NO: 74908 - DNA, 25 bp, mus musculus
ggaatcccaatgcccactttcggag

SEQ ID NO: 74909 - DNA, 25 bp, mus musculus
tacccgtacacttacatggcagcag

SEQ ID NO: 74910 - DNA, 25 bp, mus musculus
gctggttcattatcacggagcccat

SEQ ID NO: 74911 - DNA, 25 bp, mus musculus
ttatcacggagcccatttctgggca

SEQ ID NO: 74912 - DNA, 25 bp, mus musculus
cgtctgcgcttcagtccttaccaga

SEQ ID NO: 74913 - DNA, 25 bp, mus musculus
ctgcgcttcagtccttaccagatcc

SEQ ID NO: 74914 - DNA, 25 bp, mus musculus
cgcttcagtccttaccagatccctg

SEQ ID NO: 74915 - DNA, 25 bp, mus musculus
ctctcaattgctattgaggccccta

SEQ ID NO: 74916 - DNA, 25 bp, mus musculus
attgctattgaggcccctagtacgg

SEQ ID NO: 74917 - DNA, 25 bp, mus musculus
gggtcatgcggtgtgtcttatattg

SEQ ID NO: 74918 - DNA, 25 bp, mus musculus
tatattgcacaagagcctggtaact

SEQ ID NO: 74919 - DNA, 25 bp, mus musculus
attgcacaagagcctggtaactacg

SEQ ID NO: 74920 - DNA, 25 bp, mus musculus
tatatcaagttcagcgacgaacaca

SEQ ID NO: 74921 - DNA, 25 bp, mus musculus
atcaagttcagcgacgaacacatcg

SEQ ID NO: 74922 - DNA, 25 bp, mus musculus
aagttcagcgacgaacacatcgcgg

SEQ ID NO: 74923 - DNA, 25 bp, mus musculus
ttcagcgacgaacacatcgcggact

SEQ ID NO: 74924 - DNA, 25 bp, mus musculus
agcgacgaacacatcgcggactagc

SEQ ID NO: 74925 - DNA, 25 bp, mus musculus
gacgaacacatcgcggactagcctt

SEQ ID NO: 74926 - DNA, 25 bp, mus musculus
cacatcgcggactagccttgagtgg

SEQ ID NO: 74927 - DNA, 25 bp, mus musculus
gaggcccctagtacggccgagatca

SEQ ID NO: 74928 - DNA, 25 bp, mus musculus
atcgcggactagccttgagtggtgc

SEQ ID NO: 74929 - DNA, 25 bp, mus musculus
gcccctagtacggccgagatcacat

SEQ ID NO: 74930 - DNA, 25 bp, mus musculus
cctagtacggccgagatcacattcg

SEQ ID NO: 74931 - DNA, 25 bp, mus musculus
acggccgagatcacattcgatgacc

SEQ ID NO: 74932 - DNA, 25 bp, mus musculus
gccgagatcacattcgatgaccata

SEQ ID NO: 74933 - DNA, 25 bp, mus musculus
gagatcacattcgatgaccataaaa

SEQ ID NO: 74934 - DNA, 25 bp, mus musculus
atcacattcgatgaccataaaaatg

SEQ ID NO: 74935 - DNA, 25 bp, mus musculus
aatgggtcatgcggtgtgtcttata

SEQ ID NO: 74936 - DNA, 25 bp, mus musculus
agaacttccagaacatgccaaaatc

SEQ ID NO: 74937 - DNA, 25 bp, mus musculus
acttccagaacatgccaaaatcaat

SEQ ID NO: 74938 - DNA, 25 bp, mus musculus
actaagcatgctacattccaagttc

SEQ ID NO: 74939 - DNA, 25 bp, mus musculus
aagcatgctacattccaagttctct

SEQ ID NO: 74940 - DNA, 25 bp, mus musculus
acattccaagttctctgaagattgc

SEQ ID NO: 74941 - DNA, 25 bp, mus musculus
ttccaagttctctgaagattgctca

SEQ ID NO: 74942 - DNA, 25 bp, mus musculus
ttgctcaacacattggcatcttgac

SEQ ID NO: 74943 - DNA, 25 bp, mus musculus
ctcaacacattggcatcttgacatt

SEQ ID NO: 74944 - DNA, 25 bp, mus musculus
aacacattggcatcttgacattcag

SEQ ID NO: 74945 - DNA, 25 bp, mus musculus
acattggcatcttgacattcagctg

SEQ ID NO: 74946 - DNA, 25 bp, mus musculus
ttggcatcttgacattcagctgtta

SEQ ID NO: 74947 - DNA, 25 bp, mus musculus
gcatcttgacattcagctgttaaat

SEQ ID NO: 74948 - DNA, 25 bp, mus musculus
tccagaacatgccaaaatcaatgaa

SEQ ID NO: 74949 - DNA, 25 bp, mus musculus
ggacacatttggtcctggggatgat

SEQ ID NO: 74950 - DNA, 25 bp, mus musculus
cacatttggtcctggggatgatgat

SEQ ID NO: 74951 - DNA, 25 bp, mus musculus
atttggtcctggggatgatgatgaa

SEQ ID NO: 74952 - DNA, 25 bp, mus musculus
tggtcctggggatgatgatgaaatc

SEQ ID NO: 74953 - DNA, 25 bp, mus musculus
tgacatctaacataaactaagcatg

SEQ ID NO: 74954 - DNA, 25 bp, mus musculus
catctaacataaactaagcatgcta

SEQ ID NO: 74955 - DNA, 25 bp, mus musculus
taaactaagcatgctacattccaag

SEQ ID NO: 74956 - DNA, 25 bp, mus musculus
gaattatgccaattctgaaaaattt

SEQ ID NO: 74957 - DNA, 25 bp, mus musculus
attttacacatgtatggcaacacct

SEQ ID NO: 74958 - DNA, 25 bp, mus musculus
ccaacgcttcattgtaccagacatt

SEQ ID NO: 74959 - DNA, 25 bp, mus musculus
acgcttcattgtaccagacattgtc

SEQ ID NO: 74960 - DNA, 25 bp, mus musculus
cattgtaccagacattgtccagaag

SEQ ID NO: 74961 - DNA, 25 bp, mus musculus
tgtaccagacattgtccagaagttt

SEQ ID NO: 74962 - DNA, 25 bp, mus musculus
accagacattgtccagaagtttcaa

SEQ ID NO: 74963 - DNA, 25 bp, mus musculus
tgcaaaccctgaactgggctacggg

SEQ ID NO: 74964 - DNA, 25 bp, mus musculus
gacacaactatgtgtgcccattcag

SEQ ID NO: 74965 - DNA, 25 bp, mus musculus
acaactatgtgtgcccattcagatc

SEQ ID NO: 74966 - DNA, 25 bp, mus musculus
atgtgtgcccattcagatcaaagta

SEQ ID NO: 74967 - DNA, 25 bp, mus musculus
tgtgcccattcagatcaaagtactt

SEQ ID NO: 74968 - DNA, 25 bp, mus musculus
cacatgtatggcaacacctgatcta

SEQ ID NO: 74969 - DNA, 25 bp, mus musculus
tatggcaacacctgatctatcggtt

SEQ ID NO: 74970 - DNA, 25 bp, mus musculus
ggcaacacctgatctatcggttatc

SEQ ID NO: 74971 - DNA, 25 bp, mus musculus
aacacctgatctatcggttatccaa

SEQ ID NO: 74972 - DNA, 25 bp, mus musculus
tgatctatcggttatccaacgcttc

SEQ ID NO: 74973 - DNA, 25 bp, mus musculus
tctatcggttatccaacgcttcatt

SEQ ID NO: 74974 - DNA, 25 bp, mus musculus
atcggttatccaacgcttcattgta

SEQ ID NO: 74975 - DNA, 25 bp, mus musculus
tatccaacgcttcattgtaccagac

SEQ ID NO: 74976 - DNA, 25 bp, mus musculus
tctggctacaccgtcacaaggctca

SEQ ID NO: 74977 - DNA, 25 bp, mus musculus
tacaccgtcacaaggctcagcgcat

SEQ ID NO: 74978 - DNA, 25 bp, mus musculus
cttattgttgccctgcactgggatg

SEQ ID NO: 74979 - DNA, 25 bp, mus musculus
ctgcctcctgccaggctgtagtcac

SEQ ID NO: 74980 - DNA, 25 bp, mus musculus
cctgccaggctgtagtcactggctt

SEQ ID NO: 74981 - DNA, 25 bp, mus musculus
aggctgtagtcactggcttctcagt

SEQ ID NO: 74982 - DNA, 25 bp, mus musculus
tagtcactggcttctcagtggcttt

SEQ ID NO: 74983 - DNA, 25 bp, mus musculus
gcaatcctgccaacactgatttatc

SEQ ID NO: 74984 - DNA, 25 bp, mus musculus
ctgccaacactgatttatctcttaa

SEQ ID NO: 74985 - DNA, 25 bp, mus musculus
ctcttaactgtacttaattctcaca

SEQ ID NO: 74986 - DNA, 25 bp, mus musculus
actgtacttaattctcacaataaag

SEQ ID NO: 74987 - DNA, 25 bp, mus musculus
cttaattctcacaataaaggctgac

SEQ ID NO: 74988 - DNA, 25 bp, mus musculus
aggctcagcgcatatcaggtgacaa

SEQ ID NO: 74989 - DNA, 25 bp, mus musculus
acaccaggaaccaaatactacatat

SEQ ID NO: 74990 - DNA, 25 bp, mus musculus
tacatatcctaccgagtacagaagg

SEQ ID NO: 74991 - DNA, 25 bp, mus musculus
tcgaccgagtccagtccagagactc

SEQ ID NO: 74992 - DNA, 25 bp, mus musculus
gagtccagtccagagactcccatgt

SEQ ID NO: 74993 - DNA, 25 bp, mus musculus
agtccagagactcccatgtccacgc

SEQ ID NO: 74994 - DNA, 25 bp, mus musculus
ctgctgtctgtggccatgttcctgt

SEQ ID NO: 74995 - DNA, 25 bp, mus musculus
ttcctgttggtcgtgggtcttattg

SEQ ID NO: 74996 - DNA, 25 bp, mus musculus
agaacccaggtgtctccaagagaca

SEQ ID NO: 74997 - DNA, 25 bp, mus musculus
gcaggtctttgcaccaagatgaaca

SEQ ID NO: 74998 - DNA, 25 bp, mus musculus
gctgcaagagacaccctttgtatgt

SEQ ID NO: 74999 - DNA, 25 bp, mus musculus
agagacaccctttgtatgtggactt

SEQ ID NO: 75000 - DNA, 25 bp, mus musculus
atgactggatcgtggcacctccggg

SEQ ID NO: 75001 - DNA, 25 bp, mus musculus
ctccgggctatcatgccttttactg

SEQ ID NO: 75002 - DNA, 25 bp, mus musculus
ccatagtgcagactctggtgaactc

SEQ ID NO: 75003 - DNA, 25 bp, mus musculus
tgcagactctggtgaactctgtgaa

SEQ ID NO: 75004 - DNA, 25 bp, mus musculus
attccaaaatccctaaggcatgctg

SEQ ID NO: 75005 - DNA, 25 bp, mus musculus
aaatccctaaggcatgctgtgtccc

SEQ ID NO: 75006 - DNA, 25 bp, mus musculus
agctcagcgcaatctccatgttgta

SEQ ID NO: 75007 - DNA, 25 bp, mus musculus
gcgcaatctccatgttgtacctaga

SEQ ID NO: 75008 - DNA, 25 bp, mus musculus
atgaacacagctggtcacagataag

SEQ ID NO: 75009 - DNA, 25 bp, mus musculus
acagctggtcacagataaggccatt

SEQ ID NO: 75010 - DNA, 25 bp, mus musculus
ggccattgctagtgacttttggaca

SEQ ID NO: 75011 - DNA, 25 bp, mus musculus
cgctccacaaacgagaaaagcgtca

SEQ ID NO: 75012 - DNA, 25 bp, mus musculus
agcgtcaagccaaacacaaacagcg

SEQ ID NO: 75013 - DNA, 25 bp, mus musculus
aagccaaacacaaacagcggaagcg

SEQ ID NO: 75014 - DNA, 25 bp, mus musculus
aacacaaacagcggaagcgcctcaa

SEQ ID NO: 75015 - DNA, 25 bp, mus musculus
aacagcggaagcgcctcaagtccag

SEQ ID NO: 75016 - DNA, 25 bp, mus musculus
tcgccacgccaccagagtgtcatag

SEQ ID NO: 75017 - DNA, 25 bp, mus musculus
atgacagaaggactcccatgtatat

SEQ ID NO: 75018 - DNA, 25 bp, mus musculus
tgaactcaagtgtcccttttgaata

SEQ ID NO: 75019 - DNA, 25 bp, mus musculus
ttttatcaaatgctggtatgatgtg

SEQ ID NO: 75020 - DNA, 25 bp, mus musculus
actatatattctacaatgtgctcgt

SEQ ID NO: 75021 - DNA, 25 bp, mus musculus
tatatattctacaatgtgctcgttg

SEQ ID NO: 75022 - DNA, 25 bp, mus musculus
tattctacaatgtgctcgttgtgcc

SEQ ID NO: 75023 - DNA, 25 bp, mus musculus
ttctacaatgtgctcgttgtgcccc

SEQ ID NO: 75024 - DNA, 25 bp, mus musculus
ctacaatgtgctcgttgtgccccaa

SEQ ID NO: 75025 - DNA, 25 bp, mus musculus
acaatgtgctcgttgtgccccaaga

SEQ ID NO: 75026 - DNA, 25 bp, mus musculus
aatgtgctcgttgtgccccaagaag

SEQ ID NO: 75027 - DNA, 25 bp, mus musculus
tgctcgttgtgccccaagaagaacc

SEQ ID NO: 75028 - DNA, 25 bp, mus musculus
gaaggactcccatgtatatgatgta

SEQ ID NO: 75029 - DNA, 25 bp, mus musculus
gtgccccaagaagaacccagacctg

SEQ ID NO: 75030 - DNA, 25 bp, mus musculus
aggactcccatgtatatgatgtaag

SEQ ID NO: 75031 - DNA, 25 bp, mus musculus
gactcccatgtatatgatgtaagcc

SEQ ID NO: 75032 - DNA, 25 bp, mus musculus
atgtaagccagagcgagtgaggtat

SEQ ID NO: 75033 - DNA, 25 bp, mus musculus
gtaagccagagcgagtgaggtatac

SEQ ID NO: 75034 - DNA, 25 bp, mus musculus
ggtatacctgaactcaagtgtccct

SEQ ID NO: 75035 - DNA, 25 bp, mus musculus
tatacctgaactcaagtgtcccttt

SEQ ID NO: 75036 - DNA, 25 bp, mus musculus
tacctgaactcaagtgtcccttttg

SEQ ID NO: 75037 - DNA, 25 bp, mus musculus
ccagaaacatcatactcctgcttga

SEQ ID NO: 75038 - DNA, 25 bp, mus musculus
acatcatactcctgcttgaagatac

SEQ ID NO: 75039 - DNA, 25 bp, mus musculus
cagtaatcaccaactgcatccagta

SEQ ID NO: 75040 - DNA, 25 bp, mus musculus
gtaatcaccaactgcatccagtaag

SEQ ID NO: 75041 - DNA, 25 bp, mus musculus
aatcaccaactgcatccagtaagag

SEQ ID NO: 75042 - DNA, 25 bp, mus musculus
tcaccaactgcatccagtaagagat

SEQ ID NO: 75043 - DNA, 25 bp, mus musculus
accaactgcatccagtaagagatgc

SEQ ID NO: 75044 - DNA, 25 bp, mus musculus
caactgcatccagtaagagatgcat

SEQ ID NO: 75045 - DNA, 25 bp, mus musculus
actgcatccagtaagagatgcatga

SEQ ID NO: 75046 - DNA, 25 bp, mus musculus
gaggacacccagaaagaccagtgaa

SEQ ID NO: 75047 - DNA, 25 bp, mus musculus
ggacacccagaaagaccagtgaagg

SEQ ID NO: 75048 - DNA, 25 bp, mus musculus
acacccagaaagaccagtgaaggca

SEQ ID NO: 75049 - DNA, 25 bp, mus musculus
atcatactcctgcttgaagatacac

SEQ ID NO: 75050 - DNA, 25 bp, mus musculus
catactcctgcttgaagatacacat

SEQ ID NO: 75051 - DNA, 25 bp, mus musculus
tactcctgcttgaagatacacatca

SEQ ID NO: 75052 - DNA, 25 bp, mus musculus
acaatacacacagagatcaatgagc

SEQ ID NO: 75053 - DNA, 25 bp, mus musculus
aatacacacagagatcaatgagcat

SEQ ID NO: 75054 - DNA, 25 bp, mus musculus
tacacacagagatcaatgagcatca

SEQ ID NO: 75055 - DNA, 25 bp, mus musculus
tgatctacatgatacataggagcaa

SEQ ID NO: 75056 - DNA, 25 bp, mus musculus
agcagtaatcaccaactgcatccag

SEQ ID NO: 75057 - DNA, 25 bp, mus musculus
caccaaaatacacaaaatctattct

SEQ ID NO: 75058 - DNA, 25 bp, mus musculus
ggatgttgttcactgctggtataca

SEQ ID NO: 75059 - DNA, 25 bp, mus musculus
acactcccagatgggactgtttttg

SEQ ID NO: 75060 - DNA, 25 bp, mus musculus
actcccagatgggactgtttttgat

SEQ ID NO: 75061 - DNA, 25 bp, mus musculus
ctcccagatgggactgtttttgata

SEQ ID NO: 75062 - DNA, 25 bp, mus musculus
atgaagcgctcttgactatgagtaa

SEQ ID NO: 75063 - DNA, 25 bp, mus musculus
tgaagcgctcttgactatgagtaaa

SEQ ID NO: 75064 - DNA, 25 bp, mus musculus
aagcgctcttgactatgagtaaagg

SEQ ID NO: 75065 - DNA, 25 bp, mus musculus
agcgctcttgactatgagtaaagga

SEQ ID NO: 75066 - DNA, 25 bp, mus musculus
aaaggctcgactggagatcgaacca

SEQ ID NO: 75067 - DNA, 25 bp, mus musculus
aaggctcgactggagatcgaaccag

SEQ ID NO: 75068 - DNA, 25 bp, mus musculus
aggctcgactggagatcgaaccaga

SEQ ID NO: 75069 - DNA, 25 bp, mus musculus
atgttgttcactgctggtatacagg

SEQ ID NO: 75070 - DNA, 25 bp, mus musculus
tgttgttcactgctggtatacaggg

SEQ ID NO: 75071 - DNA, 25 bp, mus musculus
gttgttcactgctggtatacaggga

SEQ ID NO: 75072 - DNA, 25 bp, mus musculus
tgttcactgctggtatacagggaca

SEQ ID NO: 75073 - DNA, 25 bp, mus musculus
gttcactgctggtatacagggacac

SEQ ID NO: 75074 - DNA, 25 bp, mus musculus
ttcactgctggtatacagggacact

SEQ ID NO: 75075 - DNA, 25 bp, mus musculus
ggacactcccagatgggactgtttt

SEQ ID NO: 75076 - DNA, 25 bp, mus musculus
gacactcccagatgggactgttttt

SEQ ID NO: 75077 - DNA, 25 bp, mus musculus
atgtgcaccattccaggaacatgac

SEQ ID NO: 75078 - DNA, 25 bp, mus musculus
accattccaggaacatgactgttaa

SEQ ID NO: 75079 - DNA, 25 bp, mus musculus
attgtactgtatgtggctttttgaa

SEQ ID NO: 75080 - DNA, 25 bp, mus musculus
ctgtatgtggctttttgaagtcttc

SEQ ID NO: 75081 - DNA, 25 bp, mus musculus
ttttgaagtcttcccttgactctag

SEQ ID NO: 75082 - DNA, 25 bp, mus musculus
tgttaatccagaaacattcatgtga

SEQ ID NO: 75083 - DNA, 25 bp, mus musculus
atgtaagccaggccagcttgaaggc

SEQ ID NO: 75084 - DNA, 25 bp, mus musculus
tgaaggccaatgctctttagtcacc

SEQ ID NO: 75085 - DNA, 25 bp, mus musculus
ccaatgctctttagtcaccaagatc

SEQ ID NO: 75086 - DNA, 25 bp, mus musculus
ctctttagtcaccaagatctttgaa

SEQ ID NO: 75087 - DNA, 25 bp, mus musculus
agtcaccaagatctttgaaatgcat

SEQ ID NO: 75088 - DNA, 25 bp, mus musculus
tctttacactcttgcacaaaaatcg

SEQ ID NO: 75089 - DNA, 25 bp, mus musculus
tgagcagcatttcaccaaaaccttg

SEQ ID NO: 75090 - DNA, 25 bp, mus musculus
gcatttcaccaaaaccttgtgacag

SEQ ID NO: 75091 - DNA, 25 bp, mus musculus
caccaaaaccttgtgacagtctctt

SEQ ID NO: 75092 - DNA, 25 bp, mus musculus
gtgacagtctcttggtacatagggc

SEQ ID NO: 75093 - DNA, 25 bp, mus musculus
gtctcttggtacatagggcatagaa

SEQ ID NO: 75094 - DNA, 25 bp, mus musculus
accgaacctgggaaacatgagcaca

SEQ ID NO: 75095 - DNA, 25 bp, mus musculus
tgttacttgcactaacatttgcagg

SEQ ID NO: 75096 - DNA, 25 bp, mus musculus
ttgcactaacatttgcaggatgtcc

SEQ ID NO: 75097 - DNA, 25 bp, mus musculus
accagatacagaacgcacagtattt

SEQ ID NO: 75098 - DNA, 25 bp, mus musculus
cagatacagaacgcacagtatttgc

SEQ ID NO: 75099 - DNA, 25 bp, mus musculus
tctgcttcataggtgttctgcattt

SEQ ID NO: 75100 - DNA, 25 bp, mus musculus
tgcttcataggtgttctgcatttga

SEQ ID NO: 75101 - DNA, 25 bp, mus musculus
cttcataggtgttctgcatttgagg

SEQ ID NO: 75102 - DNA, 25 bp, mus musculus
aggtgttctgcatttgaggtgtagt

SEQ ID NO: 75103 - DNA, 25 bp, mus musculus
gtgttctgcatttgaggtgtagtga

SEQ ID NO: 75104 - DNA, 25 bp, mus musculus
tgaaatctttgctgttcaccagatg

SEQ ID NO: 75105 - DNA, 25 bp, mus musculus
atctttgctgttcaccagatgtaat

SEQ ID NO: 75106 - DNA, 25 bp, mus musculus
ctttgctgttcaccagatgtaatgt

SEQ ID NO: 75107 - DNA, 25 bp, mus musculus
ttgctgttcaccagatgtaatgttt

SEQ ID NO: 75108 - DNA, 25 bp, mus musculus
gctgttcaccagatgtaatgtttta

SEQ ID NO: 75109 - DNA, 25 bp, mus musculus
gatacagaacgcacagtatttgctg

SEQ ID NO: 75110 - DNA, 25 bp, mus musculus
gaacgcacagtatttgctgcagaac

SEQ ID NO: 75111 - DNA, 25 bp, mus musculus
agtatttgctgcagaacagtgtgaa

SEQ ID NO: 75112 - DNA, 25 bp, mus musculus
tatttgctgcagaacagtgtgaagc

SEQ ID NO: 75113 - DNA, 25 bp, mus musculus
ttatctgcttctgtttaaaaagcca

SEQ ID NO: 75114 - DNA, 25 bp, mus musculus
ttaaaaagccaacattcctctgctt

SEQ ID NO: 75115 - DNA, 25 bp, mus musculus
ccaacattcctctgcttcataggtg

SEQ ID NO: 75116 - DNA, 25 bp, mus musculus
cctctgcttcataggtgttctgcat

SEQ ID NO: 75117 - DNA, 25 bp, mus musculus
taaggcttccaagcctaaagcttct

SEQ ID NO: 75118 - DNA, 25 bp, mus musculus
ggcttccaagcctaaagcttctaag

SEQ ID NO: 75119 - DNA, 25 bp, mus musculus
gactctggctatgtgttccgaagca

SEQ ID NO: 75120 - DNA, 25 bp, mus musculus
tatgtgttccgaagcagatcaattc

SEQ ID NO: 75121 - DNA, 25 bp, mus musculus
ctgtgcactttgttatgggtacatt

SEQ ID NO: 75122 - DNA, 25 bp, mus musculus
gcatctataaactctagttgagcga

SEQ ID NO: 75123 - DNA, 25 bp, mus musculus
tgtatcattttcagctctagctgga

SEQ ID NO: 75124 - DNA, 25 bp, mus musculus
atcattttcagctctagctggactt

SEQ ID NO: 75125 - DNA, 25 bp, mus musculus
attttcagctctagctggacttctg

SEQ ID NO: 75126 - DNA, 25 bp, mus musculus
agctctagctggacttctggccggc

SEQ ID NO: 75127 - DNA, 25 bp, mus musculus
tctagctggacttctggccggcagt

SEQ ID NO: 75128 - DNA, 25 bp, mus musculus
agctggacttctggccggcagtttt

SEQ ID NO: 75129 - DNA, 25 bp, mus musculus
ttctaagccgaaggccaccaaggca

SEQ ID NO: 75130 - DNA, 25 bp, mus musculus
tggtgcgtcctgctttgaaaatctc

SEQ ID NO: 75131 - DNA, 25 bp, mus musculus
acccacaacctcattcaaaagagct

SEQ ID NO: 75132 - DNA, 25 bp, mus musculus
cacaacctcattcaaaagagctgag

SEQ ID NO: 75133 - DNA, 25 bp, mus musculus
ttctggttttctcatggtatgtccg

SEQ ID NO: 75134 - DNA, 25 bp, mus musculus
catggtatgtccgctgactctggct

SEQ ID NO: 75135 - DNA, 25 bp, mus musculus
ggtatgtccgctgactctggctatg

SEQ ID NO: 75136 - DNA, 25 bp, mus musculus
atgtccgctgactctggctatgtgt

SEQ ID NO: 75137 - DNA, 25 bp, mus musculus
accaccttctcctagatatgaagaa

SEQ ID NO: 75138 - DNA, 25 bp, mus musculus
accttctcctagatatgaagaactc

SEQ ID NO: 75139 - DNA, 25 bp, mus musculus
actttgtatgccagactagcctcaa

SEQ ID NO: 75140 - DNA, 25 bp, mus musculus
ttgtatgccagactagcctcaaacc

SEQ ID NO: 75141 - DNA, 25 bp, mus musculus
tgtgtgccaccactacctggcaata

SEQ ID NO: 75142 - DNA, 25 bp, mus musculus
gtgccaccactacctggcaatatgt

SEQ ID NO: 75143 - DNA, 25 bp, mus musculus
ccaccactacctggcaatatgtaat

SEQ ID NO: 75144 - DNA, 25 bp, mus musculus
atgtaatctaaccagggcttacaga

SEQ ID NO: 75145 - DNA, 25 bp, mus musculus
tctaaccagggcttacagaatagat

SEQ ID NO: 75146 - DNA, 25 bp, mus musculus
gatctgaattgtgctcccattagaa

SEQ ID NO: 75147 - DNA, 25 bp, mus musculus
ctgaattgtgctcccattagaacca

SEQ ID NO: 75148 - DNA, 25 bp, mus musculus
tgtgctcccattagaaccaaactaa

SEQ ID NO: 75149 - DNA, 25 bp, mus musculus
actcagtaggcaggcactctcaaga

SEQ ID NO: 75150 - DNA, 25 bp, mus musculus
ggcactctcaagaacaaccatacag

SEQ ID NO: 75151 - DNA, 25 bp, mus musculus
actctcaagaacaaccatacagttt

SEQ ID NO: 75152 - DNA, 25 bp, mus musculus
atactatataacaatcttttgttat

SEQ ID NO: 75153 - DNA, 25 bp, mus musculus
ttttcaagacacagcttctttgtat

SEQ ID NO: 75154 - DNA, 25 bp, mus musculus
acagtcctggcggtcctagaattca

SEQ ID NO: 75155 - DNA, 25 bp, mus musculus
gtcctagaattcactttgtatgcca

SEQ ID NO: 75156 - DNA, 25 bp, mus musculus
ttcactttgtatgccagactagcct

SEQ ID NO: 75157 - DNA, 25 bp, mus musculus
gtctgctgtgtgaggactgccgcca

SEQ ID NO: 75158 - DNA, 25 bp, mus musculus
tggtaagaccatcaccctggaggtc

SEQ ID NO: 75159 - DNA, 25 bp, mus musculus
tgcaggcaagcagctggaagatggc

SEQ ID NO: 75160 - DNA, 25 bp, mus musculus
caccctgtcagactacaacatccag

SEQ ID NO: 75161 - DNA, 25 bp, mus musculus
gtcagactacaacatccagaaagag

SEQ ID NO: 75162 - DNA, 25 bp, mus musculus
agactacaacatccagaaagagtcc

SEQ ID NO: 75163 - DNA, 25 bp, mus musculus
ctacaacatccagaaagagtccagc

SEQ ID NO: 75164 - DNA, 25 bp, mus musculus
gaaagagtccagcctgcacctggtc

SEQ ID NO: 75165 - DNA, 25 bp, mus musculus
gtccagcctgcacctggtccttcgc

SEQ ID NO: 75166 - DNA, 25 bp, mus musculus
cctgcacctggtccttcgcctcaga

SEQ ID NO: 75167 - DNA, 25 bp, mus musculus
ccttcgcctcagaggtggcatgcag

SEQ ID NO: 75168 - DNA, 25 bp, mus musculus
cctcagaggtggcatgcagatcttt

SEQ ID NO: 75169 - DNA, 25 bp, mus musculus
taagaccatcaccctggaggtcgag

SEQ ID NO: 75170 - DNA, 25 bp, mus musculus
ggtcgagcccagtgacaccatagag

SEQ ID NO: 75171 - DNA, 25 bp, mus musculus
cgagcccagtgacaccatagagaat

SEQ ID NO: 75172 - DNA, 25 bp, mus musculus
gcccagtgacaccatagagaatgtc

SEQ ID NO: 75173 - DNA, 25 bp, mus musculus
cccccctgaccagcagaggctgatc

SEQ ID NO: 75174 - DNA, 25 bp, mus musculus
ccctgaccagcagaggctgatcttt

SEQ ID NO: 75175 - DNA, 25 bp, mus musculus
tgaccagcagaggctgatctttgca

SEQ ID NO: 75176 - DNA, 25 bp, mus musculus
ctttgcaggcaagcagctggaagat

SEQ ID NO: 75177 - DNA, 25 bp, mus musculus
agttccgtctgctgtgtgaggactg

SEQ ID NO: 75178 - DNA, 25 bp, mus musculus
gttccgtctgctgtgtgaggactgc

SEQ ID NO: 75179 - DNA, 25 bp, mus musculus
ttccgtctgctgtgtgaggactgcc

SEQ ID NO: 75180 - DNA, 25 bp, mus musculus
gtctgctgtgtgaggactgccgcca

SEQ ID NO: 75181 - DNA, 25 bp, mus musculus
agttccgtctgctgtgtgaggactg

SEQ ID NO: 75182 - DNA, 25 bp, mus musculus
gttccgtctgctgtgtgaggactgc

SEQ ID NO: 75183 - DNA, 25 bp, mus musculus
ttccgtctgctgtgtgaggactgcc

SEQ ID NO: 75184 - DNA, 25 bp, mus musculus
gtctgctgtgtgaggactgccgcca

SEQ ID NO: 75185 - DNA, 25 bp, mus musculus
ctgctgtgtgaggactgccgccacc

SEQ ID NO: 75186 - DNA, 25 bp, mus musculus
gccaccaccgctgacgatgcagatc

SEQ ID NO: 75187 - DNA, 25 bp, mus musculus
ccaccaccgctgacgatgcagatct

SEQ ID NO: 75188 - DNA, 25 bp, mus musculus
acagtcaacttcatgggcaaagatt

SEQ ID NO: 75189 - DNA, 25 bp, mus musculus
ctctatatctggtcgtatcctggat

SEQ ID NO: 75190 - DNA, 25 bp, mus musculus
aatcacagcaaagtccatcttgact

SEQ ID NO: 75191 - DNA, 25 bp, mus musculus
ccaatgataatcaaccctaggtgtt

SEQ ID NO: 75192 - DNA, 25 bp, mus musculus
aggtgttttctcagttgtggagaag

SEQ ID NO: 75193 - DNA, 25 bp, mus musculus
tgatcacatttatgcccctgtatcc

SEQ ID NO: 75194 - DNA, 25 bp, mus musculus
catttatgcccctgtatccaactgt

SEQ ID NO: 75195 - DNA, 25 bp, mus musculus
tgcccctgtatccaactgtgcctga

SEQ ID NO: 75196 - DNA, 25 bp, mus musculus
caactgtgcctgaagctaatagtac

SEQ ID NO: 75197 - DNA, 25 bp, mus musculus
atagtacatcacctggacttttcag

SEQ ID NO: 75198 - DNA, 25 bp, mus musculus
catcacctggacttttcagttatgt

SEQ ID NO: 75199 - DNA, 25 bp, mus musculus
ctggacttttcagttatgtgaacca

SEQ ID NO: 75200 - DNA, 25 bp, mus musculus
tcgtatcctggatgctagtttttta

SEQ ID NO: 75201 - DNA, 25 bp, mus musculus
attgcccagtgaccatttccatctc

SEQ ID NO: 75202 - DNA, 25 bp, mus musculus
cagtgaccatttccatctcacgctt

SEQ ID NO: 75203 - DNA, 25 bp, mus musculus
ccatttccatctcacgcttaacttc

SEQ ID NO: 75204 - DNA, 25 bp, mus musculus
catctcttccaattttcagtcctgg

SEQ ID NO: 75205 - DNA, 25 bp, mus musculus
ttccaattttcagtcctggtgattt

SEQ ID NO: 75206 - DNA, 25 bp, mus musculus
ttttcagtcctggtgatttagacag

SEQ ID NO: 75207 - DNA, 25 bp, mus musculus
tagacagtcttttcatgctggacat

SEQ ID NO: 75208 - DNA, 25 bp, mus musculus
cggatcaagcagccagggaggcacc

SEQ ID NO: 75209 - DNA, 25 bp, mus musculus
ggatcaagcagccagggaggcacca

SEQ ID NO: 75210 - DNA, 25 bp, mus musculus
tccacgctcttaatagaggattcgt

SEQ ID NO: 75211 - DNA, 25 bp, mus musculus
gtatactcccagctacttccactac

SEQ ID NO: 75212 - DNA, 25 bp, mus musculus
tcccagctacttccactacacagag

SEQ ID NO: 75213 - DNA, 25 bp, mus musculus
cccagctacttccactacacagaga

SEQ ID NO: 75214 - DNA, 25 bp, mus musculus
cagctacttccactacacagagact

SEQ ID NO: 75215 - DNA, 25 bp, mus musculus
agctacttccactacacagagactg

SEQ ID NO: 75216 - DNA, 25 bp, mus musculus
ctacttccactacacagagactgac

SEQ ID NO: 75217 - DNA, 25 bp, mus musculus
cttccactacacagagactgacaaa

SEQ ID NO: 75218 - DNA, 25 bp, mus musculus
ccttctgagactgggagccgtatac

SEQ ID NO: 75219 - DNA, 25 bp, mus musculus
cttctgagactgggagccgtatacg

SEQ ID NO: 75220 - DNA, 25 bp, mus musculus
tcaagcagccagggaggcaccatga

SEQ ID NO: 75221 - DNA, 25 bp, mus musculus
agactgggagccgtatacgatgagg

SEQ ID NO: 75222 - DNA, 25 bp, mus musculus
agcagccagggaggcaccatgagag

SEQ ID NO: 75223 - DNA, 25 bp, mus musculus
agcgcagaaacgtccacgctcttaa

SEQ ID NO: 75224 - DNA, 25 bp, mus musculus
cgcagaaacgtccacgctcttaata

SEQ ID NO: 75225 - DNA, 25 bp, mus musculus
gcagaaacgtccacgctcttaatag

SEQ ID NO: 75226 - DNA, 25 bp, mus musculus
gaaacgtccacgctcttaatagagg

SEQ ID NO: 75227 - DNA, 25 bp, mus musculus
aacgtccacgctcttaatagaggat

SEQ ID NO: 75228 - DNA, 25 bp, mus musculus
gtccacgctcttaatagaggattcg

SEQ ID NO: 75229 - DNA, 25 bp, mus musculus
ttggccatgggagctgatgttgatc

SEQ ID NO: 75230 - DNA, 25 bp, mus musculus
ctaattcgatgactgcactgattgt

SEQ ID NO: 75231 - DNA, 25 bp, mus musculus
ggacggaaacacagccctgatgatt

SEQ ID NO: 75232 - DNA, 25 bp, mus musculus
acggaaacacagccctgatgattgc

SEQ ID NO: 75233 - DNA, 25 bp, mus musculus
ggaaacacagccctgatgattgcgt

SEQ ID NO: 75234 - DNA, 25 bp, mus musculus
acagccctgatgattgcgtcgaagg

SEQ ID NO: 75235 - DNA, 25 bp, mus musculus
agccctgatgattgcgtcgaaggaa

SEQ ID NO: 75236 - DNA, 25 bp, mus musculus
ccctgatgattgcgtcgaaggaagg

SEQ ID NO: 75237 - DNA, 25 bp, mus musculus
ctgatgattgcgtcgaaggaaggac

SEQ ID NO: 75238 - DNA, 25 bp, mus musculus
tgattgcgtcgaaggaaggacatat

SEQ ID NO: 75239 - DNA, 25 bp, mus musculus
tgttggacgccggaacatatgtgaa

SEQ ID NO: 75240 - DNA, 25 bp, mus musculus
atgtgaacatacctgacaggagtgg

SEQ ID NO: 75241 - DNA, 25 bp, mus musculus
aattcgatgactgcactgattgtgg

SEQ ID NO: 75242 - DNA, 25 bp, mus musculus
ttcgatgactgcactgattgtggca

SEQ ID NO: 75243 - DNA, 25 bp, mus musculus
cgatgactgcactgattgtggcagt

SEQ ID NO: 75244 - DNA, 25 bp, mus musculus
ggggctacacacagtcagtaaagga

SEQ ID NO: 75245 - DNA, 25 bp, mus musculus
ctacacacagtcagtaaaggagatt

SEQ ID NO: 75246 - DNA, 25 bp, mus musculus
aatccaaacgtgaacctgactgata

SEQ ID NO: 75247 - DNA, 25 bp, mus musculus
tccaaacgtgaacctgactgataag

SEQ ID NO: 75248 - DNA, 25 bp, mus musculus
cgtgaacctgactgataaggacgga

SEQ ID NO: 75249 - DNA, 25 bp, mus musculus
gatgacctctcggtacaacagaagt

SEQ ID NO: 75250 - DNA, 25 bp, mus musculus
gtacaacagaagtctacccaacaga

SEQ ID NO: 75251 - DNA, 25 bp, mus musculus
ctcgcctcaccagagtcaagtctat

SEQ ID NO: 75252 - DNA, 25 bp, mus musculus
tcaccagagtcaagtctatgatacc

SEQ ID NO: 75253 - DNA, 25 bp, mus musculus
agtctatgataccttcaagatgcag

SEQ ID NO: 75254 - DNA, 25 bp, mus musculus
gactgcaatgtcacccagatcgttg

SEQ ID NO: 75255 - DNA, 25 bp, mus musculus
aatgtcacccagatcgttggttcat

SEQ ID NO: 75256 - DNA, 25 bp, mus musculus
ggttcatggacaaccctctactcac

SEQ ID NO: 75257 - DNA, 25 bp, mus musculus
tgtaggacttctggccctggagctt

SEQ ID NO: 75258 - DNA, 25 bp, mus musculus
acttctggccctggagcttcctcaa

SEQ ID NO: 75259 - DNA, 25 bp, mus musculus
ggagcttcctcaaacacttgctttc

SEQ ID NO: 75260 - DNA, 25 bp, mus musculus
tcctcaaacacttgctttccaataa

SEQ ID NO: 75261 - DNA, 25 bp, mus musculus
cagaagtctacccaacagatgaaaa

SEQ ID NO: 75262 - DNA, 25 bp, mus musculus
caattcggacaacagcggcaatatg

SEQ ID NO: 75263 - DNA, 25 bp, mus musculus
gagcgctcacaatcctataaaggat

SEQ ID NO: 75264 - DNA, 25 bp, mus musculus
tcacaatcctataaaggatatcttg

SEQ ID NO: 75265 - DNA, 25 bp, mus musculus
ggagcagacctctatcaagctcagc

SEQ ID NO: 75266 - DNA, 25 bp, mus musculus
gacctctatcaagctcagcttaagg

SEQ ID NO: 75267 - DNA, 25 bp, mus musculus
catattcactgaccaactaaagacc

SEQ ID NO: 75268 - DNA, 25 bp, mus musculus
ccaactaaagaccaagatcaatatc

SEQ ID NO: 75269 - DNA, 25 bp, mus musculus
cgtgacagcggtcaagttgagcaca

SEQ ID NO: 75270 - DNA, 25 bp, mus musculus
acagtggtagccactgtaggccaag

SEQ ID NO: 75271 - DNA, 25 bp, mus musculus
ggcttacactgacatcaaagtgatt

SEQ ID NO: 75272 - DNA, 25 bp, mus musculus
cttacactgacatcaaagtgattgg

SEQ ID NO: 75273 - DNA, 25 bp, mus musculus
tacactgacatcaaagtgattggta

SEQ ID NO: 75274 - DNA, 25 bp, mus musculus
attggtaatggctcattcggagtag

SEQ ID NO: 75275 - DNA, 25 bp, mus musculus
tggtaatggctcattcggagtagta

SEQ ID NO: 75276 - DNA, 25 bp, mus musculus
aatggctcattcggagtagtaatcc

SEQ ID NO: 75277 - DNA, 25 bp, mus musculus
tggctcattcggagtagtaatccag

SEQ ID NO: 75278 - DNA, 25 bp, mus musculus
agtagtaatccaggcacggctggat

SEQ ID NO: 75279 - DNA, 25 bp, mus musculus
tagtaatccaggcacggctggatga

SEQ ID NO: 75280 - DNA, 25 bp, mus musculus
actggtggccatcaagaaggttctt

SEQ ID NO: 75281 - DNA, 25 bp, mus musculus
tggtagccactgtaggccaaggcca

SEQ ID NO: 75282 - DNA, 25 bp, mus musculus
gtagccactgtaggccaaggccaga

SEQ ID NO: 75283 - DNA, 25 bp, mus musculus
agccactgtaggccaaggccagagc

SEQ ID NO: 75284 - DNA, 25 bp, mus musculus
ccactgtaggccaaggccagagcgt

SEQ ID NO: 75285 - DNA, 25 bp, mus musculus
ccaaggccagagcgttcccaagaag

SEQ ID NO: 75286 - DNA, 25 bp, mus musculus
ggccagagcgttcccaagaagtggc

SEQ ID NO: 75287 - DNA, 25 bp, mus musculus
ccagagcgttcccaagaagtggctt

SEQ ID NO: 75288 - DNA, 25 bp, mus musculus
gtggcttacactgacatcaaagtga

SEQ ID NO: 75289 - DNA, 25 bp, mus musculus
tacatctttgattgggctctggttg

SEQ ID NO: 75290 - DNA, 25 bp, mus musculus
gattgggctctggttgaataaacct

SEQ ID NO: 75291 - DNA, 25 bp, mus musculus
tcaactatcaatcagcctgatgatg

SEQ ID NO: 75292 - DNA, 25 bp, mus musculus
actatcaatcagcctgatgatggca

SEQ ID NO: 75293 - DNA, 25 bp, mus musculus
atcaatcagcctgatgatggcaaat

SEQ ID NO: 75294 - DNA, 25 bp, mus musculus
ttccatatttctgcgcataaggctt

SEQ ID NO: 75295 - DNA, 25 bp, mus musculus
tctgcgcataaggcttccaaaacaa

SEQ ID NO: 75296 - DNA, 25 bp, mus musculus
gatgttattcaaaccctggggcaca

SEQ ID NO: 75297 - DNA, 25 bp, mus musculus
caaaccctggggcacaatctgtggt

SEQ ID NO: 75298 - DNA, 25 bp, mus musculus
ttctaatcgccacctagtggctata

SEQ ID NO: 75299 - DNA, 25 bp, mus musculus
taatcgccacctagtggctatacaa

SEQ ID NO: 75300 - DNA, 25 bp, mus musculus
tcgccacctagtggctatacaaata

SEQ ID NO: 75301 - DNA, 25 bp, mus musculus
taaacctagggcatagcatattaat

SEQ ID NO: 75302 - DNA, 25 bp, mus musculus
caaataaatgcatcacattgcaaag

SEQ ID NO: 75303 - DNA, 25 bp, mus musculus
gtgtcatccctggattcctttattt

SEQ ID NO: 75304 - DNA, 25 bp, mus musculus
tcatccctggattcctttatttaca

SEQ ID NO: 75305 - DNA, 25 bp, mus musculus
gaagattttccccagagaatgacaa

SEQ ID NO: 75306 - DNA, 25 bp, mus musculus
tttccccagagaatgacaagtggtt

SEQ ID NO: 75307 - DNA, 25 bp, mus musculus
tttgacaacacactctaggccttct

SEQ ID NO: 75308 - DNA, 25 bp, mus musculus
gacaacacactctaggccttctatt

SEQ ID NO: 75309 - DNA, 25 bp, mus musculus
taggccttctattaaaagcaattct

SEQ ID NO: 75310 - DNA, 25 bp, mus musculus
aagctcgtactgatgggcaaagaca

SEQ ID NO: 75311 - DNA, 25 bp, mus musculus
agctcgtactgatgggcaaagacag

SEQ ID NO: 75312 - DNA, 25 bp, mus musculus
cagagagacccatcaagttcaacgt

SEQ ID NO: 75313 - DNA, 25 bp, mus musculus
atgtttgatgtgacctcaagagttg

SEQ ID NO: 75314 - DNA, 25 bp, mus musculus
atgtgacctcaagagttgcttacta

SEQ ID NO: 75315 - DNA, 25 bp, mus musculus
gtgacctcaagagttgcttactagg

SEQ ID NO: 75316 - DNA, 25 bp, mus musculus
tgacctcaagagttgcttactagga

SEQ ID NO: 75317 - DNA, 25 bp, mus musculus
acctcaagagttgcttactaggatg

SEQ ID NO: 75318 - DNA, 25 bp, mus musculus
ttgcttactaggatgtgcctagctg

SEQ ID NO: 75319 - DNA, 25 bp, mus musculus
tactaggatgtgcctagctggcgta

SEQ ID NO: 75320 - DNA, 25 bp, mus musculus
actaggatgtgcctagctggcgtag

SEQ ID NO: 75321 - DNA, 25 bp, mus musculus
taggatgtgcctagctggcgtagag

SEQ ID NO: 75322 - DNA, 25 bp, mus musculus
gtgcaccgctcgtcttccataccaa

SEQ ID NO: 75323 - DNA, 25 bp, mus musculus
tcttccataccaacagagagaccca

SEQ ID NO: 75324 - DNA, 25 bp, mus musculus
cttccataccaacagagagacccat

SEQ ID NO: 75325 - DNA, 25 bp, mus musculus
tccataccaacagagagacccatca

SEQ ID NO: 75326 - DNA, 25 bp, mus musculus
ccataccaacagagagacccatcaa

SEQ ID NO: 75327 - DNA, 25 bp, mus musculus
ataccaacagagagacccatcaagt

SEQ ID NO: 75328 - DNA, 25 bp, mus musculus
taccaacagagagacccatcaagtt

SEQ ID NO: 75329 - DNA, 25 bp, mus musculus
ccaacagagagacccatcaagttca

SEQ ID NO: 75330 - DNA, 25 bp, mus musculus
tgatgcattgcgtcaagggcattgg

SEQ ID NO: 75331 - DNA, 25 bp, mus musculus
attgcgtcaagggcattggcaaaga

SEQ ID NO: 75332 - DNA, 25 bp, mus musculus
gggaaatcttccggcatgagaaact

SEQ ID NO: 75333 - DNA, 25 bp, mus musculus
gtgaagccatcaagatcctgatggg

SEQ ID NO: 75334 - DNA, 25 bp, mus musculus
ccatcaagatcctgatggggaagtg

SEQ ID NO: 75335 - DNA, 25 bp, mus musculus
cttggatcttttgcactgctgtgct

SEQ ID NO: 75336 - DNA, 25 bp, mus musculus
tcttttgcactgctgtgctgttact

SEQ ID NO: 75337 - DNA, 25 bp, mus musculus
tagaggtccctttccagtctcattt

SEQ ID NO: 75338 - DNA, 25 bp, mus musculus
tccagtctcatttccagtcaataca

SEQ ID NO: 75339 - DNA, 25 bp, mus musculus
ctcatttccagtcaatacattttat

SEQ ID NO: 75340 - DNA, 25 bp, mus musculus
ttaaatgtgccacagacacctttgc

SEQ ID NO: 75341 - DNA, 25 bp, mus musculus
gtgccacagacacctttgcctttgt

SEQ ID NO: 75342 - DNA, 25 bp, mus musculus
gcaaagaccatgccaagttctcacc

SEQ ID NO: 75343 - DNA, 25 bp, mus musculus
accatgccaagttctcaccagtggc

SEQ ID NO: 75344 - DNA, 25 bp, mus musculus
ccaagttctcaccagtggccacagc

SEQ ID NO: 75345 - DNA, 25 bp, mus musculus
acagactgctaccggccatcactct

SEQ ID NO: 75346 - DNA, 25 bp, mus musculus
tgctaccggccatcactctgcttga

SEQ ID NO: 75347 - DNA, 25 bp, mus musculus
agtgtttctcccctggcgtgattga

SEQ ID NO: 75348 - DNA, 25 bp, mus musculus
tggccaatgctcggctggatacctt

SEQ ID NO: 75349 - DNA, 25 bp, mus musculus
ataccttcagcagggaaatcttccg

SEQ ID NO: 75350 - DNA, 25 bp, mus musculus
taaacctaaatcccaacctgcagag

SEQ ID NO: 75351 - DNA, 25 bp, mus musculus
taaatcccaacctgcagagacacca

SEQ ID NO: 75352 - DNA, 25 bp, mus musculus
tacagtccaaccaggaccagatcct

SEQ ID NO: 75353 - DNA, 25 bp, mus musculus
ccaaccaggaccagatcctcaataa

SEQ ID NO: 75354 - DNA, 25 bp, mus musculus
aggaccagatcctcaataacctaag

SEQ ID NO: 75355 - DNA, 25 bp, mus musculus
tcaataacctaagcaagaggaagtg

SEQ ID NO: 75356 - DNA, 25 bp, mus musculus
cccaacctaggacagctgcctgatg

SEQ ID NO: 75357 - DNA, 25 bp, mus musculus
cagctgcctgatgtcctagccagat

SEQ ID NO: 75358 - DNA, 25 bp, mus musculus
cctgatgtcctagccagattacagc

SEQ ID NO: 75359 - DNA, 25 bp, mus musculus
ttacagcctcagagctcatccaaat

SEQ ID NO: 75360 - DNA, 25 bp, mus musculus
cctcagagctcatccaaataaatgt

SEQ ID NO: 75361 - DNA, 25 bp, mus musculus
agctcatccaaataaatgtttcttg

SEQ ID NO: 75362 - DNA, 25 bp, mus musculus
caacttctgttccagtagcctagtg

SEQ ID NO: 75363 - DNA, 25 bp, mus musculus
ctgttccagtagcctagtggtgaca

SEQ ID NO: 75364 - DNA, 25 bp, mus musculus
cagtagcctagtggtgacaggaaca

SEQ ID NO: 75365 - DNA, 25 bp, mus musculus
cactgtcactgtcagtctccttggt

SEQ ID NO: 75366 - DNA, 25 bp, mus musculus
cccagtggcacctctctgaagttgt

SEQ ID NO: 75367 - DNA, 25 bp, mus musculus
ctgctgatgggtcaggtggaagaaa

SEQ ID NO: 75368 - DNA, 25 bp, mus musculus
atccttcctccagagagcttcgtgg

SEQ ID NO: 75369 - DNA, 25 bp, mus musculus
cctccagagagcttcgtggttctct

SEQ ID NO: 75370 - DNA, 25 bp, mus musculus
tgtatctgtcagggatcgttgtgac

SEQ ID NO: 75371 - DNA, 25 bp, mus musculus
ctggtacctacttgtcagatggagc

SEQ ID NO: 75372 - DNA, 25 bp, mus musculus
tacagataacactttcatttgcact

SEQ ID NO: 75373 - DNA, 25 bp, mus musculus
taacactttcatttgcactgggagc

SEQ ID NO: 75374 - DNA, 25 bp, mus musculus
tttcatttgcactgggagctcttct

SEQ ID NO: 75375 - DNA, 25 bp, mus musculus
ttgcactgggagctcttcttgtgtg

SEQ ID NO: 75376 - DNA, 25 bp, mus musculus
gtgtttccatatatctctatgggtt

SEQ ID NO: 75377 - DNA, 25 bp, mus musculus
ccatatatctctatgggttacccag

SEQ ID NO: 75378 - DNA, 25 bp, mus musculus
tacccagacaagatactacatccat

SEQ ID NO: 75379 - DNA, 25 bp, mus musculus
gacaagatactacatccattcaaca

SEQ ID NO: 75380 - DNA, 25 bp, mus musculus
atactacatccattcaacaagaagc

SEQ ID NO: 75381 - DNA, 25 bp, mus musculus
aatctcaagagattcctataaggac

SEQ ID NO: 75382 - DNA, 25 bp, mus musculus
cctacttgtcagatggagctgaaat

SEQ ID NO: 75383 - DNA, 25 bp, mus musculus
gattcttctatggctacacgtatta

SEQ ID NO: 75384 - DNA, 25 bp, mus musculus
tctatggctacacgtattatgtctg

SEQ ID NO: 75385 - DNA, 25 bp, mus musculus
agtatacagacaacatcatgaaagg

SEQ ID NO: 75386 - DNA, 25 bp, mus musculus
gcttctctgctgccgcagccattgt

SEQ ID NO: 75387 - DNA, 25 bp, mus musculus
ccattgttctttctaccattgcttc

SEQ ID NO: 75388 - DNA, 25 bp, mus musculus
ctaccattgcttcagtcctactgtt

SEQ ID NO: 75389 - DNA, 25 bp, mus musculus
cagtcctactgtttggattacagat

SEQ ID NO: 75390 - DNA, 25 bp, mus musculus
ttgtttacccaggaagatagacaag

SEQ ID NO: 75391 - DNA, 25 bp, mus musculus
agacaagacccaggtatcaagacta

SEQ ID NO: 75392 - DNA, 25 bp, mus musculus
acctgtgctccaaacagtgtgtcac

SEQ ID NO: 75393 - DNA, 25 bp, mus musculus
tgtgctccaaacagtgtgtcactag

SEQ ID NO: 75394 - DNA, 25 bp, mus musculus
gattatttccctctgtccttagaga

SEQ ID NO: 75395 - DNA, 25 bp, mus musculus
cctctgtccttagagatctttgcaa

SEQ ID NO: 75396 - DNA, 25 bp, mus musculus
atctttgcaaaggtgtccaagcaga

SEQ ID NO: 75397 - DNA, 25 bp, mus musculus
aagcagaacagcacccggaccagtg

SEQ ID NO: 75398 - DNA, 25 bp, mus musculus
gccatcaccctgggcaatgccaagc

SEQ ID NO: 75399 - DNA, 25 bp, mus musculus
atcaccctgggcaatgccaagctgg

SEQ ID NO: 75400 - DNA, 25 bp, mus musculus
accctgggcaatgccaagctggaca

SEQ ID NO: 75401 - DNA, 25 bp, mus musculus
aatgccaagctggacaggatcctgg

SEQ ID NO: 75402 - DNA, 25 bp, mus musculus
caagacccaggtatcaagactactt

SEQ ID NO: 75403 - DNA, 25 bp, mus musculus
atcaagactactttgttccagcaaa

SEQ ID NO: 75404 - DNA, 25 bp, mus musculus
ttgttccagcaaaaacacttcctca

SEQ ID NO: 75405 - DNA, 25 bp, mus musculus
cagcaaaaacacttcctcagggtgg

SEQ ID NO: 75406 - DNA, 25 bp, mus musculus
cacttcctcagggtggccacctgtg

SEQ ID NO: 75407 - DNA, 25 bp, mus musculus
ttcctcagggtggccacctgtgctc

SEQ ID NO: 75408 - DNA, 25 bp, mus musculus
gtggccacctgtgctccaaacagtg

SEQ ID NO: 75409 - DNA, 25 bp, mus musculus
gccacctgtgctccaaacagtgtgt

SEQ ID NO: 75410 - DNA, 25 bp, mus musculus
cagccacggagccatttcctccgtg

SEQ ID NO: 75411 - DNA, 25 bp, mus musculus
catttcctccgtggtgtccgacgct

SEQ ID NO: 75412 - DNA, 25 bp, mus musculus
aatccttagcgtcaagctgttttgt

SEQ ID NO: 75413 - DNA, 25 bp, mus musculus
tttttaagttgccttggcatataat

SEQ ID NO: 75414 - DNA, 25 bp, mus musculus
tattttgtctgccacttgaacagtt

SEQ ID NO: 75415 - DNA, 25 bp, mus musculus
ccccacaatcactgtccagttttag

SEQ ID NO: 75416 - DNA, 25 bp, mus musculus
cactgacttattccatttcttgaaa

SEQ ID NO: 75417 - DNA, 25 bp, mus musculus
cttattccatttcttgaaagtgtat

SEQ ID NO: 75418 - DNA, 25 bp, mus musculus
aattttgtcatgcgtgttttctcaa

SEQ ID NO: 75419 - DNA, 25 bp, mus musculus
gtcatgcgtgttttctcaatcttaa

SEQ ID NO: 75420 - DNA, 25 bp, mus musculus
tttaaaatctctcgcatcgattttt

SEQ ID NO: 75421 - DNA, 25 bp, mus musculus
atctctcgcatcgatttttatcaaa

SEQ ID NO: 75422 - DNA, 25 bp, mus musculus
ctccgtggtgtccgacgctagctca

SEQ ID NO: 75423 - DNA, 25 bp, mus musculus
cgacgctagctcagcggtctactat

SEQ ID NO: 75424 - DNA, 25 bp, mus musculus
ctactattgcaactaccccgacatt

SEQ ID NO: 75425 - DNA, 25 bp, mus musculus
ttgcaactaccccgacatttgacgg

SEQ ID NO: 75426 - DNA, 25 bp, mus musculus
gacccgacctgagggccagaagcag

SEQ ID NO: 75427 - DNA, 25 bp, mus musculus
acctgagggccagaagcagtgttac

SEQ ID NO: 75428 - DNA, 25 bp, mus musculus
gtgttacacacttcctggaagcgct

SEQ ID NO: 75429 - DNA, 25 bp, mus musculus
cacacttcctggaagcgctaaggaa

SEQ ID NO: 75430 - DNA, 25 bp, mus musculus
gaatgacgccccaagagctgttgtc

SEQ ID NO: 75431 - DNA, 25 bp, mus musculus
acgccccaagagctgttgtcccaat

SEQ ID NO: 75432 - DNA, 25 bp, mus musculus
tcaatcgttgggtcgcccaggcaac

SEQ ID NO: 75433 - DNA, 25 bp, mus musculus
ttgggtcgcccaggcaacaaggtgt

SEQ ID NO: 75434 - DNA, 25 bp, mus musculus
tcgcccaggcaacaaggtgttaatg

SEQ ID NO: 75435 - DNA, 25 bp, mus musculus
atctgaatcttgagttcccccatgg

SEQ ID NO: 75436 - DNA, 25 bp, mus musculus
ctgaatcttgagttcccccatggaa

SEQ ID NO: 75437 - DNA, 25 bp, mus musculus
tgaatcttgagttcccccatggaag

SEQ ID NO: 75438 - DNA, 25 bp, mus musculus
aatcttgagttcccccatggaagtg

SEQ ID NO: 75439 - DNA, 25 bp, mus musculus
atcttgagttcccccatggaagtgg

SEQ ID NO: 75440 - DNA, 25 bp, mus musculus
atattttcattaggtctctgttggc

SEQ ID NO: 75441 - DNA, 25 bp, mus musculus
attttcattaggtctctgttggcca

SEQ ID NO: 75442 - DNA, 25 bp, mus musculus
cgccccaagagctgttgtcccaatc

SEQ ID NO: 75443 - DNA, 25 bp, mus musculus
ccccaagagctgttgtcccaatcaa

SEQ ID NO: 75444 - DNA, 25 bp, mus musculus
cccaagagctgttgtcccaatcaat

SEQ ID NO: 75445 - DNA, 25 bp, mus musculus
gagctgttgtcccaatcaatcgttg

SEQ ID NO: 75446 - DNA, 25 bp, mus musculus
agctgttgtcccaatcaatcgttgg

SEQ ID NO: 75447 - DNA, 25 bp, mus musculus
tcccaatcaatcgttgggtcgccca

SEQ ID NO: 75448 - DNA, 25 bp, mus musculus
cccaatcaatcgttgggtcgcccag

SEQ ID NO: 75449 - DNA, 25 bp, mus musculus
caatcaatcgttgggtcgcccaggc

SEQ ID NO: 75450 - DNA, 25 bp, mus musculus
aacgaggctctggctatgcagaagc

SEQ ID NO: 75451 - DNA, 25 bp, mus musculus
tatgaccgcctgctagaagaacatg

SEQ ID NO: 75452 - DNA, 25 bp, mus musculus
gcccagactatccctctggtacttg

SEQ ID NO: 75453 - DNA, 25 bp, mus musculus
cccaattttcttccatggcttatag

SEQ ID NO: 75454 - DNA, 25 bp, mus musculus
tattttggcaccattacacatactg

SEQ ID NO: 75455 - DNA, 25 bp, mus musculus
attacacatactgctcttataccaa

SEQ ID NO: 75456 - DNA, 25 bp, mus musculus
catactgctcttataccaaaaggga

SEQ ID NO: 75457 - DNA, 25 bp, mus musculus
cagagtacttttgccactgttctgc

SEQ ID NO: 75458 - DNA, 25 bp, mus musculus
gccactgttctgcctggctagggca

SEQ ID NO: 75459 - DNA, 25 bp, mus musculus
tagggcactttccactcctggaagt

SEQ ID NO: 75460 - DNA, 25 bp, mus musculus
aaagcactggtgacctggcctgcag

SEQ ID NO: 75461 - DNA, 25 bp, mus musculus
atgtaccctaaaggaggctgctgtg

SEQ ID NO: 75462 - DNA, 25 bp, mus musculus
gaacatgccaaactgcaggcatcag

SEQ ID NO: 75463 - DNA, 25 bp, mus musculus
gccaaactgcaggcatcagtacgtg

SEQ ID NO: 75464 - DNA, 25 bp, mus musculus
ctgcaggcatcagtacgtggtccct

SEQ ID NO: 75465 - DNA, 25 bp, mus musculus
gtacgtggtccctcagtcaagaagg

SEQ ID NO: 75466 - DNA, 25 bp, mus musculus
ggtccctcagtcaagaaggaggagt

SEQ ID NO: 75467 - DNA, 25 bp, mus musculus
taaaggcttggtgtttccctgcctg

SEQ ID NO: 75468 - DNA, 25 bp, mus musculus
ggcttctacctgacccatgcttact

SEQ ID NO: 75469 - DNA, 25 bp, mus musculus
gcttactgcttccttggagcccaga

SEQ ID NO: 75470 - DNA, 25 bp, mus musculus
ccgcctgctggactggttccgttcg

SEQ ID NO: 75471 - DNA, 25 bp, mus musculus
ctgctggactggttccgttcgctct

SEQ ID NO: 75472 - DNA, 25 bp, mus musculus
agaccaccttcgtcaatgtcatcgc

SEQ ID NO: 75473 - DNA, 25 bp, mus musculus
caccttcgtcaatgtcatcgcgtcc

SEQ ID NO: 75474 - DNA, 25 bp, mus musculus
ttcgtcaatgtcatcgcgtccggtc

SEQ ID NO: 75475 - DNA, 25 bp, mus musculus
cgtcaatgtcatcgcgtccggtcaa

SEQ ID NO: 75476 - DNA, 25 bp, mus musculus
aatgtcatcgcgtccggtcaattca

SEQ ID NO: 75477 - DNA, 25 bp, mus musculus
tgtcatcgcgtccggtcaattcagt

SEQ ID NO: 75478 - DNA, 25 bp, mus musculus
tcatcgcgtccggtcaattcagtga

SEQ ID NO: 75479 - DNA, 25 bp, mus musculus
atcgcgtccggtcaattcagtgaag

SEQ ID NO: 75480 - DNA, 25 bp, mus musculus
cgtccggtcaattcagtgaagatat

SEQ ID NO: 75481 - DNA, 25 bp, mus musculus
gatatgatacccacagtgggcttca

SEQ ID NO: 75482 - DNA, 25 bp, mus musculus
tggactggttccgttcgctcttctg

SEQ ID NO: 75483 - DNA, 25 bp, mus musculus
ttccgttcgctcttctggaaggagg

SEQ ID NO: 75484 - DNA, 25 bp, mus musculus
ctgcagtactccggcaagaccacct

SEQ ID NO: 75485 - DNA, 25 bp, mus musculus
gcagtactccggcaagaccaccttc

SEQ ID NO: 75486 - DNA, 25 bp, mus musculus
tactccggcaagaccaccttcgtca

SEQ ID NO: 75487 - DNA, 25 bp, mus musculus
ccggcaagaccaccttcgtcaatgt

SEQ ID NO: 75488 - DNA, 25 bp, mus musculus
ggcaagaccaccttcgtcaatgtca

SEQ ID NO: 75489 - DNA, 25 bp, mus musculus
caagaccaccttcgtcaatgtcatc

SEQ ID NO: 75490 - DNA, 25 bp, mus musculus
catccttgagtgaccagacttttct

SEQ ID NO: 75491 - DNA, 25 bp, mus musculus
tgagtgaccagacttttctattagt

SEQ ID NO: 75492 - DNA, 25 bp, mus musculus
acagtcagctctacccatctgagaa

SEQ ID NO: 75493 - DNA, 25 bp, mus musculus
agctctacccatctgagaaagaaga

SEQ ID NO: 75494 - DNA, 25 bp, mus musculus
taccacaatcattatcatcttcccc

SEQ ID NO: 75495 - DNA, 25 bp, mus musculus
ccaacttggctatgctggggccaac

SEQ ID NO: 75496 - DNA, 25 bp, mus musculus
tggctatgctggggccaactctgac

SEQ ID NO: 75497 - DNA, 25 bp, mus musculus
ccctctgctctctttctcttatact

SEQ ID NO: 75498 - DNA, 25 bp, mus musculus
ttctgacattttgcttgaggctgag

SEQ ID NO: 75499 - DNA, 25 bp, mus musculus
cattttgcttgaggctgagctctct

SEQ ID NO: 75500 - DNA, 25 bp, mus musculus
gctctctgtcatcaagtcatttggg

SEQ ID NO: 75501 - DNA, 25 bp, mus musculus
tgtcatcaagtcatttggggaagtc

SEQ ID NO: 75502 - DNA, 25 bp, mus musculus
gggttcactgagcttttctgaacat

SEQ ID NO: 75503 - DNA, 25 bp, mus musculus
gaagtcaggtcccagcaaaatctaa

SEQ ID NO: 75504 - DNA, 25 bp, mus musculus
actgagcttttctgaacatatgtct

SEQ ID NO: 75505 - DNA, 25 bp, mus musculus
tgaacatatgtcttactcatatgag

SEQ ID NO: 75506 - DNA, 25 bp, mus musculus
ttactcatatgagtcttccatggtg

SEQ ID NO: 75507 - DNA, 25 bp, mus musculus
atatgagtcttccatggtgctgtgg

SEQ ID NO: 75508 - DNA, 25 bp, mus musculus
gtcttccatggtgctgtggttggag

SEQ ID NO: 75509 - DNA, 25 bp, mus musculus
ggaccagacatagctgtgagacaca

SEQ ID NO: 75510 - DNA, 25 bp, mus musculus
agaggcagtccctccagtaagaagt

SEQ ID NO: 75511 - DNA, 25 bp, mus musculus
agtcgtatgacgaacggctgagagc

SEQ ID NO: 75512 - DNA, 25 bp, mus musculus
gtatgacgaacggctgagagcccag

SEQ ID NO: 75513 - DNA, 25 bp, mus musculus
cgttgagatcgtcgacgagtcttgc

SEQ ID NO: 75514 - DNA, 25 bp, mus musculus
tgatgcagcaggagcacccaagttc

SEQ ID NO: 75515 - DNA, 25 bp, mus musculus
atgcagcaggagcacccaagttcga

SEQ ID NO: 75516 - DNA, 25 bp, mus musculus
tgcagcaggagcacccaagttcgac

SEQ ID NO: 75517 - DNA, 25 bp, mus musculus
agcaggagcacccaagttcgacgag

SEQ ID NO: 75518 - DNA, 25 bp, mus musculus
gcaggagcacccaagttcgacgaga

SEQ ID NO: 75519 - DNA, 25 bp, mus musculus
caggagcacccaagttcgacgagat

SEQ ID NO: 75520 - DNA, 25 bp, mus musculus
aggagcacccaagttcgacgagatc

SEQ ID NO: 75521 - DNA, 25 bp, mus musculus
ggagcacccaagttcgacgagatcg

SEQ ID NO: 75522 - DNA, 25 bp, mus musculus
gagcacccaagttcgacgagatcga

SEQ ID NO: 75523 - DNA, 25 bp, mus musculus
tatgacgaacggctgagagcccaga

SEQ ID NO: 75524 - DNA, 25 bp, mus musculus
cccagaccgcgcgcgttgagatcgt

SEQ ID NO: 75525 - DNA, 25 bp, mus musculus
ccagaccgcgcgcgttgagatcgtc

SEQ ID NO: 75526 - DNA, 25 bp, mus musculus
cagaccgcgcgcgttgagatcgtcg

SEQ ID NO: 75527 - DNA, 25 bp, mus musculus
agaccgcgcgcgttgagatcgtcga

SEQ ID NO: 75528 - DNA, 25 bp, mus musculus
gaccgcgcgcgttgagatcgtcgac

SEQ ID NO: 75529 - DNA, 25 bp, mus musculus
accgcgcgcgttgagatcgtcgacg

SEQ ID NO: 75530 - DNA, 25 bp, mus musculus
ccgcgcgcgttgagatcgtcgacga

SEQ ID NO: 75531 - DNA, 25 bp, mus musculus
acctacagatctacagccggcagca

SEQ ID NO: 75532 - DNA, 25 bp, mus musculus
tctacagccggcagcatatggaacg

SEQ ID NO: 75533 - DNA, 25 bp, mus musculus
ctgacactgtataccgggcacttcg

SEQ ID NO: 75534 - DNA, 25 bp, mus musculus
ttcgtactgagcatcgggaccaggc

SEQ ID NO: 75535 - DNA, 25 bp, mus musculus
ccagcaagagactgctccagttcta

SEQ ID NO: 75536 - DNA, 25 bp, mus musculus
agagactgctccagttctatgcaga

SEQ ID NO: 75537 - DNA, 25 bp, mus musculus
agttctatgcagagaccttcccagc

SEQ ID NO: 75538 - DNA, 25 bp, mus musculus
tctatgcagagaccttcccagcgcc

SEQ ID NO: 75539 - DNA, 25 bp, mus musculus
atgcagagaccttcccagcgcctga

SEQ ID NO: 75540 - DNA, 25 bp, mus musculus
ccttcccagcgcctgaacgtggtgg

SEQ ID NO: 75541 - DNA, 25 bp, mus musculus
cagtgcaggaccgcctgttgcagag

SEQ ID NO: 75542 - DNA, 25 bp, mus musculus
tgcagagcaacccgtgttagaggcc

SEQ ID NO: 75543 - DNA, 25 bp, mus musculus
atatggaacgctaccgtggtgtcag

SEQ ID NO: 75544 - DNA, 25 bp, mus musculus
tggaacgctaccgtggtgtcagttt

SEQ ID NO: 75545 - DNA, 25 bp, mus musculus
tctatgaagtaccacctcatttgtt

SEQ ID NO: 75546 - DNA, 25 bp, mus musculus
aagtaccacctcatttgtttgcagt

SEQ ID NO: 75547 - DNA, 25 bp, mus musculus
taccacctcatttgtttgcagtggc

SEQ ID NO: 75548 - DNA, 25 bp, mus musculus
atttgtttgcagtggctgacactgt

SEQ ID NO: 75549 - DNA, 25 bp, mus musculus
tgtttgcagtggctgacactgtata

SEQ ID NO: 75550 - DNA, 25 bp, mus musculus
tggctgacactgtataccgggcact

SEQ ID NO: 75551 - DNA, 25 bp, mus musculus
cttgatcctgctcctacagcctctg

SEQ ID NO: 75552 - DNA, 25 bp, mus musculus
ctggttccacatgctgggaccggga

SEQ ID NO: 75553 - DNA, 25 bp, mus musculus
tatgccactgctagagccttcaaga

SEQ ID NO: 75554 - DNA, 25 bp, mus musculus
gccactgctagagccttcaagatca

SEQ ID NO: 75555 - DNA, 25 bp, mus musculus
gctagagccttcaagatcatccgtg

SEQ ID NO: 75556 - DNA, 25 bp, mus musculus
gccttcaagatcatccgtgaggcgt

SEQ ID NO: 75557 - DNA, 25 bp, mus musculus
aagatcatccgtgaggcgtacaaga

SEQ ID NO: 75558 - DNA, 25 bp, mus musculus
atcatccgtgaggcgtacaagaagt

SEQ ID NO: 75559 - DNA, 25 bp, mus musculus
aagtacatcactgcccacggacttc

SEQ ID NO: 75560 - DNA, 25 bp, mus musculus
gagccactacctggctctgggcctc

SEQ ID NO: 75561 - DNA, 25 bp, mus musculus
cgagccttgcgtcagaagattgtca

SEQ ID NO: 75562 - DNA, 25 bp, mus musculus
tagagacacctgacccctagacagt

SEQ ID NO: 75563 - DNA, 25 bp, mus musculus
gttccacatgctgggaccgggactg

SEQ ID NO: 75564 - DNA, 25 bp, mus musculus
tctcgcaccttcatcacgttcagtg

SEQ ID NO: 75565 - DNA, 25 bp, mus musculus
cgcaccttcatcacgttcagtgatg

SEQ ID NO: 75566 - DNA, 25 bp, mus musculus
atcacgttcagtgatgatgcaacgt

SEQ ID NO: 75567 - DNA, 25 bp, mus musculus
gaccctgttacagacataccctatg

SEQ ID NO: 75568 - DNA, 25 bp, mus musculus
gttacagacataccctatgccactg

SEQ ID NO: 75569 - DNA, 25 bp, mus musculus
acagacataccctatgccactgcta

SEQ ID NO: 75570 - DNA, 25 bp, mus musculus
gacataccctatgccactgctagag

SEQ ID NO: 75571 - DNA, 25 bp, mus musculus
agacaccactgctcagctttcttgg

SEQ ID NO: 75572 - DNA, 25 bp, mus musculus
gagaccaggacctgacaaccacagc

SEQ ID NO: 75573 - DNA, 25 bp, mus musculus
gctcaaagctcaccttcttctgaga

SEQ ID NO: 75574 - DNA, 25 bp, mus musculus
agctcaccttcttctgagaagccat

SEQ ID NO: 75575 - DNA, 25 bp, mus musculus
ttagcccagcactcctcttgagcaa

SEQ ID NO: 75576 - DNA, 25 bp, mus musculus
cagcactcctcttgagcaacctgct

SEQ ID NO: 75577 - DNA, 25 bp, mus musculus
tcctcttgagcaacctgctactcca

SEQ ID NO: 75578 - DNA, 25 bp, mus musculus
tgagcaacctgctactccagaacac

SEQ ID NO: 75579 - DNA, 25 bp, mus musculus
tactccagaacaccactgctcttct

SEQ ID NO: 75580 - DNA, 25 bp, mus musculus
ctcttctccattctgtctgcgacat

SEQ ID NO: 75581 - DNA, 25 bp, mus musculus
gtttctctgtgatcttctgcatgtg

SEQ ID NO: 75582 - DNA, 25 bp, mus musculus
gattgtaagctccaagtgggcacag

SEQ ID NO: 75583 - DNA, 25 bp, mus musculus
ccccatcaccatgtatgttatccaa

SEQ ID NO: 75584 - DNA, 25 bp, mus musculus
caccatgtatgttatccaagctagg

SEQ ID NO: 75585 - DNA, 25 bp, mus musculus
caatacagttccagatctcgtcgac

SEQ ID NO: 75586 - DNA, 25 bp, mus musculus
atatgaattccgcactgttgcagct

SEQ ID NO: 75587 - DNA, 25 bp, mus musculus
cactgttgcagctaatgtgattggc

SEQ ID NO: 75588 - DNA, 25 bp, mus musculus
agaggctcagaacactggggatcag

SEQ ID NO: 75589 - DNA, 25 bp, mus musculus
tcagaacactggggatcagagaggt

SEQ ID NO: 75590 - DNA, 25 bp, mus musculus
ttaagcacagtgagccaggggtcaa

SEQ ID NO: 75591 - DNA, 25 bp, mus musculus
ctcttttactgtctgtatccagatt

SEQ ID NO: 75592 - DNA, 25 bp, mus musculus
tactgtctgtatccagattactgta

SEQ ID NO: 75593 - DNA, 25 bp, mus musculus
atggtcagaaccatgtccatggagc

SEQ ID NO: 75594 - DNA, 25 bp, mus musculus
agaaccatgtccatggagctcccgg

SEQ ID NO: 75595 - DNA, 25 bp, mus musculus
cttctccggcagtgtgcagagtcga

SEQ ID NO: 75596 - DNA, 25 bp, mus musculus
ctgggtttcccacctgcaaagtcat

SEQ ID NO: 75597 - DNA, 25 bp, mus musculus
ttcccacctgcaaagtcatcaggga

SEQ ID NO: 75598 - DNA, 25 bp, mus musculus
cctgcaaagtcatcagggaacccag

SEQ ID NO: 75599 - DNA, 25 bp, mus musculus
tcagggaacccagcttccaggcatt

SEQ ID NO: 75600 - DNA, 25 bp, mus musculus
aacccagcttccaggcattgtaggg

SEQ ID NO: 75601 - DNA, 25 bp, mus musculus
gcttccaggcattgtagggagacat

SEQ ID NO: 75602 - DNA, 25 bp, mus musculus
tggttctctccaacatattttacaa

SEQ ID NO: 75603 - DNA, 25 bp, mus musculus
ctgtatccagattactgtactgtag

SEQ ID NO: 75604 - DNA, 25 bp, mus musculus
ggttctctccaacatattttacaat

SEQ ID NO: 75605 - DNA, 25 bp, mus musculus
ccagattactgtactgtaggctaag

SEQ ID NO: 75606 - DNA, 25 bp, mus musculus
tactgtactgtaggctaagtaacac

SEQ ID NO: 75607 - DNA, 25 bp, mus musculus
ttacatgttacatcctctttaggtt

SEQ ID NO: 75608 - DNA, 25 bp, mus musculus
tctaaccttgtcattagagtcaaac

SEQ ID NO: 75609 - DNA, 25 bp, mus musculus
tgtcgcaggagactggtgcgtttgc

SEQ ID NO: 75610 - DNA, 25 bp, mus musculus
cgtttgcattgtctgcaagggtctg

SEQ ID NO: 75611 - DNA, 25 bp, mus musculus
cattgtctgcaagggtctgttgagg

SEQ ID NO: 75612 - DNA, 25 bp, mus musculus
catagtctaccatcaaatactttag

SEQ ID NO: 75613 - DNA, 25 bp, mus musculus
ctaccatcaaatactttaggagtat

SEQ ID NO: 75614 - DNA, 25 bp, mus musculus
tgatggttcttgccgtaatagaata

SEQ ID NO: 75615 - DNA, 25 bp, mus musculus
attgcctgtatttctacctctagta

SEQ ID NO: 75616 - DNA, 25 bp, mus musculus
tgtatttctacctctagtaatgggc

SEQ ID NO: 75617 - DNA, 25 bp, mus musculus
tctacctctagtaatgggctttatg

SEQ ID NO: 75618 - DNA, 25 bp, mus musculus
cttgagcctgggcaagtgcacaagt

SEQ ID NO: 75619 - DNA, 25 bp, mus musculus
cccaactgatcagtttgagagatca

SEQ ID NO: 75620 - DNA, 25 bp, mus musculus
gagatcattaatgcccctgaagtgg

SEQ ID NO: 75621 - DNA, 25 bp, mus musculus
tccctcttattatagtattgaaatt

SEQ ID NO: 75622 - DNA, 25 bp, mus musculus
atttatcaagtcatgttcatgccct

SEQ ID NO: 75623 - DNA, 25 bp, mus musculus
caagtcatgttcatgccctgatttt

SEQ ID NO: 75624 - DNA, 25 bp, mus musculus
ggagtatccttaatctttagataga

SEQ ID NO: 75625 - DNA, 25 bp, mus musculus
taattacctcctaagttctcaagca

SEQ ID NO: 75626 - DNA, 25 bp, mus musculus
cctcctaagttctcaagcagaggca

SEQ ID NO: 75627 - DNA, 25 bp, mus musculus
aagttctcaagcagaggcagtctat

SEQ ID NO: 75628 - DNA, 25 bp, mus musculus
ttgcaaggaccttctttgctgccag

SEQ ID NO: 75629 - DNA, 25 bp, mus musculus
ggaccttctttgctgccagttacca

SEQ ID NO: 75630 - DNA, 25 bp, mus musculus
agatgcactttgctcagtaatactt

SEQ ID NO: 75631 - DNA, 25 bp, mus musculus
gattatccatttggttgttacagaa

SEQ ID NO: 75632 - DNA, 25 bp, mus musculus
gagcaggctaaccacatttgcttct

SEQ ID NO: 75633 - DNA, 25 bp, mus musculus
caggctaaccacatttgcttctggg

SEQ ID NO: 75634 - DNA, 25 bp, mus musculus
tctctgcgaaagcacatgaaagttc

SEQ ID NO: 75635 - DNA, 25 bp, mus musculus
cccagctctggctacgactcggcta

SEQ ID NO: 75636 - DNA, 25 bp, mus musculus
agctctggctacgactcggctataa

SEQ ID NO: 75637 - DNA, 25 bp, mus musculus
tctggctacgactcggctataacgt

SEQ ID NO: 75638 - DNA, 25 bp, mus musculus
ggctacgactcggctataacgtctg

SEQ ID NO: 75639 - DNA, 25 bp, mus musculus
tacgactcggctataacgtctgctc

SEQ ID NO: 75640 - DNA, 25 bp, mus musculus
gactcggctataacgtctgctctcg

SEQ ID NO: 75641 - DNA, 25 bp, mus musculus
gaatggtacgtgtgttcgggcgcct

SEQ ID NO: 75642 - DNA, 25 bp, mus musculus
tacgtgtgttcgggcgcctggacca

SEQ ID NO: 75643 - DNA, 25 bp, mus musculus
accagtggtggctgactctgcagcg

SEQ ID NO: 75644 - DNA, 25 bp, mus musculus
gctaaccacatttgcttctgggagg

SEQ ID NO: 75645 - DNA, 25 bp, mus musculus
aaggtctttgctagatcagaaaatc

SEQ ID NO: 75646 - DNA, 25 bp, mus musculus
atacacaaacgaacacatacaggcg

SEQ ID NO: 75647 - DNA, 25 bp, mus musculus
agcagcgaccgcaagaaacattcgc

SEQ ID NO: 75648 - DNA, 25 bp, mus musculus
agcgaccgcaagaaacattcgcacg

SEQ ID NO: 75649 - DNA, 25 bp, mus musculus
cacacgagcgacaagccttatatgt

SEQ ID NO: 75650 - DNA, 25 bp, mus musculus
acgagcgacaagccttatatgtgca

SEQ ID NO: 75651 - DNA, 25 bp, mus musculus
agcgacaagccttatatgtgcaagg

SEQ ID NO: 75652 - DNA, 25 bp, mus musculus
cagcgcagagcccaagccttgatga

SEQ ID NO: 75653 - DNA, 25 bp, mus musculus
aatctcctcaactgtggcttggcat

SEQ ID NO: 75654 - DNA, 25 bp, mus musculus
tatggcttaaagaccgcctacagac

SEQ ID NO: 75655 - DNA, 25 bp, mus musculus
ttaaagaccgcctacagacgcatct

SEQ ID NO: 75656 - DNA, 25 bp, mus musculus
tacagacgcatctacggtatcacta

SEQ ID NO: 75657 - DNA, 25 bp, mus musculus
atcactatttaggacctgtgctgcc

SEQ ID NO: 75658 - DNA, 25 bp, mus musculus
gacctgtgctgccctaaagccaaac

SEQ ID NO: 75659 - DNA, 25 bp, mus musculus
cctaaagccaaactctggcagctcg

SEQ ID NO: 75660 - DNA, 25 bp, mus musculus
gccaaactctggcagctcggctttg

SEQ ID NO: 75661 - DNA, 25 bp, mus musculus
ggctgctctccagaacttgatcctc

SEQ ID NO: 75662 - DNA, 25 bp, mus musculus
tctccagaacttgatcctccctgtc

SEQ ID NO: 75663 - DNA, 25 bp, mus musculus
tctctgccctgcaagtatggatgtc

SEQ ID NO: 75664 - DNA, 25 bp, mus musculus
tgtggcttggcatgctagagaagta

SEQ ID NO: 75665 - DNA, 25 bp, mus musculus
gaacagacaagtcccacacagcagc

SEQ ID NO: 75666 - DNA, 25 bp, mus musculus
cttggtgcacacctagcagacacca

SEQ ID NO: 75667 - DNA, 25 bp, mus musculus
gcacacctagcagacaccatgagga

SEQ ID NO: 75668 - DNA, 25 bp, mus musculus
ctctgtctctctgacctcacagatg

SEQ ID NO: 75669 - DNA, 25 bp, mus musculus
gacaaagccttcatgtccaagcagg

SEQ ID NO: 75670 - DNA, 25 bp, mus musculus
ctatgtgagcttgaccctgcttgtg

SEQ ID NO: 75671 - DNA, 25 bp, mus musculus
gaccctgcttgtgacgagctatcaa

SEQ ID NO: 75672 - DNA, 25 bp, mus musculus
ctttgcctccattctcaagtctgtc

SEQ ID NO: 75673 - DNA, 25 bp, mus musculus
ctccattctcaagtctgtctggtac

SEQ ID NO: 75674 - DNA, 25 bp, mus musculus
tatctaccttactggctgggatgaa

SEQ ID NO: 75675 - DNA, 25 bp, mus musculus
ggccaatcactttgctgtgcaccat

SEQ ID NO: 75676 - DNA, 25 bp, mus musculus
tcactttgctgtgcaccatgatgag

SEQ ID NO: 75677 - DNA, 25 bp, mus musculus
tgctgtgcaccatgatgaggagaaa

SEQ ID NO: 75678 - DNA, 25 bp, mus musculus
gatcacaggcctaaaacagaagact

SEQ ID NO: 75679 - DNA, 25 bp, mus musculus
gttcaagaccattgcaagtgaacac

SEQ ID NO: 75680 - DNA, 25 bp, mus musculus
tgaagccttggctgaaactctcagt

SEQ ID NO: 75681 - DNA, 25 bp, mus musculus
cttggctgaaactctcagtaaacag

SEQ ID NO: 75682 - DNA, 25 bp, mus musculus
taaacagagcatctccaactcagaa

SEQ ID NO: 75683 - DNA, 25 bp, mus musculus
tggagtccacttcattttcaacaag

SEQ ID NO: 75684 - DNA, 25 bp, mus musculus
ttgtgataatgccaccagtctgaaa

SEQ ID NO: 75685 - DNA, 25 bp, mus musculus
caccagtctgaaactcaaaaagatc

SEQ ID NO: 75686 - DNA, 25 bp, mus musculus
ctactggctgtgcagggacacgcat

SEQ ID NO: 75687 - DNA, 25 bp, mus musculus
cagggacacgcatgcctttgagtgg

SEQ ID NO: 75688 - DNA, 25 bp, mus musculus
agacctgctgcagctgctggagacc

SEQ ID NO: 75689 - DNA, 25 bp, mus musculus
caatgccaacttcctcagctacaat

SEQ ID NO: 75690 - DNA, 25 bp, mus musculus
caacttcctcagctacaatatctac

SEQ ID NO: 75691 - DNA, 25 bp, mus musculus
ctacaatatctaccttactggctgg

SEQ ID NO: 75692 - DNA, 25 bp, mus musculus
ttaatgacgccccgagagttgtctt

SEQ ID NO: 75693 - DNA, 25 bp, mus musculus
atgacgccccgagagttgtcttcat

SEQ ID NO: 75694 - DNA, 25 bp, mus musculus
atgacccacagagaacgagatgtat

SEQ ID NO: 75695 - DNA, 25 bp, mus musculus
gatgtatcgagcctctgtagtcccc

SEQ ID NO: 75696 - DNA, 25 bp, mus musculus
agcctctgtagtcccctgttgatga

SEQ ID NO: 75697 - DNA, 25 bp, mus musculus
aggttattaccaccagctgatgata

SEQ ID NO: 75698 - DNA, 25 bp, mus musculus
ttattaccaccagctgatgatatgg

SEQ ID NO: 75699 - DNA, 25 bp, mus musculus
ccaccagctgatgatatggtgaaga

SEQ ID NO: 75700 - DNA, 25 bp, mus musculus
atattctatgatgaccgtgttgtgc

SEQ ID NO: 75701 - DNA, 25 bp, mus musculus
ttctatgatgaccgtgttgtgcccc

SEQ ID NO: 75702 - DNA, 25 bp, mus musculus
tatgatgaccgtgttgtgccccaag

SEQ ID NO: 75703 - DNA, 25 bp, mus musculus
tgaccgtgttgtgccccaagaagac

SEQ ID NO: 75704 - DNA, 25 bp, mus musculus
acgccccgagagttgtcttcataca

SEQ ID NO: 75705 - DNA, 25 bp, mus musculus
ttgtcttcatacatatcgtggctcg

SEQ ID NO: 75706 - DNA, 25 bp, mus musculus
atatcgtggctcgcacaccaccaca

SEQ ID NO: 75707 - DNA, 25 bp, mus musculus
tcgtggctcgcacaccaccacagtg

SEQ ID NO: 75708 - DNA, 25 bp, mus musculus
gcacaccaccacagtgtcacagtgt

SEQ ID NO: 75709 - DNA, 25 bp, mus musculus
caccaccacagtgtcacagtgtgta

SEQ ID NO: 75710 - DNA, 25 bp, mus musculus
aaggggtcccatgtatgggatatga

SEQ ID NO: 75711 - DNA, 25 bp, mus musculus
gatatgacccacagagaacgagatg

SEQ ID NO: 75712 - DNA, 25 bp, mus musculus
cctccagagagcaactactcctctt

SEQ ID NO: 75713 - DNA, 25 bp, mus musculus
cagagagcaactactcctcttgggg

SEQ ID NO: 75714 - DNA, 25 bp, mus musculus
acaatctgctggtgcctgcccaata

SEQ ID NO: 75715 - DNA, 25 bp, mus musculus
caatctgctggtgcctgcccaatag

SEQ ID NO: 75716 - DNA, 25 bp, mus musculus
aatctgctggtgcctgcccaatagg

SEQ ID NO: 75717 - DNA, 25 bp, mus musculus
atctgctggtgcctgcccaataggt

SEQ ID NO: 75718 - DNA, 25 bp, mus musculus
tctgctggtgcctgcccaataggtt

SEQ ID NO: 75719 - DNA, 25 bp, mus musculus
ctgctggtgcctgcccaataggttc

SEQ ID NO: 75720 - DNA, 25 bp, mus musculus
tgctggtgcctgcccaataggttcg

SEQ ID NO: 75721 - DNA, 25 bp, mus musculus
ctggtgcctgcccaataggttcggt

SEQ ID NO: 75722 - DNA, 25 bp, mus musculus
tggtgcctgcccaataggttcggtt

SEQ ID NO: 75723 - DNA, 25 bp, mus musculus
agagagcaactactcctcttggggg

SEQ ID NO: 75724 - DNA, 25 bp, mus musculus
gagagcaactactcctcttggggga

SEQ ID NO: 75725 - DNA, 25 bp, mus musculus
gagcaactactcctcttgggggaat

SEQ ID NO: 75726 - DNA, 25 bp, mus musculus
caagcaatcctttgaaaacaatctg

SEQ ID NO: 75727 - DNA, 25 bp, mus musculus
aagcaatcctttgaaaacaatctgc

SEQ ID NO: 75728 - DNA, 25 bp, mus musculus
cctttgaaaacaatctgctggtgcc

SEQ ID NO: 75729 - DNA, 25 bp, mus musculus
ctttgaaaacaatctgctggtgcct

SEQ ID NO: 75730 - DNA, 25 bp, mus musculus
ttgaaaacaatctgctggtgcctgc

SEQ ID NO: 75731 - DNA, 25 bp, mus musculus
gctcattgtgctccccaaggacgtg

SEQ ID NO: 75732 - DNA, 25 bp, mus musculus
tgtgctccccaaggacgtggaggat

SEQ ID NO: 75733 - DNA, 25 bp, mus musculus
gtcccggatcttacagcacaaggat

SEQ ID NO: 75734 - DNA, 25 bp, mus musculus
gatcttacagcacaaggatgaattc

SEQ ID NO: 75735 - DNA, 25 bp, mus musculus
caaattctgttctccttagctggca

SEQ ID NO: 75736 - DNA, 25 bp, mus musculus
tccttagctggcagggccttgccaa

SEQ ID NO: 75737 - DNA, 25 bp, mus musculus
ttgccaagtctcagggaacttgtct

SEQ ID NO: 75738 - DNA, 25 bp, mus musculus
agtctcagggaacttgtctgtagtc

SEQ ID NO: 75739 - DNA, 25 bp, mus musculus
tgtagtcgcagagctctgtaaactt

SEQ ID NO: 75740 - DNA, 25 bp, mus musculus
taaactttgtatccagacaatcact

SEQ ID NO: 75741 - DNA, 25 bp, mus musculus
ccagacaatcactttctatacaata

SEQ ID NO: 75742 - DNA, 25 bp, mus musculus
aatcactttctatacaataaattgt

SEQ ID NO: 75743 - DNA, 25 bp, mus musculus
tgagtccacaggcctggagaagatt

SEQ ID NO: 75744 - DNA, 25 bp, mus musculus
caacccagaaacattgttacagtgg

SEQ ID NO: 75745 - DNA, 25 bp, mus musculus
ccccagtaccatggccaatgccaaa

SEQ ID NO: 75746 - DNA, 25 bp, mus musculus
taccatggccaatgccaaagtcaaa

SEQ ID NO: 75747 - DNA, 25 bp, mus musculus
gatgattgatcccaaggctagtctg

SEQ ID NO: 75748 - DNA, 25 bp, mus musculus
aagtctcttcaatgaaagtacatcg

SEQ ID NO: 75749 - DNA, 25 bp, mus musculus
agtgtccctgtcaaatgtgattcat

SEQ ID NO: 75750 - DNA, 25 bp, mus musculus
gtccatcgaggtgccagggtcccgg

SEQ ID NO: 75751 - DNA, 25 bp, mus musculus
agactaggactgcttagccttcctt

SEQ ID NO: 75752 - DNA, 25 bp, mus musculus
cttagccttccttatcctggagtgg

SEQ ID NO: 75753 - DNA, 25 bp, mus musculus
ctgaatatttcttctgcattcatgg

SEQ ID NO: 75754 - DNA, 25 bp, mus musculus
tctgcattcatggcagggtcaccag

SEQ ID NO: 75755 - DNA, 25 bp, mus musculus
ttcatggcagggtcaccagccatca

SEQ ID NO: 75756 - DNA, 25 bp, mus musculus
gcagggtcaccagccatcatagaca

SEQ ID NO: 75757 - DNA, 25 bp, mus musculus
gctgttgccattctttctgcacccc

SEQ ID NO: 75758 - DNA, 25 bp, mus musculus
aacgctgctctgtcctatagcttca

SEQ ID NO: 75759 - DNA, 25 bp, mus musculus
gctctgtcctatagcttcacaaaac

SEQ ID NO: 75760 - DNA, 25 bp, mus musculus
tcctatagcttcacaaaacaggagc

SEQ ID NO: 75761 - DNA, 25 bp, mus musculus
taccttgggcactattccttataca

SEQ ID NO: 75762 - DNA, 25 bp, mus musculus
gggcactattccttatacaaaatat

SEQ ID NO: 75763 - DNA, 25 bp, mus musculus
ctagccagggttcacttctccaagg

SEQ ID NO: 75764 - DNA, 25 bp, mus musculus
gtaggtttgcctccctatgggagag

SEQ ID NO: 75765 - DNA, 25 bp, mus musculus
ggtcagctttcctagcttatgacag

SEQ ID NO: 75766 - DNA, 25 bp, mus musculus
gcaaacctggtactctgctggagtc

SEQ ID NO: 75767 - DNA, 25 bp, mus musculus
ctggtactctgctggagtctcactg

SEQ ID NO: 75768 - DNA, 25 bp, mus musculus
ctctgctggagtctcactgtggctg

SEQ ID NO: 75769 - DNA, 25 bp, mus musculus
ctcactgtggctgtagctcagtttt

SEQ ID NO: 75770 - DNA, 25 bp, mus musculus
tcattttctcccttaatactgaata

SEQ ID NO: 75771 - DNA, 25 bp, mus musculus
ctggctggccagcaggagggtcatt

SEQ ID NO: 75772 - DNA, 25 bp, mus musculus
tgtttgcatttcagcaagtgacttc

SEQ ID NO: 75773 - DNA, 25 bp, mus musculus
tttgccttttgtgaaggcggaactg

SEQ ID NO: 75774 - DNA, 25 bp, mus musculus
tcctcataggaaagcactcagcctg

SEQ ID NO: 75775 - DNA, 25 bp, mus musculus
taggaaagcactcagcctgcgtggg

SEQ ID NO: 75776 - DNA, 25 bp, mus musculus
agcactcagcctgcgtgggcgtagg

SEQ ID NO: 75777 - DNA, 25 bp, mus musculus
ccatggggcctcacctcaaggtcca

SEQ ID NO: 75778 - DNA, 25 bp, mus musculus
tggggcctcacctcaaggtccacat

SEQ ID NO: 75779 - DNA, 25 bp, mus musculus
tcaaggtccacatggccttggctgt

SEQ ID NO: 75780 - DNA, 25 bp, mus musculus
tccacatggccttggctgtctgatg

SEQ ID NO: 75781 - DNA, 25 bp, mus musculus
ctgtctgatgcgcgctcacagtggg

SEQ ID NO: 75782 - DNA, 25 bp, mus musculus
aactcttggtcatgtgggagaacac

SEQ ID NO: 75783 - DNA, 25 bp, mus musculus
ttcagcaagtgacttctgcgaagtt

SEQ ID NO: 75784 - DNA, 25 bp, mus musculus
agcaagtgacttctgcgaagttcct

SEQ ID NO: 75785 - DNA, 25 bp, mus musculus
actttcttcagggcccgttgctgct

SEQ ID NO: 75786 - DNA, 25 bp, mus musculus
ttcttcagggcccgttgctgctggg

SEQ ID NO: 75787 - DNA, 25 bp, mus musculus
ttcagggcccgttgctgctgggcaa

SEQ ID NO: 75788 - DNA, 25 bp, mus musculus
tgctgctgggcaagcaccctgcagg

SEQ ID NO: 75789 - DNA, 25 bp, mus musculus
tgtgccctgggcacatttgcctttt

SEQ ID NO: 75790 - DNA, 25 bp, mus musculus
gccctgggcacatttgccttttgtg

SEQ ID NO: 75791 - DNA, 25 bp, mus musculus
agggtacaaccatcagccacgctgc

SEQ ID NO: 75792 - DNA, 25 bp, mus musculus
acgctgccaccggatcagccgcaga

SEQ ID NO: 75793 - DNA, 25 bp, mus musculus
ccgcactacaacccgatggaggtgc

SEQ ID NO: 75794 - DNA, 25 bp, mus musculus
ggcgactttggcaacttcgtggtgc

SEQ ID NO: 75795 - DNA, 25 bp, mus musculus
cgcaatggccagctctggaggcatc

SEQ ID NO: 75796 - DNA, 25 bp, mus musculus
ggccagctctggaggcatcgcgtcg

SEQ ID NO: 75797 - DNA, 25 bp, mus musculus
ctggccggaccgcactccatcttgg

SEQ ID NO: 75798 - DNA, 25 bp, mus musculus
ggtggcaaccaggccagcctgcaga

SEQ ID NO: 75799 - DNA, 25 bp, mus musculus
gccagcctgcagaacggcaatgcag

SEQ ID NO: 75800 - DNA, 25 bp, mus musculus
aacggcaatgcaggtcgccggctcg

SEQ ID NO: 75801 - DNA, 25 bp, mus musculus
ccgccgctgcacgcatagatgtctc

SEQ ID NO: 75802 - DNA, 25 bp, mus musculus
ccgctgcacgcatagatgtctccag

SEQ ID NO: 75803 - DNA, 25 bp, mus musculus
cagccgcagatcaccggcttggttc

SEQ ID NO: 75804 - DNA, 25 bp, mus musculus
acgcatagatgtctccaggcgcccc

SEQ ID NO: 75805 - DNA, 25 bp, mus musculus
ggctccaggcttgaggcctatttca

SEQ ID NO: 75806 - DNA, 25 bp, mus musculus
aggcttgaggcctatttcagtctgg

SEQ ID NO: 75807 - DNA, 25 bp, mus musculus
ttcccagctgagcagaacgcctcca

SEQ ID NO: 75808 - DNA, 25 bp, mus musculus
gctgagcagaacgcctccaaccgtg

SEQ ID NO: 75809 - DNA, 25 bp, mus musculus
gccatccacgtgcatgagttcgggg

SEQ ID NO: 75810 - DNA, 25 bp, mus musculus
cacgtgcatgagttcggggacctga

SEQ ID NO: 75811 - DNA, 25 bp, mus musculus
gacctgagccagggctgcgattcca

SEQ ID NO: 75812 - DNA, 25 bp, mus musculus
actctctaaaagcagagggtgacat

SEQ ID NO: 75813 - DNA, 25 bp, mus musculus
ttaagtctcatctcatccgtctgat

SEQ ID NO: 75814 - DNA, 25 bp, mus musculus
aatctcactgaagacaacagccaaa

SEQ ID NO: 75815 - DNA, 25 bp, mus musculus
agccaaaaccaagatgtcattgcca

SEQ ID NO: 75816 - DNA, 25 bp, mus musculus
gatgtcattgccaagatggaggagc

SEQ ID NO: 75817 - DNA, 25 bp, mus musculus
ttggcagacgcatccctactgaaga

SEQ ID NO: 75818 - DNA, 25 bp, mus musculus
gacgcatccctactgaagaaaatgg

SEQ ID NO: 75819 - DNA, 25 bp, mus musculus
cgccttgaatgccatcttcatatga

SEQ ID NO: 75820 - DNA, 25 bp, mus musculus
cttgaatgccatcttcatatgaaca

SEQ ID NO: 75821 - DNA, 25 bp, mus musculus
gaatgccatcttcatatgaacacat

SEQ ID NO: 75822 - DNA, 25 bp, mus musculus
catcttcatatgaacacattcagat

SEQ ID NO: 75823 - DNA, 25 bp, mus musculus
cttcatatgaacacattcagattcc

SEQ ID NO: 75824 - DNA, 25 bp, mus musculus
agtctcatctcatccgtctgattgg

SEQ ID NO: 75825 - DNA, 25 bp, mus musculus
acacattcagattccatctcacgga

SEQ ID NO: 75826 - DNA, 25 bp, mus musculus
tcatccgtctgattggaaatctgtg

SEQ ID NO: 75827 - DNA, 25 bp, mus musculus
agctggatggcattcctctgatcct

SEQ ID NO: 75828 - DNA, 25 bp, mus musculus
atggcattcctctgatcctggacag

SEQ ID NO: 75829 - DNA, 25 bp, mus musculus
ctctgatcctggacagcagcaacat

SEQ ID NO: 75830 - DNA, 25 bp, mus musculus
acagcagcaacatcgatggacaaca

SEQ ID NO: 75831 - DNA, 25 bp, mus musculus
atggacaacaacccctttatgatgc

SEQ ID NO: 75832 - DNA, 25 bp, mus musculus
cgaaatctcactgaagacaacagcc

SEQ ID NO: 75833 - DNA, 25 bp, mus musculus
ttttctcagttctcaggctacagag

SEQ ID NO: 75834 - DNA, 25 bp, mus musculus
tctcagttctcaggctacagagaga

SEQ ID NO: 75835 - DNA, 25 bp, mus musculus
tcatatctgcaagctcatcagagaa

SEQ ID NO: 75836 - DNA, 25 bp, mus musculus
tatctgcaagctcatcagagaatcc

SEQ ID NO: 75837 - DNA, 25 bp, mus musculus
ctgcaagctcatcagagaatccaca

SEQ ID NO: 75838 - DNA, 25 bp, mus musculus
ggcaagtcctttactcatggctact

SEQ ID NO: 75839 - DNA, 25 bp, mus musculus
aagtcctttactcatggctactctc

SEQ ID NO: 75840 - DNA, 25 bp, mus musculus
tcctttactcatggctactctcttc

SEQ ID NO: 75841 - DNA, 25 bp, mus musculus
tttactcatggctactctcttcaaa

SEQ ID NO: 75842 - DNA, 25 bp, mus musculus
actcatggctactctcttcaaattc

SEQ ID NO: 75843 - DNA, 25 bp, mus musculus
catggctactctcttcaaattcatc

SEQ ID NO: 75844 - DNA, 25 bp, mus musculus
ggctactctcttcaaattcatctaa

SEQ ID NO: 75845 - DNA, 25 bp, mus musculus
cagttctcaggctacagagagaatt

SEQ ID NO: 75846 - DNA, 25 bp, mus musculus
ttctcaggctacagagagaattata

SEQ ID NO: 75847 - DNA, 25 bp, mus musculus
aattatacaatccatactggagaaa

SEQ ID NO: 75848 - DNA, 25 bp, mus musculus
tatacaatccatactggagaaaaac

SEQ ID NO: 75849 - DNA, 25 bp, mus musculus
tcttttactacaggttcatatctgc

SEQ ID NO: 75850 - DNA, 25 bp, mus musculus
tttactacaggttcatatctgcaag

SEQ ID NO: 75851 - DNA, 25 bp, mus musculus
actacaggttcatatctgcaagctc

SEQ ID NO: 75852 - DNA, 25 bp, mus musculus
ggttcatatctgcaagctcatcaga

SEQ ID NO: 75853 - DNA, 25 bp, mus musculus
cagcactgtggctcacgggtgccat

SEQ ID NO: 75854 - DNA, 25 bp, mus musculus
tgtggctcacgggtgccatactttt

SEQ ID NO: 75855 - DNA, 25 bp, mus musculus
tccgatacaaaattctcatgcttat

SEQ ID NO: 75856 - DNA, 25 bp, mus musculus
tgcttatctgttagcatacattgtt

SEQ ID NO: 75857 - DNA, 25 bp, mus musculus
tctaatgatctgctatagaggatag

SEQ ID NO: 75858 - DNA, 25 bp, mus musculus
agaattcaacaccaagaaccatgta

SEQ ID NO: 75859 - DNA, 25 bp, mus musculus
caacaccaagaaccatgtaaccgag

SEQ ID NO: 75860 - DNA, 25 bp, mus musculus
aaccgagacacttgatctgacacag

SEQ ID NO: 75861 - DNA, 25 bp, mus musculus
gacacttgatctgacacaggggcag

SEQ ID NO: 75862 - DNA, 25 bp, mus musculus
tgatctgacacaggggcagtcggga

SEQ ID NO: 75863 - DNA, 25 bp, mus musculus
atgactgcagtaatcaccactgtac

SEQ ID NO: 75864 - DNA, 25 bp, mus musculus
aatgcacacttccgatttcctgtca

SEQ ID NO: 75865 - DNA, 25 bp, mus musculus
tcacgggtgccatacttttctctag

SEQ ID NO: 75866 - DNA, 25 bp, mus musculus
tacttttctctagttttacaatgag

SEQ ID NO: 75867 - DNA, 25 bp, mus musculus
tccatctctgtgtattgaggggtaa

SEQ ID NO: 75868 - DNA, 25 bp, mus musculus
agagtctccaggggtccttcagagt

SEQ ID NO: 75869 - DNA, 25 bp, mus musculus
tccaggggtccttcagagtgtacgg

SEQ ID NO: 75870 - DNA, 25 bp, mus musculus
ggtccttcagagtgtacgggtacag

SEQ ID NO: 75871 - DNA, 25 bp, mus musculus
ggtacaggactctccgatacaaaat

SEQ ID NO: 75872 - DNA, 25 bp, mus musculus
ggactctccgatacaaaattctcat

SEQ ID NO: 75873 - DNA, 25 bp, mus musculus
atagtctggtctacacactctgagt

SEQ ID NO: 75874 - DNA, 25 bp, mus musculus
gtctggtctacacactctgagttct

SEQ ID NO: 75875 - DNA, 25 bp, mus musculus
gatgttcgaaactcacacaagtacc

SEQ ID NO: 75876 - DNA, 25 bp, mus musculus
atgttcgaaactcacacaagtaccg

SEQ ID NO: 75877 - DNA, 25 bp, mus musculus
ttcgaaactcacacaagtaccgcat

SEQ ID NO: 75878 - DNA, 25 bp, mus musculus
tgtaatcttagccgatgtagctcag

SEQ ID NO: 75879 - DNA, 25 bp, mus musculus
gtaatcttagccgatgtagctcagc

SEQ ID NO: 75880 - DNA, 25 bp, mus musculus
taatcttagccgatgtagctcagct

SEQ ID NO: 75881 - DNA, 25 bp, mus musculus
atcttagccgatgtagctcagctag

SEQ ID NO: 75882 - DNA, 25 bp, mus musculus
cttagccgatgtagctcagctagac

SEQ ID NO: 75883 - DNA, 25 bp, mus musculus
tagccgatgtagctcagctagacca

SEQ ID NO: 75884 - DNA, 25 bp, mus musculus
agccgatgtagctcagctagaccaa

SEQ ID NO: 75885 - DNA, 25 bp, mus musculus
tctggtctacacactctgagttctc

SEQ ID NO: 75886 - DNA, 25 bp, mus musculus
ctggtctacacactctgagttctct

SEQ ID NO: 75887 - DNA, 25 bp, mus musculus
tctacacactctgagttctctcagc

SEQ ID NO: 75888 - DNA, 25 bp, mus musculus
tgagttctctcagcgatctggcagt

SEQ ID NO: 75889 - DNA, 25 bp, mus musculus
gagttctctcagcgatctggcagta

SEQ ID NO: 75890 - DNA, 25 bp, mus musculus
tctcagcgatctggcagtaacctca

SEQ ID NO: 75891 - DNA, 25 bp, mus musculus
ctcagcgatctggcagtaacctcat

SEQ ID NO: 75892 - DNA, 25 bp, mus musculus
agatgttcgaaactcacacaagtac

SEQ ID NO: 75893 - DNA, 25 bp, mus musculus
tgcccaccgtgttcgagaactatgt

SEQ ID NO: 75894 - DNA, 25 bp, mus musculus
ccaccgtgttcgagaactatgtggc

SEQ ID NO: 75895 - DNA, 25 bp, mus musculus
ctctcgagaacatccccgagaagtg

SEQ ID NO: 75896 - DNA, 25 bp, mus musculus
tcgagaacatccccgagaagtgggt

SEQ ID NO: 75897 - DNA, 25 bp, mus musculus
gctacggatcccagaatggctgcat

SEQ ID NO: 75898 - DNA, 25 bp, mus musculus
acggatcccagaatggctgcatcaa

SEQ ID NO: 75899 - DNA, 25 bp, mus musculus
gatcccagaatggctgcatcaactg

SEQ ID NO: 75900 - DNA, 25 bp, mus musculus
atggctgcatcaactgctgcaaggt

SEQ ID NO: 75901 - DNA, 25 bp, mus musculus
gctgcatcaactgctgcaaggtgct

SEQ ID NO: 75902 - DNA, 25 bp, mus musculus
gcatcaactgctgcaaggtgctatg

SEQ ID NO: 75903 - DNA, 25 bp, mus musculus
tcaactgctgcaaggtgctatgagg

SEQ ID NO: 75904 - DNA, 25 bp, mus musculus
actgctgcaaggtgctatgagggac

SEQ ID NO: 75905 - DNA, 25 bp, mus musculus
actatgtggcggacatcgaggtgga

SEQ ID NO: 75906 - DNA, 25 bp, mus musculus
tccttatgtgcttctcggtggacag

SEQ ID NO: 75907 - DNA, 25 bp, mus musculus
ttatgtgcttctcggtggacagccc

SEQ ID NO: 75908 - DNA, 25 bp, mus musculus
tgtgcttctcggtggacagcccgga

SEQ ID NO: 75909 - DNA, 25 bp, mus musculus
gcttctcggtggacagcccggactc

SEQ ID NO: 75910 - DNA, 25 bp, mus musculus
tctcggtggacagcccggactctct

SEQ ID NO: 75911 - DNA, 25 bp, mus musculus
tggacagcccggactctctcgagaa

SEQ ID NO: 75912 - DNA, 25 bp, mus musculus
actctctcgagaacatccccgagaa

SEQ ID NO: 75913 - DNA, 25 bp, mus musculus
tcttcatctaataagccttggttca

SEQ ID NO: 75914 - DNA, 25 bp, mus musculus
tcatctaataagccttggttcaagg

SEQ ID NO: 75915 - DNA, 25 bp, mus musculus
tgtctctgtagtaagctcttgacac

SEQ ID NO: 75916 - DNA, 25 bp, mus musculus
taagctcttgacacaatccatctct

SEQ ID NO: 75917 - DNA, 25 bp, mus musculus
aagctcttgacacaatccatctctt

SEQ ID NO: 75918 - DNA, 25 bp, mus musculus
ctcttgacacaatccatctcttttg

SEQ ID NO: 75919 - DNA, 25 bp, mus musculus
ttgacacaatccatctcttttgtcg

SEQ ID NO: 75920 - DNA, 25 bp, mus musculus
gacacaatccatctcttttgtcgtc

SEQ ID NO: 75921 - DNA, 25 bp, mus musculus
acacaatccatctcttttgtcgtcc

SEQ ID NO: 75922 - DNA, 25 bp, mus musculus
acaatccatctcttttgtcgtcctt

SEQ ID NO: 75923 - DNA, 25 bp, mus musculus
atccatctcttttgtcgtccttctg

SEQ ID NO: 75924 - DNA, 25 bp, mus musculus
tccatctcttttgtcgtccttctga

SEQ ID NO: 75925 - DNA, 25 bp, mus musculus
catctaataagccttggttcaaggg

SEQ ID NO: 75926 - DNA, 25 bp, mus musculus
ccatctcttttgtcgtccttctgat

SEQ ID NO: 75927 - DNA, 25 bp, mus musculus
gaaattctagcgtcgtgtctctgta

SEQ ID NO: 75928 - DNA, 25 bp, mus musculus
aattctagcgtcgtgtctctgtagt

SEQ ID NO: 75929 - DNA, 25 bp, mus musculus
attctagcgtcgtgtctctgtagta

SEQ ID NO: 75930 - DNA, 25 bp, mus musculus
tctagcgtcgtgtctctgtagtaag

SEQ ID NO: 75931 - DNA, 25 bp, mus musculus
ctagcgtcgtgtctctgtagtaagc

SEQ ID NO: 75932 - DNA, 25 bp, mus musculus
agcgtcgtgtctctgtagtaagctc

SEQ ID NO: 75933 - DNA, 25 bp, mus musculus
tcgtgtctctgtagtaagctcttga

SEQ ID NO: 75934 - DNA, 25 bp, mus musculus
ggcagcaacacgatacggtgcctgg

SEQ ID NO: 75935 - DNA, 25 bp, mus musculus
cagcaacacgatacggtgcctggct

SEQ ID NO: 75936 - DNA, 25 bp, mus musculus
tgacagcccactgaagagagaggag

SEQ ID NO: 75937 - DNA, 25 bp, mus musculus
aggagatcccctggaagactctgat

SEQ ID NO: 75938 - DNA, 25 bp, mus musculus
gagatcccctggaagactctgataa

SEQ ID NO: 75939 - DNA, 25 bp, mus musculus
gatcccctggaagactctgataact

SEQ ID NO: 75940 - DNA, 25 bp, mus musculus
atcaaagtcgagacaacctgacttt

SEQ ID NO: 75941 - DNA, 25 bp, mus musculus
cgagacaacctgactttcgtcggct

SEQ ID NO: 75942 - DNA, 25 bp, mus musculus
actttcgtcggcttttggagcatgc

SEQ ID NO: 75943 - DNA, 25 bp, mus musculus
tttcgtcggcttttggagcatgcga

SEQ ID NO: 75944 - DNA, 25 bp, mus musculus
tcgtcggcttttggagcatgcgaga

SEQ ID NO: 75945 - DNA, 25 bp, mus musculus
cggcttttggagcatgcgagatcca

SEQ ID NO: 75946 - DNA, 25 bp, mus musculus
atacggtgcctggctgtggctactc

SEQ ID NO: 75947 - DNA, 25 bp, mus musculus
tgcctggctgtggctactcatgaca

SEQ ID NO: 75948 - DNA, 25 bp, mus musculus
cctggctgtggctactcatgacagc

SEQ ID NO: 75949 - DNA, 25 bp, mus musculus
tgtggctactcatgacagcccactg

SEQ ID NO: 75950 - DNA, 25 bp, mus musculus
tggctactcatgacagcccactgaa

SEQ ID NO: 75951 - DNA, 25 bp, mus musculus
gctactcatgacagcccactgaaga

SEQ ID NO: 75952 - DNA, 25 bp, mus musculus
tactcatgacagcccactgaagaga

SEQ ID NO: 75953 - DNA, 25 bp, mus musculus
catgacagcccactgaagagagagg

SEQ ID NO: 75954 - DNA, 25 bp, mus musculus
ttctaagagcgtgacctcctaagtc

SEQ ID NO: 75955 - DNA, 25 bp, mus musculus
gagcgtgacctcctaagtctcacaa

SEQ ID NO: 75956 - DNA, 25 bp, mus musculus
tcccaaggcatgcaaggtctgtgag

SEQ ID NO: 75957 - DNA, 25 bp, mus musculus
tttgagtgttggtgctcagggtcat

SEQ ID NO: 75958 - DNA, 25 bp, mus musculus
tgttggtgctcagggtcatacttcc

SEQ ID NO: 75959 - DNA, 25 bp, mus musculus
gggtcatacttccttgtcagacaat

SEQ ID NO: 75960 - DNA, 25 bp, mus musculus
agacaatgtcactctgagaaggagg

SEQ ID NO: 75961 - DNA, 25 bp, mus musculus
gccagctttggccatcacaccttat

SEQ ID NO: 75962 - DNA, 25 bp, mus musculus
tttggccatcacaccttatgcacac

SEQ ID NO: 75963 - DNA, 25 bp, mus musculus
catcacaccttatgcacacaagttc

SEQ ID NO: 75964 - DNA, 25 bp, mus musculus
tgcacacaagttctgaagagtttgt

SEQ ID NO: 75965 - DNA, 25 bp, mus musculus
ctactgctgcatgagatactgtgaa

SEQ ID NO: 75966 - DNA, 25 bp, mus musculus
ctaagtctcacaaggaatcagagaa

SEQ ID NO: 75967 - DNA, 25 bp, mus musculus
ttcagctacttgtggttattgctca

SEQ ID NO: 75968 - DNA, 25 bp, mus musculus
actagacagtgttctctgaagaaca

SEQ ID NO: 75969 - DNA, 25 bp, mus musculus
actgtgcaccacaatgcctgcctga

SEQ ID NO: 75970 - DNA, 25 bp, mus musculus
tttagcttctttatatcgagtcact

SEQ ID NO: 75971 - DNA, 25 bp, mus musculus
ttctttatatcgagtcactccctac

SEQ ID NO: 75972 - DNA, 25 bp, mus musculus
atatcgagtcactccctactgcatt

SEQ ID NO: 75973 - DNA, 25 bp, mus musculus
agcctgtttccatgcacttgtacac

SEQ ID NO: 75974 - DNA, 25 bp, mus musculus
tttccatgcacttgtacacatttaa

SEQ ID NO: 75975 - DNA, 25 bp, mus musculus
caaactgaaagcctgacgtgacgtg

SEQ ID NO: 75976 - DNA, 25 bp, mus musculus
actgaaagcctgacgtgacgtgagt

SEQ ID NO: 75977 - DNA, 25 bp, mus musculus
tatggacatcctcctgttggaaatc

SEQ ID NO: 75978 - DNA, 25 bp, mus musculus
ggacatcctcctgttggaaatccga

SEQ ID NO: 75979 - DNA, 25 bp, mus musculus
acatcctcctgttggaaatccgaga

SEQ ID NO: 75980 - DNA, 25 bp, mus musculus
catcctcctgttggaaatccgagac

SEQ ID NO: 75981 - DNA, 25 bp, mus musculus
tcctcctgttggaaatccgagacca

SEQ ID NO: 75982 - DNA, 25 bp, mus musculus
cctcctgttggaaatccgagaccag

SEQ ID NO: 75983 - DNA, 25 bp, mus musculus
tggaaatccgagaccagcaaattac

SEQ ID NO: 75984 - DNA, 25 bp, mus musculus
ggaaatccgagaccagcaaattact

SEQ ID NO: 75985 - DNA, 25 bp, mus musculus
aaatccgagaccagcaaattactat

SEQ ID NO: 75986 - DNA, 25 bp, mus musculus
aatccgagaccagcaaattactatg

SEQ ID NO: 75987 - DNA, 25 bp, mus musculus
ctgaaagcctgacgtgacgtgagta

SEQ ID NO: 75988 - DNA, 25 bp, mus musculus
atccgagaccagcaaattactatgt

SEQ ID NO: 75989 - DNA, 25 bp, mus musculus
aaagcctgacgtgacgtgagtatca

SEQ ID NO: 75990 - DNA, 25 bp, mus musculus
agcctgacgtgacgtgagtatcacc

SEQ ID NO: 75991 - DNA, 25 bp, mus musculus
gagtatcacctatggacatcctcct

SEQ ID NO: 75992 - DNA, 25 bp, mus musculus
agtatcacctatggacatcctcctg

SEQ ID NO: 75993 - DNA, 25 bp, mus musculus
atcacctatggacatcctcctgttg

SEQ ID NO: 75994 - DNA, 25 bp, mus musculus
cacctatggacatcctcctgttgga

SEQ ID NO: 75995 - DNA, 25 bp, mus musculus
ctatggacatcctcctgttggaaat

SEQ ID NO: 75996 - DNA, 25 bp, mus musculus
tcactttagtcgatacatcaccatc

SEQ ID NO: 75997 - DNA, 25 bp, mus musculus
ctttagtcgatacatcaccatcagg

SEQ ID NO: 75998 - DNA, 25 bp, mus musculus
tttaaactccactgtcacccagtga

SEQ ID NO: 75999 - DNA, 25 bp, mus musculus
ggcggcacagcaatcccaggctgag

SEQ ID NO: 76000 - DNA, 25 bp, mus musculus
ggcacagcaatcccaggctgagcca

SEQ ID NO: 76001 - DNA, 25 bp, mus musculus
gcaatcccaggctgagccatgagga

SEQ ID NO: 76002 - DNA, 25 bp, mus musculus
gacgctgcgagaatcctcagaagag

SEQ ID NO: 76003 - DNA, 25 bp, mus musculus
cctacccacgaacagcatctactga

SEQ ID NO: 76004 - DNA, 25 bp, mus musculus
gaacagcatctactgatggagattg

SEQ ID NO: 76005 - DNA, 25 bp, mus musculus
ttatggacctcaggggaagacatgg

SEQ ID NO: 76006 - DNA, 25 bp, mus musculus
actcttcctgccagcaacgacaaac

SEQ ID NO: 76007 - DNA, 25 bp, mus musculus
cttcctgccagcaacgacaaacgaa

SEQ ID NO: 76008 - DNA, 25 bp, mus musculus
atacatcaccatcaggaggaaaagt

SEQ ID NO: 76009 - DNA, 25 bp, mus musculus
ccagcaacgacaaacgaagtgattc

SEQ ID NO: 76010 - DNA, 25 bp, mus musculus
catcaccatcaggaggaaaagtgag

SEQ ID NO: 76011 - DNA, 25 bp, mus musculus
tgagctggctgccacacttgggctc

SEQ ID NO: 76012 - DNA, 25 bp, mus musculus
tgccacacttgggctctccgagagg

SEQ ID NO: 76013 - DNA, 25 bp, mus musculus
cacacttgggctctccgagaggcag

SEQ ID NO: 76014 - DNA, 25 bp, mus musculus
cttgagtcctgtgacctccttgcaa

SEQ ID NO: 76015 - DNA, 25 bp, mus musculus
gagtcctgtgacctccttgcaaggc

SEQ ID NO: 76016 - DNA, 25 bp, mus musculus
cttgcaaggctcagtgcctggttct

SEQ ID NO: 76017 - DNA, 25 bp, mus musculus
ccggttcaggtctctccactcatca

SEQ ID NO: 76018 - DNA, 25 bp, mus musculus
cggttcaggtctctccactcatcaa

SEQ ID NO: 76019 - DNA, 25 bp, mus musculus
agcattctcaagtgaggcgtcacga

SEQ ID NO: 76020 - DNA, 25 bp, mus musculus
gcattctcaagtgaggcgtcacgag

SEQ ID NO: 76021 - DNA, 25 bp, mus musculus
cattctcaagtgaggcgtcacgagc

SEQ ID NO: 76022 - DNA, 25 bp, mus musculus
attctcaagtgaggcgtcacgagct

SEQ ID NO: 76023 - DNA, 25 bp, mus musculus
ttctcaagtgaggcgtcacgagctt

SEQ ID NO: 76024 - DNA, 25 bp, mus musculus
tctcaagtgaggcgtcacgagcttg

SEQ ID NO: 76025 - DNA, 25 bp, mus musculus
gcttgcttttctctagtcgttgaga

SEQ ID NO: 76026 - DNA, 25 bp, mus musculus
gcttttctctagtcgttgagaacga

SEQ ID NO: 76027 - DNA, 25 bp, mus musculus
ttttctctagtcgttgagaacgaat

SEQ ID NO: 76028 - DNA, 25 bp, mus musculus
aagatgacagcattctcaagtgagg

SEQ ID NO: 76029 - DNA, 25 bp, mus musculus
agatgacagcattctcaagtgaggc

SEQ ID NO: 76030 - DNA, 25 bp, mus musculus
gatgacagcattctcaagtgaggcg

SEQ ID NO: 76031 - DNA, 25 bp, mus musculus
atgacagcattctcaagtgaggcgt

SEQ ID NO: 76032 - DNA, 25 bp, mus musculus
tgacagcattctcaagtgaggcgtc

SEQ ID NO: 76033 - DNA, 25 bp, mus musculus
gacagcattctcaagtgaggcgtca

SEQ ID NO: 76034 - DNA, 25 bp, mus musculus
acagcattctcaagtgaggcgtcac

SEQ ID NO: 76035 - DNA, 25 bp, mus musculus
cagcattctcaagtgaggcgtcacg

SEQ ID NO: 76036 - DNA, 25 bp, mus musculus
agattcctacagatctataagcatg

SEQ ID NO: 76037 - DNA, 25 bp, mus musculus
ccaggcttcagaactcacaggacag

SEQ ID NO: 76038 - DNA, 25 bp, mus musculus
gtatagccgtgtttgctgagtaacc

SEQ ID NO: 76039 - DNA, 25 bp, mus musculus
cgccgttgaggctatctgaagtgta

SEQ ID NO: 76040 - DNA, 25 bp, mus musculus
aacgaatcattggccggttatagca

SEQ ID NO: 76041 - DNA, 25 bp, mus musculus
tcattggccggttatagcaatagtt

SEQ ID NO: 76042 - DNA, 25 bp, mus musculus
gaacttcgacttactgttgttatag

SEQ ID NO: 76043 - DNA, 25 bp, mus musculus
tataaatcacagcttctagctaggc

SEQ ID NO: 76044 - DNA, 25 bp, mus musculus
tcacagcttctagctaggccaaaac

SEQ ID NO: 76045 - DNA, 25 bp, mus musculus
gctaggccaaaacacttactctact

SEQ ID NO: 76046 - DNA, 25 bp, mus musculus
ccaaaacacttactctactgatctt

SEQ ID NO: 76047 - DNA, 25 bp, mus musculus
cacttactctactgatcttcaaaat

SEQ ID NO: 76048 - DNA, 25 bp, mus musculus
ttcagaactcacaggacaggattcg

SEQ ID NO: 76049 - DNA, 25 bp, mus musculus
acactgcgagctgtggagcacactt

SEQ ID NO: 76050 - DNA, 25 bp, mus musculus
tggtcagaggcgctcccgagcaagc

SEQ ID NO: 76051 - DNA, 25 bp, mus musculus
cgggcatcattctcccttagatcct

SEQ ID NO: 76052 - DNA, 25 bp, mus musculus
tcattctcccttagatcctagtgtg

SEQ ID NO: 76053 - DNA, 25 bp, mus musculus
ctgggcaaagctccaagcctcactg

SEQ ID NO: 76054 - DNA, 25 bp, mus musculus
aaagctccaagcctcactgccttgc

SEQ ID NO: 76055 - DNA, 25 bp, mus musculus
ctaattaacctcggcctactcaatg

SEQ ID NO: 76056 - DNA, 25 bp, mus musculus
caacgatcctagcagttgtggggaa

SEQ ID NO: 76057 - DNA, 25 bp, mus musculus
tcctagcagttgtggggaagatagg

SEQ ID NO: 76058 - DNA, 25 bp, mus musculus
ggatctccagggctccattcaggga

SEQ ID NO: 76059 - DNA, 25 bp, mus musculus
ggagagacttctcccagttggagga

SEQ ID NO: 76060 - DNA, 25 bp, mus musculus
agatgccaaagctgtgggctgtaag

SEQ ID NO: 76061 - DNA, 25 bp, mus musculus
caaagctgtgggctgtaaggcagtt

SEQ ID NO: 76062 - DNA, 25 bp, mus musculus
ctcttaagaggtgctgccctgaagc

SEQ ID NO: 76063 - DNA, 25 bp, mus musculus
atcagcatcagcactactggggctc

SEQ ID NO: 76064 - DNA, 25 bp, mus musculus
actactggggctcagggcaactggc

SEQ ID NO: 76065 - DNA, 25 bp, mus musculus
cagggcaactggctcccctggctat

SEQ ID NO: 76066 - DNA, 25 bp, mus musculus
ccacagtcatgacacagggctcttg

SEQ ID NO: 76067 - DNA, 25 bp, mus musculus
gctcttgtggagccctgggcaagga

SEQ ID NO: 76068 - DNA, 25 bp, mus musculus
taacttctgacacctgtacctcaga

SEQ ID NO: 76069 - DNA, 25 bp, mus musculus
ctgacacctgtacctcagatctgtt

SEQ ID NO: 76070 - DNA, 25 bp, mus musculus
atctgttcatcctactcacagccat

SEQ ID NO: 76071 - DNA, 25 bp, mus musculus
cagactgggccacggtcctgatctc

SEQ ID NO: 76072 - DNA, 25 bp, mus musculus
gggccacggtcctgatctctggggt

SEQ ID NO: 76073 - DNA, 25 bp, mus musculus
tttgttctatggaagtgtggtagac

SEQ ID NO: 76074 - DNA, 25 bp, mus musculus
tcatcctggagctcctttggatctc

SEQ ID NO: 76075 - DNA, 25 bp, mus musculus
tcctttggatctccagggctccatt

SEQ ID NO: 76076 - DNA, 25 bp, mus musculus
tatctgtgctggaggccctgggaga

SEQ ID NO: 76077 - DNA, 25 bp, mus musculus
agttcatcaagtgcctgcactctgt

SEQ ID NO: 76078 - DNA, 25 bp, mus musculus
gagagatcatctcctttggaagcgg

SEQ ID NO: 76079 - DNA, 25 bp, mus musculus
agatcatctcctttggaagcggata

SEQ ID NO: 76080 - DNA, 25 bp, mus musculus
tcatctcctttggaagcggatatgg

SEQ ID NO: 76081 - DNA, 25 bp, mus musculus
ggaactcactatcgggaagaaatgc

SEQ ID NO: 76082 - DNA, 25 bp, mus musculus
actcactatcgggaagaaatgcttt

SEQ ID NO: 76083 - DNA, 25 bp, mus musculus
gaaatgctttgcgttgcggatcgcc

SEQ ID NO: 76084 - DNA, 25 bp, mus musculus
ctttgcgttgcggatcgccagccgt

SEQ ID NO: 76085 - DNA, 25 bp, mus musculus
ggacgatatgctgatcctgggcata

SEQ ID NO: 76086 - DNA, 25 bp, mus musculus
cgatatgctgatcctgggcataact

SEQ ID NO: 76087 - DNA, 25 bp, mus musculus
gctgatcctgggcataactaacccc

SEQ ID NO: 76088 - DNA, 25 bp, mus musculus
ctttggtcaacaactgggcctgcaa

SEQ ID NO: 76089 - DNA, 25 bp, mus musculus
tggtcaacaactgggcctgcaaccc

SEQ ID NO: 76090 - DNA, 25 bp, mus musculus
tcaacaactgggcctgcaaccctga

SEQ ID NO: 76091 - DNA, 25 bp, mus musculus
acaactgggcctgcaaccctgagct

SEQ ID NO: 76092 - DNA, 25 bp, mus musculus
gggcctgcaaccctgagctgaccct

SEQ ID NO: 76093 - DNA, 25 bp, mus musculus
cctgcaaccctgagctgaccctgat

SEQ ID NO: 76094 - DNA, 25 bp, mus musculus
gcaaccctgagctgaccctgatcgc

SEQ ID NO: 76095 - DNA, 25 bp, mus musculus
tcccggaccgcagagagatcatctc

SEQ ID NO: 76096 - DNA, 25 bp, mus musculus
agcacaggctgccgcagctcagtac

SEQ ID NO: 76097 - DNA, 25 bp, mus musculus
acaggctgccgcagctcagtacacc

SEQ ID NO: 76098 - DNA, 25 bp, mus musculus
gcaatttacacagctggctggaccc

SEQ ID NO: 76099 - DNA, 25 bp, mus musculus
atttacacagctggctggacccgac

SEQ ID NO: 76100 - DNA, 25 bp, mus musculus
tacacagctggctggacccgacatg

SEQ ID NO: 76101 - DNA, 25 bp, mus musculus
tgctactgacctgatgaatattctc

SEQ ID NO: 76102 - DNA, 25 bp, mus musculus
gaatattctcaacaaagtcctttct

SEQ ID NO: 76103 - DNA, 25 bp, mus musculus
tctcaacaaagtcctttctaagcat

SEQ ID NO: 76104 - DNA, 25 bp, mus musculus
caaagtcctttctaagcataaagag

SEQ ID NO: 76105 - DNA, 25 bp, mus musculus
cagctttgatacctgtaggagcatt

SEQ ID NO: 76106 - DNA, 25 bp, mus musculus
ctttgatacctgtaggagcattgtg

SEQ ID NO: 76107 - DNA, 25 bp, mus musculus
tgatacctgtaggagcattgtgtct

SEQ ID NO: 76108 - DNA, 25 bp, mus musculus
tccccaacagcagcattttaccgtc

SEQ ID NO: 76109 - DNA, 25 bp, mus musculus
acagcagcattttaccgtcgtggag

SEQ ID NO: 76110 - DNA, 25 bp, mus musculus
gcagcattttaccgtcgtggaggcc

SEQ ID NO: 76111 - DNA, 25 bp, mus musculus
gcattttaccgtcgtggaggcctca

SEQ ID NO: 76112 - DNA, 25 bp, mus musculus
taccgtcgtggaggcctcagaaagt

SEQ ID NO: 76113 - DNA, 25 bp, mus musculus
agtcagacgttttcggcagcaattt

SEQ ID NO: 76114 - DNA, 25 bp, mus musculus
acgttttcggcagcaatttacacag

SEQ ID NO: 76115 - DNA, 25 bp, mus musculus
ttttcggcagcaatttacacagctg

SEQ ID NO: 76116 - DNA, 25 bp, mus musculus
gttctccctctcagatgccaactgc

SEQ ID NO: 76117 - DNA, 25 bp, mus musculus
agatgccaactgcctgctccaaggg

SEQ ID NO: 76118 - DNA, 25 bp, mus musculus
gttctttgctgacctcccttgcaga

SEQ ID NO: 76119 - DNA, 25 bp, mus musculus
gcaagttccttgcagttatgcagta

SEQ ID NO: 76120 - DNA, 25 bp, mus musculus
tccttgcagttatgcagtaggcggt

SEQ ID NO: 76121 - DNA, 25 bp, mus musculus
aggaggaccacaaacacaaagactg

SEQ ID NO: 76122 - DNA, 25 bp, mus musculus
tattttagcaatctcatctcacctg

SEQ ID NO: 76123 - DNA, 25 bp, mus musculus
agcaatctcatctcacctgattggg

SEQ ID NO: 76124 - DNA, 25 bp, mus musculus
ctcatctcacctgattgggatgtgt

SEQ ID NO: 76125 - DNA, 25 bp, mus musculus
tcacctgattgggatgtgtctcaag

SEQ ID NO: 76126 - DNA, 25 bp, mus musculus
gtgtctcaagtatattccttttatg

SEQ ID NO: 76127 - DNA, 25 bp, mus musculus
tctcaagtatattccttttatggaa

SEQ ID NO: 76128 - DNA, 25 bp, mus musculus
cctgctccaagggacatgcactgaa

SEQ ID NO: 76129 - DNA, 25 bp, mus musculus
gacatgcactgaaaactctgagtta

SEQ ID NO: 76130 - DNA, 25 bp, mus musculus
ggaccataccagcctaatgtcaggg

SEQ ID NO: 76131 - DNA, 25 bp, mus musculus
taccagcctaatgtcaggggccttg

SEQ ID NO: 76132 - DNA, 25 bp, mus musculus
ggccttgagcccaagtattattcag

SEQ ID NO: 76133 - DNA, 25 bp, mus musculus
tattcagaacctttcccacagctcc

SEQ ID NO: 76134 - DNA, 25 bp, mus musculus
ccatgggcaccaccaacatggctat

SEQ ID NO: 76135 - DNA, 25 bp, mus musculus
ccaacatggctatcggggatatgag

SEQ ID NO: 76136 - DNA, 25 bp, mus musculus
aacctgccgagtcaaagcagcacat

SEQ ID NO: 76137 - DNA, 25 bp, mus musculus
agtcaaagcagcacattttgacgtc

SEQ ID NO: 76138 - DNA, 25 bp, mus musculus
tgataaactccagggattccctgct

SEQ ID NO: 76139 - DNA, 25 bp, mus musculus
taaactccagggattccctgctcct

SEQ ID NO: 76140 - DNA, 25 bp, mus musculus
ccagggattccctgctcctggaagg

SEQ ID NO: 76141 - DNA, 25 bp, mus musculus
gggattccctgctcctggaaggagg

SEQ ID NO: 76142 - DNA, 25 bp, mus musculus
tcctacctgagttgttctaccctgt

SEQ ID NO: 76143 - DNA, 25 bp, mus musculus
ctgagttgttctaccctgttaacag

SEQ ID NO: 76144 - DNA, 25 bp, mus musculus
tgttctaccctgttaacagcacaga

SEQ ID NO: 76145 - DNA, 25 bp, mus musculus
tctaccctgttaacagcacagattc

SEQ ID NO: 76146 - DNA, 25 bp, mus musculus
accctgttaacagcacagattctac

SEQ ID NO: 76147 - DNA, 25 bp, mus musculus
ctgttaacagcacagattctaccag

SEQ ID NO: 76148 - DNA, 25 bp, mus musculus
caaagcagcacattttgacgtcgag

SEQ ID NO: 76149 - DNA, 25 bp, mus musculus
ttaacagcacagattctaccagtgg

SEQ ID NO: 76150 - DNA, 25 bp, mus musculus
tcgtctgttgcttggaatctatgaa

SEQ ID NO: 76151 - DNA, 25 bp, mus musculus
tctgttgcttggaatctatgaacat

SEQ ID NO: 76152 - DNA, 25 bp, mus musculus
aattaagacagacccagagctaaag

SEQ ID NO: 76153 - DNA, 25 bp, mus musculus
taagacagacccagagctaaagcta

SEQ ID NO: 76154 - DNA, 25 bp, mus musculus
gacagacccagagctaaagctaact

SEQ ID NO: 76155 - DNA, 25 bp, mus musculus
agacccagagctaaagctaactgat

SEQ ID NO: 76156 - DNA, 25 bp, mus musculus
gctaactgataaactccagggattc

SEQ ID NO: 76157 - DNA, 25 bp, mus musculus
ggccactacatcctgggggacacgc

SEQ ID NO: 76158 - DNA, 25 bp, mus musculus
cactacatcctgggggacacgcttg

SEQ ID NO: 76159 - DNA, 25 bp, mus musculus
cctcacatcatcaaactgtaccagg

SEQ ID NO: 76160 - DNA, 25 bp, mus musculus
cacatcatcaaactgtaccaggtca

SEQ ID NO: 76161 - DNA, 25 bp, mus musculus
atcaaactgtaccaggtcatcagta

SEQ ID NO: 76162 - DNA, 25 bp, mus musculus
aaactgtaccaggtcatcagtacac

SEQ ID NO: 76163 - DNA, 25 bp, mus musculus
ctgtaccaggtcatcagtacaccat

SEQ ID NO: 76164 - DNA, 25 bp, mus musculus
taccaggtcatcagtacaccatctg

SEQ ID NO: 76165 - DNA, 25 bp, mus musculus
gtcatcagtacaccatctgatattt

SEQ ID NO: 76166 - DNA, 25 bp, mus musculus
atcagtacaccatctgatattttca

SEQ ID NO: 76167 - DNA, 25 bp, mus musculus
agtacaccatctgatattttcatgg

SEQ ID NO: 76168 - DNA, 25 bp, mus musculus
tatgtctctggaggagagctatttg

SEQ ID NO: 76169 - DNA, 25 bp, mus musculus
atcctgggggacacgcttggtgtcg

SEQ ID NO: 76170 - DNA, 25 bp, mus musculus
gacacgcttggtgtcggcaccttcg

SEQ ID NO: 76171 - DNA, 25 bp, mus musculus
aagatactcaaccggcagaagattc

SEQ ID NO: 76172 - DNA, 25 bp, mus musculus
ctcaaccggcagaagattcggagcc

SEQ ID NO: 76173 - DNA, 25 bp, mus musculus
attcagaacctgaagctgttcaggc

SEQ ID NO: 76174 - DNA, 25 bp, mus musculus
aacctgaagctgttcaggcaccctc

SEQ ID NO: 76175 - DNA, 25 bp, mus musculus
aagctgttcaggcaccctcacatca

SEQ ID NO: 76176 - DNA, 25 bp, mus musculus
ctgttcaggcaccctcacatcatca

SEQ ID NO: 76177 - DNA, 25 bp, mus musculus
cttcatggcagcctggagcttactg

SEQ ID NO: 76178 - DNA, 25 bp, mus musculus
ggcagcctggagcttactgaactgc

SEQ ID NO: 76179 - DNA, 25 bp, mus musculus
atccccacaggccagcaagtagtag

SEQ ID NO: 76180 - DNA, 25 bp, mus musculus
cccacaggccagcaagtagtagaag

SEQ ID NO: 76181 - DNA, 25 bp, mus musculus
attgaaagtagcctcactggctggg

SEQ ID NO: 76182 - DNA, 25 bp, mus musculus
cacacgcagcttctccaggagcatt

SEQ ID NO: 76183 - DNA, 25 bp, mus musculus
acgcagcttctccaggagcattgtc

SEQ ID NO: 76184 - DNA, 25 bp, mus musculus
ctccaggagcattgtctggatggag

SEQ ID NO: 76185 - DNA, 25 bp, mus musculus
cattgtctggatggaggccgaagcc

SEQ ID NO: 76186 - DNA, 25 bp, mus musculus
ggccgaagccacctggccagcttgg

SEQ ID NO: 76187 - DNA, 25 bp, mus musculus
cacctggccagcttggtcaaagtcc

SEQ ID NO: 76188 - DNA, 25 bp, mus musculus
ctggccagcttggtcaaagtccagg

SEQ ID NO: 76189 - DNA, 25 bp, mus musculus
gagcttactgaactgctgtgcagcc

SEQ ID NO: 76190 - DNA, 25 bp, mus musculus
cttactgaactgctgtgcagccttc

SEQ ID NO: 76191 - DNA, 25 bp, mus musculus
ctgcttctcctcaggcttggacagt

SEQ ID NO: 76192 - DNA, 25 bp, mus musculus
ctcctcaggcttggacagtggcaca

SEQ ID NO: 76193 - DNA, 25 bp, mus musculus
ctcaggcttggacagtggcacaatt

SEQ ID NO: 76194 - DNA, 25 bp, mus musculus
cagtggcacaattccaaacacattg

SEQ ID NO: 76195 - DNA, 25 bp, mus musculus
aattccaaacacattgttctctgcc

SEQ ID NO: 76196 - DNA, 25 bp, mus musculus
tccaaacacattgttctctgccaag

SEQ ID NO: 76197 - DNA, 25 bp, mus musculus
tacctccgcgctctgggcaaacgca

SEQ ID NO: 76198 - DNA, 25 bp, mus musculus
cgcgctctgggcaaacgcagtacat

SEQ ID NO: 76199 - DNA, 25 bp, mus musculus
agactgaacctcatccaggatgtag

SEQ ID NO: 76200 - DNA, 25 bp, mus musculus
gggacccactgaggacaagcagagg

SEQ ID NO: 76201 - DNA, 25 bp, mus musculus
actcaacttggagccaggagacttc

SEQ ID NO: 76202 - DNA, 25 bp, mus musculus
agacttcaactcattgtgcgtgaca

SEQ ID NO: 76203 - DNA, 25 bp, mus musculus
caactcattgtgcgtgacacacaca

SEQ ID NO: 76204 - DNA, 25 bp, mus musculus
cgtgacacacacacatgaccgtggg

SEQ ID NO: 76205 - DNA, 25 bp, mus musculus
acacacacatgaccgtgggccaagc

SEQ ID NO: 76206 - DNA, 25 bp, mus musculus
acatgaccgtgggccaagctggagt

SEQ ID NO: 76207 - DNA, 25 bp, mus musculus
tcacttaattgcctctcataaaggt

SEQ ID NO: 76208 - DNA, 25 bp, mus musculus
aattgcctctcataaaggtatgagt

SEQ ID NO: 76209 - DNA, 25 bp, mus musculus
agtacatacaactgtgaatacatca

SEQ ID NO: 76210 - DNA, 25 bp, mus musculus
tcagccccaggctccatttctgctt

SEQ ID NO: 76211 - DNA, 25 bp, mus musculus
ccaggctccatttctgcttcctgct

SEQ ID NO: 76212 - DNA, 25 bp, mus musculus
ggtctccagcaacttacccgatgtt

SEQ ID NO: 76213 - DNA, 25 bp, mus musculus
cgatgttgaccggccctgactgaag

SEQ ID NO: 76214 - DNA, 25 bp, mus musculus
tggtcaactgtgcgccttcagtgta

SEQ ID NO: 76215 - DNA, 25 bp, mus musculus
cagtccatctacagggaactctggg

SEQ ID NO: 76216 - DNA, 25 bp, mus musculus
ctctgggaccgtctatggcaattgc

SEQ ID NO: 76217 - DNA, 25 bp, mus musculus
tatcttccatgatggaaacctgcca

SEQ ID NO: 76218 - DNA, 25 bp, mus musculus
tcttccatgatggaaacctgccaga

SEQ ID NO: 76219 - DNA, 25 bp, mus musculus
ccaacacagccggcgaggaaggtga

SEQ ID NO: 76220 - DNA, 25 bp, mus musculus
tcgaaagatgaacccttgtttgctg

SEQ ID NO: 76221 - DNA, 25 bp, mus musculus
cgaaagatgaacccttgtttgctgc

SEQ ID NO: 76222 - DNA, 25 bp, mus musculus
atcgttctcaacctgatctttggag

SEQ ID NO: 76223 - DNA, 25 bp, mus musculus
tcgttctcaacctgatctttggagt

SEQ ID NO: 76224 - DNA, 25 bp, mus musculus
gttctcaacctgatctttggagtga

SEQ ID NO: 76225 - DNA, 25 bp, mus musculus
ttctcaacctgatctttggagtgat

SEQ ID NO: 76226 - DNA, 25 bp, mus musculus
tctacgatgagtctggtgaagcagc

SEQ ID NO: 76227 - DNA, 25 bp, mus musculus
ctacgatgagtctggtgaagcagct

SEQ ID NO: 76228 - DNA, 25 bp, mus musculus
gatgagtctggtgaagcagctgtca

SEQ ID NO: 76229 - DNA, 25 bp, mus musculus
cttccatgatggaaacctgccagaa

SEQ ID NO: 76230 - DNA, 25 bp, mus musculus
tccatgatggaaacctgccagaagg

SEQ ID NO: 76231 - DNA, 25 bp, mus musculus
ccatgatggaaacctgccagaagga

SEQ ID NO: 76232 - DNA, 25 bp, mus musculus
atgatggaaacctgccagaaggaaa

SEQ ID NO: 76233 - DNA, 25 bp, mus musculus
tgatggaaacctgccagaaggaaaa

SEQ ID NO: 76234 - DNA, 25 bp, mus musculus
cctcttccaacacagccggcgagga

SEQ ID NO: 76235 - DNA, 25 bp, mus musculus
cttccaacacagccggcgaggaagg

SEQ ID NO: 76236 - DNA, 25 bp, mus musculus
tccaacacagccggcgaggaaggtg

SEQ ID NO: 76237 - DNA, 25 bp, mus musculus
tcttactacttgtatccagccacga

SEQ ID NO: 76238 - DNA, 25 bp, mus musculus
ttactacttgtatccagccacgaaa

SEQ ID NO: 76239 - DNA, 25 bp, mus musculus
caggagccccagacatgctgacacc

SEQ ID NO: 76240 - DNA, 25 bp, mus musculus
ggagccccagacatgctgacacctg

SEQ ID NO: 76241 - DNA, 25 bp, mus musculus
agccccagacatgctgacacctgtg

SEQ ID NO: 76242 - DNA, 25 bp, mus musculus
ccccagacatgctgacacctgtggc

SEQ ID NO: 76243 - DNA, 25 bp, mus musculus
ccagacatgctgacacctgtggctg

SEQ ID NO: 76244 - DNA, 25 bp, mus musculus
acatgctgacacctgtggctgctgc

SEQ ID NO: 76245 - DNA, 25 bp, mus musculus
gctgacacctgtggctgctgcagag

SEQ ID NO: 76246 - DNA, 25 bp, mus musculus
ctgtggctgctgcagaggaagacaa

SEQ ID NO: 76247 - DNA, 25 bp, mus musculus
caaggattctgaggccgaggttgaa

SEQ ID NO: 76248 - DNA, 25 bp, mus musculus
gattctgaggccgaggttgaagttg

SEQ ID NO: 76249 - DNA, 25 bp, mus musculus
tacttgtatccagccacgaaaacgg

SEQ ID NO: 76250 - DNA, 25 bp, mus musculus
tgtatccagccacgaaaacggaagc

SEQ ID NO: 76251 - DNA, 25 bp, mus musculus
tatccagccacgaaaacggaagctg

SEQ ID NO: 76252 - DNA, 25 bp, mus musculus
tccagccacgaaaacggaagctgac

SEQ ID NO: 76253 - DNA, 25 bp, mus musculus
gaagctgactctggacacagcagga

SEQ ID NO: 76254 - DNA, 25 bp, mus musculus
agctgactctggacacagcaggagc

SEQ ID NO: 76255 - DNA, 25 bp, mus musculus
ctctggacacagcaggagccccaga

SEQ ID NO: 76256 - DNA, 25 bp, mus musculus
ggacacagcaggagccccagacatg

SEQ ID NO: 76257 - DNA, 25 bp, mus musculus
cagtcctatgaataccatcgagaga

SEQ ID NO: 76258 - DNA, 25 bp, mus musculus
gtcctatgaataccatcgagagaac

SEQ ID NO: 76259 - DNA, 25 bp, mus musculus
attcagccgctcatcttcacagcac

SEQ ID NO: 76260 - DNA, 25 bp, mus musculus
tcagccgctcatcttcacagcacag

SEQ ID NO: 76261 - DNA, 25 bp, mus musculus
gctcatcttcacagcacagcagccg

SEQ ID NO: 76262 - DNA, 25 bp, mus musculus
tcatcttcacagcacagcagccgga

SEQ ID NO: 76263 - DNA, 25 bp, mus musculus
atcttcacagcacagcagccggaga

SEQ ID NO: 76264 - DNA, 25 bp, mus musculus
agcacagcagccggagagccaagag

SEQ ID NO: 76265 - DNA, 25 bp, mus musculus
cacagcagccggagagccaagagtg

SEQ ID NO: 76266 - DNA, 25 bp, mus musculus
catctaccacgtcggggactggcta

SEQ ID NO: 76267 - DNA, 25 bp, mus musculus
taccacgtcggggactggctacaag

SEQ ID NO: 76268 - DNA, 25 bp, mus musculus
agggaccttcggccgagttgtgcag

SEQ ID NO: 76269 - DNA, 25 bp, mus musculus
cagcagttaccgaagccagcgtaga

SEQ ID NO: 76270 - DNA, 25 bp, mus musculus
gcagttaccgaagccagcgtagagc

SEQ ID NO: 76271 - DNA, 25 bp, mus musculus
agttaccgaagccagcgtagagccg

SEQ ID NO: 76272 - DNA, 25 bp, mus musculus
ttaccgaagccagcgtagagccgaa

SEQ ID NO: 76273 - DNA, 25 bp, mus musculus
cgaagccagcgtagagccgaagaaa

SEQ ID NO: 76274 - DNA, 25 bp, mus musculus
agccggacattcagccgctcatctt

SEQ ID NO: 76275 - DNA, 25 bp, mus musculus
ggacattcagccgctcatcttcaca

SEQ ID NO: 76276 - DNA, 25 bp, mus musculus
acattcagccgctcatcttcacagc

SEQ ID NO: 76277 - DNA, 25 bp, mus musculus
atctttcagcggcagagccacaaga

SEQ ID NO: 76278 - DNA, 25 bp, mus musculus
gagcgccacttttctcttggtgagc

SEQ ID NO: 76279 - DNA, 25 bp, mus musculus
aaccacagcacagataaacgaggcc

SEQ ID NO: 76280 - DNA, 25 bp, mus musculus
gataaacgaggcctccaggatgagg

SEQ ID NO: 76281 - DNA, 25 bp, mus musculus
cgaggcctccaggatgaggtactcc

SEQ ID NO: 76282 - DNA, 25 bp, mus musculus
gatgcttcatctacagccatcacct

SEQ ID NO: 76283 - DNA, 25 bp, mus musculus
tcatctacagccatcaccttcgtct

SEQ ID NO: 76284 - DNA, 25 bp, mus musculus
ttccaccagcgttctcatgaggagc

SEQ ID NO: 76285 - DNA, 25 bp, mus musculus
cagcgcggtcttcactgataatcag

SEQ ID NO: 76286 - DNA, 25 bp, mus musculus
ggtcttcactgataatcagctggtc

SEQ ID NO: 76287 - DNA, 25 bp, mus musculus
ggctctgctcagttttattctctgg

SEQ ID NO: 76288 - DNA, 25 bp, mus musculus
gctcagttttattctctgggagaaa

SEQ ID NO: 76289 - DNA, 25 bp, mus musculus
gagctgtttactctggatgaagcaa

SEQ ID NO: 76290 - DNA, 25 bp, mus musculus
tttactctggatgaagcaagcctca

SEQ ID NO: 76291 - DNA, 25 bp, mus musculus
agcctcagtgacacacatgacagat

SEQ ID NO: 76292 - DNA, 25 bp, mus musculus
gacagattgcattgccgccgttgtg

SEQ ID NO: 76293 - DNA, 25 bp, mus musculus
ccccctgatggttctgactgcactt

SEQ ID NO: 76294 - DNA, 25 bp, mus musculus
gatggttctgactgcacttcagacc

SEQ ID NO: 76295 - DNA, 25 bp, mus musculus
tctgactgcacttcagacctggctc

SEQ ID NO: 76296 - DNA, 25 bp, mus musculus
tcagacctggctcagtggaaccaca

SEQ ID NO: 76297 - DNA, 25 bp, mus musculus
catcgtagccaatgtgcccgaagtg

SEQ ID NO: 76298 - DNA, 25 bp, mus musculus
cgtagccaatgtgcccgaagtgtat

SEQ ID NO: 76299 - DNA, 25 bp, mus musculus
gcaaaaactgcctggtgaagaacct

SEQ ID NO: 76300 - DNA, 25 bp, mus musculus
cgtccaccatctgctcagacaagac

SEQ ID NO: 76301 - DNA, 25 bp, mus musculus
accgcatgacagtggctcacatgtg

SEQ ID NO: 76302 - DNA, 25 bp, mus musculus
gcatgacagtggctcacatgtggtt

SEQ ID NO: 76303 - DNA, 25 bp, mus musculus
ggtttgacaaccagatccatgaggc

SEQ ID NO: 76304 - DNA, 25 bp, mus musculus
ttgacaaccagatccatgaggctga

SEQ ID NO: 76305 - DNA, 25 bp, mus musculus
acaaccagatccatgaggctgacac

SEQ ID NO: 76306 - DNA, 25 bp, mus musculus
agatccatgaggctgacaccacaga

SEQ ID NO: 76307 - DNA, 25 bp, mus musculus
tccatgaggctgacaccacagagga

SEQ ID NO: 76308 - DNA, 25 bp, mus musculus
atgaggctgacaccacagaggacca

SEQ ID NO: 76309 - DNA, 25 bp, mus musculus
agccaatgtgcccgaagtgtatggc

SEQ ID NO: 76310 - DNA, 25 bp, mus musculus
tgtgcccgaagtgtatggccaccgt

SEQ ID NO: 76311 - DNA, 25 bp, mus musculus
cgaagtgtatggccaccgtgactgt

SEQ ID NO: 76312 - DNA, 25 bp, mus musculus
tgacgctgacagccaagcgcatggc

SEQ ID NO: 76313 - DNA, 25 bp, mus musculus
cgctgacagccaagcgcatggctcg

SEQ ID NO: 76314 - DNA, 25 bp, mus musculus
tgacagccaagcgcatggctcgcaa

SEQ ID NO: 76315 - DNA, 25 bp, mus musculus
ccaagcgcatggctcgcaaaaactg

SEQ ID NO: 76316 - DNA, 25 bp, mus musculus
ctcgcaaaaactgcctggtgaagaa

SEQ ID NO: 76317 - DNA, 25 bp, mus musculus
tccaacctgtgcacctggctgcgcg

SEQ ID NO: 76318 - DNA, 25 bp, mus musculus
acctgtgcacctggctgcgcggatg

SEQ ID NO: 76319 - DNA, 25 bp, mus musculus
agcaccccaagtttgatgagattct

SEQ ID NO: 76320 - DNA, 25 bp, mus musculus
caccccaagtttgatgagattctca

SEQ ID NO: 76321 - DNA, 25 bp, mus musculus
tgagattctcactcgccttcgtctg

SEQ ID NO: 76322 - DNA, 25 bp, mus musculus
agattctcactcgccttcgtctgca

SEQ ID NO: 76323 - DNA, 25 bp, mus musculus
attctcactcgccttcgtctgcaga

SEQ ID NO: 76324 - DNA, 25 bp, mus musculus
actcgccttcgtctgcagaagctcg

SEQ ID NO: 76325 - DNA, 25 bp, mus musculus
gccttcgtctgcagaagctcggcac

SEQ ID NO: 76326 - DNA, 25 bp, mus musculus
cttcgtctgcagaagctcggcacag

SEQ ID NO: 76327 - DNA, 25 bp, mus musculus
tcgtctgcagaagctcggcacaggt

SEQ ID NO: 76328 - DNA, 25 bp, mus musculus
gtctgcagaagctcggcacaggtgg

SEQ ID NO: 76329 - DNA, 25 bp, mus musculus
ctgcgcggatgcgtgcacgtgaagc

SEQ ID NO: 76330 - DNA, 25 bp, mus musculus
atgcgtgcacgtgaagctggcgaac

SEQ ID NO: 76331 - DNA, 25 bp, mus musculus
acgtgaagctggcgaacctgagcaa

SEQ ID NO: 76332 - DNA, 25 bp, mus musculus
cgaacctgagcaagcaccccaagtt

SEQ ID NO: 76333 - DNA, 25 bp, mus musculus
aacctgagcaagcaccccaagtttg

SEQ ID NO: 76334 - DNA, 25 bp, mus musculus
cctgagcaagcaccccaagtttgat

SEQ ID NO: 76335 - DNA, 25 bp, mus musculus
agcaagcaccccaagtttgatgaga

SEQ ID NO: 76336 - DNA, 25 bp, mus musculus
caagcaccccaagtttgatgagatt

SEQ ID NO: 76337 - DNA, 25 bp, mus musculus
tatcaaaaacttcatgccaactcta

SEQ ID NO: 76338 - DNA, 25 bp, mus musculus
aaacttcatgccaactctagaagag

SEQ ID NO: 76339 - DNA, 25 bp, mus musculus
caactttacagacacctctctcgtg

SEQ ID NO: 76340 - DNA, 25 bp, mus musculus
tacagacacctctctcgtgtaccca

SEQ ID NO: 76341 - DNA, 25 bp, mus musculus
cacctctctcgtgtacccagaggac

SEQ ID NO: 76342 - DNA, 25 bp, mus musculus
cacttgcaaatctggacccagtcca

SEQ ID NO: 76343 - DNA, 25 bp, mus musculus
tggacccagtccaaaccctcagagt

SEQ ID NO: 76344 - DNA, 25 bp, mus musculus
tggattccagcttctagtggatgtt

SEQ ID NO: 76345 - DNA, 25 bp, mus musculus
tgcactcaaacgagcggcagagatg

SEQ ID NO: 76346 - DNA, 25 bp, mus musculus
caaacgagcggcagagatggagctt

SEQ ID NO: 76347 - DNA, 25 bp, mus musculus
tcaggccaaactcacagcttaaccg

SEQ ID NO: 76348 - DNA, 25 bp, mus musculus
gttctccaaaatacggtcctgattg

SEQ ID NO: 76349 - DNA, 25 bp, mus musculus
catgccaactctagaagagagccca

SEQ ID NO: 76350 - DNA, 25 bp, mus musculus
cccaggatccattttggctcgcccg

SEQ ID NO: 76351 - DNA, 25 bp, mus musculus
tcgcccgtcagtgatctgccatacc

SEQ ID NO: 76352 - DNA, 25 bp, mus musculus
gtcagtgatctgccataccactgtg

SEQ ID NO: 76353 - DNA, 25 bp, mus musculus
gatctgccataccactgtgactgca

SEQ ID NO: 76354 - DNA, 25 bp, mus musculus
cactgtgactgcattgaaggatggg

SEQ ID NO: 76355 - DNA, 25 bp, mus musculus
ctctctctgtcagccgattggtgtg

SEQ ID NO: 76356 - DNA, 25 bp, mus musculus
agatgtaccgcaaatagcacccagc

SEQ ID NO: 76357 - DNA, 25 bp, mus musculus
tgacctaggggtttctgttggatag

SEQ ID NO: 76358 - DNA, 25 bp, mus musculus
ctactcttacattctaaaccgatga

SEQ ID NO: 76359 - DNA, 25 bp, mus musculus
ctgcatgtatctgtgcatcttgttc

SEQ ID NO: 76360 - DNA, 25 bp, mus musculus
atttaatgctgtactgttctgctga

SEQ ID NO: 76361 - DNA, 25 bp, mus musculus
tgctgtactgttctgctgagctctg

SEQ ID NO: 76362 - DNA, 25 bp, mus musculus
actgttctgctgagctctgagggac

SEQ ID NO: 76363 - DNA, 25 bp, mus musculus
agctctgagggactatcttgagaga

SEQ ID NO: 76364 - DNA, 25 bp, mus musculus
ttaatctgcgtactgcttaagacag

SEQ ID NO: 76365 - DNA, 25 bp, mus musculus
gtatttccataatcaatgatggttt

SEQ ID NO: 76366 - DNA, 25 bp, mus musculus
taagtcctatgaacctgacctcttt

SEQ ID NO: 76367 - DNA, 25 bp, mus musculus
ctatgaacctgacctcttttatggc

SEQ ID NO: 76368 - DNA, 25 bp, mus musculus
gtggctacagtacacacttatcaaa

SEQ ID NO: 76369 - DNA, 25 bp, mus musculus
ttacattctaaaccgatgaaatctt

SEQ ID NO: 76370 - DNA, 25 bp, mus musculus
tctaaaccgatgaaatctttaacag

SEQ ID NO: 76371 - DNA, 25 bp, mus musculus
aatatctactcatcatttttctctc

SEQ ID NO: 76372 - DNA, 25 bp, mus musculus
tactcatcatttttctctctcagag

SEQ ID NO: 76373 - DNA, 25 bp, mus musculus
ttctctctcagagtcctagcttgag

SEQ ID NO: 76374 - DNA, 25 bp, mus musculus
ctcagagtcctagcttgagttgcac

SEQ ID NO: 76375 - DNA, 25 bp, mus musculus
gtcctagcttgagttgcactgcatg

SEQ ID NO: 76376 - DNA, 25 bp, mus musculus
gcttgagttgcactgcatgtatctg

SEQ ID NO: 76377 - DNA, 25 bp, mus musculus
ggtccaggacctgaagacagagccc

SEQ ID NO: 76378 - DNA, 25 bp, mus musculus
gcctgcccacctaagcgagaccttt

SEQ ID NO: 76379 - DNA, 25 bp, mus musculus
tccttgcgttctccagaaagactca

SEQ ID NO: 76380 - DNA, 25 bp, mus musculus
cgttctccagaaagactcagctccc

SEQ ID NO: 76381 - DNA, 25 bp, mus musculus
gccgccatgtctgcttctctgattc

SEQ ID NO: 76382 - DNA, 25 bp, mus musculus
gcttctctgattccagtggcaggta

SEQ ID NO: 76383 - DNA, 25 bp, mus musculus
ctgattccagtggcaggtagcctgg

SEQ ID NO: 76384 - DNA, 25 bp, mus musculus
tgtgaaccaacgagtttccgtacag

SEQ ID NO: 76385 - DNA, 25 bp, mus musculus
agtttccgtacagtgacagaatgac

SEQ ID NO: 76386 - DNA, 25 bp, mus musculus
gcctggcccagcacaggcatccaat

SEQ ID NO: 76387 - DNA, 25 bp, mus musculus
cccagcacaggcatccaataaacat

SEQ ID NO: 76388 - DNA, 25 bp, mus musculus
acaggcatccaataaacatattata

SEQ ID NO: 76389 - DNA, 25 bp, mus musculus
ccacctaagcgagacctttgctagc

SEQ ID NO: 76390 - DNA, 25 bp, mus musculus
aagcgagacctttgctagctccact

SEQ ID NO: 76391 - DNA, 25 bp, mus musculus
ccgctggtcacggaggtcatagatc

SEQ ID NO: 76392 - DNA, 25 bp, mus musculus
atagatctgggcttcctgggtgaaa

SEQ ID NO: 76393 - DNA, 25 bp, mus musculus
ctgggcttcctgggtgaaatgtatt

SEQ ID NO: 76394 - DNA, 25 bp, mus musculus
tccctgcaggtcactggatacctgt

SEQ ID NO: 76395 - DNA, 25 bp, mus musculus
caggtcactggatacctgtccttgc

SEQ ID NO: 76396 - DNA, 25 bp, mus musculus
tacctgtccttgcgttctccagaaa

SEQ ID NO: 76397 - DNA, 25 bp, mus musculus
gttctgaggactcgttgccagcctt

SEQ ID NO: 76398 - DNA, 25 bp, mus musculus
aggactcgttgccagcctttggagt

SEQ ID NO: 76399 - DNA, 25 bp, mus musculus
aagatctatgacctccgtggcaagt

SEQ ID NO: 76400 - DNA, 25 bp, mus musculus
atctatgacctccgtggcaagttta

SEQ ID NO: 76401 - DNA, 25 bp, mus musculus
tatgacctccgtggcaagtttaagc

SEQ ID NO: 76402 - DNA, 25 bp, mus musculus
accctccgaagagtgaggatctctg

SEQ ID NO: 76403 - DNA, 25 bp, mus musculus
aggatctctgcagatgccatgatgc

SEQ ID NO: 76404 - DNA, 25 bp, mus musculus
gatgccatgatgcaggcgctgctgg

SEQ ID NO: 76405 - DNA, 25 bp, mus musculus
atcgatgcactgagtggcatggaag

SEQ ID NO: 76406 - DNA, 25 bp, mus musculus
gatgcactgagtggcatggaaggcc

SEQ ID NO: 76407 - DNA, 25 bp, mus musculus
gcactgagtggcatggaaggccgca

SEQ ID NO: 76408 - DNA, 25 bp, mus musculus
tgagccatggctcccacactgtgct

SEQ ID NO: 76409 - DNA, 25 bp, mus musculus
tgccagcctttggagttggatgggc

SEQ ID NO: 76410 - DNA, 25 bp, mus musculus
ctgaaggacgtccctgcagaataaa

SEQ ID NO: 76411 - DNA, 25 bp, mus musculus
gagcttcaggacttatgccgacagc

SEQ ID NO: 76412 - DNA, 25 bp, mus musculus
ttatgccgacagcttcacgctcggg

SEQ ID NO: 76413 - DNA, 25 bp, mus musculus
tgccgacagcttcacgctcgggtgg

SEQ ID NO: 76414 - DNA, 25 bp, mus musculus
aacatcactgagattgcagatctga

SEQ ID NO: 76415 - DNA, 25 bp, mus musculus
attgcagatctgacccagaagatct

SEQ ID NO: 76416 - DNA, 25 bp, mus musculus
gatctgacccagaagatctatgacc

SEQ ID NO: 76417 - DNA, 25 bp, mus musculus
ctgacccagaagatctatgacctcc

SEQ ID NO: 76418 - DNA, 25 bp, mus musculus
agttcagccgtgacctgaaacgcaa

SEQ ID NO: 76419 - DNA, 25 bp, mus musculus
acctgaaacgcaaactgatcctaca

SEQ ID NO: 76420 - DNA, 25 bp, mus musculus
ccctctagagcactcttcttggcca

SEQ ID NO: 76421 - DNA, 25 bp, mus musculus
agagcactcttcttggccagaccct

SEQ ID NO: 76422 - DNA, 25 bp, mus musculus
agaccctctgtccaaggctcattag

SEQ ID NO: 76423 - DNA, 25 bp, mus musculus
attgctgttttggcatgagttgtgt

SEQ ID NO: 76424 - DNA, 25 bp, mus musculus
tttccaaaacattctcaaagcctgt

SEQ ID NO: 76425 - DNA, 25 bp, mus musculus
tctcaaagcctgtgatggaggagca

SEQ ID NO: 76426 - DNA, 25 bp, mus musculus
aggagcacaagaccctgtctgctga

SEQ ID NO: 76427 - DNA, 25 bp, mus musculus
acaagaccctgtctgctgagggccc

SEQ ID NO: 76428 - DNA, 25 bp, mus musculus
agccagtgccttcatttgcttgttg

SEQ ID NO: 76429 - DNA, 25 bp, mus musculus
tgccttcatttgcttgttgtacagt

SEQ ID NO: 76430 - DNA, 25 bp, mus musculus
aacgcaaactgatcctacagcagtt

SEQ ID NO: 76431 - DNA, 25 bp, mus musculus
aactgatcctacagcagttctgaga

SEQ ID NO: 76432 - DNA, 25 bp, mus musculus
tcctacagcagttctgagaccagca

SEQ ID NO: 76433 - DNA, 25 bp, mus musculus
tctgagaccagcacaggggcctcta

SEQ ID NO: 76434 - DNA, 25 bp, mus musculus
acaggggcctctatgtctgaatgag

SEQ ID NO: 76435 - DNA, 25 bp, mus musculus
ggctcggtcaccacgctgagcctac

SEQ ID NO: 76436 - DNA, 25 bp, mus musculus
cagacctttacctgtgagcccctag

SEQ ID NO: 76437 - DNA, 25 bp, mus musculus
tttacctgtgagcccctaggccaag

SEQ ID NO: 76438 - DNA, 25 bp, mus musculus
acacactacgatcacgttctgattg

SEQ ID NO: 76439 - DNA, 25 bp, mus musculus
tacgatcacgttctgattgagctca

SEQ ID NO: 76440 - DNA, 25 bp, mus musculus
gcttgggcactctgtcaataggctt

SEQ ID NO: 76441 - DNA, 25 bp, mus musculus
gcactctgtcaataggcttcttgta

SEQ ID NO: 76442 - DNA, 25 bp, mus musculus
taggcttcttgtactattgaagttg

SEQ ID NO: 76443 - DNA, 25 bp, mus musculus
aagacatttcttcatgtataggaaa

SEQ ID NO: 76444 - DNA, 25 bp, mus musculus
aagcctgctgcatttgtcatacatg

SEQ ID NO: 76445 - DNA, 25 bp, mus musculus
atacatgtgtctgtggaaattgctt

SEQ ID NO: 76446 - DNA, 25 bp, mus musculus
attgctttcttctgttcccagccac

SEQ ID NO: 76447 - DNA, 25 bp, mus musculus
ttcttctgttcccagccactgcttt

SEQ ID NO: 76448 - DNA, 25 bp, mus musculus
tgttcccagccactgcttttaccca

SEQ ID NO: 76449 - DNA, 25 bp, mus musculus
cagccactgcttttacccatgaaaa

SEQ ID NO: 76450 - DNA, 25 bp, mus musculus
ctgattgagctcacccaggctgggc

SEQ ID NO: 76451 - DNA, 25 bp, mus musculus
ctgaaaggctccagtgaaggaagcg

SEQ ID NO: 76452 - DNA, 25 bp, mus musculus
gtcaaccctaactacttgcttgaag

SEQ ID NO: 76453 - DNA, 25 bp, mus musculus
tacttgcttgaagattgaggtattg

SEQ ID NO: 76454 - DNA, 25 bp, mus musculus
aacttgatggccagggacctgtgct

SEQ ID NO: 76455 - DNA, 25 bp, mus musculus
atggccagggacctgtgctgtccta

SEQ ID NO: 76456 - DNA, 25 bp, mus musculus
gaccctgcacggcactgagagacag

SEQ ID NO: 76457 - DNA, 25 bp, mus musculus
aatttcatactgggacaggcttggg

SEQ ID NO: 76458 - DNA, 25 bp, mus musculus
cctttctgcgtctgcccacgtagtg

SEQ ID NO: 76459 - DNA, 25 bp, mus musculus
tgcgtctgcccacgtagtgctcttt

SEQ ID NO: 76460 - DNA, 25 bp, mus musculus
actgccctccaaatctactcttctt

SEQ ID NO: 76461 - DNA, 25 bp, mus musculus
atctactcttcttttaagcaatatg

SEQ ID NO: 76462 - DNA, 25 bp, mus musculus
ttgtatcacaccgttgtatatacca

SEQ ID NO: 76463 - DNA, 25 bp, mus musculus
cacaccgttgtatataccagtatgc

SEQ ID NO: 76464 - DNA, 25 bp, mus musculus
gtaagcgtttcctaatctgtgtata

SEQ ID NO: 76465 - DNA, 25 bp, mus musculus
agtatcgtctgcattccagcaaaaa

SEQ ID NO: 76466 - DNA, 25 bp, mus musculus
gtctgcattccagcaaaaatatcaa

SEQ ID NO: 76467 - DNA, 25 bp, mus musculus
gaactttctattgaatcctttgagt

SEQ ID NO: 76468 - DNA, 25 bp, mus musculus
tctattgaatcctttgagtaccaag

SEQ ID NO: 76469 - DNA, 25 bp, mus musculus
taccaagatttgctcacacgacatc

SEQ ID NO: 76470 - DNA, 25 bp, mus musculus
cgtagtgctctttagccagtatctg

SEQ ID NO: 76471 - DNA, 25 bp, mus musculus
gctctttagccagtatctgtaaata

SEQ ID NO: 76472 - DNA, 25 bp, mus musculus
tgggtcctttcagtttccagccatg

SEQ ID NO: 76473 - DNA, 25 bp, mus musculus
ctttcagtttccagccatgcattcc

SEQ ID NO: 76474 - DNA, 25 bp, mus musculus
agccatgcattcctgatacaatcca

SEQ ID NO: 76475 - DNA, 25 bp, mus musculus
gcattcctgatacaatccagtggta

SEQ ID NO: 76476 - DNA, 25 bp, mus musculus
caatccagtggtacttcagatcctg

SEQ ID NO: 76477 - DNA, 25 bp, mus musculus
gtagaaagcccctatgcccttcatc

SEQ ID NO: 76478 - DNA, 25 bp, mus musculus
gacactgacgagatccagagctatc

SEQ ID NO: 76479 - DNA, 25 bp, mus musculus
atccagagctatcaatacctcagtt

SEQ ID NO: 76480 - DNA, 25 bp, mus musculus
gttttggaccaacaacatggcaagc

SEQ ID NO: 76481 - DNA, 25 bp, mus musculus
gaccaacaacatggcaagcacattc

SEQ ID NO: 76482 - DNA, 25 bp, mus musculus
ctgtttcttgactgtgaaggcaaca

SEQ ID NO: 76483 - DNA, 25 bp, mus musculus
tttcttgactgtgaaggcaacatag

SEQ ID NO: 76484 - DNA, 25 bp, mus musculus
gtgtacacctgtatgtgcccatcca

SEQ ID NO: 76485 - DNA, 25 bp, mus musculus
tgcctgttttgaacatctctcttca

SEQ ID NO: 76486 - DNA, 25 bp, mus musculus
acatctctcttcattttctggaatg

SEQ ID NO: 76487 - DNA, 25 bp, mus musculus
tctctcttcattttctggaatgagt

SEQ ID NO: 76488 - DNA, 25 bp, mus musculus
ctcttcattttctggaatgagtcat

SEQ ID NO: 76489 - DNA, 25 bp, mus musculus
tcttcagagactccaagggaaagca

SEQ ID NO: 76490 - DNA, 25 bp, mus musculus
cagagctatcaatacctcagttacg

SEQ ID NO: 76491 - DNA, 25 bp, mus musculus
agctatcaatacctcagttacgcga

SEQ ID NO: 76492 - DNA, 25 bp, mus musculus
gctctgttattgtccccggagcggt

SEQ ID NO: 76493 - DNA, 25 bp, mus musculus
tccccggagcggtccttgttgcatg

SEQ ID NO: 76494 - DNA, 25 bp, mus musculus
cccaagtggggccctctactgtcag

SEQ ID NO: 76495 - DNA, 25 bp, mus musculus
cctctactgtcagacagttgaagca

SEQ ID NO: 76496 - DNA, 25 bp, mus musculus
ctactgtcagacagttgaagcacta

SEQ ID NO: 76497 - DNA, 25 bp, mus musculus
agttgaagcactaactgcttttcct

SEQ ID NO: 76498 - DNA, 25 bp, mus musculus
gaagacctgttcgtcactacaaagc

SEQ ID NO: 76499 - DNA, 25 bp, mus musculus
gacctgttcgtcactacaaagcttt

SEQ ID NO: 76500 - DNA, 25 bp, mus musculus
gtcaagcctgccttggaaaagtcac

SEQ ID NO: 76501 - DNA, 25 bp, mus musculus
aagcttcagctggattatgttgatc

SEQ ID NO: 76502 - DNA, 25 bp, mus musculus
ctttacattatgcattacccagtgc

SEQ ID NO: 76503 - DNA, 25 bp, mus musculus
tacattatgcattacccagtgccaa

SEQ ID NO: 76504 - DNA, 25 bp, mus musculus
attatgcattacccagtgccaatga

SEQ ID NO: 76505 - DNA, 25 bp, mus musculus
atgcattacccagtgccaatgaagt

SEQ ID NO: 76506 - DNA, 25 bp, mus musculus
cattacccagtgccaatgaagtcag

SEQ ID NO: 76507 - DNA, 25 bp, mus musculus
tacccagtgccaatgaagtcagggg

SEQ ID NO: 76508 - DNA, 25 bp, mus musculus
aaatctctgttggacactgtggatt

SEQ ID NO: 76509 - DNA, 25 bp, mus musculus
tctctgttggacactgtggatttct

SEQ ID NO: 76510 - DNA, 25 bp, mus musculus
ctgttcgtcactacaaagctttggt

SEQ ID NO: 76511 - DNA, 25 bp, mus musculus
ttcgtcactacaaagctttggtgca

SEQ ID NO: 76512 - DNA, 25 bp, mus musculus
gtcactacaaagctttggtgcactt

SEQ ID NO: 76513 - DNA, 25 bp, mus musculus
ctttggtgcacttgctttcgaccag

SEQ ID NO: 76514 - DNA, 25 bp, mus musculus
tggtgcacttgctttcgaccagagc

SEQ ID NO: 76515 - DNA, 25 bp, mus musculus
acttgctttcgaccagagctggtca

SEQ ID NO: 76516 - DNA, 25 bp, mus musculus
tttcgaccagagctggtcaagcctg

SEQ ID NO: 76517 - DNA, 25 bp, mus musculus
ctggtcaagcctgccttggaaaagt

SEQ ID NO: 76518 - DNA, 25 bp, mus musculus
acccctggcgcagggactgctggaa

SEQ ID NO: 76519 - DNA, 25 bp, mus musculus
ccctggcgcagggactgctggaacc

SEQ ID NO: 76520 - DNA, 25 bp, mus musculus
gcactgtcgttttcagacagactct

SEQ ID NO: 76521 - DNA, 25 bp, mus musculus
actgtcgttttcagacagactctgc

SEQ ID NO: 76522 - DNA, 25 bp, mus musculus
ctgtcgttttcagacagactctgcg

SEQ ID NO: 76523 - DNA, 25 bp, mus musculus
cgttttcagacagactctgcgggct

SEQ ID NO: 76524 - DNA, 25 bp, mus musculus
gttttcagacagactctgcgggctc

SEQ ID NO: 76525 - DNA, 25 bp, mus musculus
tttcagacagactctgcgggctccg

SEQ ID NO: 76526 - DNA, 25 bp, mus musculus
ttcagacagactctgcgggctccga

SEQ ID NO: 76527 - DNA, 25 bp, mus musculus
tcagacagactctgcgggctccgac

SEQ ID NO: 76528 - DNA, 25 bp, mus musculus
agacagactctgcgggctccgaccc

SEQ ID NO: 76529 - DNA, 25 bp, mus musculus
acagactctgcgggctccgacccga

SEQ ID NO: 76530 - DNA, 25 bp, mus musculus
actgctggaacctggctgcgcgcac

SEQ ID NO: 76531 - DNA, 25 bp, mus musculus
ctgctggaacctggctgcgcgcact

SEQ ID NO: 76532 - DNA, 25 bp, mus musculus
tggaacctggctgcgcgcactgtcg

SEQ ID NO: 76533 - DNA, 25 bp, mus musculus
tggctgcgcgcactgtcgttttcag

SEQ ID NO: 76534 - DNA, 25 bp, mus musculus
ggctgcgcgcactgtcgttttcaga

SEQ ID NO: 76535 - DNA, 25 bp, mus musculus
gcgcgcactgtcgttttcagacaga

SEQ ID NO: 76536 - DNA, 25 bp, mus musculus
gcgcactgtcgttttcagacagact

SEQ ID NO: 76537 - DNA, 25 bp, mus musculus
cgcactgtcgttttcagacagactc

SEQ ID NO: 76538 - DNA, 25 bp, mus musculus
cttccctggtgcccatggaacactg

SEQ ID NO: 76539 - DNA, 25 bp, mus musculus
gcataactcgcttctttgaggagtg

SEQ ID NO: 76540 - DNA, 25 bp, mus musculus
gccaccatggcaatgtcactctgtg

SEQ ID NO: 76541 - DNA, 25 bp, mus musculus
atggcaatgtcactctgtgcatctg

SEQ ID NO: 76542 - DNA, 25 bp, mus musculus
caatgttcatattgtccataatacc

SEQ ID NO: 76543 - DNA, 25 bp, mus musculus
tgtccataataccttatgcatgctg

SEQ ID NO: 76544 - DNA, 25 bp, mus musculus
taataccttatgcatgctgaggaag

SEQ ID NO: 76545 - DNA, 25 bp, mus musculus
cttatgcatgctgaggaagtgagat

SEQ ID NO: 76546 - DNA, 25 bp, mus musculus
gtgagatactgctcttttgagataa

SEQ ID NO: 76547 - DNA, 25 bp, mus musculus
tactgctcttttgagataaatatgc

SEQ ID NO: 76548 - DNA, 25 bp, mus musculus
gagataaatatgcctccttttcagt

SEQ ID NO: 76549 - DNA, 25 bp, mus musculus
tttcagtgtcttggatgtcctaata

SEQ ID NO: 76550 - DNA, 25 bp, mus musculus
aggataagcacatcaccttgaagga

SEQ ID NO: 76551 - DNA, 25 bp, mus musculus
agcacatcaccttgaaggaatgggg

SEQ ID NO: 76552 - DNA, 25 bp, mus musculus
tagatgaaaacctcctcttttgaat

SEQ ID NO: 76553 - DNA, 25 bp, mus musculus
cacctgctttaaccgcttcagaaat

SEQ ID NO: 76554 - DNA, 25 bp, mus musculus
tacgagcagccatgacactatacat

SEQ ID NO: 76555 - DNA, 25 bp, mus musculus
tttgtttggcatgtgagagaagaca

SEQ ID NO: 76556 - DNA, 25 bp, mus musculus
agtaattacttcttggtgatatata

SEQ ID NO: 76557 - DNA, 25 bp, mus musculus
cagttagccaccatggcaatgtcac

SEQ ID NO: 76558 - DNA, 25 bp, mus musculus
tggcccagagtcttcaccatgccaa

SEQ ID NO: 76559 - DNA, 25 bp, mus musculus
cccagagtcttcaccatgccaaact

SEQ ID NO: 76560 - DNA, 25 bp, mus musculus
cactgcatggcctgcaggaaagctc

SEQ ID NO: 76561 - DNA, 25 bp, mus musculus
acagcaccacagtggcagctcatga

SEQ ID NO: 76562 - DNA, 25 bp, mus musculus
agcaccacagtggcagctcatgagt

SEQ ID NO: 76563 - DNA, 25 bp, mus musculus
gcaccacagtggcagctcatgagtc

SEQ ID NO: 76564 - DNA, 25 bp, mus musculus
accacagtggcagctcatgagtcag

SEQ ID NO: 76565 - DNA, 25 bp, mus musculus
ctcagcacagacactggcgagcatc

SEQ ID NO: 76566 - DNA, 25 bp, mus musculus
tcagcacagacactggcgagcatct

SEQ ID NO: 76567 - DNA, 25 bp, mus musculus
agcacagacactggcgagcatcttg

SEQ ID NO: 76568 - DNA, 25 bp, mus musculus
gcacagacactggcgagcatcttgg

SEQ ID NO: 76569 - DNA, 25 bp, mus musculus
acagacactggcgagcatcttggcc

SEQ ID NO: 76570 - DNA, 25 bp, mus musculus
ccagagtcttcaccatgccaaactg

SEQ ID NO: 76571 - DNA, 25 bp, mus musculus
agagtcttcaccatgccaaactggg

SEQ ID NO: 76572 - DNA, 25 bp, mus musculus
gtcttcaccatgccaaactggggtg

SEQ ID NO: 76573 - DNA, 25 bp, mus musculus
aagacggtctaccatgcagaagaaa

SEQ ID NO: 76574 - DNA, 25 bp, mus musculus
agacggtctaccatgcagaagaaat

SEQ ID NO: 76575 - DNA, 25 bp, mus musculus
acggtctaccatgcagaagaaatcc

SEQ ID NO: 76576 - DNA, 25 bp, mus musculus
cctgtttccactgcatggcctgcag

SEQ ID NO: 76577 - DNA, 25 bp, mus musculus
tccactgcatggcctgcaggaaagc

SEQ ID NO: 76578 - DNA, 25 bp, mus musculus
agggacctctaggagtgctggatgt

SEQ ID NO: 76579 - DNA, 25 bp, mus musculus
tcgtgattctgctgtggcttcagag

SEQ ID NO: 76580 - DNA, 25 bp, mus musculus
tgcatctcatgacttcctcctgcgg

SEQ ID NO: 76581 - DNA, 25 bp, mus musculus
atctcatgacttcctcctgcggcag

SEQ ID NO: 76582 - DNA, 25 bp, mus musculus
tgcctcaggaactcctccgagcgag

SEQ ID NO: 76583 - DNA, 25 bp, mus musculus
tgcacgggcactgttctgaggatga

SEQ ID NO: 76584 - DNA, 25 bp, mus musculus
acgggcactgttctgaggatgagga

SEQ ID NO: 76585 - DNA, 25 bp, mus musculus
acatagcaactcataccaggagtga

SEQ ID NO: 76586 - DNA, 25 bp, mus musculus
tagcaactcataccaggagtgagca

SEQ ID NO: 76587 - DNA, 25 bp, mus musculus
caactcataccaggagtgagcagcc

SEQ ID NO: 76588 - DNA, 25 bp, mus musculus
agcagccacacatggtggccacaat

SEQ ID NO: 76589 - DNA, 25 bp, mus musculus
cacacatggtggccacaatattaga

SEQ ID NO: 76590 - DNA, 25 bp, mus musculus
tgattctgctgtggcttcagagttc

SEQ ID NO: 76591 - DNA, 25 bp, mus musculus
tgtggcttcagagttcgagctggtg

SEQ ID NO: 76592 - DNA, 25 bp, mus musculus
agagttcgagctggtgcagctgcta

SEQ ID NO: 76593 - DNA, 25 bp, mus musculus
gcagctgctacctggggatcgagag

SEQ ID NO: 76594 - DNA, 25 bp, mus musculus
agagctgaccatcccacactcagct

SEQ ID NO: 76595 - DNA, 25 bp, mus musculus
acactcagctaacgtcttctatgcc

SEQ ID NO: 76596 - DNA, 25 bp, mus musculus
ctcagctaacgtcttctatgccatg

SEQ ID NO: 76597 - DNA, 25 bp, mus musculus
cttctatgccatggatggtgcatct

SEQ ID NO: 76598 - DNA, 25 bp, mus musculus
gagttcctactgacttgtcactagc

SEQ ID NO: 76599 - DNA, 25 bp, mus musculus
ctgacttgtcactagcctggtgctg

SEQ ID NO: 76600 - DNA, 25 bp, mus musculus
ctgtgctttcctcacaggacaaatt

SEQ ID NO: 76601 - DNA, 25 bp, mus musculus
tcacacatagtgggtttggccagtt

SEQ ID NO: 76602 - DNA, 25 bp, mus musculus
cacatagtgggtttggccagttcat

SEQ ID NO: 76603 - DNA, 25 bp, mus musculus
ttggccagttcatgttttgtctaac

SEQ ID NO: 76604 - DNA, 25 bp, mus musculus
taaatactaagctcttggttaaatg

SEQ ID NO: 76605 - DNA, 25 bp, mus musculus
atgataaagccttgactatgcatgc

SEQ ID NO: 76606 - DNA, 25 bp, mus musculus
aagccttgactatgcatgctgcttt

SEQ ID NO: 76607 - DNA, 25 bp, mus musculus
ccttgactatgcatgctgcttttat

SEQ ID NO: 76608 - DNA, 25 bp, mus musculus
ctgatttcttcacacagacagctgg

SEQ ID NO: 76609 - DNA, 25 bp, mus musculus
tcttcacacagacagctggctttgt

SEQ ID NO: 76610 - DNA, 25 bp, mus musculus
acttgtcactagcctggtgctgatg

SEQ ID NO: 76611 - DNA, 25 bp, mus musculus
tgtcactagcctggtgctgatgtcg

SEQ ID NO: 76612 - DNA, 25 bp, mus musculus
ggaaggaccctttctgttgtgatca

SEQ ID NO: 76613 - DNA, 25 bp, mus musculus
accctttctgttgtgatcataggac

SEQ ID NO: 76614 - DNA, 25 bp, mus musculus
ataggaccacttttcaatctgtgct

SEQ ID NO: 76615 - DNA, 25 bp, mus musculus
ccacttttcaatctgtgctttcctc

SEQ ID NO: 76616 - DNA, 25 bp, mus musculus
ttcaatctgtgctttcctcacagga

SEQ ID NO: 76617 - DNA, 25 bp, mus musculus
aatctgtgctttcctcacaggacaa

SEQ ID NO: 76618 - DNA, 25 bp, mus musculus
cctgtgcctgtgagtccatactgaa

SEQ ID NO: 76619 - DNA, 25 bp, mus musculus
gtgcctgtgagtccatactgaaatt

SEQ ID NO: 76620 - DNA, 25 bp, mus musculus
gtctggttttgctgctttagcaagg

SEQ ID NO: 76621 - DNA, 25 bp, mus musculus
ttttgctgctttagcaagggaacct

SEQ ID NO: 76622 - DNA, 25 bp, mus musculus
ctgcaggtctccccagctgtcctgg

SEQ ID NO: 76623 - DNA, 25 bp, mus musculus
gacacatgcttgtgtctgctgggag

SEQ ID NO: 76624 - DNA, 25 bp, mus musculus
ttgtgtctgctgggagtgtgttatg

SEQ ID NO: 76625 - DNA, 25 bp, mus musculus
tgtctgctgggagtgtgttatgatg

SEQ ID NO: 76626 - DNA, 25 bp, mus musculus
tttcagagcaagggtgtttgcacag

SEQ ID NO: 76627 - DNA, 25 bp, mus musculus
tccagttaattctttacccagtcag

SEQ ID NO: 76628 - DNA, 25 bp, mus musculus
acccagtcagttctttactctgaga

SEQ ID NO: 76629 - DNA, 25 bp, mus musculus
tcagttctttactctgagagatttt

SEQ ID NO: 76630 - DNA, 25 bp, mus musculus
agggtctgctgcaggccctgaccag

SEQ ID NO: 76631 - DNA, 25 bp, mus musculus
tcatctaagaactctggtggcctgg

SEQ ID NO: 76632 - DNA, 25 bp, mus musculus
aactctggtggcctggcacttccca

SEQ ID NO: 76633 - DNA, 25 bp, mus musculus
acccaatgcacagttcttagtgtct

SEQ ID NO: 76634 - DNA, 25 bp, mus musculus
caatgcacagttcttagtgtctggg

SEQ ID NO: 76635 - DNA, 25 bp, mus musculus
acagttcttagtgtctgggaatgcc

SEQ ID NO: 76636 - DNA, 25 bp, mus musculus
gagttagtctggttttgctgcttta

SEQ ID NO: 76637 - DNA, 25 bp, mus musculus
ttagtctggttttgctgctttagca

SEQ ID NO: 76638 - DNA, 25 bp, mus musculus
cccaagccatagctgacatggccgc

SEQ ID NO: 76639 - DNA, 25 bp, mus musculus
ctgacatggccgcctaccagctgga

SEQ ID NO: 76640 - DNA, 25 bp, mus musculus
ggttctggaagctcctacatttacg

SEQ ID NO: 76641 - DNA, 25 bp, mus musculus
tcctacatttacggttatgtggacg

SEQ ID NO: 76642 - DNA, 25 bp, mus musculus
tataagccaggcatgacccctgagg

SEQ ID NO: 76643 - DNA, 25 bp, mus musculus
actctggccatgaaccgagatggct

SEQ ID NO: 76644 - DNA, 25 bp, mus musculus
gtcatctacctggtcaccatcacag

SEQ ID NO: 76645 - DNA, 25 bp, mus musculus
gtcaccatcacagctgctggtgtgg

SEQ ID NO: 76646 - DNA, 25 bp, mus musculus
atcacagctgctggtgtggaccatc

SEQ ID NO: 76647 - DNA, 25 bp, mus musculus
gagctgccaaaattctacgatgagt

SEQ ID NO: 76648 - DNA, 25 bp, mus musculus
tgactgatccccagaagtcccttcc

SEQ ID NO: 76649 - DNA, 25 bp, mus musculus
accagaaggctggtgcgatgggcaa

SEQ ID NO: 76650 - DNA, 25 bp, mus musculus
tggccgcctaccagctggagctaca

SEQ ID NO: 76651 - DNA, 25 bp, mus musculus
cctaccagctggagctacacgggtt

SEQ ID NO: 76652 - DNA, 25 bp, mus musculus
agctggagctacacgggttggagct

SEQ ID NO: 76653 - DNA, 25 bp, mus musculus
ttctggctgctgcaaacgtggtgaa

SEQ ID NO: 76654 - DNA, 25 bp, mus musculus
ctgctgcaaacgtggtgaagaacat

SEQ ID NO: 76655 - DNA, 25 bp, mus musculus
atgctaattcgacagccctttacca

SEQ ID NO: 76656 - DNA, 25 bp, mus musculus
attcgacagccctttaccatcggcg

SEQ ID NO: 76657 - DNA, 25 bp, mus musculus
cagccctttaccatcggcggttctg

SEQ ID NO: 76658 - DNA, 25 bp, mus musculus
tgctcctttgaagccaacgtgcctc

SEQ ID NO: 76659 - DNA, 25 bp, mus musculus
ttgcttggccctcaactgggttagg

SEQ ID NO: 76660 - DNA, 25 bp, mus musculus
ttcacaggtatcctaccagcataat

SEQ ID NO: 76661 - DNA, 25 bp, mus musculus
acaggtatcctaccagcataatgag

SEQ ID NO: 76662 - DNA, 25 bp, mus musculus
ctgtgactcgtggggcccagagtta

SEQ ID NO: 76663 - DNA, 25 bp, mus musculus
tgactcgtggggcccagagttagaa

SEQ ID NO: 76664 - DNA, 25 bp, mus musculus
cagctttctcttgggcagtacactg

SEQ ID NO: 76665 - DNA, 25 bp, mus musculus
tctcttgggcagtacactggattga

SEQ ID NO: 76666 - DNA, 25 bp, mus musculus
agtgttgattctctgatggtaactg

SEQ ID NO: 76667 - DNA, 25 bp, mus musculus
gattctctgatggtaactgacagca

SEQ ID NO: 76668 - DNA, 25 bp, mus musculus
gtaactgacagcagtggacagtgct

SEQ ID NO: 76669 - DNA, 25 bp, mus musculus
gtgttccttccaaggagacatatat

SEQ ID NO: 76670 - DNA, 25 bp, mus musculus
ggttaggaccatcgcaggtgatgca

SEQ ID NO: 76671 - DNA, 25 bp, mus musculus
catcgcaggtgatgcagggttgaca

SEQ ID NO: 76672 - DNA, 25 bp, mus musculus
gacactttaaagcactaccagccac

SEQ ID NO: 76673 - DNA, 25 bp, mus musculus
actttaaagcactaccagccacatt

SEQ ID NO: 76674 - DNA, 25 bp, mus musculus
cactaccagccacattcaggaactc

SEQ ID NO: 76675 - DNA, 25 bp, mus musculus
taccagccacattcaggaactctgt

SEQ ID NO: 76676 - DNA, 25 bp, mus musculus
cagccacattcaggaactctgttca

SEQ ID NO: 76677 - DNA, 25 bp, mus musculus
cattcaggaactctgttcacaggta

SEQ ID NO: 76678 - DNA, 25 bp, mus musculus
cagcagtgtggcctgatgttatcaa

SEQ ID NO: 76679 - DNA, 25 bp, mus musculus
atgttatcaagctgccctacttcaa

SEQ ID NO: 76680 - DNA, 25 bp, mus musculus
tgctgacactggatcctagcaagag

SEQ ID NO: 76681 - DNA, 25 bp, mus musculus
tgacactggatcctagcaagaggtg

SEQ ID NO: 76682 - DNA, 25 bp, mus musculus
cactggatcctagcaagaggtgcac

SEQ ID NO: 76683 - DNA, 25 bp, mus musculus
cagctgaacagaccctacagagtga

SEQ ID NO: 76684 - DNA, 25 bp, mus musculus
aacagaccctacagagtgactttct

SEQ ID NO: 76685 - DNA, 25 bp, mus musculus
tcagcaaaatggcacctccagacct

SEQ ID NO: 76686 - DNA, 25 bp, mus musculus
ctccagacctacctcactggcagga

SEQ ID NO: 76687 - DNA, 25 bp, mus musculus
acctacctcactggcaggattgcat

SEQ ID NO: 76688 - DNA, 25 bp, mus musculus
tacctcactggcaggattgcatgaa

SEQ ID NO: 76689 - DNA, 25 bp, mus musculus
ctcactggcaggattgcatgaattg

SEQ ID NO: 76690 - DNA, 25 bp, mus musculus
agctgccctacttcaacaccatgaa

SEQ ID NO: 76691 - DNA, 25 bp, mus musculus
tgccctacttcaacaccatgaaacc

SEQ ID NO: 76692 - DNA, 25 bp, mus musculus
aattctctttcattccttcagcggc

SEQ ID NO: 76693 - DNA, 25 bp, mus musculus
tctctttcattccttcagcggcact

SEQ ID NO: 76694 - DNA, 25 bp, mus musculus
cttcagcggcacttgatctattgga

SEQ ID NO: 76695 - DNA, 25 bp, mus musculus
tattggaccacatgctgacactgga

SEQ ID NO: 76696 - DNA, 25 bp, mus musculus
tggaccacatgctgacactggatcc

SEQ ID NO: 76697 - DNA, 25 bp, mus musculus
accacatgctgacactggatcctag

SEQ ID NO: 76698 - DNA, 25 bp, mus musculus
gtgcaacctgggtgccatgtacaac

SEQ ID NO: 76699 - DNA, 25 bp, mus musculus
tgccatgtacaacctctatgacatg

SEQ ID NO: 76700 - DNA, 25 bp, mus musculus
gacagtgctcttcaccatgtgttcc

SEQ ID NO: 76701 - DNA, 25 bp, mus musculus
gctcttcaccatgtgttccctgcct

SEQ ID NO: 76702 - DNA, 25 bp, mus musculus
agtggacccctggatcttcatcatc

SEQ ID NO: 76703 - DNA, 25 bp, mus musculus
cccctggatcttcatcatcttcagg

SEQ ID NO: 76704 - DNA, 25 bp, mus musculus
catcatcttcaggacttcagtattc

SEQ ID NO: 76705 - DNA, 25 bp, mus musculus
cacaagacctctgatctacagaaac

SEQ ID NO: 76706 - DNA, 25 bp, mus musculus
acctctgatctacagaaactggagc

SEQ ID NO: 76707 - DNA, 25 bp, mus musculus
gctttgcgtgttctgataagctgaa

SEQ ID NO: 76708 - DNA, 25 bp, mus musculus
agcacacattcaaagagccgtgctt

SEQ ID NO: 76709 - DNA, 25 bp, mus musculus
aactatctcccatgaagagatggag

SEQ ID NO: 76710 - DNA, 25 bp, mus musculus
gtacaacctctatgacatgcacagg

SEQ ID NO: 76711 - DNA, 25 bp, mus musculus
cctctatgacatgcacaggcgccag

SEQ ID NO: 76712 - DNA, 25 bp, mus musculus
tgacatgcacaggcgccagaggcac

SEQ ID NO: 76713 - DNA, 25 bp, mus musculus
cctgcatcctttggaggagctggac

SEQ ID NO: 76714 - DNA, 25 bp, mus musculus
ccactttgtgctgctggctctcatg

SEQ ID NO: 76715 - DNA, 25 bp, mus musculus
tgtgctgctggctctcatgacagtg

SEQ ID NO: 76716 - DNA, 25 bp, mus musculus
gctggctctcatgacagtgctcttc

SEQ ID NO: 76717 - DNA, 25 bp, mus musculus
tctcatgacagtgctcttcaccatg

SEQ ID NO: 76718 - DNA, 25 bp, mus musculus
atggccatttctcattcgcactgaa

SEQ ID NO: 76719 - DNA, 25 bp, mus musculus
tctcattcgcactgaaagccgagag

SEQ ID NO: 76720 - DNA, 25 bp, mus musculus
gtgccacttctaactgaaaacagaa

SEQ ID NO: 76721 - DNA, 25 bp, mus musculus
tactgttgtcaacatactgtaatca

SEQ ID NO: 76722 - DNA, 25 bp, mus musculus
tgtcaacatactgtaatcagaggag

SEQ ID NO: 76723 - DNA, 25 bp, mus musculus
gtttcaatgtgtctggatgagagtg

SEQ ID NO: 76724 - DNA, 25 bp, mus musculus
tggacagccttcttgtgactgagat

SEQ ID NO: 76725 - DNA, 25 bp, mus musculus
ttgtaagttctgtgccaggttctcc

SEQ ID NO: 76726 - DNA, 25 bp, mus musculus
taagttctgtgccaggttctccacc

SEQ ID NO: 76727 - DNA, 25 bp, mus musculus
tgccaggttctccaccactgtgtac

SEQ ID NO: 76728 - DNA, 25 bp, mus musculus
caggttctccaccactgtgtacttt

SEQ ID NO: 76729 - DNA, 25 bp, mus musculus
ctccaccactgtgtactttattgct

SEQ ID NO: 76730 - DNA, 25 bp, mus musculus
tttaagcacgacatacttaatcatt

SEQ ID NO: 76731 - DNA, 25 bp, mus musculus
aagcacgacatacttaatcattatt

SEQ ID NO: 76732 - DNA, 25 bp, mus musculus
agatttctaaacacatctatttaag

SEQ ID NO: 76733 - DNA, 25 bp, mus musculus
aacacatctatttaagcatacttta

SEQ ID NO: 76734 - DNA, 25 bp, mus musculus
aagttgctgtatcctcacagttgtc

SEQ ID NO: 76735 - DNA, 25 bp, mus musculus
cacagttgtctgcatccagggaata

SEQ ID NO: 76736 - DNA, 25 bp, mus musculus
agttgtctgcatccagggaatatga

SEQ ID NO: 76737 - DNA, 25 bp, mus musculus
tttgtgccacttctaactgaaaaca

SEQ ID NO: 76738 - DNA, 25 bp, mus musculus
tctcttactggcagaatatttcttt

SEQ ID NO: 76739 - DNA, 25 bp, mus musculus
gacatgcacacagcatacttcaatg

SEQ ID NO: 76740 - DNA, 25 bp, mus musculus
agctatgcaattttctgtttattag

SEQ ID NO: 76741 - DNA, 25 bp, mus musculus
tggtaacaactattcctcttcaagc

SEQ ID NO: 76742 - DNA, 25 bp, mus musculus
taacaactattcctcttcaagcatt

SEQ ID NO: 76743 - DNA, 25 bp, mus musculus
caactattcctcttcaagcattttc

SEQ ID NO: 76744 - DNA, 25 bp, mus musculus
ctattcctcttcaagcattttcaga

SEQ ID NO: 76745 - DNA, 25 bp, mus musculus
ttcctcttcaagcattttcagagga

SEQ ID NO: 76746 - DNA, 25 bp, mus musculus
ctcttcaagcattttcagaggagga

SEQ ID NO: 76747 - DNA, 25 bp, mus musculus
ttcaagcattttcagaggaggaaac

SEQ ID NO: 76748 - DNA, 25 bp, mus musculus
ttttctgtacaggtttgttacagtg

SEQ ID NO: 76749 - DNA, 25 bp, mus musculus
taattgtgttttccatcctacagtt

SEQ ID NO: 76750 - DNA, 25 bp, mus musculus
atgcacacagcatacttcaatgtct

SEQ ID NO: 76751 - DNA, 25 bp, mus musculus
cacacagcatacttcaatgtctatt

SEQ ID NO: 76752 - DNA, 25 bp, mus musculus
acagcatacttcaatgtctatttca

SEQ ID NO: 76753 - DNA, 25 bp, mus musculus
gcatacttcaatgtctatttcagtt

SEQ ID NO: 76754 - DNA, 25 bp, mus musculus
tacttcaatgtctatttcagttgta

SEQ ID NO: 76755 - DNA, 25 bp, mus musculus
gtctatttcagttgtacagttatga

SEQ ID NO: 76756 - DNA, 25 bp, mus musculus
gattcatatatgtatctctgaaatt

SEQ ID NO: 76757 - DNA, 25 bp, mus musculus
atgcacaacggtatcaaaagctatg

SEQ ID NO: 76758 - DNA, 25 bp, mus musculus
cgcctgatttctgttgtcctcgcag

SEQ ID NO: 76759 - DNA, 25 bp, mus musculus
ctgatttctgttgtcctcgcagtct

SEQ ID NO: 76760 - DNA, 25 bp, mus musculus
gtctaccgacacgtcatgatggaga

SEQ ID NO: 76761 - DNA, 25 bp, mus musculus
aatgtagtctcactgggacttccag

SEQ ID NO: 76762 - DNA, 25 bp, mus musculus
gtagtctcactgggacttccaggat

SEQ ID NO: 76763 - DNA, 25 bp, mus musculus
tcactgggacttccaggatctaagc

SEQ ID NO: 76764 - DNA, 25 bp, mus musculus
ctgggacttccaggatctaagcctg

SEQ ID NO: 76765 - DNA, 25 bp, mus musculus
ccaggatctaagcctgttgtgatct

SEQ ID NO: 76766 - DNA, 25 bp, mus musculus
ggatctaagcctgttgtgatctccc

SEQ ID NO: 76767 - DNA, 25 bp, mus musculus
tctaagcctgttgtgatctcccagc

SEQ ID NO: 76768 - DNA, 25 bp, mus musculus
cctgttgtgatctcccagctggagc

SEQ ID NO: 76769 - DNA, 25 bp, mus musculus
gttgtgatctcccagctggagcgag

SEQ ID NO: 76770 - DNA, 25 bp, mus musculus
gttgtcctcgcagtcttgagatacc

SEQ ID NO: 76771 - DNA, 25 bp, mus musculus
gtcctcgcagtcttgagataccaag

SEQ ID NO: 76772 - DNA, 25 bp, mus musculus
gctgccagcagcaccacaggccaaa

SEQ ID NO: 76773 - DNA, 25 bp, mus musculus
agcagcaccacaggccaaagtgacc

SEQ ID NO: 76774 - DNA, 25 bp, mus musculus
agcaccacaggccaaagtgaccttt

SEQ ID NO: 76775 - DNA, 25 bp, mus musculus
ggctgttctgctgtctcaggaggag

SEQ ID NO: 76776 - DNA, 25 bp, mus musculus
tgttctgctgtctcaggaggagtgg

SEQ ID NO: 76777 - DNA, 25 bp, mus musculus
ggcgtctaccgacacgtcatgatgg

SEQ ID NO: 76778 - DNA, 25 bp, mus musculus
catggtcaattccacacggttcttc

SEQ ID NO: 76779 - DNA, 25 bp, mus musculus
tggtcaattccacacggttcttcga

SEQ ID NO: 76780 - DNA, 25 bp, mus musculus
tgtgtcaacgtggttgctttatacg

SEQ ID NO: 76781 - DNA, 25 bp, mus musculus
tgtcaacgtggttgctttatacgcc

SEQ ID NO: 76782 - DNA, 25 bp, mus musculus
gttgctttatacgccatcatggcac

SEQ ID NO: 76783 - DNA, 25 bp, mus musculus
tgctttatacgccatcatggcactg

SEQ ID NO: 76784 - DNA, 25 bp, mus musculus
ttatacgccatcatggcactgactg

SEQ ID NO: 76785 - DNA, 25 bp, mus musculus
atacgccatcatggcactgactgca

SEQ ID NO: 76786 - DNA, 25 bp, mus musculus
catcatggcactgactgcaggtcga

SEQ ID NO: 76787 - DNA, 25 bp, mus musculus
tcatggcactgactgcaggtcgatc

SEQ ID NO: 76788 - DNA, 25 bp, mus musculus
gaagttcaccccataggatacaagt

SEQ ID NO: 76789 - DNA, 25 bp, mus musculus
ttcaccccataggatacaagtcctg

SEQ ID NO: 76790 - DNA, 25 bp, mus musculus
gtcaattccacacggttcttcgaca

SEQ ID NO: 76791 - DNA, 25 bp, mus musculus
caccccataggatacaagtcctggc

SEQ ID NO: 76792 - DNA, 25 bp, mus musculus
caattccacacggttcttcgacata

SEQ ID NO: 76793 - DNA, 25 bp, mus musculus
tccacacggttcttcgacataacgg

SEQ ID NO: 76794 - DNA, 25 bp, mus musculus
agtattccaggattcatgtgtcaac

SEQ ID NO: 76795 - DNA, 25 bp, mus musculus
aggattcatgtgtcaacgtggttgc

SEQ ID NO: 76796 - DNA, 25 bp, mus musculus
gattcatgtgtcaacgtggttgctt

SEQ ID NO: 76797 - DNA, 25 bp, mus musculus
ttcatgtgtcaacgtggttgcttta

SEQ ID NO: 76798 - DNA, 25 bp, mus musculus
catgtgtcaacgtggttgctttata

SEQ ID NO: 76799 - DNA, 25 bp, mus musculus
tctcaaagctccctgccatagcgga

SEQ ID NO: 76800 - DNA, 25 bp, mus musculus
ctgccatagcggaggaccaccagaa

SEQ ID NO: 76801 - DNA, 25 bp, mus musculus
tgagaagcctccagaactcactgca

SEQ ID NO: 76802 - DNA, 25 bp, mus musculus
gcctccagaactcactgcaaggact

SEQ ID NO: 76803 - DNA, 25 bp, mus musculus
agaactcactgcaaggactctggcc

SEQ ID NO: 76804 - DNA, 25 bp, mus musculus
cactgcaaggactctggccagtacc

SEQ ID NO: 76805 - DNA, 25 bp, mus musculus
aaggactctggccagtacccagtgg

SEQ ID NO: 76806 - DNA, 25 bp, mus musculus
tgctccagcgcagggaaggcagcac

SEQ ID NO: 76807 - DNA, 25 bp, mus musculus
gaggtctccttgagtcttccaccga

SEQ ID NO: 76808 - DNA, 25 bp, mus musculus
ccaccgatgttgtggcaccacaacc

SEQ ID NO: 76809 - DNA, 25 bp, mus musculus
tggcaccacaacctgcatcaaactg

SEQ ID NO: 76810 - DNA, 25 bp, mus musculus
ctgcatcaaactgccaggccgagag

SEQ ID NO: 76811 - DNA, 25 bp, mus musculus
aggaccaccagaagaatgctgggat

SEQ ID NO: 76812 - DNA, 25 bp, mus musculus
gtgcacgcatcaacgtgtcactgga

SEQ ID NO: 76813 - DNA, 25 bp, mus musculus
gcatcaacgtgtcactggagcagct

SEQ ID NO: 76814 - DNA, 25 bp, mus musculus
gacactactcacatcagatacggaa

SEQ ID NO: 76815 - DNA, 25 bp, mus musculus
actcacatcagatacggaaacgaaa

SEQ ID NO: 76816 - DNA, 25 bp, mus musculus
agaaggccgatatcctggagctgag

SEQ ID NO: 76817 - DNA, 25 bp, mus musculus
ccgatatcctggagctgagtgttaa

SEQ ID NO: 76818 - DNA, 25 bp, mus musculus
agtacatgagaagcctccagaactc

SEQ ID NO: 76819 - DNA, 25 bp, mus musculus
gcctcatcttgaatatttcttcagg

SEQ ID NO: 76820 - DNA, 25 bp, mus musculus
atatttcttcaggcgcagcccttcg

SEQ ID NO: 76821 - DNA, 25 bp, mus musculus
ccagaatcttctatagcagcaccgc

SEQ ID NO: 76822 - DNA, 25 bp, mus musculus
tcttctatagcagcaccgctcaacg

SEQ ID NO: 76823 - DNA, 25 bp, mus musculus
ctcaacgattcctcctgacacgata

SEQ ID NO: 76824 - DNA, 25 bp, mus musculus
gattcctcctgacacgatactcaga

SEQ ID NO: 76825 - DNA, 25 bp, mus musculus
tcctgacacgatactcagattacct

SEQ ID NO: 76826 - DNA, 25 bp, mus musculus
actcagattacctcaaacgcaacat

SEQ ID NO: 76827 - DNA, 25 bp, mus musculus
attacctcaaacgcaacatcagcaa

SEQ ID NO: 76828 - DNA, 25 bp, mus musculus
gcaacatcagcaacagatagtgggg

SEQ ID NO: 76829 - DNA, 25 bp, mus musculus
ggaagccttccatgccacaggacag

SEQ ID NO: 76830 - DNA, 25 bp, mus musculus
cttccatgccacaggacagtgtcga

SEQ ID NO: 76831 - DNA, 25 bp, mus musculus
ggcctctttacagcctgtactcagc

SEQ ID NO: 76832 - DNA, 25 bp, mus musculus
tttacagcctgtactcagcttccaa

SEQ ID NO: 76833 - DNA, 25 bp, mus musculus
gaatcattattcaggtgctgacccc

SEQ ID NO: 76834 - DNA, 25 bp, mus musculus
ttattcaggtgctgaccccttattc

SEQ ID NO: 76835 - DNA, 25 bp, mus musculus
agatgaccaagaccgccgatgagtt

SEQ ID NO: 76836 - DNA, 25 bp, mus musculus
ctgaatcctgtggctgccttgctca

SEQ ID NO: 76837 - DNA, 25 bp, mus musculus
cctgtggctgccttgctcatgaaat

SEQ ID NO: 76838 - DNA, 25 bp, mus musculus
tcccttccagaatcttctatagcag

SEQ ID NO: 76839 - DNA, 25 bp, mus musculus
cacacatctcctacaataggaagca

SEQ ID NO: 76840 - DNA, 25 bp, mus musculus
tctcctacaataggaagcaatgtgg

SEQ ID NO: 76841 - DNA, 25 bp, mus musculus
gtactatactaacacagagtttgta

SEQ ID NO: 76842 - DNA, 25 bp, mus musculus
tatactaacacagagtttgtaatag

SEQ ID NO: 76843 - DNA, 25 bp, mus musculus
aagagctctacaagatgctagccca

SEQ ID NO: 76844 - DNA, 25 bp, mus musculus
tctacaagatgctagcccacgagga

SEQ ID NO: 76845 - DNA, 25 bp, mus musculus
tacaagatgctagcccacgaggacc

SEQ ID NO: 76846 - DNA, 25 bp, mus musculus
caagatgctagcccacgaggaccta

SEQ ID NO: 76847 - DNA, 25 bp, mus musculus
agatgctagcccacgaggacctaag

SEQ ID NO: 76848 - DNA, 25 bp, mus musculus
atgctagcccacgaggacctaagaa

SEQ ID NO: 76849 - DNA, 25 bp, mus musculus
gcccacgaggacctaagaaaagctg

SEQ ID NO: 76850 - DNA, 25 bp, mus musculus
agctgggttgctgatttttgctaat

SEQ ID NO: 76851 - DNA, 25 bp, mus musculus
tacccgtttcctgatgtgggatatt

SEQ ID NO: 76852 - DNA, 25 bp, mus musculus
cgtttcctgatgtgggatattggtg

SEQ ID NO: 76853 - DNA, 25 bp, mus musculus
tttcctgatgtgggatattggtggc

SEQ ID NO: 76854 - DNA, 25 bp, mus musculus
ccaagaatcacttcgtccttcctgg

SEQ ID NO: 76855 - DNA, 25 bp, mus musculus
gaatcacttcgtccttcctggaaca

SEQ ID NO: 76856 - DNA, 25 bp, mus musculus
atcacttcgtccttcctggaacacg

SEQ ID NO: 76857 - DNA, 25 bp, mus musculus
acacgtactatactaacacagagtt

SEQ ID NO: 76858 - DNA, 25 bp, mus musculus
acgtactatactaacacagagtttg

SEQ ID NO: 76859 - DNA, 25 bp, mus musculus
ccacagccacaatggatcatcagtc

SEQ ID NO: 76860 - DNA, 25 bp, mus musculus
atcagtctgtaacccctacggagat

SEQ ID NO: 76861 - DNA, 25 bp, mus musculus
ggcttcactcttactgataggaacc

SEQ ID NO: 76862 - DNA, 25 bp, mus musculus
tcaattcaattgcccttctaacaaa

SEQ ID NO: 76863 - DNA, 25 bp, mus musculus
ctccattggtggcaaatccgaggga

SEQ ID NO: 76864 - DNA, 25 bp, mus musculus
cttgtcctttcttctatgtgataca

SEQ ID NO: 76865 - DNA, 25 bp, mus musculus
ctttcttctatgtgatacaacagac

SEQ ID NO: 76866 - DNA, 25 bp, mus musculus
tgatacaacagacgttacctcatgt

SEQ ID NO: 76867 - DNA, 25 bp, mus musculus
cgttacctcatgttgccactcacaa

SEQ ID NO: 76868 - DNA, 25 bp, mus musculus
ttgccactcacaaaccgttatgggg

SEQ ID NO: 76869 - DNA, 25 bp, mus musculus
ctggcaccaaagtcaccatggggca

SEQ ID NO: 76870 - DNA, 25 bp, mus musculus
tggggcaatctcctaatctcctttc

SEQ ID NO: 76871 - DNA, 25 bp, mus musculus
cgactcttttctatctaaagactat

SEQ ID NO: 76872 - DNA, 25 bp, mus musculus
agactatgactcccagtgagaagga

SEQ ID NO: 76873 - DNA, 25 bp, mus musculus
ccactgtttcccctagagagatgtc

SEQ ID NO: 76874 - DNA, 25 bp, mus musculus
agatgtcagctacccctaatggaca

SEQ ID NO: 76875 - DNA, 25 bp, mus musculus
cagctacccctaatggacagagtaa

SEQ ID NO: 76876 - DNA, 25 bp, mus musculus
attggtcttccagctctattgtctt

SEQ ID NO: 76877 - DNA, 25 bp, mus musculus
cttccagctctattgtcttgttcct

SEQ ID NO: 76878 - DNA, 25 bp, mus musculus
gctctattgtcttgttcctatgata

SEQ ID NO: 76879 - DNA, 25 bp, mus musculus
ttcgacgcgcacgtccagggcggct

SEQ ID NO: 76880 - DNA, 25 bp, mus musculus
gccacagtgcttcgtttccactaag

SEQ ID NO: 76881 - DNA, 25 bp, mus musculus
ctgctttctccgaagatgacttaac

SEQ ID NO: 76882 - DNA, 25 bp, mus musculus
ccagccaccggaagctttgcagatt

SEQ ID NO: 76883 - DNA, 25 bp, mus musculus
agccctcacggttcgtctccagcag

SEQ ID NO: 76884 - DNA, 25 bp, mus musculus
cacggttcgtctccagcagaagccc

SEQ ID NO: 76885 - DNA, 25 bp, mus musculus
aggctttggcggcgttgtacagtga

SEQ ID NO: 76886 - DNA, 25 bp, mus musculus
cgttgtacagtgaccaccacaagtc

SEQ ID NO: 76887 - DNA, 25 bp, mus musculus
ctcctgctgaccctgagggcaggac

SEQ ID NO: 76888 - DNA, 25 bp, mus musculus
gcgaacagctctatgtggaggttca

SEQ ID NO: 76889 - DNA, 25 bp, mus musculus
gcataggccttggctttgatctcat

SEQ ID NO: 76890 - DNA, 25 bp, mus musculus
gccttggctttgatctcattggatg

SEQ ID NO: 76891 - DNA, 25 bp, mus musculus
gtgcttcgtttccactaaggcggat

SEQ ID NO: 76892 - DNA, 25 bp, mus musculus
ccttggctttgatctcattggatgt

SEQ ID NO: 76893 - DNA, 25 bp, mus musculus
tccagtgagccaatgcctgtgggcg

SEQ ID NO: 76894 - DNA, 25 bp, mus musculus
atgcctgtgggcgaaggagtcgccc

SEQ ID NO: 76895 - DNA, 25 bp, mus musculus
tctgccctggcagagactgagggtt

SEQ ID NO: 76896 - DNA, 25 bp, mus musculus
gccggccaaagtcgtgcactgaggg

SEQ ID NO: 76897 - DNA, 25 bp, mus musculus
caaagtcgtgcactgaggggcctcg

SEQ ID NO: 76898 - DNA, 25 bp, mus musculus
ggcctcgtccatctgctttctccga

SEQ ID NO: 76899 - DNA, 25 bp, mus musculus
gtccatctgctttctccgaagatga

SEQ ID NO: 76900 - DNA, 25 bp, mus musculus
aagctctttgcatggaataaagggg

SEQ ID NO: 76901 - DNA, 25 bp, mus musculus
ctttgcactcagaatctgagataca

SEQ ID NO: 76902 - DNA, 25 bp, mus musculus
tgtaccacatggttaagttctaaat

SEQ ID NO: 76903 - DNA, 25 bp, mus musculus
tctaaatcttaaactatcagtgaaa

SEQ ID NO: 76904 - DNA, 25 bp, mus musculus
ttgtgactacctagctagcctccag

SEQ ID NO: 76905 - DNA, 25 bp, mus musculus
cctccagcaggcaacttgggagttt

SEQ ID NO: 76906 - DNA, 25 bp, mus musculus
ggagtttcacccgtgaatatctgaa

SEQ ID NO: 76907 - DNA, 25 bp, mus musculus
tcacccgtgaatatctgaataatga

SEQ ID NO: 76908 - DNA, 25 bp, mus musculus
atgagctaactttccatctattcac

SEQ ID NO: 76909 - DNA, 25 bp, mus musculus
taactttccatctattcactgtaaa

SEQ ID NO: 76910 - DNA, 25 bp, mus musculus
atgtaatccactgaactactgtacg

SEQ ID NO: 76911 - DNA, 25 bp, mus musculus
tccactgaactactgtacgtataaa

SEQ ID NO: 76912 - DNA, 25 bp, mus musculus
agatacacttagctctgcctctacg

SEQ ID NO: 76913 - DNA, 25 bp, mus musculus
ctcactgtatcccacttgagaaaaa

SEQ ID NO: 76914 - DNA, 25 bp, mus musculus
tatatactgtgtggctatctgtaaa

SEQ ID NO: 76915 - DNA, 25 bp, mus musculus
actcttatttgtctaactatagatg

SEQ ID NO: 76916 - DNA, 25 bp, mus musculus
atttgtctaactatagatgggcaac

SEQ ID NO: 76917 - DNA, 25 bp, mus musculus
acttcatctagttagcaagttctcc

SEQ ID NO: 76918 - DNA, 25 bp, mus musculus
tagcaagttctccatcactttaaga

SEQ ID NO: 76919 - DNA, 25 bp, mus musculus
gttctccatcactttaagatttaca

SEQ ID NO: 76920 - DNA, 25 bp, mus musculus
tcaggagctctgacgcctctcgttc

SEQ ID NO: 76921 - DNA, 25 bp, mus musculus
ctcgttctgtgaatgcctggtctcc

SEQ ID NO: 76922 - DNA, 25 bp, mus musculus
ttcctctcggcatacaggtgtcgca

SEQ ID NO: 76923 - DNA, 25 bp, mus musculus
tcggcatacaggtgtcgcatagaca

SEQ ID NO: 76924 - DNA, 25 bp, mus musculus
cgcatagacatccacgatgtgcaca

SEQ ID NO: 76925 - DNA, 25 bp, mus musculus
atccacgatgtgcacaatgtgtggg

SEQ ID NO: 76926 - DNA, 25 bp, mus musculus
cactgctctgcgcgccttcggatag

SEQ ID NO: 76927 - DNA, 25 bp, mus musculus
tgctctgcgcgccttcggatagtcg

SEQ ID NO: 76928 - DNA, 25 bp, mus musculus
gcgcgccttcggatagtcgctgagc

SEQ ID NO: 76929 - DNA, 25 bp, mus musculus
cttcggatagtcgctgagcatcttt

SEQ ID NO: 76930 - DNA, 25 bp, mus musculus
atagtcgctgagcatctttagggcg

SEQ ID NO: 76931 - DNA, 25 bp, mus musculus
gtcgctgagcatctttagggcgaat

SEQ ID NO: 76932 - DNA, 25 bp, mus musculus
ctcggtcctggattcgactaaagag

SEQ ID NO: 76933 - DNA, 25 bp, mus musculus
ggttctcttgtcgaagatcctgagc

SEQ ID NO: 76934 - DNA, 25 bp, mus musculus
ggtcctggattcgactaaagagctg

SEQ ID NO: 76935 - DNA, 25 bp, mus musculus
taaagagctgctccatcatcgagac

SEQ ID NO: 76936 - DNA, 25 bp, mus musculus
ccatcatcgagacactccatgacaa

SEQ ID NO: 76937 - DNA, 25 bp, mus musculus
tcgagacactccatgacaagcagca

SEQ ID NO: 76938 - DNA, 25 bp, mus musculus
acaagcagcaggcacttcctctcgg

SEQ ID NO: 76939 - DNA, 25 bp, mus musculus
aggcacttcctctcggcatacaggt

SEQ ID NO: 76940 - DNA, 25 bp, mus musculus
cacttcctctcggcatacaggtgtc

SEQ ID NO: 76941 - DNA, 25 bp, mus musculus
gctgtccaatttttggcctttgaag

SEQ ID NO: 76942 - DNA, 25 bp, mus musculus
tttttggcctttgaagagttgactg

SEQ ID NO: 76943 - DNA, 25 bp, mus musculus
tacaccctgtggacgtcctgcgtac

SEQ ID NO: 76944 - DNA, 25 bp, mus musculus
agggcgagcccaagatctataacaa

SEQ ID NO: 76945 - DNA, 25 bp, mus musculus
agcccaagatctataacaatctgcg

SEQ ID NO: 76946 - DNA, 25 bp, mus musculus
ccaagatctataacaatctgcgaga

SEQ ID NO: 76947 - DNA, 25 bp, mus musculus
agatctataacaatctgcgagaggc

SEQ ID NO: 76948 - DNA, 25 bp, mus musculus
tctataacaatctgcgagaggccat

SEQ ID NO: 76949 - DNA, 25 bp, mus musculus
acaatctgcgagaggccatacggac

SEQ ID NO: 76950 - DNA, 25 bp, mus musculus
atctgcgagaggccatacggaccat

SEQ ID NO: 76951 - DNA, 25 bp, mus musculus
aggccatacggaccatgtataagac

SEQ ID NO: 76952 - DNA, 25 bp, mus musculus
ccatacggaccatgtataagaccga

SEQ ID NO: 76953 - DNA, 25 bp, mus musculus
ttgactgagctgctctaccaagcca

SEQ ID NO: 76954 - DNA, 25 bp, mus musculus
actgagctgctctaccaagccaact

SEQ ID NO: 76955 - DNA, 25 bp, mus musculus
ctgctctaccaagccaacttgtacc

SEQ ID NO: 76956 - DNA, 25 bp, mus musculus
ttgtaccaaacgcaccagttctcag

SEQ ID NO: 76957 - DNA, 25 bp, mus musculus
taccaaacgcaccagttctcagcgc

SEQ ID NO: 76958 - DNA, 25 bp, mus musculus
caaacgcaccagttctcagcgcact

SEQ ID NO: 76959 - DNA, 25 bp, mus musculus
cagttctcagcgcactttgtgtggg

SEQ ID NO: 76960 - DNA, 25 bp, mus musculus
tcaccgtacaccctgtggacgtcct

SEQ ID NO: 76961 - DNA, 25 bp, mus musculus
ctgctcccttggggcttcatagatt

SEQ ID NO: 76962 - DNA, 25 bp, mus musculus
tagcttatggaccaaacccataggg

SEQ ID NO: 76963 - DNA, 25 bp, mus musculus
tttaaagttgtgtccactggataag

SEQ ID NO: 76964 - DNA, 25 bp, mus musculus
ttcgtcttgcccaactgttactgcc

SEQ ID NO: 76965 - DNA, 25 bp, mus musculus
ttgcccaactgttactgccaaattg

SEQ ID NO: 76966 - DNA, 25 bp, mus musculus
cccaactgttactgccaaattgaat

SEQ ID NO: 76967 - DNA, 25 bp, mus musculus
aactgttactgccaaattgaattca

SEQ ID NO: 76968 - DNA, 25 bp, mus musculus
ccccacgtcaccatgataaaatagg

SEQ ID NO: 76969 - DNA, 25 bp, mus musculus
aaatttcaatctcacctgtgtttgt

SEQ ID NO: 76970 - DNA, 25 bp, mus musculus
tctcacctgtgtttgtcttatgtga

SEQ ID NO: 76971 - DNA, 25 bp, mus musculus
cacctgtgtttgtcttatgtgatct

SEQ ID NO: 76972 - DNA, 25 bp, mus musculus
tatgtgatctcagtgttgtatttac

SEQ ID NO: 76973 - DNA, 25 bp, mus musculus
catagggacccctaatgacttctgt

SEQ ID NO: 76974 - DNA, 25 bp, mus musculus
gacccctaatgacttctgtggagat

SEQ ID NO: 76975 - DNA, 25 bp, mus musculus
taatgacttctgtggagattctcca

SEQ ID NO: 76976 - DNA, 25 bp, mus musculus
agattctccacgggcgcaagaggtc

SEQ ID NO: 76977 - DNA, 25 bp, mus musculus
ggtctctccggataaggtgccttct

SEQ ID NO: 76978 - DNA, 25 bp, mus musculus
taaggtgccttctgtaaacgagtgc

SEQ ID NO: 76979 - DNA, 25 bp, mus musculus
gccttctgtaaacgagtgcggattt

SEQ ID NO: 76980 - DNA, 25 bp, mus musculus
tgtaaccaggctattttgttcttgc

SEQ ID NO: 76981 - DNA, 25 bp, mus musculus
cggcacagcagcagctctcagactt

SEQ ID NO: 76982 - DNA, 25 bp, mus musculus
agcagctctcagacttcctgtgggc

SEQ ID NO: 76983 - DNA, 25 bp, mus musculus
ctcctgggctctgatgatgaggaac

SEQ ID NO: 76984 - DNA, 25 bp, mus musculus
gaagaccctaaggactattgcaagg

SEQ ID NO: 76985 - DNA, 25 bp, mus musculus
ggtggttactacccagtgaagatcg

SEQ ID NO: 76986 - DNA, 25 bp, mus musculus
tactacccagtgaagatcggtgatt

SEQ ID NO: 76987 - DNA, 25 bp, mus musculus
tacccagtgaagatcggtgatttgt

SEQ ID NO: 76988 - DNA, 25 bp, mus musculus
ttgttcaatgggcggtaccatgtgg

SEQ ID NO: 76989 - DNA, 25 bp, mus musculus
ttcaatgggcggtaccatgtggtgc

SEQ ID NO: 76990 - DNA, 25 bp, mus musculus
ggggccatttctctacagtctggct

SEQ ID NO: 76991 - DNA, 25 bp, mus musculus
ctacagtctggctctgctgggatat

SEQ ID NO: 76992 - DNA, 25 bp, mus musculus
cagtctggctctgctgggatattca

SEQ ID NO: 76993 - DNA, 25 bp, mus musculus
cagacttcctgtgggcctgagtcct

SEQ ID NO: 76994 - DNA, 25 bp, mus musculus
atattcagcgcaacgctttgtggcc

SEQ ID NO: 76995 - DNA, 25 bp, mus musculus
tcctgtgggcctgagtcctcaggct

SEQ ID NO: 76996 - DNA, 25 bp, mus musculus
cctgagtcctcaggctctgaattaa

SEQ ID NO: 76997 - DNA, 25 bp, mus musculus
ggctctgaattaactccagccacac

SEQ ID NO: 76998 - DNA, 25 bp, mus musculus
tctgaattaactccagccacaccag

SEQ ID NO: 76999 - DNA, 25 bp, mus musculus
ccagcacctcgtttgctgcagggac

SEQ ID NO: 77000 - DNA, 25 bp, mus musculus
gcacctcgtttgctgcagggactcc

SEQ ID NO: 77001 - DNA, 25 bp, mus musculus
ggactcctgggctctgatgatgagg

SEQ ID NO: 77002 - DNA, 25 bp, mus musculus
gagcactaccagctgggactgttct

SEQ ID NO: 77003 - DNA, 25 bp, mus musculus
tggcgccacctactgggacaatggc

SEQ ID NO: 77004 - DNA, 25 bp, mus musculus
aggtcccattcagctgtggcaattc

SEQ ID NO: 77005 - DNA, 25 bp, mus musculus
gcaattcctcctggagctgctccaa

SEQ ID NO: 77006 - DNA, 25 bp, mus musculus
gctccaagacggggctcgcagcagc

SEQ ID NO: 77007 - DNA, 25 bp, mus musculus
ctgcatccgctggacgggcaatagc

SEQ ID NO: 77008 - DNA, 25 bp, mus musculus
gttccagctgtgcgaccccaaagag

SEQ ID NO: 77009 - DNA, 25 bp, mus musculus
ttaccgccgcgacatcgtgctcaag

SEQ ID NO: 77010 - DNA, 25 bp, mus musculus
ccgcgacatcgtgctcaagagtggt

SEQ ID NO: 77011 - DNA, 25 bp, mus musculus
gcctgtcctcgcctatcaggatgat

SEQ ID NO: 77012 - DNA, 25 bp, mus musculus
gcatctgccaggtgcagaaggccaa

SEQ ID NO: 77013 - DNA, 25 bp, mus musculus
tctgccaggtgcagaaggccaataa

SEQ ID NO: 77014 - DNA, 25 bp, mus musculus
tgccggttcggactacaccaccacg

SEQ ID NO: 77015 - DNA, 25 bp, mus musculus
ttcggactacaccaccacgtggaat

SEQ ID NO: 77016 - DNA, 25 bp, mus musculus
ctacaccaccacgtggaatactggg

SEQ ID NO: 77017 - DNA, 25 bp, mus musculus
ggactgcagcatccctttcgagggg

SEQ ID NO: 77018 - DNA, 25 bp, mus musculus
gcaccagagtccagcattcaccacg

SEQ ID NO: 77019 - DNA, 25 bp, mus musculus
gccctccaaatcgaacaagcagtct

SEQ ID NO: 77020 - DNA, 25 bp, mus musculus
caaatcgaacaagcagtctgataga

SEQ ID NO: 77021 - DNA, 25 bp, mus musculus
agccacattgactcgctactccaaa

SEQ ID NO: 77022 - DNA, 25 bp, mus musculus
tcatgtccatgggctacgagcggga

SEQ ID NO: 77023 - DNA, 25 bp, mus musculus
ccgcattgagggccagctacaacaa

SEQ ID NO: 77024 - DNA, 25 bp, mus musculus
tgctccagcagctgggtcaggaaaa

SEQ ID NO: 77025 - DNA, 25 bp, mus musculus
agcagttcatccagatgttgaatga

SEQ ID NO: 77026 - DNA, 25 bp, mus musculus
tcatccagatgttgaatgagcctcc

SEQ ID NO: 77027 - DNA, 25 bp, mus musculus
agctggcggacatctctgatgtaga

SEQ ID NO: 77028 - DNA, 25 bp, mus musculus
actatatccaggtgacaccgcagga

SEQ ID NO: 77029 - DNA, 25 bp, mus musculus
tccaggtgacaccgcaggagaagga

SEQ ID NO: 77030 - DNA, 25 bp, mus musculus
tcccagagagcctggtgatccaggc

SEQ ID NO: 77031 - DNA, 25 bp, mus musculus
tccaggcctacttcgcgtgtgaaaa

SEQ ID NO: 77032 - DNA, 25 bp, mus musculus
tggctgccaacttcctcctgagtca

SEQ ID NO: 77033 - DNA, 25 bp, mus musculus
tcctcctgagtcagaactttgatga

SEQ ID NO: 77034 - DNA, 25 bp, mus musculus
ttccaggaagccctgagcctgaaca

SEQ ID NO: 77035 - DNA, 25 bp, mus musculus
ctgaacatggttctgtccaggaaag

SEQ ID NO: 77036 - DNA, 25 bp, mus musculus
atggttctgtccaggaaagccagcg

SEQ ID NO: 77037 - DNA, 25 bp, mus musculus
aggaaagccagcgcgctgagcagcc

SEQ ID NO: 77038 - DNA, 25 bp, mus musculus
agcagccggccacagaagcagcagg

SEQ ID NO: 77039 - DNA, 25 bp, mus musculus
tcctgcgggaccagcctcagttcca

SEQ ID NO: 77040 - DNA, 25 bp, mus musculus
agcctcagttccagaacatgcggca

SEQ ID NO: 77041 - DNA, 25 bp, mus musculus
agttccagaacatgcggcaagtgat

SEQ ID NO: 77042 - DNA, 25 bp, mus musculus
ttctaatgggaatccctggagatag

SEQ ID NO: 77043 - DNA, 25 bp, mus musculus
ctcctcctcaggctgtgagtactgg

SEQ ID NO: 77044 - DNA, 25 bp, mus musculus
atccttctttgctgccagccttgct

SEQ ID NO: 77045 - DNA, 25 bp, mus musculus
ctttgctgccagccttgctacagca

SEQ ID NO: 77046 - DNA, 25 bp, mus musculus
ccttgctacagcagataggtcggga

SEQ ID NO: 77047 - DNA, 25 bp, mus musculus
ttagccaacaccaggagcattttat

SEQ ID NO: 77048 - DNA, 25 bp, mus musculus
attacattcaagtaacacctcagga

SEQ ID NO: 77049 - DNA, 25 bp, mus musculus
ttcaagtaacacctcaggagaaaga

SEQ ID NO: 77050 - DNA, 25 bp, mus musculus
catattttgcttgtgagaagaatga

SEQ ID NO: 77051 - DNA, 25 bp, mus musculus
tggctgccaactttcttctacagca

SEQ ID NO: 77052 - DNA, 25 bp, mus musculus
ccaactttcttctacagcagaactt

SEQ ID NO: 77053 - DNA, 25 bp, mus musculus
ttcttctacagcagaactttgatga

SEQ ID NO: 77054 - DNA, 25 bp, mus musculus
ctcaggctgtgagtactggaactcc

SEQ ID NO: 77055 - DNA, 25 bp, mus musculus
cagtagctgcagctgcagcaaccac

SEQ ID NO: 77056 - DNA, 25 bp, mus musculus
ctgcagctgcagcaaccacgacagc

SEQ ID NO: 77057 - DNA, 25 bp, mus musculus
caaccacgacagcaactacaacaac

SEQ ID NO: 77058 - DNA, 25 bp, mus musculus
caactacaacaaccacttctggagg

SEQ ID NO: 77059 - DNA, 25 bp, mus musculus
atcagcctcagtttcaacagatgag

SEQ ID NO: 77060 - DNA, 25 bp, mus musculus
ttatccagcagaatccttctttgct

SEQ ID NO: 77061 - DNA, 25 bp, mus musculus
agcagaatccttctttgctgccagc

SEQ ID NO: 77062 - DNA, 25 bp, mus musculus
gtggttcctgttgggctttcagctc

SEQ ID NO: 77063 - DNA, 25 bp, mus musculus
ctggtaaactcctagctctgagtcc

SEQ ID NO: 77064 - DNA, 25 bp, mus musculus
actctgaagatgctttcccatatgt

SEQ ID NO: 77065 - DNA, 25 bp, mus musculus
aagatgctttcccatatgtgggcca

SEQ ID NO: 77066 - DNA, 25 bp, mus musculus
ctttcccatatgtgggccaggatga

SEQ ID NO: 77067 - DNA, 25 bp, mus musculus
gtatgtataacgccacggcaaaggc

SEQ ID NO: 77068 - DNA, 25 bp, mus musculus
ccatcgacgcaagcttggcatcttt

SEQ ID NO: 77069 - DNA, 25 bp, mus musculus
acgcaagcttggcatctttccagtt

SEQ ID NO: 77070 - DNA, 25 bp, mus musculus
catctttccagttttacagcagagg

SEQ ID NO: 77071 - DNA, 25 bp, mus musculus
tccagttttacagcagaggtgtgta

SEQ ID NO: 77072 - DNA, 25 bp, mus musculus
attgtgaccgtgataatgtgaacca

SEQ ID NO: 77073 - DNA, 25 bp, mus musculus
gctatggcacccagaagggaagcaa

SEQ ID NO: 77074 - DNA, 25 bp, mus musculus
aactcctagctctgagtccccagaa

SEQ ID NO: 77075 - DNA, 25 bp, mus musculus
tagctctgagtccccagaatcttgt

SEQ ID NO: 77076 - DNA, 25 bp, mus musculus
cccagaatcttgtggactgtgtgac

SEQ ID NO: 77077 - DNA, 25 bp, mus musculus
atcttgtggactgtgtgactgagaa

SEQ ID NO: 77078 - DNA, 25 bp, mus musculus
gctatatgaccactgctttccaata

SEQ ID NO: 77079 - DNA, 25 bp, mus musculus
ctgctttccaatacgtgcagcagaa

SEQ ID NO: 77080 - DNA, 25 bp, mus musculus
tccaatacgtgcagcagaacggagg

SEQ ID NO: 77081 - DNA, 25 bp, mus musculus
gcatcgactctgaagatgctttccc

SEQ ID NO: 77082 - DNA, 25 bp, mus musculus
tggtggcaccaaccgttagtcccat

SEQ ID NO: 77083 - DNA, 25 bp, mus musculus
gtcccattactcaggaggcataggc

SEQ ID NO: 77084 - DNA, 25 bp, mus musculus
cattgctgtaatcccagcactggag

SEQ ID NO: 77085 - DNA, 25 bp, mus musculus
tgctgtaatcccagcactggagtaa

SEQ ID NO: 77086 - DNA, 25 bp, mus musculus
tgtaatcccagcactggagtaagag

SEQ ID NO: 77087 - DNA, 25 bp, mus musculus
aatcccagcactggagtaagagtca

SEQ ID NO: 77088 - DNA, 25 bp, mus musculus
attaagcttccaggtaacctcattg

SEQ ID NO: 77089 - DNA, 25 bp, mus musculus
ccaggtaacctcattgtaccttgct

SEQ ID NO: 77090 - DNA, 25 bp, mus musculus
ggtaacctcattgtaccttgctgat

SEQ ID NO: 77091 - DNA, 25 bp, mus musculus
aacctcattgtaccttgctgatgtg

SEQ ID NO: 77092 - DNA, 25 bp, mus musculus
ctcattgtaccttgctgatgtgtca

SEQ ID NO: 77093 - DNA, 25 bp, mus musculus
tttgatactcgatttgacaaattac

SEQ ID NO: 77094 - DNA, 25 bp, mus musculus
ccattactcaggaggcataggcagg

SEQ ID NO: 77095 - DNA, 25 bp, mus musculus
gtggatctcttcagtttgaggccag

SEQ ID NO: 77096 - DNA, 25 bp, mus musculus
gatctcttcagtttgaggccagcca

SEQ ID NO: 77097 - DNA, 25 bp, mus musculus
ctcttcagtttgaggccagccaggg

SEQ ID NO: 77098 - DNA, 25 bp, mus musculus
ttgaggccagccagggctacgtaga

SEQ ID NO: 77099 - DNA, 25 bp, mus musculus
aggccagccagggctacgtagagac

SEQ ID NO: 77100 - DNA, 25 bp, mus musculus
ccagccagggctacgtagagacctg

SEQ ID NO: 77101 - DNA, 25 bp, mus musculus
gcacattgctgtaatcccagcactg

SEQ ID NO: 77102 - DNA, 25 bp, mus musculus
cacctgcagacagctgaagcccaaa

SEQ ID NO: 77103 - DNA, 25 bp, mus musculus
gctgaagcccaaagtcgaggtgcct

SEQ ID NO: 77104 - DNA, 25 bp, mus musculus
tggatccagagcagcagcggactgt

SEQ ID NO: 77105 - DNA, 25 bp, mus musculus
cagagcagcagcggactgtggcgcc

SEQ ID NO: 77106 - DNA, 25 bp, mus musculus
gcttgtaccaacatcaccatgggag

SEQ ID NO: 77107 - DNA, 25 bp, mus musculus
atcaccatgggagttgtctgcaagc

SEQ ID NO: 77108 - DNA, 25 bp, mus musculus
gttgtctgcaagctccctagagtgg

SEQ ID NO: 77109 - DNA, 25 bp, mus musculus
tgcaagctccctagagtggaagaga

SEQ ID NO: 77110 - DNA, 25 bp, mus musculus
aacagcttcttgccatcagcagccc

SEQ ID NO: 77111 - DNA, 25 bp, mus musculus
ctcctcctggccttgatgacggcag

SEQ ID NO: 77112 - DNA, 25 bp, mus musculus
taccggcgccgacagagtgcggagc

SEQ ID NO: 77113 - DNA, 25 bp, mus musculus
cccgcagaggccaccgagaagaaca

SEQ ID NO: 77114 - DNA, 25 bp, mus musculus
gcccaaagtcgaggtgcctggttgg

SEQ ID NO: 77115 - DNA, 25 bp, mus musculus
ggcatgaacttcaaccccaaaggag

SEQ ID NO: 77116 - DNA, 25 bp, mus musculus
tggcaagacaacacagctgtgaact

SEQ ID NO: 77117 - DNA, 25 bp, mus musculus
gacaacacagctgtgaactattcta

SEQ ID NO: 77118 - DNA, 25 bp, mus musculus
cctagcatgctaagccacaacagct

SEQ ID NO: 77119 - DNA, 25 bp, mus musculus
atgctaagccacaacagctgctact

SEQ ID NO: 77120 - DNA, 25 bp, mus musculus
agccacaacagctgctactggatcc

SEQ ID NO: 77121 - DNA, 25 bp, mus musculus
aacagctgctactggatccagagca

SEQ ID NO: 77122 - DNA, 25 bp, mus musculus
aggaacaatccagtccatctatggt

SEQ ID NO: 77123 - DNA, 25 bp, mus musculus
aatccagtccatctatggtgttaga

SEQ ID NO: 77124 - DNA, 25 bp, mus musculus
ttactcatctagtaaagaagattcc

SEQ ID NO: 77125 - DNA, 25 bp, mus musculus
agattcctaagaacccaccatctgg

SEQ ID NO: 77126 - DNA, 25 bp, mus musculus
ctaagaacccaccatctggctttgt

SEQ ID NO: 77127 - DNA, 25 bp, mus musculus
cctctcctcgaacgctgtcaacaag

SEQ ID NO: 77128 - DNA, 25 bp, mus musculus
ctcgaacgctgtcaacaagatccac

SEQ ID NO: 77129 - DNA, 25 bp, mus musculus
cgctgtcaacaagatccactgcaaa

SEQ ID NO: 77130 - DNA, 25 bp, mus musculus
caacaagatccactgcaaatcagtc

SEQ ID NO: 77131 - DNA, 25 bp, mus musculus
gatccactgcaaatcagtctttccg

SEQ ID NO: 77132 - DNA, 25 bp, mus musculus
ctgcaaatcagtctttccgcaaagt

SEQ ID NO: 77133 - DNA, 25 bp, mus musculus
atcagtctttccgcaaagtagtcaa

SEQ ID NO: 77134 - DNA, 25 bp, mus musculus
ctaatttccagaatcacaaaggcca

SEQ ID NO: 77135 - DNA, 25 bp, mus musculus
tccagaatcacaaaggccatgaatt

SEQ ID NO: 77136 - DNA, 25 bp, mus musculus
atcacaaaggccatgaattcattcc

SEQ ID NO: 77137 - DNA, 25 bp, mus musculus
atgaattcattcctaccctctacca

SEQ ID NO: 77138 - DNA, 25 bp, mus musculus
ctgccaactgtgaggcctgtgccaa

SEQ ID NO: 77139 - DNA, 25 bp, mus musculus
actgtgaggcctgtgccaaaccttt

SEQ ID NO: 77140 - DNA, 25 bp, mus musculus
aggcctgtgccaaacctttgtggca

SEQ ID NO: 77141 - DNA, 25 bp, mus musculus
gtgccaaacctttgtggcatgtctt

SEQ ID NO: 77142 - DNA, 25 bp, mus musculus
agtgacttccaggcctgggatttcg

SEQ ID NO: 77143 - DNA, 25 bp, mus musculus
gatttcgacttttggctataacaag

SEQ ID NO: 77144 - DNA, 25 bp, mus musculus
tgcagccaggcaccactgaccagga

SEQ ID NO: 77145 - DNA, 25 bp, mus musculus
gcaccactgaccaggaccttgtcaa

SEQ ID NO: 77146 - DNA, 25 bp, mus musculus
ccactgaccaggaccttgtcaagct

SEQ ID NO: 77147 - DNA, 25 bp, mus musculus
ctgaccaggaccttgtcaagctctg

SEQ ID NO: 77148 - DNA, 25 bp, mus musculus
aggaccttgtcaagctctgtcagcc

SEQ ID NO: 77149 - DNA, 25 bp, mus musculus
accttgtcaagctctgtcagccgta

SEQ ID NO: 77150 - DNA, 25 bp, mus musculus
ttgtcaagctctgtcagccgtagtg

SEQ ID NO: 77151 - DNA, 25 bp, mus musculus
agctctgtcagccgtagtgcaagat

SEQ ID NO: 77152 - DNA, 25 bp, mus musculus
tctgtcagccgtagtgcaagattgt

SEQ ID NO: 77153 - DNA, 25 bp, mus musculus
gcaagattgtctccactaaggccat

SEQ ID NO: 77154 - DNA, 25 bp, mus musculus
ggctcagcaaatggcacctccaagt

SEQ ID NO: 77155 - DNA, 25 bp, mus musculus
tcagcaaatggcacctccaagtcca

SEQ ID NO: 77156 - DNA, 25 bp, mus musculus
aatggcacctccaagtccaaggaat

SEQ ID NO: 77157 - DNA, 25 bp, mus musculus
ggcacctccaagtccaaggaatagc

SEQ ID NO: 77158 - DNA, 25 bp, mus musculus
gcaaaaccaacctgtatatccgagg

SEQ ID NO: 77159 - DNA, 25 bp, mus musculus
ccaacctgtatatccgaggactgca

SEQ ID NO: 77160 - DNA, 25 bp, mus musculus
tgtatatccgaggactgcagccagg

SEQ ID NO: 77161 - DNA, 25 bp, mus musculus
atatccgaggactgcagccaggcac

SEQ ID NO: 77162 - DNA, 25 bp, mus musculus
aagagcagtccaacccttacatggt

SEQ ID NO: 77163 - DNA, 25 bp, mus musculus
acccttacatggtgttagacataga

SEQ ID NO: 77164 - DNA, 25 bp, mus musculus
tagagtgccgtaggtgccacattaa

SEQ ID NO: 77165 - DNA, 25 bp, mus musculus
ttatagcgccctgcaaagtttatta

SEQ ID NO: 77166 - DNA, 25 bp, mus musculus
cgccctgcaaagtttattatgatat

SEQ ID NO: 77167 - DNA, 25 bp, mus musculus
cccgatcatcccctagaacttcaat

SEQ ID NO: 77168 - DNA, 25 bp, mus musculus
catcccctagaacttcaatgaaaat

SEQ ID NO: 77169 - DNA, 25 bp, mus musculus
tacaacaaaaccagtccattcggcg

SEQ ID NO: 77170 - DNA, 25 bp, mus musculus
agtccattcggcggcccagtcgaca

SEQ ID NO: 77171 - DNA, 25 bp, mus musculus
ggcccagtcgacagcttgctccaaa

SEQ ID NO: 77172 - DNA, 25 bp, mus musculus
gtcgacagcttgctccaaacaagcc

SEQ ID NO: 77173 - DNA, 25 bp, mus musculus
agcttgctccaaacaagccaagcta

SEQ ID NO: 77174 - DNA, 25 bp, mus musculus
acaagctatttcacgtccgacctgt

SEQ ID NO: 77175 - DNA, 25 bp, mus musculus
gcttgctccaaacaagccaagctaa

SEQ ID NO: 77176 - DNA, 25 bp, mus musculus
gacctgttacccagacagatgtata

SEQ ID NO: 77177 - DNA, 25 bp, mus musculus
ttacccagacagatgtatacagagc

SEQ ID NO: 77178 - DNA, 25 bp, mus musculus
atgagtttattcctactctttatca

SEQ ID NO: 77179 - DNA, 25 bp, mus musculus
acttcccaaccaactgtgaggcatg

SEQ ID NO: 77180 - DNA, 25 bp, mus musculus
caaccaactgtgaggcatgtatgaa

SEQ ID NO: 77181 - DNA, 25 bp, mus musculus
gtatgaagccgctgtggcacatgtt

SEQ ID NO: 77182 - DNA, 25 bp, mus musculus
ctgctctagagtgccgtaggtgcca

SEQ ID NO: 77183 - DNA, 25 bp, mus musculus
cgtgtgtctgacgcactgtatcact

SEQ ID NO: 77184 - DNA, 25 bp, mus musculus
gtgtctgacgcactgtatcactttc

SEQ ID NO: 77185 - DNA, 25 bp, mus musculus
taaggactactgactcatcaagaaa

SEQ ID NO: 77186 - DNA, 25 bp, mus musculus
ctactgactcatcaagaaatgactt

SEQ ID NO: 77187 - DNA, 25 bp, mus musculus
gtgtgtctgttgcttagccttgttc

SEQ ID NO: 77188 - DNA, 25 bp, mus musculus
ctgttgcttagccttgttcccgagt

SEQ ID NO: 77189 - DNA, 25 bp, mus musculus
gttcccgagtttcttaatgctctgt

SEQ ID NO: 77190 - DNA, 25 bp, mus musculus
tttcttaatgctctgtctgaggaag

SEQ ID NO: 77191 - DNA, 25 bp, mus musculus
cttaatgctctgtctgaggaagctg

SEQ ID NO: 77192 - DNA, 25 bp, mus musculus
gacacagattctgagctggggtcaa

SEQ ID NO: 77193 - DNA, 25 bp, mus musculus
tcaatgaaccgctacataattttgt

SEQ ID NO: 77194 - DNA, 25 bp, mus musculus
atgaaccgctacataattttgtgca

SEQ ID NO: 77195 - DNA, 25 bp, mus musculus
gacgcactgtatcactttcgggacc

SEQ ID NO: 77196 - DNA, 25 bp, mus musculus
gcactgtatcactttcgggacctgt

SEQ ID NO: 77197 - DNA, 25 bp, mus musculus
ctgtatcactttcgggacctgtctc

SEQ ID NO: 77198 - DNA, 25 bp, mus musculus
ctgtctccggatttcttctgaagac

SEQ ID NO: 77199 - DNA, 25 bp, mus musculus
aattttgggacctcatctccagatc

SEQ ID NO: 77200 - DNA, 25 bp, mus musculus
gggacctcatctccagatctcattt

SEQ ID NO: 77201 - DNA, 25 bp, mus musculus
acctcatctccagatctcatttaag

SEQ ID NO: 77202 - DNA, 25 bp, mus musculus
tcatctccagatctcatttaaggac

SEQ ID NO: 77203 - DNA, 25 bp, mus musculus
cagaactcctcatcagtgcagactg

SEQ ID NO: 77204 - DNA, 25 bp, mus musculus
gaactcctcatcagtgcagactgga

SEQ ID NO: 77205 - DNA, 25 bp, mus musculus
tcccagcagagactgcagcccagga

SEQ ID NO: 77206 - DNA, 25 bp, mus musculus
ccagcagagactgcagcccaggagg

SEQ ID NO: 77207 - DNA, 25 bp, mus musculus
agcagagactgcagcccaggaggac

SEQ ID NO: 77208 - DNA, 25 bp, mus musculus
cagagactgcagcccaggaggacag

SEQ ID NO: 77209 - DNA, 25 bp, mus musculus
gagactgcagcccaggaggacagtg

SEQ ID NO: 77210 - DNA, 25 bp, mus musculus
gactgcagcccaggaggacagtgcc

SEQ ID NO: 77211 - DNA, 25 bp, mus musculus
ctgcagcccaggaggacagtgccat

SEQ ID NO: 77212 - DNA, 25 bp, mus musculus
aggacagtgccatgctccgctccat

SEQ ID NO: 77213 - DNA, 25 bp, mus musculus
ccgctccatcctggtggcgttatgc

SEQ ID NO: 77214 - DNA, 25 bp, mus musculus
tccatcctggtggcgttatgcctgt

SEQ ID NO: 77215 - DNA, 25 bp, mus musculus
actcctcatcagtgcagactggagc

SEQ ID NO: 77216 - DNA, 25 bp, mus musculus
tcctcatcagtgcagactggagctc

SEQ ID NO: 77217 - DNA, 25 bp, mus musculus
agtgcagactggagctccagcagga

SEQ ID NO: 77218 - DNA, 25 bp, mus musculus
tgcagactggagctccagcaggaaa

SEQ ID NO: 77219 - DNA, 25 bp, mus musculus
gactggagctccagcaggaaagctc

SEQ ID NO: 77220 - DNA, 25 bp, mus musculus
agcaggaaagctcactccactgccc

SEQ ID NO: 77221 - DNA, 25 bp, mus musculus
aagggtcctcccagcagagactgca

SEQ ID NO: 77222 - DNA, 25 bp, mus musculus
gggtcctcccagcagagactgcagc

SEQ ID NO: 77223 - DNA, 25 bp, mus musculus
tcctctacgttctggctttacatga

SEQ ID NO: 77224 - DNA, 25 bp, mus musculus
acgttctggctttacatgaagtact

SEQ ID NO: 77225 - DNA, 25 bp, mus musculus
gccggttccaaatgcgatcgaatgt

SEQ ID NO: 77226 - DNA, 25 bp, mus musculus
agcataccaacagctctccttgcaa

SEQ ID NO: 77227 - DNA, 25 bp, mus musculus
ccaacagctctccttgcaaatcatc

SEQ ID NO: 77228 - DNA, 25 bp, mus musculus
gctctccttgcaaatcatcaggtgg

SEQ ID NO: 77229 - DNA, 25 bp, mus musculus
cttgcaaatcatcaggtggcctaga

SEQ ID NO: 77230 - DNA, 25 bp, mus musculus
gggccctactaggtgctggcttgct

SEQ ID NO: 77231 - DNA, 25 bp, mus musculus
tactaggtgctggcttgctaatggc

SEQ ID NO: 77232 - DNA, 25 bp, mus musculus
gcttgctaatggccttctacttttt

SEQ ID NO: 77233 - DNA, 25 bp, mus musculus
acatcgggaagcatcgagagctgcg

SEQ ID NO: 77234 - DNA, 25 bp, mus musculus
attccatcagatcacatttttcggt

SEQ ID NO: 77235 - DNA, 25 bp, mus musculus
tcagagctggctacagcaagaagga

SEQ ID NO: 77236 - DNA, 25 bp, mus musculus
cagatcacatttttcggtggcttaa

SEQ ID NO: 77237 - DNA, 25 bp, mus musculus
ggaaaatcatccagcagacttggaa

SEQ ID NO: 77238 - DNA, 25 bp, mus musculus
tcatccagcagacttggaacaggac

SEQ ID NO: 77239 - DNA, 25 bp, mus musculus
aaggtatcgccgggcaggtgtccat

SEQ ID NO: 77240 - DNA, 25 bp, mus musculus
tcgccgggcaggtgtccatagatgc

SEQ ID NO: 77241 - DNA, 25 bp, mus musculus
tctctgtggttgctatgactgacac

SEQ ID NO: 77242 - DNA, 25 bp, mus musculus
ctatgactgacactgaagcaggcac

SEQ ID NO: 77243 - DNA, 25 bp, mus musculus
caggcacccaagaggtcattggtga

SEQ ID NO: 77244 - DNA, 25 bp, mus musculus
tgacaccctggagtggtattctatt

SEQ ID NO: 77245 - DNA, 25 bp, mus musculus
tgtacccatcacgagagctatgagg

SEQ ID NO: 77246 - DNA, 25 bp, mus musculus
ctatgatacccctgatgcgccacaa

SEQ ID NO: 77247 - DNA, 25 bp, mus musculus
gccacaaacccgagaagactattgc

SEQ ID NO: 77248 - DNA, 25 bp, mus musculus
agaagactattgccactggttggtt

SEQ ID NO: 77249 - DNA, 25 bp, mus musculus
ctattgccactggttggttgcaaac

SEQ ID NO: 77250 - DNA, 25 bp, mus musculus
tgtaagatcccaacgctgacaacat

SEQ ID NO: 77251 - DNA, 25 bp, mus musculus
atcccaacgctgacaacatcacagt

SEQ ID NO: 77252 - DNA, 25 bp, mus musculus
acgctgacaacatcacagtgccttg

SEQ ID NO: 77253 - DNA, 25 bp, mus musculus
acaacatcacagtgccttgaaccta

SEQ ID NO: 77254 - DNA, 25 bp, mus musculus
tcacagtgccttgaacctaggacgc

SEQ ID NO: 77255 - DNA, 25 bp, mus musculus
cagtgccttgaacctaggacgcagg

SEQ ID NO: 77256 - DNA, 25 bp, mus musculus
catcacgagagctatgaggataact

SEQ ID NO: 77257 - DNA, 25 bp, mus musculus
tgtatttagcctcctctgtataaag

SEQ ID NO: 77258 - DNA, 25 bp, mus musculus
tagcctcctctgtataaaggacata

SEQ ID NO: 77259 - DNA, 25 bp, mus musculus
tgctcagttgcatgatctaatagaa

SEQ ID NO: 77260 - DNA, 25 bp, mus musculus
gccaacagcagctggcttgacttct

SEQ ID NO: 77261 - DNA, 25 bp, mus musculus
agcagctggcttgacttctgtaggc

SEQ ID NO: 77262 - DNA, 25 bp, mus musculus
ttctttcaacatagattttagagcc

SEQ ID NO: 77263 - DNA, 25 bp, mus musculus
accttcctatgatacccctgatgcg

SEQ ID NO: 77264 - DNA, 25 bp, mus musculus
ccagaatcaacatcactgacctatc

SEQ ID NO: 77265 - DNA, 25 bp, mus musculus
cagaatcaacatcactgacctatct

SEQ ID NO: 77266 - DNA, 25 bp, mus musculus
tctctcctatgtggagtgtacttca

SEQ ID NO: 77267 - DNA, 25 bp, mus musculus
ctctcctatgtggagtgtacttcat

SEQ ID NO: 77268 - DNA, 25 bp, mus musculus
ctgatgtccagcgttcactacacca

SEQ ID NO: 77269 - DNA, 25 bp, mus musculus
tgatgtccagcgttcactacaccag

SEQ ID NO: 77270 - DNA, 25 bp, mus musculus
gatgtccagcgttcactacaccaga

SEQ ID NO: 77271 - DNA, 25 bp, mus musculus
atgtccagcgttcactacaccagac

SEQ ID NO: 77272 - DNA, 25 bp, mus musculus
aagacgcttccagatattgtatact

SEQ ID NO: 77273 - DNA, 25 bp, mus musculus
agacgcttccagatattgtatactg

SEQ ID NO: 77274 - DNA, 25 bp, mus musculus
gacgcttccagatattgtatactga

SEQ ID NO: 77275 - DNA, 25 bp, mus musculus
acgcttccagatattgtatactgat

SEQ ID NO: 77276 - DNA, 25 bp, mus musculus
gaatcaacatcactgacctatctcc

SEQ ID NO: 77277 - DNA, 25 bp, mus musculus
aatcaacatcactgacctatctccc

SEQ ID NO: 77278 - DNA, 25 bp, mus musculus
acttaatgtctctcctatgtggagt

SEQ ID NO: 77279 - DNA, 25 bp, mus musculus
cttaatgtctctcctatgtggagtg

SEQ ID NO: 77280 - DNA, 25 bp, mus musculus
taatgtctctcctatgtggagtgta

SEQ ID NO: 77281 - DNA, 25 bp, mus musculus
aatgtctctcctatgtggagtgtac

SEQ ID NO: 77282 - DNA, 25 bp, mus musculus
atgtctctcctatgtggagtgtact

SEQ ID NO: 77283 - DNA, 25 bp, mus musculus
tgtctctcctatgtggagtgtactt

SEQ ID NO: 77284 - DNA, 25 bp, mus musculus
agtcaagctcagaactccaaacatg

SEQ ID NO: 77285 - DNA, 25 bp, mus musculus
tcaagctcagaactccaaacatgga

SEQ ID NO: 77286 - DNA, 25 bp, mus musculus
tataggaatctcacagctataggtt

SEQ ID NO: 77287 - DNA, 25 bp, mus musculus
taggaatctcacagctataggttac

SEQ ID NO: 77288 - DNA, 25 bp, mus musculus
aatctcacagctataggttacagtt

SEQ ID NO: 77289 - DNA, 25 bp, mus musculus
tctcacagctataggttacagttgg

SEQ ID NO: 77290 - DNA, 25 bp, mus musculus
ttgaagaccatttccaaacttctag

SEQ ID NO: 77291 - DNA, 25 bp, mus musculus
caaacttctagaagtcatggaaggt

SEQ ID NO: 77292 - DNA, 25 bp, mus musculus
aaggtaattttcctctgcaagctga

SEQ ID NO: 77293 - DNA, 25 bp, mus musculus
ggtaattttcctctgcaagctgatg

SEQ ID NO: 77294 - DNA, 25 bp, mus musculus
attttcctctgcaagctgatgagaa

SEQ ID NO: 77295 - DNA, 25 bp, mus musculus
tcctctgcaagctgatgagaaaatg

SEQ ID NO: 77296 - DNA, 25 bp, mus musculus
gctcagaactccaaacatggattta

SEQ ID NO: 77297 - DNA, 25 bp, mus musculus
tcagaactccaaacatggatttagt

SEQ ID NO: 77298 - DNA, 25 bp, mus musculus
agaactccaaacatggatttagtca

SEQ ID NO: 77299 - DNA, 25 bp, mus musculus
atttagtcacctatgatgacgtgca

SEQ ID NO: 77300 - DNA, 25 bp, mus musculus
ttagtcacctatgatgacgtgcatg

SEQ ID NO: 77301 - DNA, 25 bp, mus musculus
agtcacctatgatgacgtgcatgtg

SEQ ID NO: 77302 - DNA, 25 bp, mus musculus
ctatgatgacgtgcatgtgaacttc

SEQ ID NO: 77303 - DNA, 25 bp, mus musculus
gcatgtgaacttcactcaggaagag

SEQ ID NO: 77304 - DNA, 25 bp, mus musculus
ctggctgatacttctgtaagcctac

SEQ ID NO: 77305 - DNA, 25 bp, mus musculus
ctgatacttctgtaagcctacccac

SEQ ID NO: 77306 - DNA, 25 bp, mus musculus
taagcctacccacagagtatctttc

SEQ ID NO: 77307 - DNA, 25 bp, mus musculus
aagcctacccacagagtatctttca

SEQ ID NO: 77308 - DNA, 25 bp, mus musculus
agcctacccacagagtatctttcag

SEQ ID NO: 77309 - DNA, 25 bp, mus musculus
cctacccacagagtatctttcagag

SEQ ID NO: 77310 - DNA, 25 bp, mus musculus
ctacccacagagtatctttcagaga

SEQ ID NO: 77311 - DNA, 25 bp, mus musculus
tacccacagagtatctttcagagat

SEQ ID NO: 77312 - DNA, 25 bp, mus musculus
cccacagagtatctttcagagatca

SEQ ID NO: 77313 - DNA, 25 bp, mus musculus
ccacagagtatctttcagagatcac

SEQ ID NO: 77314 - DNA, 25 bp, mus musculus
gtatctttcagagatcacgaatttt

SEQ ID NO: 77315 - DNA, 25 bp, mus musculus
tatctttcagagatcacgaattttg

SEQ ID NO: 77316 - DNA, 25 bp, mus musculus
tgatacttctgtaagcctacccaca

SEQ ID NO: 77317 - DNA, 25 bp, mus musculus
atctttcagagatcacgaattttgg

SEQ ID NO: 77318 - DNA, 25 bp, mus musculus
gatacttctgtaagcctacccacag

SEQ ID NO: 77319 - DNA, 25 bp, mus musculus
tacttctgtaagcctacccacagag

SEQ ID NO: 77320 - DNA, 25 bp, mus musculus
acttctgtaagcctacccacagagt

SEQ ID NO: 77321 - DNA, 25 bp, mus musculus
cttctgtaagcctacccacagagta

SEQ ID NO: 77322 - DNA, 25 bp, mus musculus
tctgtaagcctacccacagagtatc

SEQ ID NO: 77323 - DNA, 25 bp, mus musculus
ctgtaagcctacccacagagtatct

SEQ ID NO: 77324 - DNA, 25 bp, mus musculus
tgtaagcctacccacagagtatctt

SEQ ID NO: 77325 - DNA, 25 bp, mus musculus
catcactaacttttccataccatcc

SEQ ID NO: 77326 - DNA, 25 bp, mus musculus
cactaacttttccataccatccact

SEQ ID NO: 77327 - DNA, 25 bp, mus musculus
tgaggactttcgcgagaaagactcc

SEQ ID NO: 77328 - DNA, 25 bp, mus musculus
agactccagaaatgttcagggcaag

SEQ ID NO: 77329 - DNA, 25 bp, mus musculus
tcagggcaagccctggataaccagc

SEQ ID NO: 77330 - DNA, 25 bp, mus musculus
caagccctggataaccagctataag

SEQ ID NO: 77331 - DNA, 25 bp, mus musculus
gccctggataaccagctataagctg

SEQ ID NO: 77332 - DNA, 25 bp, mus musculus
gataaccagctataagctgggccag

SEQ ID NO: 77333 - DNA, 25 bp, mus musculus
agtcgattcttccggacaagacctg

SEQ ID NO: 77334 - DNA, 25 bp, mus musculus
gccttcgttgacaacctgtgtggag

SEQ ID NO: 77335 - DNA, 25 bp, mus musculus
ttcgttgacaacctgtgtggagaat

SEQ ID NO: 77336 - DNA, 25 bp, mus musculus
gttgacaacctgtgtggagaatacc

SEQ ID NO: 77337 - DNA, 25 bp, mus musculus
taacttttccataccatccactctc

SEQ ID NO: 77338 - DNA, 25 bp, mus musculus
atccactctcatccttctatatcac

SEQ ID NO: 77339 - DNA, 25 bp, mus musculus
cactctcatccttctatatcactac

SEQ ID NO: 77340 - DNA, 25 bp, mus musculus
tctcatccttctatatcactaccaa

SEQ ID NO: 77341 - DNA, 25 bp, mus musculus
catccttctatatcactaccaacca

SEQ ID NO: 77342 - DNA, 25 bp, mus musculus
cacttcctataagccagctccaaga

SEQ ID NO: 77343 - DNA, 25 bp, mus musculus
ttcctataagccagctccaagaagc

SEQ ID NO: 77344 - DNA, 25 bp, mus musculus
catccctagtattgaggactttcgc

SEQ ID NO: 77345 - DNA, 25 bp, mus musculus
gactgtatctagagctgcgggtctc

SEQ ID NO: 77346 - DNA, 25 bp, mus musculus
atctagagctgcgggtctccctctc

SEQ ID NO: 77347 - DNA, 25 bp, mus musculus
tcttttcaccttcgtttctacatag

SEQ ID NO: 77348 - DNA, 25 bp, mus musculus
cttcgtttctacatagagatgttaa

SEQ ID NO: 77349 - DNA, 25 bp, mus musculus
aatattatccacacatttgcaatgg

SEQ ID NO: 77350 - DNA, 25 bp, mus musculus
atccacacatttgcaatggctggca

SEQ ID NO: 77351 - DNA, 25 bp, mus musculus
cacacatttgcaatggctggcatct

SEQ ID NO: 77352 - DNA, 25 bp, mus musculus
atggctggcatctgctctattccca

SEQ ID NO: 77353 - DNA, 25 bp, mus musculus
gctggcatctgctctattcccattg

SEQ ID NO: 77354 - DNA, 25 bp, mus musculus
atctgctctattcccattgctgtct

SEQ ID NO: 77355 - DNA, 25 bp, mus musculus
tgctctattcccattgctgtctgca

SEQ ID NO: 77356 - DNA, 25 bp, mus musculus
tctattcccattgctgtctgcaggc

SEQ ID NO: 77357 - DNA, 25 bp, mus musculus
actccacttcacagagcagaggtgg

SEQ ID NO: 77358 - DNA, 25 bp, mus musculus
ccacttcacagagcagaggtggccc

SEQ ID NO: 77359 - DNA, 25 bp, mus musculus
ggagaccagctctggtttattgaag

SEQ ID NO: 77360 - DNA, 25 bp, mus musculus
gaccagctctggtttattgaagatg

SEQ ID NO: 77361 - DNA, 25 bp, mus musculus
aggagaactccgggcaggcagttcg

SEQ ID NO: 77362 - DNA, 25 bp, mus musculus
ttcgtgtgaatctctcagagggaat

SEQ ID NO: 77363 - DNA, 25 bp, mus musculus
tgaatctctcagagggaatgcaact

SEQ ID NO: 77364 - DNA, 25 bp, mus musculus
tgatcttttcaccttcgtttctaca

SEQ ID NO: 77365 - DNA, 25 bp, mus musculus
gtttcatggggcagctgctacagct

SEQ ID NO: 77366 - DNA, 25 bp, mus musculus
tcatggggcagctgctacagctgga

SEQ ID NO: 77367 - DNA, 25 bp, mus musculus
atcttgccgtcccactggggtgcta

SEQ ID NO: 77368 - DNA, 25 bp, mus musculus
tccaggatgacggctgctctgatat

SEQ ID NO: 77369 - DNA, 25 bp, mus musculus
aggatgacggctgctctgatatggt

SEQ ID NO: 77370 - DNA, 25 bp, mus musculus
atgacggctgctctgatatggtgct

SEQ ID NO: 77371 - DNA, 25 bp, mus musculus
tctcccttcttcgacttgcagaaat

SEQ ID NO: 77372 - DNA, 25 bp, mus musculus
tggtcacccaagggctcagaaaaca

SEQ ID NO: 77373 - DNA, 25 bp, mus musculus
caagcagaaaccatgtctaggggtg

SEQ ID NO: 77374 - DNA, 25 bp, mus musculus
ttaagccttgtgctcccaggggagc

SEQ ID NO: 77375 - DNA, 25 bp, mus musculus
catcccgctgtaattggtgctgaaa

SEQ ID NO: 77376 - DNA, 25 bp, mus musculus
tttgtgttcaactgacatttaacgc

SEQ ID NO: 77377 - DNA, 25 bp, mus musculus
agctgctacagctggagacccaggt

SEQ ID NO: 77378 - DNA, 25 bp, mus musculus
tgctacagctggagacccaggtgct

SEQ ID NO: 77379 - DNA, 25 bp, mus musculus
agctggagacccaggtgctctgtca

SEQ ID NO: 77380 - DNA, 25 bp, mus musculus
agacccaggtgctctgtcactgagg

SEQ ID NO: 77381 - DNA, 25 bp, mus musculus
aggtgctctgtcactgaggcaaagc

SEQ ID NO: 77382 - DNA, 25 bp, mus musculus
tgctctgtcactgaggcaaagccca

SEQ ID NO: 77383 - DNA, 25 bp, mus musculus
cccacagctctggctttgactgact

SEQ ID NO: 77384 - DNA, 25 bp, mus musculus
acagctctggctttgactgactcct

SEQ ID NO: 77385 - DNA, 25 bp, mus musculus
gagtccatgaaacttgccatattca

SEQ ID NO: 77386 - DNA, 25 bp, mus musculus
atgaaacttgccatattcaatatac

SEQ ID NO: 77387 - DNA, 25 bp, mus musculus
atacattccaccacagatggactct

SEQ ID NO: 77388 - DNA, 25 bp, mus musculus
tccaccacagatggactctgtctct

SEQ ID NO: 77389 - DNA, 25 bp, mus musculus
acagatggactctgtctctagcgtt

SEQ ID NO: 77390 - DNA, 25 bp, mus musculus
ggactctgtctctagcgttagacta

SEQ ID NO: 77391 - DNA, 25 bp, mus musculus
tgtctctagcgttagactatatgaa

SEQ ID NO: 77392 - DNA, 25 bp, mus musculus
ggatcatcaaaccttgtcatggatg

SEQ ID NO: 77393 - DNA, 25 bp, mus musculus
tcaaaccttgtcatggatgaagact

SEQ ID NO: 77394 - DNA, 25 bp, mus musculus
atatgattttcaggtcctttgctta

SEQ ID NO: 77395 - DNA, 25 bp, mus musculus
ggaggcccaattcactcaaatgttt

SEQ ID NO: 77396 - DNA, 25 bp, mus musculus
ccaattcactcaaatgttttgagaa

SEQ ID NO: 77397 - DNA, 25 bp, mus musculus
cttgccatattcaatatacctgcga

SEQ ID NO: 77398 - DNA, 25 bp, mus musculus
atattcaatatacctgcgattaagt

SEQ ID NO: 77399 - DNA, 25 bp, mus musculus
cgctgtaactctgtactgctagtat

SEQ ID NO: 77400 - DNA, 25 bp, mus musculus
aactctgtactgctagtattagaac

SEQ ID NO: 77401 - DNA, 25 bp, mus musculus
ttagaacaaaactcttcccatacag

SEQ ID NO: 77402 - DNA, 25 bp, mus musculus
tgtgtcggcctttatgtaatctgta

SEQ ID NO: 77403 - DNA, 25 bp, mus musculus
ctacagatacatgcctttaaagggc

SEQ ID NO: 77404 - DNA, 25 bp, mus musculus
gtgacaatacattccaccacagatg

SEQ ID NO: 77405 - DNA, 25 bp, mus musculus
atgaaagcactgtggacaggacagt

SEQ ID NO: 77406 - DNA, 25 bp, mus musculus
tgaaagcactgtggacaggacagta

SEQ ID NO: 77407 - DNA, 25 bp, mus musculus
attaatgaccagtttgcaggctcca

SEQ ID NO: 77408 - DNA, 25 bp, mus musculus
ttaatgaccagtttgcaggctccag

SEQ ID NO: 77409 - DNA, 25 bp, mus musculus
taatgaccagtttgcaggctccagc

SEQ ID NO: 77410 - DNA, 25 bp, mus musculus
aatgaccagtttgcaggctccagca

SEQ ID NO: 77411 - DNA, 25 bp, mus musculus
accagtttgcaggctccagcaacag

SEQ ID NO: 77412 - DNA, 25 bp, mus musculus
ccagtttgcaggctccagcaacagg

SEQ ID NO: 77413 - DNA, 25 bp, mus musculus
tatagatacatcagtccaaaggact

SEQ ID NO: 77414 - DNA, 25 bp, mus musculus
atagatacatcagtccaaaggactt

SEQ ID NO: 77415 - DNA, 25 bp, mus musculus
tagatacatcagtccaaaggacttt

SEQ ID NO: 77416 - DNA, 25 bp, mus musculus
agatacatcagtccaaaggacttta

SEQ ID NO: 77417 - DNA, 25 bp, mus musculus
gatacatcagtccaaaggactttaa

SEQ ID NO: 77418 - DNA, 25 bp, mus musculus
tacatcagtccaaaggactttaaag

SEQ ID NO: 77419 - DNA, 25 bp, mus musculus
taaagtcaccattggtaagattaat

SEQ ID NO: 77420 - DNA, 25 bp, mus musculus
aaagtcaccattggtaagattaatg

SEQ ID NO: 77421 - DNA, 25 bp, mus musculus
tgttcgtagtacaggccttagaatt

SEQ ID NO: 77422 - DNA, 25 bp, mus musculus
tacaggccttagaattcatgaaagg

SEQ ID NO: 77423 - DNA, 25 bp, mus musculus
gaagccttacaatgcttataaggaa

SEQ ID NO: 77424 - DNA, 25 bp, mus musculus
gccttacaatgcttataaggaatgt

SEQ ID NO: 77425 - DNA, 25 bp, mus musculus
gaattcatactggtctgaagcactg

SEQ ID NO: 77426 - DNA, 25 bp, mus musculus
atactggtctgaagcactgttgata

SEQ ID NO: 77427 - DNA, 25 bp, mus musculus
ctggtctgaagcactgttgatatga

SEQ ID NO: 77428 - DNA, 25 bp, mus musculus
taagttcagccttcagtgtacactc

SEQ ID NO: 77429 - DNA, 25 bp, mus musculus
gttcagccttcagtgtacactcaag

SEQ ID NO: 77430 - DNA, 25 bp, mus musculus
cagccttcagtgtacactcaagatt

SEQ ID NO: 77431 - DNA, 25 bp, mus musculus
gtgtacactcaagattcatattggc

SEQ ID NO: 77432 - DNA, 25 bp, mus musculus
tcatattggctgaacccatcactgt

SEQ ID NO: 77433 - DNA, 25 bp, mus musculus
agcctttcagtatcattaccaattt

SEQ ID NO: 77434 - DNA, 25 bp, mus musculus
ctttcagtatcattaccaatttctt

SEQ ID NO: 77435 - DNA, 25 bp, mus musculus
tcagtatcattaccaatttcttgga

SEQ ID NO: 77436 - DNA, 25 bp, mus musculus
tcattaccaatttcttggacacttt

SEQ ID NO: 77437 - DNA, 25 bp, mus musculus
tcatactggcaagaacccttatgaa

SEQ ID NO: 77438 - DNA, 25 bp, mus musculus
caagaacccttatgaatgtagtgaa

SEQ ID NO: 77439 - DNA, 25 bp, mus musculus
tattcacaatcttgagaaaccgtaa

SEQ ID NO: 77440 - DNA, 25 bp, mus musculus
tcacaatcttgagaaaccgtaagaa

SEQ ID NO: 77441 - DNA, 25 bp, mus musculus
gtgcaaggcccagccataggcttag

SEQ ID NO: 77442 - DNA, 25 bp, mus musculus
caaggcccagccataggcttagccc

SEQ ID NO: 77443 - DNA, 25 bp, mus musculus
ttgtacaccactggctcgtagtacg

SEQ ID NO: 77444 - DNA, 25 bp, mus musculus
tacaccactggctcgtagtacgcaa

SEQ ID NO: 77445 - DNA, 25 bp, mus musculus
accactggctcgtagtacgcaatgt

SEQ ID NO: 77446 - DNA, 25 bp, mus musculus
actggctcgtagtacgcaatgttgg

SEQ ID NO: 77447 - DNA, 25 bp, mus musculus
atggacgatcccatgccggcccaat

SEQ ID NO: 77448 - DNA, 25 bp, mus musculus
gatcccatgccggcccaatggggtg

SEQ ID NO: 77449 - DNA, 25 bp, mus musculus
atgccggcccaatggggtgaaagag

SEQ ID NO: 77450 - DNA, 25 bp, mus musculus
agaggccagcggcatttcgtccagt

SEQ ID NO: 77451 - DNA, 25 bp, mus musculus
cagcggcatttcgtccagtgggaag

SEQ ID NO: 77452 - DNA, 25 bp, mus musculus
gcatttcgtccagtgggaagttcgg

SEQ ID NO: 77453 - DNA, 25 bp, mus musculus
ggcccagccataggcttagcccagc

SEQ ID NO: 77454 - DNA, 25 bp, mus musculus
ccagccataggcttagcccagcatg

SEQ ID NO: 77455 - DNA, 25 bp, mus musculus
gccataggcttagcccagcatgggt

SEQ ID NO: 77456 - DNA, 25 bp, mus musculus
ataggcttagcccagcatgggtaca

SEQ ID NO: 77457 - DNA, 25 bp, mus musculus
ggcttagcccagcatgggtacacgt

SEQ ID NO: 77458 - DNA, 25 bp, mus musculus
ttagcccagcatgggtacacgtagg

SEQ ID NO: 77459 - DNA, 25 bp, mus musculus
gcccagcatgggtacacgtaggtgt

SEQ ID NO: 77460 - DNA, 25 bp, mus musculus
gtgttgttgtacaccactggctcgt

SEQ ID NO: 77461 - DNA, 25 bp, mus musculus
tccagccactcgagtcactgtcatt

SEQ ID NO: 77462 - DNA, 25 bp, mus musculus
ttgctgttgtctccctggggtgcca

SEQ ID NO: 77463 - DNA, 25 bp, mus musculus
catcaaactctgtctgtataaagta

SEQ ID NO: 77464 - DNA, 25 bp, mus musculus
gtctctggctacactttctattcct

SEQ ID NO: 77465 - DNA, 25 bp, mus musculus
tctggctacactttctattcctggg

SEQ ID NO: 77466 - DNA, 25 bp, mus musculus
ttctattcctggggctgagaaaact

SEQ ID NO: 77467 - DNA, 25 bp, mus musculus
tattcctggggctgagaaaactcct

SEQ ID NO: 77468 - DNA, 25 bp, mus musculus
aactccttgacatcaaggggtcaag

SEQ ID NO: 77469 - DNA, 25 bp, mus musculus
tccttgacatcaaggggtcaagaaa

SEQ ID NO: 77470 - DNA, 25 bp, mus musculus
tgcaccgttggcttgaaggtatttt

SEQ ID NO: 77471 - DNA, 25 bp, mus musculus
ttcttccagaatggtgttattgcat

SEQ ID NO: 77472 - DNA, 25 bp, mus musculus
attttcttaatgtgatatggcaatg

SEQ ID NO: 77473 - DNA, 25 bp, mus musculus
ctgttgtctccctggggtgccagga

SEQ ID NO: 77474 - DNA, 25 bp, mus musculus
aggactcccggtgctgggctgctaa

SEQ ID NO: 77475 - DNA, 25 bp, mus musculus
gggctgctaactgggtgttgctgac

SEQ ID NO: 77476 - DNA, 25 bp, mus musculus
ctaactgggtgttgctgacatctca

SEQ ID NO: 77477 - DNA, 25 bp, mus musculus
tgctgacatctcagtgctgctgagt

SEQ ID NO: 77478 - DNA, 25 bp, mus musculus
tgacatctcagtgctgctgagttac

SEQ ID NO: 77479 - DNA, 25 bp, mus musculus
catctcagtgctgctgagttacagg

SEQ ID NO: 77480 - DNA, 25 bp, mus musculus
gtacatcaaactctgtctgtataaa

SEQ ID NO: 77481 - DNA, 25 bp, mus musculus
ttacagaggcctccagggaggcaga

SEQ ID NO: 77482 - DNA, 25 bp, mus musculus
gtcctgctctcctgacacatctttg

SEQ ID NO: 77483 - DNA, 25 bp, mus musculus
ctcacctggtcactagagaatgtgg

SEQ ID NO: 77484 - DNA, 25 bp, mus musculus
acatcgtgtctgcaccaacatcagg

SEQ ID NO: 77485 - DNA, 25 bp, mus musculus
caccaacatcaggctgtgcagccac

SEQ ID NO: 77486 - DNA, 25 bp, mus musculus
caacatcaggctgtgcagccactgc

SEQ ID NO: 77487 - DNA, 25 bp, mus musculus
ctgcagccgcaaccctgcagagaca

SEQ ID NO: 77488 - DNA, 25 bp, mus musculus
cagccgcaaccctgcagagacagag

SEQ ID NO: 77489 - DNA, 25 bp, mus musculus
ccgcaaccctgcagagacagagctg

SEQ ID NO: 77490 - DNA, 25 bp, mus musculus
caaccctgcagagacagagctggtg

SEQ ID NO: 77491 - DNA, 25 bp, mus musculus
gccttcaccaggttcccaagacttg

SEQ ID NO: 77492 - DNA, 25 bp, mus musculus
ttcaccaggttcccaagacttgaga

SEQ ID NO: 77493 - DNA, 25 bp, mus musculus
ctgctctcctgacacatctttgagt

SEQ ID NO: 77494 - DNA, 25 bp, mus musculus
ctctcctgacacatctttgagtttt

SEQ ID NO: 77495 - DNA, 25 bp, mus musculus
tcctgacacatctttgagtttttcc

SEQ ID NO: 77496 - DNA, 25 bp, mus musculus
gagtttttcccaccgtgttgctgca

SEQ ID NO: 77497 - DNA, 25 bp, mus musculus
tgttgctgcatgcgcccctgaagct

SEQ ID NO: 77498 - DNA, 25 bp, mus musculus
atgcgcccctgaagctctgtgttct

SEQ ID NO: 77499 - DNA, 25 bp, mus musculus
cgcccctgaagctctgtgttcttag

SEQ ID NO: 77500 - DNA, 25 bp, mus musculus
ccctgaagctctgtgttcttaggag

SEQ ID NO: 77501 - DNA, 25 bp, mus musculus
acgagactcgcacggtgacccagtt

SEQ ID NO: 77502 - DNA, 25 bp, mus musculus
ctcgcacggtgacccagttccactt

SEQ ID NO: 77503 - DNA, 25 bp, mus musculus
tgaagctggagctggcgggacccca

SEQ ID NO: 77504 - DNA, 25 bp, mus musculus
accacgagtgcttccagaaccgcaa

SEQ ID NO: 77505 - DNA, 25 bp, mus musculus
agtgcttccagaaccgcaacaggat

SEQ ID NO: 77506 - DNA, 25 bp, mus musculus
tccagaaccgcaacaggatatcagt

SEQ ID NO: 77507 - DNA, 25 bp, mus musculus
acaggatatcagtcctgcatcttct

SEQ ID NO: 77508 - DNA, 25 bp, mus musculus
tcctgcatcttctgtgtagtaacag

SEQ ID NO: 77509 - DNA, 25 bp, mus musculus
atcttctgtgtagtaacagggtctt

SEQ ID NO: 77510 - DNA, 25 bp, mus musculus
tcgggctccacagtcagtgcaggtg

SEQ ID NO: 77511 - DNA, 25 bp, mus musculus
tcatgtgtacttctgattgaccaaa

SEQ ID NO: 77512 - DNA, 25 bp, mus musculus
gtacttctgattgaccaaatagcac

SEQ ID NO: 77513 - DNA, 25 bp, mus musculus
tccacttcctgagttggtatgacca

SEQ ID NO: 77514 - DNA, 25 bp, mus musculus
cctccacgaggtcactcctggattt

SEQ ID NO: 77515 - DNA, 25 bp, mus musculus
cgaggtcactcctggatttccgcag

SEQ ID NO: 77516 - DNA, 25 bp, mus musculus
gccgctcttgtccgatcattgtcca

SEQ ID NO: 77517 - DNA, 25 bp, mus musculus
cgatcattgtccattgcagtgacgg

SEQ ID NO: 77518 - DNA, 25 bp, mus musculus
cgaccctggagcacttgagggacca

SEQ ID NO: 77519 - DNA, 25 bp, mus musculus
agagaccaggcatggtccagacaaa

SEQ ID NO: 77520 - DNA, 25 bp, mus musculus
cccagtaggcgctgaagctggagct

SEQ ID NO: 77521 - DNA, 25 bp, mus musculus
ggcagactccggggtgagatggagt

SEQ ID NO: 77522 - DNA, 25 bp, mus musculus
cagactccggggtgagatggagtgg

SEQ ID NO: 77523 - DNA, 25 bp, mus musculus
ctctggtatgccatcgccaaaaagg

SEQ ID NO: 77524 - DNA, 25 bp, mus musculus
tatgccatcgccaaaaaggaccccg

SEQ ID NO: 77525 - DNA, 25 bp, mus musculus
tgccatcgccaaaaaggaccccgag

SEQ ID NO: 77526 - DNA, 25 bp, mus musculus
gcaagataacatcatcgctgagttt

SEQ ID NO: 77527 - DNA, 25 bp, mus musculus
aagataacatcatcgctgagttttc

SEQ ID NO: 77528 - DNA, 25 bp, mus musculus
gataacatcatcgctgagttttctg

SEQ ID NO: 77529 - DNA, 25 bp, mus musculus
taacatcatcgctgagttttctgtg

SEQ ID NO: 77530 - DNA, 25 bp, mus musculus
atcatcgctgagttttctgtggacg

SEQ ID NO: 77531 - DNA, 25 bp, mus musculus
catcgctgagttttctgtggacgag

SEQ ID NO: 77532 - DNA, 25 bp, mus musculus
tcatatgagcgccacagccaaggga

SEQ ID NO: 77533 - DNA, 25 bp, mus musculus
gactccggggtgagatggagtgggt

SEQ ID NO: 77534 - DNA, 25 bp, mus musculus
tgagcagcttccgagtcaaggagaa

SEQ ID NO: 77535 - DNA, 25 bp, mus musculus
cagcttccgagtcaaggagaacttc

SEQ ID NO: 77536 - DNA, 25 bp, mus musculus
gagaacttcgacaaggctcgtttct

SEQ ID NO: 77537 - DNA, 25 bp, mus musculus
acttcgacaaggctcgtttctctgg

SEQ ID NO: 77538 - DNA, 25 bp, mus musculus
ttcgacaaggctcgtttctctgggc

SEQ ID NO: 77539 - DNA, 25 bp, mus musculus
tctgggctctggtatgccatcgcca

SEQ ID NO: 77540 - DNA, 25 bp, mus musculus
tgggctctggtatgccatcgccaaa

SEQ ID NO: 77541 - DNA, 25 bp, mus musculus
ctagtccaactccgagtacaagaga

SEQ ID NO: 77542 - DNA, 25 bp, mus musculus
tagtccaactccgagtacaagagaa

SEQ ID NO: 77543 - DNA, 25 bp, mus musculus
tcactgacctccaagaccaaaacca

SEQ ID NO: 77544 - DNA, 25 bp, mus musculus
cactgacctccaagaccaaaaccag

SEQ ID NO: 77545 - DNA, 25 bp, mus musculus
tgacctccaagaccaaaaccagaag

SEQ ID NO: 77546 - DNA, 25 bp, mus musculus
cctccaagaccaaaaccagaagatg

SEQ ID NO: 77547 - DNA, 25 bp, mus musculus
ctccaagaccaaaaccagaagatgg

SEQ ID NO: 77548 - DNA, 25 bp, mus musculus
tccaagaccaaaaccagaagatggt

SEQ ID NO: 77549 - DNA, 25 bp, mus musculus
ccaagaccaaaaccagaagatggtg

SEQ ID NO: 77550 - DNA, 25 bp, mus musculus
caagaccaaaaccagaagatggtgt

SEQ ID NO: 77551 - DNA, 25 bp, mus musculus
agaccaaaaccagaagatggtgttg

SEQ ID NO: 77552 - DNA, 25 bp, mus musculus
gtccaactccgagtacaagagaaag

SEQ ID NO: 77553 - DNA, 25 bp, mus musculus
tccaactccgagtacaagagaaagt

SEQ ID NO: 77554 - DNA, 25 bp, mus musculus
aaagctaatcactgacctccaagac

SEQ ID NO: 77555 - DNA, 25 bp, mus musculus
aagctaatcactgacctccaagacc

SEQ ID NO: 77556 - DNA, 25 bp, mus musculus
agctaatcactgacctccaagacca

SEQ ID NO: 77557 - DNA, 25 bp, mus musculus
gctaatcactgacctccaagaccaa

SEQ ID NO: 77558 - DNA, 25 bp, mus musculus
ctaatcactgacctccaagaccaaa

SEQ ID NO: 77559 - DNA, 25 bp, mus musculus
taatcactgacctccaagaccaaaa

SEQ ID NO: 77560 - DNA, 25 bp, mus musculus
cctccagagctcttagcgacgtaag

SEQ ID NO: 77561 - DNA, 25 bp, mus musculus
cagagctcttagcgacgtaagatcc

SEQ ID NO: 77562 - DNA, 25 bp, mus musculus
cgagatcccacagtggccactttgt

SEQ ID NO: 77563 - DNA, 25 bp, mus musculus
agatcccacagtggccactttgtcg

SEQ ID NO: 77564 - DNA, 25 bp, mus musculus
cacagtggccactttgtcgctcaag

SEQ ID NO: 77565 - DNA, 25 bp, mus musculus
gtggccactttgtcgctcaagagtg

SEQ ID NO: 77566 - DNA, 25 bp, mus musculus
ggccactttgtcgctcaagagtgtg

SEQ ID NO: 77567 - DNA, 25 bp, mus musculus
actttgtcgctcaagagtgtgagag

SEQ ID NO: 77568 - DNA, 25 bp, mus musculus
tttgtcgctcaagagtgtgagagtc

SEQ ID NO: 77569 - DNA, 25 bp, mus musculus
gaggcctttgaacatcccagatgtt

SEQ ID NO: 77570 - DNA, 25 bp, mus musculus
cctttgaacatcccagatgttgtac

SEQ ID NO: 77571 - DNA, 25 bp, mus musculus
tttgaacatcccagatgttgtacgg

SEQ ID NO: 77572 - DNA, 25 bp, mus musculus
gagctcttagcgacgtaagatccct

SEQ ID NO: 77573 - DNA, 25 bp, mus musculus
aacatcccagatgttgtacggctga

SEQ ID NO: 77574 - DNA, 25 bp, mus musculus
ttagcgacgtaagatccctgcttcg

SEQ ID NO: 77575 - DNA, 25 bp, mus musculus
cgacgtaagatccctgcttcgagaa

SEQ ID NO: 77576 - DNA, 25 bp, mus musculus
acgtaagatccctgcttcgagaatg

SEQ ID NO: 77577 - DNA, 25 bp, mus musculus
tgcggtgctatgggacggtgtacaa

SEQ ID NO: 77578 - DNA, 25 bp, mus musculus
tgtacaaacccgagatcccacagtg

SEQ ID NO: 77579 - DNA, 25 bp, mus musculus
caaacccgagatcccacagtggcca

SEQ ID NO: 77580 - DNA, 25 bp, mus musculus
aacccgagatcccacagtggccact

SEQ ID NO: 77581 - DNA, 25 bp, mus musculus
tgtgtgccttaaaactctatgtgaa

SEQ ID NO: 77582 - DNA, 25 bp, mus musculus
atgatcactacccaaatggaaattg

SEQ ID NO: 77583 - DNA, 25 bp, mus musculus
ctctcagtttcgcaaggcttgtgga

SEQ ID NO: 77584 - DNA, 25 bp, mus musculus
gtttcgcaaggcttgtggaagaaca

SEQ ID NO: 77585 - DNA, 25 bp, mus musculus
ataagtttcaagctgctgtcataga

SEQ ID NO: 77586 - DNA, 25 bp, mus musculus
ttcaagctgctgtcatagaagaact

SEQ ID NO: 77587 - DNA, 25 bp, mus musculus
gggatcttccagtgacacgcacttt

SEQ ID NO: 77588 - DNA, 25 bp, mus musculus
ttccagtgacacgcactttgattga

SEQ ID NO: 77589 - DNA, 25 bp, mus musculus
tgacacgcactttgattgactggca

SEQ ID NO: 77590 - DNA, 25 bp, mus musculus
actggcaacggatcctctctgactt

SEQ ID NO: 77591 - DNA, 25 bp, mus musculus
aacggatcctctctgacttgaatct

SEQ ID NO: 77592 - DNA, 25 bp, mus musculus
tcctctctgacttgaatctggtgat

SEQ ID NO: 77593 - DNA, 25 bp, mus musculus
gcattgaagaccacagctatgacaa

SEQ ID NO: 77594 - DNA, 25 bp, mus musculus
aagaccacagctatgacaatggaga

SEQ ID NO: 77595 - DNA, 25 bp, mus musculus
ttgtgcaagctcacttctttaggtg

SEQ ID NO: 77596 - DNA, 25 bp, mus musculus
aagctcacttctttaggtgtgtcaa

SEQ ID NO: 77597 - DNA, 25 bp, mus musculus
gtgtcaaccttcatattgaagtctc

SEQ ID NO: 77598 - DNA, 25 bp, mus musculus
tcaatcaagcccagttggctctcag

SEQ ID NO: 77599 - DNA, 25 bp, mus musculus
aagcccagttggctctcagtttcgc

SEQ ID NO: 77600 - DNA, 25 bp, mus musculus
agttggctctcagtttcgcaaggct

SEQ ID NO: 77601 - DNA, 25 bp, mus musculus
ttacgcgtcagcaacaagctaccta

SEQ ID NO: 77602 - DNA, 25 bp, mus musculus
cgcgtcagcaacaagctacctaggc

SEQ ID NO: 77603 - DNA, 25 bp, mus musculus
gcttcaggcgtcatgacaaactaca

SEQ ID NO: 77604 - DNA, 25 bp, mus musculus
gtcatgacaaactacattcccatgt

SEQ ID NO: 77605 - DNA, 25 bp, mus musculus
atgacaaactacattcccatgtgat

SEQ ID NO: 77606 - DNA, 25 bp, mus musculus
aactacattcccatgtgatggcgta

SEQ ID NO: 77607 - DNA, 25 bp, mus musculus
tacattcccatgtgatggcgtatct

SEQ ID NO: 77608 - DNA, 25 bp, mus musculus
attcccatgtgatggcgtatctcct

SEQ ID NO: 77609 - DNA, 25 bp, mus musculus
atgtgatggcgtatctcctgcattg

SEQ ID NO: 77610 - DNA, 25 bp, mus musculus
tgatggcgtatctcctgcattgggg

SEQ ID NO: 77611 - DNA, 25 bp, mus musculus
tggcgtatctcctgcattggggcca

SEQ ID NO: 77612 - DNA, 25 bp, mus musculus
cgtatctcctgcattggggccaacc

SEQ ID NO: 77613 - DNA, 25 bp, mus musculus
gtcagcaacaagctacctaggcccg

SEQ ID NO: 77614 - DNA, 25 bp, mus musculus
gagtcctgctgttcccctgcgccat

SEQ ID NO: 77615 - DNA, 25 bp, mus musculus
ggtctttgcaaggcccgatgcacac

SEQ ID NO: 77616 - DNA, 25 bp, mus musculus
ctttgcaaggcccgatgcacacctg

SEQ ID NO: 77617 - DNA, 25 bp, mus musculus
tgcaaggcccgatgcacacctgctt

SEQ ID NO: 77618 - DNA, 25 bp, mus musculus
tgcacacctgcttcaggcgtcatga

SEQ ID NO: 77619 - DNA, 25 bp, mus musculus
acacctgcttcaggcgtcatgacaa

SEQ ID NO: 77620 - DNA, 25 bp, mus musculus
cctgcttcaggcgtcatgacaaact

SEQ ID NO: 77621 - DNA, 25 bp, mus musculus
tgctaccctctcattgggagttctt

SEQ ID NO: 77622 - DNA, 25 bp, mus musculus
tgctgccagccgtcacgattctgga

SEQ ID NO: 77623 - DNA, 25 bp, mus musculus
agactcccatcttagctgagccctg

SEQ ID NO: 77624 - DNA, 25 bp, mus musculus
ctcccatcttagctgagccctgact

SEQ ID NO: 77625 - DNA, 25 bp, mus musculus
tgtccagatcaggtggctgcgtagg

SEQ ID NO: 77626 - DNA, 25 bp, mus musculus
agaacagtgctgctgtggagagaga

SEQ ID NO: 77627 - DNA, 25 bp, mus musculus
agccccttgcttctcagtggggtag

SEQ ID NO: 77628 - DNA, 25 bp, mus musculus
ggcaaaagtcacctgagctgccgag

SEQ ID NO: 77629 - DNA, 25 bp, mus musculus
ctgagctgccgagtgtgttgatcct

SEQ ID NO: 77630 - DNA, 25 bp, mus musculus
agctgccgagtgtgttgatcctcct

SEQ ID NO: 77631 - DNA, 25 bp, mus musculus
gtgtgttgatcctccttgtcaagta

SEQ ID NO: 77632 - DNA, 25 bp, mus musculus
tgttgatcctccttgtcaagtacaa

SEQ ID NO: 77633 - DNA, 25 bp, mus musculus
cagccgtcacgattctggatagtcc

SEQ ID NO: 77634 - DNA, 25 bp, mus musculus
ccgtcacgattctggatagtcccat

SEQ ID NO: 77635 - DNA, 25 bp, mus musculus
ccatcccaggttctgtttgattgag

SEQ ID NO: 77636 - DNA, 25 bp, mus musculus
actccgccaggatcaggtctagagg

SEQ ID NO: 77637 - DNA, 25 bp, mus musculus
tgtccagaaccgggcacaatggggt

SEQ ID NO: 77638 - DNA, 25 bp, mus musculus
cccaactgagacaactcaagactcc

SEQ ID NO: 77639 - DNA, 25 bp, mus musculus
gacaactcaagactcccatcttagc

SEQ ID NO: 77640 - DNA, 25 bp, mus musculus
aactcaagactcccatcttagctga

SEQ ID NO: 77641 - DNA, 25 bp, mus musculus
tcatgaagtccatcatccctagtgg

SEQ ID NO: 77642 - DNA, 25 bp, mus musculus
atgaagtccatcatccctagtggtt

SEQ ID NO: 77643 - DNA, 25 bp, mus musculus
ttatcgcttaactcccttgactgat

SEQ ID NO: 77644 - DNA, 25 bp, mus musculus
atcgcttaactcccttgactgatgg

SEQ ID NO: 77645 - DNA, 25 bp, mus musculus
cgcttaactcccttgactgatggca

SEQ ID NO: 77646 - DNA, 25 bp, mus musculus
taactcccttgactgatggcatcat

SEQ ID NO: 77647 - DNA, 25 bp, mus musculus
tcccttgactgatggcatcatcctc

SEQ ID NO: 77648 - DNA, 25 bp, mus musculus
ctgatggcatcatcctctactagga

SEQ ID NO: 77649 - DNA, 25 bp, mus musculus
gatggcatcatcctctactaggatg

SEQ ID NO: 77650 - DNA, 25 bp, mus musculus
atcatcctctactaggatgttttct

SEQ ID NO: 77651 - DNA, 25 bp, mus musculus
catcctctactaggatgttttcttc

SEQ ID NO: 77652 - DNA, 25 bp, mus musculus
tcctctactaggatgttttcttcaa

SEQ ID NO: 77653 - DNA, 25 bp, mus musculus
gaagtccatcatccctagtggttat

SEQ ID NO: 77654 - DNA, 25 bp, mus musculus
agtccatcatccctagtggttatgg

SEQ ID NO: 77655 - DNA, 25 bp, mus musculus
catcatccctagtggttatggctgg

SEQ ID NO: 77656 - DNA, 25 bp, mus musculus
atccctagtggttatggctgggatc

SEQ ID NO: 77657 - DNA, 25 bp, mus musculus
tggcatgtacttatcgcttaactcc

SEQ ID NO: 77658 - DNA, 25 bp, mus musculus
gcatgtacttatcgcttaactccct

SEQ ID NO: 77659 - DNA, 25 bp, mus musculus
atgtacttatcgcttaactcccttg

SEQ ID NO: 77660 - DNA, 25 bp, mus musculus
acttatcgcttaactcccttgactg

SEQ ID NO: 77661 - DNA, 25 bp, mus musculus
ggcgccaggctcaactaggagtcgc

SEQ ID NO: 77662 - DNA, 25 bp, mus musculus
gcgccaggctcaactaggagtcgct

SEQ ID NO: 77663 - DNA, 25 bp, mus musculus
ccagtctctttggaaccagagaaat

SEQ ID NO: 77664 - DNA, 25 bp, mus musculus
gtctctttggaaccagagaaatgag

SEQ ID NO: 77665 - DNA, 25 bp, mus musculus
agttgttactactatcccactattg

SEQ ID NO: 77666 - DNA, 25 bp, mus musculus
ttgttactactatcccactattgga

SEQ ID NO: 77667 - DNA, 25 bp, mus musculus
ttactactatcccactattggattt

SEQ ID NO: 77668 - DNA, 25 bp, mus musculus
tactactatcccactattggattta

SEQ ID NO: 77669 - DNA, 25 bp, mus musculus
ctactatcccactattggatttaat

SEQ ID NO: 77670 - DNA, 25 bp, mus musculus
tactatcccactattggatttaatg

SEQ ID NO: 77671 - DNA, 25 bp, mus musculus
ctatcccactattggatttaatgtg

SEQ ID NO: 77672 - DNA, 25 bp, mus musculus
tatcccactattggatttaatgtgg

SEQ ID NO: 77673 - DNA, 25 bp, mus musculus
ccaggctcaactaggagtcgctgcc

SEQ ID NO: 77674 - DNA, 25 bp, mus musculus
gtgacatacaaaaatctcaaattcc

SEQ ID NO: 77675 - DNA, 25 bp, mus musculus
ggctcaactaggagtcgctgccgag

SEQ ID NO: 77676 - DNA, 25 bp, mus musculus
ctcaactaggagtcgctgccgagtc

SEQ ID NO: 77677 - DNA, 25 bp, mus musculus
aactaggagtcgctgccgagtcccg

SEQ ID NO: 77678 - DNA, 25 bp, mus musculus
actaggagtcgctgccgagtcccgg

SEQ ID NO: 77679 - DNA, 25 bp, mus musculus
cggttcatcatgggtggctttttct

SEQ ID NO: 77680 - DNA, 25 bp, mus musculus
tcatcatgggtggctttttctgaag

SEQ ID NO: 77681 - DNA, 25 bp, mus musculus
ttccagtctctttggaaccagagaa

SEQ ID NO: 77682 - DNA, 25 bp, mus musculus
aactctgacgtggtgacatggaccc

SEQ ID NO: 77683 - DNA, 25 bp, mus musculus
gtgacatggaccccacgacctggcg

SEQ ID NO: 77684 - DNA, 25 bp, mus musculus
aattacaacctggtggtcaggatga

SEQ ID NO: 77685 - DNA, 25 bp, mus musculus
aacctggtggtcaggatgattgaaa

SEQ ID NO: 77686 - DNA, 25 bp, mus musculus
gaagatttcagcccttttcctggag

SEQ ID NO: 77687 - DNA, 25 bp, mus musculus
atccatagccgggtggatgtcatca

SEQ ID NO: 77688 - DNA, 25 bp, mus musculus
gtcatcaggtacgtggtgaagaacg

SEQ ID NO: 77689 - DNA, 25 bp, mus musculus
attggattccagacccgattgctgc

SEQ ID NO: 77690 - DNA, 25 bp, mus musculus
ttccagacccgattgctgcgggacc

SEQ ID NO: 77691 - DNA, 25 bp, mus musculus
cctgatatataccatcatctgtttt

SEQ ID NO: 77692 - DNA, 25 bp, mus musculus
atataccatcatctgttttggaatc

SEQ ID NO: 77693 - DNA, 25 bp, mus musculus
tgtgattagtctggacctggtaagt

SEQ ID NO: 77694 - DNA, 25 bp, mus musculus
ctcgaccttggcaggatgctgaagg

SEQ ID NO: 77695 - DNA, 25 bp, mus musculus
ctgaaggacccaacagacagcaagg

SEQ ID NO: 77696 - DNA, 25 bp, mus musculus
gacccaacagacagcaagggcattg

SEQ ID NO: 77697 - DNA, 25 bp, mus musculus
ggcccgtacctggagatcttgaatt

SEQ ID NO: 77698 - DNA, 25 bp, mus musculus
ttgaattctgctgtcagagatgaaa

SEQ ID NO: 77699 - DNA, 25 bp, mus musculus
atcttctgtcattcatcctggatta

SEQ ID NO: 77700 - DNA, 25 bp, mus musculus
tgtcattcatcctggattaaagagt

SEQ ID NO: 77701 - DNA, 25 bp, mus musculus
tacttcacgtgggctggatttaaga

SEQ ID NO: 77702 - DNA, 25 bp, mus musculus
cgatcccatgctaaatttgctggcc

SEQ ID NO: 77703 - DNA, 25 bp, mus musculus
aaatttgctggccctcgacctcgag

SEQ ID NO: 77704 - DNA, 25 bp, mus musculus
attcaagagctactggcctggatgg

SEQ ID NO: 77705 - DNA, 25 bp, mus musculus
gagctactggcctggatggtggacc

SEQ ID NO: 77706 - DNA, 25 bp, mus musculus
caagcagagctctgccgactcaggt

SEQ ID NO: 77707 - DNA, 25 bp, mus musculus
gagctctgccgactcaggtctcagt

SEQ ID NO: 77708 - DNA, 25 bp, mus musculus
tgccgactcaggtctcagtgactga

SEQ ID NO: 77709 - DNA, 25 bp, mus musculus
tctcagtgactgacctagcccagag

SEQ ID NO: 77710 - DNA, 25 bp, mus musculus
tgactgacctagcccagagcaggac

SEQ ID NO: 77711 - DNA, 25 bp, mus musculus
acctagcccagagcaggactggact

SEQ ID NO: 77712 - DNA, 25 bp, mus musculus
ctggactctgaccttagcttgcttg

SEQ ID NO: 77713 - DNA, 25 bp, mus musculus
ggtccaaagtctctgagagaaccaa

SEQ ID NO: 77714 - DNA, 25 bp, mus musculus
gctggccctcgacctcgaggtccaa

SEQ ID NO: 77715 - DNA, 25 bp, mus musculus
tacagcatcgccatggacaagatcc

SEQ ID NO: 77716 - DNA, 25 bp, mus musculus
atcgccatggacaagatccgacaac

SEQ ID NO: 77717 - DNA, 25 bp, mus musculus
aagatccgacaacaagacttcgtga

SEQ ID NO: 77718 - DNA, 25 bp, mus musculus
caagacttcgtgaactggctgctgg

SEQ ID NO: 77719 - DNA, 25 bp, mus musculus
ttcgtgaactggctgctggcacaga

SEQ ID NO: 77720 - DNA, 25 bp, mus musculus
tggaaacacaacatcacccagagag

SEQ ID NO: 77721 - DNA, 25 bp, mus musculus
tctttgcccaagagcctcagtgatg

SEQ ID NO: 77722 - DNA, 25 bp, mus musculus
gcagccagcaaggcctgacctatac

SEQ ID NO: 77723 - DNA, 25 bp, mus musculus
agcaaggcctgacctatacatcaga

SEQ ID NO: 77724 - DNA, 25 bp, mus musculus
atgactaccaggctgctggcgatga

SEQ ID NO: 77725 - DNA, 25 bp, mus musculus
accaggctgctggcgatgatgagat

SEQ ID NO: 77726 - DNA, 25 bp, mus musculus
atgagatctcctttgaccctgatga

SEQ ID NO: 77727 - DNA, 25 bp, mus musculus
acatcatcaccaacatagaaatgat

SEQ ID NO: 77728 - DNA, 25 bp, mus musculus
tcccagccaactatgtggagctgcg

SEQ ID NO: 77729 - DNA, 25 bp, mus musculus
ccaactatgtggagctgcggcagta

SEQ ID NO: 77730 - DNA, 25 bp, mus musculus
agggctgccacccagagcctaccgg

SEQ ID NO: 77731 - DNA, 25 bp, mus musculus
ctaccggcaccagcacagggttcac

SEQ ID NO: 77732 - DNA, 25 bp, mus musculus
gcaccagcacagggttcacactaca

SEQ ID NO: 77733 - DNA, 25 bp, mus musculus
gcacagggttcacactacagagcat

SEQ ID NO: 77734 - DNA, 25 bp, mus musculus
gcctgacctatacatcagagcccgt

SEQ ID NO: 77735 - DNA, 25 bp, mus musculus
cctatacatcagagcccgtgtacga

SEQ ID NO: 77736 - DNA, 25 bp, mus musculus
agactacagaggctcctggccacta

SEQ ID NO: 77737 - DNA, 25 bp, mus musculus
cagaggctcctggccactatcaagc

SEQ ID NO: 77738 - DNA, 25 bp, mus musculus
gccactatcaagcagaggatgacac

SEQ ID NO: 77739 - DNA, 25 bp, mus musculus
atgacacctacgatgggtatgagag

SEQ ID NO: 77740 - DNA, 25 bp, mus musculus
gtgacctgggcatcacagccatcgc

SEQ ID NO: 77741 - DNA, 25 bp, mus musculus
ccatcgccctgtatgactaccaggc

SEQ ID NO: 77742 - DNA, 25 bp, mus musculus
accttctcagatggagcgcagcata

SEQ ID NO: 77743 - DNA, 25 bp, mus musculus
catcatcgacaccttccatcaatac

SEQ ID NO: 77744 - DNA, 25 bp, mus musculus
ggacacaaaccaggacaatcagctg

SEQ ID NO: 77745 - DNA, 25 bp, mus musculus
aaagttgatctttgcctgtcatgag

SEQ ID NO: 77746 - DNA, 25 bp, mus musculus
gatctttgcctgtcatgagaagctg

SEQ ID NO: 77747 - DNA, 25 bp, mus musculus
gcatgagaacaacccacgtgggcat

SEQ ID NO: 77748 - DNA, 25 bp, mus musculus
gaacaacccacgtgggcatggccac

SEQ ID NO: 77749 - DNA, 25 bp, mus musculus
caacccacgtgggcatggccacagt

SEQ ID NO: 77750 - DNA, 25 bp, mus musculus
tggccacagtcatggcaaaggctgt

SEQ ID NO: 77751 - DNA, 25 bp, mus musculus
atgtgactgctgcccaaccaagtct

SEQ ID NO: 77752 - DNA, 25 bp, mus musculus
caatggcctttgttctgggaaatga

SEQ ID NO: 77753 - DNA, 25 bp, mus musculus
tggcctttgttctgggaaatgataa

SEQ ID NO: 77754 - DNA, 25 bp, mus musculus
cgacaccttccatcaatactctagg

SEQ ID NO: 77755 - DNA, 25 bp, mus musculus
caccttccatcaatactctaggaag

SEQ ID NO: 77756 - DNA, 25 bp, mus musculus
cttccatcaatactctaggaaggaa

SEQ ID NO: 77757 - DNA, 25 bp, mus musculus
ccctgacaccctgagcaagaaggaa

SEQ ID NO: 77758 - DNA, 25 bp, mus musculus
tgacaccctgagcaagaaggaattc

SEQ ID NO: 77759 - DNA, 25 bp, mus musculus
agcacagttggcaacctttatgaag

SEQ ID NO: 77760 - DNA, 25 bp, mus musculus
aaatgaagccctcataaatgacatc

SEQ ID NO: 77761 - DNA, 25 bp, mus musculus
ggacctggacacaaaccaggacaat

SEQ ID NO: 77762 - DNA, 25 bp, mus musculus
cctcacatatcctttgtcagctccg

SEQ ID NO: 77763 - DNA, 25 bp, mus musculus
tcctttgtcagctccgtcttcaaga

SEQ ID NO: 77764 - DNA, 25 bp, mus musculus
taccacaattattccaatatacaag

SEQ ID NO: 77765 - DNA, 25 bp, mus musculus
gtcactactgagtgtcctcagtttg

SEQ ID NO: 77766 - DNA, 25 bp, mus musculus
actgagtgtcctcagtttgtgcaga

SEQ ID NO: 77767 - DNA, 25 bp, mus musculus
tgtcctcagtttgtgcagaatataa

SEQ ID NO: 77768 - DNA, 25 bp, mus musculus
aacttcgaggagttccttgcgatgg

SEQ ID NO: 77769 - DNA, 25 bp, mus musculus
ttcgaggagttccttgcgatggtga

SEQ ID NO: 77770 - DNA, 25 bp, mus musculus
gagttccttgcgatggtgataaaag

SEQ ID NO: 77771 - DNA, 25 bp, mus musculus
ttccttgcgatggtgataaaagtgg

SEQ ID NO: 77772 - DNA, 25 bp, mus musculus
gtggcatctcacaaagacagccaca

SEQ ID NO: 77773 - DNA, 25 bp, mus musculus
tctcacaaagacagccacaaggagt

SEQ ID NO: 77774 - DNA, 25 bp, mus musculus
gtcagctccgtcttcaagacatcga

SEQ ID NO: 77775 - DNA, 25 bp, mus musculus
tccgtcttcaagacatcgaaatctt

SEQ ID NO: 77776 - DNA, 25 bp, mus musculus
ttcaagacatcgaaatctttcgtga

SEQ ID NO: 77777 - DNA, 25 bp, mus musculus
aaatctttcgtgacaatgccgtctg

SEQ ID NO: 77778 - DNA, 25 bp, mus musculus
ttcgtgacaatgccgtctgaactgg

SEQ ID NO: 77779 - DNA, 25 bp, mus musculus
aaggccttgagcaacctcattgatg

SEQ ID NO: 77780 - DNA, 25 bp, mus musculus
aacctcattgatgtctaccacaatt

SEQ ID NO: 77781 - DNA, 25 bp, mus musculus
ctcattgatgtctaccacaattatt

SEQ ID NO: 77782 - DNA, 25 bp, mus musculus
tctgggaactgcctgctaagcctgc

SEQ ID NO: 77783 - DNA, 25 bp, mus musculus
aactgcctgctaagcctgcagctgt

SEQ ID NO: 77784 - DNA, 25 bp, mus musculus
aaacctagaactcaactcatggtgg

SEQ ID NO: 77785 - DNA, 25 bp, mus musculus
agaactcaactcatggtggctaggg

SEQ ID NO: 77786 - DNA, 25 bp, mus musculus
cacactgatctgcctgtcttttctg

SEQ ID NO: 77787 - DNA, 25 bp, mus musculus
gatctgcctgtcttttctgctgctc

SEQ ID NO: 77788 - DNA, 25 bp, mus musculus
cctgtcttttctgctgctctctaga

SEQ ID NO: 77789 - DNA, 25 bp, mus musculus
ttttctgctgctctctagagtatgt

SEQ ID NO: 77790 - DNA, 25 bp, mus musculus
gaccagagccgagctgtgctgtagc

SEQ ID NO: 77791 - DNA, 25 bp, mus musculus
agccgagctgtgctgtagcacacac

SEQ ID NO: 77792 - DNA, 25 bp, mus musculus
cacacactaggctcagccgggagcc

SEQ ID NO: 77793 - DNA, 25 bp, mus musculus
tcagccgggagccagagcttgcaca

SEQ ID NO: 77794 - DNA, 25 bp, mus musculus
cagctgttatggcccatagggatgg

SEQ ID NO: 77795 - DNA, 25 bp, mus musculus
agagcttgcacaaccgctcgtgccg

SEQ ID NO: 77796 - DNA, 25 bp, mus musculus
tgtccctgggtacagtccttgtaca

SEQ ID NO: 77797 - DNA, 25 bp, mus musculus
cagtccttgtacatagaggaaatct

SEQ ID NO: 77798 - DNA, 25 bp, mus musculus
gaaatctgtgctggccacattcaga

SEQ ID NO: 77799 - DNA, 25 bp, mus musculus
tgtgctggccacattcagagcacca

SEQ ID NO: 77800 - DNA, 25 bp, mus musculus
aaggacctcaggcagtgtggctaag

SEQ ID NO: 77801 - DNA, 25 bp, mus musculus
ccactgcctgcatctctggtttaga

SEQ ID NO: 77802 - DNA, 25 bp, mus musculus
cctgcatctctggtttagatgattg

SEQ ID NO: 77803 - DNA, 25 bp, mus musculus
tccgaatcctcctgctgcagcctgg

SEQ ID NO: 77804 - DNA, 25 bp, mus musculus
ccagacctcacgacatgtgtgtcac

SEQ ID NO: 77805 - DNA, 25 bp, mus musculus
atggccaacttgaacagtataatct

SEQ ID NO: 77806 - DNA, 25 bp, mus musculus
aacagtataatctaccggctggaga

SEQ ID NO: 77807 - DNA, 25 bp, mus musculus
gctgccaaccgggaagaggtcctgg

SEQ ID NO: 77808 - DNA, 25 bp, mus musculus
gggacatagccccagaggtcacctt

SEQ ID NO: 77809 - DNA, 25 bp, mus musculus
agaactcagccatgcagatgtggac

SEQ ID NO: 77810 - DNA, 25 bp, mus musculus
actcagccatgcagatgtggacaac

SEQ ID NO: 77811 - DNA, 25 bp, mus musculus
ttctttctgatggccctgctcgtag

SEQ ID NO: 77812 - DNA, 25 bp, mus musculus
ctgctcgtaggaggcgctggaatcc

SEQ ID NO: 77813 - DNA, 25 bp, mus musculus
ctcgtaggaggcgctggaatcctgc

SEQ ID NO: 77814 - DNA, 25 bp, mus musculus
tcgcccctgtgggaaggcagggcca

SEQ ID NO: 77815 - DNA, 25 bp, mus musculus
gacctcacgacatgtgtgtcacctg

SEQ ID NO: 77816 - DNA, 25 bp, mus musculus
agccccactggtgacacagccgcag

SEQ ID NO: 77817 - DNA, 25 bp, mus musculus
actggtgacacagccgcagccttgc

SEQ ID NO: 77818 - DNA, 25 bp, mus musculus
ttgcaccccagcactaaggtgaacc

SEQ ID NO: 77819 - DNA, 25 bp, mus musculus
aaccccaacttgcagcggcggcatg

SEQ ID NO: 77820 - DNA, 25 bp, mus musculus
cccaacttgcagcggcggcatgaga

SEQ ID NO: 77821 - DNA, 25 bp, mus musculus
aacttgcagcggcggcatgagaaaa

SEQ ID NO: 77822 - DNA, 25 bp, mus musculus
ttgcagcggcggcatgagaaaatgg

SEQ ID NO: 77823 - DNA, 25 bp, mus musculus
gaatctgccagagcagatgatgccc

SEQ ID NO: 77824 - DNA, 25 bp, mus musculus
agatgatgcccgacagttatttgtt

SEQ ID NO: 77825 - DNA, 25 bp, mus musculus
ggtacaggcatgccttagcaggtcc

SEQ ID NO: 77826 - DNA, 25 bp, mus musculus
caggcatgccttagcaggtccaggg

SEQ ID NO: 77827 - DNA, 25 bp, mus musculus
catgccttagcaggtccaggggata

SEQ ID NO: 77828 - DNA, 25 bp, mus musculus
tgccttagcaggtccaggggataac

SEQ ID NO: 77829 - DNA, 25 bp, mus musculus
ttagcaggtccaggggataaccgct

SEQ ID NO: 77830 - DNA, 25 bp, mus musculus
ggataaccgctcaatggatctgctc

SEQ ID NO: 77831 - DNA, 25 bp, mus musculus
aaccgctcaatggatctgctcaaac

SEQ ID NO: 77832 - DNA, 25 bp, mus musculus
ccgctcaatggatctgctcaaacta

SEQ ID NO: 77833 - DNA, 25 bp, mus musculus
aatggatctgctcaaactacctaaa

SEQ ID NO: 77834 - DNA, 25 bp, mus musculus
tggatctgctcaaactacctaaatg

SEQ ID NO: 77835 - DNA, 25 bp, mus musculus
gttttagctgggagtgctgaagaag

SEQ ID NO: 77836 - DNA, 25 bp, mus musculus
tctgctcaaactacctaaatgattg

SEQ ID NO: 77837 - DNA, 25 bp, mus musculus
tttagctgggagtgctgaagaagga

SEQ ID NO: 77838 - DNA, 25 bp, mus musculus
ggagtcctgacttcagaactaacag

SEQ ID NO: 77839 - DNA, 25 bp, mus musculus
tcctgacttcagaactaacaggcgt

SEQ ID NO: 77840 - DNA, 25 bp, mus musculus
ctgacttcagaactaacaggcgtga

SEQ ID NO: 77841 - DNA, 25 bp, mus musculus
gacttcagaactaacaggcgtgatt

SEQ ID NO: 77842 - DNA, 25 bp, mus musculus
cttcagaactaacaggcgtgattag

SEQ ID NO: 77843 - DNA, 25 bp, mus musculus
tttaatgcgagaatgcggggtacag

SEQ ID NO: 77844 - DNA, 25 bp, mus musculus
gaactgtacttttatcactagagga

SEQ ID NO: 77845 - DNA, 25 bp, mus musculus
tacttttatcactagaggaatgatt

SEQ ID NO: 77846 - DNA, 25 bp, mus musculus
ggtactatcatcctagatgaaatta

SEQ ID NO: 77847 - DNA, 25 bp, mus musculus
actatcatcctagatgaaattacaa

SEQ ID NO: 77848 - DNA, 25 bp, mus musculus
agcagtacagcttttccactgatga

SEQ ID NO: 77849 - DNA, 25 bp, mus musculus
acagcttttccactgatgattttat

SEQ ID NO: 77850 - DNA, 25 bp, mus musculus
tttccactgatgattttatactccc

SEQ ID NO: 77851 - DNA, 25 bp, mus musculus
gaacttgaatccatgagcagagtca

SEQ ID NO: 77852 - DNA, 25 bp, mus musculus
ggaccaccatagcatgcattatagc

SEQ ID NO: 77853 - DNA, 25 bp, mus musculus
tagctactggttttgtgacagttgt

SEQ ID NO: 77854 - DNA, 25 bp, mus musculus
tgacagttgtccacaacacgtattt

SEQ ID NO: 77855 - DNA, 25 bp, mus musculus
ttgtccacaacacgtatttgttatt

SEQ ID NO: 77856 - DNA, 25 bp, mus musculus
ttctgttttgttatgccaaatgaga

SEQ ID NO: 77857 - DNA, 25 bp, mus musculus
actctcatttaaatctaatctgacg

SEQ ID NO: 77858 - DNA, 25 bp, mus musculus
atctaatctgacggtcctcctggtc

SEQ ID NO: 77859 - DNA, 25 bp, mus musculus
ggtctttgtacgctaccactgccta

SEQ ID NO: 77860 - DNA, 25 bp, mus musculus
ctttgtacgctaccactgcctagca

SEQ ID NO: 77861 - DNA, 25 bp, mus musculus
cacagtgcagctacctcaacttcga

SEQ ID NO: 77862 - DNA, 25 bp, mus musculus
acttcgacatcaggtagttgaaatg

SEQ ID NO: 77863 - DNA, 25 bp, mus musculus
gatggtactatcatcctagatgaaa

SEQ ID NO: 77864 - DNA, 25 bp, mus musculus
gctcacggaggccaagcaggtcacc

SEQ ID NO: 77865 - DNA, 25 bp, mus musculus
tggcctctacatcgagctcccagct

SEQ ID NO: 77866 - DNA, 25 bp, mus musculus
gagacccgacgcttgcttcatggtc

SEQ ID NO: 77867 - DNA, 25 bp, mus musculus
ttgcttcatggtctacactctggag

SEQ ID NO: 77868 - DNA, 25 bp, mus musculus
catggtctacactctggagagagag

SEQ ID NO: 77869 - DNA, 25 bp, mus musculus
gttagtccacatgtcgtgattgtgc

SEQ ID NO: 77870 - DNA, 25 bp, mus musculus
ccacatgtcgtgattgtgcagaata

SEQ ID NO: 77871 - DNA, 25 bp, mus musculus
ctgtgtttgtcacactcaagtgttg

SEQ ID NO: 77872 - DNA, 25 bp, mus musculus
ttgtcacactcaagtgttggcttta

SEQ ID NO: 77873 - DNA, 25 bp, mus musculus
gtgacctatgctatagcagtctcct

SEQ ID NO: 77874 - DNA, 25 bp, mus musculus
tatgctatagcagtctcctttgaag

SEQ ID NO: 77875 - DNA, 25 bp, mus musculus
atagcagtctcctttgaagtctgga

SEQ ID NO: 77876 - DNA, 25 bp, mus musculus
cccagctggacctctgcctgagggc

SEQ ID NO: 77877 - DNA, 25 bp, mus musculus
tggacctctgcctgagggcagtaag

SEQ ID NO: 77878 - DNA, 25 bp, mus musculus
tctgcctgagggcagtaaggacagt

SEQ ID NO: 77879 - DNA, 25 bp, mus musculus
ttttgcagctctcctagagttcgca

SEQ ID NO: 77880 - DNA, 25 bp, mus musculus
agctctcctagagttcgcagaggag

SEQ ID NO: 77881 - DNA, 25 bp, mus musculus
agaggagcaactccaggctgaccac

SEQ ID NO: 77882 - DNA, 25 bp, mus musculus
gcaactccaggctgaccacgttttc

SEQ ID NO: 77883 - DNA, 25 bp, mus musculus
ctttcttggctttgagattgtgaga

SEQ ID NO: 77884 - DNA, 25 bp, mus musculus
agcccttgcgattatcattactgac

SEQ ID NO: 77885 - DNA, 25 bp, mus musculus
ccttgcgattatcattactgacact

SEQ ID NO: 77886 - DNA, 25 bp, mus musculus
tggaacaagcactttctctcgtcag

SEQ ID NO: 77887 - DNA, 25 bp, mus musculus
cactttctctcgtcagaatgctatc

SEQ ID NO: 77888 - DNA, 25 bp, mus musculus
tttctctcgtcagaatgctatcgag

SEQ ID NO: 77889 - DNA, 25 bp, mus musculus
ctctcgtcagaatgctatcgagttg

SEQ ID NO: 77890 - DNA, 25 bp, mus musculus
gaatgctatcgagttgcttgtacga

SEQ ID NO: 77891 - DNA, 25 bp, mus musculus
tgctatcgagttgcttgtacgacag

SEQ ID NO: 77892 - DNA, 25 bp, mus musculus
tatcgagttgcttgtacgacagccg

SEQ ID NO: 77893 - DNA, 25 bp, mus musculus
gttgcttgtacgacagccggttaat

SEQ ID NO: 77894 - DNA, 25 bp, mus musculus
gcttgtacgacagccggttaatgaa

SEQ ID NO: 77895 - DNA, 25 bp, mus musculus
tgtacgacagccggttaatgaaatg

SEQ ID NO: 77896 - DNA, 25 bp, mus musculus
cattactgacactgaaatcagtgaa

SEQ ID NO: 77897 - DNA, 25 bp, mus musculus
gtacgacagccggttaatgaaatgg

SEQ ID NO: 77898 - DNA, 25 bp, mus musculus
tactgacactgaaatcagtgaattt

SEQ ID NO: 77899 - DNA, 25 bp, mus musculus
cctaaggattcctcattttcactgg

SEQ ID NO: 77900 - DNA, 25 bp, mus musculus
gattcctcattttcactggaaaacg

SEQ ID NO: 77901 - DNA, 25 bp, mus musculus
tcattttcactggaaaacgagcaaa

SEQ ID NO: 77902 - DNA, 25 bp, mus musculus
aacagtatgaacactccttcttgga

SEQ ID NO: 77903 - DNA, 25 bp, mus musculus
aacactccttcttggaacaagcact

SEQ ID NO: 77904 - DNA, 25 bp, mus musculus
ccttcttggaacaagcactttctct

SEQ ID NO: 77905 - DNA, 25 bp, mus musculus
ttggtgtttggctgccgatgctccc

SEQ ID NO: 77906 - DNA, 25 bp, mus musculus
tttggctgccgatgctcccaactgg

SEQ ID NO: 77907 - DNA, 25 bp, mus musculus
actatggcaaccagcgtcctgcaaa

SEQ ID NO: 77908 - DNA, 25 bp, mus musculus
ctgcaaaccgtgcagagaattctgg

SEQ ID NO: 77909 - DNA, 25 bp, mus musculus
gacgtcatcggcgtgctgcgggatc

SEQ ID NO: 77910 - DNA, 25 bp, mus musculus
atcggcgtgctgcgggatcagcaac

SEQ ID NO: 77911 - DNA, 25 bp, mus musculus
gacattttcggactcacattgcgca

SEQ ID NO: 77912 - DNA, 25 bp, mus musculus
ttcggactcacattgcgcacccagg

SEQ ID NO: 77913 - DNA, 25 bp, mus musculus
ttgcgcacccaggaggtgacaagcc

SEQ ID NO: 77914 - DNA, 25 bp, mus musculus
acaagccgcatacgcacccagagct

SEQ ID NO: 77915 - DNA, 25 bp, mus musculus
gcagtgccctggtcctttgacccgc

SEQ ID NO: 77916 - DNA, 25 bp, mus musculus
ccagaaatacctggttcctgacagt

SEQ ID NO: 77917 - DNA, 25 bp, mus musculus
tgccgatgctcccaactggaccatc

SEQ ID NO: 77918 - DNA, 25 bp, mus musculus
ctcaccgccttttccagggatcctg

SEQ ID NO: 77919 - DNA, 25 bp, mus musculus
gtgcaagacctcctgaggacagagc

SEQ ID NO: 77920 - DNA, 25 bp, mus musculus
gacctcctgaggacagagctagccg

SEQ ID NO: 77921 - DNA, 25 bp, mus musculus
acagagctagccgcggaggttcacc

SEQ ID NO: 77922 - DNA, 25 bp, mus musculus
gttcaccgtgtgctgtgccttgagc

SEQ ID NO: 77923 - DNA, 25 bp, mus musculus
catatgtttgtctgcggcgatgtca

SEQ ID NO: 77924 - DNA, 25 bp, mus musculus
gatgtcactatggcaaccagcgtcc

SEQ ID NO: 77925 - DNA, 25 bp, mus musculus
gctacccgggaccataccagcctat

SEQ ID NO: 77926 - DNA, 25 bp, mus musculus
cataccagcctatggccagttacct

SEQ ID NO: 77927 - DNA, 25 bp, mus musculus
cgtttgcagagcccagtgtccagca

SEQ ID NO: 77928 - DNA, 25 bp, mus musculus
gcaaaaaacgcattccctatagcaa

SEQ ID NO: 77929 - DNA, 25 bp, mus musculus
aacgcattccctatagcaaggggca

SEQ ID NO: 77930 - DNA, 25 bp, mus musculus
atgcagccaacaagtttatcactaa

SEQ ID NO: 77931 - DNA, 25 bp, mus musculus
gcaagatctcggcagccaccagcct

SEQ ID NO: 77932 - DNA, 25 bp, mus musculus
ccagcctctctgaacgccagattac

SEQ ID NO: 77933 - DNA, 25 bp, mus musculus
tctctgaacgccagattaccatctg

SEQ ID NO: 77934 - DNA, 25 bp, mus musculus
aacgccagattaccatctggtttca

SEQ ID NO: 77935 - DNA, 25 bp, mus musculus
aggttcttgccaaggtcaagaccag

SEQ ID NO: 77936 - DNA, 25 bp, mus musculus
aggtcaagaccagcactaccccgtg

SEQ ID NO: 77937 - DNA, 25 bp, mus musculus
agcctatggccagttacctggatgt

SEQ ID NO: 77938 - DNA, 25 bp, mus musculus
ggtcaagaccagcactaccccgtga

SEQ ID NO: 77939 - DNA, 25 bp, mus musculus
acgattctctgcttcccgtggacag

SEQ ID NO: 77940 - DNA, 25 bp, mus musculus
ctctgcttcccgtggacagttacca

SEQ ID NO: 77941 - DNA, 25 bp, mus musculus
ttcccgtggacagttaccagccctg

SEQ ID NO: 77942 - DNA, 25 bp, mus musculus
tggacagttaccagccctgggccct

SEQ ID NO: 77943 - DNA, 25 bp, mus musculus
tggccggtggctggaacagccagat

SEQ ID NO: 77944 - DNA, 25 bp, mus musculus
gtgaacagaacccaccaggtccatt

SEQ ID NO: 77945 - DNA, 25 bp, mus musculus
caccaggtccattctggaaagcagc

SEQ ID NO: 77946 - DNA, 25 bp, mus musculus
ttttgcaacaatgtcttttattagg

SEQ ID NO: 77947 - DNA, 25 bp, mus musculus
atgatctcttcaatttctccatata

SEQ ID NO: 77948 - DNA, 25 bp, mus musculus
catttatcttactggagcttgccaa

SEQ ID NO: 77949 - DNA, 25 bp, mus musculus
tttatcttactggagcttgccaact

SEQ ID NO: 77950 - DNA, 25 bp, mus musculus
tatcttactggagcttgccaactat

SEQ ID NO: 77951 - DNA, 25 bp, mus musculus
ttactggagcttgccaactatctag

SEQ ID NO: 77952 - DNA, 25 bp, mus musculus
actggagcttgccaactatctagag

SEQ ID NO: 77953 - DNA, 25 bp, mus musculus
gcttgccaactatctagagaaggac

SEQ ID NO: 77954 - DNA, 25 bp, mus musculus
ttgccaactatctagagaaggacac

SEQ ID NO: 77955 - DNA, 25 bp, mus musculus
tgctttaaccaggaggccagttcat

SEQ ID NO: 77956 - DNA, 25 bp, mus musculus
ctttaaccaggaggccagttcatct

SEQ ID NO: 77957 - DNA, 25 bp, mus musculus
ttaaccaggaggccagttcatctgc

SEQ ID NO: 77958 - DNA, 25 bp, mus musculus
gatctcttcaatttctccatataca

SEQ ID NO: 77959 - DNA, 25 bp, mus musculus
tctcttcaatttctccatatacagg

SEQ ID NO: 77960 - DNA, 25 bp, mus musculus
gcaaaactacgtgtgccatttatct

SEQ ID NO: 77961 - DNA, 25 bp, mus musculus
aactacgtgtgccatttatcttact

SEQ ID NO: 77962 - DNA, 25 bp, mus musculus
ctacgtgtgccatttatcttactgg

SEQ ID NO: 77963 - DNA, 25 bp, mus musculus
gtgtgccatttatcttactggagct

SEQ ID NO: 77964 - DNA, 25 bp, mus musculus
gtgccatttatcttactggagcttg

SEQ ID NO: 77965 - DNA, 25 bp, mus musculus
gccatttatcttactggagcttgcc

SEQ ID NO: 77966 - DNA, 25 bp, mus musculus
gttcacctgtcaagtggagcaccca

SEQ ID NO: 77967 - DNA, 25 bp, mus musculus
ctgtcaagtggagcacccaggcctg

SEQ ID NO: 77968 - DNA, 25 bp, mus musculus
tgctcttagccttctctgttcactt

SEQ ID NO: 77969 - DNA, 25 bp, mus musculus
tagccttctctgttcactttcttaa

SEQ ID NO: 77970 - DNA, 25 bp, mus musculus
tttctccagttaagttcagttcctg

SEQ ID NO: 77971 - DNA, 25 bp, mus musculus
ctggtctcatgattcttaggctgct

SEQ ID NO: 77972 - DNA, 25 bp, mus musculus
gtttccttcatgcacctagactcca

SEQ ID NO: 77973 - DNA, 25 bp, mus musculus
cacctagactccatatgtctacgta

SEQ ID NO: 77974 - DNA, 25 bp, mus musculus
gactccatatgtctacgtaaagagc

SEQ ID NO: 77975 - DNA, 25 bp, mus musculus
cccctctaagtttagtggatacatg

SEQ ID NO: 77976 - DNA, 25 bp, mus musculus
atacatgattcgtttccacatctga

SEQ ID NO: 77977 - DNA, 25 bp, mus musculus
gattcgtttccacatctgaagaagt

SEQ ID NO: 77978 - DNA, 25 bp, mus musculus
ctgtgccatcttcttagttggaatt

SEQ ID NO: 77979 - DNA, 25 bp, mus musculus
tggaattctgttcctaatcttaagg

SEQ ID NO: 77980 - DNA, 25 bp, mus musculus
tgtcttaacagactgtgagtgatct

SEQ ID NO: 77981 - DNA, 25 bp, mus musculus
tgcagcctgctgaaccacggaagag

SEQ ID NO: 77982 - DNA, 25 bp, mus musculus
ctgctgaaccacggaagagagaaaa

SEQ ID NO: 77983 - DNA, 25 bp, mus musculus
agttggacctaacacacagaaactg

SEQ ID NO: 77984 - DNA, 25 bp, mus musculus
acctaacacacagaaactgcctgag

SEQ ID NO: 77985 - DNA, 25 bp, mus musculus
gaactgtgctcttagccttctctgt

SEQ ID NO: 77986 - DNA, 25 bp, mus musculus
agctcattacttgcaggcggccctg

SEQ ID NO: 77987 - DNA, 25 bp, mus musculus
tcattacttgcaggcggccctgcag

SEQ ID NO: 77988 - DNA, 25 bp, mus musculus
ctggatttcaacttgcgcacccaca

SEQ ID NO: 77989 - DNA, 25 bp, mus musculus
aggcgctttgtgtgtccttttgatg

SEQ ID NO: 77990 - DNA, 25 bp, mus musculus
tgtccttttgatggctgcgagaaga

SEQ ID NO: 77991 - DNA, 25 bp, mus musculus
ccttttgatggctgcgagaagagct

SEQ ID NO: 77992 - DNA, 25 bp, mus musculus
cagaagattcacatcctaacccacg

SEQ ID NO: 77993 - DNA, 25 bp, mus musculus
aagattcacatcctaacccacgcaa

SEQ ID NO: 77994 - DNA, 25 bp, mus musculus
agacagattgtcctcaggctgggta

SEQ ID NO: 77995 - DNA, 25 bp, mus musculus
attgtcctcaggctgggtagtctta

SEQ ID NO: 77996 - DNA, 25 bp, mus musculus
gtcctcaggctgggtagtcttaatg

SEQ ID NO: 77997 - DNA, 25 bp, mus musculus
aatgacagaggcactggggatacac

SEQ ID NO: 77998 - DNA, 25 bp, mus musculus
tactgtggtgtcttatcgatgctgg

SEQ ID NO: 77999 - DNA, 25 bp, mus musculus
ttatcgatgctggagtgtcctcaag

SEQ ID NO: 78000 - DNA, 25 bp, mus musculus
tcgatgctggagtgtcctcaagccg

SEQ ID NO: 78001 - DNA, 25 bp, mus musculus
tgtcctcaagccgggtgcaagaaga

SEQ ID NO: 78002 - DNA, 25 bp, mus musculus
gccttcacggagagctcgaaactaa

SEQ ID NO: 78003 - DNA, 25 bp, mus musculus
ctaaagcgacattttctggtgcaca

SEQ ID NO: 78004 - DNA, 25 bp, mus musculus
aagcgacattttctggtgcacaccg

SEQ ID NO: 78005 - DNA, 25 bp, mus musculus
ctggtgcacaccggagagaagccgt

SEQ ID NO: 78006 - DNA, 25 bp, mus musculus
gcccaacaggctgggaagtaattga

SEQ ID NO: 78007 - DNA, 25 bp, mus musculus
aggtacatacagcgtgctgtagtga

SEQ ID NO: 78008 - DNA, 25 bp, mus musculus
gaatgatcttcgtcactctgaagcc

SEQ ID NO: 78009 - DNA, 25 bp, mus musculus
tcttcgtcactctgaagccaccgtg

SEQ ID NO: 78010 - DNA, 25 bp, mus musculus
tcgtcactctgaagccaccgtggcc

SEQ ID NO: 78011 - DNA, 25 bp, mus musculus
tccggtccttgaaactgtcgagtct

SEQ ID NO: 78012 - DNA, 25 bp, mus musculus
ggtccttgaaactgtcgagtctgct

SEQ ID NO: 78013 - DNA, 25 bp, mus musculus
tgaaactgtcgagtctgcttttaag

SEQ ID NO: 78014 - DNA, 25 bp, mus musculus
gtctgcttttaagcagtgagcgcac

SEQ ID NO: 78015 - DNA, 25 bp, mus musculus
gtgagcgcactaaccctttgtgggg

SEQ ID NO: 78016 - DNA, 25 bp, mus musculus
gtcatatagcctctgggaaagtctc

SEQ ID NO: 78017 - DNA, 25 bp, mus musculus
atatagcctctgggaaagtctcagt

SEQ ID NO: 78018 - DNA, 25 bp, mus musculus
tacatacagcgtgctgtagtgaacc

SEQ ID NO: 78019 - DNA, 25 bp, mus musculus
gatagcgatcctgtttcaacgttgt

SEQ ID NO: 78020 - DNA, 25 bp, mus musculus
tcaacgttgttacactcaagccaag

SEQ ID NO: 78021 - DNA, 25 bp, mus musculus
ttgttacactcaagccaagattgaa

SEQ ID NO: 78022 - DNA, 25 bp, mus musculus
ttacactcaagccaagattgaatgt

SEQ ID NO: 78023 - DNA, 25 bp, mus musculus
cactcaagccaagattgaatgtctg

SEQ ID NO: 78024 - DNA, 25 bp, mus musculus
atgtctgacatgaaccgtgaatgat

SEQ ID NO: 78025 - DNA, 25 bp, mus musculus
tctgacatgaaccgtgaatgatctt

SEQ ID NO: 78026 - DNA, 25 bp, mus musculus
agatgcagatgagcccgatggtgca

SEQ ID NO: 78027 - DNA, 25 bp, mus musculus
agatgagcccgatggtgcagacatt

SEQ ID NO: 78028 - DNA, 25 bp, mus musculus
cagacaccagaattctcacactggt

SEQ ID NO: 78029 - DNA, 25 bp, mus musculus
ccagaattctcacactggttgagta

SEQ ID NO: 78030 - DNA, 25 bp, mus musculus
acataccggacttcacatcaaagac

SEQ ID NO: 78031 - DNA, 25 bp, mus musculus
cggacttcacatcaaagactttcac

SEQ ID NO: 78032 - DNA, 25 bp, mus musculus
ctttcactctcatcacagactgaaa

SEQ ID NO: 78033 - DNA, 25 bp, mus musculus
attgaacgcagggactctttcagtt

SEQ ID NO: 78034 - DNA, 25 bp, mus musculus
cgcagggactctttcagttttagct

SEQ ID NO: 78035 - DNA, 25 bp, mus musculus
ttcagttttagctgttccctatgga

SEQ ID NO: 78036 - DNA, 25 bp, mus musculus
tttagctgttccctatggaacatca

SEQ ID NO: 78037 - DNA, 25 bp, mus musculus
tgttccctatggaacatcaggatat

SEQ ID NO: 78038 - DNA, 25 bp, mus musculus
accatactacaactgtcatgaatgc

SEQ ID NO: 78039 - DNA, 25 bp, mus musculus
cgcagaaacgttcgcttccagctca

SEQ ID NO: 78040 - DNA, 25 bp, mus musculus
agcctttggcgagcatctgaaaagt

SEQ ID NO: 78041 - DNA, 25 bp, mus musculus
gatcatcttcgagccggccaatgct

SEQ ID NO: 78042 - DNA, 25 bp, mus musculus
caatgctcctggagagtgctctggc

SEQ ID NO: 78043 - DNA, 25 bp, mus musculus
tcctggagagtgctctggctacatt

SEQ ID NO: 78044 - DNA, 25 bp, mus musculus
tgaacgggccagcaccagtgcaggt

SEQ ID NO: 78045 - DNA, 25 bp, mus musculus
ccttgccagacaccagaattctcac

SEQ ID NO: 78046 - DNA, 25 bp, mus musculus
gccctgaacgctaaggccaaccgtg

SEQ ID NO: 78047 - DNA, 25 bp, mus musculus
ttgagaccttgaacacccgagccat

SEQ ID NO: 78048 - DNA, 25 bp, mus musculus
tccaggctgtgctgtgcgtgtatgc

SEQ ID NO: 78049 - DNA, 25 bp, mus musculus
tgtgcgtgtatgcctctggtcgtac

SEQ ID NO: 78050 - DNA, 25 bp, mus musculus
cctctggtcgtaccacgaggcattg

SEQ ID NO: 78051 - DNA, 25 bp, mus musculus
tctggtcgtaccacgaggcattgtg

SEQ ID NO: 78052 - DNA, 25 bp, mus musculus
tggtcgtaccacgaggcattgtgat

SEQ ID NO: 78053 - DNA, 25 bp, mus musculus
gtcgtaccacgaggcattgtgatgg

SEQ ID NO: 78054 - DNA, 25 bp, mus musculus
cgtaccacgaggcattgtgatggac

SEQ ID NO: 78055 - DNA, 25 bp, mus musculus
taccacgaggcattgtgatggactg

SEQ ID NO: 78056 - DNA, 25 bp, mus musculus
tcaccacactgtgcccatctacgag

SEQ ID NO: 78057 - DNA, 25 bp, mus musculus
accacactgtgcccatctacgaggg

SEQ ID NO: 78058 - DNA, 25 bp, mus musculus
gagaccttgaacacccgagccatgt

SEQ ID NO: 78059 - DNA, 25 bp, mus musculus
gaccttgaacacccgagccatgtac

SEQ ID NO: 78060 - DNA, 25 bp, mus musculus
ttgaacacccgagccatgtacgtag

SEQ ID NO: 78061 - DNA, 25 bp, mus musculus
gaacacccgagccatgtacgtagcc

SEQ ID NO: 78062 - DNA, 25 bp, mus musculus
cgtagccatccaggctgtgctgtgc

SEQ ID NO: 78063 - DNA, 25 bp, mus musculus
tagccatccaggctgtgctgtgcgt

SEQ ID NO: 78064 - DNA, 25 bp, mus musculus
gccatccaggctgtgctgtgcgtgt

SEQ ID NO: 78065 - DNA, 25 bp, mus musculus
catccaggctgtgctgtgcgtgtat

SEQ ID NO: 78066 - DNA, 25 bp, mus musculus
caccttcttcaatctaaggacttgt

SEQ ID NO: 78067 - DNA, 25 bp, mus musculus
gacttgttttggggctcctatccag

SEQ ID NO: 78068 - DNA, 25 bp, mus musculus
cagccactttaactgcgcctatttg

SEQ ID NO: 78069 - DNA, 25 bp, mus musculus
tggctgtgtgtcctcaagagcagtc

SEQ ID NO: 78070 - DNA, 25 bp, mus musculus
agcagtcgggcagccagaggcaccc

SEQ ID NO: 78071 - DNA, 25 bp, mus musculus
tctggctctgcaatcaggaaagaca

SEQ ID NO: 78072 - DNA, 25 bp, mus musculus
cttggacccaaggaagctgcagctc

SEQ ID NO: 78073 - DNA, 25 bp, mus musculus
ctccagagctggaccctgaaagcct

SEQ ID NO: 78074 - DNA, 25 bp, mus musculus
agctggaccctgaaagcctcttagg

SEQ ID NO: 78075 - DNA, 25 bp, mus musculus
ctaatgaccttactatgaagaaggg

SEQ ID NO: 78076 - DNA, 25 bp, mus musculus
taggagccacctgtccaaccagagt

SEQ ID NO: 78077 - DNA, 25 bp, mus musculus
ggctactcaattaaacagagttgtg

SEQ ID NO: 78078 - DNA, 25 bp, mus musculus
ttttggggctcctatccaggcgttg

SEQ ID NO: 78079 - DNA, 25 bp, mus musculus
ggctcctatccaggcgttgtctgtc

SEQ ID NO: 78080 - DNA, 25 bp, mus musculus
ggcgttgtctgtcttccctgaggag

SEQ ID NO: 78081 - DNA, 25 bp, mus musculus
cccacacgaagtcttcttggtcact

SEQ ID NO: 78082 - DNA, 25 bp, mus musculus
ctcccaggatggagcccagagcata

SEQ ID NO: 78083 - DNA, 25 bp, mus musculus
agtgactctctcgagttatgatcag

SEQ ID NO: 78084 - DNA, 25 bp, mus musculus
tctctcgagttatgatcagacctgc

SEQ ID NO: 78085 - DNA, 25 bp, mus musculus
gacctgcagccactttaactgcgcc

SEQ ID NO: 78086 - DNA, 25 bp, mus musculus
aatggatgccactttaacagcacga

SEQ ID NO: 78087 - DNA, 25 bp, mus musculus
tgccactttaacagcacgagagatc

SEQ ID NO: 78088 - DNA, 25 bp, mus musculus
gttcatacccatcttcctaaacaca

SEQ ID NO: 78089 - DNA, 25 bp, mus musculus
catacccatcttcctaaacacaatc

SEQ ID NO: 78090 - DNA, 25 bp, mus musculus
cttcctaaacacaatcgacccatct

SEQ ID NO: 78091 - DNA, 25 bp, mus musculus
cccatctcaccctatggcgaacgtg

SEQ ID NO: 78092 - DNA, 25 bp, mus musculus
atctcaccctatggcgaacgtgagc

SEQ ID NO: 78093 - DNA, 25 bp, mus musculus
cagagctgccaatacccagaaatgc

SEQ ID NO: 78094 - DNA, 25 bp, mus musculus
agctgccaatacccagaaatgcatc

SEQ ID NO: 78095 - DNA, 25 bp, mus musculus
tgccaatacccagaaatgcatccga

SEQ ID NO: 78096 - DNA, 25 bp, mus musculus
caatacccagaaatgcatccgagct

SEQ ID NO: 78097 - DNA, 25 bp, mus musculus
tacccagaaatgcatccgagctggg

SEQ ID NO: 78098 - DNA, 25 bp, mus musculus
cactttaacagcacgagagatccga

SEQ ID NO: 78099 - DNA, 25 bp, mus musculus
tttaacagcacgagagatccgagag

SEQ ID NO: 78100 - DNA, 25 bp, mus musculus
aacagcacgagagatccgagagctg

SEQ ID NO: 78101 - DNA, 25 bp, mus musculus
aaatttcttcagacgaaatgagcac

SEQ ID NO: 78102 - DNA, 25 bp, mus musculus
acgaaatgagcacacctatgtccac

SEQ ID NO: 78103 - DNA, 25 bp, mus musculus
aaatgagcacacctatgtccactct

SEQ ID NO: 78104 - DNA, 25 bp, mus musculus
caacgctggcatgaaccagttcata

SEQ ID NO: 78105 - DNA, 25 bp, mus musculus
catgaaccagttcatacccatcttc

SEQ ID NO: 78106 - DNA, 25 bp, mus musculus
agtaacaatcgacagcaatgcgaaa

SEQ ID NO: 78107 - DNA, 25 bp, mus musculus
gtaacaatcgacagcaatgcgaaag

SEQ ID NO: 78108 - DNA, 25 bp, mus musculus
gcctgccatgagagtcacagatagc

SEQ ID NO: 78109 - DNA, 25 bp, mus musculus
cctgccatgagagtcacagatagca

SEQ ID NO: 78110 - DNA, 25 bp, mus musculus
acagatttccattcattcatatgga

SEQ ID NO: 78111 - DNA, 25 bp, mus musculus
gatttccattcattcatatggacag

SEQ ID NO: 78112 - DNA, 25 bp, mus musculus
ctccatctgcttcctacgactattt

SEQ ID NO: 78113 - DNA, 25 bp, mus musculus
tccatctgcttcctacgactatttt

SEQ ID NO: 78114 - DNA, 25 bp, mus musculus
atctgcttcctacgactatttttct

SEQ ID NO: 78115 - DNA, 25 bp, mus musculus
ttctcccttttatgtgagattaaag

SEQ ID NO: 78116 - DNA, 25 bp, mus musculus
ctcccttttatgtgagattaaagca

SEQ ID NO: 78117 - DNA, 25 bp, mus musculus
gattaaagcatgctcccttggcctt

SEQ ID NO: 78118 - DNA, 25 bp, mus musculus
aatcgacagcaatgcgaaagttgaa

SEQ ID NO: 78119 - DNA, 25 bp, mus musculus
ttaaagcatgctcccttggccttcc

SEQ ID NO: 78120 - DNA, 25 bp, mus musculus
acagcgcatgtgcaagtcgatgtga

SEQ ID NO: 78121 - DNA, 25 bp, mus musculus
agcgcatgtgcaagtcgatgtgaac

SEQ ID NO: 78122 - DNA, 25 bp, mus musculus
caagcttgtgacacagcctgccatg

SEQ ID NO: 78123 - DNA, 25 bp, mus musculus
aagcttgtgacacagcctgccatga

SEQ ID NO: 78124 - DNA, 25 bp, mus musculus
gcttgtgacacagcctgccatgaga

SEQ ID NO: 78125 - DNA, 25 bp, mus musculus
cttgtgacacagcctgccatgagag

SEQ ID NO: 78126 - DNA, 25 bp, mus musculus
cagcctgccatgagagtcacagata

SEQ ID NO: 78127 - DNA, 25 bp, mus musculus
catggcggttcttggcgtcacgttg

SEQ ID NO: 78128 - DNA, 25 bp, mus musculus
gcggttcttggcgtcacgttgcctt

SEQ ID NO: 78129 - DNA, 25 bp, mus musculus
ccaatgtccttgctttgtggacata

SEQ ID NO: 78130 - DNA, 25 bp, mus musculus
aatgtccttgctttgtggacatatg

SEQ ID NO: 78131 - DNA, 25 bp, mus musculus
tgtccttgctttgtggacatatgtc

SEQ ID NO: 78132 - DNA, 25 bp, mus musculus
atatgtcagctggatttgatggatg

SEQ ID NO: 78133 - DNA, 25 bp, mus musculus
atgtcagctggatttgatggatgtt

SEQ ID NO: 78134 - DNA, 25 bp, mus musculus
tgagcgcttcgggtcggtgatcaca

SEQ ID NO: 78135 - DNA, 25 bp, mus musculus
ggcgttgtccttcgtagctaggagg

SEQ ID NO: 78136 - DNA, 25 bp, mus musculus
cgttgtccttcgtagctaggaggct

SEQ ID NO: 78137 - DNA, 25 bp, mus musculus
ttgtccttcgtagctaggaggctgt

SEQ ID NO: 78138 - DNA, 25 bp, mus musculus
gtccttcgtagctaggaggctgtca

SEQ ID NO: 78139 - DNA, 25 bp, mus musculus
ggttcttggcgtcacgttgccttgc

SEQ ID NO: 78140 - DNA, 25 bp, mus musculus
cttggcgtcacgttgccttgcttgt

SEQ ID NO: 78141 - DNA, 25 bp, mus musculus
gtcacgttgccttgcttgtctgaat

SEQ ID NO: 78142 - DNA, 25 bp, mus musculus
tctgaatagccaagctcctcctcgg

SEQ ID NO: 78143 - DNA, 25 bp, mus musculus
tgaatagccaagctcctcctcggtg

SEQ ID NO: 78144 - DNA, 25 bp, mus musculus
cctcctcggtgtccgtctggataca

SEQ ID NO: 78145 - DNA, 25 bp, mus musculus
tcctcggtgtccgtctggatacagg

SEQ ID NO: 78146 - DNA, 25 bp, mus musculus
tcccaatgtccttgctttgtggaca

SEQ ID NO: 78147 - DNA, 25 bp, mus musculus
ggcctccgatcactgtgactgccag

SEQ ID NO: 78148 - DNA, 25 bp, mus musculus
ctccgatcactgtgactgccagcga

SEQ ID NO: 78149 - DNA, 25 bp, mus musculus
tgctaattccaaatagctgggagat

SEQ ID NO: 78150 - DNA, 25 bp, mus musculus
agatccaataggggctgccttggta

SEQ ID NO: 78151 - DNA, 25 bp, mus musculus
tccaataggggctgccttggtaaag

SEQ ID NO: 78152 - DNA, 25 bp, mus musculus
agattctggaatgcatctggggcag

SEQ ID NO: 78153 - DNA, 25 bp, mus musculus
ttctggaatgcatctggggcagcct

SEQ ID NO: 78154 - DNA, 25 bp, mus musculus
tggaatgcatctggggcagcctttg

SEQ ID NO: 78155 - DNA, 25 bp, mus musculus
gcatctggggcagcctttgccatcg

SEQ ID NO: 78156 - DNA, 25 bp, mus musculus
tttgccatcgtccaggagcaggagc

SEQ ID NO: 78157 - DNA, 25 bp, mus musculus
atcattctgacaatgctgttggtat

SEQ ID NO: 78158 - DNA, 25 bp, mus musculus
tgtatgggtgctgtcaatgagaaga

SEQ ID NO: 78159 - DNA, 25 bp, mus musculus
cgatcactgtgactgccagcgacac

SEQ ID NO: 78160 - DNA, 25 bp, mus musculus
ctgtgactgccagcgacacagcagg

SEQ ID NO: 78161 - DNA, 25 bp, mus musculus
tgactgccagcgacacagcagggtt

SEQ ID NO: 78162 - DNA, 25 bp, mus musculus
ctgccagcgacacagcagggttgaa

SEQ ID NO: 78163 - DNA, 25 bp, mus musculus
tgaagtgtccaccgctgctaattcc

SEQ ID NO: 78164 - DNA, 25 bp, mus musculus
agtgtccaccgctgctaattccaaa

SEQ ID NO: 78165 - DNA, 25 bp, mus musculus
caccgctgctaattccaaatagctg

SEQ ID NO: 78166 - DNA, 25 bp, mus musculus
cgctgctaattccaaatagctggga

SEQ ID NO: 78167 - DNA, 25 bp, mus musculus
tgctcctcaatgtagaagctccgtt

SEQ ID NO: 78168 - DNA, 25 bp, mus musculus
tagaagctccgttcctttattcatg

SEQ ID NO: 78169 - DNA, 25 bp, mus musculus
ggatcttactgagagccctggggtc

SEQ ID NO: 78170 - DNA, 25 bp, mus musculus
tactgagagccctggggtcctgttg

SEQ ID NO: 78171 - DNA, 25 bp, mus musculus
catagaccagccaaacctgtggggc

SEQ ID NO: 78172 - DNA, 25 bp, mus musculus
ttgtactaacatcttctgtatgaag

SEQ ID NO: 78173 - DNA, 25 bp, mus musculus
taacatcttctgtatgaagtagaaa

SEQ ID NO: 78174 - DNA, 25 bp, mus musculus
ttgaagctagcctagggcacataac

SEQ ID NO: 78175 - DNA, 25 bp, mus musculus
acataacaagtctcagaggccaacc

SEQ ID NO: 78176 - DNA, 25 bp, mus musculus
caagtctcagaggccaacctgagct

SEQ ID NO: 78177 - DNA, 25 bp, mus musculus
tcagaggccaacctgagctacaaag

SEQ ID NO: 78178 - DNA, 25 bp, mus musculus
gccaacctgagctacaaagcaagct

SEQ ID NO: 78179 - DNA, 25 bp, mus musculus
cgtggccccaggcgatacacacaag

SEQ ID NO: 78180 - DNA, 25 bp, mus musculus
cccaggcgatacacacaagagcagg

SEQ ID NO: 78181 - DNA, 25 bp, mus musculus
gttctgtctctacttactcaagggc

SEQ ID NO: 78182 - DNA, 25 bp, mus musculus
tctctacttactcaagggcttcctt

SEQ ID NO: 78183 - DNA, 25 bp, mus musculus
cttactcaagggcttccttgacaga

SEQ ID NO: 78184 - DNA, 25 bp, mus musculus
cttccttgacagagagctttctgtg

SEQ ID NO: 78185 - DNA, 25 bp, mus musculus
agttggctcctgaggagactgtcga

SEQ ID NO: 78186 - DNA, 25 bp, mus musculus
ctgtcgaaccttagaagcagctaag

SEQ ID NO: 78187 - DNA, 25 bp, mus musculus
agaccagcattgcagcacttacagt

SEQ ID NO: 78188 - DNA, 25 bp, mus musculus
gcattgcagcacttacagtcactaa

SEQ ID NO: 78189 - DNA, 25 bp, mus musculus
tgttctgtctctatgacaatatatt

SEQ ID NO: 78190 - DNA, 25 bp, mus musculus
tttaactgactttctagatgcctta

SEQ ID NO: 78191 - DNA, 25 bp, mus musculus
ggagtcactattcctggttatctca

SEQ ID NO: 78192 - DNA, 25 bp, mus musculus
actattcctggttatctcaacaacg

SEQ ID NO: 78193 - DNA, 25 bp, mus musculus
attcctggttatctcaacaacgaag

SEQ ID NO: 78194 - DNA, 25 bp, mus musculus
cctggttatctcaacaacgaaggct

SEQ ID NO: 78195 - DNA, 25 bp, mus musculus
tatctcaacaacgaaggctaggagg

SEQ ID NO: 78196 - DNA, 25 bp, mus musculus
tctctgtagcctttagttatccgta

SEQ ID NO: 78197 - DNA, 25 bp, mus musculus
ctgtagcctttagttatccgtacag

SEQ ID NO: 78198 - DNA, 25 bp, mus musculus
tagcctttagttatccgtacagatt

SEQ ID NO: 78199 - DNA, 25 bp, mus musculus
cagcacttacagtcactaattccct

SEQ ID NO: 78200 - DNA, 25 bp, mus musculus
gtcaatgacatctcactgatgctag

SEQ ID NO: 78201 - DNA, 25 bp, mus musculus
gacatctcactgatgctagactgca

SEQ ID NO: 78202 - DNA, 25 bp, mus musculus
atctcactgatgctagactgcagcc

SEQ ID NO: 78203 - DNA, 25 bp, mus musculus
atgctagactgcagcccctgcaccg

SEQ ID NO: 78204 - DNA, 25 bp, mus musculus
ccctgcaccgtagcctttgttacat

SEQ ID NO: 78205 - DNA, 25 bp, mus musculus
tgcaccgtagcctttgttacatgaa

SEQ ID NO: 78206 - DNA, 25 bp, mus musculus
acatgaagtccgctgggaaatagat

SEQ ID NO: 78207 - DNA, 25 bp, mus musculus
aggcatctcatccccggtgaagaag

SEQ ID NO: 78208 - DNA, 25 bp, mus musculus
catctcatccccggtgaagaagaca

SEQ ID NO: 78209 - DNA, 25 bp, mus musculus
cttgcgggacagtcctggtacctgg

SEQ ID NO: 78210 - DNA, 25 bp, mus musculus
tccttcatcaccggtggagtcccag

SEQ ID NO: 78211 - DNA, 25 bp, mus musculus
ttcatcaccggtggagtcccagggt

SEQ ID NO: 78212 - DNA, 25 bp, mus musculus
tgacagtcccagcctgcatttttgg

SEQ ID NO: 78213 - DNA, 25 bp, mus musculus
cagtcccagcctgcatttttggtgg

SEQ ID NO: 78214 - DNA, 25 bp, mus musculus
tcccagcctgcatttttggtggaaa

SEQ ID NO: 78215 - DNA, 25 bp, mus musculus
cagcctgcatttttggtggaaaatt

SEQ ID NO: 78216 - DNA, 25 bp, mus musculus
gcccctgcggactcccagctggatg

SEQ ID NO: 78217 - DNA, 25 bp, mus musculus
cctgcggactcccagctggatggaa

SEQ ID NO: 78218 - DNA, 25 bp, mus musculus
gcggactcccagctggatggaaaag

SEQ ID NO: 78219 - DNA, 25 bp, mus musculus
ctcatccccggtgaagaagacagag

SEQ ID NO: 78220 - DNA, 25 bp, mus musculus
gatggacaaatctccattcaacagc

SEQ ID NO: 78221 - DNA, 25 bp, mus musculus
ccacaggccggtcatcgcggtacac

SEQ ID NO: 78222 - DNA, 25 bp, mus musculus
ggtcatcgcggtacacagtggcatc

SEQ ID NO: 78223 - DNA, 25 bp, mus musculus
catcgcggtacacagtggcatcgcg

SEQ ID NO: 78224 - DNA, 25 bp, mus musculus
acacagtggcatcgcgcggagcccc

SEQ ID NO: 78225 - DNA, 25 bp, mus musculus
cccgctcaaggatctggtgtccctg

SEQ ID NO: 78226 - DNA, 25 bp, mus musculus
cctgcaaacagtccctttgtgggat

SEQ ID NO: 78227 - DNA, 25 bp, mus musculus
cccgtcactgcacagaagtaccggt

SEQ ID NO: 78228 - DNA, 25 bp, mus musculus
ccgtcactgcacagaagtaccggtg

SEQ ID NO: 78229 - DNA, 25 bp, mus musculus
gaatgtacatttcccaaatggtgca

SEQ ID NO: 78230 - DNA, 25 bp, mus musculus
aatgtacatttcccaaatggtgcaa

SEQ ID NO: 78231 - DNA, 25 bp, mus musculus
atgtacatttcccaaatggtgcaac

SEQ ID NO: 78232 - DNA, 25 bp, mus musculus
gtacatttcccaaatggtgcaacct

SEQ ID NO: 78233 - DNA, 25 bp, mus musculus
tacatttcccaaatggtgcaacctt

SEQ ID NO: 78234 - DNA, 25 bp, mus musculus
ccaaatggtgcaacctttgacaaag

SEQ ID NO: 78235 - DNA, 25 bp, mus musculus
atggtgcaacctttgacaaaggccg

SEQ ID NO: 78236 - DNA, 25 bp, mus musculus
tggtgcaacctttgacaaaggccgc

SEQ ID NO: 78237 - DNA, 25 bp, mus musculus
gtgcaacctttgacaaaggccgctt

SEQ ID NO: 78238 - DNA, 25 bp, mus musculus
tgcaacctttgacaaaggccgcttt

SEQ ID NO: 78239 - DNA, 25 bp, mus musculus
tcactgcacagaagtaccggtgtaa

SEQ ID NO: 78240 - DNA, 25 bp, mus musculus
cactgcacagaagtaccggtgtaaa

SEQ ID NO: 78241 - DNA, 25 bp, mus musculus
ccgacgatgaggccgccatggggat

SEQ ID NO: 78242 - DNA, 25 bp, mus musculus
cgacgatgaggccgccatggggatt

SEQ ID NO: 78243 - DNA, 25 bp, mus musculus
acgatgaggccgccatggggattaa

SEQ ID NO: 78244 - DNA, 25 bp, mus musculus
gatgaggccgccatggggattaaga

SEQ ID NO: 78245 - DNA, 25 bp, mus musculus
tgaggccgccatggggattaagaac

SEQ ID NO: 78246 - DNA, 25 bp, mus musculus
gaggccgccatggggattaagaact

SEQ ID NO: 78247 - DNA, 25 bp, mus musculus
ctgcatatccagacttggagaaccc

SEQ ID NO: 78248 - DNA, 25 bp, mus musculus
catatccagacttggagaaccctcc

SEQ ID NO: 78249 - DNA, 25 bp, mus musculus
ctcagatgctcaaggcaaaggaaca

SEQ ID NO: 78250 - DNA, 25 bp, mus musculus
aagtcagtcccagagaaatcgcaga

SEQ ID NO: 78251 - DNA, 25 bp, mus musculus
ttgaaattgcgggtcctggtttcat

SEQ ID NO: 78252 - DNA, 25 bp, mus musculus
gtcctggtttcattaatgtgcacct

SEQ ID NO: 78253 - DNA, 25 bp, mus musculus
tcattaatgtgcacctgagaaaaga

SEQ ID NO: 78254 - DNA, 25 bp, mus musculus
ttaatgtgcacctgagaaaagactt

SEQ ID NO: 78255 - DNA, 25 bp, mus musculus
tgtcagaacagctaaccagtctcct

SEQ ID NO: 78256 - DNA, 25 bp, mus musculus
aacagctaaccagtctcctagtgaa

SEQ ID NO: 78257 - DNA, 25 bp, mus musculus
agctaaccagtctcctagtgaatgg

SEQ ID NO: 78258 - DNA, 25 bp, mus musculus
taaccagtctcctagtgaatggagt

SEQ ID NO: 78259 - DNA, 25 bp, mus musculus
ctcccctgatcgtgacaccaagtca

SEQ ID NO: 78260 - DNA, 25 bp, mus musculus
ccctgatcgtgacaccaagtcagca

SEQ ID NO: 78261 - DNA, 25 bp, mus musculus
tcgtgacaccaagtcagcagcccaa

SEQ ID NO: 78262 - DNA, 25 bp, mus musculus
tgacaccaagtcagcagcccaagtt

SEQ ID NO: 78263 - DNA, 25 bp, mus musculus
caccaagtcagcagcccaagtttgg

SEQ ID NO: 78264 - DNA, 25 bp, mus musculus
gtcagcagcccaagtttggagacta

SEQ ID NO: 78265 - DNA, 25 bp, mus musculus
agcagcccaagtttggagactatca

SEQ ID NO: 78266 - DNA, 25 bp, mus musculus
tttctcagatgctcaaggcaaagga

SEQ ID NO: 78267 - DNA, 25 bp, mus musculus
agcgccccaagtccatcgacgacag

SEQ ID NO: 78268 - DNA, 25 bp, mus musculus
ccatcgacgacagtgagatggagag

SEQ ID NO: 78269 - DNA, 25 bp, mus musculus
actcgctgaaggagtttgtgcagtt

SEQ ID NO: 78270 - DNA, 25 bp, mus musculus
ttgtgtgctctgacggctcgggtca

SEQ ID NO: 78271 - DNA, 25 bp, mus musculus
aggccaccggacagcattcacaacg

SEQ ID NO: 78272 - DNA, 25 bp, mus musculus
ccggacagcattcacaacgacaggc

SEQ ID NO: 78273 - DNA, 25 bp, mus musculus
agcattcacaacgacaggcgcctcc

SEQ ID NO: 78274 - DNA, 25 bp, mus musculus
ctctgccaaccggtttgtcagcatc

SEQ ID NO: 78275 - DNA, 25 bp, mus musculus
gtttgtcagcatcggatcccgggac

SEQ ID NO: 78276 - DNA, 25 bp, mus musculus
cggcaactttctgaacatcccacag

SEQ ID NO: 78277 - DNA, 25 bp, mus musculus
ctttctgaacatcccacagcagtct

SEQ ID NO: 78278 - DNA, 25 bp, mus musculus
ctggttcctctgattaagatcaaca

SEQ ID NO: 78279 - DNA, 25 bp, mus musculus
atgtgttctatcctgggacaggccg

SEQ ID NO: 78280 - DNA, 25 bp, mus musculus
ctggcagcagccagtctagcggatg

SEQ ID NO: 78281 - DNA, 25 bp, mus musculus
gcagccagtctagcggatggcccaa

SEQ ID NO: 78282 - DNA, 25 bp, mus musculus
tggatgcaggccctgcttctctaaa

SEQ ID NO: 78283 - DNA, 25 bp, mus musculus
ctgcttctctaaagaagtcaggaaa

SEQ ID NO: 78284 - DNA, 25 bp, mus musculus
ctttgcttgctggagtcagaccagg

SEQ ID NO: 78285 - DNA, 25 bp, mus musculus
ttgctggagtcagaccagggagccc

SEQ ID NO: 78286 - DNA, 25 bp, mus musculus
tcatccagcagtcgagcccgtattt

SEQ ID NO: 78287 - DNA, 25 bp, mus musculus
gctgacttggccattctccccaaca

SEQ ID NO: 78288 - DNA, 25 bp, mus musculus
gacttggccattctccccaacagcg

SEQ ID NO: 78289 - DNA, 25 bp, mus musculus
agaagcatctacatcctggatgacc

SEQ ID NO: 78290 - DNA, 25 bp, mus musculus
gcccatgtgggcaaccacatcttca

SEQ ID NO: 78291 - DNA, 25 bp, mus musculus
aaccacatcttcaacagtgctatcc

SEQ ID NO: 78292 - DNA, 25 bp, mus musculus
cacatcttcaacagtgctatccgga

SEQ ID NO: 78293 - DNA, 25 bp, mus musculus
atcttcaacagtgctatccggaagc

SEQ ID NO: 78294 - DNA, 25 bp, mus musculus
gctatccggaagcgcctcaagtcta

SEQ ID NO: 78295 - DNA, 25 bp, mus musculus
ctgtttgttacacaccagttacagt

SEQ ID NO: 78296 - DNA, 25 bp, mus musculus
acacaccagttacagtatctggtcg

SEQ ID NO: 78297 - DNA, 25 bp, mus musculus
caccagttacagtatctggtcgatt

SEQ ID NO: 78298 - DNA, 25 bp, mus musculus
cagtatctggtcgattgtgatgagg

SEQ ID NO: 78299 - DNA, 25 bp, mus musculus
ctccccaacagcgacctgactgaga

SEQ ID NO: 78300 - DNA, 25 bp, mus musculus
cccaacagcgacctgactgagattg

SEQ ID NO: 78301 - DNA, 25 bp, mus musculus
agcgacctgactgagattggagagc

SEQ ID NO: 78302 - DNA, 25 bp, mus musculus
cgaggagccaacctgagtggtggac

SEQ ID NO: 78303 - DNA, 25 bp, mus musculus
ggagccaacctgagtggtggacagc

SEQ ID NO: 78304 - DNA, 25 bp, mus musculus
cagagaatcagccttgctagagcct

SEQ ID NO: 78305 - DNA, 25 bp, mus musculus
atcagccttgctagagccttgtaca

SEQ ID NO: 78306 - DNA, 25 bp, mus musculus
cttgctagagccttgtacagtgata

SEQ ID NO: 78307 - DNA, 25 bp, mus musculus
aacattggcagcttatgaagcttgc

SEQ ID NO: 78308 - DNA, 25 bp, mus musculus
acacactggagctcgttgagctggc

SEQ ID NO: 78309 - DNA, 25 bp, mus musculus
cagagccttgcagtcatttcacatg

SEQ ID NO: 78310 - DNA, 25 bp, mus musculus
gtcatttcacatgcgcagactctgg

SEQ ID NO: 78311 - DNA, 25 bp, mus musculus
tcacatgcgcagactctggagagag

SEQ ID NO: 78312 - DNA, 25 bp, mus musculus
gcaaacctgccatgggctacagatc

SEQ ID NO: 78313 - DNA, 25 bp, mus musculus
ctgccatgggctacagatcccaata

SEQ ID NO: 78314 - DNA, 25 bp, mus musculus
tgggctacagatcccaatacctgtg

SEQ ID NO: 78315 - DNA, 25 bp, mus musculus
ctgagtcatgagcccagatccacag

SEQ ID NO: 78316 - DNA, 25 bp, mus musculus
tccacagcagagcacaggctgccaa

SEQ ID NO: 78317 - DNA, 25 bp, mus musculus
cacaggctgccaagatgtctactga

SEQ ID NO: 78318 - DNA, 25 bp, mus musculus
ctgccaagatgtctactgaaagtcc

SEQ ID NO: 78319 - DNA, 25 bp, mus musculus
atctccgtggactctgtgaaaatgc

SEQ ID NO: 78320 - DNA, 25 bp, mus musculus
agcctcagggacaggctgcaacttg

SEQ ID NO: 78321 - DNA, 25 bp, mus musculus
aggctgcaacttggagcccagcgca

SEQ ID NO: 78322 - DNA, 25 bp, mus musculus
caacttggagcccagcgcatcactc

SEQ ID NO: 78323 - DNA, 25 bp, mus musculus
ttgctggtgcagttcaccatctcac

SEQ ID NO: 78324 - DNA, 25 bp, mus musculus
gtgcagttcaccatctcactggccc

SEQ ID NO: 78325 - DNA, 25 bp, mus musculus
agatcccaggagtcacagcagagcc

SEQ ID NO: 78326 - DNA, 25 bp, mus musculus
tcacagcagagccttgcagtcattt

SEQ ID NO: 78327 - DNA, 25 bp, mus musculus
ccagcgctgtgcccaccttcagaag

SEQ ID NO: 78328 - DNA, 25 bp, mus musculus
gcgctgtgcccaccttcagaaggaa

SEQ ID NO: 78329 - DNA, 25 bp, mus musculus
cggagcgtacctggtctactgcacc

SEQ ID NO: 78330 - DNA, 25 bp, mus musculus
cctggtctactgcacctgttccatt

SEQ ID NO: 78331 - DNA, 25 bp, mus musculus
ggtctactgcacctgttccattacg

SEQ ID NO: 78332 - DNA, 25 bp, mus musculus
ctactgcacctgttccattacggtg

SEQ ID NO: 78333 - DNA, 25 bp, mus musculus
cacctgttccattacggtggaagag

SEQ ID NO: 78334 - DNA, 25 bp, mus musculus
ttccattacggtggaagagaacgag

SEQ ID NO: 78335 - DNA, 25 bp, mus musculus
agactatgccttgaagaagaggaat

SEQ ID NO: 78336 - DNA, 25 bp, mus musculus
tacccgcttccaagcaaggcgcgtt

SEQ ID NO: 78337 - DNA, 25 bp, mus musculus
ctcacactcacaatatggacggttt

SEQ ID NO: 78338 - DNA, 25 bp, mus musculus
acactcacaatatggacggtttctt

SEQ ID NO: 78339 - DNA, 25 bp, mus musculus
tgcccaccttcagaaggaactgctg

SEQ ID NO: 78340 - DNA, 25 bp, mus musculus
actgctgctcagtgctatcgactca

SEQ ID NO: 78341 - DNA, 25 bp, mus musculus
cagtgctatcgactcagtgaacgct

SEQ ID NO: 78342 - DNA, 25 bp, mus musculus
tgctatcgactcagtgaacgctgcc

SEQ ID NO: 78343 - DNA, 25 bp, mus musculus
ctcagtgaacgctgcctccaagacc

SEQ ID NO: 78344 - DNA, 25 bp, mus musculus
agtgaacgctgcctccaagaccgga

SEQ ID NO: 78345 - DNA, 25 bp, mus musculus
tgcctccaagaccggagcgtacctg

SEQ ID NO: 78346 - DNA, 25 bp, mus musculus
gaccggagcgtacctggtctactgc

SEQ ID NO: 78347 - DNA, 25 bp, mus musculus
gagcatcactgagcttctaagtccg

SEQ ID NO: 78348 - DNA, 25 bp, mus musculus
catcactgagcttctaagtccgggt

SEQ ID NO: 78349 - DNA, 25 bp, mus musculus
aggagcccactgatctaagtgtact

SEQ ID NO: 78350 - DNA, 25 bp, mus musculus
cctcagttcacacgtttagcacaaa

SEQ ID NO: 78351 - DNA, 25 bp, mus musculus
ttcacacgtttagcacaaagtactg

SEQ ID NO: 78352 - DNA, 25 bp, mus musculus
atacagtccatctgctggagaaatg

SEQ ID NO: 78353 - DNA, 25 bp, mus musculus
cagtccatctgctggagaaatgtaa

SEQ ID NO: 78354 - DNA, 25 bp, mus musculus
tccatctgctggagaaatgtaaatc

SEQ ID NO: 78355 - DNA, 25 bp, mus musculus
aatctagccaacaggtatgttctta

SEQ ID NO: 78356 - DNA, 25 bp, mus musculus
ctagccaacaggtatgttcttacct

SEQ ID NO: 78357 - DNA, 25 bp, mus musculus
tatgttcttacctgatacataaatg

SEQ ID NO: 78358 - DNA, 25 bp, mus musculus
cttacctgatacataaatgacctga

SEQ ID NO: 78359 - DNA, 25 bp, mus musculus
cactgagcttctaagtccgggtctt

SEQ ID NO: 78360 - DNA, 25 bp, mus musculus
tctctgtttgttcacttaagataga

SEQ ID NO: 78361 - DNA, 25 bp, mus musculus
tctcctactgaaggaaacctaagct

SEQ ID NO: 78362 - DNA, 25 bp, mus musculus
aacctaagcttccgaacactgcaga

SEQ ID NO: 78363 - DNA, 25 bp, mus musculus
agcttccgaacactgcagatcaaag

SEQ ID NO: 78364 - DNA, 25 bp, mus musculus
ttccgaacactgcagatcaaaggga

SEQ ID NO: 78365 - DNA, 25 bp, mus musculus
cttaactttaggagcccactgatct

SEQ ID NO: 78366 - DNA, 25 bp, mus musculus
aactttaggagcccactgatctaag

SEQ ID NO: 78367 - DNA, 25 bp, mus musculus
gtgctgaatctgtcttgtgaggctt

SEQ ID NO: 78368 - DNA, 25 bp, mus musculus
ctgaatctgtcttgtgaggcttcag

SEQ ID NO: 78369 - DNA, 25 bp, mus musculus
accttgaatgtccttgtgacgccag

SEQ ID NO: 78370 - DNA, 25 bp, mus musculus
aatgtccttgtgacgccagagcttc

SEQ ID NO: 78371 - DNA, 25 bp, mus musculus
gtccttgtgacgccagagcttctgg

SEQ ID NO: 78372 - DNA, 25 bp, mus musculus
cttgtgacgccagagcttctggaga

SEQ ID NO: 78373 - DNA, 25 bp, mus musculus
gtgacgccagagcttctggagacag

SEQ ID NO: 78374 - DNA, 25 bp, mus musculus
acgccagagcttctggagacaggtg

SEQ ID NO: 78375 - DNA, 25 bp, mus musculus
accaccattgttctgaagctggtca

SEQ ID NO: 78376 - DNA, 25 bp, mus musculus
accattgttctgaagctggtcactt

SEQ ID NO: 78377 - DNA, 25 bp, mus musculus
gttctgaagctggtcactttaacca

SEQ ID NO: 78378 - DNA, 25 bp, mus musculus
atacctgactccagccaaaccactg

SEQ ID NO: 78379 - DNA, 25 bp, mus musculus
accatctcctggaatgtcaatggtt

SEQ ID NO: 78380 - DNA, 25 bp, mus musculus
atctcctggaatgtcaatggttcgg

SEQ ID NO: 78381 - DNA, 25 bp, mus musculus
gaatggaacccagatccacagacag

SEQ ID NO: 78382 - DNA, 25 bp, mus musculus
tggaacccagatccacagacagtag

SEQ ID NO: 78383 - DNA, 25 bp, mus musculus
aacccagatccacagacagtagtga

SEQ ID NO: 78384 - DNA, 25 bp, mus musculus
ccagatccacagacagtagtgagca

SEQ ID NO: 78385 - DNA, 25 bp, mus musculus
gatccacagacagtagtgagcacct

SEQ ID NO: 78386 - DNA, 25 bp, mus musculus
gtgagcaccttgaatgtccttgtga

SEQ ID NO: 78387 - DNA, 25 bp, mus musculus
tcattctggcatgctttatcacaga

SEQ ID NO: 78388 - DNA, 25 bp, mus musculus
tggcatgctttatcacagagctcaa

SEQ ID NO: 78389 - DNA, 25 bp, mus musculus
gcccacctgtgcaggatgctcctca

SEQ ID NO: 78390 - DNA, 25 bp, mus musculus
ctgtgcaggatgctcctcagaagct

SEQ ID NO: 78391 - DNA, 25 bp, mus musculus
aggatgctcctcagaagctgcccct

SEQ ID NO: 78392 - DNA, 25 bp, mus musculus
cccctgacctttggggtgcatcagt

SEQ ID NO: 78393 - DNA, 25 bp, mus musculus
acctttggggtgcatcagtgtgata

SEQ ID NO: 78394 - DNA, 25 bp, mus musculus
ctgcagtccgccatggctacggttc

SEQ ID NO: 78395 - DNA, 25 bp, mus musculus
tccgccatggctacggttcagatgt

SEQ ID NO: 78396 - DNA, 25 bp, mus musculus
atggctacggttcagatgtgcatcg

SEQ ID NO: 78397 - DNA, 25 bp, mus musculus
cgctggttctgacatacatgtgctc

SEQ ID NO: 78398 - DNA, 25 bp, mus musculus
ttctgacatacatgtgctcaaaatg

SEQ ID NO: 78399 - DNA, 25 bp, mus musculus
gctttatcacagagctcaaccaagt

SEQ ID NO: 78400 - DNA, 25 bp, mus musculus
tctgacatacatgtgctcaaaatga

SEQ ID NO: 78401 - DNA, 25 bp, mus musculus
tcacagagctcaaccaagtaagctg

SEQ ID NO: 78402 - DNA, 25 bp, mus musculus
agctcaaccaagtaagctgttggtc

SEQ ID NO: 78403 - DNA, 25 bp, mus musculus
gtatttacatagacccaaaccactg

SEQ ID NO: 78404 - DNA, 25 bp, mus musculus
acatagacccaaaccactgaatgtg

SEQ ID NO: 78405 - DNA, 25 bp, mus musculus
ttgaggctgtaccccaaagatccaa

SEQ ID NO: 78406 - DNA, 25 bp, mus musculus
ttccttctcccagtcttagtggaat

SEQ ID NO: 78407 - DNA, 25 bp, mus musculus
ctcccagtcttagtggaatcagtca

SEQ ID NO: 78408 - DNA, 25 bp, mus musculus
gccccagagatccttcaggagatgc

SEQ ID NO: 78409 - DNA, 25 bp, mus musculus
ctgtatggacctgcagtagactggt

SEQ ID NO: 78410 - DNA, 25 bp, mus musculus
agaatcaaatcccgagaagatgtca

SEQ ID NO: 78411 - DNA, 25 bp, mus musculus
aaatcccgagaagatgtcagcaatt

SEQ ID NO: 78412 - DNA, 25 bp, mus musculus
gagcccgtcttaactccgattgatg

SEQ ID NO: 78413 - DNA, 25 bp, mus musculus
gtcttaactccgattgatgagggac

SEQ ID NO: 78414 - DNA, 25 bp, mus musculus
catcttcctatgattaaccaggatg

SEQ ID NO: 78415 - DNA, 25 bp, mus musculus
ttttcctatgtgtcaccggaattgc

SEQ ID NO: 78416 - DNA, 25 bp, mus musculus
gaattgcaactgtagccttatgggg

SEQ ID NO: 78417 - DNA, 25 bp, mus musculus
caactgtagccttatggggagtcag

SEQ ID NO: 78418 - DNA, 25 bp, mus musculus
tagccttatggggagtcagaaccaa

SEQ ID NO: 78419 - DNA, 25 bp, mus musculus
gatttctccaggaatttcttatgtg

SEQ ID NO: 78420 - DNA, 25 bp, mus musculus
ctttatgagatgctgtgcggacatg

SEQ ID NO: 78421 - DNA, 25 bp, mus musculus
gcgccctttgaggctgaaaatgaag

SEQ ID NO: 78422 - DNA, 25 bp, mus musculus
ctttttgaggccatactgaatgatg

SEQ ID NO: 78423 - DNA, 25 bp, mus musculus
atcctcaagtctttcatgaccaaga

SEQ ID NO: 78424 - DNA, 25 bp, mus musculus
gcccagttgaaccatcgccagttag

SEQ ID NO: 78425 - DNA, 25 bp, mus musculus
ttgaaccatcgccagttagagccgc

SEQ ID NO: 78426 - DNA, 25 bp, mus musculus
catcgccagttagagccgcctttcc

SEQ ID NO: 78427 - DNA, 25 bp, mus musculus
cgacctagaatcaaatcccgagaag

SEQ ID NO: 78428 - DNA, 25 bp, mus musculus
tggtgcctttcccacagagcaagac

SEQ ID NO: 78429 - DNA, 25 bp, mus musculus
ctttcccacagagcaagacaatgaa

SEQ ID NO: 78430 - DNA, 25 bp, mus musculus
taaggagctacctgtcaacgcacaa

SEQ ID NO: 78431 - DNA, 25 bp, mus musculus
gctacctgtcaacgcacaaaactat

SEQ ID NO: 78432 - DNA, 25 bp, mus musculus
tgtcaacgcacaaaactatgttcgg

SEQ ID NO: 78433 - DNA, 25 bp, mus musculus
tgagcttcaaataccagttaaatgg

SEQ ID NO: 78434 - DNA, 25 bp, mus musculus
gtccatgattcagctcttctaagga

SEQ ID NO: 78435 - DNA, 25 bp, mus musculus
gattcagctcttctaaggattgcca

SEQ ID NO: 78436 - DNA, 25 bp, mus musculus
gctcttctaaggattgccagcaacg

SEQ ID NO: 78437 - DNA, 25 bp, mus musculus
agcaacgcatgagacactccttaag

SEQ ID NO: 78438 - DNA, 25 bp, mus musculus
gcatgagacactccttaagaggaag

SEQ ID NO: 78439 - DNA, 25 bp, mus musculus
tttctttgtgatctgcaaattcaag

SEQ ID NO: 78440 - DNA, 25 bp, mus musculus
gttggaccttgtttcactcaaatat

SEQ ID NO: 78441 - DNA, 25 bp, mus musculus
ccttgtttcactcaaatatgctcat

SEQ ID NO: 78442 - DNA, 25 bp, mus musculus
ttcactcaaatatgctcatatgatc

SEQ ID NO: 78443 - DNA, 25 bp, mus musculus
tgcgttggcccttaccaagttggat

SEQ ID NO: 78444 - DNA, 25 bp, mus musculus
ggaaaccatacctcatttcccagca

SEQ ID NO: 78445 - DNA, 25 bp, mus musculus
tcatttcccagcaaaccaagaagtc

SEQ ID NO: 78446 - DNA, 25 bp, mus musculus
tcagtataagactctcccaggatgg

SEQ ID NO: 78447 - DNA, 25 bp, mus musculus
tctcccaggatggaacacagacata

SEQ ID NO: 78448 - DNA, 25 bp, mus musculus
gtccctgtactttgtggtgatgcgc

SEQ ID NO: 78449 - DNA, 25 bp, mus musculus
ggtgaccctgatgcttttggaccag

SEQ ID NO: 78450 - DNA, 25 bp, mus musculus
gaacacctacattaaagacgacaca

SEQ ID NO: 78451 - DNA, 25 bp, mus musculus
taaagacgacacactgttcttgaaa

SEQ ID NO: 78452 - DNA, 25 bp, mus musculus
cgacacactgttcttgaaagtggcc

SEQ ID NO: 78453 - DNA, 25 bp, mus musculus
tttaactgacttggaggatctgtag

SEQ ID NO: 78454 - DNA, 25 bp, mus musculus
acttctcagcacaggaaaaggtgtg

SEQ ID NO: 78455 - DNA, 25 bp, mus musculus
gccctctggactgagcaggctcttg

SEQ ID NO: 78456 - DNA, 25 bp, mus musculus
tggactgagcaggctcttgttcttg

SEQ ID NO: 78457 - DNA, 25 bp, mus musculus
gctcttgttcttgtcttcctgcctc

SEQ ID NO: 78458 - DNA, 25 bp, mus musculus
ctgcctccgatgtctgatgtgtcat

SEQ ID NO: 78459 - DNA, 25 bp, mus musculus
tatcttggatccttccctggtttga

SEQ ID NO: 78460 - DNA, 25 bp, mus musculus
cctgatgcttttggaccagagcggc

SEQ ID NO: 78461 - DNA, 25 bp, mus musculus
cagcttcaaaaggccagatggcgag

SEQ ID NO: 78462 - DNA, 25 bp, mus musculus
gatgaacattgcctctggctgtccc

SEQ ID NO: 78463 - DNA, 25 bp, mus musculus
ctgtccccgctttgtgtcgcactct

SEQ ID NO: 78464 - DNA, 25 bp, mus musculus
tgtgtcgcactctactctggagaac

SEQ ID NO: 78465 - DNA, 25 bp, mus musculus
gcactctactctggagaactccaag

SEQ ID NO: 78466 - DNA, 25 bp, mus musculus
tactctggagaactccaagaacacc

SEQ ID NO: 78467 - DNA, 25 bp, mus musculus
ggagaactccaagaacacctacatt

SEQ ID NO: 78468 - DNA, 25 bp, mus musculus
ggagccaccaaactctttctgattt

SEQ ID NO: 78469 - DNA, 25 bp, mus musculus
tcctcagagagccgtgagctctgtt

SEQ ID NO: 78470 - DNA, 25 bp, mus musculus
gtcttgcacagtttgccaggtcact

SEQ ID NO: 78471 - DNA, 25 bp, mus musculus
ttgcacagtttgccaggtcacttta

SEQ ID NO: 78472 - DNA, 25 bp, mus musculus
agtttgccaggtcactttagcagtc

SEQ ID NO: 78473 - DNA, 25 bp, mus musculus
ttgccaggtcactttagcagtcact

SEQ ID NO: 78474 - DNA, 25 bp, mus musculus
ccaggtcactttagcagtcactaca

SEQ ID NO: 78475 - DNA, 25 bp, mus musculus
cactttagcagtcactacaaaaagt

SEQ ID NO: 78476 - DNA, 25 bp, mus musculus
tgctcttactcggaaccccactaca

SEQ ID NO: 78477 - DNA, 25 bp, mus musculus
tactcggaaccccactacatcaagc

SEQ ID NO: 78478 - DNA, 25 bp, mus musculus
gaaccccactacatcaagctccaga

SEQ ID NO: 78479 - DNA, 25 bp, mus musculus
cactacatcaagctccagaaggtgg

SEQ ID NO: 78480 - DNA, 25 bp, mus musculus
tcagagagccgtgagctctgttttg

SEQ ID NO: 78481 - DNA, 25 bp, mus musculus
cgtgagctctgttttgctgctctct

SEQ ID NO: 78482 - DNA, 25 bp, mus musculus
gagctctgttttgctgctctctgcc

SEQ ID NO: 78483 - DNA, 25 bp, mus musculus
tttgctgctctctgccatgtccgcc

SEQ ID NO: 78484 - DNA, 25 bp, mus musculus
tgccatgtccgcctagtcttgcaca

SEQ ID NO: 78485 - DNA, 25 bp, mus musculus
catgtccgcctagtcttgcacagtt

SEQ ID NO: 78486 - DNA, 25 bp, mus musculus
gtccgcctagtcttgcacagtttgc

SEQ ID NO: 78487 - DNA, 25 bp, mus musculus
ctagtcttgcacagtttgccaggtc

SEQ ID NO: 78488 - DNA, 25 bp, mus musculus
aaagtgcccagttcttgttgctact

SEQ ID NO: 78489 - DNA, 25 bp, mus musculus
tcttgttgctacttcagtggctgcc

SEQ ID NO: 78490 - DNA, 25 bp, mus musculus
acagcctctagttaaagtactgtca

SEQ ID NO: 78491 - DNA, 25 bp, mus musculus
taaagtactgtcagacgctcaacag

SEQ ID NO: 78492 - DNA, 25 bp, mus musculus
tcaacaggatgtccccgcatggcta

SEQ ID NO: 78493 - DNA, 25 bp, mus musculus
gattgccttcagtacctatgtgcct

SEQ ID NO: 78494 - DNA, 25 bp, mus musculus
cttcagtacctatgtgcctcccagc

SEQ ID NO: 78495 - DNA, 25 bp, mus musculus
gtttgcatctgttgacacgaggaag

SEQ ID NO: 78496 - DNA, 25 bp, mus musculus
atctgttgacacgaggaagaattac

SEQ ID NO: 78497 - DNA, 25 bp, mus musculus
ggatttcttcttcacaagctcccaa

SEQ ID NO: 78498 - DNA, 25 bp, mus musculus
cttcttcacaagctcccaatccagt

SEQ ID NO: 78499 - DNA, 25 bp, mus musculus
ctcccaatccagttgatgacgaatc

SEQ ID NO: 78500 - DNA, 25 bp, mus musculus
ttcagtggctgccagagggcttgat

SEQ ID NO: 78501 - DNA, 25 bp, mus musculus
ggctgccagagggcttgatattgaa

SEQ ID NO: 78502 - DNA, 25 bp, mus musculus
tcaacatgttatcaattttgacctt

SEQ ID NO: 78503 - DNA, 25 bp, mus musculus
tccttctaccattgatgagtatgtt

SEQ ID NO: 78504 - DNA, 25 bp, mus musculus
aattggacgcactggccgctgtgga

SEQ ID NO: 78505 - DNA, 25 bp, mus musculus
ttttgatactgactctgataatcat

SEQ ID NO: 78506 - DNA, 25 bp, mus musculus
tactgactctgataatcatttagca

SEQ ID NO: 78507 - DNA, 25 bp, mus musculus
taatcatttagcacagcctctagtt

SEQ ID NO: 78508 - DNA, 25 bp, mus musculus
tattacctgggctgcagacgcttcc

SEQ ID NO: 78509 - DNA, 25 bp, mus musculus
tgcagacgcttccagcacaatcagt

SEQ ID NO: 78510 - DNA, 25 bp, mus musculus
acatgcggacgttacagctaaacga

SEQ ID NO: 78511 - DNA, 25 bp, mus musculus
atggtacacactcaccttaggcatt

SEQ ID NO: 78512 - DNA, 25 bp, mus musculus
cacactcaccttaggcattaagggt

SEQ ID NO: 78513 - DNA, 25 bp, mus musculus
gttgaacggcacgatcctatggaaa

SEQ ID NO: 78514 - DNA, 25 bp, mus musculus
cccagggcatggctgggctgcgatc

SEQ ID NO: 78515 - DNA, 25 bp, mus musculus
tgcgatcggaacacacaccttcgag

SEQ ID NO: 78516 - DNA, 25 bp, mus musculus
gcagtttgacaactttcgcgtggaa

SEQ ID NO: 78517 - DNA, 25 bp, mus musculus
agctgctcgctagtccacacggggc

SEQ ID NO: 78518 - DNA, 25 bp, mus musculus
tgattttggttcagggcgaattctg

SEQ ID NO: 78519 - DNA, 25 bp, mus musculus
tctatatatgagcctttgaggctaa

SEQ ID NO: 78520 - DNA, 25 bp, mus musculus
cgcttccagcacaatcagtgttata

SEQ ID NO: 78521 - DNA, 25 bp, mus musculus
tgttataggcgatcaccactggacc

SEQ ID NO: 78522 - DNA, 25 bp, mus musculus
tcaccactggaccaacatgactgtg

SEQ ID NO: 78523 - DNA, 25 bp, mus musculus
ccctcggagcggcggcgtattcatt

SEQ ID NO: 78524 - DNA, 25 bp, mus musculus
tgcaaatggctcttacagagtcaca

SEQ ID NO: 78525 - DNA, 25 bp, mus musculus
tggctcttacagagtcacagctgac

SEQ ID NO: 78526 - DNA, 25 bp, mus musculus
agctgacctgggtggatggataacg

SEQ ID NO: 78527 - DNA, 25 bp, mus musculus
ttcaggacatgcggacgttacagct

SEQ ID NO: 78528 - DNA, 25 bp, mus musculus
aagacctgttcaacttctgttcaag

SEQ ID NO: 78529 - DNA, 25 bp, mus musculus
tgttcaacttctgttcaaggaagtt

SEQ ID NO: 78530 - DNA, 25 bp, mus musculus
ctttgggctggccaagaagtatcgg

SEQ ID NO: 78531 - DNA, 25 bp, mus musculus
accagcatatcccctatcgagagaa

SEQ ID NO: 78532 - DNA, 25 bp, mus musculus
cagcatatcccctatcgagagaaca

SEQ ID NO: 78533 - DNA, 25 bp, mus musculus
gcatatcccctatcgagagaacaag

SEQ ID NO: 78534 - DNA, 25 bp, mus musculus
atatcccctatcgagagaacaagaa

SEQ ID NO: 78535 - DNA, 25 bp, mus musculus
gaacaagaacctcacagggacagca

SEQ ID NO: 78536 - DNA, 25 bp, mus musculus
acaagaacctcacagggacagcacg

SEQ ID NO: 78537 - DNA, 25 bp, mus musculus
acctcacagggacagcacgctatgc

SEQ ID NO: 78538 - DNA, 25 bp, mus musculus
ctcacagggacagcacgctatgcct

SEQ ID NO: 78539 - DNA, 25 bp, mus musculus
cacagggacagcacgctatgcctcc

SEQ ID NO: 78540 - DNA, 25 bp, mus musculus
ttagtctcaaaactgttctgttgct

SEQ ID NO: 78541 - DNA, 25 bp, mus musculus
agtctcaaaactgttctgttgcttg

SEQ ID NO: 78542 - DNA, 25 bp, mus musculus
tcaaaactgttctgttgcttgctga

SEQ ID NO: 78543 - DNA, 25 bp, mus musculus
aactgttctgttgcttgctgaccaa

SEQ ID NO: 78544 - DNA, 25 bp, mus musculus
ctgttctgttgcttgctgaccaaat

SEQ ID NO: 78545 - DNA, 25 bp, mus musculus
tctgttgcttgctgaccaaatgata

SEQ ID NO: 78546 - DNA, 25 bp, mus musculus
tgttgcttgctgaccaaatgataag

SEQ ID NO: 78547 - DNA, 25 bp, mus musculus
ttgcttgctgaccaaatgataagtc

SEQ ID NO: 78548 - DNA, 25 bp, mus musculus
aatgcattctgtccactcactgtct

SEQ ID NO: 78549 - DNA, 25 bp, mus musculus
accctgagtcttggcacattccttc

SEQ ID NO: 78550 - DNA, 25 bp, mus musculus
agctgtcagaggcaactgtgatcct

SEQ ID NO: 78551 - DNA, 25 bp, mus musculus
caactgtgatcctgccttagggact

SEQ ID NO: 78552 - DNA, 25 bp, mus musculus
tgatcctgccttagggactggagaa

SEQ ID NO: 78553 - DNA, 25 bp, mus musculus
gggacttgctcagtatggtgttcta

SEQ ID NO: 78554 - DNA, 25 bp, mus musculus
aatgttcagaaccaagcagtctcct

SEQ ID NO: 78555 - DNA, 25 bp, mus musculus
cagaaccaagcagtctccttactta

SEQ ID NO: 78556 - DNA, 25 bp, mus musculus
agttcaaattccatccactttgata

SEQ ID NO: 78557 - DNA, 25 bp, mus musculus
atccactttgatagcatcaatctgt

SEQ ID NO: 78558 - DNA, 25 bp, mus musculus
cccttggcatgccagtctgtgaagg

SEQ ID NO: 78559 - DNA, 25 bp, mus musculus
gcatgccagtctgtgaaggcattaa

SEQ ID NO: 78560 - DNA, 25 bp, mus musculus
agtcttggcacattccttcaagaat

SEQ ID NO: 78561 - DNA, 25 bp, mus musculus
ggcacattccttcaagaatgtagtt

SEQ ID NO: 78562 - DNA, 25 bp, mus musculus
tgtagttaccgtctgcttgggaaga

SEQ ID NO: 78563 - DNA, 25 bp, mus musculus
taccgtctgcttgggaagatgtcag

SEQ ID NO: 78564 - DNA, 25 bp, mus musculus
agacttgggtttgccacaagtggca

SEQ ID NO: 78565 - DNA, 25 bp, mus musculus
gccacaagtggcatctgcctgcacc

SEQ ID NO: 78566 - DNA, 25 bp, mus musculus
atctgcctgcaccaattacattggt

SEQ ID NO: 78567 - DNA, 25 bp, mus musculus
ctgcaccaattacattggttatttt

SEQ ID NO: 78568 - DNA, 25 bp, mus musculus
cagattaaacagctccacgtggtgt

SEQ ID NO: 78569 - DNA, 25 bp, mus musculus
agagactgccaaagtccaggagctt

SEQ ID NO: 78570 - DNA, 25 bp, mus musculus
gccctctctgaatccgcttcatcag

SEQ ID NO: 78571 - DNA, 25 bp, mus musculus
ctctctgaatccgcttcatcagatg

SEQ ID NO: 78572 - DNA, 25 bp, mus musculus
tctgaatccgcttcatcagatgcgt

SEQ ID NO: 78573 - DNA, 25 bp, mus musculus
gaatccgcttcatcagatgcgtgac

SEQ ID NO: 78574 - DNA, 25 bp, mus musculus
tccgcttcatcagatgcgtgacata

SEQ ID NO: 78575 - DNA, 25 bp, mus musculus
gcttcatcagatgcgtgacatagcc

SEQ ID NO: 78576 - DNA, 25 bp, mus musculus
tcatcagatgcgtgacatagccggc

SEQ ID NO: 78577 - DNA, 25 bp, mus musculus
tgacatagccggctatcttgttccg

SEQ ID NO: 78578 - DNA, 25 bp, mus musculus
catagccggctatcttgttccgaag

SEQ ID NO: 78579 - DNA, 25 bp, mus musculus
agccggctatcttgttccgaagctt

SEQ ID NO: 78580 - DNA, 25 bp, mus musculus
tgatctcctgatctagggctgagac

SEQ ID NO: 78581 - DNA, 25 bp, mus musculus
cggctatcttgttccgaagcttctt

SEQ ID NO: 78582 - DNA, 25 bp, mus musculus
tctcctgatctagggctgagacctc

SEQ ID NO: 78583 - DNA, 25 bp, mus musculus
ctgagacctcaggaacgtagttatc

SEQ ID NO: 78584 - DNA, 25 bp, mus musculus
agacctcaggaacgtagttatctct

SEQ ID NO: 78585 - DNA, 25 bp, mus musculus
tagagatgcctctcacaggccctct

SEQ ID NO: 78586 - DNA, 25 bp, mus musculus
agatgcctctcacaggccctctctg

SEQ ID NO: 78587 - DNA, 25 bp, mus musculus
tgcctctcacaggccctctctgaat

SEQ ID NO: 78588 - DNA, 25 bp, mus musculus
caggccctctctgaatccgcttcat

SEQ ID NO: 78589 - DNA, 25 bp, mus musculus
ggacttccgtgaacgcagcaaaggg

SEQ ID NO: 78590 - DNA, 25 bp, mus musculus
gcgcatccaacggcagcttgaaatt

SEQ ID NO: 78591 - DNA, 25 bp, mus musculus
tatggacatcgccatgctggtggaa

SEQ ID NO: 78592 - DNA, 25 bp, mus musculus
catcgccatgctggtggaaaatcag

SEQ ID NO: 78593 - DNA, 25 bp, mus musculus
tgtcatgcacacagtggaccatgtg

SEQ ID NO: 78594 - DNA, 25 bp, mus musculus
gcacacagtggaccatgtggagaag

SEQ ID NO: 78595 - DNA, 25 bp, mus musculus
tattggactgtccgttgggctgaaa

SEQ ID NO: 78596 - DNA, 25 bp, mus musculus
actgtccgttgggctgaaataagag

SEQ ID NO: 78597 - DNA, 25 bp, mus musculus
ccagctttcactccagcttggcctg

SEQ ID NO: 78598 - DNA, 25 bp, mus musculus
cactcttgtctccagacgggaacag

SEQ ID NO: 78599 - DNA, 25 bp, mus musculus
tcttgtctccagacgggaacagagt

SEQ ID NO: 78600 - DNA, 25 bp, mus musculus
tgtctccagacgggaacagagtttg

SEQ ID NO: 78601 - DNA, 25 bp, mus musculus
cccagccatcttcacttctgggatc

SEQ ID NO: 78602 - DNA, 25 bp, mus musculus
catcttcacttctgggatcattgac

SEQ ID NO: 78603 - DNA, 25 bp, mus musculus
cacttctgggatcattgactcccag

SEQ ID NO: 78604 - DNA, 25 bp, mus musculus
tgggatcattgactcccagatttcc

SEQ ID NO: 78605 - DNA, 25 bp, mus musculus
cattgactcccagatttccaagcaa

SEQ ID NO: 78606 - DNA, 25 bp, mus musculus
gatttccaagcaagccctcagcgag

SEQ ID NO: 78607 - DNA, 25 bp, mus musculus
caagcaagccctcagcgagattgag

SEQ ID NO: 78608 - DNA, 25 bp, mus musculus
agccctcagcgagattgagggtcgg

SEQ ID NO: 78609 - DNA, 25 bp, mus musculus
catacacagatgtgactccccgaca

SEQ ID NO: 78610 - DNA, 25 bp, mus musculus
acacagatgtgactccccgacagtt

SEQ ID NO: 78611 - DNA, 25 bp, mus musculus
gggatgcccttgtgatcaagctaga

SEQ ID NO: 78612 - DNA, 25 bp, mus musculus
cccttgtgatcaagctagaggtgat

SEQ ID NO: 78613 - DNA, 25 bp, mus musculus
atgctgttagtggttctgaggttct

SEQ ID NO: 78614 - DNA, 25 bp, mus musculus
ttccttatccaatgtactctcgtga

SEQ ID NO: 78615 - DNA, 25 bp, mus musculus
cttatccaatgtactctcgtgatta

SEQ ID NO: 78616 - DNA, 25 bp, mus musculus
atccaatgtactctcgtgattatgt

SEQ ID NO: 78617 - DNA, 25 bp, mus musculus
caatgtactctcgtgattatgttta

SEQ ID NO: 78618 - DNA, 25 bp, mus musculus
attatgtttatgttcggcggtatag

SEQ ID NO: 78619 - DNA, 25 bp, mus musculus
tttatgttcggcggtatagtgtgga

SEQ ID NO: 78620 - DNA, 25 bp, mus musculus
atgttcggcggtatagtgtggatca

SEQ ID NO: 78621 - DNA, 25 bp, mus musculus
cagatgtgactccccgacagttctt

SEQ ID NO: 78622 - DNA, 25 bp, mus musculus
tgactccccgacagttcttcaatgt

SEQ ID NO: 78623 - DNA, 25 bp, mus musculus
ctccccgacagttcttcaatgttca

SEQ ID NO: 78624 - DNA, 25 bp, mus musculus
cccgacagttcttcaatgttcagct

SEQ ID NO: 78625 - DNA, 25 bp, mus musculus
gacagttcttcaatgttcagctgga

SEQ ID NO: 78626 - DNA, 25 bp, mus musculus
tcttcaatgttcagctggatacaga

SEQ ID NO: 78627 - DNA, 25 bp, mus musculus
tcaatgttcagctggatacagagta

SEQ ID NO: 78628 - DNA, 25 bp, mus musculus
atgttcagctggatacagagtacag

SEQ ID NO: 78629 - DNA, 25 bp, mus musculus
tcctccaaccaagtttattgtaatg

SEQ ID NO: 78630 - DNA, 25 bp, mus musculus
cagtgcctcatcaacccagcaggtt

SEQ ID NO: 78631 - DNA, 25 bp, mus musculus
aagcacagcccctgctggttctggc

SEQ ID NO: 78632 - DNA, 25 bp, mus musculus
tgctggttctggcagtgttcagaaa

SEQ ID NO: 78633 - DNA, 25 bp, mus musculus
taatggctcgcagcctactggacct

SEQ ID NO: 78634 - DNA, 25 bp, mus musculus
ctcgcagcctactggacctggctct

SEQ ID NO: 78635 - DNA, 25 bp, mus musculus
gcctgctctgtgatgtgtcacatgt

SEQ ID NO: 78636 - DNA, 25 bp, mus musculus
cacatgtgctgacctcctctcttgt

SEQ ID NO: 78637 - DNA, 25 bp, mus musculus
ctcttgtgcagattcctacacactc

SEQ ID NO: 78638 - DNA, 25 bp, mus musculus
ttcctacacactcaaacaacctgtg

SEQ ID NO: 78639 - DNA, 25 bp, mus musculus
cacactcaaacaacctgtgagggag

SEQ ID NO: 78640 - DNA, 25 bp, mus musculus
ttgtacagtaagttcctcagaataa

SEQ ID NO: 78641 - DNA, 25 bp, mus musculus
ctcatcaacccagcaggttctgtcc

SEQ ID NO: 78642 - DNA, 25 bp, mus musculus
gcaggttctgtccctcagcacctca

SEQ ID NO: 78643 - DNA, 25 bp, mus musculus
tggctcaggctctactactacctct

SEQ ID NO: 78644 - DNA, 25 bp, mus musculus
aggctctactactacctctcctgtc

SEQ ID NO: 78645 - DNA, 25 bp, mus musculus
tcccagcgtgcagcccatcgtcaag

SEQ ID NO: 78646 - DNA, 25 bp, mus musculus
cgtgcagcccatcgtcaagctggtc

SEQ ID NO: 78647 - DNA, 25 bp, mus musculus
cgtcaagctggtctccactgctacc

SEQ ID NO: 78648 - DNA, 25 bp, mus musculus
gctggtctccactgctaccactgca

SEQ ID NO: 78649 - DNA, 25 bp, mus musculus
aatgaagcacctatcaggcaggaga

SEQ ID NO: 78650 - DNA, 25 bp, mus musculus
gaagcacctatcaggcaggagacat

SEQ ID NO: 78651 - DNA, 25 bp, mus musculus
gtgcgcaggtacaccacggtgatga

SEQ ID NO: 78652 - DNA, 25 bp, mus musculus
cgcaggtacaccacggtgatgaagg

SEQ ID NO: 78653 - DNA, 25 bp, mus musculus
tacaccacggtgatgaaggtgaggt

SEQ ID NO: 78654 - DNA, 25 bp, mus musculus
tcagtccgcctgggtttcttgtaga

SEQ ID NO: 78655 - DNA, 25 bp, mus musculus
ataggacacacgtacagcttcggat

SEQ ID NO: 78656 - DNA, 25 bp, mus musculus
ggacacacgtacagcttcggatcct

SEQ ID NO: 78657 - DNA, 25 bp, mus musculus
cacacgtacagcttcggatccttgg

SEQ ID NO: 78658 - DNA, 25 bp, mus musculus
acgtacagcttcggatccttgggcg

SEQ ID NO: 78659 - DNA, 25 bp, mus musculus
tccttgggcgccgtggagttaatgg

SEQ ID NO: 78660 - DNA, 25 bp, mus musculus
ttgggcgccgtggagttaatggcaa

SEQ ID NO: 78661 - DNA, 25 bp, mus musculus
gcatgtctgagtttctcagtggcaa

SEQ ID NO: 78662 - DNA, 25 bp, mus musculus
tgtctgagtttctcagtggcaagct

SEQ ID NO: 78663 - DNA, 25 bp, mus musculus
tgaacttacttgatgtcacacaaga

SEQ ID NO: 78664 - DNA, 25 bp, mus musculus
acttacttgatgtcacacaagaggg

SEQ ID NO: 78665 - DNA, 25 bp, mus musculus
tacttgatgtcacacaagagggcca

SEQ ID NO: 78666 - DNA, 25 bp, mus musculus
ctcaggatccagtgatccggggaca

SEQ ID NO: 78667 - DNA, 25 bp, mus musculus
aggatccagtgatccggggacagca

SEQ ID NO: 78668 - DNA, 25 bp, mus musculus
agcaccgtgcgcaggtacaccacgg

SEQ ID NO: 78669 - DNA, 25 bp, mus musculus
ttcatgaccatcctcacgatctttg

SEQ ID NO: 78670 - DNA, 25 bp, mus musculus
ctcacgatctttgtggtagagcttt

SEQ ID NO: 78671 - DNA, 25 bp, mus musculus
ggatgccctatatcagcattgtctg

SEQ ID NO: 78672 - DNA, 25 bp, mus musculus
tgccctatatcagcattgtctgtgt

SEQ ID NO: 78673 - DNA, 25 bp, mus musculus
atatcagcattgtctgtgtcattgt

SEQ ID NO: 78674 - DNA, 25 bp, mus musculus
gcattgtctgtgtcattgtctacgt

SEQ ID NO: 78675 - DNA, 25 bp, mus musculus
tctgtgtcattgtctacgtcatagg

SEQ ID NO: 78676 - DNA, 25 bp, mus musculus
gtgtcattgtctacgtcataggaca

SEQ ID NO: 78677 - DNA, 25 bp, mus musculus
tctacgtcataggacacgccttagg

SEQ ID NO: 78678 - DNA, 25 bp, mus musculus
tcataggacacgccttaggacccag

SEQ ID NO: 78679 - DNA, 25 bp, mus musculus
tcatcactgagatcttcctgcagtc

SEQ ID NO: 78680 - DNA, 25 bp, mus musculus
tcactgagatcttcctgcagtcctc

SEQ ID NO: 78681 - DNA, 25 bp, mus musculus
cgattcctactcctcgtcggcttct

SEQ ID NO: 78682 - DNA, 25 bp, mus musculus
ccgcctacatgatcggaggcagtgt

SEQ ID NO: 78683 - DNA, 25 bp, mus musculus
atagcctgcttagtgctgacggccg

SEQ ID NO: 78684 - DNA, 25 bp, mus musculus
tgcttagtgctgacggccgcactgg

SEQ ID NO: 78685 - DNA, 25 bp, mus musculus
ctgacggccgcactgggctgcagaa

SEQ ID NO: 78686 - DNA, 25 bp, mus musculus
ggctgcagaacaccatctcctggat

SEQ ID NO: 78687 - DNA, 25 bp, mus musculus
agaacaccatctcctggatgcccta

SEQ ID NO: 78688 - DNA, 25 bp, mus musculus
acaccatctcctggatgccctatat

SEQ ID NO: 78689 - DNA, 25 bp, mus musculus
ccatctcctggatgccctatatcag

SEQ ID NO: 78690 - DNA, 25 bp, mus musculus
gattcgcaacaccaacctggacgcg

SEQ ID NO: 78691 - DNA, 25 bp, mus musculus
caacaccaacctggacgcgcagctg

SEQ ID NO: 78692 - DNA, 25 bp, mus musculus
tgccgcgggtgtccgaaatatcgag

SEQ ID NO: 78693 - DNA, 25 bp, mus musculus
atcttcggtgtttgccaccatgtgc

SEQ ID NO: 78694 - DNA, 25 bp, mus musculus
ggtgtttgccaccatgtgcggtgcc

SEQ ID NO: 78695 - DNA, 25 bp, mus musculus
cggtgcctgtggcctgaaagcggct

SEQ ID NO: 78696 - DNA, 25 bp, mus musculus
cctgaaagcggctgtggtgtgtgtc

SEQ ID NO: 78697 - DNA, 25 bp, mus musculus
tctggaccgtctgcaaggagaccag

SEQ ID NO: 78698 - DNA, 25 bp, mus musculus
ataccagcagagaccacagcggcta

SEQ ID NO: 78699 - DNA, 25 bp, mus musculus
gcagagaccacagcggctagtgggc

SEQ ID NO: 78700 - DNA, 25 bp, mus musculus
gcctctgcaactcctgggcaataaa

SEQ ID NO: 78701 - DNA, 25 bp, mus musculus
gcaactcctgggcaataaatctatt

SEQ ID NO: 78702 - DNA, 25 bp, mus musculus
caacctggacgcgcagctggttcag

SEQ ID NO: 78703 - DNA, 25 bp, mus musculus
gtgctcctcagacctgaatgagttc

SEQ ID NO: 78704 - DNA, 25 bp, mus musculus
cctgaatgagttccccatggttgtg

SEQ ID NO: 78705 - DNA, 25 bp, mus musculus
caccatgtgcaccttggacttctat

SEQ ID NO: 78706 - DNA, 25 bp, mus musculus
gtgcaccttggacttctatgagggg

SEQ ID NO: 78707 - DNA, 25 bp, mus musculus
gcaaggccgtctggatggcgccctc

SEQ ID NO: 78708 - DNA, 25 bp, mus musculus
agacaaacagtcttatctgcgtgca

SEQ ID NO: 78709 - DNA, 25 bp, mus musculus
acagtcttatctgcgtgcagcccat

SEQ ID NO: 78710 - DNA, 25 bp, mus musculus
ggcagcatacgggccttcggagaag

SEQ ID NO: 78711 - DNA, 25 bp, mus musculus
atacgggccttcggagaagctgcct

SEQ ID NO: 78712 - DNA, 25 bp, mus musculus
ttgaagggcatcccaggctggctgc

SEQ ID NO: 78713 - DNA, 25 bp, mus musculus
ggcatcccaggctggctgcatggta

SEQ ID NO: 78714 - DNA, 25 bp, mus musculus
ccaggctggctgcatggtaccagcg

SEQ ID NO: 78715 - DNA, 25 bp, mus musculus
tggctgcatggtaccagcgagtgga

SEQ ID NO: 78716 - DNA, 25 bp, mus musculus
catggtaccagcgagtggaggcagc

SEQ ID NO: 78717 - DNA, 25 bp, mus musculus
atgaagtcatcctgaaggtgaagga

SEQ ID NO: 78718 - DNA, 25 bp, mus musculus
cccctgctgacctcatcataaagca

SEQ ID NO: 78719 - DNA, 25 bp, mus musculus
ctgacctcatcataaagcagaagct

SEQ ID NO: 78720 - DNA, 25 bp, mus musculus
agaagctgatgcccagagtgctgac

SEQ ID NO: 78721 - DNA, 25 bp, mus musculus
tgatgcccagagtgctgaccatgat

SEQ ID NO: 78722 - DNA, 25 bp, mus musculus
tcagggccctgtggcataaggtgat

SEQ ID NO: 78723 - DNA, 25 bp, mus musculus
tgttccctgttttccttggtgagca

SEQ ID NO: 78724 - DNA, 25 bp, mus musculus
gtgagcaaatacctcctgaaacact

SEQ ID NO: 78725 - DNA, 25 bp, mus musculus
ctcctgaaacactggcagccacgtt

SEQ ID NO: 78726 - DNA, 25 bp, mus musculus
tggcagccacgttggcagaactgga

SEQ ID NO: 78727 - DNA, 25 bp, mus musculus
atgttaacctacaggtgcttgaaga

SEQ ID NO: 78728 - DNA, 25 bp, mus musculus
acttggtggccatcacagagctgat

SEQ ID NO: 78729 - DNA, 25 bp, mus musculus
gctgcccagtctttgaagggcatcc

SEQ ID NO: 78730 - DNA, 25 bp, mus musculus
tcatccatgggtcttcgagtctcca

SEQ ID NO: 78731 - DNA, 25 bp, mus musculus
atccatgggtcttcgagtctccaag

SEQ ID NO: 78732 - DNA, 25 bp, mus musculus
ctaggactgttcttcttcttctcag

SEQ ID NO: 78733 - DNA, 25 bp, mus musculus
atattactccctgtgtaaggaatgg

SEQ ID NO: 78734 - DNA, 25 bp, mus musculus
ctccgctatatgccagctggagcct

SEQ ID NO: 78735 - DNA, 25 bp, mus musculus
ccgctatatgccagctggagccttc

SEQ ID NO: 78736 - DNA, 25 bp, mus musculus
tgctcctgctctactggctttcttc

SEQ ID NO: 78737 - DNA, 25 bp, mus musculus
tgctctactggctttcttcctgctg

SEQ ID NO: 78738 - DNA, 25 bp, mus musculus
ctactggctttcttcctgctggaat

SEQ ID NO: 78739 - DNA, 25 bp, mus musculus
actggctttcttcctgctggaatct

SEQ ID NO: 78740 - DNA, 25 bp, mus musculus
tggctttcttcctgctggaatctgt

SEQ ID NO: 78741 - DNA, 25 bp, mus musculus
gctttcttcctgctggaatctgtgt

SEQ ID NO: 78742 - DNA, 25 bp, mus musculus
gtcttcgagtctccaagttgtctac

SEQ ID NO: 78743 - DNA, 25 bp, mus musculus
cttcgagtctccaagttgtctacta

SEQ ID NO: 78744 - DNA, 25 bp, mus musculus
gagtctccaagttgtctactatctt

SEQ ID NO: 78745 - DNA, 25 bp, mus musculus
ccaagttgtctactatcttcctagg

SEQ ID NO: 78746 - DNA, 25 bp, mus musculus
tgtctactatcttcctaggactgtt

SEQ ID NO: 78747 - DNA, 25 bp, mus musculus
tctactatcttcctaggactgttct

SEQ ID NO: 78748 - DNA, 25 bp, mus musculus
tactatcttcctaggactgttcttc

SEQ ID NO: 78749 - DNA, 25 bp, mus musculus
atcttcctaggactgttcttcttct

SEQ ID NO: 78750 - DNA, 25 bp, mus musculus
tcacattcaccaacaatcagctctt

SEQ ID NO: 78751 - DNA, 25 bp, mus musculus
tcaccaacaatcagctcttcttcct

SEQ ID NO: 78752 - DNA, 25 bp, mus musculus
tctggtagctggagtgctggtttct

SEQ ID NO: 78753 - DNA, 25 bp, mus musculus
agctggagtgctggtttctgccttc

SEQ ID NO: 78754 - DNA, 25 bp, mus musculus
ggtttctgccttcctggcatagctg

SEQ ID NO: 78755 - DNA, 25 bp, mus musculus
tgccttcctggcatagctgaggaat

SEQ ID NO: 78756 - DNA, 25 bp, mus musculus
taacatacttagcacctactgcttt

SEQ ID NO: 78757 - DNA, 25 bp, mus musculus
ctgctttctgcctatatttccttga

SEQ ID NO: 78758 - DNA, 25 bp, mus musculus
tctgcctatatttccttgaagactt

SEQ ID NO: 78759 - DNA, 25 bp, mus musculus
atttgcttcgatctaaacagtatct

SEQ ID NO: 78760 - DNA, 25 bp, mus musculus
ttcgatctaaacagtatctgttcaa

SEQ ID NO: 78761 - DNA, 25 bp, mus musculus
ctaaacagtatctgttcaaagtcat

SEQ ID NO: 78762 - DNA, 25 bp, mus musculus
acaatcagctcttcttcctgagtta

SEQ ID NO: 78763 - DNA, 25 bp, mus musculus
agctcttcttcctgagttatgctca

SEQ ID NO: 78764 - DNA, 25 bp, mus musculus
tcttcctgagttatgctcatgtaag

SEQ ID NO: 78765 - DNA, 25 bp, mus musculus
actgtccacgaaattccactatgaa

SEQ ID NO: 78766 - DNA, 25 bp, mus musculus
attccactatgaacagaggtgcaga

SEQ ID NO: 78767 - DNA, 25 bp, mus musculus
gtgcagattcctgccgactctggta

SEQ ID NO: 78768 - DNA, 25 bp, mus musculus
attcctgccgactctggtagctgga

SEQ ID NO: 78769 - DNA, 25 bp, mus musculus
gccgactctggtagctggagtgctg

SEQ ID NO: 78770 - DNA, 25 bp, mus musculus
tgtgcctcagtttcctcagctctaa

SEQ ID NO: 78771 - DNA, 25 bp, mus musculus
tcagtttcctcagctctaatctgac

SEQ ID NO: 78772 - DNA, 25 bp, mus musculus
tcctccactacatacagggttcaag

SEQ ID NO: 78773 - DNA, 25 bp, mus musculus
gttcaaggtcagcctggggtatttg

SEQ ID NO: 78774 - DNA, 25 bp, mus musculus
ggtcagcctggggtatttgagactc

SEQ ID NO: 78775 - DNA, 25 bp, mus musculus
gagactctcaaaaccaaatgacaac

SEQ ID NO: 78776 - DNA, 25 bp, mus musculus
gaccagtcagtcctcaggtactgaa

SEQ ID NO: 78777 - DNA, 25 bp, mus musculus
tcagtcctcaggtactgaaagatac

SEQ ID NO: 78778 - DNA, 25 bp, mus musculus
aagatactatctgatgccagttgct

SEQ ID NO: 78779 - DNA, 25 bp, mus musculus
ctatctgatgccagttgctgacttt

SEQ ID NO: 78780 - DNA, 25 bp, mus musculus
gatgccagttgctgactttgtaaat

SEQ ID NO: 78781 - DNA, 25 bp, mus musculus
tgatccaaataccactgaatggata

SEQ ID NO: 78782 - DNA, 25 bp, mus musculus
tcctcagctctaatctgacaggggt

SEQ ID NO: 78783 - DNA, 25 bp, mus musculus
gctctaatctgacaggggtgtcttg

SEQ ID NO: 78784 - DNA, 25 bp, mus musculus
acacaggacctggaaggaagccaca

SEQ ID NO: 78785 - DNA, 25 bp, mus musculus
agccacagagggtgttactgttact

SEQ ID NO: 78786 - DNA, 25 bp, mus musculus
tgttactgttactgctgtcaatatt

SEQ ID NO: 78787 - DNA, 25 bp, mus musculus
atatttccatcacactcagaaaaag

SEQ ID NO: 78788 - DNA, 25 bp, mus musculus
gcccttcttcaggcaggaggtcaga

SEQ ID NO: 78789 - DNA, 25 bp, mus musculus
cttcaggcaggaggtcagagttcaa

SEQ ID NO: 78790 - DNA, 25 bp, mus musculus
gttcaaaagctctgcccagcatgca

SEQ ID NO: 78791 - DNA, 25 bp, mus musculus
tgcccagcatgcactcaactccatg

SEQ ID NO: 78792 - DNA, 25 bp, mus musculus
ttatgttacacattttccagatata

SEQ ID NO: 78793 - DNA, 25 bp, mus musculus
tacacattttccagatataagagac

SEQ ID NO: 78794 - DNA, 25 bp, mus musculus
ctaggcaggacctgtggccaagttc

SEQ ID NO: 78795 - DNA, 25 bp, mus musculus
tgtggccaagttcttagtagctgtt

SEQ ID NO: 78796 - DNA, 25 bp, mus musculus
aaactgaacattccagaatgtgtgg

SEQ ID NO: 78797 - DNA, 25 bp, mus musculus
aagctagccgtgatcctcagctgtt

SEQ ID NO: 78798 - DNA, 25 bp, mus musculus
gccgtgatcctcagctgttgctgca

SEQ ID NO: 78799 - DNA, 25 bp, mus musculus
atcctcagctgttgctgcataatct

SEQ ID NO: 78800 - DNA, 25 bp, mus musculus
tgctgcataatctcttcattccgag

SEQ ID NO: 78801 - DNA, 25 bp, mus musculus
ataatctcttcattccgaggagcac

SEQ ID NO: 78802 - DNA, 25 bp, mus musculus
gcatgcactcaactccatgagcaga

SEQ ID NO: 78803 - DNA, 25 bp, mus musculus
actcaactccatgagcagaggctcc

SEQ ID NO: 78804 - DNA, 25 bp, mus musculus
aggctccagcctcaagatcctttcc

SEQ ID NO: 78805 - DNA, 25 bp, mus musculus
cagcctcaagatcctttccaaagga

SEQ ID NO: 78806 - DNA, 25 bp, mus musculus
agaatcctccagttttcactccagc

SEQ ID NO: 78807 - DNA, 25 bp, mus musculus
ctccagttttcactccagctaacac

SEQ ID NO: 78808 - DNA, 25 bp, mus musculus
ttttcactccagctaacacttatgc

SEQ ID NO: 78809 - DNA, 25 bp, mus musculus
ctaacacttatgcaaagacatatat

SEQ ID NO: 78810 - DNA, 25 bp, mus musculus
gtaatttagctgcactggcgcgttt

SEQ ID NO: 78811 - DNA, 25 bp, mus musculus
tagctgcactggcgcgtttacacgt

SEQ ID NO: 78812 - DNA, 25 bp, mus musculus
cgaaagtccactgaatcggatgacg

SEQ ID NO: 78813 - DNA, 25 bp, mus musculus
aagtccactgaatcggatgacgctg

SEQ ID NO: 78814 - DNA, 25 bp, mus musculus
tccactgaatcggatgacgctgtac

SEQ ID NO: 78815 - DNA, 25 bp, mus musculus
tcggatgacgctgtacgcattacgg

SEQ ID NO: 78816 - DNA, 25 bp, mus musculus
cgggccctaagttcgtgtgcattag

SEQ ID NO: 78817 - DNA, 25 bp, mus musculus
gccctaagttcgtgtgcattagcgt

SEQ ID NO: 78818 - DNA, 25 bp, mus musculus
agttcgtgtgcattagcgtctagaa

SEQ ID NO: 78819 - DNA, 25 bp, mus musculus
tgtcatttaactgcacttaggattt

SEQ ID NO: 78820 - DNA, 25 bp, mus musculus
ttaactgcacttaggattttctcta

SEQ ID NO: 78821 - DNA, 25 bp, mus musculus
aggattttctctagatggcaatgat

SEQ ID NO: 78822 - DNA, 25 bp, mus musculus
cactggcgcgtttacacgtgtactg

SEQ ID NO: 78823 - DNA, 25 bp, mus musculus
ttgcgtaccacttacgcttgagaat

SEQ ID NO: 78824 - DNA, 25 bp, mus musculus
gcttgagaatcccgttcgcactgta

SEQ ID NO: 78825 - DNA, 25 bp, mus musculus
tgagaatcccgttcgcactgtaatc

SEQ ID NO: 78826 - DNA, 25 bp, mus musculus
tcccgttcgcactgtaatcgaaagc

SEQ ID NO: 78827 - DNA, 25 bp, mus musculus
aatcgaaagccgacgatgcctcgaa

SEQ ID NO: 78828 - DNA, 25 bp, mus musculus
acgatgcctcgaaagtccactgaat

SEQ ID NO: 78829 - DNA, 25 bp, mus musculus
atgcctcgaaagtccactgaatcgg

SEQ ID NO: 78830 - DNA, 25 bp, mus musculus
gaagcatgccattgcctataatgta

SEQ ID NO: 78831 - DNA, 25 bp, mus musculus
aagcatgccattgcctataatgtaa

SEQ ID NO: 78832 - DNA, 25 bp, mus musculus
caaaggcaagcctcagttgttccat

SEQ ID NO: 78833 - DNA, 25 bp, mus musculus
aaaggcaagcctcagttgttccatt

SEQ ID NO: 78834 - DNA, 25 bp, mus musculus
aggcaagcctcagttgttccattgg

SEQ ID NO: 78835 - DNA, 25 bp, mus musculus
gcaagcctcagttgttccattgggc

SEQ ID NO: 78836 - DNA, 25 bp, mus musculus
aagcctcagttgttccattgggcaa

SEQ ID NO: 78837 - DNA, 25 bp, mus musculus
agcctcagttgttccattgggcaac

SEQ ID NO: 78838 - DNA, 25 bp, mus musculus
gcctcagttgttccattgggcaacc

SEQ ID NO: 78839 - DNA, 25 bp, mus musculus
ctcagttgttccattgggcaacctt

SEQ ID NO: 78840 - DNA, 25 bp, mus musculus
tcagttgttccattgggcaaccttt

SEQ ID NO: 78841 - DNA, 25 bp, mus musculus
gttgttccattgggcaacctttctg

SEQ ID NO: 78842 - DNA, 25 bp, mus musculus
agcatgccattgcctataatgtaag

SEQ ID NO: 78843 - DNA, 25 bp, mus musculus
ttgttccattgggcaacctttctga

SEQ ID NO: 78844 - DNA, 25 bp, mus musculus
gaattacgccaaaggcaagcctcag

SEQ ID NO: 78845 - DNA, 25 bp, mus musculus
aattacgccaaaggcaagcctcagt

SEQ ID NO: 78846 - DNA, 25 bp, mus musculus
attacgccaaaggcaagcctcagtt

SEQ ID NO: 78847 - DNA, 25 bp, mus musculus
tacgccaaaggcaagcctcagttgt

SEQ ID NO: 78848 - DNA, 25 bp, mus musculus
acgccaaaggcaagcctcagttgtt

SEQ ID NO: 78849 - DNA, 25 bp, mus musculus
cgccaaaggcaagcctcagttgttc

SEQ ID NO: 78850 - DNA, 25 bp, mus musculus
ccaaaggcaagcctcagttgttcca

SEQ ID NO: 78851 - DNA, 25 bp, mus musculus
gcttagacatcccttcgagctggta

SEQ ID NO: 78852 - DNA, 25 bp, mus musculus
tagacatcccttcgagctggtattc

SEQ ID NO: 78853 - DNA, 25 bp, mus musculus
attggcgccttcggcatagcggggt

SEQ ID NO: 78854 - DNA, 25 bp, mus musculus
tttcgatggtccgaactaagggcat

SEQ ID NO: 78855 - DNA, 25 bp, mus musculus
tagtcatggtttgcgcccgaatagg

SEQ ID NO: 78856 - DNA, 25 bp, mus musculus
tcatggtttgcgcccgaatagggct

SEQ ID NO: 78857 - DNA, 25 bp, mus musculus
agacatcgttaatgctccgaggaag

SEQ ID NO: 78858 - DNA, 25 bp, mus musculus
catcgttaatgctccgaggaagtaa

SEQ ID NO: 78859 - DNA, 25 bp, mus musculus
taatgctccgaggaagtaatggtaa

SEQ ID NO: 78860 - DNA, 25 bp, mus musculus
atggtaatcatctggccgtttatag

SEQ ID NO: 78861 - DNA, 25 bp, mus musculus
atcatctggccgtttatagcgcaat

SEQ ID NO: 78862 - DNA, 25 bp, mus musculus
atctggccgtttatagcgcaataag

SEQ ID NO: 78863 - DNA, 25 bp, mus musculus
acatcccttcgagctggtattcgaa

SEQ ID NO: 78864 - DNA, 25 bp, mus musculus
cttcgagctggtattcgaaggccca

SEQ ID NO: 78865 - DNA, 25 bp, mus musculus
cgaaggcccacgtgcttcaaatgtc

SEQ ID NO: 78866 - DNA, 25 bp, mus musculus
aggcccacgtgcttcaaatgtccga

SEQ ID NO: 78867 - DNA, 25 bp, mus musculus
acgtgcttcaaatgtccgatattga

SEQ ID NO: 78868 - DNA, 25 bp, mus musculus
tgcttcaaatgtccgatattgattg

SEQ ID NO: 78869 - DNA, 25 bp, mus musculus
ttcaaatgtccgatattgattggcg

SEQ ID NO: 78870 - DNA, 25 bp, mus musculus
atattgattggcgccttcggcatag

SEQ ID NO: 78871 - DNA, 25 bp, mus musculus
gaacatcaatgccttgtgttcaccc

SEQ ID NO: 78872 - DNA, 25 bp, mus musculus
aacatcaatgccttgtgttcacccc

SEQ ID NO: 78873 - DNA, 25 bp, mus musculus
cactggcccagcatcaagatctggg

SEQ ID NO: 78874 - DNA, 25 bp, mus musculus
ctggctatacagacaacttgggtgc

SEQ ID NO: 78875 - DNA, 25 bp, mus musculus
tggctatacagacaacttgggtgcg

SEQ ID NO: 78876 - DNA, 25 bp, mus musculus
ggctatacagacaacttgggtgcga

SEQ ID NO: 78877 - DNA, 25 bp, mus musculus
gctatacagacaacttgggtgcgag

SEQ ID NO: 78878 - DNA, 25 bp, mus musculus
ctatacagacaacttgggtgcgagt

SEQ ID NO: 78879 - DNA, 25 bp, mus musculus
tatacagacaacttgggtgcgagta

SEQ ID NO: 78880 - DNA, 25 bp, mus musculus
atacagacaacttgggtgcgagtat

SEQ ID NO: 78881 - DNA, 25 bp, mus musculus
tacagacaacttgggtgcgagtatg

SEQ ID NO: 78882 - DNA, 25 bp, mus musculus
agacaacttgggtgcgagtatggca

SEQ ID NO: 78883 - DNA, 25 bp, mus musculus
acatcaatgccttgtgttcacccca

SEQ ID NO: 78884 - DNA, 25 bp, mus musculus
catcaatgccttgtgttcaccccaa

SEQ ID NO: 78885 - DNA, 25 bp, mus musculus
atcaatgccttgtgttcaccccaac

SEQ ID NO: 78886 - DNA, 25 bp, mus musculus
gctgccactggcccagcatcaagat

SEQ ID NO: 78887 - DNA, 25 bp, mus musculus
ctgccactggcccagcatcaagatc

SEQ ID NO: 78888 - DNA, 25 bp, mus musculus
tgccactggcccagcatcaagatct

SEQ ID NO: 78889 - DNA, 25 bp, mus musculus
gccactggcccagcatcaagatctg

SEQ ID NO: 78890 - DNA, 25 bp, mus musculus
ccactggcccagcatcaagatctgg

SEQ ID NO: 78891 - DNA, 25 bp, mus musculus
tttttacgattcagttgataggcaa

SEQ ID NO: 78892 - DNA, 25 bp, mus musculus
atcttatttgcagtattccacagtt

SEQ ID NO: 78893 - DNA, 25 bp, mus musculus
tccagaacctgaagtactccaggcg

SEQ ID NO: 78894 - DNA, 25 bp, mus musculus
acctgaagtactccaggcgagcgct

SEQ ID NO: 78895 - DNA, 25 bp, mus musculus
agtactccaggcgagcgctctacca

SEQ ID NO: 78896 - DNA, 25 bp, mus musculus
ctgcgcctccagcctgaattgaagt

SEQ ID NO: 78897 - DNA, 25 bp, mus musculus
ctccagcctgaattgaagtttgagc

SEQ ID NO: 78898 - DNA, 25 bp, mus musculus
acagtgtttgcaactccaactggaa

SEQ ID NO: 78899 - DNA, 25 bp, mus musculus
tatgttatcttaccatctgacatgc

SEQ ID NO: 78900 - DNA, 25 bp, mus musculus
atcttaccatctgacatgcgacttt

SEQ ID NO: 78901 - DNA, 25 bp, mus musculus
ccatctgacatgcgactttggtatt

SEQ ID NO: 78902 - DNA, 25 bp, mus musculus
tttctgcttcttaaggaaattatga

SEQ ID NO: 78903 - DNA, 25 bp, mus musculus
tttgcagtattccacagttctgctt

SEQ ID NO: 78904 - DNA, 25 bp, mus musculus
gtattccacagttctgcttctagac

SEQ ID NO: 78905 - DNA, 25 bp, mus musculus
cacagttctgcttctagacttcctg

SEQ ID NO: 78906 - DNA, 25 bp, mus musculus
tctgcttctagacttcctgtaattt

SEQ ID NO: 78907 - DNA, 25 bp, mus musculus
gtaattttagcgacctttgacagca

SEQ ID NO: 78908 - DNA, 25 bp, mus musculus
ttagcgacctttgacagcagattct

SEQ ID NO: 78909 - DNA, 25 bp, mus musculus
acctttgacagcagattctgtttac

SEQ ID NO: 78910 - DNA, 25 bp, mus musculus
agattctgtttacatcagaatttgc

SEQ ID NO: 78911 - DNA, 25 bp, mus musculus
tcggccgaactacatgcaggaagac

SEQ ID NO: 78912 - DNA, 25 bp, mus musculus
ggaagaccatgcatcaccaactgga

SEQ ID NO: 78913 - DNA, 25 bp, mus musculus
actctgaagtctgggtcatcccctg

SEQ ID NO: 78914 - DNA, 25 bp, mus musculus
cctggctccacagttttgaggtgcc

SEQ ID NO: 78915 - DNA, 25 bp, mus musculus
ctgttctcctctgccagtgacttct

SEQ ID NO: 78916 - DNA, 25 bp, mus musculus
ttctcctctgccagtgacttctgtc

SEQ ID NO: 78917 - DNA, 25 bp, mus musculus
agtgacttctgtctctttagcaaga

SEQ ID NO: 78918 - DNA, 25 bp, mus musculus
gacttctgtctctttagcaagactg

SEQ ID NO: 78919 - DNA, 25 bp, mus musculus
ctctttagcaagactgcagctgtga

SEQ ID NO: 78920 - DNA, 25 bp, mus musculus
aagactgcagctgtgatacatatcc

SEQ ID NO: 78921 - DNA, 25 bp, mus musculus
gtgatacatatccactcgtgtttcc

SEQ ID NO: 78922 - DNA, 25 bp, mus musculus
atacatatccactcgtgtttcccca

SEQ ID NO: 78923 - DNA, 25 bp, mus musculus
agaccatgcatcaccaactggacaa

SEQ ID NO: 78924 - DNA, 25 bp, mus musculus
atcaccaactggacaactgtgactt

SEQ ID NO: 78925 - DNA, 25 bp, mus musculus
accaactggacaactgtgacttcca

SEQ ID NO: 78926 - DNA, 25 bp, mus musculus
ccaaccctgccttgaagcggactct

SEQ ID NO: 78927 - DNA, 25 bp, mus musculus
ccttgaagcggactctatattgcta

SEQ ID NO: 78928 - DNA, 25 bp, mus musculus
ctctatattgctactctgaagtctg

SEQ ID NO: 78929 - DNA, 25 bp, mus musculus
tatattgctactctgaagtctgggt

SEQ ID NO: 78930 - DNA, 25 bp, mus musculus
gctactctgaagtctgggtcatccc

SEQ ID NO: 78931 - DNA, 25 bp, mus musculus
tgatttctccaaggtcctaccatct

SEQ ID NO: 78932 - DNA, 25 bp, mus musculus
ggtcctaccatcttatatgtgacat

SEQ ID NO: 78933 - DNA, 25 bp, mus musculus
tggtagctctgtaacatgggaatgg

SEQ ID NO: 78934 - DNA, 25 bp, mus musculus
ctagaagcccattcagcaacctgtg

SEQ ID NO: 78935 - DNA, 25 bp, mus musculus
gcccattcagcaacctgtgagattc

SEQ ID NO: 78936 - DNA, 25 bp, mus musculus
tctctatgttagccagggttgctgt

SEQ ID NO: 78937 - DNA, 25 bp, mus musculus
ggtcaaagtgtctcaccacaaacaa

SEQ ID NO: 78938 - DNA, 25 bp, mus musculus
tcaccacaaacaaaggtatcaaatc

SEQ ID NO: 78939 - DNA, 25 bp, mus musculus
tcaaatcacaagcctggctggctga

SEQ ID NO: 78940 - DNA, 25 bp, mus musculus
ttattgatttccgccttggctggca

SEQ ID NO: 78941 - DNA, 25 bp, mus musculus
atttccgccttggctggcaataaag

SEQ ID NO: 78942 - DNA, 25 bp, mus musculus
gccttggctggcaataaaggcattt

SEQ ID NO: 78943 - DNA, 25 bp, mus musculus
ctcctgctcagtctagctctacaaa

SEQ ID NO: 78944 - DNA, 25 bp, mus musculus
ctcagtctagctctacaaagttccc

SEQ ID NO: 78945 - DNA, 25 bp, mus musculus
ctaagagactggtccgcatagataa

SEQ ID NO: 78946 - DNA, 25 bp, mus musculus
gactggtccgcatagataaaggtca

SEQ ID NO: 78947 - DNA, 25 bp, mus musculus
atcagcaccaactctcagttcatca

SEQ ID NO: 78948 - DNA, 25 bp, mus musculus
tctcagttcatcagggttgagaaag

SEQ ID NO: 78949 - DNA, 25 bp, mus musculus
ctgaaatgccgctggtagctctgta

SEQ ID NO: 78950 - DNA, 25 bp, mus musculus
tgccgctggtagctctgtaacatgg

SEQ ID NO: 78951 - DNA, 25 bp, mus musculus
aggcctaatctcagaagcatgagcc

SEQ ID NO: 78952 - DNA, 25 bp, mus musculus
cctaatctcagaagcatgagccacg

SEQ ID NO: 78953 - DNA, 25 bp, mus musculus
tgactgccttgtaaccttcctgctt

SEQ ID NO: 78954 - DNA, 25 bp, mus musculus
tgtaaccttcctgcttcccacgtgt

SEQ ID NO: 78955 - DNA, 25 bp, mus musculus
tcccacgtgtctcatatctgcctct

SEQ ID NO: 78956 - DNA, 25 bp, mus musculus
actgtgacgtcacaacccgaagata

SEQ ID NO: 78957 - DNA, 25 bp, mus musculus
gtgacgtcacaacccgaagataatg

SEQ ID NO: 78958 - DNA, 25 bp, mus musculus
tatttatacacagtgttagggatgt

SEQ ID NO: 78959 - DNA, 25 bp, mus musculus
atgtaatcttatctcagctaggcag

SEQ ID NO: 78960 - DNA, 25 bp, mus musculus
taatcttatctcagctaggcagtgg

SEQ ID NO: 78961 - DNA, 25 bp, mus musculus
tttaagtgagccttggaccaccctg

SEQ ID NO: 78962 - DNA, 25 bp, mus musculus
ctttccccaagagtgatggtttatg

SEQ ID NO: 78963 - DNA, 25 bp, mus musculus
aaccggaagcctggttattgagctg

SEQ ID NO: 78964 - DNA, 25 bp, mus musculus
aagcctggttattgagctgagtgag

SEQ ID NO: 78965 - DNA, 25 bp, mus musculus
agatccccaacacgaggacctcaga

SEQ ID NO: 78966 - DNA, 25 bp, mus musculus
acacgaggacctcagagacaacatt

SEQ ID NO: 78967 - DNA, 25 bp, mus musculus
actcctgagcatcagggattgggga

SEQ ID NO: 78968 - DNA, 25 bp, mus musculus
cctgagcatcagggattggggacag

SEQ ID NO: 78969 - DNA, 25 bp, mus musculus
tcacaggtacagcacgggcctccgt

SEQ ID NO: 78970 - DNA, 25 bp, mus musculus
gtgtcttactgactgccttgtaacc

SEQ ID NO: 78971 - DNA, 25 bp, mus musculus
gcagtcaatcgggctgaaggactcc

SEQ ID NO: 78972 - DNA, 25 bp, mus musculus
actccctgttggcccactcttctga

SEQ ID NO: 78973 - DNA, 25 bp, mus musculus
atttgagtggctctgcgctaaggca

SEQ ID NO: 78974 - DNA, 25 bp, mus musculus
gtggctctgcgctaaggcaagggtt

SEQ ID NO: 78975 - DNA, 25 bp, mus musculus
cttcagcttagcccaggtggtttcg

SEQ ID NO: 78976 - DNA, 25 bp, mus musculus
tcagcttagcccaggtggtttcgag

SEQ ID NO: 78977 - DNA, 25 bp, mus musculus
tttcgagtgccatttggccctggac

SEQ ID NO: 78978 - DNA, 25 bp, mus musculus
tcgagtgccatttggccctggacat

SEQ ID NO: 78979 - DNA, 25 bp, mus musculus
gacatgccattcccagggtgagaat

SEQ ID NO: 78980 - DNA, 25 bp, mus musculus
catgccattcccagggtgagaattt

SEQ ID NO: 78981 - DNA, 25 bp, mus musculus
tgccattcccagggtgagaatttcc

SEQ ID NO: 78982 - DNA, 25 bp, mus musculus
caagcccagggaatcggctatggca

SEQ ID NO: 78983 - DNA, 25 bp, mus musculus
tgttggcccactcttctgaccctgt

SEQ ID NO: 78984 - DNA, 25 bp, mus musculus
cttctgaccctgtggagatgcgaag

SEQ ID NO: 78985 - DNA, 25 bp, mus musculus
taactaccagaccccaggtatgcga

SEQ ID NO: 78986 - DNA, 25 bp, mus musculus
taccagaccccaggtatgcgagacc

SEQ ID NO: 78987 - DNA, 25 bp, mus musculus
tccccatcactggactgggcaggaa

SEQ ID NO: 78988 - DNA, 25 bp, mus musculus
catcactggactgggcaggaatatt

SEQ ID NO: 78989 - DNA, 25 bp, mus musculus
tcactggactgggcaggaatatttg

SEQ ID NO: 78990 - DNA, 25 bp, mus musculus
atatttgagtggctctgcgctaagg

SEQ ID NO: 78991 - DNA, 25 bp, mus musculus
attggcgcatacactggagctaagg

SEQ ID NO: 78992 - DNA, 25 bp, mus musculus
gcatacactggagctaaggagaagg

SEQ ID NO: 78993 - DNA, 25 bp, mus musculus
aaatcctgtacttagatccactttg

SEQ ID NO: 78994 - DNA, 25 bp, mus musculus
tgtacttagatccactttgactgaa

SEQ ID NO: 78995 - DNA, 25 bp, mus musculus
tagatccactttgactgaatccaaa

SEQ ID NO: 78996 - DNA, 25 bp, mus musculus
gactgaatccaaagttcccatttca

SEQ ID NO: 78997 - DNA, 25 bp, mus musculus
atccaaagttcccatttcagatact

SEQ ID NO: 78998 - DNA, 25 bp, mus musculus
catttcagatactccacatctacct

SEQ ID NO: 78999 - DNA, 25 bp, mus musculus
tctacctggctctcctgttcagtgt

SEQ ID NO: 79000 - DNA, 25 bp, mus musculus
tcctgttcagtgtgtgtgcattgat

SEQ ID NO: 79001 - DNA, 25 bp, mus musculus
gtttctctctggatggcacaattat

SEQ ID NO: 79002 - DNA, 25 bp, mus musculus
ttcgattcactacaggataaaagat

SEQ ID NO: 79003 - DNA, 25 bp, mus musculus
gaacaacacattcaggcaccacggg

SEQ ID NO: 79004 - DNA, 25 bp, mus musculus
tcttattaaacatcccgtggaatct

SEQ ID NO: 79005 - DNA, 25 bp, mus musculus
cacattcaggcaccacgggtggcta

SEQ ID NO: 79006 - DNA, 25 bp, mus musculus
attctgcaattttgatgaagaatag

SEQ ID NO: 79007 - DNA, 25 bp, mus musculus
agaatagcactgccttcaaagaaag

SEQ ID NO: 79008 - DNA, 25 bp, mus musculus
atgccaagaacttcagactgtgttc

SEQ ID NO: 79009 - DNA, 25 bp, mus musculus
agaacttcagactgtgttcatttgg

SEQ ID NO: 79010 - DNA, 25 bp, mus musculus
tcagactgtgttcatttggtttgat

SEQ ID NO: 79011 - DNA, 25 bp, mus musculus
catttggtttgattcaggtgctcaa

SEQ ID NO: 79012 - DNA, 25 bp, mus musculus
tgtttccttctgtaaaacaatgctc

SEQ ID NO: 79013 - DNA, 25 bp, mus musculus
tactaccccatgacaggcctttcag

SEQ ID NO: 79014 - DNA, 25 bp, mus musculus
aagagggcccactgcaggttctcag

SEQ ID NO: 79015 - DNA, 25 bp, mus musculus
agggcccactgcaggttctcaggca

SEQ ID NO: 79016 - DNA, 25 bp, mus musculus
cactgcaggttctcaggcagagggt

SEQ ID NO: 79017 - DNA, 25 bp, mus musculus
aatcacaggcacagggacacacgga

SEQ ID NO: 79018 - DNA, 25 bp, mus musculus
cttatagacctacaggtgattttgt

SEQ ID NO: 79019 - DNA, 25 bp, mus musculus
atagacctacaggtgattttgtagt

SEQ ID NO: 79020 - DNA, 25 bp, mus musculus
tgcacctcttagaaactggaaataa

SEQ ID NO: 79021 - DNA, 25 bp, mus musculus
gaaataagtccagcacggtagcata

SEQ ID NO: 79022 - DNA, 25 bp, mus musculus
atcccagcactcaggagggcagagg

SEQ ID NO: 79023 - DNA, 25 bp, mus musculus
aacacagtcttgatccttcctgccc

SEQ ID NO: 79024 - DNA, 25 bp, mus musculus
ggcctttcaggttgcctctgacaga

SEQ ID NO: 79025 - DNA, 25 bp, mus musculus
tatcactaggctctccaaagctgtt

SEQ ID NO: 79026 - DNA, 25 bp, mus musculus
gctctccaaagctgttgtcagccta

SEQ ID NO: 79027 - DNA, 25 bp, mus musculus
caaagctgttgtcagcctaactcat

SEQ ID NO: 79028 - DNA, 25 bp, mus musculus
tgttgtcagcctaactcatactcta

SEQ ID NO: 79029 - DNA, 25 bp, mus musculus
tgtcagcctaactcatactctaaag

SEQ ID NO: 79030 - DNA, 25 bp, mus musculus
aactcatactctaaagggaatctgt

SEQ ID NO: 79031 - DNA, 25 bp, mus musculus
aatctgtgcatattgccatgtgcta

SEQ ID NO: 79032 - DNA, 25 bp, mus musculus
tcccatcctaagaactgctagatcc

SEQ ID NO: 79033 - DNA, 25 bp, mus musculus
catcctaagaactgctagatcccgt

SEQ ID NO: 79034 - DNA, 25 bp, mus musculus
gacacttggctcttgttgggagaac

SEQ ID NO: 79035 - DNA, 25 bp, mus musculus
acttggctcttgttgggagaacaga

SEQ ID NO: 79036 - DNA, 25 bp, mus musculus
ctcttgtccacagcctgtgctcagc

SEQ ID NO: 79037 - DNA, 25 bp, mus musculus
ttgtccacagcctgtgctcagctcc

SEQ ID NO: 79038 - DNA, 25 bp, mus musculus
acagcctgtgctcagctccaactgc

SEQ ID NO: 79039 - DNA, 25 bp, mus musculus
gcctgtgctcagctccaactgctgc

SEQ ID NO: 79040 - DNA, 25 bp, mus musculus
tgtgctcagctccaactgctgcatc

SEQ ID NO: 79041 - DNA, 25 bp, mus musculus
ctccaactgctgcatctcccagagg

SEQ ID NO: 79042 - DNA, 25 bp, mus musculus
caactgctgcatctcccagaggctc

SEQ ID NO: 79043 - DNA, 25 bp, mus musculus
agctgcatagagcctacctgatcac

SEQ ID NO: 79044 - DNA, 25 bp, mus musculus
aactgctagatcccgtgtgacatca

SEQ ID NO: 79045 - DNA, 25 bp, mus musculus
atagagcctacctgatcacagctcc

SEQ ID NO: 79046 - DNA, 25 bp, mus musculus
tgctagatcccgtgtgacatcacca

SEQ ID NO: 79047 - DNA, 25 bp, mus musculus
tagatcccgtgtgacatcaccagtc

SEQ ID NO: 79048 - DNA, 25 bp, mus musculus
gctgccactgctagaagctctgagc

SEQ ID NO: 79049 - DNA, 25 bp, mus musculus
gccactgctagaagctctgagctct

SEQ ID NO: 79050 - DNA, 25 bp, mus musculus
gctagaagctctgagctctgtgctg

SEQ ID NO: 79051 - DNA, 25 bp, mus musculus
ggcacaggcactgacacttggctct

SEQ ID NO: 79052 - DNA, 25 bp, mus musculus
actgacacttggctcttgttgggag

SEQ ID NO: 79053 - DNA, 25 bp, mus musculus
aaagctcagcttgctgccttaaaca

SEQ ID NO: 79054 - DNA, 25 bp, mus musculus
tttcttctgtcttatccgctcacag

SEQ ID NO: 79055 - DNA, 25 bp, mus musculus
tttcagtacccagtatatgaaaagc

SEQ ID NO: 79056 - DNA, 25 bp, mus musculus
ttgtttgccaaacctggtaactctg

SEQ ID NO: 79057 - DNA, 25 bp, mus musculus
aactctgttcattattcgcaggatt

SEQ ID NO: 79058 - DNA, 25 bp, mus musculus
gttcattattcgcaggattaaagat

SEQ ID NO: 79059 - DNA, 25 bp, mus musculus
taaagatctctctattggaatccat

SEQ ID NO: 79060 - DNA, 25 bp, mus musculus
tctctctattggaatccatttcaaa

SEQ ID NO: 79061 - DNA, 25 bp, mus musculus
tattggaatccatttcaaaggttgt

SEQ ID NO: 79062 - DNA, 25 bp, mus musculus
ttgctcttatacagcgagtactttt

SEQ ID NO: 79063 - DNA, 25 bp, mus musculus
ttatacagcgagtacttttattcca

SEQ ID NO: 79064 - DNA, 25 bp, mus musculus
tacttttattccaacactagcaggg

SEQ ID NO: 79065 - DNA, 25 bp, mus musculus
tatccgctcacaggcacagttaagc

SEQ ID NO: 79066 - DNA, 25 bp, mus musculus
ctcacaggcacagttaagcagctgg

SEQ ID NO: 79067 - DNA, 25 bp, mus musculus
gttaattcctctaactgtgagagca

SEQ ID NO: 79068 - DNA, 25 bp, mus musculus
tcctctaactgtgagagcagatgag

SEQ ID NO: 79069 - DNA, 25 bp, mus musculus
gtaattccttctgttcgcaaatcaa

SEQ ID NO: 79070 - DNA, 25 bp, mus musculus
ccttctgttcgcaaatcaactggct

SEQ ID NO: 79071 - DNA, 25 bp, mus musculus
aaatcaactggcttcgtgtttcagt

SEQ ID NO: 79072 - DNA, 25 bp, mus musculus
ttcgtgtttcagtacccagtatatg

SEQ ID NO: 79073 - DNA, 25 bp, mus musculus
aaagtccttactcagatgggctctc

SEQ ID NO: 79074 - DNA, 25 bp, mus musculus
cttactcagatgggctctccgctga

SEQ ID NO: 79075 - DNA, 25 bp, mus musculus
tgaccaacacatttgtattttatga

SEQ ID NO: 79076 - DNA, 25 bp, mus musculus
gtattcgtgttcattgtgattaact

SEQ ID NO: 79077 - DNA, 25 bp, mus musculus
tgcccctgttgaaatgtttagcatt

SEQ ID NO: 79078 - DNA, 25 bp, mus musculus
tagttcatcacataatgaaatttta

SEQ ID NO: 79079 - DNA, 25 bp, mus musculus
tgccttaccacctttgaaaaagcat

SEQ ID NO: 79080 - DNA, 25 bp, mus musculus
accacctttgaaaaagcatacattg

SEQ ID NO: 79081 - DNA, 25 bp, mus musculus
tgcaaaacctcaaagtagggcttgc

SEQ ID NO: 79082 - DNA, 25 bp, mus musculus
cactgcagtcctccttgaccgtaag

SEQ ID NO: 79083 - DNA, 25 bp, mus musculus
tgcagtcctccttgaccgtaagaca

SEQ ID NO: 79084 - DNA, 25 bp, mus musculus
agtcctccttgaccgtaagacatga

SEQ ID NO: 79085 - DNA, 25 bp, mus musculus
cagatgggctctccgctgaacccca

SEQ ID NO: 79086 - DNA, 25 bp, mus musculus
ctgaaccccatttcttctgtttcat

SEQ ID NO: 79087 - DNA, 25 bp, mus musculus
cccatttcttctgtttcatagtgca

SEQ ID NO: 79088 - DNA, 25 bp, mus musculus
atttcttctgtttcatagtgcagaa

SEQ ID NO: 79089 - DNA, 25 bp, mus musculus
tctgtttcatagtgcagaagtattc

SEQ ID NO: 79090 - DNA, 25 bp, mus musculus
aatttccagtacagatgctgtgagc

SEQ ID NO: 79091 - DNA, 25 bp, mus musculus
taattgtgaccaacacatttgtatt

SEQ ID NO: 79092 - DNA, 25 bp, mus musculus
ttgtgaccaacacatttgtatttta

SEQ ID NO: 79093 - DNA, 25 bp, mus musculus
acactctcgcactagctgtttgata

SEQ ID NO: 79094 - DNA, 25 bp, mus musculus
tcgcactagctgtttgatactcaag

SEQ ID NO: 79095 - DNA, 25 bp, mus musculus
gcaaggacccattcataagcttatg

SEQ ID NO: 79096 - DNA, 25 bp, mus musculus
tttgcttcagtgctttgtccacgaa

SEQ ID NO: 79097 - DNA, 25 bp, mus musculus
tcagtgctttgtccacgaatggtct

SEQ ID NO: 79098 - DNA, 25 bp, mus musculus
tcaaacaatgcctgctggcttcagg

SEQ ID NO: 79099 - DNA, 25 bp, mus musculus
tgctggcttcagggccacagtccgc

SEQ ID NO: 79100 - DNA, 25 bp, mus musculus
cccagcctatggaatcttcctctga

SEQ ID NO: 79101 - DNA, 25 bp, mus musculus
ctatggaatcttcctctgactcgag

SEQ ID NO: 79102 - DNA, 25 bp, mus musculus
aatcttcctctgactcgagcctctc

SEQ ID NO: 79103 - DNA, 25 bp, mus musculus
gactgtccaagatggcgtctgtgga

SEQ ID NO: 79104 - DNA, 25 bp, mus musculus
acagcctgagctctggcaccctcgg

SEQ ID NO: 79105 - DNA, 25 bp, mus musculus
agcttcaggcactcgtggatcacgt

SEQ ID NO: 79106 - DNA, 25 bp, mus musculus
atcacgttcagcaggacccgacaga

SEQ ID NO: 79107 - DNA, 25 bp, mus musculus
ttcagcaggacccgacagagcacca

SEQ ID NO: 79108 - DNA, 25 bp, mus musculus
atggctctcagttcttctcaggaca

SEQ ID NO: 79109 - DNA, 25 bp, mus musculus
tcttctcaggacacagcgctacact

SEQ ID NO: 79110 - DNA, 25 bp, mus musculus
acagcgctacacttctgctctgagg

SEQ ID NO: 79111 - DNA, 25 bp, mus musculus
cccgacaactgcacataatccgagc

SEQ ID NO: 79112 - DNA, 25 bp, mus musculus
aactgcacataatccgagccccaca

SEQ ID NO: 79113 - DNA, 25 bp, mus musculus
gacattagcacaaaacttccatcga

SEQ ID NO: 79114 - DNA, 25 bp, mus musculus
attagcacaaaacttccatcgaagc

SEQ ID NO: 79115 - DNA, 25 bp, mus musculus
ttatctgatcccatgagccagtctg

SEQ ID NO: 79116 - DNA, 25 bp, mus musculus
gatcccatgagccagtctgtggccg

SEQ ID NO: 79117 - DNA, 25 bp, mus musculus
atgagccagtctgtggccgatttgc

SEQ ID NO: 79118 - DNA, 25 bp, mus musculus
cagtctgtggccgatttgccaccaa

SEQ ID NO: 79119 - DNA, 25 bp, mus musculus
ttgccaccaaagcttcaaaagatgg

SEQ ID NO: 79120 - DNA, 25 bp, mus musculus
ccaccaaagcttcaaaagatggctg

SEQ ID NO: 79121 - DNA, 25 bp, mus musculus
atgaactctgaccgtttcacatagc

SEQ ID NO: 79122 - DNA, 25 bp, mus musculus
gataagataatcctccctatgaaat

SEQ ID NO: 79123 - DNA, 25 bp, mus musculus
aggtctatcctagcctggcaaatag

SEQ ID NO: 79124 - DNA, 25 bp, mus musculus
tctatcctagcctggcaaatagatc

SEQ ID NO: 79125 - DNA, 25 bp, mus musculus
aaacttccatcgaagctgcagaaaa

SEQ ID NO: 79126 - DNA, 25 bp, mus musculus
atgagttctacaacctcagaaaaag

SEQ ID NO: 79127 - DNA, 25 bp, mus musculus
tctacaacctcagaaaaagcctata

SEQ ID NO: 79128 - DNA, 25 bp, mus musculus
ttgcccatgaaactccaacgaataa

SEQ ID NO: 79129 - DNA, 25 bp, mus musculus
atgaaactccaacgaataagttcag

SEQ ID NO: 79130 - DNA, 25 bp, mus musculus
cgaataagttcagttcctggcaact

SEQ ID NO: 79131 - DNA, 25 bp, mus musculus
tctaaaaccaccaagatgttatctg

SEQ ID NO: 79132 - DNA, 25 bp, mus musculus
atgttatctgatcccatgagccagt

SEQ ID NO: 79133 - DNA, 25 bp, mus musculus
cagactgtcttcccatcaacttgta

SEQ ID NO: 79134 - DNA, 25 bp, mus musculus
ccatcaacttgtagctgttctagac

SEQ ID NO: 79135 - DNA, 25 bp, mus musculus
gcttatcctgtttgagaggatgcaa

SEQ ID NO: 79136 - DNA, 25 bp, mus musculus
gatgcaacaacaccccaatggcata

SEQ ID NO: 79137 - DNA, 25 bp, mus musculus
acaacaccccaatggcatagaagcc

SEQ ID NO: 79138 - DNA, 25 bp, mus musculus
tcctgatatcactccacaggaaaca

SEQ ID NO: 79139 - DNA, 25 bp, mus musculus
tatcactccacaggaaacagagatt

SEQ ID NO: 79140 - DNA, 25 bp, mus musculus
agagatttccctctcataagggaag

SEQ ID NO: 79141 - DNA, 25 bp, mus musculus
ttccctctcataagggaagtatagg

SEQ ID NO: 79142 - DNA, 25 bp, mus musculus
gaggctgcctactacagttcaatga

SEQ ID NO: 79143 - DNA, 25 bp, mus musculus
gcctactacagttcaatgagtgaac

SEQ ID NO: 79144 - DNA, 25 bp, mus musculus
agtgaacacctgtgtcctaatgatg

SEQ ID NO: 79145 - DNA, 25 bp, mus musculus
acgggctggcctacattctaaggtg

SEQ ID NO: 79146 - DNA, 25 bp, mus musculus
tggcctacattctaaggtgattctg

SEQ ID NO: 79147 - DNA, 25 bp, mus musculus
gattctggccatccggaaagctgag

SEQ ID NO: 79148 - DNA, 25 bp, mus musculus
caagcgactcctgtatgtttcctgt

SEQ ID NO: 79149 - DNA, 25 bp, mus musculus
agccatgggcaactttgtggacctc

SEQ ID NO: 79150 - DNA, 25 bp, mus musculus
ggacctctgcagggccccatctaac

SEQ ID NO: 79151 - DNA, 25 bp, mus musculus
attccatccagtcaaggctgtggca

SEQ ID NO: 79152 - DNA, 25 bp, mus musculus
tccagtcaaggctgtggcagtggac

SEQ ID NO: 79153 - DNA, 25 bp, mus musculus
gtccagtctatctgcatcggccaac

SEQ ID NO: 79154 - DNA, 25 bp, mus musculus
cagtctatctgcatcggccaaccct

SEQ ID NO: 79155 - DNA, 25 bp, mus musculus
gtacaccgcctacaatgaggcttgg

SEQ ID NO: 79156 - DNA, 25 bp, mus musculus
cgcctacaatgaggcttggagattc

SEQ ID NO: 79157 - DNA, 25 bp, mus musculus
tgccgctgcctatgaccgccactag

SEQ ID NO: 79158 - DNA, 25 bp, mus musculus
cgctgcctatgaccgccactagtta

SEQ ID NO: 79159 - DNA, 25 bp, mus musculus
accgcggggaccacatcaagcttca

SEQ ID NO: 79160 - DNA, 25 bp, mus musculus
gggaccacatcaagcttcaggcaga

SEQ ID NO: 79161 - DNA, 25 bp, mus musculus
accacatcaagcttcaggcagacag

SEQ ID NO: 79162 - DNA, 25 bp, mus musculus
acatcaagcttcaggcagacagctt

SEQ ID NO: 79163 - DNA, 25 bp, mus musculus
agcttcaggcagacagcttcggcct

SEQ ID NO: 79164 - DNA, 25 bp, mus musculus
caccctgtcgatggccagacaggac

SEQ ID NO: 79165 - DNA, 25 bp, mus musculus
ggccaaccctgagctgggcagcaat

SEQ ID NO: 79166 - DNA, 25 bp, mus musculus
tgtgtcaggcacacagacgtacccc

SEQ ID NO: 79167 - DNA, 25 bp, mus musculus
aggcacacagacgtaccccgttgtg

SEQ ID NO: 79168 - DNA, 25 bp, mus musculus
cgttgtgaccggtcgtgatatgacg

SEQ ID NO: 79169 - DNA, 25 bp, mus musculus
gacgagcaccactctacctggttac

SEQ ID NO: 79170 - DNA, 25 bp, mus musculus
caccctggcaggaatggtgcctggg

SEQ ID NO: 79171 - DNA, 25 bp, mus musculus
cgagttctcaggcaacccatacagc

SEQ ID NO: 79172 - DNA, 25 bp, mus musculus
gttctcaggcaacccatacagccat

SEQ ID NO: 79173 - DNA, 25 bp, mus musculus
agccagtccttgtacataaaagagt

SEQ ID NO: 79174 - DNA, 25 bp, mus musculus
ccttaattcagagtgccaggcagaa

SEQ ID NO: 79175 - DNA, 25 bp, mus musculus
tgctccatcagagaattcacacttc

SEQ ID NO: 79176 - DNA, 25 bp, mus musculus
ccatcagagaattcacacttcaggg

SEQ ID NO: 79177 - DNA, 25 bp, mus musculus
atcagagaattcacacttcagggaa

SEQ ID NO: 79178 - DNA, 25 bp, mus musculus
gagaattcacacttcagggaatccc

SEQ ID NO: 79179 - DNA, 25 bp, mus musculus
gaattcacacttcagggaatcccta

SEQ ID NO: 79180 - DNA, 25 bp, mus musculus
tcacacttcagggaatccctacaaa

SEQ ID NO: 79181 - DNA, 25 bp, mus musculus
acacttcagggaatccctacaaatg

SEQ ID NO: 79182 - DNA, 25 bp, mus musculus
ttcagggaatccctacaaatgtgat

SEQ ID NO: 79183 - DNA, 25 bp, mus musculus
cagggaatccctacaaatgtgataa

SEQ ID NO: 79184 - DNA, 25 bp, mus musculus
atccctacaaatgtgataaatgtca

SEQ ID NO: 79185 - DNA, 25 bp, mus musculus
aattcagagtgccaggcagaaaact

SEQ ID NO: 79186 - DNA, 25 bp, mus musculus
ttcagagtgccaggcagaaaacttg

SEQ ID NO: 79187 - DNA, 25 bp, mus musculus
tagtaggatctcagccttaatgctc

SEQ ID NO: 79188 - DNA, 25 bp, mus musculus
gtaggatctcagccttaatgctcca

SEQ ID NO: 79189 - DNA, 25 bp, mus musculus
gatctcagccttaatgctccatcag

SEQ ID NO: 79190 - DNA, 25 bp, mus musculus
tctcagccttaatgctccatcagag

SEQ ID NO: 79191 - DNA, 25 bp, mus musculus
agccttaatgctccatcagagaatt

SEQ ID NO: 79192 - DNA, 25 bp, mus musculus
ccttaatgctccatcagagaattca

SEQ ID NO: 79193 - DNA, 25 bp, mus musculus
tcagatactttcccaaccaagcttt

SEQ ID NO: 79194 - DNA, 25 bp, mus musculus
agattaattccagcagatctttctt

SEQ ID NO: 79195 - DNA, 25 bp, mus musculus
ttgcgcttgggctacattcttgtgc

SEQ ID NO: 79196 - DNA, 25 bp, mus musculus
tgcgcttgggctacattcttgtgcc

SEQ ID NO: 79197 - DNA, 25 bp, mus musculus
gcgcttgggctacattcttgtgcct

SEQ ID NO: 79198 - DNA, 25 bp, mus musculus
tacattcttgtgccttgtgtacctc

SEQ ID NO: 79199 - DNA, 25 bp, mus musculus
tcttgtgccttgtgtacctcttgat

SEQ ID NO: 79200 - DNA, 25 bp, mus musculus
cttgtgccttgtgtacctcttgatt

SEQ ID NO: 79201 - DNA, 25 bp, mus musculus
gtctagcagctgatgttggcaagct

SEQ ID NO: 79202 - DNA, 25 bp, mus musculus
tctagcagctgatgttggcaagctt

SEQ ID NO: 79203 - DNA, 25 bp, mus musculus
ctagcagctgatgttggcaagcttg

SEQ ID NO: 79204 - DNA, 25 bp, mus musculus
tagcagctgatgttggcaagcttga

SEQ ID NO: 79205 - DNA, 25 bp, mus musculus
gattaattccagcagatctttcttg

SEQ ID NO: 79206 - DNA, 25 bp, mus musculus
gaattcaaaggcctggtgactgcct

SEQ ID NO: 79207 - DNA, 25 bp, mus musculus
attaattccagcagatctttcttgg

SEQ ID NO: 79208 - DNA, 25 bp, mus musculus
caataagtggttgcgcttgggctac

SEQ ID NO: 79209 - DNA, 25 bp, mus musculus
ataagtggttgcgcttgggctacat

SEQ ID NO: 79210 - DNA, 25 bp, mus musculus
aagtggttgcgcttgggctacattc

SEQ ID NO: 79211 - DNA, 25 bp, mus musculus
tggttgcgcttgggctacattcttg

SEQ ID NO: 79212 - DNA, 25 bp, mus musculus
ggttgcgcttgggctacattcttgt

SEQ ID NO: 79213 - DNA, 25 bp, mus musculus
gttgcgcttgggctacattcttgtg

SEQ ID NO: 79214 - DNA, 25 bp, mus musculus
tctacattcgtgcggccgaaaagct

SEQ ID NO: 79215 - DNA, 25 bp, mus musculus
acattcgtgcggccgaaaagcttcg

SEQ ID NO: 79216 - DNA, 25 bp, mus musculus
tgcgcatttaccacgttcgcattct

SEQ ID NO: 79217 - DNA, 25 bp, mus musculus
gcatttaccacgttcgcattctgag

SEQ ID NO: 79218 - DNA, 25 bp, mus musculus
tttaccacgttcgcattctgagggt

SEQ ID NO: 79219 - DNA, 25 bp, mus musculus
acgttcgcattctgagggttgaatt

SEQ ID NO: 79220 - DNA, 25 bp, mus musculus
ttcgcattctgagggttgaattcta

SEQ ID NO: 79221 - DNA, 25 bp, mus musculus
ttgaattctacttcctgttccaata

SEQ ID NO: 79222 - DNA, 25 bp, mus musculus
tcctgttccaatatgttttcgcaag

SEQ ID NO: 79223 - DNA, 25 bp, mus musculus
atgttttcgcaagcgacttcccatt

SEQ ID NO: 79224 - DNA, 25 bp, mus musculus
tcgcaagcgacttcccattccggca

SEQ ID NO: 79225 - DNA, 25 bp, mus musculus
caagcgacttcccattccggcaaat

SEQ ID NO: 79226 - DNA, 25 bp, mus musculus
agatttacagcctcgagccgaacga

SEQ ID NO: 79227 - DNA, 25 bp, mus musculus
tttacagcctcgagccgaacgatta

SEQ ID NO: 79228 - DNA, 25 bp, mus musculus
acagcctcgagccgaacgattagcc

SEQ ID NO: 79229 - DNA, 25 bp, mus musculus
agccgaacgattagcctctgatgcg

SEQ ID NO: 79230 - DNA, 25 bp, mus musculus
cgaacgattagcctctgatgcgcat

SEQ ID NO: 79231 - DNA, 25 bp, mus musculus
attagcctctgatgcgcatttacca

SEQ ID NO: 79232 - DNA, 25 bp, mus musculus
agcctctgatgcgcatttaccacgt

SEQ ID NO: 79233 - DNA, 25 bp, mus musculus
ctctgatgcgcatttaccacgttcg

SEQ ID NO: 79234 - DNA, 25 bp, mus musculus
gaagacttcagaccttatccctaat

SEQ ID NO: 79235 - DNA, 25 bp, mus musculus
cttcagaccttatccctaatcccat

SEQ ID NO: 79236 - DNA, 25 bp, mus musculus
tatccctaatcccatattgccggaa

SEQ ID NO: 79237 - DNA, 25 bp, mus musculus
atccctaatcccatattgccggaag

SEQ ID NO: 79238 - DNA, 25 bp, mus musculus
tccctaatcccatattgccggaagt

SEQ ID NO: 79239 - DNA, 25 bp, mus musculus
gttttccagtgccccatttgaccag

SEQ ID NO: 79240 - DNA, 25 bp, mus musculus
ttccagtgccccatttgaccaggta

SEQ ID NO: 79241 - DNA, 25 bp, mus musculus
tccagtgccccatttgaccaggtaa

SEQ ID NO: 79242 - DNA, 25 bp, mus musculus
tgccccatttgaccaggtaaacaag

SEQ ID NO: 79243 - DNA, 25 bp, mus musculus
ttcagaccttatccctaatcccata

SEQ ID NO: 79244 - DNA, 25 bp, mus musculus
tcagaccttatccctaatcccatat

SEQ ID NO: 79245 - DNA, 25 bp, mus musculus
cagaccttatccctaatcccatatt

SEQ ID NO: 79246 - DNA, 25 bp, mus musculus
agaccttatccctaatcccatattg

SEQ ID NO: 79247 - DNA, 25 bp, mus musculus
gaccttatccctaatcccatattgc

SEQ ID NO: 79248 - DNA, 25 bp, mus musculus
ccttatccctaatcccatattgccg

SEQ ID NO: 79249 - DNA, 25 bp, mus musculus
cttatccctaatcccatattgccgg

SEQ ID NO: 79250 - DNA, 25 bp, mus musculus
ttatccctaatcccatattgccgga

SEQ ID NO: 79251 - DNA, 25 bp, mus musculus
acccagcctacatctcaatgaaagc

SEQ ID NO: 79252 - DNA, 25 bp, mus musculus
cctacatctcaatgaaagccatcga

SEQ ID NO: 79253 - DNA, 25 bp, mus musculus
tcatccgtcctatcttcctcaggca

SEQ ID NO: 79254 - DNA, 25 bp, mus musculus
tcctcaggcacgagtcccaggtaga

SEQ ID NO: 79255 - DNA, 25 bp, mus musculus
agactgcagatgccatcagcaaaga

SEQ ID NO: 79256 - DNA, 25 bp, mus musculus
ctgcagatgccatcagcaaagaagt

SEQ ID NO: 79257 - DNA, 25 bp, mus musculus
cagtgaacttgctgggcgatgtgaa

SEQ ID NO: 79258 - DNA, 25 bp, mus musculus
acttgctgggcgatgtgaagaagag

SEQ ID NO: 79259 - DNA, 25 bp, mus musculus
cctggagctctgtgtcatgctaggg

SEQ ID NO: 79260 - DNA, 25 bp, mus musculus
ggagctctgtgtcatgctagggaca

SEQ ID NO: 79261 - DNA, 25 bp, mus musculus
agtggcacagtgcttggataatgtt

SEQ ID NO: 79262 - DNA, 25 bp, mus musculus
tgccttggaaacttcccgctgtatt

SEQ ID NO: 79263 - DNA, 25 bp, mus musculus
agagtcccaacaaagatgatgacac

SEQ ID NO: 79264 - DNA, 25 bp, mus musculus
aagatgatgacacccagtggctgac

SEQ ID NO: 79265 - DNA, 25 bp, mus musculus
atgatgacacccagtggctgacgta

SEQ ID NO: 79266 - DNA, 25 bp, mus musculus
atgacacccagtggctgacgtactg

SEQ ID NO: 79267 - DNA, 25 bp, mus musculus
ctgagatgctctacaggcgaatcat

SEQ ID NO: 79268 - DNA, 25 bp, mus musculus
tctacaggcgaatcatccgtcctat

SEQ ID NO: 79269 - DNA, 25 bp, mus musculus
acaggcgaatcatccgtcctatctt

SEQ ID NO: 79270 - DNA, 25 bp, mus musculus
ggcgaatcatccgtcctatcttcct

SEQ ID NO: 79271 - DNA, 25 bp, mus musculus
taggcccattgattgtttgtcggaa

SEQ ID NO: 79272 - DNA, 25 bp, mus musculus
acatcaaaacatactctgaacaccc

SEQ ID NO: 79273 - DNA, 25 bp, mus musculus
aatacaagcacaggggagtatacag

SEQ ID NO: 79274 - DNA, 25 bp, mus musculus
tatacagttctgatgtctttgacct

SEQ ID NO: 79275 - DNA, 25 bp, mus musculus
cacctggaacctggttactccactg

SEQ ID NO: 79276 - DNA, 25 bp, mus musculus
gaacctggttactccactgccacgt

SEQ ID NO: 79277 - DNA, 25 bp, mus musculus
ggttactccactgccacgtgactga

SEQ ID NO: 79278 - DNA, 25 bp, mus musculus
tccactgccacgtgactgaccatgt

SEQ ID NO: 79279 - DNA, 25 bp, mus musculus
tgactgaccatgtccatgctgggat

SEQ ID NO: 79280 - DNA, 25 bp, mus musculus
accatgtccatgctgggatggcaac

SEQ ID NO: 79281 - DNA, 25 bp, mus musculus
tccatgctgggatggcaactaccta

SEQ ID NO: 79282 - DNA, 25 bp, mus musculus
agactaagtctggctgaatgaaata

SEQ ID NO: 79283 - DNA, 25 bp, mus musculus
ttggaaacctacaaggcctcacaat

SEQ ID NO: 79284 - DNA, 25 bp, mus musculus
acctacaaggcctcacaatgcacgt

SEQ ID NO: 79285 - DNA, 25 bp, mus musculus
aaggcctcacaatgcacgtgaaaga

SEQ ID NO: 79286 - DNA, 25 bp, mus musculus
tcaactggtatctgatgggaatggg

SEQ ID NO: 79287 - DNA, 25 bp, mus musculus
acactgtacacttccacggccacag

SEQ ID NO: 79288 - DNA, 25 bp, mus musculus
tccacggccacagcttccaatacaa

SEQ ID NO: 79289 - DNA, 25 bp, mus musculus
gccacagcttccaatacaagcacag

SEQ ID NO: 79290 - DNA, 25 bp, mus musculus
gcttccaatacaagcacaggggagt

SEQ ID NO: 79291 - DNA, 25 bp, mus musculus
cattgccaaggcacagaagaggaga

SEQ ID NO: 79292 - DNA, 25 bp, mus musculus
ttaactccagaacaagagaaggata

SEQ ID NO: 79293 - DNA, 25 bp, mus musculus
gagtccaacagatccctgccttaca

SEQ ID NO: 79294 - DNA, 25 bp, mus musculus
aacagatccctgccttacaattgga

SEQ ID NO: 79295 - DNA, 25 bp, mus musculus
tccctgccttacaattggagcattt

SEQ ID NO: 79296 - DNA, 25 bp, mus musculus
agcatttccagaacttaatccgtga

SEQ ID NO: 79297 - DNA, 25 bp, mus musculus
tccagaacttaatccgtgagcattg

SEQ ID NO: 79298 - DNA, 25 bp, mus musculus
acttaatccgtgagcattggatact

SEQ ID NO: 79299 - DNA, 25 bp, mus musculus
acactttggtttgtcgtggtgtcag

SEQ ID NO: 79300 - DNA, 25 bp, mus musculus
tggtttgtcgtggtgtcagcgcagc

SEQ ID NO: 79301 - DNA, 25 bp, mus musculus
gtgtcagcgcagcagccgacaacta

SEQ ID NO: 79302 - DNA, 25 bp, mus musculus
gcgcagcagccgacaactaagtctc

SEQ ID NO: 79303 - DNA, 25 bp, mus musculus
aaatctcacttcacagacaaagaga

SEQ ID NO: 79304 - DNA, 25 bp, mus musculus
cgcagcagccgacaactaagtctct

SEQ ID NO: 79305 - DNA, 25 bp, mus musculus
cacttcacagacaaagagactggac

SEQ ID NO: 79306 - DNA, 25 bp, mus musculus
atgcctctcttggaatggtttgcta

SEQ ID NO: 79307 - DNA, 25 bp, mus musculus
gaattttttgaccttgatgactact

SEQ ID NO: 79308 - DNA, 25 bp, mus musculus
tttgaccttgatgactactaggtag

SEQ ID NO: 79309 - DNA, 25 bp, mus musculus
cctccagcattcaacccaaggagca

SEQ ID NO: 79310 - DNA, 25 bp, mus musculus
gcattcaacccaaggagcatacccg

SEQ ID NO: 79311 - DNA, 25 bp, mus musculus
atacccgtggtggagtccaacagat

SEQ ID NO: 79312 - DNA, 25 bp, mus musculus
tcatctttagcagacttgatgggtc

SEQ ID NO: 79313 - DNA, 25 bp, mus musculus
tctttagcagacttgatgggtccat

SEQ ID NO: 79314 - DNA, 25 bp, mus musculus
taaacttgactgcagcagatacagt

SEQ ID NO: 79315 - DNA, 25 bp, mus musculus
tgactgcagcagatacagtgatcat

SEQ ID NO: 79316 - DNA, 25 bp, mus musculus
attggaatcctcagtctgatctcca

SEQ ID NO: 79317 - DNA, 25 bp, mus musculus
ggaatcctcagtctgatctccaggc

SEQ ID NO: 79318 - DNA, 25 bp, mus musculus
atcctcagtctgatctccaggctca

SEQ ID NO: 79319 - DNA, 25 bp, mus musculus
agtctgatctccaggctcaagatag

SEQ ID NO: 79320 - DNA, 25 bp, mus musculus
ctgatctccaggctcaagatagatg

SEQ ID NO: 79321 - DNA, 25 bp, mus musculus
atctccaggctcaagatagatgtca

SEQ ID NO: 79322 - DNA, 25 bp, mus musculus
ttgttgtgtatcgtcttgtaacagc

SEQ ID NO: 79323 - DNA, 25 bp, mus musculus
tgtatcgtcttgtaacagcaaatac

SEQ ID NO: 79324 - DNA, 25 bp, mus musculus
ttgatgggtccatgtcttattcgga

SEQ ID NO: 79325 - DNA, 25 bp, mus musculus
ggtccatgtcttattcggaaagaga

SEQ ID NO: 79326 - DNA, 25 bp, mus musculus
atatatacagtttcaacacggatcc

SEQ ID NO: 79327 - DNA, 25 bp, mus musculus
acagtttcaacacggatccagatgt

SEQ ID NO: 79328 - DNA, 25 bp, mus musculus
tcaacacggatccagatgtttttct

SEQ ID NO: 79329 - DNA, 25 bp, mus musculus
ttttcttagtgagtacacgagctgg

SEQ ID NO: 79330 - DNA, 25 bp, mus musculus
tgagtacacgagctggtggtttagg

SEQ ID NO: 79331 - DNA, 25 bp, mus musculus
gcataaacttgactgcagcagatac

SEQ ID NO: 79332 - DNA, 25 bp, mus musculus
taatccaccaaatgcaatggctcag

SEQ ID NO: 79333 - DNA, 25 bp, mus musculus
accaaatgcaatggctcagacaatt

SEQ ID NO: 79334 - DNA, 25 bp, mus musculus
gagtcctagacctgggtgtatttgc

SEQ ID NO: 79335 - DNA, 25 bp, mus musculus
tatttgcactttggggccctgttgc

SEQ ID NO: 79336 - DNA, 25 bp, mus musculus
ctgttgctagccatcactgtgccag

SEQ ID NO: 79337 - DNA, 25 bp, mus musculus
ctagccatcactgtgccagagcaag

SEQ ID NO: 79338 - DNA, 25 bp, mus musculus
atcactgtgccagagcaagcacgct

SEQ ID NO: 79339 - DNA, 25 bp, mus musculus
gagcaagcacgctgagaaggctagt

SEQ ID NO: 79340 - DNA, 25 bp, mus musculus
ggctagtctccatagttgatggtta

SEQ ID NO: 79341 - DNA, 25 bp, mus musculus
aatgttacttccacaaaatatgtga

SEQ ID NO: 79342 - DNA, 25 bp, mus musculus
acttccacaaaatatgtgaatttgc

SEQ ID NO: 79343 - DNA, 25 bp, mus musculus
ctgcttctgagaggcaatgtgaaag

SEQ ID NO: 79344 - DNA, 25 bp, mus musculus
gacaattaagcactgcctttcgtct

SEQ ID NO: 79345 - DNA, 25 bp, mus musculus
taagcactgcctttcgtctttcttt

SEQ ID NO: 79346 - DNA, 25 bp, mus musculus
tgtaactcacttggtaaaagcaaat

SEQ ID NO: 79347 - DNA, 25 bp, mus musculus
gaggctgccagtgttggtacctgtg

SEQ ID NO: 79348 - DNA, 25 bp, mus musculus
gccagtgttggtacctgtggatttt

SEQ ID NO: 79349 - DNA, 25 bp, mus musculus
ggcccgctaagttctgctgagcagg

SEQ ID NO: 79350 - DNA, 25 bp, mus musculus
ctaagttctgctgagcaggcctgtc

SEQ ID NO: 79351 - DNA, 25 bp, mus musculus
tgttccttaccggtgagactgggct

SEQ ID NO: 79352 - DNA, 25 bp, mus musculus
tttgtcctacagcttgtggtgtcta

SEQ ID NO: 79353 - DNA, 25 bp, mus musculus
cttgtggtgtctatgggccagatat

SEQ ID NO: 79354 - DNA, 25 bp, mus musculus
gcccagagcgtgctggacagcaaag

SEQ ID NO: 79355 - DNA, 25 bp, mus musculus
aactaaagagccggagagtgggctg

SEQ ID NO: 79356 - DNA, 25 bp, mus musculus
gagtccctgctgatgaggcgctctc

SEQ ID NO: 79357 - DNA, 25 bp, mus musculus
ttcccagaagactcaaatcttcttc

SEQ ID NO: 79358 - DNA, 25 bp, mus musculus
gaagactcaaatcttcttcctcctc

SEQ ID NO: 79359 - DNA, 25 bp, mus musculus
tcaaatcttcttcctcctcgcacag

SEQ ID NO: 79360 - DNA, 25 bp, mus musculus
cagaactatcggacttgtcccactc

SEQ ID NO: 79361 - DNA, 25 bp, mus musculus
acttgtcccactcaaacatgatgag

SEQ ID NO: 79362 - DNA, 25 bp, mus musculus
cccactcaaacatgatgagtgagca

SEQ ID NO: 79363 - DNA, 25 bp, mus musculus
acacaaagggccagagtcagaaaag

SEQ ID NO: 79364 - DNA, 25 bp, mus musculus
ctacacgaaggactccagcatgggg

SEQ ID NO: 79365 - DNA, 25 bp, mus musculus
gaaggactccagcatggggagatag

SEQ ID NO: 79366 - DNA, 25 bp, mus musculus
ctccagcatggggagataggccacc

SEQ ID NO: 79367 - DNA, 25 bp, mus musculus
gtgataccaagcatccttgtgcttg

SEQ ID NO: 79368 - DNA, 25 bp, mus musculus
ccaagcatccttgtgcttgatgcca

SEQ ID NO: 79369 - DNA, 25 bp, mus musculus
atccttgtgcttgatgccataaagc

SEQ ID NO: 79370 - DNA, 25 bp, mus musculus
catctcactagtgcccagagcgtgc

SEQ ID NO: 79371 - DNA, 25 bp, mus musculus
actagtgcccagagcgtgctggaca

SEQ ID NO: 79372 - DNA, 25 bp, mus musculus
tttcattcaaggcctccgaatttgg

SEQ ID NO: 79373 - DNA, 25 bp, mus musculus
tcaaggcctccgaatttggcgtcct

SEQ ID NO: 79374 - DNA, 25 bp, mus musculus
agtgtcttggctttctctgctgcta

SEQ ID NO: 79375 - DNA, 25 bp, mus musculus
tgtcttggctttctctgctgctact

SEQ ID NO: 79376 - DNA, 25 bp, mus musculus
tccgctggttcctgctgtcattaaa

SEQ ID NO: 79377 - DNA, 25 bp, mus musculus
tttctagccatctctgtaagttgtg

SEQ ID NO: 79378 - DNA, 25 bp, mus musculus
ctagccatctctgtaagttgtgcat

SEQ ID NO: 79379 - DNA, 25 bp, mus musculus
gccatctctgtaagttgtgcattca

SEQ ID NO: 79380 - DNA, 25 bp, mus musculus
catctctgtaagttgtgcattcaaa

SEQ ID NO: 79381 - DNA, 25 bp, mus musculus
atctctgtaagttgtgcattcaaat

SEQ ID NO: 79382 - DNA, 25 bp, mus musculus
aaatgagtaccttatgcgcaataaa

SEQ ID NO: 79383 - DNA, 25 bp, mus musculus
aatgagtaccttatgcgcaataaaa

SEQ ID NO: 79384 - DNA, 25 bp, mus musculus
gttgccacgcacagacggtgctagc

SEQ ID NO: 79385 - DNA, 25 bp, mus musculus
gccacgcacagacggtgctagcaat

SEQ ID NO: 79386 - DNA, 25 bp, mus musculus
ccacgcacagacggtgctagcaatc

SEQ ID NO: 79387 - DNA, 25 bp, mus musculus
acgcacagacggtgctagcaatcat

SEQ ID NO: 79388 - DNA, 25 bp, mus musculus
cgcacagacggtgctagcaatcatg

SEQ ID NO: 79389 - DNA, 25 bp, mus musculus
gctcaggtgcagtgtcttggctttc

SEQ ID NO: 79390 - DNA, 25 bp, mus musculus
aggtgcagtgtcttggctttctctg

SEQ ID NO: 79391 - DNA, 25 bp, mus musculus
tgcagtgtcttggctttctctgctg

SEQ ID NO: 79392 - DNA, 25 bp, mus musculus
gttgtacatccaggagcctggctac

SEQ ID NO: 79393 - DNA, 25 bp, mus musculus
catccaggagcctggctacctgtct

SEQ ID NO: 79394 - DNA, 25 bp, mus musculus
gtctgtccacgccttctcaggtttg

SEQ ID NO: 79395 - DNA, 25 bp, mus musculus
cttctcaggtttgctggtgtctatt

SEQ ID NO: 79396 - DNA, 25 bp, mus musculus
tttgtacaagtcagtgcttttcaga

SEQ ID NO: 79397 - DNA, 25 bp, mus musculus
caagtcagtgcttttcagaaaaggt

SEQ ID NO: 79398 - DNA, 25 bp, mus musculus
tctagccagtgagtcagaggccaga

SEQ ID NO: 79399 - DNA, 25 bp, mus musculus
agagacccttcacactcttgtggtt

SEQ ID NO: 79400 - DNA, 25 bp, mus musculus
ccttcacactcttgtggttggcact

SEQ ID NO: 79401 - DNA, 25 bp, mus musculus
cactcttgtggttggcactgacttg

SEQ ID NO: 79402 - DNA, 25 bp, mus musculus
atgctgggaccaatggcagatcact

SEQ ID NO: 79403 - DNA, 25 bp, mus musculus
tctctgcctcagtgtgcactgtctg

SEQ ID NO: 79404 - DNA, 25 bp, mus musculus
tggctacctgtcttaccccttgaag

SEQ ID NO: 79405 - DNA, 25 bp, mus musculus
atctctgggtagctgtccttcagga

SEQ ID NO: 79406 - DNA, 25 bp, mus musculus
ctgtccttcaggaagatgccagctg

SEQ ID NO: 79407 - DNA, 25 bp, mus musculus
aagatgccagctgtgctatttgaag

SEQ ID NO: 79408 - DNA, 25 bp, mus musculus
ccagctgtgctatttgaagaggcca

SEQ ID NO: 79409 - DNA, 25 bp, mus musculus
accctcttagctgaattcttttgca

SEQ ID NO: 79410 - DNA, 25 bp, mus musculus
gaattcttttgcaagctgctgtatg

SEQ ID NO: 79411 - DNA, 25 bp, mus musculus
ctgtatgtctgtccacgccttctca

SEQ ID NO: 79412 - DNA, 25 bp, mus musculus
ggccccagagctaccgcacaaagct

SEQ ID NO: 79413 - DNA, 25 bp, mus musculus
cccagagctaccgcacaaagcttga

SEQ ID NO: 79414 - DNA, 25 bp, mus musculus
ggcatctagagcctggtaggacaga

SEQ ID NO: 79415 - DNA, 25 bp, mus musculus
atctagagcctggtaggacagaacc

SEQ ID NO: 79416 - DNA, 25 bp, mus musculus
gctgccataactcagaacactgtga

SEQ ID NO: 79417 - DNA, 25 bp, mus musculus
ataactcagaacactgtgaacggta

SEQ ID NO: 79418 - DNA, 25 bp, mus musculus
tcagcgcttaccccagctttgagga

SEQ ID NO: 79419 - DNA, 25 bp, mus musculus
gcgcttaccccagctttgaggacag

SEQ ID NO: 79420 - DNA, 25 bp, mus musculus
accccagctttgaggacagaaaatg

SEQ ID NO: 79421 - DNA, 25 bp, mus musculus
ggcctaacccatagagtgacccaag

SEQ ID NO: 79422 - DNA, 25 bp, mus musculus
ctaacccatagagtgacccaagagg

SEQ ID NO: 79423 - DNA, 25 bp, mus musculus
taaataaagacatccgttcaagctc

SEQ ID NO: 79424 - DNA, 25 bp, mus musculus
agagctaccgcacaaagcttgacgc

SEQ ID NO: 79425 - DNA, 25 bp, mus musculus
ccaacccagatgtgagaaggtggga

SEQ ID NO: 79426 - DNA, 25 bp, mus musculus
gccaccgaacaggtctgctttcaga

SEQ ID NO: 79427 - DNA, 25 bp, mus musculus
accgaacaggtctgctttcagacgc

SEQ ID NO: 79428 - DNA, 25 bp, mus musculus
gtctgctttcagacgcgtagcctgg

SEQ ID NO: 79429 - DNA, 25 bp, mus musculus
tgctttcagacgcgtagcctggtcc

SEQ ID NO: 79430 - DNA, 25 bp, mus musculus
gaccaggaacacggcatctagagcc

SEQ ID NO: 79431 - DNA, 25 bp, mus musculus
cacggcatctagagcctggtaggac

SEQ ID NO: 79432 - DNA, 25 bp, mus musculus
atgccgcatcaccgagtgggtcagc

SEQ ID NO: 79433 - DNA, 25 bp, mus musculus
ggtcagcgtctgcaagtgagcagac

SEQ ID NO: 79434 - DNA, 25 bp, mus musculus
caccctaggacaggtcaccaaagca

SEQ ID NO: 79435 - DNA, 25 bp, mus musculus
gcctggcatgcctacctcctgtcat

SEQ ID NO: 79436 - DNA, 25 bp, mus musculus
caatgcactgaagctgatgggcacc

SEQ ID NO: 79437 - DNA, 25 bp, mus musculus
aatggccgtcatcgggctgaagtga

SEQ ID NO: 79438 - DNA, 25 bp, mus musculus
cgtcatcgggctgaagtgactctaa

SEQ ID NO: 79439 - DNA, 25 bp, mus musculus
agggctccagacctctgctcctgtc

SEQ ID NO: 79440 - DNA, 25 bp, mus musculus
ctctgctcctgtctttcacttaaca

SEQ ID NO: 79441 - DNA, 25 bp, mus musculus
tcctgtctttcacttaacagatatt

SEQ ID NO: 79442 - DNA, 25 bp, mus musculus
ttgcgctctctttgagacactctct

SEQ ID NO: 79443 - DNA, 25 bp, mus musculus
agctccggagtctacaggctgatta

SEQ ID NO: 79444 - DNA, 25 bp, mus musculus
cccaagctcctctgggtctcaagaa

SEQ ID NO: 79445 - DNA, 25 bp, mus musculus
caagcagcagccttggctcctgaga

SEQ ID NO: 79446 - DNA, 25 bp, mus musculus
cagccccgagggtctacaatcacca

SEQ ID NO: 79447 - DNA, 25 bp, mus musculus
cgagggtctacaatcaccagacagt

SEQ ID NO: 79448 - DNA, 25 bp, mus musculus
atcaccagacagtccagatctgatt

SEQ ID NO: 79449 - DNA, 25 bp, mus musculus
agacagtccagatctgattgacatt

SEQ ID NO: 79450 - DNA, 25 bp, mus musculus
tctgattgacattcctccgctcacc

SEQ ID NO: 79451 - DNA, 25 bp, mus musculus
ttctgttcctagctcagacagctgg

SEQ ID NO: 79452 - DNA, 25 bp, mus musculus
gccacagcgccactgtgtctgaaga

SEQ ID NO: 79453 - DNA, 25 bp, mus musculus
agcgccactgtgtctgaagaacgcg

SEQ ID NO: 79454 - DNA, 25 bp, mus musculus
ttcatcaacttctccctgataatga

SEQ ID NO: 79455 - DNA, 25 bp, mus musculus
catcaacttctccctgataatgaag

SEQ ID NO: 79456 - DNA, 25 bp, mus musculus
atcaacttctccctgataatgaagg

SEQ ID NO: 79457 - DNA, 25 bp, mus musculus
cttctccctgataatgaaggaaaat

SEQ ID NO: 79458 - DNA, 25 bp, mus musculus
ttctccctgataatgaaggaaaatt

SEQ ID NO: 79459 - DNA, 25 bp, mus musculus
aaattgcttctaggcctgatcccgg

SEQ ID NO: 79460 - DNA, 25 bp, mus musculus
aattgcttctaggcctgatcccgga

SEQ ID NO: 79461 - DNA, 25 bp, mus musculus
ttgcttctaggcctgatcccggaga

SEQ ID NO: 79462 - DNA, 25 bp, mus musculus
cttctaggcctgatcccggagaaat

SEQ ID NO: 79463 - DNA, 25 bp, mus musculus
ttctaggcctgatcccggagaaatt

SEQ ID NO: 79464 - DNA, 25 bp, mus musculus
caggcaacaagggcctttcacccag

SEQ ID NO: 79465 - DNA, 25 bp, mus musculus
tttcacccaggaaagcctcgccttg

SEQ ID NO: 79466 - DNA, 25 bp, mus musculus
ttcacccaggaaagcctcgccttgc

SEQ ID NO: 79467 - DNA, 25 bp, mus musculus
caggaaagcctcgccttgcccttca

SEQ ID NO: 79468 - DNA, 25 bp, mus musculus
ttgcccttcatcaacttctccctga

SEQ ID NO: 79469 - DNA, 25 bp, mus musculus
gcccttcatcaacttctccctgata

SEQ ID NO: 79470 - DNA, 25 bp, mus musculus
cccttcatcaacttctccctgataa

SEQ ID NO: 79471 - DNA, 25 bp, mus musculus
cttcatcaacttctccctgataatg

SEQ ID NO: 79472 - DNA, 25 bp, mus musculus
gagatctgtcactgtgtgaaggacg

SEQ ID NO: 79473 - DNA, 25 bp, mus musculus
cttaattactaagtcatctgtatta

SEQ ID NO: 79474 - DNA, 25 bp, mus musculus
ttttacatcagagctttataacgaa

SEQ ID NO: 79475 - DNA, 25 bp, mus musculus
tacatcagagctttataacgaactt

SEQ ID NO: 79476 - DNA, 25 bp, mus musculus
tttaattgcctggcaaatgctgata

SEQ ID NO: 79477 - DNA, 25 bp, mus musculus
aattgcctggcaaatgctgatatca

SEQ ID NO: 79478 - DNA, 25 bp, mus musculus
ttgctgaactcattacagccccgtt

SEQ ID NO: 79479 - DNA, 25 bp, mus musculus
aactcattacagccccgttatgtca

SEQ ID NO: 79480 - DNA, 25 bp, mus musculus
tcattacagccccgttatgtcactt

SEQ ID NO: 79481 - DNA, 25 bp, mus musculus
cagccccgttatgtcactttttgat

SEQ ID NO: 79482 - DNA, 25 bp, mus musculus
cgttatgtcactttttgattacaat

SEQ ID NO: 79483 - DNA, 25 bp, mus musculus
tatgtcactttttgattacaataaa

SEQ ID NO: 79484 - DNA, 25 bp, mus musculus
aattactaagtcatctgtattaaat

SEQ ID NO: 79485 - DNA, 25 bp, mus musculus
aagagattccagccttgtaaataat

SEQ ID NO: 79486 - DNA, 25 bp, mus musculus
agattccagccttgtaaataatgaa

SEQ ID NO: 79487 - DNA, 25 bp, mus musculus
ttccagccttgtaaataatgaatgg

SEQ ID NO: 79488 - DNA, 25 bp, mus musculus
atggaagaccctgtgctgcacttaa

SEQ ID NO: 79489 - DNA, 25 bp, mus musculus
gaagaccctgtgctgcacttaaaag

SEQ ID NO: 79490 - DNA, 25 bp, mus musculus
cctgtgctgcacttaaaagtatttg

SEQ ID NO: 79491 - DNA, 25 bp, mus musculus
aaagtatttgctgcttgattatttc

SEQ ID NO: 79492 - DNA, 25 bp, mus musculus
acgcagcttttctgcagcgtccgag

SEQ ID NO: 79493 - DNA, 25 bp, mus musculus
cttttctgcagcgtccgagcatcac

SEQ ID NO: 79494 - DNA, 25 bp, mus musculus
gccacacactaaagagcaacagagg

SEQ ID NO: 79495 - DNA, 25 bp, mus musculus
cttggtcacataccaggacgcagaa

SEQ ID NO: 79496 - DNA, 25 bp, mus musculus
aggacactatccaccaagtcctgca

SEQ ID NO: 79497 - DNA, 25 bp, mus musculus
ctatccaccaagtcctgcagacctg

SEQ ID NO: 79498 - DNA, 25 bp, mus musculus
accaagtcctgcagacctgaggatc

SEQ ID NO: 79499 - DNA, 25 bp, mus musculus
tcctgcagacctgaggatcaggacc

SEQ ID NO: 79500 - DNA, 25 bp, mus musculus
aatccccaagaccataggaacagcg

SEQ ID NO: 79501 - DNA, 25 bp, mus musculus
ccatcagacgctgggtccagaccca

SEQ ID NO: 79502 - DNA, 25 bp, mus musculus
cagagactggcaccctcttcagagt

SEQ ID NO: 79503 - DNA, 25 bp, mus musculus
ctggcaccctcttcagagttgtaca

SEQ ID NO: 79504 - DNA, 25 bp, mus musculus
tgcagcgtccgagcatcacctaagc

SEQ ID NO: 79505 - DNA, 25 bp, mus musculus
gtccgagcatcacctaagcccaaga

SEQ ID NO: 79506 - DNA, 25 bp, mus musculus
cctaagcccaagatcatctggatga

SEQ ID NO: 79507 - DNA, 25 bp, mus musculus
gtctccgagcaaggggtctgcaccc

SEQ ID NO: 79508 - DNA, 25 bp, mus musculus
gtctacacttgcaaggccatcaacg

SEQ ID NO: 79509 - DNA, 25 bp, mus musculus
acttgcaaggccatcaacgtgctag

SEQ ID NO: 79510 - DNA, 25 bp, mus musculus
gttaaagcttctgccacacactaaa

SEQ ID NO: 79511 - DNA, 25 bp, mus musculus
gcttctgccacacactaaagagcaa

SEQ ID NO: 79512 - DNA, 25 bp, mus musculus
cctttgacagcatgattgtagacaa

SEQ ID NO: 79513 - DNA, 25 bp, mus musculus
acacaacaatgcagctggtatcccg

SEQ ID NO: 79514 - DNA, 25 bp, mus musculus
tgcataccccagatattggaggcca

SEQ ID NO: 79515 - DNA, 25 bp, mus musculus
atattggaggccagggcaccacatc

SEQ ID NO: 79516 - DNA, 25 bp, mus musculus
ccatccaggacatcattcgtcatat

SEQ ID NO: 79517 - DNA, 25 bp, mus musculus
aggacatcattcgtcatatccgcat

SEQ ID NO: 79518 - DNA, 25 bp, mus musculus
tcattcgtcatatccgcatcattaa

SEQ ID NO: 79519 - DNA, 25 bp, mus musculus
gtcatatccgcatcattaatggacg

SEQ ID NO: 79520 - DNA, 25 bp, mus musculus
tttgctcagcttgtctgtaggactc

SEQ ID NO: 79521 - DNA, 25 bp, mus musculus
ctcttctcactttagcactccagct

SEQ ID NO: 79522 - DNA, 25 bp, mus musculus
tcactttagcactccagctagcttg

SEQ ID NO: 79523 - DNA, 25 bp, mus musculus
tagcactccagctagcttgggggac

SEQ ID NO: 79524 - DNA, 25 bp, mus musculus
caatgcagctggtatcccggcctca

SEQ ID NO: 79525 - DNA, 25 bp, mus musculus
tgatgcctaatctctatggtaacat

SEQ ID NO: 79526 - DNA, 25 bp, mus musculus
gtaacattgtcaacaacgtctgtgc

SEQ ID NO: 79527 - DNA, 25 bp, mus musculus
ctggggccaactatggccatgtgta

SEQ ID NO: 79528 - DNA, 25 bp, mus musculus
ccaactatggccatgtgtatgcagt

SEQ ID NO: 79529 - DNA, 25 bp, mus musculus
tattcgagacagctacaaggaacac

SEQ ID NO: 79530 - DNA, 25 bp, mus musculus
cgactgccacactgctagcaagctg

SEQ ID NO: 79531 - DNA, 25 bp, mus musculus
ccatccgcaaagctgtcttagcatc

SEQ ID NO: 79532 - DNA, 25 bp, mus musculus
agatgtcagtcctgaaactattttt

SEQ ID NO: 79533 - DNA, 25 bp, mus musculus
tgtcagtcctgaaactatttttcag

SEQ ID NO: 79534 - DNA, 25 bp, mus musculus
cttagaatctctcacagctgattgc

SEQ ID NO: 79535 - DNA, 25 bp, mus musculus
agaatctctcacagctgattgcaac

SEQ ID NO: 79536 - DNA, 25 bp, mus musculus
atctctcacagctgattgcaaccag

SEQ ID NO: 79537 - DNA, 25 bp, mus musculus
cacagctgattgcaaccaggattat

SEQ ID NO: 79538 - DNA, 25 bp, mus musculus
tgattgcaaccaggattatgattac

SEQ ID NO: 79539 - DNA, 25 bp, mus musculus
tgatctgaactgaatcctatatgac

SEQ ID NO: 79540 - DNA, 25 bp, mus musculus
ctgaatcctatatgacttcatcaac

SEQ ID NO: 79541 - DNA, 25 bp, mus musculus
atatgacttcatcaacattagtaga

SEQ ID NO: 79542 - DNA, 25 bp, mus musculus
tgacttcatcaacattagtagaaac

SEQ ID NO: 79543 - DNA, 25 bp, mus musculus
cttcatcaacattagtagaaacagt

SEQ ID NO: 79544 - DNA, 25 bp, mus musculus
cagtcctgaaactatttttcagata

SEQ ID NO: 79545 - DNA, 25 bp, mus musculus
cacttatgcctatgaagggaatgat

SEQ ID NO: 79546 - DNA, 25 bp, mus musculus
ttctgttgccaattctctcagctcc

SEQ ID NO: 79547 - DNA, 25 bp, mus musculus
tgttgccaattctctcagctcctta

SEQ ID NO: 79548 - DNA, 25 bp, mus musculus
tgccaattctctcagctccttagaa

SEQ ID NO: 79549 - DNA, 25 bp, mus musculus
ttctctcagctccttagaatctctc

SEQ ID NO: 79550 - DNA, 25 bp, mus musculus
tctcagctccttagaatctctcaca

SEQ ID NO: 79551 - DNA, 25 bp, mus musculus
cagctccttagaatctctcacagct

SEQ ID NO: 79552 - DNA, 25 bp, mus musculus
tgcagtcctgtagtgctgaagccct

SEQ ID NO: 79553 - DNA, 25 bp, mus musculus
cctgtagtgctgaagccctgctcct

SEQ ID NO: 79554 - DNA, 25 bp, mus musculus
agcctctaattctatccaaggagga

SEQ ID NO: 79555 - DNA, 25 bp, mus musculus
gagacaacatcgtgagctataacga

SEQ ID NO: 79556 - DNA, 25 bp, mus musculus
tgagaaaccctgcagctatcgagga

SEQ ID NO: 79557 - DNA, 25 bp, mus musculus
agctccgccgagatataattcctga

SEQ ID NO: 79558 - DNA, 25 bp, mus musculus
atttcattaacgagcgactcaaaga

SEQ ID NO: 79559 - DNA, 25 bp, mus musculus
acgactcactggctacctacgccta

SEQ ID NO: 79560 - DNA, 25 bp, mus musculus
tggccgaatctctgagctctttaga

SEQ ID NO: 79561 - DNA, 25 bp, mus musculus
aatctctgagctctttagaatcagg

SEQ ID NO: 79562 - DNA, 25 bp, mus musculus
aatcaggtaccactgaaggagacca

SEQ ID NO: 79563 - DNA, 25 bp, mus musculus
aagattcttagcctggcgcctgtgt

SEQ ID NO: 79564 - DNA, 25 bp, mus musculus
ggcctcacactggcgccttgatcgc

SEQ ID NO: 79565 - DNA, 25 bp, mus musculus
ttagcctggcgcctgtgttataaaa

SEQ ID NO: 79566 - DNA, 25 bp, mus musculus
acactggcgccttgatcgccattct

SEQ ID NO: 79567 - DNA, 25 bp, mus musculus
tgatcgccattctcctctgcatcat

SEQ ID NO: 79568 - DNA, 25 bp, mus musculus
tcctctgcatcattattctgctggt

SEQ ID NO: 79569 - DNA, 25 bp, mus musculus
gcatcattattctgctggttatagt

SEQ ID NO: 79570 - DNA, 25 bp, mus musculus
ttatagtagtcctctttgcagccct

SEQ ID NO: 79571 - DNA, 25 bp, mus musculus
tagtcctctttgcagccctcaaaga

SEQ ID NO: 79572 - DNA, 25 bp, mus musculus
tcaaagagcctctaattctatccaa

SEQ ID NO: 79573 - DNA, 25 bp, mus musculus
tgttttcgagcgctttgctgcaagg

SEQ ID NO: 79574 - DNA, 25 bp, mus musculus
tttcgagcgctttgctgcaagggac

SEQ ID NO: 79575 - DNA, 25 bp, mus musculus
gtgccattccagaatgccgttttga

SEQ ID NO: 79576 - DNA, 25 bp, mus musculus
ccattccagaatgccgttttgaatg

SEQ ID NO: 79577 - DNA, 25 bp, mus musculus
ttccagaatgccgttttgaatgtaa

SEQ ID NO: 79578 - DNA, 25 bp, mus musculus
gacaatatccggaaatactggagcc

SEQ ID NO: 79579 - DNA, 25 bp, mus musculus
tactggagccgctactaccaaggat

SEQ ID NO: 79580 - DNA, 25 bp, mus musculus
tggagccgctactaccaaggatctc

SEQ ID NO: 79581 - DNA, 25 bp, mus musculus
agccgctactaccaaggatctcaag

SEQ ID NO: 79582 - DNA, 25 bp, mus musculus
cgctactaccaaggatctcaagggg

SEQ ID NO: 79583 - DNA, 25 bp, mus musculus
taccaaggatctcaaggggtcatat

SEQ ID NO: 79584 - DNA, 25 bp, mus musculus
gtattagacagtgcctcttcagagg

SEQ ID NO: 79585 - DNA, 25 bp, mus musculus
cctgcgcgccctgaatatgacttgg

SEQ ID NO: 79586 - DNA, 25 bp, mus musculus
ttagacagtgcctcttcagaggatg

SEQ ID NO: 79587 - DNA, 25 bp, mus musculus
gcgcgccctgaatatgacttggttt

SEQ ID NO: 79588 - DNA, 25 bp, mus musculus
tatgacttggtttgcataggtctca

SEQ ID NO: 79589 - DNA, 25 bp, mus musculus
gtttgcataggtctcacgggctccg

SEQ ID NO: 79590 - DNA, 25 bp, mus musculus
tgcataggtctcacgggctccggga

SEQ ID NO: 79591 - DNA, 25 bp, mus musculus
tccgggaaaaccagcctgctgtccg

SEQ ID NO: 79592 - DNA, 25 bp, mus musculus
gggaaaaccagcctgctgtccgagc

SEQ ID NO: 79593 - DNA, 25 bp, mus musculus
aaggcagtgccattccagaatgccg

SEQ ID NO: 79594 - DNA, 25 bp, mus musculus
agactactacagtcacctgaagaag

SEQ ID NO: 79595 - DNA, 25 bp, mus musculus
ctacagtcacctgaagaaggagagt

SEQ ID NO: 79596 - DNA, 25 bp, mus musculus
tcttctcctctatgccgaatccttg

SEQ ID NO: 79597 - DNA, 25 bp, mus musculus
tctcctctatgccgaatccttggtg

SEQ ID NO: 79598 - DNA, 25 bp, mus musculus
cctctatgccgaatccttggtggcc

SEQ ID NO: 79599 - DNA, 25 bp, mus musculus
tgccgaatccttggtggccactgcc

SEQ ID NO: 79600 - DNA, 25 bp, mus musculus
cgaatccttggtggccactgcccct

SEQ ID NO: 79601 - DNA, 25 bp, mus musculus
tcatctgttagatgtggctgttttg

SEQ ID NO: 79602 - DNA, 25 bp, mus musculus
agatgtggctgttttgcgtagcatt

SEQ ID NO: 79603 - DNA, 25 bp, mus musculus
tgttttgcgtagcattgtgtgctgc

SEQ ID NO: 79604 - DNA, 25 bp, mus musculus
tttgcgtagcattgtgtgctgcccc

SEQ ID NO: 79605 - DNA, 25 bp, mus musculus
atatctatatgatgctctttaaaaa

SEQ ID NO: 79606 - DNA, 25 bp, mus musculus
gagctgcgatccagacagcacccac

SEQ ID NO: 79607 - DNA, 25 bp, mus musculus
ctgctccttcatccagaccttggag

SEQ ID NO: 79608 - DNA, 25 bp, mus musculus
ctccttcatccagaccttggaggac

SEQ ID NO: 79609 - DNA, 25 bp, mus musculus
ctgcccgcttgcagagctcctgcag

SEQ ID NO: 79610 - DNA, 25 bp, mus musculus
aaagtgcacagtatcttggaccagg

SEQ ID NO: 79611 - DNA, 25 bp, mus musculus
cacagtatcttggaccaggtccctc

SEQ ID NO: 79612 - DNA, 25 bp, mus musculus
atcccctgcttttcttctcctctat

SEQ ID NO: 79613 - DNA, 25 bp, mus musculus
tgcttttcttctcctctatgccgaa

SEQ ID NO: 79614 - DNA, 25 bp, mus musculus
gagaattcctggccaagcagttacc

SEQ ID NO: 79615 - DNA, 25 bp, mus musculus
agaattcctggccaagcagttacct

SEQ ID NO: 79616 - DNA, 25 bp, mus musculus
ctgccctgcctgtgtggccatccgg

SEQ ID NO: 79617 - DNA, 25 bp, mus musculus
ccctgcctgtgtggccatccgggat

SEQ ID NO: 79618 - DNA, 25 bp, mus musculus
cctgtgtggccatccgggatctcaa

SEQ ID NO: 79619 - DNA, 25 bp, mus musculus
ctgtgtggccatccgggatctcaac

SEQ ID NO: 79620 - DNA, 25 bp, mus musculus
tgtggccatccgggatctcaacatt

SEQ ID NO: 79621 - DNA, 25 bp, mus musculus
tggccatccgggatctcaacattag

SEQ ID NO: 79622 - DNA, 25 bp, mus musculus
ggccatccgggatctcaacattagg

SEQ ID NO: 79623 - DNA, 25 bp, mus musculus
ccatccgggatctcaacattaggga

SEQ ID NO: 79624 - DNA, 25 bp, mus musculus
catccgggatctcaacattagggag

SEQ ID NO: 79625 - DNA, 25 bp, mus musculus
tccgggatctcaacattagggagaa

SEQ ID NO: 79626 - DNA, 25 bp, mus musculus
aattcctggccaagcagttacctgg

SEQ ID NO: 79627 - DNA, 25 bp, mus musculus
attcctggccaagcagttacctggc

SEQ ID NO: 79628 - DNA, 25 bp, mus musculus
tcctggccaagcagttacctggcgc

SEQ ID NO: 79629 - DNA, 25 bp, mus musculus
cctggccaagcagttacctggcgcg

SEQ ID NO: 79630 - DNA, 25 bp, mus musculus
tggccaagcagttacctggcgcggc

SEQ ID NO: 79631 - DNA, 25 bp, mus musculus
ggccaagcagttacctggcgcggct

SEQ ID NO: 79632 - DNA, 25 bp, mus musculus
ctgcattggtccaaacattgaattt

SEQ ID NO: 79633 - DNA, 25 bp, mus musculus
tgcattggtccaaacattgaattta

SEQ ID NO: 79634 - DNA, 25 bp, mus musculus
gggtatccaagctgcagagagacct

SEQ ID NO: 79635 - DNA, 25 bp, mus musculus
agctgcagagagacctctcagagat

SEQ ID NO: 79636 - DNA, 25 bp, mus musculus
cagcttctgctatgagagctaaaag

SEQ ID NO: 79637 - DNA, 25 bp, mus musculus
tgaatgtccacgactacacaacctt

SEQ ID NO: 79638 - DNA, 25 bp, mus musculus
atcaggcaatccagttatcccagag

SEQ ID NO: 79639 - DNA, 25 bp, mus musculus
caatccagttatcccagagcatgaa

SEQ ID NO: 79640 - DNA, 25 bp, mus musculus
tccagttatcccagagcatgaatca

SEQ ID NO: 79641 - DNA, 25 bp, mus musculus
agttatcccagagcatgaatcaccg

SEQ ID NO: 79642 - DNA, 25 bp, mus musculus
gcatgaatcaccgaatttcagaact

SEQ ID NO: 79643 - DNA, 25 bp, mus musculus
atcaccgaatttcagaactgtccac

SEQ ID NO: 79644 - DNA, 25 bp, mus musculus
gaatttcagaactgtccactcactt

SEQ ID NO: 79645 - DNA, 25 bp, mus musculus
cagaactgtccactcactttaaagt

SEQ ID NO: 79646 - DNA, 25 bp, mus musculus
acctctcagagatgcatctgtcttt

SEQ ID NO: 79647 - DNA, 25 bp, mus musculus
agatgcatctgtctttgactccgca

SEQ ID NO: 79648 - DNA, 25 bp, mus musculus
ctttgactccgcaatggtcctcctg

SEQ ID NO: 79649 - DNA, 25 bp, mus musculus
tgactccgcaatggtcctcctggac

SEQ ID NO: 79650 - DNA, 25 bp, mus musculus
ggtcctcctggacagtactcttgct

SEQ ID NO: 79651 - DNA, 25 bp, mus musculus
ggacagtactcttgctgctagtgtc

SEQ ID NO: 79652 - DNA, 25 bp, mus musculus
tactcttgctgctagtgtccaacct

SEQ ID NO: 79653 - DNA, 25 bp, mus musculus
ccaacctgcttctgtgggagaacac

SEQ ID NO: 79654 - DNA, 25 bp, mus musculus
tataatgcaactcagtccaagtacc

SEQ ID NO: 79655 - DNA, 25 bp, mus musculus
cagtccaagtaccgggaccgctgca

SEQ ID NO: 79656 - DNA, 25 bp, mus musculus
tttgtggacatggccatgctcgtag

SEQ ID NO: 79657 - DNA, 25 bp, mus musculus
gacatggccatgctcgtagagagcc

SEQ ID NO: 79658 - DNA, 25 bp, mus musculus
atgatcgaccgaattgagtacaacg

SEQ ID NO: 79659 - DNA, 25 bp, mus musculus
tccgtggactacgtggaacgagccg

SEQ ID NO: 79660 - DNA, 25 bp, mus musculus
cgagccgtgtctgacaccaagaaag

SEQ ID NO: 79661 - DNA, 25 bp, mus musculus
gtgtctgacaccaagaaagctgtga

SEQ ID NO: 79662 - DNA, 25 bp, mus musculus
tctgacaccaagaaagctgtgaagt

SEQ ID NO: 79663 - DNA, 25 bp, mus musculus
attatgatcatcatttgctgtgtgg

SEQ ID NO: 79664 - DNA, 25 bp, mus musculus
atcatcatttgctgtgtggtgctgg

SEQ ID NO: 79665 - DNA, 25 bp, mus musculus
gtggtcttggcgtcatccattgggg

SEQ ID NO: 79666 - DNA, 25 bp, mus musculus
cgctgcaaggaccgaatccagaggc

SEQ ID NO: 79667 - DNA, 25 bp, mus musculus
actggcaggactactaccaatgaag

SEQ ID NO: 79668 - DNA, 25 bp, mus musculus
aggactactaccaatgaagaactag

SEQ ID NO: 79669 - DNA, 25 bp, mus musculus
aagctggccatcttcactgatgata

SEQ ID NO: 79670 - DNA, 25 bp, mus musculus
ctggccatcttcactgatgatatca

SEQ ID NO: 79671 - DNA, 25 bp, mus musculus
atcttcactgatgatatcaaaatgg

SEQ ID NO: 79672 - DNA, 25 bp, mus musculus
aaactggaaaccagcattcgagagc

SEQ ID NO: 79673 - DNA, 25 bp, mus musculus
attcgagagctgcacgacatgtttg

SEQ ID NO: 79674 - DNA, 25 bp, mus musculus
tccattgcatcgtcccaaggaggaa

SEQ ID NO: 79675 - DNA, 25 bp, mus musculus
cattgcatcgtcccaaggaggaagg

SEQ ID NO: 79676 - DNA, 25 bp, mus musculus
gtcactcgtttcattcaaggccttc

SEQ ID NO: 79677 - DNA, 25 bp, mus musculus
cagctgcactctatggctaggtgca

SEQ ID NO: 79678 - DNA, 25 bp, mus musculus
cactctatggctaggtgcagtgtct

SEQ ID NO: 79679 - DNA, 25 bp, mus musculus
cccggtgcctttctagccatctact

SEQ ID NO: 79680 - DNA, 25 bp, mus musculus
cggtgcctttctagccatctactgt

SEQ ID NO: 79681 - DNA, 25 bp, mus musculus
tttaaaacatgctacaatcatgctg

SEQ ID NO: 79682 - DNA, 25 bp, mus musculus
ttaaaacatgctacaatcatgctga

SEQ ID NO: 79683 - DNA, 25 bp, mus musculus
acatgctacaatcatgctgaaaata

SEQ ID NO: 79684 - DNA, 25 bp, mus musculus
catgctacaatcatgctgaaaatag

SEQ ID NO: 79685 - DNA, 25 bp, mus musculus
tgctacaatcatgctgaaaatagta

SEQ ID NO: 79686 - DNA, 25 bp, mus musculus
attgcatcgtcccaaggaggaaggc

SEQ ID NO: 79687 - DNA, 25 bp, mus musculus
tgcatcgtcccaaggaggaaggcaa

SEQ ID NO: 79688 - DNA, 25 bp, mus musculus
tcgtcccaaggaggaaggcaaagcg

SEQ ID NO: 79689 - DNA, 25 bp, mus musculus
ggcctgcagggtcactcgtttcatt

SEQ ID NO: 79690 - DNA, 25 bp, mus musculus
gcctgcagggtcactcgtttcattc

SEQ ID NO: 79691 - DNA, 25 bp, mus musculus
tgcagggtcactcgtttcattcaag

SEQ ID NO: 79692 - DNA, 25 bp, mus musculus
cagggtcactcgtttcattcaaggc

SEQ ID NO: 79693 - DNA, 25 bp, mus musculus
ggtcactcgtttcattcaaggcctt

SEQ ID NO: 79694 - DNA, 25 bp, mus musculus
gattgtctctggcctgtatgagctt

SEQ ID NO: 79695 - DNA, 25 bp, mus musculus
tgagctttttcccgaaaatgagcag

SEQ ID NO: 79696 - DNA, 25 bp, mus musculus
gatggattcactcgtgcgtgatgcc

SEQ ID NO: 79697 - DNA, 25 bp, mus musculus
ttcactcgtgcgtgatgccggattt

SEQ ID NO: 79698 - DNA, 25 bp, mus musculus
cgtgcgtgatgccggatttgataaa

SEQ ID NO: 79699 - DNA, 25 bp, mus musculus
tgataaatgcacacaacggattgat

SEQ ID NO: 79700 - DNA, 25 bp, mus musculus
taactgaacgtcggaacgtattgct

SEQ ID NO: 79701 - DNA, 25 bp, mus musculus
tattgctacaaggcgctggctggtt

SEQ ID NO: 79702 - DNA, 25 bp, mus musculus
gcgctggctggttattgttgctggc

SEQ ID NO: 79703 - DNA, 25 bp, mus musculus
tcttcacctatggatctcttaatca

SEQ ID NO: 79704 - DNA, 25 bp, mus musculus
gatctcttaatcagttcaccgcggt

SEQ ID NO: 79705 - DNA, 25 bp, mus musculus
ttaatcagttcaccgcggttcagga

SEQ ID NO: 79706 - DNA, 25 bp, mus musculus
aaactcactcgcaggtcttgccaat

SEQ ID NO: 79707 - DNA, 25 bp, mus musculus
tcaggaccttaacagccatgatatc

SEQ ID NO: 79708 - DNA, 25 bp, mus musculus
actcgcaggtcttgccaatgccatc

SEQ ID NO: 79709 - DNA, 25 bp, mus musculus
aggtcttgccaatgccatcgaaccg

SEQ ID NO: 79710 - DNA, 25 bp, mus musculus
tgccaatgccatcgaaccgggcggc

SEQ ID NO: 79711 - DNA, 25 bp, mus musculus
cgaaccgggcggcattctcatctac

SEQ ID NO: 79712 - DNA, 25 bp, mus musculus
cattctcatctacaccgggcagccg

SEQ ID NO: 79713 - DNA, 25 bp, mus musculus
catctacaccgggcagccgtggcac

SEQ ID NO: 79714 - DNA, 25 bp, mus musculus
ccctcaactggagatgattgccggg

SEQ ID NO: 79715 - DNA, 25 bp, mus musculus
ctccagatgccttaaactatgcaca

SEQ ID NO: 79716 - DNA, 25 bp, mus musculus
taaactatgcacaaagctaagtgac

SEQ ID NO: 79717 - DNA, 25 bp, mus musculus
ggctctgggcacactcgtttaaaca

SEQ ID NO: 79718 - DNA, 25 bp, mus musculus
ctgccgcttcaccttctgattgaca

SEQ ID NO: 79719 - DNA, 25 bp, mus musculus
cttcaccttctgattgacaaataaa

SEQ ID NO: 79720 - DNA, 25 bp, mus musculus
tctttgctcattggttaacctttgc

SEQ ID NO: 79721 - DNA, 25 bp, mus musculus
ttgctcattggttaacctttgcact

SEQ ID NO: 79722 - DNA, 25 bp, mus musculus
ctcattggttaacctttgcactcta

SEQ ID NO: 79723 - DNA, 25 bp, mus musculus
tctaccttaccactcagtcctgttg

SEQ ID NO: 79724 - DNA, 25 bp, mus musculus
ccactcagtcctgttggaagtgaca

SEQ ID NO: 79725 - DNA, 25 bp, mus musculus
ctcagtcctgttggaagtgacatgc

SEQ ID NO: 79726 - DNA, 25 bp, mus musculus
ttcagtcctgggtattttgaagtct

SEQ ID NO: 79727 - DNA, 25 bp, mus musculus
actatgcacaaagctaagtgaccaa

SEQ ID NO: 79728 - DNA, 25 bp, mus musculus
tgaccaaacttctcattttgatttg

SEQ ID NO: 79729 - DNA, 25 bp, mus musculus
ccctttggcgaccttttgatgtgca

SEQ ID NO: 79730 - DNA, 25 bp, mus musculus
tttggcgaccttttgatgtgcagta

SEQ ID NO: 79731 - DNA, 25 bp, mus musculus
gaccttttgatgtgcagtagatcgt

SEQ ID NO: 79732 - DNA, 25 bp, mus musculus
gttttcagtggtcttatgtagagca

SEQ ID NO: 79733 - DNA, 25 bp, mus musculus
attatgtttacagtttgttgcaaca

SEQ ID NO: 79734 - DNA, 25 bp, mus musculus
tttacagtttgttgcaacagccatc

SEQ ID NO: 79735 - DNA, 25 bp, mus musculus
tactttctaagtgccatgtttagga

SEQ ID NO: 79736 - DNA, 25 bp, mus musculus
tttctaagtgccatgtttaggacct

SEQ ID NO: 79737 - DNA, 25 bp, mus musculus
cgttcatgtatgactgccgctcctt

SEQ ID NO: 79738 - DNA, 25 bp, mus musculus
gccgctcctttctttcaaggacagt

SEQ ID NO: 79739 - DNA, 25 bp, mus musculus
gctcctttctttcaaggacagtgtt

SEQ ID NO: 79740 - DNA, 25 bp, mus musculus
gtcaagctactaaaccccatgttgg

SEQ ID NO: 79741 - DNA, 25 bp, mus musculus
aagctactaaaccccatgttggctg

SEQ ID NO: 79742 - DNA, 25 bp, mus musculus
ctactaaaccccatgttggctgctg

SEQ ID NO: 79743 - DNA, 25 bp, mus musculus
ctaaaccccatgttggctgctgctg

SEQ ID NO: 79744 - DNA, 25 bp, mus musculus
ttttcatctttccagggaatatatt

SEQ ID NO: 79745 - DNA, 25 bp, mus musculus
tctttccagggaatatattgattgg

SEQ ID NO: 79746 - DNA, 25 bp, mus musculus
gaacatctatttttctacaaaactg

SEQ ID NO: 79747 - DNA, 25 bp, mus musculus
agtgccatgtttaggacctgatcat

SEQ ID NO: 79748 - DNA, 25 bp, mus musculus
tttaggacctgatcattccaagttt

SEQ ID NO: 79749 - DNA, 25 bp, mus musculus
aggacctgatcattccaagtttcac

SEQ ID NO: 79750 - DNA, 25 bp, mus musculus
acctgatcattccaagtttcacgtt

SEQ ID NO: 79751 - DNA, 25 bp, mus musculus
tcattccaagtttcacgttcatgta

SEQ ID NO: 79752 - DNA, 25 bp, mus musculus
ttccaagtttcacgttcatgtatga

SEQ ID NO: 79753 - DNA, 25 bp, mus musculus
caagtttcacgttcatgtatgactg

SEQ ID NO: 79754 - DNA, 25 bp, mus musculus
gtttcacgttcatgtatgactgccg

SEQ ID NO: 79755 - DNA, 25 bp, mus musculus
tgtggccatcttgatctacctgctg

SEQ ID NO: 79756 - DNA, 25 bp, mus musculus
catcttgatctacctgctgttctac

SEQ ID NO: 79757 - DNA, 25 bp, mus musculus
tgcacctgacttcctcatacacctg

SEQ ID NO: 79758 - DNA, 25 bp, mus musculus
tgacttcctcatacacctgaatata

SEQ ID NO: 79759 - DNA, 25 bp, mus musculus
cctcatacacctgaatataagccac

SEQ ID NO: 79760 - DNA, 25 bp, mus musculus
aagccacaaacatcatgagagctgc

SEQ ID NO: 79761 - DNA, 25 bp, mus musculus
tcatgagagctgcacaggtgcacca

SEQ ID NO: 79762 - DNA, 25 bp, mus musculus
gagctgcacaggtgcaccaggatac

SEQ ID NO: 79763 - DNA, 25 bp, mus musculus
tgcaccaggatactggtgaatccat

SEQ ID NO: 79764 - DNA, 25 bp, mus musculus
tatgcccctgctgccctgattagct

SEQ ID NO: 79765 - DNA, 25 bp, mus musculus
cctgctgccctgattagctgaagct

SEQ ID NO: 79766 - DNA, 25 bp, mus musculus
gccctgattagctgaagctgcgtgc

SEQ ID NO: 79767 - DNA, 25 bp, mus musculus
gatctacctgctgttctacagaaag

SEQ ID NO: 79768 - DNA, 25 bp, mus musculus
cctgctgttctacagaaagggcttt

SEQ ID NO: 79769 - DNA, 25 bp, mus musculus
ggcatcaactttgctaaggttctgt

SEQ ID NO: 79770 - DNA, 25 bp, mus musculus
aactttgctaaggttctgttgtgtg

SEQ ID NO: 79771 - DNA, 25 bp, mus musculus
cagtaccaaaggcaccagggactgc

SEQ ID NO: 79772 - DNA, 25 bp, mus musculus
caccagggactgcagctaagtctta

SEQ ID NO: 79773 - DNA, 25 bp, mus musculus
cagctaagtcttatggcttgcacct

SEQ ID NO: 79774 - DNA, 25 bp, mus musculus
agtcttatggcttgcacctgacttc

SEQ ID NO: 79775 - DNA, 25 bp, mus musculus
catgctggctgcagcagcctcaacg

SEQ ID NO: 79776 - DNA, 25 bp, mus musculus
ggctgcagcagcctcaacgtgagct

SEQ ID NO: 79777 - DNA, 25 bp, mus musculus
tccgcatcggccaagacaggctcct

SEQ ID NO: 79778 - DNA, 25 bp, mus musculus
tcggccaagacaggctcctgcccta

SEQ ID NO: 79779 - DNA, 25 bp, mus musculus
gccaagacaggctcctgccctacat

SEQ ID NO: 79780 - DNA, 25 bp, mus musculus
aagacaggctcctgccctacatcct

SEQ ID NO: 79781 - DNA, 25 bp, mus musculus
acatcctgtgcacagctgctgctcc

SEQ ID NO: 79782 - DNA, 25 bp, mus musculus
tcctgtgcacagctgctgctcccgt

SEQ ID NO: 79783 - DNA, 25 bp, mus musculus
tgtgcacagctgctgctcccgtcca

SEQ ID NO: 79784 - DNA, 25 bp, mus musculus
atctcctttgtggcactcattgcct

SEQ ID NO: 79785 - DNA, 25 bp, mus musculus
cccctctacatgatggtcctacgtg

SEQ ID NO: 79786 - DNA, 25 bp, mus musculus
atggtcctacgtgtggtgaaccagg

SEQ ID NO: 79787 - DNA, 25 bp, mus musculus
agcagcctcaacgtgagctcagcag

SEQ ID NO: 79788 - DNA, 25 bp, mus musculus
gtgagctcagcagcttctaagcaac

SEQ ID NO: 79789 - DNA, 25 bp, mus musculus
aagcaaccaatctatttgaactgta

SEQ ID NO: 79790 - DNA, 25 bp, mus musculus
caaccaatctatttgaactgtagct

SEQ ID NO: 79791 - DNA, 25 bp, mus musculus
ccaatctatttgaactgtagctgtg

SEQ ID NO: 79792 - DNA, 25 bp, mus musculus
tatttgaactgtagctgtgtgactg

SEQ ID NO: 79793 - DNA, 25 bp, mus musculus
aactgtagctgtgtgactggaggat

SEQ ID NO: 79794 - DNA, 25 bp, mus musculus
ggatccgcatcggccaagacaggct

SEQ ID NO: 79795 - DNA, 25 bp, mus musculus
cagatatcccaggagagtccatagt

SEQ ID NO: 79796 - DNA, 25 bp, mus musculus
tgtacactctcaagtcctctagaga

SEQ ID NO: 79797 - DNA, 25 bp, mus musculus
ctgtcaatcacgtgagtacccaggc

SEQ ID NO: 79798 - DNA, 25 bp, mus musculus
atcacgtgagtacccaggctctatg

SEQ ID NO: 79799 - DNA, 25 bp, mus musculus
acgatgcatccagtggcttactagc

SEQ ID NO: 79800 - DNA, 25 bp, mus musculus
gtggcttactagctgcagattcagg

SEQ ID NO: 79801 - DNA, 25 bp, mus musculus
tactagctgcagattcaggccgaca

SEQ ID NO: 79802 - DNA, 25 bp, mus musculus
ctgcagattcaggccgacagcaact

SEQ ID NO: 79803 - DNA, 25 bp, mus musculus
attcaggccgacagcaacttcaaca

SEQ ID NO: 79804 - DNA, 25 bp, mus musculus
agcaacttcaacagaccagtcacag

SEQ ID NO: 79805 - DNA, 25 bp, mus musculus
ttcaacagaccagtcacagactatt

SEQ ID NO: 79806 - DNA, 25 bp, mus musculus
agaccagtcacagactattcagccg

SEQ ID NO: 79807 - DNA, 25 bp, mus musculus
ctctcaagtcctctagagactacta

SEQ ID NO: 79808 - DNA, 25 bp, mus musculus
agtcctctagagactactacacgga

SEQ ID NO: 79809 - DNA, 25 bp, mus musculus
ctagagactactacacggacggcgc

SEQ ID NO: 79810 - DNA, 25 bp, mus musculus
catacttcagaactggttctgctca

SEQ ID NO: 79811 - DNA, 25 bp, mus musculus
ctggttctgctcacactctctccat

SEQ ID NO: 79812 - DNA, 25 bp, mus musculus
acactctctccatggtgcatctaga

SEQ ID NO: 79813 - DNA, 25 bp, mus musculus
ggctcaagcgacctgtcaatcacgt

SEQ ID NO: 79814 - DNA, 25 bp, mus musculus
agcgacctgtcaatcacgtgagtac

SEQ ID NO: 79815 - DNA, 25 bp, mus musculus
cagcaaacaggcgggcaggcacatc

SEQ ID NO: 79816 - DNA, 25 bp, mus musculus
gcacatctcagagctaagtagtcca

SEQ ID NO: 79817 - DNA, 25 bp, mus musculus
ctagaacaccttaggcattatagga

SEQ ID NO: 79818 - DNA, 25 bp, mus musculus
ctgcctcctgatagaggatgagaaa

SEQ ID NO: 79819 - DNA, 25 bp, mus musculus
agaagacacaaactccaaggtggtg

SEQ ID NO: 79820 - DNA, 25 bp, mus musculus
tgtggcggcactcaggacagagttt

SEQ ID NO: 79821 - DNA, 25 bp, mus musculus
tcgccaccactgagtctcactggag

SEQ ID NO: 79822 - DNA, 25 bp, mus musculus
agtctcactggagaggcacattagt

SEQ ID NO: 79823 - DNA, 25 bp, mus musculus
cattagtccttgtcaccaacaggaa

SEQ ID NO: 79824 - DNA, 25 bp, mus musculus
tccttgtcaccaacaggaaactgag

SEQ ID NO: 79825 - DNA, 25 bp, mus musculus
tcaccaacaggaaactgagtgatgg

SEQ ID NO: 79826 - DNA, 25 bp, mus musculus
gtgatggaccctcacttcacagctt

SEQ ID NO: 79827 - DNA, 25 bp, mus musculus
tagtccaaagccagcacctggccct

SEQ ID NO: 79828 - DNA, 25 bp, mus musculus
caataaacagcacctgatgcagtcc

SEQ ID NO: 79829 - DNA, 25 bp, mus musculus
tggccctgggcaactagaaacattg

SEQ ID NO: 79830 - DNA, 25 bp, mus musculus
gatggaaccactcagggctatccag

SEQ ID NO: 79831 - DNA, 25 bp, mus musculus
accactcagggctatccaggaacct

SEQ ID NO: 79832 - DNA, 25 bp, mus musculus
cagggctatccaggaacctcgatcg

SEQ ID NO: 79833 - DNA, 25 bp, mus musculus
tatccaggaacctcgatcgagcaga

SEQ ID NO: 79834 - DNA, 25 bp, mus musculus
gttgagtcccaaatgccaaagccat

SEQ ID NO: 79835 - DNA, 25 bp, mus musculus
tcccaaatgccaaagccattcaacc

SEQ ID NO: 79836 - DNA, 25 bp, mus musculus
ggacagctattcttctgacagacac

SEQ ID NO: 79837 - DNA, 25 bp, mus musculus
ttctgacagacacttatctcagtac

SEQ ID NO: 79838 - DNA, 25 bp, mus musculus
aagctccgagcacacacatcataaa

SEQ ID NO: 79839 - DNA, 25 bp, mus musculus
cacacatcataaatcctccagggat

SEQ ID NO: 79840 - DNA, 25 bp, mus musculus
gtatctctcagattggcagttggac

SEQ ID NO: 79841 - DNA, 25 bp, mus musculus
ttggcagttggaccaccgagctgcc

SEQ ID NO: 79842 - DNA, 25 bp, mus musculus
gttggaccaccgagctgccagcagt

SEQ ID NO: 79843 - DNA, 25 bp, mus musculus
agatcagaggtctccatatggctcc

SEQ ID NO: 79844 - DNA, 25 bp, mus musculus
gaggtctccatatggctccaggtcc

SEQ ID NO: 79845 - DNA, 25 bp, mus musculus
cccatttgaacattcagctgaacac

SEQ ID NO: 79846 - DNA, 25 bp, mus musculus
tgaacattcagctgaacacagaagt

SEQ ID NO: 79847 - DNA, 25 bp, mus musculus
tgaacacagaagtacgcctgaacac

SEQ ID NO: 79848 - DNA, 25 bp, mus musculus
cttatctcagtaccatgatcatcac

SEQ ID NO: 79849 - DNA, 25 bp, mus musculus
tcagtaccatgatcatcacaaggac

SEQ ID NO: 79850 - DNA, 25 bp, mus musculus
ccatgatcatcacaaggaccgccat

SEQ ID NO: 79851 - DNA, 25 bp, mus musculus
ctactcctcatttagcaatggcaaa

SEQ ID NO: 79852 - DNA, 25 bp, mus musculus
tgaccaccgatctcactcggaccat

SEQ ID NO: 79853 - DNA, 25 bp, mus musculus
tcactcggaccatcgaatgcactca

SEQ ID NO: 79854 - DNA, 25 bp, mus musculus
ggaccatcgaatgcactcagaccat

SEQ ID NO: 79855 - DNA, 25 bp, mus musculus
agaccatcgctcaagctccgagcac

SEQ ID NO: 79856 - DNA, 25 bp, mus musculus
agcccctcgggaggtccagctacag

SEQ ID NO: 79857 - DNA, 25 bp, mus musculus
ccctcgggaggtccagctacagaga

SEQ ID NO: 79858 - DNA, 25 bp, mus musculus
tgcttgtcgctgcccatgcaggaaa

SEQ ID NO: 79859 - DNA, 25 bp, mus musculus
tcgctgcccatgcaggaaacttaca

SEQ ID NO: 79860 - DNA, 25 bp, mus musculus
ctgcccatgcaggaaacttacatgg

SEQ ID NO: 79861 - DNA, 25 bp, mus musculus
acttacatggaccggtgggatcagc

SEQ ID NO: 79862 - DNA, 25 bp, mus musculus
tacatggaccggtgggatcagcgtg

SEQ ID NO: 79863 - DNA, 25 bp, mus musculus
cgtggaccaactgttcagcacagat

SEQ ID NO: 79864 - DNA, 25 bp, mus musculus
ccaactgttcagcacagatgctggt

SEQ ID NO: 79865 - DNA, 25 bp, mus musculus
actgttcagcacagatgctggtgtg

SEQ ID NO: 79866 - DNA, 25 bp, mus musculus
gttcagcacagatgctggtgtggag

SEQ ID NO: 79867 - DNA, 25 bp, mus musculus
cagcacagatgctggtgtggagtag

SEQ ID NO: 79868 - DNA, 25 bp, mus musculus
atacaaaattccgtacctgtgcatg

SEQ ID NO: 79869 - DNA, 25 bp, mus musculus
tttcctttccacacgcgcaaccttg

SEQ ID NO: 79870 - DNA, 25 bp, mus musculus
acgcgcaaccttgcgatgtgaactc

SEQ ID NO: 79871 - DNA, 25 bp, mus musculus
cgcaaccttgcgatgtgaactctga

SEQ ID NO: 79872 - DNA, 25 bp, mus musculus
atgtgaactctgagacttcgtaatg

SEQ ID NO: 79873 - DNA, 25 bp, mus musculus
actctgagacttcgtaatgtctagg

SEQ ID NO: 79874 - DNA, 25 bp, mus musculus
agacttcgtaatgtctagggtggca

SEQ ID NO: 79875 - DNA, 25 bp, mus musculus
agatgcttgtcgctgcccatgcagg

SEQ ID NO: 79876 - DNA, 25 bp, mus musculus
ggtaccaatagttacctgccatact

SEQ ID NO: 79877 - DNA, 25 bp, mus musculus
accaatagttacctgccatactcgg

SEQ ID NO: 79878 - DNA, 25 bp, mus musculus
gataactcctggctccaatccacct

SEQ ID NO: 79879 - DNA, 25 bp, mus musculus
tcctggctccaatccacctacattg

SEQ ID NO: 79880 - DNA, 25 bp, mus musculus
gatctggccttcaagttcccggatc

SEQ ID NO: 79881 - DNA, 25 bp, mus musculus
gccttcaagttcccggatctggatg

SEQ ID NO: 79882 - DNA, 25 bp, mus musculus
ccggatctggatgctggggcaattg

SEQ ID NO: 79883 - DNA, 25 bp, mus musculus
gcaattgacaccgcagagccattac

SEQ ID NO: 79884 - DNA, 25 bp, mus musculus
attgacaccgcagagccattaccgt

SEQ ID NO: 79885 - DNA, 25 bp, mus musculus
gacaccgcagagccattaccgtttg

SEQ ID NO: 79886 - DNA, 25 bp, mus musculus
gcagagccattaccgtttggggctg

SEQ ID NO: 79887 - DNA, 25 bp, mus musculus
gagccattaccgtttggggctgaag

SEQ ID NO: 79888 - DNA, 25 bp, mus musculus
agttacctgccatactcggaccaag

SEQ ID NO: 79889 - DNA, 25 bp, mus musculus
tcggaccaagttgtctggatagcca

SEQ ID NO: 79890 - DNA, 25 bp, mus musculus
tggatagccagcaaacagagtctgg

SEQ ID NO: 79891 - DNA, 25 bp, mus musculus
ctggccattagcagaccatggcaaa

SEQ ID NO: 79892 - DNA, 25 bp, mus musculus
gccattagcagaccatggcaaagaa

SEQ ID NO: 79893 - DNA, 25 bp, mus musculus
ttcttggcggctgttgctgataact

SEQ ID NO: 79894 - DNA, 25 bp, mus musculus
ttggcggctgttgctgataactcct

SEQ ID NO: 79895 - DNA, 25 bp, mus musculus
gctgataactcctggctccaatcca

SEQ ID NO: 79896 - DNA, 25 bp, mus musculus
caaccatcgaactcaaggcccttag

SEQ ID NO: 79897 - DNA, 25 bp, mus musculus
gaactcaaggcccttaggttgctga

SEQ ID NO: 79898 - DNA, 25 bp, mus musculus
cttccagaggcagctgcccaggagg

SEQ ID NO: 79899 - DNA, 25 bp, mus musculus
agacacagccctggagacagccctc

SEQ ID NO: 79900 - DNA, 25 bp, mus musculus
acagccctggagacagccctcaatg

SEQ ID NO: 79901 - DNA, 25 bp, mus musculus
agccctggagacagccctcaatgcc

SEQ ID NO: 79902 - DNA, 25 bp, mus musculus
ccctggagacagccctcaatgccaa

SEQ ID NO: 79903 - DNA, 25 bp, mus musculus
ctggagacagccctcaatgccaagg

SEQ ID NO: 79904 - DNA, 25 bp, mus musculus
ggagacagccctcaatgccaaggcc

SEQ ID NO: 79905 - DNA, 25 bp, mus musculus
acagccctcaatgccaaggcctaca

SEQ ID NO: 79906 - DNA, 25 bp, mus musculus
agccctcaatgccaaggcctacaag

SEQ ID NO: 79907 - DNA, 25 bp, mus musculus
ccctcaatgccaaggcctacaagcg

SEQ ID NO: 79908 - DNA, 25 bp, mus musculus
ggcccttaggttgctgaacttccag

SEQ ID NO: 79909 - DNA, 25 bp, mus musculus
cctcaatgccaaggcctacaagcgc

SEQ ID NO: 79910 - DNA, 25 bp, mus musculus
cccttaggttgctgaacttccagag

SEQ ID NO: 79911 - DNA, 25 bp, mus musculus
taggttgctgaacttccagaggcag

SEQ ID NO: 79912 - DNA, 25 bp, mus musculus
ggttgctgaacttccagaggcagct

SEQ ID NO: 79913 - DNA, 25 bp, mus musculus
ttgctgaacttccagaggcagctgc

SEQ ID NO: 79914 - DNA, 25 bp, mus musculus
gctgaacttccagaggcagctgccc

SEQ ID NO: 79915 - DNA, 25 bp, mus musculus
tgaacttccagaggcagctgcccag

SEQ ID NO: 79916 - DNA, 25 bp, mus musculus
aacttccagaggcagctgcccagga

SEQ ID NO: 79917 - DNA, 25 bp, mus musculus
tttgccaccaaagacagcaagcagt

SEQ ID NO: 79918 - DNA, 25 bp, mus musculus
gacagcaagcagttcctgaaatact

SEQ ID NO: 79919 - DNA, 25 bp, mus musculus
atggtgctcctgcgatcagcttctg

SEQ ID NO: 79920 - DNA, 25 bp, mus musculus
ctcctgcgatcagcttctgaagtgc

SEQ ID NO: 79921 - DNA, 25 bp, mus musculus
cgatcagcttctgaagtgctgggag

SEQ ID NO: 79922 - DNA, 25 bp, mus musculus
tgacttgtgaggctcagatgctgat

SEQ ID NO: 79923 - DNA, 25 bp, mus musculus
ctcagatgctgataccagtaacatt

SEQ ID NO: 79924 - DNA, 25 bp, mus musculus
tcaaaattaacttcacgcattgaat

SEQ ID NO: 79925 - DNA, 25 bp, mus musculus
ttaacttcacgcattgaatacattt

SEQ ID NO: 79926 - DNA, 25 bp, mus musculus
taaactgttcattagcggagtgata

SEQ ID NO: 79927 - DNA, 25 bp, mus musculus
atatctcgtcttccaattttatgta

SEQ ID NO: 79928 - DNA, 25 bp, mus musculus
ttgtcatctatgcaataaagcagtt

SEQ ID NO: 79929 - DNA, 25 bp, mus musculus
agtgcaacttgtgaccagcattgta

SEQ ID NO: 79930 - DNA, 25 bp, mus musculus
aagaccttacaggtctgtgcaatta

SEQ ID NO: 79931 - DNA, 25 bp, mus musculus
ttacaggtctgtgcaattatgaatc

SEQ ID NO: 79932 - DNA, 25 bp, mus musculus
cttgatagcatgtcctatgatgatt

SEQ ID NO: 79933 - DNA, 25 bp, mus musculus
agcatgtcctatgatgattgcctta

SEQ ID NO: 79934 - DNA, 25 bp, mus musculus
taaagcacagtcactagtattccag

SEQ ID NO: 79935 - DNA, 25 bp, mus musculus
acagtcactagtattccagttgtgt

SEQ ID NO: 79936 - DNA, 25 bp, mus musculus
cacatcatggtgctcctgcgatcag

SEQ ID NO: 79937 - DNA, 25 bp, mus musculus
ttccaggaagctcatgagcagtctg

SEQ ID NO: 79938 - DNA, 25 bp, mus musculus
gaagctcatgagcagtctgtgggca

SEQ ID NO: 79939 - DNA, 25 bp, mus musculus
cagctgtgtcctgcgttgttacttg

SEQ ID NO: 79940 - DNA, 25 bp, mus musculus
ctgtgtcctgcgttgttacttgtgt

SEQ ID NO: 79941 - DNA, 25 bp, mus musculus
gcactttagtccaggaagctttctt

SEQ ID NO: 79942 - DNA, 25 bp, mus musculus
tagtccaggaagctttctttgcgat

SEQ ID NO: 79943 - DNA, 25 bp, mus musculus
aagctttctttgcgataagactagt

SEQ ID NO: 79944 - DNA, 25 bp, mus musculus
ctttctttgcgataagactagtatg

SEQ ID NO: 79945 - DNA, 25 bp, mus musculus
ttgacctaaatatccaagacattga

SEQ ID NO: 79946 - DNA, 25 bp, mus musculus
acctaaatatccaagacattgatac

SEQ ID NO: 79947 - DNA, 25 bp, mus musculus
taaatatccaagacattgatactga

SEQ ID NO: 79948 - DNA, 25 bp, mus musculus
gtggacttcatgctttgtgctttaa

SEQ ID NO: 79949 - DNA, 25 bp, mus musculus
cacctcacagaatccatcaaccgga

SEQ ID NO: 79950 - DNA, 25 bp, mus musculus
ctcacagaatccatcaaccggaata

SEQ ID NO: 79951 - DNA, 25 bp, mus musculus
acagaatccatcaaccggaatagag

SEQ ID NO: 79952 - DNA, 25 bp, mus musculus
tccatcaaccggaatagagaagagc

SEQ ID NO: 79953 - DNA, 25 bp, mus musculus
gaagagcctttctcctcagaggaaa

SEQ ID NO: 79954 - DNA, 25 bp, mus musculus
aaccaggtcatggtgtctgagggca

SEQ ID NO: 79955 - DNA, 25 bp, mus musculus
cctcacaagcccaatcctaaacatg

SEQ ID NO: 79956 - DNA, 25 bp, mus musculus
gcacagctgtgtcctgcgttgttac

SEQ ID NO: 79957 - DNA, 25 bp, mus musculus
agattattgtctcgttgtgcacagc

SEQ ID NO: 79958 - DNA, 25 bp, mus musculus
cgttgtgcacagccaagatgttctt

SEQ ID NO: 79959 - DNA, 25 bp, mus musculus
ttgcctccatagtgttggaaaggat

SEQ ID NO: 79960 - DNA, 25 bp, mus musculus
tctcctgtctgccccataatcagat

SEQ ID NO: 79961 - DNA, 25 bp, mus musculus
gtctgccccataatcagattgctag

SEQ ID NO: 79962 - DNA, 25 bp, mus musculus
atgctgaacaggcacaccatagttt

SEQ ID NO: 79963 - DNA, 25 bp, mus musculus
aacaggcacaccatagtttaaatgg

SEQ ID NO: 79964 - DNA, 25 bp, mus musculus
tcgtggtgcagactctctcgtctct

SEQ ID NO: 79965 - DNA, 25 bp, mus musculus
tgcagactctctcgtctctggggca

SEQ ID NO: 79966 - DNA, 25 bp, mus musculus
cgtctctggggcaaccaggtcttgg

SEQ ID NO: 79967 - DNA, 25 bp, mus musculus
cagaccaaacctgaacaaaatgtgg

SEQ ID NO: 79968 - DNA, 25 bp, mus musculus
tttattcttacctatggctgaatta

SEQ ID NO: 79969 - DNA, 25 bp, mus musculus
gcacagccaagatgttctttgtgga

SEQ ID NO: 79970 - DNA, 25 bp, mus musculus
ctagcagattatccacactggttgg

SEQ ID NO: 79971 - DNA, 25 bp, mus musculus
gggtcttcctgctctccttgtttgc

SEQ ID NO: 79972 - DNA, 25 bp, mus musculus
tagaaatcagtctatccaacttgaa

SEQ ID NO: 79973 - DNA, 25 bp, mus musculus
tcagtctatccaacttgaagctctt

SEQ ID NO: 79974 - DNA, 25 bp, mus musculus
acttgaagctcttcagggttgcctc

SEQ ID NO: 79975 - DNA, 25 bp, mus musculus
agctcttcagggttgcctccatagt

SEQ ID NO: 79976 - DNA, 25 bp, mus musculus
tcagggttgcctccatagtgttgga

SEQ ID NO: 79977 - DNA, 25 bp, mus musculus
cctcaacccactggtgtacgtgatc

SEQ ID NO: 79978 - DNA, 25 bp, mus musculus
cccactggtgtacgtgatcgtgggc

SEQ ID NO: 79979 - DNA, 25 bp, mus musculus
accctggggcacagcagggtcattc

SEQ ID NO: 79980 - DNA, 25 bp, mus musculus
cttactgactgacgctctaattctc

SEQ ID NO: 79981 - DNA, 25 bp, mus musculus
gactgacgctctaattctccatgag

SEQ ID NO: 79982 - DNA, 25 bp, mus musculus
cgctctaattctccatgagtggagg

SEQ ID NO: 79983 - DNA, 25 bp, mus musculus
agatctcctgccagctttggccctg

SEQ ID NO: 79984 - DNA, 25 bp, mus musculus
cctgccagctttggccctgtggcta

SEQ ID NO: 79985 - DNA, 25 bp, mus musculus
agctttggccctgtggctacatgca

SEQ ID NO: 79986 - DNA, 25 bp, mus musculus
ggccctgtggctacatgcacagtag

SEQ ID NO: 79987 - DNA, 25 bp, mus musculus
gtggctacatgcacagtaggcatgg

SEQ ID NO: 79988 - DNA, 25 bp, mus musculus
acatgcacagtaggcatggccgcct

SEQ ID NO: 79989 - DNA, 25 bp, mus musculus
gcagatccacaagctgcaggactgg

SEQ ID NO: 79990 - DNA, 25 bp, mus musculus
aacagaagccaccaggcaggactac

SEQ ID NO: 79991 - DNA, 25 bp, mus musculus
ggactactgccaagtgtgtgaggat

SEQ ID NO: 79992 - DNA, 25 bp, mus musculus
gagctcctcagcctgggttcaggaa

SEQ ID NO: 79993 - DNA, 25 bp, mus musculus
ctcagcctgggttcaggaaggagct

SEQ ID NO: 79994 - DNA, 25 bp, mus musculus
catcctaggcagccccagggaatca

SEQ ID NO: 79995 - DNA, 25 bp, mus musculus
ctgtctcatggcataagcatgctgt

SEQ ID NO: 79996 - DNA, 25 bp, mus musculus
ataagcatgctgtggggaatgggta

SEQ ID NO: 79997 - DNA, 25 bp, mus musculus
ggatcataaagtccaactggctttt

SEQ ID NO: 79998 - DNA, 25 bp, mus musculus
agatcttttagaagccattgtacac

SEQ ID NO: 79999 - DNA, 25 bp, mus musculus
atcttttagaagccattgtacacta

SEQ ID NO: 80000 - DNA, 25 bp, mus musculus
ggatcataaagtccaactggctttt

SEQ ID NO: 80001 - DNA, 25 bp, mus musculus
gttgctgatttttctgctttataga

SEQ ID NO: 80002 - DNA, 25 bp, mus musculus
ttgctgatttttctgctttatagat

SEQ ID NO: 80003 - DNA, 25 bp, mus musculus
tgctgatttttctgctttatagatc

SEQ ID NO: 80004 - DNA, 25 bp, mus musculus
gctgatttttctgctttatagatct

SEQ ID NO: 80005 - DNA, 25 bp, mus musculus
ctgatttttctgctttatagatctt

SEQ ID NO: 80006 - DNA, 25 bp, mus musculus
ttttctgctttatagatcttttaga

SEQ ID NO: 80007 - DNA, 25 bp, mus musculus
tttctgctttatagatcttttagaa

SEQ ID NO: 80008 - DNA, 25 bp, mus musculus
agatcttttagaagccattgtacac

SEQ ID NO: 80009 - DNA, 25 bp, mus musculus
atcttttagaagccattgtacacta

SEQ ID NO: 80010 - DNA, 25 bp, mus musculus
acatgacgtgcatcatcatttgctt

SEQ ID NO: 80011 - DNA, 25 bp, mus musculus
cgtgcatcatcatttgcttcaagcc

SEQ ID NO: 80012 - DNA, 25 bp, mus musculus
ggctttcctcagcccattacaaaga

SEQ ID NO: 80013 - DNA, 25 bp, mus musculus
ttactctccttgggctcatcgacta

SEQ ID NO: 80014 - DNA, 25 bp, mus musculus
tccttgggctcatcgactatcggtt

SEQ ID NO: 80015 - DNA, 25 bp, mus musculus
ggctcatcgactatcggttctgtgc

SEQ ID NO: 80016 - DNA, 25 bp, mus musculus
tcgactatcggttctgtgcctgtgc

SEQ ID NO: 80017 - DNA, 25 bp, mus musculus
cctgtgctctgttgtgttggaggga

SEQ ID NO: 80018 - DNA, 25 bp, mus musculus
ctctgttgtgttggagggaaggact

SEQ ID NO: 80019 - DNA, 25 bp, mus musculus
ttctgatttttactctgtgaacact

SEQ ID NO: 80020 - DNA, 25 bp, mus musculus
tctctgttgtacactttcaagcaac

SEQ ID NO: 80021 - DNA, 25 bp, mus musculus
ttgtacactttcaagcaacactttt

SEQ ID NO: 80022 - DNA, 25 bp, mus musculus
tcaagccccgaaacacagtagagct

SEQ ID NO: 80023 - DNA, 25 bp, mus musculus
ctgaagacaccggcaacagtgacaa

SEQ ID NO: 80024 - DNA, 25 bp, mus musculus
catgtggactgttttctgagccctt

SEQ ID NO: 80025 - DNA, 25 bp, mus musculus
tttctgagcccttggacccgagact

SEQ ID NO: 80026 - DNA, 25 bp, mus musculus
tggacccgagactgagttttgtcct

SEQ ID NO: 80027 - DNA, 25 bp, mus musculus
ttgtccttgtcctttagccttagca

SEQ ID NO: 80028 - DNA, 25 bp, mus musculus
ttgtcctttagccttagcagtgggt

SEQ ID NO: 80029 - DNA, 25 bp, mus musculus
tttagccttagcagtgggtatgagg

SEQ ID NO: 80030 - DNA, 25 bp, mus musculus
tttgtcaggcctgatggtttctata

SEQ ID NO: 80031 - DNA, 25 bp, mus musculus
aggcctgatggtttctatagactca

SEQ ID NO: 80032 - DNA, 25 bp, mus musculus
gaactttctctgcaagcttacatta

SEQ ID NO: 80033 - DNA, 25 bp, mus musculus
tctctgcaagcttacattacagtgt

SEQ ID NO: 80034 - DNA, 25 bp, mus musculus
caagcttacattacagtgtgctgaa

SEQ ID NO: 80035 - DNA, 25 bp, mus musculus
tacattacagtgtgctgaaacacta

SEQ ID NO: 80036 - DNA, 25 bp, mus musculus
caaatactgtgctctgactcatgtt

SEQ ID NO: 80037 - DNA, 25 bp, mus musculus
ctgtgctctgactcatgttacaatg

SEQ ID NO: 80038 - DNA, 25 bp, mus musculus
tctgactcatgttacaatgagaatc

SEQ ID NO: 80039 - DNA, 25 bp, mus musculus
gtgtatggtccactttgttaacact

SEQ ID NO: 80040 - DNA, 25 bp, mus musculus
ggtccactttgttaacactttgctg

SEQ ID NO: 80041 - DNA, 25 bp, mus musculus
ctttgttaacactttgctgctccct

SEQ ID NO: 80042 - DNA, 25 bp, mus musculus
ttctatagactcagatgggaacttg

SEQ ID NO: 80043 - DNA, 25 bp, mus musculus
tttttcactgagaaacagttgtatt

SEQ ID NO: 80044 - DNA, 25 bp, mus musculus
agcaaaactatcattccattaggag

SEQ ID NO: 80045 - DNA, 25 bp, mus musculus
actatcattccattaggagaaatct

SEQ ID NO: 80046 - DNA, 25 bp, mus musculus
tttctgttggacccagatggtagaa

SEQ ID NO: 80047 - DNA, 25 bp, mus musculus
tttccaaagcagctgagaaaggctt

SEQ ID NO: 80048 - DNA, 25 bp, mus musculus
atatggaacatttcctgtgagcaca

SEQ ID NO: 80049 - DNA, 25 bp, mus musculus
tcctgtgagcacagaactgaacttt

SEQ ID NO: 80050 - DNA, 25 bp, mus musculus
ctcatgcccgtaatcctcagagcgc

SEQ ID NO: 80051 - DNA, 25 bp, mus musculus
atgcccgtaatcctcagagcgctaa

SEQ ID NO: 80052 - DNA, 25 bp, mus musculus
gataatggacctacacaatgttttg

SEQ ID NO: 80053 - DNA, 25 bp, mus musculus
tgtttatttaccctgtctctaatag

SEQ ID NO: 80054 - DNA, 25 bp, mus musculus
ttatttaccctgtctctaatagtgg

SEQ ID NO: 80055 - DNA, 25 bp, mus musculus
accctgtctctaatagtggtattct

SEQ ID NO: 80056 - DNA, 25 bp, mus musculus
taatttgatcacaatctagtcaatg

SEQ ID NO: 80057 - DNA, 25 bp, mus musculus
tttgatcacaatctagtcaatgcca

SEQ ID NO: 80058 - DNA, 25 bp, mus musculus
gatcacaatctagtcaatgccagct

SEQ ID NO: 80059 - DNA, 25 bp, mus musculus
aatctagtcaatgccagctgttaat

SEQ ID NO: 80060 - DNA, 25 bp, mus musculus
ctagtcaatgccagctgttaatatt

SEQ ID NO: 80061 - DNA, 25 bp, mus musculus
cactcatatttttgtgcatatatta

SEQ ID NO: 80062 - DNA, 25 bp, mus musculus
gtaatcctcagagcgctaatgtgat

SEQ ID NO: 80063 - DNA, 25 bp, mus musculus
gttgtgtcatacaggccctgagttg

SEQ ID NO: 80064 - DNA, 25 bp, mus musculus
tacaggccctgagttggacatttct

SEQ ID NO: 80065 - DNA, 25 bp, mus musculus
aggccctgagttggacatttctcaa

SEQ ID NO: 80066 - DNA, 25 bp, mus musculus
ggacatttctcaaacttatatatgt

SEQ ID NO: 80067 - DNA, 25 bp, mus musculus
ttctcaaacttatatatgtggtgtt

SEQ ID NO: 80068 - DNA, 25 bp, mus musculus
attatttcatctggagggaagtggc

SEQ ID NO: 80069 - DNA, 25 bp, mus musculus
aatactgactgatgcatagtagaaa

SEQ ID NO: 80070 - DNA, 25 bp, mus musculus
ttgaccctcaagtcactgtagcttt

SEQ ID NO: 80071 - DNA, 25 bp, mus musculus
gaccctcaagtcactgtagctttag

SEQ ID NO: 80072 - DNA, 25 bp, mus musculus
agttgaactgcacagtctcctttgt

SEQ ID NO: 80073 - DNA, 25 bp, mus musculus
ttgaactgcacagtctcctttgttg

SEQ ID NO: 80074 - DNA, 25 bp, mus musculus
actgcacagtctcctttgttgttgt

SEQ ID NO: 80075 - DNA, 25 bp, mus musculus
tgcacagtctcctttgttgttgtca

SEQ ID NO: 80076 - DNA, 25 bp, mus musculus
cagtctcctttgttgttgtcaattg

SEQ ID NO: 80077 - DNA, 25 bp, mus musculus
taaagttgtgctcttgcctcgtgcc

SEQ ID NO: 80078 - DNA, 25 bp, mus musculus
aagttgtgctcttgcctcgtgccaa

SEQ ID NO: 80079 - DNA, 25 bp, mus musculus
tgctcttgcctcgtgccaatatgta

SEQ ID NO: 80080 - DNA, 25 bp, mus musculus
cttgcctcgtgccaatatgtacata

SEQ ID NO: 80081 - DNA, 25 bp, mus musculus
cctcgtgccaatatgtacataactg

SEQ ID NO: 80082 - DNA, 25 bp, mus musculus
ctcaagtcactgtagctttagtagt

SEQ ID NO: 80083 - DNA, 25 bp, mus musculus
caagtcactgtagctttagtagttg

SEQ ID NO: 80084 - DNA, 25 bp, mus musculus
tttagatgctagcactgcatgtgct

SEQ ID NO: 80085 - DNA, 25 bp, mus musculus
tagatgctagcactgcatgtgctgt

SEQ ID NO: 80086 - DNA, 25 bp, mus musculus
gatgctagcactgcatgtgctgtgc

SEQ ID NO: 80087 - DNA, 25 bp, mus musculus
agcactgcatgtgctgtgcatattc

SEQ ID NO: 80088 - DNA, 25 bp, mus musculus
cactgcatgtgctgtgcatattctg

SEQ ID NO: 80089 - DNA, 25 bp, mus musculus
ctgcatgtgctgtgcatattctggt

SEQ ID NO: 80090 - DNA, 25 bp, mus musculus
ttcctcaggactgatgagtttcagc

SEQ ID NO: 80091 - DNA, 25 bp, mus musculus
gagtttcagcaaaccttccttccag

SEQ ID NO: 80092 - DNA, 25 bp, mus musculus
ctcctggtatacttccaccagaggc

SEQ ID NO: 80093 - DNA, 25 bp, mus musculus
ctggtatacttccaccagaggcttc

SEQ ID NO: 80094 - DNA, 25 bp, mus musculus
gtatacttccaccagaggcttccag

SEQ ID NO: 80095 - DNA, 25 bp, mus musculus
ttccaccagaggcttccagaagtgc

SEQ ID NO: 80096 - DNA, 25 bp, mus musculus
caccagaggcttccagaagtgcttc

SEQ ID NO: 80097 - DNA, 25 bp, mus musculus
cttccagaagtgcttcagtcccaga

SEQ ID NO: 80098 - DNA, 25 bp, mus musculus
cagtcccagaccttcacagtcaaat

SEQ ID NO: 80099 - DNA, 25 bp, mus musculus
tcccagaccttcacagtcaaatatc

SEQ ID NO: 80100 - DNA, 25 bp, mus musculus
accttcacagtcaaatatcatcaca

SEQ ID NO: 80101 - DNA, 25 bp, mus musculus
acagtcaaatatcatcacaatggtt

SEQ ID NO: 80102 - DNA, 25 bp, mus musculus
tttcagcaaaccttccttccagctg

SEQ ID NO: 80103 - DNA, 25 bp, mus musculus
gctgttacttcccaacaccacgatc

SEQ ID NO: 80104 - DNA, 25 bp, mus musculus
caacaccacgatcttccttcgtgtg

SEQ ID NO: 80105 - DNA, 25 bp, mus musculus
ccttcgtgtgtcctcactcaggaat

SEQ ID NO: 80106 - DNA, 25 bp, mus musculus
gagattgtagcccaccgggaacagt

SEQ ID NO: 80107 - DNA, 25 bp, mus musculus
cagtttcgtggcttttacaatgagc

SEQ ID NO: 80108 - DNA, 25 bp, mus musculus
tttcgtggcttttacaatgagcatg

SEQ ID NO: 80109 - DNA, 25 bp, mus musculus
tttcagggtctctgggtaattctct

SEQ ID NO: 80110 - DNA, 25 bp, mus musculus
gaaagatccctatgaatgtaatcag

SEQ ID NO: 80111 - DNA, 25 bp, mus musculus
aagcctttgcatatgactaatcttt

SEQ ID NO: 80112 - DNA, 25 bp, mus musculus
agcagtcatcttcaaacccataaag

SEQ ID NO: 80113 - DNA, 25 bp, mus musculus
cagtcatcttcaaacccataaagta

SEQ ID NO: 80114 - DNA, 25 bp, mus musculus
gtcatcttcaaacccataaagtact

SEQ ID NO: 80115 - DNA, 25 bp, mus musculus
tcttcaaacccataaagtactacat

SEQ ID NO: 80116 - DNA, 25 bp, mus musculus
taaagtactacatactggagagact

SEQ ID NO: 80117 - DNA, 25 bp, mus musculus
gtgataatgcctcttcacaacagag

SEQ ID NO: 80118 - DNA, 25 bp, mus musculus
gataatgcctcttcacaacagagag

SEQ ID NO: 80119 - DNA, 25 bp, mus musculus
atgcctcttcacaacagagaggtct

SEQ ID NO: 80120 - DNA, 25 bp, mus musculus
gcctcttcacaacagagaggtctcc

SEQ ID NO: 80121 - DNA, 25 bp, mus musculus
ctcttcacaacagagaggtctccaa

SEQ ID NO: 80122 - DNA, 25 bp, mus musculus
atatgactaatcttttgggatgcat

SEQ ID NO: 80123 - DNA, 25 bp, mus musculus
acgttaccaacataatcatagtctt

SEQ ID NO: 80124 - DNA, 25 bp, mus musculus
gttaccaacataatcatagtcttaa

SEQ ID NO: 80125 - DNA, 25 bp, mus musculus
taccaacataatcatagtcttaaag

SEQ ID NO: 80126 - DNA, 25 bp, mus musculus
atcatagtcttaaagcctttgcaga

SEQ ID NO: 80127 - DNA, 25 bp, mus musculus
tagtcttaaagcctttgcagaaagc

SEQ ID NO: 80128 - DNA, 25 bp, mus musculus
gtcttaaagcctttgcagaaagcag

SEQ ID NO: 80129 - DNA, 25 bp, mus musculus
cttaaagcctttgcagaaagcagtc

SEQ ID NO: 80130 - DNA, 25 bp, mus musculus
agtgtctctctttcaatgccatcat

SEQ ID NO: 80131 - DNA, 25 bp, mus musculus
ctttcaatgccatcatggaagagct

SEQ ID NO: 80132 - DNA, 25 bp, mus musculus
tcatgcccacgacacatatttggag

SEQ ID NO: 80133 - DNA, 25 bp, mus musculus
tgcccacgacacatatttggaggac

SEQ ID NO: 80134 - DNA, 25 bp, mus musculus
atatgtttccacatatctttatcca

SEQ ID NO: 80135 - DNA, 25 bp, mus musculus
tgtttccacatatctttatccataa

SEQ ID NO: 80136 - DNA, 25 bp, mus musculus
tccataactccagtcatggatagag

SEQ ID NO: 80137 - DNA, 25 bp, mus musculus
actccagtcatggatagagggagaa

SEQ ID NO: 80138 - DNA, 25 bp, mus musculus
tttttaaagctcacatagatattac

SEQ ID NO: 80139 - DNA, 25 bp, mus musculus
ttcttttcctccaataaattgctat

SEQ ID NO: 80140 - DNA, 25 bp, mus musculus
tcctccaataaattgctatgtgtgc

SEQ ID NO: 80141 - DNA, 25 bp, mus musculus
ttgctatgtgtgctttctaaataat

SEQ ID NO: 80142 - DNA, 25 bp, mus musculus
tcaatgccatcatggaagagctggg

SEQ ID NO: 80143 - DNA, 25 bp, mus musculus
agggcaaatcttctttcacaagtat

SEQ ID NO: 80144 - DNA, 25 bp, mus musculus
cttctttcacaagtatccttacttg

SEQ ID NO: 80145 - DNA, 25 bp, mus musculus
caagtatccttacttgtcatcagag

SEQ ID NO: 80146 - DNA, 25 bp, mus musculus
gtatccttacttgtcatcagagacg

SEQ ID NO: 80147 - DNA, 25 bp, mus musculus
tccttacttgtcatcagagacgaac

SEQ ID NO: 80148 - DNA, 25 bp, mus musculus
agactgtggcgtgatccaagaacac

SEQ ID NO: 80149 - DNA, 25 bp, mus musculus
cgtgatccaagaacacgcctgtaaa

SEQ ID NO: 80150 - DNA, 25 bp, mus musculus
tttcttcgcctaattgaacaataat

SEQ ID NO: 80151 - DNA, 25 bp, mus musculus
caataattgctcatttactatcctg

SEQ ID NO: 80152 - DNA, 25 bp, mus musculus
aggacctcccagagatatgttatac

SEQ ID NO: 80153 - DNA, 25 bp, mus musculus
taaccccagattgaataagaatgta

SEQ ID NO: 80154 - DNA, 25 bp, mus musculus
attcaggtctttttcagcagtcctg

SEQ ID NO: 80155 - DNA, 25 bp, mus musculus
gtctttttcagcagtcctgattcat

SEQ ID NO: 80156 - DNA, 25 bp, mus musculus
ttcagcagtcctgattcatgtcagt

SEQ ID NO: 80157 - DNA, 25 bp, mus musculus
agtcctgattcatgtcagttattga

SEQ ID NO: 80158 - DNA, 25 bp, mus musculus
gattcatgtcagttattgagaactg

SEQ ID NO: 80159 - DNA, 25 bp, mus musculus
gtatttatccacatgtagaataata

SEQ ID NO: 80160 - DNA, 25 bp, mus musculus
tttgtccccaggcaaggtttgacag

SEQ ID NO: 80161 - DNA, 25 bp, mus musculus
caaatgtgttctgtgttctgttgta

SEQ ID NO: 80162 - DNA, 25 bp, mus musculus
ttgctcatttactatcctggcaaga

SEQ ID NO: 80163 - DNA, 25 bp, mus musculus
atttactatcctggcaagattagag

SEQ ID NO: 80164 - DNA, 25 bp, mus musculus
tatcctggcaagattagagaaacaa

SEQ ID NO: 80165 - DNA, 25 bp, mus musculus
tgaatacacagcactagcgtcttaa

SEQ ID NO: 80166 - DNA, 25 bp, mus musculus
cacagcactagcgtcttaacactgc

SEQ ID NO: 80167 - DNA, 25 bp, mus musculus
taggtctcatgtcaaccctgcagat

SEQ ID NO: 80168 - DNA, 25 bp, mus musculus
tcatgtcaaccctgcagatttcaag

SEQ ID NO: 80169 - DNA, 25 bp, mus musculus
attttcaggacctcccagagatatg

SEQ ID NO: 80170 - DNA, 25 bp, mus musculus
agaacacctgcgagacaactccatg

SEQ ID NO: 80171 - DNA, 25 bp, mus musculus
gcgagacaactccatgaagaaggag

SEQ ID NO: 80172 - DNA, 25 bp, mus musculus
agcatcatcatcacatgcacaacca

SEQ ID NO: 80173 - DNA, 25 bp, mus musculus
atcatcatcacatgcacaaccaaca

SEQ ID NO: 80174 - DNA, 25 bp, mus musculus
atcacatgcacaaccaacatggaaa

SEQ ID NO: 80175 - DNA, 25 bp, mus musculus
acatgcacaaccaacatggaaacac

SEQ ID NO: 80176 - DNA, 25 bp, mus musculus
tatgaacatcaagctgccacaccat

SEQ ID NO: 80177 - DNA, 25 bp, mus musculus
gaacatcaagctgccacaccatgag

SEQ ID NO: 80178 - DNA, 25 bp, mus musculus
caagctgccacaccatgagagaagc

SEQ ID NO: 80179 - DNA, 25 bp, mus musculus
gctgccacaccatgagagaagcacg

SEQ ID NO: 80180 - DNA, 25 bp, mus musculus
gatcaaacggctgcgcattcagaag

SEQ ID NO: 80181 - DNA, 25 bp, mus musculus
gctgcgcattcagaagcgagagcac

SEQ ID NO: 80182 - DNA, 25 bp, mus musculus
agacaactccatgaagaaggagggc

SEQ ID NO: 80183 - DNA, 25 bp, mus musculus
gtgtacacagattctgcaccggcct

SEQ ID NO: 80184 - DNA, 25 bp, mus musculus
tacacagattctgcaccggcctcac

SEQ ID NO: 80185 - DNA, 25 bp, mus musculus
tgtgagatcctcacactgagcatca

SEQ ID NO: 80186 - DNA, 25 bp, mus musculus
gagatcctcacactgagcatcatca

SEQ ID NO: 80187 - DNA, 25 bp, mus musculus
atcctcacactgagcatcatcatca

SEQ ID NO: 80188 - DNA, 25 bp, mus musculus
ctcacactgagcatcatcatcacat

SEQ ID NO: 80189 - DNA, 25 bp, mus musculus
ctgagcatcatcatcacatgcacaa

SEQ ID NO: 80190 - DNA, 25 bp, mus musculus
gatagaactctccagcacgtaacgg

SEQ ID NO: 80191 - DNA, 25 bp, mus musculus
tagaactctccagcacgtaacggaa

SEQ ID NO: 80192 - DNA, 25 bp, mus musculus
ggaatcctgtacagcttgtgctcga

SEQ ID NO: 80193 - DNA, 25 bp, mus musculus
gaatcctgtacagcttgtgctcgag

SEQ ID NO: 80194 - DNA, 25 bp, mus musculus
atcctgtacagcttgtgctcgagta

SEQ ID NO: 80195 - DNA, 25 bp, mus musculus
tcctgtacagcttgtgctcgagtaa

SEQ ID NO: 80196 - DNA, 25 bp, mus musculus
ctgtacagcttgtgctcgagtaaat

SEQ ID NO: 80197 - DNA, 25 bp, mus musculus
tgtacagcttgtgctcgagtaaatg

SEQ ID NO: 80198 - DNA, 25 bp, mus musculus
tacagcttgtgctcgagtaaatgct

SEQ ID NO: 80199 - DNA, 25 bp, mus musculus
acagcttgtgctcgagtaaatgcta

SEQ ID NO: 80200 - DNA, 25 bp, mus musculus
agcttgtgctcgagtaaatgctagt

SEQ ID NO: 80201 - DNA, 25 bp, mus musculus
agccaaaatcggagcaagggtgcga

SEQ ID NO: 80202 - DNA, 25 bp, mus musculus
agaactctccagcacgtaacggaat

SEQ ID NO: 80203 - DNA, 25 bp, mus musculus
actctccagcacgtaacggaatcct

SEQ ID NO: 80204 - DNA, 25 bp, mus musculus
tctccagcacgtaacggaatcctgt

SEQ ID NO: 80205 - DNA, 25 bp, mus musculus
ctccagcacgtaacggaatcctgta

SEQ ID NO: 80206 - DNA, 25 bp, mus musculus
ccagcacgtaacggaatcctgtaca

SEQ ID NO: 80207 - DNA, 25 bp, mus musculus
cagcacgtaacggaatcctgtacag

SEQ ID NO: 80208 - DNA, 25 bp, mus musculus
aacggaatcctgtacagcttgtgct

SEQ ID NO: 80209 - DNA, 25 bp, mus musculus
acggaatcctgtacagcttgtgctc

SEQ ID NO: 80210 - DNA, 25 bp, mus musculus
agcaccaagccacctgttgcttgta

SEQ ID NO: 80211 - DNA, 25 bp, mus musculus
aaggtgtcgcctgttactgaattgg

SEQ ID NO: 80212 - DNA, 25 bp, mus musculus
aagccttttgactatctgaggacaa

SEQ ID NO: 80213 - DNA, 25 bp, mus musculus
tttgactatctgaggacaaggactc

SEQ ID NO: 80214 - DNA, 25 bp, mus musculus
aatcatttgtgccatttaggatttg

SEQ ID NO: 80215 - DNA, 25 bp, mus musculus
gccaaaggctacagccaagccctgg

SEQ ID NO: 80216 - DNA, 25 bp, mus musculus
ggctacagccaagccctggaactca

SEQ ID NO: 80217 - DNA, 25 bp, mus musculus
cggcctgatgttttccccatacagc

SEQ ID NO: 80218 - DNA, 25 bp, mus musculus
gatgttttccccatacagctagaaa

SEQ ID NO: 80219 - DNA, 25 bp, mus musculus
ttccccatacagctagaaacaggag

SEQ ID NO: 80220 - DNA, 25 bp, mus musculus
atttaagtgcacctggttgagctct

SEQ ID NO: 80221 - DNA, 25 bp, mus musculus
gtgcacctggttgagctctgagtaa

SEQ ID NO: 80222 - DNA, 25 bp, mus musculus
tcgcctgttactgaattggcaaacg

SEQ ID NO: 80223 - DNA, 25 bp, mus musculus
gaattggcaaacgccttcttattga

SEQ ID NO: 80224 - DNA, 25 bp, mus musculus
gcaaacgccttcttattgaatcttc

SEQ ID NO: 80225 - DNA, 25 bp, mus musculus
gccttcttattgaatcttcaccatc

SEQ ID NO: 80226 - DNA, 25 bp, mus musculus
ttattgaatcttcaccatcctgtgt

SEQ ID NO: 80227 - DNA, 25 bp, mus musculus
atggctccagagttgttgataaact

SEQ ID NO: 80228 - DNA, 25 bp, mus musculus
ttccagggccaccacggtgtgaagg

SEQ ID NO: 80229 - DNA, 25 bp, mus musculus
aactccaagccttttgactatctga

SEQ ID NO: 80230 - DNA, 25 bp, mus musculus
aacccttccggctgttgtcacagct

SEQ ID NO: 80231 - DNA, 25 bp, mus musculus
ccttccggctgttgtcacagctcac

SEQ ID NO: 80232 - DNA, 25 bp, mus musculus
cccagcaccagaagatccacagtgg

SEQ ID NO: 80233 - DNA, 25 bp, mus musculus
agcaccagaagatccacagtggaac

SEQ ID NO: 80234 - DNA, 25 bp, mus musculus
accagaagatccacagtggaacctg

SEQ ID NO: 80235 - DNA, 25 bp, mus musculus
tccacagtggaacctgacaagctct

SEQ ID NO: 80236 - DNA, 25 bp, mus musculus
gtggaacctgacaagctctacacca

SEQ ID NO: 80237 - DNA, 25 bp, mus musculus
gaacctgacaagctctacaccaagt

SEQ ID NO: 80238 - DNA, 25 bp, mus musculus
gacaagctctacaccaagttgtaac

SEQ ID NO: 80239 - DNA, 25 bp, mus musculus
aagctctacaccaagttgtaacatg

SEQ ID NO: 80240 - DNA, 25 bp, mus musculus
ctctacaccaagttgtaacatgtca

SEQ ID NO: 80241 - DNA, 25 bp, mus musculus
tacaccaagttgtaacatgtcagga

SEQ ID NO: 80242 - DNA, 25 bp, mus musculus
tccggctgttgtcacagctcactca

SEQ ID NO: 80243 - DNA, 25 bp, mus musculus
tgttgtcacagctcactcagcaccg

SEQ ID NO: 80244 - DNA, 25 bp, mus musculus
tgtcacagctcactcagcaccggag

SEQ ID NO: 80245 - DNA, 25 bp, mus musculus
tccacaccggcgagaagcttatgaa

SEQ ID NO: 80246 - DNA, 25 bp, mus musculus
acaccggcgagaagcttatgaatgc

SEQ ID NO: 80247 - DNA, 25 bp, mus musculus
tagactttattcatttctttcagca

SEQ ID NO: 80248 - DNA, 25 bp, mus musculus
actttattcatttctttcagcacca

SEQ ID NO: 80249 - DNA, 25 bp, mus musculus
ttattcatttctttcagcaccagag

SEQ ID NO: 80250 - DNA, 25 bp, mus musculus
atgccatgaatgcggccgaaatcac

SEQ ID NO: 80251 - DNA, 25 bp, mus musculus
actctctacgccacaggaactggta

SEQ ID NO: 80252 - DNA, 25 bp, mus musculus
tcacagtgtgcatcgcaccgtgctg

SEQ ID NO: 80253 - DNA, 25 bp, mus musculus
tgtgcatcgcaccgtgctgtacatg

SEQ ID NO: 80254 - DNA, 25 bp, mus musculus
tcgcaccgtgctgtacatgtgcaga

SEQ ID NO: 80255 - DNA, 25 bp, mus musculus
tgtttccactgaggcagtttctggt

SEQ ID NO: 80256 - DNA, 25 bp, mus musculus
cactgaggcagtttctggtactcct

SEQ ID NO: 80257 - DNA, 25 bp, mus musculus
ggcagtttctggtactcctatgcaa

SEQ ID NO: 80258 - DNA, 25 bp, mus musculus
ttctggtactcctatgcaatattac

SEQ ID NO: 80259 - DNA, 25 bp, mus musculus
tactcctatgcaatattacttagct

SEQ ID NO: 80260 - DNA, 25 bp, mus musculus
gaatcaactcaactgtcagtactga

SEQ ID NO: 80261 - DNA, 25 bp, mus musculus
actcaactgtcagtactgagaaggg

SEQ ID NO: 80262 - DNA, 25 bp, mus musculus
ggctgtctaatcagctccggaacca

SEQ ID NO: 80263 - DNA, 25 bp, mus musculus
ctaatcagctccggaaccagaagtg

SEQ ID NO: 80264 - DNA, 25 bp, mus musculus
agctccggaaccagaagtgaaccag

SEQ ID NO: 80265 - DNA, 25 bp, mus musculus
tcagctttcctctcatgtggcaaac

SEQ ID NO: 80266 - DNA, 25 bp, mus musculus
ttcctctcatgtggcaaacgtgcga

SEQ ID NO: 80267 - DNA, 25 bp, mus musculus
actctgtggtcctgagtgccagaag

SEQ ID NO: 80268 - DNA, 25 bp, mus musculus
gctgtctccatgggttggtcacagt

SEQ ID NO: 80269 - DNA, 25 bp, mus musculus
tccatgggttggtcacagtgtgcat

SEQ ID NO: 80270 - DNA, 25 bp, mus musculus
aaagcaggtacctgtcagtggctac

SEQ ID NO: 80271 - DNA, 25 bp, mus musculus
acctgtcagtggctacctggcctca

SEQ ID NO: 80272 - DNA, 25 bp, mus musculus
tggtccttcagagccagtgacactg

SEQ ID NO: 80273 - DNA, 25 bp, mus musculus
tccttcagagccagtgacactggca

SEQ ID NO: 80274 - DNA, 25 bp, mus musculus
cggcctggtcatccagaagaatctt

SEQ ID NO: 80275 - DNA, 25 bp, mus musculus
catccagaagaatcttccagccgca

SEQ ID NO: 80276 - DNA, 25 bp, mus musculus
ccagaagaatcttccagccgcagtg

SEQ ID NO: 80277 - DNA, 25 bp, mus musculus
gaagaatcttccagccgcagtgacc

SEQ ID NO: 80278 - DNA, 25 bp, mus musculus
gaatcttccagccgcagtgaccacc

SEQ ID NO: 80279 - DNA, 25 bp, mus musculus
cgcagtgaccaccacactcaacatt

SEQ ID NO: 80280 - DNA, 25 bp, mus musculus
caccacactcaacattgtgcctatc

SEQ ID NO: 80281 - DNA, 25 bp, mus musculus
cacactcaacattgtgcctatcttg

SEQ ID NO: 80282 - DNA, 25 bp, mus musculus
tgtcagtggctacctggcctcagca

SEQ ID NO: 80283 - DNA, 25 bp, mus musculus
cagtggctacctggcctcagcagct

SEQ ID NO: 80284 - DNA, 25 bp, mus musculus
tggctacctggcctcagcagctggt

SEQ ID NO: 80285 - DNA, 25 bp, mus musculus
ctacctggcctcagcagctggtcct

SEQ ID NO: 80286 - DNA, 25 bp, mus musculus
cctggcctcagcagctggtccttca

SEQ ID NO: 80287 - DNA, 25 bp, mus musculus
ggcctcagcagctggtccttcagag

SEQ ID NO: 80288 - DNA, 25 bp, mus musculus
ctcagcagctggtccttcagagcca

SEQ ID NO: 80289 - DNA, 25 bp, mus musculus
agctggtccttcagagccagtgaca

SEQ ID NO: 80290 - DNA, 25 bp, mus musculus
agctcaaaaaccagaagtgatcaga

SEQ ID NO: 80291 - DNA, 25 bp, mus musculus
ccccatgcattgtggcaaagccagc

SEQ ID NO: 80292 - DNA, 25 bp, mus musculus
atagccagagcatctctagcctgga

SEQ ID NO: 80293 - DNA, 25 bp, mus musculus
agagcatctctagcctggaaaagaa

SEQ ID NO: 80294 - DNA, 25 bp, mus musculus
tctctagcctggaaaagaagaaagc

SEQ ID NO: 80295 - DNA, 25 bp, mus musculus
ccagacaggtcctgttgttgccaac

SEQ ID NO: 80296 - DNA, 25 bp, mus musculus
ctctccatacacccagaattctgtt

SEQ ID NO: 80297 - DNA, 25 bp, mus musculus
ttctgttggacgtcagtgtcctttt

SEQ ID NO: 80298 - DNA, 25 bp, mus musculus
tgtgccaaagctagcagctcacttg

SEQ ID NO: 80299 - DNA, 25 bp, mus musculus
aaagctagcagctcacttgtagtgc

SEQ ID NO: 80300 - DNA, 25 bp, mus musculus
atgcattattaccacgggtttgagg

SEQ ID NO: 80301 - DNA, 25 bp, mus musculus
caaagttctgttagctcagactgac

SEQ ID NO: 80302 - DNA, 25 bp, mus musculus
agccagctggcctttcccgtgtgca

SEQ ID NO: 80303 - DNA, 25 bp, mus musculus
ctgttagctcagactgactcattta

SEQ ID NO: 80304 - DNA, 25 bp, mus musculus
tttcccgtgtgcatgtgagcgtgtg

SEQ ID NO: 80305 - DNA, 25 bp, mus musculus
agctttctcacaccgtgccttatac

SEQ ID NO: 80306 - DNA, 25 bp, mus musculus
ctcacaccgtgccttatacacgcta

SEQ ID NO: 80307 - DNA, 25 bp, mus musculus
cttatacacgctatacgaaaaccag

SEQ ID NO: 80308 - DNA, 25 bp, mus musculus
atgctaccttccatttcactagctt

SEQ ID NO: 80309 - DNA, 25 bp, mus musculus
atttcactagctttgatggtcattt

SEQ ID NO: 80310 - DNA, 25 bp, mus musculus
tccctgggtgtgatagccagagcat

SEQ ID NO: 80311 - DNA, 25 bp, mus musculus
cgattgagctatggccggcctcaac

SEQ ID NO: 80312 - DNA, 25 bp, mus musculus
agctatggccggcctcaactcactg

SEQ ID NO: 80313 - DNA, 25 bp, mus musculus
tcactggaggcagtgaagcgcaaga

SEQ ID NO: 80314 - DNA, 25 bp, mus musculus
cctgcagcagcaggcagacgacgca

SEQ ID NO: 80315 - DNA, 25 bp, mus musculus
ctgcagcagcaggcagacgacgcag

SEQ ID NO: 80316 - DNA, 25 bp, mus musculus
agacgacgcagaggatcgcgcgcaa

SEQ ID NO: 80317 - DNA, 25 bp, mus musculus
caaggcctgcagcgcgaactggatg

SEQ ID NO: 80318 - DNA, 25 bp, mus musculus
cctgcagcgcgaactggatggcgag

SEQ ID NO: 80319 - DNA, 25 bp, mus musculus
cacacccgtgcagacatctggaaga

SEQ ID NO: 80320 - DNA, 25 bp, mus musculus
acacccgtgcagacatctggaagag

SEQ ID NO: 80321 - DNA, 25 bp, mus musculus
acccgtgcagacatctggaagaggc

SEQ ID NO: 80322 - DNA, 25 bp, mus musculus
cccgtgcagacatctggaagaggca

SEQ ID NO: 80323 - DNA, 25 bp, mus musculus
tatggccggcctcaactcactggag

SEQ ID NO: 80324 - DNA, 25 bp, mus musculus
atggccggcctcaactcactggagg

SEQ ID NO: 80325 - DNA, 25 bp, mus musculus
ggccggcctcaactcactggaggca

SEQ ID NO: 80326 - DNA, 25 bp, mus musculus
gccggcctcaactcactggaggcag

SEQ ID NO: 80327 - DNA, 25 bp, mus musculus
cggcctcaactcactggaggcagtg

SEQ ID NO: 80328 - DNA, 25 bp, mus musculus
ggcctcaactcactggaggcagtga

SEQ ID NO: 80329 - DNA, 25 bp, mus musculus
caactcactggaggcagtgaagcgc

SEQ ID NO: 80330 - DNA, 25 bp, mus musculus
aactcactggaggcagtgaagcgca

SEQ ID NO: 80331 - DNA, 25 bp, mus musculus
atcctctacaagctgaaactcgggg

SEQ ID NO: 80332 - DNA, 25 bp, mus musculus
cctctacaagctgaaactcggggag

SEQ ID NO: 80333 - DNA, 25 bp, mus musculus
ctccttgtgtttgcaaacaaacagg

SEQ ID NO: 80334 - DNA, 25 bp, mus musculus
actccctgcgtcaccgcaattggta

SEQ ID NO: 80335 - DNA, 25 bp, mus musculus
tccctgcgtcaccgcaattggtaca

SEQ ID NO: 80336 - DNA, 25 bp, mus musculus
cctgcgtcaccgcaattggtacatt

SEQ ID NO: 80337 - DNA, 25 bp, mus musculus
tgcgtcaccgcaattggtacattca

SEQ ID NO: 80338 - DNA, 25 bp, mus musculus
cgtcaccgcaattggtacattcagg

SEQ ID NO: 80339 - DNA, 25 bp, mus musculus
tcaccgcaattggtacattcaggcc

SEQ ID NO: 80340 - DNA, 25 bp, mus musculus
tgtatgaaggcttggactggctggc

SEQ ID NO: 80341 - DNA, 25 bp, mus musculus
tgaaggcttggactggctggccaat

SEQ ID NO: 80342 - DNA, 25 bp, mus musculus
cttggactggctggccaatcagctc

SEQ ID NO: 80343 - DNA, 25 bp, mus musculus
tctacaagctgaaactcggggagat

SEQ ID NO: 80344 - DNA, 25 bp, mus musculus
ggacaagattcggcccctctggaga

SEQ ID NO: 80345 - DNA, 25 bp, mus musculus
acaagattcggcccctctggagaca

SEQ ID NO: 80346 - DNA, 25 bp, mus musculus
aagattcggcccctctggagacact

SEQ ID NO: 80347 - DNA, 25 bp, mus musculus
cagcaatgatcgggagcgagtgaac

SEQ ID NO: 80348 - DNA, 25 bp, mus musculus
atgctgtgctccttgtgtttgcaaa

SEQ ID NO: 80349 - DNA, 25 bp, mus musculus
gctgtgctccttgtgtttgcaaaca

SEQ ID NO: 80350 - DNA, 25 bp, mus musculus
tgtgctccttgtgtttgcaaacaaa

SEQ ID NO: 80351 - DNA, 25 bp, mus musculus
gatatctaaccaaggacatgtttga

SEQ ID NO: 80352 - DNA, 25 bp, mus musculus
atctaaccaaggacatgtttgatag

SEQ ID NO: 80353 - DNA, 25 bp, mus musculus
gatacagagctatcctgacaccttt

SEQ ID NO: 80354 - DNA, 25 bp, mus musculus
acagagctatcctgacacctttaga

SEQ ID NO: 80355 - DNA, 25 bp, mus musculus
ctatcctgacacctttagacagatc

SEQ ID NO: 80356 - DNA, 25 bp, mus musculus
tgacacctttagacagatctgagtg

SEQ ID NO: 80357 - DNA, 25 bp, mus musculus
ctttagacagatctgagtggttttt

SEQ ID NO: 80358 - DNA, 25 bp, mus musculus
gagacctttatcattcctcagacag

SEQ ID NO: 80359 - DNA, 25 bp, mus musculus
tttatcattcctcagacagtctgct

SEQ ID NO: 80360 - DNA, 25 bp, mus musculus
attcctcagacagtctgctgattta

SEQ ID NO: 80361 - DNA, 25 bp, mus musculus
cctcagacagtctgctgatttaaaa

SEQ ID NO: 80362 - DNA, 25 bp, mus musculus
aacactattcagttttcttgtactg

SEQ ID NO: 80363 - DNA, 25 bp, mus musculus
atatctgagacaggtttgggcagaa

SEQ ID NO: 80364 - DNA, 25 bp, mus musculus
ttgtttaccaagaacaatgttgcta

SEQ ID NO: 80365 - DNA, 25 bp, mus musculus
agtatccattattatgcttcccttg

SEQ ID NO: 80366 - DNA, 25 bp, mus musculus
atccattattatgcttcccttgaac

SEQ ID NO: 80367 - DNA, 25 bp, mus musculus
tatgcttcccttgaacctaaatgcc

SEQ ID NO: 80368 - DNA, 25 bp, mus musculus
tcccttgaacctaaatgcctggata

SEQ ID NO: 80369 - DNA, 25 bp, mus musculus
gaacctaaatgcctggatacagagc

SEQ ID NO: 80370 - DNA, 25 bp, mus musculus
cctaaatgcctggatacagagctat

SEQ ID NO: 80371 - DNA, 25 bp, mus musculus
gacaatcttcagaaacttaatgtca

SEQ ID NO: 80372 - DNA, 25 bp, mus musculus
ctgaggacgctgcacctccagcaca

SEQ ID NO: 80373 - DNA, 25 bp, mus musculus
ctttcaagcaatcgtcttgcaactg

SEQ ID NO: 80374 - DNA, 25 bp, mus musculus
aatcgtcttgcaactgtgcctgctg

SEQ ID NO: 80375 - DNA, 25 bp, mus musculus
tttgctttgctgtccagtctgttgc

SEQ ID NO: 80376 - DNA, 25 bp, mus musculus
ctgtccagtctgttgcgactcaatc

SEQ ID NO: 80377 - DNA, 25 bp, mus musculus
agtctgttgcgactcaatctttcca

SEQ ID NO: 80378 - DNA, 25 bp, mus musculus
ttgcgactcaatctttccagtaacc

SEQ ID NO: 80379 - DNA, 25 bp, mus musculus
cgactcaatctttccagtaaccagc

SEQ ID NO: 80380 - DNA, 25 bp, mus musculus
ctcaatctttccagtaaccagctga

SEQ ID NO: 80381 - DNA, 25 bp, mus musculus
ctttccagtaaccagctgaagaatt

SEQ ID NO: 80382 - DNA, 25 bp, mus musculus
tccagtaaccagctgaagaatttgc

SEQ ID NO: 80383 - DNA, 25 bp, mus musculus
ctgcacctccagcacaatgagctga

SEQ ID NO: 80384 - DNA, 25 bp, mus musculus
ctccagcacaatgagctgacttgca

SEQ ID NO: 80385 - DNA, 25 bp, mus musculus
acttgcatccccgagggatttgagc

SEQ ID NO: 80386 - DNA, 25 bp, mus musculus
tgcatccccgagggatttgagcatc

SEQ ID NO: 80387 - DNA, 25 bp, mus musculus
ggatttgagcatctttcctgcttag

SEQ ID NO: 80388 - DNA, 25 bp, mus musculus
tttgagcatctttcctgcttagaag

SEQ ID NO: 80389 - DNA, 25 bp, mus musculus
ctttcctgcttagaagatttagatc

SEQ ID NO: 80390 - DNA, 25 bp, mus musculus
gatctttcaagcaatcgtcttgcaa

SEQ ID NO: 80391 - DNA, 25 bp, mus musculus
gtccaggagtctgctgatgaactcc

SEQ ID NO: 80392 - DNA, 25 bp, mus musculus
tctgctgatgaactccagaagatgc

SEQ ID NO: 80393 - DNA, 25 bp, mus musculus
tgtgccacccaaggcacaggcctgt

SEQ ID NO: 80394 - DNA, 25 bp, mus musculus
gccacccaaggcacaggcctgtatg

SEQ ID NO: 80395 - DNA, 25 bp, mus musculus
acccaaggcacaggcctgtatgatg

SEQ ID NO: 80396 - DNA, 25 bp, mus musculus
ctgtcccacgagctgtcaaagcgct

SEQ ID NO: 80397 - DNA, 25 bp, mus musculus
gtgcatcccgggatgaccagactcc

SEQ ID NO: 80398 - DNA, 25 bp, mus musculus
atgaccagactcccggactcctcag

SEQ ID NO: 80399 - DNA, 25 bp, mus musculus
agactcccggactcctcaggcagtg

SEQ ID NO: 80400 - DNA, 25 bp, mus musculus
cgttggagcctggagccttgctctc

SEQ ID NO: 80401 - DNA, 25 bp, mus musculus
tctctgggcacagagggctctgctc

SEQ ID NO: 80402 - DNA, 25 bp, mus musculus
acctgtggatgggcttcctggccaa

SEQ ID NO: 80403 - DNA, 25 bp, mus musculus
caggacatgcccaatgccatgcccg

SEQ ID NO: 80404 - DNA, 25 bp, mus musculus
gacatgcccaatgccatgcccgtga

SEQ ID NO: 80405 - DNA, 25 bp, mus musculus
cccaatgccatgcccgtgagcgagc

SEQ ID NO: 80406 - DNA, 25 bp, mus musculus
ctgactgacaagctgggccttcagc

SEQ ID NO: 80407 - DNA, 25 bp, mus musculus
gacaagctgggccttcagcacctgc

SEQ ID NO: 80408 - DNA, 25 bp, mus musculus
ctgggccttcagcacctgcgtagcc

SEQ ID NO: 80409 - DNA, 25 bp, mus musculus
ggccttcagcacctgcgtagccgca

SEQ ID NO: 80410 - DNA, 25 bp, mus musculus
cttcagcacctgcgtagccgcacgt

SEQ ID NO: 80411 - DNA, 25 bp, mus musculus
ctctatgaggggctcacatggttaa

SEQ ID NO: 80412 - DNA, 25 bp, mus musculus
acctctaactacaaatcctaatgag

SEQ ID NO: 80413 - DNA, 25 bp, mus musculus
agatgccttgtgacttccagcaaac

SEQ ID NO: 80414 - DNA, 25 bp, mus musculus
cttgtgacttccagcaaacggggtg

SEQ ID NO: 80415 - DNA, 25 bp, mus musculus
ttgcccaggttcttatcacttgctg

SEQ ID NO: 80416 - DNA, 25 bp, mus musculus
aggttcttatcacttgctgtagatg

SEQ ID NO: 80417 - DNA, 25 bp, mus musculus
ttatcacttgctgtagatggcttat

SEQ ID NO: 80418 - DNA, 25 bp, mus musculus
ttttgcattcatgcagactatgttc

SEQ ID NO: 80419 - DNA, 25 bp, mus musculus
attcatgcagactatgttccaagtc

SEQ ID NO: 80420 - DNA, 25 bp, mus musculus
tatgttccaagtctgtttcatctag

SEQ ID NO: 80421 - DNA, 25 bp, mus musculus
ccaagtctgtttcatctagtaaact

SEQ ID NO: 80422 - DNA, 25 bp, mus musculus
ctgtttcatctagtaaactgaaaat

SEQ ID NO: 80423 - DNA, 25 bp, mus musculus
aactacaaatcctaatgagcgtcct

SEQ ID NO: 80424 - DNA, 25 bp, mus musculus
catcacctctttgaattgccactct

SEQ ID NO: 80425 - DNA, 25 bp, mus musculus
ttgaatctgaactctggagttactg

SEQ ID NO: 80426 - DNA, 25 bp, mus musculus
ctgaactctggagttactgttctac

SEQ ID NO: 80427 - DNA, 25 bp, mus musculus
tcttggctttgcgttaggatgctct

SEQ ID NO: 80428 - DNA, 25 bp, mus musculus
ctttgcgttaggatgctctgatctg

SEQ ID NO: 80429 - DNA, 25 bp, mus musculus
atgctctgatctgacatttgacacg

SEQ ID NO: 80430 - DNA, 25 bp, mus musculus
tgatctgacatttgacacgaataca

SEQ ID NO: 80431 - DNA, 25 bp, mus musculus
tgagcaccctgggaggtcatgcctg

SEQ ID NO: 80432 - DNA, 25 bp, mus musculus
agcaccctgggaggtcatgcctgat

SEQ ID NO: 80433 - DNA, 25 bp, mus musculus
gagttcaatgctgctctaccttaag

SEQ ID NO: 80434 - DNA, 25 bp, mus musculus
gttcaatgctgctctaccttaagtt

SEQ ID NO: 80435 - DNA, 25 bp, mus musculus
ttcaatgctgctctaccttaagttg

SEQ ID NO: 80436 - DNA, 25 bp, mus musculus
caatgctgctctaccttaagttgcc

SEQ ID NO: 80437 - DNA, 25 bp, mus musculus
aatgctgctctaccttaagttgccg

SEQ ID NO: 80438 - DNA, 25 bp, mus musculus
tgctgctctaccttaagttgccgaa

SEQ ID NO: 80439 - DNA, 25 bp, mus musculus
gctgctctaccttaagttgccgaat

SEQ ID NO: 80440 - DNA, 25 bp, mus musculus
tgctctaccttaagttgccgaatgg

SEQ ID NO: 80441 - DNA, 25 bp, mus musculus
gctctaccttaagttgccgaatggt

SEQ ID NO: 80442 - DNA, 25 bp, mus musculus
tctaccttaagttgccgaatggtct

SEQ ID NO: 80443 - DNA, 25 bp, mus musculus
taattgaccggaacagcttctgagt

SEQ ID NO: 80444 - DNA, 25 bp, mus musculus
attgaccggaacagcttctgagttc

SEQ ID NO: 80445 - DNA, 25 bp, mus musculus
ttgaccggaacagcttctgagttca

SEQ ID NO: 80446 - DNA, 25 bp, mus musculus
gaccggaacagcttctgagttcaat

SEQ ID NO: 80447 - DNA, 25 bp, mus musculus
cggaacagcttctgagttcaatgct

SEQ ID NO: 80448 - DNA, 25 bp, mus musculus
agcttctgagttcaatgctgctcta

SEQ ID NO: 80449 - DNA, 25 bp, mus musculus
tctgagttcaatgctgctctacctt

SEQ ID NO: 80450 - DNA, 25 bp, mus musculus
tgagttcaatgctgctctaccttaa

SEQ ID NO: 80451 - DNA, 25 bp, mus musculus
cggtgctccactgagtggcctgcag

SEQ ID NO: 80452 - DNA, 25 bp, mus musculus
accagagtgcacgcgctgcggccac

SEQ ID NO: 80453 - DNA, 25 bp, mus musculus
cttcctagatgaacggctgtactgt

SEQ ID NO: 80454 - DNA, 25 bp, mus musculus
agatgaacggctgtactgtgagaat

SEQ ID NO: 80455 - DNA, 25 bp, mus musculus
tgagaatcacgccaaggctcgagtc

SEQ ID NO: 80456 - DNA, 25 bp, mus musculus
tgtataccccaatgctaaggtggaa

SEQ ID NO: 80457 - DNA, 25 bp, mus musculus
atcttgtcttgcctctgcttcactt

SEQ ID NO: 80458 - DNA, 25 bp, mus musculus
tcttgcctctgcttcacttaatgtt

SEQ ID NO: 80459 - DNA, 25 bp, mus musculus
ttcacttaatgttccctcatggcca

SEQ ID NO: 80460 - DNA, 25 bp, mus musculus
taatgttccctcatggccagtgtaa

SEQ ID NO: 80461 - DNA, 25 bp, mus musculus
aatatatgtcctcctggcctttcta

SEQ ID NO: 80462 - DNA, 25 bp, mus musculus
ctttctaataaagtccttctgcttg

SEQ ID NO: 80463 - DNA, 25 bp, mus musculus
aaccattgtcaaggcgagagacaag

SEQ ID NO: 80464 - DNA, 25 bp, mus musculus
agacaagctctaccatccggagtgc

SEQ ID NO: 80465 - DNA, 25 bp, mus musculus
gctctaccatccggagtgcttcatg

SEQ ID NO: 80466 - DNA, 25 bp, mus musculus
ccatccggagtgcttcatgtgcagc

SEQ ID NO: 80467 - DNA, 25 bp, mus musculus
cgactgcggcctgaatctcaaacag

SEQ ID NO: 80468 - DNA, 25 bp, mus musculus
cggcctgaatctcaaacagcgtggg

SEQ ID NO: 80469 - DNA, 25 bp, mus musculus
gaatctcaaacagcgtgggtacttc

SEQ ID NO: 80470 - DNA, 25 bp, mus musculus
gtacttcttcctagatgaacggctg

SEQ ID NO: 80471 - DNA, 25 bp, mus musculus
tcaaagactaacctttcagtccatg

SEQ ID NO: 80472 - DNA, 25 bp, mus musculus
caaagactaacctttcagtccatga

SEQ ID NO: 80473 - DNA, 25 bp, mus musculus
cgtttcgtgtgtagtccagatgaag

SEQ ID NO: 80474 - DNA, 25 bp, mus musculus
gtttcgtgtgtagtccagatgaagt

SEQ ID NO: 80475 - DNA, 25 bp, mus musculus
ttcgtgtgtagtccagatgaagtca

SEQ ID NO: 80476 - DNA, 25 bp, mus musculus
ggaaatccaacagacatgtcgcagt

SEQ ID NO: 80477 - DNA, 25 bp, mus musculus
aaatccaacagacatgtcgcagtta

SEQ ID NO: 80478 - DNA, 25 bp, mus musculus
aatccaacagacatgtcgcagttac

SEQ ID NO: 80479 - DNA, 25 bp, mus musculus
tccaacagacatgtcgcagttacaa

SEQ ID NO: 80480 - DNA, 25 bp, mus musculus
aacagacatgtcgcagttacaaata

SEQ ID NO: 80481 - DNA, 25 bp, mus musculus
agtcacagcatatttcttattaatg

SEQ ID NO: 80482 - DNA, 25 bp, mus musculus
gtcacagcatatttcttattaatgt

SEQ ID NO: 80483 - DNA, 25 bp, mus musculus
agactaacctttcagtccatgaaga

SEQ ID NO: 80484 - DNA, 25 bp, mus musculus
actaacctttcagtccatgaagaca

SEQ ID NO: 80485 - DNA, 25 bp, mus musculus
ctaacctttcagtccatgaagacaa

SEQ ID NO: 80486 - DNA, 25 bp, mus musculus
ggtgcacagaacgtttcgtgtgtag

SEQ ID NO: 80487 - DNA, 25 bp, mus musculus
tgcacagaacgtttcgtgtgtagtc

SEQ ID NO: 80488 - DNA, 25 bp, mus musculus
acagaacgtttcgtgtgtagtccag

SEQ ID NO: 80489 - DNA, 25 bp, mus musculus
cagaacgtttcgtgtgtagtccaga

SEQ ID NO: 80490 - DNA, 25 bp, mus musculus
aacgtttcgtgtgtagtccagatga

SEQ ID NO: 80491 - DNA, 25 bp, mus musculus
caaacagtccagccaacagccaagc

SEQ ID NO: 80492 - DNA, 25 bp, mus musculus
acagtccagccaacagccaagcagc

SEQ ID NO: 80493 - DNA, 25 bp, mus musculus
tcatccttcatcgttgttgtgtata

SEQ ID NO: 80494 - DNA, 25 bp, mus musculus
cctcccagtagaaaggctagcaagt

SEQ ID NO: 80495 - DNA, 25 bp, mus musculus
agaacctacaaaagcttgtgtatct

SEQ ID NO: 80496 - DNA, 25 bp, mus musculus
acctacaaaagcttgtgtatcttga

SEQ ID NO: 80497 - DNA, 25 bp, mus musculus
atacataacttcagtgcaagagact

SEQ ID NO: 80498 - DNA, 25 bp, mus musculus
aacttcagtgcaagagactttgtca

SEQ ID NO: 80499 - DNA, 25 bp, mus musculus
tttgtcacttatttcctcacctgtg

SEQ ID NO: 80500 - DNA, 25 bp, mus musculus
gtcacttatttcctcacctgtgcaa

SEQ ID NO: 80501 - DNA, 25 bp, mus musculus
acttatttcctcacctgtgcaagag

SEQ ID NO: 80502 - DNA, 25 bp, mus musculus
ctcacctgtgcaagagggactgcga

SEQ ID NO: 80503 - DNA, 25 bp, mus musculus
cagccaacagccaagcagcacagct

SEQ ID NO: 80504 - DNA, 25 bp, mus musculus
ccaacagccaagcagcacagcttta

SEQ ID NO: 80505 - DNA, 25 bp, mus musculus
acagccaagcagcacagctttatca

SEQ ID NO: 80506 - DNA, 25 bp, mus musculus
cagcacagctttatcaggaaaacaa

SEQ ID NO: 80507 - DNA, 25 bp, mus musculus
tttcggccattgttgagcaaagctg

SEQ ID NO: 80508 - DNA, 25 bp, mus musculus
attcataatagacacctggtctgct

SEQ ID NO: 80509 - DNA, 25 bp, mus musculus
aatagacacctggtctgctcatcct

SEQ ID NO: 80510 - DNA, 25 bp, mus musculus
agacacctggtctgctcatccttca

SEQ ID NO: 80511 - DNA, 25 bp, mus musculus
gttctggaacccttgtccatggcca

SEQ ID NO: 80512 - DNA, 25 bp, mus musculus
gaacccttgtccatggccacagcgt

SEQ ID NO: 80513 - DNA, 25 bp, mus musculus
agccagttgatcacagggagcctgt

SEQ ID NO: 80514 - DNA, 25 bp, mus musculus
ttgatcacagggagcctgtgtttgt

SEQ ID NO: 80515 - DNA, 25 bp, mus musculus
gtgttccagagtctttactgacacc

SEQ ID NO: 80516 - DNA, 25 bp, mus musculus
gctgcatccgccactttgtaattga

SEQ ID NO: 80517 - DNA, 25 bp, mus musculus
tccgccactttgtaattgacagccg

SEQ ID NO: 80518 - DNA, 25 bp, mus musculus
taattgacagccgccctgtgagctt

SEQ ID NO: 80519 - DNA, 25 bp, mus musculus
acagccgccctgtgagcttcagtaa

SEQ ID NO: 80520 - DNA, 25 bp, mus musculus
gccctgtgagcttcagtaaagctgc

SEQ ID NO: 80521 - DNA, 25 bp, mus musculus
cctgacacagctgcaggctgctgaa

SEQ ID NO: 80522 - DNA, 25 bp, mus musculus
ctgaagctctcacctggttgaaggg

SEQ ID NO: 80523 - DNA, 25 bp, mus musculus
atggccacagcgtcaacggggaata

SEQ ID NO: 80524 - DNA, 25 bp, mus musculus
tcagagacttttctacctcagtaac

SEQ ID NO: 80525 - DNA, 25 bp, mus musculus
ctacctcagtaactcccaagcagaa

SEQ ID NO: 80526 - DNA, 25 bp, mus musculus
cagtaactcccaagcagaatctctg

SEQ ID NO: 80527 - DNA, 25 bp, mus musculus
ctcccaagcagaatctctgtgatgg

SEQ ID NO: 80528 - DNA, 25 bp, mus musculus
attcaaacgtggttcagttggatgt

SEQ ID NO: 80529 - DNA, 25 bp, mus musculus
tgaaccatgtagttgggccgttgaa

SEQ ID NO: 80530 - DNA, 25 bp, mus musculus
cgttgaatccaaagccagttgatca

SEQ ID NO: 80531 - DNA, 25 bp, mus musculus
atcctgatccaaagtgacctgactc

SEQ ID NO: 80532 - DNA, 25 bp, mus musculus
ctgatccaaagtgacctgactccca

SEQ ID NO: 80533 - DNA, 25 bp, mus musculus
agtggcttgctccagaaaggcttct

SEQ ID NO: 80534 - DNA, 25 bp, mus musculus
ggcttgctccagaaaggcttctcct

SEQ ID NO: 80535 - DNA, 25 bp, mus musculus
cagaaaggcttctcctgagacctgc

SEQ ID NO: 80536 - DNA, 25 bp, mus musculus
aaaggcttctcctgagacctgcaag

SEQ ID NO: 80537 - DNA, 25 bp, mus musculus
ttctcctgagacctgcaagcatcag

SEQ ID NO: 80538 - DNA, 25 bp, mus musculus
tgagacctgcaagcatcaggggaga

SEQ ID NO: 80539 - DNA, 25 bp, mus musculus
gagatatttggtcctttgggatcct

SEQ ID NO: 80540 - DNA, 25 bp, mus musculus
tgactctaggagcaccaccataccc

SEQ ID NO: 80541 - DNA, 25 bp, mus musculus
taggagcaccaccataccctgaagt

SEQ ID NO: 80542 - DNA, 25 bp, mus musculus
ccaccagcatcctacaatatcttca

SEQ ID NO: 80543 - DNA, 25 bp, mus musculus
gacctgactcccaaactttgtcatc

SEQ ID NO: 80544 - DNA, 25 bp, mus musculus
gcatcctacaatatcttcagagaaa

SEQ ID NO: 80545 - DNA, 25 bp, mus musculus
cccaaactttgtcatctgggcctgg

SEQ ID NO: 80546 - DNA, 25 bp, mus musculus
tgtcatctgggcctggcttatgaag

SEQ ID NO: 80547 - DNA, 25 bp, mus musculus
catctgggcctggcttatgaagttc

SEQ ID NO: 80548 - DNA, 25 bp, mus musculus
ctgggcctggcttatgaagttcatg

SEQ ID NO: 80549 - DNA, 25 bp, mus musculus
tatgaagttcatgcccatggggcat

SEQ ID NO: 80550 - DNA, 25 bp, mus musculus
tccctctcaagtggcttgctccaga

SEQ ID NO: 80551 - DNA, 25 bp, mus musculus
tcaagtggcttgctccagaaaggct

SEQ ID NO: 80552 - DNA, 25 bp, mus musculus
gcctcacatccgaaagtcagtctcc

SEQ ID NO: 80553 - DNA, 25 bp, mus musculus
aaagtcagtctccacaagtagccct

SEQ ID NO: 80554 - DNA, 25 bp, mus musculus
cctaaggccacaaactgttgagcac

SEQ ID NO: 80555 - DNA, 25 bp, mus musculus
aactgttgagcacacacagtggaca

SEQ ID NO: 80556 - DNA, 25 bp, mus musculus
tgagcacacacagtggacatacggc

SEQ ID NO: 80557 - DNA, 25 bp, mus musculus
atacggcattcagcagtgggtttgg

SEQ ID NO: 80558 - DNA, 25 bp, mus musculus
cattcagcagtgggtttggaacata

SEQ ID NO: 80559 - DNA, 25 bp, mus musculus
tggatctcatgaaacctgtaccagg

SEQ ID NO: 80560 - DNA, 25 bp, mus musculus
atcgattctcactgaggagaagcct

SEQ ID NO: 80561 - DNA, 25 bp, mus musculus
agctctggccaggcctcataggaaa

SEQ ID NO: 80562 - DNA, 25 bp, mus musculus
ccagcgtcaacggtcaccatgggtg

SEQ ID NO: 80563 - DNA, 25 bp, mus musculus
aaactggttccatgtactgtgaact

SEQ ID NO: 80564 - DNA, 25 bp, mus musculus
agtctccacaagtagccctgcagga

SEQ ID NO: 80565 - DNA, 25 bp, mus musculus
cacaagtagccctgcaggagctgct

SEQ ID NO: 80566 - DNA, 25 bp, mus musculus
tagccctgcaggagctgctattgca

SEQ ID NO: 80567 - DNA, 25 bp, mus musculus
agctgctattgcatcaacctctggg

SEQ ID NO: 80568 - DNA, 25 bp, mus musculus
tattgcatcaacctctggggcatcc

SEQ ID NO: 80569 - DNA, 25 bp, mus musculus
atcaacctctggggcatccaataac

SEQ ID NO: 80570 - DNA, 25 bp, mus musculus
caataacagttcttcgaattgagac

SEQ ID NO: 80571 - DNA, 25 bp, mus musculus
ttgagaccaactcctaaggccacaa

SEQ ID NO: 80572 - DNA, 25 bp, mus musculus
aaccccagacacacgggctctagtg

SEQ ID NO: 80573 - DNA, 25 bp, mus musculus
cccagacacacgggctctagtggct

SEQ ID NO: 80574 - DNA, 25 bp, mus musculus
ggcattctttgtctttggggctgcc

SEQ ID NO: 80575 - DNA, 25 bp, mus musculus
tgccctgtgtgctgagagtgtcaac

SEQ ID NO: 80576 - DNA, 25 bp, mus musculus
ggcctacctggagacacgtctggct

SEQ ID NO: 80577 - DNA, 25 bp, mus musculus
ctacctggagacacgtctggctgac

SEQ ID NO: 80578 - DNA, 25 bp, mus musculus
acacgtctggctgactggatccaca

SEQ ID NO: 80579 - DNA, 25 bp, mus musculus
acgtctggctgactggatccacagc

SEQ ID NO: 80580 - DNA, 25 bp, mus musculus
cgtctggctgactggatccacagca

SEQ ID NO: 80581 - DNA, 25 bp, mus musculus
gctgactggatccacagcagtgggg

SEQ ID NO: 80582 - DNA, 25 bp, mus musculus
cggagttcacagctctatacgggga

SEQ ID NO: 80583 - DNA, 25 bp, mus musculus
gaactgggcatcagtgaggacagtg

SEQ ID NO: 80584 - DNA, 25 bp, mus musculus
agacacacgggctctagtggctgac

SEQ ID NO: 80585 - DNA, 25 bp, mus musculus
cacacgggctctagtggctgacttt

SEQ ID NO: 80586 - DNA, 25 bp, mus musculus
tctagtggctgactttgtaggctat

SEQ ID NO: 80587 - DNA, 25 bp, mus musculus
gctgcaccaagccatgcgggctgct

SEQ ID NO: 80588 - DNA, 25 bp, mus musculus
gcaccaagccatgcgggctgctgga

SEQ ID NO: 80589 - DNA, 25 bp, mus musculus
catgcgggctgctggagacgagttt

SEQ ID NO: 80590 - DNA, 25 bp, mus musculus
agcccagcaacgcttcacccaggtt

SEQ ID NO: 80591 - DNA, 25 bp, mus musculus
ctggggccgtcttgtggcattcttt

SEQ ID NO: 80592 - DNA, 25 bp, mus musculus
atctcaactctgtgtatctcaagtg

SEQ ID NO: 80593 - DNA, 25 bp, mus musculus
ataacaatgaccaaacatctcgctg

SEQ ID NO: 80594 - DNA, 25 bp, mus musculus
atcacagataccagaagctgcaggt

SEQ ID NO: 80595 - DNA, 25 bp, mus musculus
tctactagctgtggaccccaagaaa

SEQ ID NO: 80596 - DNA, 25 bp, mus musculus
caagaaaggcctcttgtcttctcct

SEQ ID NO: 80597 - DNA, 25 bp, mus musculus
cctgatgaagcagctccctgtgcct

SEQ ID NO: 80598 - DNA, 25 bp, mus musculus
gctccctgtgcctacaagggttcag

SEQ ID NO: 80599 - DNA, 25 bp, mus musculus
tgtgcctacaagggttcagaataaa

SEQ ID NO: 80600 - DNA, 25 bp, mus musculus
tgtgtaccatcatgttcaaatcaca

SEQ ID NO: 80601 - DNA, 25 bp, mus musculus
ccatcatgttcaaatcacatcgaca

SEQ ID NO: 80602 - DNA, 25 bp, mus musculus
aatcacatcgacagtgtgtttcatt

SEQ ID NO: 80603 - DNA, 25 bp, mus musculus
tttcattacggaatagctgaaatga

SEQ ID NO: 80604 - DNA, 25 bp, mus musculus
ttccttcctacaaatggaagactga

SEQ ID NO: 80605 - DNA, 25 bp, mus musculus
ttataggacccattcgcctgaagag

SEQ ID NO: 80606 - DNA, 25 bp, mus musculus
gacccattcgcctgaagagggaccg

SEQ ID NO: 80607 - DNA, 25 bp, mus musculus
caggacttctgcctcaaatacatga

SEQ ID NO: 80608 - DNA, 25 bp, mus musculus
gcctgtacctgttttccttcatggt

SEQ ID NO: 80609 - DNA, 25 bp, mus musculus
tcatggttcttgcgctaaatgtggt

SEQ ID NO: 80610 - DNA, 25 bp, mus musculus
agcatttcctaaatcggtggatgga

SEQ ID NO: 80611 - DNA, 25 bp, mus musculus
tcctaaatcggtggatggatcacag

SEQ ID NO: 80612 - DNA, 25 bp, mus musculus
cactatcaaatgcaactcacaacac

SEQ ID NO: 80613 - DNA, 25 bp, mus musculus
tatcaaatgcaactcacaacaccac

SEQ ID NO: 80614 - DNA, 25 bp, mus musculus
agccaattgccaatatcttatgtct

SEQ ID NO: 80615 - DNA, 25 bp, mus musculus
caattgccaatatcttatgtctcag

SEQ ID NO: 80616 - DNA, 25 bp, mus musculus
ccaatatcttatgtctcagcaaata

SEQ ID NO: 80617 - DNA, 25 bp, mus musculus
atatcttatgtctcagcaaatacag

SEQ ID NO: 80618 - DNA, 25 bp, mus musculus
tcttatgtctcagcaaatacagacg

SEQ ID NO: 80619 - DNA, 25 bp, mus musculus
gtctcagcaaatacagacggatcta

SEQ ID NO: 80620 - DNA, 25 bp, mus musculus
ggatctagcttccaaaacaagtata

SEQ ID NO: 80621 - DNA, 25 bp, mus musculus
agcttccaaaacaagtatactgaat

SEQ ID NO: 80622 - DNA, 25 bp, mus musculus
tatactgaattcctgctctagtatt

SEQ ID NO: 80623 - DNA, 25 bp, mus musculus
actgaattcctgctctagtattggg

SEQ ID NO: 80624 - DNA, 25 bp, mus musculus
tgaagtcaactgatctcccagccaa

SEQ ID NO: 80625 - DNA, 25 bp, mus musculus
cagccaaccgtgcctttgatgttaa

SEQ ID NO: 80626 - DNA, 25 bp, mus musculus
ttaagtttgtcgatgtcttgccaaa

SEQ ID NO: 80627 - DNA, 25 bp, mus musculus
ttgtcgatgtcttgccaaaggaagt

SEQ ID NO: 80628 - DNA, 25 bp, mus musculus
ctgccaaagtcttttcatcagatgg

SEQ ID NO: 80629 - DNA, 25 bp, mus musculus
aaactgacctaacaagcagctttga

SEQ ID NO: 80630 - DNA, 25 bp, mus musculus
ctgacctaacaagcagctttgatac

SEQ ID NO: 80631 - DNA, 25 bp, mus musculus
taaagccaattgccaatatcttatg

SEQ ID NO: 80632 - DNA, 25 bp, mus musculus
tcggtgccagacacatttgccagca

SEQ ID NO: 80633 - DNA, 25 bp, mus musculus
ccagacacatttgccagcaaagtag

SEQ ID NO: 80634 - DNA, 25 bp, mus musculus
gctttctctgtcactctcttcacta

SEQ ID NO: 80635 - DNA, 25 bp, mus musculus
ttcactatttttgctttcatcaacg

SEQ ID NO: 80636 - DNA, 25 bp, mus musculus
ctgtttgtgctcctgtggctcttgt

SEQ ID NO: 80637 - DNA, 25 bp, mus musculus
ctggaagcctactgccacataaagg

SEQ ID NO: 80638 - DNA, 25 bp, mus musculus
gcctactgccacataaagggcttct

SEQ ID NO: 80639 - DNA, 25 bp, mus musculus
gacatttgtcatgttcacttaaact

SEQ ID NO: 80640 - DNA, 25 bp, mus musculus
tggaatccagcttcaagaacatccg

SEQ ID NO: 80641 - DNA, 25 bp, mus musculus
ccagcttcaagaacatccgtactag

SEQ ID NO: 80642 - DNA, 25 bp, mus musculus
tcaagaacatccgtactaggccgga

SEQ ID NO: 80643 - DNA, 25 bp, mus musculus
acatccgtactaggccggaagtcag

SEQ ID NO: 80644 - DNA, 25 bp, mus musculus
acatttgccagcaaagtagcagcta

SEQ ID NO: 80645 - DNA, 25 bp, mus musculus
tactaggccggaagtcagaaaccat

SEQ ID NO: 80646 - DNA, 25 bp, mus musculus
aaagtagcagctacccaggaccagt

SEQ ID NO: 80647 - DNA, 25 bp, mus musculus
acccaggaccagtatgcagatgcgt

SEQ ID NO: 80648 - DNA, 25 bp, mus musculus
tctataggcaatgtcactggaagca

SEQ ID NO: 80649 - DNA, 25 bp, mus musculus
ctgggaatcggcgtggcctggtcca

SEQ ID NO: 80650 - DNA, 25 bp, mus musculus
tggtccattgctgccatctaccatg

SEQ ID NO: 80651 - DNA, 25 bp, mus musculus
attgctgccatctaccatgcggcca

SEQ ID NO: 80652 - DNA, 25 bp, mus musculus
gccatctaccatgcggccaacgggg

SEQ ID NO: 80653 - DNA, 25 bp, mus musculus
acggctgcttctcgacccacgtctg

SEQ ID NO: 80654 - DNA, 25 bp, mus musculus
cggcaccgcgaggtcctggacgcca

SEQ ID NO: 80655 - DNA, 25 bp, mus musculus
gaggccacgccacgacacggactca

SEQ ID NO: 80656 - DNA, 25 bp, mus musculus
acacggactcaggccacgccacgat

SEQ ID NO: 80657 - DNA, 25 bp, mus musculus
cacggactcaggccacgccacgatg

SEQ ID NO: 80658 - DNA, 25 bp, mus musculus
cggactcaggccacgccacgatgaa

SEQ ID NO: 80659 - DNA, 25 bp, mus musculus
aggccacgccacgatgaagcaggac

SEQ ID NO: 80660 - DNA, 25 bp, mus musculus
gccacgccacgatgaagcaggacgc

SEQ ID NO: 80661 - DNA, 25 bp, mus musculus
cacgcccacgatgaagcaggacacg

SEQ ID NO: 80662 - DNA, 25 bp, mus musculus
cactatagaggccacgccaaccacg

SEQ ID NO: 80663 - DNA, 25 bp, mus musculus
ctatagaggccacgccaaccacgac

SEQ ID NO: 80664 - DNA, 25 bp, mus musculus
tatagaggccacgccaaccacgacc

SEQ ID NO: 80665 - DNA, 25 bp, mus musculus
aggtcctggacgccatcgacgccgc

SEQ ID NO: 80666 - DNA, 25 bp, mus musculus
gccccgcggcacctgatgtggaagc

SEQ ID NO: 80667 - DNA, 25 bp, mus musculus
ccccgcggcacctgatgtggaagcc

SEQ ID NO: 80668 - DNA, 25 bp, mus musculus
ccgcggcacctgatgtggaagccgt

SEQ ID NO: 80669 - DNA, 25 bp, mus musculus
cacctgatgtggaagccgtggctgc

SEQ ID NO: 80670 - DNA, 25 bp, mus musculus
acctgatgtggaagccgtggctgca

SEQ ID NO: 80671 - DNA, 25 bp, mus musculus
gcgatgacgacgcccactacggagg

SEQ ID NO: 80672 - DNA, 25 bp, mus musculus
actacggaggccacgccacgacacg

SEQ ID NO: 80673 - DNA, 25 bp, mus musculus
tgcttggatatccaggttcgagaaa

SEQ ID NO: 80674 - DNA, 25 bp, mus musculus
tggatatccaggttcgagaaaccca

SEQ ID NO: 80675 - DNA, 25 bp, mus musculus
acatgaacgtgcagtgccatgcctg

SEQ ID NO: 80676 - DNA, 25 bp, mus musculus
aggacatccggaagctggactacgg

SEQ ID NO: 80677 - DNA, 25 bp, mus musculus
gacatccggaagctggactacgggc

SEQ ID NO: 80678 - DNA, 25 bp, mus musculus
tccggaagctggactacgggcagca

SEQ ID NO: 80679 - DNA, 25 bp, mus musculus
agctggactacgggcagcacgtggt

SEQ ID NO: 80680 - DNA, 25 bp, mus musculus
acgcagggacgcgtctgtgatatga

SEQ ID NO: 80681 - DNA, 25 bp, mus musculus
agggacgcgtctgtgatatgatccg

SEQ ID NO: 80682 - DNA, 25 bp, mus musculus
gtgatatgatccgccggagaagttt

SEQ ID NO: 80683 - DNA, 25 bp, mus musculus
tatgatccgccggagaagtttactg

SEQ ID NO: 80684 - DNA, 25 bp, mus musculus
tgatccgccggagaagtttactgac

SEQ ID NO: 80685 - DNA, 25 bp, mus musculus
ttcgagaaacccaagctttgatcct

SEQ ID NO: 80686 - DNA, 25 bp, mus musculus
cgagaaacccaagctttgatcctgg

SEQ ID NO: 80687 - DNA, 25 bp, mus musculus
acccaagctttgatcctggctccaa

SEQ ID NO: 80688 - DNA, 25 bp, mus musculus
aagctttgatcctggctccaaccag

SEQ ID NO: 80689 - DNA, 25 bp, mus musculus
gctttgatcctggctccaaccaggg

SEQ ID NO: 80690 - DNA, 25 bp, mus musculus
tgatcctggctccaaccagggaatt

SEQ ID NO: 80691 - DNA, 25 bp, mus musculus
tggctccaaccagggaattagcggt

SEQ ID NO: 80692 - DNA, 25 bp, mus musculus
gctccaaccagggaattagcggtgc

SEQ ID NO: 80693 - DNA, 25 bp, mus musculus
ctagctttcatttcgaagtctttga

SEQ ID NO: 80694 - DNA, 25 bp, mus musculus
ttcatttcgaagtctttgacctcaa

SEQ ID NO: 80695 - DNA, 25 bp, mus musculus
gcaccccagtcacgtgctgttataa

SEQ ID NO: 80696 - DNA, 25 bp, mus musculus
cagtcacgtgctgttataatgttgt

SEQ ID NO: 80697 - DNA, 25 bp, mus musculus
agaagattcacgtccggaagctgaa

SEQ ID NO: 80698 - DNA, 25 bp, mus musculus
gtccccgggaagctgtgatcttcag

SEQ ID NO: 80699 - DNA, 25 bp, mus musculus
ctgtgatcttcaggaccatactgga

SEQ ID NO: 80700 - DNA, 25 bp, mus musculus
taaaccacttggataagacgtctca

SEQ ID NO: 80701 - DNA, 25 bp, mus musculus
ataagacgtctcaaaccttcatcct

SEQ ID NO: 80702 - DNA, 25 bp, mus musculus
tcatccttgaaccttcatgtctagg

SEQ ID NO: 80703 - DNA, 25 bp, mus musculus
ttgaaccttcatgtctaggctgaga

SEQ ID NO: 80704 - DNA, 25 bp, mus musculus
cttcatgtctaggctgagagttcca

SEQ ID NO: 80705 - DNA, 25 bp, mus musculus
tctttgacctcaacatgaagatttc

SEQ ID NO: 80706 - DNA, 25 bp, mus musculus
acctcaacatgaagatttccacact

SEQ ID NO: 80707 - DNA, 25 bp, mus musculus
agatttccacacttctatgcctcct

SEQ ID NO: 80708 - DNA, 25 bp, mus musculus
ttctatgcctcctgctcatagctac

SEQ ID NO: 80709 - DNA, 25 bp, mus musculus
tgctcatagctaccaccatcagtcc

SEQ ID NO: 80710 - DNA, 25 bp, mus musculus
tagctaccaccatcagtcctcaggt

SEQ ID NO: 80711 - DNA, 25 bp, mus musculus
tcagtcctcaggtattggctggacc

SEQ ID NO: 80712 - DNA, 25 bp, mus musculus
ctggaccagatgcggtgagcacccc

SEQ ID NO: 80713 - DNA, 25 bp, mus musculus
aaggctccaggaggcactgacaaga

SEQ ID NO: 80714 - DNA, 25 bp, mus musculus
gctccaggaggcactgacaagagca

SEQ ID NO: 80715 - DNA, 25 bp, mus musculus
cttaccccacgacgggtgagctctg

SEQ ID NO: 80716 - DNA, 25 bp, mus musculus
caactctccctggagcaccgagatt

SEQ ID NO: 80717 - DNA, 25 bp, mus musculus
ctctccctggagcaccgagattcct

SEQ ID NO: 80718 - DNA, 25 bp, mus musculus
tccctggagcaccgagattcctgag

SEQ ID NO: 80719 - DNA, 25 bp, mus musculus
ctggagcaccgagattcctgagagc

SEQ ID NO: 80720 - DNA, 25 bp, mus musculus
caccgagattcctgagagctatggg

SEQ ID NO: 80721 - DNA, 25 bp, mus musculus
gattcctgagagctatgggcacggg

SEQ ID NO: 80722 - DNA, 25 bp, mus musculus
cactccctgagcttttgctgcctta

SEQ ID NO: 80723 - DNA, 25 bp, mus musculus
tccctgagcttttgctgccttaacc

SEQ ID NO: 80724 - DNA, 25 bp, mus musculus
ctgagcttttgctgccttaaccgcc

SEQ ID NO: 80725 - DNA, 25 bp, mus musculus
actgacatcagtgacgaagatgagg

SEQ ID NO: 80726 - DNA, 25 bp, mus musculus
aagccagagcccggagaggcaccgg

SEQ ID NO: 80727 - DNA, 25 bp, mus musculus
tgcatgccccttaaactgcgcttta

SEQ ID NO: 80728 - DNA, 25 bp, mus musculus
cttaaactgcgctttaagcggcgct

SEQ ID NO: 80729 - DNA, 25 bp, mus musculus
aaactgcgctttaagcggcgctgga

SEQ ID NO: 80730 - DNA, 25 bp, mus musculus
cgctttaagcggcgctggagtgaag

SEQ ID NO: 80731 - DNA, 25 bp, mus musculus
tttaagcggcgctggagtgaagact

SEQ ID NO: 80732 - DNA, 25 bp, mus musculus
aagcggcgctggagtgaagactgtc

SEQ ID NO: 80733 - DNA, 25 bp, mus musculus
cagatgcaccatcaagcctgccacg

SEQ ID NO: 80734 - DNA, 25 bp, mus musculus
atgcaccatcaagcctgccacgaga

SEQ ID NO: 80735 - DNA, 25 bp, mus musculus
acatagctagagcctgtgttctgtg

SEQ ID NO: 80736 - DNA, 25 bp, mus musculus
tgtgcttccaagggagttctgaaga

SEQ ID NO: 80737 - DNA, 25 bp, mus musculus
gcttccaagggagttctgaagaagg

SEQ ID NO: 80738 - DNA, 25 bp, mus musculus
gccacacaaacattgggacttcttt

SEQ ID NO: 80739 - DNA, 25 bp, mus musculus
taaatccagcttttattgttaggtg

SEQ ID NO: 80740 - DNA, 25 bp, mus musculus
actttattagatgcctgcgctggga

SEQ ID NO: 80741 - DNA, 25 bp, mus musculus
tgtagacgttcctaaatcttcttga

SEQ ID NO: 80742 - DNA, 25 bp, mus musculus
agacgttcctaaatcttcttgagtg

SEQ ID NO: 80743 - DNA, 25 bp, mus musculus
taaatcttcttgagtgcattatgta

SEQ ID NO: 80744 - DNA, 25 bp, mus musculus
atcttcttgagtgcattatgtatta

SEQ ID NO: 80745 - DNA, 25 bp, mus musculus
gcctgccacgagaagaaggggactt

SEQ ID NO: 80746 - DNA, 25 bp, mus musculus
cagggtcttcacttactcagcgagt

SEQ ID NO: 80747 - DNA, 25 bp, mus musculus
cacttactcagcgagtgattattgg

SEQ ID NO: 80748 - DNA, 25 bp, mus musculus
ttactcagcgagtgattattggccg

SEQ ID NO: 80749 - DNA, 25 bp, mus musculus
tgattattggccgcagttatcagag

SEQ ID NO: 80750 - DNA, 25 bp, mus musculus
ttggccgcagttatcagagtaagga

SEQ ID NO: 80751 - DNA, 25 bp, mus musculus
tggacttcaacatagctagagcctg

SEQ ID NO: 80752 - DNA, 25 bp, mus musculus
tcaacatagctagagcctgtgttct

SEQ ID NO: 80753 - DNA, 25 bp, mus musculus
ctccacctggcttgcagacaaactg

SEQ ID NO: 80754 - DNA, 25 bp, mus musculus
caaactgccttgagacagtgaccga

SEQ ID NO: 80755 - DNA, 25 bp, mus musculus
tttttctgctattgtgactgtgaag

SEQ ID NO: 80756 - DNA, 25 bp, mus musculus
ggaaacactgttcactctgagcgac

SEQ ID NO: 80757 - DNA, 25 bp, mus musculus
actgttcactctgagcgaccatttc

SEQ ID NO: 80758 - DNA, 25 bp, mus musculus
cactctgagcgaccatttcgtttta

SEQ ID NO: 80759 - DNA, 25 bp, mus musculus
atttttctggagtcaatggcttgtt

SEQ ID NO: 80760 - DNA, 25 bp, mus musculus
tcaatggcttgttcagcatccagat

SEQ ID NO: 80761 - DNA, 25 bp, mus musculus
tcagcatccagatgtggctgttgac

SEQ ID NO: 80762 - DNA, 25 bp, mus musculus
tgttgacatatctacacttcgcacc

SEQ ID NO: 80763 - DNA, 25 bp, mus musculus
tacacttcgcaccggagtgactgga

SEQ ID NO: 80764 - DNA, 25 bp, mus musculus
tcgcaccggagtgactggaattgtg

SEQ ID NO: 80765 - DNA, 25 bp, mus musculus
tggttctgctgccctactcaagcag

SEQ ID NO: 80766 - DNA, 25 bp, mus musculus
tgctgccctactcaagcagggtggc

SEQ ID NO: 80767 - DNA, 25 bp, mus musculus
aatgggcactccagggacacagctt

SEQ ID NO: 80768 - DNA, 25 bp, mus musculus
cactccagggacacagcttgggaca

SEQ ID NO: 80769 - DNA, 25 bp, mus musculus
acagtctcacacagcctcttctaat

SEQ ID NO: 80770 - DNA, 25 bp, mus musculus
tcacacagcctcttctaatgggctc

SEQ ID NO: 80771 - DNA, 25 bp, mus musculus
ttctaatgggctctcggggccattt

SEQ ID NO: 80772 - DNA, 25 bp, mus musculus
tgtaataacagctgcaggtttttct

SEQ ID NO: 80773 - DNA, 25 bp, mus musculus
aatcaagtccacaggaagtcctgtg

SEQ ID NO: 80774 - DNA, 25 bp, mus musculus
gtaaatccagtcttggctaaaagct

SEQ ID NO: 80775 - DNA, 25 bp, mus musculus
ctgggccccaagaacggatcattca

SEQ ID NO: 80776 - DNA, 25 bp, mus musculus
tgggccccaagaacggatcattcaa

SEQ ID NO: 80777 - DNA, 25 bp, mus musculus
tgagattactaaaccacgcattgag

SEQ ID NO: 80778 - DNA, 25 bp, mus musculus
agattactaaaccacgcattgagta

SEQ ID NO: 80779 - DNA, 25 bp, mus musculus
gattactaaaccacgcattgagtat

SEQ ID NO: 80780 - DNA, 25 bp, mus musculus
ttactaaaccacgcattgagtatgg

SEQ ID NO: 80781 - DNA, 25 bp, mus musculus
ctaaaccacgcattgagtatggaga

SEQ ID NO: 80782 - DNA, 25 bp, mus musculus
taaaccacgcattgagtatggagaa

SEQ ID NO: 80783 - DNA, 25 bp, mus musculus
aaccacgcattgagtatggagaata

SEQ ID NO: 80784 - DNA, 25 bp, mus musculus
accacgcattgagtatggagaatag

SEQ ID NO: 80785 - DNA, 25 bp, mus musculus
aatccagtcttggctaaaagctcct

SEQ ID NO: 80786 - DNA, 25 bp, mus musculus
cttggctaaaagctccttctcagtg

SEQ ID NO: 80787 - DNA, 25 bp, mus musculus
ggctaaaagctccttctcagtgact

SEQ ID NO: 80788 - DNA, 25 bp, mus musculus
gctaaaagctccttctcagtgactt

SEQ ID NO: 80789 - DNA, 25 bp, mus musculus
aagctccttctcagtgacttgtacc

SEQ ID NO: 80790 - DNA, 25 bp, mus musculus
agctccttctcagtgacttgtaccg

SEQ ID NO: 80791 - DNA, 25 bp, mus musculus
ctgctgggccccaagaacggatcat

SEQ ID NO: 80792 - DNA, 25 bp, mus musculus
tgctgggccccaagaacggatcatt

SEQ ID NO: 80793 - DNA, 25 bp, mus musculus
actggtcatagctactcgcggcatg

SEQ ID NO: 80794 - DNA, 25 bp, mus musculus
ctggtcatagctactcgcggcatgt

SEQ ID NO: 80795 - DNA, 25 bp, mus musculus
actcgcggcatgtggacgattggaa

SEQ ID NO: 80796 - DNA, 25 bp, mus musculus
tcgcggcatgtggacgattggaaca

SEQ ID NO: 80797 - DNA, 25 bp, mus musculus
gaacaggaactcggtgcgtggatgc

SEQ ID NO: 80798 - DNA, 25 bp, mus musculus
aacaggaactcggtgcgtggatgca

SEQ ID NO: 80799 - DNA, 25 bp, mus musculus
acaggaactcggtgcgtggatgcaa

SEQ ID NO: 80800 - DNA, 25 bp, mus musculus
aggaactcggtgcgtggatgcaatg

SEQ ID NO: 80801 - DNA, 25 bp, mus musculus
ggaactcggtgcgtggatgcaatgc

SEQ ID NO: 80802 - DNA, 25 bp, mus musculus
gaactcggtgcgtggatgcaatgct

SEQ ID NO: 80803 - DNA, 25 bp, mus musculus
actcggtgcgtggatgcaatgctgg

SEQ ID NO: 80804 - DNA, 25 bp, mus musculus
ctcggtgcgtggatgcaatgctggt

SEQ ID NO: 80805 - DNA, 25 bp, mus musculus
ggtcatagctactcgcggcatgtgg

SEQ ID NO: 80806 - DNA, 25 bp, mus musculus
gtcatagctactcgcggcatgtgga

SEQ ID NO: 80807 - DNA, 25 bp, mus musculus
tcatagctactcgcggcatgtggac

SEQ ID NO: 80808 - DNA, 25 bp, mus musculus
atagctactcgcggcatgtggacga

SEQ ID NO: 80809 - DNA, 25 bp, mus musculus
tagctactcgcggcatgtggacgat

SEQ ID NO: 80810 - DNA, 25 bp, mus musculus
agctactcgcggcatgtggacgatt

SEQ ID NO: 80811 - DNA, 25 bp, mus musculus
ctactcgcggcatgtggacgattgg

SEQ ID NO: 80812 - DNA, 25 bp, mus musculus
tactcgcggcatgtggacgattgga

SEQ ID NO: 80813 - DNA, 25 bp, mus musculus
acccaaagtcatcattgtgcaggcc

SEQ ID NO: 80814 - DNA, 25 bp, mus musculus
accccagttgtgcagaggtgtagat

SEQ ID NO: 80815 - DNA, 25 bp, mus musculus
ctttgatatattcctgaaggtgcaa

SEQ ID NO: 80816 - DNA, 25 bp, mus musculus
aagtattcattcccagatgcccacc

SEQ ID NO: 80817 - DNA, 25 bp, mus musculus
tcattcccagatgcccaccattgat

SEQ ID NO: 80818 - DNA, 25 bp, mus musculus
ccagatgcccaccattgatcgggca

SEQ ID NO: 80819 - DNA, 25 bp, mus musculus
gcccaccattgatcgggcaaccttg

SEQ ID NO: 80820 - DNA, 25 bp, mus musculus
ctttcctggcaactgagaacaaagc

SEQ ID NO: 80821 - DNA, 25 bp, mus musculus
gcaactgaatctcatttcttcagct

SEQ ID NO: 80822 - DNA, 25 bp, mus musculus
tcttggccaaggatcacattctatt

SEQ ID NO: 80823 - DNA, 25 bp, mus musculus
atgaattcaagaccagcctaagcaa

SEQ ID NO: 80824 - DNA, 25 bp, mus musculus
tctgttccatagacaagcaaacaag

SEQ ID NO: 80825 - DNA, 25 bp, mus musculus
agctgatgctgtcaagctgagccac

SEQ ID NO: 80826 - DNA, 25 bp, mus musculus
tgctgtcaagctgagccacgtggag

SEQ ID NO: 80827 - DNA, 25 bp, mus musculus
gaaggacttcattgccttctactct

SEQ ID NO: 80828 - DNA, 25 bp, mus musculus
cttcattgccttctactctacaacc

SEQ ID NO: 80829 - DNA, 25 bp, mus musculus
aggaggctcttacttcatcactaga

SEQ ID NO: 80830 - DNA, 25 bp, mus musculus
ctcttacttcatcactagactcatt

SEQ ID NO: 80831 - DNA, 25 bp, mus musculus
cttccggaaacatgcttgctcttgt

SEQ ID NO: 80832 - DNA, 25 bp, mus musculus
tcatctctttgatatattcctgaag

SEQ ID NO: 80833 - DNA, 25 bp, mus musculus
tgagcgtagcatctacactgacaac

SEQ ID NO: 80834 - DNA, 25 bp, mus musculus
gagcgtagcatctacactgacaacc

SEQ ID NO: 80835 - DNA, 25 bp, mus musculus
actgacaaccggcagattggcaccg

SEQ ID NO: 80836 - DNA, 25 bp, mus musculus
cgttagtatacggtccaggatgaga

SEQ ID NO: 80837 - DNA, 25 bp, mus musculus
ggtaaccctatcatctgtctcctgc

SEQ ID NO: 80838 - DNA, 25 bp, mus musculus
gtaaccctatcatctgtctcctgcg

SEQ ID NO: 80839 - DNA, 25 bp, mus musculus
atctgtctcctgcggatgggacaag

SEQ ID NO: 80840 - DNA, 25 bp, mus musculus
aaactggctaacatgactctataga

SEQ ID NO: 80841 - DNA, 25 bp, mus musculus
aactggctaacatgactctatagac

SEQ ID NO: 80842 - DNA, 25 bp, mus musculus
ctggctaacatgactctatagacca

SEQ ID NO: 80843 - DNA, 25 bp, mus musculus
tggctaacatgactctatagaccag

SEQ ID NO: 80844 - DNA, 25 bp, mus musculus
ggctaacatgactctatagaccagc

SEQ ID NO: 80845 - DNA, 25 bp, mus musculus
agcgtagcatctacactgacaaccg

SEQ ID NO: 80846 - DNA, 25 bp, mus musculus
ctaacatgactctatagaccagcca

SEQ ID NO: 80847 - DNA, 25 bp, mus musculus
gcgtagcatctacactgacaaccgg

SEQ ID NO: 80848 - DNA, 25 bp, mus musculus
gtagcatctacactgacaaccggca

SEQ ID NO: 80849 - DNA, 25 bp, mus musculus
tagcatctacactgacaaccggcag

SEQ ID NO: 80850 - DNA, 25 bp, mus musculus
agcatctacactgacaaccggcaga

SEQ ID NO: 80851 - DNA, 25 bp, mus musculus
gcatctacactgacaaccggcagat

SEQ ID NO: 80852 - DNA, 25 bp, mus musculus
tacactgacaaccggcagattggca

SEQ ID NO: 80853 - DNA, 25 bp, mus musculus
cactgacaaccggcagattggcacc

SEQ ID NO: 80854 - DNA, 25 bp, mus musculus
agtatactgccatgcaaacggtttt

SEQ ID NO: 80855 - DNA, 25 bp, mus musculus
gtatactgccatgcaaacggtttta

SEQ ID NO: 80856 - DNA, 25 bp, mus musculus
aagcctttgcttggcagtgtagtct

SEQ ID NO: 80857 - DNA, 25 bp, mus musculus
agcctttgcttggcagtgtagtctc

SEQ ID NO: 80858 - DNA, 25 bp, mus musculus
gcctttgcttggcagtgtagtctcc

SEQ ID NO: 80859 - DNA, 25 bp, mus musculus
cctttgcttggcagtgtagtctcca

SEQ ID NO: 80860 - DNA, 25 bp, mus musculus
ctttgcttggcagtgtagtctccat

SEQ ID NO: 80861 - DNA, 25 bp, mus musculus
tttgcttggcagtgtagtctccata

SEQ ID NO: 80862 - DNA, 25 bp, mus musculus
ttgcttggcagtgtagtctccatat

SEQ ID NO: 80863 - DNA, 25 bp, mus musculus
cagtgtagtctccatatccataaaa

SEQ ID NO: 80864 - DNA, 25 bp, mus musculus
agtgtagtctccatatccataaaag

SEQ ID NO: 80865 - DNA, 25 bp, mus musculus
gtgtagtctccatatccataaaaga

SEQ ID NO: 80866 - DNA, 25 bp, mus musculus
tatactgccatgcaaacggttttac

SEQ ID NO: 80867 - DNA, 25 bp, mus musculus
tactgccatgcaaacggttttacca

SEQ ID NO: 80868 - DNA, 25 bp, mus musculus
actgccatgcaaacggttttaccag

SEQ ID NO: 80869 - DNA, 25 bp, mus musculus
ctgccatgcaaacggttttaccaga

SEQ ID NO: 80870 - DNA, 25 bp, mus musculus
ccatgcaaacggttttaccagattg

SEQ ID NO: 80871 - DNA, 25 bp, mus musculus
catgcaaacggttttaccagattga

SEQ ID NO: 80872 - DNA, 25 bp, mus musculus
taaagcctttgcttggcagtgtagt

SEQ ID NO: 80873 - DNA, 25 bp, mus musculus
aaagcctttgcttggcagtgtagtc

SEQ ID NO: 80874 - DNA, 25 bp, mus musculus
aaggaagccaccatttggctcaagc

SEQ ID NO: 80875 - DNA, 25 bp, mus musculus
aggaagccaccatttggctcaagct

SEQ ID NO: 80876 - DNA, 25 bp, mus musculus
tttggctcaagcttgaggaatgtga

SEQ ID NO: 80877 - DNA, 25 bp, mus musculus
tggctcaagcttgaggaatgtgaaa

SEQ ID NO: 80878 - DNA, 25 bp, mus musculus
tgaaattgccagggttatggattat

SEQ ID NO: 80879 - DNA, 25 bp, mus musculus
gaaattgccagggttatggattatc

SEQ ID NO: 80880 - DNA, 25 bp, mus musculus
aaattgccagggttatggattatct

SEQ ID NO: 80881 - DNA, 25 bp, mus musculus
ttatcttgaaccgtaacaggatcca

SEQ ID NO: 80882 - DNA, 25 bp, mus musculus
tatcttgaaccgtaacaggatccag

SEQ ID NO: 80883 - DNA, 25 bp, mus musculus
tcttgaaccgtaacaggatccagga

SEQ ID NO: 80884 - DNA, 25 bp, mus musculus
tgaaccgtaacaggatccaggagtt

SEQ ID NO: 80885 - DNA, 25 bp, mus musculus
tatgttcgccttcctgggggcttgg

SEQ ID NO: 80886 - DNA, 25 bp, mus musculus
gaagccaccatttggctcaagcttg

SEQ ID NO: 80887 - DNA, 25 bp, mus musculus
aagccaccatttggctcaagcttga

SEQ ID NO: 80888 - DNA, 25 bp, mus musculus
agccaccatttggctcaagcttgag

SEQ ID NO: 80889 - DNA, 25 bp, mus musculus
ccaccatttggctcaagcttgagga

SEQ ID NO: 80890 - DNA, 25 bp, mus musculus
caccatttggctcaagcttgaggaa

SEQ ID NO: 80891 - DNA, 25 bp, mus musculus
accatttggctcaagcttgaggaat

SEQ ID NO: 80892 - DNA, 25 bp, mus musculus
catttggctcaagcttgaggaatgt

SEQ ID NO: 80893 - DNA, 25 bp, mus musculus
atttggctcaagcttgaggaatgtg

SEQ ID NO: 80894 - DNA, 25 bp, mus musculus
atagctaccttgtgtctggtgtgct

SEQ ID NO: 80895 - DNA, 25 bp, mus musculus
accttgtgtctggtgtgctgagaat

SEQ ID NO: 80896 - DNA, 25 bp, mus musculus
gcttgtgcacatactccttcactac

SEQ ID NO: 80897 - DNA, 25 bp, mus musculus
actccttcactacactgtcaggtcc

SEQ ID NO: 80898 - DNA, 25 bp, mus musculus
tcactacactgtcaggtccgtgtgt

SEQ ID NO: 80899 - DNA, 25 bp, mus musculus
cacacccagttctgaaactgacatc

SEQ ID NO: 80900 - DNA, 25 bp, mus musculus
cagggataccctccagcctaacgat

SEQ ID NO: 80901 - DNA, 25 bp, mus musculus
ccagcctaacgataggctctgaatt

SEQ ID NO: 80902 - DNA, 25 bp, mus musculus
ctgaattactcagtctctgggaaac

SEQ ID NO: 80903 - DNA, 25 bp, mus musculus
ttctagactgagctcagccttccct

SEQ ID NO: 80904 - DNA, 25 bp, mus musculus
cttccctcagcaggcatcactggca

SEQ ID NO: 80905 - DNA, 25 bp, mus musculus
tcagcaggcatcactggcagcccct

SEQ ID NO: 80906 - DNA, 25 bp, mus musculus
gatacagactgccctagagtgttag

SEQ ID NO: 80907 - DNA, 25 bp, mus musculus
gactgccctagagtgttagaatggg

SEQ ID NO: 80908 - DNA, 25 bp, mus musculus
agctccttgcttcctgaagaaccag

SEQ ID NO: 80909 - DNA, 25 bp, mus musculus
ttgcttcctgaagaaccagagctcc

SEQ ID NO: 80910 - DNA, 25 bp, mus musculus
gaaccagagctcctgtggcccttgc

SEQ ID NO: 80911 - DNA, 25 bp, mus musculus
gagctcctgtggcccttgctaacca

SEQ ID NO: 80912 - DNA, 25 bp, mus musculus
gcctcttagagatttgcatgggacg

SEQ ID NO: 80913 - DNA, 25 bp, mus musculus
tttgcatgggacgtgcatgcttgtg

SEQ ID NO: 80914 - DNA, 25 bp, mus musculus
tttcttgttcggtacctagcattgg

SEQ ID NO: 80915 - DNA, 25 bp, mus musculus
ttcttgttcggtacctagcattgga

SEQ ID NO: 80916 - DNA, 25 bp, mus musculus
ggcatcgactccaccggtatcgtac

SEQ ID NO: 80917 - DNA, 25 bp, mus musculus
gcatcgactccaccggtatcgtaca

SEQ ID NO: 80918 - DNA, 25 bp, mus musculus
catcgactccaccggtatcgtacac

SEQ ID NO: 80919 - DNA, 25 bp, mus musculus
atcgactccaccggtatcgtacacg

SEQ ID NO: 80920 - DNA, 25 bp, mus musculus
gactccaccggtatcgtacacggtg

SEQ ID NO: 80921 - DNA, 25 bp, mus musculus
caccggtatcgtacacggtgacagc

SEQ ID NO: 80922 - DNA, 25 bp, mus musculus
accggtatcgtacacggtgacagcg

SEQ ID NO: 80923 - DNA, 25 bp, mus musculus
ggtatcgtacacggtgacagcgacg

SEQ ID NO: 80924 - DNA, 25 bp, mus musculus
gtatcgtacacggtgacagcgacgt

SEQ ID NO: 80925 - DNA, 25 bp, mus musculus
gtacacggtgacagcgacgtgcagc

SEQ ID NO: 80926 - DNA, 25 bp, mus musculus
tcttgttcggtacctagcattggaa

SEQ ID NO: 80927 - DNA, 25 bp, mus musculus
tgttcggtacctagcattggaacca

SEQ ID NO: 80928 - DNA, 25 bp, mus musculus
gttcggtacctagcattggaaccat

SEQ ID NO: 80929 - DNA, 25 bp, mus musculus
ttcggtacctagcattggaaccatc

SEQ ID NO: 80930 - DNA, 25 bp, mus musculus
tcggtacctagcattggaaccatca

SEQ ID NO: 80931 - DNA, 25 bp, mus musculus
gtacctagcattggaaccatcagag

SEQ ID NO: 80932 - DNA, 25 bp, mus musculus
acctagcattggaaccatcagagac

SEQ ID NO: 80933 - DNA, 25 bp, mus musculus
atggcatcgactccaccggtatcgt

SEQ ID NO: 80934 - DNA, 25 bp, mus musculus
tcttctcagagttcaggaaaaacag

SEQ ID NO: 80935 - DNA, 25 bp, mus musculus
ggctgccttagtattctgttcctca

SEQ ID NO: 80936 - DNA, 25 bp, mus musculus
aatacagagtccagccattaccatt

SEQ ID NO: 80937 - DNA, 25 bp, mus musculus
gagtccagccattaccattctcctg

SEQ ID NO: 80938 - DNA, 25 bp, mus musculus
agccattaccattctcctgcgttac

SEQ ID NO: 80939 - DNA, 25 bp, mus musculus
taccattctcctgcgttactttgac

SEQ ID NO: 80940 - DNA, 25 bp, mus musculus
tctcctgcgttactttgacatggga

SEQ ID NO: 80941 - DNA, 25 bp, mus musculus
gattggatcatctctacttctgtat

SEQ ID NO: 80942 - DNA, 25 bp, mus musculus
atttattactagacctcaaccacag

SEQ ID NO: 80943 - DNA, 25 bp, mus musculus
tactagacctcaaccacagccttct

SEQ ID NO: 80944 - DNA, 25 bp, mus musculus
tccactctctgcctgtaggatgtac

SEQ ID NO: 80945 - DNA, 25 bp, mus musculus
aatctacagatctgttttgtacttt

SEQ ID NO: 80946 - DNA, 25 bp, mus musculus
cttagtattctgttcctcatgatta

SEQ ID NO: 80947 - DNA, 25 bp, mus musculus
ttgtggcatcctatagttttacatt

SEQ ID NO: 80948 - DNA, 25 bp, mus musculus
catcctatagttttacattgtgtat

SEQ ID NO: 80949 - DNA, 25 bp, mus musculus
taccacgtgcacagacagcccaatg

SEQ ID NO: 80950 - DNA, 25 bp, mus musculus
gtgcacagacagcccaatgagtggg

SEQ ID NO: 80951 - DNA, 25 bp, mus musculus
agacagcccaatgagtgggccattt

SEQ ID NO: 80952 - DNA, 25 bp, mus musculus
tctccacaaccctggtgtaatacag

SEQ ID NO: 80953 - DNA, 25 bp, mus musculus
caaccctggtgtaatacagagtcca

SEQ ID NO: 80954 - DNA, 25 bp, mus musculus
cttccaagccttcattgacttcatg

SEQ ID NO: 80955 - DNA, 25 bp, mus musculus
tgacttcatgacccgagagactgcc

SEQ ID NO: 80956 - DNA, 25 bp, mus musculus
gatggcgccctacaagggatctggg

SEQ ID NO: 80957 - DNA, 25 bp, mus musculus
gccctacaagggatctggggctcca

SEQ ID NO: 80958 - DNA, 25 bp, mus musculus
ggctccatctggagctctggactac

SEQ ID NO: 80959 - DNA, 25 bp, mus musculus
tccatctggagctctggactacgtg

SEQ ID NO: 80960 - DNA, 25 bp, mus musculus
tctggactacgtggctttctctagt

SEQ ID NO: 80961 - DNA, 25 bp, mus musculus
ggactacgtggctttctctagtgcc

SEQ ID NO: 80962 - DNA, 25 bp, mus musculus
tttctctagtgccctctatggagag

SEQ ID NO: 80963 - DNA, 25 bp, mus musculus
tagtgccctctatggagagagtgac

SEQ ID NO: 80964 - DNA, 25 bp, mus musculus
cctctgacattctccgtggaaaagg

SEQ ID NO: 80965 - DNA, 25 bp, mus musculus
ctgacattctccgtggaaaaggaga

SEQ ID NO: 80966 - DNA, 25 bp, mus musculus
gacccgagagactgccgagacagac

SEQ ID NO: 80967 - DNA, 25 bp, mus musculus
ccgagagactgccgagacagacacg

SEQ ID NO: 80968 - DNA, 25 bp, mus musculus
tgccgagacagacacggctgaacaa

SEQ ID NO: 80969 - DNA, 25 bp, mus musculus
agtggtagcctccttcaaaatcctg

SEQ ID NO: 80970 - DNA, 25 bp, mus musculus
ctacattaccccagaggagctgcgg

SEQ ID NO: 80971 - DNA, 25 bp, mus musculus
taccccagaggagctgcggagagag

SEQ ID NO: 80972 - DNA, 25 bp, mus musculus
tgagtactgcatccgtcggatggcg

SEQ ID NO: 80973 - DNA, 25 bp, mus musculus
catccgtcggatggcgccctacaag

SEQ ID NO: 80974 - DNA, 25 bp, mus musculus
atcaaagctaccattgctggtggtg

SEQ ID NO: 80975 - DNA, 25 bp, mus musculus
cacatccacaaatcgctgatcggga

SEQ ID NO: 80976 - DNA, 25 bp, mus musculus
ctgcattcgagtcttaaccatattt

SEQ ID NO: 80977 - DNA, 25 bp, mus musculus
tcgagtcttaaccatatttaagtgt

SEQ ID NO: 80978 - DNA, 25 bp, mus musculus
ttactgtggcttcaaagaagctatt

SEQ ID NO: 80979 - DNA, 25 bp, mus musculus
acagacattgtttccactctggtgg

SEQ ID NO: 80980 - DNA, 25 bp, mus musculus
tccactctggtggataagctcaata

SEQ ID NO: 80981 - DNA, 25 bp, mus musculus
gggtcttaccttagatctcactcag

SEQ ID NO: 80982 - DNA, 25 bp, mus musculus
agatctcactcagcaacaagtacat

SEQ ID NO: 80983 - DNA, 25 bp, mus musculus
gcaacaagtacattctctgcttact

SEQ ID NO: 80984 - DNA, 25 bp, mus musculus
agtacattctctgcttactaattaa

SEQ ID NO: 80985 - DNA, 25 bp, mus musculus
ttctctgcttactaattaaacagtg

SEQ ID NO: 80986 - DNA, 25 bp, mus musculus
cacaaatcgctgatcgggaagaaag

SEQ ID NO: 80987 - DNA, 25 bp, mus musculus
aattaaacagtgcatctgtagtcat

SEQ ID NO: 80988 - DNA, 25 bp, mus musculus
tgcctggattccttattatctcagg

SEQ ID NO: 80989 - DNA, 25 bp, mus musculus
gattccttattatctcaggactcta

SEQ ID NO: 80990 - DNA, 25 bp, mus musculus
ttattatctcaggactctaaatatt

SEQ ID NO: 80991 - DNA, 25 bp, mus musculus
cagctgtccagtgttggtgattcca

SEQ ID NO: 80992 - DNA, 25 bp, mus musculus
tccagtgttggtgattccagtggac

SEQ ID NO: 80993 - DNA, 25 bp, mus musculus
gattccagtggactgtatctctgtg

SEQ ID NO: 80994 - DNA, 25 bp, mus musculus
ccaaccaaatttctgcattcgagtc

SEQ ID NO: 80995 - DNA, 25 bp, mus musculus
cagcaggaaccacaacaaaacgcca

SEQ ID NO: 80996 - DNA, 25 bp, mus musculus
agcaggaaccacaacaaaacgccag

SEQ ID NO: 80997 - DNA, 25 bp, mus musculus
gcaggaaccacaacaaaacgccagc

SEQ ID NO: 80998 - DNA, 25 bp, mus musculus
aggaaccacaacaaaacgccagcag

SEQ ID NO: 80999 - DNA, 25 bp, mus musculus
ggaaccacaacaaaacgccagcagg

SEQ ID NO: 81000 - DNA, 25 bp, mus musculus
gaaccacaacaaaacgccagcaggg

SEQ ID NO: 81001 - DNA, 25 bp, mus musculus
accacaacaaaacgccagcagggcg

SEQ ID NO: 81002 - DNA, 25 bp, mus musculus
ccacaacaaaacgccagcagggcgg

SEQ ID NO: 81003 - DNA, 25 bp, mus musculus
cagcaggaaccacaacaaaacgcca

SEQ ID NO: 81004 - DNA, 25 bp, mus musculus
agcaggaaccacaacaaaacgccag

SEQ ID NO: 81005 - DNA, 25 bp, mus musculus
gcaggaaccacaacaaaacgccagc

SEQ ID NO: 81006 - DNA, 25 bp, mus musculus
aggaaccacaacaaaacgccagcag

SEQ ID NO: 81007 - DNA, 25 bp, mus musculus
ggaaccacaacaaaacgccagcagg

SEQ ID NO: 81008 - DNA, 25 bp, mus musculus
gaaccacaacaaaacgccagcaggg

SEQ ID NO: 81009 - DNA, 25 bp, mus musculus
accacaacaaaacgccagcagggcg

SEQ ID NO: 81010 - DNA, 25 bp, mus musculus
ccacaacaaaacgccagcagggcgg

SEQ ID NO: 81011 - DNA, 25 bp, mus musculus
cacaacaaaacgccagcagggcggg

SEQ ID NO: 81012 - DNA, 25 bp, mus musculus
agcagcagcggggcggctgaggcag

SEQ ID NO: 81013 - DNA, 25 bp, mus musculus
gttgtacacttggggatctacacac

SEQ ID NO: 81014 - DNA, 25 bp, mus musculus
acacactcacagctgaaaatgtttt

SEQ ID NO: 81015 - DNA, 25 bp, mus musculus
tttccttaaacatgaagttgataag

SEQ ID NO: 81016 - DNA, 25 bp, mus musculus
cactccacttgatgcacatgagtct

SEQ ID NO: 81017 - DNA, 25 bp, mus musculus
tccacttgatgcacatgagtcttcc

SEQ ID NO: 81018 - DNA, 25 bp, mus musculus
acttgatgcacatgagtcttcccca

SEQ ID NO: 81019 - DNA, 25 bp, mus musculus
tgatgcacatgagtcttccccaaat

SEQ ID NO: 81020 - DNA, 25 bp, mus musculus
tgcacatgagtcttccccaaatagc

SEQ ID NO: 81021 - DNA, 25 bp, mus musculus
acatgagtcttccccaaatagcttt

SEQ ID NO: 81022 - DNA, 25 bp, mus musculus
ttccccaaatagcttttctgaagtg

SEQ ID NO: 81023 - DNA, 25 bp, mus musculus
cccaaatagcttttctgaagtgact

SEQ ID NO: 81024 - DNA, 25 bp, mus musculus
tatactgtgtgttttctcagagtac

SEQ ID NO: 81025 - DNA, 25 bp, mus musculus
cactcacagctgaaaatgttttccc

SEQ ID NO: 81026 - DNA, 25 bp, mus musculus
gaactttttatcgatctagaattca

SEQ ID NO: 81027 - DNA, 25 bp, mus musculus
ctttttatcgatctagaattcattg

SEQ ID NO: 81028 - DNA, 25 bp, mus musculus
gtctcttgttgacttgtctgtcaaa

SEQ ID NO: 81029 - DNA, 25 bp, mus musculus
tcttgttgacttgtctgtcaaatat

SEQ ID NO: 81030 - DNA, 25 bp, mus musculus
tgttgacttgtctgtcaaatatttc

SEQ ID NO: 81031 - DNA, 25 bp, mus musculus
gtctgtcaaatatttccttaaacat

SEQ ID NO: 81032 - DNA, 25 bp, mus musculus
atatttccttaaacatgaagttgat

SEQ ID NO: 81033 - DNA, 25 bp, mus musculus
cccgacggcttcttgttggtgctgg

SEQ ID NO: 81034 - DNA, 25 bp, mus musculus
cgagccggcacaggacctcttcgac

SEQ ID NO: 81035 - DNA, 25 bp, mus musculus
atgccacaattgtggggtcgtgcac

SEQ ID NO: 81036 - DNA, 25 bp, mus musculus
gccacaattgtggggtcgtgcaccg

SEQ ID NO: 81037 - DNA, 25 bp, mus musculus
cacaattgtggggtcgtgcaccgcg

SEQ ID NO: 81038 - DNA, 25 bp, mus musculus
acgagaacctgctggtggacctgcg

SEQ ID NO: 81039 - DNA, 25 bp, mus musculus
gaacctgctggtggacctgcgctcg

SEQ ID NO: 81040 - DNA, 25 bp, mus musculus
acctgctggtggacctgcgctcggg

SEQ ID NO: 81041 - DNA, 25 bp, mus musculus
ctgcgctcgggagactgaagctcat

SEQ ID NO: 81042 - DNA, 25 bp, mus musculus
gactgaagctcatcgacttcggctc

SEQ ID NO: 81043 - DNA, 25 bp, mus musculus
ctgaagctcatcgacttcggctcgg

SEQ ID NO: 81044 - DNA, 25 bp, mus musculus
gaagctcatcgacttcggctcgggc

SEQ ID NO: 81045 - DNA, 25 bp, mus musculus
agccggcacaggacctcttcgactt

SEQ ID NO: 81046 - DNA, 25 bp, mus musculus
ggcacaggacctcttcgacttcatc

SEQ ID NO: 81047 - DNA, 25 bp, mus musculus
cacaggacctcttcgacttcatcac

SEQ ID NO: 81048 - DNA, 25 bp, mus musculus
tcatcactgaacgaggcgccctgga

SEQ ID NO: 81049 - DNA, 25 bp, mus musculus
cactgaacgaggcgccctggacgag

SEQ ID NO: 81050 - DNA, 25 bp, mus musculus
tgccgctgtcgcatgccacaattgt

SEQ ID NO: 81051 - DNA, 25 bp, mus musculus
ccgctgtcgcatgccacaattgtgg

SEQ ID NO: 81052 - DNA, 25 bp, mus musculus
tgtcgcatgccacaattgtggggtc

SEQ ID NO: 81053 - DNA, 25 bp, mus musculus
atcccgctgggtctgagctcccagt

SEQ ID NO: 81054 - DNA, 25 bp, mus musculus
ggttcgcatgcctggaaggactcta

SEQ ID NO: 81055 - DNA, 25 bp, mus musculus
gtccctgggactcactgcccagctt

SEQ ID NO: 81056 - DNA, 25 bp, mus musculus
cactgcccagcttcacttcattcag

SEQ ID NO: 81057 - DNA, 25 bp, mus musculus
ccagcttcacttcattcagcaccat

SEQ ID NO: 81058 - DNA, 25 bp, mus musculus
tcacttcattcagcaccatggaaga

SEQ ID NO: 81059 - DNA, 25 bp, mus musculus
cattcagcaccatggaagatgatgg

SEQ ID NO: 81060 - DNA, 25 bp, mus musculus
gttacaactactatggggctgacaa

SEQ ID NO: 81061 - DNA, 25 bp, mus musculus
ctgacaaccagtctgaatgcgacta

SEQ ID NO: 81062 - DNA, 25 bp, mus musculus
ctgaatgcgactacgcagactggaa

SEQ ID NO: 81063 - DNA, 25 bp, mus musculus
gcgactacgcagactggaagccctc

SEQ ID NO: 81064 - DNA, 25 bp, mus musculus
acgcagactggaagccctctggagc

SEQ ID NO: 81065 - DNA, 25 bp, mus musculus
aagcaccctcagacctcttactctg

SEQ ID NO: 81066 - DNA, 25 bp, mus musculus
actggaagccctctggagcgctcat

SEQ ID NO: 81067 - DNA, 25 bp, mus musculus
cctcagacctcttactctgaggttc

SEQ ID NO: 81068 - DNA, 25 bp, mus musculus
acctcttactctgaggttcaagcca

SEQ ID NO: 81069 - DNA, 25 bp, mus musculus
tactctgaggttcaagccaatcctt

SEQ ID NO: 81070 - DNA, 25 bp, mus musculus
gaggttcaagccaatccttcagggt

SEQ ID NO: 81071 - DNA, 25 bp, mus musculus
tgcttgctgagttggtgacccatct

SEQ ID NO: 81072 - DNA, 25 bp, mus musculus
tggtgacccatctgtggaactggtg

SEQ ID NO: 81073 - DNA, 25 bp, mus musculus
cccatctgtggaactggtgtccctg

SEQ ID NO: 81074 - DNA, 25 bp, mus musculus
ctatgactcatggtccaaagaaaca

SEQ ID NO: 81075 - DNA, 25 bp, mus musculus
tatgactcatggtccaaagaaacac

SEQ ID NO: 81076 - DNA, 25 bp, mus musculus
aatgcatgccatcatcatcatttac

SEQ ID NO: 81077 - DNA, 25 bp, mus musculus
tgcatgccatcatcatcatttacct

SEQ ID NO: 81078 - DNA, 25 bp, mus musculus
gcatgccatcatcatcatttaccta

SEQ ID NO: 81079 - DNA, 25 bp, mus musculus
catgccatcatcatcatttacctag

SEQ ID NO: 81080 - DNA, 25 bp, mus musculus
tgccatcatcatcatttacctaggg

SEQ ID NO: 81081 - DNA, 25 bp, mus musculus
gccatcatcatcatttacctaggga

SEQ ID NO: 81082 - DNA, 25 bp, mus musculus
ccatcatcatcatttacctagggaa

SEQ ID NO: 81083 - DNA, 25 bp, mus musculus
atcatcatcatttacctagggaaca

SEQ ID NO: 81084 - DNA, 25 bp, mus musculus
tcatcatcatttacctagggaacag

SEQ ID NO: 81085 - DNA, 25 bp, mus musculus
catcatcatttacctagggaacaga

SEQ ID NO: 81086 - DNA, 25 bp, mus musculus
gaaacacctgaagcgtgtagcatgc

SEQ ID NO: 81087 - DNA, 25 bp, mus musculus
aacacctgaagcgtgtagcatgctc

SEQ ID NO: 81088 - DNA, 25 bp, mus musculus
cacctgaagcgtgtagcatgctcca

SEQ ID NO: 81089 - DNA, 25 bp, mus musculus
gtgtagcatgctccaaaacattgga

SEQ ID NO: 81090 - DNA, 25 bp, mus musculus
gtagcatgctccaaaacattggatg

SEQ ID NO: 81091 - DNA, 25 bp, mus musculus
tagcatgctccaaaacattggatgc

SEQ ID NO: 81092 - DNA, 25 bp, mus musculus
ggaatgcatgccatcatcatcattt

SEQ ID NO: 81093 - DNA, 25 bp, mus musculus
gaatgcatgccatcatcatcattta

SEQ ID NO: 81094 - DNA, 25 bp, mus musculus
tgttaactagcacactgcgaaatgg

SEQ ID NO: 81095 - DNA, 25 bp, mus musculus
ctagcacactgcgaaatggtcatac

SEQ ID NO: 81096 - DNA, 25 bp, mus musculus
acgcaggctattgtgtcggtttgta

SEQ ID NO: 81097 - DNA, 25 bp, mus musculus
tgttcccataagttttacagggatg

SEQ ID NO: 81098 - DNA, 25 bp, mus musculus
accatgaacagagcatcccatgcca

SEQ ID NO: 81099 - DNA, 25 bp, mus musculus
aacagagcatcccatgccagttgca

SEQ ID NO: 81100 - DNA, 25 bp, mus musculus
gcatcccatgccagttgcagctact

SEQ ID NO: 81101 - DNA, 25 bp, mus musculus
catgccagttgcagctacttgacca

SEQ ID NO: 81102 - DNA, 25 bp, mus musculus
agttgcagctacttgaccatgggta

SEQ ID NO: 81103 - DNA, 25 bp, mus musculus
agctacttgaccatgggtaacaaca

SEQ ID NO: 81104 - DNA, 25 bp, mus musculus
atgagaccccatctcatttttactt

SEQ ID NO: 81105 - DNA, 25 bp, mus musculus
cgttggccttacaatcaaatgtaag

SEQ ID NO: 81106 - DNA, 25 bp, mus musculus
gtcataccgatgacccgtgcagtca

SEQ ID NO: 81107 - DNA, 25 bp, mus musculus
acccgtgcagtcactaggtagtagt

SEQ ID NO: 81108 - DNA, 25 bp, mus musculus
caaatctatgctctagagaatgtat

SEQ ID NO: 81109 - DNA, 25 bp, mus musculus
atcttttacatatcattgcaatttc

SEQ ID NO: 81110 - DNA, 25 bp, mus musculus
tacatatcattgcaatttccttatg

SEQ ID NO: 81111 - DNA, 25 bp, mus musculus
tcattgcaatttccttatgttaatc

SEQ ID NO: 81112 - DNA, 25 bp, mus musculus
cctttagcattacggtgacaatgac

SEQ ID NO: 81113 - DNA, 25 bp, mus musculus
cataatcatatccagaaaaggggaa

SEQ ID NO: 81114 - DNA, 25 bp, mus musculus
gctgatcctggggctcattcttgca

SEQ ID NO: 81115 - DNA, 25 bp, mus musculus
gctcattcttgcaatttctggggtc

SEQ ID NO: 81116 - DNA, 25 bp, mus musculus
ccttgatctcacaacttcctgtgtt

SEQ ID NO: 81117 - DNA, 25 bp, mus musculus
ctgtgttcacagcatttgacctaac

SEQ ID NO: 81118 - DNA, 25 bp, mus musculus
tcacagcatttgacctaaccatacc

SEQ ID NO: 81119 - DNA, 25 bp, mus musculus
catttgacctaaccatacctaattg

SEQ ID NO: 81120 - DNA, 25 bp, mus musculus
gttgtcttgttctcctatacaataa

SEQ ID NO: 81121 - DNA, 25 bp, mus musculus
ttgttctcctatacaataatggaga

SEQ ID NO: 81122 - DNA, 25 bp, mus musculus
agtactcttgaccccacgaagagct

SEQ ID NO: 81123 - DNA, 25 bp, mus musculus
cttgaccccacgaagagctgggcct

SEQ ID NO: 81124 - DNA, 25 bp, mus musculus
cccacgaagagctgggcctctcatg

SEQ ID NO: 81125 - DNA, 25 bp, mus musculus
taatgctctgtatttcttgtgaaat

SEQ ID NO: 81126 - DNA, 25 bp, mus musculus
tcttgcaatttctggggtcatctgg

SEQ ID NO: 81127 - DNA, 25 bp, mus musculus
tcctctactcccactggtgagcatc

SEQ ID NO: 81128 - DNA, 25 bp, mus musculus
actcccactggtgagcatctttgtg

SEQ ID NO: 81129 - DNA, 25 bp, mus musculus
tggatttgctatctactttggctat

SEQ ID NO: 81130 - DNA, 25 bp, mus musculus
tgctatctactttggctatgggatc

SEQ ID NO: 81131 - DNA, 25 bp, mus musculus
tgggatccaacacagtatgaaagaa

SEQ ID NO: 81132 - DNA, 25 bp, mus musculus
ccaaactatagaccttgatctcaca

SEQ ID NO: 81133 - DNA, 25 bp, mus musculus
tatagaccttgatctcacaacttcc

SEQ ID NO: 81134 - DNA, 25 bp, mus musculus
acatctgacctcatagtgttgggtc

SEQ ID NO: 81135 - DNA, 25 bp, mus musculus
ctgacctcatagtgttgggtctccc

SEQ ID NO: 81136 - DNA, 25 bp, mus musculus
agtaatgtcacaacgacatatgata

SEQ ID NO: 81137 - DNA, 25 bp, mus musculus
taatgtcacaacgacatatgataga

SEQ ID NO: 81138 - DNA, 25 bp, mus musculus
atgtcacaacgacatatgatagatg

SEQ ID NO: 81139 - DNA, 25 bp, mus musculus
gtcacaacgacatatgatagatggg

SEQ ID NO: 81140 - DNA, 25 bp, mus musculus
ttcccaactctaagcaaagcccaga

SEQ ID NO: 81141 - DNA, 25 bp, mus musculus
tctaagcaaagcccagacgagcctt

SEQ ID NO: 81142 - DNA, 25 bp, mus musculus
agcaaagcccagacgagcctttgag

SEQ ID NO: 81143 - DNA, 25 bp, mus musculus
caaagcccagacgagcctttgagaa

SEQ ID NO: 81144 - DNA, 25 bp, mus musculus
aagcccagacgagcctttgagaagc

SEQ ID NO: 81145 - DNA, 25 bp, mus musculus
ccagacgagcctttgagaagccaga

SEQ ID NO: 81146 - DNA, 25 bp, mus musculus
gacctcatagtgttgggtctccctg

SEQ ID NO: 81147 - DNA, 25 bp, mus musculus
cctcatagtgttgggtctccctgga

SEQ ID NO: 81148 - DNA, 25 bp, mus musculus
tcatagtgttgggtctccctggaaa

SEQ ID NO: 81149 - DNA, 25 bp, mus musculus
gtctccctggaaaacaactgagcag

SEQ ID NO: 81150 - DNA, 25 bp, mus musculus
ctccctggaaaacaactgagcagga

SEQ ID NO: 81151 - DNA, 25 bp, mus musculus
gactatttcagtacttttggagagg

SEQ ID NO: 81152 - DNA, 25 bp, mus musculus
ggctttgttcgatttacagaatatg

SEQ ID NO: 81153 - DNA, 25 bp, mus musculus
atatgaaacccaagtgaaagtaatg

SEQ ID NO: 81154 - DNA, 25 bp, mus musculus
ttgcatacaatcaccccaataggaa

SEQ ID NO: 81155 - DNA, 25 bp, mus musculus
ttttgcttttattgcctgcagtaga

SEQ ID NO: 81156 - DNA, 25 bp, mus musculus
attccagtctgtatggttacgccta

SEQ ID NO: 81157 - DNA, 25 bp, mus musculus
gctaatctcagggatgcagagagaa

SEQ ID NO: 81158 - DNA, 25 bp, mus musculus
aaagtatgagtcctgtgctgttgtg

SEQ ID NO: 81159 - DNA, 25 bp, mus musculus
tgagtcctgtgctgttgtggaaatc

SEQ ID NO: 81160 - DNA, 25 bp, mus musculus
gagttcttttccagtgctgactgca

SEQ ID NO: 81161 - DNA, 25 bp, mus musculus
ttttccagtgctgactgcagcatgg

SEQ ID NO: 81162 - DNA, 25 bp, mus musculus
agtgctgactgcagcatgggcttga

SEQ ID NO: 81163 - DNA, 25 bp, mus musculus
gactgcagcatgggcttgaaattga

SEQ ID NO: 81164 - DNA, 25 bp, mus musculus
aagtatgtattcttggcaggtggca

SEQ ID NO: 81165 - DNA, 25 bp, mus musculus
gtattcttggcaggtggcattctag

SEQ ID NO: 81166 - DNA, 25 bp, mus musculus
ttttattgcctgcagtagatagata

SEQ ID NO: 81167 - DNA, 25 bp, mus musculus
aaactaactgcattcttcacactcc

SEQ ID NO: 81168 - DNA, 25 bp, mus musculus
actgcattcttcacactcctccttg

SEQ ID NO: 81169 - DNA, 25 bp, mus musculus
ctccttgctgtttaagatgtgcagg

SEQ ID NO: 81170 - DNA, 25 bp, mus musculus
aggaaaatctttcctatcgtgtcat

SEQ ID NO: 81171 - DNA, 25 bp, mus musculus
atctttcctatcgtgtcatatctgg

SEQ ID NO: 81172 - DNA, 25 bp, mus musculus
gtgtcatatctggtcatgaaactgt

SEQ ID NO: 81173 - DNA, 25 bp, mus musculus
gtctagcgttttattccagtctgta

SEQ ID NO: 81174 - DNA, 25 bp, mus musculus
ggagctagacccgatcacccaactg

SEQ ID NO: 81175 - DNA, 25 bp, mus musculus
agcccctcggagatgcttcacttgt

SEQ ID NO: 81176 - DNA, 25 bp, mus musculus
acatggtccaggtgatccgtcagat

SEQ ID NO: 81177 - DNA, 25 bp, mus musculus
atggtccaggtgatccgtcagatgc

SEQ ID NO: 81178 - DNA, 25 bp, mus musculus
tccaggtgatccgtcagatgcaccc

SEQ ID NO: 81179 - DNA, 25 bp, mus musculus
tgaacaaggcatctgtccgagacat

SEQ ID NO: 81180 - DNA, 25 bp, mus musculus
caaggcatctgtccgagacatcaag

SEQ ID NO: 81181 - DNA, 25 bp, mus musculus
aggcatctgtccgagacatcaagaa

SEQ ID NO: 81182 - DNA, 25 bp, mus musculus
gcatctgtccgagacatcaagaagc

SEQ ID NO: 81183 - DNA, 25 bp, mus musculus
atctgtccgagacatcaagaagccc

SEQ ID NO: 81184 - DNA, 25 bp, mus musculus
tctgtccgagacatcaagaagccct

SEQ ID NO: 81185 - DNA, 25 bp, mus musculus
ctgtccgagacatcaagaagccctg

SEQ ID NO: 81186 - DNA, 25 bp, mus musculus
agatgcttcacttgtccccagtgtc

SEQ ID NO: 81187 - DNA, 25 bp, mus musculus
atgcttcacttgtccccagtgtcga

SEQ ID NO: 81188 - DNA, 25 bp, mus musculus
ttccgcccaacctgcagttggccaa

SEQ ID NO: 81189 - DNA, 25 bp, mus musculus
cagttggccaacatggtccaggtga

SEQ ID NO: 81190 - DNA, 25 bp, mus musculus
gttggccaacatggtccaggtgatc

SEQ ID NO: 81191 - DNA, 25 bp, mus musculus
tggccaacatggtccaggtgatccg

SEQ ID NO: 81192 - DNA, 25 bp, mus musculus
gccaacatggtccaggtgatccgtc

SEQ ID NO: 81193 - DNA, 25 bp, mus musculus
caacatggtccaggtgatccgtcag

SEQ ID NO: 81194 - DNA, 25 bp, mus musculus
aggttactgaactgccgggctgatg

SEQ ID NO: 81195 - DNA, 25 bp, mus musculus
ctgaactgccgggctgatgttagag

SEQ ID NO: 81196 - DNA, 25 bp, mus musculus
tttctgtgacatttacgtctcatgt

SEQ ID NO: 81197 - DNA, 25 bp, mus musculus
tgacatttacgtctcatgtaatttg

SEQ ID NO: 81198 - DNA, 25 bp, mus musculus
catttacgtctcatgtaatttgcat

SEQ ID NO: 81199 - DNA, 25 bp, mus musculus
ttacgtctcatgtaatttgcatcgc

SEQ ID NO: 81200 - DNA, 25 bp, mus musculus
atgtaatttgcatcgcattggtggg

SEQ ID NO: 81201 - DNA, 25 bp, mus musculus
taatttgcatcgcattggtgggtta

SEQ ID NO: 81202 - DNA, 25 bp, mus musculus
gcatcgcattggtgggttattctag

SEQ ID NO: 81203 - DNA, 25 bp, mus musculus
gtactgtatttggcttcttcattaa

SEQ ID NO: 81204 - DNA, 25 bp, mus musculus
ctgtatttggcttcttcattaatag

SEQ ID NO: 81205 - DNA, 25 bp, mus musculus
gcttcttcattaataggatatttca

SEQ ID NO: 81206 - DNA, 25 bp, mus musculus
tgccgggctgatgttagagacactg

SEQ ID NO: 81207 - DNA, 25 bp, mus musculus
gacactggccagaaaagctataata

SEQ ID NO: 81208 - DNA, 25 bp, mus musculus
ttgatcactatacatttgttctatg

SEQ ID NO: 81209 - DNA, 25 bp, mus musculus
actatacatttgttctatgctgcct

SEQ ID NO: 81210 - DNA, 25 bp, mus musculus
atacatttgttctatgctgccttat

SEQ ID NO: 81211 - DNA, 25 bp, mus musculus
ttctatgctgccttatgttcataag

SEQ ID NO: 81212 - DNA, 25 bp, mus musculus
gctgccttatgttcataagaatatc

SEQ ID NO: 81213 - DNA, 25 bp, mus musculus
tatcaacagacagctagagccagaa

SEQ ID NO: 81214 - DNA, 25 bp, mus musculus
gttcggcaaaagccctcaagtgctg

SEQ ID NO: 81215 - DNA, 25 bp, mus musculus
cggcaaaagccctcaagtgctgaag

SEQ ID NO: 81216 - DNA, 25 bp, mus musculus
gaacaaattaccatcagtttacaga

SEQ ID NO: 81217 - DNA, 25 bp, mus musculus
caaattaccatcagtttacagaagt

SEQ ID NO: 81218 - DNA, 25 bp, mus musculus
attaccatcagtttacagaagttgg

SEQ ID NO: 81219 - DNA, 25 bp, mus musculus
ggaattcatgcaggcacttaccatg

SEQ ID NO: 81220 - DNA, 25 bp, mus musculus
attcatgcaggcacttaccatgcca

SEQ ID NO: 81221 - DNA, 25 bp, mus musculus
catgcaggcacttaccatgccaata

SEQ ID NO: 81222 - DNA, 25 bp, mus musculus
gcaggcacttaccatgccaatatgg

SEQ ID NO: 81223 - DNA, 25 bp, mus musculus
ggcacttaccatgccaatatggaac

SEQ ID NO: 81224 - DNA, 25 bp, mus musculus
acttaccatgccaatatggaaccag

SEQ ID NO: 81225 - DNA, 25 bp, mus musculus
catgccaatatggaaccagaagata

SEQ ID NO: 81226 - DNA, 25 bp, mus musculus
aagccctcaagtgctgaagacttta

SEQ ID NO: 81227 - DNA, 25 bp, mus musculus
atcatatactgtttctctcagaaag

SEQ ID NO: 81228 - DNA, 25 bp, mus musculus
atatactgtttctctcagaaagact

SEQ ID NO: 81229 - DNA, 25 bp, mus musculus
tactgtttctctcagaaagactctg

SEQ ID NO: 81230 - DNA, 25 bp, mus musculus
tgtttctctcagaaagactctgaac

SEQ ID NO: 81231 - DNA, 25 bp, mus musculus
ttctctcagaaagactctgaacaaa

SEQ ID NO: 81232 - DNA, 25 bp, mus musculus
gactctgaacaaattaccatcagtt

SEQ ID NO: 81233 - DNA, 25 bp, mus musculus
tctgaacaaattaccatcagtttac

SEQ ID NO: 81234 - DNA, 25 bp, mus musculus
gtccctgatgctaagatcctgaatc

SEQ ID NO: 81235 - DNA, 25 bp, mus musculus
ccctgatgctaagatcctgaatctt

SEQ ID NO: 81236 - DNA, 25 bp, mus musculus
tcccactttagttgccatattgtgg

SEQ ID NO: 81237 - DNA, 25 bp, mus musculus
tttagttgccatattgtggtcagat

SEQ ID NO: 81238 - DNA, 25 bp, mus musculus
tagttgccatattgtggtcagatga

SEQ ID NO: 81239 - DNA, 25 bp, mus musculus
gttgccatattgtggtcagatgaat

SEQ ID NO: 81240 - DNA, 25 bp, mus musculus
tatgagcaacgtctcttctggaaca

SEQ ID NO: 81241 - DNA, 25 bp, mus musculus
tgagcaacgtctcttctggaacact

SEQ ID NO: 81242 - DNA, 25 bp, mus musculus
agcaacgtctcttctggaacactgc

SEQ ID NO: 81243 - DNA, 25 bp, mus musculus
caacgtctcttctggaacactgcag

SEQ ID NO: 81244 - DNA, 25 bp, mus musculus
gtctcttctggaacactgcaggctt

SEQ ID NO: 81245 - DNA, 25 bp, mus musculus
cttctggaacactgcaggcttgccc

SEQ ID NO: 81246 - DNA, 25 bp, mus musculus
tgctaagatcctgaatctttgagtt

SEQ ID NO: 81247 - DNA, 25 bp, mus musculus
ctaagatcctgaatctttgagtttg

SEQ ID NO: 81248 - DNA, 25 bp, mus musculus
gatcctgaatctttgagtttgggac

SEQ ID NO: 81249 - DNA, 25 bp, mus musculus
atctttgagtttgggacgcaagaga

SEQ ID NO: 81250 - DNA, 25 bp, mus musculus
ctttgagtttgggacgcaagagatc

SEQ ID NO: 81251 - DNA, 25 bp, mus musculus
tggagttcccactttagttgccata

SEQ ID NO: 81252 - DNA, 25 bp, mus musculus
gagttcccactttagttgccatatt

SEQ ID NO: 81253 - DNA, 25 bp, mus musculus
gttcccactttagttgccatattgt

SEQ ID NO: 81254 - DNA, 25 bp, mus musculus
atgcagcaagtccctatatacctag

SEQ ID NO: 81255 - DNA, 25 bp, mus musculus
agcctggacatgcctaccctgaaag

SEQ ID NO: 81256 - DNA, 25 bp, mus musculus
cagacccttgctgcctcattgggaa

SEQ ID NO: 81257 - DNA, 25 bp, mus musculus
agttggccagctggacttcagagag

SEQ ID NO: 81258 - DNA, 25 bp, mus musculus
cattttcaaagatagcctgggagca

SEQ ID NO: 81259 - DNA, 25 bp, mus musculus
tagcctgggagcactgtctctgacc

SEQ ID NO: 81260 - DNA, 25 bp, mus musculus
actgtctctgaccacctgtcttcct

SEQ ID NO: 81261 - DNA, 25 bp, mus musculus
tctgcaccgtgctcagggaaatggc

SEQ ID NO: 81262 - DNA, 25 bp, mus musculus
ccttcattccagaggccagctgtct

SEQ ID NO: 81263 - DNA, 25 bp, mus musculus
ttccagaggccagctgtctgcctga

SEQ ID NO: 81264 - DNA, 25 bp, mus musculus
aggccagctgtctgcctgacttttc

SEQ ID NO: 81265 - DNA, 25 bp, mus musculus
gctgtctgcctgacttttcctccgt

SEQ ID NO: 81266 - DNA, 25 bp, mus musculus
gacatgcctaccctgaaagcagctg

SEQ ID NO: 81267 - DNA, 25 bp, mus musculus
cctaccctgaaagcagctgccttca

SEQ ID NO: 81268 - DNA, 25 bp, mus musculus
gcagctgccttcattacccttttct

SEQ ID NO: 81269 - DNA, 25 bp, mus musculus
gccttcattacccttttctgtgcgc

SEQ ID NO: 81270 - DNA, 25 bp, mus musculus
cttttctgtgcgcctgttctgaagc

SEQ ID NO: 81271 - DNA, 25 bp, mus musculus
taaacctgtccacatcttcactacc

SEQ ID NO: 81272 - DNA, 25 bp, mus musculus
cccttctgctgaaggaatggtgacg

SEQ ID NO: 81273 - DNA, 25 bp, mus musculus
aacaggattccccagacccttgctg

SEQ ID NO: 81274 - DNA, 25 bp, mus musculus
gctcacatatgactacaagtttcct

SEQ ID NO: 81275 - DNA, 25 bp, mus musculus
ctcacatatgactacaagtttccta

SEQ ID NO: 81276 - DNA, 25 bp, mus musculus
caagtttcctatcgaggatgccagc

SEQ ID NO: 81277 - DNA, 25 bp, mus musculus
aagtttcctatcgaggatgccagca

SEQ ID NO: 81278 - DNA, 25 bp, mus musculus
agtttcctatcgaggatgccagcaa

SEQ ID NO: 81279 - DNA, 25 bp, mus musculus
gtttcctatcgaggatgccagcaac

SEQ ID NO: 81280 - DNA, 25 bp, mus musculus
tttcctatcgaggatgccagcaaca

SEQ ID NO: 81281 - DNA, 25 bp, mus musculus
ttcctatcgaggatgccagcaacaa

SEQ ID NO: 81282 - DNA, 25 bp, mus musculus
tcctatcgaggatgccagcaacaag

SEQ ID NO: 81283 - DNA, 25 bp, mus musculus
atatgactacaagtttcctatcgag

SEQ ID NO: 81284 - DNA, 25 bp, mus musculus
tatgactacaagtttcctatcgagg

SEQ ID NO: 81285 - DNA, 25 bp, mus musculus
atgactacaagtttcctatcgagga

SEQ ID NO: 81286 - DNA, 25 bp, mus musculus
tgactacaagtttcctatcgaggat

SEQ ID NO: 81287 - DNA, 25 bp, mus musculus
gactacaagtttcctatcgaggatg

SEQ ID NO: 81288 - DNA, 25 bp, mus musculus
ctacaagtttcctatcgaggatgcc

SEQ ID NO: 81289 - DNA, 25 bp, mus musculus
tacaagtttcctatcgaggatgcca

SEQ ID NO: 81290 - DNA, 25 bp, mus musculus
acaagtttcctatcgaggatgccag

SEQ ID NO: 81291 - DNA, 25 bp, mus musculus
tgctcacctatggctctcctactca

SEQ ID NO: 81292 - DNA, 25 bp, mus musculus
tcacctatggctctcctactcagca

SEQ ID NO: 81293 - DNA, 25 bp, mus musculus
tagatcacttcaacaatgagatgct

SEQ ID NO: 81294 - DNA, 25 bp, mus musculus
atcacttcaacaatgagatgctcct

SEQ ID NO: 81295 - DNA, 25 bp, mus musculus
atgagatgctcctaaacttctgttc

SEQ ID NO: 81296 - DNA, 25 bp, mus musculus
agatgctcctaaacttctgttcttt

SEQ ID NO: 81297 - DNA, 25 bp, mus musculus
taagataactcaaagctccccttct

SEQ ID NO: 81298 - DNA, 25 bp, mus musculus
tctctcccagtcgtgatttgttaaa

SEQ ID NO: 81299 - DNA, 25 bp, mus musculus
caaggtcttctcactcaagctgttg

SEQ ID NO: 81300 - DNA, 25 bp, mus musculus
cttctcactcaagctgttgacaatg

SEQ ID NO: 81301 - DNA, 25 bp, mus musculus
ctcactcaagctgttgacaatgcca

SEQ ID NO: 81302 - DNA, 25 bp, mus musculus
gttgacaatgccagtgtgtttaccc

SEQ ID NO: 81303 - DNA, 25 bp, mus musculus
atggctctcctactcagcagcaaca

SEQ ID NO: 81304 - DNA, 25 bp, mus musculus
ctcctactcagcagcaacatgcact

SEQ ID NO: 81305 - DNA, 25 bp, mus musculus
ctcagcagcaacatgcactgcccgg

SEQ ID NO: 81306 - DNA, 25 bp, mus musculus
agcagcaacatgcactgcccggcaa

SEQ ID NO: 81307 - DNA, 25 bp, mus musculus
agcaacatgcactgcccggcaagag

SEQ ID NO: 81308 - DNA, 25 bp, mus musculus
cactgcccggcaagagcaacaggtg

SEQ ID NO: 81309 - DNA, 25 bp, mus musculus
tgcccggcaagagcaacaggtggga

SEQ ID NO: 81310 - DNA, 25 bp, mus musculus
agatggcatgcatgggcttagatca

SEQ ID NO: 81311 - DNA, 25 bp, mus musculus
atacatactgattccaggaatgctt

SEQ ID NO: 81312 - DNA, 25 bp, mus musculus
actgattccaggaatgctttctata

SEQ ID NO: 81313 - DNA, 25 bp, mus musculus
gttcagttcacatcccatcaaagtg

SEQ ID NO: 81314 - DNA, 25 bp, mus musculus
cagttcacatcccatcaaagtggcc

SEQ ID NO: 81315 - DNA, 25 bp, mus musculus
ttcacatcccatcaaagtggcccct

SEQ ID NO: 81316 - DNA, 25 bp, mus musculus
tcccatcaaagtggccccttcataa

SEQ ID NO: 81317 - DNA, 25 bp, mus musculus
catcaaagtggccccttcataatcc

SEQ ID NO: 81318 - DNA, 25 bp, mus musculus
caaagtggccccttcataatccttg

SEQ ID NO: 81319 - DNA, 25 bp, mus musculus
ggccccttcataatccttgatgtag

SEQ ID NO: 81320 - DNA, 25 bp, mus musculus
cccttcataatccttgatgtagcca

SEQ ID NO: 81321 - DNA, 25 bp, mus musculus
ttcataatccttgatgtagccaaca

SEQ ID NO: 81322 - DNA, 25 bp, mus musculus
atccttgatgtagccaacatatttg

SEQ ID NO: 81323 - DNA, 25 bp, mus musculus
gattccaggaatgctttctatagga

SEQ ID NO: 81324 - DNA, 25 bp, mus musculus
ggagaaaccctgcttcttgaaatag

SEQ ID NO: 81325 - DNA, 25 bp, mus musculus
aggaatctgccgaactccatctttg

SEQ ID NO: 81326 - DNA, 25 bp, mus musculus
aatctgccgaactccatctttgaaa

SEQ ID NO: 81327 - DNA, 25 bp, mus musculus
ctgccgaactccatctttgaaacac

SEQ ID NO: 81328 - DNA, 25 bp, mus musculus
gtagacttttcgaatctgggcttgt

SEQ ID NO: 81329 - DNA, 25 bp, mus musculus
ttctatcagctttttaatgatctcc

SEQ ID NO: 81330 - DNA, 25 bp, mus musculus
aatgatctccttctgctttttaatg

SEQ ID NO: 81331 - DNA, 25 bp, mus musculus
gatctccttctgctttttaatgatg

SEQ ID NO: 81332 - DNA, 25 bp, mus musculus
ttggaagcctgggcgcttcggcgtc

SEQ ID NO: 81333 - DNA, 25 bp, mus musculus
ccagtgatccactggggttgtacga

SEQ ID NO: 81334 - DNA, 25 bp, mus musculus
catcggcgctcgatcgggacctgga

SEQ ID NO: 81335 - DNA, 25 bp, mus musculus
cggcgctcgatcgggacctggattt

SEQ ID NO: 81336 - DNA, 25 bp, mus musculus
actattgcacgcccgaggtgagcga

SEQ ID NO: 81337 - DNA, 25 bp, mus musculus
agatgatctcgggagattggctgga

SEQ ID NO: 81338 - DNA, 25 bp, mus musculus
tgatctcgggagattggctggagtc

SEQ ID NO: 81339 - DNA, 25 bp, mus musculus
tctcgggagattggctggagtccag

SEQ ID NO: 81340 - DNA, 25 bp, mus musculus
agtccagcatctctaacctggtctt

SEQ ID NO: 81341 - DNA, 25 bp, mus musculus
ccagcatctctaacctggtcttcac

SEQ ID NO: 81342 - DNA, 25 bp, mus musculus
gcatctctaacctggtcttcaccta

SEQ ID NO: 81343 - DNA, 25 bp, mus musculus
tcacctactgaagggagcgcgggcc

SEQ ID NO: 81344 - DNA, 25 bp, mus musculus
gtgatccactggggttgtacgaaga

SEQ ID NO: 81345 - DNA, 25 bp, mus musculus
atccactggggttgtacgaagatgg

SEQ ID NO: 81346 - DNA, 25 bp, mus musculus
gcagcagcgcagcatcatcgccagc

SEQ ID NO: 81347 - DNA, 25 bp, mus musculus
tcgaagacgacctgctcgacctgaa

SEQ ID NO: 81348 - DNA, 25 bp, mus musculus
tgctcgacctgaaccccagctcaaa

SEQ ID NO: 81349 - DNA, 25 bp, mus musculus
actttgagagcatgtccctgggcag

SEQ ID NO: 81350 - DNA, 25 bp, mus musculus
gcatgtccctgggcagtttcagctc

SEQ ID NO: 81351 - DNA, 25 bp, mus musculus
gcagtttcagctcctcatcggcgct

SEQ ID NO: 81352 - DNA, 25 bp, mus musculus
tcctaggacaacgcggcagtccgcg

SEQ ID NO: 81353 - DNA, 25 bp, mus musculus
taggacaacgcggcagtccgcgtgt

SEQ ID NO: 81354 - DNA, 25 bp, mus musculus
atattcatacgaagactgccgtgat

SEQ ID NO: 81355 - DNA, 25 bp, mus musculus
atacgaagactgccgtgatatccgt

SEQ ID NO: 81356 - DNA, 25 bp, mus musculus
ccgtgatatccgtccgttgtctacg

SEQ ID NO: 81357 - DNA, 25 bp, mus musculus
tgatatccgtccgttgtctacgtta

SEQ ID NO: 81358 - DNA, 25 bp, mus musculus
tccgttgtctacgttacactataga

SEQ ID NO: 81359 - DNA, 25 bp, mus musculus
gttgtctacgttacactatagaatc

SEQ ID NO: 81360 - DNA, 25 bp, mus musculus
gtctacgttacactatagaatctat

SEQ ID NO: 81361 - DNA, 25 bp, mus musculus
aatctatcatggacatcgtgacatg

SEQ ID NO: 81362 - DNA, 25 bp, mus musculus
tcatggacatcgtgacatgcgatta

SEQ ID NO: 81363 - DNA, 25 bp, mus musculus
acatcgtgacatgcgattaaaacct

SEQ ID NO: 81364 - DNA, 25 bp, mus musculus
gtccgcgtgtctgagatgatcgact

SEQ ID NO: 81365 - DNA, 25 bp, mus musculus
atcgactataacctgcgcgagaacg

SEQ ID NO: 81366 - DNA, 25 bp, mus musculus
acaagtgatcttgcttctgttaggt

SEQ ID NO: 81367 - DNA, 25 bp, mus musculus
cttgcttctgttaggtactagagag

SEQ ID NO: 81368 - DNA, 25 bp, mus musculus
caacaccatcatcaagcagatcgct

SEQ ID NO: 81369 - DNA, 25 bp, mus musculus
caccatcatcaagcagatcgctatt

SEQ ID NO: 81370 - DNA, 25 bp, mus musculus
catcatcaagcagatcgctattatc

SEQ ID NO: 81371 - DNA, 25 bp, mus musculus
gcagatcgctattatctatgaagat

SEQ ID NO: 81372 - DNA, 25 bp, mus musculus
tcatctgaaggctctatatctatac

SEQ ID NO: 81373 - DNA, 25 bp, mus musculus
ggctctatatctatactgacttcta

SEQ ID NO: 81374 - DNA, 25 bp, mus musculus
tctatactgacttctagtagacgat

SEQ ID NO: 81375 - DNA, 25 bp, mus musculus
acttcctgggcaaacatcatagata

SEQ ID NO: 81376 - DNA, 25 bp, mus musculus
cttcctgggcaaacatcatagatag

SEQ ID NO: 81377 - DNA, 25 bp, mus musculus
ttcctgggcaaacatcatagataga

SEQ ID NO: 81378 - DNA, 25 bp, mus musculus
agactaacattgggtgctaggatct

SEQ ID NO: 81379 - DNA, 25 bp, mus musculus
gactaacattgggtgctaggatctg

SEQ ID NO: 81380 - DNA, 25 bp, mus musculus
actaacattgggtgctaggatctgg

SEQ ID NO: 81381 - DNA, 25 bp, mus musculus
ctaacattgggtgctaggatctggt

SEQ ID NO: 81382 - DNA, 25 bp, mus musculus
acattgggtgctaggatctggtagg

SEQ ID NO: 81383 - DNA, 25 bp, mus musculus
cattgggtgctaggatctggtagga

SEQ ID NO: 81384 - DNA, 25 bp, mus musculus
gctctatatctatactgacttctag

SEQ ID NO: 81385 - DNA, 25 bp, mus musculus
ctctatatctatactgacttctagt

SEQ ID NO: 81386 - DNA, 25 bp, mus musculus
tctatatctatactgacttctagta

SEQ ID NO: 81387 - DNA, 25 bp, mus musculus
ctatatctatactgacttctagtag

SEQ ID NO: 81388 - DNA, 25 bp, mus musculus
tatatctatactgacttctagtaga

SEQ ID NO: 81389 - DNA, 25 bp, mus musculus
atatctatactgacttctagtagac

SEQ ID NO: 81390 - DNA, 25 bp, mus musculus
tatctatactgacttctagtagacg

SEQ ID NO: 81391 - DNA, 25 bp, mus musculus
atctatactgacttctagtagacga

SEQ ID NO: 81392 - DNA, 25 bp, mus musculus
ctagctgcctttgcagactgacttc

SEQ ID NO: 81393 - DNA, 25 bp, mus musculus
gctgcctttgcagactgacttcttg

SEQ ID NO: 81394 - DNA, 25 bp, mus musculus
aagctcacccatattggagaaagaa

SEQ ID NO: 81395 - DNA, 25 bp, mus musculus
aacagcttcactgtgaattccaaac

SEQ ID NO: 81396 - DNA, 25 bp, mus musculus
tccaaacttatgtcacatcaaagac

SEQ ID NO: 81397 - DNA, 25 bp, mus musculus
aaacttatgtcacatcaaagacttc

SEQ ID NO: 81398 - DNA, 25 bp, mus musculus
cttatgtcacatcaaagacttcaga

SEQ ID NO: 81399 - DNA, 25 bp, mus musculus
tcacatcaaagacttcagatgggag

SEQ ID NO: 81400 - DNA, 25 bp, mus musculus
gacaaagcccataatgtgtgatgaa

SEQ ID NO: 81401 - DNA, 25 bp, mus musculus
aaagcccataatgtgtgatgaatgt

SEQ ID NO: 81402 - DNA, 25 bp, mus musculus
ttaatcgtacttcagaccttattca

SEQ ID NO: 81403 - DNA, 25 bp, mus musculus
atcgtacttcagaccttattcaaca

SEQ ID NO: 81404 - DNA, 25 bp, mus musculus
tttgcagactgacttcttgttcgta

SEQ ID NO: 81405 - DNA, 25 bp, mus musculus
cttcagaccttattcaacatcagag

SEQ ID NO: 81406 - DNA, 25 bp, mus musculus
gcagactgacttcttgttcgtaggc

SEQ ID NO: 81407 - DNA, 25 bp, mus musculus
gactgacttcttgttcgtaggcttc

SEQ ID NO: 81408 - DNA, 25 bp, mus musculus
taagaccctgagaaacatccttttg

SEQ ID NO: 81409 - DNA, 25 bp, mus musculus
gagaaacatccttttggaagactga

SEQ ID NO: 81410 - DNA, 25 bp, mus musculus
catccttttggaagactgaatagga

SEQ ID NO: 81411 - DNA, 25 bp, mus musculus
gagtttcaccaagttagagttgagg

SEQ ID NO: 81412 - DNA, 25 bp, mus musculus
gaggaaaagctcacccatattggag

SEQ ID NO: 81413 - DNA, 25 bp, mus musculus
gggaatcactacaacacttagcttc

SEQ ID NO: 81414 - DNA, 25 bp, mus musculus
gaatcactacaacacttagcttccc

SEQ ID NO: 81415 - DNA, 25 bp, mus musculus
atgaatcctatatctgtttgtatat

SEQ ID NO: 81416 - DNA, 25 bp, mus musculus
tatatttgcaagccctttgtattat

SEQ ID NO: 81417 - DNA, 25 bp, mus musculus
tatttgcaagccctttgtattataa

SEQ ID NO: 81418 - DNA, 25 bp, mus musculus
aataccattgaaatcagcatgacaa

SEQ ID NO: 81419 - DNA, 25 bp, mus musculus
ataacactgttggcacttataggta

SEQ ID NO: 81420 - DNA, 25 bp, mus musculus
cactgttggcacttataggtaacgt

SEQ ID NO: 81421 - DNA, 25 bp, mus musculus
tttaagtgcaacatttctgtatact

SEQ ID NO: 81422 - DNA, 25 bp, mus musculus
tgcaacatttctgtatactgtaaaa

SEQ ID NO: 81423 - DNA, 25 bp, mus musculus
actgaactgtttggtcgagtctttg

SEQ ID NO: 81424 - DNA, 25 bp, mus musculus
tgaactgtttggtcgagtctttgtg

SEQ ID NO: 81425 - DNA, 25 bp, mus musculus
cccataccatgacaaaacctagctt

SEQ ID NO: 81426 - DNA, 25 bp, mus musculus
cataccatgacaaaacctagctttt

SEQ ID NO: 81427 - DNA, 25 bp, mus musculus
gaatttattggcagccaaggaatgt

SEQ ID NO: 81428 - DNA, 25 bp, mus musculus
atttattggcagccaaggaatgtgt

SEQ ID NO: 81429 - DNA, 25 bp, mus musculus
ttattggcagccaaggaatgtgtcc

SEQ ID NO: 81430 - DNA, 25 bp, mus musculus
aatgtgtccaagacacaagctgagg

SEQ ID NO: 81431 - DNA, 25 bp, mus musculus
tgtgtccaagacacaagctgaggtt

SEQ ID NO: 81432 - DNA, 25 bp, mus musculus
tgtccaagacacaagctgaggtttt

SEQ ID NO: 81433 - DNA, 25 bp, mus musculus
cgactgggactctgtgtagatacgc

SEQ ID NO: 81434 - DNA, 25 bp, mus musculus
actctgtgtagatacgctgaaaatt

SEQ ID NO: 81435 - DNA, 25 bp, mus musculus
gtatccgcacgatgtcacttacagt

SEQ ID NO: 81436 - DNA, 25 bp, mus musculus
tatccgcacgatgtcacttacagtt

SEQ ID NO: 81437 - DNA, 25 bp, mus musculus
atccgcacgatgtcacttacagttt

SEQ ID NO: 81438 - DNA, 25 bp, mus musculus
acgatgtcacttacagtttgggcaa

SEQ ID NO: 81439 - DNA, 25 bp, mus musculus
cgatgtcacttacagtttgggcaaa

SEQ ID NO: 81440 - DNA, 25 bp, mus musculus
gatgtcacttacagtttgggcaaag

SEQ ID NO: 81441 - DNA, 25 bp, mus musculus
atgtcacttacagtttgggcaaagc

SEQ ID NO: 81442 - DNA, 25 bp, mus musculus
tgtcacttacagtttgggcaaagca

SEQ ID NO: 81443 - DNA, 25 bp, mus musculus
gtcacttacagtttgggcaaagcaa

SEQ ID NO: 81444 - DNA, 25 bp, mus musculus
tcacttacagtttgggcaaagcaag

SEQ ID NO: 81445 - DNA, 25 bp, mus musculus
tcaggtccgcgtggtatccgcacga

SEQ ID NO: 81446 - DNA, 25 bp, mus musculus
aggtccgcgtggtatccgcacgatg

SEQ ID NO: 81447 - DNA, 25 bp, mus musculus
cgcgtggtatccgcacgatgtcact

SEQ ID NO: 81448 - DNA, 25 bp, mus musculus
gcgtggtatccgcacgatgtcactt

SEQ ID NO: 81449 - DNA, 25 bp, mus musculus
cgtggtatccgcacgatgtcactta

SEQ ID NO: 81450 - DNA, 25 bp, mus musculus
gtggtatccgcacgatgtcacttac

SEQ ID NO: 81451 - DNA, 25 bp, mus musculus
tggtatccgcacgatgtcacttaca

SEQ ID NO: 81452 - DNA, 25 bp, mus musculus
ggtatccgcacgatgtcacttacag

SEQ ID NO: 81453 - DNA, 25 bp, mus musculus
tttccagaacaacctgaagaagatt

SEQ ID NO: 81454 - DNA, 25 bp, mus musculus
tccagaacaacctgaagaagattca

SEQ ID NO: 81455 - DNA, 25 bp, mus musculus
accctctaaaacttggctgtgagca

SEQ ID NO: 81456 - DNA, 25 bp, mus musculus
cctctaaaacttggctgtgagcaag

SEQ ID NO: 81457 - DNA, 25 bp, mus musculus
ctctaaaacttggctgtgagcaagg

SEQ ID NO: 81458 - DNA, 25 bp, mus musculus
ctaaaacttggctgtgagcaagggt

SEQ ID NO: 81459 - DNA, 25 bp, mus musculus
aaacttggctgtgagcaagggtggc

SEQ ID NO: 81460 - DNA, 25 bp, mus musculus
agcagaactggacaacccaggattt

SEQ ID NO: 81461 - DNA, 25 bp, mus musculus
tggacaacccaggattttcaattcg

SEQ ID NO: 81462 - DNA, 25 bp, mus musculus
gattttcaattcgttctgtagggca

SEQ ID NO: 81463 - DNA, 25 bp, mus musculus
caattcgttctgtagggcaagaaat

SEQ ID NO: 81464 - DNA, 25 bp, mus musculus
ttcgttctgtagggcaagaaattca

SEQ ID NO: 81465 - DNA, 25 bp, mus musculus
gaagattcaattccattgggctgtg

SEQ ID NO: 81466 - DNA, 25 bp, mus musculus
agattcaattccattgggctgtgat

SEQ ID NO: 81467 - DNA, 25 bp, mus musculus
ttcaattccattgggctgtgataac

SEQ ID NO: 81468 - DNA, 25 bp, mus musculus
tcaattccattgggctgtgataaca

SEQ ID NO: 81469 - DNA, 25 bp, mus musculus
attccattgggctgtgataacaaac

SEQ ID NO: 81470 - DNA, 25 bp, mus musculus
gtgaatccgagcttcgagaattttg

SEQ ID NO: 81471 - DNA, 25 bp, mus musculus
gaatccgagcttcgagaattttgag

SEQ ID NO: 81472 - DNA, 25 bp, mus musculus
aatccgagcttcgagaattttgagg

SEQ ID NO: 81473 - DNA, 25 bp, mus musculus
tcagtcacctttgaggctgacctct

SEQ ID NO: 81474 - DNA, 25 bp, mus musculus
tgcctccactgtcatgatgtcctac

SEQ ID NO: 81475 - DNA, 25 bp, mus musculus
gctcagatgtcttcttttctatata

SEQ ID NO: 81476 - DNA, 25 bp, mus musculus
aggccacaacattactggatatttc

SEQ ID NO: 81477 - DNA, 25 bp, mus musculus
atttgctaattcttgtggcttaaga

SEQ ID NO: 81478 - DNA, 25 bp, mus musculus
taattcttgtggcttaagacatttt

SEQ ID NO: 81479 - DNA, 25 bp, mus musculus
ttctgtacagttgtttgcccaaaat

SEQ ID NO: 81480 - DNA, 25 bp, mus musculus
actgtcccactaactaccatagctt

SEQ ID NO: 81481 - DNA, 25 bp, mus musculus
ccactaactaccatagctttctgtc

SEQ ID NO: 81482 - DNA, 25 bp, mus musculus
actaccatagctttctgtctggctc

SEQ ID NO: 81483 - DNA, 25 bp, mus musculus
atagctttctgtctggctcttacag

SEQ ID NO: 81484 - DNA, 25 bp, mus musculus
ttctgtctggctcttacaggataga

SEQ ID NO: 81485 - DNA, 25 bp, mus musculus
cactgtcatgatgtcctacactatt

SEQ ID NO: 81486 - DNA, 25 bp, mus musculus
catgatgtcctacactattcccgtt

SEQ ID NO: 81487 - DNA, 25 bp, mus musculus
tgattttggtatcctgtctattgaa

SEQ ID NO: 81488 - DNA, 25 bp, mus musculus
tggtatcctgtctattgaaatgtgc

SEQ ID NO: 81489 - DNA, 25 bp, mus musculus
aatgtgccattcagtatattcagat

SEQ ID NO: 81490 - DNA, 25 bp, mus musculus
tactaacctgttcaaaatgagtggc

SEQ ID NO: 81491 - DNA, 25 bp, mus musculus
ttgcttttaacagctcagatgtctt

SEQ ID NO: 81492 - DNA, 25 bp, mus musculus
ttaacagctcagatgtcttcttttc

SEQ ID NO: 81493 - DNA, 25 bp, mus musculus
ccgcatatttcccatcgactccgta

SEQ ID NO: 81494 - DNA, 25 bp, mus musculus
atttcccatcgactccgtaatctga

SEQ ID NO: 81495 - DNA, 25 bp, mus musculus
tgtaagccttcttgcttttgataac

SEQ ID NO: 81496 - DNA, 25 bp, mus musculus
ccttcttgcttttgataacacagta

SEQ ID NO: 81497 - DNA, 25 bp, mus musculus
attatctcaacctatatctcccttg

SEQ ID NO: 81498 - DNA, 25 bp, mus musculus
tcaacctatatctcccttgaaaata

SEQ ID NO: 81499 - DNA, 25 bp, mus musculus
tatatctcccttgaaaatactttca

SEQ ID NO: 81500 - DNA, 25 bp, mus musculus
cgcaaaacctaggactgaaagcaag

SEQ ID NO: 81501 - DNA, 25 bp, mus musculus
gcccgacttattttctaagactgca

SEQ ID NO: 81502 - DNA, 25 bp, mus musculus
cttattttctaagactgcaaagatc

SEQ ID NO: 81503 - DNA, 25 bp, mus musculus
cactttgtcaccagccctgggacct

SEQ ID NO: 81504 - DNA, 25 bp, mus musculus
gtcaccagccctgggacctgaggcc

SEQ ID NO: 81505 - DNA, 25 bp, mus musculus
catcgactccgtaatctgatgatgt

SEQ ID NO: 81506 - DNA, 25 bp, mus musculus
gtcattccagtgagctctgatgagg

SEQ ID NO: 81507 - DNA, 25 bp, mus musculus
aatctgatgatgttccctcttgcac

SEQ ID NO: 81508 - DNA, 25 bp, mus musculus
atgatgttccctcttgcactgaata

SEQ ID NO: 81509 - DNA, 25 bp, mus musculus
ttccctcttgcactgaataatacat

SEQ ID NO: 81510 - DNA, 25 bp, mus musculus
ctgccgatggtgtccgacagcaccc

SEQ ID NO: 81511 - DNA, 25 bp, mus musculus
atggtgtccgacagcaccctgggca

SEQ ID NO: 81512 - DNA, 25 bp, mus musculus
agcaccctgggcattagggtggtag

SEQ ID NO: 81513 - DNA, 25 bp, mus musculus
aggctcccaggcctagggctgagag

SEQ ID NO: 81514 - DNA, 25 bp, mus musculus
atgcgagctctactcattcatgaga

SEQ ID NO: 81515 - DNA, 25 bp, mus musculus
cgagctctactcattcatgagaaga

SEQ ID NO: 81516 - DNA, 25 bp, mus musculus
tagcagatgccccattgttatggtg

SEQ ID NO: 81517 - DNA, 25 bp, mus musculus
cagatgccccattgttatggtggct

SEQ ID NO: 81518 - DNA, 25 bp, mus musculus
ccccattgttatggtggctggctgt

SEQ ID NO: 81519 - DNA, 25 bp, mus musculus
cattgttatggtggctggctgtcca

SEQ ID NO: 81520 - DNA, 25 bp, mus musculus
tgttatggtggctggctgtccattt

SEQ ID NO: 81521 - DNA, 25 bp, mus musculus
tatggtggctggctgtccattttcc

SEQ ID NO: 81522 - DNA, 25 bp, mus musculus
tggctgtccattttcctacagtgaa

SEQ ID NO: 81523 - DNA, 25 bp, mus musculus
ctgtccattttcctacagtgaagtt

SEQ ID NO: 81524 - DNA, 25 bp, mus musculus
tccattttcctacagtgaagttagg

SEQ ID NO: 81525 - DNA, 25 bp, mus musculus
attttcctacagtgaagttaggcag

SEQ ID NO: 81526 - DNA, 25 bp, mus musculus
ctactcattcatgagaagaagactt

SEQ ID NO: 81527 - DNA, 25 bp, mus musculus
aagacttcctcggtgacagctggct

SEQ ID NO: 81528 - DNA, 25 bp, mus musculus
acttcctcggtgacagctggctctg

SEQ ID NO: 81529 - DNA, 25 bp, mus musculus
tgacagctgctaatggcagtgactc

SEQ ID NO: 81530 - DNA, 25 bp, mus musculus
ctaatggcagtgactctgagagtga

SEQ ID NO: 81531 - DNA, 25 bp, mus musculus
ctcctcatcatcatcgcgatgaaga

SEQ ID NO: 81532 - DNA, 25 bp, mus musculus
atcatcatcgcgatgaagatgagga

SEQ ID NO: 81533 - DNA, 25 bp, mus musculus
aagtagcagatgccccattgttatg

SEQ ID NO: 81534 - DNA, 25 bp, mus musculus
gttactggccagataattggcaatg

SEQ ID NO: 81535 - DNA, 25 bp, mus musculus
aggaagtgcccattctgcaattccg

SEQ ID NO: 81536 - DNA, 25 bp, mus musculus
ggaactcggcattccaatatagtca

SEQ ID NO: 81537 - DNA, 25 bp, mus musculus
ctcggcattccaatatagtcagcct

SEQ ID NO: 81538 - DNA, 25 bp, mus musculus
tccaatatagtcagcctgcaggagt

SEQ ID NO: 81539 - DNA, 25 bp, mus musculus
caatatagtcagcctgcaggagtgc

SEQ ID NO: 81540 - DNA, 25 bp, mus musculus
atagtcagcctgcaggagtgcccat

SEQ ID NO: 81541 - DNA, 25 bp, mus musculus
agtcagcctgcaggagtgcccatta

SEQ ID NO: 81542 - DNA, 25 bp, mus musculus
agtgcccattagggatccaggcgga

SEQ ID NO: 81543 - DNA, 25 bp, mus musculus
tgcccattagggatccaggcggatc

SEQ ID NO: 81544 - DNA, 25 bp, mus musculus
ggatccaggcggatcccatctttgg

SEQ ID NO: 81545 - DNA, 25 bp, mus musculus
atccaggcggatcccatctttggtt

SEQ ID NO: 81546 - DNA, 25 bp, mus musculus
agtgcccattctgcaattccgggaa

SEQ ID NO: 81547 - DNA, 25 bp, mus musculus
atcccatctttggttcccgtcaatg

SEQ ID NO: 81548 - DNA, 25 bp, mus musculus
tgcccattctgcaattccgggaatc

SEQ ID NO: 81549 - DNA, 25 bp, mus musculus
cccattctgcaattccgggaatctc

SEQ ID NO: 81550 - DNA, 25 bp, mus musculus
cattctgcaattccgggaatctctc

SEQ ID NO: 81551 - DNA, 25 bp, mus musculus
ttctgcaattccgggaatctctcct

SEQ ID NO: 81552 - DNA, 25 bp, mus musculus
ctgcaattccgggaatctctccttt

SEQ ID NO: 81553 - DNA, 25 bp, mus musculus
taaaggaactcggcattccaatata

SEQ ID NO: 81554 - DNA, 25 bp, mus musculus
aaggaactcggcattccaatatagt

SEQ ID NO: 81555 - DNA, 25 bp, mus musculus
agccgtcagagcttccacatggcca

SEQ ID NO: 81556 - DNA, 25 bp, mus musculus
ttccacatggccatgggcaacccca

SEQ ID NO: 81557 - DNA, 25 bp, mus musculus
ttcatagtgcctgggctcacgtggc

SEQ ID NO: 81558 - DNA, 25 bp, mus musculus
ttgccactgtgactctcaccagcag

SEQ ID NO: 81559 - DNA, 25 bp, mus musculus
ctgtgactctcaccagcagtgcctg

SEQ ID NO: 81560 - DNA, 25 bp, mus musculus
ctctcaccagcagtgcctggtcctt

SEQ ID NO: 81561 - DNA, 25 bp, mus musculus
aatagacagttcctcttttatatgg

SEQ ID NO: 81562 - DNA, 25 bp, mus musculus
cagttcctcttttatatggagaatc

SEQ ID NO: 81563 - DNA, 25 bp, mus musculus
tccaggtgcctagtcagctctcatg

SEQ ID NO: 81564 - DNA, 25 bp, mus musculus
tgcctagtcagctctcatgttgagg

SEQ ID NO: 81565 - DNA, 25 bp, mus musculus
tcagtggtaccctgggaagaagaag

SEQ ID NO: 81566 - DNA, 25 bp, mus musculus
gactgtgtagctgcctttgttactc

SEQ ID NO: 81567 - DNA, 25 bp, mus musculus
tagggacccatcttgaggccacatt

SEQ ID NO: 81568 - DNA, 25 bp, mus musculus
cccatcttgaggccacattgggtct

SEQ ID NO: 81569 - DNA, 25 bp, mus musculus
ttgaggccacattgggtctgtgccc

SEQ ID NO: 81570 - DNA, 25 bp, mus musculus
tgtgcccttggcctggcaagtttca

SEQ ID NO: 81571 - DNA, 25 bp, mus musculus
cttggcctggcaagtttcagcctgg

SEQ ID NO: 81572 - DNA, 25 bp, mus musculus
ctggcaagtttcagcctggtgccct

SEQ ID NO: 81573 - DNA, 25 bp, mus musculus
agcctggtgcccttcatagtgcctg

SEQ ID NO: 81574 - DNA, 25 bp, mus musculus
gtgcccttcatagtgcctgggctca

SEQ ID NO: 81575 - DNA, 25 bp, mus musculus
aactgctctgatgtatggagccaag

SEQ ID NO: 81576 - DNA, 25 bp, mus musculus
caagaagaccctcaacactgaaggt

SEQ ID NO: 81577 - DNA, 25 bp, mus musculus
gaacaatagctccaatctgtacacc

SEQ ID NO: 81578 - DNA, 25 bp, mus musculus
tagctccaatctgtacaccatcctg

SEQ ID NO: 81579 - DNA, 25 bp, mus musculus
caatctgtacaccatcctggcctat

SEQ ID NO: 81580 - DNA, 25 bp, mus musculus
caccatcctggcctatctttctggc

SEQ ID NO: 81581 - DNA, 25 bp, mus musculus
ctatctttctggcaacatcaccttc

SEQ ID NO: 81582 - DNA, 25 bp, mus musculus
tggcaacatcaccttctacactggg

SEQ ID NO: 81583 - DNA, 25 bp, mus musculus
catcaccttctacactggggtatcc

SEQ ID NO: 81584 - DNA, 25 bp, mus musculus
ctacactggggtatccaagaaagag

SEQ ID NO: 81585 - DNA, 25 bp, mus musculus
gtcctttgaagagacgctggatccc

SEQ ID NO: 81586 - DNA, 25 bp, mus musculus
gacgctggatcccttttcctccaag

SEQ ID NO: 81587 - DNA, 25 bp, mus musculus
gaagaccctcaacactgaaggtgtt

SEQ ID NO: 81588 - DNA, 25 bp, mus musculus
gaccatgaactttgatgtggaaaat

SEQ ID NO: 81589 - DNA, 25 bp, mus musculus
cttcaaagtgactatcaccttccag

SEQ ID NO: 81590 - DNA, 25 bp, mus musculus
agtgactatcaccttccagaacaat

SEQ ID NO: 81591 - DNA, 25 bp, mus musculus
gactatcaccttccagaacaatagc

SEQ ID NO: 81592 - DNA, 25 bp, mus musculus
tatcaccttccagaacaatagctcc

SEQ ID NO: 81593 - DNA, 25 bp, mus musculus
cttccagaacaatagctccaatctg

SEQ ID NO: 81594 - DNA, 25 bp, mus musculus
ccagaacaatagctccaatctgtac

SEQ ID NO: 81595 - DNA, 25 bp, mus musculus
tggatcctgagattgcgctgaaaat

SEQ ID NO: 81596 - DNA, 25 bp, mus musculus
tgaaaattctgcatcgccagacaaa

SEQ ID NO: 81597 - DNA, 25 bp, mus musculus
atgtttcaatgaaccagcagaatcc

SEQ ID NO: 81598 - DNA, 25 bp, mus musculus
caatgaaccagcagaatccgcagcc

SEQ ID NO: 81599 - DNA, 25 bp, mus musculus
ggctcaatctttgggtggaatgcat

SEQ ID NO: 81600 - DNA, 25 bp, mus musculus
atctttgggtggaatgcatgtcaat

SEQ ID NO: 81601 - DNA, 25 bp, mus musculus
tgtcaatggcgcacctcctatgatg

SEQ ID NO: 81602 - DNA, 25 bp, mus musculus
tggcgcacctcctatgatgcaagct

SEQ ID NO: 81603 - DNA, 25 bp, mus musculus
acctcctatgatgcaagcttctatg

SEQ ID NO: 81604 - DNA, 25 bp, mus musculus
gcaagcttctatgccaggtggagtt

SEQ ID NO: 81605 - DNA, 25 bp, mus musculus
ttctatgccaggtggagttccagcc

SEQ ID NO: 81606 - DNA, 25 bp, mus musculus
cccagtgcagatggcagctgctgta

SEQ ID NO: 81607 - DNA, 25 bp, mus musculus
ttctgcatcgccagacaaatatccc

SEQ ID NO: 81608 - DNA, 25 bp, mus musculus
atcgccagacaaatatcccaacgct

SEQ ID NO: 81609 - DNA, 25 bp, mus musculus
agacaaatatcccaacgctgatttc

SEQ ID NO: 81610 - DNA, 25 bp, mus musculus
atatcccaacgctgatttcaggcaa

SEQ ID NO: 81611 - DNA, 25 bp, mus musculus
tgatttcaggcaaccctcagccagt

SEQ ID NO: 81612 - DNA, 25 bp, mus musculus
accctcagccagttcatgttgctgg

SEQ ID NO: 81613 - DNA, 25 bp, mus musculus
agccagttcatgttgctgggcctgg

SEQ ID NO: 81614 - DNA, 25 bp, mus musculus
ttcatgttgctgggcctggctcagg

SEQ ID NO: 81615 - DNA, 25 bp, mus musculus
actcagactgaagccctgcagcagc

SEQ ID NO: 81616 - DNA, 25 bp, mus musculus
aaggactctgaggccatccgtagtc

SEQ ID NO: 81617 - DNA, 25 bp, mus musculus
ggttgcttcaacttttagctctgct

SEQ ID NO: 81618 - DNA, 25 bp, mus musculus
aagctttcctactatctacatttca

SEQ ID NO: 81619 - DNA, 25 bp, mus musculus
tcctactatctacatttcaaaatga

SEQ ID NO: 81620 - DNA, 25 bp, mus musculus
tatctacatttcaaaatgatctctg

SEQ ID NO: 81621 - DNA, 25 bp, mus musculus
catttcaaaatgatctctggaaaat

SEQ ID NO: 81622 - DNA, 25 bp, mus musculus
aatgcaatgctactgcatagataaa

SEQ ID NO: 81623 - DNA, 25 bp, mus musculus
tgtccccctgaagcctgagctcctt

SEQ ID NO: 81624 - DNA, 25 bp, mus musculus
cctgaagcctgagctcctttgcttt

SEQ ID NO: 81625 - DNA, 25 bp, mus musculus
gcctgagctcctttgctttcaacta

SEQ ID NO: 81626 - DNA, 25 bp, mus musculus
gctcctttgctttcaactatagaat

SEQ ID NO: 81627 - DNA, 25 bp, mus musculus
tctgaggccatccgtagtcagtatg

SEQ ID NO: 81628 - DNA, 25 bp, mus musculus
cagtatgctcattactttgacctct

SEQ ID NO: 81629 - DNA, 25 bp, mus musculus
gctcattactttgacctctctttgg

SEQ ID NO: 81630 - DNA, 25 bp, mus musculus
tactttgacctctctttggtgaata

SEQ ID NO: 81631 - DNA, 25 bp, mus musculus
caagaagcctttgaccaggcttgca

SEQ ID NO: 81632 - DNA, 25 bp, mus musculus
gcctttgaccaggcttgcagttctc

SEQ ID NO: 81633 - DNA, 25 bp, mus musculus
agttctccacagtgggtgcctgtct

SEQ ID NO: 81634 - DNA, 25 bp, mus musculus
gtttcagccagcatttggaatgcca

SEQ ID NO: 81635 - DNA, 25 bp, mus musculus
tgccctctttccggtccacactagg

SEQ ID NO: 81636 - DNA, 25 bp, mus musculus
tccggtccacactagggacgcctga

SEQ ID NO: 81637 - DNA, 25 bp, mus musculus
cagtctgatggccaactgctgcaac

SEQ ID NO: 81638 - DNA, 25 bp, mus musculus
gtctgatggccaactgctgcaactt

SEQ ID NO: 81639 - DNA, 25 bp, mus musculus
tctgatggccaactgctgcaacttg

SEQ ID NO: 81640 - DNA, 25 bp, mus musculus
tgatggccaactgctgcaacttgtt

SEQ ID NO: 81641 - DNA, 25 bp, mus musculus
gatggccaactgctgcaacttgttc

SEQ ID NO: 81642 - DNA, 25 bp, mus musculus
tggccaactgctgcaacttgttcaa

SEQ ID NO: 81643 - DNA, 25 bp, mus musculus
ggccaactgctgcaacttgttcaag

SEQ ID NO: 81644 - DNA, 25 bp, mus musculus
ccaactgctgcaacttgttcaagcg

SEQ ID NO: 81645 - DNA, 25 bp, mus musculus
ctgctgcaacttgttcaagcggtgg

SEQ ID NO: 81646 - DNA, 25 bp, mus musculus
gctgcaacttgttcaagcggtggcg

SEQ ID NO: 81647 - DNA, 25 bp, mus musculus
ccggtccacactagggacgcctgag

SEQ ID NO: 81648 - DNA, 25 bp, mus musculus
ggtccacactagggacgcctgaggc

SEQ ID NO: 81649 - DNA, 25 bp, mus musculus
ccacactagggacgcctgaggcgtg

SEQ ID NO: 81650 - DNA, 25 bp, mus musculus
cacactagggacgcctgaggcgtgg

SEQ ID NO: 81651 - DNA, 25 bp, mus musculus
gatgttcagtctgatggccaactgc

SEQ ID NO: 81652 - DNA, 25 bp, mus musculus
tgttcagtctgatggccaactgctg

SEQ ID NO: 81653 - DNA, 25 bp, mus musculus
gttcagtctgatggccaactgctgc

SEQ ID NO: 81654 - DNA, 25 bp, mus musculus
tcagtctgatggccaactgctgcaa

SEQ ID NO: 81655 - DNA, 25 bp, mus musculus
agctaaattctccctggttggcatc

SEQ ID NO: 81656 - DNA, 25 bp, mus musculus
attctccctggttggcatcggagga

SEQ ID NO: 81657 - DNA, 25 bp, mus musculus
cccggttctggatctcattgacgcc

SEQ ID NO: 81658 - DNA, 25 bp, mus musculus
tctggatctcattgacgccattcag

SEQ ID NO: 81659 - DNA, 25 bp, mus musculus
tgacgccattcagccaggttccata

SEQ ID NO: 81660 - DNA, 25 bp, mus musculus
gccaggttccataaactatgacctt

SEQ ID NO: 81661 - DNA, 25 bp, mus musculus
tgaccttctaaagacagaaaacttg

SEQ ID NO: 81662 - DNA, 25 bp, mus musculus
gaaactcaacaatgcaaagtatgcc

SEQ ID NO: 81663 - DNA, 25 bp, mus musculus
tgcaaagtatgccatctctatggcc

SEQ ID NO: 81664 - DNA, 25 bp, mus musculus
agtgaaccccaaaatggtcatgaca

SEQ ID NO: 81665 - DNA, 25 bp, mus musculus
catggctgcccaggatgcagaggac

SEQ ID NO: 81666 - DNA, 25 bp, mus musculus
agaggaccattcaagcattgcaaag

SEQ ID NO: 81667 - DNA, 25 bp, mus musculus
aaaccgaactctcacgctggcattg

SEQ ID NO: 81668 - DNA, 25 bp, mus musculus
cattcaagcattgcaaagtcctgac

SEQ ID NO: 81669 - DNA, 25 bp, mus musculus
aactctcacgctggcattggtttgg

SEQ ID NO: 81670 - DNA, 25 bp, mus musculus
cacactgaatatcctggaagatatc

SEQ ID NO: 81671 - DNA, 25 bp, mus musculus
tgacattattgtcaactgggtgaat

SEQ ID NO: 81672 - DNA, 25 bp, mus musculus
tattgtcaactgggtgaatatgacc

SEQ ID NO: 81673 - DNA, 25 bp, mus musculus
acagaaaagctcatccattgctagc

SEQ ID NO: 81674 - DNA, 25 bp, mus musculus
tgctagcttcaaggacccaaagatc

SEQ ID NO: 81675 - DNA, 25 bp, mus musculus
cagcctcccggttctggatctcatt

SEQ ID NO: 81676 - DNA, 25 bp, mus musculus
cgagcccagcgaccgaaattgcgag

SEQ ID NO: 81677 - DNA, 25 bp, mus musculus
gcccagcgaccgaaattgcgaggac

SEQ ID NO: 81678 - DNA, 25 bp, mus musculus
gagcttctgtccccagtctgggaga

SEQ ID NO: 81679 - DNA, 25 bp, mus musculus
ctgtccccagtctgggagacttgtg

SEQ ID NO: 81680 - DNA, 25 bp, mus musculus
tccccagtctgggagacttgtgtcc

SEQ ID NO: 81681 - DNA, 25 bp, mus musculus
tcggacctccgcagtgtgcggcgct

SEQ ID NO: 81682 - DNA, 25 bp, mus musculus
cggacaccggcaggcacacacttac

SEQ ID NO: 81683 - DNA, 25 bp, mus musculus
acaccggcaggcacacacttacttc

SEQ ID NO: 81684 - DNA, 25 bp, mus musculus
ggcacacacttacttccgcgccttg

SEQ ID NO: 81685 - DNA, 25 bp, mus musculus
ctctagcagatcagctgatacctgg

SEQ ID NO: 81686 - DNA, 25 bp, mus musculus
tccccatgtcgctgaggcttctacc

SEQ ID NO: 81687 - DNA, 25 bp, mus musculus
ccatgtcgctgaggcttctacccct

SEQ ID NO: 81688 - DNA, 25 bp, mus musculus
aaattgcgaggactgagcgtcgccg

SEQ ID NO: 81689 - DNA, 25 bp, mus musculus
atgccgtttgctttctaatcatttc

SEQ ID NO: 81690 - DNA, 25 bp, mus musculus
taatcatttcattactactttgaat

SEQ ID NO: 81691 - DNA, 25 bp, mus musculus
tcatttcattactactttgaatgca

SEQ ID NO: 81692 - DNA, 25 bp, mus musculus
cattactactttgaatgcagacaat

SEQ ID NO: 81693 - DNA, 25 bp, mus musculus
gcccggaagccaatcccaggtgtca

SEQ ID NO: 81694 - DNA, 25 bp, mus musculus
atcccaggtgtcagcgagcttctgt

SEQ ID NO: 81695 - DNA, 25 bp, mus musculus
agcgagcttctgtccccagtctggg

SEQ ID NO: 81696 - DNA, 25 bp, mus musculus
gagtcggttgctgcagagagctcgc

SEQ ID NO: 81697 - DNA, 25 bp, mus musculus
gagagctcgccagctctagagaatg

SEQ ID NO: 81698 - DNA, 25 bp, mus musculus
tctcatcgctgctatgacctagttc

SEQ ID NO: 81699 - DNA, 25 bp, mus musculus
tgctatgacctagttcccacaagtt

SEQ ID NO: 81700 - DNA, 25 bp, mus musculus
tatgacctagttcccacaagttcca

SEQ ID NO: 81701 - DNA, 25 bp, mus musculus
gtatttgacacttcgctacaggtaa

SEQ ID NO: 81702 - DNA, 25 bp, mus musculus
tttgacacttcgctacaggtaaaga

SEQ ID NO: 81703 - DNA, 25 bp, mus musculus
gacacttcgctacaggtaaagaaag

SEQ ID NO: 81704 - DNA, 25 bp, mus musculus
ggcatgctgaccatcaccgagttca

SEQ ID NO: 81705 - DNA, 25 bp, mus musculus
ctgaccatcaccgagttcatcaaca

SEQ ID NO: 81706 - DNA, 25 bp, mus musculus
accatcaccgagttcatcaacattt

SEQ ID NO: 81707 - DNA, 25 bp, mus musculus
atcaccgagttcatcaacattttgc

SEQ ID NO: 81708 - DNA, 25 bp, mus musculus
tcgccagctctagagaatgagcact

SEQ ID NO: 81709 - DNA, 25 bp, mus musculus
gagttcatcaacattttgcaccgat

SEQ ID NO: 81710 - DNA, 25 bp, mus musculus
gagaccccggaatcaaacaatagtg

SEQ ID NO: 81711 - DNA, 25 bp, mus musculus
agtgtgtatacttccttcatgaagt

SEQ ID NO: 81712 - DNA, 25 bp, mus musculus
gtgtatacttccttcatgaagtctc

SEQ ID NO: 81713 - DNA, 25 bp, mus musculus
acttccttcatgaagtctcatcgct

SEQ ID NO: 81714 - DNA, 25 bp, mus musculus
tccttcatgaagtctcatcgctgct

SEQ ID NO: 81715 - DNA, 25 bp, mus musculus
ttcatgaagtctcatcgctgctatg

SEQ ID NO: 81716 - DNA, 25 bp, mus musculus
aagtctcatcgctgctatgacctag

SEQ ID NO: 81717 - DNA, 25 bp, mus musculus
atcactgagctgtgcttctgctcct

SEQ ID NO: 81718 - DNA, 25 bp, mus musculus
actgagctgtgcttctgctcctgat

SEQ ID NO: 81719 - DNA, 25 bp, mus musculus
gcaacctgcctctatttgtgggcag

SEQ ID NO: 81720 - DNA, 25 bp, mus musculus
tgcctctatttgtgggcagttggtt

SEQ ID NO: 81721 - DNA, 25 bp, mus musculus
tgtgtctcgcccagaacctagggaa

SEQ ID NO: 81722 - DNA, 25 bp, mus musculus
gtctcgcccagaacctagggaaatg

SEQ ID NO: 81723 - DNA, 25 bp, mus musculus
agcacctgtcagtgctgcacattag

SEQ ID NO: 81724 - DNA, 25 bp, mus musculus
cagtgctgcacattagacagctgtg

SEQ ID NO: 81725 - DNA, 25 bp, mus musculus
tgctgcacattagacagctgtgtca

SEQ ID NO: 81726 - DNA, 25 bp, mus musculus
tgcacattagacagctgtgtcagga

SEQ ID NO: 81727 - DNA, 25 bp, mus musculus
agctgtgtcaggacttctcctttaa

SEQ ID NO: 81728 - DNA, 25 bp, mus musculus
atgattgaccggactgcggaataaa

SEQ ID NO: 81729 - DNA, 25 bp, mus musculus
gagctgtgcttctgctcctgatttc

SEQ ID NO: 81730 - DNA, 25 bp, mus musculus
ttctgctcctgatttccctggagtt

SEQ ID NO: 81731 - DNA, 25 bp, mus musculus
ccctggagttctgcaggaaagttgc

SEQ ID NO: 81732 - DNA, 25 bp, mus musculus
aagttgctctccagctcattcgtgg

SEQ ID NO: 81733 - DNA, 25 bp, mus musculus
ttgctctccagctcattcgtggcca

SEQ ID NO: 81734 - DNA, 25 bp, mus musculus
tcattcgtggccagccgtgctcagg

SEQ ID NO: 81735 - DNA, 25 bp, mus musculus
agccgtgctcagggcctcgggactc

SEQ ID NO: 81736 - DNA, 25 bp, mus musculus
atagcaacctgcctctatttgtggg

SEQ ID NO: 81737 - DNA, 25 bp, mus musculus
caatgccgttcttattctgtaacat

SEQ ID NO: 81738 - DNA, 25 bp, mus musculus
atgattattcatactggctgtcaac

SEQ ID NO: 81739 - DNA, 25 bp, mus musculus
ctgttcacagtcaaactactgctat

SEQ ID NO: 81740 - DNA, 25 bp, mus musculus
acagtcaaactactgctatccctcc

SEQ ID NO: 81741 - DNA, 25 bp, mus musculus
tgttcacaagtgcaggctctgaggg

SEQ ID NO: 81742 - DNA, 25 bp, mus musculus
caggctctgagggtgctggacaagc

SEQ ID NO: 81743 - DNA, 25 bp, mus musculus
gagccagtccatttatagaatgcca

SEQ ID NO: 81744 - DNA, 25 bp, mus musculus
actcctacagtttctggctggcttc

SEQ ID NO: 81745 - DNA, 25 bp, mus musculus
cgctgaacccagaaagaatgttcag

SEQ ID NO: 81746 - DNA, 25 bp, mus musculus
tgttcagaaaacctattccatcaac

SEQ ID NO: 81747 - DNA, 25 bp, mus musculus
ctattccatcaactgtgaaagctgg

SEQ ID NO: 81748 - DNA, 25 bp, mus musculus
aaatcataagccgctgtcaggtgtg

SEQ ID NO: 81749 - DNA, 25 bp, mus musculus
attcatactggctgtcaacaccagc

SEQ ID NO: 81750 - DNA, 25 bp, mus musculus
caccagctctgatgccaatggacat

SEQ ID NO: 81751 - DNA, 25 bp, mus musculus
ctctgatgccaatggacatggctcc

SEQ ID NO: 81752 - DNA, 25 bp, mus musculus
tggacatggctccaattagtggcag

SEQ ID NO: 81753 - DNA, 25 bp, mus musculus
ttagcagatgcaccgtctgtgaagg

SEQ ID NO: 81754 - DNA, 25 bp, mus musculus
gatgcaccgtctgtgaaggtccagc

SEQ ID NO: 81755 - DNA, 25 bp, mus musculus
caatggccatagctgttcacagtca

SEQ ID NO: 81756 - DNA, 25 bp, mus musculus
ccatagctgttcacagtcaaactac

SEQ ID NO: 81757 - DNA, 25 bp, mus musculus
gccaagaccgtggcgtatttctacg

SEQ ID NO: 81758 - DNA, 25 bp, mus musculus
gaccccgatgtgggcaacttccact

SEQ ID NO: 81759 - DNA, 25 bp, mus musculus
gtcctgcattatggtctctataaga

SEQ ID NO: 81760 - DNA, 25 bp, mus musculus
atcgtcttcaagccttaccaggcct

SEQ ID NO: 81761 - DNA, 25 bp, mus musculus
caggcctcccagcatgacatgtgcc

SEQ ID NO: 81762 - DNA, 25 bp, mus musculus
tcccagcatgacatgtgccgcttcc

SEQ ID NO: 81763 - DNA, 25 bp, mus musculus
cgcttccattctgaggactacatcg

SEQ ID NO: 81764 - DNA, 25 bp, mus musculus
cattctgaggactacatcgactccc

SEQ ID NO: 81765 - DNA, 25 bp, mus musculus
tacatcgactccctgggctgtgatc

SEQ ID NO: 81766 - DNA, 25 bp, mus musculus
cgattaggctgcttcaatctcagca

SEQ ID NO: 81767 - DNA, 25 bp, mus musculus
ggctgcttcaatctcagcattcgag

SEQ ID NO: 81768 - DNA, 25 bp, mus musculus
ctcagcattcgaggacatggggaat

SEQ ID NO: 81769 - DNA, 25 bp, mus musculus
ttccactatggagctggacacccaa

SEQ ID NO: 81770 - DNA, 25 bp, mus musculus
gctggacacccaatgaaacctcatc

SEQ ID NO: 81771 - DNA, 25 bp, mus musculus
cacccaatgaaacctcatcgcctgg

SEQ ID NO: 81772 - DNA, 25 bp, mus musculus
atgaaacctcatcgcctggcattga

SEQ ID NO: 81773 - DNA, 25 bp, mus musculus
cctcatcgcctggcattgactcata

SEQ ID NO: 81774 - DNA, 25 bp, mus musculus
gcattgactcatagcctagtcctgc

SEQ ID NO: 81775 - DNA, 25 bp, mus musculus
actcatagcctagtcctgcattatg

SEQ ID NO: 81776 - DNA, 25 bp, mus musculus
agcctagtcctgcattatggtctct

SEQ ID NO: 81777 - DNA, 25 bp, mus musculus
acagatgcctacacttgggtttatt

SEQ ID NO: 81778 - DNA, 25 bp, mus musculus
aagcgctttttacattccttgcaat

SEQ ID NO: 81779 - DNA, 25 bp, mus musculus
ttgccatacagtgcctttccattga

SEQ ID NO: 81780 - DNA, 25 bp, mus musculus
tttgctcttcatttaaaccaaatca

SEQ ID NO: 81781 - DNA, 25 bp, mus musculus
ttaaaccaaatcatatttcatagtt

SEQ ID NO: 81782 - DNA, 25 bp, mus musculus
atatttcatagtttacgctcgaggg

SEQ ID NO: 81783 - DNA, 25 bp, mus musculus
ttcttggcagcttttaacattatag

SEQ ID NO: 81784 - DNA, 25 bp, mus musculus
gactgctggtcacagttgcaaatca

SEQ ID NO: 81785 - DNA, 25 bp, mus musculus
aagtctgagcagctgctgtatatag

SEQ ID NO: 81786 - DNA, 25 bp, mus musculus
ttgtggcaccttatgttgcacttat

SEQ ID NO: 81787 - DNA, 25 bp, mus musculus
caccttatgttgcacttatgttggg

SEQ ID NO: 81788 - DNA, 25 bp, mus musculus
ttttaatcacagtcacaggactttt

SEQ ID NO: 81789 - DNA, 25 bp, mus musculus
tttttacattccttgcaatactgat

SEQ ID NO: 81790 - DNA, 25 bp, mus musculus
cattccttgcaatactgatggtggt

SEQ ID NO: 81791 - DNA, 25 bp, mus musculus
tgatgcgcaggtctcattggttcgt

SEQ ID NO: 81792 - DNA, 25 bp, mus musculus
gcaggtctcattggttcgttcattc

SEQ ID NO: 81793 - DNA, 25 bp, mus musculus
ctcattggttcgttcattctgcagt

SEQ ID NO: 81794 - DNA, 25 bp, mus musculus
ggttcgttcattctgcagttgccat

SEQ ID NO: 81795 - DNA, 25 bp, mus musculus
ttcattctgcagttgccatacagtg

SEQ ID NO: 81796 - DNA, 25 bp, mus musculus
ctgcagttgccatacagtgcctttc

SEQ ID NO: 81797 - DNA, 25 bp, mus musculus
tataccatagtaccagtaggggctt

SEQ ID NO: 81798 - DNA, 25 bp, mus musculus
ttacatgttttctcttgtgcatcaa

SEQ ID NO: 81799 - DNA, 25 bp, mus musculus
tataaatcattctattggagagaaa

SEQ ID NO: 81800 - DNA, 25 bp, mus musculus
aaatcattctattggagagaaatgc

SEQ ID NO: 81801 - DNA, 25 bp, mus musculus
aaatgcattgttttctgccagtgga

SEQ ID NO: 81802 - DNA, 25 bp, mus musculus
tgcattgttttctgccagtggatat

SEQ ID NO: 81803 - DNA, 25 bp, mus musculus
cattgttttctgccagtggatattt

SEQ ID NO: 81804 - DNA, 25 bp, mus musculus
aaagtttgcagactgagaggagaga

SEQ ID NO: 81805 - DNA, 25 bp, mus musculus
aacatgaaatcctttcactttggca

SEQ ID NO: 81806 - DNA, 25 bp, mus musculus
catgaaatcctttcactttggcaga

SEQ ID NO: 81807 - DNA, 25 bp, mus musculus
atgaaatcctttcactttggcagaa

SEQ ID NO: 81808 - DNA, 25 bp, mus musculus
tcctttcactttggcagaaaaacat

SEQ ID NO: 81809 - DNA, 25 bp, mus musculus
acatgttttctcttgtgcatcaatt

SEQ ID NO: 81810 - DNA, 25 bp, mus musculus
gttttctcttgtgcatcaatttaaa

SEQ ID NO: 81811 - DNA, 25 bp, mus musculus
acaaccatgtaaactacttctcttg

SEQ ID NO: 81812 - DNA, 25 bp, mus musculus
caaccatgtaaactacttctcttgt

SEQ ID NO: 81813 - DNA, 25 bp, mus musculus
ccatgtaaactacttctcttgttag

SEQ ID NO: 81814 - DNA, 25 bp, mus musculus
aaactacttctcttgttagatagat

SEQ ID NO: 81815 - DNA, 25 bp, mus musculus
actacttctcttgttagatagattt

SEQ ID NO: 81816 - DNA, 25 bp, mus musculus
acttctcttgttagatagattttca

SEQ ID NO: 81817 - DNA, 25 bp, mus musculus
gagagaccaagccgctcagccgttt

SEQ ID NO: 81818 - DNA, 25 bp, mus musculus
agaccaagccgctcagccgtttgta

SEQ ID NO: 81819 - DNA, 25 bp, mus musculus
aattttgagactagccctgctctct

SEQ ID NO: 81820 - DNA, 25 bp, mus musculus
tttgagactagccctgctctcttca

SEQ ID NO: 81821 - DNA, 25 bp, mus musculus
agccctgctctcttcatttcctaca

SEQ ID NO: 81822 - DNA, 25 bp, mus musculus
ttcatttcctacaaccacaccacaa

SEQ ID NO: 81823 - DNA, 25 bp, mus musculus
cattatcactactgggagttaaggt

SEQ ID NO: 81824 - DNA, 25 bp, mus musculus
tttctttagattcctggcatgacaa

SEQ ID NO: 81825 - DNA, 25 bp, mus musculus
ctttagattcctggcatgacaatta

SEQ ID NO: 81826 - DNA, 25 bp, mus musculus
attcctggcatgacaattaataggt

SEQ ID NO: 81827 - DNA, 25 bp, mus musculus
taacctaatgttgtagggctgagga

SEQ ID NO: 81828 - DNA, 25 bp, mus musculus
tagtctccatagtatgtgtaacctg

SEQ ID NO: 81829 - DNA, 25 bp, mus musculus
ccaagccgctcagccgtttgtagaa

SEQ ID NO: 81830 - DNA, 25 bp, mus musculus
agaagcctttctacttcctgcagaa

SEQ ID NO: 81831 - DNA, 25 bp, mus musculus
agcctttctacttcctgcagaagtc

SEQ ID NO: 81832 - DNA, 25 bp, mus musculus
tcctgcagaagtctgagatgctaag

SEQ ID NO: 81833 - DNA, 25 bp, mus musculus
tgctaaggctccgttaagttcacac

SEQ ID NO: 81834 - DNA, 25 bp, mus musculus
taaggctccgttaagttcacaccag

SEQ ID NO: 81835 - DNA, 25 bp, mus musculus
ggctccgttaagttcacaccagcca

SEQ ID NO: 81836 - DNA, 25 bp, mus musculus
gttaagttcacaccagccaaactct

SEQ ID NO: 81837 - DNA, 25 bp, mus musculus
ctgtaccaacactagaaagtgccca

SEQ ID NO: 81838 - DNA, 25 bp, mus musculus
tagaaagtgcccagtatccaggaat

SEQ ID NO: 81839 - DNA, 25 bp, mus musculus
ccacagcctgtgtgcggccaactca

SEQ ID NO: 81840 - DNA, 25 bp, mus musculus
tccgcagctttgctaacccattact

SEQ ID NO: 81841 - DNA, 25 bp, mus musculus
caccgcttttgtctcagccaggacc

SEQ ID NO: 81842 - DNA, 25 bp, mus musculus
ccgtgtctgtgccaacagcccctga

SEQ ID NO: 81843 - DNA, 25 bp, mus musculus
agagccacaagcccacagaggatcc

SEQ ID NO: 81844 - DNA, 25 bp, mus musculus
ccacagaggatccagccagtgtata

SEQ ID NO: 81845 - DNA, 25 bp, mus musculus
aggatccagccagtgtatatgaaca

SEQ ID NO: 81846 - DNA, 25 bp, mus musculus
tgaagcaactcaacgccatcacagg

SEQ ID NO: 81847 - DNA, 25 bp, mus musculus
aactcaacgccatcacaggctcagc

SEQ ID NO: 81848 - DNA, 25 bp, mus musculus
acgccatcacaggctcagcctttta

SEQ ID NO: 81849 - DNA, 25 bp, mus musculus
catctcccacatgtggatacccgca

SEQ ID NO: 81850 - DNA, 25 bp, mus musculus
cgccatcacaggctcagccttttaa

SEQ ID NO: 81851 - DNA, 25 bp, mus musculus
ccacatgtggatacccgcatccaca

SEQ ID NO: 81852 - DNA, 25 bp, mus musculus
atccacagttcactctccggccagt

SEQ ID NO: 81853 - DNA, 25 bp, mus musculus
taccattcccaacgctgtctgtgga

SEQ ID NO: 81854 - DNA, 25 bp, mus musculus
tcccaacgctgtctgtggaccgagg

SEQ ID NO: 81855 - DNA, 25 bp, mus musculus
gtgaaggaccaaccacgcaacagca

SEQ ID NO: 81856 - DNA, 25 bp, mus musculus
ctcagcccgaacatccgagcagtga

SEQ ID NO: 81857 - DNA, 25 bp, mus musculus
ccgaacatccgagcagtgaagaagc

SEQ ID NO: 81858 - DNA, 25 bp, mus musculus
ctgtcccatgaggtgctcaacccta

SEQ ID NO: 81859 - DNA, 25 bp, mus musculus
tcccatgaggtgctcaaccctatgt

SEQ ID NO: 81860 - DNA, 25 bp, mus musculus
agattcatcgccatggctctgtacc

SEQ ID NO: 81861 - DNA, 25 bp, mus musculus
ttcatcgccatggctctgtaccatg

SEQ ID NO: 81862 - DNA, 25 bp, mus musculus
gctctgtaccatgggaagttcatcg

SEQ ID NO: 81863 - DNA, 25 bp, mus musculus
aagttcatcgacacaggcttcactc

SEQ ID NO: 81864 - DNA, 25 bp, mus musculus
ctccctttctacaagcggatgtcaa

SEQ ID NO: 81865 - DNA, 25 bp, mus musculus
ttctacaagcggatgtcaacaagag

SEQ ID NO: 81866 - DNA, 25 bp, mus musculus
tcaacaagagaccgactctgaagga

SEQ ID NO: 81867 - DNA, 25 bp, mus musculus
acaagagaccgactctgaaggacct

SEQ ID NO: 81868 - DNA, 25 bp, mus musculus
gaccgactctgaaggacctggagtc

SEQ ID NO: 81869 - DNA, 25 bp, mus musculus
tggagtctattgaccctgagtttta

SEQ ID NO: 81870 - DNA, 25 bp, mus musculus
gaggtgctcaaccctatgtactgtt

SEQ ID NO: 81871 - DNA, 25 bp, mus musculus
gtgctcaaccctatgtactgtttgt

SEQ ID NO: 81872 - DNA, 25 bp, mus musculus
ctcaaccctatgtactgtttgtttg

SEQ ID NO: 81873 - DNA, 25 bp, mus musculus
cctatgtactgtttgtttgaatatg

SEQ ID NO: 81874 - DNA, 25 bp, mus musculus
ctcacctacttccgctttatcggca

SEQ ID NO: 81875 - DNA, 25 bp, mus musculus
acctacttccgctttatcggcagat

SEQ ID NO: 81876 - DNA, 25 bp, mus musculus
tacttccgctttatcggcagattca

SEQ ID NO: 81877 - DNA, 25 bp, mus musculus
cgctttatcggcagattcatcgcca

SEQ ID NO: 81878 - DNA, 25 bp, mus musculus
tctaccagggctacacaagtcccta

SEQ ID NO: 81879 - DNA, 25 bp, mus musculus
agggctacacaagtccctatcagca

SEQ ID NO: 81880 - DNA, 25 bp, mus musculus
gctaccagtcctggacgctggccaa

SEQ ID NO: 81881 - DNA, 25 bp, mus musculus
agtcctggacgctggccaacgggtg

SEQ ID NO: 81882 - DNA, 25 bp, mus musculus
ggaacagccaggtgtactgtgccaa

SEQ ID NO: 81883 - DNA, 25 bp, mus musculus
gtgccaaggatcagccacagggttc

SEQ ID NO: 81884 - DNA, 25 bp, mus musculus
ctttaaaccagccggacatgtgcgt

SEQ ID NO: 81885 - DNA, 25 bp, mus musculus
gggtgccttacaccaaactgcagct

SEQ ID NO: 81886 - DNA, 25 bp, mus musculus
ccaaactgcagctcaaagaactgga

SEQ ID NO: 81887 - DNA, 25 bp, mus musculus
ggatctcagctgccacgaacctttc

SEQ ID NO: 81888 - DNA, 25 bp, mus musculus
taaccatttggtttcagaatcgaag

SEQ ID NO: 81889 - DNA, 25 bp, mus musculus
tcgtctccaagctcaaagacactgt

SEQ ID NO: 81890 - DNA, 25 bp, mus musculus
atcagcacgtgcctggctacatcga

SEQ ID NO: 81891 - DNA, 25 bp, mus musculus
caagctcaaagacactgtctcctga

SEQ ID NO: 81892 - DNA, 25 bp, mus musculus
acgtgcctggctacatcgacatggt

SEQ ID NO: 81893 - DNA, 25 bp, mus musculus
ctggctacatcgacatggtgtccac

SEQ ID NO: 81894 - DNA, 25 bp, mus musculus
acatggtgtccacttttggatccgg

SEQ ID NO: 81895 - DNA, 25 bp, mus musculus
ctcggcacgaggcatacatctccat

SEQ ID NO: 81896 - DNA, 25 bp, mus musculus
acgaggcatacatctccatggaggg

SEQ ID NO: 81897 - DNA, 25 bp, mus musculus
catacatctccatggagggctacca

SEQ ID NO: 81898 - DNA, 25 bp, mus musculus
tctccatggagggctaccagtcctg

SEQ ID NO: 81899 - DNA, 25 bp, mus musculus
ggccatcgtttgtggacgtttggag

SEQ ID NO: 81900 - DNA, 25 bp, mus musculus
actgctcctataaatgtgttccttc

SEQ ID NO: 81901 - DNA, 25 bp, mus musculus
atcaagtctgtctgtctctgggtgg

SEQ ID NO: 81902 - DNA, 25 bp, mus musculus
cttctgcactggccctcacacagtg

SEQ ID NO: 81903 - DNA, 25 bp, mus musculus
cacagtgacctctctccaaggcaca

SEQ ID NO: 81904 - DNA, 25 bp, mus musculus
gacctctctccaaggcacagttcct

SEQ ID NO: 81905 - DNA, 25 bp, mus musculus
aggcacagttcctgtatctacatcc

SEQ ID NO: 81906 - DNA, 25 bp, mus musculus
tgtatctacatcccactcgtgtatg

SEQ ID NO: 81907 - DNA, 25 bp, mus musculus
tacatcccactcgtgtatgagactt

SEQ ID NO: 81908 - DNA, 25 bp, mus musculus
agttgccgtcatctccggattgaaa

SEQ ID NO: 81909 - DNA, 25 bp, mus musculus
cgtcatctccggattgaaacagatt

SEQ ID NO: 81910 - DNA, 25 bp, mus musculus
ctaaacactattcactaataaagat

SEQ ID NO: 81911 - DNA, 25 bp, mus musculus
ggctggacctgcacacgctgttcct

SEQ ID NO: 81912 - DNA, 25 bp, mus musculus
gctcttgctgtccagatgccctcat

SEQ ID NO: 81913 - DNA, 25 bp, mus musculus
cagatgccctcatgaaccagtggcc

SEQ ID NO: 81914 - DNA, 25 bp, mus musculus
ctggccttggccagcttagaccata

SEQ ID NO: 81915 - DNA, 25 bp, mus musculus
ttggccagcttagaccatacatcag

SEQ ID NO: 81916 - DNA, 25 bp, mus musculus
agcttagaccatacatcagcgtatg

SEQ ID NO: 81917 - DNA, 25 bp, mus musculus
gaccatacatcagcgtatgctagtt

SEQ ID NO: 81918 - DNA, 25 bp, mus musculus
taccctgcagtgggcgtgatcaagt

SEQ ID NO: 81919 - DNA, 25 bp, mus musculus
ctgtagacacacatcgtgacaagcc

SEQ ID NO: 81920 - DNA, 25 bp, mus musculus
acacacatcgtgacaagccaactca

SEQ ID NO: 81921 - DNA, 25 bp, mus musculus
gtgtttcctccagctttggcctctt

SEQ ID NO: 81922 - DNA, 25 bp, mus musculus
tgcccttgccactaatcaaccaaga

SEQ ID NO: 81923 - DNA, 25 bp, mus musculus
tgccactaatcaaccaagaagtcat

SEQ ID NO: 81924 - DNA, 25 bp, mus musculus
taatcaaccaagaagtcatttaact

SEQ ID NO: 81925 - DNA, 25 bp, mus musculus
agaatctgagctcatgcgtgtgcag

SEQ ID NO: 81926 - DNA, 25 bp, mus musculus
gagcagcctcagccattctctaggt

SEQ ID NO: 81927 - DNA, 25 bp, mus musculus
cctcagccattctctaggtaaacac

SEQ ID NO: 81928 - DNA, 25 bp, mus musculus
tctttagacatgtccccagatggga

SEQ ID NO: 81929 - DNA, 25 bp, mus musculus
gttcttctgtttcctgatgtctgac

SEQ ID NO: 81930 - DNA, 25 bp, mus musculus
cctgatgtctgaccccagtctgtga

SEQ ID NO: 81931 - DNA, 25 bp, mus musculus
atcgtgacaagccaactcacaactt

SEQ ID NO: 81932 - DNA, 25 bp, mus musculus
agagccaaacccctgtaaggatgag

SEQ ID NO: 81933 - DNA, 25 bp, mus musculus
acagctttacgcctctgtccagttc

SEQ ID NO: 81934 - DNA, 25 bp, mus musculus
ctctgtccagttcgaacacaataag

SEQ ID NO: 81935 - DNA, 25 bp, mus musculus
agcctctccgtgctctggacatgca

SEQ ID NO: 81936 - DNA, 25 bp, mus musculus
tccgtgctctggacatgcaagaagg

SEQ ID NO: 81937 - DNA, 25 bp, mus musculus
accagccgaagacccaagtcagcat

SEQ ID NO: 81938 - DNA, 25 bp, mus musculus
cgaagacccaagtcagcattccggt

SEQ ID NO: 81939 - DNA, 25 bp, mus musculus
tcaagtgtcctctgcatacagtgct

SEQ ID NO: 81940 - DNA, 25 bp, mus musculus
gtcctctgcatacagtgctcaaact

SEQ ID NO: 81941 - DNA, 25 bp, mus musculus
attgtctctgttctcactaccttcc

SEQ ID NO: 81942 - DNA, 25 bp, mus musculus
tctgttctcactaccttcctcctgt

SEQ ID NO: 81943 - DNA, 25 bp, mus musculus
ctcctgtaggaactgctggccttgt

SEQ ID NO: 81944 - DNA, 25 bp, mus musculus
taggaactgctggccttgttctcct

SEQ ID NO: 81945 - DNA, 25 bp, mus musculus
ttctccttaagcagactctggcttt

SEQ ID NO: 81946 - DNA, 25 bp, mus musculus
agactctggctttggcctgagtgtg

SEQ ID NO: 81947 - DNA, 25 bp, mus musculus
gagtgtgccctacctccagagaata

SEQ ID NO: 81948 - DNA, 25 bp, mus musculus
gtagcagctcccaaacaggtctcaa

SEQ ID NO: 81949 - DNA, 25 bp, mus musculus
gtctcaattcctagccataactaag

SEQ ID NO: 81950 - DNA, 25 bp, mus musculus
gacatttattcctgcctgtaggaca

SEQ ID NO: 81951 - DNA, 25 bp, mus musculus
tgcatacagtgctcaaactcacacc

SEQ ID NO: 81952 - DNA, 25 bp, mus musculus
cagtgctcaaactcacacctgtggc

SEQ ID NO: 81953 - DNA, 25 bp, mus musculus
tcacacctgtggcttatggctgcag

SEQ ID NO: 81954 - DNA, 25 bp, mus musculus
agtccatctacctgaatgtggaggc

SEQ ID NO: 81955 - DNA, 25 bp, mus musculus
tctacctgaatgtggaggctgtgaa

SEQ ID NO: 81956 - DNA, 25 bp, mus musculus
aggaagccttggacactgtacctgc

SEQ ID NO: 81957 - DNA, 25 bp, mus musculus
actgagcccttttcaagtgatcaga

SEQ ID NO: 81958 - DNA, 25 bp, mus musculus
gatcagattgtctctgttctcacta

SEQ ID NO: 81959 - DNA, 25 bp, mus musculus
ggtgactgcccatagtcctaatact

SEQ ID NO: 81960 - DNA, 25 bp, mus musculus
gtgactgcccatagtcctaatactt

SEQ ID NO: 81961 - DNA, 25 bp, mus musculus
ataccctgtgttcagacaaagggag

SEQ ID NO: 81962 - DNA, 25 bp, mus musculus
ccctgtgttcagacaaagggagcaa

SEQ ID NO: 81963 - DNA, 25 bp, mus musculus
cccacatcttgttgatagccctatc

SEQ ID NO: 81964 - DNA, 25 bp, mus musculus
ccacatcttgttgatagccctatcc

SEQ ID NO: 81965 - DNA, 25 bp, mus musculus
acatcttgttgatagccctatcctg

SEQ ID NO: 81966 - DNA, 25 bp, mus musculus
tcttgttgatagccctatcctgtgc

SEQ ID NO: 81967 - DNA, 25 bp, mus musculus
gttgatagccctatcctgtgcctag

SEQ ID NO: 81968 - DNA, 25 bp, mus musculus
atcctgtgcctagggatttccttcg

SEQ ID NO: 81969 - DNA, 25 bp, mus musculus
cctgtgcctagggatttccttcgtg

SEQ ID NO: 81970 - DNA, 25 bp, mus musculus
tgcctagggatttccttcgtgccca

SEQ ID NO: 81971 - DNA, 25 bp, mus musculus
gactgcccatagtcctaatacttgg

SEQ ID NO: 81972 - DNA, 25 bp, mus musculus
gcccatagtcctaatacttgggagg

SEQ ID NO: 81973 - DNA, 25 bp, mus musculus
ggaaccaatcattggctacataatg

SEQ ID NO: 81974 - DNA, 25 bp, mus musculus
gaaccaatcattggctacataatga

SEQ ID NO: 81975 - DNA, 25 bp, mus musculus
accaatcattggctacataatgagt

SEQ ID NO: 81976 - DNA, 25 bp, mus musculus
ccaatcattggctacataatgagtt

SEQ ID NO: 81977 - DNA, 25 bp, mus musculus
atcattggctacataatgagttaaa

SEQ ID NO: 81978 - DNA, 25 bp, mus musculus
taaataccctgtgttcagacaaagg

SEQ ID NO: 81979 - DNA, 25 bp, mus musculus
ttctctagctctgccctttgtagca

SEQ ID NO: 81980 - DNA, 25 bp, mus musculus
agctctgccctttgtagcacacaag

SEQ ID NO: 81981 - DNA, 25 bp, mus musculus
tctttgctgtaactaggcttcacca

SEQ ID NO: 81982 - DNA, 25 bp, mus musculus
ctgtaactaggcttcaccaatagcc

SEQ ID NO: 81983 - DNA, 25 bp, mus musculus
ctctcataggctctcttcatggtgc

SEQ ID NO: 81984 - DNA, 25 bp, mus musculus
taggctctcttcatggtgccaagcc

SEQ ID NO: 81985 - DNA, 25 bp, mus musculus
atggtgccaagcctcaaatcctttg

SEQ ID NO: 81986 - DNA, 25 bp, mus musculus
ccaagcctcaaatcctttgaatgac

SEQ ID NO: 81987 - DNA, 25 bp, mus musculus
ccccttcagtcttgggccatcaact

SEQ ID NO: 81988 - DNA, 25 bp, mus musculus
cagtcttgggccatcaactgctact

SEQ ID NO: 81989 - DNA, 25 bp, mus musculus
tgggccatcaactgctactgaggct

SEQ ID NO: 81990 - DNA, 25 bp, mus musculus
atcaactgctactgaggctgcactt

SEQ ID NO: 81991 - DNA, 25 bp, mus musculus
acacaagttgtcttctaggctccag

SEQ ID NO: 81992 - DNA, 25 bp, mus musculus
gatgcctgtactccactgctgctgc

SEQ ID NO: 81993 - DNA, 25 bp, mus musculus
tgtactccactgctgctgctgttct

SEQ ID NO: 81994 - DNA, 25 bp, mus musculus
ctgctgctgttcttggtactcattt

SEQ ID NO: 81995 - DNA, 25 bp, mus musculus
ctcatttatggtactggcatctcca

SEQ ID NO: 81996 - DNA, 25 bp, mus musculus
tatggtactggcatctccaaaacac

SEQ ID NO: 81997 - DNA, 25 bp, mus musculus
actggcatctccaaaacactgttgt

SEQ ID NO: 81998 - DNA, 25 bp, mus musculus
ctgttgtctttgctgtaactaggct

SEQ ID NO: 81999 - DNA, 25 bp, mus musculus
tcccagttacatcccagaccgtgtg

SEQ ID NO: 82000 - DNA, 25 bp, mus musculus
ttacatcccagaccgtgtgcaaaag

SEQ ID NO: 82001 - DNA, 25 bp, mus musculus
cagcaccactgtagagactgcagaa

SEQ ID NO: 82002 - DNA, 25 bp, mus musculus
ggaacccattgaccagaagtttgtg

SEQ ID NO: 82003 - DNA, 25 bp, mus musculus
tgagcccattgatgatggttcagag

SEQ ID NO: 82004 - DNA, 25 bp, mus musculus
ctgttcctgctcctatgatgctacc

SEQ ID NO: 82005 - DNA, 25 bp, mus musculus
ctgctcctatgatgctaccacacac

SEQ ID NO: 82006 - DNA, 25 bp, mus musculus
tatctacaaacgcatggctggttct

SEQ ID NO: 82007 - DNA, 25 bp, mus musculus
caaacgcatggctggttctgccttt

SEQ ID NO: 82008 - DNA, 25 bp, mus musculus
catggctggttctgcctttgatttt

SEQ ID NO: 82009 - DNA, 25 bp, mus musculus
tggttctgcctttgattttgagaac

SEQ ID NO: 82010 - DNA, 25 bp, mus musculus
ccaacttgtatgtccttctctaggg

SEQ ID NO: 82011 - DNA, 25 bp, mus musculus
ccaggttattcgcatcatctgtatc

SEQ ID NO: 82012 - DNA, 25 bp, mus musculus
tattcgcatcatctgtatcctcagc

SEQ ID NO: 82013 - DNA, 25 bp, mus musculus
caatgatgccaattcctgccaaatt

SEQ ID NO: 82014 - DNA, 25 bp, mus musculus
tgccaattcctgccaaattatcatc

SEQ ID NO: 82015 - DNA, 25 bp, mus musculus
ttcctgccaaattatcatccctcag

SEQ ID NO: 82016 - DNA, 25 bp, mus musculus
ccaaattatcatccctcagaaccag

SEQ ID NO: 82017 - DNA, 25 bp, mus musculus
ccctcagaaccaggtcaacaggaag

SEQ ID NO: 82018 - DNA, 25 bp, mus musculus
cattgccagcaccactgtagagact

SEQ ID NO: 82019 - DNA, 25 bp, mus musculus
catcaaaaacaccaatgacgccaac

SEQ ID NO: 82020 - DNA, 25 bp, mus musculus
ctctgcacacaatgtggccgcacaa

SEQ ID NO: 82021 - DNA, 25 bp, mus musculus
ttatatcccgtacctatgatgcaac

SEQ ID NO: 82022 - DNA, 25 bp, mus musculus
tatatcccgtacctatgatgcaaca

SEQ ID NO: 82023 - DNA, 25 bp, mus musculus
atatcccgtacctatgatgcaacaa

SEQ ID NO: 82024 - DNA, 25 bp, mus musculus
cgtacctatgatgcaacaactcact

SEQ ID NO: 82025 - DNA, 25 bp, mus musculus
tgatgcaacaactcactttgagacg

SEQ ID NO: 82026 - DNA, 25 bp, mus musculus
gatgcaacaactcactttgagacga

SEQ ID NO: 82027 - DNA, 25 bp, mus musculus
atgcaacaactcactttgagacgac

SEQ ID NO: 82028 - DNA, 25 bp, mus musculus
tgcaacaactcactttgagacgacc

SEQ ID NO: 82029 - DNA, 25 bp, mus musculus
acatgttatcatctaattaggacaa

SEQ ID NO: 82030 - DNA, 25 bp, mus musculus
catgttatcatctaattaggacaaa

SEQ ID NO: 82031 - DNA, 25 bp, mus musculus
ctgcacacaatgtggccgcacaagg

SEQ ID NO: 82032 - DNA, 25 bp, mus musculus
tgccagcacaacggtggagaccaag

SEQ ID NO: 82033 - DNA, 25 bp, mus musculus
aaggaaatcagaccagccctggagc

SEQ ID NO: 82034 - DNA, 25 bp, mus musculus
ggaaatcagaccagccctggagctt

SEQ ID NO: 82035 - DNA, 25 bp, mus musculus
gaaatcagaccagccctggagcttt

SEQ ID NO: 82036 - DNA, 25 bp, mus musculus
atcagaccagccctggagcttttgg

SEQ ID NO: 82037 - DNA, 25 bp, mus musculus
tcagaccagccctggagcttttgga

SEQ ID NO: 82038 - DNA, 25 bp, mus musculus
ctttatatcccgtacctatgatgca

SEQ ID NO: 82039 - DNA, 25 bp, mus musculus
aactccctctggctttgctatgctc

SEQ ID NO: 82040 - DNA, 25 bp, mus musculus
ggctttgctatgctccttccttccc

SEQ ID NO: 82041 - DNA, 25 bp, mus musculus
gccgtagcatccaaaccctgcatgt

SEQ ID NO: 82042 - DNA, 25 bp, mus musculus
cgtagcatccaaaccctgcatgtgc

SEQ ID NO: 82043 - DNA, 25 bp, mus musculus
gcatccaaaccctgcatgtgctcag

SEQ ID NO: 82044 - DNA, 25 bp, mus musculus
atccaaaccctgcatgtgctcagtg

SEQ ID NO: 82045 - DNA, 25 bp, mus musculus
ccaaaccctgcatgtgctcagtgga

SEQ ID NO: 82046 - DNA, 25 bp, mus musculus
aaaccctgcatgtgctcagtggaga

SEQ ID NO: 82047 - DNA, 25 bp, mus musculus
cctgcatgtgctcagtggagatatg

SEQ ID NO: 82048 - DNA, 25 bp, mus musculus
tgcatgtgctcagtggagatatgag

SEQ ID NO: 82049 - DNA, 25 bp, mus musculus
atgagtcagctgccggctggagttc

SEQ ID NO: 82050 - DNA, 25 bp, mus musculus
gagtcagctgccggctggagttcga

SEQ ID NO: 82051 - DNA, 25 bp, mus musculus
ccgcagcgccagtccaggtgccatg

SEQ ID NO: 82052 - DNA, 25 bp, mus musculus
ccagtccaggtgccatggctgctat

SEQ ID NO: 82053 - DNA, 25 bp, mus musculus
agtccaggtgccatggctgctatgt

SEQ ID NO: 82054 - DNA, 25 bp, mus musculus
tccaggtgccatggctgctatgtac

SEQ ID NO: 82055 - DNA, 25 bp, mus musculus
cttagccggcacggctaaggcctgg

SEQ ID NO: 82056 - DNA, 25 bp, mus musculus
ctaaggcctggtgctggtcaccgtg

SEQ ID NO: 82057 - DNA, 25 bp, mus musculus
tggtcaccgtgccgtagcatccaaa

SEQ ID NO: 82058 - DNA, 25 bp, mus musculus
gtcaccgtgccgtagcatccaaacc

SEQ ID NO: 82059 - DNA, 25 bp, mus musculus
ctccgagcactagttccacaagtcg

SEQ ID NO: 82060 - DNA, 25 bp, mus musculus
gcactagttccacaagtcgcattac

SEQ ID NO: 82061 - DNA, 25 bp, mus musculus
ctagcatcttctttaacacttcagg

SEQ ID NO: 82062 - DNA, 25 bp, mus musculus
ttaacacttcaggtaactgaggcat

SEQ ID NO: 82063 - DNA, 25 bp, mus musculus
cttcaggtaactgaggcatgaatac

SEQ ID NO: 82064 - DNA, 25 bp, mus musculus
tgaataccttaatcacttgcccaaa

SEQ ID NO: 82065 - DNA, 25 bp, mus musculus
tcacttgcccaaagtaattattggc

SEQ ID NO: 82066 - DNA, 25 bp, mus musculus
agtaattattggccactgcaagcct

SEQ ID NO: 82067 - DNA, 25 bp, mus musculus
ccactgcaagcctgttctcattcct

SEQ ID NO: 82068 - DNA, 25 bp, mus musculus
caagcctgttctcattcctgggaga

SEQ ID NO: 82069 - DNA, 25 bp, mus musculus
tgttctcattcctgggagattcaag

SEQ ID NO: 82070 - DNA, 25 bp, mus musculus
cattcctgggagattcaagaaaagg

SEQ ID NO: 82071 - DNA, 25 bp, mus musculus
gttccacaagtcgcattaccttgcc

SEQ ID NO: 82072 - DNA, 25 bp, mus musculus
caagtcgcattaccttgccaggaga

SEQ ID NO: 82073 - DNA, 25 bp, mus musculus
gcattaccttgccaggagactacgg

SEQ ID NO: 82074 - DNA, 25 bp, mus musculus
gataaaacatcatccagaaacttcc

SEQ ID NO: 82075 - DNA, 25 bp, mus musculus
acatcatccagaaacttccttggaa

SEQ ID NO: 82076 - DNA, 25 bp, mus musculus
atccccaaggtctgaagacaatgtg

SEQ ID NO: 82077 - DNA, 25 bp, mus musculus
tttctgaggactttggtactagcat

SEQ ID NO: 82078 - DNA, 25 bp, mus musculus
ttggtactagcatcttctttaacac

SEQ ID NO: 82079 - DNA, 25 bp, mus musculus
aaccaccaaacttatgacctgtctg

SEQ ID NO: 82080 - DNA, 25 bp, mus musculus
acttatgacctgtctgttaaaactg

SEQ ID NO: 82081 - DNA, 25 bp, mus musculus
gataacccattagaagcacaagaat

SEQ ID NO: 82082 - DNA, 25 bp, mus musculus
aacccattagaagcacaagaattat

SEQ ID NO: 82083 - DNA, 25 bp, mus musculus
atttattcatactgcacatagttta

SEQ ID NO: 82084 - DNA, 25 bp, mus musculus
tcatactgcacatagtttaatacct

SEQ ID NO: 82085 - DNA, 25 bp, mus musculus
ttctgtttatccattaccaagttga

SEQ ID NO: 82086 - DNA, 25 bp, mus musculus
tgtttatccattaccaagttgaact

SEQ ID NO: 82087 - DNA, 25 bp, mus musculus
ttatccattaccaagttgaactgag

SEQ ID NO: 82088 - DNA, 25 bp, mus musculus
tccattaccaagttgaactgagatt

SEQ ID NO: 82089 - DNA, 25 bp, mus musculus
tttcttctgtacatatttgggacaa

SEQ ID NO: 82090 - DNA, 25 bp, mus musculus
cttctgtacatatttgggacaaaat

SEQ ID NO: 82091 - DNA, 25 bp, mus musculus
tatgacctgtctgttaaaactgtct

SEQ ID NO: 82092 - DNA, 25 bp, mus musculus
ctttgtatgttcacacaaagtgcta

SEQ ID NO: 82093 - DNA, 25 bp, mus musculus
ttcacacaaagtgctaggaaatgga

SEQ ID NO: 82094 - DNA, 25 bp, mus musculus
tagtgctgcttatatccaggagccc

SEQ ID NO: 82095 - DNA, 25 bp, mus musculus
tgctgcttatatccaggagcccata

SEQ ID NO: 82096 - DNA, 25 bp, mus musculus
ttatatccaggagcccatacaagta

SEQ ID NO: 82097 - DNA, 25 bp, mus musculus
ccaggagcccatacaagtaatgtag

SEQ ID NO: 82098 - DNA, 25 bp, mus musculus
tttgataacccattagaagcacaag

SEQ ID NO: 82099 - DNA, 25 bp, mus musculus
aagcctgatcacctaaaactagaga

SEQ ID NO: 82100 - DNA, 25 bp, mus musculus
cctgatcacctaaaactagagacac

SEQ ID NO: 82101 - DNA, 25 bp, mus musculus
gttcctaagcaactctaaaatgtgc

SEQ ID NO: 82102 - DNA, 25 bp, mus musculus
aagcctgtcttccaggcaactgaaa

SEQ ID NO: 82103 - DNA, 25 bp, mus musculus
gtcttccaggcaactgaaatctacc

SEQ ID NO: 82104 - DNA, 25 bp, mus musculus
ttccaggcaactgaaatctacctcc

SEQ ID NO: 82105 - DNA, 25 bp, mus musculus
ttttatactgcgagcactggtatta

SEQ ID NO: 82106 - DNA, 25 bp, mus musculus
tatactgcgagcactggtattagca

SEQ ID NO: 82107 - DNA, 25 bp, mus musculus
agtgatgatcatgcctgggattcat

SEQ ID NO: 82108 - DNA, 25 bp, mus musculus
gatgatcatgcctgggattcattag

SEQ ID NO: 82109 - DNA, 25 bp, mus musculus
tacacattcgttcaataaacatctg

SEQ ID NO: 82110 - DNA, 25 bp, mus musculus
ttcgttcaataaacatctgcattga

SEQ ID NO: 82111 - DNA, 25 bp, mus musculus
atagagtctatcttgtctaaattca

SEQ ID NO: 82112 - DNA, 25 bp, mus musculus
ttgtctaaattcataaccttatgcc

SEQ ID NO: 82113 - DNA, 25 bp, mus musculus
tctaaattcataaccttatgccaac

SEQ ID NO: 82114 - DNA, 25 bp, mus musculus
ttatgccaaccgactcactaccttc

SEQ ID NO: 82115 - DNA, 25 bp, mus musculus
taccttcacatccagccagttccta

SEQ ID NO: 82116 - DNA, 25 bp, mus musculus
cttcacatccagccagttcctaagc

SEQ ID NO: 82117 - DNA, 25 bp, mus musculus
cagccagttcctaagcaactctaaa

SEQ ID NO: 82118 - DNA, 25 bp, mus musculus
ccagttcctaagcaactctaaaatg

SEQ ID NO: 82119 - DNA, 25 bp, mus musculus
cactcacggaccagcgggccagcag

SEQ ID NO: 82120 - DNA, 25 bp, mus musculus
ggccagcagccaggactgctcagag

SEQ ID NO: 82121 - DNA, 25 bp, mus musculus
gcaattctgtatggcttctgtataa

SEQ ID NO: 82122 - DNA, 25 bp, mus musculus
aattctgtatggcttctgtataaat

SEQ ID NO: 82123 - DNA, 25 bp, mus musculus
tttaatctcagagatttcgatgttt

SEQ ID NO: 82124 - DNA, 25 bp, mus musculus
taatctcagagatttcgatgttttc

SEQ ID NO: 82125 - DNA, 25 bp, mus musculus
tcgatgttttcaaagcccgggtgct

SEQ ID NO: 82126 - DNA, 25 bp, mus musculus
actcgagagcggcgaacactactaa

SEQ ID NO: 82127 - DNA, 25 bp, mus musculus
gcggcgaacactactaactcctgcg

SEQ ID NO: 82128 - DNA, 25 bp, mus musculus
ggcgaacactactaactcctgcggt

SEQ ID NO: 82129 - DNA, 25 bp, mus musculus
cgaacactactaactcctgcggtct

SEQ ID NO: 82130 - DNA, 25 bp, mus musculus
aacactactaactcctgcggtctag

SEQ ID NO: 82131 - DNA, 25 bp, mus musculus
ccagcagccaggactgctcagagga

SEQ ID NO: 82132 - DNA, 25 bp, mus musculus
acactactaactcctgcggtctaga

SEQ ID NO: 82133 - DNA, 25 bp, mus musculus
agcagccaggactgctcagaggatg

SEQ ID NO: 82134 - DNA, 25 bp, mus musculus
gacgattgagctgtgccctggacct

SEQ ID NO: 82135 - DNA, 25 bp, mus musculus
cgattgagctgtgccctggacctcc

SEQ ID NO: 82136 - DNA, 25 bp, mus musculus
tagccgtctcttccttttcgaagca

SEQ ID NO: 82137 - DNA, 25 bp, mus musculus
gccgtctcttccttttcgaagcaat

SEQ ID NO: 82138 - DNA, 25 bp, mus musculus
cgccgtgcaattctgtatggcttct

SEQ ID NO: 82139 - DNA, 25 bp, mus musculus
ccgtgcaattctgtatggcttctgt

SEQ ID NO: 82140 - DNA, 25 bp, mus musculus
cctgtaccgctcagaccagctggaa

SEQ ID NO: 82141 - DNA, 25 bp, mus musculus
ccgctcagaccagctggaagaactg

SEQ ID NO: 82142 - DNA, 25 bp, mus musculus
atctgctcctgagctcctagaccct

SEQ ID NO: 82143 - DNA, 25 bp, mus musculus
gctcctagaccctatgcctacagac

SEQ ID NO: 82144 - DNA, 25 bp, mus musculus
agaccctatgcctacagacctagaa

SEQ ID NO: 82145 - DNA, 25 bp, mus musculus
ccctgttcctccagagaacatcctg

SEQ ID NO: 82146 - DNA, 25 bp, mus musculus
tcctccagagaacatcctggatgtc

SEQ ID NO: 82147 - DNA, 25 bp, mus musculus
tcctgtacaaactcctcaagtactg

SEQ ID NO: 82148 - DNA, 25 bp, mus musculus
tcctcaagtactgcctccaatgagg

SEQ ID NO: 82149 - DNA, 25 bp, mus musculus
agtactgcctccaatgagggacgtt

SEQ ID NO: 82150 - DNA, 25 bp, mus musculus
ggacgttcctggcagtgacagcata

SEQ ID NO: 82151 - DNA, 25 bp, mus musculus
ggcctatgtgtcctggggcactagg

SEQ ID NO: 82152 - DNA, 25 bp, mus musculus
tcaggaagaccactatcctgacagt

SEQ ID NO: 82153 - DNA, 25 bp, mus musculus
agaccactatcctgacagtgacaaa

SEQ ID NO: 82154 - DNA, 25 bp, mus musculus
tgacaaacgccatgagatttcccag

SEQ ID NO: 82155 - DNA, 25 bp, mus musculus
acgccatgagatttcccagatggtg

SEQ ID NO: 82156 - DNA, 25 bp, mus musculus
agcccccagtgctgacagcagccag

SEQ ID NO: 82157 - DNA, 25 bp, mus musculus
tgacagcagccagcacagatctgct

SEQ ID NO: 82158 - DNA, 25 bp, mus musculus
cagccagcacagatctgctcctgag

SEQ ID NO: 82159 - DNA, 25 bp, mus musculus
gcacagatctgctcctgagctccta

SEQ ID NO: 82160 - DNA, 25 bp, mus musculus
ttctgggacttccctaacagcatgg

SEQ ID NO: 82161 - DNA, 25 bp, mus musculus
tctgggacttccctaacagcatggc

SEQ ID NO: 82162 - DNA, 25 bp, mus musculus
ctcctgctctgggaccggagagaca

SEQ ID NO: 82163 - DNA, 25 bp, mus musculus
tcctgctctgggaccggagagacat

SEQ ID NO: 82164 - DNA, 25 bp, mus musculus
tgctctgggaccggagagacatcgg

SEQ ID NO: 82165 - DNA, 25 bp, mus musculus
gagagacatcggcctctgcaggctt

SEQ ID NO: 82166 - DNA, 25 bp, mus musculus
acttaatgaacaagccagtgaggag

SEQ ID NO: 82167 - DNA, 25 bp, mus musculus
aatgaacaagccagtgaggagattt

SEQ ID NO: 82168 - DNA, 25 bp, mus musculus
atgaacaagccagtgaggagatttt

SEQ ID NO: 82169 - DNA, 25 bp, mus musculus
tgaacaagccagtgaggagattttg

SEQ ID NO: 82170 - DNA, 25 bp, mus musculus
tccgccaaccattttttcagaagag

SEQ ID NO: 82171 - DNA, 25 bp, mus musculus
caaccattttttcagaagaggtcag

SEQ ID NO: 82172 - DNA, 25 bp, mus musculus
tgggacttccctaacagcatggccc

SEQ ID NO: 82173 - DNA, 25 bp, mus musculus
ggacttccctaacagcatggcccct

SEQ ID NO: 82174 - DNA, 25 bp, mus musculus
ctaacagcatggcccctaaacgcca

SEQ ID NO: 82175 - DNA, 25 bp, mus musculus
aacagcatggcccctaaacgccagt

SEQ ID NO: 82176 - DNA, 25 bp, mus musculus
acagcatggcccctaaacgccagtc

SEQ ID NO: 82177 - DNA, 25 bp, mus musculus
cagcatggcccctaaacgccagtct

SEQ ID NO: 82178 - DNA, 25 bp, mus musculus
cacctcctgctctgggaccggagag

SEQ ID NO: 82179 - DNA, 25 bp, mus musculus
cctcctgctctgggaccggagagac

SEQ ID NO: 82180 - DNA, 25 bp, mus musculus
agctaggccctatcctgacatcagc

SEQ ID NO: 82181 - DNA, 25 bp, mus musculus
tgagcacctggctcaggtaactcac

SEQ ID NO: 82182 - DNA, 25 bp, mus musculus
tcagtatacttcagcatgcccacca

SEQ ID NO: 82183 - DNA, 25 bp, mus musculus
taaagtggcagccccatgggggaca

SEQ ID NO: 82184 - DNA, 25 bp, mus musculus
agggattcactcttctttagagcaa

SEQ ID NO: 82185 - DNA, 25 bp, mus musculus
tcactcttctttagagcaaattgtt

SEQ ID NO: 82186 - DNA, 25 bp, mus musculus
aattgttcctcagacttcactgggc

SEQ ID NO: 82187 - DNA, 25 bp, mus musculus
gacttcactgggcaacctgtctgac

SEQ ID NO: 82188 - DNA, 25 bp, mus musculus
actgggcaacctgtctgaccttatc

SEQ ID NO: 82189 - DNA, 25 bp, mus musculus
gtctgaccttatctatacctcagcc

SEQ ID NO: 82190 - DNA, 25 bp, mus musculus
ctatacctcagccatcgtcaccaat

SEQ ID NO: 82191 - DNA, 25 bp, mus musculus
ctcagccatcgtcaccaatgtagac

SEQ ID NO: 82192 - DNA, 25 bp, mus musculus
aactcacctgcctgaagccaagatc

SEQ ID NO: 82193 - DNA, 25 bp, mus musculus
cgtcaccaatgtagaccacttctaa

SEQ ID NO: 82194 - DNA, 25 bp, mus musculus
cctgcctgaagccaagatccaggtg

SEQ ID NO: 82195 - DNA, 25 bp, mus musculus
ccagaatcggcgagccaagagaatc

SEQ ID NO: 82196 - DNA, 25 bp, mus musculus
agccctaaactccaggctggagctt

SEQ ID NO: 82197 - DNA, 25 bp, mus musculus
aaactcctgttctcttccagacact

SEQ ID NO: 82198 - DNA, 25 bp, mus musculus
gctaccttgggaccctggaacatca

SEQ ID NO: 82199 - DNA, 25 bp, mus musculus
taccagttcagctcagtatacttca

SEQ ID NO: 82200 - DNA, 25 bp, mus musculus
ttcagctcagtatacttcagcatgc

SEQ ID NO: 82201 - DNA, 25 bp, mus musculus
ccatacatactccactgatgccaaa

SEQ ID NO: 82202 - DNA, 25 bp, mus musculus
tacatactccactgatgccaaacca

SEQ ID NO: 82203 - DNA, 25 bp, mus musculus
ttgatgtcttctacttcagctgcct

SEQ ID NO: 82204 - DNA, 25 bp, mus musculus
atgtcttctacttcagctgcctcat

SEQ ID NO: 82205 - DNA, 25 bp, mus musculus
tcccactcaatgtgctttttgtaga

SEQ ID NO: 82206 - DNA, 25 bp, mus musculus
cactcaatgtgctttttgtagaaga

SEQ ID NO: 82207 - DNA, 25 bp, mus musculus
aaatggagcgccaggtcttccttgc

SEQ ID NO: 82208 - DNA, 25 bp, mus musculus
tggagcgccaggtcttccttgcaac

SEQ ID NO: 82209 - DNA, 25 bp, mus musculus
agcgccaggtcttccttgcaacgtg

SEQ ID NO: 82210 - DNA, 25 bp, mus musculus
tcttccttgcaacgtggaaggatat

SEQ ID NO: 82211 - DNA, 25 bp, mus musculus
tccttgcaacgtggaaggatattcc

SEQ ID NO: 82212 - DNA, 25 bp, mus musculus
atgaactccagtttcagattaagga

SEQ ID NO: 82213 - DNA, 25 bp, mus musculus
atactccactgatgccaaaccagag

SEQ ID NO: 82214 - DNA, 25 bp, mus musculus
cactgatgccaaaccagagcattga

SEQ ID NO: 82215 - DNA, 25 bp, mus musculus
tgatgccaaaccagagcattgacgt

SEQ ID NO: 82216 - DNA, 25 bp, mus musculus
tgccaaaccagagcattgacgtctc

SEQ ID NO: 82217 - DNA, 25 bp, mus musculus
cgctcaacaccttgggcccagtcat

SEQ ID NO: 82218 - DNA, 25 bp, mus musculus
tcaacaccttgggcccagtcatgaa

SEQ ID NO: 82219 - DNA, 25 bp, mus musculus
agatggagcccctgaataacctgca

SEQ ID NO: 82220 - DNA, 25 bp, mus musculus
tgaataacctgcaggtggctgttaa

SEQ ID NO: 82221 - DNA, 25 bp, mus musculus
ctagctctttccactcctgtggtag

SEQ ID NO: 82222 - DNA, 25 bp, mus musculus
agctctttccactcctgtggtagaa

SEQ ID NO: 82223 - DNA, 25 bp, mus musculus
cctcaggctctagacaaaattcaga

SEQ ID NO: 82224 - DNA, 25 bp, mus musculus
tcatttaacttggaagctctgtctg

SEQ ID NO: 82225 - DNA, 25 bp, mus musculus
atttaacttggaagctctgtctgga

SEQ ID NO: 82226 - DNA, 25 bp, mus musculus
ttaacttggaagctctgtctggaag

SEQ ID NO: 82227 - DNA, 25 bp, mus musculus
ctctgtctggaagctctggatataa

SEQ ID NO: 82228 - DNA, 25 bp, mus musculus
ctgtctggaagctctggatataagt

SEQ ID NO: 82229 - DNA, 25 bp, mus musculus
tataagttcggtgttcttgctaaga

SEQ ID NO: 82230 - DNA, 25 bp, mus musculus
taagttcggtgttcttgctaagatt

SEQ ID NO: 82231 - DNA, 25 bp, mus musculus
agttcggtgttcttgctaagattgt

SEQ ID NO: 82232 - DNA, 25 bp, mus musculus
atatgaaaacacgacatcagcgggg

SEQ ID NO: 82233 - DNA, 25 bp, mus musculus
aacgtgctgtccttctgagtcaccc

SEQ ID NO: 82234 - DNA, 25 bp, mus musculus
cgtgctgtccttctgagtcaccctc

SEQ ID NO: 82235 - DNA, 25 bp, mus musculus
tcctcctcatccaagaagaagaagg

SEQ ID NO: 82236 - DNA, 25 bp, mus musculus
ctcctcatccaagaagaagaaggca

SEQ ID NO: 82237 - DNA, 25 bp, mus musculus
tggaggatcctcaggctctagacaa

SEQ ID NO: 82238 - DNA, 25 bp, mus musculus
gaggatcctcaggctctagacaaaa

SEQ ID NO: 82239 - DNA, 25 bp, mus musculus
ggatcctcaggctctagacaaaatt

SEQ ID NO: 82240 - DNA, 25 bp, mus musculus
atcctcaggctctagacaaaattca

SEQ ID NO: 82241 - DNA, 25 bp, mus musculus
ctggccgcgcacgcgccttacatga

SEQ ID NO: 82242 - DNA, 25 bp, mus musculus
gcgcacgcgccttacatgatgttcc

SEQ ID NO: 82243 - DNA, 25 bp, mus musculus
caagaactccagcatcgcggatctc

SEQ ID NO: 82244 - DNA, 25 bp, mus musculus
aactccagcatcgcggatctcagac

SEQ ID NO: 82245 - DNA, 25 bp, mus musculus
ccagcatcgcggatctcagactgaa

SEQ ID NO: 82246 - DNA, 25 bp, mus musculus
agcatcgcggatctcagactgaaag

SEQ ID NO: 82247 - DNA, 25 bp, mus musculus
catcgcggatctcagactgaaagct

SEQ ID NO: 82248 - DNA, 25 bp, mus musculus
tcgcggatctcagactgaaagctaa

SEQ ID NO: 82249 - DNA, 25 bp, mus musculus
tttctgcaccctggatccccagggc

SEQ ID NO: 82250 - DNA, 25 bp, mus musculus
tctgcaccctggatccccagggcgg

SEQ ID NO: 82251 - DNA, 25 bp, mus musculus
actctgcgctggacccgggatccca

SEQ ID NO: 82252 - DNA, 25 bp, mus musculus
gcgatggactcgttcataggaataa

SEQ ID NO: 82253 - DNA, 25 bp, mus musculus
gcgccttacatgatgttcccggcac

SEQ ID NO: 82254 - DNA, 25 bp, mus musculus
gccttacatgatgttcccggcaccg

SEQ ID NO: 82255 - DNA, 25 bp, mus musculus
cttacatgatgttcccggcaccgcc

SEQ ID NO: 82256 - DNA, 25 bp, mus musculus
gccaagaccaccagcaagaactcca

SEQ ID NO: 82257 - DNA, 25 bp, mus musculus
caagaccaccagcaagaactccagc

SEQ ID NO: 82258 - DNA, 25 bp, mus musculus
agaccaccagcaagaactccagcat

SEQ ID NO: 82259 - DNA, 25 bp, mus musculus
caccagcaagaactccagcatcgcg

SEQ ID NO: 82260 - DNA, 25 bp, mus musculus
ccagcaagaactccagcatcgcgga

SEQ ID NO: 82261 - DNA, 25 bp, mus musculus
gaatgtgttgcagcagtgggaactg

SEQ ID NO: 82262 - DNA, 25 bp, mus musculus
tcgacaacaacaaaagatttttcag

SEQ ID NO: 82263 - DNA, 25 bp, mus musculus
aactataatatccgaaatcattagc

SEQ ID NO: 82264 - DNA, 25 bp, mus musculus
ttaagtaccagctattccaatgtat

SEQ ID NO: 82265 - DNA, 25 bp, mus musculus
accagctattccaatgtatcaaact

SEQ ID NO: 82266 - DNA, 25 bp, mus musculus
agctattccaatgtatcaaactttc

SEQ ID NO: 82267 - DNA, 25 bp, mus musculus
tattccaatgtatcaaactttcagg

SEQ ID NO: 82268 - DNA, 25 bp, mus musculus
tttaatagttgttctctccacgatt

SEQ ID NO: 82269 - DNA, 25 bp, mus musculus
aatagttgttctctccacgattgtg

SEQ ID NO: 82270 - DNA, 25 bp, mus musculus
agttgttctctccacgattgtgtca

SEQ ID NO: 82271 - DNA, 25 bp, mus musculus
tgttctctccacgattgtgtcaata

SEQ ID NO: 82272 - DNA, 25 bp, mus musculus
ctccacgattgtgtcaataaagatg

SEQ ID NO: 82273 - DNA, 25 bp, mus musculus
gatttttcagcagtctagaattgtt

SEQ ID NO: 82274 - DNA, 25 bp, mus musculus
aattgttcagagccagagaatgttt

SEQ ID NO: 82275 - DNA, 25 bp, mus musculus
gatacacgagcagttcataaagagt

SEQ ID NO: 82276 - DNA, 25 bp, mus musculus
taatctatttactggcacacaaagt

SEQ ID NO: 82277 - DNA, 25 bp, mus musculus
tctatttactggcacacaaagtgaa

SEQ ID NO: 82278 - DNA, 25 bp, mus musculus
ggaaactcagcagcaagagatggca

SEQ ID NO: 82279 - DNA, 25 bp, mus musculus
aactcagcagcaagagatggcaaat

SEQ ID NO: 82280 - DNA, 25 bp, mus musculus
attctgatgagtctttgaagaaaga

SEQ ID NO: 82281 - DNA, 25 bp, mus musculus
ttggagacgcgttggacaggactga

SEQ ID NO: 82282 - DNA, 25 bp, mus musculus
gcaacagtactctgttggaatgcac

SEQ ID NO: 82283 - DNA, 25 bp, mus musculus
ttgtccatactgtgcgtaaaatcac

SEQ ID NO: 82284 - DNA, 25 bp, mus musculus
ctcccttaagcggtatgtctcaggg

SEQ ID NO: 82285 - DNA, 25 bp, mus musculus
aggaattcttgcagctgattggcta

SEQ ID NO: 82286 - DNA, 25 bp, mus musculus
tcttgcagctgattggctacagcag

SEQ ID NO: 82287 - DNA, 25 bp, mus musculus
ttggctacagcagcaagttccagag

SEQ ID NO: 82288 - DNA, 25 bp, mus musculus
gctacagcagcaagttccagagagt

SEQ ID NO: 82289 - DNA, 25 bp, mus musculus
agaggcttcgctctaaagctgagca

SEQ ID NO: 82290 - DNA, 25 bp, mus musculus
ggcttcgctctaaagctgagcactt

SEQ ID NO: 82291 - DNA, 25 bp, mus musculus
ctaaagctgagcacttccgcctgcc

SEQ ID NO: 82292 - DNA, 25 bp, mus musculus
aagctgagcacttccgcctgcccag

SEQ ID NO: 82293 - DNA, 25 bp, mus musculus
ccccgctatcactacaagcaaaagt

SEQ ID NO: 82294 - DNA, 25 bp, mus musculus
tatcactacaagcaaaagtcatctg

SEQ ID NO: 82295 - DNA, 25 bp, mus musculus
aagtcatctggtttctacagaaggg

SEQ ID NO: 82296 - DNA, 25 bp, mus musculus
tcatctggtttctacagaagggacg

SEQ ID NO: 82297 - DNA, 25 bp, mus musculus
tggacttgggcttgctcttcctcag

SEQ ID NO: 82298 - DNA, 25 bp, mus musculus
ggacctatttttgccagacagtaga

SEQ ID NO: 82299 - DNA, 25 bp, mus musculus
cctatttttgccagacagtagaaca

SEQ ID NO: 82300 - DNA, 25 bp, mus musculus
aacacaattttgtccatactgtgcg

SEQ ID NO: 82301 - DNA, 25 bp, mus musculus
tcaaagaagccatccaaaagtgtga

SEQ ID NO: 82302 - DNA, 25 bp, mus musculus
aagccatccaaaagtgtgagtatat

SEQ ID NO: 82303 - DNA, 25 bp, mus musculus
tttatgtgtcatctctggccatcaa

SEQ ID NO: 82304 - DNA, 25 bp, mus musculus
atgtgtcatctctggccatcaaggg

SEQ ID NO: 82305 - DNA, 25 bp, mus musculus
tgtcatctctggccatcaagggttg

SEQ ID NO: 82306 - DNA, 25 bp, mus musculus
ctctggccatcaagggttgcagaaa

SEQ ID NO: 82307 - DNA, 25 bp, mus musculus
tggccatcaagggttgcagaaataa

SEQ ID NO: 82308 - DNA, 25 bp, mus musculus
gaaataatcctgcagttcctaaaat

SEQ ID NO: 82309 - DNA, 25 bp, mus musculus
ataatcctgcagttcctaaaatgca

SEQ ID NO: 82310 - DNA, 25 bp, mus musculus
cagttcctaaaatgcacaccaggat

SEQ ID NO: 82311 - DNA, 25 bp, mus musculus
ttcctaaaatgcacaccaggatgaa

SEQ ID NO: 82312 - DNA, 25 bp, mus musculus
ctaaaatgcacaccaggatgaaaac

SEQ ID NO: 82313 - DNA, 25 bp, mus musculus
caaactccaagcagtgatcggcaga

SEQ ID NO: 82314 - DNA, 25 bp, mus musculus
actccaagcagtgatcggcagaagt

SEQ ID NO: 82315 - DNA, 25 bp, mus musculus
cccttgcatcagcacaggtgagcga

SEQ ID NO: 82316 - DNA, 25 bp, mus musculus
ttgcatcagcacaggtgagcgagcc

SEQ ID NO: 82317 - DNA, 25 bp, mus musculus
catcagcacaggtgagcgagccttg

SEQ ID NO: 82318 - DNA, 25 bp, mus musculus
tgagcgagccttgcgaacaggtcac

SEQ ID NO: 82319 - DNA, 25 bp, mus musculus
gcgagccttgcgaacaggtcacagt

SEQ ID NO: 82320 - DNA, 25 bp, mus musculus
cttgcgaacaggtcacagtttatgt

SEQ ID NO: 82321 - DNA, 25 bp, mus musculus
tattctgccaaagcaaattgataca

SEQ ID NO: 82322 - DNA, 25 bp, mus musculus
gttttaggacggtgggatgatgtct

SEQ ID NO: 82323 - DNA, 25 bp, mus musculus
tctttcaacctacacatcctaactt

SEQ ID NO: 82324 - DNA, 25 bp, mus musculus
ttcaacctacacatcctaacttatg

SEQ ID NO: 82325 - DNA, 25 bp, mus musculus
ctacacatcctaacttatggactct

SEQ ID NO: 82326 - DNA, 25 bp, mus musculus
atcctaacttatggactcttttgat

SEQ ID NO: 82327 - DNA, 25 bp, mus musculus
tgttcatctttaccaaatgaaatgc

SEQ ID NO: 82328 - DNA, 25 bp, mus musculus
tcatctttaccaaatgaaatgccaa

SEQ ID NO: 82329 - DNA, 25 bp, mus musculus
aaagccactggctatgctgtatttt

SEQ ID NO: 82330 - DNA, 25 bp, mus musculus
gccactggctatgctgtattttgat

SEQ ID NO: 82331 - DNA, 25 bp, mus musculus
ttttacttctctggcaaaatacact

SEQ ID NO: 82332 - DNA, 25 bp, mus musculus
ttctctggcaaaatacacttttgtt

SEQ ID NO: 82333 - DNA, 25 bp, mus musculus
gatgtcttggcttatgcacttttcc

SEQ ID NO: 82334 - DNA, 25 bp, mus musculus
gcttatgcacttttcccttactgtg

SEQ ID NO: 82335 - DNA, 25 bp, mus musculus
ccttactgtgcatctgcctgacagt

SEQ ID NO: 82336 - DNA, 25 bp, mus musculus
gcatctgcctgacagtgtttgttct

SEQ ID NO: 82337 - DNA, 25 bp, mus musculus
ttctaaatacctcacttgccatgct

SEQ ID NO: 82338 - DNA, 25 bp, mus musculus
taaatacctcacttgccatgctttg

SEQ ID NO: 82339 - DNA, 25 bp, mus musculus
ttgccatgctttgtgtgggtgatca

SEQ ID NO: 82340 - DNA, 25 bp, mus musculus
ccatgctttgtgtgggtgatcatgg

SEQ ID NO: 82341 - DNA, 25 bp, mus musculus
gaagcaaatatccaggccctgctga

SEQ ID NO: 82342 - DNA, 25 bp, mus musculus
aagcaaatatccaggccctgctgaa

SEQ ID NO: 82343 - DNA, 25 bp, mus musculus
cgtgcagctgtcactacgcggcccg

SEQ ID NO: 82344 - DNA, 25 bp, mus musculus
tgcagctgtcactacgcggcccgcg

SEQ ID NO: 82345 - DNA, 25 bp, mus musculus
gcagctgtcactacgcggcccgcga

SEQ ID NO: 82346 - DNA, 25 bp, mus musculus
cggcccgcgagccatggattccttc

SEQ ID NO: 82347 - DNA, 25 bp, mus musculus
cccgcgagccatggattccttcggg

SEQ ID NO: 82348 - DNA, 25 bp, mus musculus
catggattccttcgggaatactttg

SEQ ID NO: 82349 - DNA, 25 bp, mus musculus
agcaaatatccaggccctgctgaag

SEQ ID NO: 82350 - DNA, 25 bp, mus musculus
gactccatcgtgcagctgtcactac

SEQ ID NO: 82351 - DNA, 25 bp, mus musculus
actccatcgtgcagctgtcactacg

SEQ ID NO: 82352 - DNA, 25 bp, mus musculus
ctccatcgtgcagctgtcactacgc

SEQ ID NO: 82353 - DNA, 25 bp, mus musculus
tccatcgtgcagctgtcactacgcg

SEQ ID NO: 82354 - DNA, 25 bp, mus musculus
ccatcgtgcagctgtcactacgcgg

SEQ ID NO: 82355 - DNA, 25 bp, mus musculus
catcgtgcagctgtcactacgcggc

SEQ ID NO: 82356 - DNA, 25 bp, mus musculus
atcgtgcagctgtcactacgcggcc

SEQ ID NO: 82357 - DNA, 25 bp, mus musculus
gatggaaaccctatcaacctcagca

SEQ ID NO: 82358 - DNA, 25 bp, mus musculus
aacctcagcagaactcctcaagcct

SEQ ID NO: 82359 - DNA, 25 bp, mus musculus
tatgccaactagtcatcaaatctca

SEQ ID NO: 82360 - DNA, 25 bp, mus musculus
aactagtcatcaaatctcatcaaga

SEQ ID NO: 82361 - DNA, 25 bp, mus musculus
tcatcaaatctcatcaagaattgta

SEQ ID NO: 82362 - DNA, 25 bp, mus musculus
tcaaatctcatcaagaattgtaggt

SEQ ID NO: 82363 - DNA, 25 bp, mus musculus
ttcactcatgtatgtttcccacctg

SEQ ID NO: 82364 - DNA, 25 bp, mus musculus
actcatgtatgtttcccacctgatt

SEQ ID NO: 82365 - DNA, 25 bp, mus musculus
catgtatgtttcccacctgattcag

SEQ ID NO: 82366 - DNA, 25 bp, mus musculus
tgtttcccacctgattcagttaaga

SEQ ID NO: 82367 - DNA, 25 bp, mus musculus
ttcccacctgattcagttaagagca

SEQ ID NO: 82368 - DNA, 25 bp, mus musculus
ccacctgattcagttaagagcagaa

SEQ ID NO: 82369 - DNA, 25 bp, mus musculus
agaactcctcaagcctacatgtgtc

SEQ ID NO: 82370 - DNA, 25 bp, mus musculus
caagcctacatgtgtctacctcgtt

SEQ ID NO: 82371 - DNA, 25 bp, mus musculus
gcctacatgtgtctacctcgtttgc

SEQ ID NO: 82372 - DNA, 25 bp, mus musculus
tacatgtgtctacctcgtttgccca

SEQ ID NO: 82373 - DNA, 25 bp, mus musculus
tgatgctttctgtagccaagagaag

SEQ ID NO: 82374 - DNA, 25 bp, mus musculus
gcatatatctcttcagaagcaaact

SEQ ID NO: 82375 - DNA, 25 bp, mus musculus
atctcttcagaagcaaactcagtat

SEQ ID NO: 82376 - DNA, 25 bp, mus musculus
tcttcagaagcaaactcagtatatt

SEQ ID NO: 82377 - DNA, 25 bp, mus musculus
cccggtgcaccacgaaaagctcgat

SEQ ID NO: 82378 - DNA, 25 bp, mus musculus
gcaccacgaaaagctcgatccaggc

SEQ ID NO: 82379 - DNA, 25 bp, mus musculus
gaggccacctgcgccatctgcctgg

SEQ ID NO: 82380 - DNA, 25 bp, mus musculus
tgcgccatctgcctggattacttca

SEQ ID NO: 82381 - DNA, 25 bp, mus musculus
gccatctgcctggattacttcaccg

SEQ ID NO: 82382 - DNA, 25 bp, mus musculus
atctgcctggattacttcaccgacc

SEQ ID NO: 82383 - DNA, 25 bp, mus musculus
ccggtgatgaccgactgcggccaca

SEQ ID NO: 82384 - DNA, 25 bp, mus musculus
cacaacttctgccgcgagtgcatcc

SEQ ID NO: 82385 - DNA, 25 bp, mus musculus
aacttctgccgcgagtgcatccgac

SEQ ID NO: 82386 - DNA, 25 bp, mus musculus
cgcgagtgcatccgacgttgctggg

SEQ ID NO: 82387 - DNA, 25 bp, mus musculus
gagtgcatccgacgttgctggggcc

SEQ ID NO: 82388 - DNA, 25 bp, mus musculus
atccgacgttgctggggccagcccg

SEQ ID NO: 82389 - DNA, 25 bp, mus musculus
ccacgaaaagctcgatccaggcgca

SEQ ID NO: 82390 - DNA, 25 bp, mus musculus
cgaaaagctcgatccaggcgcagac

SEQ ID NO: 82391 - DNA, 25 bp, mus musculus
gctcgatccaggcgcagacgcagca

SEQ ID NO: 82392 - DNA, 25 bp, mus musculus
cgatccaggcgcagacgcagcacca

SEQ ID NO: 82393 - DNA, 25 bp, mus musculus
tccaggcgcagacgcagcaccatgg

SEQ ID NO: 82394 - DNA, 25 bp, mus musculus
agacgcagcaccatggctgccccag

SEQ ID NO: 82395 - DNA, 25 bp, mus musculus
accatggctgccccagacttgtcca

SEQ ID NO: 82396 - DNA, 25 bp, mus musculus
atggctgccccagacttgtccacca

SEQ ID NO: 82397 - DNA, 25 bp, mus musculus
ctcaggcatgcaacagcacattctt

SEQ ID NO: 82398 - DNA, 25 bp, mus musculus
aggcatgcaacagcacattctttgg

SEQ ID NO: 82399 - DNA, 25 bp, mus musculus
catatggcatgcatggtagaaaatg

SEQ ID NO: 82400 - DNA, 25 bp, mus musculus
gagactattactttcctctataaat

SEQ ID NO: 82401 - DNA, 25 bp, mus musculus
gcttgtcctaagagctatggcttta

SEQ ID NO: 82402 - DNA, 25 bp, mus musculus
tgtcctaagagctatggctttaatg

SEQ ID NO: 82403 - DNA, 25 bp, mus musculus
aatgcagcaaggcttgctaatcttc

SEQ ID NO: 82404 - DNA, 25 bp, mus musculus
cagtcattacggctatttcggggag

SEQ ID NO: 82405 - DNA, 25 bp, mus musculus
gaagctatccataggctgctggcct

SEQ ID NO: 82406 - DNA, 25 bp, mus musculus
gctatccataggctgctggccttga

SEQ ID NO: 82407 - DNA, 25 bp, mus musculus
aggctgctggccttgattaacggat

SEQ ID NO: 82408 - DNA, 25 bp, mus musculus
ctgctggccttgattaacggattgt

SEQ ID NO: 82409 - DNA, 25 bp, mus musculus
gcaacagcacattctttggtacttg

SEQ ID NO: 82410 - DNA, 25 bp, mus musculus
agaggcaccgcaacttttgatggga

SEQ ID NO: 82411 - DNA, 25 bp, mus musculus
ggcaccgcaacttttgatgggacag

SEQ ID NO: 82412 - DNA, 25 bp, mus musculus
gcgatagccagtgcggttgttaaag

SEQ ID NO: 82413 - DNA, 25 bp, mus musculus
tgtcgaacactgttttctacacact

SEQ ID NO: 82414 - DNA, 25 bp, mus musculus
tctacacactatcattcattagtag

SEQ ID NO: 82415 - DNA, 25 bp, mus musculus
cactatcattcattagtagaagatt

SEQ ID NO: 82416 - DNA, 25 bp, mus musculus
tgtgtgcgcctaggacatatggcat

SEQ ID NO: 82417 - DNA, 25 bp, mus musculus
tgcgccgtgacgtacagcatgtatc

SEQ ID NO: 82418 - DNA, 25 bp, mus musculus
acgtacagcatgtatcacagcagca

SEQ ID NO: 82419 - DNA, 25 bp, mus musculus
cgcaaccgcaaattcaagtgcaaag

SEQ ID NO: 82420 - DNA, 25 bp, mus musculus
aaccgcaaattcaagtgcaaagctg

SEQ ID NO: 82421 - DNA, 25 bp, mus musculus
aaggttcttccaaatgatccagtgt

SEQ ID NO: 82422 - DNA, 25 bp, mus musculus
gttcttccaaatgatccagtgtttc

SEQ ID NO: 82423 - DNA, 25 bp, mus musculus
cttccaaatgatccagtgtttctgg

SEQ ID NO: 82424 - DNA, 25 bp, mus musculus
gatccagtgtttctggagcctcatg

SEQ ID NO: 82425 - DNA, 25 bp, mus musculus
ccagtgtttctggagcctcatgaag

SEQ ID NO: 82426 - DNA, 25 bp, mus musculus
gtgtttctggagcctcatgaagaat

SEQ ID NO: 82427 - DNA, 25 bp, mus musculus
tttctggagcctcatgaagaattga

SEQ ID NO: 82428 - DNA, 25 bp, mus musculus
ttgacactttgcaagtactatgaaa

SEQ ID NO: 82429 - DNA, 25 bp, mus musculus
agcatgtatcacagcagcagccaga

SEQ ID NO: 82430 - DNA, 25 bp, mus musculus
atgtatcacagcagcagccagaaac

SEQ ID NO: 82431 - DNA, 25 bp, mus musculus
agcagccagaaacggcactggacct

SEQ ID NO: 82432 - DNA, 25 bp, mus musculus
aaacggcactggaccttcgctagcg

SEQ ID NO: 82433 - DNA, 25 bp, mus musculus
cggcactggaccttcgctagcgagg

SEQ ID NO: 82434 - DNA, 25 bp, mus musculus
tggaccttcgctagcgaggagcagc

SEQ ID NO: 82435 - DNA, 25 bp, mus musculus
ggcggacgcaaccgcaaattcaagt

SEQ ID NO: 82436 - DNA, 25 bp, mus musculus
ggacgcaaccgcaaattcaagtgca

SEQ ID NO: 82437 - DNA, 25 bp, mus musculus
gccacgcgtccggtgagacagaggc

SEQ ID NO: 82438 - DNA, 25 bp, mus musculus
cacgcgtccggtgagacagaggcaa

SEQ ID NO: 82439 - DNA, 25 bp, mus musculus
gccctgacgctgtgtgtcaccaaag

SEQ ID NO: 82440 - DNA, 25 bp, mus musculus
tagacatggaggccctggaacgcat

SEQ ID NO: 82441 - DNA, 25 bp, mus musculus
gacatggaggccctggaacgcatgt

SEQ ID NO: 82442 - DNA, 25 bp, mus musculus
gaggccctggaacgcatgttccgtt

SEQ ID NO: 82443 - DNA, 25 bp, mus musculus
ctggaacgcatgttccgttacctga

SEQ ID NO: 82444 - DNA, 25 bp, mus musculus
cgcatgttccgttacctgaaatttg

SEQ ID NO: 82445 - DNA, 25 bp, mus musculus
accgcccagcaatttctggaagagt

SEQ ID NO: 82446 - DNA, 25 bp, mus musculus
cgcccagcaatttctggaagagttg

SEQ ID NO: 82447 - DNA, 25 bp, mus musculus
cccagcaatttctggaagagttgga

SEQ ID NO: 82448 - DNA, 25 bp, mus musculus
atttcagcagaccatagataattgg

SEQ ID NO: 82449 - DNA, 25 bp, mus musculus
cgcgtccggtgagacagaggcaaaa

SEQ ID NO: 82450 - DNA, 25 bp, mus musculus
tgagtgatcctcagccattgcagga

SEQ ID NO: 82451 - DNA, 25 bp, mus musculus
agtgatcctcagccattgcaggagg

SEQ ID NO: 82452 - DNA, 25 bp, mus musculus
tgatcctcagccattgcaggaggaa

SEQ ID NO: 82453 - DNA, 25 bp, mus musculus
cctcagccattgcaggaggaaagat

SEQ ID NO: 82454 - DNA, 25 bp, mus musculus
tcagccattgcaggaggaaagatat

SEQ ID NO: 82455 - DNA, 25 bp, mus musculus
tatgatatgtcaggtgcccgcctgg

SEQ ID NO: 82456 - DNA, 25 bp, mus musculus
atatgtcaggtgcccgcctggccct

SEQ ID NO: 82457 - DNA, 25 bp, mus musculus
gatcagagctctcctgttcttttgg

SEQ ID NO: 82458 - DNA, 25 bp, mus musculus
agctctcctgttcttttggataatc

SEQ ID NO: 82459 - DNA, 25 bp, mus musculus
gaccatcctgattttccattttggg

SEQ ID NO: 82460 - DNA, 25 bp, mus musculus
tactaactggaggtccattttgtgc

SEQ ID NO: 82461 - DNA, 25 bp, mus musculus
gtccattttgtgccttgtgccagat

SEQ ID NO: 82462 - DNA, 25 bp, mus musculus
tttgtgccttgtgccagatgtcact

SEQ ID NO: 82463 - DNA, 25 bp, mus musculus
gccagatgtcactgcattggaagag

SEQ ID NO: 82464 - DNA, 25 bp, mus musculus
tgattacatatcaccctaatccaag

SEQ ID NO: 82465 - DNA, 25 bp, mus musculus
catatcaccctaatccaagcttctg

SEQ ID NO: 82466 - DNA, 25 bp, mus musculus
atccaagcttctgagcaattctggc

SEQ ID NO: 82467 - DNA, 25 bp, mus musculus
gagcaattctggctctgctgaatct

SEQ ID NO: 82468 - DNA, 25 bp, mus musculus
tgtatatttctcctttctaagaaat

SEQ ID NO: 82469 - DNA, 25 bp, mus musculus
gataatccagttcttggctcaatgg

SEQ ID NO: 82470 - DNA, 25 bp, mus musculus
ccagttcttggctcaatggcaaaaa

SEQ ID NO: 82471 - DNA, 25 bp, mus musculus
actcctgcgctgattgcccttcgct

SEQ ID NO: 82472 - DNA, 25 bp, mus musculus
cttcgctaccagctacaacgtgggg

SEQ ID NO: 82473 - DNA, 25 bp, mus musculus
taccagctacaacgtggggttgtgg

SEQ ID NO: 82474 - DNA, 25 bp, mus musculus
gtcctcgccaagagtttctctgaga

SEQ ID NO: 82475 - DNA, 25 bp, mus musculus
atgaaagtcctcgatgacctgaata

SEQ ID NO: 82476 - DNA, 25 bp, mus musculus
tttaaggaccatcctgattttccat

SEQ ID NO: 82477 - DNA, 25 bp, mus musculus
ctcatgacagacaagggctgtgtaa

SEQ ID NO: 82478 - DNA, 25 bp, mus musculus
cagctgattttggcctggctcgggc

SEQ ID NO: 82479 - DNA, 25 bp, mus musculus
tcccagggcctcaagtcttctggcc

SEQ ID NO: 82480 - DNA, 25 bp, mus musculus
ccagggcctcaagtcttctggccct

SEQ ID NO: 82481 - DNA, 25 bp, mus musculus
agggcctcaagtcttctggccctgg

SEQ ID NO: 82482 - DNA, 25 bp, mus musculus
ggcctcaagtcttctggccctggag

SEQ ID NO: 82483 - DNA, 25 bp, mus musculus
cctcaagtcttctggccctggaggt

SEQ ID NO: 82484 - DNA, 25 bp, mus musculus
tcaagtcttctggccctggaggtca

SEQ ID NO: 82485 - DNA, 25 bp, mus musculus
aagtcttctggccctggaggtcagc

SEQ ID NO: 82486 - DNA, 25 bp, mus musculus
tggccctggaggtcagccctggtca

SEQ ID NO: 82487 - DNA, 25 bp, mus musculus
tagagagcctgactgcagcatccaa

SEQ ID NO: 82488 - DNA, 25 bp, mus musculus
gagcctgactgcagcatccaaggag

SEQ ID NO: 82489 - DNA, 25 bp, mus musculus
ctctggtaccgagccccagagctgc

SEQ ID NO: 82490 - DNA, 25 bp, mus musculus
taccgagccccagagctgctgcttg

SEQ ID NO: 82491 - DNA, 25 bp, mus musculus
ccgagccccagagctgctgcttgga

SEQ ID NO: 82492 - DNA, 25 bp, mus musculus
accagcattgacatgtggtaggcgt

SEQ ID NO: 82493 - DNA, 25 bp, mus musculus
gcattgacatgtggtaggcgtggtt

SEQ ID NO: 82494 - DNA, 25 bp, mus musculus
attgacatgtggtaggcgtggtttc

SEQ ID NO: 82495 - DNA, 25 bp, mus musculus
tgacatgtggtaggcgtggtttctg

SEQ ID NO: 82496 - DNA, 25 bp, mus musculus
gctcccagggcctcaagtcttctgg

SEQ ID NO: 82497 - DNA, 25 bp, mus musculus
tcagtgggtgcccgtgattaatctc

SEQ ID NO: 82498 - DNA, 25 bp, mus musculus
tgcccgtgattaatctcccggaacg

SEQ ID NO: 82499 - DNA, 25 bp, mus musculus
tcaactgcacgagggctcagagatg

SEQ ID NO: 82500 - DNA, 25 bp, mus musculus
ctttcaaataagccaaatattgctt

SEQ ID NO: 82501 - DNA, 25 bp, mus musculus
ttcaaataagccaaatattgctttg

SEQ ID NO: 82502 - DNA, 25 bp, mus musculus
taatcatattttcaagccacagttt

SEQ ID NO: 82503 - DNA, 25 bp, mus musculus
atcatattttcaagccacagtttaa

SEQ ID NO: 82504 - DNA, 25 bp, mus musculus
catattttcaagccacagtttaaat

SEQ ID NO: 82505 - DNA, 25 bp, mus musculus
tattttcaagccacagtttaaatgt

SEQ ID NO: 82506 - DNA, 25 bp, mus musculus
ttttcaagccacagtttaaatgtat

SEQ ID NO: 82507 - DNA, 25 bp, mus musculus
ttcaagccacagtttaaatgtattt

SEQ ID NO: 82508 - DNA, 25 bp, mus musculus
ttttgaagcacattatctaaaataa

SEQ ID NO: 82509 - DNA, 25 bp, mus musculus
actgaaccaaattgcactgaagttt

SEQ ID NO: 82510 - DNA, 25 bp, mus musculus
tgaaccaaattgcactgaagttttg

SEQ ID NO: 82511 - DNA, 25 bp, mus musculus
tacctttgtagttactcaagcagtc

SEQ ID NO: 82512 - DNA, 25 bp, mus musculus
tttgtagttactcaagcagtcactc

SEQ ID NO: 82513 - DNA, 25 bp, mus musculus
tgtagttactcaagcagtcactccc

SEQ ID NO: 82514 - DNA, 25 bp, mus musculus
ccgagttcaactgcacgagggctca

SEQ ID NO: 82515 - DNA, 25 bp, mus musculus
gagttcaactgcacgagggctcaga

SEQ ID NO: 82516 - DNA, 25 bp, mus musculus
gttcaactgcacgagggctcagaga

SEQ ID NO: 82517 - DNA, 25 bp, mus musculus
taaagaattacgcttgcctttgtcg

SEQ ID NO: 82518 - DNA, 25 bp, mus musculus
gttctcggaatttcctgagaggatg

SEQ ID NO: 82519 - DNA, 25 bp, mus musculus
caatccagctccagttgagacctag

SEQ ID NO: 82520 - DNA, 25 bp, mus musculus
agctccagttgagacctagtgcaat

SEQ ID NO: 82521 - DNA, 25 bp, mus musculus
gacctagtgcaatttccctgcagat

SEQ ID NO: 82522 - DNA, 25 bp, mus musculus
tttccctgcagatgaacacatagct

SEQ ID NO: 82523 - DNA, 25 bp, mus musculus
tgaacacatagctgtgctttagact

SEQ ID NO: 82524 - DNA, 25 bp, mus musculus
catagctgtgctttagactgatgca

SEQ ID NO: 82525 - DNA, 25 bp, mus musculus
ttagactgatgcacccgtgtcctgt

SEQ ID NO: 82526 - DNA, 25 bp, mus musculus
acccgtgtcctgtgatggcaggaca

SEQ ID NO: 82527 - DNA, 25 bp, mus musculus
gctgtgtgctcgagacccatctaga

SEQ ID NO: 82528 - DNA, 25 bp, mus musculus
tgctcgagacccatctagacctcgc

SEQ ID NO: 82529 - DNA, 25 bp, mus musculus
ggaatttcctgagaggatggagtgc

SEQ ID NO: 82530 - DNA, 25 bp, mus musculus
ttatttgtctgccttgtgcctgaca

SEQ ID NO: 82531 - DNA, 25 bp, mus musculus
gtctgccttgtgcctgacacagcgg

SEQ ID NO: 82532 - DNA, 25 bp, mus musculus
cttgtgcctgacacagcggaattta

SEQ ID NO: 82533 - DNA, 25 bp, mus musculus
agagatgacccagcatggtagctag

SEQ ID NO: 82534 - DNA, 25 bp, mus musculus
tagctagccactaccagcttggtga

SEQ ID NO: 82535 - DNA, 25 bp, mus musculus
gttgaggccagccaagacttctgtg

SEQ ID NO: 82536 - DNA, 25 bp, mus musculus
gccagccaagacttctgtgactcct

SEQ ID NO: 82537 - DNA, 25 bp, mus musculus
tccgttagctgcagaaggctgaggc

SEQ ID NO: 82538 - DNA, 25 bp, mus musculus
ccccacgtgaagcagttgtgcgagc

SEQ ID NO: 82539 - DNA, 25 bp, mus musculus
tgatctgctcgatctccaatgaagc

SEQ ID NO: 82540 - DNA, 25 bp, mus musculus
tctccaatgaagcgctcagagcacc

SEQ ID NO: 82541 - DNA, 25 bp, mus musculus
ccaatgaagcgctcagagcaccgat

SEQ ID NO: 82542 - DNA, 25 bp, mus musculus
caccgatgcgtgtccctgtctctaa

SEQ ID NO: 82543 - DNA, 25 bp, mus musculus
cgatgcgtgtccctgtctctaatca

SEQ ID NO: 82544 - DNA, 25 bp, mus musculus
tgcgtgtccctgtctctaatcatgt

SEQ ID NO: 82545 - DNA, 25 bp, mus musculus
ctgtctctaatcatgtgtatgagcg

SEQ ID NO: 82546 - DNA, 25 bp, mus musculus
tctctaatcatgtgtatgagcggcg

SEQ ID NO: 82547 - DNA, 25 bp, mus musculus
atcatgtgtatgagcggcgactcat

SEQ ID NO: 82548 - DNA, 25 bp, mus musculus
tgtatgagcggcgactcattgagaa

SEQ ID NO: 82549 - DNA, 25 bp, mus musculus
accctctgtgaggcgactggcagca

SEQ ID NO: 82550 - DNA, 25 bp, mus musculus
agcggcgactcattgagaagtacat

SEQ ID NO: 82551 - DNA, 25 bp, mus musculus
agcagcgctacgacggcgccatgtc

SEQ ID NO: 82552 - DNA, 25 bp, mus musculus
agcgctacgacggcgccatgtccct

SEQ ID NO: 82553 - DNA, 25 bp, mus musculus
gctacgacggcgccatgtccctgat

SEQ ID NO: 82554 - DNA, 25 bp, mus musculus
acggcgccatgtccctgatctgctc

SEQ ID NO: 82555 - DNA, 25 bp, mus musculus
gcgccatgtccctgatctgctcgat

SEQ ID NO: 82556 - DNA, 25 bp, mus musculus
ccatgtccctgatctgctcgatctc

SEQ ID NO: 82557 - DNA, 25 bp, mus musculus
ccctgatctgctcgatctccaatga

SEQ ID NO: 82558 - DNA, 25 bp, mus musculus
ctcttcttgactgcaatgcgagccc

SEQ ID NO: 82559 - DNA, 25 bp, mus musculus
gcccgaatgcgcacagaggatccca

SEQ ID NO: 82560 - DNA, 25 bp, mus musculus
gaatgtgcaatccctagggtggcat

SEQ ID NO: 82561 - DNA, 25 bp, mus musculus
gcaatccctagggtggcatctgaat

SEQ ID NO: 82562 - DNA, 25 bp, mus musculus
aattcatgttaccagcaaaagatct

SEQ ID NO: 82563 - DNA, 25 bp, mus musculus
aagatctaagccagcatctcttttt

SEQ ID NO: 82564 - DNA, 25 bp, mus musculus
tttcactatgtagccctgtgttgcc

SEQ ID NO: 82565 - DNA, 25 bp, mus musculus
tatgtagccctgtgttgccagtaac

SEQ ID NO: 82566 - DNA, 25 bp, mus musculus
gccctgtgttgccagtaactcataa

SEQ ID NO: 82567 - DNA, 25 bp, mus musculus
tgttgccagtaactcataaagaccc

SEQ ID NO: 82568 - DNA, 25 bp, mus musculus
cacacttctcagaatcatttgaaat

SEQ ID NO: 82569 - DNA, 25 bp, mus musculus
tgatatccaaggtgctaggctaagg

SEQ ID NO: 82570 - DNA, 25 bp, mus musculus
acagaggatcccagtggcagcagct

SEQ ID NO: 82571 - DNA, 25 bp, mus musculus
gatcccagtggcagcagctatgtcg

SEQ ID NO: 82572 - DNA, 25 bp, mus musculus
tatgtcgcggccatgcaccaagaag

SEQ ID NO: 82573 - DNA, 25 bp, mus musculus
gcggccatgcaccaagaagccttct

SEQ ID NO: 82574 - DNA, 25 bp, mus musculus
atgcaccaagaagccttctctaatc

SEQ ID NO: 82575 - DNA, 25 bp, mus musculus
gccttctctaatctgcagacccagg

SEQ ID NO: 82576 - DNA, 25 bp, mus musculus
tctaatctgcagacccaggagaatg

SEQ ID NO: 82577 - DNA, 25 bp, mus musculus
ctccctgaatgtgcaatccctaggg

SEQ ID NO: 82578 - DNA, 25 bp, mus musculus
tctgggcgacatggcgtggttgcca

SEQ ID NO: 82579 - DNA, 25 bp, mus musculus
tctgtactggaaggccccgctgttc

SEQ ID NO: 82580 - DNA, 25 bp, mus musculus
atgttcgtagctatgtggcgcaaag

SEQ ID NO: 82581 - DNA, 25 bp, mus musculus
ttcgtagctatgtggcgcaaagtcc

SEQ ID NO: 82582 - DNA, 25 bp, mus musculus
tggcgcaaagtcctgctgacctgcc

SEQ ID NO: 82583 - DNA, 25 bp, mus musculus
cgcaaagtcctgctgacctgccatg

SEQ ID NO: 82584 - DNA, 25 bp, mus musculus
aaagtcctgctgacctgccatgatg

SEQ ID NO: 82585 - DNA, 25 bp, mus musculus
gtcctgctgacctgccatgatgatg

SEQ ID NO: 82586 - DNA, 25 bp, mus musculus
ctgctgacctgccatgatgatgctg

SEQ ID NO: 82587 - DNA, 25 bp, mus musculus
ctgacctgccatgatgatgctgcgc

SEQ ID NO: 82588 - DNA, 25 bp, mus musculus
catgatgatgctgcgcggttcgtgc

SEQ ID NO: 82589 - DNA, 25 bp, mus musculus
cggttcgtgcggctgctgggccacc

SEQ ID NO: 82590 - DNA, 25 bp, mus musculus
cggcgacgcacaggctctgtatccg

SEQ ID NO: 82591 - DNA, 25 bp, mus musculus
cgcacaggctctgtatccgtgcaca

SEQ ID NO: 82592 - DNA, 25 bp, mus musculus
acaggctctgtatccgtgcacatgt

SEQ ID NO: 82593 - DNA, 25 bp, mus musculus
ggctctgtatccgtgcacatgttcg

SEQ ID NO: 82594 - DNA, 25 bp, mus musculus
gtatccgtgcacatgttcgtagcta

SEQ ID NO: 82595 - DNA, 25 bp, mus musculus
tccgtgcacatgttcgtagctatgt

SEQ ID NO: 82596 - DNA, 25 bp, mus musculus
gtgcacatgttcgtagctatgtggc

SEQ ID NO: 82597 - DNA, 25 bp, mus musculus
cacatgttcgtagctatgtggcgca

SEQ ID NO: 82598 - DNA, 25 bp, mus musculus
ctgcgccgtgcaccgcaatggatcc

SEQ ID NO: 82599 - DNA, 25 bp, mus musculus
tgcgccgtgcaccgcaatggatcca

SEQ ID NO: 82600 - DNA, 25 bp, mus musculus
tccagaaaattaccacgtcctatga

SEQ ID NO: 82601 - DNA, 25 bp, mus musculus
aaattaccacgtcctatgaagatcg

SEQ ID NO: 82602 - DNA, 25 bp, mus musculus
aattaccacgtcctatgaagatcgg

SEQ ID NO: 82603 - DNA, 25 bp, mus musculus
attaccacgtcctatgaagatcggt

SEQ ID NO: 82604 - DNA, 25 bp, mus musculus
accacgtcctatgaagatcggtgga

SEQ ID NO: 82605 - DNA, 25 bp, mus musculus
ccacgtcctatgaagatcggtggaa

SEQ ID NO: 82606 - DNA, 25 bp, mus musculus
cacgtcctatgaagatcggtggaaa

SEQ ID NO: 82607 - DNA, 25 bp, mus musculus
cgtcctatgaagatcggtggaaact

SEQ ID NO: 82608 - DNA, 25 bp, mus musculus
gcgccgtgcaccgcaatggatccaa

SEQ ID NO: 82609 - DNA, 25 bp, mus musculus
cgccgtgcaccgcaatggatccaag

SEQ ID NO: 82610 - DNA, 25 bp, mus musculus
gccgtgcaccgcaatggatccaagt

SEQ ID NO: 82611 - DNA, 25 bp, mus musculus
ccgtgcaccgcaatggatccaagtt

SEQ ID NO: 82612 - DNA, 25 bp, mus musculus
cgtgcaccgcaatggatccaagttc

SEQ ID NO: 82613 - DNA, 25 bp, mus musculus
gtgcaccgcaatggatccaagttcg

SEQ ID NO: 82614 - DNA, 25 bp, mus musculus
tgcaccgcaatggatccaagttcga

SEQ ID NO: 82615 - DNA, 25 bp, mus musculus
atccagaaaattaccacgtcctatg

SEQ ID NO: 82616 - DNA, 25 bp, mus musculus
gatgtgcagctgaccactctcgctc

SEQ ID NO: 82617 - DNA, 25 bp, mus musculus
gtgcagctgaccactctcgctcaca

SEQ ID NO: 82618 - DNA, 25 bp, mus musculus
gccaagtcttcctgggcccgtcagg

SEQ ID NO: 82619 - DNA, 25 bp, mus musculus
cgtcaggagagcctgcaggagcgca

SEQ ID NO: 82620 - DNA, 25 bp, mus musculus
agcctgcaggagcgcaagcaggcac

SEQ ID NO: 82621 - DNA, 25 bp, mus musculus
cgcaagcaggcactgtatgaatatg

SEQ ID NO: 82622 - DNA, 25 bp, mus musculus
agacaggcccaggaggctgaatgag

SEQ ID NO: 82623 - DNA, 25 bp, mus musculus
ctcacccagctaacaacaggccgga

SEQ ID NO: 82624 - DNA, 25 bp, mus musculus
acccagctaacaacaggccggatga

SEQ ID NO: 82625 - DNA, 25 bp, mus musculus
cagctaacaacaggccggatgagtg

SEQ ID NO: 82626 - DNA, 25 bp, mus musculus
cccccaatctcacattaaattcagg

SEQ ID NO: 82627 - DNA, 25 bp, mus musculus
ccaatctcacattaaattcagggtt

SEQ ID NO: 82628 - DNA, 25 bp, mus musculus
accactctcgctcacagagtcaagg

SEQ ID NO: 82629 - DNA, 25 bp, mus musculus
ctgccccatgtgccattgaatgtca

SEQ ID NO: 82630 - DNA, 25 bp, mus musculus
aatgtcatccagagagacctggcca

SEQ ID NO: 82631 - DNA, 25 bp, mus musculus
gtcatccagagagacctggccagga

SEQ ID NO: 82632 - DNA, 25 bp, mus musculus
atccagagagacctggccaggactg

SEQ ID NO: 82633 - DNA, 25 bp, mus musculus
ctggccaggactgggtgtgtagact

SEQ ID NO: 82634 - DNA, 25 bp, mus musculus
gtagacttgaccatcacaaacctgc

SEQ ID NO: 82635 - DNA, 25 bp, mus musculus
ttgaccatcacaaacctgctcgagg

SEQ ID NO: 82636 - DNA, 25 bp, mus musculus
catctttggggacagtccttgtaca

SEQ ID NO: 82637 - DNA, 25 bp, mus musculus
ggacagtccttgtacatcctcagct

SEQ ID NO: 82638 - DNA, 25 bp, mus musculus
ttggcaatttgctcttttggcagaa

SEQ ID NO: 82639 - DNA, 25 bp, mus musculus
tcaatttaggggctgttgaggaaca

SEQ ID NO: 82640 - DNA, 25 bp, mus musculus
atggatcagtgctcagggcattgct

SEQ ID NO: 82641 - DNA, 25 bp, mus musculus
cagtgctcagggcattgctgactgt

SEQ ID NO: 82642 - DNA, 25 bp, mus musculus
tgctcagggcattgctgactgtgca

SEQ ID NO: 82643 - DNA, 25 bp, mus musculus
cattgctgactgtgcacccgattcg

SEQ ID NO: 82644 - DNA, 25 bp, mus musculus
tgctgactgtgcacccgattcggag

SEQ ID NO: 82645 - DNA, 25 bp, mus musculus
tgactgtgcacccgattcggagctc

SEQ ID NO: 82646 - DNA, 25 bp, mus musculus
tgcacccgattcggagctccagcca

SEQ ID NO: 82647 - DNA, 25 bp, mus musculus
cgattcggagctccagccagggccg

SEQ ID NO: 82648 - DNA, 25 bp, mus musculus
ttgtacatcctcagctcactgctag

SEQ ID NO: 82649 - DNA, 25 bp, mus musculus
tacatcctcagctcactgctagcag

SEQ ID NO: 82650 - DNA, 25 bp, mus musculus
agctcactgctagcagagggattct

SEQ ID NO: 82651 - DNA, 25 bp, mus musculus
ggattcttgccacgggtgaaatcga

SEQ ID NO: 82652 - DNA, 25 bp, mus musculus
tttctacttcagtcaaacctgatgt

SEQ ID NO: 82653 - DNA, 25 bp, mus musculus
ctacttcagtcaaacctgatgttgt

SEQ ID NO: 82654 - DNA, 25 bp, mus musculus
cttcagtcaaacctgatgttgtagt

SEQ ID NO: 82655 - DNA, 25 bp, mus musculus
ttgtagtgccagttggcaatttgct

SEQ ID NO: 82656 - DNA, 25 bp, mus musculus
tccaaccagttcaaagcttgttgtc

SEQ ID NO: 82657 - DNA, 25 bp, mus musculus
ccaaccagttcaaagcttgttgtct

SEQ ID NO: 82658 - DNA, 25 bp, mus musculus
tgtcttcgacactacgttgcaagtc

SEQ ID NO: 82659 - DNA, 25 bp, mus musculus
gtcttcgacactacgttgcaagtca

SEQ ID NO: 82660 - DNA, 25 bp, mus musculus
ttcgacactacgttgcaagtcaaaa

SEQ ID NO: 82661 - DNA, 25 bp, mus musculus
tcgacactacgttgcaagtcaaaaa

SEQ ID NO: 82662 - DNA, 25 bp, mus musculus
gacactacgttgcaagtcaaaaagg

SEQ ID NO: 82663 - DNA, 25 bp, mus musculus
gccttctttgccttggtagccaacg

SEQ ID NO: 82664 - DNA, 25 bp, mus musculus
tgccttggtagccaacggagtccgt

SEQ ID NO: 82665 - DNA, 25 bp, mus musculus
ttggtagccaacggagtccgtgcag

SEQ ID NO: 82666 - DNA, 25 bp, mus musculus
tagccaacggagtccgtgcagcgcc

SEQ ID NO: 82667 - DNA, 25 bp, mus musculus
aggaatgctcacgattacagatttc

SEQ ID NO: 82668 - DNA, 25 bp, mus musculus
caaccagttcaaagcttgttgtctt

SEQ ID NO: 82669 - DNA, 25 bp, mus musculus
ggaatgctcacgattacagatttca

SEQ ID NO: 82670 - DNA, 25 bp, mus musculus
tcaaagcttgttgtcttcgacacta

SEQ ID NO: 82671 - DNA, 25 bp, mus musculus
aaagcttgttgtcttcgacactacg

SEQ ID NO: 82672 - DNA, 25 bp, mus musculus
aagcttgttgtcttcgacactacgt

SEQ ID NO: 82673 - DNA, 25 bp, mus musculus
cttgttgtcttcgacactacgttgc

SEQ ID NO: 82674 - DNA, 25 bp, mus musculus
ttgttgtcttcgacactacgttgca

SEQ ID NO: 82675 - DNA, 25 bp, mus musculus
tgttgtcttcgacactacgttgcaa

SEQ ID NO: 82676 - DNA, 25 bp, mus musculus
ttgtcttcgacactacgttgcaagt

SEQ ID NO: 82677 - DNA, 25 bp, mus musculus
cactatctttttaagctacaagaga

SEQ ID NO: 82678 - DNA, 25 bp, mus musculus
attgtagcacactgacctgaaggca

SEQ ID NO: 82679 - DNA, 25 bp, mus musculus
ggtagccacagtttgggtgcaatta

SEQ ID NO: 82680 - DNA, 25 bp, mus musculus
agccacagtttgggtgcaattagag

SEQ ID NO: 82681 - DNA, 25 bp, mus musculus
atgatgttccaggtattgtggacca

SEQ ID NO: 82682 - DNA, 25 bp, mus musculus
atgttccaggtattgtggaccatga

SEQ ID NO: 82683 - DNA, 25 bp, mus musculus
ggcattggtttcctttgtcatagtt

SEQ ID NO: 82684 - DNA, 25 bp, mus musculus
ggtttcctttgtcatagttgccgtg

SEQ ID NO: 82685 - DNA, 25 bp, mus musculus
tgtcatagttgccgtggtgattagg

SEQ ID NO: 82686 - DNA, 25 bp, mus musculus
tttactgtgtttattggtagaagtg

SEQ ID NO: 82687 - DNA, 25 bp, mus musculus
atgaactaacactacattttcagtc

SEQ ID NO: 82688 - DNA, 25 bp, mus musculus
agtctcctgtcatttttaggatata

SEQ ID NO: 82689 - DNA, 25 bp, mus musculus
tgacctgaaggcattgtcctgttat

SEQ ID NO: 82690 - DNA, 25 bp, mus musculus
attgtcctgttatagtgtcacatta

SEQ ID NO: 82691 - DNA, 25 bp, mus musculus
tcctgtagcttctgccctctactgg

SEQ ID NO: 82692 - DNA, 25 bp, mus musculus
tgtagcttctgccctctactggttg

SEQ ID NO: 82693 - DNA, 25 bp, mus musculus
tgccctctactggttgtcaccatac

SEQ ID NO: 82694 - DNA, 25 bp, mus musculus
ctggttgtcaccataccagcatacg

SEQ ID NO: 82695 - DNA, 25 bp, mus musculus
gtcaccataccagcatacggtagcc

SEQ ID NO: 82696 - DNA, 25 bp, mus musculus
ataccagcatacggtagccacagtt

SEQ ID NO: 82697 - DNA, 25 bp, mus musculus
tgcaatgcatgcggtctctacagca

SEQ ID NO: 82698 - DNA, 25 bp, mus musculus
gcatgcggtctctacagcaagatga

SEQ ID NO: 82699 - DNA, 25 bp, mus musculus
tatatgaaactccatggggtgcctc

SEQ ID NO: 82700 - DNA, 25 bp, mus musculus
agtggctctgtccctatgactccta

SEQ ID NO: 82701 - DNA, 25 bp, mus musculus
cctatgactcctacttcctcttctt

SEQ ID NO: 82702 - DNA, 25 bp, mus musculus
tcagatgactgcaccaaaaatactt

SEQ ID NO: 82703 - DNA, 25 bp, mus musculus
gactgcaccaaaaatacttctcctt

SEQ ID NO: 82704 - DNA, 25 bp, mus musculus
gcagtgatgtctgcagtgggagaaa

SEQ ID NO: 82705 - DNA, 25 bp, mus musculus
tattcaggtcaagacggcctctaca

SEQ ID NO: 82706 - DNA, 25 bp, mus musculus
ggtcaagacggcctctacataggtg

SEQ ID NO: 82707 - DNA, 25 bp, mus musculus
gacggcctctacataggtgtcagtc

SEQ ID NO: 82708 - DNA, 25 bp, mus musculus
aggattcttggtgtgctctggccct

SEQ ID NO: 82709 - DNA, 25 bp, mus musculus
ggtctctacagcaagatgaatgcgc

SEQ ID NO: 82710 - DNA, 25 bp, mus musculus
ttggtgtgctctggccctggcctga

SEQ ID NO: 82711 - DNA, 25 bp, mus musculus
aatgcgctcagcaggcccctcatca

SEQ ID NO: 82712 - DNA, 25 bp, mus musculus
aagccacagaagcgcgtgccttcat

SEQ ID NO: 82713 - DNA, 25 bp, mus musculus
cagaagcgcgtgccttcatcacggc

SEQ ID NO: 82714 - DNA, 25 bp, mus musculus
ggactgtcctgtgccaactgtcaca

SEQ ID NO: 82715 - DNA, 25 bp, mus musculus
tcctgtgccaactgtcacaccacaa

SEQ ID NO: 82716 - DNA, 25 bp, mus musculus
accactaccttatggcgtagaaatg

SEQ ID NO: 82717 - DNA, 25 bp, mus musculus
tgcaatgcttgcgggctctatatga

SEQ ID NO: 82718 - DNA, 25 bp, mus musculus
gaaatcctatttctcactttctctt

SEQ ID NO: 82719 - DNA, 25 bp, mus musculus
accgccggtgaatggtggctttgca

SEQ ID NO: 82720 - DNA, 25 bp, mus musculus
ctgctcctccatactttgagtctga

SEQ ID NO: 82721 - DNA, 25 bp, mus musculus
tcctccatactttgagtctgagggg

SEQ ID NO: 82722 - DNA, 25 bp, mus musculus
ctccatactttgagtctgaggggcc

SEQ ID NO: 82723 - DNA, 25 bp, mus musculus
ccatactttgagtctgaggggcctg

SEQ ID NO: 82724 - DNA, 25 bp, mus musculus
atactttgagtctgaggggcctggc

SEQ ID NO: 82725 - DNA, 25 bp, mus musculus
ccctgagccgggcgccaagtcattg

SEQ ID NO: 82726 - DNA, 25 bp, mus musculus
cattgagcatttgcccacggatcac

SEQ ID NO: 82727 - DNA, 25 bp, mus musculus
ttgagcatttgcccacggatcactc

SEQ ID NO: 82728 - DNA, 25 bp, mus musculus
gagcatttgcccacggatcactctc

SEQ ID NO: 82729 - DNA, 25 bp, mus musculus
gacctggaggctgggccatcaggac

SEQ ID NO: 82730 - DNA, 25 bp, mus musculus
aatggtggctttgcaggaagacaaa

SEQ ID NO: 82731 - DNA, 25 bp, mus musculus
gaagacaaatccacctgcgagttgg

SEQ ID NO: 82732 - DNA, 25 bp, mus musculus
cccctggtggctcaatgtcagcttg

SEQ ID NO: 82733 - DNA, 25 bp, mus musculus
gtggctcaatgtcagcttgtctagg

SEQ ID NO: 82734 - DNA, 25 bp, mus musculus
ggctcaatgtcagcttgtctaggaa

SEQ ID NO: 82735 - DNA, 25 bp, mus musculus
ctcaatgtcagcttgtctaggaagg

SEQ ID NO: 82736 - DNA, 25 bp, mus musculus
caatgtcagcttgtctaggaaggtg

SEQ ID NO: 82737 - DNA, 25 bp, mus musculus
gtcagcttgtctaggaaggtgcgcg

SEQ ID NO: 82738 - DNA, 25 bp, mus musculus
gcatgctagagccaccttttaagcc

SEQ ID NO: 82739 - DNA, 25 bp, mus musculus
catgctagagccaccttttaagcct

SEQ ID NO: 82740 - DNA, 25 bp, mus musculus
gcccacagaccaagacttctaccag

SEQ ID NO: 82741 - DNA, 25 bp, mus musculus
cagaccaagacttctaccagaagtt

SEQ ID NO: 82742 - DNA, 25 bp, mus musculus
agacttctaccagaagtttgccaca

SEQ ID NO: 82743 - DNA, 25 bp, mus musculus
gtttgccacaggcagtgtgtccatc

SEQ ID NO: 82744 - DNA, 25 bp, mus musculus
ttgccacaggcagtgtgtccatccc

SEQ ID NO: 82745 - DNA, 25 bp, mus musculus
catcccctggcagaatgagatggtg

SEQ ID NO: 82746 - DNA, 25 bp, mus musculus
tggagaccgagtgcttccaggaact

SEQ ID NO: 82747 - DNA, 25 bp, mus musculus
tgttcccccagacctggactggaag

SEQ ID NO: 82748 - DNA, 25 bp, mus musculus
cccagacctggactggaagggccag

SEQ ID NO: 82749 - DNA, 25 bp, mus musculus
cagacctggactggaagggccagcc

SEQ ID NO: 82750 - DNA, 25 bp, mus musculus
tgctagagccaccttttaagcctga

SEQ ID NO: 82751 - DNA, 25 bp, mus musculus
gctagagccaccttttaagcctgat

SEQ ID NO: 82752 - DNA, 25 bp, mus musculus
cttttaagcctgatccccaggctat

SEQ ID NO: 82753 - DNA, 25 bp, mus musculus
tccccaggctatttattgcaaggat

SEQ ID NO: 82754 - DNA, 25 bp, mus musculus
atctggagcccacagaccaagactt

SEQ ID NO: 82755 - DNA, 25 bp, mus musculus
tggagcccacagaccaagacttcta

SEQ ID NO: 82756 - DNA, 25 bp, mus musculus
ggagcccacagaccaagacttctac

SEQ ID NO: 82757 - DNA, 25 bp, mus musculus
agcccacagaccaagacttctacca

SEQ ID NO: 82758 - DNA, 25 bp, mus musculus
cgccatgctggcccggagaagaaaa

SEQ ID NO: 82759 - DNA, 25 bp, mus musculus
ccccaaagacgagtcagccagtcag

SEQ ID NO: 82760 - DNA, 25 bp, mus musculus
ttctccttgactacagggacccaga

SEQ ID NO: 82761 - DNA, 25 bp, mus musculus
cagaagacccatttcttctttctgt

SEQ ID NO: 82762 - DNA, 25 bp, mus musculus
ttctttctgtacttcctgcctggca

SEQ ID NO: 82763 - DNA, 25 bp, mus musculus
tacttcctgcctggcacctgctttc

SEQ ID NO: 82764 - DNA, 25 bp, mus musculus
tttccctgcctctacttgaccaaga

SEQ ID NO: 82765 - DNA, 25 bp, mus musculus
ccctgcctctacttgaccaagagtt

SEQ ID NO: 82766 - DNA, 25 bp, mus musculus
ccagctcccacttggaagattccac

SEQ ID NO: 82767 - DNA, 25 bp, mus musculus
gctcccacttggaagattccacgtg

SEQ ID NO: 82768 - DNA, 25 bp, mus musculus
atggtcacacccacgctggctgctg

SEQ ID NO: 82769 - DNA, 25 bp, mus musculus
cccacgctggctgctgattggataa

SEQ ID NO: 82770 - DNA, 25 bp, mus musculus
agacgagtcagccagtcaggaggag

SEQ ID NO: 82771 - DNA, 25 bp, mus musculus
gaacagcacaaccttgccaaggatg

SEQ ID NO: 82772 - DNA, 25 bp, mus musculus
cagcacaaccttgccaaggatgaag

SEQ ID NO: 82773 - DNA, 25 bp, mus musculus
cacaaccttgccaaggatgaagtcg

SEQ ID NO: 82774 - DNA, 25 bp, mus musculus
ctgctccagtgatgactccgacttg

SEQ ID NO: 82775 - DNA, 25 bp, mus musculus
cagtgatgactccgacttggagagg

SEQ ID NO: 82776 - DNA, 25 bp, mus musculus
aatcatcgaagtctttgtccaggag

SEQ ID NO: 82777 - DNA, 25 bp, mus musculus
catcgaagtctttgtccaggagctg

SEQ ID NO: 82778 - DNA, 25 bp, mus musculus
ctgtgccaacgcgtttgctgtcacg

SEQ ID NO: 82779 - DNA, 25 bp, mus musculus
tgccaacgcgtttgctgtcacgtgc

SEQ ID NO: 82780 - DNA, 25 bp, mus musculus
ggaggacctgcaccactaccgcaac

SEQ ID NO: 82781 - DNA, 25 bp, mus musculus
ctaccgcaacctcagcgagttcttc

SEQ ID NO: 82782 - DNA, 25 bp, mus musculus
cagcgagttcttccggcgtaacgtg

SEQ ID NO: 82783 - DNA, 25 bp, mus musculus
cttccggcgtaacgtgaagcctcag

SEQ ID NO: 82784 - DNA, 25 bp, mus musculus
gaagcctcaggcacggcccgtatgt

SEQ ID NO: 82785 - DNA, 25 bp, mus musculus
acggcccgtatgtggcttgcactgt

SEQ ID NO: 82786 - DNA, 25 bp, mus musculus
cttgcactgtgtgaccagcccatca

SEQ ID NO: 82787 - DNA, 25 bp, mus musculus
ctgtgtgaccagcccatcagatggc

SEQ ID NO: 82788 - DNA, 25 bp, mus musculus
tgtgaccagcccatcagatggcaag

SEQ ID NO: 82789 - DNA, 25 bp, mus musculus
gaccagcccatcagatggcaagatc

SEQ ID NO: 82790 - DNA, 25 bp, mus musculus
cgcgtttgctgtcacgtgcctgtgg

SEQ ID NO: 82791 - DNA, 25 bp, mus musculus
cctgtggtcgcctcaaccaagtaga

SEQ ID NO: 82792 - DNA, 25 bp, mus musculus
tcaaccaagtagaacttccttactg

SEQ ID NO: 82793 - DNA, 25 bp, mus musculus
tagaacttccttactggctccggag

SEQ ID NO: 82794 - DNA, 25 bp, mus musculus
ggagccagtctacagcctgtatatc

SEQ ID NO: 82795 - DNA, 25 bp, mus musculus
agtctacagcctgtatatctggacc

SEQ ID NO: 82796 - DNA, 25 bp, mus musculus
cctgtatatctggacctttggggtg

SEQ ID NO: 82797 - DNA, 25 bp, mus musculus
ctggacctttggggtgaacatgact

SEQ ID NO: 82798 - DNA, 25 bp, mus musculus
tggcgtgtaactcgccacagtcacc

SEQ ID NO: 82799 - DNA, 25 bp, mus musculus
cgtgtaactcgccacagtcaccagc

SEQ ID NO: 82800 - DNA, 25 bp, mus musculus
agatgggctactttctcttgctcag

SEQ ID NO: 82801 - DNA, 25 bp, mus musculus
tcttgctcagttttgggactacagt

SEQ ID NO: 82802 - DNA, 25 bp, mus musculus
ggactacagtgttgtgctggtttag

SEQ ID NO: 82803 - DNA, 25 bp, mus musculus
ctacagtgttgtgctggtttagaaa

SEQ ID NO: 82804 - DNA, 25 bp, mus musculus
ttgcgcaactgtggacactatcaat

SEQ ID NO: 82805 - DNA, 25 bp, mus musculus
cgcaactgtggacactatcaatggt

SEQ ID NO: 82806 - DNA, 25 bp, mus musculus
aactgtggacactatcaatggtgcc

SEQ ID NO: 82807 - DNA, 25 bp, mus musculus
cttgaaatctatgacctcaactttt

SEQ ID NO: 82808 - DNA, 25 bp, mus musculus
atctatgacctcaacttttcaaaag

SEQ ID NO: 82809 - DNA, 25 bp, mus musculus
tatgacctcaacttttcaaaagact

SEQ ID NO: 82810 - DNA, 25 bp, mus musculus
actcgccacagtcaccagcggtgtg

SEQ ID NO: 82811 - DNA, 25 bp, mus musculus
ccgcgtccagctacctggagaactc

SEQ ID NO: 82812 - DNA, 25 bp, mus musculus
cgtccagctacctggagaactcggc

SEQ ID NO: 82813 - DNA, 25 bp, mus musculus
gctacctggagaactcggcttcctg

SEQ ID NO: 82814 - DNA, 25 bp, mus musculus
ggtacccaagcgcagccagctcaat

SEQ ID NO: 82815 - DNA, 25 bp, mus musculus
acccaagcgcagccagctcaatcaa

SEQ ID NO: 82816 - DNA, 25 bp, mus musculus
caagcgcagccagctcaatcaattc

SEQ ID NO: 82817 - DNA, 25 bp, mus musculus
tggcctccgggacgctttattagat

SEQ ID NO: 82818 - DNA, 25 bp, mus musculus
aggctttaaaccatcgctttcagca

SEQ ID NO: 82819 - DNA, 25 bp, mus musculus
taaaccatcgctttcagcagactca

SEQ ID NO: 82820 - DNA, 25 bp, mus musculus
ccaacagctacatgccggggtattc

SEQ ID NO: 82821 - DNA, 25 bp, mus musculus
ggtattcacactggtattcctcacc

SEQ ID NO: 82822 - DNA, 25 bp, mus musculus
ccatgcagagaccacagatgatgtg

SEQ ID NO: 82823 - DNA, 25 bp, mus musculus
gacttctctgagtgaacgcctacgg

SEQ ID NO: 82824 - DNA, 25 bp, mus musculus
tctgagtgaacgcctacggagcttc

SEQ ID NO: 82825 - DNA, 25 bp, mus musculus
tgaacgcctacggagcttctgaagg

SEQ ID NO: 82826 - DNA, 25 bp, mus musculus
cctacggagcttctgaaggagacat

SEQ ID NO: 82827 - DNA, 25 bp, mus musculus
gagacattctccaccggcagaagaa

SEQ ID NO: 82828 - DNA, 25 bp, mus musculus
ttctccaccggcagaagaatctgca

SEQ ID NO: 82829 - DNA, 25 bp, mus musculus
atctgcacaaacatggcagcatttt

SEQ ID NO: 82830 - DNA, 25 bp, mus musculus
atcgctttcagcagactcaatacct

SEQ ID NO: 82831 - DNA, 25 bp, mus musculus
tggctgcttccttaggactgacaca

SEQ ID NO: 82832 - DNA, 25 bp, mus musculus
cttccttaggactgacacaaacaca

SEQ ID NO: 82833 - DNA, 25 bp, mus musculus
ctccagtgtgggacgtttctgcctc

SEQ ID NO: 82834 - DNA, 25 bp, mus musculus
acgtttctgcctctgccaagggcgt

SEQ ID NO: 82835 - DNA, 25 bp, mus musculus
ctgccaagggcgtcagtatgcctcc

SEQ ID NO: 82836 - DNA, 25 bp, mus musculus
tcagtatgcctcccaacagctacat

SEQ ID NO: 82837 - DNA, 25 bp, mus musculus
tgcctcccaacagctacatgccggg

SEQ ID NO: 82838 - DNA, 25 bp, mus musculus
ctactcagctgcatttctggaccta

SEQ ID NO: 82839 - DNA, 25 bp, mus musculus
agctgcatttctggacctacagcct

SEQ ID NO: 82840 - DNA, 25 bp, mus musculus
ggcagctctgagtccagctggggcc

SEQ ID NO: 82841 - DNA, 25 bp, mus musculus
tctgagtccagctggggcctgcttc

SEQ ID NO: 82842 - DNA, 25 bp, mus musculus
agctctcaccttagtgcgaatggag

SEQ ID NO: 82843 - DNA, 25 bp, mus musculus
tcctgggggccttgttactagtgca

SEQ ID NO: 82844 - DNA, 25 bp, mus musculus
tgttactagtgcaagccatgccaat

SEQ ID NO: 82845 - DNA, 25 bp, mus musculus
tactagtgcaagccatgccaatttg

SEQ ID NO: 82846 - DNA, 25 bp, mus musculus
tagtgcaagccatgccaatttgttc

SEQ ID NO: 82847 - DNA, 25 bp, mus musculus
tgcaagccatgccaatttgttctca

SEQ ID NO: 82848 - DNA, 25 bp, mus musculus
tgccaatttgttctcaggatcagag

SEQ ID NO: 82849 - DNA, 25 bp, mus musculus
tttgttctcaggatcagagtatttt

SEQ ID NO: 82850 - DNA, 25 bp, mus musculus
atttctggacctacagcctggacca

SEQ ID NO: 82851 - DNA, 25 bp, mus musculus
atccaagccaatgtactgagcctcg

SEQ ID NO: 82852 - DNA, 25 bp, mus musculus
gtaaccctatgccatcttcccttga

SEQ ID NO: 82853 - DNA, 25 bp, mus musculus
ctggtagcatccgcattgaagtggt

SEQ ID NO: 82854 - DNA, 25 bp, mus musculus
cccaccaaatggctggcttgggcct

SEQ ID NO: 82855 - DNA, 25 bp, mus musculus
aaatggctggcttgggcctctcttc

SEQ ID NO: 82856 - DNA, 25 bp, mus musculus
tttagttcacaccttgatttcactc

SEQ ID NO: 82857 - DNA, 25 bp, mus musculus
aagctcaggcaaggcagctctgagt

SEQ ID NO: 82858 - DNA, 25 bp, mus musculus
tccgcaagcccttcagtgacatcat

SEQ ID NO: 82859 - DNA, 25 bp, mus musculus
agctcgatgacagtgacctggcgct

SEQ ID NO: 82860 - DNA, 25 bp, mus musculus
ccattctgcgggctctagaattcca

SEQ ID NO: 82861 - DNA, 25 bp, mus musculus
ctctagaattccatctgcaggtcaa

SEQ ID NO: 82862 - DNA, 25 bp, mus musculus
tccccaagctgctgcagaagatggc

SEQ ID NO: 82863 - DNA, 25 bp, mus musculus
agatggcagacctgcggcagctggt

SEQ ID NO: 82864 - DNA, 25 bp, mus musculus
cagacctgcggcagctggtcactga

SEQ ID NO: 82865 - DNA, 25 bp, mus musculus
tcactgagcatgcccagatgatgca

SEQ ID NO: 82866 - DNA, 25 bp, mus musculus
gccacggactgttcagaggaccagc

SEQ ID NO: 82867 - DNA, 25 bp, mus musculus
gaccagccacaggcactggcagtca

SEQ ID NO: 82868 - DNA, 25 bp, mus musculus
ccacaggcactggcagtcaagcagc

SEQ ID NO: 82869 - DNA, 25 bp, mus musculus
ctagagcctactcacaacactccag

SEQ ID NO: 82870 - DNA, 25 bp, mus musculus
tcgcggccatcattctgtgtggaga

SEQ ID NO: 82871 - DNA, 25 bp, mus musculus
ccatcattctgtgtggagaccggcc

SEQ ID NO: 82872 - DNA, 25 bp, mus musculus
accggccaggcctcatgaatgtgcc

SEQ ID NO: 82873 - DNA, 25 bp, mus musculus
caggcctcatgaatgtgccccaggt

SEQ ID NO: 82874 - DNA, 25 bp, mus musculus
atgtgccccaggtagaagccatcca

SEQ ID NO: 82875 - DNA, 25 bp, mus musculus
tagaagccatccaggacaccattct

SEQ ID NO: 82876 - DNA, 25 bp, mus musculus
ccatccaggacaccattctgcgggc

SEQ ID NO: 82877 - DNA, 25 bp, mus musculus
aggacaccattctgcgggctctaga

SEQ ID NO: 82878 - DNA, 25 bp, mus musculus
cagattatctccttatgtaaaggta

SEQ ID NO: 82879 - DNA, 25 bp, mus musculus
tcctcacaaaattactatcaggtct

SEQ ID NO: 82880 - DNA, 25 bp, mus musculus
agttctctgctcattaatcttcaga

SEQ ID NO: 82881 - DNA, 25 bp, mus musculus
ctgctcattaatcttcagaccacag

SEQ ID NO: 82882 - DNA, 25 bp, mus musculus
ctcattaatcttcagaccacagtta

SEQ ID NO: 82883 - DNA, 25 bp, mus musculus
attaatcttcagaccacagttacta

SEQ ID NO: 82884 - DNA, 25 bp, mus musculus
cttcagaccacagttactaaaactg

SEQ ID NO: 82885 - DNA, 25 bp, mus musculus
cagaccacagttactaaaactgtgg

SEQ ID NO: 82886 - DNA, 25 bp, mus musculus
tgctattctaagagcatcagggctc

SEQ ID NO: 82887 - DNA, 25 bp, mus musculus
tattctaagagcatcagggctctga

SEQ ID NO: 82888 - DNA, 25 bp, mus musculus
ttttctgcaaattctctagtataga

SEQ ID NO: 82889 - DNA, 25 bp, mus musculus
gaatcctctaaacatttttgtatct

SEQ ID NO: 82890 - DNA, 25 bp, mus musculus
tactatcaggtctgccataaattct

SEQ ID NO: 82891 - DNA, 25 bp, mus musculus
tatcaggtctgccataaattcttcc

SEQ ID NO: 82892 - DNA, 25 bp, mus musculus
caggtctgccataaattcttcctaa

SEQ ID NO: 82893 - DNA, 25 bp, mus musculus
tgccataaattcttcctaagttctc

SEQ ID NO: 82894 - DNA, 25 bp, mus musculus
cataaattcttcctaagttctctgc

SEQ ID NO: 82895 - DNA, 25 bp, mus musculus
aaattcttcctaagttctctgctca

SEQ ID NO: 82896 - DNA, 25 bp, mus musculus
ttcctaagttctctgctcattaatc

SEQ ID NO: 82897 - DNA, 25 bp, mus musculus
ctaagttctctgctcattaatcttc

SEQ ID NO: 82898 - DNA, 25 bp, mus musculus
actgaagtcctcaaaaacatccaga

SEQ ID NO: 82899 - DNA, 25 bp, mus musculus
ctgaagtcctcaaaaacatccagaa

SEQ ID NO: 82900 - DNA, 25 bp, mus musculus
cctgcccgagttgtatggacaaggt

SEQ ID NO: 82901 - DNA, 25 bp, mus musculus
ctgcccgagttgtatggacaaggtc

SEQ ID NO: 82902 - DNA, 25 bp, mus musculus
tgtgtcctcagatagagaggctttg

SEQ ID NO: 82903 - DNA, 25 bp, mus musculus
agaggctttgtgggtgctattcact

SEQ ID NO: 82904 - DNA, 25 bp, mus musculus
tgggtgctattcactcctcagtggg

SEQ ID NO: 82905 - DNA, 25 bp, mus musculus
gggtgctattcactcctcagtgggt

SEQ ID NO: 82906 - DNA, 25 bp, mus musculus
ttcactcctcagtgggtaaacagga

SEQ ID NO: 82907 - DNA, 25 bp, mus musculus
tcactcctcagtgggtaaacaggat

SEQ ID NO: 82908 - DNA, 25 bp, mus musculus
cactcctcagtgggtaaacaggatg

SEQ ID NO: 82909 - DNA, 25 bp, mus musculus
actcctcagtgggtaaacaggatga

SEQ ID NO: 82910 - DNA, 25 bp, mus musculus
tgaagtcctcaaaaacatccagaaa

SEQ ID NO: 82911 - DNA, 25 bp, mus musculus
aactgacaagtatgcccgggctgaa

SEQ ID NO: 82912 - DNA, 25 bp, mus musculus
actgacaagtatgcccgggctgaac

SEQ ID NO: 82913 - DNA, 25 bp, mus musculus
actgaaacctgcccgagttgtatgg

SEQ ID NO: 82914 - DNA, 25 bp, mus musculus
ctgaaacctgcccgagttgtatgga

SEQ ID NO: 82915 - DNA, 25 bp, mus musculus
tgaaacctgcccgagttgtatggac

SEQ ID NO: 82916 - DNA, 25 bp, mus musculus
aacctgcccgagttgtatggacaag

SEQ ID NO: 82917 - DNA, 25 bp, mus musculus
acctgcccgagttgtatggacaagg

SEQ ID NO: 82918 - DNA, 25 bp, mus musculus
ttttgcacaaagcagtcatctccga

SEQ ID NO: 82919 - DNA, 25 bp, mus musculus
ttgcacaaagcagtcatctccgaat

SEQ ID NO: 82920 - DNA, 25 bp, mus musculus
agcagtggtctccaatgccataaaa

SEQ ID NO: 82921 - DNA, 25 bp, mus musculus
gtggtctccaatgccataaaagata

SEQ ID NO: 82922 - DNA, 25 bp, mus musculus
ggtctccaatgccataaaagataaa

SEQ ID NO: 82923 - DNA, 25 bp, mus musculus
gggagcccccatatgattgtaccca

SEQ ID NO: 82924 - DNA, 25 bp, mus musculus
gagcccccatatgattgtacccagg

SEQ ID NO: 82925 - DNA, 25 bp, mus musculus
gcccccatatgattgtacccagggt

SEQ ID NO: 82926 - DNA, 25 bp, mus musculus
ccccatatgattgtacccagggtgg

SEQ ID NO: 82927 - DNA, 25 bp, mus musculus
ccatatgattgtacccagggtggta

SEQ ID NO: 82928 - DNA, 25 bp, mus musculus
ccccagctgaaaaacccaggatgtg

SEQ ID NO: 82929 - DNA, 25 bp, mus musculus
ctgaaaaacccaggatgtgtcccat

SEQ ID NO: 82930 - DNA, 25 bp, mus musculus
gcacaaagcagtcatctccgaatac

SEQ ID NO: 82931 - DNA, 25 bp, mus musculus
aacccaggatgtgtcccatgtgtgg

SEQ ID NO: 82932 - DNA, 25 bp, mus musculus
aaagcagtcatctccgaatacataa

SEQ ID NO: 82933 - DNA, 25 bp, mus musculus
agcagtcatctccgaatacataagc

SEQ ID NO: 82934 - DNA, 25 bp, mus musculus
cagtcatctccgaatacataagcaa

SEQ ID NO: 82935 - DNA, 25 bp, mus musculus
gtcatctccgaatacataagcaaac

SEQ ID NO: 82936 - DNA, 25 bp, mus musculus
catctccgaatacataagcaaacac

SEQ ID NO: 82937 - DNA, 25 bp, mus musculus
tctccgaatacataagcaaacacat

SEQ ID NO: 82938 - DNA, 25 bp, mus musculus
atggtaaagcctttgcaggaagcag

SEQ ID NO: 82939 - DNA, 25 bp, mus musculus
ctgtgccgtatgtcttccggtactt

SEQ ID NO: 82940 - DNA, 25 bp, mus musculus
atgtcttccggtacttcgtagctga

SEQ ID NO: 82941 - DNA, 25 bp, mus musculus
caagacttctgagtctctgtaacca

SEQ ID NO: 82942 - DNA, 25 bp, mus musculus
gacttctgagtctctgtaaccatct

SEQ ID NO: 82943 - DNA, 25 bp, mus musculus
gtctctgtaaccatctgaagttggt

SEQ ID NO: 82944 - DNA, 25 bp, mus musculus
tctgtaaccatctgaagttggtttt

SEQ ID NO: 82945 - DNA, 25 bp, mus musculus
gtaaccatctgaagttggttttcat

SEQ ID NO: 82946 - DNA, 25 bp, mus musculus
tctttctgggcccaggttcactgct

SEQ ID NO: 82947 - DNA, 25 bp, mus musculus
ttctgggcccaggttcactgctccc

SEQ ID NO: 82948 - DNA, 25 bp, mus musculus
tgctccctgctttcagtagcagagg

SEQ ID NO: 82949 - DNA, 25 bp, mus musculus
ctgctttcagtagcagagggtgtct

SEQ ID NO: 82950 - DNA, 25 bp, mus musculus
tgttatccagagcaggccagtacaa

SEQ ID NO: 82951 - DNA, 25 bp, mus musculus
tcttccggtacttcgtagctgagct

SEQ ID NO: 82952 - DNA, 25 bp, mus musculus
ggtacttcgtagctgagctggcagc

SEQ ID NO: 82953 - DNA, 25 bp, mus musculus
agctggcagccatgaacatcaaagt

SEQ ID NO: 82954 - DNA, 25 bp, mus musculus
cccgccatctgagctaggagataag

SEQ ID NO: 82955 - DNA, 25 bp, mus musculus
taagcacaggaggtgtcctgtataa

SEQ ID NO: 82956 - DNA, 25 bp, mus musculus
gtgtcctgtataacacaagtgaggg

SEQ ID NO: 82957 - DNA, 25 bp, mus musculus
ttatgggctcactctgggtctatac

SEQ ID NO: 82958 - DNA, 25 bp, mus musculus
gctcactctgggtctatacaagaat

SEQ ID NO: 82959 - DNA, 25 bp, mus musculus
ctgaaggccttttctcatctctggg

SEQ ID NO: 82960 - DNA, 25 bp, mus musculus
actccttgcagacttttgtgccaca

SEQ ID NO: 82961 - DNA, 25 bp, mus musculus
gctacttactggcctggtctggctg

SEQ ID NO: 82962 - DNA, 25 bp, mus musculus
tactggcctggtctggctgaacact

SEQ ID NO: 82963 - DNA, 25 bp, mus musculus
ctggctgaacactgccttatggcca

SEQ ID NO: 82964 - DNA, 25 bp, mus musculus
tgccttatggccaggatagtgtttc

SEQ ID NO: 82965 - DNA, 25 bp, mus musculus
gtgtttcactgttaccagaataagc

SEQ ID NO: 82966 - DNA, 25 bp, mus musculus
cccatctcaaggggataggtcatgg

SEQ ID NO: 82967 - DNA, 25 bp, mus musculus
gtcatggctgctcacttcctggatg

SEQ ID NO: 82968 - DNA, 25 bp, mus musculus
cacttcctggatgcagggcagtacc

SEQ ID NO: 82969 - DNA, 25 bp, mus musculus
gcagcacaccctgctggcaacaatt

SEQ ID NO: 82970 - DNA, 25 bp, mus musculus
caccctgctggcaacaattaaagca

SEQ ID NO: 82971 - DNA, 25 bp, mus musculus
cttttgtgccacagcctggcctgga

SEQ ID NO: 82972 - DNA, 25 bp, mus musculus
ccctcaaggcgcttcgtgactttgc

SEQ ID NO: 82973 - DNA, 25 bp, mus musculus
cccgctttgttcagactgtctgtga

SEQ ID NO: 82974 - DNA, 25 bp, mus musculus
agactgtctgtgagggagatgactg

SEQ ID NO: 82975 - DNA, 25 bp, mus musculus
atgactgccagccggtgtacactta

SEQ ID NO: 82976 - DNA, 25 bp, mus musculus
acaacaacatcacttgtgctggccc

SEQ ID NO: 82977 - DNA, 25 bp, mus musculus
tcgaccttcgagacatcagtgaaac

SEQ ID NO: 82978 - DNA, 25 bp, mus musculus
gtgaaacactctttgtgcactgctg

SEQ ID NO: 82979 - DNA, 25 bp, mus musculus
tgatctcgtccagttcggcaaccct

SEQ ID NO: 82980 - DNA, 25 bp, mus musculus
gttcggcaaccctgccagttacatt

SEQ ID NO: 82981 - DNA, 25 bp, mus musculus
ttacagccaccgctgccagcattgg

SEQ ID NO: 82982 - DNA, 25 bp, mus musculus
aggctggcctggtgaccatggtgat

SEQ ID NO: 82983 - DNA, 25 bp, mus musculus
aggacgtcaccctgatcattgctgt

SEQ ID NO: 82984 - DNA, 25 bp, mus musculus
tcaccctgatcattgctgttgactg

SEQ ID NO: 82985 - DNA, 25 bp, mus musculus
tggaccggttcaggaccatggtgaa

SEQ ID NO: 82986 - DNA, 25 bp, mus musculus
tggtgaacgtcctgggtgatgcgtt

SEQ ID NO: 82987 - DNA, 25 bp, mus musculus
agaagctctcgaagaaggagctgga

SEQ ID NO: 82988 - DNA, 25 bp, mus musculus
tcaacatcgtgaacccctttgcctt

SEQ ID NO: 82989 - DNA, 25 bp, mus musculus
ccctcgataacgaagactcagatac

SEQ ID NO: 82990 - DNA, 25 bp, mus musculus
agtcttatgtcaatgggggcttcgc

SEQ ID NO: 82991 - DNA, 25 bp, mus musculus
caaccctgccagttacattccgctg

SEQ ID NO: 82992 - DNA, 25 bp, mus musculus
gttcacccagacctcacagttctag

SEQ ID NO: 82993 - DNA, 25 bp, mus musculus
tgcctgttggtgccaccatcaacat

SEQ ID NO: 82994 - DNA, 25 bp, mus musculus
ttggtgccaccatcaacatggacgg

SEQ ID NO: 82995 - DNA, 25 bp, mus musculus
gcactgcgctctacgaagctgtggc

SEQ ID NO: 82996 - DNA, 25 bp, mus musculus
acgaagctgtggcagccgtgtttat

SEQ ID NO: 82997 - DNA, 25 bp, mus musculus
ctgtggcagccgtgtttattgcgca

SEQ ID NO: 82998 - DNA, 25 bp, mus musculus
ttgcgcaactgaatggcttggacct

SEQ ID NO: 82999 - DNA, 25 bp, mus musculus
atggcttggacctaagcattgggca

SEQ ID NO: 83000 - DNA, 25 bp, mus musculus
acgtgtggtccgcagccgagagatc

SEQ ID NO: 83001 - DNA, 25 bp, mus musculus
agagatctttgactcctatattatg

SEQ ID NO: 83002 - DNA, 25 bp, mus musculus
tcccttttcaaagaatgctacggag

SEQ ID NO: 83003 - DNA, 25 bp, mus musculus
tgtccagggccacctgatgaagaag

SEQ ID NO: 83004 - DNA, 25 bp, mus musculus
ccagggccacctgatgaagaagcag

SEQ ID NO: 83005 - DNA, 25 bp, mus musculus
gcaggttgctccagatctcttacag

SEQ ID NO: 83006 - DNA, 25 bp, mus musculus
ggttgctccagatctcttacaggca

SEQ ID NO: 83007 - DNA, 25 bp, mus musculus
tgctccagatctcttacaggcatac

SEQ ID NO: 83008 - DNA, 25 bp, mus musculus
tccagatctcttacaggcatacatt

SEQ ID NO: 83009 - DNA, 25 bp, mus musculus
tctcttacaggcatacattgaggag

SEQ ID NO: 83010 - DNA, 25 bp, mus musculus
cttacaggcatacattgaggagatt

SEQ ID NO: 83011 - DNA, 25 bp, mus musculus
gatttgtcagaacctccgagaggac

SEQ ID NO: 83012 - DNA, 25 bp, mus musculus
gatctttgactcctatattatgaaa

SEQ ID NO: 83013 - DNA, 25 bp, mus musculus
ttgtcagaacctccgagaggacgtg

SEQ ID NO: 83014 - DNA, 25 bp, mus musculus
gaaagaactgctggcctgcacacat

SEQ ID NO: 83015 - DNA, 25 bp, mus musculus
agaactgctggcctgcacacatccc

SEQ ID NO: 83016 - DNA, 25 bp, mus musculus
actgctggcctgcacacatcccttt

SEQ ID NO: 83017 - DNA, 25 bp, mus musculus
gctggcctgcacacatcccttttca

SEQ ID NO: 83018 - DNA, 25 bp, mus musculus
ctgcacacatcccttttcaaagaat

SEQ ID NO: 83019 - DNA, 25 bp, mus musculus
cacacatcccttttcaaagaatgct

SEQ ID NO: 83020 - DNA, 25 bp, mus musculus
acatcccttttcaaagaatgctacg

SEQ ID NO: 83021 - DNA, 25 bp, mus musculus
gctcccacatacgccgatctgtgga

SEQ ID NO: 83022 - DNA, 25 bp, mus musculus
tggaagtccggcagggatgtctata

SEQ ID NO: 83023 - DNA, 25 bp, mus musculus
accaccagagtgaacgggcagccat

SEQ ID NO: 83024 - DNA, 25 bp, mus musculus
ccaccagagtgaacgggcagccatg

SEQ ID NO: 83025 - DNA, 25 bp, mus musculus
tgaacgggcagccatggaaacccga

SEQ ID NO: 83026 - DNA, 25 bp, mus musculus
gcagccatggaaacccgagtacaag

SEQ ID NO: 83027 - DNA, 25 bp, mus musculus
catggaaacccgagtacaagatggc

SEQ ID NO: 83028 - DNA, 25 bp, mus musculus
tggaaacccgagtacaagatggcgc

SEQ ID NO: 83029 - DNA, 25 bp, mus musculus
ggaaacccgagtacaagatggcgct

SEQ ID NO: 83030 - DNA, 25 bp, mus musculus
gaaacccgagtacaagatggcgctg

SEQ ID NO: 83031 - DNA, 25 bp, mus musculus
gtacaagatggcgctgaggtatgag

SEQ ID NO: 83032 - DNA, 25 bp, mus musculus
tacaagatggcgctgaggtatgagg

SEQ ID NO: 83033 - DNA, 25 bp, mus musculus
gaagtccggcagggatgtctatacc

SEQ ID NO: 83034 - DNA, 25 bp, mus musculus
attagacgtaccagcgcaggctctg

SEQ ID NO: 83035 - DNA, 25 bp, mus musculus
ttagacgtaccagcgcaggctctgc

SEQ ID NO: 83036 - DNA, 25 bp, mus musculus
tagacgtaccagcgcaggctctgcc

SEQ ID NO: 83037 - DNA, 25 bp, mus musculus
agacgtaccagcgcaggctctgcca

SEQ ID NO: 83038 - DNA, 25 bp, mus musculus
ggaaaccaccagagtgaacgggcag

SEQ ID NO: 83039 - DNA, 25 bp, mus musculus
gaaaccaccagagtgaacgggcagc

SEQ ID NO: 83040 - DNA, 25 bp, mus musculus
aaccaccagagtgaacgggcagcca

SEQ ID NO: 83041 - DNA, 25 bp, mus musculus
ataggccacagagtactggattcac

SEQ ID NO: 83042 - DNA, 25 bp, mus musculus
gtactggattcacgggcacaatcaa

SEQ ID NO: 83043 - DNA, 25 bp, mus musculus
catctgggaacctcttgatttgaga

SEQ ID NO: 83044 - DNA, 25 bp, mus musculus
ctgggaacctcttgatttgagaggt

SEQ ID NO: 83045 - DNA, 25 bp, mus musculus
cacacaatattctctcatcatgctg

SEQ ID NO: 83046 - DNA, 25 bp, mus musculus
acaatattctctcatcatgctgagg

SEQ ID NO: 83047 - DNA, 25 bp, mus musculus
atattctctcatcatgctgaggctc

SEQ ID NO: 83048 - DNA, 25 bp, mus musculus
ttctctcatcatgctgaggctcctc

SEQ ID NO: 83049 - DNA, 25 bp, mus musculus
tctcatcatgctgaggctcctcagt

SEQ ID NO: 83050 - DNA, 25 bp, mus musculus
catcatgctgaggctcctcagttat

SEQ ID NO: 83051 - DNA, 25 bp, mus musculus
gctgaggctcctcagttatagagat

SEQ ID NO: 83052 - DNA, 25 bp, mus musculus
gaggctcctcagttatagagatgag

SEQ ID NO: 83053 - DNA, 25 bp, mus musculus
ctggattcacgggcacaatcaaaat

SEQ ID NO: 83054 - DNA, 25 bp, mus musculus
gattcacgggcacaatcaaaattcc

SEQ ID NO: 83055 - DNA, 25 bp, mus musculus
ttggtcccagaactttggcagaatc

SEQ ID NO: 83056 - DNA, 25 bp, mus musculus
gtcccagaactttggcagaatcact

SEQ ID NO: 83057 - DNA, 25 bp, mus musculus
cagaatcactgatgtcatctgggaa

SEQ ID NO: 83058 - DNA, 25 bp, mus musculus
aatcactgatgtcatctgggaacct

SEQ ID NO: 83059 - DNA, 25 bp, mus musculus
tgatgtcatctgggaacctcttgat

SEQ ID NO: 83060 - DNA, 25 bp, mus musculus
tgtcatctgggaacctcttgatttg

SEQ ID NO: 83061 - DNA, 25 bp, mus musculus
ccagcacacacagtaagactcagct

SEQ ID NO: 83062 - DNA, 25 bp, mus musculus
ctcagctggaccttgaagcccgcaa

SEQ ID NO: 83063 - DNA, 25 bp, mus musculus
cctataggctctctcggtgtttcat

SEQ ID NO: 83064 - DNA, 25 bp, mus musculus
ctcggtgtttcattctgcatgcata

SEQ ID NO: 83065 - DNA, 25 bp, mus musculus
gtttcattctgcatgcatagagtga

SEQ ID NO: 83066 - DNA, 25 bp, mus musculus
attacaaataggcaacctatggaat

SEQ ID NO: 83067 - DNA, 25 bp, mus musculus
caacctatggaatctgcttctatat

SEQ ID NO: 83068 - DNA, 25 bp, mus musculus
gatctaaatcctctctctttgtttc

SEQ ID NO: 83069 - DNA, 25 bp, mus musculus
ttctaatcatagcccctgtcattga

SEQ ID NO: 83070 - DNA, 25 bp, mus musculus
tcattgaaagcttcaatctgttttc

SEQ ID NO: 83071 - DNA, 25 bp, mus musculus
tcaatctgttttcctttaaagatca

SEQ ID NO: 83072 - DNA, 25 bp, mus musculus
gtatatacattgtctttggaatatt

SEQ ID NO: 83073 - DNA, 25 bp, mus musculus
tggaccttgaagcccgcaagatgcc

SEQ ID NO: 83074 - DNA, 25 bp, mus musculus
tgctgcttgctgaccatgaagacct

SEQ ID NO: 83075 - DNA, 25 bp, mus musculus
ttgctgaccatgaagacctgcatga

SEQ ID NO: 83076 - DNA, 25 bp, mus musculus
tgcatgacctctgtctaagccgctt

SEQ ID NO: 83077 - DNA, 25 bp, mus musculus
gtctaagccgcttttctacaccatg

SEQ ID NO: 83078 - DNA, 25 bp, mus musculus
tttctacaccatggccaatcaccct

SEQ ID NO: 83079 - DNA, 25 bp, mus musculus
caccatggccaatcacccttttgga

SEQ ID NO: 83080 - DNA, 25 bp, mus musculus
aagcgctattttcctataggctctc

SEQ ID NO: 83081 - DNA, 25 bp, mus musculus
tggacaacctttgcaaatactaaat

SEQ ID NO: 83082 - DNA, 25 bp, mus musculus
ttcaaccttggaaaagcttgatgtt

SEQ ID NO: 83083 - DNA, 25 bp, mus musculus
tagtgcctttgacagttgaggacag

SEQ ID NO: 83084 - DNA, 25 bp, mus musculus
attttccactgcctgccatggcttc

SEQ ID NO: 83085 - DNA, 25 bp, mus musculus
ctgccatggcttctatagctgaata

SEQ ID NO: 83086 - DNA, 25 bp, mus musculus
cctttctcctggagctggactcttc

SEQ ID NO: 83087 - DNA, 25 bp, mus musculus
tcctggagctggactcttcatttcc

SEQ ID NO: 83088 - DNA, 25 bp, mus musculus
agctggactcttcatttcctcagga

SEQ ID NO: 83089 - DNA, 25 bp, mus musculus
actcttcatttcctcaggacggact

SEQ ID NO: 83090 - DNA, 25 bp, mus musculus
ctcaggacggactgactggacattg

SEQ ID NO: 83091 - DNA, 25 bp, mus musculus
tgactggacattgttcctgccattg

SEQ ID NO: 83092 - DNA, 25 bp, mus musculus
actcccaatgatttgtataaaggtg

SEQ ID NO: 83093 - DNA, 25 bp, mus musculus
gtcagagttcacccactgagcagtg

SEQ ID NO: 83094 - DNA, 25 bp, mus musculus
ccactgagcagtgagcctcagaaga

SEQ ID NO: 83095 - DNA, 25 bp, mus musculus
gagcctcagaagacctgaaacaaga

SEQ ID NO: 83096 - DNA, 25 bp, mus musculus
agcccttgccccaggaatgctgaat

SEQ ID NO: 83097 - DNA, 25 bp, mus musculus
tgccccaggaatgctgaatcgtctt

SEQ ID NO: 83098 - DNA, 25 bp, mus musculus
tcttggtcatcaacagaggagagaa

SEQ ID NO: 83099 - DNA, 25 bp, mus musculus
agctagcagggctctgacactgtct

SEQ ID NO: 83100 - DNA, 25 bp, mus musculus
tcctctgggcagtagtgcctttgac

SEQ ID NO: 83101 - DNA, 25 bp, mus musculus
actcccaatgtcggagagcaaccgc

SEQ ID NO: 83102 - DNA, 25 bp, mus musculus
cccacagcttcctgcaaaaatgacc

SEQ ID NO: 83103 - DNA, 25 bp, mus musculus
tctcccagatcccacagaagtgacg

SEQ ID NO: 83104 - DNA, 25 bp, mus musculus
agatcccacagaagtgacggagagt

SEQ ID NO: 83105 - DNA, 25 bp, mus musculus
tacagtgactctgatgaggccagtt

SEQ ID NO: 83106 - DNA, 25 bp, mus musculus
gactctgatgaggccagttaggaag

SEQ ID NO: 83107 - DNA, 25 bp, mus musculus
ggcaacagctccctgaaaactgaga

SEQ ID NO: 83108 - DNA, 25 bp, mus musculus
agctccctgaaaactgagacaacca

SEQ ID NO: 83109 - DNA, 25 bp, mus musculus
actgagacaaccaaatgcccttcct

SEQ ID NO: 83110 - DNA, 25 bp, mus musculus
gtgacaaatatccctgcacccttta

SEQ ID NO: 83111 - DNA, 25 bp, mus musculus
tggtctgtggtgatcgttgttagca

SEQ ID NO: 83112 - DNA, 25 bp, mus musculus
gttagcaacgacttgacttcggacg

SEQ ID NO: 83113 - DNA, 25 bp, mus musculus
gcttcctgcaaaaatgaccaccatc

SEQ ID NO: 83114 - DNA, 25 bp, mus musculus
acgacttgacttcggacggctgcag

SEQ ID NO: 83115 - DNA, 25 bp, mus musculus
tgcaaaaatgaccaccatcaccttc

SEQ ID NO: 83116 - DNA, 25 bp, mus musculus
cacttcccagccttcgaggacaggg

SEQ ID NO: 83117 - DNA, 25 bp, mus musculus
gacagggccctaacagcgatgatgg

SEQ ID NO: 83118 - DNA, 25 bp, mus musculus
gccctaacagcgatgatggcacaga

SEQ ID NO: 83119 - DNA, 25 bp, mus musculus
aaggacctgtcgccttcgctgcccg

SEQ ID NO: 83120 - DNA, 25 bp, mus musculus
atcctgcagcctgtacaggaggaca

SEQ ID NO: 83121 - DNA, 25 bp, mus musculus
aacagcaaaacatctcccagatccc

SEQ ID NO: 83122 - DNA, 25 bp, mus musculus
caggctcatgtactgctacatcccc

SEQ ID NO: 83123 - DNA, 25 bp, mus musculus
ctgctacatccccgatgatggatgg

SEQ ID NO: 83124 - DNA, 25 bp, mus musculus
tgtcagctcggcagtgaccccagtc

SEQ ID NO: 83125 - DNA, 25 bp, mus musculus
cacacccatcagataagccatgcca

SEQ ID NO: 83126 - DNA, 25 bp, mus musculus
catcagataagccatgccattacta

SEQ ID NO: 83127 - DNA, 25 bp, mus musculus
ataagccatgccattactaacagtc

SEQ ID NO: 83128 - DNA, 25 bp, mus musculus
catgccattactaacagtctaagcg

SEQ ID NO: 83129 - DNA, 25 bp, mus musculus
ggacctactgacccagcgcagtcat

SEQ ID NO: 83130 - DNA, 25 bp, mus musculus
actgacccagcgcagtcattgacca

SEQ ID NO: 83131 - DNA, 25 bp, mus musculus
ccagcgcagtcattgaccagtgcat

SEQ ID NO: 83132 - DNA, 25 bp, mus musculus
tactgcaggcaagccacgtaacacc

SEQ ID NO: 83133 - DNA, 25 bp, mus musculus
cagtgccagcctggtacagaaccag

SEQ ID NO: 83134 - DNA, 25 bp, mus musculus
catccccgatgatggatggactgat

SEQ ID NO: 83135 - DNA, 25 bp, mus musculus
tgagctctatgacttctatcactat

SEQ ID NO: 83136 - DNA, 25 bp, mus musculus
ctatgacttctatcactatttctac

SEQ ID NO: 83137 - DNA, 25 bp, mus musculus
tcactatttctacatggtgaccaac

SEQ ID NO: 83138 - DNA, 25 bp, mus musculus
tttctacatggtgaccaacacgctc

SEQ ID NO: 83139 - DNA, 25 bp, mus musculus
catggtgaccaacacgctcttctat

SEQ ID NO: 83140 - DNA, 25 bp, mus musculus
gaccaacacgctcttctatgtcagc

SEQ ID NO: 83141 - DNA, 25 bp, mus musculus
cttctatgtcagctcggcagtgacc

SEQ ID NO: 83142 - DNA, 25 bp, mus musculus
gtctcctagttggatctgtcttcag

SEQ ID NO: 83143 - DNA, 25 bp, mus musculus
ctagttggatctgtcttcagcttct

SEQ ID NO: 83144 - DNA, 25 bp, mus musculus
ccccgactactgctgccaagatgat

SEQ ID NO: 83145 - DNA, 25 bp, mus musculus
cgactactgctgccaagatgatgtg

SEQ ID NO: 83146 - DNA, 25 bp, mus musculus
gactactgctgccaagatgatgtgt

SEQ ID NO: 83147 - DNA, 25 bp, mus musculus
ctactgctgccaagatgatgtgtgg

SEQ ID NO: 83148 - DNA, 25 bp, mus musculus
tactgctgccaagatgatgtgtggc

SEQ ID NO: 83149 - DNA, 25 bp, mus musculus
ctgctgccaagatgatgtgtggcgc

SEQ ID NO: 83150 - DNA, 25 bp, mus musculus
tgctgccaagatgatgtgtggcgcg

SEQ ID NO: 83151 - DNA, 25 bp, mus musculus
taaatgcgtgcacttgagggtgttt

SEQ ID NO: 83152 - DNA, 25 bp, mus musculus
aatgcgtgcacttgagggtgtttca

SEQ ID NO: 83153 - DNA, 25 bp, mus musculus
atgcgtgcacttgagggtgtttcaa

SEQ ID NO: 83154 - DNA, 25 bp, mus musculus
gttggatctgtcttcagcttctccg

SEQ ID NO: 83155 - DNA, 25 bp, mus musculus
ttggatctgtcttcagcttctccgt

SEQ ID NO: 83156 - DNA, 25 bp, mus musculus
ggatctgtcttcagcttctccgtgc

SEQ ID NO: 83157 - DNA, 25 bp, mus musculus
gatctgtcttcagcttctccgtgct

SEQ ID NO: 83158 - DNA, 25 bp, mus musculus
tctgtcttcagcttctccgtgctac

SEQ ID NO: 83159 - DNA, 25 bp, mus musculus
tgctaccccgactactgctgccaag

SEQ ID NO: 83160 - DNA, 25 bp, mus musculus
ctaccccgactactgctgccaagat

SEQ ID NO: 83161 - DNA, 25 bp, mus musculus
taccccgactactgctgccaagatg

SEQ ID NO: 83162 - DNA, 25 bp, mus musculus
gagtgcttcatggatggctggtgac

SEQ ID NO: 83163 - DNA, 25 bp, mus musculus
tggtgactgggccttgtgctcccaa

SEQ ID NO: 83164 - DNA, 25 bp, mus musculus
caggcccaaagtggcctgttgtcat

SEQ ID NO: 83165 - DNA, 25 bp, mus musculus
caaagtggcctgttgtcatagcaac

SEQ ID NO: 83166 - DNA, 25 bp, mus musculus
gaataacaacagcaacaatgccttt

SEQ ID NO: 83167 - DNA, 25 bp, mus musculus
caacagcaacaatgcctttgcaggc

SEQ ID NO: 83168 - DNA, 25 bp, mus musculus
caacaatgcctttgcaggcagcccc

SEQ ID NO: 83169 - DNA, 25 bp, mus musculus
cagagagccaatctcacattcaagt

SEQ ID NO: 83170 - DNA, 25 bp, mus musculus
gccaatctcacattcaagtgttcac

SEQ ID NO: 83171 - DNA, 25 bp, mus musculus
ctcacattcaagtgttcaccaaccc

SEQ ID NO: 83172 - DNA, 25 bp, mus musculus
ttcaagtgttcaccaaccctgacgt

SEQ ID NO: 83173 - DNA, 25 bp, mus musculus
tttctgcattctgtatagaaacata

SEQ ID NO: 83174 - DNA, 25 bp, mus musculus
ctgggccttgtgctcccaagctctg

SEQ ID NO: 83175 - DNA, 25 bp, mus musculus
agctggagtttccctgatgtcccag

SEQ ID NO: 83176 - DNA, 25 bp, mus musculus
agtttccctgatgtcccagagtcaa

SEQ ID NO: 83177 - DNA, 25 bp, mus musculus
cctgatgtcccagagtcaagagcag

SEQ ID NO: 83178 - DNA, 25 bp, mus musculus
gtcccagagtcaagagcagggatct

SEQ ID NO: 83179 - DNA, 25 bp, mus musculus
attatttctggtgacctcatcaaaa

SEQ ID NO: 83180 - DNA, 25 bp, mus musculus
actcttgttgctcttagcaacccca

SEQ ID NO: 83181 - DNA, 25 bp, mus musculus
accattgggcattgccatgtagaga

SEQ ID NO: 83182 - DNA, 25 bp, mus musculus
tgcctgattctactctgcttcccag

SEQ ID NO: 83183 - DNA, 25 bp, mus musculus
tcttgctctcctgcctgggtccaaa

SEQ ID NO: 83184 - DNA, 25 bp, mus musculus
aaatctgaccaagtcaagccagaca

SEQ ID NO: 83185 - DNA, 25 bp, mus musculus
atctgaccaagtcaagccagacagt

SEQ ID NO: 83186 - DNA, 25 bp, mus musculus
ctgaccaagtcaagccagacagtgg

SEQ ID NO: 83187 - DNA, 25 bp, mus musculus
tttgtaactggtgcagaagacataa

SEQ ID NO: 83188 - DNA, 25 bp, mus musculus
gacataatctctggtgccagtcgta

SEQ ID NO: 83189 - DNA, 25 bp, mus musculus
cataatctctggtgccagtcgtatc

SEQ ID NO: 83190 - DNA, 25 bp, mus musculus
taatctctggtgccagtcgtatcac

SEQ ID NO: 83191 - DNA, 25 bp, mus musculus
atctctggtgccagtcgtatcacga

SEQ ID NO: 83192 - DNA, 25 bp, mus musculus
ctctggtgccagtcgtatcacgaag

SEQ ID NO: 83193 - DNA, 25 bp, mus musculus
ggtgccagtcgtatcacgaagtcat

SEQ ID NO: 83194 - DNA, 25 bp, mus musculus
gctctcctgcctgggtccaaagatg

SEQ ID NO: 83195 - DNA, 25 bp, mus musculus
ccttccatcttcagagaagagctga

SEQ ID NO: 83196 - DNA, 25 bp, mus musculus
acctcagctgcaaccacctcagagg

SEQ ID NO: 83197 - DNA, 25 bp, mus musculus
ctcagctgcaaccacctcagaggaa

SEQ ID NO: 83198 - DNA, 25 bp, mus musculus
gctgcaaccacctcagaggaaaatc

SEQ ID NO: 83199 - DNA, 25 bp, mus musculus
tgcaaccacctcagaggaaaatctg

SEQ ID NO: 83200 - DNA, 25 bp, mus musculus
caaccacctcagaggaaaatctgac

SEQ ID NO: 83201 - DNA, 25 bp, mus musculus
accacctcagaggaaaatctgacca

SEQ ID NO: 83202 - DNA, 25 bp, mus musculus
tagtccctcggcttcagaagacttc

SEQ ID NO: 83203 - DNA, 25 bp, mus musculus
tccctcggcttcagaagacttcacc

SEQ ID NO: 83204 - DNA, 25 bp, mus musculus
ccactaggcctttgtaaggcaacat

SEQ ID NO: 83205 - DNA, 25 bp, mus musculus
aaggcaacatcaatacattcttcct

SEQ ID NO: 83206 - DNA, 25 bp, mus musculus
gcaacatcaatacattcttcctccc

SEQ ID NO: 83207 - DNA, 25 bp, mus musculus
tacccccaagtgaattctgggagct

SEQ ID NO: 83208 - DNA, 25 bp, mus musculus
acctgaccacttgttaggttgctgc

SEQ ID NO: 83209 - DNA, 25 bp, mus musculus
ccacttgttaggttgctgcaccctc

SEQ ID NO: 83210 - DNA, 25 bp, mus musculus
aggttgctgcaccctcgctgaagct

SEQ ID NO: 83211 - DNA, 25 bp, mus musculus
ttgctgcaccctcgctgaagctgcc

SEQ ID NO: 83212 - DNA, 25 bp, mus musculus
cgctgaagctgccctcggtctattt

SEQ ID NO: 83213 - DNA, 25 bp, mus musculus
agctgccctcggtctatttctccac

SEQ ID NO: 83214 - DNA, 25 bp, mus musculus
ctcggcttcagaagacttcacctat

SEQ ID NO: 83215 - DNA, 25 bp, mus musculus
ttcagaagacttcacctatggcccg

SEQ ID NO: 83216 - DNA, 25 bp, mus musculus
agacttcacctatggcccgggcgat

SEQ ID NO: 83217 - DNA, 25 bp, mus musculus
ctttcctggcctgcccaaagacctg

SEQ ID NO: 83218 - DNA, 25 bp, mus musculus
gccctgtttcatcccataccactag

SEQ ID NO: 83219 - DNA, 25 bp, mus musculus
ctgtttcatcccataccactaggcc

SEQ ID NO: 83220 - DNA, 25 bp, mus musculus
tttcatcccataccactaggccttt

SEQ ID NO: 83221 - DNA, 25 bp, mus musculus
catcccataccactaggcctttgta

SEQ ID NO: 83222 - DNA, 25 bp, mus musculus
ttgttagcactcatggtgctccctc

SEQ ID NO: 83223 - DNA, 25 bp, mus musculus
taaagttggggctgctatggctacc

SEQ ID NO: 83224 - DNA, 25 bp, mus musculus
tctcggacacgggagtcagggtagt

SEQ ID NO: 83225 - DNA, 25 bp, mus musculus
tcggacacgggagtcagggtagtca

SEQ ID NO: 83226 - DNA, 25 bp, mus musculus
gtagtcaggcccctgacatctgcat

SEQ ID NO: 83227 - DNA, 25 bp, mus musculus
gcccctgacatctgcatactgagct

SEQ ID NO: 83228 - DNA, 25 bp, mus musculus
ccctgacatctgcatactgagctct

SEQ ID NO: 83229 - DNA, 25 bp, mus musculus
gacatctgcatactgagctctgtat

SEQ ID NO: 83230 - DNA, 25 bp, mus musculus
tctgcatactgagctctgtattcca

SEQ ID NO: 83231 - DNA, 25 bp, mus musculus
tgcatactgagctctgtattccaag

SEQ ID NO: 83232 - DNA, 25 bp, mus musculus
catactgagctctgtattccaagtg

SEQ ID NO: 83233 - DNA, 25 bp, mus musculus
tactgagctctgtattccaagtgat

SEQ ID NO: 83234 - DNA, 25 bp, mus musculus
gctgctatggctaccaaaggatgag

SEQ ID NO: 83235 - DNA, 25 bp, mus musculus
ctgagctctgtattccaagtgatgg

SEQ ID NO: 83236 - DNA, 25 bp, mus musculus
ctatggctaccaaaggatgagctgg

SEQ ID NO: 83237 - DNA, 25 bp, mus musculus
gtgcctgttacatgacactctccac

SEQ ID NO: 83238 - DNA, 25 bp, mus musculus
gcctgttacatgacactctccacca

SEQ ID NO: 83239 - DNA, 25 bp, mus musculus
ctgttacatgacactctccaccacg

SEQ ID NO: 83240 - DNA, 25 bp, mus musculus
gttacatgacactctccaccacgac

SEQ ID NO: 83241 - DNA, 25 bp, mus musculus
ccacgacgaccttgctgctctcgga

SEQ ID NO: 83242 - DNA, 25 bp, mus musculus
gctctcggacacgggagtcagggta

SEQ ID NO: 83243 - DNA, 25 bp, mus musculus
atggctcgcggtaccttctgggaga

SEQ ID NO: 83244 - DNA, 25 bp, mus musculus
ggcttttcatgctgctcttagagaa

SEQ ID NO: 83245 - DNA, 25 bp, mus musculus
tatttgtcgggtctcgcctaggtga

SEQ ID NO: 83246 - DNA, 25 bp, mus musculus
ctcgcctaggtgactcccagctcgt

SEQ ID NO: 83247 - DNA, 25 bp, mus musculus
actcccagctcgtaaagctcaatgt

SEQ ID NO: 83248 - DNA, 25 bp, mus musculus
cccagctcgtaaagctcaatgtcga

SEQ ID NO: 83249 - DNA, 25 bp, mus musculus
agctcgtaaagctcaatgtcgacag

SEQ ID NO: 83250 - DNA, 25 bp, mus musculus
tcaatgtcgacagcaacgaacaagg

SEQ ID NO: 83251 - DNA, 25 bp, mus musculus
acagcaacgaacaaggctcctatgt

SEQ ID NO: 83252 - DNA, 25 bp, mus musculus
gcaacgaacaaggctcctatgtagt

SEQ ID NO: 83253 - DNA, 25 bp, mus musculus
ccaatttaggacccattgtggatat

SEQ ID NO: 83254 - DNA, 25 bp, mus musculus
atttaggacccattgtggatatgtg

SEQ ID NO: 83255 - DNA, 25 bp, mus musculus
ttttcatgctgctcttagagaagga

SEQ ID NO: 83256 - DNA, 25 bp, mus musculus
ctgtcaccctcaaggaccttcgagt

SEQ ID NO: 83257 - DNA, 25 bp, mus musculus
tcaccctcaaggaccttcgagtgga

SEQ ID NO: 83258 - DNA, 25 bp, mus musculus
tcctcggagagacctccattgctga

SEQ ID NO: 83259 - DNA, 25 bp, mus musculus
agacctccattgctgagtgcctaac

SEQ ID NO: 83260 - DNA, 25 bp, mus musculus
ttgctgagtgcctaacttatcttga

SEQ ID NO: 83261 - DNA, 25 bp, mus musculus
ctgagtgcctaacttatcttgataa

SEQ ID NO: 83262 - DNA, 25 bp, mus musculus
agtgcctaacttatcttgataatgg

SEQ ID NO: 83263 - DNA, 25 bp, mus musculus
gagtccatccatctatgctcctgaa

SEQ ID NO: 83264 - DNA, 25 bp, mus musculus
atccatctatgctcctgaactctcc

SEQ ID NO: 83265 - DNA, 25 bp, mus musculus
tcctaaaacaagacaatcagggcat

SEQ ID NO: 83266 - DNA, 25 bp, mus musculus
acaatcagggcatggcttgagagga

SEQ ID NO: 83267 - DNA, 25 bp, mus musculus
tttatttctcagcctgcccttgggg

SEQ ID NO: 83268 - DNA, 25 bp, mus musculus
agggtgccctgtcttcattttgcga

SEQ ID NO: 83269 - DNA, 25 bp, mus musculus
cttcattttgcgacatgggttgaag

SEQ ID NO: 83270 - DNA, 25 bp, mus musculus
tttgcgacatgggttgaagaactag

SEQ ID NO: 83271 - DNA, 25 bp, mus musculus
ttattattcctggctgtatctgagt

SEQ ID NO: 83272 - DNA, 25 bp, mus musculus
ttcctggctgtatctgagtccaggg

SEQ ID NO: 83273 - DNA, 25 bp, mus musculus
gctgtatctgagtccagggagccct

SEQ ID NO: 83274 - DNA, 25 bp, mus musculus
tctgagtccagggagcccttgtacg

SEQ ID NO: 83275 - DNA, 25 bp, mus musculus
tcctgaactctccagttagccatct

SEQ ID NO: 83276 - DNA, 25 bp, mus musculus
actctccagttagccatctcaagga

SEQ ID NO: 83277 - DNA, 25 bp, mus musculus
cagttagccatctcaaggagaaaca

SEQ ID NO: 83278 - DNA, 25 bp, mus musculus
acagacttaagctctgattgtggtg

SEQ ID NO: 83279 - DNA, 25 bp, mus musculus
gacaacttctttcttctttgccagc

SEQ ID NO: 83280 - DNA, 25 bp, mus musculus
ttctttcttctttgccagcctccca

SEQ ID NO: 83281 - DNA, 25 bp, mus musculus
agtggctgcccttacacgtctccta

SEQ ID NO: 83282 - DNA, 25 bp, mus musculus
tacacgtctcctacttcaatggtgg

SEQ ID NO: 83283 - DNA, 25 bp, mus musculus
tccacccgaagctgatcatcgcagg

SEQ ID NO: 83284 - DNA, 25 bp, mus musculus
cgaagctgatcatcgcagggaccag

SEQ ID NO: 83285 - DNA, 25 bp, mus musculus
gctgccgtgctggtatgatattcta

SEQ ID NO: 83286 - DNA, 25 bp, mus musculus
agttcccctatgctgggacagacag

SEQ ID NO: 83287 - DNA, 25 bp, mus musculus
cctatgctgggacagacagtgtggg

SEQ ID NO: 83288 - DNA, 25 bp, mus musculus
gtgtgggctcacatttcctgtgtgg

SEQ ID NO: 83289 - DNA, 25 bp, mus musculus
gctcacatttcctgtgtggaagaga

SEQ ID NO: 83290 - DNA, 25 bp, mus musculus
ctggactgtcacttctgggaaagat

SEQ ID NO: 83291 - DNA, 25 bp, mus musculus
aagagctcctcaggaagaaataaca

SEQ ID NO: 83292 - DNA, 25 bp, mus musculus
aggaagccccaaggtcccagctctg

SEQ ID NO: 83293 - DNA, 25 bp, mus musculus
ggtcccagctctggacacagtattt

SEQ ID NO: 83294 - DNA, 25 bp, mus musculus
aggcagtgtccacaggaggaaggtc

SEQ ID NO: 83295 - DNA, 25 bp, mus musculus
ggaccagctgctactcccggaacct

SEQ ID NO: 83296 - DNA, 25 bp, mus musculus
gctgctactcccggaacctggacta

SEQ ID NO: 83297 - DNA, 25 bp, mus musculus
tggactacgcacggctgcggaagat

SEQ ID NO: 83298 - DNA, 25 bp, mus musculus
acgcacggctgcggaagattgcgga

SEQ ID NO: 83299 - DNA, 25 bp, mus musculus
cgtatctcatggcagacatggcaca

SEQ ID NO: 83300 - DNA, 25 bp, mus musculus
ccccctttgaacactgccatgtagt

SEQ ID NO: 83301 - DNA, 25 bp, mus musculus
ttgaacactgccatgtagtgaccac

SEQ ID NO: 83302 - DNA, 25 bp, mus musculus
cccacaagaccctgagaggctgccg

SEQ ID NO: 83303 - DNA, 25 bp, mus musculus
tttaattgacactggataggttagg

SEQ ID NO: 83304 - DNA, 25 bp, mus musculus
taagcccaggaatctatctgtgttc

SEQ ID NO: 83305 - DNA, 25 bp, mus musculus
atgcaccttctataactattgttgt

SEQ ID NO: 83306 - DNA, 25 bp, mus musculus
cttagcgttgcacggcaaacatttc

SEQ ID NO: 83307 - DNA, 25 bp, mus musculus
agcgttgcacggcaaacatttcact

SEQ ID NO: 83308 - DNA, 25 bp, mus musculus
cggcaaacatttcactgactgacct

SEQ ID NO: 83309 - DNA, 25 bp, mus musculus
caaacatttcactgactgacctcta

SEQ ID NO: 83310 - DNA, 25 bp, mus musculus
acatttcactgactgacctctacac

SEQ ID NO: 83311 - DNA, 25 bp, mus musculus
cactgactgacctctacactgccat

SEQ ID NO: 83312 - DNA, 25 bp, mus musculus
tgactgacctctacactgccatgat

SEQ ID NO: 83313 - DNA, 25 bp, mus musculus
ctgacctctacactgccatgattga

SEQ ID NO: 83314 - DNA, 25 bp, mus musculus
tctacactgccatgattgatcattt

SEQ ID NO: 83315 - DNA, 25 bp, mus musculus
tctatctgtgttcatctccactgca

SEQ ID NO: 83316 - DNA, 25 bp, mus musculus
atctgtgttcatctccactgcactg

SEQ ID NO: 83317 - DNA, 25 bp, mus musculus
tgtgttcatctccactgcactggga

SEQ ID NO: 83318 - DNA, 25 bp, mus musculus
catctccactgcactgggattacaa

SEQ ID NO: 83319 - DNA, 25 bp, mus musculus
ctccactgcactgggattacaagca

SEQ ID NO: 83320 - DNA, 25 bp, mus musculus
cactgcactgggattacaagcatgc

SEQ ID NO: 83321 - DNA, 25 bp, mus musculus
attacaagcatgcaccttctataac

SEQ ID NO: 83322 - DNA, 25 bp, mus musculus
agcatgcaccttctataactattgt

SEQ ID NO: 83323 - DNA, 25 bp, mus musculus
tggtatgttggcctcactaacttga

SEQ ID NO: 83324 - DNA, 25 bp, mus musculus
accctgacctgtgaagctcacagca

SEQ ID NO: 83325 - DNA, 25 bp, mus musculus
tttgtcctcgctgtagtcatcatca

SEQ ID NO: 83326 - DNA, 25 bp, mus musculus
gtagtcatcatcatcgcagcactat

SEQ ID NO: 83327 - DNA, 25 bp, mus musculus
atcatcatcgcagcactatacacta

SEQ ID NO: 83328 - DNA, 25 bp, mus musculus
atcgcagcactatacactatacgaa

SEQ ID NO: 83329 - DNA, 25 bp, mus musculus
gcactatacactatacgaagatgca

SEQ ID NO: 83330 - DNA, 25 bp, mus musculus
agatgcaggcatggtcgtgctctgc

SEQ ID NO: 83331 - DNA, 25 bp, mus musculus
aggcatggtcgtgctctgcagtcca

SEQ ID NO: 83332 - DNA, 25 bp, mus musculus
ggtcgtgctctgcagtccaatccct

SEQ ID NO: 83333 - DNA, 25 bp, mus musculus
cagtccaatccctcagagagggaga

SEQ ID NO: 83334 - DNA, 25 bp, mus musculus
tcatctgtgaacggcgactgtagac

SEQ ID NO: 83335 - DNA, 25 bp, mus musculus
acctgtgaagctcacagcaaaccag

SEQ ID NO: 83336 - DNA, 25 bp, mus musculus
cacagcaaaccagcgcctgacatgg

SEQ ID NO: 83337 - DNA, 25 bp, mus musculus
aaaccagcgcctgacatggctggat

SEQ ID NO: 83338 - DNA, 25 bp, mus musculus
gcgcctgacatggctggatataact

SEQ ID NO: 83339 - DNA, 25 bp, mus musculus
tctgttaagcgccagggcaatatgc

SEQ ID NO: 83340 - DNA, 25 bp, mus musculus
atctccaccgtagaggatggtctca

SEQ ID NO: 83341 - DNA, 25 bp, mus musculus
acggtcattgtgtgcgaagtcacca

SEQ ID NO: 83342 - DNA, 25 bp, mus musculus
atcgtctttgtcctcgctgtagtca

SEQ ID NO: 83343 - DNA, 25 bp, mus musculus
ttgtgcttttcatcggcatcatcat

SEQ ID NO: 83344 - DNA, 25 bp, mus musculus
tcggcatcatcatcatccttgtgca

SEQ ID NO: 83345 - DNA, 25 bp, mus musculus
tgctcatcccactctttggaatcca

SEQ ID NO: 83346 - DNA, 25 bp, mus musculus
tcccactctttggaatccactacac

SEQ ID NO: 83347 - DNA, 25 bp, mus musculus
gaatccactacacagtatttgcctt

SEQ ID NO: 83348 - DNA, 25 bp, mus musculus
cagtatttgccttctctccagagaa

SEQ ID NO: 83349 - DNA, 25 bp, mus musculus
ctgtactctactgcttcctgaatgg

SEQ ID NO: 83350 - DNA, 25 bp, mus musculus
acttcactatggacttcaagcaccg

SEQ ID NO: 83351 - DNA, 25 bp, mus musculus
ctatggacttcaagcaccggcatcc

SEQ ID NO: 83352 - DNA, 25 bp, mus musculus
gcacccagctgtccatcctgagcaa

SEQ ID NO: 83353 - DNA, 25 bp, mus musculus
agctgtccatcctgagcaagagcag

SEQ ID NO: 83354 - DNA, 25 bp, mus musculus
ccatcctgagcaagagcagctccca

SEQ ID NO: 83355 - DNA, 25 bp, mus musculus
tcatcatcatccttgtgcagaagct

SEQ ID NO: 83356 - DNA, 25 bp, mus musculus
cgagcatctacttcagctgcgtgca

SEQ ID NO: 83357 - DNA, 25 bp, mus musculus
tctacttcagctgcgtgcagaaatg

SEQ ID NO: 83358 - DNA, 25 bp, mus musculus
gctactgcaagccacagcgggctca

SEQ ID NO: 83359 - DNA, 25 bp, mus musculus
gggctcagcagcactcttgcaagat

SEQ ID NO: 83360 - DNA, 25 bp, mus musculus
agcagcactcttgcaagatgtcaga

SEQ ID NO: 83361 - DNA, 25 bp, mus musculus
actcttgcaagatgtcagaactatc

SEQ ID NO: 83362 - DNA, 25 bp, mus musculus
aactatccaccattactctacggct

SEQ ID NO: 83363 - DNA, 25 bp, mus musculus
tctgtgaccctggatttagtcttcc

SEQ ID NO: 83364 - DNA, 25 bp, mus musculus
gtgaccctggatttagtcttccatc

SEQ ID NO: 83365 - DNA, 25 bp, mus musculus
gagcactgctgctgtccacagcttg

SEQ ID NO: 83366 - DNA, 25 bp, mus musculus
cactgctgctgtccacagcttgggg

SEQ ID NO: 83367 - DNA, 25 bp, mus musculus
cagcttcagactgcagcaggcctga

SEQ ID NO: 83368 - DNA, 25 bp, mus musculus
cagactgcagcaggcctgacttcag

SEQ ID NO: 83369 - DNA, 25 bp, mus musculus
gcagcaggcctgacttcagtttctt

SEQ ID NO: 83370 - DNA, 25 bp, mus musculus
acttcagtttcttccctgagccata

SEQ ID NO: 83371 - DNA, 25 bp, mus musculus
gtttcttccctgagccatactcacc

SEQ ID NO: 83372 - DNA, 25 bp, mus musculus
atttgtcctgggataccgtatccag

SEQ ID NO: 83373 - DNA, 25 bp, mus musculus
attgatatggttcgtgccaggttgg

SEQ ID NO: 83374 - DNA, 25 bp, mus musculus
cgtgccaggttggtctgcagccctg

SEQ ID NO: 83375 - DNA, 25 bp, mus musculus
catctttgttactatggcacctggc

SEQ ID NO: 83376 - DNA, 25 bp, mus musculus
ctttgttactatggcacctggcctc

SEQ ID NO: 83377 - DNA, 25 bp, mus musculus
gtgaccacttctcaaagatccctga

SEQ ID NO: 83378 - DNA, 25 bp, mus musculus
accacttctcaaagatccctgacag

SEQ ID NO: 83379 - DNA, 25 bp, mus musculus
acttctcaaagatccctgacagagc

SEQ ID NO: 83380 - DNA, 25 bp, mus musculus
caaagatccctgacagagcactgct

SEQ ID NO: 83381 - DNA, 25 bp, mus musculus
agatccctgacagagcactgctgct

SEQ ID NO: 83382 - DNA, 25 bp, mus musculus
tccctgacagagcactgctgctgtc

SEQ ID NO: 83383 - DNA, 25 bp, mus musculus
ccctgacatccaagagatccgagtc

SEQ ID NO: 83384 - DNA, 25 bp, mus musculus
catccaagagatccgagtcagccca

SEQ ID NO: 83385 - DNA, 25 bp, mus musculus
caagacacccaacacattcgctgtg

SEQ ID NO: 83386 - DNA, 25 bp, mus musculus
ccgaggcatcctgctgcaggccaac

SEQ ID NO: 83387 - DNA, 25 bp, mus musculus
catcctgctgcaggccaacagtgac

SEQ ID NO: 83388 - DNA, 25 bp, mus musculus
caagctctctcgaaggagatctgcg

SEQ ID NO: 83389 - DNA, 25 bp, mus musculus
atctgcgcagatgcgggtctgagtt

SEQ ID NO: 83390 - DNA, 25 bp, mus musculus
gcagatgcgggtctgagttgaaagc

SEQ ID NO: 83391 - DNA, 25 bp, mus musculus
ggacttccagtggcccagaccactc

SEQ ID NO: 83392 - DNA, 25 bp, mus musculus
ccatctgttctgtcatctgccactc

SEQ ID NO: 83393 - DNA, 25 bp, mus musculus
ggaggcctataccacatgacgaatt

SEQ ID NO: 83394 - DNA, 25 bp, mus musculus
ctataccacatgacgaattgtgctc

SEQ ID NO: 83395 - DNA, 25 bp, mus musculus
agagatccgagtcagcccaatcgtc

SEQ ID NO: 83396 - DNA, 25 bp, mus musculus
aatcgtctccaagaagggatacctg

SEQ ID NO: 83397 - DNA, 25 bp, mus musculus
cctggagccacacacggctggctgg

SEQ ID NO: 83398 - DNA, 25 bp, mus musculus
gccacacacggctggctgggccaag

SEQ ID NO: 83399 - DNA, 25 bp, mus musculus
gcgtccctacgcctacatgtacaac

SEQ ID NO: 83400 - DNA, 25 bp, mus musculus
atttgtgctcaacctctccactgcg

SEQ ID NO: 83401 - DNA, 25 bp, mus musculus
ggaccagcaggccatgctcaagaca

SEQ ID NO: 83402 - DNA, 25 bp, mus musculus
catgctcaagacacccaacacattc

SEQ ID NO: 83403 - DNA, 25 bp, mus musculus
gctggctgcactggtgcaggactat

SEQ ID NO: 83404 - DNA, 25 bp, mus musculus
ctctagcttggacagccccagatct

SEQ ID NO: 83405 - DNA, 25 bp, mus musculus
tctccaggctattactggttgcttt

SEQ ID NO: 83406 - DNA, 25 bp, mus musculus
ttgctttcctgaggcaaagaatggt

SEQ ID NO: 83407 - DNA, 25 bp, mus musculus
gagaaagtcccacaggctaaaagag

SEQ ID NO: 83408 - DNA, 25 bp, mus musculus
gtcccacaggctaaaagagaatcac

SEQ ID NO: 83409 - DNA, 25 bp, mus musculus
gaatcacccaggaagatggcagaga

SEQ ID NO: 83410 - DNA, 25 bp, mus musculus
ggcagtcatctggcttcctagtaga

SEQ ID NO: 83411 - DNA, 25 bp, mus musculus
catctggcttcctagtagagcttct

SEQ ID NO: 83412 - DNA, 25 bp, mus musculus
gcttcctagtagagcttctagtctt

SEQ ID NO: 83413 - DNA, 25 bp, mus musculus
tagtagagcttctagtcttgcttct

SEQ ID NO: 83414 - DNA, 25 bp, mus musculus
tagtcttgcttctggaagtgttggt

SEQ ID NO: 83415 - DNA, 25 bp, mus musculus
cttggacagccccagatctaagcgg

SEQ ID NO: 83416 - DNA, 25 bp, mus musculus
gaatctgagtacctgcatgctgggc

SEQ ID NO: 83417 - DNA, 25 bp, mus musculus
gagtacctgcatgctgggcacgtac

SEQ ID NO: 83418 - DNA, 25 bp, mus musculus
cacgtacacacaagacctcaacaag

SEQ ID NO: 83419 - DNA, 25 bp, mus musculus
cacacaagacctcaacaagtttcac

SEQ ID NO: 83420 - DNA, 25 bp, mus musculus
tggcaactaagctccttctctcctt

SEQ ID NO: 83421 - DNA, 25 bp, mus musculus
tttcttcctataacttgatgcatgt

SEQ ID NO: 83422 - DNA, 25 bp, mus musculus
ctctctggttgctctccaggctatt

SEQ ID NO: 83423 - DNA, 25 bp, mus musculus
caggaaagctctctccacttaaagt

SEQ ID NO: 83424 - DNA, 25 bp, mus musculus
agctctctccacttaaagtgcagtc

SEQ ID NO: 83425 - DNA, 25 bp, mus musculus
agagctaagccggaactcaggaaca

SEQ ID NO: 83426 - DNA, 25 bp, mus musculus
aggaacattttcttcacagattgag

SEQ ID NO: 83427 - DNA, 25 bp, mus musculus
aacattttcttcacagattgagaat

SEQ ID NO: 83428 - DNA, 25 bp, mus musculus
tacacctgtcttgtgtccttttcat

SEQ ID NO: 83429 - DNA, 25 bp, mus musculus
gtgtccttttcatttgcaaccagtg

SEQ ID NO: 83430 - DNA, 25 bp, mus musculus
tccttttcatttgcaaccagtgcct

SEQ ID NO: 83431 - DNA, 25 bp, mus musculus
tcatttgcaaccagtgcctgaacct

SEQ ID NO: 83432 - DNA, 25 bp, mus musculus
tttgcaaccagtgcctgaacctgag

SEQ ID NO: 83433 - DNA, 25 bp, mus musculus
gcaaccagtgcctgaacctgagaca

SEQ ID NO: 83434 - DNA, 25 bp, mus musculus
gcctgaacctgagacagtgttaaaa

SEQ ID NO: 83435 - DNA, 25 bp, mus musculus
tctctccacttaaagtgcagtctaa

SEQ ID NO: 83436 - DNA, 25 bp, mus musculus
ctccacttaaagtgcagtctaagaa

SEQ ID NO: 83437 - DNA, 25 bp, mus musculus
ctaagaagcttccatgtcgaggcca

SEQ ID NO: 83438 - DNA, 25 bp, mus musculus
agaagcttccatgtcgaggccagac

SEQ ID NO: 83439 - DNA, 25 bp, mus musculus
agcttccatgtcgaggccagactac

SEQ ID NO: 83440 - DNA, 25 bp, mus musculus
catgtcgaggccagactacctgccg

SEQ ID NO: 83441 - DNA, 25 bp, mus musculus
agactacctgccgggatcgtgtgat

SEQ ID NO: 83442 - DNA, 25 bp, mus musculus
ctacctgccgggatcgtgtgattct

SEQ ID NO: 83443 - DNA, 25 bp, mus musculus
gtgtgtccaggagctggcttcaccc

SEQ ID NO: 83444 - DNA, 25 bp, mus musculus
ctccttgctcttcatcttcgtacgg

SEQ ID NO: 83445 - DNA, 25 bp, mus musculus
gaaattgatatccctcatgtatggc

SEQ ID NO: 83446 - DNA, 25 bp, mus musculus
attgatatccctcatgtatggcttt

SEQ ID NO: 83447 - DNA, 25 bp, mus musculus
atccctcatgtatggctttacctgg

SEQ ID NO: 83448 - DNA, 25 bp, mus musculus
cctcatgtatggctttacctggcag

SEQ ID NO: 83449 - DNA, 25 bp, mus musculus
tggctttacctggcagaactgatta

SEQ ID NO: 83450 - DNA, 25 bp, mus musculus
ctttacctggcagaactgattacac

SEQ ID NO: 83451 - DNA, 25 bp, mus musculus
gaactgattacacctattctccagg

SEQ ID NO: 83452 - DNA, 25 bp, mus musculus
ctgattacacctattctccaggaag

SEQ ID NO: 83453 - DNA, 25 bp, mus musculus
acacctattctccaggaagatgggg

SEQ ID NO: 83454 - DNA, 25 bp, mus musculus
attctccaggaagatggggtgccca

SEQ ID NO: 83455 - DNA, 25 bp, mus musculus
cttgctcttcatcttcgtacggctt

SEQ ID NO: 83456 - DNA, 25 bp, mus musculus
catcttcgtacggcttggtatcgag

SEQ ID NO: 83457 - DNA, 25 bp, mus musculus
cgtacggcttggtatcgagtccacg

SEQ ID NO: 83458 - DNA, 25 bp, mus musculus
tatcgagtccacgctggagcgtagt

SEQ ID NO: 83459 - DNA, 25 bp, mus musculus
gcgtagtaccattgctcgtgagcat

SEQ ID NO: 83460 - DNA, 25 bp, mus musculus
gcgactactgcaccaactgctctgt

SEQ ID NO: 83461 - DNA, 25 bp, mus musculus
gcactctctactgcccagtactatc

SEQ ID NO: 83462 - DNA, 25 bp, mus musculus
tactatcaagggctgtatgaaacac

SEQ ID NO: 83463 - DNA, 25 bp, mus musculus
ttcaggaggccaggctccttgctga

SEQ ID NO: 83464 - DNA, 25 bp, mus musculus
aggccaggctccttgctgagcgatg

SEQ ID NO: 83465 - DNA, 25 bp, mus musculus
gaggccatctcgttctcgttctcat

SEQ ID NO: 83466 - DNA, 25 bp, mus musculus
ttctcgttctcatccttggtgccct

SEQ ID NO: 83467 - DNA, 25 bp, mus musculus
gggcctttggctttcactggtggag

SEQ ID NO: 83468 - DNA, 25 bp, mus musculus
gaagattttctgccttagaacatgg

SEQ ID NO: 83469 - DNA, 25 bp, mus musculus
tttctgccttagaacatgggattca

SEQ ID NO: 83470 - DNA, 25 bp, mus musculus
agccatttccggctcagaggaagat

SEQ ID NO: 83471 - DNA, 25 bp, mus musculus
agcccgagccggagccacagctgga

SEQ ID NO: 83472 - DNA, 25 bp, mus musculus
agctggagccagagcccaggcagct

SEQ ID NO: 83473 - DNA, 25 bp, mus musculus
ccgaggcagccagcaggtctcagca

SEQ ID NO: 83474 - DNA, 25 bp, mus musculus
cagccagcaggtctcagcagctccg

SEQ ID NO: 83475 - DNA, 25 bp, mus musculus
ggctccttgctgagcgatggcagtg

SEQ ID NO: 83476 - DNA, 25 bp, mus musculus
cgaataaactccctgtcagcagcat

SEQ ID NO: 83477 - DNA, 25 bp, mus musculus
ggcagtgtcagctgtacgagggcca

SEQ ID NO: 83478 - DNA, 25 bp, mus musculus
gtcagctgtacgagggccagaggct

SEQ ID NO: 83479 - DNA, 25 bp, mus musculus
tgtacgagggccagaggcttcttgg

SEQ ID NO: 83480 - DNA, 25 bp, mus musculus
cagtgtacgccgcagagtctagctc

SEQ ID NO: 83481 - DNA, 25 bp, mus musculus
acgccgcagagtctagctcaggcgc

SEQ ID NO: 83482 - DNA, 25 bp, mus musculus
ctagctcaggcgcccacagtgctag

SEQ ID NO: 83483 - DNA, 25 bp, mus musculus
ttaaaggaggccatctcgttctcgt

SEQ ID NO: 83484 - DNA, 25 bp, mus musculus
attatgtccaagctgttaaattctt

SEQ ID NO: 83485 - DNA, 25 bp, mus musculus
ttatgtccaagctgttaaattctta

SEQ ID NO: 83486 - DNA, 25 bp, mus musculus
tcttacaaagaggccaagtgctcag

SEQ ID NO: 83487 - DNA, 25 bp, mus musculus
aagaggccaagtgctcagcgccaga

SEQ ID NO: 83488 - DNA, 25 bp, mus musculus
aggccaagtgctcagcgccagagtt

SEQ ID NO: 83489 - DNA, 25 bp, mus musculus
ggccaagtgctcagcgccagagttt

SEQ ID NO: 83490 - DNA, 25 bp, mus musculus
gccaagtgctcagcgccagagttta

SEQ ID NO: 83491 - DNA, 25 bp, mus musculus
aagtgctcagcgccagagtttaaag

SEQ ID NO: 83492 - DNA, 25 bp, mus musculus
agtgctcagcgccagagtttaaagg

SEQ ID NO: 83493 - DNA, 25 bp, mus musculus
aggcccgcgtatctacagaaaattg

SEQ ID NO: 83494 - DNA, 25 bp, mus musculus
ggcccgcgtatctacagaaaattgg

SEQ ID NO: 83495 - DNA, 25 bp, mus musculus
gcccgcgtatctacagaaaattgga

SEQ ID NO: 83496 - DNA, 25 bp, mus musculus
tatgtccaagctgttaaattcttac

SEQ ID NO: 83497 - DNA, 25 bp, mus musculus
gtgattgacgaacccatcattgaca

SEQ ID NO: 83498 - DNA, 25 bp, mus musculus
tgattgacgaacccatcattgacat

SEQ ID NO: 83499 - DNA, 25 bp, mus musculus
gattgacgaacccatcattgacatt

SEQ ID NO: 83500 - DNA, 25 bp, mus musculus
attgacgaacccatcattgacattc

SEQ ID NO: 83501 - DNA, 25 bp, mus musculus
cgaacccatcattgacattcttaca

SEQ ID NO: 83502 - DNA, 25 bp, mus musculus
acattcttacaaagaggccaagtgc

SEQ ID NO: 83503 - DNA, 25 bp, mus musculus
cattcttacaaagaggccaagtgct

SEQ ID NO: 83504 - DNA, 25 bp, mus musculus
ccacttcctgacaaatctgattttt

SEQ ID NO: 83505 - DNA, 25 bp, mus musculus
caccagtctgcctagagcatcactg

SEQ ID NO: 83506 - DNA, 25 bp, mus musculus
gtctacagcagccacagccactgtg

SEQ ID NO: 83507 - DNA, 25 bp, mus musculus
agcagccacagccactgtgcacaat

SEQ ID NO: 83508 - DNA, 25 bp, mus musculus
cacagccactgtgcacaatggacag

SEQ ID NO: 83509 - DNA, 25 bp, mus musculus
cactgtgcacaatggacagggtgcc

SEQ ID NO: 83510 - DNA, 25 bp, mus musculus
cctcggagctttggcttggcatctt

SEQ ID NO: 83511 - DNA, 25 bp, mus musculus
ggcttggcatcttgggttcatttga

SEQ ID NO: 83512 - DNA, 25 bp, mus musculus
tcgttgtacccagggcatggcaatg

SEQ ID NO: 83513 - DNA, 25 bp, mus musculus
ttatttctactctcaccctgagaga

SEQ ID NO: 83514 - DNA, 25 bp, mus musculus
tcaccctgagagacctgggcagcca

SEQ ID NO: 83515 - DNA, 25 bp, mus musculus
tgagccaggtgccaccactgtaagg

SEQ ID NO: 83516 - DNA, 25 bp, mus musculus
tctgcctagagcatcactggaaccc

SEQ ID NO: 83517 - DNA, 25 bp, mus musculus
tagagcatcactggaacccgcacta

SEQ ID NO: 83518 - DNA, 25 bp, mus musculus
cagacaagaagtcttccctcaacta

SEQ ID NO: 83519 - DNA, 25 bp, mus musculus
agaagtcttccctcaactacgtgtg

SEQ ID NO: 83520 - DNA, 25 bp, mus musculus
cttccctcaactacgtgtgatgacc

SEQ ID NO: 83521 - DNA, 25 bp, mus musculus
tcaactacgtgtgatgaccaagtcc

SEQ ID NO: 83522 - DNA, 25 bp, mus musculus
gatgaccaagtccaaggttgaccag

SEQ ID NO: 83523 - DNA, 25 bp, mus musculus
tgaccagggactgtctacagcagcc

SEQ ID NO: 83524 - DNA, 25 bp, mus musculus
gaatcacaggggacagccagtggtg

SEQ ID NO: 83525 - DNA, 25 bp, mus musculus
aagcttctatgaggcgctcagtcag

SEQ ID NO: 83526 - DNA, 25 bp, mus musculus
agagccatgaggctggcacagatga

SEQ ID NO: 83527 - DNA, 25 bp, mus musculus
atgagtctggccttcggctgggcag

SEQ ID NO: 83528 - DNA, 25 bp, mus musculus
ttcggctgggcagctgtcaatatta

SEQ ID NO: 83529 - DNA, 25 bp, mus musculus
gtcaatattacttctacagacggca

SEQ ID NO: 83530 - DNA, 25 bp, mus musculus
aatattacttctacagacggcagac

SEQ ID NO: 83531 - DNA, 25 bp, mus musculus
attacttctacagacggcagacaca

SEQ ID NO: 83532 - DNA, 25 bp, mus musculus
acttctacagacggcagacacagca

SEQ ID NO: 83533 - DNA, 25 bp, mus musculus
tctacagacggcagacacagcatct

SEQ ID NO: 83534 - DNA, 25 bp, mus musculus
acagacggcagacacagcatctgct

SEQ ID NO: 83535 - DNA, 25 bp, mus musculus
cacagcatctgctgtgacgactcct

SEQ ID NO: 83536 - DNA, 25 bp, mus musculus
cttctatgaggcgctcagtcagttg

SEQ ID NO: 83537 - DNA, 25 bp, mus musculus
tgctgtgacgactcctcatgacaaa

SEQ ID NO: 83538 - DNA, 25 bp, mus musculus
ctatgaggcgctcagtcagttgagg

SEQ ID NO: 83539 - DNA, 25 bp, mus musculus
ggcgctcagtcagttgagggttata

SEQ ID NO: 83540 - DNA, 25 bp, mus musculus
cctctgctgtcttccagagccatga

SEQ ID NO: 83541 - DNA, 25 bp, mus musculus
ctgctgtcttccagagccatgaggc

SEQ ID NO: 83542 - DNA, 25 bp, mus musculus
ctgtcttccagagccatgaggctgg

SEQ ID NO: 83543 - DNA, 25 bp, mus musculus
tcttccagagccatgaggctggcac

SEQ ID NO: 83544 - DNA, 25 bp, mus musculus
tccagagccatgaggctggcacaga

SEQ ID NO: 83545 - DNA, 25 bp, mus musculus
cttgcccctattcttatcagcgggc

SEQ ID NO: 83546 - DNA, 25 bp, mus musculus
gcccctattcttatcagcgggcttg

SEQ ID NO: 83547 - DNA, 25 bp, mus musculus
ctagcagctgagaccagtgtaacca

SEQ ID NO: 83548 - DNA, 25 bp, mus musculus
gagaccagtgtaaccaaccgtcact

SEQ ID NO: 83549 - DNA, 25 bp, mus musculus
aaccgtcacttggcaaagaactcat

SEQ ID NO: 83550 - DNA, 25 bp, mus musculus
gcaaagaactcataaccatcctcta

SEQ ID NO: 83551 - DNA, 25 bp, mus musculus
aactcataaccatcctctacaacgt

SEQ ID NO: 83552 - DNA, 25 bp, mus musculus
tcataaccatcctctacaacgtggt

SEQ ID NO: 83553 - DNA, 25 bp, mus musculus
ccatcctctacaacgtggtgtgctc

SEQ ID NO: 83554 - DNA, 25 bp, mus musculus
tctacaacgtggtgtgctctgagat

SEQ ID NO: 83555 - DNA, 25 bp, mus musculus
acaacgtggtgtgctctgagattga

SEQ ID NO: 83556 - DNA, 25 bp, mus musculus
tcatatcatgcttgtgaaggaactg

SEQ ID NO: 83557 - DNA, 25 bp, mus musculus
cctattcttatcagcgggcttgagg

SEQ ID NO: 83558 - DNA, 25 bp, mus musculus
atatcatgcttgtgaaggaactggc

SEQ ID NO: 83559 - DNA, 25 bp, mus musculus
gatctgaacgcatgacatgagggtg

SEQ ID NO: 83560 - DNA, 25 bp, mus musculus
ctgaacgcatgacatgagggtgtat

SEQ ID NO: 83561 - DNA, 25 bp, mus musculus
gtatgcacactaattcatgcactag

SEQ ID NO: 83562 - DNA, 25 bp, mus musculus
tgcacactaattcatgcactagaat

SEQ ID NO: 83563 - DNA, 25 bp, mus musculus
ctaattcatgcactagaattgtcaa

SEQ ID NO: 83564 - DNA, 25 bp, mus musculus
ttgtcaaaatctcgagagtagctag

SEQ ID NO: 83565 - DNA, 25 bp, mus musculus
tagctagcagctgagaccagtgtaa

SEQ ID NO: 83566 - DNA, 25 bp, mus musculus
aatgcagccaggggcatctatgtcc

SEQ ID NO: 83567 - DNA, 25 bp, mus musculus
ggcatctatgtcctttgggattggc

SEQ ID NO: 83568 - DNA, 25 bp, mus musculus
atcttagcacttgggaagctgaggc

SEQ ID NO: 83569 - DNA, 25 bp, mus musculus
cagttcaaggccagcctgggatata

SEQ ID NO: 83570 - DNA, 25 bp, mus musculus
aaggccagcctgggatatatatcaa

SEQ ID NO: 83571 - DNA, 25 bp, mus musculus
agatctcattcatatctatctatct

SEQ ID NO: 83572 - DNA, 25 bp, mus musculus
ttatggatctcagtcactaaacctc

SEQ ID NO: 83573 - DNA, 25 bp, mus musculus
atctcagtcactaaacctctgccac

SEQ ID NO: 83574 - DNA, 25 bp, mus musculus
aaacctctgccacaggcagccacaa

SEQ ID NO: 83575 - DNA, 25 bp, mus musculus
gccacaagaggccagctaatgaaaa

SEQ ID NO: 83576 - DNA, 25 bp, mus musculus
aaacctattgcggatttatcatctg

SEQ ID NO: 83577 - DNA, 25 bp, mus musculus
attgcggatttatcatctggattta

SEQ ID NO: 83578 - DNA, 25 bp, mus musculus
agtccaatttaccaacttattcatg

SEQ ID NO: 83579 - DNA, 25 bp, mus musculus
caacttattcatgatcactactgcc

SEQ ID NO: 83580 - DNA, 25 bp, mus musculus
attcatgatcactactgcccagcct

SEQ ID NO: 83581 - DNA, 25 bp, mus musculus
tactgcccagcctgacttgaacctg

SEQ ID NO: 83582 - DNA, 25 bp, mus musculus
tgacttgaacctggaacacagggta

SEQ ID NO: 83583 - DNA, 25 bp, mus musculus
gaacctggaacacagggtagagctc

SEQ ID NO: 83584 - DNA, 25 bp, mus musculus
cttcagtatccatcagaagatttag

SEQ ID NO: 83585 - DNA, 25 bp, mus musculus
actgtaatcttagcacttgggaagc

SEQ ID NO: 83586 - DNA, 25 bp, mus musculus
tttgaagaagcccccttgccatcaa

SEQ ID NO: 83587 - DNA, 25 bp, mus musculus
tgaagaagcccccttgccatcaaga

SEQ ID NO: 83588 - DNA, 25 bp, mus musculus
cagctattcctccgctgtaatcagg

SEQ ID NO: 83589 - DNA, 25 bp, mus musculus
gctattcctccgctgtaatcagggt

SEQ ID NO: 83590 - DNA, 25 bp, mus musculus
tattcctccgctgtaatcagggtta

SEQ ID NO: 83591 - DNA, 25 bp, mus musculus
aagttgatgccccaagccaagtccg

SEQ ID NO: 83592 - DNA, 25 bp, mus musculus
tgatgccccaagccaagtccgggac

SEQ ID NO: 83593 - DNA, 25 bp, mus musculus
acaggcttcatttgccaaatcaaat

SEQ ID NO: 83594 - DNA, 25 bp, mus musculus
tttgccaaatcaaatccggagccag

SEQ ID NO: 83595 - DNA, 25 bp, mus musculus
tgccaaatcaaatccggagccagtt

SEQ ID NO: 83596 - DNA, 25 bp, mus musculus
ccaaatcaaatccggagccagtttg

SEQ ID NO: 83597 - DNA, 25 bp, mus musculus
caaatccggagccagtttgattagg

SEQ ID NO: 83598 - DNA, 25 bp, mus musculus
agcccccttgccatcaagaagccag

SEQ ID NO: 83599 - DNA, 25 bp, mus musculus
cttgccatcaagaagccagctattc

SEQ ID NO: 83600 - DNA, 25 bp, mus musculus
tgccatcaagaagccagctattcct

SEQ ID NO: 83601 - DNA, 25 bp, mus musculus
ccatcaagaagccagctattcctcc

SEQ ID NO: 83602 - DNA, 25 bp, mus musculus
caagaagccagctattcctccgctg

SEQ ID NO: 83603 - DNA, 25 bp, mus musculus
agaagccagctattcctccgctgta

SEQ ID NO: 83604 - DNA, 25 bp, mus musculus
aagccagctattcctccgctgtaat

SEQ ID NO: 83605 - DNA, 25 bp, mus musculus
gccagctattcctccgctgtaatca

SEQ ID NO: 83606 - DNA, 25 bp, mus musculus
catgcctggcggcaccctagcagct

SEQ ID NO: 83607 - DNA, 25 bp, mus musculus
cggcaccctagcagctgtcctgagc

SEQ ID NO: 83608 - DNA, 25 bp, mus musculus
ttggaattctcggcaatccctttgg

SEQ ID NO: 83609 - DNA, 25 bp, mus musculus
tggaattctcggcaatccctttggc

SEQ ID NO: 83610 - DNA, 25 bp, mus musculus
ggaattctcggcaatccctttggca

SEQ ID NO: 83611 - DNA, 25 bp, mus musculus
gaattctcggcaatccctttggcat

SEQ ID NO: 83612 - DNA, 25 bp, mus musculus
aattctcggcaatccctttggcatc

SEQ ID NO: 83613 - DNA, 25 bp, mus musculus
attctcggcaatccctttggcatca

SEQ ID NO: 83614 - DNA, 25 bp, mus musculus
ttctcggcaatccctttggcatcaa

SEQ ID NO: 83615 - DNA, 25 bp, mus musculus
tctcggcaatccctttggcatcaac

SEQ ID NO: 83616 - DNA, 25 bp, mus musculus
ctcggcaatccctttggcatcaaca

SEQ ID NO: 83617 - DNA, 25 bp, mus musculus
tcggcaatccctttggcatcaacaa

SEQ ID NO: 83618 - DNA, 25 bp, mus musculus
ggcaccctagcagctgtcctgagcc

SEQ ID NO: 83619 - DNA, 25 bp, mus musculus
cggcaatccctttggcatcaacaac

SEQ ID NO: 83620 - DNA, 25 bp, mus musculus
ctggccgccatgcagctagagacgc

SEQ ID NO: 83621 - DNA, 25 bp, mus musculus
gacggcagacgttgccgttggaatt

SEQ ID NO: 83622 - DNA, 25 bp, mus musculus
cggcagacgttgccgttggaattct

SEQ ID NO: 83623 - DNA, 25 bp, mus musculus
ggcagacgttgccgttggaattctc

SEQ ID NO: 83624 - DNA, 25 bp, mus musculus
gcagacgttgccgttggaattctcg

SEQ ID NO: 83625 - DNA, 25 bp, mus musculus
cagacgttgccgttggaattctcgg

SEQ ID NO: 83626 - DNA, 25 bp, mus musculus
ttgccgttggaattctcggcaatcc

SEQ ID NO: 83627 - DNA, 25 bp, mus musculus
ccctgagaaccatgtggtcgtgtct

SEQ ID NO: 83628 - DNA, 25 bp, mus musculus
gaaccatgtggtcgtgtcttactgc

SEQ ID NO: 83629 - DNA, 25 bp, mus musculus
tgtctcttttggaagtccgtgctcc

SEQ ID NO: 83630 - DNA, 25 bp, mus musculus
aagtccgtgctccatcaattccagg

SEQ ID NO: 83631 - DNA, 25 bp, mus musculus
gtgctccatcaattccaggcaattc

SEQ ID NO: 83632 - DNA, 25 bp, mus musculus
catcaattccaggcaattcttgatt

SEQ ID NO: 83633 - DNA, 25 bp, mus musculus
tcctcctaaagacgaagactctcct

SEQ ID NO: 83634 - DNA, 25 bp, mus musculus
taaagacgaagactctcctaaatct

SEQ ID NO: 83635 - DNA, 25 bp, mus musculus
cgaagactctcctaaatctaatgga

SEQ ID NO: 83636 - DNA, 25 bp, mus musculus
accaggtcaccctttgtcacttcag

SEQ ID NO: 83637 - DNA, 25 bp, mus musculus
tcaccctttgtcacttcagtctgcc

SEQ ID NO: 83638 - DNA, 25 bp, mus musculus
tttgtcacttcagtctgccatctca

SEQ ID NO: 83639 - DNA, 25 bp, mus musculus
ggcttcccaggtggtgtacatcgat

SEQ ID NO: 83640 - DNA, 25 bp, mus musculus
tctgccatctcagtaagtcctccct

SEQ ID NO: 83641 - DNA, 25 bp, mus musculus
catcgatgtgcagtccatgtatcag

SEQ ID NO: 83642 - DNA, 25 bp, mus musculus
gtatcagccgcaagccaaagcagag

SEQ ID NO: 83643 - DNA, 25 bp, mus musculus
ctataagccacagatgcgccttccc

SEQ ID NO: 83644 - DNA, 25 bp, mus musculus
ccccgctgtggaagacacagcagca

SEQ ID NO: 83645 - DNA, 25 bp, mus musculus
agacacagcagcagaagatgaagag

SEQ ID NO: 83646 - DNA, 25 bp, mus musculus
cagacctcaggccaatgtaaacact

SEQ ID NO: 83647 - DNA, 25 bp, mus musculus
agattccccgaggtccacagacagc

SEQ ID NO: 83648 - DNA, 25 bp, mus musculus
tgaagcctgctgggagtgtgaatga

SEQ ID NO: 83649 - DNA, 25 bp, mus musculus
agcctgctgggagtgtgaatgacgt

SEQ ID NO: 83650 - DNA, 25 bp, mus musculus
ccagtcctggaggattgcgaggagc

SEQ ID NO: 83651 - DNA, 25 bp, mus musculus
tgtacttaagtctcaacctgtgata

SEQ ID NO: 83652 - DNA, 25 bp, mus musculus
taagtctcaacctgtgatacaatct

SEQ ID NO: 83653 - DNA, 25 bp, mus musculus
tatctgacacagaacaccgggtcta

SEQ ID NO: 83654 - DNA, 25 bp, mus musculus
aatcacctgctttattagatggctt

SEQ ID NO: 83655 - DNA, 25 bp, mus musculus
tattagatggcttccaagttttctc

SEQ ID NO: 83656 - DNA, 25 bp, mus musculus
tccaagttttctcctaggtgacact

SEQ ID NO: 83657 - DNA, 25 bp, mus musculus
cactgttggtgcctcagctgacagg

SEQ ID NO: 83658 - DNA, 25 bp, mus musculus
tggtgcctcagctgacagggagcag

SEQ ID NO: 83659 - DNA, 25 bp, mus musculus
ctcagctgacagggagcagctgggt

SEQ ID NO: 83660 - DNA, 25 bp, mus musculus
gcctggatgccttagatttggaccg

SEQ ID NO: 83661 - DNA, 25 bp, mus musculus
ttccatgccacagagctgtcagaat

SEQ ID NO: 83662 - DNA, 25 bp, mus musculus
atgccttagatttggaccggatgaa

SEQ ID NO: 83663 - DNA, 25 bp, mus musculus
ttcgggagctgcacaaggtgaagga

SEQ ID NO: 83664 - DNA, 25 bp, mus musculus
agatcattgatgccatcaggcagga

SEQ ID NO: 83665 - DNA, 25 bp, mus musculus
atgccatcaggcaggagctaagtgg

SEQ ID NO: 83666 - DNA, 25 bp, mus musculus
ccatcaggcaggagctaagtgggat

SEQ ID NO: 83667 - DNA, 25 bp, mus musculus
ggatcagcaccacgtaagatggcac

SEQ ID NO: 83668 - DNA, 25 bp, mus musculus
aagatggcaccagtcctggaggatt

SEQ ID NO: 83669 - DNA, 25 bp, mus musculus
gaactagttggtcctcaggatgctt

SEQ ID NO: 83670 - DNA, 25 bp, mus musculus
actagttggtcctcaggatgcttcc

SEQ ID NO: 83671 - DNA, 25 bp, mus musculus
tcatgtcgatacccatgactgtagg

SEQ ID NO: 83672 - DNA, 25 bp, mus musculus
gtcgatacccatgactgtaggccct

SEQ ID NO: 83673 - DNA, 25 bp, mus musculus
cgatacccatgactgtaggccctcc

SEQ ID NO: 83674 - DNA, 25 bp, mus musculus
atacccatgactgtaggccctccta

SEQ ID NO: 83675 - DNA, 25 bp, mus musculus
atgactgtaggccctcctattgcag

SEQ ID NO: 83676 - DNA, 25 bp, mus musculus
gactgtaggccctcctattgcaggg

SEQ ID NO: 83677 - DNA, 25 bp, mus musculus
ctgtaggccctcctattgcagggtt

SEQ ID NO: 83678 - DNA, 25 bp, mus musculus
gccctcctattgcagggttacttca

SEQ ID NO: 83679 - DNA, 25 bp, mus musculus
cctcctattgcagggttacttcatg

SEQ ID NO: 83680 - DNA, 25 bp, mus musculus
tcctattgcagggttacttcatgac

SEQ ID NO: 83681 - DNA, 25 bp, mus musculus
tggtcctcaggatgcttcccaagca

SEQ ID NO: 83682 - DNA, 25 bp, mus musculus
gtcctcaggatgcttcccaagcaat

SEQ ID NO: 83683 - DNA, 25 bp, mus musculus
cctcaggatgcttcccaagcaattg

SEQ ID NO: 83684 - DNA, 25 bp, mus musculus
aggatgcttcccaagcaattggatt

SEQ ID NO: 83685 - DNA, 25 bp, mus musculus
gatgcttcccaagcaattggatttc

SEQ ID NO: 83686 - DNA, 25 bp, mus musculus
cttcccaagcaattggatttctact

SEQ ID NO: 83687 - DNA, 25 bp, mus musculus
ggatttctacttggattcatgtcga

SEQ ID NO: 83688 - DNA, 25 bp, mus musculus
attcatgtcgatacccatgactgta

SEQ ID NO: 83689 - DNA, 25 bp, mus musculus
gctggcccctaggggaatgaatgtg

SEQ ID NO: 83690 - DNA, 25 bp, mus musculus
ggcccacacttctttgtaccttctg

SEQ ID NO: 83691 - DNA, 25 bp, mus musculus
ctacctccctagcagagctgcctat

SEQ ID NO: 83692 - DNA, 25 bp, mus musculus
gctctgctgggctgaagcctagaca

SEQ ID NO: 83693 - DNA, 25 bp, mus musculus
agcctagacagggctctatttcctg

SEQ ID NO: 83694 - DNA, 25 bp, mus musculus
cctcttctgtgtcctgaagacaggt

SEQ ID NO: 83695 - DNA, 25 bp, mus musculus
ctgtgtcctgaagacaggtggcagg

SEQ ID NO: 83696 - DNA, 25 bp, mus musculus
cacatccaggtcccaaggtcacctg

SEQ ID NO: 83697 - DNA, 25 bp, mus musculus
aatgaagtactgtgcccccaatcca

SEQ ID NO: 83698 - DNA, 25 bp, mus musculus
gaagtactgtgcccccaatccagcc

SEQ ID NO: 83699 - DNA, 25 bp, mus musculus
caatccagcccgagcttccggaagg

SEQ ID NO: 83700 - DNA, 25 bp, mus musculus
gttttcgccattgctcaggccaccg

SEQ ID NO: 83701 - DNA, 25 bp, mus musculus
tttgtaccttctgggtaccagtctg

SEQ ID NO: 83702 - DNA, 25 bp, mus musculus
tctgggtaccagtctgttcccaggt

SEQ ID NO: 83703 - DNA, 25 bp, mus musculus
caagtttgggtctcccatatcagac

SEQ ID NO: 83704 - DNA, 25 bp, mus musculus
gtttgggtctcccatatcagacaat

SEQ ID NO: 83705 - DNA, 25 bp, mus musculus
gtctcccatatcagacaatgtgcca

SEQ ID NO: 83706 - DNA, 25 bp, mus musculus
catatcagacaatgtgccaagatgg

SEQ ID NO: 83707 - DNA, 25 bp, mus musculus
atggaggcccacagaagtggacgga

SEQ ID NO: 83708 - DNA, 25 bp, mus musculus
gttcagctacctccctagcagagct

SEQ ID NO: 83709 - DNA, 25 bp, mus musculus
gcctggatgtccatcctcccaagat

SEQ ID NO: 83710 - DNA, 25 bp, mus musculus
ctgcctctgctgctgagggcacgta

SEQ ID NO: 83711 - DNA, 25 bp, mus musculus
aaattccactctggtcaccatagtg

SEQ ID NO: 83712 - DNA, 25 bp, mus musculus
cactgatatgtccttatactggaga

SEQ ID NO: 83713 - DNA, 25 bp, mus musculus
cacatcaggaaccttgaagatggaa

SEQ ID NO: 83714 - DNA, 25 bp, mus musculus
aagttccctctagaacagtcagtat

SEQ ID NO: 83715 - DNA, 25 bp, mus musculus
tcagtatcacctcttgactcttaat

SEQ ID NO: 83716 - DNA, 25 bp, mus musculus
ctttttctaaggccagctgtaatgc

SEQ ID NO: 83717 - DNA, 25 bp, mus musculus
ctaaggccagctgtaatgctaagtg

SEQ ID NO: 83718 - DNA, 25 bp, mus musculus
ctaagtgccagatccaaatccatga

SEQ ID NO: 83719 - DNA, 25 bp, mus musculus
gccagatccaaatccatgagaaaat

SEQ ID NO: 83720 - DNA, 25 bp, mus musculus
tccaaatccatgagaaaatagttaa

SEQ ID NO: 83721 - DNA, 25 bp, mus musculus
tgcgttcctgtgtgccccatcaaaa

SEQ ID NO: 83722 - DNA, 25 bp, mus musculus
tccatactgcaactgggtcctgcaa

SEQ ID NO: 83723 - DNA, 25 bp, mus musculus
ctgcaactgggtcctgcaacataaa

SEQ ID NO: 83724 - DNA, 25 bp, mus musculus
ctgggtcctgcaacataaaggaagt

SEQ ID NO: 83725 - DNA, 25 bp, mus musculus
ttgactccatttcccaagcccaggg

SEQ ID NO: 83726 - DNA, 25 bp, mus musculus
tatattcttgctgccacaatgtatg

SEQ ID NO: 83727 - DNA, 25 bp, mus musculus
gtatgatctttcaaattccactctg

SEQ ID NO: 83728 - DNA, 25 bp, mus musculus
tctttcaaattccactctggtcacc

SEQ ID NO: 83729 - DNA, 25 bp, mus musculus
gccaacctcatgacagatgacctcc

SEQ ID NO: 83730 - DNA, 25 bp, mus musculus
ctcatgacagatgacctcccttgcc

SEQ ID NO: 83731 - DNA, 25 bp, mus musculus
gtcacctatgagcagctcaaaagag

SEQ ID NO: 83732 - DNA, 25 bp, mus musculus
cagctcaaaagagccctaatggctg

SEQ ID NO: 83733 - DNA, 25 bp, mus musculus
gccctaatggctgcctaccaatctc

SEQ ID NO: 83734 - DNA, 25 bp, mus musculus
atggctgcctaccaatctcgggagg

SEQ ID NO: 83735 - DNA, 25 bp, mus musculus
caatctcgggaggcacctttctgag

SEQ ID NO: 83736 - DNA, 25 bp, mus musculus
gcacctttctgagcctctccatgct

SEQ ID NO: 83737 - DNA, 25 bp, mus musculus
ttctgagcctctccatgctgacctg

SEQ ID NO: 83738 - DNA, 25 bp, mus musculus
actgatgactcacagtgaggaggcc

SEQ ID NO: 83739 - DNA, 25 bp, mus musculus
tctacagctaagcccacatcttcat

SEQ ID NO: 83740 - DNA, 25 bp, mus musculus
gctaagcccacatcttcatcttcat

SEQ ID NO: 83741 - DNA, 25 bp, mus musculus
tcccctgttgatgtggtcaagacga

SEQ ID NO: 83742 - DNA, 25 bp, mus musculus
atgaactctgccttgggccagtacc

SEQ ID NO: 83743 - DNA, 25 bp, mus musculus
tctgccttgggccagtaccacagcg

SEQ ID NO: 83744 - DNA, 25 bp, mus musculus
cagtaccacagcgcaggtcactgtg

SEQ ID NO: 83745 - DNA, 25 bp, mus musculus
gcaggtcactgtgcccttaccatgc

SEQ ID NO: 83746 - DNA, 25 bp, mus musculus
cactgtgcccttaccatgctccgga

SEQ ID NO: 83747 - DNA, 25 bp, mus musculus
ttcatgccttcctttctccgcttgg

SEQ ID NO: 83748 - DNA, 25 bp, mus musculus
atgtttgtcacctatgagcagctca

SEQ ID NO: 83749 - DNA, 25 bp, mus musculus
gtagattccggcaagtatagcagaa

SEQ ID NO: 83750 - DNA, 25 bp, mus musculus
agattccggcaagtatagcagaagc

SEQ ID NO: 83751 - DNA, 25 bp, mus musculus
acatctcgcagtggagatgcgacac

SEQ ID NO: 83752 - DNA, 25 bp, mus musculus
atctcgcagtggagatgcgacacca

SEQ ID NO: 83753 - DNA, 25 bp, mus musculus
atgcgacaccagtcgctagtatagt

SEQ ID NO: 83754 - DNA, 25 bp, mus musculus
gcgacaccagtcgctagtatagtac

SEQ ID NO: 83755 - DNA, 25 bp, mus musculus
caccagtcgctagtatagtacgatc

SEQ ID NO: 83756 - DNA, 25 bp, mus musculus
tacgatcaattatgccccagagaac

SEQ ID NO: 83757 - DNA, 25 bp, mus musculus
cgatcaattatgccccagagaacat

SEQ ID NO: 83758 - DNA, 25 bp, mus musculus
caattatgccccagagaacatatgc

SEQ ID NO: 83759 - DNA, 25 bp, mus musculus
tatgccccagagaacatatgcttca

SEQ ID NO: 83760 - DNA, 25 bp, mus musculus
tgccccagagaacatatgcttcagt

SEQ ID NO: 83761 - DNA, 25 bp, mus musculus
cgtacacatgatctacaaatgtagg

SEQ ID NO: 83762 - DNA, 25 bp, mus musculus
catatgcttcagtagcagcattgtt

SEQ ID NO: 83763 - DNA, 25 bp, mus musculus
tacacatgatctacaaatgtaggtg

SEQ ID NO: 83764 - DNA, 25 bp, mus musculus
aagccgtccttcaactaggcatcgg

SEQ ID NO: 83765 - DNA, 25 bp, mus musculus
gccgtccttcaactaggcatcgggt

SEQ ID NO: 83766 - DNA, 25 bp, mus musculus
cgtccttcaactaggcatcgggtct

SEQ ID NO: 83767 - DNA, 25 bp, mus musculus
tcaactaggcatcgggtcttagaaa

SEQ ID NO: 83768 - DNA, 25 bp, mus musculus
aaactgacagttgatcgtagactag

SEQ ID NO: 83769 - DNA, 25 bp, mus musculus
attgacatctcgcagtggagatgcg

SEQ ID NO: 83770 - DNA, 25 bp, mus musculus
tctaccctaatggtgtgatggagac

SEQ ID NO: 83771 - DNA, 25 bp, mus musculus
accctaatggtgtgatggagaccaa

SEQ ID NO: 83772 - DNA, 25 bp, mus musculus
ccaacctggtgcattaccgtgttga

SEQ ID NO: 83773 - DNA, 25 bp, mus musculus
tgcattaccgtgttgacctgaactt

SEQ ID NO: 83774 - DNA, 25 bp, mus musculus
gtgttgacctgaacttggcaggcac

SEQ ID NO: 83775 - DNA, 25 bp, mus musculus
ttgacctgaacttggcaggcaccaa

SEQ ID NO: 83776 - DNA, 25 bp, mus musculus
acctgaacttggcaggcaccaagaa

SEQ ID NO: 83777 - DNA, 25 bp, mus musculus
acttggcaggcaccaagaacagctc

SEQ ID NO: 83778 - DNA, 25 bp, mus musculus
caggcaccaagaacagctccggaca

SEQ ID NO: 83779 - DNA, 25 bp, mus musculus
ccaagaacagctccggacaatgaag

SEQ ID NO: 83780 - DNA, 25 bp, mus musculus
agaacagctccggacaatgaagaca

SEQ ID NO: 83781 - DNA, 25 bp, mus musculus
acagctccggacaatgaagacaagc

SEQ ID NO: 83782 - DNA, 25 bp, mus musculus
ccaagatgcatgccactggatatgt

SEQ ID NO: 83783 - DNA, 25 bp, mus musculus
agatgcatgccactggatatgtcca

SEQ ID NO: 83784 - DNA, 25 bp, mus musculus
tgcatgccactggatatgtccacgc

SEQ ID NO: 83785 - DNA, 25 bp, mus musculus
ccactggatatgtccacgcaacctt

SEQ ID NO: 83786 - DNA, 25 bp, mus musculus
gatatgtccacgcaaccttctacac

SEQ ID NO: 83787 - DNA, 25 bp, mus musculus
tctacacccctgagggcttgcgcaa

SEQ ID NO: 83788 - DNA, 25 bp, mus musculus
acacccctgagggcttgcgcaatgg

SEQ ID NO: 83789 - DNA, 25 bp, mus musculus
cccctgagggcttgcgcaatggaat

SEQ ID NO: 83790 - DNA, 25 bp, mus musculus
tccactcagttgccgatgctttgtc

SEQ ID NO: 83791 - DNA, 25 bp, mus musculus
cagttgccgatgctttgtctccaga

SEQ ID NO: 83792 - DNA, 25 bp, mus musculus
ccaagttcattttgctgtcctcttg

SEQ ID NO: 83793 - DNA, 25 bp, mus musculus
cctcttgactggatctgtcacaagc

SEQ ID NO: 83794 - DNA, 25 bp, mus musculus
atctgtcacaagccaacttggggtc

SEQ ID NO: 83795 - DNA, 25 bp, mus musculus
gcactttgccctgatttcggatcct

SEQ ID NO: 83796 - DNA, 25 bp, mus musculus
tgccctgatttcggatcctgagtaa

SEQ ID NO: 83797 - DNA, 25 bp, mus musculus
tagtttttcataacactgagcctgt

SEQ ID NO: 83798 - DNA, 25 bp, mus musculus
ctgttggcgtcggtacagacaccag

SEQ ID NO: 83799 - DNA, 25 bp, mus musculus
gtacagacaccagccaccgagctct

SEQ ID NO: 83800 - DNA, 25 bp, mus musculus
acactggttcacatctacagctatt

SEQ ID NO: 83801 - DNA, 25 bp, mus musculus
atctacagctatttgaggtgccggg

SEQ ID NO: 83802 - DNA, 25 bp, mus musculus
tatctttaaccagacagtgttagac

SEQ ID NO: 83803 - DNA, 25 bp, mus musculus
caagcatgtgacctcgtcttgccgc

SEQ ID NO: 83804 - DNA, 25 bp, mus musculus
ttcctgtaagttacatcatgagcag

SEQ ID NO: 83805 - DNA, 25 bp, mus musculus
attgtgaacaggacttccgagcaca

SEQ ID NO: 83806 - DNA, 25 bp, mus musculus
aacaggacttccgagcacacacaca

SEQ ID NO: 83807 - DNA, 25 bp, mus musculus
gagcacacacacagaagaatgcggc

SEQ ID NO: 83808 - DNA, 25 bp, mus musculus
actaacactgcatccttggacgaac

SEQ ID NO: 83809 - DNA, 25 bp, mus musculus
actgcatccttggacgaacggtgcc

SEQ ID NO: 83810 - DNA, 25 bp, mus musculus
gcagacatacatgtcttctgcggcg

SEQ ID NO: 83811 - DNA, 25 bp, mus musculus
cagacatacatgtcttctgcggcgg

SEQ ID NO: 83812 - DNA, 25 bp, mus musculus
gcgcctactgattggtgtgctctgc

SEQ ID NO: 83813 - DNA, 25 bp, mus musculus
cgcctactgattggtgtgctctgct

SEQ ID NO: 83814 - DNA, 25 bp, mus musculus
ctactgattggtgtgctctgcttat

SEQ ID NO: 83815 - DNA, 25 bp, mus musculus
tactgattggtgtgctctgcttatg

SEQ ID NO: 83816 - DNA, 25 bp, mus musculus
tgattggtgtgctctgcttatgata

SEQ ID NO: 83817 - DNA, 25 bp, mus musculus
cactagacctactgtctgagatccc

SEQ ID NO: 83818 - DNA, 25 bp, mus musculus
actagacctactgtctgagatccct

SEQ ID NO: 83819 - DNA, 25 bp, mus musculus
ctagacctactgtctgagatcccta

SEQ ID NO: 83820 - DNA, 25 bp, mus musculus
gtctgagatccctaagagagattaa

SEQ ID NO: 83821 - DNA, 25 bp, mus musculus
tctgagatccctaagagagattaac

SEQ ID NO: 83822 - DNA, 25 bp, mus musculus
agacatacatgtcttctgcggcggc

SEQ ID NO: 83823 - DNA, 25 bp, mus musculus
acatacatgtcttctgcggcggcgt

SEQ ID NO: 83824 - DNA, 25 bp, mus musculus
catacatgtcttctgcggcggcgtc

SEQ ID NO: 83825 - DNA, 25 bp, mus musculus
atacatgtcttctgcggcggcgtcg

SEQ ID NO: 83826 - DNA, 25 bp, mus musculus
gagatggcgcctactgattggtgtg

SEQ ID NO: 83827 - DNA, 25 bp, mus musculus
gatggcgcctactgattggtgtgct

SEQ ID NO: 83828 - DNA, 25 bp, mus musculus
atggcgcctactgattggtgtgctc

SEQ ID NO: 83829 - DNA, 25 bp, mus musculus
tggcgcctactgattggtgtgctct

SEQ ID NO: 83830 - DNA, 25 bp, mus musculus
ctcttcaggtatcaaggttacattg

SEQ ID NO: 83831 - DNA, 25 bp, mus musculus
tacattggtgcagccctagttttgg

SEQ ID NO: 83832 - DNA, 25 bp, mus musculus
attgcagctggcatctttaatgact

SEQ ID NO: 83833 - DNA, 25 bp, mus musculus
aatgacttggggtctggaagcaaca

SEQ ID NO: 83834 - DNA, 25 bp, mus musculus
agcaagctggactttcttcgtccat

SEQ ID NO: 83835 - DNA, 25 bp, mus musculus
ctggactttcttcgtccattctcag

SEQ ID NO: 83836 - DNA, 25 bp, mus musculus
tttcttcgtccattctcagtgccca

SEQ ID NO: 83837 - DNA, 25 bp, mus musculus
cgtccattctcagtgcccaacaaga

SEQ ID NO: 83838 - DNA, 25 bp, mus musculus
ttctcagtgcccaacaagaaaggga

SEQ ID NO: 83839 - DNA, 25 bp, mus musculus
gagaaaggcactaccgctgtcctca

SEQ ID NO: 83840 - DNA, 25 bp, mus musculus
acccctctggagattgaggtgctag

SEQ ID NO: 83841 - DNA, 25 bp, mus musculus
atgcctttggcaattgctcaattaa

SEQ ID NO: 83842 - DNA, 25 bp, mus musculus
gttactggacctcatctctacagca

SEQ ID NO: 83843 - DNA, 25 bp, mus musculus
ggacctcatctctacagcatctatc

SEQ ID NO: 83844 - DNA, 25 bp, mus musculus
catctctacagcatctatcctcatg

SEQ ID NO: 83845 - DNA, 25 bp, mus musculus
tacagcatctatcctcatggatcaa

SEQ ID NO: 83846 - DNA, 25 bp, mus musculus
atctatcctcatggatcaactgata

SEQ ID NO: 83847 - DNA, 25 bp, mus musculus
aaattgccttatgtcaccatgggtt

SEQ ID NO: 83848 - DNA, 25 bp, mus musculus
tctggctccttggcagcaatggctg

SEQ ID NO: 83849 - DNA, 25 bp, mus musculus
tccttggcagcaatggctgtgtttg

SEQ ID NO: 83850 - DNA, 25 bp, mus musculus
ttccacaccgtgcgcttcggtgcgc

SEQ ID NO: 83851 - DNA, 25 bp, mus musculus
cacaccgtgcgcttcggtgcgctgt

SEQ ID NO: 83852 - DNA, 25 bp, mus musculus
gtgtgggctccaggcttgaaacagc

SEQ ID NO: 83853 - DNA, 25 bp, mus musculus
gctccaggcttgaaacagccgctgc

SEQ ID NO: 83854 - DNA, 25 bp, mus musculus
agcaacctctacatccaggaatgag

SEQ ID NO: 83855 - DNA, 25 bp, mus musculus
ctctacatccaggaatgagccattg

SEQ ID NO: 83856 - DNA, 25 bp, mus musculus
tgcagactcctaacagacgcactag

SEQ ID NO: 83857 - DNA, 25 bp, mus musculus
ctcctaacagacgcactagtggtca

SEQ ID NO: 83858 - DNA, 25 bp, mus musculus
atgacatgaccttatctcccaataa

SEQ ID NO: 83859 - DNA, 25 bp, mus musculus
acatgaccttatctcccaataaact

SEQ ID NO: 83860 - DNA, 25 bp, mus musculus
tgaccttatctcccaataaacttga

SEQ ID NO: 83861 - DNA, 25 bp, mus musculus
tatctcccaataaacttgactttag

SEQ ID NO: 83862 - DNA, 25 bp, mus musculus
ctggacgactccagcacggagcaca

SEQ ID NO: 83863 - DNA, 25 bp, mus musculus
tccagcacggagcacaagggaccag

SEQ ID NO: 83864 - DNA, 25 bp, mus musculus
cacaagggaccagtgcaggtgatcc

SEQ ID NO: 83865 - DNA, 25 bp, mus musculus
acccctgagatccccatgacagaag

SEQ ID NO: 83866 - DNA, 25 bp, mus musculus
gaagatcgactcgaggccttctgga

SEQ ID NO: 83867 - DNA, 25 bp, mus musculus
ctcgaggccttctggaagcatggag

SEQ ID NO: 83868 - DNA, 25 bp, mus musculus
gaggccttctggaagcatggagttc

SEQ ID NO: 83869 - DNA, 25 bp, mus musculus
gccttctggaagcatggagttcagg

SEQ ID NO: 83870 - DNA, 25 bp, mus musculus
gcacacgtcaagatcacgtacgacg

SEQ ID NO: 83871 - DNA, 25 bp, mus musculus
cacacgtcaagatcacgtacgacgc

SEQ ID NO: 83872 - DNA, 25 bp, mus musculus
gatcacgtacgacgccgcgcgcgac

SEQ ID NO: 83873 - DNA, 25 bp, mus musculus
atcacgtacgacgccgcgcgcgacg

SEQ ID NO: 83874 - DNA, 25 bp, mus musculus
cgcgcgacgtagtcctcagagcaga

SEQ ID NO: 83875 - DNA, 25 bp, mus musculus
cgtagtcctcagagcagacccgcgc

SEQ ID NO: 83876 - DNA, 25 bp, mus musculus
gagtagcactcgccgctccggcgca

SEQ ID NO: 83877 - DNA, 25 bp, mus musculus
caagttgctctctgggtgagtgtgg

SEQ ID NO: 83878 - DNA, 25 bp, mus musculus
aagttgctctctgggtgagtgtggt

SEQ ID NO: 83879 - DNA, 25 bp, mus musculus
ttgctctctgggtgagtgtggtgaa

SEQ ID NO: 83880 - DNA, 25 bp, mus musculus
agtgctgtcatttgctccgaaatgg

SEQ ID NO: 83881 - DNA, 25 bp, mus musculus
gtgctgtcatttgctccgaaatggc

SEQ ID NO: 83882 - DNA, 25 bp, mus musculus
acacgtcaagatcacgtacgacgcc

SEQ ID NO: 83883 - DNA, 25 bp, mus musculus
cacgtcaagatcacgtacgacgccg

SEQ ID NO: 83884 - DNA, 25 bp, mus musculus
acgtcaagatcacgtacgacgccgc

SEQ ID NO: 83885 - DNA, 25 bp, mus musculus
cgtcaagatcacgtacgacgccgcg

SEQ ID NO: 83886 - DNA, 25 bp, mus musculus
tcaagatcacgtacgacgccgcgcg

SEQ ID NO: 83887 - DNA, 25 bp, mus musculus
caagatcacgtacgacgccgcgcgc

SEQ ID NO: 83888 - DNA, 25 bp, mus musculus
aagatcacgtacgacgccgcgcgcg

SEQ ID NO: 83889 - DNA, 25 bp, mus musculus
agatcacgtacgacgccgcgcgcga

SEQ ID NO: 83890 - DNA, 25 bp, mus musculus
cggtccctggtgccagctctagcca

SEQ ID NO: 83891 - DNA, 25 bp, mus musculus
tccctggtgccagctctagccatga

SEQ ID NO: 83892 - DNA, 25 bp, mus musculus
tcaaccaggactacctctcaggcat

SEQ ID NO: 83893 - DNA, 25 bp, mus musculus
accaggactacctctcaggcatggc

SEQ ID NO: 83894 - DNA, 25 bp, mus musculus
aggactacctctcaggcatggcagc

SEQ ID NO: 83895 - DNA, 25 bp, mus musculus
acctctcaggcatggcagccaacat

SEQ ID NO: 83896 - DNA, 25 bp, mus musculus
tctcaggcatggcagccaacatgtc

SEQ ID NO: 83897 - DNA, 25 bp, mus musculus
tggcagccaacatgtctggaacatt

SEQ ID NO: 83898 - DNA, 25 bp, mus musculus
gagccaacgtgccaaatctgtatcc

SEQ ID NO: 83899 - DNA, 25 bp, mus musculus
acgtgccaaatctgtatcctggggc

SEQ ID NO: 83900 - DNA, 25 bp, mus musculus
tgccaaatctgtatcctggggctcc

SEQ ID NO: 83901 - DNA, 25 bp, mus musculus
caaatctgtatcctggggctcctgg

SEQ ID NO: 83902 - DNA, 25 bp, mus musculus
ccagctctagccatgagctacccag

SEQ ID NO: 83903 - DNA, 25 bp, mus musculus
gctctagccatgagctacccaggct

SEQ ID NO: 83904 - DNA, 25 bp, mus musculus
gcatgccccctatcgggctggataa

SEQ ID NO: 83905 - DNA, 25 bp, mus musculus
tgccccctatcgggctggataacgt

SEQ ID NO: 83906 - DNA, 25 bp, mus musculus
acgtagccaactatgcggggcagtt

SEQ ID NO: 83907 - DNA, 25 bp, mus musculus
tagccaactatgcggggcagttcaa

SEQ ID NO: 83908 - DNA, 25 bp, mus musculus
ccaactatgcggggcagttcaacca

SEQ ID NO: 83909 - DNA, 25 bp, mus musculus
ggcagttcaaccaggactacctctc

SEQ ID NO: 83910 - DNA, 25 bp, mus musculus
gctagtcccttctctgatatgctcc

SEQ ID NO: 83911 - DNA, 25 bp, mus musculus
ctcctgcacccatcagaagagcaat

SEQ ID NO: 83912 - DNA, 25 bp, mus musculus
cttctgcaatttcagcaatgcttgc

SEQ ID NO: 83913 - DNA, 25 bp, mus musculus
cagcaatgcttgcctctgacttcat

SEQ ID NO: 83914 - DNA, 25 bp, mus musculus
ttgcctctgacttcatgccagtgtc

SEQ ID NO: 83915 - DNA, 25 bp, mus musculus
ctgactgctctcatgtgttccccat

SEQ ID NO: 83916 - DNA, 25 bp, mus musculus
actgctctcatgtgttccccatata

SEQ ID NO: 83917 - DNA, 25 bp, mus musculus
gctctcatgtgttccccatataccc

SEQ ID NO: 83918 - DNA, 25 bp, mus musculus
tgttccccatatacccctagctcag

SEQ ID NO: 83919 - DNA, 25 bp, mus musculus
tatacccctagctcaggaaataaag

SEQ ID NO: 83920 - DNA, 25 bp, mus musculus
ccctaggtgctgtcatctcctcctg

SEQ ID NO: 83921 - DNA, 25 bp, mus musculus
ctgtcatctcctcctggaagtgtct

SEQ ID NO: 83922 - DNA, 25 bp, mus musculus
ctgcacccatcagaagagcaatata

SEQ ID NO: 83923 - DNA, 25 bp, mus musculus
taccctgaatacgggctgctcccag

SEQ ID NO: 83924 - DNA, 25 bp, mus musculus
cctgaatacgggctgctcccagtcc

SEQ ID NO: 83925 - DNA, 25 bp, mus musculus
cccccatgaaaacatcaatatcaac

SEQ ID NO: 83926 - DNA, 25 bp, mus musculus
catcaatatcaaccctggtgtggca

SEQ ID NO: 83927 - DNA, 25 bp, mus musculus
tatcaaccctggtgtggcatctgtg

SEQ ID NO: 83928 - DNA, 25 bp, mus musculus
gaatagctaccaaagctccttctgc

SEQ ID NO: 83929 - DNA, 25 bp, mus musculus
ctccttctgcaatttcagcaatgct

SEQ ID NO: 83930 - DNA, 25 bp, mus musculus
cagtttccacactgcgagactggga

SEQ ID NO: 83931 - DNA, 25 bp, mus musculus
ctgaccttccttgatgctgtgggcc

SEQ ID NO: 83932 - DNA, 25 bp, mus musculus
ctacagcaagcagggaccgagcgca

SEQ ID NO: 83933 - DNA, 25 bp, mus musculus
gatgtcttcagtgtggccctgaagc

SEQ ID NO: 83934 - DNA, 25 bp, mus musculus
ttcagtgtggccctgaagcagacac

SEQ ID NO: 83935 - DNA, 25 bp, mus musculus
gagcagtatatctacctctacaact

SEQ ID NO: 83936 - DNA, 25 bp, mus musculus
tacctctacaactgtctgaacagcg

SEQ ID NO: 83937 - DNA, 25 bp, mus musculus
tgtctgaacagcgcattgaggaaca

SEQ ID NO: 83938 - DNA, 25 bp, mus musculus
aagtgaccttgccctgctaggcatc

SEQ ID NO: 83939 - DNA, 25 bp, mus musculus
ccttgccctgctaggcatcacgttc

SEQ ID NO: 83940 - DNA, 25 bp, mus musculus
aggcatcacgttccagcaatccacc

SEQ ID NO: 83941 - DNA, 25 bp, mus musculus
gcctcacgctgtcaaagggcagagt

SEQ ID NO: 83942 - DNA, 25 bp, mus musculus
ttccttgatgctgtgggccagtgct

SEQ ID NO: 83943 - DNA, 25 bp, mus musculus
tgctcccggggcaatagcaagaagc

SEQ ID NO: 83944 - DNA, 25 bp, mus musculus
accctgctcagtcactccagcaagg

SEQ ID NO: 83945 - DNA, 25 bp, mus musculus
ctcagtcactccagcaaggtcacaa

SEQ ID NO: 83946 - DNA, 25 bp, mus musculus
cactccagcaaggtcacaaaccagc

SEQ ID NO: 83947 - DNA, 25 bp, mus musculus
agcaaggtcacaaaccagctgagca

SEQ ID NO: 83948 - DNA, 25 bp, mus musculus
accttcttggctatggaacagctgc

SEQ ID NO: 83949 - DNA, 25 bp, mus musculus
cagctgctacagcaagcagggaccg

SEQ ID NO: 83950 - DNA, 25 bp, mus musculus
tcctacatcaagatcatggacgtgg

SEQ ID NO: 83951 - DNA, 25 bp, mus musculus
aagatcatggacgtgggccagagct

SEQ ID NO: 83952 - DNA, 25 bp, mus musculus
tattacctcatgaacatccatgtga

SEQ ID NO: 83953 - DNA, 25 bp, mus musculus
ctcatgaacatccatgtgacacccc

SEQ ID NO: 83954 - DNA, 25 bp, mus musculus
gagttttccaagcatctggcccagt

SEQ ID NO: 83955 - DNA, 25 bp, mus musculus
ttttccaagcatctggcccagttca

SEQ ID NO: 83956 - DNA, 25 bp, mus musculus
tccaagcatctggcccagttcatca

SEQ ID NO: 83957 - DNA, 25 bp, mus musculus
aagcatctggcccagttcatcagtg

SEQ ID NO: 83958 - DNA, 25 bp, mus musculus
catctggcccagttcatcagtgacc

SEQ ID NO: 83959 - DNA, 25 bp, mus musculus
cagttcatcagtgaccagaacatta

SEQ ID NO: 83960 - DNA, 25 bp, mus musculus
ttcatcagtgaccagaacattaagg

SEQ ID NO: 83961 - DNA, 25 bp, mus musculus
gatctgaaggtctggacgagccaga

SEQ ID NO: 83962 - DNA, 25 bp, mus musculus
atcatggacgtgggccagagctatg

SEQ ID NO: 83963 - DNA, 25 bp, mus musculus
gtgaaccgtgttgctgatcacatcc

SEQ ID NO: 83964 - DNA, 25 bp, mus musculus
aaccgtgttgctgatcacatccaga

SEQ ID NO: 83965 - DNA, 25 bp, mus musculus
cgtgttgctgatcacatccagagtc

SEQ ID NO: 83966 - DNA, 25 bp, mus musculus
gttgctgatcacatccagagtcgca

SEQ ID NO: 83967 - DNA, 25 bp, mus musculus
gatcacatccagagtcgcatcgttt

SEQ ID NO: 83968 - DNA, 25 bp, mus musculus
cgcatcgtttattacctcatgaaca

SEQ ID NO: 83969 - DNA, 25 bp, mus musculus
atcgtttattacctcatgaacatcc

SEQ ID NO: 83970 - DNA, 25 bp, mus musculus
aatcggactacctattggatagact

SEQ ID NO: 83971 - DNA, 25 bp, mus musculus
atagactacattcttcgccatgacg

SEQ ID NO: 83972 - DNA, 25 bp, mus musculus
ctctacttcatattgtcctatgtga

SEQ ID NO: 83973 - DNA, 25 bp, mus musculus
ggaatccccaatggcaaatacaaag

SEQ ID NO: 83974 - DNA, 25 bp, mus musculus
aacagcccaggtgaagggatcagtt

SEQ ID NO: 83975 - DNA, 25 bp, mus musculus
tgctattctttagtctaacagctac

SEQ ID NO: 83976 - DNA, 25 bp, mus musculus
gtctaacagctactaaaagtaaatg

SEQ ID NO: 83977 - DNA, 25 bp, mus musculus
gtcagcaaacaatcctaacatgccc

SEQ ID NO: 83978 - DNA, 25 bp, mus musculus
catgccctcatcagatcttattaat

SEQ ID NO: 83979 - DNA, 25 bp, mus musculus
gtaaagagcacaaccctaaatgcaa

SEQ ID NO: 83980 - DNA, 25 bp, mus musculus
attctaatactgatgcagagagttg

SEQ ID NO: 83981 - DNA, 25 bp, mus musculus
atactgatgcagagagttggcagtg

SEQ ID NO: 83982 - DNA, 25 bp, mus musculus
catgacggagcccatcacctccgtt

SEQ ID NO: 83983 - DNA, 25 bp, mus musculus
tctgctgtccatcagatctctttct

SEQ ID NO: 83984 - DNA, 25 bp, mus musculus
tatttcctactggatattgcctttg

SEQ ID NO: 83985 - DNA, 25 bp, mus musculus
ctactggatattgcctttgtgcttc

SEQ ID NO: 83986 - DNA, 25 bp, mus musculus
gatattgcctttgtgcttctgcttg

SEQ ID NO: 83987 - DNA, 25 bp, mus musculus
ctgcttggtgctgtcttgctctact

SEQ ID NO: 83988 - DNA, 25 bp, mus musculus
ggtgctgtcttgctctacttcatat

SEQ ID NO: 83989 - DNA, 25 bp, mus musculus
gtcttgctctacttcatattgtcct

SEQ ID NO: 83990 - DNA, 25 bp, mus musculus
gatctctttgaatctgatgatgagg

SEQ ID NO: 83991 - DNA, 25 bp, mus musculus
ctaccataagaacgccttgcgcatt

SEQ ID NO: 83992 - DNA, 25 bp, mus musculus
acatgactaacctagagcagtgtct

SEQ ID NO: 83993 - DNA, 25 bp, mus musculus
tgactaacctagagcagtgtctcga

SEQ ID NO: 83994 - DNA, 25 bp, mus musculus
tcgatgcattcatgcagatggcctg

SEQ ID NO: 83995 - DNA, 25 bp, mus musculus
atgcattcatgcagatggcctgttc

SEQ ID NO: 83996 - DNA, 25 bp, mus musculus
tcatgcagatggcctgttctggggc

SEQ ID NO: 83997 - DNA, 25 bp, mus musculus
agatggcctgttctggggctctcta

SEQ ID NO: 83998 - DNA, 25 bp, mus musculus
cctgttctggggctctctaaattgg

SEQ ID NO: 83999 - DNA, 25 bp, mus musculus
ctctctaaattggttccagtggata

SEQ ID NO: 84000 - DNA, 25 bp, mus musculus
tctaaattggttccagtggatatgg

SEQ ID NO: 84001 - DNA, 25 bp, mus musculus
aaattggttccagtggatatggatt

SEQ ID NO: 84002 - DNA, 25 bp, mus musculus
ccataagaacgccttgcgcattaga

SEQ ID NO: 84003 - DNA, 25 bp, mus musculus
agccctgcattggttgcacgtcttc

SEQ ID NO: 84004 - DNA, 25 bp, mus musculus
cctgcattggttgcacgtcttccat

SEQ ID NO: 84005 - DNA, 25 bp, mus musculus
gcacgtcttccatcctgactgacgt

SEQ ID NO: 84006 - DNA, 25 bp, mus musculus
cgtcttccatcctgactgacgtaca

SEQ ID NO: 84007 - DNA, 25 bp, mus musculus
tcctgactgacgtacagccttggga

SEQ ID NO: 84008 - DNA, 25 bp, mus musculus
agccttgggacgatgggacggacat

SEQ ID NO: 84009 - DNA, 25 bp, mus musculus
cggacatgactaacctagagcagtg

SEQ ID NO: 84010 - DNA, 25 bp, mus musculus
cacagcagccagtgaccgaaggaca

SEQ ID NO: 84011 - DNA, 25 bp, mus musculus
ttacacctgctgcagcagcctgagc

SEQ ID NO: 84012 - DNA, 25 bp, mus musculus
cacagatccctggaggctggagagc

SEQ ID NO: 84013 - DNA, 25 bp, mus musculus
cagctgctcccagtggaagagatgt

SEQ ID NO: 84014 - DNA, 25 bp, mus musculus
ctgctcccagtggaagagatgtgtc

SEQ ID NO: 84015 - DNA, 25 bp, mus musculus
atgtgtccttactcattttggagca

SEQ ID NO: 84016 - DNA, 25 bp, mus musculus
tgtccttactcattttggagcaggt

SEQ ID NO: 84017 - DNA, 25 bp, mus musculus
gaggtcagaccacagccaccaatca

SEQ ID NO: 84018 - DNA, 25 bp, mus musculus
gtcagaccacagccaccaatcatct

SEQ ID NO: 84019 - DNA, 25 bp, mus musculus
ttccctgtctccaagccatccatag

SEQ ID NO: 84020 - DNA, 25 bp, mus musculus
aagccatccatagccccatgtctaa

SEQ ID NO: 84021 - DNA, 25 bp, mus musculus
tccatagccccatgtctaacctcat

SEQ ID NO: 84022 - DNA, 25 bp, mus musculus
cacctgctgcagcagcctgagcagc

SEQ ID NO: 84023 - DNA, 25 bp, mus musculus
ccccatgtctaacctcatagttgcc

SEQ ID NO: 84024 - DNA, 25 bp, mus musculus
cagctaccagtcttgggccatggtg

SEQ ID NO: 84025 - DNA, 25 bp, mus musculus
gtcttgggccatggtgctggctctg

SEQ ID NO: 84026 - DNA, 25 bp, mus musculus
ccaggctagataccccagtgcccaa

SEQ ID NO: 84027 - DNA, 25 bp, mus musculus
cagtgcccaaaaccatgcatgcaca

SEQ ID NO: 84028 - DNA, 25 bp, mus musculus
ccaaaaccatgcatgcacagatccc

SEQ ID NO: 84029 - DNA, 25 bp, mus musculus
ccatgcatgcacagatccctggagg

SEQ ID NO: 84030 - DNA, 25 bp, mus musculus
atgcacagatccctggaggctggag

SEQ ID NO: 84031 - DNA, 25 bp, mus musculus
caagtcatccatatttcattggtgt

SEQ ID NO: 84032 - DNA, 25 bp, mus musculus
atccatatttcattggtgtccagtt

SEQ ID NO: 84033 - DNA, 25 bp, mus musculus
gaagctctttcttgcctcaggaata

SEQ ID NO: 84034 - DNA, 25 bp, mus musculus
ctttcttgcctcaggaatagcagaa

SEQ ID NO: 84035 - DNA, 25 bp, mus musculus
agcagaagctacctaagaggcctct

SEQ ID NO: 84036 - DNA, 25 bp, mus musculus
agctacctaagaggcctctgaagtc

SEQ ID NO: 84037 - DNA, 25 bp, mus musculus
ctaagaggcctctgaagtcattata

SEQ ID NO: 84038 - DNA, 25 bp, mus musculus
gtctgaagaaaccaccacactgttc

SEQ ID NO: 84039 - DNA, 25 bp, mus musculus
actgttccctagacatgggctgtga

SEQ ID NO: 84040 - DNA, 25 bp, mus musculus
ttcatgcaacagaaccaaaggggtc

SEQ ID NO: 84041 - DNA, 25 bp, mus musculus
cttttccctccagaggcagcctgta

SEQ ID NO: 84042 - DNA, 25 bp, mus musculus
agtagtcacacatttctatccttaa

SEQ ID NO: 84043 - DNA, 25 bp, mus musculus
atttcattggtgtccagttccatcc

SEQ ID NO: 84044 - DNA, 25 bp, mus musculus
ctgagttttcctctaggccaatgaa

SEQ ID NO: 84045 - DNA, 25 bp, mus musculus
tttcctctaggccaatgaagccttc

SEQ ID NO: 84046 - DNA, 25 bp, mus musculus
cgtacctggggctcttacttgcagc

SEQ ID NO: 84047 - DNA, 25 bp, mus musculus
tcttacttgcagcaacggggaatct

SEQ ID NO: 84048 - DNA, 25 bp, mus musculus
acaagctgccatacagtgatggata

SEQ ID NO: 84049 - DNA, 25 bp, mus musculus
atgccagcgatgacagctttccaga

SEQ ID NO: 84050 - DNA, 25 bp, mus musculus
tcaactgaagctctttcttgcctca

SEQ ID NO: 84051 - DNA, 25 bp, mus musculus
cgctcacaccaggttacccagcaaa

SEQ ID NO: 84052 - DNA, 25 bp, mus musculus
caccaggttacccagcaaatgaaca

SEQ ID NO: 84053 - DNA, 25 bp, mus musculus
atgatgcacagaaactcttagaaca

SEQ ID NO: 84054 - DNA, 25 bp, mus musculus
atgcacagaaactcttagaacacat

SEQ ID NO: 84055 - DNA, 25 bp, mus musculus
tgccttacaacgtgggacctggctt

SEQ ID NO: 84056 - DNA, 25 bp, mus musculus
acaacgtgggacctggctttgctgg

SEQ ID NO: 84057 - DNA, 25 bp, mus musculus
tgggacctggctttgctggaaactt

SEQ ID NO: 84058 - DNA, 25 bp, mus musculus
tttcaacacaaaaggtcaagatgca

SEQ ID NO: 84059 - DNA, 25 bp, mus musculus
agatgcatattcactcttacactaa

SEQ ID NO: 84060 - DNA, 25 bp, mus musculus
tgcatattcactcttacactaaagt

SEQ ID NO: 84061 - DNA, 25 bp, mus musculus
atattcactcttacactaaagtgac

SEQ ID NO: 84062 - DNA, 25 bp, mus musculus
actcttacactaaagtgacaagaat

SEQ ID NO: 84063 - DNA, 25 bp, mus musculus
caggttacccagcaaatgaacatgc

SEQ ID NO: 84064 - DNA, 25 bp, mus musculus
gttacccagcaaatgaacatgctta

SEQ ID NO: 84065 - DNA, 25 bp, mus musculus
tgacaaacgctgttggccttccaag

SEQ ID NO: 84066 - DNA, 25 bp, mus musculus
caaacgctgttggccttccaagtat

SEQ ID NO: 84067 - DNA, 25 bp, mus musculus
ctgttggccttccaagtattcctgt

SEQ ID NO: 84068 - DNA, 25 bp, mus musculus
ttggccttccaagtattcctgtcca

SEQ ID NO: 84069 - DNA, 25 bp, mus musculus
gccttccaagtattcctgtccatcc

SEQ ID NO: 84070 - DNA, 25 bp, mus musculus
tccatcctattggatatgatgatgc

SEQ ID NO: 84071 - DNA, 25 bp, mus musculus
tccaacaggttgactacagtcagtg

SEQ ID NO: 84072 - DNA, 25 bp, mus musculus
aggttgactacagtcagtggggcca

SEQ ID NO: 84073 - DNA, 25 bp, mus musculus
ctccaaaccaagctgggtatggaat

SEQ ID NO: 84074 - DNA, 25 bp, mus musculus
tggcaagcttcccgacacagtgagc

SEQ ID NO: 84075 - DNA, 25 bp, mus musculus
ttgtaattcaccacaggctgcagtc

SEQ ID NO: 84076 - DNA, 25 bp, mus musculus
ttcaccacaggctgcagtctcctgt

SEQ ID NO: 84077 - DNA, 25 bp, mus musculus
tgcagtctcctgtcacactctgaag

SEQ ID NO: 84078 - DNA, 25 bp, mus musculus
ctcctgtcacactctgaagacatga

SEQ ID NO: 84079 - DNA, 25 bp, mus musculus
tcacactctgaagacatgaaaagta

SEQ ID NO: 84080 - DNA, 25 bp, mus musculus
tttggaacctttagcacagctttgc

SEQ ID NO: 84081 - DNA, 25 bp, mus musculus
acctttagcacagctttgcttggtg

SEQ ID NO: 84082 - DNA, 25 bp, mus musculus
cacatgtcttctagttctgcctttt

SEQ ID NO: 84083 - DNA, 25 bp, mus musculus
actacagtcagtggggccagtggag

SEQ ID NO: 84084 - DNA, 25 bp, mus musculus
tgtatggaaacccacaacagtatgg

SEQ ID NO: 84085 - DNA, 25 bp, mus musculus
gaaacccacaacagtatggacagta

SEQ ID NO: 84086 - DNA, 25 bp, mus musculus
caccctatggagtatatgggcagcc

SEQ ID NO: 84087 - DNA, 25 bp, mus musculus
tatatgggcagccgtggaaccaaca

SEQ ID NO: 84088 - DNA, 25 bp, mus musculus
tagatcaatccccttctgctgcttg

SEQ ID NO: 84089 - DNA, 25 bp, mus musculus
aatccccttctgctgcttggatggg

SEQ ID NO: 84090 - DNA, 25 bp, mus musculus
ttggtgctcagcctcctcaaggaca

SEQ ID NO: 84091 - DNA, 25 bp, mus musculus
ggtaagatcactttcatcagaaatt

SEQ ID NO: 84092 - DNA, 25 bp, mus musculus
cagtcgctgcggaagaagggaagaa

SEQ ID NO: 84093 - DNA, 25 bp, mus musculus
tgcagtgtctttagcccatcatggc

SEQ ID NO: 84094 - DNA, 25 bp, mus musculus
gtctttagcccatcatggctactca

SEQ ID NO: 84095 - DNA, 25 bp, mus musculus
agcccatcatggctactcaggccag

SEQ ID NO: 84096 - DNA, 25 bp, mus musculus
aggccagcacttgagtaccacacaa

SEQ ID NO: 84097 - DNA, 25 bp, mus musculus
gcacttgagtaccacacaaagatgg

SEQ ID NO: 84098 - DNA, 25 bp, mus musculus
gagtaccacacaaagatggcctctg

SEQ ID NO: 84099 - DNA, 25 bp, mus musculus
cacacaaagatggcctctgttttta

SEQ ID NO: 84100 - DNA, 25 bp, mus musculus
atttacagtgactcagaagggatct

SEQ ID NO: 84101 - DNA, 25 bp, mus musculus
gggatctcatccagatgaaaggctc

SEQ ID NO: 84102 - DNA, 25 bp, mus musculus
aaggctctcattttaatctgctcgc

SEQ ID NO: 84103 - DNA, 25 bp, mus musculus
ttgcacctggcttacagttactggc

SEQ ID NO: 84104 - DNA, 25 bp, mus musculus
tcattttaatctgctcgctctcagt

SEQ ID NO: 84105 - DNA, 25 bp, mus musculus
tacagttactggctctgacaagttc

SEQ ID NO: 84106 - DNA, 25 bp, mus musculus
tactggctctgacaagttcagagat

SEQ ID NO: 84107 - DNA, 25 bp, mus musculus
gaactatcaagcttgtcctggatac

SEQ ID NO: 84108 - DNA, 25 bp, mus musculus
taactccagcttcagggccctcaca

SEQ ID NO: 84109 - DNA, 25 bp, mus musculus
cagggccctcacagcctcagcagag

SEQ ID NO: 84110 - DNA, 25 bp, mus musculus
cttcttccccatgtctgttcatggt

SEQ ID NO: 84111 - DNA, 25 bp, mus musculus
ccccatgtctgttcatggtgcagtg

SEQ ID NO: 84112 - DNA, 25 bp, mus musculus
ttgcttcccaggccaacagctggga

SEQ ID NO: 84113 - DNA, 25 bp, mus musculus
cccaggccaacagctgggacttctt

SEQ ID NO: 84114 - DNA, 25 bp, mus musculus
ttccataggcaccagccaataagat

SEQ ID NO: 84115 - DNA, 25 bp, mus musculus
aggcaccagccaataagatgaccac

SEQ ID NO: 84116 - DNA, 25 bp, mus musculus
ataagatgaccactcatgaggtgat

SEQ ID NO: 84117 - DNA, 25 bp, mus musculus
tgaccactcatgaggtgatcagagc

SEQ ID NO: 84118 - DNA, 25 bp, mus musculus
ggagtcttcagccagccagatggaa

SEQ ID NO: 84119 - DNA, 25 bp, mus musculus
aaagtgcacacaatctttgtctttg

SEQ ID NO: 84120 - DNA, 25 bp, mus musculus
cacacaatctttgtctttggctgaa

SEQ ID NO: 84121 - DNA, 25 bp, mus musculus
gtctttggctgaattcacaggactt

SEQ ID NO: 84122 - DNA, 25 bp, mus musculus
atcatttacctccagtcttgttata

SEQ ID NO: 84123 - DNA, 25 bp, mus musculus
tacctccagtcttgttatagagata

SEQ ID NO: 84124 - DNA, 25 bp, mus musculus
ccaacagctgggacttctttattat

SEQ ID NO: 84125 - DNA, 25 bp, mus musculus
tttctgtgatcatctcaagaagatg

SEQ ID NO: 84126 - DNA, 25 bp, mus musculus
gtctgttatttccataagctccttt

SEQ ID NO: 84127 - DNA, 25 bp, mus musculus
tatttccataagctcctttacttgt

SEQ ID NO: 84128 - DNA, 25 bp, mus musculus
cataagctcctttacttgtggaaat

SEQ ID NO: 84129 - DNA, 25 bp, mus musculus
ctcctttacttgtggaaatgaaatg

SEQ ID NO: 84130 - DNA, 25 bp, mus musculus
agagacagctcataaagctgtataa

SEQ ID NO: 84131 - DNA, 25 bp, mus musculus
aagagtgtgcctggataggaattat

SEQ ID NO: 84132 - DNA, 25 bp, mus musculus
caattcggacagtgatccaaataca

SEQ ID NO: 84133 - DNA, 25 bp, mus musculus
aattcggacagtgatccaaatacat

SEQ ID NO: 84134 - DNA, 25 bp, mus musculus
ttccattatattctacacttccacg

SEQ ID NO: 84135 - DNA, 25 bp, mus musculus
cattatattctacacttccacgcca

SEQ ID NO: 84136 - DNA, 25 bp, mus musculus
attatattctacacttccacgccag

SEQ ID NO: 84137 - DNA, 25 bp, mus musculus
tatattctacacttccacgccagca

SEQ ID NO: 84138 - DNA, 25 bp, mus musculus
atattctacacttccacgccagcag

SEQ ID NO: 84139 - DNA, 25 bp, mus musculus
ttctacacttccacgccagcagcaa

SEQ ID NO: 84140 - DNA, 25 bp, mus musculus
tccacgccagcagcaacaacgcatt

SEQ ID NO: 84141 - DNA, 25 bp, mus musculus
acgccagcagcaacaacgcattttt

SEQ ID NO: 84142 - DNA, 25 bp, mus musculus
gccagcagcaacaacgcatttttga

SEQ ID NO: 84143 - DNA, 25 bp, mus musculus
agcagcaacaacgcatttttgagcc

SEQ ID NO: 84144 - DNA, 25 bp, mus musculus
cagtgatccaaatacatatgtgtga

SEQ ID NO: 84145 - DNA, 25 bp, mus musculus
gcagcaacaacgcatttttgagcca

SEQ ID NO: 84146 - DNA, 25 bp, mus musculus
tgatccaaatacatatgtgtgaaga

SEQ ID NO: 84147 - DNA, 25 bp, mus musculus
gagaccttcttcttttcttgactgg

SEQ ID NO: 84148 - DNA, 25 bp, mus musculus
ttcttcttttcttgactggtcaaga

SEQ ID NO: 84149 - DNA, 25 bp, mus musculus
ttaaaatcattccattatattctac

SEQ ID NO: 84150 - DNA, 25 bp, mus musculus
aaatcattccattatattctacact

SEQ ID NO: 84151 - DNA, 25 bp, mus musculus
aatcattccattatattctacactt

SEQ ID NO: 84152 - DNA, 25 bp, mus musculus
cattccattatattctacacttcca

SEQ ID NO: 84153 - DNA, 25 bp, mus musculus
tcatggctttatccaggcatctgat

SEQ ID NO: 84154 - DNA, 25 bp, mus musculus
ctttatccaggcatctgatgttata

SEQ ID NO: 84155 - DNA, 25 bp, mus musculus
ttgtgactacattgtctccaaagaa

SEQ ID NO: 84156 - DNA, 25 bp, mus musculus
ttaagccatgcacattgttgctgct

SEQ ID NO: 84157 - DNA, 25 bp, mus musculus
catgcacattgttgctgctgttact

SEQ ID NO: 84158 - DNA, 25 bp, mus musculus
ctccttctcagtagatcatctaggg

SEQ ID NO: 84159 - DNA, 25 bp, mus musculus
gcagtcactgcagctacttatcatc

SEQ ID NO: 84160 - DNA, 25 bp, mus musculus
actgcagctacttatcatcaccaga

SEQ ID NO: 84161 - DNA, 25 bp, mus musculus
gctacttatcatcaccagagcttaa

SEQ ID NO: 84162 - DNA, 25 bp, mus musculus
tatcatcaccagagcttaactactc

SEQ ID NO: 84163 - DNA, 25 bp, mus musculus
gtgatctctgcagttagacacacag

SEQ ID NO: 84164 - DNA, 25 bp, mus musculus
gttagacacacagctctcgtccaga

SEQ ID NO: 84165 - DNA, 25 bp, mus musculus
tgaatctgtcttgcctttgacaaca

SEQ ID NO: 84166 - DNA, 25 bp, mus musculus
acacagctctcgtccagactcaagc

SEQ ID NO: 84167 - DNA, 25 bp, mus musculus
gcctttgacaacactaacagatcca

SEQ ID NO: 84168 - DNA, 25 bp, mus musculus
gacaacactaacagatccaatattc

SEQ ID NO: 84169 - DNA, 25 bp, mus musculus
actaacagatccaatattccagcat

SEQ ID NO: 84170 - DNA, 25 bp, mus musculus
agatccaatattccagcatcatcag

SEQ ID NO: 84171 - DNA, 25 bp, mus musculus
ccagcatcatcaggaagcatcaaat

SEQ ID NO: 84172 - DNA, 25 bp, mus musculus
tggatcatctttgggcagtcctgtt

SEQ ID NO: 84173 - DNA, 25 bp, mus musculus
gccacattgtgactacattgtctcc

SEQ ID NO: 84174 - DNA, 25 bp, mus musculus
agacggccaggtacgagttgtgcca

SEQ ID NO: 84175 - DNA, 25 bp, mus musculus
acggccaggtacgagttgtgccata

SEQ ID NO: 84176 - DNA, 25 bp, mus musculus
aggtgctcggcaccatgcagattgt

SEQ ID NO: 84177 - DNA, 25 bp, mus musculus
gtgctcggcaccatgcagattgttt

SEQ ID NO: 84178 - DNA, 25 bp, mus musculus
tgctcggcaccatgcagattgtttt

SEQ ID NO: 84179 - DNA, 25 bp, mus musculus
tcggcaccatgcagattgttttgga

SEQ ID NO: 84180 - DNA, 25 bp, mus musculus
cggcaccatgcagattgttttggag

SEQ ID NO: 84181 - DNA, 25 bp, mus musculus
ggcaccatgcagattgttttggaga

SEQ ID NO: 84182 - DNA, 25 bp, mus musculus
gcaccatgcagattgttttggagac

SEQ ID NO: 84183 - DNA, 25 bp, mus musculus
accatgcagattgttttggagacag

SEQ ID NO: 84184 - DNA, 25 bp, mus musculus
gttactgacgtgtcaggttttgacg

SEQ ID NO: 84185 - DNA, 25 bp, mus musculus
ttactgacgtgtcaggttttgacgt

SEQ ID NO: 84186 - DNA, 25 bp, mus musculus
ggttgacccttgatgcccgtactat

SEQ ID NO: 84187 - DNA, 25 bp, mus musculus
tgcccgtactattcgggaccctgat

SEQ ID NO: 84188 - DNA, 25 bp, mus musculus
cctgatcgcctcatgaaggtgctcg

SEQ ID NO: 84189 - DNA, 25 bp, mus musculus
ctgatcgcctcatgaaggtgctcgg

SEQ ID NO: 84190 - DNA, 25 bp, mus musculus
tgatcgcctcatgaaggtgctcggc

SEQ ID NO: 84191 - DNA, 25 bp, mus musculus
gatcgcctcatgaaggtgctcggca

SEQ ID NO: 84192 - DNA, 25 bp, mus musculus
cctcatgaaggtgctcggcaccatg

SEQ ID NO: 84193 - DNA, 25 bp, mus musculus
tgaaggtgctcggcaccatgcagat

SEQ ID NO: 84194 - DNA, 25 bp, mus musculus
agcttcagtccttcagtgataggca

SEQ ID NO: 84195 - DNA, 25 bp, mus musculus
agtccttcagtgataggcaacctag

SEQ ID NO: 84196 - DNA, 25 bp, mus musculus
ctaatcttggcatgtgcacattcct

SEQ ID NO: 84197 - DNA, 25 bp, mus musculus
ttggcatgtgcacattcctcagagg

SEQ ID NO: 84198 - DNA, 25 bp, mus musculus
tgtgcacattcctcagaggtaccag

SEQ ID NO: 84199 - DNA, 25 bp, mus musculus
cattcctcagaggtaccaggtattc

SEQ ID NO: 84200 - DNA, 25 bp, mus musculus
ggtattcccagccatgcatctctgt

SEQ ID NO: 84201 - DNA, 25 bp, mus musculus
cccagccatgcatctctgtgggaag

SEQ ID NO: 84202 - DNA, 25 bp, mus musculus
catgcatctctgtgggaagatagaa

SEQ ID NO: 84203 - DNA, 25 bp, mus musculus
tcatgctctgcagttacataggtag

SEQ ID NO: 84204 - DNA, 25 bp, mus musculus
ccatttgtcctgttctaattatgaa

SEQ ID NO: 84205 - DNA, 25 bp, mus musculus
tgtcatatttcattcaaatgccaat

SEQ ID NO: 84206 - DNA, 25 bp, mus musculus
tctttatcagccaggcaatgactct

SEQ ID NO: 84207 - DNA, 25 bp, mus musculus
tcagccaggcaatgactctgaactc

SEQ ID NO: 84208 - DNA, 25 bp, mus musculus
tgactctgaactctgaaatgctata

SEQ ID NO: 84209 - DNA, 25 bp, mus musculus
ggatcaatggccttatctgttacac

SEQ ID NO: 84210 - DNA, 25 bp, mus musculus
atggccttatctgttacacatacac

SEQ ID NO: 84211 - DNA, 25 bp, mus musculus
cacattttcacagcatagcttggct

SEQ ID NO: 84212 - DNA, 25 bp, mus musculus
ttcacagcatagcttggctttatgc

SEQ ID NO: 84213 - DNA, 25 bp, mus musculus
gcatagcttggctttatgctaatct

SEQ ID NO: 84214 - DNA, 25 bp, mus musculus
ttgacagactttggcttcagcaaca

SEQ ID NO: 84215 - DNA, 25 bp, mus musculus
tttggcttcagcaacaaatttcagc

SEQ ID NO: 84216 - DNA, 25 bp, mus musculus
tacgatgcccctgcagtagacatat

SEQ ID NO: 84217 - DNA, 25 bp, mus musculus
gatgcccctgcagtagacatatgga

SEQ ID NO: 84218 - DNA, 25 bp, mus musculus
tggagcctgggcgtgatccttttca

SEQ ID NO: 84219 - DNA, 25 bp, mus musculus
ggcgtgatccttttcatgctggtgt

SEQ ID NO: 84220 - DNA, 25 bp, mus musculus
ttcatgctggtgtgttggcagccac

SEQ ID NO: 84221 - DNA, 25 bp, mus musculus
tgttggcagccacccttccaagaag

SEQ ID NO: 84222 - DNA, 25 bp, mus musculus
cccttccaagaagccaacgacagcg

SEQ ID NO: 84223 - DNA, 25 bp, mus musculus
ttccaagaagccaacgacagcgaga

SEQ ID NO: 84224 - DNA, 25 bp, mus musculus
caagaagccaacgacagcgagacac

SEQ ID NO: 84225 - DNA, 25 bp, mus musculus
gagacactgaccatgatcatggact

SEQ ID NO: 84226 - DNA, 25 bp, mus musculus
ggcttcagcaacaaatttcagcctg

SEQ ID NO: 84227 - DNA, 25 bp, mus musculus
agcaacaaatttcagcctggaaaga

SEQ ID NO: 84228 - DNA, 25 bp, mus musculus
ctcaccacgagctgcgggtctcttg

SEQ ID NO: 84229 - DNA, 25 bp, mus musculus
agctgcgggtctcttgcatactctg

SEQ ID NO: 84230 - DNA, 25 bp, mus musculus
tactctgctccagaaatcctgcttg

SEQ ID NO: 84231 - DNA, 25 bp, mus musculus
gctccagaaatcctgcttggcgatg

SEQ ID NO: 84232 - DNA, 25 bp, mus musculus
gaaatcctgcttggcgatgagtacg

SEQ ID NO: 84233 - DNA, 25 bp, mus musculus
gagtacgatgcccctgcagtagaca

SEQ ID NO: 84234 - DNA, 25 bp, mus musculus
gaacggcctcagccagcaagcacga

SEQ ID NO: 84235 - DNA, 25 bp, mus musculus
aacggcctcagccagcaagcacgag

SEQ ID NO: 84236 - DNA, 25 bp, mus musculus
catcgtcatggaccctctgggtgga

SEQ ID NO: 84237 - DNA, 25 bp, mus musculus
cgtcatggaccctctgggtggatca

SEQ ID NO: 84238 - DNA, 25 bp, mus musculus
gtcatggaccctctgggtggatcag

SEQ ID NO: 84239 - DNA, 25 bp, mus musculus
catggaccctctgggtggatcagac

SEQ ID NO: 84240 - DNA, 25 bp, mus musculus
atggaccctctgggtggatcagaca

SEQ ID NO: 84241 - DNA, 25 bp, mus musculus
gaccctctgggtggatcagacacgg

SEQ ID NO: 84242 - DNA, 25 bp, mus musculus
ctcctcaaacccatgggcaaagttg

SEQ ID NO: 84243 - DNA, 25 bp, mus musculus
tcctcaaacccatgggcaaagttgt

SEQ ID NO: 84244 - DNA, 25 bp, mus musculus
ctcaaacccatgggcaaagttgtca

SEQ ID NO: 84245 - DNA, 25 bp, mus musculus
tcaaacccatgggcaaagttgtcac

SEQ ID NO: 84246 - DNA, 25 bp, mus musculus
atcgactaccacacgactgactatg

SEQ ID NO: 84247 - DNA, 25 bp, mus musculus
cgactaccacacgactgactatgtg

SEQ ID NO: 84248 - DNA, 25 bp, mus musculus
ctaccacacgactgactatgtggac

SEQ ID NO: 84249 - DNA, 25 bp, mus musculus
taccacacgactgactatgtggacg

SEQ ID NO: 84250 - DNA, 25 bp, mus musculus
ccacacgactgactatgtggacgag

SEQ ID NO: 84251 - DNA, 25 bp, mus musculus
cacacgactgactatgtggacgaga

SEQ ID NO: 84252 - DNA, 25 bp, mus musculus
tcccccaaaggagtagacatcgtca

SEQ ID NO: 84253 - DNA, 25 bp, mus musculus
gacatcgtcatggaccctctgggtg

SEQ ID NO: 84254 - DNA, 25 bp, mus musculus
tcaaaacagctccagccgcagccgg

SEQ ID NO: 84255 - DNA, 25 bp, mus musculus
acagctccagccgcagccgggcaag

SEQ ID NO: 84256 - DNA, 25 bp, mus musculus
aagtttccagacaggtcaacattag

SEQ ID NO: 84257 - DNA, 25 bp, mus musculus
agtttccagacaggtcaacattagt

SEQ ID NO: 84258 - DNA, 25 bp, mus musculus
gtttccagacaggtcaacattagtt

SEQ ID NO: 84259 - DNA, 25 bp, mus musculus
tttccagacaggtcaacattagttg

SEQ ID NO: 84260 - DNA, 25 bp, mus musculus
ttccagacaggtcaacattagttgt

SEQ ID NO: 84261 - DNA, 25 bp, mus musculus
tccagacaggtcaacattagttgtc

SEQ ID NO: 84262 - DNA, 25 bp, mus musculus
tcaacattagttgtctgcctggaaa

SEQ ID NO: 84263 - DNA, 25 bp, mus musculus
agctccagccgcagccgggcaaggt

SEQ ID NO: 84264 - DNA, 25 bp, mus musculus
tcttctacctggggctatgatccgt

SEQ ID NO: 84265 - DNA, 25 bp, mus musculus
cttctacctggggctatgatccgtg

SEQ ID NO: 84266 - DNA, 25 bp, mus musculus
ttctacctggggctatgatccgtgg

SEQ ID NO: 84267 - DNA, 25 bp, mus musculus
tctacctggggctatgatccgtggg

SEQ ID NO: 84268 - DNA, 25 bp, mus musculus
ctacctggggctatgatccgtgggc

SEQ ID NO: 84269 - DNA, 25 bp, mus musculus
acaagtttccagacaggtcaacatt

SEQ ID NO: 84270 - DNA, 25 bp, mus musculus
caagtttccagacaggtcaacatta

SEQ ID NO: 84271 - DNA, 25 bp, mus musculus
gcaacgactggcctacaaggtggag

SEQ ID NO: 84272 - DNA, 25 bp, mus musculus
gcatctcatcaacgccatgtccata

SEQ ID NO: 84273 - DNA, 25 bp, mus musculus
atggcagccatgtttcatcacagcc

SEQ ID NO: 84274 - DNA, 25 bp, mus musculus
gccatgtttcatcacagccggttcc

SEQ ID NO: 84275 - DNA, 25 bp, mus musculus
cccatcacagtgtgagctcaggaca

SEQ ID NO: 84276 - DNA, 25 bp, mus musculus
tgagctcaggacacaacgggcaagg

SEQ ID NO: 84277 - DNA, 25 bp, mus musculus
caggacacaacgggcaaggagaagg

SEQ ID NO: 84278 - DNA, 25 bp, mus musculus
gtggccctttaagctgagaggcttg

SEQ ID NO: 84279 - DNA, 25 bp, mus musculus
gatggttctgcctctgtgactgctg

SEQ ID NO: 84280 - DNA, 25 bp, mus musculus
tctgcctctgtgactgctgctttgc

SEQ ID NO: 84281 - DNA, 25 bp, mus musculus
actgctgctttgcatgaaaattcat

SEQ ID NO: 84282 - DNA, 25 bp, mus musculus
acagaaacataaatcctccctgtca

SEQ ID NO: 84283 - DNA, 25 bp, mus musculus
catcaacgccatgtccatagagagc

SEQ ID NO: 84284 - DNA, 25 bp, mus musculus
cgccatgtccatagagagctgaaag

SEQ ID NO: 84285 - DNA, 25 bp, mus musculus
catataagctatcacactggcttct

SEQ ID NO: 84286 - DNA, 25 bp, mus musculus
agctatcacactggcttctcaaaag

SEQ ID NO: 84287 - DNA, 25 bp, mus musculus
cacactggcttctcaaaaggaaaga

SEQ ID NO: 84288 - DNA, 25 bp, mus musculus
ccccagagctggctatcctctgaaa

SEQ ID NO: 84289 - DNA, 25 bp, mus musculus
agctggctatcctctgaaacctcac

SEQ ID NO: 84290 - DNA, 25 bp, mus musculus
ctgtcaatggcagccatgtttcatc

SEQ ID NO: 84291 - DNA, 25 bp, mus musculus
gctgtgctggccacctaaaagataa

SEQ ID NO: 84292 - DNA, 25 bp, mus musculus
tgtgctggccacctaaaagataatc

SEQ ID NO: 84293 - DNA, 25 bp, mus musculus
acactgccttcaaaagggcatacta

SEQ ID NO: 84294 - DNA, 25 bp, mus musculus
actgccttcaaaagggcatactatc

SEQ ID NO: 84295 - DNA, 25 bp, mus musculus
aaagggcatactatcccagcatggg

SEQ ID NO: 84296 - DNA, 25 bp, mus musculus
agggcatactatcccagcatgggca

SEQ ID NO: 84297 - DNA, 25 bp, mus musculus
ggcatactatcccagcatgggcatg

SEQ ID NO: 84298 - DNA, 25 bp, mus musculus
catactatcccagcatgggcatgag

SEQ ID NO: 84299 - DNA, 25 bp, mus musculus
ctatcccagcatgggcatgagcagc

SEQ ID NO: 84300 - DNA, 25 bp, mus musculus
atcccagcatgggcatgagcagcct

SEQ ID NO: 84301 - DNA, 25 bp, mus musculus
cccagcatgggcatgagcagcctga

SEQ ID NO: 84302 - DNA, 25 bp, mus musculus
tccattatcatggtaagttgcttct

SEQ ID NO: 84303 - DNA, 25 bp, mus musculus
tgctggccacctaaaagataatcag

SEQ ID NO: 84304 - DNA, 25 bp, mus musculus
ctggccacctaaaagataatcagtg

SEQ ID NO: 84305 - DNA, 25 bp, mus musculus
atcagtgaattctacctgaagtact

SEQ ID NO: 84306 - DNA, 25 bp, mus musculus
gaattctacctgaagtactgaggga

SEQ ID NO: 84307 - DNA, 25 bp, mus musculus
attctacctgaagtactgagggaca

SEQ ID NO: 84308 - DNA, 25 bp, mus musculus
tctacctgaagtactgagggacact

SEQ ID NO: 84309 - DNA, 25 bp, mus musculus
agggacactgccttcaaaagggcat

SEQ ID NO: 84310 - DNA, 25 bp, mus musculus
ggacactgccttcaaaagggcatac

SEQ ID NO: 84311 - DNA, 25 bp, mus musculus
ctacacgcccaagtgcctaggggca

SEQ ID NO: 84312 - DNA, 25 bp, mus musculus
acacgcccaagtgcctaggggcaag

SEQ ID NO: 84313 - DNA, 25 bp, mus musculus
ggtcacaatcctgccaaacggcgcc

SEQ ID NO: 84314 - DNA, 25 bp, mus musculus
aatcctgccaaacggcgccattttg

SEQ ID NO: 84315 - DNA, 25 bp, mus musculus
tcctgccaaacggcgccattttgca

SEQ ID NO: 84316 - DNA, 25 bp, mus musculus
caaacggcgccattttgcagagcca

SEQ ID NO: 84317 - DNA, 25 bp, mus musculus
cggcgccattttgcagagccaggac

SEQ ID NO: 84318 - DNA, 25 bp, mus musculus
gcgccattttgcagagccaggacat

SEQ ID NO: 84319 - DNA, 25 bp, mus musculus
ccaggacatggccttggcttatcag

SEQ ID NO: 84320 - DNA, 25 bp, mus musculus
cagcgctgaatgtcagccttatctg

SEQ ID NO: 84321 - DNA, 25 bp, mus musculus
tcagccttatctggccacctgagag

SEQ ID NO: 84322 - DNA, 25 bp, mus musculus
agccttatctggccacctgagagac

SEQ ID NO: 84323 - DNA, 25 bp, mus musculus
tacaccactttcgaggctgaaaggg

SEQ ID NO: 84324 - DNA, 25 bp, mus musculus
ccactttcgaggctgaaagggatgc

SEQ ID NO: 84325 - DNA, 25 bp, mus musculus
aagggatgcccgaaccattgagaca

SEQ ID NO: 84326 - DNA, 25 bp, mus musculus
gatgcccgaaccattgagacagagt

SEQ ID NO: 84327 - DNA, 25 bp, mus musculus
aggtcaccatggtcacaatcctgcc

SEQ ID NO: 84328 - DNA, 25 bp, mus musculus
caccatggtcacaatcctgccaaac

SEQ ID NO: 84329 - DNA, 25 bp, mus musculus
ccatggtcacaatcctgccaaacgg

SEQ ID NO: 84330 - DNA, 25 bp, mus musculus
atggtcacaatcctgccaaacggcg

SEQ ID NO: 84331 - DNA, 25 bp, mus musculus
catggacgcctacttagtggagcag

SEQ ID NO: 84332 - DNA, 25 bp, mus musculus
cctccatgctaatgacttcaatgtc

SEQ ID NO: 84333 - DNA, 25 bp, mus musculus
ctcttgtcggaagcacaagcttcga

SEQ ID NO: 84334 - DNA, 25 bp, mus musculus
gcacaagcttcgacagaagcctgag

SEQ ID NO: 84335 - DNA, 25 bp, mus musculus
gcttcgacagaagcctgagcagatc

SEQ ID NO: 84336 - DNA, 25 bp, mus musculus
cttgcttctgagccatcctcccagt

SEQ ID NO: 84337 - DNA, 25 bp, mus musculus
tctgagccatcctcccagtcagggg

SEQ ID NO: 84338 - DNA, 25 bp, mus musculus
tccagggctgagatccagagcggtg

SEQ ID NO: 84339 - DNA, 25 bp, mus musculus
gttaccaagccaagatgccccatca

SEQ ID NO: 84340 - DNA, 25 bp, mus musculus
aagccaagatgccccatcacacctg

SEQ ID NO: 84341 - DNA, 25 bp, mus musculus
ccttcattagtgccttgctttgggc

SEQ ID NO: 84342 - DNA, 25 bp, mus musculus
ttagtgccttgctttgggccctgca

SEQ ID NO: 84343 - DNA, 25 bp, mus musculus
tgacttcaatgtcctaagtgcactc

SEQ ID NO: 84344 - DNA, 25 bp, mus musculus
caatgtcctaagtgcactcagcgag

SEQ ID NO: 84345 - DNA, 25 bp, mus musculus
cctaagtgcactcagcgagctctac

SEQ ID NO: 84346 - DNA, 25 bp, mus musculus
tgcactcagcgagctctacttctat

SEQ ID NO: 84347 - DNA, 25 bp, mus musculus
gctctacttctatgtcaccaagtac

SEQ ID NO: 84348 - DNA, 25 bp, mus musculus
ggagatcctcacctcgctggaccga

SEQ ID NO: 84349 - DNA, 25 bp, mus musculus
ctcgctggaccgagatgcctcttgt

SEQ ID NO: 84350 - DNA, 25 bp, mus musculus
ggaccgagatgcctcttgtcggaag

SEQ ID NO: 84351 - DNA, 25 bp, mus musculus
ttggctcaatcattaacccaaccat

SEQ ID NO: 84352 - DNA, 25 bp, mus musculus
ggctcaatcattaacccaaccatta

SEQ ID NO: 84353 - DNA, 25 bp, mus musculus
taatctcaaaacgtcttcaatcctt

SEQ ID NO: 84354 - DNA, 25 bp, mus musculus
aacgtcttcaatccttccaacaatg

SEQ ID NO: 84355 - DNA, 25 bp, mus musculus
gtcttcaatccttccaacaatggat

SEQ ID NO: 84356 - DNA, 25 bp, mus musculus
cttcaatccttccaacaatggatag

SEQ ID NO: 84357 - DNA, 25 bp, mus musculus
ttcaatccttccaacaatggatagg

SEQ ID NO: 84358 - DNA, 25 bp, mus musculus
tcaatccttccaacaatggataggt

SEQ ID NO: 84359 - DNA, 25 bp, mus musculus
caatccttccaacaatggataggta

SEQ ID NO: 84360 - DNA, 25 bp, mus musculus
ctattatccaaccaattatggttat

SEQ ID NO: 84361 - DNA, 25 bp, mus musculus
tattatccaaccaattatggttatc

SEQ ID NO: 84362 - DNA, 25 bp, mus musculus
tatccaaccaattatggttatccca

SEQ ID NO: 84363 - DNA, 25 bp, mus musculus
gctcaatcattaacccaaccattat

SEQ ID NO: 84364 - DNA, 25 bp, mus musculus
ctcaatcattaacccaaccattata

SEQ ID NO: 84365 - DNA, 25 bp, mus musculus
tcaatcattaacccaaccattatag

SEQ ID NO: 84366 - DNA, 25 bp, mus musculus
atcattaacccaaccattataggat

SEQ ID NO: 84367 - DNA, 25 bp, mus musculus
attccctcaatcctaatcccattct

SEQ ID NO: 84368 - DNA, 25 bp, mus musculus
cggctaatctcaaaacgtcttcaat

SEQ ID NO: 84369 - DNA, 25 bp, mus musculus
ggctaatctcaaaacgtcttcaatc

SEQ ID NO: 84370 - DNA, 25 bp, mus musculus
ctaatctcaaaacgtcttcaatcct

SEQ ID NO: 84371 - DNA, 25 bp, mus musculus
tcatcgtattacacccggagaggcc

SEQ ID NO: 84372 - DNA, 25 bp, mus musculus
gaatcccgaacctgttgacccatga

SEQ ID NO: 84373 - DNA, 25 bp, mus musculus
gaacgacaccattcagattgatttg

SEQ ID NO: 84374 - DNA, 25 bp, mus musculus
acgacaccattcagattgatttgaa

SEQ ID NO: 84375 - DNA, 25 bp, mus musculus
gacaccattcagattgatttgaaga

SEQ ID NO: 84376 - DNA, 25 bp, mus musculus
attaactgacttcatcaagtttgac

SEQ ID NO: 84377 - DNA, 25 bp, mus musculus
acttcatcaagtttgacactgggaa

SEQ ID NO: 84378 - DNA, 25 bp, mus musculus
ttcatcaagtttgacactgggaacc

SEQ ID NO: 84379 - DNA, 25 bp, mus musculus
gtttgacactgggaacctgtgtatg

SEQ ID NO: 84380 - DNA, 25 bp, mus musculus
ttgacactgggaacctgtgtatggt

SEQ ID NO: 84381 - DNA, 25 bp, mus musculus
cactgggaacctgtgtatggtgact

SEQ ID NO: 84382 - DNA, 25 bp, mus musculus
ctgggaacctgtgtatggtgactgg

SEQ ID NO: 84383 - DNA, 25 bp, mus musculus
atcccgaacctgttgacccatgatg

SEQ ID NO: 84384 - DNA, 25 bp, mus musculus
attggtgtactcaccaacagagaga

SEQ ID NO: 84385 - DNA, 25 bp, mus musculus
cccgaacctgttgacccatgatgct

SEQ ID NO: 84386 - DNA, 25 bp, mus musculus
atgctcgtacaattcggtaccctga

SEQ ID NO: 84387 - DNA, 25 bp, mus musculus
tgatcccctcatcaaggtgaacgac

SEQ ID NO: 84388 - DNA, 25 bp, mus musculus
atcccctcatcaaggtgaacgacac

SEQ ID NO: 84389 - DNA, 25 bp, mus musculus
cccctcatcaaggtgaacgacacca

SEQ ID NO: 84390 - DNA, 25 bp, mus musculus
aggtgaacgacaccattcagattga

SEQ ID NO: 84391 - DNA, 25 bp, mus musculus
gtgaacgacaccattcagattgatt

SEQ ID NO: 84392 - DNA, 25 bp, mus musculus
cccagggttctgcaagcagaagagc

SEQ ID NO: 84393 - DNA, 25 bp, mus musculus
cagaagagctacaaccctcgtacgg

SEQ ID NO: 84394 - DNA, 25 bp, mus musculus
gcaaggcttcagcaactcagcgggc

SEQ ID NO: 84395 - DNA, 25 bp, mus musculus
caaggcttcagcaactcagcgggct

SEQ ID NO: 84396 - DNA, 25 bp, mus musculus
aaggcttcagcaactcagcgggctg

SEQ ID NO: 84397 - DNA, 25 bp, mus musculus
aggcttcagcaactcagcgggctgg

SEQ ID NO: 84398 - DNA, 25 bp, mus musculus
gcttcagcaactcagcgggctggcc

SEQ ID NO: 84399 - DNA, 25 bp, mus musculus
cttcagcaactcagcgggctggccg

SEQ ID NO: 84400 - DNA, 25 bp, mus musculus
ttcagcaactcagcgggctggccgt

SEQ ID NO: 84401 - DNA, 25 bp, mus musculus
tcagcaactcagcgggctggccgtg

SEQ ID NO: 84402 - DNA, 25 bp, mus musculus
cagcaactcagcgggctggccgtgc

SEQ ID NO: 84403 - DNA, 25 bp, mus musculus
agcaactcagcgggctggccgtgca

SEQ ID NO: 84404 - DNA, 25 bp, mus musculus
gagctacaaccctcgtacgggaatg

SEQ ID NO: 84405 - DNA, 25 bp, mus musculus
cccctgcagcaaggcttcagcaact

SEQ ID NO: 84406 - DNA, 25 bp, mus musculus
ccctgcagcaaggcttcagcaactc

SEQ ID NO: 84407 - DNA, 25 bp, mus musculus
cctgcagcaaggcttcagcaactca

SEQ ID NO: 84408 - DNA, 25 bp, mus musculus
ctgcagcaaggcttcagcaactcag

SEQ ID NO: 84409 - DNA, 25 bp, mus musculus
tgcagcaaggcttcagcaactcagc

SEQ ID NO: 84410 - DNA, 25 bp, mus musculus
cagcaaggcttcagcaactcagcgg

SEQ ID NO: 84411 - DNA, 25 bp, mus musculus
agcaaggcttcagcaactcagcggg

SEQ ID NO: 84412 - DNA, 25 bp, mus musculus
ctgcttcatttcgaggccaactgag

SEQ ID NO: 84413 - DNA, 25 bp, mus musculus
catttcgaggccaactgagaaaacg

SEQ ID NO: 84414 - DNA, 25 bp, mus musculus
acttcaaggtcaagtgtaggtgagc

SEQ ID NO: 84415 - DNA, 25 bp, mus musculus
cccttctgagcatgtaccctctttg

SEQ ID NO: 84416 - DNA, 25 bp, mus musculus
tgagcatgtaccctctttgtagaca

SEQ ID NO: 84417 - DNA, 25 bp, mus musculus
tgtaccctctttgtagacaacattg

SEQ ID NO: 84418 - DNA, 25 bp, mus musculus
aacattgatctgacaactcctcctc

SEQ ID NO: 84419 - DNA, 25 bp, mus musculus
agctgttcatacacaatataagtca

SEQ ID NO: 84420 - DNA, 25 bp, mus musculus
tcatacacaatataagtcaaaattg

SEQ ID NO: 84421 - DNA, 25 bp, mus musculus
ccaagccctcgtgacaactgggcct

SEQ ID NO: 84422 - DNA, 25 bp, mus musculus
gacaactgggccttggagtcacctg

SEQ ID NO: 84423 - DNA, 25 bp, mus musculus
tgggccttggagtcacctggacaag

SEQ ID NO: 84424 - DNA, 25 bp, mus musculus
ttttatgatttccgcatccgtgatt

SEQ ID NO: 84425 - DNA, 25 bp, mus musculus
tggagtcacctggacaagtcctatg

SEQ ID NO: 84426 - DNA, 25 bp, mus musculus
gatttccgcatccgtgatttgcatg

SEQ ID NO: 84427 - DNA, 25 bp, mus musculus
ttgcatgctgctcaatgtggccgag

SEQ ID NO: 84428 - DNA, 25 bp, mus musculus
gctgctcaatgtggccgagttgtgt

SEQ ID NO: 84429 - DNA, 25 bp, mus musculus
caatgtggccgagttgtgttacctg

SEQ ID NO: 84430 - DNA, 25 bp, mus musculus
gttgtgttacctgctgcttaaattg

SEQ ID NO: 84431 - DNA, 25 bp, mus musculus
ttacctgctgcttaaattgtgcttt

SEQ ID NO: 84432 - DNA, 25 bp, mus musculus
ttaagcacttcaaggtcaagtgtag

SEQ ID NO: 84433 - DNA, 25 bp, mus musculus
cgaactacatcgagaccctgagagt

SEQ ID NO: 84434 - DNA, 25 bp, mus musculus
acatcgagaccctgagagtgcagat

SEQ ID NO: 84435 - DNA, 25 bp, mus musculus
ctcgctgaccactgtgtccttgtca

SEQ ID NO: 84436 - DNA, 25 bp, mus musculus
gaccactgtgtccttgtcatggaca

SEQ ID NO: 84437 - DNA, 25 bp, mus musculus
cttgtcatggacaccagtgaccatg

SEQ ID NO: 84438 - DNA, 25 bp, mus musculus
atggacaccagtgaccatgcacagt

SEQ ID NO: 84439 - DNA, 25 bp, mus musculus
accagtgaccatgcacagttgtgtt

SEQ ID NO: 84440 - DNA, 25 bp, mus musculus
ttgtgttccttgcattctaagtcag

SEQ ID NO: 84441 - DNA, 25 bp, mus musculus
tccttgcattctaagtcagtggagg

SEQ ID NO: 84442 - DNA, 25 bp, mus musculus
agagacgtcctacaaggcagattca

SEQ ID NO: 84443 - DNA, 25 bp, mus musculus
gtcctacaaggcagattcagaccaa

SEQ ID NO: 84444 - DNA, 25 bp, mus musculus
agattcagaccaatatttcttcgta

SEQ ID NO: 84445 - DNA, 25 bp, mus musculus
agaccctgagagtgcagatccatgc

SEQ ID NO: 84446 - DNA, 25 bp, mus musculus
tccatgcaaactgccgtatccgaag

SEQ ID NO: 84447 - DNA, 25 bp, mus musculus
acttctcagacagactctactcaga

SEQ ID NO: 84448 - DNA, 25 bp, mus musculus
cagacagactctactcagaagatga

SEQ ID NO: 84449 - DNA, 25 bp, mus musculus
gactctactcagaagatgagctgcc

SEQ ID NO: 84450 - DNA, 25 bp, mus musculus
agctgccagcagagttcaaactcta

SEQ ID NO: 84451 - DNA, 25 bp, mus musculus
aactctatctaccagttcagaacaa

SEQ ID NO: 84452 - DNA, 25 bp, mus musculus
actgtgctgtggctcgctgaccact

SEQ ID NO: 84453 - DNA, 25 bp, mus musculus
agcccctctgatggccactcagaga

SEQ ID NO: 84454 - DNA, 25 bp, mus musculus
tctgatggccactcagagaatacca

SEQ ID NO: 84455 - DNA, 25 bp, mus musculus
gctcacagcctttagcgctttgttg

SEQ ID NO: 84456 - DNA, 25 bp, mus musculus
cacagcctttagcgctttgttgctt

SEQ ID NO: 84457 - DNA, 25 bp, mus musculus
ttaatctgaaggttctggtaacctg

SEQ ID NO: 84458 - DNA, 25 bp, mus musculus
tttgtacttttctgtgactcacctg

SEQ ID NO: 84459 - DNA, 25 bp, mus musculus
cttttctgtgactcacctgcccttc

SEQ ID NO: 84460 - DNA, 25 bp, mus musculus
ttctgtgactcacctgcccttcctt

SEQ ID NO: 84461 - DNA, 25 bp, mus musculus
gcctcgtcccactatgcacagattg

SEQ ID NO: 84462 - DNA, 25 bp, mus musculus
tcgtcccactatgcacagattgaaa

SEQ ID NO: 84463 - DNA, 25 bp, mus musculus
tcccactatgcacagattgaaactt

SEQ ID NO: 84464 - DNA, 25 bp, mus musculus
cctacaaacctgttagtgtgatctg

SEQ ID NO: 84465 - DNA, 25 bp, mus musculus
ggccactcagagaataccataataa

SEQ ID NO: 84466 - DNA, 25 bp, mus musculus
acaatgttctggttgtgcatgaaat

SEQ ID NO: 84467 - DNA, 25 bp, mus musculus
atgttctggttgtgcatgaaattgg

SEQ ID NO: 84468 - DNA, 25 bp, mus musculus
gttgttccttcatatgaacctgtaa

SEQ ID NO: 84469 - DNA, 25 bp, mus musculus
gttccttcatatgaacctgtaaaat

SEQ ID NO: 84470 - DNA, 25 bp, mus musculus
ccttcatatgaacctgtaaaatgct

SEQ ID NO: 84471 - DNA, 25 bp, mus musculus
ggagttcacgctcacagcctttagc

SEQ ID NO: 84472 - DNA, 25 bp, mus musculus
cacgctcacagcctttagcgctttg

SEQ ID NO: 84473 - DNA, 25 bp, mus musculus
actgcccctacagacctggggtgct

SEQ ID NO: 84474 - DNA, 25 bp, mus musculus
cctacagacctggggtgctttgctc

SEQ ID NO: 84475 - DNA, 25 bp, mus musculus
cctgtgacaatccacaaggctgaat

SEQ ID NO: 84476 - DNA, 25 bp, mus musculus
acaatccacaaggctgaatcacagc

SEQ ID NO: 84477 - DNA, 25 bp, mus musculus
atccacaaggctgaatcacagcccc

SEQ ID NO: 84478 - DNA, 25 bp, mus musculus
gaatcacagcccctggggttgaggt

SEQ ID NO: 84479 - DNA, 25 bp, mus musculus
ctgtggctcttggtgaggctgccac

SEQ ID NO: 84480 - DNA, 25 bp, mus musculus
ctcttggtgaggctgccactggatc

SEQ ID NO: 84481 - DNA, 25 bp, mus musculus
cagctcctagagtacagaggaagaa

SEQ ID NO: 84482 - DNA, 25 bp, mus musculus
caatttccccatctgtaaactgtag

SEQ ID NO: 84483 - DNA, 25 bp, mus musculus
gatatgactactgacctacctcaca

SEQ ID NO: 84484 - DNA, 25 bp, mus musculus
atgactactgacctacctcacaggg

SEQ ID NO: 84485 - DNA, 25 bp, mus musculus
gacctggggtgctttgctcgctttc

SEQ ID NO: 84486 - DNA, 25 bp, mus musculus
gcttctgagcttttcctgcaacagg

SEQ ID NO: 84487 - DNA, 25 bp, mus musculus
gatatacttcagctccttcttcccc

SEQ ID NO: 84488 - DNA, 25 bp, mus musculus
ctggcctttgggtctccatggttca

SEQ ID NO: 84489 - DNA, 25 bp, mus musculus
tctccatggttcagtcctgctcagc

SEQ ID NO: 84490 - DNA, 25 bp, mus musculus
ccatggttcagtcctgctcagcttg

SEQ ID NO: 84491 - DNA, 25 bp, mus musculus
tggttcagtcctgctcagcttgggc

SEQ ID NO: 84492 - DNA, 25 bp, mus musculus
cctgctcagcttgggcctgtgacaa

SEQ ID NO: 84493 - DNA, 25 bp, mus musculus
tccttctggaatgactcctttgcca

SEQ ID NO: 84494 - DNA, 25 bp, mus musculus
atgctttcactgacctatgagccac

SEQ ID NO: 84495 - DNA, 25 bp, mus musculus
cacagcaatggctctgttgcccatt

SEQ ID NO: 84496 - DNA, 25 bp, mus musculus
aatggctctgttgcccatttcaatg

SEQ ID NO: 84497 - DNA, 25 bp, mus musculus
tctgttgcccatttcaatgtttccc

SEQ ID NO: 84498 - DNA, 25 bp, mus musculus
gtttcccaagtcacaggacctagca

SEQ ID NO: 84499 - DNA, 25 bp, mus musculus
cctagcatctattctttccactgtg

SEQ ID NO: 84500 - DNA, 25 bp, mus musculus
atctattctttccactgtgagtacg

SEQ ID NO: 84501 - DNA, 25 bp, mus musculus
tctttccactgtgagtacgtcagca

SEQ ID NO: 84502 - DNA, 25 bp, mus musculus
gagtacgtcagcagtgtgagcaaga

SEQ ID NO: 84503 - DNA, 25 bp, mus musculus
aaaggcaatctccttgtgaccaacg

SEQ ID NO: 84504 - DNA, 25 bp, mus musculus
aatctccttgtgaccaacgtgccct

SEQ ID NO: 84505 - DNA, 25 bp, mus musculus
tcactgacctatgagccactctttg

SEQ ID NO: 84506 - DNA, 25 bp, mus musculus
acctatgagccactctttggtgcaa

SEQ ID NO: 84507 - DNA, 25 bp, mus musculus
acattcaagttcattctggctagtc

SEQ ID NO: 84508 - DNA, 25 bp, mus musculus
aagttcattctggctagtcgcttct

SEQ ID NO: 84509 - DNA, 25 bp, mus musculus
tatccagtgtctgcccgatattggt

SEQ ID NO: 84510 - DNA, 25 bp, mus musculus
gtgtctgcccgatattggtttgcca

SEQ ID NO: 84511 - DNA, 25 bp, mus musculus
tattggtttgccatggaacgacttg

SEQ ID NO: 84512 - DNA, 25 bp, mus musculus
tttgccatggaacgacttgaaatcc

SEQ ID NO: 84513 - DNA, 25 bp, mus musculus
tcagcgtgcaggaggctgtggcact

SEQ ID NO: 84514 - DNA, 25 bp, mus musculus
gacacacacctgcaggcatgcagac

SEQ ID NO: 84515 - DNA, 25 bp, mus musculus
atgctttccactattatgacagcga

SEQ ID NO: 84516 - DNA, 25 bp, mus musculus
tccactattatgacagcgatggccc

SEQ ID NO: 84517 - DNA, 25 bp, mus musculus
acagcgatggccctgtcctttatcc

SEQ ID NO: 84518 - DNA, 25 bp, mus musculus
gcgatggccctgtcctttatccacg

SEQ ID NO: 84519 - DNA, 25 bp, mus musculus
atggccctgtcctttatccacgcgc

SEQ ID NO: 84520 - DNA, 25 bp, mus musculus
tttatccacgcgctctgtgcctctt

SEQ ID NO: 84521 - DNA, 25 bp, mus musculus
ctctgtgcctctttgagatgcccac

SEQ ID NO: 84522 - DNA, 25 bp, mus musculus
gcctctttgagatgcccacaggggt

SEQ ID NO: 84523 - DNA, 25 bp, mus musculus
ttgagatgcccacaggggtacccct

SEQ ID NO: 84524 - DNA, 25 bp, mus musculus
ttaggcgccactttgactcaaactt

SEQ ID NO: 84525 - DNA, 25 bp, mus musculus
acacacctgcaggcatgcagactaa

SEQ ID NO: 84526 - DNA, 25 bp, mus musculus
ctcacgagctggcccctggtattga

SEQ ID NO: 84527 - DNA, 25 bp, mus musculus
tggcccctggtattgactgtccaga

SEQ ID NO: 84528 - DNA, 25 bp, mus musculus
ctggtattgactgtccagagaccgc

SEQ ID NO: 84529 - DNA, 25 bp, mus musculus
ttgactgtccagagaccgctacttt

SEQ ID NO: 84530 - DNA, 25 bp, mus musculus
actgtccagagaccgctactttcct

SEQ ID NO: 84531 - DNA, 25 bp, mus musculus
ccgctactttcctggatgctttcca

SEQ ID NO: 84532 - DNA, 25 bp, mus musculus
tcctggatgctttccactattatga

SEQ ID NO: 84533 - DNA, 25 bp, mus musculus
gagaatcagccagacactgatgaca

SEQ ID NO: 84534 - DNA, 25 bp, mus musculus
gaatcagccagacactgatgacaaa

SEQ ID NO: 84535 - DNA, 25 bp, mus musculus
cactggaggctggatgggtttgatt

SEQ ID NO: 84536 - DNA, 25 bp, mus musculus
tgattcagcttaatacaaggataaa

SEQ ID NO: 84537 - DNA, 25 bp, mus musculus
atacttggatcactacactttgttt

SEQ ID NO: 84538 - DNA, 25 bp, mus musculus
ggatcactacactttgtttacaatt

SEQ ID NO: 84539 - DNA, 25 bp, mus musculus
tgtttacaatttcctggtcagtaat

SEQ ID NO: 84540 - DNA, 25 bp, mus musculus
tttacaatttcctggtcagtaatga

SEQ ID NO: 84541 - DNA, 25 bp, mus musculus
caatttcctggtcagtaatgataaa

SEQ ID NO: 84542 - DNA, 25 bp, mus musculus
aatctatgtcatcattattttctga

SEQ ID NO: 84543 - DNA, 25 bp, mus musculus
atatgttgaaccctaccaaattcag

SEQ ID NO: 84544 - DNA, 25 bp, mus musculus
catcccatattctgttttaatacaa

SEQ ID NO: 84545 - DNA, 25 bp, mus musculus
cagccagacactgatgacaaaagtg

SEQ ID NO: 84546 - DNA, 25 bp, mus musculus
agacagacatggctttgggaagaag

SEQ ID NO: 84547 - DNA, 25 bp, mus musculus
atactatcccattataagttcaaca

SEQ ID NO: 84548 - DNA, 25 bp, mus musculus
tataagttcaacaaccgaacaagtg

SEQ ID NO: 84549 - DNA, 25 bp, mus musculus
agttcaacaaccgaacaagtgtcat

SEQ ID NO: 84550 - DNA, 25 bp, mus musculus
ttcaacaaccgaacaagtgtcatgt

SEQ ID NO: 84551 - DNA, 25 bp, mus musculus
caacaaccgaacaagtgtcatgtta

SEQ ID NO: 84552 - DNA, 25 bp, mus musculus
ttagctgagacactggaggctggat

SEQ ID NO: 84553 - DNA, 25 bp, mus musculus
ccatcttgaaccttctggataccta

SEQ ID NO: 84554 - DNA, 25 bp, mus musculus
tcttgaaccttctggatacctacga

SEQ ID NO: 84555 - DNA, 25 bp, mus musculus
atgttacctttgctgagacatttga

SEQ ID NO: 84556 - DNA, 25 bp, mus musculus
ttacctttgctgagacatttgatgg

SEQ ID NO: 84557 - DNA, 25 bp, mus musculus
gtgctattcagcagtcagctgcaca

SEQ ID NO: 84558 - DNA, 25 bp, mus musculus
ctattcagcagtcagctgcacaaaa

SEQ ID NO: 84559 - DNA, 25 bp, mus musculus
ttcagcagtcagctgcacaaaaggg

SEQ ID NO: 84560 - DNA, 25 bp, mus musculus
agattaaacttcacaaaatcatcta

SEQ ID NO: 84561 - DNA, 25 bp, mus musculus
aacttcacaaaatcatctaccatct

SEQ ID NO: 84562 - DNA, 25 bp, mus musculus
ttcacaaaatcatctaccatcttat

SEQ ID NO: 84563 - DNA, 25 bp, mus musculus
aaatcatctaccatcttattgaaga

SEQ ID NO: 84564 - DNA, 25 bp, mus musculus
tctaccatcttattgaagatttgca

SEQ ID NO: 84565 - DNA, 25 bp, mus musculus
tgaaccttctggatacctacgatgc

SEQ ID NO: 84566 - DNA, 25 bp, mus musculus
ttctggatacctacgatgcttccca

SEQ ID NO: 84567 - DNA, 25 bp, mus musculus
tggatacctacgatgcttcccacga

SEQ ID NO: 84568 - DNA, 25 bp, mus musculus
atacctacgatgcttcccacgaatg

SEQ ID NO: 84569 - DNA, 25 bp, mus musculus
cctacgatgcttcccacgaatgtga

SEQ ID NO: 84570 - DNA, 25 bp, mus musculus
atgcttcccacgaatgtgaactcga

SEQ ID NO: 84571 - DNA, 25 bp, mus musculus
cccacgaatgtgaactcgaattagt

SEQ ID NO: 84572 - DNA, 25 bp, mus musculus
atgatgttacctttgctgagacatt

SEQ ID NO: 84573 - DNA, 25 bp, mus musculus
ataatccacaatttgctcaaatact

SEQ ID NO: 84574 - DNA, 25 bp, mus musculus
aatccacaatttgctcaaatactgg

SEQ ID NO: 84575 - DNA, 25 bp, mus musculus
gcttaatctgtactaatgggatggc

SEQ ID NO: 84576 - DNA, 25 bp, mus musculus
aatctgtactaatgggatggcacgt

SEQ ID NO: 84577 - DNA, 25 bp, mus musculus
atggcacgtggtcacatgcagtcca

SEQ ID NO: 84578 - DNA, 25 bp, mus musculus
ggcacgtggtcacatgcagtccatg

SEQ ID NO: 84579 - DNA, 25 bp, mus musculus
cgtggtcacatgcagtccatgtggg

SEQ ID NO: 84580 - DNA, 25 bp, mus musculus
gtcacatgcagtccatgtgggattc

SEQ ID NO: 84581 - DNA, 25 bp, mus musculus
catgcagtccatgtgggattctaac

SEQ ID NO: 84582 - DNA, 25 bp, mus musculus
tgcagtccatgtgggattctaacat

SEQ ID NO: 84583 - DNA, 25 bp, mus musculus
gattctaacataacattgagtgagt

SEQ ID NO: 84584 - DNA, 25 bp, mus musculus
ttctaacataacattgagtgagttt

SEQ ID NO: 84585 - DNA, 25 bp, mus musculus
tccacaatttgctcaaatactggtt

SEQ ID NO: 84586 - DNA, 25 bp, mus musculus
cacaatttgctcaaatactggtttt

SEQ ID NO: 84587 - DNA, 25 bp, mus musculus
ttcttataaactttctacaggatgt

SEQ ID NO: 84588 - DNA, 25 bp, mus musculus
caaattcttcacatttcacgttgac

SEQ ID NO: 84589 - DNA, 25 bp, mus musculus
aattcttcacatttcacgttgacta

SEQ ID NO: 84590 - DNA, 25 bp, mus musculus
ttcttcacatttcacgttgactatg

SEQ ID NO: 84591 - DNA, 25 bp, mus musculus
acatttcacgttgactatgtactta

SEQ ID NO: 84592 - DNA, 25 bp, mus musculus
atttcacgttgactatgtacttacg

SEQ ID NO: 84593 - DNA, 25 bp, mus musculus
tccttgtggatcagaccacaggttt

SEQ ID NO: 84594 - DNA, 25 bp, mus musculus
atcagaccacaggtttgtccagagg

SEQ ID NO: 84595 - DNA, 25 bp, mus musculus
gaggccctgtacaccaccaggcaca

SEQ ID NO: 84596 - DNA, 25 bp, mus musculus
accaggcacagagattcaggttctc

SEQ ID NO: 84597 - DNA, 25 bp, mus musculus
tctcccctatgggtgtagatcacat

SEQ ID NO: 84598 - DNA, 25 bp, mus musculus
gtgtcaatgtccccggcaatgcttc

SEQ ID NO: 84599 - DNA, 25 bp, mus musculus
atgtccccggcaatgcttcctcggg

SEQ ID NO: 84600 - DNA, 25 bp, mus musculus
tccccggcaatgcttcctcgggctg

SEQ ID NO: 84601 - DNA, 25 bp, mus musculus
cttcctcgggctggtgcatcttcat

SEQ ID NO: 84602 - DNA, 25 bp, mus musculus
cctcgggctggtgcatcttcatcta

SEQ ID NO: 84603 - DNA, 25 bp, mus musculus
ggcaagacgccgatgaggggatcct

SEQ ID NO: 84604 - DNA, 25 bp, mus musculus
aatctgcaatggccatagcaagtct

SEQ ID NO: 84605 - DNA, 25 bp, mus musculus
tgtccagaggggttgcctttatccg

SEQ ID NO: 84606 - DNA, 25 bp, mus musculus
caattaccagtttcattggtcataa

SEQ ID NO: 84607 - DNA, 25 bp, mus musculus
caggttcctccgagcccatcacagt

SEQ ID NO: 84608 - DNA, 25 bp, mus musculus
cctccgagcccatcacagtgaagtt

SEQ ID NO: 84609 - DNA, 25 bp, mus musculus
ccgagcccatcacagtgaagtttgc

SEQ ID NO: 84610 - DNA, 25 bp, mus musculus
agcccatcacagtgaagtttgcagc

SEQ ID NO: 84611 - DNA, 25 bp, mus musculus
ttgcagccaatcccaaccagaacaa

SEQ ID NO: 84612 - DNA, 25 bp, mus musculus
cgcagctgtaccactcgcctgctag

SEQ ID NO: 84613 - DNA, 25 bp, mus musculus
ccagccagcacttcaatgagatgag

SEQ ID NO: 84614 - DNA, 25 bp, mus musculus
tggtggcctcccagataatgaatta

SEQ ID NO: 84615 - DNA, 25 bp, mus musculus
tgacagatctggcattcattgaaga

SEQ ID NO: 84616 - DNA, 25 bp, mus musculus
atttctccaaaatgcgaatgatatc

SEQ ID NO: 84617 - DNA, 25 bp, mus musculus
tgatatcacacattattcgagagat

SEQ ID NO: 84618 - DNA, 25 bp, mus musculus
tacgccagttccagcagaccgctta

SEQ ID NO: 84619 - DNA, 25 bp, mus musculus
agttccagcagaccgcttaccgcat

SEQ ID NO: 84620 - DNA, 25 bp, mus musculus
agcagaccgcttaccgcatagacca

SEQ ID NO: 84621 - DNA, 25 bp, mus musculus
tagaccagcagccaaaggtcataca

SEQ ID NO: 84622 - DNA, 25 bp, mus musculus
tcatacaatacctgcttgacaaagc

SEQ ID NO: 84623 - DNA, 25 bp, mus musculus
attcactctatgagctgtcactcaa

SEQ ID NO: 84624 - DNA, 25 bp, mus musculus
tctatgagctgtcactcaaaattga

SEQ ID NO: 84625 - DNA, 25 bp, mus musculus
tgaattatgccgacatcagctcccg

SEQ ID NO: 84626 - DNA, 25 bp, mus musculus
agctgtcactcaaaattgaacctcg

SEQ ID NO: 84627 - DNA, 25 bp, mus musculus
gccgatgtctccacaactacaatgg

SEQ ID NO: 84628 - DNA, 25 bp, mus musculus
tggagatcacctcagccttaaacag

SEQ ID NO: 84629 - DNA, 25 bp, mus musculus
tcacctcagccttaaacagaagtcc

SEQ ID NO: 84630 - DNA, 25 bp, mus musculus
gaagtcccatctacaggctgaagaa

SEQ ID NO: 84631 - DNA, 25 bp, mus musculus
ccatctacaggctgaagaaaacctg

SEQ ID NO: 84632 - DNA, 25 bp, mus musculus
acctcagagagactctcaaaaactg

SEQ ID NO: 84633 - DNA, 25 bp, mus musculus
tgtacttgacagatctggcattcat

SEQ ID NO: 84634 - DNA, 25 bp, mus musculus
tggccttgaatgtcaactggcgtta

SEQ ID NO: 84635 - DNA, 25 bp, mus musculus
tgtcaactggcgttaggatcccttt

SEQ ID NO: 84636 - DNA, 25 bp, mus musculus
tttgctcctgttgacgtgttatcaa

SEQ ID NO: 84637 - DNA, 25 bp, mus musculus
ttgctcctgttgacgtgttatcaag

SEQ ID NO: 84638 - DNA, 25 bp, mus musculus
gctcctgttgacgtgttatcaagtg

SEQ ID NO: 84639 - DNA, 25 bp, mus musculus
ctcctgttgacgtgttatcaagtgg

SEQ ID NO: 84640 - DNA, 25 bp, mus musculus
ctatcagaagtcttgcctggagaga

SEQ ID NO: 84641 - DNA, 25 bp, mus musculus
tatcagaagtcttgcctggagagag

SEQ ID NO: 84642 - DNA, 25 bp, mus musculus
cagaagtcttgcctggagagagagt

SEQ ID NO: 84643 - DNA, 25 bp, mus musculus
agaagtcttgcctggagagagagta

SEQ ID NO: 84644 - DNA, 25 bp, mus musculus
gaagtcttgcctggagagagagtag

SEQ ID NO: 84645 - DNA, 25 bp, mus musculus
agtcttgcctggagagagagtagga

SEQ ID NO: 84646 - DNA, 25 bp, mus musculus
gttaggatcccttttgctcctgttg

SEQ ID NO: 84647 - DNA, 25 bp, mus musculus
ttaggatcccttttgctcctgttga

SEQ ID NO: 84648 - DNA, 25 bp, mus musculus
aggatcccttttgctcctgttgacg

SEQ ID NO: 84649 - DNA, 25 bp, mus musculus
ggatcccttttgctcctgttgacgt

SEQ ID NO: 84650 - DNA, 25 bp, mus musculus
gatcccttttgctcctgttgacgtg

SEQ ID NO: 84651 - DNA, 25 bp, mus musculus
tcccttttgctcctgttgacgtgtt

SEQ ID NO: 84652 - DNA, 25 bp, mus musculus
ccttttgctcctgttgacgtgttat

SEQ ID NO: 84653 - DNA, 25 bp, mus musculus
ttttgctcctgttgacgtgttatca

SEQ ID NO: 84654 - DNA, 25 bp, mus musculus
gggatctgcttttgcctgataaccc

SEQ ID NO: 84655 - DNA, 25 bp, mus musculus
tgcttttgcctgataaccctggttg

SEQ ID NO: 84656 - DNA, 25 bp, mus musculus
atagtctatgttatctgttgtagga

SEQ ID NO: 84657 - DNA, 25 bp, mus musculus
tgatacatgtgcccaagaaaggacc

SEQ ID NO: 84658 - DNA, 25 bp, mus musculus
aatcttcttagaattgcttcacctg

SEQ ID NO: 84659 - DNA, 25 bp, mus musculus
cttagaattgcttcacctgcatagt

SEQ ID NO: 84660 - DNA, 25 bp, mus musculus
attgcttcacctgcatagtagccat

SEQ ID NO: 84661 - DNA, 25 bp, mus musculus
tcacctgcatagtagccatctgtct

SEQ ID NO: 84662 - DNA, 25 bp, mus musculus
gcatagtagccatctgtctgcagcg

SEQ ID NO: 84663 - DNA, 25 bp, mus musculus
gatatggcctctacatactaagtgt

SEQ ID NO: 84664 - DNA, 25 bp, mus musculus
gcctctacatactaagtgttctctt

SEQ ID NO: 84665 - DNA, 25 bp, mus musculus
tctctcattttccaagaagcattac

SEQ ID NO: 84666 - DNA, 25 bp, mus musculus
gtttgcatttcacaaatctgtaaat

SEQ ID NO: 84667 - DNA, 25 bp, mus musculus
atgtccttgtcttctcttaagtgga

SEQ ID NO: 84668 - DNA, 25 bp, mus musculus
atttcttcttgagtcctctatagat

SEQ ID NO: 84669 - DNA, 25 bp, mus musculus
tcttgagtcctctatagatgaacat

SEQ ID NO: 84670 - DNA, 25 bp, mus musculus
tacatgtccccatatttagtgctca

SEQ ID NO: 84671 - DNA, 25 bp, mus musculus
tccccatatttagtgctcagtctgc

SEQ ID NO: 84672 - DNA, 25 bp, mus musculus
gtgctcagtctgccatatgctttat

SEQ ID NO: 84673 - DNA, 25 bp, mus musculus
agtctgccatatgctttatagaagt

SEQ ID NO: 84674 - DNA, 25 bp, mus musculus
taaccatgcgccattcgtcacggat

SEQ ID NO: 84675 - DNA, 25 bp, mus musculus
accatgcgccattcgtcacggatct

SEQ ID NO: 84676 - DNA, 25 bp, mus musculus
tctcagtatcctgaccctctacgtc

SEQ ID NO: 84677 - DNA, 25 bp, mus musculus
tcagtatcctgaccctctacgtcat

SEQ ID NO: 84678 - DNA, 25 bp, mus musculus
agtatcctgaccctctacgtcatgt

SEQ ID NO: 84679 - DNA, 25 bp, mus musculus
tcctgaccctctacgtcatgtagca

SEQ ID NO: 84680 - DNA, 25 bp, mus musculus
ctgaccctctacgtcatgtagcatg

SEQ ID NO: 84681 - DNA, 25 bp, mus musculus
gaccctctacgtcatgtagcatggc

SEQ ID NO: 84682 - DNA, 25 bp, mus musculus
ccctctacgtcatgtagcatggcgg

SEQ ID NO: 84683 - DNA, 25 bp, mus musculus
ctctacgtcatgtagcatggcggga

SEQ ID NO: 84684 - DNA, 25 bp, mus musculus
ctacgtcatgtagcatggcgggaag

SEQ ID NO: 84685 - DNA, 25 bp, mus musculus
ggctcatggcactggagagttgagt

SEQ ID NO: 84686 - DNA, 25 bp, mus musculus
catgcgccattcgtcacggatctca

SEQ ID NO: 84687 - DNA, 25 bp, mus musculus
tgcgccattcgtcacggatctcagt

SEQ ID NO: 84688 - DNA, 25 bp, mus musculus
cgccattcgtcacggatctcagtat

SEQ ID NO: 84689 - DNA, 25 bp, mus musculus
ccattcgtcacggatctcagtatcc

SEQ ID NO: 84690 - DNA, 25 bp, mus musculus
attcgtcacggatctcagtatcctg

SEQ ID NO: 84691 - DNA, 25 bp, mus musculus
cacggatctcagtatcctgaccctc

SEQ ID NO: 84692 - DNA, 25 bp, mus musculus
cggatctcagtatcctgaccctcta

SEQ ID NO: 84693 - DNA, 25 bp, mus musculus
gatctcagtatcctgaccctctacg

SEQ ID NO: 84694 - DNA, 25 bp, mus musculus
tgcctaccgttactacatcgacgac

SEQ ID NO: 84695 - DNA, 25 bp, mus musculus
caaacccaagaacagcgtatggaag

SEQ ID NO: 84696 - DNA, 25 bp, mus musculus
gcctactgagagctgtcattgactt

SEQ ID NO: 84697 - DNA, 25 bp, mus musculus
ctgtcattgacttactgtctaaagc

SEQ ID NO: 84698 - DNA, 25 bp, mus musculus
ttgacttactgtctaaagccctgtg

SEQ ID NO: 84699 - DNA, 25 bp, mus musculus
ctaaagccctgtgctccgtgactcc

SEQ ID NO: 84700 - DNA, 25 bp, mus musculus
gctccgtgactcccacgcatgaact

SEQ ID NO: 84701 - DNA, 25 bp, mus musculus
tgactcccacgcatgaactcatcag

SEQ ID NO: 84702 - DNA, 25 bp, mus musculus
atgaactcatcagggccgtgtctac

SEQ ID NO: 84703 - DNA, 25 bp, mus musculus
tcatcagggccgtgtctactcctta

SEQ ID NO: 84704 - DNA, 25 bp, mus musculus
tgtctactccttaattgtcacatta

SEQ ID NO: 84705 - DNA, 25 bp, mus musculus
tggtcggccattgttttggttatgt

SEQ ID NO: 84706 - DNA, 25 bp, mus musculus
agactcggtcacctgagtgaagtgg

SEQ ID NO: 84707 - DNA, 25 bp, mus musculus
ggctgtgctcctgtgaactgcagtg

SEQ ID NO: 84708 - DNA, 25 bp, mus musculus
gaactgcagtgctccccagtgcagt

SEQ ID NO: 84709 - DNA, 25 bp, mus musculus
tcctgtaatctgcagcagggagcac

SEQ ID NO: 84710 - DNA, 25 bp, mus musculus
aatctgcagcagggagcacgtcctc

SEQ ID NO: 84711 - DNA, 25 bp, mus musculus
ttattctaaacgtcactggccaggg

SEQ ID NO: 84712 - DNA, 25 bp, mus musculus
taaacgtcactggccaggggactcg

SEQ ID NO: 84713 - DNA, 25 bp, mus musculus
tcactggccaggggactcgcctact

SEQ ID NO: 84714 - DNA, 25 bp, mus musculus
ggttccgccatggaatccaacaagg

SEQ ID NO: 84715 - DNA, 25 bp, mus musculus
ttccgccatggaatccaacaaggat

SEQ ID NO: 84716 - DNA, 25 bp, mus musculus
aggccatccaaagcaaccagcccga

SEQ ID NO: 84717 - DNA, 25 bp, mus musculus
cgcttcctggagaaggcgcacggct

SEQ ID NO: 84718 - DNA, 25 bp, mus musculus
acgccacgagtcagcgcactgatcg

SEQ ID NO: 84719 - DNA, 25 bp, mus musculus
cacgagtcagcgcactgatcgagtc

SEQ ID NO: 84720 - DNA, 25 bp, mus musculus
cgagtcagcgcactgatcgagtccc

SEQ ID NO: 84721 - DNA, 25 bp, mus musculus
agtcagcgcactgatcgagtccctc

SEQ ID NO: 84722 - DNA, 25 bp, mus musculus
tcagcgcactgatcgagtccctcaa

SEQ ID NO: 84723 - DNA, 25 bp, mus musculus
cgcactgatcgagtccctcaaccaa

SEQ ID NO: 84724 - DNA, 25 bp, mus musculus
cactgatcgagtccctcaaccaaaa

SEQ ID NO: 84725 - DNA, 25 bp, mus musculus
acagtccaccggtgatcaccctcaa

SEQ ID NO: 84726 - DNA, 25 bp, mus musculus
ccgccatggaatccaacaaggatga

SEQ ID NO: 84727 - DNA, 25 bp, mus musculus
aggatgaagccgagcgctgtatcag

SEQ ID NO: 84728 - DNA, 25 bp, mus musculus
gatgaagccgagcgctgtatcagca

SEQ ID NO: 84729 - DNA, 25 bp, mus musculus
aagccgagcgctgtatcagcatcgc

SEQ ID NO: 84730 - DNA, 25 bp, mus musculus
ctgtatcagcatcgccctcaaggcc

SEQ ID NO: 84731 - DNA, 25 bp, mus musculus
gtatcagcatcgccctcaaggccat

SEQ ID NO: 84732 - DNA, 25 bp, mus musculus
atcgccctcaaggccatccaaagca

SEQ ID NO: 84733 - DNA, 25 bp, mus musculus
ctcaaggccatccaaagcaaccagc

SEQ ID NO: 84734 - DNA, 25 bp, mus musculus
cctacatatggatgcctgataccca

SEQ ID NO: 84735 - DNA, 25 bp, mus musculus
tatggatgcctgatacccatttaac

SEQ ID NO: 84736 - DNA, 25 bp, mus musculus
gcctcaggtcacaacccatccatgt

SEQ ID NO: 84737 - DNA, 25 bp, mus musculus
ggtcacaacccatccatgtgtggac

SEQ ID NO: 84738 - DNA, 25 bp, mus musculus
aacccatccatgtgtggaccagact

SEQ ID NO: 84739 - DNA, 25 bp, mus musculus
atccctctggttccacgcctctaga

SEQ ID NO: 84740 - DNA, 25 bp, mus musculus
ccacgcctctagatttggaagcaga

SEQ ID NO: 84741 - DNA, 25 bp, mus musculus
aagcagattctaagcaccaggtcat

SEQ ID NO: 84742 - DNA, 25 bp, mus musculus
agcaccaggtcattttatctaatgt

SEQ ID NO: 84743 - DNA, 25 bp, mus musculus
ttttatctaatgtctaacatcctta

SEQ ID NO: 84744 - DNA, 25 bp, mus musculus
ctaatgtctaacatccttacaaatc

SEQ ID NO: 84745 - DNA, 25 bp, mus musculus
ccctctcataaatgtggatctgttt

SEQ ID NO: 84746 - DNA, 25 bp, mus musculus
aactatcaaagccgtcatttcccat

SEQ ID NO: 84747 - DNA, 25 bp, mus musculus
caaagccgtcatttcccatggggtg

SEQ ID NO: 84748 - DNA, 25 bp, mus musculus
cgtcatttcccatggggtgtagcca

SEQ ID NO: 84749 - DNA, 25 bp, mus musculus
accccagagtattcagaccaatcaa

SEQ ID NO: 84750 - DNA, 25 bp, mus musculus
tcagaccaatcaaagcataagagtg

SEQ ID NO: 84751 - DNA, 25 bp, mus musculus
tctgtctatagtcttcactgcttat

SEQ ID NO: 84752 - DNA, 25 bp, mus musculus
ttgttgactttctattatggaaatc

SEQ ID NO: 84753 - DNA, 25 bp, mus musculus
acatgtacacagtagacgtgatggc

SEQ ID NO: 84754 - DNA, 25 bp, mus musculus
gagcctgctatgctaggaggctatg

SEQ ID NO: 84755 - DNA, 25 bp, mus musculus
ttctcaggcaggtgaccgtaggagg

SEQ ID NO: 84756 - DNA, 25 bp, mus musculus
taaccttctgcctagactagctagc

SEQ ID NO: 84757 - DNA, 25 bp, mus musculus
tctgcctagactagctagcctggct

SEQ ID NO: 84758 - DNA, 25 bp, mus musculus
tctgctcttgcccttctggagggat

SEQ ID NO: 84759 - DNA, 25 bp, mus musculus
cttgcccttctggagggattctcat

SEQ ID NO: 84760 - DNA, 25 bp, mus musculus
cttctggagggattctcatggccct

SEQ ID NO: 84761 - DNA, 25 bp, mus musculus
ttccccagactgtgatagtccaggg

SEQ ID NO: 84762 - DNA, 25 bp, mus musculus
gtctgtagctgggttagagatgtag

SEQ ID NO: 84763 - DNA, 25 bp, mus musculus
gatgtagaccatctacaatacccta

SEQ ID NO: 84764 - DNA, 25 bp, mus musculus
gaccatctacaataccctatttatg

SEQ ID NO: 84765 - DNA, 25 bp, mus musculus
taccctatttatgtcttcctttgag

SEQ ID NO: 84766 - DNA, 25 bp, mus musculus
ggcacttccaggaaaagtgcatttt

SEQ ID NO: 84767 - DNA, 25 bp, mus musculus
cctgtccaatgctgattccctttcg

SEQ ID NO: 84768 - DNA, 25 bp, mus musculus
agattctaggtggcactgtttgcct

SEQ ID NO: 84769 - DNA, 25 bp, mus musculus
gcactgtttgccttaataccccagg

SEQ ID NO: 84770 - DNA, 25 bp, mus musculus
ttaataccccaggagttcatcttct

SEQ ID NO: 84771 - DNA, 25 bp, mus musculus
ccccaggagttcatcttcttctctg

SEQ ID NO: 84772 - DNA, 25 bp, mus musculus
atcttcttctctgcctgctaacctt

SEQ ID NO: 84773 - DNA, 25 bp, mus musculus
gcctgctaaccttctgcctagacta

SEQ ID NO: 84774 - DNA, 25 bp, mus musculus
gagggaaccaatccccagcagcaca

SEQ ID NO: 84775 - DNA, 25 bp, mus musculus
cagcacaaataggcccctagaccca

SEQ ID NO: 84776 - DNA, 25 bp, mus musculus
gtgctcttggttcccagagctataa

SEQ ID NO: 84777 - DNA, 25 bp, mus musculus
ggctccctgctgtgcctgtttattt

SEQ ID NO: 84778 - DNA, 25 bp, mus musculus
tcctggtttctgctgacgctgggct

SEQ ID NO: 84779 - DNA, 25 bp, mus musculus
ggtctcacctgtaccctctaggcgc

SEQ ID NO: 84780 - DNA, 25 bp, mus musculus
ttcaggagcacaggcgtgtggcttc

SEQ ID NO: 84781 - DNA, 25 bp, mus musculus
ctggctgtgtacacagggtgcttta

SEQ ID NO: 84782 - DNA, 25 bp, mus musculus
tgctttattctccacagagtgatac

SEQ ID NO: 84783 - DNA, 25 bp, mus musculus
cttggccgatgtccccatatgtaca

SEQ ID NO: 84784 - DNA, 25 bp, mus musculus
cgatgtccccatatgtacagaactg

SEQ ID NO: 84785 - DNA, 25 bp, mus musculus
ccccatatgtacagaactgaataaa

SEQ ID NO: 84786 - DNA, 25 bp, mus musculus
gcccctagacccagctttatgcagg

SEQ ID NO: 84787 - DNA, 25 bp, mus musculus
tatacctaaccaagacaacacagag

SEQ ID NO: 84788 - DNA, 25 bp, mus musculus
ccttgccctctctggcaagcagcag

SEQ ID NO: 84789 - DNA, 25 bp, mus musculus
cctctctggcaagcagcagtcctgg

SEQ ID NO: 84790 - DNA, 25 bp, mus musculus
tggcaagcagcagtcctgggatcac

SEQ ID NO: 84791 - DNA, 25 bp, mus musculus
gcagcagtcctgggatcacacattt

SEQ ID NO: 84792 - DNA, 25 bp, mus musculus
ggatcacacatttgcaagggaccac

SEQ ID NO: 84793 - DNA, 25 bp, mus musculus
tcccttgtgctcttggttcccagag

SEQ ID NO: 84794 - DNA, 25 bp, mus musculus
ccatctggcacagggacagagacca

SEQ ID NO: 84795 - DNA, 25 bp, mus musculus
agactgagccaagcgaccgcgcgac

SEQ ID NO: 84796 - DNA, 25 bp, mus musculus
tgctgtggctctatgacaggtacag

SEQ ID NO: 84797 - DNA, 25 bp, mus musculus
ctgtggctctatgacaggtacagcg

SEQ ID NO: 84798 - DNA, 25 bp, mus musculus
ctctatgacaggtacagcggcacga

SEQ ID NO: 84799 - DNA, 25 bp, mus musculus
atgacaggtacagcggcacgagtag

SEQ ID NO: 84800 - DNA, 25 bp, mus musculus
caggtacagcggcacgagtagagtc

SEQ ID NO: 84801 - DNA, 25 bp, mus musculus
ggtacagcggcacgagtagagtcca

SEQ ID NO: 84802 - DNA, 25 bp, mus musculus
tacagcggcacgagtagagtccagg

SEQ ID NO: 84803 - DNA, 25 bp, mus musculus
aggctacccggacaccggcatcgca

SEQ ID NO: 84804 - DNA, 25 bp, mus musculus
ctgcgcggtggtaacacggtccgca

SEQ ID NO: 84805 - DNA, 25 bp, mus musculus
ggtggtaacacggtccgcagcttca

SEQ ID NO: 84806 - DNA, 25 bp, mus musculus
aagcgaccgcgcgacaggtggtagc

SEQ ID NO: 84807 - DNA, 25 bp, mus musculus
tggtaacacggtccgcagcttcaga

SEQ ID NO: 84808 - DNA, 25 bp, mus musculus
gaccgcgcgacaggtggtagcccga

SEQ ID NO: 84809 - DNA, 25 bp, mus musculus
gacctgaggccgcacgacaaggtgt

SEQ ID NO: 84810 - DNA, 25 bp, mus musculus
cctgaggccgcacgacaaggtgtcg

SEQ ID NO: 84811 - DNA, 25 bp, mus musculus
tgaggccgcacgacaaggtgtcgga

SEQ ID NO: 84812 - DNA, 25 bp, mus musculus
tgtcggagcatatgctgtggctcta

SEQ ID NO: 84813 - DNA, 25 bp, mus musculus
catatgctgtggctctatgacaggt

SEQ ID NO: 84814 - DNA, 25 bp, mus musculus
tatgctgtggctctatgacaggtac

SEQ ID NO: 84815 - DNA, 25 bp, mus musculus
aactcacttcataattgtttacgcg

SEQ ID NO: 84816 - DNA, 25 bp, mus musculus
aattgtttacgcgtgtctgatcacc

SEQ ID NO: 84817 - DNA, 25 bp, mus musculus
ttcttcgttctctggtcctatgtga

SEQ ID NO: 84818 - DNA, 25 bp, mus musculus
gttctctggtcctatgtgagattac

SEQ ID NO: 84819 - DNA, 25 bp, mus musculus
ttgggctttccctgaatgcaagata

SEQ ID NO: 84820 - DNA, 25 bp, mus musculus
tttccctgaatgcaagataaagcct

SEQ ID NO: 84821 - DNA, 25 bp, mus musculus
taaagcaccatggtcagaagcagaa

SEQ ID NO: 84822 - DNA, 25 bp, mus musculus
tggactcagctatccattaagaact

SEQ ID NO: 84823 - DNA, 25 bp, mus musculus
tatgccatcatctggatacatcaaa

SEQ ID NO: 84824 - DNA, 25 bp, mus musculus
atcatctggatacatcaaagtaatt

SEQ ID NO: 84825 - DNA, 25 bp, mus musculus
aatttatgtataacctccactattg

SEQ ID NO: 84826 - DNA, 25 bp, mus musculus
catcacaactacaactttttcatca

SEQ ID NO: 84827 - DNA, 25 bp, mus musculus
ttacgcgtgtctgatcaccaagtag

SEQ ID NO: 84828 - DNA, 25 bp, mus musculus
gtgtctgatcaccaagtagcatgac

SEQ ID NO: 84829 - DNA, 25 bp, mus musculus
gatcaccaagtagcatgactgatct

SEQ ID NO: 84830 - DNA, 25 bp, mus musculus
gcatgactgatctgctctttaaact

SEQ ID NO: 84831 - DNA, 25 bp, mus musculus
tgctctttaaactctgtgatctgtg

SEQ ID NO: 84832 - DNA, 25 bp, mus musculus
ttaaactctgtgatctgtgaaatga

SEQ ID NO: 84833 - DNA, 25 bp, mus musculus
aagcaaccacttattctggctacta

SEQ ID NO: 84834 - DNA, 25 bp, mus musculus
gctactaaggagctctcctttctta

SEQ ID NO: 84835 - DNA, 25 bp, mus musculus
agcaatgacattgccttggtccacc

SEQ ID NO: 84836 - DNA, 25 bp, mus musculus
aatgacattgccttggtccacctct

SEQ ID NO: 84837 - DNA, 25 bp, mus musculus
aacacacagttctattggccaacag

SEQ ID NO: 84838 - DNA, 25 bp, mus musculus
cagttctattggccaacaggctatg

SEQ ID NO: 84839 - DNA, 25 bp, mus musculus
tattggccaacaggctatggtgctc

SEQ ID NO: 84840 - DNA, 25 bp, mus musculus
tggccaacaggctatggtgctccaa

SEQ ID NO: 84841 - DNA, 25 bp, mus musculus
ggctatggtgctccaagaggcccgg

SEQ ID NO: 84842 - DNA, 25 bp, mus musculus
cagccccgacttctacgggaatcag

SEQ ID NO: 84843 - DNA, 25 bp, mus musculus
cgacttctacgggaatcagttcaag

SEQ ID NO: 84844 - DNA, 25 bp, mus musculus
gaatcagttcaagcccaagattgtt

SEQ ID NO: 84845 - DNA, 25 bp, mus musculus
tcagttcaagcccaagattgttctg

SEQ ID NO: 84846 - DNA, 25 bp, mus musculus
gttcaagcccaagattgttctgtgc

SEQ ID NO: 84847 - DNA, 25 bp, mus musculus
attgccttggtccacctctctagct

SEQ ID NO: 84848 - DNA, 25 bp, mus musculus
ctgcctctcacagaatacatccagc

SEQ ID NO: 84849 - DNA, 25 bp, mus musculus
cctctcacagaatacatccagccag

SEQ ID NO: 84850 - DNA, 25 bp, mus musculus
acagaatacatccagccagtgtgtc

SEQ ID NO: 84851 - DNA, 25 bp, mus musculus
gaatacatccagccagtgtgtctcc

SEQ ID NO: 84852 - DNA, 25 bp, mus musculus
tacatccagccagtgtgtctccctg

SEQ ID NO: 84853 - DNA, 25 bp, mus musculus
ctccctgctgcgggacaggccctgg

SEQ ID NO: 84854 - DNA, 25 bp, mus musculus
caggccctggtggatggcaaggtct

SEQ ID NO: 84855 - DNA, 25 bp, mus musculus
gacagcaagtcctagaactggaaaa

SEQ ID NO: 84856 - DNA, 25 bp, mus musculus
ttcattttaacaggtatctgaccag

SEQ ID NO: 84857 - DNA, 25 bp, mus musculus
caatggccaaggaccaccatacgga

SEQ ID NO: 84858 - DNA, 25 bp, mus musculus
tggccaaggaccaccatacggacct

SEQ ID NO: 84859 - DNA, 25 bp, mus musculus
cggacctgacgaccttatagaagtg

SEQ ID NO: 84860 - DNA, 25 bp, mus musculus
gaccttgggcctatcccttcttgca

SEQ ID NO: 84861 - DNA, 25 bp, mus musculus
cttgggcctatcccttcttgcactc

SEQ ID NO: 84862 - DNA, 25 bp, mus musculus
atcccttcttgcactctaggttgag

SEQ ID NO: 84863 - DNA, 25 bp, mus musculus
tgcactctaggttgagcgaagctgc

SEQ ID NO: 84864 - DNA, 25 bp, mus musculus
cctgctgtcacctcactgggctcta

SEQ ID NO: 84865 - DNA, 25 bp, mus musculus
tcactgggctctaaggtactgtggg

SEQ ID NO: 84866 - DNA, 25 bp, mus musculus
ctgagaacataaacccttggcgagt

SEQ ID NO: 84867 - DNA, 25 bp, mus musculus
ttaacaggtatctgaccaggcgccg

SEQ ID NO: 84868 - DNA, 25 bp, mus musculus
acaggtatctgaccaggcgccgtcg

SEQ ID NO: 84869 - DNA, 25 bp, mus musculus
ggtatctgaccaggcgccgtcggat

SEQ ID NO: 84870 - DNA, 25 bp, mus musculus
tgcccaacaccaagggcaggtcttc

SEQ ID NO: 84871 - DNA, 25 bp, mus musculus
ccccgggccagcatttgcagccaat

SEQ ID NO: 84872 - DNA, 25 bp, mus musculus
gccagcatttgcagccaatggccaa

SEQ ID NO: 84873 - DNA, 25 bp, mus musculus
agcatttgcagccaatggccaagga

SEQ ID NO: 84874 - DNA, 25 bp, mus musculus
atttgcagccaatggccaaggacca

SEQ ID NO: 84875 - DNA, 25 bp, mus musculus
aggtgtttgtcctgaaggagggcat

SEQ ID NO: 84876 - DNA, 25 bp, mus musculus
tgaagatcaccttcaaggtcaacaa

SEQ ID NO: 84877 - DNA, 25 bp, mus musculus
tggcacgtggcctctacgtggtcag

SEQ ID NO: 84878 - DNA, 25 bp, mus musculus
gtggcctctacgtggtcaggtccct

SEQ ID NO: 84879 - DNA, 25 bp, mus musculus
tcttcactgatgacgacaggctgaa

SEQ ID NO: 84880 - DNA, 25 bp, mus musculus
ggcacctccatgtctgccaggactg

SEQ ID NO: 84881 - DNA, 25 bp, mus musculus
tctgccaggactggaaggactgaac

SEQ ID NO: 84882 - DNA, 25 bp, mus musculus
ttcccaatttcttgtcagttgcaga

SEQ ID NO: 84883 - DNA, 25 bp, mus musculus
atttcttgtcagttgcagagacctg

SEQ ID NO: 84884 - DNA, 25 bp, mus musculus
ttgcagagacctgcaagcattccct

SEQ ID NO: 84885 - DNA, 25 bp, mus musculus
gcaagcattccctagacctcccagt

SEQ ID NO: 84886 - DNA, 25 bp, mus musculus
tcccagttggtgaccagatgtcccc

SEQ ID NO: 84887 - DNA, 25 bp, mus musculus
tcaccttcaaggtcaacaaggagat

SEQ ID NO: 84888 - DNA, 25 bp, mus musculus
gtggcctcaaatgtctgcatcacac

SEQ ID NO: 84889 - DNA, 25 bp, mus musculus
gtctgcatcacacctatcgtcgggg

SEQ ID NO: 84890 - DNA, 25 bp, mus musculus
atcacacctatcgtcggggactgcg

SEQ ID NO: 84891 - DNA, 25 bp, mus musculus
acaaggccatcttcatggtgggaag

SEQ ID NO: 84892 - DNA, 25 bp, mus musculus
ccatcttcatggtgggaagctacgg

SEQ ID NO: 84893 - DNA, 25 bp, mus musculus
gctacggccccagagcccaggagta

SEQ ID NO: 84894 - DNA, 25 bp, mus musculus
ttgtgacttcagtggaggaagcacc

SEQ ID NO: 84895 - DNA, 25 bp, mus musculus
tggacacatgtcacttaacacgtcc

SEQ ID NO: 84896 - DNA, 25 bp, mus musculus
catgtcacttaacacgtccaataaa

SEQ ID NO: 84897 - DNA, 25 bp, mus musculus
atctccccaggactccaatcagcgt

SEQ ID NO: 84898 - DNA, 25 bp, mus musculus
ccaggactccaatcagcgttggccc

SEQ ID NO: 84899 - DNA, 25 bp, mus musculus
atgctggagacggggctgaagaaaa

SEQ ID NO: 84900 - DNA, 25 bp, mus musculus
acattctttacctctgattgtgtgg

SEQ ID NO: 84901 - DNA, 25 bp, mus musculus
tttacctctgattgtgtggccattt

SEQ ID NO: 84902 - DNA, 25 bp, mus musculus
gtgtgattctctgtgcccaacttgc

SEQ ID NO: 84903 - DNA, 25 bp, mus musculus
gtgcccaacttgctttaagaagaat

SEQ ID NO: 84904 - DNA, 25 bp, mus musculus
atatcccatgcacgttcaatttttg

SEQ ID NO: 84905 - DNA, 25 bp, mus musculus
catgcacgttcaatttttggcatga

SEQ ID NO: 84906 - DNA, 25 bp, mus musculus
cgttcaatttttggcatgagtctaa

SEQ ID NO: 84907 - DNA, 25 bp, mus musculus
agacatttctcagcctcctgatgtc

SEQ ID NO: 84908 - DNA, 25 bp, mus musculus
gcctcctgatgtcaactctgaactc

SEQ ID NO: 84909 - DNA, 25 bp, mus musculus
tgatgtcaactctgaactctggaca

SEQ ID NO: 84910 - DNA, 25 bp, mus musculus
caactctgaactctggacaacgggg

SEQ ID NO: 84911 - DNA, 25 bp, mus musculus
ccatcagagacctgctctccaagaa

SEQ ID NO: 84912 - DNA, 25 bp, mus musculus
gagacctgctctccaagaaaacagc

SEQ ID NO: 84913 - DNA, 25 bp, mus musculus
agatttggactccttccagagtgag

SEQ ID NO: 84914 - DNA, 25 bp, mus musculus
cttccagagtgagtcctcatctccc

SEQ ID NO: 84915 - DNA, 25 bp, mus musculus
tctttatcacagcttttttcccatg

SEQ ID NO: 84916 - DNA, 25 bp, mus musculus
tcacagcttttttcccatggtattc

SEQ ID NO: 84917 - DNA, 25 bp, mus musculus
ctctgctctgccgcacacagcggag

SEQ ID NO: 84918 - DNA, 25 bp, mus musculus
agagcagagccaccgaatgttgtag

SEQ ID NO: 84919 - DNA, 25 bp, mus musculus
cagcattttgtacctggccactgat

SEQ ID NO: 84920 - DNA, 25 bp, mus musculus
tttgtacctggccactgatgcagct

SEQ ID NO: 84921 - DNA, 25 bp, mus musculus
cctggccactgatgcagcttagaac

SEQ ID NO: 84922 - DNA, 25 bp, mus musculus
tgcagcttagaaccatacccagata

SEQ ID NO: 84923 - DNA, 25 bp, mus musculus
ttagaaccatacccagataatccgg

SEQ ID NO: 84924 - DNA, 25 bp, mus musculus
ccatacccagataatccggcaaatc

SEQ ID NO: 84925 - DNA, 25 bp, mus musculus
ccagataatccggcaaatccttcac

SEQ ID NO: 84926 - DNA, 25 bp, mus musculus
gcaaatccttcacaacctggaaaat

SEQ ID NO: 84927 - DNA, 25 bp, mus musculus
cttttttcccatggtattctcagat

SEQ ID NO: 84928 - DNA, 25 bp, mus musculus
ttagtcacgcgcaagcagtagagtg

SEQ ID NO: 84929 - DNA, 25 bp, mus musculus
gtttccccgctgatacctgagcagc

SEQ ID NO: 84930 - DNA, 25 bp, mus musculus
cccagcacactcactgtcagtatta

SEQ ID NO: 84931 - DNA, 25 bp, mus musculus
aaggcacagcagcctgttaataagc

SEQ ID NO: 84932 - DNA, 25 bp, mus musculus
ctagccctgcctcagagtgcacatg

SEQ ID NO: 84933 - DNA, 25 bp, mus musculus
ctgcctcagagtgcacatgtgggga

SEQ ID NO: 84934 - DNA, 25 bp, mus musculus
acctgccagtggctctgctctgccg

SEQ ID NO: 84935 - DNA, 25 bp, mus musculus
aatgactgcagccccaagcacagcc

SEQ ID NO: 84936 - DNA, 25 bp, mus musculus
cacagccctaggatccaaaccagga

SEQ ID NO: 84937 - DNA, 25 bp, mus musculus
tgggcttaatcgtccatataattca

SEQ ID NO: 84938 - DNA, 25 bp, mus musculus
taatcgtccatataattcaacagta

SEQ ID NO: 84939 - DNA, 25 bp, mus musculus
taacacctaacaagttcacctgcac

SEQ ID NO: 84940 - DNA, 25 bp, mus musculus
ctaacaagttcacctgcacacattg

SEQ ID NO: 84941 - DNA, 25 bp, mus musculus
cctgcacacattgttggaagcccag

SEQ ID NO: 84942 - DNA, 25 bp, mus musculus
cacattgttggaagcccagaaagag

SEQ ID NO: 84943 - DNA, 25 bp, mus musculus
acagattaccaggatcagtgcaggc

SEQ ID NO: 84944 - DNA, 25 bp, mus musculus
taccaggatcagtgcaggcatagct

SEQ ID NO: 84945 - DNA, 25 bp, mus musculus
tcctcgctgttgcctcgatcaaaga

SEQ ID NO: 84946 - DNA, 25 bp, mus musculus
ctgttgcctcgatcaaagaaactgc

SEQ ID NO: 84947 - DNA, 25 bp, mus musculus
attattcctggcctgcaccatgggg

SEQ ID NO: 84948 - DNA, 25 bp, mus musculus
tgtgttgttggccaccatagagtct

SEQ ID NO: 84949 - DNA, 25 bp, mus musculus
caccatagagtctccgactttcatt

SEQ ID NO: 84950 - DNA, 25 bp, mus musculus
tttcatttactaattactggtggtg

SEQ ID NO: 84951 - DNA, 25 bp, mus musculus
agcttgtgcttctccgctttaaacg

SEQ ID NO: 84952 - DNA, 25 bp, mus musculus
ctagcgccatatctacccattttga

SEQ ID NO: 84953 - DNA, 25 bp, mus musculus
ccatatctacccattttgaattgat

SEQ ID NO: 84954 - DNA, 25 bp, mus musculus
ctacccattttgaattgatagccat

SEQ ID NO: 84955 - DNA, 25 bp, mus musculus
taaatgatctgttcctttaaggtag

SEQ ID NO: 84956 - DNA, 25 bp, mus musculus
aatgatctgttcctttaaggtagag

SEQ ID NO: 84957 - DNA, 25 bp, mus musculus
cgagtgcacacagggtattgaaact

SEQ ID NO: 84958 - DNA, 25 bp, mus musculus
tctctcttggctggtcaagtattat

SEQ ID NO: 84959 - DNA, 25 bp, mus musculus
tctcttggctggtcaagtattattt

SEQ ID NO: 84960 - DNA, 25 bp, mus musculus
gcaataggcatctcatttctgcggg

SEQ ID NO: 84961 - DNA, 25 bp, mus musculus
aataggcatctcatttctgcgggct

SEQ ID NO: 84962 - DNA, 25 bp, mus musculus
taggcatctcatttctgcgggctga

SEQ ID NO: 84963 - DNA, 25 bp, mus musculus
ggcatctcatttctgcgggctgaac

SEQ ID NO: 84964 - DNA, 25 bp, mus musculus
tctcatttctgcgggctgaaccgga

SEQ ID NO: 84965 - DNA, 25 bp, mus musculus
gactggacctctaagcctgtccgtg

SEQ ID NO: 84966 - DNA, 25 bp, mus musculus
ggacctctaagcctgtccgtgctcc

SEQ ID NO: 84967 - DNA, 25 bp, mus musculus
aggctccgtgctgagaaactgttga

SEQ ID NO: 84968 - DNA, 25 bp, mus musculus
tacttcttatgactttttgagaaat

SEQ ID NO: 84969 - DNA, 25 bp, mus musculus
cttcttatgactttttgagaaatgg

SEQ ID NO: 84970 - DNA, 25 bp, mus musculus
gtcatgtagcccctctagcttttat

SEQ ID NO: 84971 - DNA, 25 bp, mus musculus
tagcccctctagcttttatgcgagt

SEQ ID NO: 84972 - DNA, 25 bp, mus musculus
ccctctagcttttatgcgagtgcac

SEQ ID NO: 84973 - DNA, 25 bp, mus musculus
agcttttatgcgagtgcacacaggg

SEQ ID NO: 84974 - DNA, 25 bp, mus musculus
cttttatgcgagtgcacacagggta

SEQ ID NO: 84975 - DNA, 25 bp, mus musculus
aatttgaccagtatctcaattgcag

SEQ ID NO: 84976 - DNA, 25 bp, mus musculus
atctcaattgcagccggactcgacc

SEQ ID NO: 84977 - DNA, 25 bp, mus musculus
tcctttcgcatatgtatgttagggt

SEQ ID NO: 84978 - DNA, 25 bp, mus musculus
tatgcaacagcctttagagctggtg

SEQ ID NO: 84979 - DNA, 25 bp, mus musculus
ccatttctgtcgcctcctcatttac

SEQ ID NO: 84980 - DNA, 25 bp, mus musculus
gtgctttgggccttccctaggatcg

SEQ ID NO: 84981 - DNA, 25 bp, mus musculus
ttccctaggatcgtcaggccctgga

SEQ ID NO: 84982 - DNA, 25 bp, mus musculus
gtcaggccctggacgtgcaagctac

SEQ ID NO: 84983 - DNA, 25 bp, mus musculus
acgtgcaagctacctctgccaggat

SEQ ID NO: 84984 - DNA, 25 bp, mus musculus
aagctacctctgccaggattggtgg

SEQ ID NO: 84985 - DNA, 25 bp, mus musculus
ttctgccatttatgttctagaatga

SEQ ID NO: 84986 - DNA, 25 bp, mus musculus
ttactttgccgggatatacatatat

SEQ ID NO: 84987 - DNA, 25 bp, mus musculus
ccaaactaggtccgcgcgccatgtc

SEQ ID NO: 84988 - DNA, 25 bp, mus musculus
cgcgcgccatgtcctgtccagaaga

SEQ ID NO: 84989 - DNA, 25 bp, mus musculus
gcctcatttctgcgctgtctgatgc

SEQ ID NO: 84990 - DNA, 25 bp, mus musculus
ctagcagcgcggtctattacagtgc

SEQ ID NO: 84991 - DNA, 25 bp, mus musculus
ccgcttctgcatgtggccaagtggc

SEQ ID NO: 84992 - DNA, 25 bp, mus musculus
ctgcatgtggccaagtggcagagtt

SEQ ID NO: 84993 - DNA, 25 bp, mus musculus
cagagttgcctgctcccttcctttc

SEQ ID NO: 84994 - DNA, 25 bp, mus musculus
ctcccttcctttcgcatatgtatgt

SEQ ID NO: 84995 - DNA, 25 bp, mus musculus
agcctgctggttgcccttgaacatt

SEQ ID NO: 84996 - DNA, 25 bp, mus musculus
ctggttgcccttgaacattttcaat

SEQ ID NO: 84997 - DNA, 25 bp, mus musculus
aatgatgcttattcaccactgttgg

SEQ ID NO: 84998 - DNA, 25 bp, mus musculus
catgtctactatgcacacagatgaa

SEQ ID NO: 84999 - DNA, 25 bp, mus musculus
attaaaactggctcacataccaaca

SEQ ID NO: 85000 - DNA, 25 bp, mus musculus
actggctcacataccaacaggcata

SEQ ID NO: 85001 - DNA, 25 bp, mus musculus
agccagacttaaacacataatatct

SEQ ID NO: 85002 - DNA, 25 bp, mus musculus
taagcatgtctactccattcagcca

SEQ ID NO: 85003 - DNA, 25 bp, mus musculus
ctccattcagccatagaacacacag

SEQ ID NO: 85004 - DNA, 25 bp, mus musculus
ataacttaaacaacctagacatcat

SEQ ID NO: 85005 - DNA, 25 bp, mus musculus
taaacaacctagacatcattactga

SEQ ID NO: 85006 - DNA, 25 bp, mus musculus
acctagacatcattactgaggaaga

SEQ ID NO: 85007 - DNA, 25 bp, mus musculus
gcccttgaacattttcaatgtcatc

SEQ ID NO: 85008 - DNA, 25 bp, mus musculus
tttcaatgtcatcttcgactggtat

SEQ ID NO: 85009 - DNA, 25 bp, mus musculus
cttcgactggtatcatgagatgctg

SEQ ID NO: 85010 - DNA, 25 bp, mus musculus
atttgtagtttgccacttgattgct

SEQ ID NO: 85011 - DNA, 25 bp, mus musculus
agtttgccacttgattgctatggtt

SEQ ID NO: 85012 - DNA, 25 bp, mus musculus
ccacttgattgctatggtttctact

SEQ ID NO: 85013 - DNA, 25 bp, mus musculus
ttgcataaatcctctcttttatgga

SEQ ID NO: 85014 - DNA, 25 bp, mus musculus
tctcttttatggatttctcaacaaa

SEQ ID NO: 85015 - DNA, 25 bp, mus musculus
gcctccatccagccaagagagcaaa

SEQ ID NO: 85016 - DNA, 25 bp, mus musculus
tccatccagccaagagagcaaatcg

SEQ ID NO: 85017 - DNA, 25 bp, mus musculus
tggcccctgcagagccttttggggg

SEQ ID NO: 85018 - DNA, 25 bp, mus musculus
tgtgtggaccctgggcctctgagaa

SEQ ID NO: 85019 - DNA, 25 bp, mus musculus
cctgggcctctgagaaatgtcccga

SEQ ID NO: 85020 - DNA, 25 bp, mus musculus
ctgggtgccccatcttcctgatttc

SEQ ID NO: 85021 - DNA, 25 bp, mus musculus
ccatcttcctgatttctcccttgga

SEQ ID NO: 85022 - DNA, 25 bp, mus musculus
tgatttctcccttggatcctggggt

SEQ ID NO: 85023 - DNA, 25 bp, mus musculus
taaatgttggggctgtggttgaacg

SEQ ID NO: 85024 - DNA, 25 bp, mus musculus
cccctaggtggctgtcaacagaggg

SEQ ID NO: 85025 - DNA, 25 bp, mus musculus
ttttgccacttacccagctccaagt

SEQ ID NO: 85026 - DNA, 25 bp, mus musculus
tgccacttacccagctccaagtttt

SEQ ID NO: 85027 - DNA, 25 bp, mus musculus
caaatcggagaatcccacgtcacag

SEQ ID NO: 85028 - DNA, 25 bp, mus musculus
ggagaatcccacgtcacaggcttcc

SEQ ID NO: 85029 - DNA, 25 bp, mus musculus
gaatcccacgtcacaggcttcccag

SEQ ID NO: 85030 - DNA, 25 bp, mus musculus
tcccacgtcacaggcttcccagtga

SEQ ID NO: 85031 - DNA, 25 bp, mus musculus
cacgtcacaggcttcccagtgaagg

SEQ ID NO: 85032 - DNA, 25 bp, mus musculus
ccctcacagctccagggagcagaag

SEQ ID NO: 85033 - DNA, 25 bp, mus musculus
cagctccagggagcagaagacggaa

SEQ ID NO: 85034 - DNA, 25 bp, mus musculus
agactgggcgtctgaaatgggcagc

SEQ ID NO: 85035 - DNA, 25 bp, mus musculus
agaagcagctgcactacacagagac

SEQ ID NO: 85036 - DNA, 25 bp, mus musculus
actacacagagacgcttctccagca

SEQ ID NO: 85037 - DNA, 25 bp, mus musculus
agaccctgatcctggtgaagctgga

SEQ ID NO: 85038 - DNA, 25 bp, mus musculus
agctggagccatgggtatgcaaggc

SEQ ID NO: 85039 - DNA, 25 bp, mus musculus
gcagtctcggcttgtgcttgtctag

SEQ ID NO: 85040 - DNA, 25 bp, mus musculus
tgtgcttgtctagcaccaacagtct

SEQ ID NO: 85041 - DNA, 25 bp, mus musculus
gcaccaacagtctctacgaagacat

SEQ ID NO: 85042 - DNA, 25 bp, mus musculus
acagtctctacgaagacatcgaaca

SEQ ID NO: 85043 - DNA, 25 bp, mus musculus
aagacatcgaacacttcctcatgga

SEQ ID NO: 85044 - DNA, 25 bp, mus musculus
gtcagtggccttgactcagaatccc

SEQ ID NO: 85045 - DNA, 25 bp, mus musculus
ggccttgactcagaatcccaactcc

SEQ ID NO: 85046 - DNA, 25 bp, mus musculus
gactcagaatcccaactcccaataa

SEQ ID NO: 85047 - DNA, 25 bp, mus musculus
tccagcatgtgtctcccggccttca

SEQ ID NO: 85048 - DNA, 25 bp, mus musculus
ctcccggccttcagctggagcttcg

SEQ ID NO: 85049 - DNA, 25 bp, mus musculus
agcttcgaggaccgtcactgtgggc

SEQ ID NO: 85050 - DNA, 25 bp, mus musculus
taggcagccctatgggcactaccgg

SEQ ID NO: 85051 - DNA, 25 bp, mus musculus
acttcagcactttcttccgagaact

SEQ ID NO: 85052 - DNA, 25 bp, mus musculus
tcttccgagaactggaggagtttcg

SEQ ID NO: 85053 - DNA, 25 bp, mus musculus
aagacttgtcagcagggaggcccaa

SEQ ID NO: 85054 - DNA, 25 bp, mus musculus
aggagaagaccctgatcctggtgaa

SEQ ID NO: 85055 - DNA, 25 bp, mus musculus
tcttcgggatctactcatctctgtg

SEQ ID NO: 85056 - DNA, 25 bp, mus musculus
ggatctactcatctctgtggcctgc

SEQ ID NO: 85057 - DNA, 25 bp, mus musculus
agaagaaccacgtgaatctgtaccg

SEQ ID NO: 85058 - DNA, 25 bp, mus musculus
gctccgagtccctgcagcagaacct

SEQ ID NO: 85059 - DNA, 25 bp, mus musculus
agtccctgcagcagaacctgcttca

SEQ ID NO: 85060 - DNA, 25 bp, mus musculus
acggctatgctttctctcaagatga

SEQ ID NO: 85061 - DNA, 25 bp, mus musculus
atgctttctctcaagatgaaaacgg

SEQ ID NO: 85062 - DNA, 25 bp, mus musculus
gcatcgtctcacagtctgaagtcat

SEQ ID NO: 85063 - DNA, 25 bp, mus musculus
aagtcatcagagcctatgacaccac

SEQ ID NO: 85064 - DNA, 25 bp, mus musculus
tcagagcctatgacaccacgaaaca

SEQ ID NO: 85065 - DNA, 25 bp, mus musculus
cctatgacaccacgaaacagaggcc

SEQ ID NO: 85066 - DNA, 25 bp, mus musculus
acaccacgaaacagaggcccgatga

SEQ ID NO: 85067 - DNA, 25 bp, mus musculus
actcatctctgtggcctgccgtgcc

SEQ ID NO: 85068 - DNA, 25 bp, mus musculus
gaaacagaggcccgatgagtggtga

SEQ ID NO: 85069 - DNA, 25 bp, mus musculus
aggcagccatgctcttcagctctgg

SEQ ID NO: 85070 - DNA, 25 bp, mus musculus
ccatgctcttcagctctggagtctt

SEQ ID NO: 85071 - DNA, 25 bp, mus musculus
tgcttctggatgtgctgtacaaagt

SEQ ID NO: 85072 - DNA, 25 bp, mus musculus
aagttcaggagcttgaggcgaaatc

SEQ ID NO: 85073 - DNA, 25 bp, mus musculus
ctcaagacccgggcgcagtcgtact

SEQ ID NO: 85074 - DNA, 25 bp, mus musculus
agagagcgcagctgctcaagaacgt

SEQ ID NO: 85075 - DNA, 25 bp, mus musculus
tgctcaagaacgtctttaagaagaa

SEQ ID NO: 85076 - DNA, 25 bp, mus musculus
cctgctccgcatccttggggatcat

SEQ ID NO: 85077 - DNA, 25 bp, mus musculus
gctccgcatccttggggatcatatc

SEQ ID NO: 85078 - DNA, 25 bp, mus musculus
cctttgaagctcctttgagcaacgt

SEQ ID NO: 85079 - DNA, 25 bp, mus musculus
aagctcctttgagcaacgtacaaat

SEQ ID NO: 85080 - DNA, 25 bp, mus musculus
ctcctttgagcaacgtacaaattca

SEQ ID NO: 85081 - DNA, 25 bp, mus musculus
tccaatcccctgaatcctgcttgaa

SEQ ID NO: 85082 - DNA, 25 bp, mus musculus
ctgaatcctgcttgaaaccttcaaa

SEQ ID NO: 85083 - DNA, 25 bp, mus musculus
cttcaaaagcccttggcttgctggc

SEQ ID NO: 85084 - DNA, 25 bp, mus musculus
aagcccttggcttgctggccgcaaa

SEQ ID NO: 85085 - DNA, 25 bp, mus musculus
ttggcttgctggccgcaaaattcct

SEQ ID NO: 85086 - DNA, 25 bp, mus musculus
tgctggccgcaaaattcctgtttag

SEQ ID NO: 85087 - DNA, 25 bp, mus musculus
attgttgcaattccaaaggggacag

SEQ ID NO: 85088 - DNA, 25 bp, mus musculus
ccgcatccttggggatcatatcttg

SEQ ID NO: 85089 - DNA, 25 bp, mus musculus
gagattcctttcggttcggactatg

SEQ ID NO: 85090 - DNA, 25 bp, mus musculus
ggatcatatcttggagtctgggatt

SEQ ID NO: 85091 - DNA, 25 bp, mus musculus
tatcttggagtctgggatttctcag

SEQ ID NO: 85092 - DNA, 25 bp, mus musculus
gatttctcagggctttaggtttctg

SEQ ID NO: 85093 - DNA, 25 bp, mus musculus
ttctcagggctttaggtttctgctc

SEQ ID NO: 85094 - DNA, 25 bp, mus musculus
taggtttctgctcctttgaagctcc

SEQ ID NO: 85095 - DNA, 25 bp, mus musculus
tctgctcctttgaagctcctttgag

SEQ ID NO: 85096 - DNA, 25 bp, mus musculus
gctcctttgaagctcctttgagcaa

SEQ ID NO: 85097 - DNA, 25 bp, mus musculus
gaattcaatcattggacctactaaa

SEQ ID NO: 85098 - DNA, 25 bp, mus musculus
attcaatcattggacctactaaact

SEQ ID NO: 85099 - DNA, 25 bp, mus musculus
caaagcttctccagaagaatattcc

SEQ ID NO: 85100 - DNA, 25 bp, mus musculus
aagcttctccagaagaatattccgg

SEQ ID NO: 85101 - DNA, 25 bp, mus musculus
gcttctccagaagaatattccggat

SEQ ID NO: 85102 - DNA, 25 bp, mus musculus
ttctccagaagaatattccggatga

SEQ ID NO: 85103 - DNA, 25 bp, mus musculus
aattgattctgaccagttcatggac

SEQ ID NO: 85104 - DNA, 25 bp, mus musculus
ttgattctgaccagttcatggactt

SEQ ID NO: 85105 - DNA, 25 bp, mus musculus
gattctgaccagttcatggacttaa

SEQ ID NO: 85106 - DNA, 25 bp, mus musculus
ttctgaccagttcatggacttaagg

SEQ ID NO: 85107 - DNA, 25 bp, mus musculus
gcaagcggcaaccaaccggaatcct

SEQ ID NO: 85108 - DNA, 25 bp, mus musculus
gcggcaaccaaccggaatcctgagt

SEQ ID NO: 85109 - DNA, 25 bp, mus musculus
tcaatcattggacctactaaactca

SEQ ID NO: 85110 - DNA, 25 bp, mus musculus
aatcattggacctactaaactcagt

SEQ ID NO: 85111 - DNA, 25 bp, mus musculus
attggacctactaaactcagtcttg

SEQ ID NO: 85112 - DNA, 25 bp, mus musculus
ctaaactcagtcttgaacaactggg

SEQ ID NO: 85113 - DNA, 25 bp, mus musculus
aaactcagtcttgaacaactgggat

SEQ ID NO: 85114 - DNA, 25 bp, mus musculus
actcagtcttgaacaactgggatta

SEQ ID NO: 85115 - DNA, 25 bp, mus musculus
tcagtcttgaacaactgggattatt

SEQ ID NO: 85116 - DNA, 25 bp, mus musculus
ggaccaaagcttctccagaagaata

SEQ ID NO: 85117 - DNA, 25 bp, mus musculus
ttgatttcacgttgtgtaaatatct

SEQ ID NO: 85118 - DNA, 25 bp, mus musculus
aatatcttcttggagaccatttgcc

SEQ ID NO: 85119 - DNA, 25 bp, mus musculus
cgttttggactctggctccaactga

SEQ ID NO: 85120 - DNA, 25 bp, mus musculus
tggctccaactgagtcacaggccag

SEQ ID NO: 85121 - DNA, 25 bp, mus musculus
agtcacaggccagtagcattttatg

SEQ ID NO: 85122 - DNA, 25 bp, mus musculus
ttttatgtatctggtgccatcctgc

SEQ ID NO: 85123 - DNA, 25 bp, mus musculus
gtatctggtgccatcctgctgtttt

SEQ ID NO: 85124 - DNA, 25 bp, mus musculus
ggtgccatcctgctgttttggtact

SEQ ID NO: 85125 - DNA, 25 bp, mus musculus
aatatgttgatgcccatctcactta

SEQ ID NO: 85126 - DNA, 25 bp, mus musculus
tgacatgtcatgatccttcggaatc

SEQ ID NO: 85127 - DNA, 25 bp, mus musculus
gtcatgatccttcggaatcttcatt

SEQ ID NO: 85128 - DNA, 25 bp, mus musculus
atccttcggaatcttcatttaagtg

SEQ ID NO: 85129 - DNA, 25 bp, mus musculus
ttcttggagaccatttgccttgggc

SEQ ID NO: 85130 - DNA, 25 bp, mus musculus
ccccatcattactgagtctctgcag

SEQ ID NO: 85131 - DNA, 25 bp, mus musculus
cattactgagtctctgcaggtgtac

SEQ ID NO: 85132 - DNA, 25 bp, mus musculus
tgagtctctgcaggtgtacaaaaat

SEQ ID NO: 85133 - DNA, 25 bp, mus musculus
gtgggcaattctctctgaagttgag

SEQ ID NO: 85134 - DNA, 25 bp, mus musculus
aattctctctgaagttgagtaatca

SEQ ID NO: 85135 - DNA, 25 bp, mus musculus
gtaatcaccatgactgtaaatgcgg

SEQ ID NO: 85136 - DNA, 25 bp, mus musculus
accatgactgtaaatgcgggccacc

SEQ ID NO: 85137 - DNA, 25 bp, mus musculus
tgattatgtcgcagccaagtttcat

SEQ ID NO: 85138 - DNA, 25 bp, mus musculus
tgtcgcagccaagtttcatgaggaa

SEQ ID NO: 85139 - DNA, 25 bp, mus musculus
tatgacctttcaggctgatcccaaa

SEQ ID NO: 85140 - DNA, 25 bp, mus musculus
tggacacattctggctcacgcttcc

SEQ ID NO: 85141 - DNA, 25 bp, mus musculus
cattctggctcacgcttccacaaca

SEQ ID NO: 85142 - DNA, 25 bp, mus musculus
cgcttccacaacaagaataagcttg

SEQ ID NO: 85143 - DNA, 25 bp, mus musculus
aagcttgcgcaagggaagaggagaa

SEQ ID NO: 85144 - DNA, 25 bp, mus musculus
agccaccttcgcaataaccgctgga

SEQ ID NO: 85145 - DNA, 25 bp, mus musculus
cttcgcaataaccgctggagggatc

SEQ ID NO: 85146 - DNA, 25 bp, mus musculus
gtacagactgcttcttgctgcttat

SEQ ID NO: 85147 - DNA, 25 bp, mus musculus
actgcttcttgctgcttattagggg

SEQ ID NO: 85148 - DNA, 25 bp, mus musculus
agccttgaatttacatcttgaaata

SEQ ID NO: 85149 - DNA, 25 bp, mus musculus
cattttcaaactattgatcattgac

SEQ ID NO: 85150 - DNA, 25 bp, mus musculus
ggctgaacgccagcaaaaattggcc

SEQ ID NO: 85151 - DNA, 25 bp, mus musculus
attggcccagatgttgtcacgactc

SEQ ID NO: 85152 - DNA, 25 bp, mus musculus
gttgtcacgactccaaaaaatctca

SEQ ID NO: 85153 - DNA, 25 bp, mus musculus
tgtgaccaatcaaatgactgcagat

SEQ ID NO: 85154 - DNA, 25 bp, mus musculus
aatgactgcagatccaggagcaact

SEQ ID NO: 85155 - DNA, 25 bp, mus musculus
tgcagatccaggagcaactatgacc

SEQ ID NO: 85156 - DNA, 25 bp, mus musculus
agcaactatgacctttcaggctgat

SEQ ID NO: 85157 - DNA, 25 bp, mus musculus
tagaattagtttccatccattaagg

SEQ ID NO: 85158 - DNA, 25 bp, mus musculus
gacctccggattcaattaatggact

SEQ ID NO: 85159 - DNA, 25 bp, mus musculus
ctctctgcagatcatggacattaag

SEQ ID NO: 85160 - DNA, 25 bp, mus musculus
ctctgcagatcatggacattaagcc

SEQ ID NO: 85161 - DNA, 25 bp, mus musculus
atcatggacattaagccaggcggaa

SEQ ID NO: 85162 - DNA, 25 bp, mus musculus
gacattaagccaggcggaaactcaa

SEQ ID NO: 85163 - DNA, 25 bp, mus musculus
gattctggattctctaacgaagttt

SEQ ID NO: 85164 - DNA, 25 bp, mus musculus
ttctggattctctaacgaagtttga

SEQ ID NO: 85165 - DNA, 25 bp, mus musculus
ggattctctaacgaagtttgagagt

SEQ ID NO: 85166 - DNA, 25 bp, mus musculus
attctctaacgaagtttgagagtct

SEQ ID NO: 85167 - DNA, 25 bp, mus musculus
tttgagagtctccctcgcgttttgt

SEQ ID NO: 85168 - DNA, 25 bp, mus musculus
tgagagtctccctcgcgttttgtgg

SEQ ID NO: 85169 - DNA, 25 bp, mus musculus
ccagtcttttgacaaatgggattat

SEQ ID NO: 85170 - DNA, 25 bp, mus musculus
ttttccgatggtgaatttaggcatt

SEQ ID NO: 85171 - DNA, 25 bp, mus musculus
atttaggcattgctctctgcagatc

SEQ ID NO: 85172 - DNA, 25 bp, mus musculus
ttaggcattgctctctgcagatcat

SEQ ID NO: 85173 - DNA, 25 bp, mus musculus
aggcattgctctctgcagatcatgg

SEQ ID NO: 85174 - DNA, 25 bp, mus musculus
gcattgctctctgcagatcatggac

SEQ ID NO: 85175 - DNA, 25 bp, mus musculus
attgctctctgcagatcatggacat

SEQ ID NO: 85176 - DNA, 25 bp, mus musculus
tgctctctgcagatcatggacatta

SEQ ID NO: 85177 - DNA, 25 bp, mus musculus
aggtcatgcacctgaagaggagctg

SEQ ID NO: 85178 - DNA, 25 bp, mus musculus
tgcacctgaagaggagctggaataa

SEQ ID NO: 85179 - DNA, 25 bp, mus musculus
gtctcgatcgctggcagcttcacac

SEQ ID NO: 85180 - DNA, 25 bp, mus musculus
tctcgatcgctggcagcttcacacg

SEQ ID NO: 85181 - DNA, 25 bp, mus musculus
tcactagccagatccaagcatcata

SEQ ID NO: 85182 - DNA, 25 bp, mus musculus
actagccagatccaagcatcataga

SEQ ID NO: 85183 - DNA, 25 bp, mus musculus
ctagccagatccaagcatcatagat

SEQ ID NO: 85184 - DNA, 25 bp, mus musculus
agccagatccaagcatcatagatgg

SEQ ID NO: 85185 - DNA, 25 bp, mus musculus
gccagatccaagcatcatagatgga

SEQ ID NO: 85186 - DNA, 25 bp, mus musculus
agatccaagcatcatagatggagcc

SEQ ID NO: 85187 - DNA, 25 bp, mus musculus
atccaagcatcatagatggagccac

SEQ ID NO: 85188 - DNA, 25 bp, mus musculus
catcatagatggagccacggcttct

SEQ ID NO: 85189 - DNA, 25 bp, mus musculus
tccagcgagctgtgtggaagtctgc

SEQ ID NO: 85190 - DNA, 25 bp, mus musculus
ctgccacaggagccagtctcgatcg

SEQ ID NO: 85191 - DNA, 25 bp, mus musculus
cacaggagccagtctcgatcgctgg

SEQ ID NO: 85192 - DNA, 25 bp, mus musculus
aggagccagtctcgatcgctggcag

SEQ ID NO: 85193 - DNA, 25 bp, mus musculus
gagccagtctcgatcgctggcagct

SEQ ID NO: 85194 - DNA, 25 bp, mus musculus
agccagtctcgatcgctggcagctt

SEQ ID NO: 85195 - DNA, 25 bp, mus musculus
ccagtctcgatcgctggcagcttca

SEQ ID NO: 85196 - DNA, 25 bp, mus musculus
cagtctcgatcgctggcagcttcac

SEQ ID NO: 85197 - DNA, 25 bp, mus musculus
ggacacaatggccctgagcagctga

SEQ ID NO: 85198 - DNA, 25 bp, mus musculus
aatggccctgagcagctgagccctg

SEQ ID NO: 85199 - DNA, 25 bp, mus musculus
gttctgcccagggatatttgctgct

SEQ ID NO: 85200 - DNA, 25 bp, mus musculus
gatatttgctgcttggcaagagctg

SEQ ID NO: 85201 - DNA, 25 bp, mus musculus
ggaccaattcacatttcttggcttc

SEQ ID NO: 85202 - DNA, 25 bp, mus musculus
attcacatttcttggcttcttcagc

SEQ ID NO: 85203 - DNA, 25 bp, mus musculus
atttcttggcttcttcagctgctac

SEQ ID NO: 85204 - DNA, 25 bp, mus musculus
tggcttcttcagctgctaccagcag

SEQ ID NO: 85205 - DNA, 25 bp, mus musculus
ctgctaccagcaggcagagtctgag

SEQ ID NO: 85206 - DNA, 25 bp, mus musculus
gagatacccaaggctaggccacata

SEQ ID NO: 85207 - DNA, 25 bp, mus musculus
atacccaaggctaggccacataagt

SEQ ID NO: 85208 - DNA, 25 bp, mus musculus
cccaaggctaggccacataagtcac

SEQ ID NO: 85209 - DNA, 25 bp, mus musculus
cagctgagccctggaagtgcccacc

SEQ ID NO: 85210 - DNA, 25 bp, mus musculus
cttggcccacctgtaccaagtccag

SEQ ID NO: 85211 - DNA, 25 bp, mus musculus
ccctgccatgcaggccaattcttat

SEQ ID NO: 85212 - DNA, 25 bp, mus musculus
catgcaggccaattcttatcgctgt

SEQ ID NO: 85213 - DNA, 25 bp, mus musculus
ttcttatcgctgtggatgtaagggt

SEQ ID NO: 85214 - DNA, 25 bp, mus musculus
ttcctgctgagccgcctctgtgcct

SEQ ID NO: 85215 - DNA, 25 bp, mus musculus
gatagcacagcgtggctggttctgc

SEQ ID NO: 85216 - DNA, 25 bp, mus musculus
acagcgtggctggttctgcccaggg

SEQ ID NO: 85217 - DNA, 25 bp, mus musculus
tagatccagggtgttcctccaacca

SEQ ID NO: 85218 - DNA, 25 bp, mus musculus
tgtcctgattgttggtcgtgccatg

SEQ ID NO: 85219 - DNA, 25 bp, mus musculus
gaccaagactcgtggcctggttcct

SEQ ID NO: 85220 - DNA, 25 bp, mus musculus
ccaagactcgtggcctggttcctca

SEQ ID NO: 85221 - DNA, 25 bp, mus musculus
gactcgtggcctggttcctcagagg

SEQ ID NO: 85222 - DNA, 25 bp, mus musculus
ctcgtggcctggttcctcagaggta

SEQ ID NO: 85223 - DNA, 25 bp, mus musculus
cgtggcctggttcctcagaggtatt

SEQ ID NO: 85224 - DNA, 25 bp, mus musculus
tggcctggttcctcagaggtattgg

SEQ ID NO: 85225 - DNA, 25 bp, mus musculus
gcctggttcctcagaggtattgggc

SEQ ID NO: 85226 - DNA, 25 bp, mus musculus
ctggttcctcagaggtattgggcaa

SEQ ID NO: 85227 - DNA, 25 bp, mus musculus
ggttcctcagaggtattgggcaaag

SEQ ID NO: 85228 - DNA, 25 bp, mus musculus
ttcctcagaggtattgggcaaagtg

SEQ ID NO: 85229 - DNA, 25 bp, mus musculus
tcctgattgttggtcgtgccatgac

SEQ ID NO: 85230 - DNA, 25 bp, mus musculus
ctgattgttggtcgtgccatgacct

SEQ ID NO: 85231 - DNA, 25 bp, mus musculus
ttgttggtcgtgccatgaccttgga

SEQ ID NO: 85232 - DNA, 25 bp, mus musculus
gttggtcgtgccatgaccttggaag

SEQ ID NO: 85233 - DNA, 25 bp, mus musculus
tggtcgtgccatgaccttggaaggc

SEQ ID NO: 85234 - DNA, 25 bp, mus musculus
gtcgtgccatgaccttggaaggccc

SEQ ID NO: 85235 - DNA, 25 bp, mus musculus
ttttgaccaagactcgtggcctggt

SEQ ID NO: 85236 - DNA, 25 bp, mus musculus
ttgaccaagactcgtggcctggttc

SEQ ID NO: 85237 - DNA, 25 bp, mus musculus
tggtccttcctccttggctggaagc

SEQ ID NO: 85238 - DNA, 25 bp, mus musculus
gtccttcctccttggctggaagcat

SEQ ID NO: 85239 - DNA, 25 bp, mus musculus
ctacaaggccaatatcctgaatgac

SEQ ID NO: 85240 - DNA, 25 bp, mus musculus
acaaggccaatatcctgaatgacag

SEQ ID NO: 85241 - DNA, 25 bp, mus musculus
aaggccaatatcctgaatgacagtc

SEQ ID NO: 85242 - DNA, 25 bp, mus musculus
aatatcctgaatgacagtcgcgggt

SEQ ID NO: 85243 - DNA, 25 bp, mus musculus
tcctgaatgacagtcgcgggtttat

SEQ ID NO: 85244 - DNA, 25 bp, mus musculus
ctgaatgacagtcgcgggtttattc

SEQ ID NO: 85245 - DNA, 25 bp, mus musculus
atttacactgagatgtctgtgttca

SEQ ID NO: 85246 - DNA, 25 bp, mus musculus
ttacactgagatgtctgtgttcaca

SEQ ID NO: 85247 - DNA, 25 bp, mus musculus
gttcacagtgaattctccgaaaaag

SEQ ID NO: 85248 - DNA, 25 bp, mus musculus
tcacagtgaattctccgaaaaagcc

SEQ ID NO: 85249 - DNA, 25 bp, mus musculus
ttcctccttggctggaagcatctaa

SEQ ID NO: 85250 - DNA, 25 bp, mus musculus
cctccttggctggaagcatctaaga

SEQ ID NO: 85251 - DNA, 25 bp, mus musculus
tccttggctggaagcatctaagatt

SEQ ID NO: 85252 - DNA, 25 bp, mus musculus
attaatatcatttcctacaaggcca

SEQ ID NO: 85253 - DNA, 25 bp, mus musculus
atatcatttcctacaaggccaatat

SEQ ID NO: 85254 - DNA, 25 bp, mus musculus
atcatttcctacaaggccaatatcc

SEQ ID NO: 85255 - DNA, 25 bp, mus musculus
catttcctacaaggccaatatcctg

SEQ ID NO: 85256 - DNA, 25 bp, mus musculus
tttcctacaaggccaatatcctgaa

SEQ ID NO: 85257 - DNA, 25 bp, mus musculus
tgtggcttcctactgtcagaagtag

SEQ ID NO: 85258 - DNA, 25 bp, mus musculus
gcttcctactgtcagaagtagtatc

SEQ ID NO: 85259 - DNA, 25 bp, mus musculus
aattggcttcatggcaggcggaaac

SEQ ID NO: 85260 - DNA, 25 bp, mus musculus
ggcttcatggcaggcggaaacgaac

SEQ ID NO: 85261 - DNA, 25 bp, mus musculus
aacaggattccgagttctctttatg

SEQ ID NO: 85262 - DNA, 25 bp, mus musculus
caggattccgagttctctttatgag

SEQ ID NO: 85263 - DNA, 25 bp, mus musculus
attccgagttctctttatgagtggt

SEQ ID NO: 85264 - DNA, 25 bp, mus musculus
tccgagttctctttatgagtggttt

SEQ ID NO: 85265 - DNA, 25 bp, mus musculus
cgagttctctttatgagtggtttag

SEQ ID NO: 85266 - DNA, 25 bp, mus musculus
agttctctttatgagtggtttagca

SEQ ID NO: 85267 - DNA, 25 bp, mus musculus
ttctctttatgagtggtttagcagt

SEQ ID NO: 85268 - DNA, 25 bp, mus musculus
gcagttacttcggggttatgtgaga

SEQ ID NO: 85269 - DNA, 25 bp, mus musculus
ttcctactgtcagaagtagtatcaa

SEQ ID NO: 85270 - DNA, 25 bp, mus musculus
ttctaacacttagtccttgcaaata

SEQ ID NO: 85271 - DNA, 25 bp, mus musculus
ctaacacttagtccttgcaaataat

SEQ ID NO: 85272 - DNA, 25 bp, mus musculus
aacacttagtccttgcaaataattg

SEQ ID NO: 85273 - DNA, 25 bp, mus musculus
cacttagtccttgcaaataattggc

SEQ ID NO: 85274 - DNA, 25 bp, mus musculus
cttagtccttgcaaataattggctt

SEQ ID NO: 85275 - DNA, 25 bp, mus musculus
tagtccttgcaaataattggcttca

SEQ ID NO: 85276 - DNA, 25 bp, mus musculus
ataattggcttcatggcaggcggaa

SEQ ID NO: 85277 - DNA, 25 bp, mus musculus
agccaaggcctggccacacagacca

SEQ ID NO: 85278 - DNA, 25 bp, mus musculus
ggcctggccacacagaccaggaaag

SEQ ID NO: 85279 - DNA, 25 bp, mus musculus
cagaccattccggtaccatcaatag

SEQ ID NO: 85280 - DNA, 25 bp, mus musculus
attccggtaccatcaatagctatga

SEQ ID NO: 85281 - DNA, 25 bp, mus musculus
tccatctcaacagccaactctatga

SEQ ID NO: 85282 - DNA, 25 bp, mus musculus
tcaacagccaactctatgacatcat

SEQ ID NO: 85283 - DNA, 25 bp, mus musculus
tctatgacatcatcaccatgcgcta

SEQ ID NO: 85284 - DNA, 25 bp, mus musculus
tcaccatgcgctatgcggacaaaca

SEQ ID NO: 85285 - DNA, 25 bp, mus musculus
acatcgactttgacagcttcatctg

SEQ ID NO: 85286 - DNA, 25 bp, mus musculus
actttgacagcttcatctgctgctt

SEQ ID NO: 85287 - DNA, 25 bp, mus musculus
acagcttcatctgctgcttcgtcag

SEQ ID NO: 85288 - DNA, 25 bp, mus musculus
tcatctgctgcttcgtcaggctgga

SEQ ID NO: 85289 - DNA, 25 bp, mus musculus
agcagcagcaattccggaacatctt

SEQ ID NO: 85290 - DNA, 25 bp, mus musculus
gctgcagcttaccatgtatgcctga

SEQ ID NO: 85291 - DNA, 25 bp, mus musculus
agcaattccggaacatcttcaggca

SEQ ID NO: 85292 - DNA, 25 bp, mus musculus
agatcgcaggcgacgacatggagat

SEQ ID NO: 85293 - DNA, 25 bp, mus musculus
aactcaagaatgtcctcaacacagt

SEQ ID NO: 85294 - DNA, 25 bp, mus musculus
tcacgctggagtcctgcagaagcat

SEQ ID NO: 85295 - DNA, 25 bp, mus musculus
tgatagctctcatggatacagatgg

SEQ ID NO: 85296 - DNA, 25 bp, mus musculus
tgaatcttcaagagttccatcacct

SEQ ID NO: 85297 - DNA, 25 bp, mus musculus
tcttcaagcactatgacacagacca

SEQ ID NO: 85298 - DNA, 25 bp, mus musculus
tggagcctgttgaacctgggctccc

SEQ ID NO: 85299 - DNA, 25 bp, mus musculus
tgttgaacctgggctccctgcgtgg

SEQ ID NO: 85300 - DNA, 25 bp, mus musculus
tgggacctcgtggactggatgcgat

SEQ ID NO: 85301 - DNA, 25 bp, mus musculus
gggacctcgtggactggatgcgatc

SEQ ID NO: 85302 - DNA, 25 bp, mus musculus
ggacctcgtggactggatgcgatcg

SEQ ID NO: 85303 - DNA, 25 bp, mus musculus
gatgcgatcggtttctccgtgaatc

SEQ ID NO: 85304 - DNA, 25 bp, mus musculus
atgcgatcggtttctccgtgaatca

SEQ ID NO: 85305 - DNA, 25 bp, mus musculus
gcgatcggtttctccgtgaatcagt

SEQ ID NO: 85306 - DNA, 25 bp, mus musculus
tcggtttctccgtgaatcagttcgg

SEQ ID NO: 85307 - DNA, 25 bp, mus musculus
tttctccgtgaatcagttcggacac

SEQ ID NO: 85308 - DNA, 25 bp, mus musculus
ttctccgtgaatcagttcggacacc

SEQ ID NO: 85309 - DNA, 25 bp, mus musculus
tctccgtgaatcagttcggacaccc

SEQ ID NO: 85310 - DNA, 25 bp, mus musculus
gttgaacctgggctccctgcgtggg

SEQ ID NO: 85311 - DNA, 25 bp, mus musculus
acgattcgggactacaccgaggatg

SEQ ID NO: 85312 - DNA, 25 bp, mus musculus
cgattcgggactacaccgaggatga

SEQ ID NO: 85313 - DNA, 25 bp, mus musculus
gattcgggactacaccgaggatgaa

SEQ ID NO: 85314 - DNA, 25 bp, mus musculus
ttcgggactacaccgaggatgaacg

SEQ ID NO: 85315 - DNA, 25 bp, mus musculus
tcgggactacaccgaggatgaacga

SEQ ID NO: 85316 - DNA, 25 bp, mus musculus
cgggactacaccgaggatgaacgat

SEQ ID NO: 85317 - DNA, 25 bp, mus musculus
ggactacaccgaggatgaacgatct

SEQ ID NO: 85318 - DNA, 25 bp, mus musculus
aaccaaaaactcccaatgcagagat

SEQ ID NO: 85319 - DNA, 25 bp, mus musculus
aaactcccaatgcagagatgacggg

SEQ ID NO: 85320 - DNA, 25 bp, mus musculus
tacactgaagaccaagccacctaat

SEQ ID NO: 85321 - DNA, 25 bp, mus musculus
caagccacctaatttacaatctctg

SEQ ID NO: 85322 - DNA, 25 bp, mus musculus
tttcaaatgtgcttttagtgcaatt

SEQ ID NO: 85323 - DNA, 25 bp, mus musculus
agctgaagacctgctcaaaatacat

SEQ ID NO: 85324 - DNA, 25 bp, mus musculus
agacctgctcaaaatacatcttttg

SEQ ID NO: 85325 - DNA, 25 bp, mus musculus
gctcaaaatacatcttttggtcata

SEQ ID NO: 85326 - DNA, 25 bp, mus musculus
aatacatcttttggtcatagttatg

SEQ ID NO: 85327 - DNA, 25 bp, mus musculus
acatcttttggtcatagttatgaaa

SEQ ID NO: 85328 - DNA, 25 bp, mus musculus
tgtgtacctatgtatgcttaataaa

SEQ ID NO: 85329 - DNA, 25 bp, mus musculus
ttgtacatcaccatacacatcccac

SEQ ID NO: 85330 - DNA, 25 bp, mus musculus
ctcccaatgcagagatgacggggcc

SEQ ID NO: 85331 - DNA, 25 bp, mus musculus
ggcctctcagctcatggtttgtacc

SEQ ID NO: 85332 - DNA, 25 bp, mus musculus
ctctcagctcatggtttgtaccccg

SEQ ID NO: 85333 - DNA, 25 bp, mus musculus
tcagctcatggtttgtaccccggag

SEQ ID NO: 85334 - DNA, 25 bp, mus musculus
ggtttgtaccccggaggctgctgag

SEQ ID NO: 85335 - DNA, 25 bp, mus musculus
ttgtaccccggaggctgctgaggcc

SEQ ID NO: 85336 - DNA, 25 bp, mus musculus
ggctgctgaggcccacttcttcaaa

SEQ ID NO: 85337 - DNA, 25 bp, mus musculus
actctttcatagttaaagtacactg

SEQ ID NO: 85338 - DNA, 25 bp, mus musculus
aacgaaacaacgtgtgcgtgcaata

SEQ ID NO: 85339 - DNA, 25 bp, mus musculus
cgaaacaacgtgtgcgtgcaatacc

SEQ ID NO: 85340 - DNA, 25 bp, mus musculus
ctacattgaccacggggtgatgtac

SEQ ID NO: 85341 - DNA, 25 bp, mus musculus
tacattgaccacggggtgatgtact

SEQ ID NO: 85342 - DNA, 25 bp, mus musculus
acattgaccacggggtgatgtactt

SEQ ID NO: 85343 - DNA, 25 bp, mus musculus
cattgaccacggggtgatgtactta

SEQ ID NO: 85344 - DNA, 25 bp, mus musculus
attgaccacggggtgatgtacttag

SEQ ID NO: 85345 - DNA, 25 bp, mus musculus
ttgaccacggggtgatgtacttagt

SEQ ID NO: 85346 - DNA, 25 bp, mus musculus
tgaccacggggtgatgtacttagtg

SEQ ID NO: 85347 - DNA, 25 bp, mus musculus
acaacgtgtgcgtgcaataccagaa

SEQ ID NO: 85348 - DNA, 25 bp, mus musculus
acgtgtgcgtgcaataccagaatat

SEQ ID NO: 85349 - DNA, 25 bp, mus musculus
gagaatctacattgaccacggggtg

SEQ ID NO: 85350 - DNA, 25 bp, mus musculus
agaatctacattgaccacggggtga

SEQ ID NO: 85351 - DNA, 25 bp, mus musculus
gaatctacattgaccacggggtgat

SEQ ID NO: 85352 - DNA, 25 bp, mus musculus
aatctacattgaccacggggtgatg

SEQ ID NO: 85353 - DNA, 25 bp, mus musculus
atctacattgaccacggggtgatgt

SEQ ID NO: 85354 - DNA, 25 bp, mus musculus
tctacattgaccacggggtgatgta

SEQ ID NO: 85355 - DNA, 25 bp, mus musculus
tttccttgttgtgctagccttcatg

SEQ ID NO: 85356 - DNA, 25 bp, mus musculus
gctagccttcatggctgttaagcgg

SEQ ID NO: 85357 - DNA, 25 bp, mus musculus
ctaccgatcaataccagaagacggt

SEQ ID NO: 85358 - DNA, 25 bp, mus musculus
taacgacagccagcagtaatagagt

SEQ ID NO: 85359 - DNA, 25 bp, mus musculus
tgcaacatcaaagccacaacagaag

SEQ ID NO: 85360 - DNA, 25 bp, mus musculus
gaagaccacaaccaagaagctcact

SEQ ID NO: 85361 - DNA, 25 bp, mus musculus
cacaaccaagaagctcactgttctg

SEQ ID NO: 85362 - DNA, 25 bp, mus musculus
caagaagctcactgttctgtggtct

SEQ ID NO: 85363 - DNA, 25 bp, mus musculus
gctcactgttctgtggtctgataca

SEQ ID NO: 85364 - DNA, 25 bp, mus musculus
tgttctgtggtctgatacaagagca

SEQ ID NO: 85365 - DNA, 25 bp, mus musculus
aacatgcccatctctttctctgttg

SEQ ID NO: 85366 - DNA, 25 bp, mus musculus
agtctattgctgacagtgtaaaaaa

SEQ ID NO: 85367 - DNA, 25 bp, mus musculus
cttcatggctgttaagcggatgatt

SEQ ID NO: 85368 - DNA, 25 bp, mus musculus
tatctcaaaggcattggagcacaaa

SEQ ID NO: 85369 - DNA, 25 bp, mus musculus
agcattcaacagagggtccatgaac

SEQ ID NO: 85370 - DNA, 25 bp, mus musculus
cgtggtctccggtggcaacacagac

SEQ ID NO: 85371 - DNA, 25 bp, mus musculus
caacagctactcatatcaggatgtt

SEQ ID NO: 85372 - DNA, 25 bp, mus musculus
atatcaggatgttccttactaccga

SEQ ID NO: 85373 - DNA, 25 bp, mus musculus
ggatgttccttactaccgatcaata

SEQ ID NO: 85374 - DNA, 25 bp, mus musculus
tccttactaccgatcaataccagaa

SEQ ID NO: 85375 - DNA, 25 bp, mus musculus
gatcagctagaaaccctgaagcgag

SEQ ID NO: 85376 - DNA, 25 bp, mus musculus
cagctagaaaccctgaagcgagaga

SEQ ID NO: 85377 - DNA, 25 bp, mus musculus
gaacttcaggctgctctagaagaag

SEQ ID NO: 85378 - DNA, 25 bp, mus musculus
cttcaggctgctctagaagaagcag

SEQ ID NO: 85379 - DNA, 25 bp, mus musculus
ggaaagatcctgcgcatccagctgg

SEQ ID NO: 85380 - DNA, 25 bp, mus musculus
aagatcctgcgcatccagctggagc

SEQ ID NO: 85381 - DNA, 25 bp, mus musculus
atcctgcgcatccagctggagctga

SEQ ID NO: 85382 - DNA, 25 bp, mus musculus
ctgcgcatccagctggagctgaacc

SEQ ID NO: 85383 - DNA, 25 bp, mus musculus
cgcatccagctggagctgaaccaag

SEQ ID NO: 85384 - DNA, 25 bp, mus musculus
ctgaaccaagtcaagtctgagatcg

SEQ ID NO: 85385 - DNA, 25 bp, mus musculus
aaccaagtcaagtctgagatcgaca

SEQ ID NO: 85386 - DNA, 25 bp, mus musculus
tcaagtctgagatcgacaggaagat

SEQ ID NO: 85387 - DNA, 25 bp, mus musculus
ctagaaaccctgaagcgagagaata

SEQ ID NO: 85388 - DNA, 25 bp, mus musculus
gagatttctgacctcacggaacaga

SEQ ID NO: 85389 - DNA, 25 bp, mus musculus
atttctgacctcacggaacagattg

SEQ ID NO: 85390 - DNA, 25 bp, mus musculus
tctgacctcacggaacagattgcag

SEQ ID NO: 85391 - DNA, 25 bp, mus musculus
gacctcacggaacagattgcagaag

SEQ ID NO: 85392 - DNA, 25 bp, mus musculus
ggaaagcgcatccacgaactggaga

SEQ ID NO: 85393 - DNA, 25 bp, mus musculus
aagcgcatccacgaactggagaaaa

SEQ ID NO: 85394 - DNA, 25 bp, mus musculus
cgcatccacgaactggagaaaatta

SEQ ID NO: 85395 - DNA, 25 bp, mus musculus
ccaaaggacctgcggcatctgcggg

SEQ ID NO: 85396 - DNA, 25 bp, mus musculus
aaaggacctgcggcatctgcgggct

SEQ ID NO: 85397 - DNA, 25 bp, mus musculus
tatagaccagttcgaatatgatggg

SEQ ID NO: 85398 - DNA, 25 bp, mus musculus
acaattgcgatgcatacctacaaat

SEQ ID NO: 85399 - DNA, 25 bp, mus musculus
caattgcgatgcatacctacaaatg

SEQ ID NO: 85400 - DNA, 25 bp, mus musculus
attgcgatgcatacctacaaatgaa

SEQ ID NO: 85401 - DNA, 25 bp, mus musculus
ttgcgatgcatacctacaaatgaag

SEQ ID NO: 85402 - DNA, 25 bp, mus musculus
tgcgatgcatacctacaaatgaagg

SEQ ID NO: 85403 - DNA, 25 bp, mus musculus
gatgcatacctacaaatgaagggca

SEQ ID NO: 85404 - DNA, 25 bp, mus musculus
atgcatacctacaaatgaagggcaa

SEQ ID NO: 85405 - DNA, 25 bp, mus musculus
tgcatacctacaaatgaagggcaac

SEQ ID NO: 85406 - DNA, 25 bp, mus musculus
gcatacctacaaatgaagggcaaca

SEQ ID NO: 85407 - DNA, 25 bp, mus musculus
tgtttgctgtgctcgttagtcaaga

SEQ ID NO: 85408 - DNA, 25 bp, mus musculus
gtttgctgtgctcgttagtcaagac

SEQ ID NO: 85409 - DNA, 25 bp, mus musculus
ttgctgtgctcgttagtcaagacta

SEQ ID NO: 85410 - DNA, 25 bp, mus musculus
tgctgtgctcgttagtcaagactat

SEQ ID NO: 85411 - DNA, 25 bp, mus musculus
gctgtgctcgttagtcaagactata

SEQ ID NO: 85412 - DNA, 25 bp, mus musculus
caagactatagaccagttcgaatat

SEQ ID NO: 85413 - DNA, 25 bp, mus musculus
actatagaccagttcgaatatgatg

SEQ ID NO: 85414 - DNA, 25 bp, mus musculus
ctatagaccagttcgaatatgatgg

SEQ ID NO: 85415 - DNA, 25 bp, mus musculus
agcaccccgtgggtccctcagattg

SEQ ID NO: 85416 - DNA, 25 bp, mus musculus
tagataagagccccaggaaggagta

SEQ ID NO: 85417 - DNA, 25 bp, mus musculus
tctccatctccaatacaaggggccg

SEQ ID NO: 85418 - DNA, 25 bp, mus musculus
ctccatctccaatacaaggggccgc

SEQ ID NO: 85419 - DNA, 25 bp, mus musculus
tccatctccaatacaaggggccgct

SEQ ID NO: 85420 - DNA, 25 bp, mus musculus
catctccaatacaaggggccgcttg

SEQ ID NO: 85421 - DNA, 25 bp, mus musculus
atctccaatacaaggggccgcttga

SEQ ID NO: 85422 - DNA, 25 bp, mus musculus
tctccaatacaaggggccgcttgag

SEQ ID NO: 85423 - DNA, 25 bp, mus musculus
ctccaatacaaggggccgcttgagt

SEQ ID NO: 85424 - DNA, 25 bp, mus musculus
ttagcccattggccaagaaacctcg

SEQ ID NO: 85425 - DNA, 25 bp, mus musculus
tagcccattggccaagaaacctcgg

SEQ ID NO: 85426 - DNA, 25 bp, mus musculus
tggccaagaaacctcggaagtcaag

SEQ ID NO: 85427 - DNA, 25 bp, mus musculus
gataagagccccaggaaggagtaca

SEQ ID NO: 85428 - DNA, 25 bp, mus musculus
taagagccccaggaaggagtacaag

SEQ ID NO: 85429 - DNA, 25 bp, mus musculus
agtacaagatctccatctccaatac

SEQ ID NO: 85430 - DNA, 25 bp, mus musculus
gtacaagatctccatctccaataca

SEQ ID NO: 85431 - DNA, 25 bp, mus musculus
acaagatctccatctccaatacaag

SEQ ID NO: 85432 - DNA, 25 bp, mus musculus
caagatctccatctccaatacaagg

SEQ ID NO: 85433 - DNA, 25 bp, mus musculus
agatctccatctccaatacaagggg

SEQ ID NO: 85434 - DNA, 25 bp, mus musculus
atctccatctccaatacaaggggcc

SEQ ID NO: 85435 - DNA, 25 bp, mus musculus
tgattcatgcttactgtaaagtgaa

SEQ ID NO: 85436 - DNA, 25 bp, mus musculus
ttcatgcttactgtaaagtgaaagt

SEQ ID NO: 85437 - DNA, 25 bp, mus musculus
cttataccacaatacatcgaaaact

SEQ ID NO: 85438 - DNA, 25 bp, mus musculus
ataccacaatacatcgaaaacttca

SEQ ID NO: 85439 - DNA, 25 bp, mus musculus
ccacaatacatcgaaaacttcagat

SEQ ID NO: 85440 - DNA, 25 bp, mus musculus
caatacatcgaaaacttcagatgca

SEQ ID NO: 85441 - DNA, 25 bp, mus musculus
aacttcagatgcatgttgaaaaaca

SEQ ID NO: 85442 - DNA, 25 bp, mus musculus
gtttaatatcctgtaaggcacgtga

SEQ ID NO: 85443 - DNA, 25 bp, mus musculus
taatatcctgtaaggcacgtgagtg

SEQ ID NO: 85444 - DNA, 25 bp, mus musculus
tatcctgtaaggcacgtgagtgtac

SEQ ID NO: 85445 - DNA, 25 bp, mus musculus
tatggaattctggggctttgattta

SEQ ID NO: 85446 - DNA, 25 bp, mus musculus
ccttaccttgtattgtgaattccat

SEQ ID NO: 85447 - DNA, 25 bp, mus musculus
tttaagctcagcaattttgaacact

SEQ ID NO: 85448 - DNA, 25 bp, mus musculus
tattgaccataactgtcaactcccc

SEQ ID NO: 85449 - DNA, 25 bp, mus musculus
tgaccataactgtcaactccccttt

SEQ ID NO: 85450 - DNA, 25 bp, mus musculus
ccataactgtcaactcccctttgag

SEQ ID NO: 85451 - DNA, 25 bp, mus musculus
taactgtcaactcccctttgagctt

SEQ ID NO: 85452 - DNA, 25 bp, mus musculus
gctttcctcaagttagttatgttgt

SEQ ID NO: 85453 - DNA, 25 bp, mus musculus
aatgttgctcttataccacaataca

SEQ ID NO: 85454 - DNA, 25 bp, mus musculus
gttgctcttataccacaatacatcg

SEQ ID NO: 85455 - DNA, 25 bp, mus musculus
tttccaggcactgaggaccgcagtc

SEQ ID NO: 85456 - DNA, 25 bp, mus musculus
gaccgcagtccctaattcctggcag

SEQ ID NO: 85457 - DNA, 25 bp, mus musculus
agctatgctaacactagaaaccatg

SEQ ID NO: 85458 - DNA, 25 bp, mus musculus
gctaacactagaaaccatggccagt

SEQ ID NO: 85459 - DNA, 25 bp, mus musculus
aacactagaaaccatggccagtgaa

SEQ ID NO: 85460 - DNA, 25 bp, mus musculus
actagaaaccatggccagtgaagaa

SEQ ID NO: 85461 - DNA, 25 bp, mus musculus
aaccatggccagtgaagaagaatat

SEQ ID NO: 85462 - DNA, 25 bp, mus musculus
agaccgggccacaggctatcatttc

SEQ ID NO: 85463 - DNA, 25 bp, mus musculus
ccgggccacaggctatcatttccac

SEQ ID NO: 85464 - DNA, 25 bp, mus musculus
cgccctgacttgtgagggctgcaag

SEQ ID NO: 85465 - DNA, 25 bp, mus musculus
ctgcaagggcttcttcagtgatact

SEQ ID NO: 85466 - DNA, 25 bp, mus musculus
gggcttcttcagtgatactgtcagc

SEQ ID NO: 85467 - DNA, 25 bp, mus musculus
agtccctaattcctggcagttcctg

SEQ ID NO: 85468 - DNA, 25 bp, mus musculus
ccctaattcctggcagttcctgaga

SEQ ID NO: 85469 - DNA, 25 bp, mus musculus
taattcctggcagttcctgagatct

SEQ ID NO: 85470 - DNA, 25 bp, mus musculus
aggaggcatcctacacccgatcttg

SEQ ID NO: 85471 - DNA, 25 bp, mus musculus
cctacacccgatcttgtggcctgct

SEQ ID NO: 85472 - DNA, 25 bp, mus musculus
acacccgatcttgtggcctgctgcc

SEQ ID NO: 85473 - DNA, 25 bp, mus musculus
gatcttgtggcctgctgcctaaggg

SEQ ID NO: 85474 - DNA, 25 bp, mus musculus
gacagctatgctaacactagaaacc

SEQ ID NO: 85475 - DNA, 25 bp, mus musculus
tgcgtgtcaccgatggagctctggt

SEQ ID NO: 85476 - DNA, 25 bp, mus musculus
cgtgtcaccgatggagctctggtgg

SEQ ID NO: 85477 - DNA, 25 bp, mus musculus
cagaccttccagcgcatcgtggaga

SEQ ID NO: 85478 - DNA, 25 bp, mus musculus
gaccttccagcgcatcgtggagaac

SEQ ID NO: 85479 - DNA, 25 bp, mus musculus
ccttccagcgcatcgtggagaacgt

SEQ ID NO: 85480 - DNA, 25 bp, mus musculus
ttccagcgcatcgtggagaacgtca

SEQ ID NO: 85481 - DNA, 25 bp, mus musculus
agaacgtcaacgtcatcatctctac

SEQ ID NO: 85482 - DNA, 25 bp, mus musculus
aacgtcaacgtcatcatctctacct

SEQ ID NO: 85483 - DNA, 25 bp, mus musculus
cgtcaacgtcatcatctctacctac

SEQ ID NO: 85484 - DNA, 25 bp, mus musculus
aacgtcatcatctctacctacggcg

SEQ ID NO: 85485 - DNA, 25 bp, mus musculus
cgtcatcatctctacctacggcgag

SEQ ID NO: 85486 - DNA, 25 bp, mus musculus
tcctgggaccgtagctttggttctg

SEQ ID NO: 85487 - DNA, 25 bp, mus musculus
cagaaactgtgctgcgccaggccat

SEQ ID NO: 85488 - DNA, 25 bp, mus musculus
tgcgccaggccatcgctgaacgcat

SEQ ID NO: 85489 - DNA, 25 bp, mus musculus
cgccaggccatcgctgaacgcatca

SEQ ID NO: 85490 - DNA, 25 bp, mus musculus
ccaggccatcgctgaacgcatcaag

SEQ ID NO: 85491 - DNA, 25 bp, mus musculus
gccatcgctgaacgcatcaagcccg

SEQ ID NO: 85492 - DNA, 25 bp, mus musculus
tcaagcccgtcctgatgatgaacaa

SEQ ID NO: 85493 - DNA, 25 bp, mus musculus
gcccgtcctgatgatgaacaagatg

SEQ ID NO: 85494 - DNA, 25 bp, mus musculus
agctctaccagaccttccagcgcat

SEQ ID NO: 85495 - DNA, 25 bp, mus musculus
actgctccgaagcagaagtgggtga

SEQ ID NO: 85496 - DNA, 25 bp, mus musculus
gcaacaggcccaagagcgagttggc

SEQ ID NO: 85497 - DNA, 25 bp, mus musculus
gcatagcggaccacagcttctatgg

SEQ ID NO: 85498 - DNA, 25 bp, mus musculus
tagcggaccacagcttctatggccc

SEQ ID NO: 85499 - DNA, 25 bp, mus musculus
accacagcttctatggcccggagcc

SEQ ID NO: 85500 - DNA, 25 bp, mus musculus
gcttctatggcccggagccccctgt

SEQ ID NO: 85501 - DNA, 25 bp, mus musculus
gctccaacggggactggggctctat

SEQ ID NO: 85502 - DNA, 25 bp, mus musculus
cagtctcccaagcgggtaacctgag

SEQ ID NO: 85503 - DNA, 25 bp, mus musculus
gtaacctgagccccacggcctcatt

SEQ ID NO: 85504 - DNA, 25 bp, mus musculus
gccccacggcctcattggaggaatt

SEQ ID NO: 85505 - DNA, 25 bp, mus musculus
catcctatctgctcccgggagcact

SEQ ID NO: 85506 - DNA, 25 bp, mus musculus
cctatctgctcccgggagcactggt

SEQ ID NO: 85507 - DNA, 25 bp, mus musculus
acaggcccaagagcgagttggcact

SEQ ID NO: 85508 - DNA, 25 bp, mus musculus
actggtgttctcagacttcttgtga

SEQ ID NO: 85509 - DNA, 25 bp, mus musculus
tggcactcagcaaacagcgaagaag

SEQ ID NO: 85510 - DNA, 25 bp, mus musculus
cactcagcaaacagcgaagaagccg

SEQ ID NO: 85511 - DNA, 25 bp, mus musculus
atgacgccaaacttacaaagatcga

SEQ ID NO: 85512 - DNA, 25 bp, mus musculus
acatctgggcactgactcagacgct

SEQ ID NO: 85513 - DNA, 25 bp, mus musculus
gggcactgactcagacgctgcgcat

SEQ ID NO: 85514 - DNA, 25 bp, mus musculus
tgactcagacgctgcgcatagcgga

SEQ ID NO: 85515 - DNA, 25 bp, mus musculus
ctcagacgctgcgcatagcggacca

SEQ ID NO: 85516 - DNA, 25 bp, mus musculus
cgagcagatcagcccagaggaggaa

SEQ ID NO: 85517 - DNA, 25 bp, mus musculus
gatcagcccagaggaggaagagcgc

SEQ ID NO: 85518 - DNA, 25 bp, mus musculus
gaaggacccaggtggttctggcagc

SEQ ID NO: 85519 - DNA, 25 bp, mus musculus
ggacccaggtggttctggcagcacc

SEQ ID NO: 85520 - DNA, 25 bp, mus musculus
agtgccttgcatctccctttctcca

SEQ ID NO: 85521 - DNA, 25 bp, mus musculus
tgaaccggaagcactgcataccccc

SEQ ID NO: 85522 - DNA, 25 bp, mus musculus
tctgactccttttactccgagtctg

SEQ ID NO: 85523 - DNA, 25 bp, mus musculus
tactccgagtctggttttcacctat

SEQ ID NO: 85524 - DNA, 25 bp, mus musculus
ggttttcacctatcctagcacacca

SEQ ID NO: 85525 - DNA, 25 bp, mus musculus
tttcacctatcctagcacaccagaa

SEQ ID NO: 85526 - DNA, 25 bp, mus musculus
ctccactcaccgaaagagtagcagc

SEQ ID NO: 85527 - DNA, 25 bp, mus musculus
cactcaccgaaagagtagcagcagc

SEQ ID NO: 85528 - DNA, 25 bp, mus musculus
caagctagcagctgctaagtgcaga

SEQ ID NO: 85529 - DNA, 25 bp, mus musculus
gaaatcggggctgcagcgagagatt

SEQ ID NO: 85530 - DNA, 25 bp, mus musculus
atcggggctgcagcgagagattgaa

SEQ ID NO: 85531 - DNA, 25 bp, mus musculus
gaaggaacgccttgagctggtgctg

SEQ ID NO: 85532 - DNA, 25 bp, mus musculus
acgccttgagctggtgctggaagcc

SEQ ID NO: 85533 - DNA, 25 bp, mus musculus
ggaagcccatcgcctcatctgcaaa

SEQ ID NO: 85534 - DNA, 25 bp, mus musculus
tcgcctcatctgcaaaatcccagaa

SEQ ID NO: 85535 - DNA, 25 bp, mus musculus
cctcatctgcaaaatcccagaagga

SEQ ID NO: 85536 - DNA, 25 bp, mus musculus
tgtcaagaacctggagagtgataca

SEQ ID NO: 85537 - DNA, 25 bp, mus musculus
ctacattatctggaatgccaaactt

SEQ ID NO: 85538 - DNA, 25 bp, mus musculus
ggactaccacttaggatacggcatg

SEQ ID NO: 85539 - DNA, 25 bp, mus musculus
taccacttaggatacggcatgacaa

SEQ ID NO: 85540 - DNA, 25 bp, mus musculus
atgattcataacatggccatgcatt

SEQ ID NO: 85541 - DNA, 25 bp, mus musculus
gattcataacatggccatgcattac

SEQ ID NO: 85542 - DNA, 25 bp, mus musculus
taacatggccatgcattacctgttt

SEQ ID NO: 85543 - DNA, 25 bp, mus musculus
atggccatgcattacctgtttcgag

SEQ ID NO: 85544 - DNA, 25 bp, mus musculus
ggccatgcattacctgtttcgagtc

SEQ ID NO: 85545 - DNA, 25 bp, mus musculus
atgcattacctgtttcgagtcgaag

SEQ ID NO: 85546 - DNA, 25 bp, mus musculus
gcattacctgtttcgagtcgaagat

SEQ ID NO: 85547 - DNA, 25 bp, mus musculus
tacctgtttcgagtcgaagatctgt

SEQ ID NO: 85548 - DNA, 25 bp, mus musculus
tatctggaatgccaaacttgacagc

SEQ ID NO: 85549 - DNA, 25 bp, mus musculus
gaatgccaaacttgacagcaacttt

SEQ ID NO: 85550 - DNA, 25 bp, mus musculus
caaacttgacagcaactttggctgc

SEQ ID NO: 85551 - DNA, 25 bp, mus musculus
cttgacagcaactttggctgccggt

SEQ ID NO: 85552 - DNA, 25 bp, mus musculus
tgacagcaactttggctgccggtcc

SEQ ID NO: 85553 - DNA, 25 bp, mus musculus
agcaactttggctgccggtccgtca

SEQ ID NO: 85554 - DNA, 25 bp, mus musculus
tttggctgccggtccgtcaaagtga

SEQ ID NO: 85555 - DNA, 25 bp, mus musculus
tggctgccggtccgtcaaagtgaag

SEQ ID NO: 85556 - DNA, 25 bp, mus musculus
aaatggccaaggcattaagggaatg

SEQ ID NO: 85557 - DNA, 25 bp, mus musculus
aatggccaaggcattaagggaatgg

SEQ ID NO: 85558 - DNA, 25 bp, mus musculus
gctcgattttttcggcacatgctta

SEQ ID NO: 85559 - DNA, 25 bp, mus musculus
ctcgattttttcggcacatgcttat

SEQ ID NO: 85560 - DNA, 25 bp, mus musculus
tcgattttttcggcacatgcttata

SEQ ID NO: 85561 - DNA, 25 bp, mus musculus
gattttttcggcacatgcttataaa

SEQ ID NO: 85562 - DNA, 25 bp, mus musculus
ttttttcggcacatgcttataaatg

SEQ ID NO: 85563 - DNA, 25 bp, mus musculus
tttttcggcacatgcttataaatgc

SEQ ID NO: 85564 - DNA, 25 bp, mus musculus
ttttcggcacatgcttataaatgct

SEQ ID NO: 85565 - DNA, 25 bp, mus musculus
tttcggcacatgcttataaatgctg

SEQ ID NO: 85566 - DNA, 25 bp, mus musculus
ttcggcacatgcttataaatgctga

SEQ ID NO: 85567 - DNA, 25 bp, mus musculus
tcggcacatgcttataaatgctgag

SEQ ID NO: 85568 - DNA, 25 bp, mus musculus
aaggtctcgttgccacaaaagagtg

SEQ ID NO: 85569 - DNA, 25 bp, mus musculus
aggtctcgttgccacaaaagagtgc

SEQ ID NO: 85570 - DNA, 25 bp, mus musculus
ggtctcgttgccacaaaagagtgct

SEQ ID NO: 85571 - DNA, 25 bp, mus musculus
gtctcgttgccacaaaagagtgctc

SEQ ID NO: 85572 - DNA, 25 bp, mus musculus
ctcgttgccacaaaagagtgctcga

SEQ ID NO: 85573 - DNA, 25 bp, mus musculus
ttgccacaaaagagtgctcgatttt

SEQ ID NO: 85574 - DNA, 25 bp, mus musculus
agtgctcgattttttcggcacatgc

SEQ ID NO: 85575 - DNA, 25 bp, mus musculus
gtgctcgattttttcggcacatgct

SEQ ID NO: 85576 - DNA, 25 bp, mus musculus
catgaatcctttccagaaaaatgag

SEQ ID NO: 85577 - DNA, 25 bp, mus musculus
gctcttttcacctgtctctactgaa

SEQ ID NO: 85578 - DNA, 25 bp, mus musculus
catgaaacctgttttgactttgtat

SEQ ID NO: 85579 - DNA, 25 bp, mus musculus
gactttgtattccctggacttcctg

SEQ ID NO: 85580 - DNA, 25 bp, mus musculus
ttccctggacttcctgcactggatt

SEQ ID NO: 85581 - DNA, 25 bp, mus musculus
ggacttcctgcactggattgaagac

SEQ ID NO: 85582 - DNA, 25 bp, mus musculus
tgaagacacgtcaacatctgtctac

SEQ ID NO: 85583 - DNA, 25 bp, mus musculus
agacacgtcaacatctgtctacaat

SEQ ID NO: 85584 - DNA, 25 bp, mus musculus
cacgtcaacatctgtctacaatgcc

SEQ ID NO: 85585 - DNA, 25 bp, mus musculus
aacatctgtctacaatgccttcagc

SEQ ID NO: 85586 - DNA, 25 bp, mus musculus
atctgtctacaatgccttcagcagc

SEQ ID NO: 85587 - DNA, 25 bp, mus musculus
tgtctacaatgccttcagcagcctc

SEQ ID NO: 85588 - DNA, 25 bp, mus musculus
ttcacctgtctctactgaagagatg

SEQ ID NO: 85589 - DNA, 25 bp, mus musculus
caatgccttcagcagcctctagtat

SEQ ID NO: 85590 - DNA, 25 bp, mus musculus
acctgtctctactgaagagatgctg

SEQ ID NO: 85591 - DNA, 25 bp, mus musculus
agagatgctgcctgaacctccaagc

SEQ ID NO: 85592 - DNA, 25 bp, mus musculus
ttcaactccgaagctcttcggttct

SEQ ID NO: 85593 - DNA, 25 bp, mus musculus
gaagctcttcggttctagctcccca

SEQ ID NO: 85594 - DNA, 25 bp, mus musculus
cggttctagctccccattgagtatg

SEQ ID NO: 85595 - DNA, 25 bp, mus musculus
ttctagctccccattgagtatggct

SEQ ID NO: 85596 - DNA, 25 bp, mus musculus
tagctccccattgagtatggcttta

SEQ ID NO: 85597 - DNA, 25 bp, mus musculus
gaacctggtccagtgcatccagaac

SEQ ID NO: 85598 - DNA, 25 bp, mus musculus
cctggtccagtgcatccagaacaag

SEQ ID NO: 85599 - DNA, 25 bp, mus musculus
ttagctgcccttgcctggctttctc

SEQ ID NO: 85600 - DNA, 25 bp, mus musculus
gcccttgcctggctttctcctcatt

SEQ ID NO: 85601 - DNA, 25 bp, mus musculus
tctctcctttatgccaaagaagtga

SEQ ID NO: 85602 - DNA, 25 bp, mus musculus
ctcctttatgccaaagaagtgaaca

SEQ ID NO: 85603 - DNA, 25 bp, mus musculus
gcgtcagtctgtgacatgagacact

SEQ ID NO: 85604 - DNA, 25 bp, mus musculus
gacatgagacacttcctcttatgta

SEQ ID NO: 85605 - DNA, 25 bp, mus musculus
agacacttcctcttatgtactgtgt

SEQ ID NO: 85606 - DNA, 25 bp, mus musculus
cacttcctcttatgtactgtgtcgt

SEQ ID NO: 85607 - DNA, 25 bp, mus musculus
ttcctcttatgtactgtgtcgtgaa

SEQ ID NO: 85608 - DNA, 25 bp, mus musculus
ttatgtactgtgtcgtgaataaacc

SEQ ID NO: 85609 - DNA, 25 bp, mus musculus
ccagaacaagcccctgtacttcgct

SEQ ID NO: 85610 - DNA, 25 bp, mus musculus
tcagcacagtggatcacccagaagt

SEQ ID NO: 85611 - DNA, 25 bp, mus musculus
gcacagtggatcacccagaagtggc

SEQ ID NO: 85612 - DNA, 25 bp, mus musculus
tggatcacccagaagtggctctacc

SEQ ID NO: 85613 - DNA, 25 bp, mus musculus
atcacccagaagtggctctacctgt

SEQ ID NO: 85614 - DNA, 25 bp, mus musculus
acccagaagtggctctacctgtgcc

SEQ ID NO: 85615 - DNA, 25 bp, mus musculus
ttctagagacttcgctctccactaa

SEQ ID NO: 85616 - DNA, 25 bp, mus musculus
atcttagctgcccttgcctggcttt

SEQ ID NO: 85617 - DNA, 25 bp, mus musculus
atgctccagactcagcctgtgtgat

SEQ ID NO: 85618 - DNA, 25 bp, mus musculus
cagactcagcctgtgtgatcggcct

SEQ ID NO: 85619 - DNA, 25 bp, mus musculus
tggagcacgtcacacgccgcacctt

SEQ ID NO: 85620 - DNA, 25 bp, mus musculus
cacgccgcaccttgagcatagacaa

SEQ ID NO: 85621 - DNA, 25 bp, mus musculus
gcaccttgagcatagacaagggttt

SEQ ID NO: 85622 - DNA, 25 bp, mus musculus
agggtttctgagcttactgtcacta

SEQ ID NO: 85623 - DNA, 25 bp, mus musculus
tctgagcttactgtcactactgttc

SEQ ID NO: 85624 - DNA, 25 bp, mus musculus
cttactgtcactactgttcctgcgt

SEQ ID NO: 85625 - DNA, 25 bp, mus musculus
gctagccacagatcccagcaccgag

SEQ ID NO: 85626 - DNA, 25 bp, mus musculus
cacagatcccagcaccgaggggaac

SEQ ID NO: 85627 - DNA, 25 bp, mus musculus
gggtctactgtgctgctctggggct

SEQ ID NO: 85628 - DNA, 25 bp, mus musculus
ctttcagtcagacccacattgcctc

SEQ ID NO: 85629 - DNA, 25 bp, mus musculus
cagcctgtgtgatcggcctgcggaa

SEQ ID NO: 85630 - DNA, 25 bp, mus musculus
gtccggtcacagaactcaagaaaga

SEQ ID NO: 85631 - DNA, 25 bp, mus musculus
attttgagcaccgcatgccccggga

SEQ ID NO: 85632 - DNA, 25 bp, mus musculus
agcaccgcatgccccgggagcagtg

SEQ ID NO: 85633 - DNA, 25 bp, mus musculus
cacactaccgcatcagcatggcaga

SEQ ID NO: 85634 - DNA, 25 bp, mus musculus
accgcatcagcatggcagactatgt

SEQ ID NO: 85635 - DNA, 25 bp, mus musculus
tcagcatggcagactatgtgtctgg

SEQ ID NO: 85636 - DNA, 25 bp, mus musculus
tggcagactatgtgtctggggagct

SEQ ID NO: 85637 - DNA, 25 bp, mus musculus
ggtgatttactgcccaaagacaagt

SEQ ID NO: 85638 - DNA, 25 bp, mus musculus
ttactgcccaaagacaagtccatct

SEQ ID NO: 85639 - DNA, 25 bp, mus musculus
gccaacaaccttcaaactttgcaga

SEQ ID NO: 85640 - DNA, 25 bp, mus musculus
aaattgtttctgacatgcaggataa

SEQ ID NO: 85641 - DNA, 25 bp, mus musculus
ttgtttctgacatgcaggataatcc

SEQ ID NO: 85642 - DNA, 25 bp, mus musculus
tgcaggataatcctctctgttacta

SEQ ID NO: 85643 - DNA, 25 bp, mus musculus
aggataatcctctctgttactaata

SEQ ID NO: 85644 - DNA, 25 bp, mus musculus
ataatcctctctgttactaatatgg

SEQ ID NO: 85645 - DNA, 25 bp, mus musculus
atcctctctgttactaatatgggaa

SEQ ID NO: 85646 - DNA, 25 bp, mus musculus
atgcttactggctccctttccctct

SEQ ID NO: 85647 - DNA, 25 bp, mus musculus
tctctccacaaacaggttagaaatt

SEQ ID NO: 85648 - DNA, 25 bp, mus musculus
aattcatctgaggattgcctttggt

SEQ ID NO: 85649 - DNA, 25 bp, mus musculus
ctgcccaaagacaagtccatctgaa

SEQ ID NO: 85650 - DNA, 25 bp, mus musculus
cccaaagacaagtccatctgaagca

SEQ ID NO: 85651 - DNA, 25 bp, mus musculus
gacaagtccatctgaagcaagaact

SEQ ID NO: 85652 - DNA, 25 bp, mus musculus
tccatctgaagcaagaactgactat

SEQ ID NO: 85653 - DNA, 25 bp, mus musculus
gagacttcaaggcagctctcagaca

SEQ ID NO: 85654 - DNA, 25 bp, mus musculus
acttcaaggcagctctcagacaaga

SEQ ID NO: 85655 - DNA, 25 bp, mus musculus
tcaaggcagctctcagacaagaata

SEQ ID NO: 85656 - DNA, 25 bp, mus musculus
aggcagctctcagacaagaatattc

SEQ ID NO: 85657 - DNA, 25 bp, mus musculus
gcctataccttcctgtgtaagcaga

SEQ ID NO: 85658 - DNA, 25 bp, mus musculus
aggccaggctcattttgacacagaa

SEQ ID NO: 85659 - DNA, 25 bp, mus musculus
tgacttctacaaaccatgtggctct

SEQ ID NO: 85660 - DNA, 25 bp, mus musculus
tggctctacctggttgcactggtgg

SEQ ID NO: 85661 - DNA, 25 bp, mus musculus
tacctggttgcactggtgggcctgt

SEQ ID NO: 85662 - DNA, 25 bp, mus musculus
gcactggtgggcctgtggacgctcc

SEQ ID NO: 85663 - DNA, 25 bp, mus musculus
tggacgctcctgcgcttcttcaggg

SEQ ID NO: 85664 - DNA, 25 bp, mus musculus
gtgagccatctccaagacaagtatg

SEQ ID NO: 85665 - DNA, 25 bp, mus musculus
catctccaagacaagtatgtcttca

SEQ ID NO: 85666 - DNA, 25 bp, mus musculus
atcacgggctgtgactctggctttg

SEQ ID NO: 85667 - DNA, 25 bp, mus musculus
ggctgtgactctggctttgggaacc

SEQ ID NO: 85668 - DNA, 25 bp, mus musculus
gactctggctttgggaaccttctgg

SEQ ID NO: 85669 - DNA, 25 bp, mus musculus
ccaggctcattttgacacagaatat

SEQ ID NO: 85670 - DNA, 25 bp, mus musculus
ttttgacacagaatatctctctctg

SEQ ID NO: 85671 - DNA, 25 bp, mus musculus
tgacacagaatatctctctctgctt

SEQ ID NO: 85672 - DNA, 25 bp, mus musculus
agaatatctctctctgcttgacttc

SEQ ID NO: 85673 - DNA, 25 bp, mus musculus
atatctctctctgcttgacttctac

SEQ ID NO: 85674 - DNA, 25 bp, mus musculus
tctctctctgcttgacttctacaaa

SEQ ID NO: 85675 - DNA, 25 bp, mus musculus
tctgcttgacttctacaaaccatgt

SEQ ID NO: 85676 - DNA, 25 bp, mus musculus
gcttgacttctacaaaccatgtggc

SEQ ID NO: 85677 - DNA, 25 bp, mus musculus
gacaaatccaaggacaatagtggtg

SEQ ID NO: 85678 - DNA, 25 bp, mus musculus
gccaagtcagaacaactcagcaacc

SEQ ID NO: 85679 - DNA, 25 bp, mus musculus
cttccctgtttgaggacattggctt

SEQ ID NO: 85680 - DNA, 25 bp, mus musculus
tcattttatactgttttggcatgga

SEQ ID NO: 85681 - DNA, 25 bp, mus musculus
ttttatactgttttggcatggactg

SEQ ID NO: 85682 - DNA, 25 bp, mus musculus
tatactgttttggcatggactgtat

SEQ ID NO: 85683 - DNA, 25 bp, mus musculus
actgttttggcatggactgtattta

SEQ ID NO: 85684 - DNA, 25 bp, mus musculus
ttccaccatgctttatgtgattgta

SEQ ID NO: 85685 - DNA, 25 bp, mus musculus
caccatgctttatgtgattgtattt

SEQ ID NO: 85686 - DNA, 25 bp, mus musculus
caattggcctttctgagctgatttt

SEQ ID NO: 85687 - DNA, 25 bp, mus musculus
ttggcctttctgagctgatttttcc

SEQ ID NO: 85688 - DNA, 25 bp, mus musculus
gcctttctgagctgatttttccatc

SEQ ID NO: 85689 - DNA, 25 bp, mus musculus
aagtcagaacaactcagcaaccctt

SEQ ID NO: 85690 - DNA, 25 bp, mus musculus
tcagaacaactcagcaacccttgaa

SEQ ID NO: 85691 - DNA, 25 bp, mus musculus
gaacaactcagcaacccttgaattt

SEQ ID NO: 85692 - DNA, 25 bp, mus musculus
caactcagcaacccttgaatttgac

SEQ ID NO: 85693 - DNA, 25 bp, mus musculus
ctcagcaacccttgaatttgactct

SEQ ID NO: 85694 - DNA, 25 bp, mus musculus
agcaacccttgaatttgactctcca

SEQ ID NO: 85695 - DNA, 25 bp, mus musculus
tgaatttgactctccaactttagga

SEQ ID NO: 85696 - DNA, 25 bp, mus musculus
tgactctccaactttaggaacctcg

SEQ ID NO: 85697 - DNA, 25 bp, mus musculus
cgtgcctaaacgcgtgtactagact

SEQ ID NO: 85698 - DNA, 25 bp, mus musculus
tgacatgggtgtacttcgcgagatc

SEQ ID NO: 85699 - DNA, 25 bp, mus musculus
tgctagcctaaacctggcagtggct

SEQ ID NO: 85700 - DNA, 25 bp, mus musculus
tagcctaaacctggcagtggctccg

SEQ ID NO: 85701 - DNA, 25 bp, mus musculus
cctaaacctggcagtggctccgtca

SEQ ID NO: 85702 - DNA, 25 bp, mus musculus
cctggcagtggctccgtcaatgcca

SEQ ID NO: 85703 - DNA, 25 bp, mus musculus
agtggctccgtcaatgccaatttgc

SEQ ID NO: 85704 - DNA, 25 bp, mus musculus
tccgtcaatgccaatttgcatggca

SEQ ID NO: 85705 - DNA, 25 bp, mus musculus
gtcaatgccaatttgcatggcagca

SEQ ID NO: 85706 - DNA, 25 bp, mus musculus
aatgccaatttgcatggcagcaagg

SEQ ID NO: 85707 - DNA, 25 bp, mus musculus
aatttgcatggcagcaagggattct

SEQ ID NO: 85708 - DNA, 25 bp, mus musculus
gaaacgactgtacctgggtgtacat

SEQ ID NO: 85709 - DNA, 25 bp, mus musculus
tcgcgagatcatcatccctgaccta

SEQ ID NO: 85710 - DNA, 25 bp, mus musculus
cgagatcatcatccctgacctacct

SEQ ID NO: 85711 - DNA, 25 bp, mus musculus
acgctccgttgactatggtctacgg

SEQ ID NO: 85712 - DNA, 25 bp, mus musculus
cgttgactatggtctacggctagtc

SEQ ID NO: 85713 - DNA, 25 bp, mus musculus
tggtctacggctagtccaaaccttg

SEQ ID NO: 85714 - DNA, 25 bp, mus musculus
tctacggctagtccaaaccttgtag

SEQ ID NO: 85715 - DNA, 25 bp, mus musculus
agtctgccctgctagcctaaacctg

SEQ ID NO: 85716 - DNA, 25 bp, mus musculus
ctgccctgctagcctaaacctggca

SEQ ID NO: 85717 - DNA, 25 bp, mus musculus
tgcagtccctcggtgagagacacgt

SEQ ID NO: 85718 - DNA, 25 bp, mus musculus
cagtccctcggtgagagacacgttg

SEQ ID NO: 85719 - DNA, 25 bp, mus musculus
aggagctgctggctgctgactctgc

SEQ ID NO: 85720 - DNA, 25 bp, mus musculus
gagctgctggctgctgactctgccc

SEQ ID NO: 85721 - DNA, 25 bp, mus musculus
ctggctgctgactctgccctctagc

SEQ ID NO: 85722 - DNA, 25 bp, mus musculus
ggctgctgactctgccctctagcag

SEQ ID NO: 85723 - DNA, 25 bp, mus musculus
tgccctctagcagggccctcaagag

SEQ ID NO: 85724 - DNA, 25 bp, mus musculus
ctctagcagggccctcaagagccca

SEQ ID NO: 85725 - DNA, 25 bp, mus musculus
ccacacctgtgttcacaagccagtg

SEQ ID NO: 85726 - DNA, 25 bp, mus musculus
tcacaagccagtgctctgtaggagt

SEQ ID NO: 85727 - DNA, 25 bp, mus musculus
acaagccagtgctctgtaggagtgg

SEQ ID NO: 85728 - DNA, 25 bp, mus musculus
aagccagtgctctgtaggagtggtg

SEQ ID NO: 85729 - DNA, 25 bp, mus musculus
gtccctcggtgagagacacgttgag

SEQ ID NO: 85730 - DNA, 25 bp, mus musculus
aatgagctgctattccccagtgtgc

SEQ ID NO: 85731 - DNA, 25 bp, mus musculus
tattccccagtgtgcacagtgctgt

SEQ ID NO: 85732 - DNA, 25 bp, mus musculus
ccagtgtgcacagtgctgtggaggc

SEQ ID NO: 85733 - DNA, 25 bp, mus musculus
tgcacagtgctgtggaggctgcatg

SEQ ID NO: 85734 - DNA, 25 bp, mus musculus
cacagtgctgtggaggctgcatgtg

SEQ ID NO: 85735 - DNA, 25 bp, mus musculus
ctgcatgtgcccgccgtgaggagct

SEQ ID NO: 85736 - DNA, 25 bp, mus musculus
tgaggagctgctggctgctgactct

SEQ ID NO: 85737 - DNA, 25 bp, mus musculus
agcaaaatggatcccactgatgcca

SEQ ID NO: 85738 - DNA, 25 bp, mus musculus
atggatcccactgatgccaagtatc

SEQ ID NO: 85739 - DNA, 25 bp, mus musculus
ttcttcacttgtgctgctcctcaca

SEQ ID NO: 85740 - DNA, 25 bp, mus musculus
agcgctcatgagactctctgcttcg

SEQ ID NO: 85741 - DNA, 25 bp, mus musculus
catgagactctctgcttcgggttga

SEQ ID NO: 85742 - DNA, 25 bp, mus musculus
agcagttgccaggttggtccaccgg

SEQ ID NO: 85743 - DNA, 25 bp, mus musculus
ggatacaaatgtccccatctaggca

SEQ ID NO: 85744 - DNA, 25 bp, mus musculus
aaatgtccccatctaggcaaggtct

SEQ ID NO: 85745 - DNA, 25 bp, mus musculus
tgtcctatgggtctatggtcactgt

SEQ ID NO: 85746 - DNA, 25 bp, mus musculus
cctgcaactggcaacaatgtccaat

SEQ ID NO: 85747 - DNA, 25 bp, mus musculus
actggcaacaatgtccaataaacag

SEQ ID NO: 85748 - DNA, 25 bp, mus musculus
gtccaataaacagttccaggtgctg

SEQ ID NO: 85749 - DNA, 25 bp, mus musculus
cccactgatgccaagtatcacatgc

SEQ ID NO: 85750 - DNA, 25 bp, mus musculus
aagtatcacatgcagcgttgcatcg

SEQ ID NO: 85751 - DNA, 25 bp, mus musculus
cagcgttgcatcgattctggcctct

SEQ ID NO: 85752 - DNA, 25 bp, mus musculus
tgcatcgattctggcctctgggtcc

SEQ ID NO: 85753 - DNA, 25 bp, mus musculus
tgggtccccaactccaagtctggtg

SEQ ID NO: 85754 - DNA, 25 bp, mus musculus
gtcagtgcgtgacccttctccggaa

SEQ ID NO: 85755 - DNA, 25 bp, mus musculus
aacttagccaccatgtccctagctc

SEQ ID NO: 85756 - DNA, 25 bp, mus musculus
cccaacttcttcacttgtgctgctc

SEQ ID NO: 85757 - DNA, 25 bp, mus musculus
acttgctcatcacaggaaaaattgt

SEQ ID NO: 85758 - DNA, 25 bp, mus musculus
cattcagtgtttatttccgacacaa

SEQ ID NO: 85759 - DNA, 25 bp, mus musculus
agagtcatgtgtcctggttatgttc

SEQ ID NO: 85760 - DNA, 25 bp, mus musculus
tatgttccaaaccatttaaggtcat

SEQ ID NO: 85761 - DNA, 25 bp, mus musculus
tctgcattcacattatcttttacag

SEQ ID NO: 85762 - DNA, 25 bp, mus musculus
ttcacattatcttttacagtgttga

SEQ ID NO: 85763 - DNA, 25 bp, mus musculus
actacaattaccatagtgagagacc

SEQ ID NO: 85764 - DNA, 25 bp, mus musculus
agagaccatacttatcttttggata

SEQ ID NO: 85765 - DNA, 25 bp, mus musculus
tttctccaatagtaatagaaatgaa

SEQ ID NO: 85766 - DNA, 25 bp, mus musculus
catgttactttacctaggaatgctc

SEQ ID NO: 85767 - DNA, 25 bp, mus musculus
acagtgccagatttccatggcaaaa

SEQ ID NO: 85768 - DNA, 25 bp, mus musculus
gactgcaattccttgtccagatttc

SEQ ID NO: 85769 - DNA, 25 bp, mus musculus
atttccgacacaattcaacaggtct

SEQ ID NO: 85770 - DNA, 25 bp, mus musculus
gacacaattcaacaggtctgggcaa

SEQ ID NO: 85771 - DNA, 25 bp, mus musculus
atgtttcagtgagcttggtacctcc

SEQ ID NO: 85772 - DNA, 25 bp, mus musculus
aatcttttaactgccatattgagta

SEQ ID NO: 85773 - DNA, 25 bp, mus musculus
ctttgtgcaatttcgacccatccaa

SEQ ID NO: 85774 - DNA, 25 bp, mus musculus
gcaatttcgacccatccaaaatctg

SEQ ID NO: 85775 - DNA, 25 bp, mus musculus
tcgacccatccaaaatctgctacca

SEQ ID NO: 85776 - DNA, 25 bp, mus musculus
catccaaaatctgctaccaggagca

SEQ ID NO: 85777 - DNA, 25 bp, mus musculus
tatatttcaggcataactccactgg

SEQ ID NO: 85778 - DNA, 25 bp, mus musculus
ataactccactggtcaagggaatgt

SEQ ID NO: 85779 - DNA, 25 bp, mus musculus
tgtcctggctctgctctaagccctt

SEQ ID NO: 85780 - DNA, 25 bp, mus musculus
gctctaagcccttcaaggtgatctg

SEQ ID NO: 85781 - DNA, 25 bp, mus musculus
tatgccctgactacaactatcacag

SEQ ID NO: 85782 - DNA, 25 bp, mus musculus
ctgactacaactatcacagtgacac

SEQ ID NO: 85783 - DNA, 25 bp, mus musculus
atcacagtgacacaccttactttcc

SEQ ID NO: 85784 - DNA, 25 bp, mus musculus
ctgagactgaagcctgcggagttaa

SEQ ID NO: 85785 - DNA, 25 bp, mus musculus
ggtcacatctgttgcctggaatgtg

SEQ ID NO: 85786 - DNA, 25 bp, mus musculus
gaatgtgtctaccttgctgctcttg

SEQ ID NO: 85787 - DNA, 25 bp, mus musculus
gtctaccttgctgctcttgttgact

SEQ ID NO: 85788 - DNA, 25 bp, mus musculus
tggtgcacacatgctagtggaaaac

SEQ ID NO: 85789 - DNA, 25 bp, mus musculus
atttggcacaacaaaccgtgattga

SEQ ID NO: 85790 - DNA, 25 bp, mus musculus
aagattccaagtccttcaactgtcg

SEQ ID NO: 85791 - DNA, 25 bp, mus musculus
ccttcaactgtcgcattgagtatga

SEQ ID NO: 85792 - DNA, 25 bp, mus musculus
actgtcgcattgagtatgagaaggt

SEQ ID NO: 85793 - DNA, 25 bp, mus musculus
ttgacaaggccaccaagaacacact

SEQ ID NO: 85794 - DNA, 25 bp, mus musculus
aggccaccaagaacacactctgcaa

SEQ ID NO: 85795 - DNA, 25 bp, mus musculus
ccaagaacacactctgcaactacga

SEQ ID NO: 85796 - DNA, 25 bp, mus musculus
cctgttaccaggagcagacccaaag

SEQ ID NO: 85797 - DNA, 25 bp, mus musculus
agtcctttcacattgttattctggg

SEQ ID NO: 85798 - DNA, 25 bp, mus musculus
tgggtttggactgtgctggaaagac

SEQ ID NO: 85799 - DNA, 25 bp, mus musculus
tggactctgtcgatgttgagagaat

SEQ ID NO: 85800 - DNA, 25 bp, mus musculus
atcagggagtccctgtgcttatagt

SEQ ID NO: 85801 - DNA, 25 bp, mus musculus
gagtccctgtgcttatagttgctaa

SEQ ID NO: 85802 - DNA, 25 bp, mus musculus
actcgctctctctctcagagattga

SEQ ID NO: 85803 - DNA, 25 bp, mus musculus
ctctctcagagattgagaagttgtt

SEQ ID NO: 85804 - DNA, 25 bp, mus musculus
aactgagctcatcgactccttggca

SEQ ID NO: 85805 - DNA, 25 bp, mus musculus
tgagctcatcgactccttggcatct

SEQ ID NO: 85806 - DNA, 25 bp, mus musculus
catcgactccttggcatctgcagcc

SEQ ID NO: 85807 - DNA, 25 bp, mus musculus
tgcagcccacctgtgcaatcatagg

SEQ ID NO: 85808 - DNA, 25 bp, mus musculus
ccacctgtgcaatcataggagatgg

SEQ ID NO: 85809 - DNA, 25 bp, mus musculus
acaggctgcagttcaacgaatttgt

SEQ ID NO: 85810 - DNA, 25 bp, mus musculus
gcaattccaaaacagtcacttttca

SEQ ID NO: 85811 - DNA, 25 bp, mus musculus
ccaaaacagtcacttttcacttctg

SEQ ID NO: 85812 - DNA, 25 bp, mus musculus
cagtcacttttcacttctgggatgt

SEQ ID NO: 85813 - DNA, 25 bp, mus musculus
cttttcacttctgggatgtaggtgg

SEQ ID NO: 85814 - DNA, 25 bp, mus musculus
ttcacttctgggatgtaggtggtca

SEQ ID NO: 85815 - DNA, 25 bp, mus musculus
ggaagtcatacacccgatgcacaga

SEQ ID NO: 85816 - DNA, 25 bp, mus musculus
catacacccgatgcacagatggtat

SEQ ID NO: 85817 - DNA, 25 bp, mus musculus
ttaccctgggcatcctcatttctac

SEQ ID NO: 85818 - DNA, 25 bp, mus musculus
tcctcatttctactcagcgggtccg

SEQ ID NO: 85819 - DNA, 25 bp, mus musculus
gcgcgcagagcctccagaagtggct

SEQ ID NO: 85820 - DNA, 25 bp, mus musculus
agagcctccagaagtggctgcacaa

SEQ ID NO: 85821 - DNA, 25 bp, mus musculus
tgcacaacaatatcatctccatagt

SEQ ID NO: 85822 - DNA, 25 bp, mus musculus
acaatatcatctccatagtgggaat

SEQ ID NO: 85823 - DNA, 25 bp, mus musculus
tcatctccatagtgggaatctgtct

SEQ ID NO: 85824 - DNA, 25 bp, mus musculus
agctcggcttcatgacgctctcaat

SEQ ID NO: 85825 - DNA, 25 bp, mus musculus
gcttcatgacgctctcaatattcct

SEQ ID NO: 85826 - DNA, 25 bp, mus musculus
tgacgctctcaatattcctgtgtag

SEQ ID NO: 85827 - DNA, 25 bp, mus musculus
gaaatctggatcacgtctatgaccg

SEQ ID NO: 85828 - DNA, 25 bp, mus musculus
tggatcacgtctatgaccggctggc

SEQ ID NO: 85829 - DNA, 25 bp, mus musculus
agagctaccgcacgaatccggatga

SEQ ID NO: 85830 - DNA, 25 bp, mus musculus
accgcacgaatccggatgagacagc

SEQ ID NO: 85831 - DNA, 25 bp, mus musculus
cacagttccagctgcgctgctgcgg

SEQ ID NO: 85832 - DNA, 25 bp, mus musculus
actggaacaaggcccagatgctgaa

SEQ ID NO: 85833 - DNA, 25 bp, mus musculus
acaaggcccagatgctgaaagcgaa

SEQ ID NO: 85834 - DNA, 25 bp, mus musculus
acaactccacggcgaccaatgactc

SEQ ID NO: 85835 - DNA, 25 bp, mus musculus
atgactccaccgtctttgataagct

SEQ ID NO: 85836 - DNA, 25 bp, mus musculus
tatgtgcactccctgcaaaagccca

SEQ ID NO: 85837 - DNA, 25 bp, mus musculus
gacaggatgcctagccgatgcgaga

SEQ ID NO: 85838 - DNA, 25 bp, mus musculus
aggatgcctagccgatgcgagagcc

SEQ ID NO: 85839 - DNA, 25 bp, mus musculus
tgcgcttcgtgcacacgatgtctga

SEQ ID NO: 85840 - DNA, 25 bp, mus musculus
tcgtgcacacgatgtctgaccaagt

SEQ ID NO: 85841 - DNA, 25 bp, mus musculus
acacgatgtctgaccaagtccagca

SEQ ID NO: 85842 - DNA, 25 bp, mus musculus
tgtctgaccaagtccagcaataagt

SEQ ID NO: 85843 - DNA, 25 bp, mus musculus
ctgaccaagtccagcaataagttgc

SEQ ID NO: 85844 - DNA, 25 bp, mus musculus
accaagtccagcaataagttgcagg

SEQ ID NO: 85845 - DNA, 25 bp, mus musculus
ttgcaggctcccaagtcacacgagg

SEQ ID NO: 85846 - DNA, 25 bp, mus musculus
caggctcccaagtcacacgaggact

SEQ ID NO: 85847 - DNA, 25 bp, mus musculus
taaaggcttaccaccaggagcttgg

SEQ ID NO: 85848 - DNA, 25 bp, mus musculus
cttaccaccaggagcttggagaact

SEQ ID NO: 85849 - DNA, 25 bp, mus musculus
atgcctagccgatgcgagagccgga

SEQ ID NO: 85850 - DNA, 25 bp, mus musculus
cagctcaaatggcaaaccaaaagcc

SEQ ID NO: 85851 - DNA, 25 bp, mus musculus
caaaccaaaagccaggtgagcaggc

SEQ ID NO: 85852 - DNA, 25 bp, mus musculus
ctctgaatcgcttctggcattatat

SEQ ID NO: 85853 - DNA, 25 bp, mus musculus
atcgcttctggcattatatgcgctt

SEQ ID NO: 85854 - DNA, 25 bp, mus musculus
gcttctggcattatatgcgcttcgt

SEQ ID NO: 85855 - DNA, 25 bp, mus musculus
attatatgcgcttcgtgcacacgat

SEQ ID NO: 85856 - DNA, 25 bp, mus musculus
atatgcgcttcgtgcacacgatgtc

SEQ ID NO: 85857 - DNA, 25 bp, mus musculus
gcttcggtgacctctcaggaggaac

SEQ ID NO: 85858 - DNA, 25 bp, mus musculus
gtgacctctcaggaggaacaggcat

SEQ ID NO: 85859 - DNA, 25 bp, mus musculus
agccttgatctcacttcagggcttc

SEQ ID NO: 85860 - DNA, 25 bp, mus musculus
gatctcacttcagggcttcctgtcc

SEQ ID NO: 85861 - DNA, 25 bp, mus musculus
acttcagggcttcctgtcctgtatt

SEQ ID NO: 85862 - DNA, 25 bp, mus musculus
tttaaaacatgcttgcctccttctt

SEQ ID NO: 85863 - DNA, 25 bp, mus musculus
ccttcttaaagacaagccctgcatt

SEQ ID NO: 85864 - DNA, 25 bp, mus musculus
caagccctgcattggagtcccctca

SEQ ID NO: 85865 - DNA, 25 bp, mus musculus
ccatgtctgcccagataagccctca

SEQ ID NO: 85866 - DNA, 25 bp, mus musculus
ctgcccagataagccctcaataaca

SEQ ID NO: 85867 - DNA, 25 bp, mus musculus
agataagccctcaataacactcact

SEQ ID NO: 85868 - DNA, 25 bp, mus musculus
gccctcaataacactcactgaatgc

SEQ ID NO: 85869 - DNA, 25 bp, mus musculus
ttcctggtacagactacaagttctg

SEQ ID NO: 85870 - DNA, 25 bp, mus musculus
ataacactcactgaatgccggaatt

SEQ ID NO: 85871 - DNA, 25 bp, mus musculus
cattggattgggctcactgaccagg

SEQ ID NO: 85872 - DNA, 25 bp, mus musculus
attgggctcactgaccagggcacag

SEQ ID NO: 85873 - DNA, 25 bp, mus musculus
ccattcaacaatgcccagagcaaag

SEQ ID NO: 85874 - DNA, 25 bp, mus musculus
cacgtccggcagcagtggaatgaca

SEQ ID NO: 85875 - DNA, 25 bp, mus musculus
tacccctgggtgtgcaagaagtcca

SEQ ID NO: 85876 - DNA, 25 bp, mus musculus
aagtccacagggtggtctgcggcca

SEQ ID NO: 85877 - DNA, 25 bp, mus musculus
tccttcagccttgatctcacttcag

SEQ ID NO: 85878 - DNA, 25 bp, mus musculus
tctcccttgtagaaacctggcttgt

SEQ ID NO: 85879 - DNA, 25 bp, mus musculus
tggcttgttctgatggagaaaagga

SEQ ID NO: 85880 - DNA, 25 bp, mus musculus
agaccgggccaactcagatttctct

SEQ ID NO: 85881 - DNA, 25 bp, mus musculus
cgggccaactcagatttctctaaat

SEQ ID NO: 85882 - DNA, 25 bp, mus musculus
gggccaactcagatttctctaaatg

SEQ ID NO: 85883 - DNA, 25 bp, mus musculus
gccaactcagatttctctaaatggc

SEQ ID NO: 85884 - DNA, 25 bp, mus musculus
ccaactcagatttctctaaatggcc

SEQ ID NO: 85885 - DNA, 25 bp, mus musculus
caactcagatttctctaaatggcct

SEQ ID NO: 85886 - DNA, 25 bp, mus musculus
aactcagatttctctaaatggccta

SEQ ID NO: 85887 - DNA, 25 bp, mus musculus
ctcagatttctctaaatggcctata

SEQ ID NO: 85888 - DNA, 25 bp, mus musculus
cagatttctctaaatggcctatatt

SEQ ID NO: 85889 - DNA, 25 bp, mus musculus
agatttctctaaatggcctatatta

SEQ ID NO: 85890 - DNA, 25 bp, mus musculus
agtatcgaatgggcgtctttcagag

SEQ ID NO: 85891 - DNA, 25 bp, mus musculus
gatttctctaaatggcctatattag

SEQ ID NO: 85892 - DNA, 25 bp, mus musculus
tatcgaatgggcgtctttcagagac

SEQ ID NO: 85893 - DNA, 25 bp, mus musculus
gcgtctttcagagaccgggccaact

SEQ ID NO: 85894 - DNA, 25 bp, mus musculus
tctttcagagaccgggccaactcag

SEQ ID NO: 85895 - DNA, 25 bp, mus musculus
ctttcagagaccgggccaactcaga

SEQ ID NO: 85896 - DNA, 25 bp, mus musculus
cagagaccgggccaactcagatttc

SEQ ID NO: 85897 - DNA, 25 bp, mus musculus
agagaccgggccaactcagatttct

SEQ ID NO: 85898 - DNA, 25 bp, mus musculus
gagaccgggccaactcagatttctc

SEQ ID NO: 85899 - DNA, 25 bp, mus musculus
actacttcacgctggctcagcagcc

SEQ ID NO: 85900 - DNA, 25 bp, mus musculus
ccatccagcctggacagatcatcat

SEQ ID NO: 85901 - DNA, 25 bp, mus musculus
ccaatgcccaacagatcacacagac

SEQ ID NO: 85902 - DNA, 25 bp, mus musculus
cccaacagatcacacagacagaggt

SEQ ID NO: 85903 - DNA, 25 bp, mus musculus
agatcacacagacagaggtccagca

SEQ ID NO: 85904 - DNA, 25 bp, mus musculus
agcagctgtaccagatccagcaagt

SEQ ID NO: 85905 - DNA, 25 bp, mus musculus
tgtaccagatccagcaagtcaccat

SEQ ID NO: 85906 - DNA, 25 bp, mus musculus
agatccagcaagtcaccatgcctgc

SEQ ID NO: 85907 - DNA, 25 bp, mus musculus
agcaagtcaccatgcctgcaggcca

SEQ ID NO: 85908 - DNA, 25 bp, mus musculus
tcaccatgcctgcaggccaagacct

SEQ ID NO: 85909 - DNA, 25 bp, mus musculus
ttcagtcagccaatcagccctctga

SEQ ID NO: 85910 - DNA, 25 bp, mus musculus
cagccaatcagccctctgatgggca

SEQ ID NO: 85911 - DNA, 25 bp, mus musculus
agcctggacagatcatcattgcaca

SEQ ID NO: 85912 - DNA, 25 bp, mus musculus
gacagatcatcattgcacagcctca

SEQ ID NO: 85913 - DNA, 25 bp, mus musculus
agctgaatgctgcccagctgcaata

SEQ ID NO: 85914 - DNA, 25 bp, mus musculus
atgctgcccagctgcaatatatccg

SEQ ID NO: 85915 - DNA, 25 bp, mus musculus
cccagctgcaatatatccgattagc

SEQ ID NO: 85916 - DNA, 25 bp, mus musculus
gattagcccagcctgtatcaggcac

SEQ ID NO: 85917 - DNA, 25 bp, mus musculus
ttgtccaaggacagatccagacact

SEQ ID NO: 85918 - DNA, 25 bp, mus musculus
ttgctaccaatgcccaacagatcac

SEQ ID NO: 85919 - DNA, 25 bp, mus musculus
cactgccagcacccgaggctgctgg

SEQ ID NO: 85920 - DNA, 25 bp, mus musculus
ctgctggcatccgggacacaggttc

SEQ ID NO: 85921 - DNA, 25 bp, mus musculus
ttcccagtactgtaagtgcgtgcta

SEQ ID NO: 85922 - DNA, 25 bp, mus musculus
cccagtactgtaagtgcgtgctatg

SEQ ID NO: 85923 - DNA, 25 bp, mus musculus
tgtaagtgcgtgctatgcaggagag

SEQ ID NO: 85924 - DNA, 25 bp, mus musculus
taagtgcgtgctatgcaggagagcc

SEQ ID NO: 85925 - DNA, 25 bp, mus musculus
agtgcgtgctatgcaggagagccga

SEQ ID NO: 85926 - DNA, 25 bp, mus musculus
tgctatgcaggagagccgaggccca

SEQ ID NO: 85927 - DNA, 25 bp, mus musculus
gagagccgaggcccacctatttcat

SEQ ID NO: 85928 - DNA, 25 bp, mus musculus
gagccgaggcccacctatttcatct

SEQ ID NO: 85929 - DNA, 25 bp, mus musculus
agatggctgcggatgctggagacaa

SEQ ID NO: 85930 - DNA, 25 bp, mus musculus
atggctgcggatgctggagacaact

SEQ ID NO: 85931 - DNA, 25 bp, mus musculus
gctggcatccgggacacaggttcca

SEQ ID NO: 85932 - DNA, 25 bp, mus musculus
tggcatccgggacacaggttccact

SEQ ID NO: 85933 - DNA, 25 bp, mus musculus
ccgggacacaggttccactcaactg

SEQ ID NO: 85934 - DNA, 25 bp, mus musculus
gacacaggttccactcaactgaaga

SEQ ID NO: 85935 - DNA, 25 bp, mus musculus
caggttccactcaactgaagacaaa

SEQ ID NO: 85936 - DNA, 25 bp, mus musculus
atcaaggcgctggtcattgacctgg

SEQ ID NO: 85937 - DNA, 25 bp, mus musculus
gtcattgacctgggttcccagtact

SEQ ID NO: 85938 - DNA, 25 bp, mus musculus
tgggttcccagtactgtaagtgcgt

SEQ ID NO: 85939 - DNA, 25 bp, mus musculus
tgttcagcaaagtgcgcttctgcag

SEQ ID NO: 85940 - DNA, 25 bp, mus musculus
tctgcagcggccgcaagaggccagt

SEQ ID NO: 85941 - DNA, 25 bp, mus musculus
aaggctatctctacagctcagatgt

SEQ ID NO: 85942 - DNA, 25 bp, mus musculus
atgtgatctattcctcaaccctgta

SEQ ID NO: 85943 - DNA, 25 bp, mus musculus
tctattcctcaaccctgtatcgcca

SEQ ID NO: 85944 - DNA, 25 bp, mus musculus
cctcaaccctgtatcgccagcagga

SEQ ID NO: 85945 - DNA, 25 bp, mus musculus
aatcaggccgtgcatggtttctagg

SEQ ID NO: 85946 - DNA, 25 bp, mus musculus
gccgtgcatggtttctaggactcaa

SEQ ID NO: 85947 - DNA, 25 bp, mus musculus
ttgtaccaaaacctattgaagtgtg

SEQ ID NO: 85948 - DNA, 25 bp, mus musculus
acagagaaccatcactacacgaaat

SEQ ID NO: 85949 - DNA, 25 bp, mus musculus
aaccatcactacacgaaattggaga

SEQ ID NO: 85950 - DNA, 25 bp, mus musculus
catcactacacgaaattggagaaaa

SEQ ID NO: 85951 - DNA, 25 bp, mus musculus
ggagaccagaaccccagctgaaagg

SEQ ID NO: 85952 - DNA, 25 bp, mus musculus
cagaaccccagctgaaagggattgt

SEQ ID NO: 85953 - DNA, 25 bp, mus musculus
ggttattcagccagcagggatattt

SEQ ID NO: 85954 - DNA, 25 bp, mus musculus
gatatttcctgcagatgcatccaga

SEQ ID NO: 85955 - DNA, 25 bp, mus musculus
tcctgcagatgcatccagatggtac

SEQ ID NO: 85956 - DNA, 25 bp, mus musculus
acagcgactacaccctcttcaatct

SEQ ID NO: 85957 - DNA, 25 bp, mus musculus
tggccatccaaggggttaaagccag

SEQ ID NO: 85958 - DNA, 25 bp, mus musculus
gcctttatgtggccatgaatggaga

SEQ ID NO: 85959 - DNA, 25 bp, mus musculus
ctatcttgatctacgtagccttctt

SEQ ID NO: 85960 - DNA, 25 bp, mus musculus
tgatctacgtagccttctttgagat

SEQ ID NO: 85961 - DNA, 25 bp, mus musculus
tgaaccaggactgcttctgagtgct

SEQ ID NO: 85962 - DNA, 25 bp, mus musculus
gcttctgagtgctgctattctcacc

SEQ ID NO: 85963 - DNA, 25 bp, mus musculus
cactccatgaaaactcagctgcacc

SEQ ID NO: 85964 - DNA, 25 bp, mus musculus
atgaaaactcagctgcacccaatgc

SEQ ID NO: 85965 - DNA, 25 bp, mus musculus
actcagctgcacccaatgctggggt

SEQ ID NO: 85966 - DNA, 25 bp, mus musculus
ctgcacccaatgctggggttgacca

SEQ ID NO: 85967 - DNA, 25 bp, mus musculus
ttgaccagatcgccaatggctttta

SEQ ID NO: 85968 - DNA, 25 bp, mus musculus
accagatcgccaatggcttttaagt

SEQ ID NO: 85969 - DNA, 25 bp, mus musculus
agatcgccaatggcttttaagtgtt

SEQ ID NO: 85970 - DNA, 25 bp, mus musculus
tcgccaatggcttttaagtgtttga

SEQ ID NO: 85971 - DNA, 25 bp, mus musculus
ccattgcggtggctggctgttgtaa

SEQ ID NO: 85972 - DNA, 25 bp, mus musculus
cctccaactttctggtcggaatgct

SEQ ID NO: 85973 - DNA, 25 bp, mus musculus
ctgcagcctacttaggagcctacgt

SEQ ID NO: 85974 - DNA, 25 bp, mus musculus
cctacgtttttatcatcttcgctgc

SEQ ID NO: 85975 - DNA, 25 bp, mus musculus
tcatcttcgctgccttcctcatctt

SEQ ID NO: 85976 - DNA, 25 bp, mus musculus
tcatcttcttcctaatcttcacctt

SEQ ID NO: 85977 - DNA, 25 bp, mus musculus
cccctggcaacgcctgagccgggag

SEQ ID NO: 85978 - DNA, 25 bp, mus musculus
acctcatcaggatgaaccaggactg

SEQ ID NO: 85979 - DNA, 25 bp, mus musculus
aactctttggctccaagaagaggcg

SEQ ID NO: 85980 - DNA, 25 bp, mus musculus
ggagaccagagcctcagcttaaggg

SEQ ID NO: 85981 - DNA, 25 bp, mus musculus
cggaacatttcacacctgagtgcaa

SEQ ID NO: 85982 - DNA, 25 bp, mus musculus
atttcacacctgagtgcaaattcaa

SEQ ID NO: 85983 - DNA, 25 bp, mus musculus
acgtgacatactcatcaatgatcta

SEQ ID NO: 85984 - DNA, 25 bp, mus musculus
catactcatcaatgatctaccgtca

SEQ ID NO: 85985 - DNA, 25 bp, mus musculus
accgtcagcagcaatccggccgagg

SEQ ID NO: 85986 - DNA, 25 bp, mus musculus
ctgcagcacattttctgcccaaacc

SEQ ID NO: 85987 - DNA, 25 bp, mus musculus
ccaaaccactgaaagtggccatgta

SEQ ID NO: 85988 - DNA, 25 bp, mus musculus
agccatctctgcacgatctcacgga

SEQ ID NO: 85989 - DNA, 25 bp, mus musculus
gcagaagcgtctctggtgtactgaa

SEQ ID NO: 85990 - DNA, 25 bp, mus musculus
gcaaatccatgagccacaacgaatc

SEQ ID NO: 85991 - DNA, 25 bp, mus musculus
cagagcctcagcttaagggtatagt

SEQ ID NO: 85992 - DNA, 25 bp, mus musculus
catgagccacaacgaatcaacgtag

SEQ ID NO: 85993 - DNA, 25 bp, mus musculus
ttaccaaactatacagccgacaagg

SEQ ID NO: 85994 - DNA, 25 bp, mus musculus
acttgcaactgcaggcagatggaac

SEQ ID NO: 85995 - DNA, 25 bp, mus musculus
acagcacttacactctgtttaacct

SEQ ID NO: 85996 - DNA, 25 bp, mus musculus
ttaacctcatccctgtgggtcttcg

SEQ ID NO: 85997 - DNA, 25 bp, mus musculus
tcatccctgtgggtcttcgggtggt

SEQ ID NO: 85998 - DNA, 25 bp, mus musculus
gagttcaaaccaagctgtatttggc

SEQ ID NO: 85999 - DNA, 25 bp, mus musculus
acacctcggaacatttcacacctga

SEQ ID NO: 86000 - DNA, 25 bp, mus musculus
ggatactcagctacctcccagcagc

SEQ ID NO: 86001 - DNA, 25 bp, mus musculus
cagcctccacagtactcacatcaga

SEQ ID NO: 86002 - DNA, 25 bp, mus musculus
ctgcaggactggctgcggcactcgc

SEQ ID NO: 86003 - DNA, 25 bp, mus musculus
aatgtactgtacaaccacatcttca

SEQ ID NO: 86004 - DNA, 25 bp, mus musculus
ctgtacaaccacatcttcacaatgt

SEQ ID NO: 86005 - DNA, 25 bp, mus musculus
tacaaccacatcttcacaatgtcca

SEQ ID NO: 86006 - DNA, 25 bp, mus musculus
aaccacatcttcacaatgtccagta

SEQ ID NO: 86007 - DNA, 25 bp, mus musculus
atcttcacaatgtccagtagccgag

SEQ ID NO: 86008 - DNA, 25 bp, mus musculus
acaatgtccagtagccgagtccacc

SEQ ID NO: 86009 - DNA, 25 bp, mus musculus
agtagccgagtccaccagttgtcac

SEQ ID NO: 86010 - DNA, 25 bp, mus musculus
agccgagtccaccagttgtcacaga

SEQ ID NO: 86011 - DNA, 25 bp, mus musculus
gtccaccagttgtcacagattgggg

SEQ ID NO: 86012 - DNA, 25 bp, mus musculus
cagtactcacatcagacacatcggt

SEQ ID NO: 86013 - DNA, 25 bp, mus musculus
aagtgctagcacagttgtgttgtgg

SEQ ID NO: 86014 - DNA, 25 bp, mus musculus
tcacatcagacacatcggtactgag

SEQ ID NO: 86015 - DNA, 25 bp, mus musculus
cagacacatcggtactgagctgtgc

SEQ ID NO: 86016 - DNA, 25 bp, mus musculus
acacatcggtactgagctgtgctgg

SEQ ID NO: 86017 - DNA, 25 bp, mus musculus
catcggtactgagctgtgctggagt

SEQ ID NO: 86018 - DNA, 25 bp, mus musculus
gctgtgctggagtctgtcagtgcac

SEQ ID NO: 86019 - DNA, 25 bp, mus musculus
tctgtcagtgcactgttgctcatgc

SEQ ID NO: 86020 - DNA, 25 bp, mus musculus
ctcatgctgcaggactggctgcggc

SEQ ID NO: 86021 - DNA, 25 bp, mus musculus
gactagcactgtttgctagacctgg

SEQ ID NO: 86022 - DNA, 25 bp, mus musculus
tagcactgtttgctagacctggcat

SEQ ID NO: 86023 - DNA, 25 bp, mus musculus
caccagtggcactgttcactgcttt

SEQ ID NO: 86024 - DNA, 25 bp, mus musculus
cagtggcactgttcactgctttctg

SEQ ID NO: 86025 - DNA, 25 bp, mus musculus
cactgttcactgctttctgggcagc

SEQ ID NO: 86026 - DNA, 25 bp, mus musculus
tgttcactgctttctgggcagcctc

SEQ ID NO: 86027 - DNA, 25 bp, mus musculus
tcactgctttctgggcagcctctat

SEQ ID NO: 86028 - DNA, 25 bp, mus musculus
ctttctgggcagcctctatcgcttg

SEQ ID NO: 86029 - DNA, 25 bp, mus musculus
tctgggcagcctctatcgcttggtg

SEQ ID NO: 86030 - DNA, 25 bp, mus musculus
gggcagcctctatcgcttggtgggc

SEQ ID NO: 86031 - DNA, 25 bp, mus musculus
ctatcgcttggtgggcttgtagtac

SEQ ID NO: 86032 - DNA, 25 bp, mus musculus
tcgcttggtgggcttgtagtacagc

SEQ ID NO: 86033 - DNA, 25 bp, mus musculus
tgtttgctagacctggcatttgctc

SEQ ID NO: 86034 - DNA, 25 bp, mus musculus
gtacagctacagcttcatcaacctt

SEQ ID NO: 86035 - DNA, 25 bp, mus musculus
ctagacctggcatttgctcggtaca

SEQ ID NO: 86036 - DNA, 25 bp, mus musculus
ctggcatttgctcggtacataaggt

SEQ ID NO: 86037 - DNA, 25 bp, mus musculus
gcatttgctcggtacataaggttca

SEQ ID NO: 86038 - DNA, 25 bp, mus musculus
tttgctcggtacataaggttcaaag

SEQ ID NO: 86039 - DNA, 25 bp, mus musculus
tatctgtacgtggtccctgatcaat

SEQ ID NO: 86040 - DNA, 25 bp, mus musculus
ctgtacgtggtccctgatcaattaa

SEQ ID NO: 86041 - DNA, 25 bp, mus musculus
gaacaccagtggcactgttcactgc

SEQ ID NO: 86042 - DNA, 25 bp, mus musculus
agtcactttgccagaaacagctcct

SEQ ID NO: 86043 - DNA, 25 bp, mus musculus
gcggcccagagcctcagctcaaagg

SEQ ID NO: 86044 - DNA, 25 bp, mus musculus
ccatgaacgctgaggggctattgta

SEQ ID NO: 86045 - DNA, 25 bp, mus musculus
tattgtacagctcgccacatttcac

SEQ ID NO: 86046 - DNA, 25 bp, mus musculus
acagctcgccacatttcacagcaga

SEQ ID NO: 86047 - DNA, 25 bp, mus musculus
attactatgtcctgtatgcctctgc

SEQ ID NO: 86048 - DNA, 25 bp, mus musculus
atgtcctgtatgcctctgctctcta

SEQ ID NO: 86049 - DNA, 25 bp, mus musculus
tgtatgcctctgctctctaccgtca

SEQ ID NO: 86050 - DNA, 25 bp, mus musculus
ctctctaccgtcagcgtcgttctgg

SEQ ID NO: 86051 - DNA, 25 bp, mus musculus
ccaaggcagctgcccactttgtgcc

SEQ ID NO: 86052 - DNA, 25 bp, mus musculus
cccactttgtgcccaagctcctgga

SEQ ID NO: 86053 - DNA, 25 bp, mus musculus
ccatgtaccgggagccttctctcca

SEQ ID NO: 86054 - DNA, 25 bp, mus musculus
cagagcctcagctcaaaggcatcgt

SEQ ID NO: 86055 - DNA, 25 bp, mus musculus
gcatcgtcaccaaactgttctgccg

SEQ ID NO: 86056 - DNA, 25 bp, mus musculus
acctccaggcgaatcccgatgggag

SEQ ID NO: 86057 - DNA, 25 bp, mus musculus
aggcgaatcccgatgggagtatcca

SEQ ID NO: 86058 - DNA, 25 bp, mus musculus
atcccgatgggagtatccagggcac

SEQ ID NO: 86059 - DNA, 25 bp, mus musculus
agggcaccccagaggacaccagctc

SEQ ID NO: 86060 - DNA, 25 bp, mus musculus
gactccgtgtggtcaccatccagag

SEQ ID NO: 86061 - DNA, 25 bp, mus musculus
acatggccatgaacgctgaggggct

SEQ ID NO: 86062 - DNA, 25 bp, mus musculus
acttgcagatgcaccccgatggagc

SEQ ID NO: 86063 - DNA, 25 bp, mus musculus
agatgcaccccgatggagctctcga

SEQ ID NO: 86064 - DNA, 25 bp, mus musculus
atgtaatctactcatccatgctgta

SEQ ID NO: 86065 - DNA, 25 bp, mus musculus
tctactcatccatgctgtacaggca

SEQ ID NO: 86066 - DNA, 25 bp, mus musculus
cagcagctcattttctacccaagcc

SEQ ID NO: 86067 - DNA, 25 bp, mus musculus
ctcattttctacccaagccattgga

SEQ ID NO: 86068 - DNA, 25 bp, mus musculus
ttctacccaagccattggaagttgc

SEQ ID NO: 86069 - DNA, 25 bp, mus musculus
aagttgccatgtaccgagaaccatc

SEQ ID NO: 86070 - DNA, 25 bp, mus musculus
ccatgtaccgagaaccatccttgca

SEQ ID NO: 86071 - DNA, 25 bp, mus musculus
accgagaaccatccttgcatgatgt

SEQ ID NO: 86072 - DNA, 25 bp, mus musculus
aaccatccttgcatgatgttggtga

SEQ ID NO: 86073 - DNA, 25 bp, mus musculus
gcaaaccagtcaacaagtgcaagac

SEQ ID NO: 86074 - DNA, 25 bp, mus musculus
accccgatggagctctcgatggaac

SEQ ID NO: 86075 - DNA, 25 bp, mus musculus
atgacagcaccaattccacactgtt

SEQ ID NO: 86076 - DNA, 25 bp, mus musculus
gcaccaattccacactgttcaacct

SEQ ID NO: 86077 - DNA, 25 bp, mus musculus
tcaacctcatcccagtgggactgcg

SEQ ID NO: 86078 - DNA, 25 bp, mus musculus
tcatcccagtgggactgcgcgttgt

SEQ ID NO: 86079 - DNA, 25 bp, mus musculus
cagtgggactgcgcgttgttgccat

SEQ ID NO: 86080 - DNA, 25 bp, mus musculus
gcgttgttgccatccagggagtgaa

SEQ ID NO: 86081 - DNA, 25 bp, mus musculus
ttgccatccagggagtgaagacagg

SEQ ID NO: 86082 - DNA, 25 bp, mus musculus
agagctggacttctccaccttcctg

SEQ ID NO: 86083 - DNA, 25 bp, mus musculus
caccttcctgaccatcatgcatatg

SEQ ID NO: 86084 - DNA, 25 bp, mus musculus
agagaagctcactcacaaggaagtg

SEQ ID NO: 86085 - DNA, 25 bp, mus musculus
gaagctcactcacaaggaagtggat

SEQ ID NO: 86086 - DNA, 25 bp, mus musculus
gctcactcacaaggaagtggatgat

SEQ ID NO: 86087 - DNA, 25 bp, mus musculus
tgatcttttcaaggaagcaggcatt

SEQ ID NO: 86088 - DNA, 25 bp, mus musculus
tgaaccaaacggccaagtgaaatat

SEQ ID NO: 86089 - DNA, 25 bp, mus musculus
atatgacacgtttatccagaggatc

SEQ ID NO: 86090 - DNA, 25 bp, mus musculus
tgacacgtttatccagaggatcacc

SEQ ID NO: 86091 - DNA, 25 bp, mus musculus
cacgtttatccagaggatcaccatt

SEQ ID NO: 86092 - DNA, 25 bp, mus musculus
ccagaggatcaccattcctgtgcga

SEQ ID NO: 86093 - DNA, 25 bp, mus musculus
gaggatcaccattcctgtgcgagac

SEQ ID NO: 86094 - DNA, 25 bp, mus musculus
cttcctgaccatcatgcatatgcaa

SEQ ID NO: 86095 - DNA, 25 bp, mus musculus
caccattcctgtgcgagactactaa

SEQ ID NO: 86096 - DNA, 25 bp, mus musculus
cctgaccatcatgcatatgcaaatc

SEQ ID NO: 86097 - DNA, 25 bp, mus musculus
gaccatcatgcatatgcaaatcaag

SEQ ID NO: 86098 - DNA, 25 bp, mus musculus
gaaagaaatccttctggccatgctg

SEQ ID NO: 86099 - DNA, 25 bp, mus musculus
tctggccatgctgatggcagacaag

SEQ ID NO: 86100 - DNA, 25 bp, mus musculus
aggttacatcatggcgtctgagctg

SEQ ID NO: 86101 - DNA, 25 bp, mus musculus
ttacatcatggcgtctgagctgcgg

SEQ ID NO: 86102 - DNA, 25 bp, mus musculus
catggcgtctgagctgcggtcgaaa

SEQ ID NO: 86103 - DNA, 25 bp, mus musculus
ccatgcagccataccagataggtac

SEQ ID NO: 86104 - DNA, 25 bp, mus musculus
tgacctcatctgcccatcatgcaga

SEQ ID NO: 86105 - DNA, 25 bp, mus musculus
tctccacggcattgcagctgaagcc

SEQ ID NO: 86106 - DNA, 25 bp, mus musculus
tgaagcctcctgtgaagacaggaca

SEQ ID NO: 86107 - DNA, 25 bp, mus musculus
acatctaagtcacacgcttccagat

SEQ ID NO: 86108 - DNA, 25 bp, mus musculus
aagtcacacgcttccagatgtcact

SEQ ID NO: 86109 - DNA, 25 bp, mus musculus
tccagatgtcactaacagttctctc

SEQ ID NO: 86110 - DNA, 25 bp, mus musculus
taacagttctctcactcagctgggt

SEQ ID NO: 86111 - DNA, 25 bp, mus musculus
ttctctcactcagctgggtggcctg

SEQ ID NO: 86112 - DNA, 25 bp, mus musculus
gttctgtgccatctgcagatttgtt

SEQ ID NO: 86113 - DNA, 25 bp, mus musculus
tgccatctgcagatttgttgggtgt

SEQ ID NO: 86114 - DNA, 25 bp, mus musculus
tcaatcaaatgcatactgagaatag

SEQ ID NO: 86115 - DNA, 25 bp, mus musculus
tgtgtctgtcatgtctatctatgtg

SEQ ID NO: 86116 - DNA, 25 bp, mus musculus
tgtcatgtctatctatgtggcctgg

SEQ ID NO: 86117 - DNA, 25 bp, mus musculus
ttactctcaatagcaggttctcctg

SEQ ID NO: 86118 - DNA, 25 bp, mus musculus
tcaatagcaggttctcctgtggctg

SEQ ID NO: 86119 - DNA, 25 bp, mus musculus
gagactcacgcagctggagcctgct

SEQ ID NO: 86120 - DNA, 25 bp, mus musculus
cacagacctgcaaaggcaaaccaca

SEQ ID NO: 86121 - DNA, 25 bp, mus musculus
gtccagtacacatctccacggcatt

SEQ ID NO: 86122 - DNA, 25 bp, mus musculus
tacacatctccacggcattgcagct

SEQ ID NO: 86123 - DNA, 25 bp, mus musculus
ttccaggccagagccaccagaagga

SEQ ID NO: 86124 - DNA, 25 bp, mus musculus
ggccagagccaccagaaggaacctg

SEQ ID NO: 86125 - DNA, 25 bp, mus musculus
ttgtgcctcctctgagaaatcctct

SEQ ID NO: 86126 - DNA, 25 bp, mus musculus
tgtgcctcctctgagaaatcctctt

SEQ ID NO: 86127 - DNA, 25 bp, mus musculus
gttcatgttgctctcagctgcggag

SEQ ID NO: 86128 - DNA, 25 bp, mus musculus
ttcatgttgctctcagctgcggaga

SEQ ID NO: 86129 - DNA, 25 bp, mus musculus
catgttgctctcagctgcggagaac

SEQ ID NO: 86130 - DNA, 25 bp, mus musculus
gcggagaactccatctcgtcaatgc

SEQ ID NO: 86131 - DNA, 25 bp, mus musculus
ggagaactccatctcgtcaatgccc

SEQ ID NO: 86132 - DNA, 25 bp, mus musculus
gaactccatctcgtcaatgccctca

SEQ ID NO: 86133 - DNA, 25 bp, mus musculus
catctcgtcaatgccctcacgcgta

SEQ ID NO: 86134 - DNA, 25 bp, mus musculus
gtcaatgccctcacgcgtataccag

SEQ ID NO: 86135 - DNA, 25 bp, mus musculus
gccagagccaccagaaggaacctga

SEQ ID NO: 86136 - DNA, 25 bp, mus musculus
tcaatgccctcacgcgtataccagg

SEQ ID NO: 86137 - DNA, 25 bp, mus musculus
cagagccaccagaaggaacctgaag

SEQ ID NO: 86138 - DNA, 25 bp, mus musculus
agagccaccagaaggaacctgaagg

SEQ ID NO: 86139 - DNA, 25 bp, mus musculus
caggtctctgtgcctgagggctcct

SEQ ID NO: 86140 - DNA, 25 bp, mus musculus
ctctgtgcctgagggctcctcttgt

SEQ ID NO: 86141 - DNA, 25 bp, mus musculus
tctgtgcctgagggctcctcttgtg

SEQ ID NO: 86142 - DNA, 25 bp, mus musculus
tcctcttgtgcctcctctgagaaat

SEQ ID NO: 86143 - DNA, 25 bp, mus musculus
tcttgtgcctcctctgagaaatcct

SEQ ID NO: 86144 - DNA, 25 bp, mus musculus
cagcccacactggtgagacagctag

SEQ ID NO: 86145 - DNA, 25 bp, mus musculus
cagctagccgcacagttcatgaatg

SEQ ID NO: 86146 - DNA, 25 bp, mus musculus
attaaccagaacctattctcctatg

SEQ ID NO: 86147 - DNA, 25 bp, mus musculus
gcccgcacaagcccgatggtgacac

SEQ ID NO: 86148 - DNA, 25 bp, mus musculus
gtgacactgcctccagaggaaccgc

SEQ ID NO: 86149 - DNA, 25 bp, mus musculus
ctgcctccagaggaaccgcgaccat

SEQ ID NO: 86150 - DNA, 25 bp, mus musculus
gaccttggcctgaagacaggtccca

SEQ ID NO: 86151 - DNA, 25 bp, mus musculus
ggcctgaagacaggtcccagagaac

SEQ ID NO: 86152 - DNA, 25 bp, mus musculus
accccaagctggtgattcactggac

SEQ ID NO: 86153 - DNA, 25 bp, mus musculus
actggacatctctgcgttcagcttg

SEQ ID NO: 86154 - DNA, 25 bp, mus musculus
catctctgcgttcagcttgagtgta

SEQ ID NO: 86155 - DNA, 25 bp, mus musculus
tgcgttcagcttgagtgtatctgaa

SEQ ID NO: 86156 - DNA, 25 bp, mus musculus
atgaatggcagcctgtcggaggaag

SEQ ID NO: 86157 - DNA, 25 bp, mus musculus
aggaactgcctggccaaagcccttg

SEQ ID NO: 86158 - DNA, 25 bp, mus musculus
gccaaagcccttgatgaggtgaaga

SEQ ID NO: 86159 - DNA, 25 bp, mus musculus
ttccccagagacatggagaacgaca

SEQ ID NO: 86160 - DNA, 25 bp, mus musculus
aacgacaaggccatgctgataatga

SEQ ID NO: 86161 - DNA, 25 bp, mus musculus
cacgcaccatctttgctccgtgatg

SEQ ID NO: 86162 - DNA, 25 bp, mus musculus
ccatctttgctccgtgatgtcttcc

SEQ ID NO: 86163 - DNA, 25 bp, mus musculus
ttgctccgtgatgtcttccacacga

SEQ ID NO: 86164 - DNA, 25 bp, mus musculus
atcttatttcactaaaagtctcatc

SEQ ID NO: 86165 - DNA, 25 bp, mus musculus
tcttatttcactaaaagtctcatca

SEQ ID NO: 86166 - DNA, 25 bp, mus musculus
aacttattatcacccatatagtgct

SEQ ID NO: 86167 - DNA, 25 bp, mus musculus
acttattatcacccatatagtgcta

SEQ ID NO: 86168 - DNA, 25 bp, mus musculus
cttattatcacccatatagtgctaa

SEQ ID NO: 86169 - DNA, 25 bp, mus musculus
ttattatcacccatatagtgctaat

SEQ ID NO: 86170 - DNA, 25 bp, mus musculus
tattatcacccatatagtgctaatc

SEQ ID NO: 86171 - DNA, 25 bp, mus musculus
attatcacccatatagtgctaatcc

SEQ ID NO: 86172 - DNA, 25 bp, mus musculus
ttatcacccatatagtgctaatcca

SEQ ID NO: 86173 - DNA, 25 bp, mus musculus
tatcacccatatagtgctaatccac

SEQ ID NO: 86174 - DNA, 25 bp, mus musculus
atcacccatatagtgctaatccaca

SEQ ID NO: 86175 - DNA, 25 bp, mus musculus
tcacccatatagtgctaatccacac

SEQ ID NO: 86176 - DNA, 25 bp, mus musculus
cttatttcactaaaagtctcatcac

SEQ ID NO: 86177 - DNA, 25 bp, mus musculus
cacccatatagtgctaatccacacc

SEQ ID NO: 86178 - DNA, 25 bp, mus musculus
ttatttcactaaaagtctcatcaca

SEQ ID NO: 86179 - DNA, 25 bp, mus musculus
tatttcactaaaagtctcatcacaa

SEQ ID NO: 86180 - DNA, 25 bp, mus musculus
gcaccttcaccaaattcattaccac

SEQ ID NO: 86181 - DNA, 25 bp, mus musculus
gttaaacttattatcacccatatag

SEQ ID NO: 86182 - DNA, 25 bp, mus musculus
ttaaacttattatcacccatatagt

SEQ ID NO: 86183 - DNA, 25 bp, mus musculus
taaacttattatcacccatatagtg

SEQ ID NO: 86184 - DNA, 25 bp, mus musculus
aaacttattatcacccatatagtgc

SEQ ID NO: 86185 - DNA, 25 bp, mus musculus
acccgtggctctgtctgcttttaga

SEQ ID NO: 86186 - DNA, 25 bp, mus musculus
ggctctgtctgcttttagagcagaa

SEQ ID NO: 86187 - DNA, 25 bp, mus musculus
gacagtgtattcctcccaggtctct

SEQ ID NO: 86188 - DNA, 25 bp, mus musculus
accgggccattttccacatctgcat

SEQ ID NO: 86189 - DNA, 25 bp, mus musculus
ccattttccacatctgcatcagaag

SEQ ID NO: 86190 - DNA, 25 bp, mus musculus
tccacatctgcatcagaagagatgc

SEQ ID NO: 86191 - DNA, 25 bp, mus musculus
cctcccatgttagtatctgataata

SEQ ID NO: 86192 - DNA, 25 bp, mus musculus
gataatatcagtctctccttatcag

SEQ ID NO: 86193 - DNA, 25 bp, mus musculus
atcagtctctccttatcagaggaga

SEQ ID NO: 86194 - DNA, 25 bp, mus musculus
ctctccttatcagaggagagacctt

SEQ ID NO: 86195 - DNA, 25 bp, mus musculus
atgactacagacctatttttagata

SEQ ID NO: 86196 - DNA, 25 bp, mus musculus
catcttccagtattgggaaggttat

SEQ ID NO: 86197 - DNA, 25 bp, mus musculus
agtgccaacaccttggcctgcacct

SEQ ID NO: 86198 - DNA, 25 bp, mus musculus
aacaccttggcctgcacctggtgag

SEQ ID NO: 86199 - DNA, 25 bp, mus musculus
tggtgagtccagcctgctctcagcg

SEQ ID NO: 86200 - DNA, 25 bp, mus musculus
ctcagcggtctgcctgagaatacat

SEQ ID NO: 86201 - DNA, 25 bp, mus musculus
aatacatcaggggcctctgaagagg

SEQ ID NO: 86202 - DNA, 25 bp, mus musculus
gttgggtgtcctgcaggttactata

SEQ ID NO: 86203 - DNA, 25 bp, mus musculus
tgtcctgcaggttactataccttga

SEQ ID NO: 86204 - DNA, 25 bp, mus musculus
ctttggatctgctttgtgcttggct

SEQ ID NO: 86205 - DNA, 25 bp, mus musculus
tgtctgtgtatgtgttctgagaagg

SEQ ID NO: 86206 - DNA, 25 bp, mus musculus
gaaactattcctagctccagttcta

SEQ ID NO: 86207 - DNA, 25 bp, mus musculus
gaactcaattctagcactacatggt

SEQ ID NO: 86208 - DNA, 25 bp, mus musculus
tgctcacggccactgtctgtaacac

SEQ ID NO: 86209 - DNA, 25 bp, mus musculus
cggccactgtctgtaacacccagtc

SEQ ID NO: 86210 - DNA, 25 bp, mus musculus
ttcgagcctctgcaggcactaggca

SEQ ID NO: 86211 - DNA, 25 bp, mus musculus
cctctgcaggcactaggcatggatg

SEQ ID NO: 86212 - DNA, 25 bp, mus musculus
tatgcaggcaaaacacccatgcact

SEQ ID NO: 86213 - DNA, 25 bp, mus musculus
ggcaaaacacccatgcactgacttt

SEQ ID NO: 86214 - DNA, 25 bp, mus musculus
acacccatgcactgacttttaagaa

SEQ ID NO: 86215 - DNA, 25 bp, mus musculus
ctagtctgattcctttcaatttgtc

SEQ ID NO: 86216 - DNA, 25 bp, mus musculus
atagcctagtctgtcttaaattcag

SEQ ID NO: 86217 - DNA, 25 bp, mus musculus
agctccagttctaggggatctgatc

SEQ ID NO: 86218 - DNA, 25 bp, mus musculus
tctgatctctcttctgacctctaca

SEQ ID NO: 86219 - DNA, 25 bp, mus musculus
tctgacctctacaggcaaaattagg

SEQ ID NO: 86220 - DNA, 25 bp, mus musculus
gcacccctgtggtgcacatatatgc

SEQ ID NO: 86221 - DNA, 25 bp, mus musculus
tatatgcacgccaaacacatgaagt

SEQ ID NO: 86222 - DNA, 25 bp, mus musculus
cacgccaaacacatgaagttacaaa

SEQ ID NO: 86223 - DNA, 25 bp, mus musculus
gctcttcccaggaacctagaactca

SEQ ID NO: 86224 - DNA, 25 bp, mus musculus
aacctagaactcaattctagcacta

SEQ ID NO: 86225 - DNA, 25 bp, mus musculus
ttatgtttggtgatccggttcgcca

SEQ ID NO: 86226 - DNA, 25 bp, mus musculus
tgtttggtgatccggttcgccagcc

SEQ ID NO: 86227 - DNA, 25 bp, mus musculus
gctcaacgtatctgcagtctcgcta

SEQ ID NO: 86228 - DNA, 25 bp, mus musculus
caacgtatctgcagtctcgctacta

SEQ ID NO: 86229 - DNA, 25 bp, mus musculus
cgtatctgcagtctcgctactacag

SEQ ID NO: 86230 - DNA, 25 bp, mus musculus
atctgcagtctcgctactacagagc

SEQ ID NO: 86231 - DNA, 25 bp, mus musculus
ctcgctactacagagctgcagagat

SEQ ID NO: 86232 - DNA, 25 bp, mus musculus
gctactacagagctgcagagattat

SEQ ID NO: 86233 - DNA, 25 bp, mus musculus
tggggttgccgttttgtgaagccat

SEQ ID NO: 86234 - DNA, 25 bp, mus musculus
ccatagacatgtggtcactgggatg

SEQ ID NO: 86235 - DNA, 25 bp, mus musculus
tagacatgtggtcactgggatgcgt

SEQ ID NO: 86236 - DNA, 25 bp, mus musculus
acatgtggtcactgggatgcgtgat

SEQ ID NO: 86237 - DNA, 25 bp, mus musculus
ttggtgatccggttcgccagccgta

SEQ ID NO: 86238 - DNA, 25 bp, mus musculus
gccagccgtacagggttaaagtgat

SEQ ID NO: 86239 - DNA, 25 bp, mus musculus
tagactgtggatcggccagtcatgt

SEQ ID NO: 86240 - DNA, 25 bp, mus musculus
actgtggatcggccagtcatgtatc

SEQ ID NO: 86241 - DNA, 25 bp, mus musculus
gtggatcggccagtcatgtatcaaa

SEQ ID NO: 86242 - DNA, 25 bp, mus musculus
gatcggccagtcatgtatcaaagac

SEQ ID NO: 86243 - DNA, 25 bp, mus musculus
agactgtgtgctcaacgtatctgca

SEQ ID NO: 86244 - DNA, 25 bp, mus musculus
tgtgctcaacgtatctgcagtctcg

SEQ ID NO: 86245 - DNA, 25 bp, mus musculus
tgaagccagtccagcacttagcctg

SEQ ID NO: 86246 - DNA, 25 bp, mus musculus
cagtccagcacttagcctgggtcgc

SEQ ID NO: 86247 - DNA, 25 bp, mus musculus
tagacaaccgtcagcatgctcgcta

SEQ ID NO: 86248 - DNA, 25 bp, mus musculus
agcatgctcgctaaccacgtgtgtg

SEQ ID NO: 86249 - DNA, 25 bp, mus musculus
ctcgctaaccacgtgtgtgactggc

SEQ ID NO: 86250 - DNA, 25 bp, mus musculus
gtgtgtgactggcctcactggcatc

SEQ ID NO: 86251 - DNA, 25 bp, mus musculus
cctcactggcatctagctaacgggc

SEQ ID NO: 86252 - DNA, 25 bp, mus musculus
tggcatctagctaacgggccaaagg

SEQ ID NO: 86253 - DNA, 25 bp, mus musculus
gaataccagtgtcactctttatgtc

SEQ ID NO: 86254 - DNA, 25 bp, mus musculus
cagtgtcactctttatgtcttggct

SEQ ID NO: 86255 - DNA, 25 bp, mus musculus
cactctttatgtcttggctacagta

SEQ ID NO: 86256 - DNA, 25 bp, mus musculus
ttatgtcttggctacagtaccgagc

SEQ ID NO: 86257 - DNA, 25 bp, mus musculus
ttcagacggtcaagcaagtgcaaag

SEQ ID NO: 86258 - DNA, 25 bp, mus musculus
cctaataaacttcacttcagctcac

SEQ ID NO: 86259 - DNA, 25 bp, mus musculus
attacaccattctactccacgacat

SEQ ID NO: 86260 - DNA, 25 bp, mus musculus
tactccacgacattgcatcgcagga

SEQ ID NO: 86261 - DNA, 25 bp, mus musculus
acgacattgcatcgcaggagattat

SEQ ID NO: 86262 - DNA, 25 bp, mus musculus
ttccctggcaaatgcaagtcctgtg

SEQ ID NO: 86263 - DNA, 25 bp, mus musculus
tgcaagtcctgtggcatccacagta

SEQ ID NO: 86264 - DNA, 25 bp, mus musculus
tcctgtggcatccacagtacggcac

SEQ ID NO: 86265 - DNA, 25 bp, mus musculus
aacccgtagacaaccgtcagcatgc

SEQ ID NO: 86266 - DNA, 25 bp, mus musculus
tgtccgctccacactgtcctgaaac

SEQ ID NO: 86267 - DNA, 25 bp, mus musculus
ccgctccacactgtcctgaaactga

SEQ ID NO: 86268 - DNA, 25 bp, mus musculus
aatcggtgagcacacaccgtgagag

SEQ ID NO: 86269 - DNA, 25 bp, mus musculus
atcggtgagcacacaccgtgagagg

SEQ ID NO: 86270 - DNA, 25 bp, mus musculus
cggtgagcacacaccgtgagaggtc

SEQ ID NO: 86271 - DNA, 25 bp, mus musculus
ggtgagcacacaccgtgagaggtca

SEQ ID NO: 86272 - DNA, 25 bp, mus musculus
gtgagcacacaccgtgagaggtcag

SEQ ID NO: 86273 - DNA, 25 bp, mus musculus
gagcacacaccgtgagaggtcagag

SEQ ID NO: 86274 - DNA, 25 bp, mus musculus
agcacacaccgtgagaggtcagagg

SEQ ID NO: 86275 - DNA, 25 bp, mus musculus
gcacacaccgtgagaggtcagaggc

SEQ ID NO: 86276 - DNA, 25 bp, mus musculus
acacaccgtgagaggtcagaggctg

SEQ ID NO: 86277 - DNA, 25 bp, mus musculus
cacaccgtgagaggtcagaggctgt

SEQ ID NO: 86278 - DNA, 25 bp, mus musculus
cgctccacactgtcctgaaactgac

SEQ ID NO: 86279 - DNA, 25 bp, mus musculus
gctccacactgtcctgaaactgaca

SEQ ID NO: 86280 - DNA, 25 bp, mus musculus
actgtcctgaaactgacacctgtgg

SEQ ID NO: 86281 - DNA, 25 bp, mus musculus
ctgtcctgaaactgacacctgtggc

SEQ ID NO: 86282 - DNA, 25 bp, mus musculus
tcctgaaactgacacctgtggcata

SEQ ID NO: 86283 - DNA, 25 bp, mus musculus
cctgaaactgacacctgtggcatat

SEQ ID NO: 86284 - DNA, 25 bp, mus musculus
agtccatttacttgaatgtagaatc

SEQ ID NO: 86285 - DNA, 25 bp, mus musculus
gtccatttacttgaatgtagaatcg

SEQ ID NO: 86286 - DNA, 25 bp, mus musculus
caccgaggcctgtctagagctggcc

SEQ ID NO: 86287 - DNA, 25 bp, mus musculus
agatgcttttgacgtggcaagtttc

SEQ ID NO: 86288 - DNA, 25 bp, mus musculus
tcagctctacatacagatcattgag

SEQ ID NO: 86289 - DNA, 25 bp, mus musculus
agagcccccagatgatgatgatgca

SEQ ID NO: 86290 - DNA, 25 bp, mus musculus
aatgttgctgaagtgcctggagacc

SEQ ID NO: 86291 - DNA, 25 bp, mus musculus
gtgcctggagacctttgacgatctg

SEQ ID NO: 86292 - DNA, 25 bp, mus musculus
ggagacctttgacgatctgtaaagc

SEQ ID NO: 86293 - DNA, 25 bp, mus musculus
aataccagtagctagagttatactg

SEQ ID NO: 86294 - DNA, 25 bp, mus musculus
tatactgccttgtctttcaagactc

SEQ ID NO: 86295 - DNA, 25 bp, mus musculus
gccttgtctttcaagactcattgag

SEQ ID NO: 86296 - DNA, 25 bp, mus musculus
tctttcaagactcattgagaaaggc

SEQ ID NO: 86297 - DNA, 25 bp, mus musculus
ctgcttccaaaagccttcttgatgt

SEQ ID NO: 86298 - DNA, 25 bp, mus musculus
tgaggcccagcatatgtctaacatc

SEQ ID NO: 86299 - DNA, 25 bp, mus musculus
ccagcatatgtctaacatcagcgct

SEQ ID NO: 86300 - DNA, 25 bp, mus musculus
tatgtctaacatcagcgctatgttt

SEQ ID NO: 86301 - DNA, 25 bp, mus musculus
taacatcagcgctatgtttgccacc

SEQ ID NO: 86302 - DNA, 25 bp, mus musculus
cagcgctatgtttgccacctgcaac

SEQ ID NO: 86303 - DNA, 25 bp, mus musculus
tatgtttgccacctgcaactcagaa

SEQ ID NO: 86304 - DNA, 25 bp, mus musculus
tgccacctgcaactcagaaaatcca

SEQ ID NO: 86305 - DNA, 25 bp, mus musculus
gaaatttcagctctacatacagatc

SEQ ID NO: 86306 - DNA, 25 bp, mus musculus
gagatgattcgcccaggcgtgtctt

SEQ ID NO: 86307 - DNA, 25 bp, mus musculus
agatgattcgcccaggcgtgtcttc

SEQ ID NO: 86308 - DNA, 25 bp, mus musculus
ctagacatcagtggtgtgaattgtt

SEQ ID NO: 86309 - DNA, 25 bp, mus musculus
acatgtggctcagagcaaaggcgtg

SEQ ID NO: 86310 - DNA, 25 bp, mus musculus
catgtggctcagagcaaaggcgtgg

SEQ ID NO: 86311 - DNA, 25 bp, mus musculus
tggctcagagcaaaggcgtggagtt

SEQ ID NO: 86312 - DNA, 25 bp, mus musculus
tggagttctagcgtctcaagtaccc

SEQ ID NO: 86313 - DNA, 25 bp, mus musculus
ggagttctagcgtctcaagtaccct

SEQ ID NO: 86314 - DNA, 25 bp, mus musculus
gagttctagcgtctcaagtacccta

SEQ ID NO: 86315 - DNA, 25 bp, mus musculus
tgtaggccgcactagacatcagtgg

SEQ ID NO: 86316 - DNA, 25 bp, mus musculus
gtaggccgcactagacatcagtggt

SEQ ID NO: 86317 - DNA, 25 bp, mus musculus
taggccgcactagacatcagtggtg

SEQ ID NO: 86318 - DNA, 25 bp, mus musculus
aggccgcactagacatcagtggtgt

SEQ ID NO: 86319 - DNA, 25 bp, mus musculus
ggccgcactagacatcagtggtgtg

SEQ ID NO: 86320 - DNA, 25 bp, mus musculus
gccgcactagacatcagtggtgtga

SEQ ID NO: 86321 - DNA, 25 bp, mus musculus
ccgcactagacatcagtggtgtgaa

SEQ ID NO: 86322 - DNA, 25 bp, mus musculus
cgcactagacatcagtggtgtgaat

SEQ ID NO: 86323 - DNA, 25 bp, mus musculus
gttacctctgaagctcccaagaggc

SEQ ID NO: 86324 - DNA, 25 bp, mus musculus
tctgaagctcccaagaggcctggcc

SEQ ID NO: 86325 - DNA, 25 bp, mus musculus
tgagacaggccatcatgaggcatgc

SEQ ID NO: 86326 - DNA, 25 bp, mus musculus
ggcatgcagctcaattgtctatgtc

SEQ ID NO: 86327 - DNA, 25 bp, mus musculus
cagctcaattgtctatgtccccagc

SEQ ID NO: 86328 - DNA, 25 bp, mus musculus
caccgatgctatttattcagtttgg

SEQ ID NO: 86329 - DNA, 25 bp, mus musculus
aagtagctctgatcctgatggcaag

SEQ ID NO: 86330 - DNA, 25 bp, mus musculus
ctctgatcctgatggcaagaccttg

SEQ ID NO: 86331 - DNA, 25 bp, mus musculus
tcctgatggcaagaccttggctgtc

SEQ ID NO: 86332 - DNA, 25 bp, mus musculus
tggcaagaccttggctgtcaaagca

SEQ ID NO: 86333 - DNA, 25 bp, mus musculus
gaccttggctgtcaaagcaggactg

SEQ ID NO: 86334 - DNA, 25 bp, mus musculus
tctcgcctgtcatttgaataaacag

SEQ ID NO: 86335 - DNA, 25 bp, mus musculus
gctcccaagaggcctggccacttat

SEQ ID NO: 86336 - DNA, 25 bp, mus musculus
aagaggcctggccacttatggcctc

SEQ ID NO: 86337 - DNA, 25 bp, mus musculus
cttgtgagctggtgtgcaccgagca

SEQ ID NO: 86338 - DNA, 25 bp, mus musculus
ccgagcagcagctgttccactccgg

SEQ ID NO: 86339 - DNA, 25 bp, mus musculus
agcagctgttccactccgggcttgt

SEQ ID NO: 86340 - DNA, 25 bp, mus musculus
actccgggcttgtgctaaccacctg

SEQ ID NO: 86341 - DNA, 25 bp, mus musculus
ggcttgtgctaaccacctgttctgg

SEQ ID NO: 86342 - DNA, 25 bp, mus musculus
tgctaaccacctgttctggggccag

SEQ ID NO: 86343 - DNA, 25 bp, mus musculus
gccttggccgatcttctgcttgtca

SEQ ID NO: 86344 - DNA, 25 bp, mus musculus
gcccgcttgctgtacccttacctgg

SEQ ID NO: 86345 - DNA, 25 bp, mus musculus
tcatgctttcatgaccattgggcct

SEQ ID NO: 86346 - DNA, 25 bp, mus musculus
tttcatgaccattgggcctgctggt

SEQ ID NO: 86347 - DNA, 25 bp, mus musculus
gaccattgggcctgctggtctacct

SEQ ID NO: 86348 - DNA, 25 bp, mus musculus
tctacctggtcttagcccaggaagc

SEQ ID NO: 86349 - DNA, 25 bp, mus musculus
agtctcctgcagacacagttatacc

SEQ ID NO: 86350 - DNA, 25 bp, mus musculus
acacagttatacctgcctttctgca

SEQ ID NO: 86351 - DNA, 25 bp, mus musculus
ttatacctgcctttctgcactgctc

SEQ ID NO: 86352 - DNA, 25 bp, mus musculus
ttctgcactgctccaggcatgccct

SEQ ID NO: 86353 - DNA, 25 bp, mus musculus
ccaggcatgcccttagagcatggtg

SEQ ID NO: 86354 - DNA, 25 bp, mus musculus
gtacccggatcctcgaatcgaggat

SEQ ID NO: 86355 - DNA, 25 bp, mus musculus
tacccttacctggcctggctggctt

SEQ ID NO: 86356 - DNA, 25 bp, mus musculus
tacctggcctggctggcttttgcca

SEQ ID NO: 86357 - DNA, 25 bp, mus musculus
ctggcttttgccaccgtgctcaact

SEQ ID NO: 86358 - DNA, 25 bp, mus musculus
accgtgctcaactactatgtatggc

SEQ ID NO: 86359 - DNA, 25 bp, mus musculus
ctcaactactatgtatggcgtgata

SEQ ID NO: 86360 - DNA, 25 bp, mus musculus
tgaaggcacccagccatcaggaatg

SEQ ID NO: 86361 - DNA, 25 bp, mus musculus
gccaggcaccatgggtggcagccat

SEQ ID NO: 86362 - DNA, 25 bp, mus musculus
caccatgggtggcagccatcatgct

SEQ ID NO: 86363 - DNA, 25 bp, mus musculus
tgtaacatttatgcacctggaagcc

SEQ ID NO: 86364 - DNA, 25 bp, mus musculus
atttatgcacctggaagccttaaga

SEQ ID NO: 86365 - DNA, 25 bp, mus musculus
gagccacttcttactgttaacaaat

SEQ ID NO: 86366 - DNA, 25 bp, mus musculus
cctacatgtcccctgtatcttcaaa

SEQ ID NO: 86367 - DNA, 25 bp, mus musculus
tgtcccctgtatcttcaaaacgtca

SEQ ID NO: 86368 - DNA, 25 bp, mus musculus
ctgtatcttcaaaacgtcaacattt

SEQ ID NO: 86369 - DNA, 25 bp, mus musculus
tctgtctgtcagggtaccccttcac

SEQ ID NO: 86370 - DNA, 25 bp, mus musculus
tgtcagggtaccccttcactgtgct

SEQ ID NO: 86371 - DNA, 25 bp, mus musculus
ccttcactgtgcttccatgggctat

SEQ ID NO: 86372 - DNA, 25 bp, mus musculus
ccagacttagcgtgctgcagctcaa

SEQ ID NO: 86373 - DNA, 25 bp, mus musculus
catgaaaatcaccactgcctgtgct

SEQ ID NO: 86374 - DNA, 25 bp, mus musculus
aatcaccactgcctgtgctggtgcc

SEQ ID NO: 86375 - DNA, 25 bp, mus musculus
actagtgcgctgtgaagtctctacc

SEQ ID NO: 86376 - DNA, 25 bp, mus musculus
tgaagtctctacccgctttgacatg

SEQ ID NO: 86377 - DNA, 25 bp, mus musculus
ctctacccgctttgacatgggtggc

SEQ ID NO: 86378 - DNA, 25 bp, mus musculus
ccagccacgaagtactgatgcgggg

SEQ ID NO: 86379 - DNA, 25 bp, mus musculus
gcgtccatgtacttgtgttcaaaaa

SEQ ID NO: 86380 - DNA, 25 bp, mus musculus
gtaaggcctagcagcagatgtcatc

SEQ ID NO: 86381 - DNA, 25 bp, mus musculus
cctagcagcagatgtcatcagtgag

SEQ ID NO: 86382 - DNA, 25 bp, mus musculus
ggtcacgagccacttcttactgtta

SEQ ID NO: 86383 - DNA, 25 bp, mus musculus
tttccatgctatgccctcggagatc

SEQ ID NO: 86384 - DNA, 25 bp, mus musculus
tgctatgccctcggagatcttcacc

SEQ ID NO: 86385 - DNA, 25 bp, mus musculus
ccatctagaatctcacgactcagag

SEQ ID NO: 86386 - DNA, 25 bp, mus musculus
agaatctcacgactcagagaccatc

SEQ ID NO: 86387 - DNA, 25 bp, mus musculus
tgagtgtcctggtcacaccacctgg

SEQ ID NO: 86388 - DNA, 25 bp, mus musculus
tcacaccacctggctgagctcaaaa

SEQ ID NO: 86389 - DNA, 25 bp, mus musculus
gcatatccccaagagtccaggagct

SEQ ID NO: 86390 - DNA, 25 bp, mus musculus
ccccaagagtccaggagctgagagc

SEQ ID NO: 86391 - DNA, 25 bp, mus musculus
tgagagccatgccccttaaaacagc

SEQ ID NO: 86392 - DNA, 25 bp, mus musculus
ctcttggacacacacagccttggtg

SEQ ID NO: 86393 - DNA, 25 bp, mus musculus
gacacacacagccttggtgcctcta

SEQ ID NO: 86394 - DNA, 25 bp, mus musculus
gcctctaggttccagcctgcattta

SEQ ID NO: 86395 - DNA, 25 bp, mus musculus
ggagatcttcaccttcctgcgcatg

SEQ ID NO: 86396 - DNA, 25 bp, mus musculus
tcgcgtgcacacaggcacctgcaat

SEQ ID NO: 86397 - DNA, 25 bp, mus musculus
accaggcctgccatgggtgtctcga

SEQ ID NO: 86398 - DNA, 25 bp, mus musculus
ttccttgaccttgccattatggctg

SEQ ID NO: 86399 - DNA, 25 bp, mus musculus
gaccttgccattatggctgctgtca

SEQ ID NO: 86400 - DNA, 25 bp, mus musculus
gccattatggctgctgtcactccct

SEQ ID NO: 86401 - DNA, 25 bp, mus musculus
agcacagatccaggtctcactcaga

SEQ ID NO: 86402 - DNA, 25 bp, mus musculus
aaactcagccatgaagcaccatcta

SEQ ID NO: 86403 - DNA, 25 bp, mus musculus
tctctaatctctactctccaacaat

SEQ ID NO: 86404 - DNA, 25 bp, mus musculus
taatctctactctccaacaatgaag

SEQ ID NO: 86405 - DNA, 25 bp, mus musculus
tgaactgcctatcggaacatagcat

SEQ ID NO: 86406 - DNA, 25 bp, mus musculus
aactgcctatcggaacatagcatga

SEQ ID NO: 86407 - DNA, 25 bp, mus musculus
gcctatcggaacatagcatgaccat

SEQ ID NO: 86408 - DNA, 25 bp, mus musculus
atagcatgaccatagcgcgaggacg

SEQ ID NO: 86409 - DNA, 25 bp, mus musculus
agcatgaccatagcgcgaggacgcg

SEQ ID NO: 86410 - DNA, 25 bp, mus musculus
catcgaccgaaaagcctcttagaat

SEQ ID NO: 86411 - DNA, 25 bp, mus musculus
acagctacacgcgcctgcaggaaca

SEQ ID NO: 86412 - DNA, 25 bp, mus musculus
agctacacgcgcctgcaggaacagg

SEQ ID NO: 86413 - DNA, 25 bp, mus musculus
acgcgcctgcaggaacaggtgacga

SEQ ID NO: 86414 - DNA, 25 bp, mus musculus
tgtaatagactacatccacagcctt

SEQ ID NO: 86415 - DNA, 25 bp, mus musculus
atctctactctccaacaatgaaggc

SEQ ID NO: 86416 - DNA, 25 bp, mus musculus
ctactctccaacaatgaaggcgcag

SEQ ID NO: 86417 - DNA, 25 bp, mus musculus
actctccaacaatgaaggcgcagag

SEQ ID NO: 86418 - DNA, 25 bp, mus musculus
gagaccaaatgcgcaactactacga

SEQ ID NO: 86419 - DNA, 25 bp, mus musculus
gaccaaatgcgcaactactacgaga

SEQ ID NO: 86420 - DNA, 25 bp, mus musculus
aaatgcgcaactactacgagacggt

SEQ ID NO: 86421 - DNA, 25 bp, mus musculus
atgcgcaactactacgagacggtga

SEQ ID NO: 86422 - DNA, 25 bp, mus musculus
gcaactactacgagacggtgaactg

SEQ ID NO: 86423 - DNA, 25 bp, mus musculus
cctgctgagtttcagctgctctatc

SEQ ID NO: 86424 - DNA, 25 bp, mus musculus
cagctgctctatcgaatgcatgggg

SEQ ID NO: 86425 - DNA, 25 bp, mus musculus
aaagcctgtctgccacttacaagga

SEQ ID NO: 86426 - DNA, 25 bp, mus musculus
tcttttgcactgctctttgaatggt

SEQ ID NO: 86427 - DNA, 25 bp, mus musculus
gcactgctctttgaatggtcttaac

SEQ ID NO: 86428 - DNA, 25 bp, mus musculus
attgaagccgtgtgatttagacttg

SEQ ID NO: 86429 - DNA, 25 bp, mus musculus
ataataaaccgactcccatgtgaat

SEQ ID NO: 86430 - DNA, 25 bp, mus musculus
aaccgactcccatgtgaatgaggaa

SEQ ID NO: 86431 - DNA, 25 bp, mus musculus
cctctctactttgatatagtcctca

SEQ ID NO: 86432 - DNA, 25 bp, mus musculus
gatatagtcctcacaaccagggagc

SEQ ID NO: 86433 - DNA, 25 bp, mus musculus
gtcctcacaaccagggagctctggc

SEQ ID NO: 86434 - DNA, 25 bp, mus musculus
ctttagccaaggggatcagaatctt

SEQ ID NO: 86435 - DNA, 25 bp, mus musculus
actctgtcacactgtgcctaagaac

SEQ ID NO: 86436 - DNA, 25 bp, mus musculus
tgtgcctaagaactccaaatggaaa

SEQ ID NO: 86437 - DNA, 25 bp, mus musculus
aatagtctccagaacagaacccata

SEQ ID NO: 86438 - DNA, 25 bp, mus musculus
ctccagaacagaacccatagacaat

SEQ ID NO: 86439 - DNA, 25 bp, mus musculus
aacagaacccatagacaatctggca

SEQ ID NO: 86440 - DNA, 25 bp, mus musculus
acccatagacaatctggcaaagcct

SEQ ID NO: 86441 - DNA, 25 bp, mus musculus
agacaatctggcaaagcctgtctgc

SEQ ID NO: 86442 - DNA, 25 bp, mus musculus
tctggcaaagcctgtctgccactta

SEQ ID NO: 86443 - DNA, 25 bp, mus musculus
cctccctgagcatgcacgatggtat

SEQ ID NO: 86444 - DNA, 25 bp, mus musculus
ttctcagctcttcacgaactcagct

SEQ ID NO: 86445 - DNA, 25 bp, mus musculus
aggcccctgcagagaccacatctgc

SEQ ID NO: 86446 - DNA, 25 bp, mus musculus
ctgcagagaccacatctgccatgaa

SEQ ID NO: 86447 - DNA, 25 bp, mus musculus
gcacttaccatactctgccttgtat

SEQ ID NO: 86448 - DNA, 25 bp, mus musculus
cttgtattatagctccttgtgcact

SEQ ID NO: 86449 - DNA, 25 bp, mus musculus
ctccttgtgcacttgtcctatgtct

SEQ ID NO: 86450 - DNA, 25 bp, mus musculus
ttttattcatctgtatccatcacag

SEQ ID NO: 86451 - DNA, 25 bp, mus musculus
gtatccatcacagcattaggcgtgg

SEQ ID NO: 86452 - DNA, 25 bp, mus musculus
atcacagcattaggcgtggtgcata

SEQ ID NO: 86453 - DNA, 25 bp, mus musculus
gcattaggcgtggtgcatagcacac

SEQ ID NO: 86454 - DNA, 25 bp, mus musculus
gtgcatagcacacaacagttgctca

SEQ ID NO: 86455 - DNA, 25 bp, mus musculus
gctcttcacgaactcagctaagatc

SEQ ID NO: 86456 - DNA, 25 bp, mus musculus
ctcagctaagatctcctgacccaca

SEQ ID NO: 86457 - DNA, 25 bp, mus musculus
atcaggtcccttcatagcctgcact

SEQ ID NO: 86458 - DNA, 25 bp, mus musculus
catagcctgcactggccaatccaga

SEQ ID NO: 86459 - DNA, 25 bp, mus musculus
ctgcactggccaatccagaagagtt

SEQ ID NO: 86460 - DNA, 25 bp, mus musculus
tgtgcctttggccttgcagttcgca

SEQ ID NO: 86461 - DNA, 25 bp, mus musculus
cttgcagttcgcatcttctggatca

SEQ ID NO: 86462 - DNA, 25 bp, mus musculus
gttcgcatcttctggatcattcttg

SEQ ID NO: 86463 - DNA, 25 bp, mus musculus
tcggatccatggacttatctgcaga

SEQ ID NO: 86464 - DNA, 25 bp, mus musculus
ccatggacttatctgcagagtttcc

SEQ ID NO: 86465 - DNA, 25 bp, mus musculus
tgccccctggcaaggaaggagacat

SEQ ID NO: 86466 - DNA, 25 bp, mus musculus
ccccctggcaaggaaggagacatag

SEQ ID NO: 86467 - DNA, 25 bp, mus musculus
aagcccatctggcctatcggcatgt

SEQ ID NO: 86468 - DNA, 25 bp, mus musculus
gcccatctggcctatcggcatgttc

SEQ ID NO: 86469 - DNA, 25 bp, mus musculus
ccatctggcctatcggcatgttctc

SEQ ID NO: 86470 - DNA, 25 bp, mus musculus
atctggcctatcggcatgttctctg

SEQ ID NO: 86471 - DNA, 25 bp, mus musculus
catgttctctggatatgtggacaat

SEQ ID NO: 86472 - DNA, 25 bp, mus musculus
tgttctctggatatgtggacaatcc

SEQ ID NO: 86473 - DNA, 25 bp, mus musculus
atgtggacaatcccaagaagacaca

SEQ ID NO: 86474 - DNA, 25 bp, mus musculus
atattcgaggagacttttggcttat

SEQ ID NO: 86475 - DNA, 25 bp, mus musculus
atggacttatctgcagagtttccag

SEQ ID NO: 86476 - DNA, 25 bp, mus musculus
ttatctgcagagtttccaggacaat

SEQ ID NO: 86477 - DNA, 25 bp, mus musculus
atctgcagagtttccaggacaatga

SEQ ID NO: 86478 - DNA, 25 bp, mus musculus
tcaaaccaggctacctgggaacagc

SEQ ID NO: 86479 - DNA, 25 bp, mus musculus
ctgggaacagcctttgctcactatg

SEQ ID NO: 86480 - DNA, 25 bp, mus musculus
acagcctttgctcactatgatgtac

SEQ ID NO: 86481 - DNA, 25 bp, mus musculus
agcctttgctcactatgatgtacag

SEQ ID NO: 86482 - DNA, 25 bp, mus musculus
tttgctcactatgatgtacaggtca

SEQ ID NO: 86483 - DNA, 25 bp, mus musculus
gcgctgccgaatttcttcacctgca

SEQ ID NO: 86484 - DNA, 25 bp, mus musculus
ccgaatttcttcacctgcaagatat

SEQ ID NO: 86485 - DNA, 25 bp, mus musculus
aacgtgtcaccatcagctaccattg

SEQ ID NO: 86486 - DNA, 25 bp, mus musculus
accattgtgccctcatgcataaatg

SEQ ID NO: 86487 - DNA, 25 bp, mus musculus
gtgccctcatgcataaatgaagtcc

SEQ ID NO: 86488 - DNA, 25 bp, mus musculus
atctctacacactaagccgaaaaca

SEQ ID NO: 86489 - DNA, 25 bp, mus musculus
cttaatttgagcctggctgttttga

SEQ ID NO: 86490 - DNA, 25 bp, mus musculus
ttgagcctggctgttttgaaaattg

SEQ ID NO: 86491 - DNA, 25 bp, mus musculus
tcaccgcaaaacaatctaaagtcat

SEQ ID NO: 86492 - DNA, 25 bp, mus musculus
aatctaaagtcatctacaggccaac

SEQ ID NO: 86493 - DNA, 25 bp, mus musculus
tgtttgttgcttgccaaacttccaa

SEQ ID NO: 86494 - DNA, 25 bp, mus musculus
ttgcttgccaaacttccaataaatt

SEQ ID NO: 86495 - DNA, 25 bp, mus musculus
ttcttcacctgcaagatattcttca

SEQ ID NO: 86496 - DNA, 25 bp, mus musculus
ccaaacttccaataaattctgcttg

SEQ ID NO: 86497 - DNA, 25 bp, mus musculus
acctgcaagatattcttcaggagga

SEQ ID NO: 86498 - DNA, 25 bp, mus musculus
acagagtcagcagtaccgatgatga

SEQ ID NO: 86499 - DNA, 25 bp, mus musculus
tcagcagtaccgatgatgaggacac

SEQ ID NO: 86500 - DNA, 25 bp, mus musculus
aggacacttgccaagctggatgtac

SEQ ID NO: 86501 - DNA, 25 bp, mus musculus
cttgccaagctggatgtactgaaga

SEQ ID NO: 86502 - DNA, 25 bp, mus musculus
atcagaacccacaagctgaccaaga

SEQ ID NO: 86503 - DNA, 25 bp, mus musculus
tgaacccaactgattaagcaggcag

SEQ ID NO: 86504 - DNA, 25 bp, mus musculus
tcctgtcccagcaatttgtcgagct

SEQ ID NO: 86505 - DNA, 25 bp, mus musculus
aatttgtcgagctcatcaacaagtg

SEQ ID NO: 86506 - DNA, 25 bp, mus musculus
agaacatcctgagctcggccgacta

SEQ ID NO: 86507 - DNA, 25 bp, mus musculus
tcctgagctcggccgactacgtgga

SEQ ID NO: 86508 - DNA, 25 bp, mus musculus
agcacgtcaagatagccctagagaa

SEQ ID NO: 86509 - DNA, 25 bp, mus musculus
aagtcatgattgccatctgtgtctc

SEQ ID NO: 86510 - DNA, 25 bp, mus musculus
tgattgccatctgtgtctctgtcac

SEQ ID NO: 86511 - DNA, 25 bp, mus musculus
gtgtctctgtcactgttctcatctt

SEQ ID NO: 86512 - DNA, 25 bp, mus musculus
ctgttctcatcttggctgtcatcat

SEQ ID NO: 86513 - DNA, 25 bp, mus musculus
tcatcttggctgtcatcattggcat

SEQ ID NO: 86514 - DNA, 25 bp, mus musculus
tggctgtcatcattggcatcaccat

SEQ ID NO: 86515 - DNA, 25 bp, mus musculus
tcatcattggcatcaccataaccgt

SEQ ID NO: 86516 - DNA, 25 bp, mus musculus
tcgagctcatcaacaagtgcaactc

SEQ ID NO: 86517 - DNA, 25 bp, mus musculus
tggcatcaccataaccgttggataa

SEQ ID NO: 86518 - DNA, 25 bp, mus musculus
tcatcaacaagtgcaactcaatgca

SEQ ID NO: 86519 - DNA, 25 bp, mus musculus
caatgcagtccgaataccgagagaa

SEQ ID NO: 86520 - DNA, 25 bp, mus musculus
tcctgaaggacacgcaggtgactcg

SEQ ID NO: 86521 - DNA, 25 bp, mus musculus
tctctgcgcggcacagtgagatcca

SEQ ID NO: 86522 - DNA, 25 bp, mus musculus
gcagtatccgagagctccatgagat

SEQ ID NO: 86523 - DNA, 25 bp, mus musculus
tccgagagctccatgagatctttac

SEQ ID NO: 86524 - DNA, 25 bp, mus musculus
tgatcaaccgcatcgagaagaacat

SEQ ID NO: 86525 - DNA, 25 bp, mus musculus
ttttggtacccgagatgtctgcaag

SEQ ID NO: 86526 - DNA, 25 bp, mus musculus
agatgtctgcaaggagctgctccct

SEQ ID NO: 86527 - DNA, 25 bp, mus musculus
ggtgacagtcctgtccagaatcctt

SEQ ID NO: 86528 - DNA, 25 bp, mus musculus
cctgtccagaatccttgccaggaaa

SEQ ID NO: 86529 - DNA, 25 bp, mus musculus
gtccagaatccttgccaggaaactc

SEQ ID NO: 86530 - DNA, 25 bp, mus musculus
cagaatccttgccaggaaactcaat

SEQ ID NO: 86531 - DNA, 25 bp, mus musculus
aatccttgccaggaaactcaatgag

SEQ ID NO: 86532 - DNA, 25 bp, mus musculus
ccttgccaggaaactcaatgagcag

SEQ ID NO: 86533 - DNA, 25 bp, mus musculus
ggcccttttgcctccagatgcagag

SEQ ID NO: 86534 - DNA, 25 bp, mus musculus
ccttttgcctccagatgcagagggg

SEQ ID NO: 86535 - DNA, 25 bp, mus musculus
tttgcctccagatgcagaggggcct

SEQ ID NO: 86536 - DNA, 25 bp, mus musculus
agacttgctgaaggccaaggaaagc

SEQ ID NO: 86537 - DNA, 25 bp, mus musculus
caaggagctgctccctctaataaaa

SEQ ID NO: 86538 - DNA, 25 bp, mus musculus
tctaataaaaccccaaggcagagtg

SEQ ID NO: 86539 - DNA, 25 bp, mus musculus
gaatgtgtccagcatggtgagtctc

SEQ ID NO: 86540 - DNA, 25 bp, mus musculus
tgtgtccagcatggtgagtctcagg

SEQ ID NO: 86541 - DNA, 25 bp, mus musculus
gtccagcatggtgagtctcagggcc

SEQ ID NO: 86542 - DNA, 25 bp, mus musculus
aaactgcaggctggagctgcagcag

SEQ ID NO: 86543 - DNA, 25 bp, mus musculus
tcgaagcgagaccatcacagaggag

SEQ ID NO: 86544 - DNA, 25 bp, mus musculus
cgagaccatcacagaggaggagctg

SEQ ID NO: 86545 - DNA, 25 bp, mus musculus
tccatggagatgcccagctggctct

SEQ ID NO: 86546 - DNA, 25 bp, mus musculus
atgcccagctggctctgatcagcct

SEQ ID NO: 86547 - DNA, 25 bp, mus musculus
atttccaagtgctgacgcgggtcct

SEQ ID NO: 86548 - DNA, 25 bp, mus musculus
tccaagtgctgacgcgggtccttat

SEQ ID NO: 86549 - DNA, 25 bp, mus musculus
tccttatctcccgaagcgagagtga

SEQ ID NO: 86550 - DNA, 25 bp, mus musculus
tctcccgaagcgagagtgaccttct

SEQ ID NO: 86551 - DNA, 25 bp, mus musculus
accttctaagcattcgggctgagtt

SEQ ID NO: 86552 - DNA, 25 bp, mus musculus
ttctaagcattcgggctgagttcaa

SEQ ID NO: 86553 - DNA, 25 bp, mus musculus
taagcattcgggctgagttcaagaa

SEQ ID NO: 86554 - DNA, 25 bp, mus musculus
agtctctctattcttctcttcagga

SEQ ID NO: 86555 - DNA, 25 bp, mus musculus
tctattcttctcttcaggatgtagt

SEQ ID NO: 86556 - DNA, 25 bp, mus musculus
attcttctcttcaggatgtagtcag

SEQ ID NO: 86557 - DNA, 25 bp, mus musculus
ctctgatcagcctagcttccatgtt

SEQ ID NO: 86558 - DNA, 25 bp, mus musculus
tgatcagcctagcttccatgttgag

SEQ ID NO: 86559 - DNA, 25 bp, mus musculus
gaaacacagcgctgtactttgctaa

SEQ ID NO: 86560 - DNA, 25 bp, mus musculus
acacagcgctgtactttgctaacaa

SEQ ID NO: 86561 - DNA, 25 bp, mus musculus
tgtactttgctaacaaactccacca

SEQ ID NO: 86562 - DNA, 25 bp, mus musculus
aaactgagcctaatttccaagtgct

SEQ ID NO: 86563 - DNA, 25 bp, mus musculus
ctgagcctaatttccaagtgctgac

SEQ ID NO: 86564 - DNA, 25 bp, mus musculus
ctaatttccaagtgctgacgcgggt

SEQ ID NO: 86565 - DNA, 25 bp, mus musculus
catccccagatcagccatttacttt

SEQ ID NO: 86566 - DNA, 25 bp, mus musculus
cagatcagccatttactttgtctac

SEQ ID NO: 86567 - DNA, 25 bp, mus musculus
atgaattgccttttgaccgccatga

SEQ ID NO: 86568 - DNA, 25 bp, mus musculus
ttgaccgccatgactggatcatcaa

SEQ ID NO: 86569 - DNA, 25 bp, mus musculus
actggatcatcaatcgttgtggcac

SEQ ID NO: 86570 - DNA, 25 bp, mus musculus
tcatcaatcgttgtggcacagaagt

SEQ ID NO: 86571 - DNA, 25 bp, mus musculus
accagttcactatcctggatgtgcg

SEQ ID NO: 86572 - DNA, 25 bp, mus musculus
tcactatcctggatgtgcgtcctgc

SEQ ID NO: 86573 - DNA, 25 bp, mus musculus
tcctggatgtgcgtcctgcctttga

SEQ ID NO: 86574 - DNA, 25 bp, mus musculus
attcattctctgcagtatgggacag

SEQ ID NO: 86575 - DNA, 25 bp, mus musculus
tctctgcagtatgggacagaatgaa

SEQ ID NO: 86576 - DNA, 25 bp, mus musculus
cttggtggcgctggacttcgtaact

SEQ ID NO: 86577 - DNA, 25 bp, mus musculus
ttactttgtctacctcaagagagga

SEQ ID NO: 86578 - DNA, 25 bp, mus musculus
tgtctacctcaagagaggagtcatc

SEQ ID NO: 86579 - DNA, 25 bp, mus musculus
caattccaagagctgactctgagaa

SEQ ID NO: 86580 - DNA, 25 bp, mus musculus
gggaagcccttcatgctcatgagtg

SEQ ID NO: 86581 - DNA, 25 bp, mus musculus
cccttcatgctcatgagtgtccttg

SEQ ID NO: 86582 - DNA, 25 bp, mus musculus
atgctcatgagtgtccttgtggccc

SEQ ID NO: 86583 - DNA, 25 bp, mus musculus
atgagtgtccttgtggcccatcgtt

SEQ ID NO: 86584 - DNA, 25 bp, mus musculus
attcaccaagagcaagaattcgttc

SEQ ID NO: 86585 - DNA, 25 bp, mus musculus
cgagagccaacatcgactgggtgaa

SEQ ID NO: 86586 - DNA, 25 bp, mus musculus
ccaacatcgactgggtgaaggagaa

SEQ ID NO: 86587 - DNA, 25 bp, mus musculus
cagagctccagacaccagcatccta

SEQ ID NO: 86588 - DNA, 25 bp, mus musculus
caccagcatcctactctcaaggatg

SEQ ID NO: 86589 - DNA, 25 bp, mus musculus
tccagcctgtggagccagcctagct

SEQ ID NO: 86590 - DNA, 25 bp, mus musculus
agccagcctagctcctaactgtcag

SEQ ID NO: 86591 - DNA, 25 bp, mus musculus
cctagctcctaactgtcaggctgac

SEQ ID NO: 86592 - DNA, 25 bp, mus musculus
tcctaactgtcaggctgacggacac

SEQ ID NO: 86593 - DNA, 25 bp, mus musculus
ctcagggaagcccagctctgaagct

SEQ ID NO: 86594 - DNA, 25 bp, mus musculus
agagactccctgaatgctttactat

SEQ ID NO: 86595 - DNA, 25 bp, mus musculus
tccctgaatgctttactatccctgc

SEQ ID NO: 86596 - DNA, 25 bp, mus musculus
atccagaaccaaagaatcaacaggg

SEQ ID NO: 86597 - DNA, 25 bp, mus musculus
tattcaagtggttcacagagaacag

SEQ ID NO: 86598 - DNA, 25 bp, mus musculus
gcagttagttcctggttctgagaac

SEQ ID NO: 86599 - DNA, 25 bp, mus musculus
agttcctggttctgagaaccacttg

SEQ ID NO: 86600 - DNA, 25 bp, mus musculus
tgagaaccacttgtcccagtatgac

SEQ ID NO: 86601 - DNA, 25 bp, mus musculus
ccacttgtcccagtatgacacctct

SEQ ID NO: 86602 - DNA, 25 bp, mus musculus
gtatgacacctcttactatctcagc

SEQ ID NO: 86603 - DNA, 25 bp, mus musculus
ttactatctcagcagcctgtgcagg

SEQ ID NO: 86604 - DNA, 25 bp, mus musculus
tctcagcagcctgtgcagggtctct

SEQ ID NO: 86605 - DNA, 25 bp, mus musculus
ttttcttcatctccaatcctgaaag

SEQ ID NO: 86606 - DNA, 25 bp, mus musculus
tcttcatctccaatcctgaaagcat

SEQ ID NO: 86607 - DNA, 25 bp, mus musculus
ttagtgcctgagctagatcggccag

SEQ ID NO: 86608 - DNA, 25 bp, mus musculus
tttccccggcatccaaaatcatggc

SEQ ID NO: 86609 - DNA, 25 bp, mus musculus
cggcatccaaaatcatggctcctag

SEQ ID NO: 86610 - DNA, 25 bp, mus musculus
catccaaaatcatggctcctagttt

SEQ ID NO: 86611 - DNA, 25 bp, mus musculus
ccaaaatcatggctcctagtttcag

SEQ ID NO: 86612 - DNA, 25 bp, mus musculus
aaatcatggctcctagtttcagaag

SEQ ID NO: 86613 - DNA, 25 bp, mus musculus
tcatggctcctagtttcagaagatc

SEQ ID NO: 86614 - DNA, 25 bp, mus musculus
tggctcctagtttcagaagatctgc

SEQ ID NO: 86615 - DNA, 25 bp, mus musculus
agtgatgagccctgcctggtccctg

SEQ ID NO: 86616 - DNA, 25 bp, mus musculus
tgcctggtccctggtttcctgagtt

SEQ ID NO: 86617 - DNA, 25 bp, mus musculus
tcatctccaatcctgaaagcatgtg

SEQ ID NO: 86618 - DNA, 25 bp, mus musculus
tctccaatcctgaaagcatgtgccc

SEQ ID NO: 86619 - DNA, 25 bp, mus musculus
ccaatcctgaaagcatgtgcccctg

SEQ ID NO: 86620 - DNA, 25 bp, mus musculus
atcctgaaagcatgtgcccctgagg

SEQ ID NO: 86621 - DNA, 25 bp, mus musculus
ctgaaagcatgtgcccctgaggggc

SEQ ID NO: 86622 - DNA, 25 bp, mus musculus
aaagcatgtgcccctgaggggcata

SEQ ID NO: 86623 - DNA, 25 bp, mus musculus
tgtgcccctgaggggcataaacccg

SEQ ID NO: 86624 - DNA, 25 bp, mus musculus
tggttagtgcctgagctagatcggc

SEQ ID NO: 86625 - DNA, 25 bp, mus musculus
gtcactgttggctggttcctagttg

SEQ ID NO: 86626 - DNA, 25 bp, mus musculus
tggttatcagtgctgccgtggtgcg

SEQ ID NO: 86627 - DNA, 25 bp, mus musculus
ctaatggctcacgtatgtgcagtta

SEQ ID NO: 86628 - DNA, 25 bp, mus musculus
atggctcacgtatgtgcagttacag

SEQ ID NO: 86629 - DNA, 25 bp, mus musculus
acagattgccagcctagggtctaat

SEQ ID NO: 86630 - DNA, 25 bp, mus musculus
gattgccagcctagggtctaatctt

SEQ ID NO: 86631 - DNA, 25 bp, mus musculus
tgccagcctagggtctaatcttctt

SEQ ID NO: 86632 - DNA, 25 bp, mus musculus
gtctaatcttcttggcaaatacttt

SEQ ID NO: 86633 - DNA, 25 bp, mus musculus
caaattccttgtgtccctagcataa

SEQ ID NO: 86634 - DNA, 25 bp, mus musculus
ccttgtgtccctagcataatccacg

SEQ ID NO: 86635 - DNA, 25 bp, mus musculus
cctagcataatccacgaggtctttg

SEQ ID NO: 86636 - DNA, 25 bp, mus musculus
atccacgaggtctttgagattacaa

SEQ ID NO: 86637 - DNA, 25 bp, mus musculus
ttatcagtgctgccgtggtgcggcc

SEQ ID NO: 86638 - DNA, 25 bp, mus musculus
gttaaatgtgctacccaccaatgat

SEQ ID NO: 86639 - DNA, 25 bp, mus musculus
aaatgtgctacccaccaatgatgga

SEQ ID NO: 86640 - DNA, 25 bp, mus musculus
tgtgctacccaccaatgatggaaaa

SEQ ID NO: 86641 - DNA, 25 bp, mus musculus
ttatgaaaaccgtgccatggtgtgc

SEQ ID NO: 86642 - DNA, 25 bp, mus musculus
tattcacccatcattagaattactt

SEQ ID NO: 86643 - DNA, 25 bp, mus musculus
gtaaccccaaacatgacaaattatg

SEQ ID NO: 86644 - DNA, 25 bp, mus musculus
accccaaacatgacaaattatgaat

SEQ ID NO: 86645 - DNA, 25 bp, mus musculus
cccaagccacagcagtgtacaaggt

SEQ ID NO: 86646 - DNA, 25 bp, mus musculus
tctctgagtatgcccgtcgctttgg

SEQ ID NO: 86647 - DNA, 25 bp, mus musculus
gagtttcaggggcagtgcaggacaa

SEQ ID NO: 86648 - DNA, 25 bp, mus musculus
tcgttccttacctgattgctggcat

SEQ ID NO: 86649 - DNA, 25 bp, mus musculus
tgattgctggcatccagcattcctg

SEQ ID NO: 86650 - DNA, 25 bp, mus musculus
ctggcatccagcattcctgtcaaga

SEQ ID NO: 86651 - DNA, 25 bp, mus musculus
tccagcattcctgtcaagacattgg

SEQ ID NO: 86652 - DNA, 25 bp, mus musculus
attcctgtcaagacattggtgccaa

SEQ ID NO: 86653 - DNA, 25 bp, mus musculus
agagtttaacccaagtcagagccat

SEQ ID NO: 86654 - DNA, 25 bp, mus musculus
taacccaagtcagagccatgacgta

SEQ ID NO: 86655 - DNA, 25 bp, mus musculus
acagcctccattcgtacgagaaacg

SEQ ID NO: 86656 - DNA, 25 bp, mus musculus
aacagatccagtatatgccttgaat

SEQ ID NO: 86657 - DNA, 25 bp, mus musculus
gctttggtgttcctgttattgctga

SEQ ID NO: 86658 - DNA, 25 bp, mus musculus
gtgttcctgttattgctgatggagg

SEQ ID NO: 86659 - DNA, 25 bp, mus musculus
atattgccaaagctttggctcttgg

SEQ ID NO: 86660 - DNA, 25 bp, mus musculus
ctcttggggcttccacagtcatgat

SEQ ID NO: 86661 - DNA, 25 bp, mus musculus
gggcttccacagtcatgatgggctc

SEQ ID NO: 86662 - DNA, 25 bp, mus musculus
tggacaaacatctcagcagccagaa

SEQ ID NO: 86663 - DNA, 25 bp, mus musculus
aacatctcagcagccagaaccgata

SEQ ID NO: 86664 - DNA, 25 bp, mus musculus
gccagaaccgatacttcagtgaagc

SEQ ID NO: 86665 - DNA, 25 bp, mus musculus
ctgacgttgtcagccctgctcgatg

SEQ ID NO: 86666 - DNA, 25 bp, mus musculus
ttgtcagccctgctcgatggcaaga

SEQ ID NO: 86667 - DNA, 25 bp, mus musculus
agcccctgtagagatgccaggctac

SEQ ID NO: 86668 - DNA, 25 bp, mus musculus
atctgtatccagtccccagatgaaa

SEQ ID NO: 86669 - DNA, 25 bp, mus musculus
atccagtccccagatgaaattgtga

SEQ ID NO: 86670 - DNA, 25 bp, mus musculus
attgtgacttcccgagcatcgaacc

SEQ ID NO: 86671 - DNA, 25 bp, mus musculus
acttcccgagcatcgaaccctggtg

SEQ ID NO: 86672 - DNA, 25 bp, mus musculus
cgagcatcgaaccctggtgtccaga

SEQ ID NO: 86673 - DNA, 25 bp, mus musculus
gtccagatcctatctgctcggaagc

SEQ ID NO: 86674 - DNA, 25 bp, mus musculus
atcctatctgctcggaagcatgtac

SEQ ID NO: 86675 - DNA, 25 bp, mus musculus
cacacctgcgtgaaagggatgtttt

SEQ ID NO: 86676 - DNA, 25 bp, mus musculus
ttagactgatcctcacaccctgttc

SEQ ID NO: 86677 - DNA, 25 bp, mus musculus
gccctgctcgatggcaagaacgtca

SEQ ID NO: 86678 - DNA, 25 bp, mus musculus
ggtggccacaagcttggcctaggac

SEQ ID NO: 86679 - DNA, 25 bp, mus musculus
cacaagcttggcctaggactggaat

SEQ ID NO: 86680 - DNA, 25 bp, mus musculus
tgcagcatagctaccttcagaattt

SEQ ID NO: 86681 - DNA, 25 bp, mus musculus
atagctaccttcagaatttagtgta

SEQ ID NO: 86682 - DNA, 25 bp, mus musculus
ttagacctccaggctaaggatgact

SEQ ID NO: 86683 - DNA, 25 bp, mus musculus
ccatttcagaggtacagcagaaacc

SEQ ID NO: 86684 - DNA, 25 bp, mus musculus
tacagcagaaaccccattccagaaa

SEQ ID NO: 86685 - DNA, 25 bp, mus musculus
gaattatgaaccacaacaaccaggc

SEQ ID NO: 86686 - DNA, 25 bp, mus musculus
ttatgaaccacaacaaccaggccat

SEQ ID NO: 86687 - DNA, 25 bp, mus musculus
aatcctggggctgctggaaactcac

SEQ ID NO: 86688 - DNA, 25 bp, mus musculus
atcctggggctgctggaaactcact

SEQ ID NO: 86689 - DNA, 25 bp, mus musculus
tgctggaaactcacttgaagattcg

SEQ ID NO: 86690 - DNA, 25 bp, mus musculus
gaaactcacttgaagattcgaactt

SEQ ID NO: 86691 - DNA, 25 bp, mus musculus
gattcgaacttttctagtgggcgag

SEQ ID NO: 86692 - DNA, 25 bp, mus musculus
tcgaacttttctagtgggcgagcga

SEQ ID NO: 86693 - DNA, 25 bp, mus musculus
gaacttttctagtgggcgagcgatt

SEQ ID NO: 86694 - DNA, 25 bp, mus musculus
cgagcgattgacactggctgatatt

SEQ ID NO: 86695 - DNA, 25 bp, mus musculus
gcgattgacactggctgatattaca

SEQ ID NO: 86696 - DNA, 25 bp, mus musculus
caagccccatttcagggttatcttg

SEQ ID NO: 86697 - DNA, 25 bp, mus musculus
tatgaaccacaacaaccaggccatt

SEQ ID NO: 86698 - DNA, 25 bp, mus musculus
atgaaccacaacaaccaggccattg

SEQ ID NO: 86699 - DNA, 25 bp, mus musculus
tgaaccacaacaaccaggccattga

SEQ ID NO: 86700 - DNA, 25 bp, mus musculus
ccacaacaaccaggccattgaaaat

SEQ ID NO: 86701 - DNA, 25 bp, mus musculus
cacaacaaccaggccattgaaaatg

SEQ ID NO: 86702 - DNA, 25 bp, mus musculus
agttgaagcgaatcctggggctgct

SEQ ID NO: 86703 - DNA, 25 bp, mus musculus
gaagcgaatcctggggctgctggaa

SEQ ID NO: 86704 - DNA, 25 bp, mus musculus
aagcgaatcctggggctgctggaaa

SEQ ID NO: 86705 - DNA, 25 bp, mus musculus
aacttcaatgcaggaggccacaagg

SEQ ID NO: 86706 - DNA, 25 bp, mus musculus
tagagtatcacttgtccctggaaat

SEQ ID NO: 86707 - DNA, 25 bp, mus musculus
tgttcctcagcaacaacgtagtgtc

SEQ ID NO: 86708 - DNA, 25 bp, mus musculus
tcagcaacaacgtagtgtcatgtta

SEQ ID NO: 86709 - DNA, 25 bp, mus musculus
cccggtctgtacaccgtgtcctgca

SEQ ID NO: 86710 - DNA, 25 bp, mus musculus
tcctgcatgtcccagtccacttttc

SEQ ID NO: 86711 - DNA, 25 bp, mus musculus
atgtcccagtccacttttccatggc

SEQ ID NO: 86712 - DNA, 25 bp, mus musculus
cagtccacttttccatggccttttg

SEQ ID NO: 86713 - DNA, 25 bp, mus musculus
ccatggccttttgttatatcagtct

SEQ ID NO: 86714 - DNA, 25 bp, mus musculus
gttatatcagtctctgctctagtga

SEQ ID NO: 86715 - DNA, 25 bp, mus musculus
tcagtctctgctctagtgagagctt

SEQ ID NO: 86716 - DNA, 25 bp, mus musculus
tctgctctagtgagagctttggttt

SEQ ID NO: 86717 - DNA, 25 bp, mus musculus
atcacttgtccctggaaatgaagag

SEQ ID NO: 86718 - DNA, 25 bp, mus musculus
cttcccacactgaagtctagagatt

SEQ ID NO: 86719 - DNA, 25 bp, mus musculus
tacagatctatccaatgggaggtcc

SEQ ID NO: 86720 - DNA, 25 bp, mus musculus
aattgtcatgtttgtgccacatttc

SEQ ID NO: 86721 - DNA, 25 bp, mus musculus
catgtttgtgccacatttcagttga

SEQ ID NO: 86722 - DNA, 25 bp, mus musculus
tgtgccacatttcagttgagttctg

SEQ ID NO: 86723 - DNA, 25 bp, mus musculus
acatttcagttgagttctgcagagt

SEQ ID NO: 86724 - DNA, 25 bp, mus musculus
taaatatgttcctcagcaacaacgt

SEQ ID NO: 86725 - DNA, 25 bp, mus musculus
gtagctttctccaaccagcctgagg

SEQ ID NO: 86726 - DNA, 25 bp, mus musculus
ttctccaaccagcctgagggagtct

SEQ ID NO: 86727 - DNA, 25 bp, mus musculus
atcgcatggtgccggaaggaccagc

SEQ ID NO: 86728 - DNA, 25 bp, mus musculus
gaccagcagcgtgtgaagctgccca

SEQ ID NO: 86729 - DNA, 25 bp, mus musculus
atgttctactctttcctcagcagct

SEQ ID NO: 86730 - DNA, 25 bp, mus musculus
tactctttcctcagcagctacgcag

SEQ ID NO: 86731 - DNA, 25 bp, mus musculus
gtgtccccacaggacataagcaccg

SEQ ID NO: 86732 - DNA, 25 bp, mus musculus
gacataagcaccgctctgcgagcct

SEQ ID NO: 86733 - DNA, 25 bp, mus musculus
tggctccaccaactgcagaagcaga

SEQ ID NO: 86734 - DNA, 25 bp, mus musculus
caccaactgcagaagcagatgactg

SEQ ID NO: 86735 - DNA, 25 bp, mus musculus
cattccataatggcgtggaaggctg

SEQ ID NO: 86736 - DNA, 25 bp, mus musculus
gcacacactagccaattaaagtcag

SEQ ID NO: 86737 - DNA, 25 bp, mus musculus
aaccagcctgagggagtctccatca

SEQ ID NO: 86738 - DNA, 25 bp, mus musculus
ggagtctccatcaacgtcattgctg

SEQ ID NO: 86739 - DNA, 25 bp, mus musculus
cccaaatcaaataagcccatcataa

SEQ ID NO: 86740 - DNA, 25 bp, mus musculus
tcaaataagcccatcataagcctga

SEQ ID NO: 86741 - DNA, 25 bp, mus musculus
aagcccatcataagcctgacattct

SEQ ID NO: 86742 - DNA, 25 bp, mus musculus
agcctgacattctcctgtgatggcc

SEQ ID NO: 86743 - DNA, 25 bp, mus musculus
acattctcctgtgatggccaccatt

SEQ ID NO: 86744 - DNA, 25 bp, mus musculus
gatggccaccatttgtacactgcca

SEQ ID NO: 86745 - DNA, 25 bp, mus musculus
tggtcctacatcttctacaacggga

SEQ ID NO: 86746 - DNA, 25 bp, mus musculus
gtcctacatcttctacaacgggaag

SEQ ID NO: 86747 - DNA, 25 bp, mus musculus
aacgcagtgcgaacactcggccaac

SEQ ID NO: 86748 - DNA, 25 bp, mus musculus
acgcagtgcgaacactcggccaacg

SEQ ID NO: 86749 - DNA, 25 bp, mus musculus
cagtgcgaacactcggccaacgtga

SEQ ID NO: 86750 - DNA, 25 bp, mus musculus
agtgcgaacactcggccaacgtgag

SEQ ID NO: 86751 - DNA, 25 bp, mus musculus
gtgcgaacactcggccaacgtgaga

SEQ ID NO: 86752 - DNA, 25 bp, mus musculus
gcgaacactcggccaacgtgagaag

SEQ ID NO: 86753 - DNA, 25 bp, mus musculus
cgaacactcggccaacgtgagaagt

SEQ ID NO: 86754 - DNA, 25 bp, mus musculus
gaacactcggccaacgtgagaagtc

SEQ ID NO: 86755 - DNA, 25 bp, mus musculus
cactcggccaacgtgagaagtccac

SEQ ID NO: 86756 - DNA, 25 bp, mus musculus
actcggccaacgtgagaagtccaca

SEQ ID NO: 86757 - DNA, 25 bp, mus musculus
catcttctacaacgggaagacccag

SEQ ID NO: 86758 - DNA, 25 bp, mus musculus
ggagtcattgtctcacggaatcggg

SEQ ID NO: 86759 - DNA, 25 bp, mus musculus
gagtcattgtctcacggaatcgggt

SEQ ID NO: 86760 - DNA, 25 bp, mus musculus
tgccctgtctcgagaacgcagtgcg

SEQ ID NO: 86761 - DNA, 25 bp, mus musculus
ccctgtctcgagaacgcagtgcgaa

SEQ ID NO: 86762 - DNA, 25 bp, mus musculus
ctgtctcgagaacgcagtgcgaaca

SEQ ID NO: 86763 - DNA, 25 bp, mus musculus
tgtctcgagaacgcagtgcgaacac

SEQ ID NO: 86764 - DNA, 25 bp, mus musculus
tctcgagaacgcagtgcgaacactc

SEQ ID NO: 86765 - DNA, 25 bp, mus musculus
agccggaacacggtgagatgtacga

SEQ ID NO: 86766 - DNA, 25 bp, mus musculus
acaatattctgaacaagcctctcca

SEQ ID NO: 86767 - DNA, 25 bp, mus musculus
gcaaggcacctcctggaaggcctcc

SEQ ID NO: 86768 - DNA, 25 bp, mus musculus
ccaagaggctgggtgccaaggatga

SEQ ID NO: 86769 - DNA, 25 bp, mus musculus
actttgtgagtgttggttgtcctgc

SEQ ID NO: 86770 - DNA, 25 bp, mus musculus
tgttggttgtcctgctgtcatggga

SEQ ID NO: 86771 - DNA, 25 bp, mus musculus
ttggttgtcctgctgtcatgggacc

SEQ ID NO: 86772 - DNA, 25 bp, mus musculus
ttgtcctgctgtcatgggaccttgg

SEQ ID NO: 86773 - DNA, 25 bp, mus musculus
cctgctgtcatgggaccttggggaa

SEQ ID NO: 86774 - DNA, 25 bp, mus musculus
tgctgtcatgggaccttggggaaga

SEQ ID NO: 86775 - DNA, 25 bp, mus musculus
ctgtcatgggaccttggggaagaag

SEQ ID NO: 86776 - DNA, 25 bp, mus musculus
ttgactttgtgaccttgtattgagt

SEQ ID NO: 86777 - DNA, 25 bp, mus musculus
tattctgaacaagcctctccagttg

SEQ ID NO: 86778 - DNA, 25 bp, mus musculus
gactttgtgaccttgtattgagttc

SEQ ID NO: 86779 - DNA, 25 bp, mus musculus
ttctgaacaagcctctccagttgaa

SEQ ID NO: 86780 - DNA, 25 bp, mus musculus
ctgaacaagcctctccagttgaaac

SEQ ID NO: 86781 - DNA, 25 bp, mus musculus
gaacaagcctctccagttgaaacca

SEQ ID NO: 86782 - DNA, 25 bp, mus musculus
gcctctccagttgaaaccaaatatt

SEQ ID NO: 86783 - DNA, 25 bp, mus musculus
atattacaaactcggcaaggcacct

SEQ ID NO: 86784 - DNA, 25 bp, mus musculus
tacaaactcggcaaggcacctcctg

SEQ ID NO: 86785 - DNA, 25 bp, mus musculus
aactcggcaaggcacctcctggaag

SEQ ID NO: 86786 - DNA, 25 bp, mus musculus
gtacccaggcattctgacaggatgc

SEQ ID NO: 86787 - DNA, 25 bp, mus musculus
acccaggcattctgacaggatgcag

SEQ ID NO: 86788 - DNA, 25 bp, mus musculus
ggcttaatgtccaactttcagcagg

SEQ ID NO: 86789 - DNA, 25 bp, mus musculus
aatcagggccctgcattgtccaacc

SEQ ID NO: 86790 - DNA, 25 bp, mus musculus
ctgcattgtccaaccgaaatgcttc

SEQ ID NO: 86791 - DNA, 25 bp, mus musculus
attgtccaaccgaaatgcttcctga

SEQ ID NO: 86792 - DNA, 25 bp, mus musculus
tgtccaaccgaaatgcttcctgaag

SEQ ID NO: 86793 - DNA, 25 bp, mus musculus
tccaaccgaaatgcttcctgaagga

SEQ ID NO: 86794 - DNA, 25 bp, mus musculus
atgcttcctgaaggacctaacaagt

SEQ ID NO: 86795 - DNA, 25 bp, mus musculus
gcttcctgaaggacctaacaagtgc

SEQ ID NO: 86796 - DNA, 25 bp, mus musculus
aaggacctaacaagtgccagagaat

SEQ ID NO: 86797 - DNA, 25 bp, mus musculus
ggacctaacaagtgccagagaattg

SEQ ID NO: 86798 - DNA, 25 bp, mus musculus
ccaggcattctgacaggatgcagaa

SEQ ID NO: 86799 - DNA, 25 bp, mus musculus
gcattctgacaggatgcagaaggag

SEQ ID NO: 86800 - DNA, 25 bp, mus musculus
aggagatcacagcctagcacctagc

SEQ ID NO: 86801 - DNA, 25 bp, mus musculus
gagatcacagcctagcacctagcac

SEQ ID NO: 86802 - DNA, 25 bp, mus musculus
gatcacagcctagcacctagcacga

SEQ ID NO: 86803 - DNA, 25 bp, mus musculus
tcacagcctagcacctagcacgatg

SEQ ID NO: 86804 - DNA, 25 bp, mus musculus
gtgggtccaatctgggcttaatgtc

SEQ ID NO: 86805 - DNA, 25 bp, mus musculus
gtccaatctgggcttaatgtccaac

SEQ ID NO: 86806 - DNA, 25 bp, mus musculus
tggagctactgccttgcccccagga

SEQ ID NO: 86807 - DNA, 25 bp, mus musculus
tggcacccaagaaggccaagagaag

SEQ ID NO: 86808 - DNA, 25 bp, mus musculus
atcttcgggacacctttgcagccat

SEQ ID NO: 86809 - DNA, 25 bp, mus musculus
ccatgggccgtctcaatgtgaagaa

SEQ ID NO: 86810 - DNA, 25 bp, mus musculus
tgggccgtctcaatgtgaagaatga

SEQ ID NO: 86811 - DNA, 25 bp, mus musculus
atgaggaactcgacgctatgatgaa

SEQ ID NO: 86812 - DNA, 25 bp, mus musculus
aactcgacgctatgatgaaggaagc

SEQ ID NO: 86813 - DNA, 25 bp, mus musculus
aagccagtgggcccatcaacttcac

SEQ ID NO: 86814 - DNA, 25 bp, mus musculus
ccagtgggcccatcaacttcactgt

SEQ ID NO: 86815 - DNA, 25 bp, mus musculus
ggcccatcaacttcactgtcttcct

SEQ ID NO: 86816 - DNA, 25 bp, mus musculus
ccatcaacttcactgtcttcctgac

SEQ ID NO: 86817 - DNA, 25 bp, mus musculus
tcaacttcactgtcttcctgaccat

SEQ ID NO: 86818 - DNA, 25 bp, mus musculus
aagggagctccaacgtcttctccat

SEQ ID NO: 86819 - DNA, 25 bp, mus musculus
ggagctccaacgtcttctccatgtt

SEQ ID NO: 86820 - DNA, 25 bp, mus musculus
ccaacgtcttctccatgtttgacca

SEQ ID NO: 86821 - DNA, 25 bp, mus musculus
acgtcttctccatgtttgaccagac

SEQ ID NO: 86822 - DNA, 25 bp, mus musculus
tcttctccatgtttgaccagactca

SEQ ID NO: 86823 - DNA, 25 bp, mus musculus
tgtttgaccagactcagatccagga

SEQ ID NO: 86824 - DNA, 25 bp, mus musculus
ttgaccagactcagatccaggagtt

SEQ ID NO: 86825 - DNA, 25 bp, mus musculus
aggatcttcgggacacctttgcagc

SEQ ID NO: 86826 - DNA, 25 bp, mus musculus
tggagctactgccttgcccccagga

SEQ ID NO: 86827 - DNA, 25 bp, mus musculus
ggagctactgccttgcccccaggag

SEQ ID NO: 86828 - DNA, 25 bp, mus musculus
ggcacccaagaaggccaagagaagg

SEQ ID NO: 86829 - DNA, 25 bp, mus musculus
gcacccaagaaggccaagagaaggg

SEQ ID NO: 86830 - DNA, 25 bp, mus musculus
taagacatggcacccaagaaggcca

SEQ ID NO: 86831 - DNA, 25 bp, mus musculus
aagacatggcacccaagaaggccaa

SEQ ID NO: 86832 - DNA, 25 bp, mus musculus
agacatggcacccaagaaggccaag

SEQ ID NO: 86833 - DNA, 25 bp, mus musculus
gacatggcacccaagaaggccaaga

SEQ ID NO: 86834 - DNA, 25 bp, mus musculus
acatggcacccaagaaggccaagag

SEQ ID NO: 86835 - DNA, 25 bp, mus musculus
catggcacccaagaaggccaagaga

SEQ ID NO: 86836 - DNA, 25 bp, mus musculus
atggcacccaagaaggccaagagaa

SEQ ID NO: 86837 - DNA, 25 bp, mus musculus
tggcacccaagaaggccaagagaag

SEQ ID NO: 86838 - DNA, 25 bp, mus musculus
tggagctactgccttgcccccagga

SEQ ID NO: 86839 - DNA, 25 bp, mus musculus
ggagctactgccttgcccccaggag

SEQ ID NO: 86840 - DNA, 25 bp, mus musculus
ggcacccaagaaggccaagagaagg

SEQ ID NO: 86841 - DNA, 25 bp, mus musculus
gcacccaagaaggccaagagaaggg

SEQ ID NO: 86842 - DNA, 25 bp, mus musculus
taagacatggcacccaagaaggcca

SEQ ID NO: 86843 - DNA, 25 bp, mus musculus
aagacatggcacccaagaaggccaa

SEQ ID NO: 86844 - DNA, 25 bp, mus musculus
agacatggcacccaagaaggccaag

SEQ ID NO: 86845 - DNA, 25 bp, mus musculus
gacatggcacccaagaaggccaaga

SEQ ID NO: 86846 - DNA, 25 bp, mus musculus
acatggcacccaagaaggccaagag

SEQ ID NO: 86847 - DNA, 25 bp, mus musculus
catggcacccaagaaggccaagaga

SEQ ID NO: 86848 - DNA, 25 bp, mus musculus
atggcacccaagaaggccaagagaa

SEQ ID NO: 86849 - DNA, 25 bp, mus musculus
tggcacccaagaaggccaagagaag

SEQ ID NO: 86850 - DNA, 25 bp, mus musculus
tggatttccagaacatcagttgcaa

SEQ ID NO: 86851 - DNA, 25 bp, mus musculus
cccatctggggcacactggattcac

SEQ ID NO: 86852 - DNA, 25 bp, mus musculus
ctggattcacgcattgggtatggct

SEQ ID NO: 86853 - DNA, 25 bp, mus musculus
tggattcacgcattgggtatggctc

SEQ ID NO: 86854 - DNA, 25 bp, mus musculus
ggattcacgcattgggtatggctcc

SEQ ID NO: 86855 - DNA, 25 bp, mus musculus
gattcacgcattgggtatggctcct

SEQ ID NO: 86856 - DNA, 25 bp, mus musculus
ctcctacatagtctcggaagaactt

SEQ ID NO: 86857 - DNA, 25 bp, mus musculus
tcctacatagtctcggaagaacttg

SEQ ID NO: 86858 - DNA, 25 bp, mus musculus
cctacatagtctcggaagaacttgg

SEQ ID NO: 86859 - DNA, 25 bp, mus musculus
ggttcacagagggcgctataggtcc

SEQ ID NO: 86860 - DNA, 25 bp, mus musculus
gttcacagagggcgctataggtccc

SEQ ID NO: 86861 - DNA, 25 bp, mus musculus
ggcgctataggtccccttgggctct

SEQ ID NO: 86862 - DNA, 25 bp, mus musculus
atctggggcacactggattcacgca

SEQ ID NO: 86863 - DNA, 25 bp, mus musculus
gggcacactggattcacgcattggg

SEQ ID NO: 86864 - DNA, 25 bp, mus musculus
ggcacactggattcacgcattgggt

SEQ ID NO: 86865 - DNA, 25 bp, mus musculus
gcacactggattcacgcattgggta

SEQ ID NO: 86866 - DNA, 25 bp, mus musculus
cacactggattcacgcattgggtat

SEQ ID NO: 86867 - DNA, 25 bp, mus musculus
acactggattcacgcattgggtatg

SEQ ID NO: 86868 - DNA, 25 bp, mus musculus
cactggattcacgcattgggtatgg

SEQ ID NO: 86869 - DNA, 25 bp, mus musculus
actggattcacgcattgggtatggc

SEQ ID NO: 86870 - DNA, 25 bp, mus musculus
cagcccagcaggtcctggagcatat

SEQ ID NO: 86871 - DNA, 25 bp, mus musculus
cccagcaggtcctggagcatatgta

SEQ ID NO: 86872 - DNA, 25 bp, mus musculus
aacacaatgtgcgcctggaaattga

SEQ ID NO: 86873 - DNA, 25 bp, mus musculus
acaatgtgcgcctggaaattgaatc

SEQ ID NO: 86874 - DNA, 25 bp, mus musculus
atgtgcgcctggaaattgaatctgc

SEQ ID NO: 86875 - DNA, 25 bp, mus musculus
tttctcagggaacccatgggatcca

SEQ ID NO: 86876 - DNA, 25 bp, mus musculus
ctcagggaacccatgggatccatgc

SEQ ID NO: 86877 - DNA, 25 bp, mus musculus
agggaacccatgggatccatgcgga

SEQ ID NO: 86878 - DNA, 25 bp, mus musculus
gaacccatgggatccatgcggagac

SEQ ID NO: 86879 - DNA, 25 bp, mus musculus
cccatgggatccatgcggagacgat

SEQ ID NO: 86880 - DNA, 25 bp, mus musculus
atgggatccatgcggagacgatcaa

SEQ ID NO: 86881 - DNA, 25 bp, mus musculus
ggatccatgcggagacgatcaaaaa

SEQ ID NO: 86882 - DNA, 25 bp, mus musculus
agcaggtcctggagcatatgtagac

SEQ ID NO: 86883 - DNA, 25 bp, mus musculus
aggtcctggagcatatgtagacatt

SEQ ID NO: 86884 - DNA, 25 bp, mus musculus
atatgtagacatttcccgaacacaa

SEQ ID NO: 86885 - DNA, 25 bp, mus musculus
tgtagacatttcccgaacacaatgt

SEQ ID NO: 86886 - DNA, 25 bp, mus musculus
agacatttcccgaacacaatgtgcg

SEQ ID NO: 86887 - DNA, 25 bp, mus musculus
catttcccgaacacaatgtgcgcct

SEQ ID NO: 86888 - DNA, 25 bp, mus musculus
ttcccgaacacaatgtgcgcctgga

SEQ ID NO: 86889 - DNA, 25 bp, mus musculus
ccgaacacaatgtgcgcctggaaat

SEQ ID NO: 86890 - DNA, 25 bp, mus musculus
cgggcactgtaccaatacataggcc

SEQ ID NO: 86891 - DNA, 25 bp, mus musculus
ctgtaccaatacataggccaggatg

SEQ ID NO: 86892 - DNA, 25 bp, mus musculus
ccaaaccctgccagtggaagccttg

SEQ ID NO: 86893 - DNA, 25 bp, mus musculus
tcaagcccagtgggacccctgtgta

SEQ ID NO: 86894 - DNA, 25 bp, mus musculus
ccagtgggacccctgtgtatggagg

SEQ ID NO: 86895 - DNA, 25 bp, mus musculus
ggacccctgtgtatggaggatgagc

SEQ ID NO: 86896 - DNA, 25 bp, mus musculus
cactgtagcaccccatgcctggtac

SEQ ID NO: 86897 - DNA, 25 bp, mus musculus
cattttttcctgtgtccaatagtag

SEQ ID NO: 86898 - DNA, 25 bp, mus musculus
ctgccctgggagcaaagtgctgtgc

SEQ ID NO: 86899 - DNA, 25 bp, mus musculus
agtgctgtgcactgcccagagttag

SEQ ID NO: 86900 - DNA, 25 bp, mus musculus
gctgtgcactgcccagagttaggag

SEQ ID NO: 86901 - DNA, 25 bp, mus musculus
gtgcactgcccagagttaggagacg

SEQ ID NO: 86902 - DNA, 25 bp, mus musculus
caatacataggccaggatgtggatg

SEQ ID NO: 86903 - DNA, 25 bp, mus musculus
gtcattgagatcctcatagaagact

SEQ ID NO: 86904 - DNA, 25 bp, mus musculus
ctcatagaagactcatctggctggt

SEQ ID NO: 86905 - DNA, 25 bp, mus musculus
cttcatggccaggaaggtctctttc

SEQ ID NO: 86906 - DNA, 25 bp, mus musculus
gaaggtctctttccaggaaactatg

SEQ ID NO: 86907 - DNA, 25 bp, mus musculus
ctctttccaggaaactatgtggaga

SEQ ID NO: 86908 - DNA, 25 bp, mus musculus
aagatctgatcgtccatccaccagc

SEQ ID NO: 86909 - DNA, 25 bp, mus musculus
tgggatccaaaccctgccagtggaa

SEQ ID NO: 86910 - DNA, 25 bp, mus musculus
ctggcgactaggcctctgtggcaga

SEQ ID NO: 86911 - DNA, 25 bp, mus musculus
tggcgactaggcctctgtggcagag

SEQ ID NO: 86912 - DNA, 25 bp, mus musculus
aagccaaagagctccaacaagcacg

SEQ ID NO: 86913 - DNA, 25 bp, mus musculus
agccaaagagctccaacaagcacga

SEQ ID NO: 86914 - DNA, 25 bp, mus musculus
gccaaagagctccaacaagcacgaa

SEQ ID NO: 86915 - DNA, 25 bp, mus musculus
ccaaagagctccaacaagcacgaag

SEQ ID NO: 86916 - DNA, 25 bp, mus musculus
caaagagctccaacaagcacgaagg

SEQ ID NO: 86917 - DNA, 25 bp, mus musculus
aagagctccaacaagcacgaaggga

SEQ ID NO: 86918 - DNA, 25 bp, mus musculus
agagctccaacaagcacgaagggaa

SEQ ID NO: 86919 - DNA, 25 bp, mus musculus
gagctccaacaagcacgaagggaaa

SEQ ID NO: 86920 - DNA, 25 bp, mus musculus
agctccaacaagcacgaagggaaag

SEQ ID NO: 86921 - DNA, 25 bp, mus musculus
gcgactaggcctctgtggcagagaa

SEQ ID NO: 86922 - DNA, 25 bp, mus musculus
cgactaggcctctgtggcagagaat

SEQ ID NO: 86923 - DNA, 25 bp, mus musculus
gactaggcctctgtggcagagaatc

SEQ ID NO: 86924 - DNA, 25 bp, mus musculus
agttcaagccaaagagctccaacaa

SEQ ID NO: 86925 - DNA, 25 bp, mus musculus
gttcaagccaaagagctccaacaag

SEQ ID NO: 86926 - DNA, 25 bp, mus musculus
ttcaagccaaagagctccaacaagc

SEQ ID NO: 86927 - DNA, 25 bp, mus musculus
tcaagccaaagagctccaacaagca

SEQ ID NO: 86928 - DNA, 25 bp, mus musculus
caagccaaagagctccaacaagcac

SEQ ID NO: 86929 - DNA, 25 bp, mus musculus
aaggaatgccttgctcttatcattt

SEQ ID NO: 86930 - DNA, 25 bp, mus musculus
aggaatgccttgctcttatcatttt

SEQ ID NO: 86931 - DNA, 25 bp, mus musculus
ggtatcctcagcacttgaccaagac

SEQ ID NO: 86932 - DNA, 25 bp, mus musculus
gtatcctcagcacttgaccaagacc

SEQ ID NO: 86933 - DNA, 25 bp, mus musculus
tatcctcagcacttgaccaagaccg

SEQ ID NO: 86934 - DNA, 25 bp, mus musculus
tcctcagcacttgaccaagaccgcg

SEQ ID NO: 86935 - DNA, 25 bp, mus musculus
cctcagcacttgaccaagaccgcga

SEQ ID NO: 86936 - DNA, 25 bp, mus musculus
tcagcacttgaccaagaccgcgaga

SEQ ID NO: 86937 - DNA, 25 bp, mus musculus
agcacttgaccaagaccgcgagaga

SEQ ID NO: 86938 - DNA, 25 bp, mus musculus
cacttgaccaagaccgcgagagaga

SEQ ID NO: 86939 - DNA, 25 bp, mus musculus
acttgaccaagaccgcgagagagac

SEQ ID NO: 86940 - DNA, 25 bp, mus musculus
cttgaccaagaccgcgagagagact

SEQ ID NO: 86941 - DNA, 25 bp, mus musculus
ggtatacctaacctgctggtttatg

SEQ ID NO: 86942 - DNA, 25 bp, mus musculus
gtatacctaacctgctggtttatgg

SEQ ID NO: 86943 - DNA, 25 bp, mus musculus
tatacctaacctgctggtttatggg

SEQ ID NO: 86944 - DNA, 25 bp, mus musculus
acctgctggtttatgggtatcctca

SEQ ID NO: 86945 - DNA, 25 bp, mus musculus
ttatgggtatcctcagcacttgacc

SEQ ID NO: 86946 - DNA, 25 bp, mus musculus
tatgggtatcctcagcacttgacca

SEQ ID NO: 86947 - DNA, 25 bp, mus musculus
atgggtatcctcagcacttgaccaa

SEQ ID NO: 86948 - DNA, 25 bp, mus musculus
gggtatcctcagcacttgaccaaga

SEQ ID NO: 86949 - DNA, 25 bp, mus musculus
cacatgctcaggacccatagatgaa

SEQ ID NO: 86950 - DNA, 25 bp, mus musculus
ctcaggacccatagatgaactatta

SEQ ID NO: 86951 - DNA, 25 bp, mus musculus
agagcctgccaaggctgcctcggac

SEQ ID NO: 86952 - DNA, 25 bp, mus musculus
ggctgcctcggacctgactgcctgg

SEQ ID NO: 86953 - DNA, 25 bp, mus musculus
ccccttatcaaaccctgatgctgtt

SEQ ID NO: 86954 - DNA, 25 bp, mus musculus
acacgaattgctcaatgcatgagtc

SEQ ID NO: 86955 - DNA, 25 bp, mus musculus
attgctcaatgcatgagtctgcaac

SEQ ID NO: 86956 - DNA, 25 bp, mus musculus
atgagtctgcaaccttcaacaggga

SEQ ID NO: 86957 - DNA, 25 bp, mus musculus
ctgcaaccttcaacagggagccctc

SEQ ID NO: 86958 - DNA, 25 bp, mus musculus
aagtctaatatgctcggtgtgctgt

SEQ ID NO: 86959 - DNA, 25 bp, mus musculus
aatatgctcggtgtgctgttttaat

SEQ ID NO: 86960 - DNA, 25 bp, mus musculus
ggtcaaggccctgtttctatcgcta

SEQ ID NO: 86961 - DNA, 25 bp, mus musculus
caaggatgacctcttgctgttgaat

SEQ ID NO: 86962 - DNA, 25 bp, mus musculus
gtcaaggccctgtttctatcgctat

SEQ ID NO: 86963 - DNA, 25 bp, mus musculus
tgacctcttgctgttgaatgagatc

SEQ ID NO: 86964 - DNA, 25 bp, mus musculus
tgagatcttcagcacttcctgcctg

SEQ ID NO: 86965 - DNA, 25 bp, mus musculus
cacttcctgcctggatgagggagag

SEQ ID NO: 86966 - DNA, 25 bp, mus musculus
caagccccagataggctccggattc

SEQ ID NO: 86967 - DNA, 25 bp, mus musculus
aggctccggattccttccgtcacag

SEQ ID NO: 86968 - DNA, 25 bp, mus musculus
gtcacagcttttagaccaaaatatg

SEQ ID NO: 86969 - DNA, 25 bp, mus musculus
tctccaggcctctctgcaagagcct

SEQ ID NO: 86970 - DNA, 25 bp, mus musculus
atgctgttacctttaagctttgtca

SEQ ID NO: 86971 - DNA, 25 bp, mus musculus
aggccagctcctgggcactgatgaa

SEQ ID NO: 86972 - DNA, 25 bp, mus musculus
ctatcttattatagctgcatgatgt

SEQ ID NO: 86973 - DNA, 25 bp, mus musculus
gcctatgtacccaccagtagaataa

SEQ ID NO: 86974 - DNA, 25 bp, mus musculus
tatgtacccaccagtagaataaagg

SEQ ID NO: 86975 - DNA, 25 bp, mus musculus
ttatctgtactctatcttactcaaa

SEQ ID NO: 86976 - DNA, 25 bp, mus musculus
gtactctatcttactcaaatactgt

SEQ ID NO: 86977 - DNA, 25 bp, mus musculus
tatcttactcaaatactgttgactc

SEQ ID NO: 86978 - DNA, 25 bp, mus musculus
cttactcaaatactgttgactctgt

SEQ ID NO: 86979 - DNA, 25 bp, mus musculus
actcaaatactgttgactctgtaca

SEQ ID NO: 86980 - DNA, 25 bp, mus musculus
atactgttgactctgtacattaaag

SEQ ID NO: 86981 - DNA, 25 bp, mus musculus
ctgttgactctgtacattaaagctc

SEQ ID NO: 86982 - DNA, 25 bp, mus musculus
ccagctcctgggcactgatgaaagt

SEQ ID NO: 86983 - DNA, 25 bp, mus musculus
ctcatatatgatgtctccggaattc

SEQ ID NO: 86984 - DNA, 25 bp, mus musculus
atgtaacttagcagcatctgtagct

SEQ ID NO: 86985 - DNA, 25 bp, mus musculus
cttagcagcatctgtagcttttcat

SEQ ID NO: 86986 - DNA, 25 bp, mus musculus
agcatctgtagcttttcattgtgtg

SEQ ID NO: 86987 - DNA, 25 bp, mus musculus
gtgttatatccagcttgagagatca

SEQ ID NO: 86988 - DNA, 25 bp, mus musculus
tgagagatcaccttcaaaaggccca

SEQ ID NO: 86989 - DNA, 25 bp, mus musculus
ttcaaaaggcccagcctatcttatt

SEQ ID NO: 86990 - DNA, 25 bp, mus musculus
cccagcctatcttattatagctgca

SEQ ID NO: 86991 - DNA, 25 bp, mus musculus
tatcgcaaagagccactcttgtgtt

SEQ ID NO: 86992 - DNA, 25 bp, mus musculus
cgcaaagagccactcttgtgttatg

SEQ ID NO: 86993 - DNA, 25 bp, mus musculus
aaccgtctctatgctaaagcatgac

SEQ ID NO: 86994 - DNA, 25 bp, mus musculus
aaagcatgactactgcctggaacga

SEQ ID NO: 86995 - DNA, 25 bp, mus musculus
gcatgactactgcctggaacgacca

SEQ ID NO: 86996 - DNA, 25 bp, mus musculus
acgatgacctcagtagatacataca

SEQ ID NO: 86997 - DNA, 25 bp, mus musculus
atgacctcagtagatacatacagta

SEQ ID NO: 86998 - DNA, 25 bp, mus musculus
acatacagtatctgtgtatgtgata

SEQ ID NO: 86999 - DNA, 25 bp, mus musculus
tacagtatctgtgtatgtgataaca

SEQ ID NO: 87000 - DNA, 25 bp, mus musculus
tgtgataacacctatgtatgatcat

SEQ ID NO: 87001 - DNA, 25 bp, mus musculus
gataacacctatgtatgatcatgta

SEQ ID NO: 87002 - DNA, 25 bp, mus musculus
aacacctatgtatgatcatgtactt

SEQ ID NO: 87003 - DNA, 25 bp, mus musculus
gagccactcttgtgttatgccaggc

SEQ ID NO: 87004 - DNA, 25 bp, mus musculus
acggctccagacgcctggcaatgct

SEQ ID NO: 87005 - DNA, 25 bp, mus musculus
gctccagacgcctggcaatgctgat

SEQ ID NO: 87006 - DNA, 25 bp, mus musculus
ccagacgcctggcaatgctgatcac

SEQ ID NO: 87007 - DNA, 25 bp, mus musculus
gcctggcaatgctgatcacgaatga

SEQ ID NO: 87008 - DNA, 25 bp, mus musculus
tcacgaatgaaccgtctctatgcta

SEQ ID NO: 87009 - DNA, 25 bp, mus musculus
cgaatgaaccgtctctatgctaaag

SEQ ID NO: 87010 - DNA, 25 bp, mus musculus
atgaaccgtctctatgctaaagcat

SEQ ID NO: 87011 - DNA, 25 bp, mus musculus
gggttcgccaaacattgcgtgaagt

SEQ ID NO: 87012 - DNA, 25 bp, mus musculus
ttcgccaaacattgcgtgaagtgca

SEQ ID NO: 87013 - DNA, 25 bp, mus musculus
aagctggctgggcagcgtttcaccg

SEQ ID NO: 87014 - DNA, 25 bp, mus musculus
cagcgtttcaccgctgtggaggacc

SEQ ID NO: 87015 - DNA, 25 bp, mus musculus
ttcaccgctgtggaggaccagtatt

SEQ ID NO: 87016 - DNA, 25 bp, mus musculus
gaccagtattactgcgtggattgct

SEQ ID NO: 87017 - DNA, 25 bp, mus musculus
cagtattactgcgtggattgctaca

SEQ ID NO: 87018 - DNA, 25 bp, mus musculus
aaaggctccagtgtggtggcctatg

SEQ ID NO: 87019 - DNA, 25 bp, mus musculus
agtgtggtggcctatgaaggacaat

SEQ ID NO: 87020 - DNA, 25 bp, mus musculus
ggacaatcctggcacgactactgct

SEQ ID NO: 87021 - DNA, 25 bp, mus musculus
tcctggcacgactactgcttccact

SEQ ID NO: 87022 - DNA, 25 bp, mus musculus
cacgactactgcttccactgcaaaa

SEQ ID NO: 87023 - DNA, 25 bp, mus musculus
tgcaacaaggccatcacatctggag

SEQ ID NO: 87024 - DNA, 25 bp, mus musculus
tactgcttccactgcaaaaaatgct

SEQ ID NO: 87025 - DNA, 25 bp, mus musculus
ggaatcacttaccaggatcagccct

SEQ ID NO: 87026 - DNA, 25 bp, mus musculus
atcacttaccaggatcagccctggc

SEQ ID NO: 87027 - DNA, 25 bp, mus musculus
taccaggatcagccctggcatgccg

SEQ ID NO: 87028 - DNA, 25 bp, mus musculus
gatcagccctggcatgccgagtgct

SEQ ID NO: 87029 - DNA, 25 bp, mus musculus
tgtgttacctgctctaagaagctgg

SEQ ID NO: 87030 - DNA, 25 bp, mus musculus
acctgctctaagaagctggctgggc

SEQ ID NO: 87031 - DNA, 25 bp, mus musculus
tctaagaagctggctgggcagcgtt

SEQ ID NO: 87032 - DNA, 25 bp, mus musculus
cgactacactcaatgtaggccttca

SEQ ID NO: 87033 - DNA, 25 bp, mus musculus
ctacactcaatgtaggccttcaggg

SEQ ID NO: 87034 - DNA, 25 bp, mus musculus
tggaccacaccaggacgatctgtgg

SEQ ID NO: 87035 - DNA, 25 bp, mus musculus
gcattgtagttccagcaggtcggag

SEQ ID NO: 87036 - DNA, 25 bp, mus musculus
ttgtagttccagcaggtcggagcgg

SEQ ID NO: 87037 - DNA, 25 bp, mus musculus
ttccagcaggtcggagcggacgaaa

SEQ ID NO: 87038 - DNA, 25 bp, mus musculus
gttcagtccagcccaggaggaaaga

SEQ ID NO: 87039 - DNA, 25 bp, mus musculus
cagtccagcccaggaggaaagaact

SEQ ID NO: 87040 - DNA, 25 bp, mus musculus
aacagactctgcagtctgcctgtgt

SEQ ID NO: 87041 - DNA, 25 bp, mus musculus
agactctgcagtctgcctgtgtagt

SEQ ID NO: 87042 - DNA, 25 bp, mus musculus
tgcagtctgcctgtgtagtggaaag

SEQ ID NO: 87043 - DNA, 25 bp, mus musculus
agtctgcctgtgtagtggaaagcaa

SEQ ID NO: 87044 - DNA, 25 bp, mus musculus
cactcaatgtaggccttcagggtga

SEQ ID NO: 87045 - DNA, 25 bp, mus musculus
agggcaaacctctcctgcagttggt

SEQ ID NO: 87046 - DNA, 25 bp, mus musculus
gcaaacctctcctgcagttggtcta

SEQ ID NO: 87047 - DNA, 25 bp, mus musculus
aacctctcctgcagttggtctacca

SEQ ID NO: 87048 - DNA, 25 bp, mus musculus
tcctgcagttggtctaccacgctgc

SEQ ID NO: 87049 - DNA, 25 bp, mus musculus
agttggtctaccacgctgcgctgga

SEQ ID NO: 87050 - DNA, 25 bp, mus musculus
ctgcgctggaccacaccaggacgat

SEQ ID NO: 87051 - DNA, 25 bp, mus musculus
cgctggaccacaccaggacgatctg

SEQ ID NO: 87052 - DNA, 25 bp, mus musculus
agaagatgccacccaagcgcatact

SEQ ID NO: 87053 - DNA, 25 bp, mus musculus
agatgccacccaagcgcatactaag

SEQ ID NO: 87054 - DNA, 25 bp, mus musculus
agaaccaggcttggtgctgacactg

SEQ ID NO: 87055 - DNA, 25 bp, mus musculus
ggtgccccttctgcaggatgttgtg

SEQ ID NO: 87056 - DNA, 25 bp, mus musculus
ccttctgcaggatgttgtgcaggct

SEQ ID NO: 87057 - DNA, 25 bp, mus musculus
tctgcaggatgttgtgcaggctgag

SEQ ID NO: 87058 - DNA, 25 bp, mus musculus
gcatgcatactgtgtgtctgagcca

SEQ ID NO: 87059 - DNA, 25 bp, mus musculus
tgcatactgtgtgtctgagccaaag

SEQ ID NO: 87060 - DNA, 25 bp, mus musculus
atactgtgtgtctgagccaaagtgg

SEQ ID NO: 87061 - DNA, 25 bp, mus musculus
gtggccaggtctactcctttggctg

SEQ ID NO: 87062 - DNA, 25 bp, mus musculus
gccaggtctactcctttggctgcaa

SEQ ID NO: 87063 - DNA, 25 bp, mus musculus
aggtctactcctttggctgcaatga

SEQ ID NO: 87064 - DNA, 25 bp, mus musculus
tgccacccaagcgcatactaagaga

SEQ ID NO: 87065 - DNA, 25 bp, mus musculus
cacccaagcgcatactaagagaagg

SEQ ID NO: 87066 - DNA, 25 bp, mus musculus
agtctcacacaggtcccacaacaca

SEQ ID NO: 87067 - DNA, 25 bp, mus musculus
acacaggtcccacaacacagaacca

SEQ ID NO: 87068 - DNA, 25 bp, mus musculus
caggtcccacaacacagaaccaggc

SEQ ID NO: 87069 - DNA, 25 bp, mus musculus
ccacaacacagaaccaggcttggtg

SEQ ID NO: 87070 - DNA, 25 bp, mus musculus
caacacagaaccaggcttggtgctg

SEQ ID NO: 87071 - DNA, 25 bp, mus musculus
cacagaaccaggcttggtgctgaca

SEQ ID NO: 87072 - DNA, 25 bp, mus musculus
taaatgccggtgctctcagcgcaca

SEQ ID NO: 87073 - DNA, 25 bp, mus musculus
gtgctctcagcgcacacaggtattt

SEQ ID NO: 87074 - DNA, 25 bp, mus musculus
acagtggctattccttcacgcacat

SEQ ID NO: 87075 - DNA, 25 bp, mus musculus
attccttcacgcacattgttcctta

SEQ ID NO: 87076 - DNA, 25 bp, mus musculus
ccttcacgcacattgttccttactg

SEQ ID NO: 87077 - DNA, 25 bp, mus musculus
tcacgcacattgttccttactgtag

SEQ ID NO: 87078 - DNA, 25 bp, mus musculus
acattgttccttactgtagaagcaa

SEQ ID NO: 87079 - DNA, 25 bp, mus musculus
taacgaaccatctaaaagagatcat

SEQ ID NO: 87080 - DNA, 25 bp, mus musculus
aagagatcatatcctacaggcagct

SEQ ID NO: 87081 - DNA, 25 bp, mus musculus
agatcatatcctacaggcagctgca

SEQ ID NO: 87082 - DNA, 25 bp, mus musculus
tatcctacaggcagctgcatgtgat

SEQ ID NO: 87083 - DNA, 25 bp, mus musculus
acaggcagctgcatgtgatggatga

SEQ ID NO: 87084 - DNA, 25 bp, mus musculus
tcagcgcacacaggtatttccgaga

SEQ ID NO: 87085 - DNA, 25 bp, mus musculus
ataacccttctgagctgtgctgcat

SEQ ID NO: 87086 - DNA, 25 bp, mus musculus
cttctgagctgtgctgcatcattgt

SEQ ID NO: 87087 - DNA, 25 bp, mus musculus
ctgagctgtgctgcatcattgtcga

SEQ ID NO: 87088 - DNA, 25 bp, mus musculus
agctgtgctgcatcattgtcgacag

SEQ ID NO: 87089 - DNA, 25 bp, mus musculus
gctgcatcattgtcgacagtggcta

SEQ ID NO: 87090 - DNA, 25 bp, mus musculus
gcatcattgtcgacagtggctattc

SEQ ID NO: 87091 - DNA, 25 bp, mus musculus
tcattgtcgacagtggctattcctt

SEQ ID NO: 87092 - DNA, 25 bp, mus musculus
gcacgagacctgcttcacctgtcag

SEQ ID NO: 87093 - DNA, 25 bp, mus musculus
gacctgcttcacctgtcagcgctgc

SEQ ID NO: 87094 - DNA, 25 bp, mus musculus
tgtgtgcacagcctgcaagaagcag

SEQ ID NO: 87095 - DNA, 25 bp, mus musculus
cacagcctgcaagaagcagctatct

SEQ ID NO: 87096 - DNA, 25 bp, mus musculus
gctatctgggcaacgcttcacagca

SEQ ID NO: 87097 - DNA, 25 bp, mus musculus
tgagtttccatactgcctgacctgc

SEQ ID NO: 87098 - DNA, 25 bp, mus musculus
tccatactgcctgacctgcttctgt

SEQ ID NO: 87099 - DNA, 25 bp, mus musculus
tttcgaggaacgccaatggcacaac

SEQ ID NO: 87100 - DNA, 25 bp, mus musculus
ccaatggcacaacgactgctttaac

SEQ ID NO: 87101 - DNA, 25 bp, mus musculus
gcacaacgactgctttaactgtaag

SEQ ID NO: 87102 - DNA, 25 bp, mus musculus
cttcctcacagagagagatgacatc

SEQ ID NO: 87103 - DNA, 25 bp, mus musculus
tatttgaaggcggcacagaagccac

SEQ ID NO: 87104 - DNA, 25 bp, mus musculus
cttcacctgtcagcgctgccagcag

SEQ ID NO: 87105 - DNA, 25 bp, mus musculus
aggcggcacagaagccacagcgcgt

SEQ ID NO: 87106 - DNA, 25 bp, mus musculus
caagagcttcatacctaaggagaat

SEQ ID NO: 87107 - DNA, 25 bp, mus musculus
tcagaacttctgcgtgccctgctat

SEQ ID NO: 87108 - DNA, 25 bp, mus musculus
cttctgcgtgccctgctatgagaag

SEQ ID NO: 87109 - DNA, 25 bp, mus musculus
gtgcaaaaagcctatcaccacagga

SEQ ID NO: 87110 - DNA, 25 bp, mus musculus
tatcaccacaggaggtgttacttac

SEQ ID NO: 87111 - DNA, 25 bp, mus musculus
tacttaccgggagcagccctggcac

SEQ ID NO: 87112 - DNA, 25 bp, mus musculus
gcagccctggcacaaggaatgcttt

SEQ ID NO: 87113 - DNA, 25 bp, mus musculus
tgtacatccagcaggtgacaacatc

SEQ ID NO: 87114 - DNA, 25 bp, mus musculus
aggtgacaacatcatctgtggcagc

SEQ ID NO: 87115 - DNA, 25 bp, mus musculus
agatctgggtgttctggatgtggcc

SEQ ID NO: 87116 - DNA, 25 bp, mus musculus
tggcaccattcgactcttcagctaa

SEQ ID NO: 87117 - DNA, 25 bp, mus musculus
cattcgactcttcagctaagccaac

SEQ ID NO: 87118 - DNA, 25 bp, mus musculus
actcttcagctaagccaacacacta

SEQ ID NO: 87119 - DNA, 25 bp, mus musculus
gggtgtgcctccacacagaatcctc

SEQ ID NO: 87120 - DNA, 25 bp, mus musculus
acacagaatcctcaatagaatccca

SEQ ID NO: 87121 - DNA, 25 bp, mus musculus
cctgtcttcctgattcagcctccag

SEQ ID NO: 87122 - DNA, 25 bp, mus musculus
ttcctgattcagcctccagcaactg

SEQ ID NO: 87123 - DNA, 25 bp, mus musculus
gcaactgcccagccttgaccttaca

SEQ ID NO: 87124 - DNA, 25 bp, mus musculus
ttgatacaatgtcacccactgaggt

SEQ ID NO: 87125 - DNA, 25 bp, mus musculus
caacatcatctgtggcagctatgac

SEQ ID NO: 87126 - DNA, 25 bp, mus musculus
tgacctggatctttccaccaagcca

SEQ ID NO: 87127 - DNA, 25 bp, mus musculus
ttccaccaagccatacaaagtgctg

SEQ ID NO: 87128 - DNA, 25 bp, mus musculus
caagccatacaaagtgctgaggcac

SEQ ID NO: 87129 - DNA, 25 bp, mus musculus
agtgctgaggcaccacaagaaggcc

SEQ ID NO: 87130 - DNA, 25 bp, mus musculus
ctcagacgacggcagtgttatcgtg

SEQ ID NO: 87131 - DNA, 25 bp, mus musculus
tatcgtgtgccatggcatggtgtac

SEQ ID NO: 87132 - DNA, 25 bp, mus musculus
cctgctgcagaacccattgctggtg

SEQ ID NO: 87133 - DNA, 25 bp, mus musculus
tcggagcaaccacggcgtccgcagt

SEQ ID NO: 87134 - DNA, 25 bp, mus musculus
agcaaccacggcgtccgcagttcgg

SEQ ID NO: 87135 - DNA, 25 bp, mus musculus
ctgcacctggagtaccgcttttaca

SEQ ID NO: 87136 - DNA, 25 bp, mus musculus
gcacctggagtaccgcttttacaag

SEQ ID NO: 87137 - DNA, 25 bp, mus musculus
ctggagtaccgcttttacaagcagc

SEQ ID NO: 87138 - DNA, 25 bp, mus musculus
agtaccgcttttacaagcagctcag

SEQ ID NO: 87139 - DNA, 25 bp, mus musculus
taccgcttttacaagcagctcagca

SEQ ID NO: 87140 - DNA, 25 bp, mus musculus
ccgcttttacaagcagctcagcacg

SEQ ID NO: 87141 - DNA, 25 bp, mus musculus
gcttttacaagcagctcagcacgac

SEQ ID NO: 87142 - DNA, 25 bp, mus musculus
ttacaagcagctcagcacgacagag

SEQ ID NO: 87143 - DNA, 25 bp, mus musculus
acaagcagctcagcacgacagaggg

SEQ ID NO: 87144 - DNA, 25 bp, mus musculus
gcagctcagcacgacagagggcgtc

SEQ ID NO: 87145 - DNA, 25 bp, mus musculus
gaccagctcaggggtcctgatggtg

SEQ ID NO: 87146 - DNA, 25 bp, mus musculus
agcttcgcctaggaaagaatctgta

SEQ ID NO: 87147 - DNA, 25 bp, mus musculus
gtacgtggctatcaagctggagccc

SEQ ID NO: 87148 - DNA, 25 bp, mus musculus
acgtggctatcaagctggagcccat

SEQ ID NO: 87149 - DNA, 25 bp, mus musculus
ggctatcaagctggagcccatcaag

SEQ ID NO: 87150 - DNA, 25 bp, mus musculus
ctatcaagctggagcccatcaagtc

SEQ ID NO: 87151 - DNA, 25 bp, mus musculus
ggccccacagctgcacctggagtac

SEQ ID NO: 87152 - DNA, 25 bp, mus musculus
acagctgcacctggagtaccgcttt

SEQ ID NO: 87153 - DNA, 25 bp, mus musculus
agtatgtcataccaatgcctttgta

SEQ ID NO: 87154 - DNA, 25 bp, mus musculus
caatgcctttgtacacttgtgtgtg

SEQ ID NO: 87155 - DNA, 25 bp, mus musculus
gtgttgtgcactgatctcagaagaa

SEQ ID NO: 87156 - DNA, 25 bp, mus musculus
tgcactgatctcagaagaatgctta

SEQ ID NO: 87157 - DNA, 25 bp, mus musculus
ttgtaatttctctttctcataggaa

SEQ ID NO: 87158 - DNA, 25 bp, mus musculus
tttctcataggaatccagttcattc

SEQ ID NO: 87159 - DNA, 25 bp, mus musculus
atccagttcattcttatgtacctat

SEQ ID NO: 87160 - DNA, 25 bp, mus musculus
ttcattcttatgtacctatgctgag

SEQ ID NO: 87161 - DNA, 25 bp, mus musculus
tacctatgctgagaatcgtgccaat

SEQ ID NO: 87162 - DNA, 25 bp, mus musculus
taagaagccaatacttccttagatg

SEQ ID NO: 87163 - DNA, 25 bp, mus musculus
gccaatacttccttagatgatgcaa

SEQ ID NO: 87164 - DNA, 25 bp, mus musculus
acttccttagatgatgcaataaata

SEQ ID NO: 87165 - DNA, 25 bp, mus musculus
tagtaaacaactgatcctgatccaa

SEQ ID NO: 87166 - DNA, 25 bp, mus musculus
gatcctgatccaagtttctacattt

SEQ ID NO: 87167 - DNA, 25 bp, mus musculus
tcctatctcaggttggctgctatga

SEQ ID NO: 87168 - DNA, 25 bp, mus musculus
ctcaggttggctgctatgagacaaa

SEQ ID NO: 87169 - DNA, 25 bp, mus musculus
acttacacatgccttgggctcttct

SEQ ID NO: 87170 - DNA, 25 bp, mus musculus
ctcttctctgttgtgagtgtatata

SEQ ID NO: 87171 - DNA, 25 bp, mus musculus
accagcattacagtgttgtgcactg

SEQ ID NO: 87172 - DNA, 25 bp, mus musculus
attacagtgttgtgcactgatctca

SEQ ID NO: 87173 - DNA, 25 bp, mus musculus
cctactcccatgacaacattatctg

SEQ ID NO: 87174 - DNA, 25 bp, mus musculus
ttatctgtggtatcacatctgtttc

SEQ ID NO: 87175 - DNA, 25 bp, mus musculus
atggatgccatggcgactggaagac

SEQ ID NO: 87176 - DNA, 25 bp, mus musculus
ccattccaaccttgaatcgttacag

SEQ ID NO: 87177 - DNA, 25 bp, mus musculus
caaccttgaatcgttacagcgatag

SEQ ID NO: 87178 - DNA, 25 bp, mus musculus
gcgatagcatatcctatccaaccat

SEQ ID NO: 87179 - DNA, 25 bp, mus musculus
gcatatcctatccaaccatactaac

SEQ ID NO: 87180 - DNA, 25 bp, mus musculus
tttccttcacttattgctgaaccaa

SEQ ID NO: 87181 - DNA, 25 bp, mus musculus
tcacttattgctgaaccaagagcac

SEQ ID NO: 87182 - DNA, 25 bp, mus musculus
attgctgaaccaagagcacaattcc

SEQ ID NO: 87183 - DNA, 25 bp, mus musculus
gaaccaagagcacaattcccattaa

SEQ ID NO: 87184 - DNA, 25 bp, mus musculus
aaattgtgcatttttctgggccatt

SEQ ID NO: 87185 - DNA, 25 bp, mus musculus
tcacatctgtttccttctccaagag

SEQ ID NO: 87186 - DNA, 25 bp, mus musculus
ctgtttccttctccaagagtggccg

SEQ ID NO: 87187 - DNA, 25 bp, mus musculus
tccttgctgggtatgatgacttcaa

SEQ ID NO: 87188 - DNA, 25 bp, mus musculus
cactcaaagctgacagagcaggtgt

SEQ ID NO: 87189 - DNA, 25 bp, mus musculus
tcttagctggacacgacaaccgagt

SEQ ID NO: 87190 - DNA, 25 bp, mus musculus
ctggacacgacaaccgagtcagctg

SEQ ID NO: 87191 - DNA, 25 bp, mus musculus
acgacaaccgagtcagctgcttggg

SEQ ID NO: 87192 - DNA, 25 bp, mus musculus
tggcaacagggtcctgggacagctt

SEQ ID NO: 87193 - DNA, 25 bp, mus musculus
ctaacagtggcctggactacatcaa

SEQ ID NO: 87194 - DNA, 25 bp, mus musculus
tggactacatcaaagtcacctggaa

SEQ ID NO: 87195 - DNA, 25 bp, mus musculus
tggtcattgccttctgcaacagctg

SEQ ID NO: 87196 - DNA, 25 bp, mus musculus
ttgccttctgcaacagctgctgcag

SEQ ID NO: 87197 - DNA, 25 bp, mus musculus
tctgcaacagctgctgcagcgaacc

SEQ ID NO: 87198 - DNA, 25 bp, mus musculus
gcgaacctgtgcacatgttcaccat

SEQ ID NO: 87199 - DNA, 25 bp, mus musculus
ctgtgcacatgttcaccatttggct

SEQ ID NO: 87200 - DNA, 25 bp, mus musculus
acatgttcaccatttggctgggcta

SEQ ID NO: 87201 - DNA, 25 bp, mus musculus
tgggctacatcaactccacgctgaa

SEQ ID NO: 87202 - DNA, 25 bp, mus musculus
tcatctacccgctgtgcaacgagaa

SEQ ID NO: 87203 - DNA, 25 bp, mus musculus
atgtccaaaggatgccacatggtgg

SEQ ID NO: 87204 - DNA, 25 bp, mus musculus
ggcgtcgctagacccctgagcctag

SEQ ID NO: 87205 - DNA, 25 bp, mus musculus
acatcaaagtcacctggaagaggct

SEQ ID NO: 87206 - DNA, 25 bp, mus musculus
aagtcacctggaagaggctccgctc

SEQ ID NO: 87207 - DNA, 25 bp, mus musculus
tccgctcacattccagacagtatgt

SEQ ID NO: 87208 - DNA, 25 bp, mus musculus
cacattccagacagtatgtgtccgg

SEQ ID NO: 87209 - DNA, 25 bp, mus musculus
ccagacagtatgtgtccgggttgca

SEQ ID NO: 87210 - DNA, 25 bp, mus musculus
ggattccctatttcatcttcttcat

SEQ ID NO: 87211 - DNA, 25 bp, mus musculus
cctatttcatcttcttcatggtcat

SEQ ID NO: 87212 - DNA, 25 bp, mus musculus
tcttcatggtcattgccttctgcaa

SEQ ID NO: 87213 - DNA, 25 bp, mus musculus
tcggaagctccagtcccataggttt

SEQ ID NO: 87214 - DNA, 25 bp, mus musculus
ctgctgactcaagtgcagagtgtca

SEQ ID NO: 87215 - DNA, 25 bp, mus musculus
gacctcagctttctctagctcccta

SEQ ID NO: 87216 - DNA, 25 bp, mus musculus
agctttctctagctccctagtctag

SEQ ID NO: 87217 - DNA, 25 bp, mus musculus
tcccagctgcactttaaccctaggg

SEQ ID NO: 87218 - DNA, 25 bp, mus musculus
cagctgcactttaaccctagggcag

SEQ ID NO: 87219 - DNA, 25 bp, mus musculus
cctctgtcccctgatatgctggtac

SEQ ID NO: 87220 - DNA, 25 bp, mus musculus
ctgtcccctgatatgctggtaccat

SEQ ID NO: 87221 - DNA, 25 bp, mus musculus
atgctggtaccattgtttgtgtcca

SEQ ID NO: 87222 - DNA, 25 bp, mus musculus
ttgtttgtgtccaggggatgccagc

SEQ ID NO: 87223 - DNA, 25 bp, mus musculus
tttgtgtccaggggatgccagctca

SEQ ID NO: 87224 - DNA, 25 bp, mus musculus
taactagtagccatctcccctggac

SEQ ID NO: 87225 - DNA, 25 bp, mus musculus
ctgactcaagtgcagagtgtcactg

SEQ ID NO: 87226 - DNA, 25 bp, mus musculus
ctccctctggagatcttagctctct

SEQ ID NO: 87227 - DNA, 25 bp, mus musculus
tctggaccctttaggaaagtagctg

SEQ ID NO: 87228 - DNA, 25 bp, mus musculus
gtagctgcagccagccctgctgtct

SEQ ID NO: 87229 - DNA, 25 bp, mus musculus
gccggtctttctgaaagaggtgatg

SEQ ID NO: 87230 - DNA, 25 bp, mus musculus
gatggtccatctccatcacctggga

SEQ ID NO: 87231 - DNA, 25 bp, mus musculus
tctccatcacctgggaccatagtgg

SEQ ID NO: 87232 - DNA, 25 bp, mus musculus
actgacctcagctttctctagctcc

SEQ ID NO: 87233 - DNA, 25 bp, mus musculus
attaccaaggacatgtttgaagaag

SEQ ID NO: 87234 - DNA, 25 bp, mus musculus
gccctgcgagctttggctgatgatg

SEQ ID NO: 87235 - DNA, 25 bp, mus musculus
ttacctgtttgtacacagagagcct

SEQ ID NO: 87236 - DNA, 25 bp, mus musculus
acacagagagcctaagcccagtttt

SEQ ID NO: 87237 - DNA, 25 bp, mus musculus
ctgtgcctttgttgtgttgcaatgc

SEQ ID NO: 87238 - DNA, 25 bp, mus musculus
gtaccatgcatgctgtatgtagagg

SEQ ID NO: 87239 - DNA, 25 bp, mus musculus
gctatgtccttactgtgtggagcat

SEQ ID NO: 87240 - DNA, 25 bp, mus musculus
tataactggcagccgtacatccttt

SEQ ID NO: 87241 - DNA, 25 bp, mus musculus
tggcagccgtacatcctttactgtg

SEQ ID NO: 87242 - DNA, 25 bp, mus musculus
ccgtacatcctttactgtgatatga

SEQ ID NO: 87243 - DNA, 25 bp, mus musculus
atcctttactgtgatatgatgggct

SEQ ID NO: 87244 - DNA, 25 bp, mus musculus
tcccataactattattagaacaaag

SEQ ID NO: 87245 - DNA, 25 bp, mus musculus
gatttcctaacagtgactgggaaga

SEQ ID NO: 87246 - DNA, 25 bp, mus musculus
gctgcatggccctcggactagagtc

SEQ ID NO: 87247 - DNA, 25 bp, mus musculus
tggccctcggactagagtcactcac

SEQ ID NO: 87248 - DNA, 25 bp, mus musculus
tagagtcactcactgttgttattgc

SEQ ID NO: 87249 - DNA, 25 bp, mus musculus
aggcagtattccactatataaacct

SEQ ID NO: 87250 - DNA, 25 bp, mus musculus
actatataaacctcttctattcctg

SEQ ID NO: 87251 - DNA, 25 bp, mus musculus
taaacctcttctattcctggaatgt

SEQ ID NO: 87252 - DNA, 25 bp, mus musculus
tgcttcttacctgtttgtacacaga

SEQ ID NO: 87253 - DNA, 25 bp, mus musculus
tgtcctgcttctcctgagatgatgg

SEQ ID NO: 87254 - DNA, 25 bp, mus musculus
tgacacagccttctccttgtggact

SEQ ID NO: 87255 - DNA, 25 bp, mus musculus
ttgcttctctcctttaagacacaag

SEQ ID NO: 87256 - DNA, 25 bp, mus musculus
ctctcctttaagacacaagacctga

SEQ ID NO: 87257 - DNA, 25 bp, mus musculus
tttaagacacaagacctgagctcac

SEQ ID NO: 87258 - DNA, 25 bp, mus musculus
gacctgagctcacatttgtaatacc

SEQ ID NO: 87259 - DNA, 25 bp, mus musculus
catttgtaataccaacatcaagaag

SEQ ID NO: 87260 - DNA, 25 bp, mus musculus
taataccaacatcaagaaggcagag

SEQ ID NO: 87261 - DNA, 25 bp, mus musculus
ttcaagacctagactagttagtgag

SEQ ID NO: 87262 - DNA, 25 bp, mus musculus
gttctagaccagtctaagctgcggt

SEQ ID NO: 87263 - DNA, 25 bp, mus musculus
gaccagtctaagctgcggtgatgtc

SEQ ID NO: 87264 - DNA, 25 bp, mus musculus
tctaagctgcggtgatgtcctgttt

SEQ ID NO: 87265 - DNA, 25 bp, mus musculus
ctccttgtggacttaggccacacat

SEQ ID NO: 87266 - DNA, 25 bp, mus musculus
ttaggccacacatgctaaataaaga

SEQ ID NO: 87267 - DNA, 25 bp, mus musculus
tgtccaatctagaaagcatatttaa

SEQ ID NO: 87268 - DNA, 25 bp, mus musculus
ttggtatcggtaccaggagaagcca

SEQ ID NO: 87269 - DNA, 25 bp, mus musculus
catcattcttgtacattgacatttt

SEQ ID NO: 87270 - DNA, 25 bp, mus musculus
ttcttaaatagctcacagggatagg

SEQ ID NO: 87271 - DNA, 25 bp, mus musculus
aatagctcacagggataggtagcgc

SEQ ID NO: 87272 - DNA, 25 bp, mus musculus
gacggattgcttctctcctttaaga

SEQ ID NO: 87273 - DNA, 25 bp, mus musculus
gaagcccaagactgatgagagtcac

SEQ ID NO: 87274 - DNA, 25 bp, mus musculus
aatcttggtctgggtcggcacagaa

SEQ ID NO: 87275 - DNA, 25 bp, mus musculus
tagcatgactacaccagacaaccga

SEQ ID NO: 87276 - DNA, 25 bp, mus musculus
agcatgactacaccagacaaccgag

SEQ ID NO: 87277 - DNA, 25 bp, mus musculus
gcatgactacaccagacaaccgagg

SEQ ID NO: 87278 - DNA, 25 bp, mus musculus
catgactacaccagacaaccgagga

SEQ ID NO: 87279 - DNA, 25 bp, mus musculus
atgactacaccagacaaccgaggaa

SEQ ID NO: 87280 - DNA, 25 bp, mus musculus
tgactacaccagacaaccgaggaat

SEQ ID NO: 87281 - DNA, 25 bp, mus musculus
caccagacaaccgaggaattcgact

SEQ ID NO: 87282 - DNA, 25 bp, mus musculus
ccagacaaccgaggaattcgactct

SEQ ID NO: 87283 - DNA, 25 bp, mus musculus
tatcacgagccataggaagtgaacc

SEQ ID NO: 87284 - DNA, 25 bp, mus musculus
atcacgagccataggaagtgaaccg

SEQ ID NO: 87285 - DNA, 25 bp, mus musculus
ggctggcgctagctagcatgactac

SEQ ID NO: 87286 - DNA, 25 bp, mus musculus
ctggcgctagctagcatgactacac

SEQ ID NO: 87287 - DNA, 25 bp, mus musculus
ggcgctagctagcatgactacacca

SEQ ID NO: 87288 - DNA, 25 bp, mus musculus
agctagcatgactacaccagacaac

SEQ ID NO: 87289 - DNA, 25 bp, mus musculus
gctagcatgactacaccagacaacc

SEQ ID NO: 87290 - DNA, 25 bp, mus musculus
ctagcatgactacaccagacaaccg

SEQ ID NO: 87291 - DNA, 25 bp, mus musculus
gaatcgaagcctcttaggatggcag

SEQ ID NO: 87292 - DNA, 25 bp, mus musculus
cctcttaggatggcaggtgatttgg

SEQ ID NO: 87293 - DNA, 25 bp, mus musculus
agactggcaagcatggccatgcaaa

SEQ ID NO: 87294 - DNA, 25 bp, mus musculus
gcaagcatggccatgcaaaggtcca

SEQ ID NO: 87295 - DNA, 25 bp, mus musculus
caaaggtccatctggttgacattga

SEQ ID NO: 87296 - DNA, 25 bp, mus musculus
aggtccatctggttgacattgacat

SEQ ID NO: 87297 - DNA, 25 bp, mus musculus
acattgacatatttactgggaagat

SEQ ID NO: 87298 - DNA, 25 bp, mus musculus
attgaagaatctgcccgtcgactca

SEQ ID NO: 87299 - DNA, 25 bp, mus musculus
gaagaatctgcccgtcgactcaaaa

SEQ ID NO: 87300 - DNA, 25 bp, mus musculus
gaatctgcccgtcgactcaaaatat

SEQ ID NO: 87301 - DNA, 25 bp, mus musculus
tctgcccgtcgactcaaaatatgga

SEQ ID NO: 87302 - DNA, 25 bp, mus musculus
gcccgtcgactcaaaatatggatgg

SEQ ID NO: 87303 - DNA, 25 bp, mus musculus
gccaccttccacatgcagtgctcaa

SEQ ID NO: 87304 - DNA, 25 bp, mus musculus
ttccacatgcagtgctcaagcgtta

SEQ ID NO: 87305 - DNA, 25 bp, mus musculus
cacatgcagtgctcaagcgttacgt

SEQ ID NO: 87306 - DNA, 25 bp, mus musculus
atgcagtgctcaagcgttacgtcag

SEQ ID NO: 87307 - DNA, 25 bp, mus musculus
tgctcaagcgttacgtcagagatgg

SEQ ID NO: 87308 - DNA, 25 bp, mus musculus
tcaagcgttacgtcagagatggttt

SEQ ID NO: 87309 - DNA, 25 bp, mus musculus
tggtgctcgatagccggacatgtag

SEQ ID NO: 87310 - DNA, 25 bp, mus musculus
tcgatagccggacatgtaggatcgt

SEQ ID NO: 87311 - DNA, 25 bp, mus musculus
aattcagcgaacaatgttggaactg

SEQ ID NO: 87312 - DNA, 25 bp, mus musculus
agttatcatggccacaaaccgaata

SEQ ID NO: 87313 - DNA, 25 bp, mus musculus
gatggccttgcgggaacgcagaatg

SEQ ID NO: 87314 - DNA, 25 bp, mus musculus
ctatctctagtggcccacagtcgtc

SEQ ID NO: 87315 - DNA, 25 bp, mus musculus
ccattctccagttcatttttgccag

SEQ ID NO: 87316 - DNA, 25 bp, mus musculus
tccagttcatttttgccagtagaaa

SEQ ID NO: 87317 - DNA, 25 bp, mus musculus
agcctgtatcgtggaggacactgtg

SEQ ID NO: 87318 - DNA, 25 bp, mus musculus
cactgtgcctccatatgttgttggt

SEQ ID NO: 87319 - DNA, 25 bp, mus musculus
gcctccatatgttgttggtcattgt

SEQ ID NO: 87320 - DNA, 25 bp, mus musculus
atatgttgttggtcattgtgccgtg

SEQ ID NO: 87321 - DNA, 25 bp, mus musculus
tgttggtcattgtgccgtgctgctc

SEQ ID NO: 87322 - DNA, 25 bp, mus musculus
tgccgtgctgctctctactcccaat

SEQ ID NO: 87323 - DNA, 25 bp, mus musculus
catggccacaaaccgaatagaaact

SEQ ID NO: 87324 - DNA, 25 bp, mus musculus
tttggatccagcacttatcaggcca

SEQ ID NO: 87325 - DNA, 25 bp, mus musculus
caggccaggccgcattgacagaaag

SEQ ID NO: 87326 - DNA, 25 bp, mus musculus
gcgtatcttccagattcacaccagc

SEQ ID NO: 87327 - DNA, 25 bp, mus musculus
cttccagattcacaccagcaggatg

SEQ ID NO: 87328 - DNA, 25 bp, mus musculus
caccagcaggatgacactggctgat

SEQ ID NO: 87329 - DNA, 25 bp, mus musculus
tgacctctctggggccgacatcaag

SEQ ID NO: 87330 - DNA, 25 bp, mus musculus
tggcttgatggccttgcgggaacgc

SEQ ID NO: 87331 - DNA, 25 bp, mus musculus
gatggcaactaggcctctatggcaa

SEQ ID NO: 87332 - DNA, 25 bp, mus musculus
atggcaactaggcctctatggcaaa

SEQ ID NO: 87333 - DNA, 25 bp, mus musculus
caagcctaggaactccggacaagca

SEQ ID NO: 87334 - DNA, 25 bp, mus musculus
aagcctaggaactccggacaagcag

SEQ ID NO: 87335 - DNA, 25 bp, mus musculus
agcctaggaactccggacaagcaga

SEQ ID NO: 87336 - DNA, 25 bp, mus musculus
gcctaggaactccggacaagcagaa

SEQ ID NO: 87337 - DNA, 25 bp, mus musculus
ctaggaactccggacaagcagaaag

SEQ ID NO: 87338 - DNA, 25 bp, mus musculus
taggaactccggacaagcagaaagg

SEQ ID NO: 87339 - DNA, 25 bp, mus musculus
gaagcgagtccttggtctggtgttg

SEQ ID NO: 87340 - DNA, 25 bp, mus musculus
tggcaactaggcctctatggcaaaa

SEQ ID NO: 87341 - DNA, 25 bp, mus musculus
ggcaactaggcctctatggcaaaaa

SEQ ID NO: 87342 - DNA, 25 bp, mus musculus
gcaactaggcctctatggcaaaaaa

SEQ ID NO: 87343 - DNA, 25 bp, mus musculus
caactaggcctctatggcaaaaaat

SEQ ID NO: 87344 - DNA, 25 bp, mus musculus
agatcaagcctaggaactccggaca

SEQ ID NO: 87345 - DNA, 25 bp, mus musculus
gatcaagcctaggaactccggacaa

SEQ ID NO: 87346 - DNA, 25 bp, mus musculus
atcaagcctaggaactccggacaag

SEQ ID NO: 87347 - DNA, 25 bp, mus musculus
tcaagcctaggaactccggacaagc

SEQ ID NO: 87348 - DNA, 25 bp, mus musculus
gaatccagagaccatcagggaacgt

SEQ ID NO: 87349 - DNA, 25 bp, mus musculus
agagaccatcagggaacgtgcaggg

SEQ ID NO: 87350 - DNA, 25 bp, mus musculus
ctcaagccctatgaaccccacatgt

SEQ ID NO: 87351 - DNA, 25 bp, mus musculus
cacatgtgcagcctgcctccttctt

SEQ ID NO: 87352 - DNA, 25 bp, mus musculus
ctgcctccttcttgctggtcaaaag

SEQ ID NO: 87353 - DNA, 25 bp, mus musculus
gtgctggaccaatgctcagactcca

SEQ ID NO: 87354 - DNA, 25 bp, mus musculus
gaccaatgctcagactccagcctct

SEQ ID NO: 87355 - DNA, 25 bp, mus musculus
agcctctttcacgccacattgaagt

SEQ ID NO: 87356 - DNA, 25 bp, mus musculus
tttcacgccacattgaagttagggg

SEQ ID NO: 87357 - DNA, 25 bp, mus musculus
gcatcaccgattcttccaggattgg

SEQ ID NO: 87358 - DNA, 25 bp, mus musculus
tgggcaccacgcctcacagaaatca

SEQ ID NO: 87359 - DNA, 25 bp, mus musculus
ccacgcctcacagaaatcaagataa

SEQ ID NO: 87360 - DNA, 25 bp, mus musculus
cggcccacactaaatgcaggctgta

SEQ ID NO: 87361 - DNA, 25 bp, mus musculus
agcccagtgggagctcagccagggt

SEQ ID NO: 87362 - DNA, 25 bp, mus musculus
tagagcctgactccttcattctcta

SEQ ID NO: 87363 - DNA, 25 bp, mus musculus
ctgactccttcattctctagtgatg

SEQ ID NO: 87364 - DNA, 25 bp, mus musculus
ccttcattctctagtgatgtttgac

SEQ ID NO: 87365 - DNA, 25 bp, mus musculus
gtttgaccacaacaagatagtagcg

SEQ ID NO: 87366 - DNA, 25 bp, mus musculus
ccaaaggatatcccaagcaagggat

SEQ ID NO: 87367 - DNA, 25 bp, mus musculus
ttgtccactgtccaccctagccagg

SEQ ID NO: 87368 - DNA, 25 bp, mus musculus
actcagtgtgcgcgctcctcacaaa

SEQ ID NO: 87369 - DNA, 25 bp, mus musculus
cgctcctcacaaagggcctcctggt

SEQ ID NO: 87370 - DNA, 25 bp, mus musculus
attcctgagaccggcactccaaaat

SEQ ID NO: 87371 - DNA, 25 bp, mus musculus
gagaccggcactccaaaatctgccc

SEQ ID NO: 87372 - DNA, 25 bp, mus musculus
tcccttcaaacatcagaagagctgg

SEQ ID NO: 87373 - DNA, 25 bp, mus musculus
aagtcttgcaagctgaggcagcaga

SEQ ID NO: 87374 - DNA, 25 bp, mus musculus
tcttgcaagctgaggcagcagatag

SEQ ID NO: 87375 - DNA, 25 bp, mus musculus
gggaagcagctcctcaacttagtgg

SEQ ID NO: 87376 - DNA, 25 bp, mus musculus
aagcagctcctcaacttagtggtca

SEQ ID NO: 87377 - DNA, 25 bp, mus musculus
ctcaacttagtggtcattggtcatg

SEQ ID NO: 87378 - DNA, 25 bp, mus musculus
ttagtggtcattggtcatgttgatg

SEQ ID NO: 87379 - DNA, 25 bp, mus musculus
attggtcatgttgatgctgggaaaa

SEQ ID NO: 87380 - DNA, 25 bp, mus musculus
tcctcacaaagggcctcctggtgat

SEQ ID NO: 87381 - DNA, 25 bp, mus musculus
caaagggcctcctggtgatgatgtg

SEQ ID NO: 87382 - DNA, 25 bp, mus musculus
agggcctcctggtgatgatgtgagc

SEQ ID NO: 87383 - DNA, 25 bp, mus musculus
gcctcctggtgatgatgtgagcgta

SEQ ID NO: 87384 - DNA, 25 bp, mus musculus
gagcgtacttctcctaacattcctg

SEQ ID NO: 87385 - DNA, 25 bp, mus musculus
cgtacttctcctaacattcctgaga

SEQ ID NO: 87386 - DNA, 25 bp, mus musculus
cctaacattcctgagaccggcactc

SEQ ID NO: 87387 - DNA, 25 bp, mus musculus
aacattcctgagaccggcactccaa

SEQ ID NO: 87388 - DNA, 25 bp, mus musculus
aatgtctccatcaggccttcactat

SEQ ID NO: 87389 - DNA, 25 bp, mus musculus
gtctccatcaggccttcactatcat

SEQ ID NO: 87390 - DNA, 25 bp, mus musculus
ttatgacgcaggctgaccggttcag

SEQ ID NO: 87391 - DNA, 25 bp, mus musculus
ttgcagctttcccgccagatgtctg

SEQ ID NO: 87392 - DNA, 25 bp, mus musculus
tcccgccagatgtctgtggcaactt

SEQ ID NO: 87393 - DNA, 25 bp, mus musculus
cgccagatgtctgtggcaacttaga

SEQ ID NO: 87394 - DNA, 25 bp, mus musculus
atctgtgctacgtcatcacacacgg

SEQ ID NO: 87395 - DNA, 25 bp, mus musculus
tgtgctacgtcatcacacacggcga

SEQ ID NO: 87396 - DNA, 25 bp, mus musculus
tcatcacacacggcgaggagaagga

SEQ ID NO: 87397 - DNA, 25 bp, mus musculus
tgtgtctcctccatacctggagtca

SEQ ID NO: 87398 - DNA, 25 bp, mus musculus
atacctggagtcagccaagatgggg

SEQ ID NO: 87399 - DNA, 25 bp, mus musculus
cagtttccatcactcccagagtccg

SEQ ID NO: 87400 - DNA, 25 bp, mus musculus
atcaggccttcactatcatggacca

SEQ ID NO: 87401 - DNA, 25 bp, mus musculus
gggacacctttgctgcactgggtcg

SEQ ID NO: 87402 - DNA, 25 bp, mus musculus
cctttgctgcactgggtcgcataaa

SEQ ID NO: 87403 - DNA, 25 bp, mus musculus
tcaagggcacggacccagaagagac

SEQ ID NO: 87404 - DNA, 25 bp, mus musculus
ctatactgcacgccttcaaagtgtt

SEQ ID NO: 87405 - DNA, 25 bp, mus musculus
tactgcacgccttcaaagtgtttga

SEQ ID NO: 87406 - DNA, 25 bp, mus musculus
tgcacgccttcaaagtgtttgacac

SEQ ID NO: 87407 - DNA, 25 bp, mus musculus
agcttatgacgcaggctgaccggtt

SEQ ID NO: 87408 - DNA, 25 bp, mus musculus
ttcagtgcacggggaatttgaccca

SEQ ID NO: 87409 - DNA, 25 bp, mus musculus
caaagctctatggtatcgctggctc

SEQ ID NO: 87410 - DNA, 25 bp, mus musculus
tatcgctggctcaaccaatgtgact

SEQ ID NO: 87411 - DNA, 25 bp, mus musculus
atcgctggctcaaccaatgtgactg

SEQ ID NO: 87412 - DNA, 25 bp, mus musculus
tggctcaaccaatgtgactggggat

SEQ ID NO: 87413 - DNA, 25 bp, mus musculus
ggctcaaccaatgtgactggggata

SEQ ID NO: 87414 - DNA, 25 bp, mus musculus
gctcaaccaatgtgactggggataa

SEQ ID NO: 87415 - DNA, 25 bp, mus musculus
ctcaaccaatgtgactggggataat

SEQ ID NO: 87416 - DNA, 25 bp, mus musculus
tcaaccaatgtgactggggataatg

SEQ ID NO: 87417 - DNA, 25 bp, mus musculus
caaccaatgtgactggggataatgt

SEQ ID NO: 87418 - DNA, 25 bp, mus musculus
acctggacatatttccaaatgacct

SEQ ID NO: 87419 - DNA, 25 bp, mus musculus
cctggacatatttccaaatgacctg

SEQ ID NO: 87420 - DNA, 25 bp, mus musculus
aaagctctatggtatcgctggctca

SEQ ID NO: 87421 - DNA, 25 bp, mus musculus
aagctctatggtatcgctggctcaa

SEQ ID NO: 87422 - DNA, 25 bp, mus musculus
agctctatggtatcgctggctcaac

SEQ ID NO: 87423 - DNA, 25 bp, mus musculus
tatggtatcgctggctcaaccaatg

SEQ ID NO: 87424 - DNA, 25 bp, mus musculus
atggtatcgctggctcaaccaatgt

SEQ ID NO: 87425 - DNA, 25 bp, mus musculus
tggtatcgctggctcaaccaatgtg

SEQ ID NO: 87426 - DNA, 25 bp, mus musculus
ggtatcgctggctcaaccaatgtga

SEQ ID NO: 87427 - DNA, 25 bp, mus musculus
gtatcgctggctcaaccaatgtgac

SEQ ID NO: 87428 - DNA, 25 bp, mus musculus
gtcctcatgctggccttcggagcct

SEQ ID NO: 87429 - DNA, 25 bp, mus musculus
tcctcatgctggccttcggagcctt

SEQ ID NO: 87430 - DNA, 25 bp, mus musculus
ttctaaggtccatcctgagagaact

SEQ ID NO: 87431 - DNA, 25 bp, mus musculus
tctaaggtccatcctgagagaactg

SEQ ID NO: 87432 - DNA, 25 bp, mus musculus
ctaaggtccatcctgagagaactgg

SEQ ID NO: 87433 - DNA, 25 bp, mus musculus
taaggtccatcctgagagaactggc

SEQ ID NO: 87434 - DNA, 25 bp, mus musculus
aggtccatcctgagagaactggcta

SEQ ID NO: 87435 - DNA, 25 bp, mus musculus
ggtccatcctgagagaactggctac

SEQ ID NO: 87436 - DNA, 25 bp, mus musculus
catgctggccttcggagccttgccc

SEQ ID NO: 87437 - DNA, 25 bp, mus musculus
catggccatcgagaacactcaagaa

SEQ ID NO: 87438 - DNA, 25 bp, mus musculus
atggccatcgagaacactcaagaag

SEQ ID NO: 87439 - DNA, 25 bp, mus musculus
tggccatcgagaacactcaagaaga

SEQ ID NO: 87440 - DNA, 25 bp, mus musculus
ggccatcgagaacactcaagaagaa

SEQ ID NO: 87441 - DNA, 25 bp, mus musculus
gccatcgagaacactcaagaagaag

SEQ ID NO: 87442 - DNA, 25 bp, mus musculus
ccatcgagaacactcaagaagaaga

SEQ ID NO: 87443 - DNA, 25 bp, mus musculus
cttctaaggtccatcctgagagaac

SEQ ID NO: 87444 - DNA, 25 bp, mus musculus
aatcagagaacttcgcaccggggcg

SEQ ID NO: 87445 - DNA, 25 bp, mus musculus
ctgagacaatcctgcagagatctgc

SEQ ID NO: 87446 - DNA, 25 bp, mus musculus
gcataagcctcattactacttgaac

SEQ ID NO: 87447 - DNA, 25 bp, mus musculus
taagcctcattactacttgaacttt

SEQ ID NO: 87448 - DNA, 25 bp, mus musculus
gcctcattactacttgaactttcca

SEQ ID NO: 87449 - DNA, 25 bp, mus musculus
tccaaaacctagcgaggaacgtgca

SEQ ID NO: 87450 - DNA, 25 bp, mus musculus
tgcaatgcttgttgtccagccaaag

SEQ ID NO: 87451 - DNA, 25 bp, mus musculus
aatgcttgttgtccagccaaaggta

SEQ ID NO: 87452 - DNA, 25 bp, mus musculus
tgtccagccaaaggtaactatagta

SEQ ID NO: 87453 - DNA, 25 bp, mus musculus
aatgtctcagcaaggtgtaaggttg

SEQ ID NO: 87454 - DNA, 25 bp, mus musculus
gcgcctgattatcgcctgtggatga

SEQ ID NO: 87455 - DNA, 25 bp, mus musculus
cctgattatcgcctgtggatgaaga

SEQ ID NO: 87456 - DNA, 25 bp, mus musculus
tgcagagatctgcctggctgcccct

SEQ ID NO: 87457 - DNA, 25 bp, mus musculus
aaaccaataaactgtctcaatgctg

SEQ ID NO: 87458 - DNA, 25 bp, mus musculus
gatctgcctggctgcccctagggga

SEQ ID NO: 87459 - DNA, 25 bp, mus musculus
cagaggaacccaagaccaagccagg

SEQ ID NO: 87460 - DNA, 25 bp, mus musculus
ccaagaccaagccaggctcatgcca

SEQ ID NO: 87461 - DNA, 25 bp, mus musculus
catgccagaaaccgagacttacagg

SEQ ID NO: 87462 - DNA, 25 bp, mus musculus
gccttgcccgctcataaactggttt

SEQ ID NO: 87463 - DNA, 25 bp, mus musculus
gctcataaactggtttctcacgggg

SEQ ID NO: 87464 - DNA, 25 bp, mus musculus
gtttctcacggggcataagcctcat

SEQ ID NO: 87465 - DNA, 25 bp, mus musculus
ctgctcacacacctggaccatggac

SEQ ID NO: 87466 - DNA, 25 bp, mus musculus
acacacctggaccatggaccctggg

SEQ ID NO: 87467 - DNA, 25 bp, mus musculus
ctgtcccccaggctgtgccaagtgt

SEQ ID NO: 87468 - DNA, 25 bp, mus musculus
tcccccaggctgtgccaagtgtgcc

SEQ ID NO: 87469 - DNA, 25 bp, mus musculus
ctgtgccaagtgtgcccggggctgc

SEQ ID NO: 87470 - DNA, 25 bp, mus musculus
tgccaagtgtgcccggggctgcatc

SEQ ID NO: 87471 - DNA, 25 bp, mus musculus
caagtgcagctgctgtccctgaaac

SEQ ID NO: 87472 - DNA, 25 bp, mus musculus
tccctgaaacccacctatggcagcg

SEQ ID NO: 87473 - DNA, 25 bp, mus musculus
ctgaaacccacctatggcagcggga

SEQ ID NO: 87474 - DNA, 25 bp, mus musculus
cccacctatggcagcgggagagatc

SEQ ID NO: 87475 - DNA, 25 bp, mus musculus
aagtgactacacagtacctgagtca

SEQ ID NO: 87476 - DNA, 25 bp, mus musculus
cacagtacctgagtcaagggattta

SEQ ID NO: 87477 - DNA, 25 bp, mus musculus
gaccatggaccctggggaatgcacg

SEQ ID NO: 87478 - DNA, 25 bp, mus musculus
cacgtgtatgtctggagggatctgc

SEQ ID NO: 87479 - DNA, 25 bp, mus musculus
agggatctgcatctgcggagataat

SEQ ID NO: 87480 - DNA, 25 bp, mus musculus
gatctgcatctgcggagataattgc

SEQ ID NO: 87481 - DNA, 25 bp, mus musculus
ttgcaaatgcacaacctgcagctgt

SEQ ID NO: 87482 - DNA, 25 bp, mus musculus
atgcacaacctgcagctgtaaaacc

SEQ ID NO: 87483 - DNA, 25 bp, mus musculus
cacaacctgcagctgtaaaacctgt

SEQ ID NO: 87484 - DNA, 25 bp, mus musculus
aacctgcagctgtaaaacctgtcgt

SEQ ID NO: 87485 - DNA, 25 bp, mus musculus
agccttgctcgggggctagactact

SEQ ID NO: 87486 - DNA, 25 bp, mus musculus
cttgctcgggggctagactactata

SEQ ID NO: 87487 - DNA, 25 bp, mus musculus
cggatcttttccattgtagagcaaa

SEQ ID NO: 87488 - DNA, 25 bp, mus musculus
agactgaagcttgtctcagagttat

SEQ ID NO: 87489 - DNA, 25 bp, mus musculus
atcaaggctgagctgctgtacaaga

SEQ ID NO: 87490 - DNA, 25 bp, mus musculus
ttactaaaccagttgcagtactgtg

SEQ ID NO: 87491 - DNA, 25 bp, mus musculus
ctaaaccagttgcagtactgtgagg

SEQ ID NO: 87492 - DNA, 25 bp, mus musculus
cagttgcagtactgtgaggaggcag

SEQ ID NO: 87493 - DNA, 25 bp, mus musculus
ggcatcccactggtggccatcattg

SEQ ID NO: 87494 - DNA, 25 bp, mus musculus
ccactggtggccatcattggtgagc

SEQ ID NO: 87495 - DNA, 25 bp, mus musculus
gtggccatcattggtgagcaggaac

SEQ ID NO: 87496 - DNA, 25 bp, mus musculus
gccatcattggtgagcaggaactca

SEQ ID NO: 87497 - DNA, 25 bp, mus musculus
ctagactactatactggggtcatct

SEQ ID NO: 87498 - DNA, 25 bp, mus musculus
ccatctgctgaactgaacaaactat

SEQ ID NO: 87499 - DNA, 25 bp, mus musculus
gactactatactggggtcatctatg

SEQ ID NO: 87500 - DNA, 25 bp, mus musculus
tatactggggtcatctatgaggcag

SEQ ID NO: 87501 - DNA, 25 bp, mus musculus
gtgctgctacagatgccaacccaag

SEQ ID NO: 87502 - DNA, 25 bp, mus musculus
ctgctacagatgccaacccaagctg

SEQ ID NO: 87503 - DNA, 25 bp, mus musculus
atgccaacccaagctggggaagagc

SEQ ID NO: 87504 - DNA, 25 bp, mus musculus
tacgatggcctggttggcatgtttg

SEQ ID NO: 87505 - DNA, 25 bp, mus musculus
ggcatgtttgaccccaaggggcgca

SEQ ID NO: 87506 - DNA, 25 bp, mus musculus
gtatacagcagttggctgagaacac

SEQ ID NO: 87507 - DNA, 25 bp, mus musculus
tcatcatctatggcaatgaagactc

SEQ ID NO: 87508 - DNA, 25 bp, mus musculus
tgtcagcagctcataccaaagaaat

SEQ ID NO: 87509 - DNA, 25 bp, mus musculus
cagctcataccaaagaaatacttga

SEQ ID NO: 87510 - DNA, 25 bp, mus musculus
accggctggtgcctctactggacag

SEQ ID NO: 87511 - DNA, 25 bp, mus musculus
tggtgcctctactggacaggccctt

SEQ ID NO: 87512 - DNA, 25 bp, mus musculus
cagaagactgagcctttctggtgct

SEQ ID NO: 87513 - DNA, 25 bp, mus musculus
gataattcctcccaggacagtgtgt

SEQ ID NO: 87514 - DNA, 25 bp, mus musculus
tggcctttctgagccaattccagga

SEQ ID NO: 87515 - DNA, 25 bp, mus musculus
aaccacacttcagtgaccacttcat

SEQ ID NO: 87516 - DNA, 25 bp, mus musculus
gtgaccacttcatgtgaaagacatt

SEQ ID NO: 87517 - DNA, 25 bp, mus musculus
agacatttctgaagctactgaaggt

SEQ ID NO: 87518 - DNA, 25 bp, mus musculus
tggtgcctttgatgctctacatgcc

SEQ ID NO: 87519 - DNA, 25 bp, mus musculus
ctttgatgctctacatgccggccaa

SEQ ID NO: 87520 - DNA, 25 bp, mus musculus
tgctctacatgccggccaaaattgg

SEQ ID NO: 87521 - DNA, 25 bp, mus musculus
ttcctgctaccccgatcattgagtc

SEQ ID NO: 87522 - DNA, 25 bp, mus musculus
ctaccccgatcattgagtccagagc

SEQ ID NO: 87523 - DNA, 25 bp, mus musculus
ttgagtccagagccagattttgcct

SEQ ID NO: 87524 - DNA, 25 bp, mus musculus
ccagattttgcctgtcagcagctca

SEQ ID NO: 87525 - DNA, 25 bp, mus musculus
tttgcctgtcagcagctcataccaa

SEQ ID NO: 87526 - DNA, 25 bp, mus musculus
cgtcttgcatgcacattctcggcat

SEQ ID NO: 87527 - DNA, 25 bp, mus musculus
cttgcatgcacattctcggcatcct

SEQ ID NO: 87528 - DNA, 25 bp, mus musculus
ttactcatgtactagctggatgttc

SEQ ID NO: 87529 - DNA, 25 bp, mus musculus
gatgttcagtcatatcgcgatatcg

SEQ ID NO: 87530 - DNA, 25 bp, mus musculus
gttcagtcatatcgcgatatcggca

SEQ ID NO: 87531 - DNA, 25 bp, mus musculus
gatatcggcattggtacgccgcagc

SEQ ID NO: 87532 - DNA, 25 bp, mus musculus
attggtacgccgcagcagtgttctc

SEQ ID NO: 87533 - DNA, 25 bp, mus musculus
ggtacgccgcagcagtgttctcata

SEQ ID NO: 87534 - DNA, 25 bp, mus musculus
ccgcagcagtgttctcatagtcgtc

SEQ ID NO: 87535 - DNA, 25 bp, mus musculus
cagtgttctcatagtcgtctgtgat

SEQ ID NO: 87536 - DNA, 25 bp, mus musculus
tgttctcatagtcgtctgtgatact

SEQ ID NO: 87537 - DNA, 25 bp, mus musculus
catagtcgtctgtgatactggcccg

SEQ ID NO: 87538 - DNA, 25 bp, mus musculus
aagagctgatcctcacatgtgccat

SEQ ID NO: 87539 - DNA, 25 bp, mus musculus
tgatcctcacatgtgccattagtac

SEQ ID NO: 87540 - DNA, 25 bp, mus musculus
tcacatgtgccattagtacgtacct

SEQ ID NO: 87541 - DNA, 25 bp, mus musculus
ttagtacgtacctccatgcagtcat

SEQ ID NO: 87542 - DNA, 25 bp, mus musculus
gtacgtacctccatgcagtcatcga

SEQ ID NO: 87543 - DNA, 25 bp, mus musculus
cgtacctccatgcagtcatcgatta

SEQ ID NO: 87544 - DNA, 25 bp, mus musculus
attaagagcacgtagccagtgtcag

SEQ ID NO: 87545 - DNA, 25 bp, mus musculus
gagttactcatgtactagctggatg

SEQ ID NO: 87546 - DNA, 25 bp, mus musculus
ggaactctcacagctgagaccagac

SEQ ID NO: 87547 - DNA, 25 bp, mus musculus
ctcacagctgagaccagacaactag

SEQ ID NO: 87548 - DNA, 25 bp, mus musculus
atcttcggtggtgagcggctgactc

SEQ ID NO: 87549 - DNA, 25 bp, mus musculus
gagcggctgactctagatcggttaa

SEQ ID NO: 87550 - DNA, 25 bp, mus musculus
ctgactctagatcggttaaagatgg

SEQ ID NO: 87551 - DNA, 25 bp, mus musculus
ggctatgactccctcatgagtaatg

SEQ ID NO: 87552 - DNA, 25 bp, mus musculus
gactccctcatgagtaatgaggctt

SEQ ID NO: 87553 - DNA, 25 bp, mus musculus
gtacctcattttatctgcccagttc

SEQ ID NO: 87554 - DNA, 25 bp, mus musculus
cattttatctgcccagttcctactc

SEQ ID NO: 87555 - DNA, 25 bp, mus musculus
gaagacaagccagctgtctctggat

SEQ ID NO: 87556 - DNA, 25 bp, mus musculus
tagcttcaccataggtacttaagtc

SEQ ID NO: 87557 - DNA, 25 bp, mus musculus
atacaccaacactgatatcatatag

SEQ ID NO: 87558 - DNA, 25 bp, mus musculus
agcagagaccctgactcaaaactgg

SEQ ID NO: 87559 - DNA, 25 bp, mus musculus
aaaggaccccaagatagtcatgctc

SEQ ID NO: 87560 - DNA, 25 bp, mus musculus
ttgacagtcaccccagtgaactacc

SEQ ID NO: 87561 - DNA, 25 bp, mus musculus
ccagtgaactaccttcctagccatg

SEQ ID NO: 87562 - DNA, 25 bp, mus musculus
ccctccaacatagaagatctgtcac

SEQ ID NO: 87563 - DNA, 25 bp, mus musculus
gaagatctgtcaccacatgaggctg

SEQ ID NO: 87564 - DNA, 25 bp, mus musculus
gaggctgacccaactgattcttttg

SEQ ID NO: 87565 - DNA, 25 bp, mus musculus
actgattcttttgacctggagcatc

SEQ ID NO: 87566 - DNA, 25 bp, mus musculus
atttttgcatcaagttctctccgcc

SEQ ID NO: 87567 - DNA, 25 bp, mus musculus
ctcactggtgagaaccctctgcagg

SEQ ID NO: 87568 - DNA, 25 bp, mus musculus
gagaaccctctgcaggtcctggtga

SEQ ID NO: 87569 - DNA, 25 bp, mus musculus
ctcattaatgctgccaagggctcct

SEQ ID NO: 87570 - DNA, 25 bp, mus musculus
aatgctgccaagggctcctccaatt

SEQ ID NO: 87571 - DNA, 25 bp, mus musculus
aagggctcctccaattcctatgcca

SEQ ID NO: 87572 - DNA, 25 bp, mus musculus
ggctcctccaattcctatgccatca

SEQ ID NO: 87573 - DNA, 25 bp, mus musculus
aattcctatgccatcaagaagaaag

SEQ ID NO: 87574 - DNA, 25 bp, mus musculus
tcctatgccatcaagaagaaagatg

SEQ ID NO: 87575 - DNA, 25 bp, mus musculus
aagtctaaccgctgatttcccagct

SEQ ID NO: 87576 - DNA, 25 bp, mus musculus
tctaaccgctgatttcccagctgct

SEQ ID NO: 87577 - DNA, 25 bp, mus musculus
aaccgctgatttcccagctgctgcc

SEQ ID NO: 87578 - DNA, 25 bp, mus musculus
cccagctgctgcctaataaactgtg

SEQ ID NO: 87579 - DNA, 25 bp, mus musculus
aaccctctgcaggtcctggtgaatg

SEQ ID NO: 87580 - DNA, 25 bp, mus musculus
gtgaatcaggccatctggctgctgt

SEQ ID NO: 87581 - DNA, 25 bp, mus musculus
caggccatctggctgctgtgcacag

SEQ ID NO: 87582 - DNA, 25 bp, mus musculus
atctggctgctgtgcacaggggctc

SEQ ID NO: 87583 - DNA, 25 bp, mus musculus
gctcgtgaggctgctttccggaaca

SEQ ID NO: 87584 - DNA, 25 bp, mus musculus
gctgctttccggaacatcaagaaca

SEQ ID NO: 87585 - DNA, 25 bp, mus musculus
gctttccggaacatcaagaacatcg

SEQ ID NO: 87586 - DNA, 25 bp, mus musculus
atcaagaacatcgccgagtgccttg

SEQ ID NO: 87587 - DNA, 25 bp, mus musculus
aagatcatttccaggatgacaacac

SEQ ID NO: 87588 - DNA, 25 bp, mus musculus
tccaggatgacaacacccttttcct

SEQ ID NO: 87589 - DNA, 25 bp, mus musculus
attgatcccttccagtgccggaagg

SEQ ID NO: 87590 - DNA, 25 bp, mus musculus
ttccagtgccggaaggtggctctta

SEQ ID NO: 87591 - DNA, 25 bp, mus musculus
aaggtggctcttaccatctgcaatg

SEQ ID NO: 87592 - DNA, 25 bp, mus musculus
gtggctcttaccatctgcaatgtct

SEQ ID NO: 87593 - DNA, 25 bp, mus musculus
cttaccatctgcaatgtctccatca

SEQ ID NO: 87594 - DNA, 25 bp, mus musculus
accatctgcaatgtctccatcacct

SEQ ID NO: 87595 - DNA, 25 bp, mus musculus
atctgcaatgtctccatcaccttgt

SEQ ID NO: 87596 - DNA, 25 bp, mus musculus
gtctccatcaccttgttcaaaaaga

SEQ ID NO: 87597 - DNA, 25 bp, mus musculus
aagatggcccaactgtcaggaaatg

SEQ ID NO: 87598 - DNA, 25 bp, mus musculus
atggcccaactgtcaggaaatggaa

SEQ ID NO: 87599 - DNA, 25 bp, mus musculus
tcccatggactcctcctgctagtgg

SEQ ID NO: 87600 - DNA, 25 bp, mus musculus
catggactcctcctgctagtgggct

SEQ ID NO: 87601 - DNA, 25 bp, mus musculus
ttgtgctgtctgcttctcataacca

SEQ ID NO: 87602 - DNA, 25 bp, mus musculus
tgtctgcttctcataaccaagacta

SEQ ID NO: 87603 - DNA, 25 bp, mus musculus
ctgcttctcataaccaagactaaac

SEQ ID NO: 87604 - DNA, 25 bp, mus musculus
tatgaagacccaagcattgatccct

SEQ ID NO: 87605 - DNA, 25 bp, mus musculus
gaagacccaagcattgatcccttcc

SEQ ID NO: 87606 - DNA, 25 bp, mus musculus
ccaagcattgatcccttccagtgcc

SEQ ID NO: 87607 - DNA, 25 bp, mus musculus
gattctcccgggcacagctgtccct

SEQ ID NO: 87608 - DNA, 25 bp, mus musculus
cacagctgtccctgtccaggtccag

SEQ ID NO: 87609 - DNA, 25 bp, mus musculus
aactgcagccgacaggcctggaaaa

SEQ ID NO: 87610 - DNA, 25 bp, mus musculus
aggccctcctggaaggaatgggcag

SEQ ID NO: 87611 - DNA, 25 bp, mus musculus
gctgcctcttcgaacggcaacccag

SEQ ID NO: 87612 - DNA, 25 bp, mus musculus
tcttcgaacggcaacccagcctggc

SEQ ID NO: 87613 - DNA, 25 bp, mus musculus
ctatgtcctctttgtgtggaaatat

SEQ ID NO: 87614 - DNA, 25 bp, mus musculus
gtgactgtggcttcccagatgaatg

SEQ ID NO: 87615 - DNA, 25 bp, mus musculus
gcttcccagatgaatgcactgatcc

SEQ ID NO: 87616 - DNA, 25 bp, mus musculus
aatgcactgatccctgctgtgacca

SEQ ID NO: 87617 - DNA, 25 bp, mus musculus
gcactgatccctgctgtgaccattt

SEQ ID NO: 87618 - DNA, 25 bp, mus musculus
ctgatccctgctgtgaccatttcac

SEQ ID NO: 87619 - DNA, 25 bp, mus musculus
agctgcatcatggaggcctccacag

SEQ ID NO: 87620 - DNA, 25 bp, mus musculus
atggaggcctccacagacttcctac

SEQ ID NO: 87621 - DNA, 25 bp, mus musculus
gaggcctccacagacttcctaccag

SEQ ID NO: 87622 - DNA, 25 bp, mus musculus
gcctccacagacttcctaccaggtt

SEQ ID NO: 87623 - DNA, 25 bp, mus musculus
ttcctaccaggtttgaacttcagca

SEQ ID NO: 87624 - DNA, 25 bp, mus musculus
ggtttgaacttcagcaactgcagcc

SEQ ID NO: 87625 - DNA, 25 bp, mus musculus
ttgaacttcagcaactgcagccgac

SEQ ID NO: 87626 - DNA, 25 bp, mus musculus
ttcagcaactgcagccgacaggcct

SEQ ID NO: 87627 - DNA, 25 bp, mus musculus
gttagctattctcatcgcttttatg

SEQ ID NO: 87628 - DNA, 25 bp, mus musculus
attgtcagcaacacctatgcatgca

SEQ ID NO: 87629 - DNA, 25 bp, mus musculus
ttttgagaatgtcccatcctcatga

SEQ ID NO: 87630 - DNA, 25 bp, mus musculus
ttgagaatgtcccatcctcatgagc

SEQ ID NO: 87631 - DNA, 25 bp, mus musculus
gagaatgtcccatcctcatgagccg

SEQ ID NO: 87632 - DNA, 25 bp, mus musculus
gaatgtcccatcctcatgagccgga

SEQ ID NO: 87633 - DNA, 25 bp, mus musculus
atgtcccatcctcatgagccggagc

SEQ ID NO: 87634 - DNA, 25 bp, mus musculus
gtcccatcctcatgagccggagctt

SEQ ID NO: 87635 - DNA, 25 bp, mus musculus
cccatcctcatgagccggagcttat

SEQ ID NO: 87636 - DNA, 25 bp, mus musculus
catcctcatgagccggagcttatga

SEQ ID NO: 87637 - DNA, 25 bp, mus musculus
tcctcatgagccggagcttatgaac

SEQ ID NO: 87638 - DNA, 25 bp, mus musculus
tcgctctcaacagatcgacctgggt

SEQ ID NO: 87639 - DNA, 25 bp, mus musculus
tgtcagcaacacctatgcatgcaga

SEQ ID NO: 87640 - DNA, 25 bp, mus musculus
tcagcaacacctatgcatgcagaca

SEQ ID NO: 87641 - DNA, 25 bp, mus musculus
agcaacacctatgcatgcagacacg

SEQ ID NO: 87642 - DNA, 25 bp, mus musculus
atgcagacacgctgatgttcagtcc

SEQ ID NO: 87643 - DNA, 25 bp, mus musculus
acacgctgatgttcagtccattttg

SEQ ID NO: 87644 - DNA, 25 bp, mus musculus
acgctgatgttcagtccattttgag

SEQ ID NO: 87645 - DNA, 25 bp, mus musculus
atgttcagtccattttgagaatgtc

SEQ ID NO: 87646 - DNA, 25 bp, mus musculus
gttcagtccattttgagaatgtccc

SEQ ID NO: 87647 - DNA, 25 bp, mus musculus
ggagaacccagcagatccttactga

SEQ ID NO: 87648 - DNA, 25 bp, mus musculus
cccagcagatccttactgagcacat

SEQ ID NO: 87649 - DNA, 25 bp, mus musculus
ctgaactctttttcaggcccatcat

SEQ ID NO: 87650 - DNA, 25 bp, mus musculus
tctttttcaggcccatcattggtgc

SEQ ID NO: 87651 - DNA, 25 bp, mus musculus
ccatcattggtgcagtcagcatgga

SEQ ID NO: 87652 - DNA, 25 bp, mus musculus
ccactcaagtgcattttactataga

SEQ ID NO: 87653 - DNA, 25 bp, mus musculus
gtaaaaatccctctgctccatactg

SEQ ID NO: 87654 - DNA, 25 bp, mus musculus
atccctctgctccatactggcttct

SEQ ID NO: 87655 - DNA, 25 bp, mus musculus
ctgctccatactggcttcttgtgaa

SEQ ID NO: 87656 - DNA, 25 bp, mus musculus
gcaaacaaatcactatttctgtata

SEQ ID NO: 87657 - DNA, 25 bp, mus musculus
aaatcactatttctgtatatctcta

SEQ ID NO: 87658 - DNA, 25 bp, mus musculus
ctatttctgtatatctctaagagtg

SEQ ID NO: 87659 - DNA, 25 bp, mus musculus
ttactgagcacatccggatgatgca

SEQ ID NO: 87660 - DNA, 25 bp, mus musculus
agcacatccggatgatgcagagaga

SEQ ID NO: 87661 - DNA, 25 bp, mus musculus
agtaccagatcagatccgctgaact

SEQ ID NO: 87662 - DNA, 25 bp, mus musculus
agatcagatccgctgaactgaacag

SEQ ID NO: 87663 - DNA, 25 bp, mus musculus
gatccgctgaactgaacagtgccct

SEQ ID NO: 87664 - DNA, 25 bp, mus musculus
ctgaactgaacagtgcccttttcct

SEQ ID NO: 87665 - DNA, 25 bp, mus musculus
gtgcccttttcctgctgagattcat

SEQ ID NO: 87666 - DNA, 25 bp, mus musculus
tcgtcactgaactctttttcaggcc

SEQ ID NO: 87667 - DNA, 25 bp, mus musculus
ttttgaactgaggccctgtggcgtg

SEQ ID NO: 87668 - DNA, 25 bp, mus musculus
gccctgtggcgtggcagtctgcagt

SEQ ID NO: 87669 - DNA, 25 bp, mus musculus
tacctgagtactctgggaagcaggc

SEQ ID NO: 87670 - DNA, 25 bp, mus musculus
ctgagtactctgggaagcaggctta

SEQ ID NO: 87671 - DNA, 25 bp, mus musculus
agtactctgggaagcaggcttactc

SEQ ID NO: 87672 - DNA, 25 bp, mus musculus
gctagctggctgctatcccaggagt

SEQ ID NO: 87673 - DNA, 25 bp, mus musculus
agctggctgctatcccaggagtaga

SEQ ID NO: 87674 - DNA, 25 bp, mus musculus
tggctgctatcccaggagtagaagg

SEQ ID NO: 87675 - DNA, 25 bp, mus musculus
gaggcccctacagaaggctctggag

SEQ ID NO: 87676 - DNA, 25 bp, mus musculus
gcccctacagaaggctctggagcca

SEQ ID NO: 87677 - DNA, 25 bp, mus musculus
cctacagaaggctctggagccaggg

SEQ ID NO: 87678 - DNA, 25 bp, mus musculus
ggctctggagccagggagaactgta

SEQ ID NO: 87679 - DNA, 25 bp, mus musculus
cctttcgcacactgcatgtctgtct

SEQ ID NO: 87680 - DNA, 25 bp, mus musculus
tgcatgtctgtcttccttgctggaa

SEQ ID NO: 87681 - DNA, 25 bp, mus musculus
atgtctgtcttccttgctggaacac

SEQ ID NO: 87682 - DNA, 25 bp, mus musculus
ttccttgctggaacactggacacac

SEQ ID NO: 87683 - DNA, 25 bp, mus musculus
gtctgcgggcctagtacttccactg

SEQ ID NO: 87684 - DNA, 25 bp, mus musculus
ggctcttcctttctctggagcagaa

SEQ ID NO: 87685 - DNA, 25 bp, mus musculus
tcttcctttctctggagcagaagtt

SEQ ID NO: 87686 - DNA, 25 bp, mus musculus
tcctttctctggagcagaagttaag

SEQ ID NO: 87687 - DNA, 25 bp, mus musculus
tggtcctatctaggcagtccagttt

SEQ ID NO: 87688 - DNA, 25 bp, mus musculus
ggcagtccagtttcttgtcttgcat

SEQ ID NO: 87689 - DNA, 25 bp, mus musculus
tttccttactgtgcactccagatta

SEQ ID NO: 87690 - DNA, 25 bp, mus musculus
acagataaaccctgaaggcagatgc

SEQ ID NO: 87691 - DNA, 25 bp, mus musculus
aaaccctgaaggcagatgctgaatc

SEQ ID NO: 87692 - DNA, 25 bp, mus musculus
tcctctccacagttctcagttgtat

SEQ ID NO: 87693 - DNA, 25 bp, mus musculus
ccacagttctcagttgtatgttcat

SEQ ID NO: 87694 - DNA, 25 bp, mus musculus
ttctcagttgtatgttcatgtagca

SEQ ID NO: 87695 - DNA, 25 bp, mus musculus
ttgctccgcatctatgttctgcttg

SEQ ID NO: 87696 - DNA, 25 bp, mus musculus
tatgttctgcttgactgactgccaa

SEQ ID NO: 87697 - DNA, 25 bp, mus musculus
ctgcttgactgactgccaacttgga

SEQ ID NO: 87698 - DNA, 25 bp, mus musculus
gactgactgccaacttggaaagtca

SEQ ID NO: 87699 - DNA, 25 bp, mus musculus
cttgcatctttttcggaatgctggg

SEQ ID NO: 87700 - DNA, 25 bp, mus musculus
tattgctaactatcatgagaacttg

SEQ ID NO: 87701 - DNA, 25 bp, mus musculus
gagcacacactacatgcaggatctt

SEQ ID NO: 87702 - DNA, 25 bp, mus musculus
acactacatgcaggatcttctcttg

SEQ ID NO: 87703 - DNA, 25 bp, mus musculus
ggatcttctcttgtcatattcagta

SEQ ID NO: 87704 - DNA, 25 bp, mus musculus
tctcttgtcatattcagtaagcttt

SEQ ID NO: 87705 - DNA, 25 bp, mus musculus
gtagataccaagtccccaggagctc

SEQ ID NO: 87706 - DNA, 25 bp, mus musculus
ctaagtttcccaatgctcccattca

SEQ ID NO: 87707 - DNA, 25 bp, mus musculus
cagctgtcttcttcctgccttcatt

SEQ ID NO: 87708 - DNA, 25 bp, mus musculus
tgaatctcttgacctgttcagaaga

SEQ ID NO: 87709 - DNA, 25 bp, mus musculus
gaatctcttgacctgttcagaagaa

SEQ ID NO: 87710 - DNA, 25 bp, mus musculus
tgcctaaggggcacctaagggatct

SEQ ID NO: 87711 - DNA, 25 bp, mus musculus
ggcacctaagggatcttgtgcatta

SEQ ID NO: 87712 - DNA, 25 bp, mus musculus
atcttgtgcattatctttaacgagt

SEQ ID NO: 87713 - DNA, 25 bp, mus musculus
tgtgcattatctttaacgagtttta

SEQ ID NO: 87714 - DNA, 25 bp, mus musculus
cgagttttagccacactctctaaag

SEQ ID NO: 87715 - DNA, 25 bp, mus musculus
gagttttagccacactctctaaagg

SEQ ID NO: 87716 - DNA, 25 bp, mus musculus
tttagccacactctctaaagggttg

SEQ ID NO: 87717 - DNA, 25 bp, mus musculus
tctgccctgtgtgaagtccccttta

SEQ ID NO: 87718 - DNA, 25 bp, mus musculus
agactctgttcaaacacctcagtga

SEQ ID NO: 87719 - DNA, 25 bp, mus musculus
gactctgttcaaacacctcagtgat

SEQ ID NO: 87720 - DNA, 25 bp, mus musculus
atctcttgacctgttcagaagaagg

SEQ ID NO: 87721 - DNA, 25 bp, mus musculus
actctgttcaaacacctcagtgatt

SEQ ID NO: 87722 - DNA, 25 bp, mus musculus
aaatctacctgggagaatgccttgc

SEQ ID NO: 87723 - DNA, 25 bp, mus musculus
atctacctgggagaatgccttgcct

SEQ ID NO: 87724 - DNA, 25 bp, mus musculus
tctacctgggagaatgccttgccta

SEQ ID NO: 87725 - DNA, 25 bp, mus musculus
ctacctgggagaatgccttgcctaa

SEQ ID NO: 87726 - DNA, 25 bp, mus musculus
gagaatgccttgcctaaggggcacc

SEQ ID NO: 87727 - DNA, 25 bp, mus musculus
gaatgccttgcctaaggggcaccta

SEQ ID NO: 87728 - DNA, 25 bp, mus musculus
atgccttgcctaaggggcacctaag

SEQ ID NO: 87729 - DNA, 25 bp, mus musculus
gcttaccccacaaagtgtgtcgaag

SEQ ID NO: 87730 - DNA, 25 bp, mus musculus
actgcctgagctgcgagggctccag

SEQ ID NO: 87731 - DNA, 25 bp, mus musculus
tctaccttcctacagatggtcagcc

SEQ ID NO: 87732 - DNA, 25 bp, mus musculus
gtcagccatagcctgttccttgggg

SEQ ID NO: 87733 - DNA, 25 bp, mus musculus
ctgttccttggggtagccctgcatc

SEQ ID NO: 87734 - DNA, 25 bp, mus musculus
gtagccctgcatctgacagctgtat

SEQ ID NO: 87735 - DNA, 25 bp, mus musculus
ctgcatctgacagctgtatctcccc

SEQ ID NO: 87736 - DNA, 25 bp, mus musculus
ctgggttctactgcagcatctctga

SEQ ID NO: 87737 - DNA, 25 bp, mus musculus
tctactgcagcatctctgagcacct

SEQ ID NO: 87738 - DNA, 25 bp, mus musculus
gcagcatctctgagcacctgaacag

SEQ ID NO: 87739 - DNA, 25 bp, mus musculus
ttgaactctgcttgctggctgcagt

SEQ ID NO: 87740 - DNA, 25 bp, mus musculus
tgctggctgcagtctaaagttggac

SEQ ID NO: 87741 - DNA, 25 bp, mus musculus
tgagctgcgagggctccagtaggaa

SEQ ID NO: 87742 - DNA, 25 bp, mus musculus
gtaaagctggcttcacacagctggg

SEQ ID NO: 87743 - DNA, 25 bp, mus musculus
tcacacagctgggaacctcctgcat

SEQ ID NO: 87744 - DNA, 25 bp, mus musculus
agctgggaacctcctgcatcaccaa

SEQ ID NO: 87745 - DNA, 25 bp, mus musculus
cgtgcagcaatgccgatgagacctt

SEQ ID NO: 87746 - DNA, 25 bp, mus musculus
ccgatgagaccttctgcgagatggt

SEQ ID NO: 87747 - DNA, 25 bp, mus musculus
tgaagtccaatcggctctgcgaacg

SEQ ID NO: 87748 - DNA, 25 bp, mus musculus
tcttcatccagttttgctgccgcac

SEQ ID NO: 87749 - DNA, 25 bp, mus musculus
aatcagtagcccttgagccattaac

SEQ ID NO: 87750 - DNA, 25 bp, mus musculus
tagcccttgagccattaacagcagt

SEQ ID NO: 87751 - DNA, 25 bp, mus musculus
gcttccttctaaatcaaacccattg

SEQ ID NO: 87752 - DNA, 25 bp, mus musculus
tccttctaaatcaaacccattgttg

SEQ ID NO: 87753 - DNA, 25 bp, mus musculus
catgcatgtgcaccagggtgttatt

SEQ ID NO: 87754 - DNA, 25 bp, mus musculus
gcatgtgcaccagggtgttatttaa

SEQ ID NO: 87755 - DNA, 25 bp, mus musculus
tttaagccattgcacattcaagttg

SEQ ID NO: 87756 - DNA, 25 bp, mus musculus
ctaggctcattggcctagacattat

SEQ ID NO: 87757 - DNA, 25 bp, mus musculus
ggctcattggcctagacattatgat

SEQ ID NO: 87758 - DNA, 25 bp, mus musculus
tcattggcctagacattatgatttg

SEQ ID NO: 87759 - DNA, 25 bp, mus musculus
tttaatgctccatcaagatgtctaa

SEQ ID NO: 87760 - DNA, 25 bp, mus musculus
gctccatcaagatgtctaataaaag

SEQ ID NO: 87761 - DNA, 25 bp, mus musculus
cccttgagccattaacagcagtgtt

SEQ ID NO: 87762 - DNA, 25 bp, mus musculus
cattaacagcagtgttcttctggca

SEQ ID NO: 87763 - DNA, 25 bp, mus musculus
taacagcagtgttcttctggcaagt

SEQ ID NO: 87764 - DNA, 25 bp, mus musculus
tattcacgagcattagagatgaact

SEQ ID NO: 87765 - DNA, 25 bp, mus musculus
taactagacatctgttgttatctct

SEQ ID NO: 87766 - DNA, 25 bp, mus musculus
tgttatctctatagctctgcttcct

SEQ ID NO: 87767 - DNA, 25 bp, mus musculus
ctctatagctctgcttccttctaaa

SEQ ID NO: 87768 - DNA, 25 bp, mus musculus
agctctgcttccttctaaatcaaac

SEQ ID NO: 87769 - DNA, 25 bp, mus musculus
actgtggcaggctgggcagtgcctc

SEQ ID NO: 87770 - DNA, 25 bp, mus musculus
ggagctgcttccagacagtgggcga

SEQ ID NO: 87771 - DNA, 25 bp, mus musculus
ccagccatgggtcaagaggcttgtg

SEQ ID NO: 87772 - DNA, 25 bp, mus musculus
tgttcctacatgtcttaaggagctg

SEQ ID NO: 87773 - DNA, 25 bp, mus musculus
ttcactgaaaaccgtggacttgcac

SEQ ID NO: 87774 - DNA, 25 bp, mus musculus
cgtggacttgcacatctccaacagc

SEQ ID NO: 87775 - DNA, 25 bp, mus musculus
ctctgaccagtacaaggcctacctc

SEQ ID NO: 87776 - DNA, 25 bp, mus musculus
caaggcctacctccaggacttggtg

SEQ ID NO: 87777 - DNA, 25 bp, mus musculus
catggacttccaggccactggaaat

SEQ ID NO: 87778 - DNA, 25 bp, mus musculus
cttccaggccactggaaatatctga

SEQ ID NO: 87779 - DNA, 25 bp, mus musculus
actcagctgctaccaataaagcagt

SEQ ID NO: 87780 - DNA, 25 bp, mus musculus
ctgctaccaataaagcagtttatgc

SEQ ID NO: 87781 - DNA, 25 bp, mus musculus
cctcaggcccttcgtggcagatctg

SEQ ID NO: 87782 - DNA, 25 bp, mus musculus
gcccttcgtggcagatctgattgcc

SEQ ID NO: 87783 - DNA, 25 bp, mus musculus
agatctgattgccttcatggaagga

SEQ ID NO: 87784 - DNA, 25 bp, mus musculus
gattgccttcatggaaggaagtgga

SEQ ID NO: 87785 - DNA, 25 bp, mus musculus
tctgtggttctgcatgggggaaatg

SEQ ID NO: 87786 - DNA, 25 bp, mus musculus
gttctgcatgggggaaatgtggccc

SEQ ID NO: 87787 - DNA, 25 bp, mus musculus
gtggccccaggaccagccatgggtc

SEQ ID NO: 87788 - DNA, 25 bp, mus musculus
ccaggaccagccatgggtcaagagg

SEQ ID NO: 87789 - DNA, 25 bp, mus musculus
aaatgtgtttccatgaaggtcaagc

SEQ ID NO: 87790 - DNA, 25 bp, mus musculus
tgtttccatgaaggtcaagccaaaa

SEQ ID NO: 87791 - DNA, 25 bp, mus musculus
cacattggcttacaaactaggcaaa

SEQ ID NO: 87792 - DNA, 25 bp, mus musculus
ttttatgccttagaaggttctgttg

SEQ ID NO: 87793 - DNA, 25 bp, mus musculus
ttatgccttagaaggttctgttgct

SEQ ID NO: 87794 - DNA, 25 bp, mus musculus
tgccttagaaggttctgttgctata

SEQ ID NO: 87795 - DNA, 25 bp, mus musculus
aatccgctggctaagagacaattcc

SEQ ID NO: 87796 - DNA, 25 bp, mus musculus
atccgctggctaagagacaattccg

SEQ ID NO: 87797 - DNA, 25 bp, mus musculus
cttctgaccacattggcttacaaac

SEQ ID NO: 87798 - DNA, 25 bp, mus musculus
ttctgaccacattggcttacaaact

SEQ ID NO: 87799 - DNA, 25 bp, mus musculus
tctgaccacattggcttacaaacta

SEQ ID NO: 87800 - DNA, 25 bp, mus musculus
ctgaccacattggcttacaaactag

SEQ ID NO: 87801 - DNA, 25 bp, mus musculus
tgaccacattggcttacaaactagg

SEQ ID NO: 87802 - DNA, 25 bp, mus musculus
gaccacattggcttacaaactaggc

SEQ ID NO: 87803 - DNA, 25 bp, mus musculus
accacattggcttacaaactaggca

SEQ ID NO: 87804 - DNA, 25 bp, mus musculus
ccacattggcttacaaactaggcaa

SEQ ID NO: 87805 - DNA, 25 bp, mus musculus
tcttcggcccggtcaatcatgaaga

SEQ ID NO: 87806 - DNA, 25 bp, mus musculus
acttggagaagcactgccgggatat

SEQ ID NO: 87807 - DNA, 25 bp, mus musculus
aggcaaactctgaggaccggcattt

SEQ ID NO: 87808 - DNA, 25 bp, mus musculus
actctgaggaccggcatttggtgga

SEQ ID NO: 87809 - DNA, 25 bp, mus musculus
accaaatgcctgactcgtcagacaa

SEQ ID NO: 87810 - DNA, 25 bp, mus musculus
actcgtcagacaatcaggctgggtt

SEQ ID NO: 87811 - DNA, 25 bp, mus musculus
ggaagcgacctgctgcagaagattc

SEQ ID NO: 87812 - DNA, 25 bp, mus musculus
acgctggcactgtggagcagacgcc

SEQ ID NO: 87813 - DNA, 25 bp, mus musculus
tggagcagacgcccaagaagcccgg

SEQ ID NO: 87814 - DNA, 25 bp, mus musculus
gccttcgacgccagacgtaaacagc

SEQ ID NO: 87815 - DNA, 25 bp, mus musculus
agatacatcactgctttatgaagca

SEQ ID NO: 87816 - DNA, 25 bp, mus musculus
atcactgctttatgaagcaaggaag

SEQ ID NO: 87817 - DNA, 25 bp, mus musculus
agaagcactgccgggatatggaaga

SEQ ID NO: 87818 - DNA, 25 bp, mus musculus
aagcgagtcagcgcaagtggaattt

SEQ ID NO: 87819 - DNA, 25 bp, mus musculus
tcgactttcagaatcataagcccct

SEQ ID NO: 87820 - DNA, 25 bp, mus musculus
agcccctggagggcagatacgaatg

SEQ ID NO: 87821 - DNA, 25 bp, mus musculus
gcagcttgcccgagttctactacag

SEQ ID NO: 87822 - DNA, 25 bp, mus musculus
cccccaagagcgcctgcaaggtgct

SEQ ID NO: 87823 - DNA, 25 bp, mus musculus
agagcgcctgcaaggtgctggcgca

SEQ ID NO: 87824 - DNA, 25 bp, mus musculus
tgcctttaattgggtctcaggcaaa

SEQ ID NO: 87825 - DNA, 25 bp, mus musculus
cagctactcagtttcttccagtccc

SEQ ID NO: 87826 - DNA, 25 bp, mus musculus
tgatgccttttcgtctaacccgcca

SEQ ID NO: 87827 - DNA, 25 bp, mus musculus
tatatctaggccatgaagcttcatc

SEQ ID NO: 87828 - DNA, 25 bp, mus musculus
atgaagcttcatccgcctttaggag

SEQ ID NO: 87829 - DNA, 25 bp, mus musculus
gttatacagctgtagctcgaggcaa

SEQ ID NO: 87830 - DNA, 25 bp, mus musculus
cagctgtagctcgaggcaacagaga

SEQ ID NO: 87831 - DNA, 25 bp, mus musculus
acagagactacaacattcgtgcaca

SEQ ID NO: 87832 - DNA, 25 bp, mus musculus
actacaacattcgtgcacaagagcc

SEQ ID NO: 87833 - DNA, 25 bp, mus musculus
acattcgtgcacaagagccagagag

SEQ ID NO: 87834 - DNA, 25 bp, mus musculus
cagaccccaatatccttggcaggac

SEQ ID NO: 87835 - DNA, 25 bp, mus musculus
ccaatatccttggcaggacttggga

SEQ ID NO: 87836 - DNA, 25 bp, mus musculus
tccttggcaggacttgggaaggatg

SEQ ID NO: 87837 - DNA, 25 bp, mus musculus
gtctaacccgccaatttgtcagtct

SEQ ID NO: 87838 - DNA, 25 bp, mus musculus
cccgccaatttgtcagtctcatgtt

SEQ ID NO: 87839 - DNA, 25 bp, mus musculus
aatttgtcagtctcatgttgccaat

SEQ ID NO: 87840 - DNA, 25 bp, mus musculus
gtctcatgtgcacggtcatggtgca

SEQ ID NO: 87841 - DNA, 25 bp, mus musculus
atgcactgagggctttccgctcttg

SEQ ID NO: 87842 - DNA, 25 bp, mus musculus
gctcttgtgcaggtctgctcactga

SEQ ID NO: 87843 - DNA, 25 bp, mus musculus
tcactgacaccatggaaatttttgt

SEQ ID NO: 87844 - DNA, 25 bp, mus musculus
ccaacccagctgttataacttgtga

SEQ ID NO: 87845 - DNA, 25 bp, mus musculus
ccttgctcgattacttcctacagga

SEQ ID NO: 87846 - DNA, 25 bp, mus musculus
tcgattacttcctacaggaacatgg

SEQ ID NO: 87847 - DNA, 25 bp, mus musculus
gctactgcttggtctgctacctatt

SEQ ID NO: 87848 - DNA, 25 bp, mus musculus
tcaaggacaggcacaacgggaacat

SEQ ID NO: 87849 - DNA, 25 bp, mus musculus
ggaacatccttctggacgcagaagg

SEQ ID NO: 87850 - DNA, 25 bp, mus musculus
tccttctggacgcagaaggtcacat

SEQ ID NO: 87851 - DNA, 25 bp, mus musculus
cagaaggtcacatcatccacatcga

SEQ ID NO: 87852 - DNA, 25 bp, mus musculus
gtcacatcatccacatcgactttgg

SEQ ID NO: 87853 - DNA, 25 bp, mus musculus
tcatccacatcgactttggcttcat

SEQ ID NO: 87854 - DNA, 25 bp, mus musculus
acatcgactttggcttcatcctttc

SEQ ID NO: 87855 - DNA, 25 bp, mus musculus
gaaacctgggcttcgagacatcagc

SEQ ID NO: 87856 - DNA, 25 bp, mus musculus
tcgagacatcagcgtttaagctgac

SEQ ID NO: 87857 - DNA, 25 bp, mus musculus
acttcctacaggaacatggcagtta

SEQ ID NO: 87858 - DNA, 25 bp, mus musculus
agcgtttaagctgaccacagaagtt

SEQ ID NO: 87859 - DNA, 25 bp, mus musculus
gcagttataccactgaggcattcct

SEQ ID NO: 87860 - DNA, 25 bp, mus musculus
ataccactgaggcattcctcagtgc

SEQ ID NO: 87861 - DNA, 25 bp, mus musculus
cattcctcagtgcccagcgcaattt

SEQ ID NO: 87862 - DNA, 25 bp, mus musculus
tcagtgcccagcgcaattttgtgca

SEQ ID NO: 87863 - DNA, 25 bp, mus musculus
cccagcgcaattttgtgcaaagctg

SEQ ID NO: 87864 - DNA, 25 bp, mus musculus
ttgtgcaaagctgtgctggctactg

SEQ ID NO: 87865 - DNA, 25 bp, mus musculus
aaagctgtgctggctactgcttggt

SEQ ID NO: 87866 - DNA, 25 bp, mus musculus
gtctccttccttcgagctgccttct

SEQ ID NO: 87867 - DNA, 25 bp, mus musculus
ttccttcgagctgccttctacgtgg

SEQ ID NO: 87868 - DNA, 25 bp, mus musculus
ctgtcaatgctctccacaacaatgc

SEQ ID NO: 87869 - DNA, 25 bp, mus musculus
atgctctccacaacaatgcaacagc

SEQ ID NO: 87870 - DNA, 25 bp, mus musculus
ctctccacaacaatgcaacagccgg

SEQ ID NO: 87871 - DNA, 25 bp, mus musculus
tccacaacaatgcaacagccggcca

SEQ ID NO: 87872 - DNA, 25 bp, mus musculus
acaatgcaacagccggccagcggtg

SEQ ID NO: 87873 - DNA, 25 bp, mus musculus
atgcaacagccggccagcggtgact

SEQ ID NO: 87874 - DNA, 25 bp, mus musculus
ggagctcttcctgaccatgcagctg

SEQ ID NO: 87875 - DNA, 25 bp, mus musculus
caccgatgagcgccgcagtgacaac

SEQ ID NO: 87876 - DNA, 25 bp, mus musculus
ccctgctctctccattggtttctct

SEQ ID NO: 87877 - DNA, 25 bp, mus musculus
tctctccattggtttctctgttacc

SEQ ID NO: 87878 - DNA, 25 bp, mus musculus
cttcgagctgccttctacgtggctg

SEQ ID NO: 87879 - DNA, 25 bp, mus musculus
cgagctgccttctacgtggctgccc

SEQ ID NO: 87880 - DNA, 25 bp, mus musculus
ttctacgtggctgcccagctgctgg

SEQ ID NO: 87881 - DNA, 25 bp, mus musculus
ggggcgccatcctccatgagattac

SEQ ID NO: 87882 - DNA, 25 bp, mus musculus
tcctccatgagattacccctgtaga

SEQ ID NO: 87883 - DNA, 25 bp, mus musculus
tccatgagattacccctgtagaaat

SEQ ID NO: 87884 - DNA, 25 bp, mus musculus
atgagattacccctgtagaaatccg

SEQ ID NO: 87885 - DNA, 25 bp, mus musculus
tggctgtcaatgctctccacaacaa

SEQ ID NO: 87886 - DNA, 25 bp, mus musculus
gcttataaacttcagcctcagggct

SEQ ID NO: 87887 - DNA, 25 bp, mus musculus
tataaacttcagcctcagggctcca

SEQ ID NO: 87888 - DNA, 25 bp, mus musculus
catcagctcctgctttggtatactg

SEQ ID NO: 87889 - DNA, 25 bp, mus musculus
cagctcctgctttggtatactgatg

SEQ ID NO: 87890 - DNA, 25 bp, mus musculus
agagactctgactgaactggaggcg

SEQ ID NO: 87891 - DNA, 25 bp, mus musculus
caaaggcagcctgaacatcaatgaa

SEQ ID NO: 87892 - DNA, 25 bp, mus musculus
ggaactggccactcagcaactgcct

SEQ ID NO: 87893 - DNA, 25 bp, mus musculus
actggccactcagcaactgcctcat

SEQ ID NO: 87894 - DNA, 25 bp, mus musculus
ggccactcagcaactgcctcatttg

SEQ ID NO: 87895 - DNA, 25 bp, mus musculus
tcagcaactgcctcatttgctcaag

SEQ ID NO: 87896 - DNA, 25 bp, mus musculus
gcaactgcctcatttgctcaaggac

SEQ ID NO: 87897 - DNA, 25 bp, mus musculus
actgcctcatttgctcaaggacgtg

SEQ ID NO: 87898 - DNA, 25 bp, mus musculus
aaacttcagcctcagggctccagat

SEQ ID NO: 87899 - DNA, 25 bp, mus musculus
tcatttgctcaaggacgtgggctct

SEQ ID NO: 87900 - DNA, 25 bp, mus musculus
cagcctcagggctccagatcggtta

SEQ ID NO: 87901 - DNA, 25 bp, mus musculus
cctcagggctccagatcggttagct

SEQ ID NO: 87902 - DNA, 25 bp, mus musculus
cagggctccagatcggttagctgca

SEQ ID NO: 87903 - DNA, 25 bp, mus musculus
tcggttagctgcatcccaccttctt

SEQ ID NO: 87904 - DNA, 25 bp, mus musculus
tctttcccggtcaatctgtgtggac

SEQ ID NO: 87905 - DNA, 25 bp, mus musculus
ttcccggtcaatctgtgtggacatc

SEQ ID NO: 87906 - DNA, 25 bp, mus musculus
ggacatcagctcctgctttggtata

SEQ ID NO: 87907 - DNA, 25 bp, mus musculus
ttaaccacttcttctgacaatggtg

SEQ ID NO: 87908 - DNA, 25 bp, mus musculus
acttcttctgacaatggtgtcaagg

SEQ ID NO: 87909 - DNA, 25 bp, mus musculus
gctttgccatcctctacataatact

SEQ ID NO: 87910 - DNA, 25 bp, mus musculus
ccatcctctacataatactagtgtg

SEQ ID NO: 87911 - DNA, 25 bp, mus musculus
tttccagatggcaccctcactataa

SEQ ID NO: 87912 - DNA, 25 bp, mus musculus
gatggcaccctcactataacactat

SEQ ID NO: 87913 - DNA, 25 bp, mus musculus
accctcactataacactattaatag

SEQ ID NO: 87914 - DNA, 25 bp, mus musculus
acactattaatagccccactgatac

SEQ ID NO: 87915 - DNA, 25 bp, mus musculus
ttaatagccccactgatacccattt

SEQ ID NO: 87916 - DNA, 25 bp, mus musculus
tcccaaaatttcctgagagaccagg

SEQ ID NO: 87917 - DNA, 25 bp, mus musculus
gatatgttatgcctccatttcaatt

SEQ ID NO: 87918 - DNA, 25 bp, mus musculus
ttatgcctccatttcaattaaagtc

SEQ ID NO: 87919 - DNA, 25 bp, mus musculus
ctgcagtctgaagtcccacactaca

SEQ ID NO: 87920 - DNA, 25 bp, mus musculus
agctataagccctacaggagctaca

SEQ ID NO: 87921 - DNA, 25 bp, mus musculus
agctacagggaccaccacaggtcag

SEQ ID NO: 87922 - DNA, 25 bp, mus musculus
gggaactgtcctcctgatggcagat

SEQ ID NO: 87923 - DNA, 25 bp, mus musculus
tgtcctcctgatggcagatcttgtt

SEQ ID NO: 87924 - DNA, 25 bp, mus musculus
cttgctctgcctgcccaatatgtgt

SEQ ID NO: 87925 - DNA, 25 bp, mus musculus
tatgtgtgggcactaggggtcttga

SEQ ID NO: 87926 - DNA, 25 bp, mus musculus
acttgggctttgccatcctctacat

SEQ ID NO: 87927 - DNA, 25 bp, mus musculus
gtgatggcgactcttaccgaggcaa

SEQ ID NO: 87928 - DNA, 25 bp, mus musculus
gcgactcttaccgaggcaaagtgag

SEQ ID NO: 87929 - DNA, 25 bp, mus musculus
ggatcgcagagcacaacttctgcag

SEQ ID NO: 87930 - DNA, 25 bp, mus musculus
tcgcagagcacaacttctgcagaca

SEQ ID NO: 87931 - DNA, 25 bp, mus musculus
cagagcacaacttctgcagacaccc

SEQ ID NO: 87932 - DNA, 25 bp, mus musculus
acttctgcagacacccagatggaga

SEQ ID NO: 87933 - DNA, 25 bp, mus musculus
tctgcagacacccagatggagacca

SEQ ID NO: 87934 - DNA, 25 bp, mus musculus
gacacccagatggagaccacaaacg

SEQ ID NO: 87935 - DNA, 25 bp, mus musculus
gagaccacaaacgctggtgtttcgt

SEQ ID NO: 87936 - DNA, 25 bp, mus musculus
gctggtgtttcgtcaaggtgaacag

SEQ ID NO: 87937 - DNA, 25 bp, mus musculus
atgttacagtctgtccagtgcctga

SEQ ID NO: 87938 - DNA, 25 bp, mus musculus
ttacagtctgtccagtgcctgacag

SEQ ID NO: 87939 - DNA, 25 bp, mus musculus
gtaagacagtctaccagcacccatg

SEQ ID NO: 87940 - DNA, 25 bp, mus musculus
cagtctaccagcacccatgccttta

SEQ ID NO: 87941 - DNA, 25 bp, mus musculus
accagcacccatgcctttactggaa

SEQ ID NO: 87942 - DNA, 25 bp, mus musculus
gcctttactggaactcgcagctgct

SEQ ID NO: 87943 - DNA, 25 bp, mus musculus
tttactggaactcgcagctgctctt

SEQ ID NO: 87944 - DNA, 25 bp, mus musculus
cgcagctgctcttgcaggagactta

SEQ ID NO: 87945 - DNA, 25 bp, mus musculus
agctgctcttgcaggagacttataa

SEQ ID NO: 87946 - DNA, 25 bp, mus musculus
agacccacgggatcgcagagcacaa

SEQ ID NO: 87947 - DNA, 25 bp, mus musculus
tgctgcttgttcgaagggtgcttct

SEQ ID NO: 87948 - DNA, 25 bp, mus musculus
ttgttcgaagggtgcttctggctgg

SEQ ID NO: 87949 - DNA, 25 bp, mus musculus
agattttcttctcttatggcatagg

SEQ ID NO: 87950 - DNA, 25 bp, mus musculus
tcttctcttatggcataggcttggg

SEQ ID NO: 87951 - DNA, 25 bp, mus musculus
cttatggcataggcttgggggcctt

SEQ ID NO: 87952 - DNA, 25 bp, mus musculus
gggccttaacaggcctaggcagctt

SEQ ID NO: 87953 - DNA, 25 bp, mus musculus
taacaggcctaggcagcttcaatcg

SEQ ID NO: 87954 - DNA, 25 bp, mus musculus
gcctaggcagcttcaatcgctttaa

SEQ ID NO: 87955 - DNA, 25 bp, mus musculus
gcagcttcaatcgctttaacaacaa

SEQ ID NO: 87956 - DNA, 25 bp, mus musculus
tcaatcgctttaacaacaactgtta

SEQ ID NO: 87957 - DNA, 25 bp, mus musculus
atggcatcatcctgggacttattaa

SEQ ID NO: 87958 - DNA, 25 bp, mus musculus
tcatcctgggacttattaacagcgg

SEQ ID NO: 87959 - DNA, 25 bp, mus musculus
tggctggagccctggatggtatcat

SEQ ID NO: 87960 - DNA, 25 bp, mus musculus
gtatcatctactatctcaagcctga

SEQ ID NO: 87961 - DNA, 25 bp, mus musculus
tctactatctcaagcctgactggtc

SEQ ID NO: 87962 - DNA, 25 bp, mus musculus
agcctgactggtcaaagctagggtc

SEQ ID NO: 87963 - DNA, 25 bp, mus musculus
caaagctagggtctcctcaggtatg

SEQ ID NO: 87964 - DNA, 25 bp, mus musculus
tagggtctcctcaggtatggataga

SEQ ID NO: 87965 - DNA, 25 bp, mus musculus
atgcttggacccagattttcttctc

SEQ ID NO: 87966 - DNA, 25 bp, mus musculus
ggacccagattttcttctcttatgg

SEQ ID NO: 87967 - DNA, 25 bp, mus musculus
accagcacagcacacatcgcatgag

SEQ ID NO: 87968 - DNA, 25 bp, mus musculus
acagcacacatcgcatgaggacaga

SEQ ID NO: 87969 - DNA, 25 bp, mus musculus
ccattctgggccagactgtcccctg

SEQ ID NO: 87970 - DNA, 25 bp, mus musculus
gttcaaccacaaccattaatggatc

SEQ ID NO: 87971 - DNA, 25 bp, mus musculus
gtcggtgtcacctcacagcaacttc

SEQ ID NO: 87972 - DNA, 25 bp, mus musculus
tcacagcaacttctcctttggtggc

SEQ ID NO: 87973 - DNA, 25 bp, mus musculus
caacttctcctttggtggctgctca

SEQ ID NO: 87974 - DNA, 25 bp, mus musculus
ctcctttggtggctgctcagccagt

SEQ ID NO: 87975 - DNA, 25 bp, mus musculus
tggtggctgctcagccagtgatact

SEQ ID NO: 87976 - DNA, 25 bp, mus musculus
tgatacttaggcccctggacaatga

SEQ ID NO: 87977 - DNA, 25 bp, mus musculus
gccagtcctaagctgctacttgtgt

SEQ ID NO: 87978 - DNA, 25 bp, mus musculus
tcttctccaaggctttccaagagca

SEQ ID NO: 87979 - DNA, 25 bp, mus musculus
cacatcgcatgaggacagagaccaa

SEQ ID NO: 87980 - DNA, 25 bp, mus musculus
caaggctttccaagagcagaggcaa

SEQ ID NO: 87981 - DNA, 25 bp, mus musculus
agaccaaggcagccaagactttatg

SEQ ID NO: 87982 - DNA, 25 bp, mus musculus
ctttatgtgtcatcatgggctgctt

SEQ ID NO: 87983 - DNA, 25 bp, mus musculus
tcatgggctgcttctgtttctgctg

SEQ ID NO: 87984 - DNA, 25 bp, mus musculus
ttgtggaccctttcatagactacac

SEQ ID NO: 87985 - DNA, 25 bp, mus musculus
ggactgctttcctctggcttggcta

SEQ ID NO: 87986 - DNA, 25 bp, mus musculus
ttctctatgccttcttgaataagtc

SEQ ID NO: 87987 - DNA, 25 bp, mus musculus
ctttcagacgtgccttcctcatcat

SEQ ID NO: 87988 - DNA, 25 bp, mus musculus
aatgaatgcatccagggctctgaaa

SEQ ID NO: 87989 - DNA, 25 bp, mus musculus
agcatccatggttatcacggagtct

SEQ ID NO: 87990 - DNA, 25 bp, mus musculus
ctttaactctcggggagattagctg

SEQ ID NO: 87991 - DNA, 25 bp, mus musculus
taactctcggggagattagctgaaa

SEQ ID NO: 87992 - DNA, 25 bp, mus musculus
ctcctttcctgtatgtgcactgtag

SEQ ID NO: 87993 - DNA, 25 bp, mus musculus
atgtgcactgtaggggctcttagaa

SEQ ID NO: 87994 - DNA, 25 bp, mus musculus
tgcactgtaggggctcttagaatgg

SEQ ID NO: 87995 - DNA, 25 bp, mus musculus
tgaagagactcgctctggagccagg

SEQ ID NO: 87996 - DNA, 25 bp, mus musculus
agcccgttcaaggctcagggcttca

SEQ ID NO: 87997 - DNA, 25 bp, mus musculus
ggcttcatcctcagcaccaacaaat

SEQ ID NO: 87998 - DNA, 25 bp, mus musculus
gcccaggtaaacactctgtgacact

SEQ ID NO: 87999 - DNA, 25 bp, mus musculus
gtaaacactctgtgacactgaagaa

SEQ ID NO: 88000 - DNA, 25 bp, mus musculus
atccatggttatcacggagtctcct

SEQ ID NO: 88001 - DNA, 25 bp, mus musculus
ggttatcacggagtctcctgctgcc

SEQ ID NO: 88002 - DNA, 25 bp, mus musculus
tcagctccggtaccttcaaaccctg

SEQ ID NO: 88003 - DNA, 25 bp, mus musculus
tcaaaccctgaccactatcgctgcg

SEQ ID NO: 88004 - DNA, 25 bp, mus musculus
cactatcgctgcggagaaaaactcc

SEQ ID NO: 88005 - DNA, 25 bp, mus musculus
ccctctgcccatcgacatgttgcag

SEQ ID NO: 88006 - DNA, 25 bp, mus musculus
gcccatcgacatgttgcagggcatc

SEQ ID NO: 88007 - DNA, 25 bp, mus musculus
catcgacatgttgcagggcatcatg

SEQ ID NO: 88008 - DNA, 25 bp, mus musculus
gactctacagccaggagaacccttg

SEQ ID NO: 88009 - DNA, 25 bp, mus musculus
ccatctctgtcattttaaacagctc

SEQ ID NO: 88010 - DNA, 25 bp, mus musculus
tgattccccagttcactgacaaatg

SEQ ID NO: 88011 - DNA, 25 bp, mus musculus
tagcttcagatgtctttgcgccatc

SEQ ID NO: 88012 - DNA, 25 bp, mus musculus
cagatgtctttgcgccatcagcact

SEQ ID NO: 88013 - DNA, 25 bp, mus musculus
cgccatcagcactcagaaaggaagg

SEQ ID NO: 88014 - DNA, 25 bp, mus musculus
gaggagccccttgttttgatgaata

SEQ ID NO: 88015 - DNA, 25 bp, mus musculus
tagtaggtgccactcgattggttcc

SEQ ID NO: 88016 - DNA, 25 bp, mus musculus
ctcgattggttcctcgggctggcaa

SEQ ID NO: 88017 - DNA, 25 bp, mus musculus
aatgctcatgagttattgtgcttct

SEQ ID NO: 88018 - DNA, 25 bp, mus musculus
agcactgatcaattcccattccact

SEQ ID NO: 88019 - DNA, 25 bp, mus musculus
ctgaagcactgcctgatgttttata

SEQ ID NO: 88020 - DNA, 25 bp, mus musculus
ctgtcattttaaacagctcactgct

SEQ ID NO: 88021 - DNA, 25 bp, mus musculus
cactgctttgtcaagttgctgtcac

SEQ ID NO: 88022 - DNA, 25 bp, mus musculus
tttgtcaagttgctgtcactgttgc

SEQ ID NO: 88023 - DNA, 25 bp, mus musculus
aagttgctgtcactgttgcccacta

SEQ ID NO: 88024 - DNA, 25 bp, mus musculus
ttgatttgacctagtgtcatggtaa

SEQ ID NO: 88025 - DNA, 25 bp, mus musculus
atggtaaagccacatttccatgcaa

SEQ ID NO: 88026 - DNA, 25 bp, mus musculus
aagccacatttccatgcaatggcgg

SEQ ID NO: 88027 - DNA, 25 bp, mus musculus
catttccatgcaatggcggctaggt

SEQ ID NO: 88028 - DNA, 25 bp, mus musculus
gcaatgtgctgcagctggctaggac

SEQ ID NO: 88029 - DNA, 25 bp, mus musculus
atgtgctgcagctggctaggactct

SEQ ID NO: 88030 - DNA, 25 bp, mus musculus
tcaatagccggactcctggggagac

SEQ ID NO: 88031 - DNA, 25 bp, mus musculus
gagaccaagacttccaatgctacca

SEQ ID NO: 88032 - DNA, 25 bp, mus musculus
agaccaagacttccaatgctaccat

SEQ ID NO: 88033 - DNA, 25 bp, mus musculus
accaagacttccaatgctaccatgt

SEQ ID NO: 88034 - DNA, 25 bp, mus musculus
aagacttccaatgctaccatgtctg

SEQ ID NO: 88035 - DNA, 25 bp, mus musculus
agacttccaatgctaccatgtctgt

SEQ ID NO: 88036 - DNA, 25 bp, mus musculus
cttccaatgctaccatgtctgtata

SEQ ID NO: 88037 - DNA, 25 bp, mus musculus
accatgtctgtatactttgtggtaa

SEQ ID NO: 88038 - DNA, 25 bp, mus musculus
ccatgtctgtatactttgtggtaat

SEQ ID NO: 88039 - DNA, 25 bp, mus musculus
gtaatgctgagtcgcgatgacatcg

SEQ ID NO: 88040 - DNA, 25 bp, mus musculus
actctgagaactgcagacctcaata

SEQ ID NO: 88041 - DNA, 25 bp, mus musculus
tgagaactgcagacctcaatagccg

SEQ ID NO: 88042 - DNA, 25 bp, mus musculus
agaactgcagacctcaatagccgga

SEQ ID NO: 88043 - DNA, 25 bp, mus musculus
gaactgcagacctcaatagccggac

SEQ ID NO: 88044 - DNA, 25 bp, mus musculus
actgcagacctcaatagccggactc

SEQ ID NO: 88045 - DNA, 25 bp, mus musculus
ctgcagacctcaatagccggactcc

SEQ ID NO: 88046 - DNA, 25 bp, mus musculus
gcagacctcaatagccggactcctg

SEQ ID NO: 88047 - DNA, 25 bp, mus musculus
gacctcaatagccggactcctgggg

SEQ ID NO: 88048 - DNA, 25 bp, mus musculus
aagagcctgttgccacagcaccgga

SEQ ID NO: 88049 - DNA, 25 bp, mus musculus
ctgttgccacagcaccggagcagga

SEQ ID NO: 88050 - DNA, 25 bp, mus musculus
agcctctgccaaaaagcggctggga

SEQ ID NO: 88051 - DNA, 25 bp, mus musculus
acctacctgccaaagctcaacagac

SEQ ID NO: 88052 - DNA, 25 bp, mus musculus
ctgccaaagctcaacagacagcagc

SEQ ID NO: 88053 - DNA, 25 bp, mus musculus
aagctcaacagacagcagcccttat

SEQ ID NO: 88054 - DNA, 25 bp, mus musculus
aacagacagcagcccttatgcgcgg

SEQ ID NO: 88055 - DNA, 25 bp, mus musculus
cccttatgcgcggatcttgcgctca

SEQ ID NO: 88056 - DNA, 25 bp, mus musculus
atggttgttgccctgaggttggtca

SEQ ID NO: 88057 - DNA, 25 bp, mus musculus
ttggtcagctgcttagctgataagt

SEQ ID NO: 88058 - DNA, 25 bp, mus musculus
ttaagcttcagcatacacccagaac

SEQ ID NO: 88059 - DNA, 25 bp, mus musculus
atacacccagaactgtattcagaat

SEQ ID NO: 88060 - DNA, 25 bp, mus musculus
ccacagcaccggagcaggaaaactt

SEQ ID NO: 88061 - DNA, 25 bp, mus musculus
tcgtcaagcattaaccaactgtgat

SEQ ID NO: 88062 - DNA, 25 bp, mus musculus
cttaatcaagcagaaccagaccctg

SEQ ID NO: 88063 - DNA, 25 bp, mus musculus
gaccctggctgagctgcagaataac

SEQ ID NO: 88064 - DNA, 25 bp, mus musculus
cattgctgagcagtatcacactgtg

SEQ ID NO: 88065 - DNA, 25 bp, mus musculus
gtatcacactgtgctaaagctccaa

SEQ ID NO: 88066 - DNA, 25 bp, mus musculus
gctaaagctccaaggccaagcctct

SEQ ID NO: 88067 - DNA, 25 bp, mus musculus
gctccaaggccaagcctctgccaaa

SEQ ID NO: 88068 - DNA, 25 bp, mus musculus
gcatccatttcaacagctcggagca

SEQ ID NO: 88069 - DNA, 25 bp, mus musculus
atttcaacagctcggagcatctgca

SEQ ID NO: 88070 - DNA, 25 bp, mus musculus
ggaggcctctgctatcctcagtatt

SEQ ID NO: 88071 - DNA, 25 bp, mus musculus
tatcctcagtattgactaggagttt

SEQ ID NO: 88072 - DNA, 25 bp, mus musculus
aagtgtatcatcgttccctgttctc

SEQ ID NO: 88073 - DNA, 25 bp, mus musculus
atcatcgttccctgttctcagttct

SEQ ID NO: 88074 - DNA, 25 bp, mus musculus
cagttctgttcctctctttagtctc

SEQ ID NO: 88075 - DNA, 25 bp, mus musculus
tgccccggagagctgcacactgcac

SEQ ID NO: 88076 - DNA, 25 bp, mus musculus
ctgcacactgcacaaggctgtcgat

SEQ ID NO: 88077 - DNA, 25 bp, mus musculus
actgcacaaggctgtcgatcatctc

SEQ ID NO: 88078 - DNA, 25 bp, mus musculus
tgtcgatcatctcattgcaggtcgt

SEQ ID NO: 88079 - DNA, 25 bp, mus musculus
cagctcattggaatcccagtgaaga

SEQ ID NO: 88080 - DNA, 25 bp, mus musculus
acagctcggagcatctgcacgcagt

SEQ ID NO: 88081 - DNA, 25 bp, mus musculus
aagagcccttcctatgcggagcagt

SEQ ID NO: 88082 - DNA, 25 bp, mus musculus
tttgaactctaatgtcctgcacctc

SEQ ID NO: 88083 - DNA, 25 bp, mus musculus
gcacctcagctccttcaaagtccag

SEQ ID NO: 88084 - DNA, 25 bp, mus musculus
cttcaaagtccagcattggctggtg

SEQ ID NO: 88085 - DNA, 25 bp, mus musculus
agtccagcattggctggtgaccctg

SEQ ID NO: 88086 - DNA, 25 bp, mus musculus
gcattggctggtgaccctgaggctg

SEQ ID NO: 88087 - DNA, 25 bp, mus musculus
ccacagctggcctgagctggaggcc

SEQ ID NO: 88088 - DNA, 25 bp, mus musculus
aattccaaactcacctacctgctgc

SEQ ID NO: 88089 - DNA, 25 bp, mus musculus
ttccaaactcacctacctgctgcag

SEQ ID NO: 88090 - DNA, 25 bp, mus musculus
gacagcaagacccttatggtggtac

SEQ ID NO: 88091 - DNA, 25 bp, mus musculus
cagcaagacccttatggtggtacag

SEQ ID NO: 88092 - DNA, 25 bp, mus musculus
gcaagacccttatggtggtacaggt

SEQ ID NO: 88093 - DNA, 25 bp, mus musculus
agaagaacaccagcgagactctgta

SEQ ID NO: 88094 - DNA, 25 bp, mus musculus
accagcgagactctgtactccctca

SEQ ID NO: 88095 - DNA, 25 bp, mus musculus
cagcgagactctgtactccctcaga

SEQ ID NO: 88096 - DNA, 25 bp, mus musculus
gcgagactctgtactccctcagatt

SEQ ID NO: 88097 - DNA, 25 bp, mus musculus
gagactctgtactccctcagatttg

SEQ ID NO: 88098 - DNA, 25 bp, mus musculus
gactctgtactccctcagatttgct

SEQ ID NO: 88099 - DNA, 25 bp, mus musculus
gtactccctcagatttgctgagagg

SEQ ID NO: 88100 - DNA, 25 bp, mus musculus
acctacctgctgcaggactcactca

SEQ ID NO: 88101 - DNA, 25 bp, mus musculus
ctccctcagatttgctgagagggtc

SEQ ID NO: 88102 - DNA, 25 bp, mus musculus
ctacctgctgcaggactcactcagt

SEQ ID NO: 88103 - DNA, 25 bp, mus musculus
acctgctgcaggactcactcagtgg

SEQ ID NO: 88104 - DNA, 25 bp, mus musculus
gctgcaggactcactcagtggtgac

SEQ ID NO: 88105 - DNA, 25 bp, mus musculus
caggactcactcagtggtgacagca

SEQ ID NO: 88106 - DNA, 25 bp, mus musculus
ggactcactcagtggtgacagcaag

SEQ ID NO: 88107 - DNA, 25 bp, mus musculus
tcactcagtggtgacagcaagaccc

SEQ ID NO: 88108 - DNA, 25 bp, mus musculus
gtgacagcaagacccttatggtggt

SEQ ID NO: 88109 - DNA, 25 bp, mus musculus
gactcggtgcgttcaaggaccttcg

SEQ ID NO: 88110 - DNA, 25 bp, mus musculus
tgcgttcaaggaccttcgcgaggat

SEQ ID NO: 88111 - DNA, 25 bp, mus musculus
tcagagcttgtttgactcggtggtg

SEQ ID NO: 88112 - DNA, 25 bp, mus musculus
gaaagctgtaactgcctgcaggctt

SEQ ID NO: 88113 - DNA, 25 bp, mus musculus
aaagctgtaactgcctgcaggcttc

SEQ ID NO: 88114 - DNA, 25 bp, mus musculus
aagctgtaactgcctgcaggcttcc

SEQ ID NO: 88115 - DNA, 25 bp, mus musculus
tgtaactgcctgcaggcttccagct

SEQ ID NO: 88116 - DNA, 25 bp, mus musculus
gtaactgcctgcaggcttccagctg

SEQ ID NO: 88117 - DNA, 25 bp, mus musculus
taactgcctgcaggcttccagctga

SEQ ID NO: 88118 - DNA, 25 bp, mus musculus
aactgcctgcaggcttccagctgac

SEQ ID NO: 88119 - DNA, 25 bp, mus musculus
ggtacctccttattcagaagatccg

SEQ ID NO: 88120 - DNA, 25 bp, mus musculus
gtacctccttattcagaagatccgg

SEQ ID NO: 88121 - DNA, 25 bp, mus musculus
gcgttcaaggaccttcgcgaggatc

SEQ ID NO: 88122 - DNA, 25 bp, mus musculus
ttcaaggaccttcgcgaggatcttc

SEQ ID NO: 88123 - DNA, 25 bp, mus musculus
gaccttcgcgaggatcttcagaact

SEQ ID NO: 88124 - DNA, 25 bp, mus musculus
cttcgcgaggatcttcagaactgat

SEQ ID NO: 88125 - DNA, 25 bp, mus musculus
ctgataacttcgtttttggtcagag

SEQ ID NO: 88126 - DNA, 25 bp, mus musculus
tgataacttcgtttttggtcagagt

SEQ ID NO: 88127 - DNA, 25 bp, mus musculus
ttcgtttttggtcagagtagggctg

SEQ ID NO: 88128 - DNA, 25 bp, mus musculus
ttcagagcttgtttgactcggtggt

SEQ ID NO: 88129 - DNA, 25 bp, mus musculus
ggactccgtctgcgatgagtaccct

SEQ ID NO: 88130 - DNA, 25 bp, mus musculus
tccgtctgcgatgagtaccctcctt

SEQ ID NO: 88131 - DNA, 25 bp, mus musculus
agatgtcggacacactggttgatgc

SEQ ID NO: 88132 - DNA, 25 bp, mus musculus
gtcggacacactggttgatgcctac

SEQ ID NO: 88133 - DNA, 25 bp, mus musculus
cggacacactggttgatgcctacaa

SEQ ID NO: 88134 - DNA, 25 bp, mus musculus
cacactggttgatgcctacaatgca

SEQ ID NO: 88135 - DNA, 25 bp, mus musculus
ggttgatgcctacaatgcagcctct

SEQ ID NO: 88136 - DNA, 25 bp, mus musculus
ttgatgcctacaatgcagcctctca

SEQ ID NO: 88137 - DNA, 25 bp, mus musculus
tgcctacaatgcagcctctcagtcc

SEQ ID NO: 88138 - DNA, 25 bp, mus musculus
caatgcagcctctcagtccacagct

SEQ ID NO: 88139 - DNA, 25 bp, mus musculus
atgcagcctctcagtccacagctgg

SEQ ID NO: 88140 - DNA, 25 bp, mus musculus
agtccacagctggttgaaacacaga

SEQ ID NO: 88141 - DNA, 25 bp, mus musculus
cgtctgcgatgagtaccctccttat

SEQ ID NO: 88142 - DNA, 25 bp, mus musculus
tgcgatgagtaccctccttatcagc

SEQ ID NO: 88143 - DNA, 25 bp, mus musculus
cgatgagtaccctccttatcagcaa

SEQ ID NO: 88144 - DNA, 25 bp, mus musculus
agtactcacacagaatcatgaacac

SEQ ID NO: 88145 - DNA, 25 bp, mus musculus
tagcttcttccaagatgtcggacac

SEQ ID NO: 88146 - DNA, 25 bp, mus musculus
ttcttccaagatgtcggacacactg

SEQ ID NO: 88147 - DNA, 25 bp, mus musculus
cttccaagatgtcggacacactggt

SEQ ID NO: 88148 - DNA, 25 bp, mus musculus
caagatgtcggacacactggttgat

SEQ ID NO: 88149 - DNA, 25 bp, mus musculus
cagaagctcactgacaataatgtca

SEQ ID NO: 88150 - DNA, 25 bp, mus musculus
ctcactgacaataatgtcagctttc

SEQ ID NO: 88151 - DNA, 25 bp, mus musculus
ggctgcccgaaaagacgcattcaca

SEQ ID NO: 88152 - DNA, 25 bp, mus musculus
acccagcaccataagtacctggaca

SEQ ID NO: 88153 - DNA, 25 bp, mus musculus
ttctggtactcggtctagcaaacat

SEQ ID NO: 88154 - DNA, 25 bp, mus musculus
aatagcctgctgatattgagagtat

SEQ ID NO: 88155 - DNA, 25 bp, mus musculus
cttttcaaacacttcatatgtctga

SEQ ID NO: 88156 - DNA, 25 bp, mus musculus
cagattgtccatcagaggctggagt

SEQ ID NO: 88157 - DNA, 25 bp, mus musculus
ttcatagcctttggcaaaaagctca

SEQ ID NO: 88158 - DNA, 25 bp, mus musculus
taagtattccaagtactggaggtag

SEQ ID NO: 88159 - DNA, 25 bp, mus musculus
ttccaacttgaggagccggaagatc

SEQ ID NO: 88160 - DNA, 25 bp, mus musculus
gaagatcagcctctgctgcacctta

SEQ ID NO: 88161 - DNA, 25 bp, mus musculus
aatgtcagctttctccggagccacc

SEQ ID NO: 88162 - DNA, 25 bp, mus musculus
agcctctgctgcaccttagaaagaa

SEQ ID NO: 88163 - DNA, 25 bp, mus musculus
tgagacaactgtcacctggctcccc

SEQ ID NO: 88164 - DNA, 25 bp, mus musculus
ccattcttcaaactgccagttctct

SEQ ID NO: 88165 - DNA, 25 bp, mus musculus
ttcaaactgccagttctctagcgtc

SEQ ID NO: 88166 - DNA, 25 bp, mus musculus
tagcgtcaccacagcattggggttc

SEQ ID NO: 88167 - DNA, 25 bp, mus musculus
caccacagcattggggttcttctcc

SEQ ID NO: 88168 - DNA, 25 bp, mus musculus
ggggttcttctccacagcatacagc

SEQ ID NO: 88169 - DNA, 25 bp, mus musculus
ctgtttggctgcccgaaaagacgca

SEQ ID NO: 88170 - DNA, 25 bp, mus musculus
cttctaaatttgcccagaaatatgg

SEQ ID NO: 88171 - DNA, 25 bp, mus musculus
aatttgcccagaaatatggaggagc

SEQ ID NO: 88172 - DNA, 25 bp, mus musculus
gaaacagccagcacttggcactggg

SEQ ID NO: 88173 - DNA, 25 bp, mus musculus
gccagcacttggcactgggcatcac

SEQ ID NO: 88174 - DNA, 25 bp, mus musculus
cactgggcatcaccgagctgcctgt

SEQ ID NO: 88175 - DNA, 25 bp, mus musculus
actcactagcgtctaagagcacacg

SEQ ID NO: 88176 - DNA, 25 bp, mus musculus
gcacacgaattcactatcgattctg

SEQ ID NO: 88177 - DNA, 25 bp, mus musculus
gaattcactatcgattctggaacct

SEQ ID NO: 88178 - DNA, 25 bp, mus musculus
actatcgattctggaaccttcagag

SEQ ID NO: 88179 - DNA, 25 bp, mus musculus
gattctggaaccttcagaggtctcc

SEQ ID NO: 88180 - DNA, 25 bp, mus musculus
ggaaccttcagaggtctccctatag

SEQ ID NO: 88181 - DNA, 25 bp, mus musculus
ttcagaggtctccctatagtgagtc

SEQ ID NO: 88182 - DNA, 25 bp, mus musculus
gtctggagtctacaactctgactga

SEQ ID NO: 88183 - DNA, 25 bp, mus musculus
cccttgttcatgctcagtaatggtg

SEQ ID NO: 88184 - DNA, 25 bp, mus musculus
ttcatgctcagtaatggtgtgaacc

SEQ ID NO: 88185 - DNA, 25 bp, mus musculus
gtgaacccagtaagcacgacagaga

SEQ ID NO: 88186 - DNA, 25 bp, mus musculus
acagagaatctccattaccaaactg

SEQ ID NO: 88187 - DNA, 25 bp, mus musculus
cattaccaaactgcagatggcgttt

SEQ ID NO: 88188 - DNA, 25 bp, mus musculus
caaactgcagatggcgtttatggcg

SEQ ID NO: 88189 - DNA, 25 bp, mus musculus
gctcactactgtgaaacagccagca

SEQ ID NO: 88190 - DNA, 25 bp, mus musculus
acacttctacctgctgtaaatgata

SEQ ID NO: 88191 - DNA, 25 bp, mus musculus
aatgatatacccatcaactccttga

SEQ ID NO: 88192 - DNA, 25 bp, mus musculus
cttcagacctaatcacagctcagcg

SEQ ID NO: 88193 - DNA, 25 bp, mus musculus
tcacagctcagcgtctgctccttca

SEQ ID NO: 88194 - DNA, 25 bp, mus musculus
gtctgctccttcatcacagaaccca

SEQ ID NO: 88195 - DNA, 25 bp, mus musculus
tccttcatcacagaacccagtcttt

SEQ ID NO: 88196 - DNA, 25 bp, mus musculus
ctcatctttcctttgatctggatga

SEQ ID NO: 88197 - DNA, 25 bp, mus musculus
tttcctttgatctggatgaaaacga

SEQ ID NO: 88198 - DNA, 25 bp, mus musculus
agtccagtctcacagggcgcttgag

SEQ ID NO: 88199 - DNA, 25 bp, mus musculus
gtctcacagggcgcttgagcccagt

SEQ ID NO: 88200 - DNA, 25 bp, mus musculus
gcttgagcccagttgaaggatttta

SEQ ID NO: 88201 - DNA, 25 bp, mus musculus
ccctatctcatcatttagcacttat

SEQ ID NO: 88202 - DNA, 25 bp, mus musculus
atacccatcaactccttgaaagtct

SEQ ID NO: 88203 - DNA, 25 bp, mus musculus
atcaactccttgaaagtctcaggaa

SEQ ID NO: 88204 - DNA, 25 bp, mus musculus
tgggaccctttaagccagagagtga

SEQ ID NO: 88205 - DNA, 25 bp, mus musculus
gtcccagtggcttctaaagatcaga

SEQ ID NO: 88206 - DNA, 25 bp, mus musculus
gaataggcctccgaatcacacattt

SEQ ID NO: 88207 - DNA, 25 bp, mus musculus
tcaggctgtttcccattacttcaga

SEQ ID NO: 88208 - DNA, 25 bp, mus musculus
tgtttcccattacttcagacctaat

SEQ ID NO: 88209 - DNA, 25 bp, mus musculus
ccattacttcagacctaatcacagc

SEQ ID NO: 88210 - DNA, 25 bp, mus musculus
ccccaatgcatccaagtttgcccag

SEQ ID NO: 88211 - DNA, 25 bp, mus musculus
tgcatccaagtttgcccagaagatt

SEQ ID NO: 88212 - DNA, 25 bp, mus musculus
gcttactcctaagcttttcatcagc

SEQ ID NO: 88213 - DNA, 25 bp, mus musculus
tactcctaagcttttcatcagcggt

SEQ ID NO: 88214 - DNA, 25 bp, mus musculus
taagcttttcatcagcggtccattc

SEQ ID NO: 88215 - DNA, 25 bp, mus musculus
tttcatcagcggtccattcccaagc

SEQ ID NO: 88216 - DNA, 25 bp, mus musculus
cagcggtccattcccaagccttgga

SEQ ID NO: 88217 - DNA, 25 bp, mus musculus
tgccttggacttgggtatctggctt

SEQ ID NO: 88218 - DNA, 25 bp, mus musculus
tgtggctcagggatctgcctgagct

SEQ ID NO: 88219 - DNA, 25 bp, mus musculus
ggtttcctcctgcctggcatttgat

SEQ ID NO: 88220 - DNA, 25 bp, mus musculus
ctcctgcctggcatttgataccatt

SEQ ID NO: 88221 - DNA, 25 bp, mus musculus
ctgcctggcatttgataccattacc

SEQ ID NO: 88222 - DNA, 25 bp, mus musculus
caagtttgcccagaagattggcggc

SEQ ID NO: 88223 - DNA, 25 bp, mus musculus
ctctgagcgctgtccccgctgtagc

SEQ ID NO: 88224 - DNA, 25 bp, mus musculus
gtcctggcataagtcctgcttccga

SEQ ID NO: 88225 - DNA, 25 bp, mus musculus
ctggcataagtcctgcttccgatgt

SEQ ID NO: 88226 - DNA, 25 bp, mus musculus
gcataagtcctgcttccgatgtgcc

SEQ ID NO: 88227 - DNA, 25 bp, mus musculus
cttccgatgtgccaagtgtggcaaa

SEQ ID NO: 88228 - DNA, 25 bp, mus musculus
atgtgccaagtgtggcaaaggcctt

SEQ ID NO: 88229 - DNA, 25 bp, mus musculus
gcgcaccctgcttactcctaagctt

SEQ ID NO: 88230 - DNA, 25 bp, mus musculus
cacctgaacgtcatgtaagaggacc

SEQ ID NO: 88231 - DNA, 25 bp, mus musculus
ccttgccagggactgatgggcagaa

SEQ ID NO: 88232 - DNA, 25 bp, mus musculus
ggacaactccattaaacagctgtgc

SEQ ID NO: 88233 - DNA, 25 bp, mus musculus
ctccattaaacagctgtgctgctcc

SEQ ID NO: 88234 - DNA, 25 bp, mus musculus
ctgctcctctgtcttacgtcatgac

SEQ ID NO: 88235 - DNA, 25 bp, mus musculus
cttacgtcatgacactgcacttgca

SEQ ID NO: 88236 - DNA, 25 bp, mus musculus
aggttattcacgtcatttcttcagt

SEQ ID NO: 88237 - DNA, 25 bp, mus musculus
taacagcttgtcacctgctgttatc

SEQ ID NO: 88238 - DNA, 25 bp, mus musculus
cttgtcacctgctgttatctggaga

SEQ ID NO: 88239 - DNA, 25 bp, mus musculus
acctgctgttatctggagaaaggca

SEQ ID NO: 88240 - DNA, 25 bp, mus musculus
tcttataccaaacttgagtgatgca

SEQ ID NO: 88241 - DNA, 25 bp, mus musculus
aatatggtcccatgtaagtagtgga

SEQ ID NO: 88242 - DNA, 25 bp, mus musculus
ggcagaactacacaaaatcatgttc

SEQ ID NO: 88243 - DNA, 25 bp, mus musculus
actacacaaaatcatgttcaactca

SEQ ID NO: 88244 - DNA, 25 bp, mus musculus
catgttcaactcatgttaccttcga

SEQ ID NO: 88245 - DNA, 25 bp, mus musculus
tttttccatggtacttgctagtgac

SEQ ID NO: 88246 - DNA, 25 bp, mus musculus
acttgctagtgactgtctccagaat

SEQ ID NO: 88247 - DNA, 25 bp, mus musculus
ctgtctccagaatcagcttgaaaag

SEQ ID NO: 88248 - DNA, 25 bp, mus musculus
acactttgtcgaaactgaaatatcg

SEQ ID NO: 88249 - DNA, 25 bp, mus musculus
tatgtttgtgttccagaaggacaac

SEQ ID NO: 88250 - DNA, 25 bp, mus musculus
acagggcttgcacgtcactctggtc

SEQ ID NO: 88251 - DNA, 25 bp, mus musculus
tctggtctgttcatcgtggttcaca

SEQ ID NO: 88252 - DNA, 25 bp, mus musculus
ctcactaagcaaatgtaccaccaat

SEQ ID NO: 88253 - DNA, 25 bp, mus musculus
caccaatgagccaggttcctagcct

SEQ ID NO: 88254 - DNA, 25 bp, mus musculus
ttccttttggaagctcagttcttga

SEQ ID NO: 88255 - DNA, 25 bp, mus musculus
ttggaagctcagttcttgagttgtc

SEQ ID NO: 88256 - DNA, 25 bp, mus musculus
ttcttgagttgtcagagggcctcat

SEQ ID NO: 88257 - DNA, 25 bp, mus musculus
ttgccgtcctcctctgagagcagtg

SEQ ID NO: 88258 - DNA, 25 bp, mus musculus
tcctcctctgagagcagtgatgcag

SEQ ID NO: 88259 - DNA, 25 bp, mus musculus
agcagtgatgcaggccaggagacat

SEQ ID NO: 88260 - DNA, 25 bp, mus musculus
tgccatgtgcactttgggattttgt

SEQ ID NO: 88261 - DNA, 25 bp, mus musculus
ctgtcctccagtgttctgttaatat

SEQ ID NO: 88262 - DNA, 25 bp, mus musculus
ctgttcatcgtggttcacagggcaa

SEQ ID NO: 88263 - DNA, 25 bp, mus musculus
atcgtggttcacagggcaaggtgaa

SEQ ID NO: 88264 - DNA, 25 bp, mus musculus
gcaatcttactgttttctggtgctg

SEQ ID NO: 88265 - DNA, 25 bp, mus musculus
ttactgttttctggtgctgactgct

SEQ ID NO: 88266 - DNA, 25 bp, mus musculus
ttttctggtgctgactgctacaccc

SEQ ID NO: 88267 - DNA, 25 bp, mus musculus
tacacccaggactttgccctcacta

SEQ ID NO: 88268 - DNA, 25 bp, mus musculus
caggactttgccctcactaagcaaa

SEQ ID NO: 88269 - DNA, 25 bp, mus musculus
tttgccctcactaagcaaatgtacc

SEQ ID NO: 88270 - DNA, 25 bp, mus musculus
ggctccattggacatcccagtaccc

SEQ ID NO: 88271 - DNA, 25 bp, mus musculus
attggacatcccagtacccgatcca

SEQ ID NO: 88272 - DNA, 25 bp, mus musculus
gatacctcggatagaggatgggaat

SEQ ID NO: 88273 - DNA, 25 bp, mus musculus
taattttggcgtgtctgtccaggaa

SEQ ID NO: 88274 - DNA, 25 bp, mus musculus
tggcgtgtctgtccaggaaaagttg

SEQ ID NO: 88275 - DNA, 25 bp, mus musculus
gctgatgaccaaccttcacaccaag

SEQ ID NO: 88276 - DNA, 25 bp, mus musculus
aggcttccacacgcagatctccaag

SEQ ID NO: 88277 - DNA, 25 bp, mus musculus
ccacacgcagatctccaagtacttc

SEQ ID NO: 88278 - DNA, 25 bp, mus musculus
caaagcagccaagcagccccacgtg

SEQ ID NO: 88279 - DNA, 25 bp, mus musculus
gtaccaggagatccgtctgatggtc

SEQ ID NO: 88280 - DNA, 25 bp, mus musculus
gatccgaaatgcttatgctgtgtta

SEQ ID NO: 88281 - DNA, 25 bp, mus musculus
aaatgcttatgctgtgttatatgac

SEQ ID NO: 88282 - DNA, 25 bp, mus musculus
gcaacgcctaaaacctgagatcaag

SEQ ID NO: 88283 - DNA, 25 bp, mus musculus
cctaaaacctgagatcaaggatgtc

SEQ ID NO: 88284 - DNA, 25 bp, mus musculus
cactgagcaactcaatctggtcact

SEQ ID NO: 88285 - DNA, 25 bp, mus musculus
gcaactcaatctggtcactacctgg

SEQ ID NO: 88286 - DNA, 25 bp, mus musculus
caatctggtcactacctggttgcag

SEQ ID NO: 88287 - DNA, 25 bp, mus musculus
ggtcactacctggttgcagctacag

SEQ ID NO: 88288 - DNA, 25 bp, mus musculus
gttgcagctacagatacctcggata

SEQ ID NO: 88289 - DNA, 25 bp, mus musculus
gctacagatacctcggatagaggat

SEQ ID NO: 88290 - DNA, 25 bp, mus musculus
aagcttctggccttgctcgctttgg

SEQ ID NO: 88291 - DNA, 25 bp, mus musculus
ctggccttgctcgctttggttaagc

SEQ ID NO: 88292 - DNA, 25 bp, mus musculus
atggattaccgggccttggtgcatg

SEQ ID NO: 88293 - DNA, 25 bp, mus musculus
taccgggccttggtgcatgagcgag

SEQ ID NO: 88294 - DNA, 25 bp, mus musculus
gccttggtgcatgagcgagatgaag

SEQ ID NO: 88295 - DNA, 25 bp, mus musculus
gcagcctatggggcgcttagggcca

SEQ ID NO: 88296 - DNA, 25 bp, mus musculus
gcgcttagggccatggtgctggacc

SEQ ID NO: 88297 - DNA, 25 bp, mus musculus
ctgagggccttctatgctgagcttt

SEQ ID NO: 88298 - DNA, 25 bp, mus musculus
gccttctatgctgagctttatcata

SEQ ID NO: 88299 - DNA, 25 bp, mus musculus
gagctttatcatatcatcagcagca

SEQ ID NO: 88300 - DNA, 25 bp, mus musculus
tatcatatcatcagcagcaacctag

SEQ ID NO: 88301 - DNA, 25 bp, mus musculus
atcatcagcagcaacctagagaaaa

SEQ ID NO: 88302 - DNA, 25 bp, mus musculus
gtctggactctcaaagagaagtgca

SEQ ID NO: 88303 - DNA, 25 bp, mus musculus
gtaatcacatggatccagcacctga

SEQ ID NO: 88304 - DNA, 25 bp, mus musculus
atccagcacctgatccccaagattg

SEQ ID NO: 88305 - DNA, 25 bp, mus musculus
atccccaagattgaggatggaaatg

SEQ ID NO: 88306 - DNA, 25 bp, mus musculus
gctttccagacaaccatttccaagt

SEQ ID NO: 88307 - DNA, 25 bp, mus musculus
cagacaaccatttccaagtacttct

SEQ ID NO: 88308 - DNA, 25 bp, mus musculus
tacttctcagaacgaggggatgctg

SEQ ID NO: 88309 - DNA, 25 bp, mus musculus
gacacccatgtaatggattaccggg

SEQ ID NO: 88310 - DNA, 25 bp, mus musculus
tgtaccggttgacctgcaacgactg

SEQ ID NO: 88311 - DNA, 25 bp, mus musculus
accggttgacctgcaacgactgccg

SEQ ID NO: 88312 - DNA, 25 bp, mus musculus
acgacagctggcccacagagcgcat

SEQ ID NO: 88313 - DNA, 25 bp, mus musculus
acagctggcccacagagcgcatcct

SEQ ID NO: 88314 - DNA, 25 bp, mus musculus
ggcccacagagcgcatccttcatgt

SEQ ID NO: 88315 - DNA, 25 bp, mus musculus
ccacagagcgcatccttcatgttcc

SEQ ID NO: 88316 - DNA, 25 bp, mus musculus
tgtccacagacgactgtcagcagtc

SEQ ID NO: 88317 - DNA, 25 bp, mus musculus
ccacagacgactgtcagcagtcgtc

SEQ ID NO: 88318 - DNA, 25 bp, mus musculus
cagacgactgtcagcagtcgtccca

SEQ ID NO: 88319 - DNA, 25 bp, mus musculus
acgactgtcagcagtcgtcccagca

SEQ ID NO: 88320 - DNA, 25 bp, mus musculus
ttacctgcaacaccaattcccacaa

SEQ ID NO: 88321 - DNA, 25 bp, mus musculus
ggaactcgtcctcgcggcatcacga

SEQ ID NO: 88322 - DNA, 25 bp, mus musculus
tgacctgcaacgactgccgaactat

SEQ ID NO: 88323 - DNA, 25 bp, mus musculus
cctgcaacgactgccgaactatgac

SEQ ID NO: 88324 - DNA, 25 bp, mus musculus
cgcaatgcacacgccactttatcga

SEQ ID NO: 88325 - DNA, 25 bp, mus musculus
aatgcacacgccactttatcgacca

SEQ ID NO: 88326 - DNA, 25 bp, mus musculus
ccatccaccaggtgcacgacagctg

SEQ ID NO: 88327 - DNA, 25 bp, mus musculus
tccaccaggtgcacgacagctggcc

SEQ ID NO: 88328 - DNA, 25 bp, mus musculus
aggtgcacgacagctggcccacaga

SEQ ID NO: 88329 - DNA, 25 bp, mus musculus
tgcacgacagctggcccacagagcg

SEQ ID NO: 88330 - DNA, 25 bp, mus musculus
ggccttcaaggctcatcgctgctca

SEQ ID NO: 88331 - DNA, 25 bp, mus musculus
gccttcaaggctcatcgctgctcag

SEQ ID NO: 88332 - DNA, 25 bp, mus musculus
agcaaccgcacgttggagttctccg

SEQ ID NO: 88333 - DNA, 25 bp, mus musculus
gcaaccgcacgttggagttctccga

SEQ ID NO: 88334 - DNA, 25 bp, mus musculus
ttggagttctccgaaatttgcttgt

SEQ ID NO: 88335 - DNA, 25 bp, mus musculus
gagttctccgaaatttgcttgtggg

SEQ ID NO: 88336 - DNA, 25 bp, mus musculus
tctccgaaatttgcttgtgggaaag

SEQ ID NO: 88337 - DNA, 25 bp, mus musculus
gttccagcattttgaaggtttatgg

SEQ ID NO: 88338 - DNA, 25 bp, mus musculus
gaagtacgccaaaggcgaagctaca

SEQ ID NO: 88339 - DNA, 25 bp, mus musculus
aagtacgccaaaggcgaagctacag

SEQ ID NO: 88340 - DNA, 25 bp, mus musculus
gtacgccaaaggcgaagctacaggt

SEQ ID NO: 88341 - DNA, 25 bp, mus musculus
tacgccaaaggcgaagctacaggtg

SEQ ID NO: 88342 - DNA, 25 bp, mus musculus
cttcaaggctcatcgctgctcagta

SEQ ID NO: 88343 - DNA, 25 bp, mus musculus
aaggctcatcgctgctcagtacagc

SEQ ID NO: 88344 - DNA, 25 bp, mus musculus
cgctgctcagtacagcggggcatca

SEQ ID NO: 88345 - DNA, 25 bp, mus musculus
ctcagtacagcggggcatcaggtcc

SEQ ID NO: 88346 - DNA, 25 bp, mus musculus
tcagtacagcggggcatcaggtccg

SEQ ID NO: 88347 - DNA, 25 bp, mus musculus
ttgggcaaagcaaccgcacgttgga

SEQ ID NO: 88348 - DNA, 25 bp, mus musculus
gggcaaagcaaccgcacgttggagt

SEQ ID NO: 88349 - DNA, 25 bp, mus musculus
caaagcaaccgcacgttggagttct

SEQ ID NO: 88350 - DNA, 25 bp, mus musculus
accaatagccacgatggactggatg

SEQ ID NO: 88351 - DNA, 25 bp, mus musculus
gatggtcccacttacaagaagcgca

SEQ ID NO: 88352 - DNA, 25 bp, mus musculus
gaggactatcgccgcactgtcacag

SEQ ID NO: 88353 - DNA, 25 bp, mus musculus
gactatcgccgcactgtcacagaga

SEQ ID NO: 88354 - DNA, 25 bp, mus musculus
tatcgccgcactgtcacagagattg

SEQ ID NO: 88355 - DNA, 25 bp, mus musculus
gaatacatcagcctccggctcatca

SEQ ID NO: 88356 - DNA, 25 bp, mus musculus
agcctccggctcatcatctcagagc

SEQ ID NO: 88357 - DNA, 25 bp, mus musculus
aatcagtatgtcactctccatgaca

SEQ ID NO: 88358 - DNA, 25 bp, mus musculus
tatgtcactctccatgacatgatcc

SEQ ID NO: 88359 - DNA, 25 bp, mus musculus
actctccatgacatgatcctgaaaa

SEQ ID NO: 88360 - DNA, 25 bp, mus musculus
aagatcaaacggccccggagcagca

SEQ ID NO: 88361 - DNA, 25 bp, mus musculus
acactgtactgaggccagggccagg

SEQ ID NO: 88362 - DNA, 25 bp, mus musculus
ggtcccacttacaagaagcgcaggt

SEQ ID NO: 88363 - DNA, 25 bp, mus musculus
gtgtttgtgatgcccaatgggatgt

SEQ ID NO: 88364 - DNA, 25 bp, mus musculus
tttgtgatgcccaatgggatgttga

SEQ ID NO: 88365 - DNA, 25 bp, mus musculus
gtaaaacccgagattcggctgctga

SEQ ID NO: 88366 - DNA, 25 bp, mus musculus
gagattcggctgctgatcgagaaat

SEQ ID NO: 88367 - DNA, 25 bp, mus musculus
ctgttgattcccagaatagaagatg

SEQ ID NO: 88368 - DNA, 25 bp, mus musculus
gcatcttacctggaccagatttcta

SEQ ID NO: 88369 - DNA, 25 bp, mus musculus
atagctaaatatccccatgtggagg

SEQ ID NO: 88370 - DNA, 25 bp, mus musculus
acctccacgaggtggcatgacacag

SEQ ID NO: 88371 - DNA, 25 bp, mus musculus
aggtacgcttcacaggacagcgtcg

SEQ ID NO: 88372 - DNA, 25 bp, mus musculus
gacacagcctttttgatcatttctt

SEQ ID NO: 88373 - DNA, 25 bp, mus musculus
acagcctttttgatcatttctttga

SEQ ID NO: 88374 - DNA, 25 bp, mus musculus
ttgatcatttctttgatgtgaaaag

SEQ ID NO: 88375 - DNA, 25 bp, mus musculus
atcatttctttgatgtgaaaagcat

SEQ ID NO: 88376 - DNA, 25 bp, mus musculus
gcatcttttggttatcagttaaatt

SEQ ID NO: 88377 - DNA, 25 bp, mus musculus
cattatttccccaatttcacaacag

SEQ ID NO: 88378 - DNA, 25 bp, mus musculus
ttccccaatttcacaacaggattca

SEQ ID NO: 88379 - DNA, 25 bp, mus musculus
aatttcacaacaggattcatattgt

SEQ ID NO: 88380 - DNA, 25 bp, mus musculus
ttcacaacaggattcatattgttaa

SEQ ID NO: 88381 - DNA, 25 bp, mus musculus
tatcttaaactgtctacaacaaaat

SEQ ID NO: 88382 - DNA, 25 bp, mus musculus
gcttcacaggacagcgtcgttgaag

SEQ ID NO: 88383 - DNA, 25 bp, mus musculus
caggacagcgtcgttgaagtcccac

SEQ ID NO: 88384 - DNA, 25 bp, mus musculus
gaagtcccactgttggcagttttgg

SEQ ID NO: 88385 - DNA, 25 bp, mus musculus
ttggcagttttggcagtggtaccta

SEQ ID NO: 88386 - DNA, 25 bp, mus musculus
gtggtacctaactcatcgtgtttgc

SEQ ID NO: 88387 - DNA, 25 bp, mus musculus
cctaactcatcgtgtttgcattctt

SEQ ID NO: 88388 - DNA, 25 bp, mus musculus
tcatcgtgtttgcattcttgttaag

SEQ ID NO: 88389 - DNA, 25 bp, mus musculus
tgtgacacagcctttttgatcattt

SEQ ID NO: 88390 - DNA, 25 bp, mus musculus
cacaactttagccaacggagaagca

SEQ ID NO: 88391 - DNA, 25 bp, mus musculus
caactttagccaacggagaagcagc

SEQ ID NO: 88392 - DNA, 25 bp, mus musculus
atttgcttccttgtctaatctcgtc

SEQ ID NO: 88393 - DNA, 25 bp, mus musculus
ttgcttccttgtctaatctcgtcaa

SEQ ID NO: 88394 - DNA, 25 bp, mus musculus
ttccttgtctaatctcgtcaatgag

SEQ ID NO: 88395 - DNA, 25 bp, mus musculus
ccttgtctaatctcgtcaatgagaa

SEQ ID NO: 88396 - DNA, 25 bp, mus musculus
ttgtctaatctcgtcaatgagaaca

SEQ ID NO: 88397 - DNA, 25 bp, mus musculus
gtctaatctcgtcaatgagaacacc

SEQ ID NO: 88398 - DNA, 25 bp, mus musculus
tcgtcaatgagaacaccctgaaggc

SEQ ID NO: 88399 - DNA, 25 bp, mus musculus
gtcaatgagaacaccctgaaggcca

SEQ ID NO: 88400 - DNA, 25 bp, mus musculus
atgagaacaccctgaaggccataga

SEQ ID NO: 88401 - DNA, 25 bp, mus musculus
acaccctgaaggccatagaagaaat

SEQ ID NO: 88402 - DNA, 25 bp, mus musculus
actttagccaacggagaagcagcac

SEQ ID NO: 88403 - DNA, 25 bp, mus musculus
tttagccaacggagaagcagcacca

SEQ ID NO: 88404 - DNA, 25 bp, mus musculus
caaatgatgccgggcctgatacaaa

SEQ ID NO: 88405 - DNA, 25 bp, mus musculus
atgacagcgaggtgcccagcctgcc

SEQ ID NO: 88406 - DNA, 25 bp, mus musculus
ctgcccctaggactgacaggtgctt

SEQ ID NO: 88407 - DNA, 25 bp, mus musculus
tgaggacacttcatttgcttccttg

SEQ ID NO: 88408 - DNA, 25 bp, mus musculus
aggacacttcatttgcttccttgtc

SEQ ID NO: 88409 - DNA, 25 bp, mus musculus
tcatttgcttccttgtctaatctcg

SEQ ID NO: 88410 - DNA, 25 bp, mus musculus
ccctatactgggggacatccagatg

SEQ ID NO: 88411 - DNA, 25 bp, mus musculus
cctactccatggccagacagttcaa

SEQ ID NO: 88412 - DNA, 25 bp, mus musculus
tggatcttctcccaactgctcgcca

SEQ ID NO: 88413 - DNA, 25 bp, mus musculus
caactgctcgccagctaggctgcac

SEQ ID NO: 88414 - DNA, 25 bp, mus musculus
gctgcaccgtgggccaactagctat

SEQ ID NO: 88415 - DNA, 25 bp, mus musculus
ccgtgggccaactagctatagcctg

SEQ ID NO: 88416 - DNA, 25 bp, mus musculus
gccaactagctatagcctggtgtct

SEQ ID NO: 88417 - DNA, 25 bp, mus musculus
tgtccagtgcagagcagctgatgga

SEQ ID NO: 88418 - DNA, 25 bp, mus musculus
aacatctgggctccctacaggtgct

SEQ ID NO: 88419 - DNA, 25 bp, mus musculus
tgggctccctacaggtgctgagtca

SEQ ID NO: 88420 - DNA, 25 bp, mus musculus
tgagtcagctgacgccgcaaacggt

SEQ ID NO: 88421 - DNA, 25 bp, mus musculus
atgcgctcttggggaacaaatcgca

SEQ ID NO: 88422 - DNA, 25 bp, mus musculus
ccatggccagacagttcaatctgat

SEQ ID NO: 88423 - DNA, 25 bp, mus musculus
gaacaaatcgcattccaagaagtag

SEQ ID NO: 88424 - DNA, 25 bp, mus musculus
agttcaatctgatccctcctgtgtg

SEQ ID NO: 88425 - DNA, 25 bp, mus musculus
ctgtgtgcgagcaagcggagaacca

SEQ ID NO: 88426 - DNA, 25 bp, mus musculus
ctgagctctaccacaaaattggtgt

SEQ ID NO: 88427 - DNA, 25 bp, mus musculus
gcggcctcattactagcaagtatga

SEQ ID NO: 88428 - DNA, 25 bp, mus musculus
gagttccggatacttgcaaagccac

SEQ ID NO: 88429 - DNA, 25 bp, mus musculus
aagccactgtcaagggctaccagtg

SEQ ID NO: 88430 - DNA, 25 bp, mus musculus
agcaacaagccagagtgatggatct

SEQ ID NO: 88431 - DNA, 25 bp, mus musculus
taaacttataatcaaccaattaatg

SEQ ID NO: 88432 - DNA, 25 bp, mus musculus
aacttataatcaaccaattaatgct

SEQ ID NO: 88433 - DNA, 25 bp, mus musculus
ttcaacacaccaaaaggacgaccat

SEQ ID NO: 88434 - DNA, 25 bp, mus musculus
ttacacttattacccacttatccat

SEQ ID NO: 88435 - DNA, 25 bp, mus musculus
tacacttattacccacttatccata

SEQ ID NO: 88436 - DNA, 25 bp, mus musculus
cacttattacccacttatccataat

SEQ ID NO: 88437 - DNA, 25 bp, mus musculus
ttattacccacttatccataatcct

SEQ ID NO: 88438 - DNA, 25 bp, mus musculus
attacccacttatccataatcctag

SEQ ID NO: 88439 - DNA, 25 bp, mus musculus
ttacccacttatccataatcctagg

SEQ ID NO: 88440 - DNA, 25 bp, mus musculus
tacccacttatccataatcctaggt

SEQ ID NO: 88441 - DNA, 25 bp, mus musculus
cttataatcaaccaattaatgctat

SEQ ID NO: 88442 - DNA, 25 bp, mus musculus
ttataatcaaccaattaatgctatt

SEQ ID NO: 88443 - DNA, 25 bp, mus musculus
tataatcaaccaattaatgctattc

SEQ ID NO: 88444 - DNA, 25 bp, mus musculus
ataatcaaccaattaatgctattca

SEQ ID NO: 88445 - DNA, 25 bp, mus musculus
taatcaaccaattaatgctattcaa

SEQ ID NO: 88446 - DNA, 25 bp, mus musculus
aatcaaccaattaatgctattcaac

SEQ ID NO: 88447 - DNA, 25 bp, mus musculus
atcaaccaattaatgctattcaaca

SEQ ID NO: 88448 - DNA, 25 bp, mus musculus
tcaaccaattaatgctattcaacac

SEQ ID NO: 88449 - DNA, 25 bp, mus musculus
tacctagaacagaaccagttcagag

SEQ ID NO: 88450 - DNA, 25 bp, mus musculus
ctgcttccaagttgttaggaatagc

SEQ ID NO: 88451 - DNA, 25 bp, mus musculus
acctccataattctagatgatatga

SEQ ID NO: 88452 - DNA, 25 bp, mus musculus
accccagctcagacaaaatgtgttt

SEQ ID NO: 88453 - DNA, 25 bp, mus musculus
acttaaaaacttctgtgtgactcat

SEQ ID NO: 88454 - DNA, 25 bp, mus musculus
aaacttctgtgtgactcattcctac

SEQ ID NO: 88455 - DNA, 25 bp, mus musculus
cctaccctactgccatgcgaatgag

SEQ ID NO: 88456 - DNA, 25 bp, mus musculus
ctactgccatgcgaatgagatggaa

SEQ ID NO: 88457 - DNA, 25 bp, mus musculus
ctgccatgcgaatgagatggaattc

SEQ ID NO: 88458 - DNA, 25 bp, mus musculus
tggtccagaacttgttcctgtctgt

SEQ ID NO: 88459 - DNA, 25 bp, mus musculus
acttgttcctgtctgtattatgaga

SEQ ID NO: 88460 - DNA, 25 bp, mus musculus
tgttcctgtctgtattatgagaata

SEQ ID NO: 88461 - DNA, 25 bp, mus musculus
attgttgtcagttagtcgtagcctt

SEQ ID NO: 88462 - DNA, 25 bp, mus musculus
cctttctggcttctattttcagaag

SEQ ID NO: 88463 - DNA, 25 bp, mus musculus
aaatgctaattgctcacgaattaaa

SEQ ID NO: 88464 - DNA, 25 bp, mus musculus
aaacctgcttgacagaagtgtttga

SEQ ID NO: 88465 - DNA, 25 bp, mus musculus
ttcagtaaccacggacctgaggctg

SEQ ID NO: 88466 - DNA, 25 bp, mus musculus
ggacctgaggctgattgtgtaccta

SEQ ID NO: 88467 - DNA, 25 bp, mus musculus
tgtgtacctacctccataattctag

SEQ ID NO: 88468 - DNA, 25 bp, mus musculus
cctacctccataattctagatgata

SEQ ID NO: 88469 - DNA, 25 bp, mus musculus
atctttgacgagtacatccgcagcg

SEQ ID NO: 88470 - DNA, 25 bp, mus musculus
tacatccgcagcgaagcccctaaag

SEQ ID NO: 88471 - DNA, 25 bp, mus musculus
gggaagacccgcacattgatggaga

SEQ ID NO: 88472 - DNA, 25 bp, mus musculus
aaggactcctatccgcgcttcctca

SEQ ID NO: 88473 - DNA, 25 bp, mus musculus
ttcctcaagtcaccagcttatcgcg

SEQ ID NO: 88474 - DNA, 25 bp, mus musculus
aagtcaccagcttatcgcgacctgg

SEQ ID NO: 88475 - DNA, 25 bp, mus musculus
tatcgcgacctggctgcccaagcct

SEQ ID NO: 88476 - DNA, 25 bp, mus musculus
gctgagccttcacacacttgagcct

SEQ ID NO: 88477 - DNA, 25 bp, mus musculus
tgagcctccgcagcaacctagaagc

SEQ ID NO: 88478 - DNA, 25 bp, mus musculus
tccgcagcaacctagaagccatcgg

SEQ ID NO: 88479 - DNA, 25 bp, mus musculus
gcaacctagaagccatcgggaagag

SEQ ID NO: 88480 - DNA, 25 bp, mus musculus
atcctgtgcagcaagtgcaagagga

SEQ ID NO: 88481 - DNA, 25 bp, mus musculus
cgcagcgaagcccctaaagaggtga

SEQ ID NO: 88482 - DNA, 25 bp, mus musculus
aacatagatcacgagacccgagaac

SEQ ID NO: 88483 - DNA, 25 bp, mus musculus
gatcacgagacccgagaactgacca

SEQ ID NO: 88484 - DNA, 25 bp, mus musculus
gagacccgagaactgaccaagacaa

SEQ ID NO: 88485 - DNA, 25 bp, mus musculus
aagacaaacctacaagctgccacta

SEQ ID NO: 88486 - DNA, 25 bp, mus musculus
aacctacaagctgccactaccagtt

SEQ ID NO: 88487 - DNA, 25 bp, mus musculus
caagctgccactaccagttgcttcg

SEQ ID NO: 88488 - DNA, 25 bp, mus musculus
tgcttcgatgtggctcaggggaaga

SEQ ID NO: 88489 - DNA, 25 bp, mus musculus
atgatcttcagtgtatgttcaccaa

SEQ ID NO: 88490 - DNA, 25 bp, mus musculus
gaactgtgccaaagcctacctactg

SEQ ID NO: 88491 - DNA, 25 bp, mus musculus
gtgttctccaaggaaccgtatcaat

SEQ ID NO: 88492 - DNA, 25 bp, mus musculus
gttctccaaggaaccgtatcaattg

SEQ ID NO: 88493 - DNA, 25 bp, mus musculus
tctccaaggaaccgtatcaattggc

SEQ ID NO: 88494 - DNA, 25 bp, mus musculus
tatcaattggccctgacccatgcgg

SEQ ID NO: 88495 - DNA, 25 bp, mus musculus
tcaattggccctgacccatgcggta

SEQ ID NO: 88496 - DNA, 25 bp, mus musculus
aattggccctgacccatgcggtata

SEQ ID NO: 88497 - DNA, 25 bp, mus musculus
ccctgacccatgcggtatacctggt

SEQ ID NO: 88498 - DNA, 25 bp, mus musculus
ctgacccatgcggtatacctggtgt

SEQ ID NO: 88499 - DNA, 25 bp, mus musculus
gacccatgcggtatacctggtgtat

SEQ ID NO: 88500 - DNA, 25 bp, mus musculus
aatgcttgagtgtcacattgttcca

SEQ ID NO: 88501 - DNA, 25 bp, mus musculus
actgtgccaaagcctacctactgaa

SEQ ID NO: 88502 - DNA, 25 bp, mus musculus
tgtgccaaagcctacctactgaaag

SEQ ID NO: 88503 - DNA, 25 bp, mus musculus
tgccaaagcctacctactgaaagtc

SEQ ID NO: 88504 - DNA, 25 bp, mus musculus
aaagcctacctactgaaagtcacag

SEQ ID NO: 88505 - DNA, 25 bp, mus musculus
cctacctactgaaagtcacagatgt

SEQ ID NO: 88506 - DNA, 25 bp, mus musculus
tacctactgaaagtcacagatgtca

SEQ ID NO: 88507 - DNA, 25 bp, mus musculus
cctactgaaagtcacagatgtcatg

SEQ ID NO: 88508 - DNA, 25 bp, mus musculus
tggtgttctccaaggaaccgtatca

SEQ ID NO: 88509 - DNA, 25 bp, mus musculus
cacagcaaacaattattcttctata

SEQ ID NO: 88510 - DNA, 25 bp, mus musculus
cattttctgttgtgtgaagggatat

SEQ ID NO: 88511 - DNA, 25 bp, mus musculus
tatgagcccatgtcccagacacatt

SEQ ID NO: 88512 - DNA, 25 bp, mus musculus
cccatgtcccagacacatttacatc

SEQ ID NO: 88513 - DNA, 25 bp, mus musculus
tcccagacacatttacatcataact

SEQ ID NO: 88514 - DNA, 25 bp, mus musculus
caaaggtctctctcctgacctagca

SEQ ID NO: 88515 - DNA, 25 bp, mus musculus
tctctctcctgacctagcatcaaca

SEQ ID NO: 88516 - DNA, 25 bp, mus musculus
tcctgacctagcatcaacagaaaag

SEQ ID NO: 88517 - DNA, 25 bp, mus musculus
aatctttacattgacgtcaagccat

SEQ ID NO: 88518 - DNA, 25 bp, mus musculus
tacattgacgtcaagccatcttttt

SEQ ID NO: 88519 - DNA, 25 bp, mus musculus
gactatcctgaacatgtgaaaaatt

SEQ ID NO: 88520 - DNA, 25 bp, mus musculus
ttgttcagacacagctgaattcccc

SEQ ID NO: 88521 - DNA, 25 bp, mus musculus
tatgacattttccacacacataagt

SEQ ID NO: 88522 - DNA, 25 bp, mus musculus
ctgttgtaactcatctaatttcaat

SEQ ID NO: 88523 - DNA, 25 bp, mus musculus
taactcatctaatttcaatttactg

SEQ ID NO: 88524 - DNA, 25 bp, mus musculus
tttcaatttactgttaccagcagag

SEQ ID NO: 88525 - DNA, 25 bp, mus musculus
gttaccagcagagtcgctgttgttt

SEQ ID NO: 88526 - DNA, 25 bp, mus musculus
agcagagtcgctgttgttttgttct

SEQ ID NO: 88527 - DNA, 25 bp, mus musculus
gttgttttgttctccattcacatga

SEQ ID NO: 88528 - DNA, 25 bp, mus musculus
tccattcacatgaatttctatttaa

SEQ ID NO: 88529 - DNA, 25 bp, mus musculus
ggcgtgagccatcccacttctctgc

SEQ ID NO: 88530 - DNA, 25 bp, mus musculus
gtagtctcgaatgtcctgggcccat

SEQ ID NO: 88531 - DNA, 25 bp, mus musculus
caccatggcttcatagagctggctt

SEQ ID NO: 88532 - DNA, 25 bp, mus musculus
gatgcttatccaagggccgcagatg

SEQ ID NO: 88533 - DNA, 25 bp, mus musculus
gcttatccaagggccgcagatgtag

SEQ ID NO: 88534 - DNA, 25 bp, mus musculus
ccaagggccgcagatgtagctccct

SEQ ID NO: 88535 - DNA, 25 bp, mus musculus
gtagctcccttgtgtccgtttcctg

SEQ ID NO: 88536 - DNA, 25 bp, mus musculus
gctcccttgtgtccgtttcctgcct

SEQ ID NO: 88537 - DNA, 25 bp, mus musculus
ttgtgtccgtttcctgcctaggaag

SEQ ID NO: 88538 - DNA, 25 bp, mus musculus
cctgcctaggaagttgcctgcacgt

SEQ ID NO: 88539 - DNA, 25 bp, mus musculus
taggaagttgcctgcacgtgagaga

SEQ ID NO: 88540 - DNA, 25 bp, mus musculus
tacatacacacctaacaagacttta

SEQ ID NO: 88541 - DNA, 25 bp, mus musculus
tcgaatgtcctgggcccatccacct

SEQ ID NO: 88542 - DNA, 25 bp, mus musculus
gtcctgggcccatccacctgcgtat

SEQ ID NO: 88543 - DNA, 25 bp, mus musculus
tccacctgcgtatggatgtgcccac

SEQ ID NO: 88544 - DNA, 25 bp, mus musculus
tctcccaagcctcttttgggaggct

SEQ ID NO: 88545 - DNA, 25 bp, mus musculus
ctcctcacagggcagcaccatggct

SEQ ID NO: 88546 - DNA, 25 bp, mus musculus
ctcacagggcagcaccatggcttca

SEQ ID NO: 88547 - DNA, 25 bp, mus musculus
acagggcagcaccatggcttcatag

SEQ ID NO: 88548 - DNA, 25 bp, mus musculus
cagcaccatggcttcatagagctgg

SEQ ID NO: 88549 - DNA, 25 bp, mus musculus
atgcgtcaccagaagacattaaaag

SEQ ID NO: 88550 - DNA, 25 bp, mus musculus
tgcgtcaccagaagacattaaaaga

SEQ ID NO: 88551 - DNA, 25 bp, mus musculus
agccatctcgacgatgagcgtgagt

SEQ ID NO: 88552 - DNA, 25 bp, mus musculus
ccatctcgacgatgagcgtgagtac

SEQ ID NO: 88553 - DNA, 25 bp, mus musculus
catctcgacgatgagcgtgagtacc

SEQ ID NO: 88554 - DNA, 25 bp, mus musculus
tctcgacgatgagcgtgagtaccgc

SEQ ID NO: 88555 - DNA, 25 bp, mus musculus
taccgcttcacattccggaaggcag

SEQ ID NO: 88556 - DNA, 25 bp, mus musculus
ccgcttcacattccggaaggcagac

SEQ ID NO: 88557 - DNA, 25 bp, mus musculus
cttcacattccggaaggcagacgat

SEQ ID NO: 88558 - DNA, 25 bp, mus musculus
ttcacattccggaaggcagacgatg

SEQ ID NO: 88559 - DNA, 25 bp, mus musculus
cacattccggaaggcagacgatgtc

SEQ ID NO: 88560 - DNA, 25 bp, mus musculus
acattccggaaggcagacgatgtct

SEQ ID NO: 88561 - DNA, 25 bp, mus musculus
agcacttaaatggcatcctgataaa

SEQ ID NO: 88562 - DNA, 25 bp, mus musculus
gcatcctgataaaaatccagaaaat

SEQ ID NO: 88563 - DNA, 25 bp, mus musculus
attcaaagaagtcgccgaggcatat

SEQ ID NO: 88564 - DNA, 25 bp, mus musculus
ttagacggcagaggtgcaagccatc

SEQ ID NO: 88565 - DNA, 25 bp, mus musculus
aggtgcaagccatctcgacgatgag

SEQ ID NO: 88566 - DNA, 25 bp, mus musculus
ggtgcaagccatctcgacgatgagc

SEQ ID NO: 88567 - DNA, 25 bp, mus musculus
tgcaagccatctcgacgatgagcgt

SEQ ID NO: 88568 - DNA, 25 bp, mus musculus
aagccatctcgacgatgagcgtgag

SEQ ID NO: 88569 - DNA, 25 bp, mus musculus
ggcactcggtcaaggtggtcctggt

SEQ ID NO: 88570 - DNA, 25 bp, mus musculus
tcgccaaaggggccttcccagagag

SEQ ID NO: 88571 - DNA, 25 bp, mus musculus
tgcacctccaaatctgggacacagc

SEQ ID NO: 88572 - DNA, 25 bp, mus musculus
tagacctgcgtaaggacaaggtgct

SEQ ID NO: 88573 - DNA, 25 bp, mus musculus
tgacctaccacaggggccacgatat

SEQ ID NO: 88574 - DNA, 25 bp, mus musculus
cctaccacaggggccacgatatggc

SEQ ID NO: 88575 - DNA, 25 bp, mus musculus
gttcagctcggctccatgacaacgt

SEQ ID NO: 88576 - DNA, 25 bp, mus musculus
cagctcggctccatgacaacgtgga

SEQ ID NO: 88577 - DNA, 25 bp, mus musculus
aagcagtcttccaggaagcagcaga

SEQ ID NO: 88578 - DNA, 25 bp, mus musculus
cagtcttccaggaagcagcagaagt

SEQ ID NO: 88579 - DNA, 25 bp, mus musculus
tggctctcagcagtcgcagacataa

SEQ ID NO: 88580 - DNA, 25 bp, mus musculus
tcagcagtcgcagacataacttttg

SEQ ID NO: 88581 - DNA, 25 bp, mus musculus
gggccttcccagagagctacagtcc

SEQ ID NO: 88582 - DNA, 25 bp, mus musculus
agagctacagtcccacagtgtttga

SEQ ID NO: 88583 - DNA, 25 bp, mus musculus
gctacagtcccacagtgtttgagcg

SEQ ID NO: 88584 - DNA, 25 bp, mus musculus
gtcccacagtgtttgagcgctataa

SEQ ID NO: 88585 - DNA, 25 bp, mus musculus
agcgctataatgccactctgcagat

SEQ ID NO: 88586 - DNA, 25 bp, mus musculus
atgccactctgcagatgaagggtaa

SEQ ID NO: 88587 - DNA, 25 bp, mus musculus
ccactctgcagatgaagggtaaacc

SEQ ID NO: 88588 - DNA, 25 bp, mus musculus
ctgtgcacctccaaatctgggacac

SEQ ID NO: 88589 - DNA, 25 bp, mus musculus
cagagggcactgggcctgttgcctg

SEQ ID NO: 88590 - DNA, 25 bp, mus musculus
cctgccagtcatggacaaccatgtg

SEQ ID NO: 88591 - DNA, 25 bp, mus musculus
gagcctcagtctgactgatttcaaa

SEQ ID NO: 88592 - DNA, 25 bp, mus musculus
tcctgtgtattgcttttaagagagc

SEQ ID NO: 88593 - DNA, 25 bp, mus musculus
gagccatcagttagctatcagaatc

SEQ ID NO: 88594 - DNA, 25 bp, mus musculus
ccatcagttagctatcagaatctag

SEQ ID NO: 88595 - DNA, 25 bp, mus musculus
atttttggacttagctgtactgtgt

SEQ ID NO: 88596 - DNA, 25 bp, mus musculus
tttggacttagctgtactgtgtgat

SEQ ID NO: 88597 - DNA, 25 bp, mus musculus
ggacttagctgtactgtgtgatatt

SEQ ID NO: 88598 - DNA, 25 bp, mus musculus
ttttaggatgccaacatgagacctg

SEQ ID NO: 88599 - DNA, 25 bp, mus musculus
gaggatctactgctgtacagctaat

SEQ ID NO: 88600 - DNA, 25 bp, mus musculus
gatctactgctgtacagctaataaa

SEQ ID NO: 88601 - DNA, 25 bp, mus musculus
gccagtcatggacaaccatgtgaaa

SEQ ID NO: 88602 - DNA, 25 bp, mus musculus
agtcatggacaaccatgtgaaaaat

SEQ ID NO: 88603 - DNA, 25 bp, mus musculus
tcctgatttccagctcatggagcca

SEQ ID NO: 88604 - DNA, 25 bp, mus musculus
tttccagctcatggagccagcgttt

SEQ ID NO: 88605 - DNA, 25 bp, mus musculus
ccagctcatggagccagcgtttgaa

SEQ ID NO: 88606 - DNA, 25 bp, mus musculus
tctttggtctgtttgtagctgaatg

SEQ ID NO: 88607 - DNA, 25 bp, mus musculus
ctctgtccaagccagaagagttgat

SEQ ID NO: 88608 - DNA, 25 bp, mus musculus
tgattcttgcacatgaattgtcaca

SEQ ID NO: 88609 - DNA, 25 bp, mus musculus
ctttggagagcttcttctgctcatg

SEQ ID NO: 88610 - DNA, 25 bp, mus musculus
gctcatgtctctgaccctggatgga

SEQ ID NO: 88611 - DNA, 25 bp, mus musculus
catcatctataacatcctgctcttt

SEQ ID NO: 88612 - DNA, 25 bp, mus musculus
ctataacatcctgctctttggcctg

SEQ ID NO: 88613 - DNA, 25 bp, mus musculus
gaccagtgccttgggtcagagcttt

SEQ ID NO: 88614 - DNA, 25 bp, mus musculus
tgccttgggtcagagctttatcttc

SEQ ID NO: 88615 - DNA, 25 bp, mus musculus
gagctttatcttcatgacagtcgtg

SEQ ID NO: 88616 - DNA, 25 bp, mus musculus
catgacagtcgtgtacttcggtccc

SEQ ID NO: 88617 - DNA, 25 bp, mus musculus
gaagttcttcaccatcttggcttct

SEQ ID NO: 88618 - DNA, 25 bp, mus musculus
cctgggtctcggtcttgatgccaag

SEQ ID NO: 88619 - DNA, 25 bp, mus musculus
tattatctcgaacagtggcatcttg

SEQ ID NO: 88620 - DNA, 25 bp, mus musculus
ctcgaacagtggcatcttgggaaaa

SEQ ID NO: 88621 - DNA, 25 bp, mus musculus
gtctctgaccctggatggactgaca

SEQ ID NO: 88622 - DNA, 25 bp, mus musculus
gaccctggatggactgacaggtgtt

SEQ ID NO: 88623 - DNA, 25 bp, mus musculus
actgacaggtgtttcccaggaccat

SEQ ID NO: 88624 - DNA, 25 bp, mus musculus
ttaccaaacaggttccaaccacatg

SEQ ID NO: 88625 - DNA, 25 bp, mus musculus
aacaggttccaaccacatgatgttg

SEQ ID NO: 88626 - DNA, 25 bp, mus musculus
ttggtccacgttcttgcttggtgct

SEQ ID NO: 88627 - DNA, 25 bp, mus musculus
tgggatcctgtttactggggagctc

SEQ ID NO: 88628 - DNA, 25 bp, mus musculus
cccgaccatcatctataacatcctg

SEQ ID NO: 88629 - DNA, 25 bp, mus musculus
aacataatctcgcgacgccttctac

SEQ ID NO: 88630 - DNA, 25 bp, mus musculus
cgacgccttctactctggaccgctt

SEQ ID NO: 88631 - DNA, 25 bp, mus musculus
ctgaccaaagcctcattctcaactc

SEQ ID NO: 88632 - DNA, 25 bp, mus musculus
aaagcctcattctcaactcaccagg

SEQ ID NO: 88633 - DNA, 25 bp, mus musculus
tcattctcaactcaccaggatgctg

SEQ ID NO: 88634 - DNA, 25 bp, mus musculus
caccaggatgctgaacctgagacgc

SEQ ID NO: 88635 - DNA, 25 bp, mus musculus
tgcgctggcaggagaactggagaaa

SEQ ID NO: 88636 - DNA, 25 bp, mus musculus
atagcccacagacatggcttcattt

SEQ ID NO: 88637 - DNA, 25 bp, mus musculus
tctctttccaaagccaaacagcctt

SEQ ID NO: 88638 - DNA, 25 bp, mus musculus
tccaaagccaaacagccttgccctg

SEQ ID NO: 88639 - DNA, 25 bp, mus musculus
tgtcccaacttctcagccttaagtt

SEQ ID NO: 88640 - DNA, 25 bp, mus musculus
tatctacccagatcagtatggtatt

SEQ ID NO: 88641 - DNA, 25 bp, mus musculus
ctggaacactgcgcatgcgcacagt

SEQ ID NO: 88642 - DNA, 25 bp, mus musculus
cactgcgcatgcgcacagtgcacgc

SEQ ID NO: 88643 - DNA, 25 bp, mus musculus
gcatgcgcacagtgcacgcagatgg

SEQ ID NO: 88644 - DNA, 25 bp, mus musculus
ctgctgccgcgcaaacagcatctta

SEQ ID NO: 88645 - DNA, 25 bp, mus musculus
ccgcgcaaacagcatcttagccgtt

SEQ ID NO: 88646 - DNA, 25 bp, mus musculus
catcttagccgttgtccatggtgac

SEQ ID NO: 88647 - DNA, 25 bp, mus musculus
acgaaaagcaactgcctgctgacca

SEQ ID NO: 88648 - DNA, 25 bp, mus musculus
tgcctgctgaccaaagcctcattct

SEQ ID NO: 88649 - DNA, 25 bp, mus musculus
tcacatcagagctataccgatcact

SEQ ID NO: 88650 - DNA, 25 bp, mus musculus
catcagagctataccgatcactagg

SEQ ID NO: 88651 - DNA, 25 bp, mus musculus
tgcgctctgactttctcttgatata

SEQ ID NO: 88652 - DNA, 25 bp, mus musculus
gctctgactttctcttgatatatgg

SEQ ID NO: 88653 - DNA, 25 bp, mus musculus
actttctcttgatatatggagatgt

SEQ ID NO: 88654 - DNA, 25 bp, mus musculus
gagatgtcatctccaatatcaatat

SEQ ID NO: 88655 - DNA, 25 bp, mus musculus
tcatctccaatatcaatatctgcag

SEQ ID NO: 88656 - DNA, 25 bp, mus musculus
ccaatatcaatatctgcagagccct

SEQ ID NO: 88657 - DNA, 25 bp, mus musculus
tcaatatctgcagagccctggagga

SEQ ID NO: 88658 - DNA, 25 bp, mus musculus
atatctgcagagccctggaggaaca

SEQ ID NO: 88659 - DNA, 25 bp, mus musculus
tctgcagagccctggaggaacacag

SEQ ID NO: 88660 - DNA, 25 bp, mus musculus
gagccctggaggaacacaggttaag

SEQ ID NO: 88661 - DNA, 25 bp, mus musculus
cagagctataccgatcactaggaga

SEQ ID NO: 88662 - DNA, 25 bp, mus musculus
tataccgatcactaggagacgtcct

SEQ ID NO: 88663 - DNA, 25 bp, mus musculus
acgtcctccgtgacgtcgatgccaa

SEQ ID NO: 88664 - DNA, 25 bp, mus musculus
tccgtgacgtcgatgccaaggcctt

SEQ ID NO: 88665 - DNA, 25 bp, mus musculus
atgccaaggccttggtgcgctctga

SEQ ID NO: 88666 - DNA, 25 bp, mus musculus
ccaaggccttggtgcgctctgactt

SEQ ID NO: 88667 - DNA, 25 bp, mus musculus
aggccttggtgcgctctgactttct

SEQ ID NO: 88668 - DNA, 25 bp, mus musculus
tggtgcgctctgactttctcttgat

SEQ ID NO: 88669 - DNA, 25 bp, mus musculus
caagccattgactacgactgggacc

SEQ ID NO: 88670 - DNA, 25 bp, mus musculus
gccattgactacgactgggaccccg

SEQ ID NO: 88671 - DNA, 25 bp, mus musculus
ggtgcaatcaaacgtgcctaccttc

SEQ ID NO: 88672 - DNA, 25 bp, mus musculus
gcctaccttcccgactttgaatctg

SEQ ID NO: 88673 - DNA, 25 bp, mus musculus
cttcccgactttgaatctggtagca

SEQ ID NO: 88674 - DNA, 25 bp, mus musculus
cccgactttgaatctggtagcaaca

SEQ ID NO: 88675 - DNA, 25 bp, mus musculus
tctggtagcaacaatcccgtccgtg

SEQ ID NO: 88676 - DNA, 25 bp, mus musculus
ggtagcaacaatcccgtccgtgaag

SEQ ID NO: 88677 - DNA, 25 bp, mus musculus
gaagttgacctgggcctgaaatatt

SEQ ID NO: 88678 - DNA, 25 bp, mus musculus
tatttaatgcagccagatggattag

SEQ ID NO: 88679 - DNA, 25 bp, mus musculus
ttaatgcagccagatggattagccg

SEQ ID NO: 88680 - DNA, 25 bp, mus musculus
atttactggtcagatgctaagagtc

SEQ ID NO: 88681 - DNA, 25 bp, mus musculus
ataggcctcagtgttgtatactaca

SEQ ID NO: 88682 - DNA, 25 bp, mus musculus
gttgtatactacactgtgctgtcac

SEQ ID NO: 88683 - DNA, 25 bp, mus musculus
gtatactacactgtgctgtcacagg

SEQ ID NO: 88684 - DNA, 25 bp, mus musculus
tactacactgtgctgtcacagggct

SEQ ID NO: 88685 - DNA, 25 bp, mus musculus
gtgctgtcacagggctctcaattcg

SEQ ID NO: 88686 - DNA, 25 bp, mus musculus
ctgtcacagggctctcaattcggtg

SEQ ID NO: 88687 - DNA, 25 bp, mus musculus
cagggctctcaattcggtgcaatca

SEQ ID NO: 88688 - DNA, 25 bp, mus musculus
tctcaattcggtgcaatcaaacgtg

SEQ ID NO: 88689 - DNA, 25 bp, mus musculus
ctgcatgagaccctggatcatctca

SEQ ID NO: 88690 - DNA, 25 bp, mus musculus
gagaccctggatcatctcatcaaag

SEQ ID NO: 88691 - DNA, 25 bp, mus musculus
ctggcttctgggctgcacagccgca

SEQ ID NO: 88692 - DNA, 25 bp, mus musculus
ctgcacagccgcagcagggagagct

SEQ ID NO: 88693 - DNA, 25 bp, mus musculus
gagagctcgcaggccacctcaaggt

SEQ ID NO: 88694 - DNA, 25 bp, mus musculus
tcgcaggccacctcaaggtcagcaa

SEQ ID NO: 88695 - DNA, 25 bp, mus musculus
gccacctcaaggtcagcaaacagaa

SEQ ID NO: 88696 - DNA, 25 bp, mus musculus
tgtcatggcctcctcttacctgcct

SEQ ID NO: 88697 - DNA, 25 bp, mus musculus
gcccttgtgtttgctctgactcact

SEQ ID NO: 88698 - DNA, 25 bp, mus musculus
taaccccgattcctggactgctgga

SEQ ID NO: 88699 - DNA, 25 bp, mus musculus
cgattcctggactgctggaacagac

SEQ ID NO: 88700 - DNA, 25 bp, mus musculus
gactgcgagccgacgatgagcccac

SEQ ID NO: 88701 - DNA, 25 bp, mus musculus
ctctatccttatttaggccccagca

SEQ ID NO: 88702 - DNA, 25 bp, mus musculus
ccttatttaggccccagcacactca

SEQ ID NO: 88703 - DNA, 25 bp, mus musculus
ttaggccccagcacactcagagaca

SEQ ID NO: 88704 - DNA, 25 bp, mus musculus
aggcctcaggatatcatcgtgttta

SEQ ID NO: 88705 - DNA, 25 bp, mus musculus
ctgacagtctataacctgaaccgca

SEQ ID NO: 88706 - DNA, 25 bp, mus musculus
gtctataacctgaaccgcaccactc

SEQ ID NO: 88707 - DNA, 25 bp, mus musculus
accactcctggagtgaggatcgttc

SEQ ID NO: 88708 - DNA, 25 bp, mus musculus
cacaacacaaaaagcttcctagagg

SEQ ID NO: 88709 - DNA, 25 bp, mus musculus
tttctgcgtgcttctccaaagttct

SEQ ID NO: 88710 - DNA, 25 bp, mus musculus
cgtgcttctccaaagttctgtatca

SEQ ID NO: 88711 - DNA, 25 bp, mus musculus
ctgtaactgcccttcaaatggcatg

SEQ ID NO: 88712 - DNA, 25 bp, mus musculus
ctgcccttcaaatggcatgaggagg

SEQ ID NO: 88713 - DNA, 25 bp, mus musculus
agatcccgcatgtgtctgtattcaa

SEQ ID NO: 88714 - DNA, 25 bp, mus musculus
tattcaaacagcacttagagatgct

SEQ ID NO: 88715 - DNA, 25 bp, mus musculus
acttagagatgctcctgtcagtgtc

SEQ ID NO: 88716 - DNA, 25 bp, mus musculus
agatgctcctgtcagtgtcctccag

SEQ ID NO: 88717 - DNA, 25 bp, mus musculus
ggctccaccaagacacacaccgggg

SEQ ID NO: 88718 - DNA, 25 bp, mus musculus
catggtccatttcatgtgatctatt

SEQ ID NO: 88719 - DNA, 25 bp, mus musculus
ccatttcatgtgatctattactctg

SEQ ID NO: 88720 - DNA, 25 bp, mus musculus
atctattactctgacataaatccat

SEQ ID NO: 88721 - DNA, 25 bp, mus musculus
aagttctgtatcacagctgagctga

SEQ ID NO: 88722 - DNA, 25 bp, mus musculus
aacttctagttgcgctcgctttggt

SEQ ID NO: 88723 - DNA, 25 bp, mus musculus
tttccctccagcagtgcttactaca

SEQ ID NO: 88724 - DNA, 25 bp, mus musculus
tccagcagtgcttactacacaagac

SEQ ID NO: 88725 - DNA, 25 bp, mus musculus
agtgcttactacacaagacaaatca

SEQ ID NO: 88726 - DNA, 25 bp, mus musculus
ttaagtggctgcagaaccagcaacc

SEQ ID NO: 88727 - DNA, 25 bp, mus musculus
ggctgcagaaccagcaacctgtaac

SEQ ID NO: 88728 - DNA, 25 bp, mus musculus
agcaacctgtaactgcccttcaaat

SEQ ID NO: 88729 - DNA, 25 bp, mus musculus
tgggtccgaagctgcttgagtctcg

SEQ ID NO: 88730 - DNA, 25 bp, mus musculus
cgaagctgcttgagtctcgactttg

SEQ ID NO: 88731 - DNA, 25 bp, mus musculus
tcctaatgcttgcctcatgcctggg

SEQ ID NO: 88732 - DNA, 25 bp, mus musculus
tgcttgcctcatgcctgggacaaac

SEQ ID NO: 88733 - DNA, 25 bp, mus musculus
cccagtggtttgccatccagcatat

SEQ ID NO: 88734 - DNA, 25 bp, mus musculus
agtggtttgccatccagcatatcaa

SEQ ID NO: 88735 - DNA, 25 bp, mus musculus
ggtttgccatccagcatatcaataa

SEQ ID NO: 88736 - DNA, 25 bp, mus musculus
ataatgccaacctccaatgtaatgt

SEQ ID NO: 88737 - DNA, 25 bp, mus musculus
ccaacctccaatgtaatgttgaaat

SEQ ID NO: 88738 - DNA, 25 bp, mus musculus
acctccaatgtaatgttgaaatgca

SEQ ID NO: 88739 - DNA, 25 bp, mus musculus
gcttaaatacttttcttcatacaag

SEQ ID NO: 88740 - DNA, 25 bp, mus musculus
ttcttcatacaagttttgctaatgc

SEQ ID NO: 88741 - DNA, 25 bp, mus musculus
agctgcttgagtctcgactttgtct

SEQ ID NO: 88742 - DNA, 25 bp, mus musculus
agtctcgactttgtctcctgctgct

SEQ ID NO: 88743 - DNA, 25 bp, mus musculus
gactttgtctcctgctgctgctagg

SEQ ID NO: 88744 - DNA, 25 bp, mus musculus
gtctcctgctgctgctaggacttgt

SEQ ID NO: 88745 - DNA, 25 bp, mus musculus
tcctgctgctgctaggacttgtcct

SEQ ID NO: 88746 - DNA, 25 bp, mus musculus
tgctgctgctaggacttgtcctaat

SEQ ID NO: 88747 - DNA, 25 bp, mus musculus
taggacttgtcctaatgcttgcctc

SEQ ID NO: 88748 - DNA, 25 bp, mus musculus
gacttgtcctaatgcttgcctcatg

SEQ ID NO: 88749 - DNA, 25 bp, mus musculus
ctgcctatgctggagaaatgctggt

SEQ ID NO: 88750 - DNA, 25 bp, mus musculus
gtgccagtgttatacccaggcctca

SEQ ID NO: 88751 - DNA, 25 bp, mus musculus
ttgaagcagatccctcctttaaact

SEQ ID NO: 88752 - DNA, 25 bp, mus musculus
ggatctcctgctgccttgctttctt

SEQ ID NO: 88753 - DNA, 25 bp, mus musculus
cacgaaggtttccctgagtgcagag

SEQ ID NO: 88754 - DNA, 25 bp, mus musculus
ttccctgagtgcagagagatcagcc

SEQ ID NO: 88755 - DNA, 25 bp, mus musculus
ccctgcagacccacagagaagattc

SEQ ID NO: 88756 - DNA, 25 bp, mus musculus
tgcagacccacagagaagattcaga

SEQ ID NO: 88757 - DNA, 25 bp, mus musculus
ttccttctgacacaagggagacacg

SEQ ID NO: 88758 - DNA, 25 bp, mus musculus
gatagcctgacatcagatgacagac

SEQ ID NO: 88759 - DNA, 25 bp, mus musculus
gactgtagcacatctctgggcgttt

SEQ ID NO: 88760 - DNA, 25 bp, mus musculus
agcacatctctgggcgtttccctac

SEQ ID NO: 88761 - DNA, 25 bp, mus musculus
ttatacccaggcctcaacacctcag

SEQ ID NO: 88762 - DNA, 25 bp, mus musculus
tccagcttcatgaacccagacaaga

SEQ ID NO: 88763 - DNA, 25 bp, mus musculus
agcttcatgaacccagacaagatac

SEQ ID NO: 88764 - DNA, 25 bp, mus musculus
atgaacccagacaagataccgactc

SEQ ID NO: 88765 - DNA, 25 bp, mus musculus
cctttggcacattcgtcccttgact

SEQ ID NO: 88766 - DNA, 25 bp, mus musculus
gactcttcggccttgctccaggctt

SEQ ID NO: 88767 - DNA, 25 bp, mus musculus
gccttgctccaggctttgaagcaga

SEQ ID NO: 88768 - DNA, 25 bp, mus musculus
ttgctccaggctttgaagcagatcc

SEQ ID NO: 88769 - DNA, 25 bp, mus musculus
cgcaagtcggacggagccttctacg

SEQ ID NO: 88770 - DNA, 25 bp, mus musculus
ccttctacgccgtgaaggtgctgca

SEQ ID NO: 88771 - DNA, 25 bp, mus musculus
agaacgcaacgtgctgttgaagaac

SEQ ID NO: 88772 - DNA, 25 bp, mus musculus
tgggcctgcggtaatccttccagaa

SEQ ID NO: 88773 - DNA, 25 bp, mus musculus
tgcggtaatccttccagaacccaga

SEQ ID NO: 88774 - DNA, 25 bp, mus musculus
tccttccagaacccagagaaactct

SEQ ID NO: 88775 - DNA, 25 bp, mus musculus
tccagaacccagagaaactctaatt

SEQ ID NO: 88776 - DNA, 25 bp, mus musculus
aaactctaatttgtgcttgactatg

SEQ ID NO: 88777 - DNA, 25 bp, mus musculus
actctaatttgtgcttgactatgtc

SEQ ID NO: 88778 - DNA, 25 bp, mus musculus
taatttgtgcttgactatgtcaacg

SEQ ID NO: 88779 - DNA, 25 bp, mus musculus
atttgtgcttgactatgtcaacggg

SEQ ID NO: 88780 - DNA, 25 bp, mus musculus
gagagctcttcttccatctacagcg

SEQ ID NO: 88781 - DNA, 25 bp, mus musculus
aagagcaggaccacatcatggcaga

SEQ ID NO: 88782 - DNA, 25 bp, mus musculus
gctcttcttccatctacagcgggaa

SEQ ID NO: 88783 - DNA, 25 bp, mus musculus
gagcaggaccacatcatggcagaac

SEQ ID NO: 88784 - DNA, 25 bp, mus musculus
gcaggaccacatcatggcagaacgc

SEQ ID NO: 88785 - DNA, 25 bp, mus musculus
aggaccacatcatggcagaacgcaa

SEQ ID NO: 88786 - DNA, 25 bp, mus musculus
gaccacatcatggcagaacgcaacg

SEQ ID NO: 88787 - DNA, 25 bp, mus musculus
ccacatcatggcagaacgcaacgtg

SEQ ID NO: 88788 - DNA, 25 bp, mus musculus
tggcagaacgcaacgtgctgttgaa

SEQ ID NO: 88789 - DNA, 25 bp, mus musculus
gcagaacgcaacgtgctgttgaaga

SEQ ID NO: 88790 - DNA, 25 bp, mus musculus
ccttttcccaatgttgcacacctct

SEQ ID NO: 88791 - DNA, 25 bp, mus musculus
aatccatcagcacctctgtggagga

SEQ ID NO: 88792 - DNA, 25 bp, mus musculus
ctcactatacgagattctactaaga

SEQ ID NO: 88793 - DNA, 25 bp, mus musculus
attcctaaaataactgctgctacct

SEQ ID NO: 88794 - DNA, 25 bp, mus musculus
tactattaacattccctaagatgct

SEQ ID NO: 88795 - DNA, 25 bp, mus musculus
taacattccctaagatgcttcttga

SEQ ID NO: 88796 - DNA, 25 bp, mus musculus
tccctaagatgcttcttgaaaagac

SEQ ID NO: 88797 - DNA, 25 bp, mus musculus
gtgtgttccaactttggactgtgga

SEQ ID NO: 88798 - DNA, 25 bp, mus musculus
tccaactttggactgtggagccgta

SEQ ID NO: 88799 - DNA, 25 bp, mus musculus
tcttttcagtactacttctgagata

SEQ ID NO: 88800 - DNA, 25 bp, mus musculus
cagtactacttctgagataagaacc

SEQ ID NO: 88801 - DNA, 25 bp, mus musculus
atctctcgccaagacattaaagttt

SEQ ID NO: 88802 - DNA, 25 bp, mus musculus
tcagcacctctgtggaggaaatcct

SEQ ID NO: 88803 - DNA, 25 bp, mus musculus
agtacatccaatatcaacaggtcac

SEQ ID NO: 88804 - DNA, 25 bp, mus musculus
tccaatatcaacaggtcaccatccc

SEQ ID NO: 88805 - DNA, 25 bp, mus musculus
ttcatccccagatacctgtgagcta

SEQ ID NO: 88806 - DNA, 25 bp, mus musculus
tacctgtgagctactggtaccccag

SEQ ID NO: 88807 - DNA, 25 bp, mus musculus
tgagctactggtaccccagtaagga

SEQ ID NO: 88808 - DNA, 25 bp, mus musculus
ccttcccaaatgctcactatacgag

SEQ ID NO: 88809 - DNA, 25 bp, mus musculus
caaatgctcactatacgagattcta

SEQ ID NO: 88810 - DNA, 25 bp, mus musculus
gacagccaacatctgtgatacaagc

SEQ ID NO: 88811 - DNA, 25 bp, mus musculus
tacaagcatgtctgttgggactctt

SEQ ID NO: 88812 - DNA, 25 bp, mus musculus
ttacacagactggcaaactttcact

SEQ ID NO: 88813 - DNA, 25 bp, mus musculus
cacagactggcaaactttcactcaa

SEQ ID NO: 88814 - DNA, 25 bp, mus musculus
gcaaactttcactcaacctcggctt

SEQ ID NO: 88815 - DNA, 25 bp, mus musculus
tcaacctcggcttggtgaagaatcc

SEQ ID NO: 88816 - DNA, 25 bp, mus musculus
acctcggcttggtgaagaatccatt

SEQ ID NO: 88817 - DNA, 25 bp, mus musculus
gtgaagactacgttcgcccatataa

SEQ ID NO: 88818 - DNA, 25 bp, mus musculus
actacgttcgcccatataactatga

SEQ ID NO: 88819 - DNA, 25 bp, mus musculus
ttcgcccatataactatgaaggcaa

SEQ ID NO: 88820 - DNA, 25 bp, mus musculus
aaggctccatggctggctctgtggg

SEQ ID NO: 88821 - DNA, 25 bp, mus musculus
ctgtgggctgctgcagtgatcggca

SEQ ID NO: 88822 - DNA, 25 bp, mus musculus
tgttgggactcttggtggtcaagga

SEQ ID NO: 88823 - DNA, 25 bp, mus musculus
gactcttggtggtcaaggaatcaaa

SEQ ID NO: 88824 - DNA, 25 bp, mus musculus
aatcaaaacacagcaaagttttgag

SEQ ID NO: 88825 - DNA, 25 bp, mus musculus
aggccacaccttggagtcccacaag

SEQ ID NO: 88826 - DNA, 25 bp, mus musculus
gcctggccgatatgcttacacagac

SEQ ID NO: 88827 - DNA, 25 bp, mus musculus
tggccgatatgcttacacagactgg

SEQ ID NO: 88828 - DNA, 25 bp, mus musculus
ccgatatgcttacacagactggcaa

SEQ ID NO: 88829 - DNA, 25 bp, mus musculus
tgcttacacagactggcaaactttc

SEQ ID NO: 88830 - DNA, 25 bp, mus musculus
gttcgcctatggatgacgaatatcg

SEQ ID NO: 88831 - DNA, 25 bp, mus musculus
ttcgcctatggatgacgaatatcgg

SEQ ID NO: 88832 - DNA, 25 bp, mus musculus
tcgaacaacgggctcccggcatgtg

SEQ ID NO: 88833 - DNA, 25 bp, mus musculus
gaacaacgggctcccggcatgtggc

SEQ ID NO: 88834 - DNA, 25 bp, mus musculus
acaacgggctcccggcatgtggcaa

SEQ ID NO: 88835 - DNA, 25 bp, mus musculus
ctcccggcatgtggcaaagccgggc

SEQ ID NO: 88836 - DNA, 25 bp, mus musculus
gctttcgcggggcagacgaatggct

SEQ ID NO: 88837 - DNA, 25 bp, mus musculus
ctttcgcggggcagacgaatggctc

SEQ ID NO: 88838 - DNA, 25 bp, mus musculus
cagacgaatggctccccggggcttg

SEQ ID NO: 88839 - DNA, 25 bp, mus musculus
ggaaggacttcctatgtgggtgaca

SEQ ID NO: 88840 - DNA, 25 bp, mus musculus
gaaggacttcctatgtgggtgacaa

SEQ ID NO: 88841 - DNA, 25 bp, mus musculus
aaggacttcctatgtgggtgacaag

SEQ ID NO: 88842 - DNA, 25 bp, mus musculus
atgacgaatatcggcctgcgctggg

SEQ ID NO: 88843 - DNA, 25 bp, mus musculus
tgacgaatatcggcctgcgctgggt

SEQ ID NO: 88844 - DNA, 25 bp, mus musculus
acgaatatcggcctgcgctgggtcc

SEQ ID NO: 88845 - DNA, 25 bp, mus musculus
cgaatatcggcctgcgctgggtccg

SEQ ID NO: 88846 - DNA, 25 bp, mus musculus
gaatatcggcctgcgctgggtccgt

SEQ ID NO: 88847 - DNA, 25 bp, mus musculus
atatcggcctgcgctgggtccgtcg

SEQ ID NO: 88848 - DNA, 25 bp, mus musculus
cgtcgaacaacgggctcccggcatg

SEQ ID NO: 88849 - DNA, 25 bp, mus musculus
gtcgaacaacgggctcccggcatgt

SEQ ID NO: 88850 - DNA, 25 bp, mus musculus
cttcacagctgggacattcgcttag

SEQ ID NO: 88851 - DNA, 25 bp, mus musculus
acagctgggacattcgcttagcaga

SEQ ID NO: 88852 - DNA, 25 bp, mus musculus
ttctagaggtacccattcagggctg

SEQ ID NO: 88853 - DNA, 25 bp, mus musculus
ctagaggtacccattcagggctgtc

SEQ ID NO: 88854 - DNA, 25 bp, mus musculus
agaggtacccattcagggctgtcat

SEQ ID NO: 88855 - DNA, 25 bp, mus musculus
aggtacccattcagggctgtcatca

SEQ ID NO: 88856 - DNA, 25 bp, mus musculus
acccattcagggctgtcatcaggca

SEQ ID NO: 88857 - DNA, 25 bp, mus musculus
ccattcagggctgtcatcaggcatc

SEQ ID NO: 88858 - DNA, 25 bp, mus musculus
ggctgtcatcaggcatcccgaggct

SEQ ID NO: 88859 - DNA, 25 bp, mus musculus
ctgtcatcaggcatcccgaggctct

SEQ ID NO: 88860 - DNA, 25 bp, mus musculus
gtcatcaggcatcccgaggctctaa

SEQ ID NO: 88861 - DNA, 25 bp, mus musculus
catcaggcatcccgaggctctaagg

SEQ ID NO: 88862 - DNA, 25 bp, mus musculus
ctgggacattcgcttagcagatcca

SEQ ID NO: 88863 - DNA, 25 bp, mus musculus
caggcatcccgaggctctaaggtca

SEQ ID NO: 88864 - DNA, 25 bp, mus musculus
gggacattcgcttagcagatccagg

SEQ ID NO: 88865 - DNA, 25 bp, mus musculus
cattcgcttagcagatccaggaggc

SEQ ID NO: 88866 - DNA, 25 bp, mus musculus
ttcgcttagcagatccaggaggctt

SEQ ID NO: 88867 - DNA, 25 bp, mus musculus
cgcttagcagatccaggaggcttca

SEQ ID NO: 88868 - DNA, 25 bp, mus musculus
cttagcagatccaggaggcttcaag

SEQ ID NO: 88869 - DNA, 25 bp, mus musculus
agatccaggaggcttcaaggagcaa

SEQ ID NO: 88870 - DNA, 25 bp, mus musculus
atccaggaggcttcaaggagcaacg

SEQ ID NO: 88871 - DNA, 25 bp, mus musculus
gtactgacagcactgcagctatggc

SEQ ID NO: 88872 - DNA, 25 bp, mus musculus
ctgacagcactgcagctatggctag

SEQ ID NO: 88873 - DNA, 25 bp, mus musculus
cacgttcttgctcggagtcctgtca

SEQ ID NO: 88874 - DNA, 25 bp, mus musculus
gttcttgctcggagtcctgtcaatt

SEQ ID NO: 88875 - DNA, 25 bp, mus musculus
cttgctcggagtcctgtcaattcca

SEQ ID NO: 88876 - DNA, 25 bp, mus musculus
agtcctgtcaattccacgcctgact

SEQ ID NO: 88877 - DNA, 25 bp, mus musculus
cctctgggataccatgcggtgtaac

SEQ ID NO: 88878 - DNA, 25 bp, mus musculus
ctgggataccatgcggtgtaaccct

SEQ ID NO: 88879 - DNA, 25 bp, mus musculus
ggataccatgcggtgtaaccctggt

SEQ ID NO: 88880 - DNA, 25 bp, mus musculus
catgcggtgtaaccctggtagaaat

SEQ ID NO: 88881 - DNA, 25 bp, mus musculus
gtgtaaccctggtagaaatgctctg

SEQ ID NO: 88882 - DNA, 25 bp, mus musculus
tagaaatgctctgatcagcgctact

SEQ ID NO: 88883 - DNA, 25 bp, mus musculus
acagcactgcagctatggctagttc

SEQ ID NO: 88884 - DNA, 25 bp, mus musculus
gaaatgctctgatcagcgctactac

SEQ ID NO: 88885 - DNA, 25 bp, mus musculus
ctgcagctatggctagttcaccgtg

SEQ ID NO: 88886 - DNA, 25 bp, mus musculus
cagctatggctagttcaccgtggta

SEQ ID NO: 88887 - DNA, 25 bp, mus musculus
gttcaccgtggtacgcggttcatgg

SEQ ID NO: 88888 - DNA, 25 bp, mus musculus
caccgtggtacgcggttcatggatc

SEQ ID NO: 88889 - DNA, 25 bp, mus musculus
ggtacgcggttcatggatcgggatc

SEQ ID NO: 88890 - DNA, 25 bp, mus musculus
acgcggttcatggatcgggatcacg

SEQ ID NO: 88891 - DNA, 25 bp, mus musculus
cgggatcacgttcttgctcggagtc

SEQ ID NO: 88892 - DNA, 25 bp, mus musculus
tcaaggttgctcaccacggaggaga

SEQ ID NO: 88893 - DNA, 25 bp, mus musculus
ttgctcaccacggaggagaaaggcg

SEQ ID NO: 88894 - DNA, 25 bp, mus musculus
ctgtttacagtgttctgaggtatac

SEQ ID NO: 88895 - DNA, 25 bp, mus musculus
ttgggttgctgtggactaggaatag

SEQ ID NO: 88896 - DNA, 25 bp, mus musculus
tcctatttctccagtgcactatctg

SEQ ID NO: 88897 - DNA, 25 bp, mus musculus
ttctccagtgcactatctgaccact

SEQ ID NO: 88898 - DNA, 25 bp, mus musculus
agtgcactatctgaccactctctca

SEQ ID NO: 88899 - DNA, 25 bp, mus musculus
agacaaccctgagcgaccacctgca

SEQ ID NO: 88900 - DNA, 25 bp, mus musculus
cacactttctggtccctgacctcta

SEQ ID NO: 88901 - DNA, 25 bp, mus musculus
ctctccaggtatttggcatggacca

SEQ ID NO: 88902 - DNA, 25 bp, mus musculus
gcattgattcttggacttgaggaac

SEQ ID NO: 88903 - DNA, 25 bp, mus musculus
ctcttaactgaattgcttgttcagt

SEQ ID NO: 88904 - DNA, 25 bp, mus musculus
atattgtagtctcctcagttacttg

SEQ ID NO: 88905 - DNA, 25 bp, mus musculus
tagtctcctcagttacttgctaaca

SEQ ID NO: 88906 - DNA, 25 bp, mus musculus
cctcagttacttgctaacatctcca

SEQ ID NO: 88907 - DNA, 25 bp, mus musculus
ttacttgctaacatctccatttcct

SEQ ID NO: 88908 - DNA, 25 bp, mus musculus
gctaacatctccatttccttaggta

SEQ ID NO: 88909 - DNA, 25 bp, mus musculus
atctccatttccttaggtagagtgg

SEQ ID NO: 88910 - DNA, 25 bp, mus musculus
gtctctcctggcctgtttacagtgt

SEQ ID NO: 88911 - DNA, 25 bp, mus musculus
cctggcctgtttacagtgttctgag

SEQ ID NO: 88912 - DNA, 25 bp, mus musculus
tatcagtgtgtcgttttgctgcaga

SEQ ID NO: 88913 - DNA, 25 bp, mus musculus
agtgtgtcgttttgctgcagagtaa

SEQ ID NO: 88914 - DNA, 25 bp, mus musculus
tggacatcactttaatagagagagg

SEQ ID NO: 88915 - DNA, 25 bp, mus musculus
aggagaatccttctatcaagatagg

SEQ ID NO: 88916 - DNA, 25 bp, mus musculus
gagaatccttctatcaagataggat

SEQ ID NO: 88917 - DNA, 25 bp, mus musculus
atccttctatcaagataggatgaag

SEQ ID NO: 88918 - DNA, 25 bp, mus musculus
tgcctgggtgttctgtgccattaac

SEQ ID NO: 88919 - DNA, 25 bp, mus musculus
cctgggtgttctgtgccattaacga

SEQ ID NO: 88920 - DNA, 25 bp, mus musculus
ggtgttctgtgccattaacgatagt

SEQ ID NO: 88921 - DNA, 25 bp, mus musculus
tgttctgtgccattaacgatagtga

SEQ ID NO: 88922 - DNA, 25 bp, mus musculus
ttctgtgccattaacgatagtgaaa

SEQ ID NO: 88923 - DNA, 25 bp, mus musculus
ggctatacctatgacacatctgacc

SEQ ID NO: 88924 - DNA, 25 bp, mus musculus
tgtgtcgttttgctgcagagtaaaa

SEQ ID NO: 88925 - DNA, 25 bp, mus musculus
ctatacctatgacacatctgacctg

SEQ ID NO: 88926 - DNA, 25 bp, mus musculus
tgtcgttttgctgcagagtaaaaac

SEQ ID NO: 88927 - DNA, 25 bp, mus musculus
gaaagcctggaacctcatctgtgac

SEQ ID NO: 88928 - DNA, 25 bp, mus musculus
aagcctggaacctcatctgtgacgt

SEQ ID NO: 88929 - DNA, 25 bp, mus musculus
aacctcatctgtgacgtgtcccggg

SEQ ID NO: 88930 - DNA, 25 bp, mus musculus
cctcatctgtgacgtgtcccgggaa

SEQ ID NO: 88931 - DNA, 25 bp, mus musculus
atgcattggacatcactttaataga

SEQ ID NO: 88932 - DNA, 25 bp, mus musculus
attggacatcactttaatagagaga

SEQ ID NO: 88933 - DNA, 25 bp, mus musculus
tgtaggccctcaagaatgacgttcc

SEQ ID NO: 88934 - DNA, 25 bp, mus musculus
ccagtatcatcctcacttcctgcag

SEQ ID NO: 88935 - DNA, 25 bp, mus musculus
atttgcctcctagttccatatctaa

SEQ ID NO: 88936 - DNA, 25 bp, mus musculus
ctcctagttccatatctaaaacaag

SEQ ID NO: 88937 - DNA, 25 bp, mus musculus
tttggacttgctgcagcgtctggga

SEQ ID NO: 88938 - DNA, 25 bp, mus musculus
cttgctgcagcgtctgggaccctcc

SEQ ID NO: 88939 - DNA, 25 bp, mus musculus
actgtccttgctccatcttgtatga

SEQ ID NO: 88940 - DNA, 25 bp, mus musculus
cttgctccatcttgtatgagaacct

SEQ ID NO: 88941 - DNA, 25 bp, mus musculus
ttgtgctgaacgggcccagtttcct

SEQ ID NO: 88942 - DNA, 25 bp, mus musculus
tgaacgggcccagtttccttgtatg

SEQ ID NO: 88943 - DNA, 25 bp, mus musculus
gatacaccatgtatttgctttgtca

SEQ ID NO: 88944 - DNA, 25 bp, mus musculus
ccatgtatttgctttgtcaaaatat

SEQ ID NO: 88945 - DNA, 25 bp, mus musculus
taggttcaccatttgctttggtgat

SEQ ID NO: 88946 - DNA, 25 bp, mus musculus
aggtcttaagatacccagaggtcag

SEQ ID NO: 88947 - DNA, 25 bp, mus musculus
taagatacccagaggtcaggctcaa

SEQ ID NO: 88948 - DNA, 25 bp, mus musculus
ggaacttcttccatgatctcaagct

SEQ ID NO: 88949 - DNA, 25 bp, mus musculus
atgatctcaagctggccagatgggc

SEQ ID NO: 88950 - DNA, 25 bp, mus musculus
tgtgcctgtcattccagggaaaaat

SEQ ID NO: 88951 - DNA, 25 bp, mus musculus
gctggactttctgtatcccagactt

SEQ ID NO: 88952 - DNA, 25 bp, mus musculus
gtatcccagacttatcttcatggtt

SEQ ID NO: 88953 - DNA, 25 bp, mus musculus
acttgactgaagccctgtcgctcta

SEQ ID NO: 88954 - DNA, 25 bp, mus musculus
tgactgaagccctgtcgctctatga

SEQ ID NO: 88955 - DNA, 25 bp, mus musculus
ccatatgccgtatatgccatcaaat

SEQ ID NO: 88956 - DNA, 25 bp, mus musculus
tatgccgtatatgccatcaaatgtg

SEQ ID NO: 88957 - DNA, 25 bp, mus musculus
tatgccatcaaatgtgtcaggcaac

SEQ ID NO: 88958 - DNA, 25 bp, mus musculus
gtcaggcaactgctcatgaattcct

SEQ ID NO: 88959 - DNA, 25 bp, mus musculus
caactgctcatgaattccttctagt

SEQ ID NO: 88960 - DNA, 25 bp, mus musculus
ctgctcatgaattccttctagtggt

SEQ ID NO: 88961 - DNA, 25 bp, mus musculus
caattagacagcccagcaaagactg

SEQ ID NO: 88962 - DNA, 25 bp, mus musculus
gacagcccagcaaagactgcagaat

SEQ ID NO: 88963 - DNA, 25 bp, mus musculus
gcagaatgcactgaccccctagaat

SEQ ID NO: 88964 - DNA, 25 bp, mus musculus
tcagtagacctttaatttggacatg

SEQ ID NO: 88965 - DNA, 25 bp, mus musculus
ctgaagccctgtcgctctatgaaga

SEQ ID NO: 88966 - DNA, 25 bp, mus musculus
aacagctggggcgtctgtattgtcc

SEQ ID NO: 88967 - DNA, 25 bp, mus musculus
ggcgtctgtattgtcctgtggaatt

SEQ ID NO: 88968 - DNA, 25 bp, mus musculus
attgtcctgtggaattctcaaaaga

SEQ ID NO: 88969 - DNA, 25 bp, mus musculus
tctgtgtcccttcatacttggaatt

SEQ ID NO: 88970 - DNA, 25 bp, mus musculus
gtgtgctgcgagccaccttcctgac

SEQ ID NO: 88971 - DNA, 25 bp, mus musculus
tcctgacctccatatgccgtatatg

SEQ ID NO: 88972 - DNA, 25 bp, mus musculus
cctccatatgccgtatatgccatca

SEQ ID NO: 88973 - DNA, 25 bp, mus musculus
acttccggattccattcatggcctt

SEQ ID NO: 88974 - DNA, 25 bp, mus musculus
ttccggattccattcatggccttct

SEQ ID NO: 88975 - DNA, 25 bp, mus musculus
ttattccgatgatgattttaggact

SEQ ID NO: 88976 - DNA, 25 bp, mus musculus
atggacttcacagcaggcggaaaca

SEQ ID NO: 88977 - DNA, 25 bp, mus musculus
ggacttcacagcaggcggaaacaaa

SEQ ID NO: 88978 - DNA, 25 bp, mus musculus
acttcacagcaggcggaaacaaaca

SEQ ID NO: 88979 - DNA, 25 bp, mus musculus
agaattcactgtagacacaggcatc

SEQ ID NO: 88980 - DNA, 25 bp, mus musculus
aattcactgtagacacaggcatctc

SEQ ID NO: 88981 - DNA, 25 bp, mus musculus
ttcactgtagacacaggcatctcag

SEQ ID NO: 88982 - DNA, 25 bp, mus musculus
ctgtagacacaggcatctcagtgta

SEQ ID NO: 88983 - DNA, 25 bp, mus musculus
gtagacacaggcatctcagtgtaaa

SEQ ID NO: 88984 - DNA, 25 bp, mus musculus
agacacaggcatctcagtgtaaatt

SEQ ID NO: 88985 - DNA, 25 bp, mus musculus
ccggattccattcatggccttctta

SEQ ID NO: 88986 - DNA, 25 bp, mus musculus
ggattccattcatggccttcttaac

SEQ ID NO: 88987 - DNA, 25 bp, mus musculus
attccattcatggccttcttaactt

SEQ ID NO: 88988 - DNA, 25 bp, mus musculus
tccattcatggccttcttaacttag

SEQ ID NO: 88989 - DNA, 25 bp, mus musculus
cattcatggccttcttaacttagtc

SEQ ID NO: 88990 - DNA, 25 bp, mus musculus
ttcatggccttcttaacttagtcct

SEQ ID NO: 88991 - DNA, 25 bp, mus musculus
catggccttcttaacttagtccttg

SEQ ID NO: 88992 - DNA, 25 bp, mus musculus
tcttaacttagtccttgaacaactg

SEQ ID NO: 88993 - DNA, 25 bp, mus musculus
ggcacgatccagacctctgtccaca

SEQ ID NO: 88994 - DNA, 25 bp, mus musculus
cacgatccagacctctgtccacaaa

SEQ ID NO: 88995 - DNA, 25 bp, mus musculus
gctctcgcgaatatcccagcatcat

SEQ ID NO: 88996 - DNA, 25 bp, mus musculus
tcgcgaatatcccagcatcatcctt

SEQ ID NO: 88997 - DNA, 25 bp, mus musculus
cccagcatcatccttcctgagctta

SEQ ID NO: 88998 - DNA, 25 bp, mus musculus
gcatcatccttcctgagcttatgcc

SEQ ID NO: 88999 - DNA, 25 bp, mus musculus
atcatccttcctgagcttatgccac

SEQ ID NO: 89000 - DNA, 25 bp, mus musculus
tccttcctgagcttatgccacgaag

SEQ ID NO: 89001 - DNA, 25 bp, mus musculus
cttcctgagcttatgccacgaagct

SEQ ID NO: 89002 - DNA, 25 bp, mus musculus
tcctgagcttatgccacgaagctga

SEQ ID NO: 89003 - DNA, 25 bp, mus musculus
gcttatgccacgaagctgagatcaa

SEQ ID NO: 89004 - DNA, 25 bp, mus musculus
ttatgccacgaagctgagatcaatg

SEQ ID NO: 89005 - DNA, 25 bp, mus musculus
agacctctgtccacaaactcaactc

SEQ ID NO: 89006 - DNA, 25 bp, mus musculus
tttaaacagcagtgcctttgatatc

SEQ ID NO: 89007 - DNA, 25 bp, mus musculus
taaacagcagtgcctttgatatcgt

SEQ ID NO: 89008 - DNA, 25 bp, mus musculus
ccaccgctcgatgagacctggcaaa

SEQ ID NO: 89009 - DNA, 25 bp, mus musculus
accgctcgatgagacctggcaaagt

SEQ ID NO: 89010 - DNA, 25 bp, mus musculus
ctcgatgagacctggcaaagtactg

SEQ ID NO: 89011 - DNA, 25 bp, mus musculus
atgaccgctctcgcgaatatcccag

SEQ ID NO: 89012 - DNA, 25 bp, mus musculus
gaccgctctcgcgaatatcccagca

SEQ ID NO: 89013 - DNA, 25 bp, mus musculus
tccaggcctccaaggaagctagagc

SEQ ID NO: 89014 - DNA, 25 bp, mus musculus
ctagagctgcagcagctgtcaacca

SEQ ID NO: 89015 - DNA, 25 bp, mus musculus
ctcattgtcattgtggtcctcttct

SEQ ID NO: 89016 - DNA, 25 bp, mus musculus
gtcattgtggtcctcttcttcctgt

SEQ ID NO: 89017 - DNA, 25 bp, mus musculus
gtggtcctcttcttcctgtgctgga

SEQ ID NO: 89018 - DNA, 25 bp, mus musculus
ctcttcttcctgtgctggatgccca

SEQ ID NO: 89019 - DNA, 25 bp, mus musculus
ttcctgtgctggatgcccatcttca

SEQ ID NO: 89020 - DNA, 25 bp, mus musculus
atgcccatcttcagtgccaatgcct

SEQ ID NO: 89021 - DNA, 25 bp, mus musculus
agtgccaatgcctggcgggcatatg

SEQ ID NO: 89022 - DNA, 25 bp, mus musculus
aatgcctggcgggcatatgacacgg

SEQ ID NO: 89023 - DNA, 25 bp, mus musculus
gcatatgacacggtttctgccgaga

SEQ ID NO: 89024 - DNA, 25 bp, mus musculus
gtttctgccgagaaacacctctcag

SEQ ID NO: 89025 - DNA, 25 bp, mus musculus
ctgcagcagctgtcaaccagcagca

SEQ ID NO: 89026 - DNA, 25 bp, mus musculus
tcaaccagcagcagtggtggcagaa

SEQ ID NO: 89027 - DNA, 25 bp, mus musculus
atcaaccggatcaggagcagtggtt

SEQ ID NO: 89028 - DNA, 25 bp, mus musculus
agtggttctgctgccaacctgatcg

SEQ ID NO: 89029 - DNA, 25 bp, mus musculus
tctgctgccaacctgatcgccaaga

SEQ ID NO: 89030 - DNA, 25 bp, mus musculus
gccaacctgatcgccaagaagcgcg

SEQ ID NO: 89031 - DNA, 25 bp, mus musculus
gtgatccgcatgctcattgtcattg

SEQ ID NO: 89032 - DNA, 25 bp, mus musculus
cgcatgctcattgtcattgtggtcc

SEQ ID NO: 89033 - DNA, 25 bp, mus musculus
cctgtaccttgtcagtcgtgtgtgc

SEQ ID NO: 89034 - DNA, 25 bp, mus musculus
cttatgagacccacttatgggcata

SEQ ID NO: 89035 - DNA, 25 bp, mus musculus
ctacaggcttcagaagctgaggcct

SEQ ID NO: 89036 - DNA, 25 bp, mus musculus
actacaactctcatggtgccctgtg

SEQ ID NO: 89037 - DNA, 25 bp, mus musculus
actctcatggtgccctgtgacatgg

SEQ ID NO: 89038 - DNA, 25 bp, mus musculus
atggtgccctgtgacatggagagtc

SEQ ID NO: 89039 - DNA, 25 bp, mus musculus
catgcctacttaggatcttctgtct

SEQ ID NO: 89040 - DNA, 25 bp, mus musculus
tacttaggatcttctgtctgtggta

SEQ ID NO: 89041 - DNA, 25 bp, mus musculus
ggatcttctgtctgtggtaggacgg

SEQ ID NO: 89042 - DNA, 25 bp, mus musculus
ataatactcacagcagctcacatgt

SEQ ID NO: 89043 - DNA, 25 bp, mus musculus
ctcacagcagctcacatgtggtagt

SEQ ID NO: 89044 - DNA, 25 bp, mus musculus
gcagctcacatgtggtagtggtttc

SEQ ID NO: 89045 - DNA, 25 bp, mus musculus
gggcatatcttcctagctgcatatt

SEQ ID NO: 89046 - DNA, 25 bp, mus musculus
atcttcctagctgcatattccatga

SEQ ID NO: 89047 - DNA, 25 bp, mus musculus
aacactggcaccttttggcattgtc

SEQ ID NO: 89048 - DNA, 25 bp, mus musculus
tccaaaacgcaaccaatcgctaatg

SEQ ID NO: 89049 - DNA, 25 bp, mus musculus
acgcaaccaatcgctaatgcacacc

SEQ ID NO: 89050 - DNA, 25 bp, mus musculus
gctaatgcacaccacactgccttgg

SEQ ID NO: 89051 - DNA, 25 bp, mus musculus
gccttggatgccctgaagcaaaaaa

SEQ ID NO: 89052 - DNA, 25 bp, mus musculus
caagtcctacaggcttcagaagctg

SEQ ID NO: 89053 - DNA, 25 bp, mus musculus
ataagcaacaaggcttcaggagaga

SEQ ID NO: 89054 - DNA, 25 bp, mus musculus
agcaacaaggcttcaggagagatca

SEQ ID NO: 89055 - DNA, 25 bp, mus musculus
agcataatgaactccttggttattg

SEQ ID NO: 89056 - DNA, 25 bp, mus musculus
gttattgtcctcttcttatctggaa

SEQ ID NO: 89057 - DNA, 25 bp, mus musculus
attgtcctcttcttatctggaatgg

SEQ ID NO: 89058 - DNA, 25 bp, mus musculus
gtcctcttcttatctggaatggtag

SEQ ID NO: 89059 - DNA, 25 bp, mus musculus
ctcttcttatctggaatggtagcta

SEQ ID NO: 89060 - DNA, 25 bp, mus musculus
atgttacgcacgctacataaagata

SEQ ID NO: 89061 - DNA, 25 bp, mus musculus
ttacgcacgctacataaagatattg

SEQ ID NO: 89062 - DNA, 25 bp, mus musculus
aaccagatggactctacggaagatg

SEQ ID NO: 89063 - DNA, 25 bp, mus musculus
gactctacggaagatgcccaggaag

SEQ ID NO: 89064 - DNA, 25 bp, mus musculus
tctacggaagatgcccaggaagaat

SEQ ID NO: 89065 - DNA, 25 bp, mus musculus
tattctattagttttgaggaagaga

SEQ ID NO: 89066 - DNA, 25 bp, mus musculus
atcagatgggcgtctaggtgggact

SEQ ID NO: 89067 - DNA, 25 bp, mus musculus
agatgggcgtctaggtgggactata

SEQ ID NO: 89068 - DNA, 25 bp, mus musculus
ctggagtctatgcctcacacccata

SEQ ID NO: 89069 - DNA, 25 bp, mus musculus
gagtctatgcctcacacccatattc

SEQ ID NO: 89070 - DNA, 25 bp, mus musculus
tctatgcctcacacccatattcagt

SEQ ID NO: 89071 - DNA, 25 bp, mus musculus
cacacccatattcagtggtttagca

SEQ ID NO: 89072 - DNA, 25 bp, mus musculus
acccatattcagtggtttagcataa

SEQ ID NO: 89073 - DNA, 25 bp, mus musculus
tcatgaatctgttcagtggtgttat

SEQ ID NO: 89074 - DNA, 25 bp, mus musculus
tgaatctgttcagtggtgttatgac

SEQ ID NO: 89075 - DNA, 25 bp, mus musculus
acgccagcagctatcaagaattatg

SEQ ID NO: 89076 - DNA, 25 bp, mus musculus
tttgcctcgtcgaagtactgatttc

SEQ ID NO: 89077 - DNA, 25 bp, mus musculus
gcctcgtcgaagtactgatttcaca

SEQ ID NO: 89078 - DNA, 25 bp, mus musculus
tactgatttcacaagcagggactat

SEQ ID NO: 89079 - DNA, 25 bp, mus musculus
tgatttcacaagcagggactattat

SEQ ID NO: 89080 - DNA, 25 bp, mus musculus
agataaccaggtggtccagttgcat

SEQ ID NO: 89081 - DNA, 25 bp, mus musculus
gttgcatccctctactgtgcttgat

SEQ ID NO: 89082 - DNA, 25 bp, mus musculus
gcatccctctactgtgcttgatcac

SEQ ID NO: 89083 - DNA, 25 bp, mus musculus
tccctctactgtgcttgatcacaag

SEQ ID NO: 89084 - DNA, 25 bp, mus musculus
tactgtgcttgatcacaagcctgaa

SEQ ID NO: 89085 - DNA, 25 bp, mus musculus
ttatgacaacttcattaactaccgg

SEQ ID NO: 89086 - DNA, 25 bp, mus musculus
tcacaagcctgaatgggtgctttat

SEQ ID NO: 89087 - DNA, 25 bp, mus musculus
cattaactaccggtccctgatgtct

SEQ ID NO: 89088 - DNA, 25 bp, mus musculus
taactaccggtccctgatgtctgca

SEQ ID NO: 89089 - DNA, 25 bp, mus musculus
ctaccggtccctgatgtctgcagac

SEQ ID NO: 89090 - DNA, 25 bp, mus musculus
gtccctgatgtctgcagacaatgta

SEQ ID NO: 89091 - DNA, 25 bp, mus musculus
cctgatgtctgcagacaatgtacgc

SEQ ID NO: 89092 - DNA, 25 bp, mus musculus
agacaatgtacgccagcagctatca

SEQ ID NO: 89093 - DNA, 25 bp, mus musculus
caatgtacgccagcagctatcaaga

SEQ ID NO: 89094 - DNA, 25 bp, mus musculus
tgtcttctcagcatcaagcacagga

SEQ ID NO: 89095 - DNA, 25 bp, mus musculus
cttctcagcatcaagcacaggattg

SEQ ID NO: 89096 - DNA, 25 bp, mus musculus
tacttctcagagacccttacgtcgg

SEQ ID NO: 89097 - DNA, 25 bp, mus musculus
ttctcagagacccttacgtcgggcg

SEQ ID NO: 89098 - DNA, 25 bp, mus musculus
tctcagagacccttacgtcgggcga

SEQ ID NO: 89099 - DNA, 25 bp, mus musculus
cctgatcagctctaccatgaggcgt

SEQ ID NO: 89100 - DNA, 25 bp, mus musculus
atcagctctaccatgaggcgtgtcc

SEQ ID NO: 89101 - DNA, 25 bp, mus musculus
cagctctaccatgaggcgtgtccat

SEQ ID NO: 89102 - DNA, 25 bp, mus musculus
agctctaccatgaggcgtgtccata

SEQ ID NO: 89103 - DNA, 25 bp, mus musculus
taggacgacactgctatgaagaggt

SEQ ID NO: 89104 - DNA, 25 bp, mus musculus
ggacgacactgctatgaagaggtct

SEQ ID NO: 89105 - DNA, 25 bp, mus musculus
gacgacactgctatgaagaggtctg

SEQ ID NO: 89106 - DNA, 25 bp, mus musculus
ttctcagcatcaagcacaggattga

SEQ ID NO: 89107 - DNA, 25 bp, mus musculus
tcagcatcaagcacaggattgagat

SEQ ID NO: 89108 - DNA, 25 bp, mus musculus
agcatcaagcacaggattgagattg

SEQ ID NO: 89109 - DNA, 25 bp, mus musculus
gcatcaagcacaggattgagattga

SEQ ID NO: 89110 - DNA, 25 bp, mus musculus
agattgagtccttcttcgtatgata

SEQ ID NO: 89111 - DNA, 25 bp, mus musculus
attgagtccttcttcgtatgataat

SEQ ID NO: 89112 - DNA, 25 bp, mus musculus
gagtccttcttcgtatgataatact

SEQ ID NO: 89113 - DNA, 25 bp, mus musculus
agtccttcttcgtatgataatactt

SEQ ID NO: 89114 - DNA, 25 bp, mus musculus
atctgacaggagccaggcgaggtcc

SEQ ID NO: 89115 - DNA, 25 bp, mus musculus
agttttacactctagtgccatatat

SEQ ID NO: 89116 - DNA, 25 bp, mus musculus
aagcgtctcttcagggatgaggtcg

SEQ ID NO: 89117 - DNA, 25 bp, mus musculus
tccacgtctgtaagtctccagggat

SEQ ID NO: 89118 - DNA, 25 bp, mus musculus
tctgtaagtctccagggatgatcag

SEQ ID NO: 89119 - DNA, 25 bp, mus musculus
cccgtgtgcagtcatgaatgtcccc

SEQ ID NO: 89120 - DNA, 25 bp, mus musculus
catgaatgtccccagtgctgtgttt

SEQ ID NO: 89121 - DNA, 25 bp, mus musculus
ttagaagccaagtcctgttcttatt

SEQ ID NO: 89122 - DNA, 25 bp, mus musculus
gccaagtcctgttcttatttctgca

SEQ ID NO: 89123 - DNA, 25 bp, mus musculus
tcctgttcttatttctgcagtgact

SEQ ID NO: 89124 - DNA, 25 bp, mus musculus
tcttatttctgcagtgactgctggg

SEQ ID NO: 89125 - DNA, 25 bp, mus musculus
ttctgcagtgactgctgggaagtgg

SEQ ID NO: 89126 - DNA, 25 bp, mus musculus
tgtcgtgtttacttcgtgatgagga

SEQ ID NO: 89127 - DNA, 25 bp, mus musculus
accaataaacagatgctcctgctgg

SEQ ID NO: 89128 - DNA, 25 bp, mus musculus
cccttcggtgctacctgtcttgtca

SEQ ID NO: 89129 - DNA, 25 bp, mus musculus
acctgtcttgtcaccagactgcagc

SEQ ID NO: 89130 - DNA, 25 bp, mus musculus
cttgtcaccagactgcagcttgcct

SEQ ID NO: 89131 - DNA, 25 bp, mus musculus
accagactgcagcttgcctgtcgga

SEQ ID NO: 89132 - DNA, 25 bp, mus musculus
cttggatgctcagcaagcaagcgtc

SEQ ID NO: 89133 - DNA, 25 bp, mus musculus
tgctcagcaagcaagcgtctcttca

SEQ ID NO: 89134 - DNA, 25 bp, mus musculus
gcaagcaagcgtctcttcagggatg

SEQ ID NO: 89135 - DNA, 25 bp, mus musculus
tctagggtctgctaatgctggcttg

SEQ ID NO: 89136 - DNA, 25 bp, mus musculus
tcagccacttctttcctgttgtgca

SEQ ID NO: 89137 - DNA, 25 bp, mus musculus
ctggataacgcttgtgtgagacact

SEQ ID NO: 89138 - DNA, 25 bp, mus musculus
agacacttgagcagaacggatacaa

SEQ ID NO: 89139 - DNA, 25 bp, mus musculus
atttacaagtctcttcatatctatg

SEQ ID NO: 89140 - DNA, 25 bp, mus musculus
tacaagtctcttcatatctatgtat

SEQ ID NO: 89141 - DNA, 25 bp, mus musculus
gtcatgtttccggggcgtattcaag

SEQ ID NO: 89142 - DNA, 25 bp, mus musculus
cattgtaattatcctcgccatagtc

SEQ ID NO: 89143 - DNA, 25 bp, mus musculus
tatcctcgccatagtcaggtaatag

SEQ ID NO: 89144 - DNA, 25 bp, mus musculus
cctcgccatagtcaggtaatagcat

SEQ ID NO: 89145 - DNA, 25 bp, mus musculus
tccctaccaacctgctgtatccaaa

SEQ ID NO: 89146 - DNA, 25 bp, mus musculus
ccaacctgctgtatccaaagttttg

SEQ ID NO: 89147 - DNA, 25 bp, mus musculus
gccacttctttcctgttgtgcagtt

SEQ ID NO: 89148 - DNA, 25 bp, mus musculus
ctgttgtgcagttggcttgccaagc

SEQ ID NO: 89149 - DNA, 25 bp, mus musculus
ttgtgcagttggcttgccaagcagg

SEQ ID NO: 89150 - DNA, 25 bp, mus musculus
ccttgcctgcactctctaccatgtg

SEQ ID NO: 89151 - DNA, 25 bp, mus musculus
ccatgtgaccatgagcactgctcta

SEQ ID NO: 89152 - DNA, 25 bp, mus musculus
tgtgaccatgagcactgctctaggg

SEQ ID NO: 89153 - DNA, 25 bp, mus musculus
gaccatgagcactgctctagggaca

SEQ ID NO: 89154 - DNA, 25 bp, mus musculus
tctccttccagaagttggaaatcaa

SEQ ID NO: 89155 - DNA, 25 bp, mus musculus
tactctaccatagctctttcagtgt

SEQ ID NO: 89156 - DNA, 25 bp, mus musculus
ctctaccatagctctttcagtgtaa

SEQ ID NO: 89157 - DNA, 25 bp, mus musculus
ggaccactctgtgtctcctttcatg

SEQ ID NO: 89158 - DNA, 25 bp, mus musculus
cactctgtgtctcctttcatgagaa

SEQ ID NO: 89159 - DNA, 25 bp, mus musculus
gaatttcaggcgattggaagaatca

SEQ ID NO: 89160 - DNA, 25 bp, mus musculus
agaatcagttcactgtagcccagta

SEQ ID NO: 89161 - DNA, 25 bp, mus musculus
aatcagttcactgtagcccagtatg

SEQ ID NO: 89162 - DNA, 25 bp, mus musculus
tcagttcactgtagcccagtatgag

SEQ ID NO: 89163 - DNA, 25 bp, mus musculus
agttcactgtagcccagtatgagaa

SEQ ID NO: 89164 - DNA, 25 bp, mus musculus
ttcactgtagcccagtatgagaaat

SEQ ID NO: 89165 - DNA, 25 bp, mus musculus
cactgtagcccagtatgagaaattt

SEQ ID NO: 89166 - DNA, 25 bp, mus musculus
ctgtagcccagtatgagaaatttga

SEQ ID NO: 89167 - DNA, 25 bp, mus musculus
ctaccatagctctttcagtgtaatg

SEQ ID NO: 89168 - DNA, 25 bp, mus musculus
gattcaacactgaagtttagatcag

SEQ ID NO: 89169 - DNA, 25 bp, mus musculus
accatagctctttcagtgtaatgaa

SEQ ID NO: 89170 - DNA, 25 bp, mus musculus
tagctctttcagtgtaatgaaggag

SEQ ID NO: 89171 - DNA, 25 bp, mus musculus
gtgcaaattacactactatgatgaa

SEQ ID NO: 89172 - DNA, 25 bp, mus musculus
gcaaattacactactatgatgaaag

SEQ ID NO: 89173 - DNA, 25 bp, mus musculus
agagatggaccactctgtgtctcct

SEQ ID NO: 89174 - DNA, 25 bp, mus musculus
agatggaccactctgtgtctccttt

SEQ ID NO: 89175 - DNA, 25 bp, mus musculus
atggaccactctgtgtctcctttca

SEQ ID NO: 89176 - DNA, 25 bp, mus musculus
ttcaaggctagcctgagctacttta

SEQ ID NO: 89177 - DNA, 25 bp, mus musculus
cttctccccagaagagcagagagcc

SEQ ID NO: 89178 - DNA, 25 bp, mus musculus
agtcatctacccaggtcaggctggg

SEQ ID NO: 89179 - DNA, 25 bp, mus musculus
catctacccaggtcaggctgggaag

SEQ ID NO: 89180 - DNA, 25 bp, mus musculus
ccaggagcctcgcctggaatctcct

SEQ ID NO: 89181 - DNA, 25 bp, mus musculus
tcgcctggaatctcctcatttgcac

SEQ ID NO: 89182 - DNA, 25 bp, mus musculus
tcatttgcaccaggtctgacctctc

SEQ ID NO: 89183 - DNA, 25 bp, mus musculus
ggtgtgcaccagtgccacaaagatg

SEQ ID NO: 89184 - DNA, 25 bp, mus musculus
gtgcaccagtgccacaaagatgtca

SEQ ID NO: 89185 - DNA, 25 bp, mus musculus
caccagtgccacaaagatgtcactg

SEQ ID NO: 89186 - DNA, 25 bp, mus musculus
tgccacaaagatgtcactggttaag

SEQ ID NO: 89187 - DNA, 25 bp, mus musculus
tagaagcctttggtcctgtaagact

SEQ ID NO: 89188 - DNA, 25 bp, mus musculus
ctccccagaagagcagagagcccca

SEQ ID NO: 89189 - DNA, 25 bp, mus musculus
gcagagagccccaggatccagccta

SEQ ID NO: 89190 - DNA, 25 bp, mus musculus
gagagccccaggatccagcctaaac

SEQ ID NO: 89191 - DNA, 25 bp, mus musculus
ccctgtaccctctatcctggtcagg

SEQ ID NO: 89192 - DNA, 25 bp, mus musculus
tgtaccctctatcctggtcaggatg

SEQ ID NO: 89193 - DNA, 25 bp, mus musculus
tgtctgactggggaaccaagtcatc

SEQ ID NO: 89194 - DNA, 25 bp, mus musculus
gaaccaagtcatctacccaggtcag

SEQ ID NO: 89195 - DNA, 25 bp, mus musculus
ccaagtcatctacccaggtcaggct

SEQ ID NO: 89196 - DNA, 25 bp, mus musculus
tagatttccatcaatactataccca

SEQ ID NO: 89197 - DNA, 25 bp, mus musculus
atttccatcaatactatacccatcg

SEQ ID NO: 89198 - DNA, 25 bp, mus musculus
ttagtatcaaactcataatgctaat

SEQ ID NO: 89199 - DNA, 25 bp, mus musculus
gtatcaaactcataatgctaattca

SEQ ID NO: 89200 - DNA, 25 bp, mus musculus
tcaaactcataatgctaattcacac

SEQ ID NO: 89201 - DNA, 25 bp, mus musculus
aactcataatgctaattcacacagc

SEQ ID NO: 89202 - DNA, 25 bp, mus musculus
tcataatgctaattcacacagcatc

SEQ ID NO: 89203 - DNA, 25 bp, mus musculus
taatgctaattcacacagcatcagg

SEQ ID NO: 89204 - DNA, 25 bp, mus musculus
tgctaattcacacagcatcaggacg

SEQ ID NO: 89205 - DNA, 25 bp, mus musculus
taattcacacagcatcaggacgaac

SEQ ID NO: 89206 - DNA, 25 bp, mus musculus
ttcacacagcatcaggacgaacatg

SEQ ID NO: 89207 - DNA, 25 bp, mus musculus
acacagcatcaggacgaacatgaac

SEQ ID NO: 89208 - DNA, 25 bp, mus musculus
tccatcaatactatacccatcgctc

SEQ ID NO: 89209 - DNA, 25 bp, mus musculus
atcaatactatacccatcgctcaat

SEQ ID NO: 89210 - DNA, 25 bp, mus musculus
aatactatacccatcgctcaatacg

SEQ ID NO: 89211 - DNA, 25 bp, mus musculus
atacccatcgctcaatacgcctaat

SEQ ID NO: 89212 - DNA, 25 bp, mus musculus
cccatcgctcaatacgcctaatcaa

SEQ ID NO: 89213 - DNA, 25 bp, mus musculus
atcgctcaatacgcctaatcaacaa

SEQ ID NO: 89214 - DNA, 25 bp, mus musculus
acaatcgtctcgagacttaccaata

SEQ ID NO: 89215 - DNA, 25 bp, mus musculus
gtctcgagacttaccaatactgact

SEQ ID NO: 89216 - DNA, 25 bp, mus musculus
tgacttacttagaggcctcaccaaa

SEQ ID NO: 89217 - DNA, 25 bp, mus musculus
cttacttagaggcctcaccaaactg

SEQ ID NO: 89218 - DNA, 25 bp, mus musculus
tagcccatctagtgctcccaggaag

SEQ ID NO: 89219 - DNA, 25 bp, mus musculus
tagtgctcccaggaagaaggatgga

SEQ ID NO: 89220 - DNA, 25 bp, mus musculus
aggatgtcctgtgtcatgctgtagc

SEQ ID NO: 89221 - DNA, 25 bp, mus musculus
tcctgtgtcatgctgtagcaaatag

SEQ ID NO: 89222 - DNA, 25 bp, mus musculus
gtgaccagacaagttctcggacagt

SEQ ID NO: 89223 - DNA, 25 bp, mus musculus
accagacaagttctcggacagttgc

SEQ ID NO: 89224 - DNA, 25 bp, mus musculus
agacaagttctcggacagttgctca

SEQ ID NO: 89225 - DNA, 25 bp, mus musculus
caagttctcggacagttgctcacac

SEQ ID NO: 89226 - DNA, 25 bp, mus musculus
gttctcggacagttgctcacactac

SEQ ID NO: 89227 - DNA, 25 bp, mus musculus
ctcggacagttgctcacactacttg

SEQ ID NO: 89228 - DNA, 25 bp, mus musculus
acttagaggcctcaccaaactgcgt

SEQ ID NO: 89229 - DNA, 25 bp, mus musculus
aggcctcaccaaactgcgtctcaat

SEQ ID NO: 89230 - DNA, 25 bp, mus musculus
cctcaccaaactgcgtctcaatgtc

SEQ ID NO: 89231 - DNA, 25 bp, mus musculus
caccaaactgcgtctcaatgtcgat

SEQ ID NO: 89232 - DNA, 25 bp, mus musculus
caaactgcgtctcaatgtcgatgag

SEQ ID NO: 89233 - DNA, 25 bp, mus musculus
gcgtctcaatgtcgatgaggcattt

SEQ ID NO: 89234 - DNA, 25 bp, mus musculus
atttgatcagctggtgcgcgctgtc

SEQ ID NO: 89235 - DNA, 25 bp, mus musculus
ataagaactctctcctagcccatct

SEQ ID NO: 89236 - DNA, 25 bp, mus musculus
tccacggggcaacttttcagtatct

SEQ ID NO: 89237 - DNA, 25 bp, mus musculus
tcaagagcaactccattgtgctggg

SEQ ID NO: 89238 - DNA, 25 bp, mus musculus
gcatcttcgcattgctgctcggcct

SEQ ID NO: 89239 - DNA, 25 bp, mus musculus
tcgcattgctgctcggcctgacggg

SEQ ID NO: 89240 - DNA, 25 bp, mus musculus
gcttcaccctgttcctcaaatacca

SEQ ID NO: 89241 - DNA, 25 bp, mus musculus
aataccaaagccgagtgaagtactg

SEQ ID NO: 89242 - DNA, 25 bp, mus musculus
atctaaaggacccagaccaattcat

SEQ ID NO: 89243 - DNA, 25 bp, mus musculus
aggacccagaccaattcatcttaga

SEQ ID NO: 89244 - DNA, 25 bp, mus musculus
cagaccaattcatcttagaggtctt

SEQ ID NO: 89245 - DNA, 25 bp, mus musculus
aattcatcttagaggtcttggacaa

SEQ ID NO: 89246 - DNA, 25 bp, mus musculus
tgtcaattatttcttctccagaaaa

SEQ ID NO: 89247 - DNA, 25 bp, mus musculus
ttatttcttctccagaaaaggagcg

SEQ ID NO: 89248 - DNA, 25 bp, mus musculus
gcaactccattgtgctgggcaatct

SEQ ID NO: 89249 - DNA, 25 bp, mus musculus
ccattgtgctgggcaatctgaagcc

SEQ ID NO: 89250 - DNA, 25 bp, mus musculus
aaatccgaccacatgggctcttgag

SEQ ID NO: 89251 - DNA, 25 bp, mus musculus
ccgccaggctgcagcaagtcatcct

SEQ ID NO: 89252 - DNA, 25 bp, mus musculus
ggctgcagcaagtcatcctgattcc

SEQ ID NO: 89253 - DNA, 25 bp, mus musculus
agcaagtcatcctgattccgttggg

SEQ ID NO: 89254 - DNA, 25 bp, mus musculus
tcatcctgattccgttgggcatctt

SEQ ID NO: 89255 - DNA, 25 bp, mus musculus
cgttgggcatcttcgcattgctgct

SEQ ID NO: 89256 - DNA, 25 bp, mus musculus
cccagtctgtggagatgcgagaaat

SEQ ID NO: 89257 - DNA, 25 bp, mus musculus
gtactgatggctactcagacagcga

SEQ ID NO: 89258 - DNA, 25 bp, mus musculus
ccaaagcccggcgactggatgacta

SEQ ID NO: 89259 - DNA, 25 bp, mus musculus
aagcccggcgactggatgactactc

SEQ ID NO: 89260 - DNA, 25 bp, mus musculus
tggatgactactcactagagcgggt

SEQ ID NO: 89261 - DNA, 25 bp, mus musculus
gcacctctgagcgctctctgggccg

SEQ ID NO: 89262 - DNA, 25 bp, mus musculus
cctctgagcgctctctgggccgata

SEQ ID NO: 89263 - DNA, 25 bp, mus musculus
ctctgggccgatacactgatgtgga

SEQ ID NO: 89264 - DNA, 25 bp, mus musculus
tgggccgatacactgatgtggacac

SEQ ID NO: 89265 - DNA, 25 bp, mus musculus
gcatgaccacccaatcgggtgacct

SEQ ID NO: 89266 - DNA, 25 bp, mus musculus
cgggtgacctgccctccaaagatcg

SEQ ID NO: 89267 - DNA, 25 bp, mus musculus
gggagcacacgacacacagacagta

SEQ ID NO: 89268 - DNA, 25 bp, mus musculus
gctactcagacagcgaacactacct

SEQ ID NO: 89269 - DNA, 25 bp, mus musculus
ggagcacacgacacacagacagtag

SEQ ID NO: 89270 - DNA, 25 bp, mus musculus
gaaatgacctcagtaccatctctga

SEQ ID NO: 89271 - DNA, 25 bp, mus musculus
atgacctcagtaccatctctgatac

SEQ ID NO: 89272 - DNA, 25 bp, mus musculus
acctcagtaccatctctgataccag

SEQ ID NO: 89273 - DNA, 25 bp, mus musculus
tgaagcgctcagcctctgtgctggg

SEQ ID NO: 89274 - DNA, 25 bp, mus musculus
agcgctcagcctctgtgctgggacc

SEQ ID NO: 89275 - DNA, 25 bp, mus musculus
cctctgtgctgggacccaaagcccg

SEQ ID NO: 89276 - DNA, 25 bp, mus musculus
tgctgggacccaaagcccggcgact

SEQ ID NO: 89277 - DNA, 25 bp, mus musculus
gcccttagcacagagagggagatgc

SEQ ID NO: 89278 - DNA, 25 bp, mus musculus
tgcatttctgttgatacgttgccca

SEQ ID NO: 89279 - DNA, 25 bp, mus musculus
tcacttatagtgggctcatcaggag

SEQ ID NO: 89280 - DNA, 25 bp, mus musculus
ttatagtgggctcatcaggaggagc

SEQ ID NO: 89281 - DNA, 25 bp, mus musculus
tgcctccttggtctctagaggtatt

SEQ ID NO: 89282 - DNA, 25 bp, mus musculus
tccttggtctctagaggtattgaga

SEQ ID NO: 89283 - DNA, 25 bp, mus musculus
cttggtctctagaggtattgagaca

SEQ ID NO: 89284 - DNA, 25 bp, mus musculus
gcttggacctttgcagggaggccat

SEQ ID NO: 89285 - DNA, 25 bp, mus musculus
tatttaactgcaataaactggccag

SEQ ID NO: 89286 - DNA, 25 bp, mus musculus
actgcaataaactggccagtgtggc

SEQ ID NO: 89287 - DNA, 25 bp, mus musculus
tgcaataaactggccagtgtggccc

SEQ ID NO: 89288 - DNA, 25 bp, mus musculus
caataaactggccagtgtggccccg

SEQ ID NO: 89289 - DNA, 25 bp, mus musculus
catttctgttgatacgttgcccact

SEQ ID NO: 89290 - DNA, 25 bp, mus musculus
tctgttgatacgttgcccactaccc

SEQ ID NO: 89291 - DNA, 25 bp, mus musculus
tgttgatacgttgcccactaccctc

SEQ ID NO: 89292 - DNA, 25 bp, mus musculus
ctcctccatgcgaaaacgatgccca

SEQ ID NO: 89293 - DNA, 25 bp, mus musculus
caccagcccatcacttatagtgggc

SEQ ID NO: 89294 - DNA, 25 bp, mus musculus
agcccatcacttatagtgggctcat

SEQ ID NO: 89295 - DNA, 25 bp, mus musculus
cccatcacttatagtgggctcatca

SEQ ID NO: 89296 - DNA, 25 bp, mus musculus
catcacttatagtgggctcatcagg

SEQ ID NO: 89297 - DNA, 25 bp, mus musculus
acctggcggagctggaccagctgct

SEQ ID NO: 89298 - DNA, 25 bp, mus musculus
tctccgagggcttggcccaaggcaa

SEQ ID NO: 89299 - DNA, 25 bp, mus musculus
tttggccacgctacgtgaaggtggg

SEQ ID NO: 89300 - DNA, 25 bp, mus musculus
gcagctgcttcagcaagcgctcctg

SEQ ID NO: 89301 - DNA, 25 bp, mus musculus
gctgcttcagcaagcgctcctgctc

SEQ ID NO: 89302 - DNA, 25 bp, mus musculus
gcttcagcaagcgctcctgctctgt

SEQ ID NO: 89303 - DNA, 25 bp, mus musculus
gcaagcgctcctgctctgtgcccga

SEQ ID NO: 89304 - DNA, 25 bp, mus musculus
agccatccaagtctgtgcacctcac

SEQ ID NO: 89305 - DNA, 25 bp, mus musculus
catccaagtctgtgcacctcacggt

SEQ ID NO: 89306 - DNA, 25 bp, mus musculus
ggattcccatccagtaccccatcat

SEQ ID NO: 89307 - DNA, 25 bp, mus musculus
accccatcatttccgagtgtaagtg

SEQ ID NO: 89308 - DNA, 25 bp, mus musculus
tcatttccgagtgtaagtgttcctg

SEQ ID NO: 89309 - DNA, 25 bp, mus musculus
gcttggcccaaggcaagaaacagcg

SEQ ID NO: 89310 - DNA, 25 bp, mus musculus
aacagcgcctgagcaagaagctgag

SEQ ID NO: 89311 - DNA, 25 bp, mus musculus
agatgtggctgtggtcacagacctt

SEQ ID NO: 89312 - DNA, 25 bp, mus musculus
agaccttctgcccggtgctgtacgc

SEQ ID NO: 89313 - DNA, 25 bp, mus musculus
cggtgctgtacgcgtggaatgacct

SEQ ID NO: 89314 - DNA, 25 bp, mus musculus
tgctgtacgcgtggaatgacctagg

SEQ ID NO: 89315 - DNA, 25 bp, mus musculus
taggcagccgcttttggccacgcta

SEQ ID NO: 89316 - DNA, 25 bp, mus musculus
gccgcttttggccacgctacgtgaa

SEQ ID NO: 89317 - DNA, 25 bp, mus musculus
acagtctgccatcacgactctgctc

SEQ ID NO: 89318 - DNA, 25 bp, mus musculus
catcacgactctgctcgcgacgatc

SEQ ID NO: 89319 - DNA, 25 bp, mus musculus
catgactgcatatggcacagactcg

SEQ ID NO: 89320 - DNA, 25 bp, mus musculus
atatggcacagactcgatggataag

SEQ ID NO: 89321 - DNA, 25 bp, mus musculus
tggcacagactcgatggataaggcc

SEQ ID NO: 89322 - DNA, 25 bp, mus musculus
cacagactcgatggataaggccagg

SEQ ID NO: 89323 - DNA, 25 bp, mus musculus
agtcaacgacacgtagtaagacact

SEQ ID NO: 89324 - DNA, 25 bp, mus musculus
gtaagacactcgagcagctgacacc

SEQ ID NO: 89325 - DNA, 25 bp, mus musculus
tcgagcagctgacaccgctcgtcag

SEQ ID NO: 89326 - DNA, 25 bp, mus musculus
agcagctgacaccgctcgtcaggtc

SEQ ID NO: 89327 - DNA, 25 bp, mus musculus
cgctcgtcaggtcagccgggactcg

SEQ ID NO: 89328 - DNA, 25 bp, mus musculus
ggactcgtctggtgacactgctcca

SEQ ID NO: 89329 - DNA, 25 bp, mus musculus
cacgactctgctcgcgacgatcgca

SEQ ID NO: 89330 - DNA, 25 bp, mus musculus
tgacactgctccaggaggctgctga

SEQ ID NO: 89331 - DNA, 25 bp, mus musculus
gacgatcgcactgctggccaccatc

SEQ ID NO: 89332 - DNA, 25 bp, mus musculus
gctggccaccatctgcagccaggca

SEQ ID NO: 89333 - DNA, 25 bp, mus musculus
catctgcagccaggcaggagctccg

SEQ ID NO: 89334 - DNA, 25 bp, mus musculus
gatgctgttcactcggtactcgcag

SEQ ID NO: 89335 - DNA, 25 bp, mus musculus
gctgttcactcggtactcgcagagc

SEQ ID NO: 89336 - DNA, 25 bp, mus musculus
tcggtactcgcagagcatgactgca

SEQ ID NO: 89337 - DNA, 25 bp, mus musculus
gtactcgcagagcatgactgcatat

SEQ ID NO: 89338 - DNA, 25 bp, mus musculus
acttgaattcaccttaagcaggatg

SEQ ID NO: 89339 - DNA, 25 bp, mus musculus
gtcttaaagccaggtcacttgctgg

SEQ ID NO: 89340 - DNA, 25 bp, mus musculus
agcattcagtgattcctgcctgttc

SEQ ID NO: 89341 - DNA, 25 bp, mus musculus
ttcctgcctgttcatcaagagtatg

SEQ ID NO: 89342 - DNA, 25 bp, mus musculus
tattagcatcttacatttatcaact

SEQ ID NO: 89343 - DNA, 25 bp, mus musculus
acatttatcaactttgtggcacttt

SEQ ID NO: 89344 - DNA, 25 bp, mus musculus
atcaactttgtggcactttgtgata

SEQ ID NO: 89345 - DNA, 25 bp, mus musculus
tttgtggcactttgtgatacaaatg

SEQ ID NO: 89346 - DNA, 25 bp, mus musculus
ttgggtgtcttcctactatgccatt

SEQ ID NO: 89347 - DNA, 25 bp, mus musculus
ctactatgccattatttctctgaca

SEQ ID NO: 89348 - DNA, 25 bp, mus musculus
tgccattatttctctgacacttaag

SEQ ID NO: 89349 - DNA, 25 bp, mus musculus
tatttctctgacacttaagaaagaa

SEQ ID NO: 89350 - DNA, 25 bp, mus musculus
aagccaggtcacttgctggctggaa

SEQ ID NO: 89351 - DNA, 25 bp, mus musculus
attcatttgatgaccagcttgccaa

SEQ ID NO: 89352 - DNA, 25 bp, mus musculus
accagcttgccaagagtcctgtccc

SEQ ID NO: 89353 - DNA, 25 bp, mus musculus
ttgccaagagtcctgtcccctactg

SEQ ID NO: 89354 - DNA, 25 bp, mus musculus
agagtcctgtcccctactgatgtgt

SEQ ID NO: 89355 - DNA, 25 bp, mus musculus
ttcttatagctgcctacatgttttg

SEQ ID NO: 89356 - DNA, 25 bp, mus musculus
gttcttttcattgcactgagcattc

SEQ ID NO: 89357 - DNA, 25 bp, mus musculus
ttcattgcactgagcattcagtgat

SEQ ID NO: 89358 - DNA, 25 bp, mus musculus
cctaggagggctgcacctgaccttg

SEQ ID NO: 89359 - DNA, 25 bp, mus musculus
gcacctgaccttggactgggccgtg

SEQ ID NO: 89360 - DNA, 25 bp, mus musculus
gtgcatctgagaccctgaagagcag

SEQ ID NO: 89361 - DNA, 25 bp, mus musculus
catctgagaccctgaagagcaggga

SEQ ID NO: 89362 - DNA, 25 bp, mus musculus
agaccctgaagagcagggaactgag

SEQ ID NO: 89363 - DNA, 25 bp, mus musculus
tgagatcctgggttctggggtctct

SEQ ID NO: 89364 - DNA, 25 bp, mus musculus
gggttctggggtctctatgaaatct

SEQ ID NO: 89365 - DNA, 25 bp, mus musculus
tatgaaatctgttcacagtgtcttc

SEQ ID NO: 89366 - DNA, 25 bp, mus musculus
gaaatctgttcacagtgtcttcctc

SEQ ID NO: 89367 - DNA, 25 bp, mus musculus
atctgttcacagtgtcttcctcact

SEQ ID NO: 89368 - DNA, 25 bp, mus musculus
tgttcacagtgtcttcctcacttcc

SEQ ID NO: 89369 - DNA, 25 bp, mus musculus
cagtgtcttcctcacttcctacatt

SEQ ID NO: 89370 - DNA, 25 bp, mus musculus
gactcgactgtgactcgggactgaa

SEQ ID NO: 89371 - DNA, 25 bp, mus musculus
tcgactgtgactcgggactgaaaac

SEQ ID NO: 89372 - DNA, 25 bp, mus musculus
gactgaaaaccaccatcgataccgc

SEQ ID NO: 89373 - DNA, 25 bp, mus musculus
acacccagctagacagtctttccag

SEQ ID NO: 89374 - DNA, 25 bp, mus musculus
cccagctagacagtctttccagtag

SEQ ID NO: 89375 - DNA, 25 bp, mus musculus
agctagacagtctttccagtagacc

SEQ ID NO: 89376 - DNA, 25 bp, mus musculus
tagacagtctttccagtagacctgg

SEQ ID NO: 89377 - DNA, 25 bp, mus musculus
tgggtgcatctgagaccctgaagag

SEQ ID NO: 89378 - DNA, 25 bp, mus musculus
tgactattcttgggcgatttgatta

SEQ ID NO: 89379 - DNA, 25 bp, mus musculus
attacagccagtgtgacatttggta

SEQ ID NO: 89380 - DNA, 25 bp, mus musculus
cccatcataaatgtggcgcggctat

SEQ ID NO: 89381 - DNA, 25 bp, mus musculus
gcagcatcctcatagctgtctgcga

SEQ ID NO: 89382 - DNA, 25 bp, mus musculus
gcatcctcatagctgtctgcgatga

SEQ ID NO: 89383 - DNA, 25 bp, mus musculus
tcatagctgtctgcgatgatgccag

SEQ ID NO: 89384 - DNA, 25 bp, mus musculus
ctgtctgcgatgatgccagcatttg

SEQ ID NO: 89385 - DNA, 25 bp, mus musculus
gcgatgatgccagcatttggcgatg

SEQ ID NO: 89386 - DNA, 25 bp, mus musculus
aattagtctgttgtctgtaaaatag

SEQ ID NO: 89387 - DNA, 25 bp, mus musculus
atgtatcttgctagtaagggcacat

SEQ ID NO: 89388 - DNA, 25 bp, mus musculus
ttttcagcattcgatcaggctgagc

SEQ ID NO: 89389 - DNA, 25 bp, mus musculus
gtactgtcttcctgctcggacttta

SEQ ID NO: 89390 - DNA, 25 bp, mus musculus
acagccagtgtgacatttggtacat

SEQ ID NO: 89391 - DNA, 25 bp, mus musculus
agatgcttgcattgggcaatcaggt

SEQ ID NO: 89392 - DNA, 25 bp, mus musculus
aagatcctcataaagccaaatgcac

SEQ ID NO: 89393 - DNA, 25 bp, mus musculus
atcctcataaagccaaatgcacaac

SEQ ID NO: 89394 - DNA, 25 bp, mus musculus
aagccaaatgcacaacactgaccca

SEQ ID NO: 89395 - DNA, 25 bp, mus musculus
ccaaatgcacaacactgacccatca

SEQ ID NO: 89396 - DNA, 25 bp, mus musculus
caacactgacccatcataaatgtgg

SEQ ID NO: 89397 - DNA, 25 bp, mus musculus
cactgacccatcataaatgtggcgc

SEQ ID NO: 89398 - DNA, 25 bp, mus musculus
accttttgtgctgagtccgtctaga

SEQ ID NO: 89399 - DNA, 25 bp, mus musculus
ttttgtgctgagtccgtctagaggc

SEQ ID NO: 89400 - DNA, 25 bp, mus musculus
agctgtggcttcaaccagcctgagg

SEQ ID NO: 89401 - DNA, 25 bp, mus musculus
ggcttcaaccagcctgaggtggacg

SEQ ID NO: 89402 - DNA, 25 bp, mus musculus
aaccagcctgaggtggacggcagag

SEQ ID NO: 89403 - DNA, 25 bp, mus musculus
cagcctgaggtggacggcagagctc

SEQ ID NO: 89404 - DNA, 25 bp, mus musculus
aagtctgggctacttctgctttgga

SEQ ID NO: 89405 - DNA, 25 bp, mus musculus
tctgggctacttctgctttggaaag

SEQ ID NO: 89406 - DNA, 25 bp, mus musculus
gggctacttctgctttggaaagctg

SEQ ID NO: 89407 - DNA, 25 bp, mus musculus
ctacttctgctttggaaagctgctg

SEQ ID NO: 89408 - DNA, 25 bp, mus musculus
cttctgctttggaaagctgctgcgg

SEQ ID NO: 89409 - DNA, 25 bp, mus musculus
aaagctgctgcggaacactgagggg

SEQ ID NO: 89410 - DNA, 25 bp, mus musculus
gagtccgtctagaggccaccagttc

SEQ ID NO: 89411 - DNA, 25 bp, mus musculus
gctgctgcggaacactgaggggtcc

SEQ ID NO: 89412 - DNA, 25 bp, mus musculus
aggccaccagttcctcacagctcag

SEQ ID NO: 89413 - DNA, 25 bp, mus musculus
ccagttcctcacagctcagcagagc

SEQ ID NO: 89414 - DNA, 25 bp, mus musculus
gttcctcacagctcagcagagctgg

SEQ ID NO: 89415 - DNA, 25 bp, mus musculus
cacagctcagcagagctggaagaaa

SEQ ID NO: 89416 - DNA, 25 bp, mus musculus
gaaagtcagtcaacactgaggaacc

SEQ ID NO: 89417 - DNA, 25 bp, mus musculus
agtcagtcaacactgaggaaccaca

SEQ ID NO: 89418 - DNA, 25 bp, mus musculus
gaagaccgctgggcctgaagaggct

SEQ ID NO: 89419 - DNA, 25 bp, mus musculus
tacaccacaggtgtcacttctcgcc

SEQ ID NO: 89420 - DNA, 25 bp, mus musculus
accacaggtgtcacttctcgcctga

SEQ ID NO: 89421 - DNA, 25 bp, mus musculus
accgtgactgggcttccagatggag

SEQ ID NO: 89422 - DNA, 25 bp, mus musculus
gtgactgggcttccagatggagccg

SEQ ID NO: 89423 - DNA, 25 bp, mus musculus
actgggcttccagatggagccgccc

SEQ ID NO: 89424 - DNA, 25 bp, mus musculus
cccacaggcactgagtacgagactc

SEQ ID NO: 89425 - DNA, 25 bp, mus musculus
gagtacgagactctcactgctaagt

SEQ ID NO: 89426 - DNA, 25 bp, mus musculus
gagactctcactgctaagtttcact

SEQ ID NO: 89427 - DNA, 25 bp, mus musculus
actctcactgctaagtttcacttcg

SEQ ID NO: 89428 - DNA, 25 bp, mus musculus
gctaagtttcacttcgtggacttgg

SEQ ID NO: 89429 - DNA, 25 bp, mus musculus
aagtttcacttcgtggacttggctg

SEQ ID NO: 89430 - DNA, 25 bp, mus musculus
tttcacttcgtggacttggctggct

SEQ ID NO: 89431 - DNA, 25 bp, mus musculus
ggtgtcacttctcgcctgatcaact

SEQ ID NO: 89432 - DNA, 25 bp, mus musculus
ttcgtggacttggctggctcagagc

SEQ ID NO: 89433 - DNA, 25 bp, mus musculus
acttctcgcctgatcaactcccagg

SEQ ID NO: 89434 - DNA, 25 bp, mus musculus
atccagtgcctgaagcagggcgccc

SEQ ID NO: 89435 - DNA, 25 bp, mus musculus
gtacagagctcccgatcccatgcca

SEQ ID NO: 89436 - DNA, 25 bp, mus musculus
accatccacctgtgccagatgcgcg

SEQ ID NO: 89437 - DNA, 25 bp, mus musculus
gcccagcctgacctggtgaatgaga

SEQ ID NO: 89438 - DNA, 25 bp, mus musculus
cagcctgacctggtgaatgagaccg

SEQ ID NO: 89439 - DNA, 25 bp, mus musculus
aatgagaccgtgactgggcttccag

SEQ ID NO: 89440 - DNA, 25 bp, mus musculus
gtacacaccttagttacttcatttg

SEQ ID NO: 89441 - DNA, 25 bp, mus musculus
gttacttcatttggctccgttggct

SEQ ID NO: 89442 - DNA, 25 bp, mus musculus
ttgaacacagtattctcccagtcca

SEQ ID NO: 89443 - DNA, 25 bp, mus musculus
atgcagtgtctttctttggtgcctt

SEQ ID NO: 89444 - DNA, 25 bp, mus musculus
tctttggtgcctttcctgttcagca

SEQ ID NO: 89445 - DNA, 25 bp, mus musculus
gtgcctttcctgttcagcattctca

SEQ ID NO: 89446 - DNA, 25 bp, mus musculus
ttcagcattctcagcctgtggcagt

SEQ ID NO: 89447 - DNA, 25 bp, mus musculus
attctcagcctgtggcagtaaagag

SEQ ID NO: 89448 - DNA, 25 bp, mus musculus
ctcttcagttggtgtgtttccggat

SEQ ID NO: 89449 - DNA, 25 bp, mus musculus
ttacactgttagacactatttttca

SEQ ID NO: 89450 - DNA, 25 bp, mus musculus
tgttagacactatttttcagaatct

SEQ ID NO: 89451 - DNA, 25 bp, mus musculus
acactatttttcagaatctgaatgt

SEQ ID NO: 89452 - DNA, 25 bp, mus musculus
tcatttggctccgttggcttgtgtt

SEQ ID NO: 89453 - DNA, 25 bp, mus musculus
ctaccagttcactccagtgccattg

SEQ ID NO: 89454 - DNA, 25 bp, mus musculus
gttcactccagtgccattgtcttta

SEQ ID NO: 89455 - DNA, 25 bp, mus musculus
tccagtgccattgtctttatatgaa

SEQ ID NO: 89456 - DNA, 25 bp, mus musculus
ctcttccatggtagcgctcaaagcc

SEQ ID NO: 89457 - DNA, 25 bp, mus musculus
agcgctcaaagccctaatggaagtt

SEQ ID NO: 89458 - DNA, 25 bp, mus musculus
aatagccctattctctgcttgaaca

SEQ ID NO: 89459 - DNA, 25 bp, mus musculus
cctattctctgcttgaacacagtat

SEQ ID NO: 89460 - DNA, 25 bp, mus musculus
cctttgacatcgatgccatcggatc

SEQ ID NO: 89461 - DNA, 25 bp, mus musculus
ctttgacatcgatgccatcggatcg

SEQ ID NO: 89462 - DNA, 25 bp, mus musculus
atgccatcggatcgcttaacgtcac

SEQ ID NO: 89463 - DNA, 25 bp, mus musculus
tgccatcggatcgcttaacgtcact

SEQ ID NO: 89464 - DNA, 25 bp, mus musculus
ccatcggatcgcttaacgtcactgc

SEQ ID NO: 89465 - DNA, 25 bp, mus musculus
catcggatcgcttaacgtcactgct

SEQ ID NO: 89466 - DNA, 25 bp, mus musculus
atcggatcgcttaacgtcactgctg

SEQ ID NO: 89467 - DNA, 25 bp, mus musculus
tcggatcgcttaacgtcactgctgc

SEQ ID NO: 89468 - DNA, 25 bp, mus musculus
ggatcgcttaacgtcactgctgccg

SEQ ID NO: 89469 - DNA, 25 bp, mus musculus
atcgcttaacgtcactgctgccgac

SEQ ID NO: 89470 - DNA, 25 bp, mus musculus
gtataagatcaccattgccaacgac

SEQ ID NO: 89471 - DNA, 25 bp, mus musculus
tataagatcaccattgccaacgaca

SEQ ID NO: 89472 - DNA, 25 bp, mus musculus
tttgacatcgatgccatcggatcgc

SEQ ID NO: 89473 - DNA, 25 bp, mus musculus
ttgacatcgatgccatcggatcgct

SEQ ID NO: 89474 - DNA, 25 bp, mus musculus
gacatcgatgccatcggatcgctta

SEQ ID NO: 89475 - DNA, 25 bp, mus musculus
acatcgatgccatcggatcgcttaa

SEQ ID NO: 89476 - DNA, 25 bp, mus musculus
catcgatgccatcggatcgcttaac

SEQ ID NO: 89477 - DNA, 25 bp, mus musculus
atcgatgccatcggatcgcttaacg

SEQ ID NO: 89478 - DNA, 25 bp, mus musculus
cgatgccatcggatcgcttaacgtc

SEQ ID NO: 89479 - DNA, 25 bp, mus musculus
gatgccatcggatcgcttaacgtca

SEQ ID NO: 89480 - DNA, 25 bp, mus musculus
tgcacctgactgacctggatgatga

SEQ ID NO: 89481 - DNA, 25 bp, mus musculus
aaatcatcatggctgccccactgag

SEQ ID NO: 89482 - DNA, 25 bp, mus musculus
acatgaccggcaaatgcaagtcctg

SEQ ID NO: 89483 - DNA, 25 bp, mus musculus
ccggcaaatgcaagtcctggatgac

SEQ ID NO: 89484 - DNA, 25 bp, mus musculus
gcaaatgcaagtcctggatgactcc

SEQ ID NO: 89485 - DNA, 25 bp, mus musculus
aatgcaagtcctggatgactccatg

SEQ ID NO: 89486 - DNA, 25 bp, mus musculus
agtcctggatgactccatgtccgga

SEQ ID NO: 89487 - DNA, 25 bp, mus musculus
cctggatgactccatgtccggagag

SEQ ID NO: 89488 - DNA, 25 bp, mus musculus
ggatgactccatgtccggagagaag

SEQ ID NO: 89489 - DNA, 25 bp, mus musculus
gtatgtactaacttctccagaggca

SEQ ID NO: 89490 - DNA, 25 bp, mus musculus
tgtactaacttctccagaggcaagt

SEQ ID NO: 89491 - DNA, 25 bp, mus musculus
ttctccagaggcaagttcaaggttt

SEQ ID NO: 89492 - DNA, 25 bp, mus musculus
tggctgccccactgaggataacaga

SEQ ID NO: 89493 - DNA, 25 bp, mus musculus
ctgccccactgaggataacagatgt

SEQ ID NO: 89494 - DNA, 25 bp, mus musculus
cagatgtcacttccggactgctagg

SEQ ID NO: 89495 - DNA, 25 bp, mus musculus
atgtcacttccggactgctaggggg

SEQ ID NO: 89496 - DNA, 25 bp, mus musculus
atggcatgtataccaccttaggtga

SEQ ID NO: 89497 - DNA, 25 bp, mus musculus
tgtataccaccttaggtgacatgac

SEQ ID NO: 89498 - DNA, 25 bp, mus musculus
ataccaccttaggtgacatgaccgg

SEQ ID NO: 89499 - DNA, 25 bp, mus musculus
ccaccttaggtgacatgaccggcaa

SEQ ID NO: 89500 - DNA, 25 bp, mus musculus
tcagagtcctcacaaactgtccctt

SEQ ID NO: 89501 - DNA, 25 bp, mus musculus
gagtcctcacaaactgtcccttagg

SEQ ID NO: 89502 - DNA, 25 bp, mus musculus
ggacactggccctcaagagtgacta

SEQ ID NO: 89503 - DNA, 25 bp, mus musculus
cactggccctcaagagtgactacat

SEQ ID NO: 89504 - DNA, 25 bp, mus musculus
ccctcaagagtgactacattagtct

SEQ ID NO: 89505 - DNA, 25 bp, mus musculus
actacattagtctgctggcctcaag

SEQ ID NO: 89506 - DNA, 25 bp, mus musculus
acattagtctgctggcctcaagcac

SEQ ID NO: 89507 - DNA, 25 bp, mus musculus
ttagtctgctggcctcaagcactta

SEQ ID NO: 89508 - DNA, 25 bp, mus musculus
tggcctcaagcacttacctagccac

SEQ ID NO: 89509 - DNA, 25 bp, mus musculus
gcacttacctagccacggcctacat

SEQ ID NO: 89510 - DNA, 25 bp, mus musculus
cttacctagccacggcctacatctt

SEQ ID NO: 89511 - DNA, 25 bp, mus musculus
acctagccacggcctacatcttagt

SEQ ID NO: 89512 - DNA, 25 bp, mus musculus
tcctcacaaactgtcccttagggtg

SEQ ID NO: 89513 - DNA, 25 bp, mus musculus
actgtcccttagggtggcctgagct

SEQ ID NO: 89514 - DNA, 25 bp, mus musculus
ggcctgagctctctgccatatctgg

SEQ ID NO: 89515 - DNA, 25 bp, mus musculus
agctctctgccatatctgggaacgg

SEQ ID NO: 89516 - DNA, 25 bp, mus musculus
tctctgccatatctgggaacgggta

SEQ ID NO: 89517 - DNA, 25 bp, mus musculus
ctgccatatctgggaacgggtatga

SEQ ID NO: 89518 - DNA, 25 bp, mus musculus
tatctgggaacgggtatgagtggcc

SEQ ID NO: 89519 - DNA, 25 bp, mus musculus
tctggacactggccctcaagagtga

SEQ ID NO: 89520 - DNA, 25 bp, mus musculus
agaagtctcagaagccatgttgtca

SEQ ID NO: 89521 - DNA, 25 bp, mus musculus
aagtctcagaagccatgttgtcaga

SEQ ID NO: 89522 - DNA, 25 bp, mus musculus
atggcaaggtcgctctggcagcggc

SEQ ID NO: 89523 - DNA, 25 bp, mus musculus
gtcgctctggcagcggcgttgaact

SEQ ID NO: 89524 - DNA, 25 bp, mus musculus
cgctctggcagcggcgttgaacttg

SEQ ID NO: 89525 - DNA, 25 bp, mus musculus
ctctggcagcggcgttgaacttgag

SEQ ID NO: 89526 - DNA, 25 bp, mus musculus
ctgcgaccgcagagcaagtgggaaa

SEQ ID NO: 89527 - DNA, 25 bp, mus musculus
gggcatgcttcagcgactggacacg

SEQ ID NO: 89528 - DNA, 25 bp, mus musculus
gcatgcttcagcgactggacacgag

SEQ ID NO: 89529 - DNA, 25 bp, mus musculus
atgcttcagcgactggacacgagct

SEQ ID NO: 89530 - DNA, 25 bp, mus musculus
gcttcagcgactggacacgagcttt

SEQ ID NO: 89531 - DNA, 25 bp, mus musculus
ttcagcgactggacacgagctttct

SEQ ID NO: 89532 - DNA, 25 bp, mus musculus
gtctcagaagccatgttgtcagaag

SEQ ID NO: 89533 - DNA, 25 bp, mus musculus
ctcagaagccatgttgtcagaagct

SEQ ID NO: 89534 - DNA, 25 bp, mus musculus
ggaaggtcatcctccatggagaaca

SEQ ID NO: 89535 - DNA, 25 bp, mus musculus
aaggtcatcctccatggagaacacg

SEQ ID NO: 89536 - DNA, 25 bp, mus musculus
ggtcatcctccatggagaacacgct

SEQ ID NO: 89537 - DNA, 25 bp, mus musculus
tcatcctccatggagaacacgctgt

SEQ ID NO: 89538 - DNA, 25 bp, mus musculus
atcctccatggagaacacgctgtgg

SEQ ID NO: 89539 - DNA, 25 bp, mus musculus
cctccatggagaacacgctgtggtc

SEQ ID NO: 89540 - DNA, 25 bp, mus musculus
agtttacttccttaaatgtatgatg

SEQ ID NO: 89541 - DNA, 25 bp, mus musculus
ttacttccttaaatgtatgatgcct

SEQ ID NO: 89542 - DNA, 25 bp, mus musculus
acattcctggtgcgtgtcccatgtc

SEQ ID NO: 89543 - DNA, 25 bp, mus musculus
cctccaagtgcctgtcttaatgact

SEQ ID NO: 89544 - DNA, 25 bp, mus musculus
tgtcttaatgacttgtgtagttgga

SEQ ID NO: 89545 - DNA, 25 bp, mus musculus
cggttaatagccacgcctatattca

SEQ ID NO: 89546 - DNA, 25 bp, mus musculus
ttaatagccacgcctatattcaacc

SEQ ID NO: 89547 - DNA, 25 bp, mus musculus
gccacgcctatattcaaccagaata

SEQ ID NO: 89548 - DNA, 25 bp, mus musculus
acgcctatattcaaccagaatactt

SEQ ID NO: 89549 - DNA, 25 bp, mus musculus
cctatattcaaccagaatacttgtg

SEQ ID NO: 89550 - DNA, 25 bp, mus musculus
atattcaaccagaatacttgtgaaa

SEQ ID NO: 89551 - DNA, 25 bp, mus musculus
ttcaaccagaatacttgtgaaatca

SEQ ID NO: 89552 - DNA, 25 bp, mus musculus
atgtatgatgcctggttgtcatcag

SEQ ID NO: 89553 - DNA, 25 bp, mus musculus
gatgcctggttgtcatcagtgaatg

SEQ ID NO: 89554 - DNA, 25 bp, mus musculus
gtgaatgacagccttttctggatta

SEQ ID NO: 89555 - DNA, 25 bp, mus musculus
gacagccttttctggattacctaca

SEQ ID NO: 89556 - DNA, 25 bp, mus musculus
agccttttctggattacctacaatg

SEQ ID NO: 89557 - DNA, 25 bp, mus musculus
gacaaacttcaaacattcctggtgc

SEQ ID NO: 89558 - DNA, 25 bp, mus musculus
cttcaaacattcctggtgcgtgtcc

SEQ ID NO: 89559 - DNA, 25 bp, mus musculus
caaacattcctggtgcgtgtcccat

SEQ ID NO: 89560 - DNA, 25 bp, mus musculus
ttctctgcggaatcaccatggcggc

SEQ ID NO: 89561 - DNA, 25 bp, mus musculus
gcggaatcaccatggcggctgggac

SEQ ID NO: 89562 - DNA, 25 bp, mus musculus
ctcaatcggctgctcagtaaagcgg

SEQ ID NO: 89563 - DNA, 25 bp, mus musculus
tcaatcggctgctcagtaaagcggg

SEQ ID NO: 89564 - DNA, 25 bp, mus musculus
caatcggctgctcagtaaagcgggg

SEQ ID NO: 89565 - DNA, 25 bp, mus musculus
aatcggctgctcagtaaagcggggc

SEQ ID NO: 89566 - DNA, 25 bp, mus musculus
tagagcaatgccattgcccattttt

SEQ ID NO: 89567 - DNA, 25 bp, mus musculus
aggaaatactccaagggcagctcac

SEQ ID NO: 89568 - DNA, 25 bp, mus musculus
ggaaatactccaagggcagctcaca

SEQ ID NO: 89569 - DNA, 25 bp, mus musculus
gaaatactccaagggcagctcacag

SEQ ID NO: 89570 - DNA, 25 bp, mus musculus
cggaatcaccatggcggctgggacc

SEQ ID NO: 89571 - DNA, 25 bp, mus musculus
gaatcaccatggcggctgggaccct

SEQ ID NO: 89572 - DNA, 25 bp, mus musculus
aatcaccatggcggctgggaccctg

SEQ ID NO: 89573 - DNA, 25 bp, mus musculus
caaggctcaatcggctgctcagtaa

SEQ ID NO: 89574 - DNA, 25 bp, mus musculus
aaggctcaatcggctgctcagtaaa

SEQ ID NO: 89575 - DNA, 25 bp, mus musculus
aggctcaatcggctgctcagtaaag

SEQ ID NO: 89576 - DNA, 25 bp, mus musculus
ggctcaatcggctgctcagtaaagc

SEQ ID NO: 89577 - DNA, 25 bp, mus musculus
gctcaatcggctgctcagtaaagcg

SEQ ID NO: 89578 - DNA, 25 bp, mus musculus
tgcatagcaagctgtctgtgatcca

SEQ ID NO: 89579 - DNA, 25 bp, mus musculus
atgtgaagccatccaatgtcctcat

SEQ ID NO: 89580 - DNA, 25 bp, mus musculus
cagcggaccagttctcccctgagtt

SEQ ID NO: 89581 - DNA, 25 bp, mus musculus
ttgtggacttcactagccagtgcct

SEQ ID NO: 89582 - DNA, 25 bp, mus musculus
acttcactagccagtgcctaaggaa

SEQ ID NO: 89583 - DNA, 25 bp, mus musculus
taaggaagaaccccgcagagcgcat

SEQ ID NO: 89584 - DNA, 25 bp, mus musculus
agaaccccgcagagcgcatgagcta

SEQ ID NO: 89585 - DNA, 25 bp, mus musculus
tgagctacctggagctgatggaaca

SEQ ID NO: 89586 - DNA, 25 bp, mus musculus
tggaacacccattcttcaccttgca

SEQ ID NO: 89587 - DNA, 25 bp, mus musculus
tcttcaccttgcacaaaactaagaa

SEQ ID NO: 89588 - DNA, 25 bp, mus musculus
agacagacattgctgcctttgtgaa

SEQ ID NO: 89589 - DNA, 25 bp, mus musculus
gggacaccctttagagcacaatgga

SEQ ID NO: 89590 - DNA, 25 bp, mus musculus
tcctcatcaacaaggaagggcatgt

SEQ ID NO: 89591 - DNA, 25 bp, mus musculus
caatggatgctggctgcaagcctta

SEQ ID NO: 89592 - DNA, 25 bp, mus musculus
gctgcaagccttacatggcccctga

SEQ ID NO: 89593 - DNA, 25 bp, mus musculus
acatggcccctgagaggatcaaccc

SEQ ID NO: 89594 - DNA, 25 bp, mus musculus
agatggccattctgcgattccctta

SEQ ID NO: 89595 - DNA, 25 bp, mus musculus
tcccttatgagtcttggggcacacc

SEQ ID NO: 89596 - DNA, 25 bp, mus musculus
atgagtcttggggcacaccgttcca

SEQ ID NO: 89597 - DNA, 25 bp, mus musculus
gcacaccgttccagcagctgaagca

SEQ ID NO: 89598 - DNA, 25 bp, mus musculus
gagcggcaccatctccatgccaagg

SEQ ID NO: 89599 - DNA, 25 bp, mus musculus
catctccatgccaaggttgaacaaa

SEQ ID NO: 89600 - DNA, 25 bp, mus musculus
gaaatcggccaagtccaaagacata

SEQ ID NO: 89601 - DNA, 25 bp, mus musculus
atcggccaagtccaaagacatactt

SEQ ID NO: 89602 - DNA, 25 bp, mus musculus
caaagacatactttctgctgaagaa

SEQ ID NO: 89603 - DNA, 25 bp, mus musculus
agacatactttctgctgaagaagta

SEQ ID NO: 89604 - DNA, 25 bp, mus musculus
gtggtctcagtctctggaaaaactc

SEQ ID NO: 89605 - DNA, 25 bp, mus musculus
gtctcagtctctggaaaaactcctt

SEQ ID NO: 89606 - DNA, 25 bp, mus musculus
tctggaaaaactccttgccaaccag

SEQ ID NO: 89607 - DNA, 25 bp, mus musculus
ccttgccaaccagacaggtcaaaat

SEQ ID NO: 89608 - DNA, 25 bp, mus musculus
tgccaaccagacaggtcaaaatgtc

SEQ ID NO: 89609 - DNA, 25 bp, mus musculus
caaccagacaggtcaaaatgtcttt

SEQ ID NO: 89610 - DNA, 25 bp, mus musculus
gttcttttctgctagcccaaaggat

SEQ ID NO: 89611 - DNA, 25 bp, mus musculus
ttctgctagcccaaaggattcgaaa

SEQ ID NO: 89612 - DNA, 25 bp, mus musculus
cagccattctcttctagacgacaaa

SEQ ID NO: 89613 - DNA, 25 bp, mus musculus
ccattctcttctagacgacaaaaag

SEQ ID NO: 89614 - DNA, 25 bp, mus musculus
ttctcttctagacgacaaaaagcag

SEQ ID NO: 89615 - DNA, 25 bp, mus musculus
aacatacctgagatcgatgatccca

SEQ ID NO: 89616 - DNA, 25 bp, mus musculus
gagatcgatgatcccacatctggaa

SEQ ID NO: 89617 - DNA, 25 bp, mus musculus
acatctggaatctgggatgaaatcg

SEQ ID NO: 89618 - DNA, 25 bp, mus musculus
tacaacaacagcaacccagaagatc

SEQ ID NO: 89619 - DNA, 25 bp, mus musculus
aacccagaagatcacagtcacgata

SEQ ID NO: 89620 - DNA, 25 bp, mus musculus
aacaccctcaactgtgcggaagtga

SEQ ID NO: 89621 - DNA, 25 bp, mus musculus
tattcccagaacaagtgtgagagag

SEQ ID NO: 89622 - DNA, 25 bp, mus musculus
ggcatggtctgtgctggcagcagca

SEQ ID NO: 89623 - DNA, 25 bp, mus musculus
gctgacacgtgccagggtgactcag

SEQ ID NO: 89624 - DNA, 25 bp, mus musculus
cagggcatcacctcatggggctcag

SEQ ID NO: 89625 - DNA, 25 bp, mus musculus
atcacctcatggggctcagacccct

SEQ ID NO: 89626 - DNA, 25 bp, mus musculus
tcatggggctcagacccctgtggga

SEQ ID NO: 89627 - DNA, 25 bp, mus musculus
cctggagtctacaccaaaatctgcc

SEQ ID NO: 89628 - DNA, 25 bp, mus musculus
accaaaatctgccgctacactacct

SEQ ID NO: 89629 - DNA, 25 bp, mus musculus
accatggacaacagggactgatcct

SEQ ID NO: 89630 - DNA, 25 bp, mus musculus
gaagatcacagtcacgatataatgc

SEQ ID NO: 89631 - DNA, 25 bp, mus musculus
tcaataaacaccaccattggttggc

SEQ ID NO: 89632 - DNA, 25 bp, mus musculus
cgactgcagaactcagcaaacctcg

SEQ ID NO: 89633 - DNA, 25 bp, mus musculus
cagaactcagcaaacctcggggaca

SEQ ID NO: 89634 - DNA, 25 bp, mus musculus
tcagcaaacctcggggacaaggtga

SEQ ID NO: 89635 - DNA, 25 bp, mus musculus
aagccggtccaactggccaatctgt

SEQ ID NO: 89636 - DNA, 25 bp, mus musculus
gtccaactggccaatctgtgtccca

SEQ ID NO: 89637 - DNA, 25 bp, mus musculus
tgtcccaaagttggccagaagtgca

SEQ ID NO: 89638 - DNA, 25 bp, mus musculus
actgtcaccagccctcaagagaact

SEQ ID NO: 89639 - DNA, 25 bp, mus musculus
cagcgcactgtgccacagccgcgag

SEQ ID NO: 89640 - DNA, 25 bp, mus musculus
gccgtgtcctcggtatcgaaaacag

SEQ ID NO: 89641 - DNA, 25 bp, mus musculus
attcattttgacagtccatttgagt

SEQ ID NO: 89642 - DNA, 25 bp, mus musculus
ttcattttgacagtccatttgagtt

SEQ ID NO: 89643 - DNA, 25 bp, mus musculus
tcattttgacagtccatttgagttt

SEQ ID NO: 89644 - DNA, 25 bp, mus musculus
cattttgacagtccatttgagtttg

SEQ ID NO: 89645 - DNA, 25 bp, mus musculus
attttgacagtccatttgagtttgg

SEQ ID NO: 89646 - DNA, 25 bp, mus musculus
ttttgacagtccatttgagtttggc

SEQ ID NO: 89647 - DNA, 25 bp, mus musculus
tttgacagtccatttgagtttggct

SEQ ID NO: 89648 - DNA, 25 bp, mus musculus
ttgacagtccatttgagtttggctt

SEQ ID NO: 89649 - DNA, 25 bp, mus musculus
tgacagtccatttgagtttggcttc

SEQ ID NO: 89650 - DNA, 25 bp, mus musculus
gacagtccatttgagtttggcttca

SEQ ID NO: 89651 - DNA, 25 bp, mus musculus
gtgtcctcggtatcgaaaacaggca

SEQ ID NO: 89652 - DNA, 25 bp, mus musculus
tgtcctcggtatcgaaaacaggcac

SEQ ID NO: 89653 - DNA, 25 bp, mus musculus
gtcctcggtatcgaaaacaggcact

SEQ ID NO: 89654 - DNA, 25 bp, mus musculus
tcctcggtatcgaaaacaggcactt

SEQ ID NO: 89655 - DNA, 25 bp, mus musculus
ggacatctacgacaaatatggcaaa

SEQ ID NO: 89656 - DNA, 25 bp, mus musculus
gacatctacgacaaatatggcaaag

SEQ ID NO: 89657 - DNA, 25 bp, mus musculus
acatctacgacaaatatggcaaaga

SEQ ID NO: 89658 - DNA, 25 bp, mus musculus
aattcattttgacagtccatttgag

SEQ ID NO: 89659 - DNA, 25 bp, mus musculus
acacttgccaattcatcatgggagc

SEQ ID NO: 89660 - DNA, 25 bp, mus musculus
gccaattcatcatgggagcactgat

SEQ ID NO: 89661 - DNA, 25 bp, mus musculus
agtgaatgtcccgcaagtgtcctcc

SEQ ID NO: 89662 - DNA, 25 bp, mus musculus
gaatgtcccgcaagtgtcctccatg

SEQ ID NO: 89663 - DNA, 25 bp, mus musculus
tgtcccgcaagtgtcctccatgcag

SEQ ID NO: 89664 - DNA, 25 bp, mus musculus
gcaagtgtcctccatgcagatggga

SEQ ID NO: 89665 - DNA, 25 bp, mus musculus
agtgtcctccatgcagatgggagcg

SEQ ID NO: 89666 - DNA, 25 bp, mus musculus
aggactggatagcctgcttggcagt

SEQ ID NO: 89667 - DNA, 25 bp, mus musculus
actggatagcctgcttggcagtgac

SEQ ID NO: 89668 - DNA, 25 bp, mus musculus
ggatagcctgcttggcagtgacctt

SEQ ID NO: 89669 - DNA, 25 bp, mus musculus
tagcctgcttggcagtgaccttggc

SEQ ID NO: 89670 - DNA, 25 bp, mus musculus
cttcatcccgtcatcagtgcctgcg

SEQ ID NO: 89671 - DNA, 25 bp, mus musculus
aattcatcatgggagcactgatgca

SEQ ID NO: 89672 - DNA, 25 bp, mus musculus
tgcaggtgatagccccgttggcacc

SEQ ID NO: 89673 - DNA, 25 bp, mus musculus
tgatagccccgttggcaccaccact

SEQ ID NO: 89674 - DNA, 25 bp, mus musculus
cactacaaccaacctggagcagcct

SEQ ID NO: 89675 - DNA, 25 bp, mus musculus
tacaaccaacctggagcagcctcag

SEQ ID NO: 89676 - DNA, 25 bp, mus musculus
caacctggagcagcctcaggtcatt

SEQ ID NO: 89677 - DNA, 25 bp, mus musculus
tgaccttctgggggatcttttgaat

SEQ ID NO: 89678 - DNA, 25 bp, mus musculus
cccagtgaatgtcccgcaagtgtcc

SEQ ID NO: 89679 - DNA, 25 bp, mus musculus
tccttcaaggtacagaccagtccaa

SEQ ID NO: 89680 - DNA, 25 bp, mus musculus
cagaccagtccaaaatgtacagaca

SEQ ID NO: 89681 - DNA, 25 bp, mus musculus
gcttagtgcaagccctggttgcccc

SEQ ID NO: 89682 - DNA, 25 bp, mus musculus
tagtgcaagccctggttgccccaga

SEQ ID NO: 89683 - DNA, 25 bp, mus musculus
tggttgccccagagacccaagtgat

SEQ ID NO: 89684 - DNA, 25 bp, mus musculus
ccccagagacccaagtgatgttatg

SEQ ID NO: 89685 - DNA, 25 bp, mus musculus
tgttatgtgaccttgaccctaagtt

SEQ ID NO: 89686 - DNA, 25 bp, mus musculus
tacttctggttggtgaataaagatg

SEQ ID NO: 89687 - DNA, 25 bp, mus musculus
agtcgatagctgggcaggagagacc

SEQ ID NO: 89688 - DNA, 25 bp, mus musculus
ttaagagcagcccagatggaaacat

SEQ ID NO: 89689 - DNA, 25 bp, mus musculus
atctgcccagctcttgtgctgatta

SEQ ID NO: 89690 - DNA, 25 bp, mus musculus
gctcttgtgctgattaaggcttgtt

SEQ ID NO: 89691 - DNA, 25 bp, mus musculus
cctcactatgaacacaaacaatcct

SEQ ID NO: 89692 - DNA, 25 bp, mus musculus
cactatgaacacaaacaatcctggt

SEQ ID NO: 89693 - DNA, 25 bp, mus musculus
gaacacaaacaatcctggtgtaaat

SEQ ID NO: 89694 - DNA, 25 bp, mus musculus
aagagagcctgccgtctctttgtgg

SEQ ID NO: 89695 - DNA, 25 bp, mus musculus
tatattgagctttggtctgttatgc

SEQ ID NO: 89696 - DNA, 25 bp, mus musculus
ctttggtctgttatgctttggaatg

SEQ ID NO: 89697 - DNA, 25 bp, mus musculus
tggtctgttatgctttggaatgctt

SEQ ID NO: 89698 - DNA, 25 bp, mus musculus
aatgcttagtgcaagccctggttgc

SEQ ID NO: 89699 - DNA, 25 bp, mus musculus
gtgaaggtctcaggctctgtcagat

SEQ ID NO: 89700 - DNA, 25 bp, mus musculus
gtctcaggctctgtcagatcactcg

SEQ ID NO: 89701 - DNA, 25 bp, mus musculus
actcgcgacatatctcggacggctc

SEQ ID NO: 89702 - DNA, 25 bp, mus musculus
gcgacatatctcggacggctcagca

SEQ ID NO: 89703 - DNA, 25 bp, mus musculus
acatatctcggacggctcagcaaca

SEQ ID NO: 89704 - DNA, 25 bp, mus musculus
tctcggacggctcagcaacaacttg

SEQ ID NO: 89705 - DNA, 25 bp, mus musculus
ctcggacggctcagcaacaacttga

SEQ ID NO: 89706 - DNA, 25 bp, mus musculus
ctacgcattatttcagcttattcaa

SEQ ID NO: 89707 - DNA, 25 bp, mus musculus
atttcagcttattcaagtcatcgct

SEQ ID NO: 89708 - DNA, 25 bp, mus musculus
cagcttattcaagtcatcgctggcc

SEQ ID NO: 89709 - DNA, 25 bp, mus musculus
aacagacatttccagctgcttctgc

SEQ ID NO: 89710 - DNA, 25 bp, mus musculus
acagacatttccagctgcttctgca

SEQ ID NO: 89711 - DNA, 25 bp, mus musculus
ctcaggctctgtcagatcactcgcg

SEQ ID NO: 89712 - DNA, 25 bp, mus musculus
tcaggctctgtcagatcactcgcga

SEQ ID NO: 89713 - DNA, 25 bp, mus musculus
ctctgtcagatcactcgcgacatat

SEQ ID NO: 89714 - DNA, 25 bp, mus musculus
tctgtcagatcactcgcgacatatc

SEQ ID NO: 89715 - DNA, 25 bp, mus musculus
gtcagatcactcgcgacatatctcg

SEQ ID NO: 89716 - DNA, 25 bp, mus musculus
cagatcactcgcgacatatctcgga

SEQ ID NO: 89717 - DNA, 25 bp, mus musculus
agatcactcgcgacatatctcggac

SEQ ID NO: 89718 - DNA, 25 bp, mus musculus
tcactcgcgacatatctcggacggc

SEQ ID NO: 89719 - DNA, 25 bp, mus musculus
gcattccgtggcccacagacgtggt

SEQ ID NO: 89720 - DNA, 25 bp, mus musculus
ggcccacagacgtggtcatttccca

SEQ ID NO: 89721 - DNA, 25 bp, mus musculus
ttgatcacgtcaccatactatctca

SEQ ID NO: 89722 - DNA, 25 bp, mus musculus
atcacgtcaccatactatctcataa

SEQ ID NO: 89723 - DNA, 25 bp, mus musculus
tcaccatactatctcataatgtcag

SEQ ID NO: 89724 - DNA, 25 bp, mus musculus
ccatactatctcataatgtcagtga

SEQ ID NO: 89725 - DNA, 25 bp, mus musculus
tactatctcataatgtcagtgagct

SEQ ID NO: 89726 - DNA, 25 bp, mus musculus
tatctcataatgtcagtgagctcac

SEQ ID NO: 89727 - DNA, 25 bp, mus musculus
agctcactgcagaaatgcacaggat

SEQ ID NO: 89728 - DNA, 25 bp, mus musculus
tcactgcagaaatgcacaggatatt

SEQ ID NO: 89729 - DNA, 25 bp, mus musculus
gatataaaccaggcaggtggttctc

SEQ ID NO: 89730 - DNA, 25 bp, mus musculus
aaccaggcaggtggttctctgacag

SEQ ID NO: 89731 - DNA, 25 bp, mus musculus
ctttgagtcaaccttgcttctcagg

SEQ ID NO: 89732 - DNA, 25 bp, mus musculus
ggttctctgacagataccttactgc

SEQ ID NO: 89733 - DNA, 25 bp, mus musculus
tgagtcaaccttgcttctcagggac

SEQ ID NO: 89734 - DNA, 25 bp, mus musculus
tcctgatgctgttggcatcaaactt

SEQ ID NO: 89735 - DNA, 25 bp, mus musculus
tccttctgtggaagaatgtggcccc

SEQ ID NO: 89736 - DNA, 25 bp, mus musculus
agatgtccatatatgacctgcttga

SEQ ID NO: 89737 - DNA, 25 bp, mus musculus
tgtccatatatgacctgcttgatca

SEQ ID NO: 89738 - DNA, 25 bp, mus musculus
ccatatatgacctgcttgatcacgt

SEQ ID NO: 89739 - DNA, 25 bp, mus musculus
tgcttgatcacgtcaccatactatc

SEQ ID NO: 89740 - DNA, 25 bp, mus musculus
cttcgtggcagctttggaaacaggt

SEQ ID NO: 89741 - DNA, 25 bp, mus musculus
aacaggttgtccgttctgctgcagg

SEQ ID NO: 89742 - DNA, 25 bp, mus musculus
agcttggacggctggtaccagtgcc

SEQ ID NO: 89743 - DNA, 25 bp, mus musculus
gtggtttcctatttatgtgaccctg

SEQ ID NO: 89744 - DNA, 25 bp, mus musculus
ttatgtgaccctgttcctcctggac

SEQ ID NO: 89745 - DNA, 25 bp, mus musculus
tgtgaccctgttcctcctggaccaa

SEQ ID NO: 89746 - DNA, 25 bp, mus musculus
gttcctcctggaccaatctccctgt

SEQ ID NO: 89747 - DNA, 25 bp, mus musculus
ccaatctccctgtgttgcaagtcga

SEQ ID NO: 89748 - DNA, 25 bp, mus musculus
atctccctgtgttgcaagtcgaaag

SEQ ID NO: 89749 - DNA, 25 bp, mus musculus
ccagccttctcatttctgctttctt

SEQ ID NO: 89750 - DNA, 25 bp, mus musculus
tttctgctttcttactggaccagtc

SEQ ID NO: 89751 - DNA, 25 bp, mus musculus
ctgctttcttactggaccagtcttt

SEQ ID NO: 89752 - DNA, 25 bp, mus musculus
aggttgtccgttctgctgcaggatt

SEQ ID NO: 89753 - DNA, 25 bp, mus musculus
ttgtccgttctgctgcaggattcaa

SEQ ID NO: 89754 - DNA, 25 bp, mus musculus
gttctgctgcaggattcaagtgagg

SEQ ID NO: 89755 - DNA, 25 bp, mus musculus
aggcctagaactcagtgccttaggg

SEQ ID NO: 89756 - DNA, 25 bp, mus musculus
cagtgccttaggggtaaggctgtca

SEQ ID NO: 89757 - DNA, 25 bp, mus musculus
aaggctgtcagcttggacggctggt

SEQ ID NO: 89758 - DNA, 25 bp, mus musculus
gctgtcagcttggacggctggtacc

SEQ ID NO: 89759 - DNA, 25 bp, mus musculus
gtcagcttggacggctggtaccagt

SEQ ID NO: 89760 - DNA, 25 bp, mus musculus
caagactgctgtactatttgttgac

SEQ ID NO: 89761 - DNA, 25 bp, mus musculus
tgaccttagtcccagcgaaggctat

SEQ ID NO: 89762 - DNA, 25 bp, mus musculus
tgtccctttatgaatcagatacaag

SEQ ID NO: 89763 - DNA, 25 bp, mus musculus
ttagtaccatttgtccaatacattt

SEQ ID NO: 89764 - DNA, 25 bp, mus musculus
ccatttgtccaatacatttgctttt

SEQ ID NO: 89765 - DNA, 25 bp, mus musculus
tttataagacccaaactcattcatt

SEQ ID NO: 89766 - DNA, 25 bp, mus musculus
ataagacccaaactcattcattaat

SEQ ID NO: 89767 - DNA, 25 bp, mus musculus
ctcattcattaatcaggtttaatct

SEQ ID NO: 89768 - DNA, 25 bp, mus musculus
gattatcgttctcttaaagtgccag

SEQ ID NO: 89769 - DNA, 25 bp, mus musculus
taatttcacgcgcttttgtgatgga

SEQ ID NO: 89770 - DNA, 25 bp, mus musculus
tttcacgcgcttttgtgatggagtg

SEQ ID NO: 89771 - DNA, 25 bp, mus musculus
tgaacatgagtcctggatgatacta

SEQ ID NO: 89772 - DNA, 25 bp, mus musculus
ccttagtcccagcgaaggctatcac

SEQ ID NO: 89773 - DNA, 25 bp, mus musculus
tcccagcgaaggctatcacaagaac

SEQ ID NO: 89774 - DNA, 25 bp, mus musculus
tcacaagaacgctggctgtaaagct

SEQ ID NO: 89775 - DNA, 25 bp, mus musculus
caagaacgctggctgtaaagctttg

SEQ ID NO: 89776 - DNA, 25 bp, mus musculus
ctgtaaagctttgcccttctatcta

SEQ ID NO: 89777 - DNA, 25 bp, mus musculus
agctttgcccttctatctagatatg

SEQ ID NO: 89778 - DNA, 25 bp, mus musculus
tttgcccttctatctagatatggat

SEQ ID NO: 89779 - DNA, 25 bp, mus musculus
tatactgtggtttgtccctttatga

SEQ ID NO: 89780 - DNA, 25 bp, mus musculus
gagtcctgacactctattagcactg

SEQ ID NO: 89781 - DNA, 25 bp, mus musculus
catgctcaccaacagacagaaggtt

SEQ ID NO: 89782 - DNA, 25 bp, mus musculus
tcctagataactccagacataagat

SEQ ID NO: 89783 - DNA, 25 bp, mus musculus
ataactccagacataagatactcaa

SEQ ID NO: 89784 - DNA, 25 bp, mus musculus
ttcttcacatttcccatccacacag

SEQ ID NO: 89785 - DNA, 25 bp, mus musculus
cacacagcagggccagaacacagag

SEQ ID NO: 89786 - DNA, 25 bp, mus musculus
tctgagccttgtgtctgttccttca

SEQ ID NO: 89787 - DNA, 25 bp, mus musculus
gtctgttccttcatgaatgtatgat

SEQ ID NO: 89788 - DNA, 25 bp, mus musculus
gccttggtttcttggctgtacaatg

SEQ ID NO: 89789 - DNA, 25 bp, mus musculus
gtttcttggctgtacaatgggcttg

SEQ ID NO: 89790 - DNA, 25 bp, mus musculus
ggtaacactcacctcacagggttgt

SEQ ID NO: 89791 - DNA, 25 bp, mus musculus
actcacctcacagggttgttgtgaa

SEQ ID NO: 89792 - DNA, 25 bp, mus musculus
atttctacagacattctttgggata

SEQ ID NO: 89793 - DNA, 25 bp, mus musculus
attttaaacatccatggaccagcac

SEQ ID NO: 89794 - DNA, 25 bp, mus musculus
catggaccagcaccataaggtagtc

SEQ ID NO: 89795 - DNA, 25 bp, mus musculus
ggtagtctgtgctacaccagatgtt

SEQ ID NO: 89796 - DNA, 25 bp, mus musculus
ctgtgctacaccagatgttaacact

SEQ ID NO: 89797 - DNA, 25 bp, mus musculus
ttagtacctagtcggtgaatccaga

SEQ ID NO: 89798 - DNA, 25 bp, mus musculus
agattctaagtctcctagataactc

SEQ ID NO: 89799 - DNA, 25 bp, mus musculus
taagtctcctagataactccagaca

SEQ ID NO: 89800 - DNA, 25 bp, mus musculus
ggaccacccaatctcgaggctgagg

SEQ ID NO: 89801 - DNA, 25 bp, mus musculus
cccaatctcgaggctgaggcagtac

SEQ ID NO: 89802 - DNA, 25 bp, mus musculus
gtggcattccagggtgacttttgct

SEQ ID NO: 89803 - DNA, 25 bp, mus musculus
gcattccagggtgacttttgctcct

SEQ ID NO: 89804 - DNA, 25 bp, mus musculus
ggtgacttttgctcctgttcctgct

SEQ ID NO: 89805 - DNA, 25 bp, mus musculus
gacttttgctcctgttcctgctccc

SEQ ID NO: 89806 - DNA, 25 bp, mus musculus
aggctacttcactggggcaccatgt

SEQ ID NO: 89807 - DNA, 25 bp, mus musculus
cttcactggggcaccatgtttgcag

SEQ ID NO: 89808 - DNA, 25 bp, mus musculus
accatgtttgcagccattgctgcgg

SEQ ID NO: 89809 - DNA, 25 bp, mus musculus
atgtttgcagccattgctgcggcta

SEQ ID NO: 89810 - DNA, 25 bp, mus musculus
tttgcagccattgctgcggctactt

SEQ ID NO: 89811 - DNA, 25 bp, mus musculus
gccattgctgcggctacttcactcc

SEQ ID NO: 89812 - DNA, 25 bp, mus musculus
aatctcgaggctgaggcagtacctg

SEQ ID NO: 89813 - DNA, 25 bp, mus musculus
taagtaaaccacaggtctgcctttg

SEQ ID NO: 89814 - DNA, 25 bp, mus musculus
gcagtacctgctgaaccagggttgg

SEQ ID NO: 89815 - DNA, 25 bp, mus musculus
agcctttgagcaggctgagcggaag

SEQ ID NO: 89816 - DNA, 25 bp, mus musculus
gctccgcaggcagcaggagtcgctg

SEQ ID NO: 89817 - DNA, 25 bp, mus musculus
tagtcagctgtgcgaacatgctgag

SEQ ID NO: 89818 - DNA, 25 bp, mus musculus
tcagctgtgcgaacatgctgagcag

SEQ ID NO: 89819 - DNA, 25 bp, mus musculus
acatgctgagcagccagggtggcat

SEQ ID NO: 89820 - DNA, 25 bp, mus musculus
tgagcagccagggtggcattccagg

SEQ ID NO: 89821 - DNA, 25 bp, mus musculus
tcagccacaagtgacagtcaggaca

SEQ ID NO: 89822 - DNA, 25 bp, mus musculus
gacaccaggatcaatggggatgaac

SEQ ID NO: 89823 - DNA, 25 bp, mus musculus
gggcttcaggacttcacctccaaag

SEQ ID NO: 89824 - DNA, 25 bp, mus musculus
accaagagcccacttgagggtctct

SEQ ID NO: 89825 - DNA, 25 bp, mus musculus
aagagcccacttgagggtctctcaa

SEQ ID NO: 89826 - DNA, 25 bp, mus musculus
ccacttgagggtctctcaagagcaa

SEQ ID NO: 89827 - DNA, 25 bp, mus musculus
aagacaaagcctccagttcctgcac

SEQ ID NO: 89828 - DNA, 25 bp, mus musculus
tgcccaggacctaagcagaaaactg

SEQ ID NO: 89829 - DNA, 25 bp, mus musculus
actgggccaaggtctgaagaagatg

SEQ ID NO: 89830 - DNA, 25 bp, mus musculus
gggtcacctggatccaatgtttgga

SEQ ID NO: 89831 - DNA, 25 bp, mus musculus
tcacctggatccaatgtttggaaga

SEQ ID NO: 89832 - DNA, 25 bp, mus musculus
tggaagaatcctccatcttcctggc

SEQ ID NO: 89833 - DNA, 25 bp, mus musculus
ttacctatagaggctgggttcaaag

SEQ ID NO: 89834 - DNA, 25 bp, mus musculus
ctgactgtgaccaccagccttgcac

SEQ ID NO: 89835 - DNA, 25 bp, mus musculus
actgtgaccaccagccttgcaccta

SEQ ID NO: 89836 - DNA, 25 bp, mus musculus
cttgcacctaattggtccctgctgg

SEQ ID NO: 89837 - DNA, 25 bp, mus musculus
cctaattggtccctgctggtccttg

SEQ ID NO: 89838 - DNA, 25 bp, mus musculus
ctgctggtccttgggcttcaggact

SEQ ID NO: 89839 - DNA, 25 bp, mus musculus
ctggtccttgggcttcaggacttca

SEQ ID NO: 89840 - DNA, 25 bp, mus musculus
gtccttgggcttcaggacttcacct

SEQ ID NO: 89841 - DNA, 25 bp, mus musculus
tgcagcaacaggcggccactgcgca

SEQ ID NO: 89842 - DNA, 25 bp, mus musculus
aacaggcggccactgcgcaagctgc

SEQ ID NO: 89843 - DNA, 25 bp, mus musculus
ttcaccttcaccgagctctgcagct

SEQ ID NO: 89844 - DNA, 25 bp, mus musculus
ttcaccgagctctgcagctcttgga

SEQ ID NO: 89845 - DNA, 25 bp, mus musculus
atgaagtcctgcacaccatgcccat

SEQ ID NO: 89846 - DNA, 25 bp, mus musculus
acccacagcctttagactgagatct

SEQ ID NO: 89847 - DNA, 25 bp, mus musculus
cgccctaaccatttccaggatggtg

SEQ ID NO: 89848 - DNA, 25 bp, mus musculus
tcttttcctaaagggttgagagatg

SEQ ID NO: 89849 - DNA, 25 bp, mus musculus
gtgtttgctgccttgctcttagcag

SEQ ID NO: 89850 - DNA, 25 bp, mus musculus
gctgccttgctcttagcagacagaa

SEQ ID NO: 89851 - DNA, 25 bp, mus musculus
ttgctcttagcagacagaaactgaa

SEQ ID NO: 89852 - DNA, 25 bp, mus musculus
cagttcttgctgagtcttccctgct

SEQ ID NO: 89853 - DNA, 25 bp, mus musculus
gaatagctccagccatcagtctgtc

SEQ ID NO: 89854 - DNA, 25 bp, mus musculus
ctgctggcatcggtgtggatgacct

SEQ ID NO: 89855 - DNA, 25 bp, mus musculus
gattgtgcattctcaggatgagctt

SEQ ID NO: 89856 - DNA, 25 bp, mus musculus
ggggcccagactaccccaggcagag

SEQ ID NO: 89857 - DNA, 25 bp, mus musculus
accccaggcagagcatcaaggaaac

SEQ ID NO: 89858 - DNA, 25 bp, mus musculus
gcatcaaggaaaccccgtgctggat

SEQ ID NO: 89859 - DNA, 25 bp, mus musculus
aggaaaccccgtgctggattgagat

SEQ ID NO: 89860 - DNA, 25 bp, mus musculus
ttgagattcaccttcaccgagctct

SEQ ID NO: 89861 - DNA, 25 bp, mus musculus
aaaccactgaattcaaagagagagc

SEQ ID NO: 89862 - DNA, 25 bp, mus musculus
gagcgcctttgatttcaaaggaatg

SEQ ID NO: 89863 - DNA, 25 bp, mus musculus
agtttctctggtggatgccttgttt

SEQ ID NO: 89864 - DNA, 25 bp, mus musculus
tgccttgtttctgaaactgctatgt

SEQ ID NO: 89865 - DNA, 25 bp, mus musculus
cttgtttctgaaactgctatgtacg

SEQ ID NO: 89866 - DNA, 25 bp, mus musculus
gaaactgctatgtacgacccatcct

SEQ ID NO: 89867 - DNA, 25 bp, mus musculus
actgctatgtacgacccatcctgtg

SEQ ID NO: 89868 - DNA, 25 bp, mus musculus
atgtacgacccatcctgtgtataac

SEQ ID NO: 89869 - DNA, 25 bp, mus musculus
tacgacccatcctgtgtataacatt

SEQ ID NO: 89870 - DNA, 25 bp, mus musculus
gacccatcctgtgtataacatttcg

SEQ ID NO: 89871 - DNA, 25 bp, mus musculus
gtataacatttcgtacgatattatt

SEQ ID NO: 89872 - DNA, 25 bp, mus musculus
tgttttacttttcagcaaatatgaa

SEQ ID NO: 89873 - DNA, 25 bp, mus musculus
ggacgcgtacgcccacaaatgtttg

SEQ ID NO: 89874 - DNA, 25 bp, mus musculus
cgcgtacgcccacaaatgtttgact

SEQ ID NO: 89875 - DNA, 25 bp, mus musculus
cgcccacaaatgtttgactggatat

SEQ ID NO: 89876 - DNA, 25 bp, mus musculus
ggatttttcgcttgcgagcaaagga

SEQ ID NO: 89877 - DNA, 25 bp, mus musculus
ttcgcttgcgagcaaaggaatgtat

SEQ ID NO: 89878 - DNA, 25 bp, mus musculus
tatactaaatgccacactgtatgtt

SEQ ID NO: 89879 - DNA, 25 bp, mus musculus
actaaatgccacactgtatgtttct

SEQ ID NO: 89880 - DNA, 25 bp, mus musculus
aaatgccacactgtatgtttctaac

SEQ ID NO: 89881 - DNA, 25 bp, mus musculus
tccccaagcgcgttggtcttgctca

SEQ ID NO: 89882 - DNA, 25 bp, mus musculus
gcgttggtcttgctcacatatccca

SEQ ID NO: 89883 - DNA, 25 bp, mus musculus
acagtagcatctgtcgcaaacagca

SEQ ID NO: 89884 - DNA, 25 bp, mus musculus
gcatctgtcgcaaacagcaggtgac

SEQ ID NO: 89885 - DNA, 25 bp, mus musculus
tctgtcgcaaacagcaggtgacggc

SEQ ID NO: 89886 - DNA, 25 bp, mus musculus
gtcgcaaacagcaggtgacggccgt

SEQ ID NO: 89887 - DNA, 25 bp, mus musculus
aacagcaggtgacggccgtagacca

SEQ ID NO: 89888 - DNA, 25 bp, mus musculus
ccgtagaccagtctgagtgtttgtc

SEQ ID NO: 89889 - DNA, 25 bp, mus musculus
tagaccagtctgagtgtttgtccct

SEQ ID NO: 89890 - DNA, 25 bp, mus musculus
agtctgagtgtttgtccctttcagg

SEQ ID NO: 89891 - DNA, 25 bp, mus musculus
tgtccctttcaggactcctggagtc

SEQ ID NO: 89892 - DNA, 25 bp, mus musculus
ccctttcaggactcctggagtccag

SEQ ID NO: 89893 - DNA, 25 bp, mus musculus
ttggtcttgctcacatatcccaagt

SEQ ID NO: 89894 - DNA, 25 bp, mus musculus
gactcctggagtccaggggccttgt

SEQ ID NO: 89895 - DNA, 25 bp, mus musculus
ctcacatatcccaagtcatttcgga

SEQ ID NO: 89896 - DNA, 25 bp, mus musculus
acatatcccaagtcatttcggaagt

SEQ ID NO: 89897 - DNA, 25 bp, mus musculus
cccaagtcatttcggaagttgatgg

SEQ ID NO: 89898 - DNA, 25 bp, mus musculus
tcatttcggaagttgatgggaacag

SEQ ID NO: 89899 - DNA, 25 bp, mus musculus
tgctgcttttgacccggcggctgaa

SEQ ID NO: 89900 - DNA, 25 bp, mus musculus
tgcttttgacccggcggctgaaaat

SEQ ID NO: 89901 - DNA, 25 bp, mus musculus
cctacagtagcatctgtcgcaaaca

SEQ ID NO: 89902 - DNA, 25 bp, mus musculus
agcgaactcgtggcagtcatcggcg

SEQ ID NO: 89903 - DNA, 25 bp, mus musculus
cgaactcgtggcagtcatcggcgat

SEQ ID NO: 89904 - DNA, 25 bp, mus musculus
gatcataatccctgtcggtcttgag

SEQ ID NO: 89905 - DNA, 25 bp, mus musculus
ataatccctgtcggtcttgagcact

SEQ ID NO: 89906 - DNA, 25 bp, mus musculus
aatccctgtcggtcttgagcacttc

SEQ ID NO: 89907 - DNA, 25 bp, mus musculus
tccctgtcggtcttgagcacttctg

SEQ ID NO: 89908 - DNA, 25 bp, mus musculus
tcggtcttgagcacttctgcagagt

SEQ ID NO: 89909 - DNA, 25 bp, mus musculus
ggtcttgagcacttctgcagagtca

SEQ ID NO: 89910 - DNA, 25 bp, mus musculus
tcttgagcacttctgcagagtcatg

SEQ ID NO: 89911 - DNA, 25 bp, mus musculus
ttgagcacttctgcagagtcatgaa

SEQ ID NO: 89912 - DNA, 25 bp, mus musculus
gcacttctgcagagtcatgaatctc

SEQ ID NO: 89913 - DNA, 25 bp, mus musculus
acttctgcagagtcatgaatctcaa

SEQ ID NO: 89914 - DNA, 25 bp, mus musculus
acgtggaccagcattttggggatat

SEQ ID NO: 89915 - DNA, 25 bp, mus musculus
gtactggactcaggggcaccgatca

SEQ ID NO: 89916 - DNA, 25 bp, mus musculus
tggactcaggggcaccgatcataat

SEQ ID NO: 89917 - DNA, 25 bp, mus musculus
gactcaggggcaccgatcataatcc

SEQ ID NO: 89918 - DNA, 25 bp, mus musculus
ctcaggggcaccgatcataatccct

SEQ ID NO: 89919 - DNA, 25 bp, mus musculus
ggcaccgatcataatccctgtcggt

SEQ ID NO: 89920 - DNA, 25 bp, mus musculus
caccgatcataatccctgtcggtct

SEQ ID NO: 89921 - DNA, 25 bp, mus musculus
ccgatcataatccctgtcggtcttg

SEQ ID NO: 89922 - DNA, 25 bp, mus musculus
aagtcctggagactggtcagacact

SEQ ID NO: 89923 - DNA, 25 bp, mus musculus
gcaacctggttgctggatgcctcca

SEQ ID NO: 89924 - DNA, 25 bp, mus musculus
ggagccatccacctgactgcagtac

SEQ ID NO: 89925 - DNA, 25 bp, mus musculus
cttatgagggtccactcacaccacc

SEQ ID NO: 89926 - DNA, 25 bp, mus musculus
cctacaatttcatgccacattatac

SEQ ID NO: 89927 - DNA, 25 bp, mus musculus
tgccacattatacctctgcaagtct

SEQ ID NO: 89928 - DNA, 25 bp, mus musculus
atgtgcattcaactccctttcagac

SEQ ID NO: 89929 - DNA, 25 bp, mus musculus
atgttcctgtagacctgagctatga

SEQ ID NO: 89930 - DNA, 25 bp, mus musculus
ctgtagacctgagctatgattccta

SEQ ID NO: 89931 - DNA, 25 bp, mus musculus
acctgagctatgattcctactccca

SEQ ID NO: 89932 - DNA, 25 bp, mus musculus
gcattggaactcagctcaatacgat

SEQ ID NO: 89933 - DNA, 25 bp, mus musculus
gaactcagctcaatacgatcttctc

SEQ ID NO: 89934 - DNA, 25 bp, mus musculus
tggttgctggatgcctccaactggg

SEQ ID NO: 89935 - DNA, 25 bp, mus musculus
gctcaatacgatcttctctgattag

SEQ ID NO: 89936 - DNA, 25 bp, mus musculus
aatcttcaatttgtgactctactat

SEQ ID NO: 89937 - DNA, 25 bp, mus musculus
caatttgtgactctactatctctgt

SEQ ID NO: 89938 - DNA, 25 bp, mus musculus
tctctgtccacagcttcaactatca

SEQ ID NO: 89939 - DNA, 25 bp, mus musculus
gcttcaactatcagtctccagggct

SEQ ID NO: 89940 - DNA, 25 bp, mus musculus
gccctccttatggccatatggaaac

SEQ ID NO: 89941 - DNA, 25 bp, mus musculus
tggaaacacattctctccatctcaa

SEQ ID NO: 89942 - DNA, 25 bp, mus musculus
cttttgggagccatccacctgactg

SEQ ID NO: 89943 - DNA, 25 bp, mus musculus
gcaagacctgcaatcaaaccactgg

SEQ ID NO: 89944 - DNA, 25 bp, mus musculus
cctgcaatcaaaccactggccaatg

SEQ ID NO: 89945 - DNA, 25 bp, mus musculus
aggactatgctgtccagatccacat

SEQ ID NO: 89946 - DNA, 25 bp, mus musculus
atgctgtccagatccacatcctgaa

SEQ ID NO: 89947 - DNA, 25 bp, mus musculus
tccacatcctgaaggccgacaaagc

SEQ ID NO: 89948 - DNA, 25 bp, mus musculus
tcaccgtgaacatcatctccgtgta

SEQ ID NO: 89949 - DNA, 25 bp, mus musculus
tgtggatccgctcacgagacatcgc

SEQ ID NO: 89950 - DNA, 25 bp, mus musculus
cacgagacatcgcctgcaagtgtcc

SEQ ID NO: 89951 - DNA, 25 bp, mus musculus
acatcgcctgcaagtgtcccaaaat

SEQ ID NO: 89952 - DNA, 25 bp, mus musculus
tcaagcccctcaagaagtacttgct

SEQ ID NO: 89953 - DNA, 25 bp, mus musculus
agaagtacttgctgttgggtaatgc

SEQ ID NO: 89954 - DNA, 25 bp, mus musculus
acaagagcagcctggtgatccagtg

SEQ ID NO: 89955 - DNA, 25 bp, mus musculus
ccactggccaatgtccctgcaagga

SEQ ID NO: 89956 - DNA, 25 bp, mus musculus
gccaatgtccctgcaaggacggcgt

SEQ ID NO: 89957 - DNA, 25 bp, mus musculus
tgacgggcatcacctgcaaccgatg

SEQ ID NO: 89958 - DNA, 25 bp, mus musculus
cctgcaaccgatgtgccaaaggcta

SEQ ID NO: 89959 - DNA, 25 bp, mus musculus
ccccttgcatcaagattcctgtggc

SEQ ID NO: 89960 - DNA, 25 bp, mus musculus
gcatcaagattcctgtggcgccgcc

SEQ ID NO: 89961 - DNA, 25 bp, mus musculus
actgtgattcctattgcaaggcctc

SEQ ID NO: 89962 - DNA, 25 bp, mus musculus
attgcaaggcctccaaaggcaagct

SEQ ID NO: 89963 - DNA, 25 bp, mus musculus
cagacataccagtgtgctgccagat

SEQ ID NO: 89964 - DNA, 25 bp, mus musculus
taccagtgtgctgccagatgggaga

SEQ ID NO: 89965 - DNA, 25 bp, mus musculus
catctcttgtttcactgttcgtaag

SEQ ID NO: 89966 - DNA, 25 bp, mus musculus
ttgtttcactgttcgtaagatggtc

SEQ ID NO: 89967 - DNA, 25 bp, mus musculus
tttcactgttcgtaagatggtcttc

SEQ ID NO: 89968 - DNA, 25 bp, mus musculus
taagatggtcttctcagggtctttt

SEQ ID NO: 89969 - DNA, 25 bp, mus musculus
gatggtcttctcagggtcttttcaa

SEQ ID NO: 89970 - DNA, 25 bp, mus musculus
cttctcagggtcttttcaactcaat

SEQ ID NO: 89971 - DNA, 25 bp, mus musculus
ttttcaactcaatttctgcttagta

SEQ ID NO: 89972 - DNA, 25 bp, mus musculus
tcaactcaatttctgcttagtattg

SEQ ID NO: 89973 - DNA, 25 bp, mus musculus
actcaatttctgcttagtattgcat

SEQ ID NO: 89974 - DNA, 25 bp, mus musculus
tttctgcttagtattgcatcaagag

SEQ ID NO: 89975 - DNA, 25 bp, mus musculus
cagtgtgctgccagatgggagatat

SEQ ID NO: 89976 - DNA, 25 bp, mus musculus
tgtgctgccagatgggagatatgaa

SEQ ID NO: 89977 - DNA, 25 bp, mus musculus
ataatctccgttttgtagacaacag

SEQ ID NO: 89978 - DNA, 25 bp, mus musculus
acaacaggacctgactgaacagaaa

SEQ ID NO: 89979 - DNA, 25 bp, mus musculus
acaggacctgactgaacagaaacta

SEQ ID NO: 89980 - DNA, 25 bp, mus musculus
acagaaactacgcatctcttgtttc

SEQ ID NO: 89981 - DNA, 25 bp, mus musculus
actacgcatctcttgtttcactgtt

SEQ ID NO: 89982 - DNA, 25 bp, mus musculus
acgcatctcttgtttcactgttcgt

SEQ ID NO: 89983 - DNA, 25 bp, mus musculus
aaccctgagcccatgggcaagcagg

SEQ ID NO: 89984 - DNA, 25 bp, mus musculus
cacccggagcagcaccgggtcgtga

SEQ ID NO: 89985 - DNA, 25 bp, mus musculus
aaggactagtgctctcacccagagc

SEQ ID NO: 89986 - DNA, 25 bp, mus musculus
ccagagccccacgtgcactgatgtt

SEQ ID NO: 89987 - DNA, 25 bp, mus musculus
tggccatggctgacactaagctgtt

SEQ ID NO: 89988 - DNA, 25 bp, mus musculus
acactaagctgtttgtatgaggttt

SEQ ID NO: 89989 - DNA, 25 bp, mus musculus
tgttttgtgaccaagctgtgtagta

SEQ ID NO: 89990 - DNA, 25 bp, mus musculus
actttgtgcattctgaattttaagg

SEQ ID NO: 89991 - DNA, 25 bp, mus musculus
tatcctgtattctatcagatctgcc

SEQ ID NO: 89992 - DNA, 25 bp, mus musculus
gtattctatcagatctgccactgtg

SEQ ID NO: 89993 - DNA, 25 bp, mus musculus
tatcagatctgccactgtgcaggtg

SEQ ID NO: 89994 - DNA, 25 bp, mus musculus
cactgtgcaggtggcaagtgagact

SEQ ID NO: 89995 - DNA, 25 bp, mus musculus
cagggctttccagatagctaccggt

SEQ ID NO: 89996 - DNA, 25 bp, mus musculus
tttccagatagctaccggttcttcg

SEQ ID NO: 89997 - DNA, 25 bp, mus musculus
ggcaacatcctggacagacaccggc

SEQ ID NO: 89998 - DNA, 25 bp, mus musculus
atcctggacagacaccggcaggtgg

SEQ ID NO: 89999 - DNA, 25 bp, mus musculus
gacagacaccggcaggtgggtaatg

SEQ ID NO: 90000 - DNA, 25 bp, mus musculus
gccattggcctggagattaagctct

SEQ ID NO: 90001 - DNA, 25 bp, mus musculus
agcgcatcagctgcagttaaagcaa

SEQ ID NO: 90002 - DNA, 25 bp, mus musculus
gaggctgctaccaaggactagtgct

SEQ ID NO: 90003 - DNA, 25 bp, mus musculus
ctgttccaagctcagcactggccat

SEQ ID NO: 90004 - DNA, 25 bp, mus musculus
caagctcagcactggccatgaacag

SEQ ID NO: 90005 - DNA, 25 bp, mus musculus
aatcccggtgaagggcaagctgctg

SEQ ID NO: 90006 - DNA, 25 bp, mus musculus
gcagacacactcctgagccacaagg

SEQ ID NO: 90007 - DNA, 25 bp, mus musculus
cacaaggcctgcctggcaatgggtg

SEQ ID NO: 90008 - DNA, 25 bp, mus musculus
gcctgcctggcaatgggtgcccatt

SEQ ID NO: 90009 - DNA, 25 bp, mus musculus
tctccatggaactctcttggtctcc

SEQ ID NO: 90010 - DNA, 25 bp, mus musculus
tggaactctcttggtctccctcttt

SEQ ID NO: 90011 - DNA, 25 bp, mus musculus
cctctttccctttatgtgcaacgtg

SEQ ID NO: 90012 - DNA, 25 bp, mus musculus
gctgtccaaggctggatatgttttg

SEQ ID NO: 90013 - DNA, 25 bp, mus musculus
tgttttgattcaggctctatgtagc

SEQ ID NO: 90014 - DNA, 25 bp, mus musculus
gattcaggctctatgtagcatcctc

SEQ ID NO: 90015 - DNA, 25 bp, mus musculus
cagcactggccatgaacagccagcc

SEQ ID NO: 90016 - DNA, 25 bp, mus musculus
attcaggctctatgtagcatcctct

SEQ ID NO: 90017 - DNA, 25 bp, mus musculus
ccagaacactggtcacaaccgtggc

SEQ ID NO: 90018 - DNA, 25 bp, mus musculus
cactggtcacaaccgtggccacgag

SEQ ID NO: 90019 - DNA, 25 bp, mus musculus
ccacgagtcctccatgaagaagctc

SEQ ID NO: 90020 - DNA, 25 bp, mus musculus
gtcctccatgaagaagctcgtggcc

SEQ ID NO: 90021 - DNA, 25 bp, mus musculus
agacaacttttccctgtcatcagag

SEQ ID NO: 90022 - DNA, 25 bp, mus musculus
cttttccctgtcatcagagggcgag

SEQ ID NO: 90023 - DNA, 25 bp, mus musculus
ggagcaaatcccggtgaagggcaag

SEQ ID NO: 90024 - DNA, 25 bp, mus musculus
cagcacctgctcaagagggacaaag

SEQ ID NO: 90025 - DNA, 25 bp, mus musculus
aagctgatccacgaaggtggtgccc

SEQ ID NO: 90026 - DNA, 25 bp, mus musculus
cagagcctggtccattgtaccaggc

SEQ ID NO: 90027 - DNA, 25 bp, mus musculus
ctggtccattgtaccaggcagccta

SEQ ID NO: 90028 - DNA, 25 bp, mus musculus
cattgtaccaggcagcctagcccag

SEQ ID NO: 90029 - DNA, 25 bp, mus musculus
tgccttaggtccccagcagctgtac

SEQ ID NO: 90030 - DNA, 25 bp, mus musculus
aggtccccagcagctgtacagaagg

SEQ ID NO: 90031 - DNA, 25 bp, mus musculus
ccagcagctgtacagaaggggctct

SEQ ID NO: 90032 - DNA, 25 bp, mus musculus
ttctctccacagagctggggtgcag

SEQ ID NO: 90033 - DNA, 25 bp, mus musculus
ccacagagctggggtgcagccccaa

SEQ ID NO: 90034 - DNA, 25 bp, mus musculus
ggtgcagccccaacatgtgattttg

SEQ ID NO: 90035 - DNA, 25 bp, mus musculus
gccccaacatgtgattttgaatgag

SEQ ID NO: 90036 - DNA, 25 bp, mus musculus
atccacgaaggtggtgcccacatct

SEQ ID NO: 90037 - DNA, 25 bp, mus musculus
cacatctatgtctgcggggatgctc

SEQ ID NO: 90038 - DNA, 25 bp, mus musculus
tatgtctgcggggatgctcgaaata

SEQ ID NO: 90039 - DNA, 25 bp, mus musculus
aacacattctatgacatcgtggccg

SEQ ID NO: 90040 - DNA, 25 bp, mus musculus
gacatcgtggccgagtttgggccca

SEQ ID NO: 90041 - DNA, 25 bp, mus musculus
gggcccatggagcacacccaggctg

SEQ ID NO: 90042 - DNA, 25 bp, mus musculus
tgggcccttaggcagagcctggtcc

SEQ ID NO: 90043 - DNA, 25 bp, mus musculus
cttaggcagagcctggtccattgta

SEQ ID NO: 90044 - DNA, 25 bp, mus musculus
gtgggaaacctctgtccattgaggc

SEQ ID NO: 90045 - DNA, 25 bp, mus musculus
ctctgtccattgaggcagatgacaa

SEQ ID NO: 90046 - DNA, 25 bp, mus musculus
cttgcctcttctgcagggatcaccc

SEQ ID NO: 90047 - DNA, 25 bp, mus musculus
gggatcacccatcattctgaggtcc

SEQ ID NO: 90048 - DNA, 25 bp, mus musculus
atcacccatcattctgaggtcccca

SEQ ID NO: 90049 - DNA, 25 bp, mus musculus
aacccaagggtcacatatagtgctg

SEQ ID NO: 90050 - DNA, 25 bp, mus musculus
agtgctgctgctttcactgctgcac

SEQ ID NO: 90051 - DNA, 25 bp, mus musculus
gctgctgctttcactgctgcaccaa

SEQ ID NO: 90052 - DNA, 25 bp, mus musculus
ttcactgctgcaccaatgcccttgg

SEQ ID NO: 90053 - DNA, 25 bp, mus musculus
gtgcttgctgagggtagaagcccta

SEQ ID NO: 90054 - DNA, 25 bp, mus musculus
ccttgctctgtgctgctaggttgtg

SEQ ID NO: 90055 - DNA, 25 bp, mus musculus
ctgctaggttgtggccacagctaag

SEQ ID NO: 90056 - DNA, 25 bp, mus musculus
ctctggatggccacgtcctttgtcg

SEQ ID NO: 90057 - DNA, 25 bp, mus musculus
atggccacgtcctttgtcggaagtg

SEQ ID NO: 90058 - DNA, 25 bp, mus musculus
cactgaggccagtccttgcctctac

SEQ ID NO: 90059 - DNA, 25 bp, mus musculus
tgaggccagtccttgcctctaccct

SEQ ID NO: 90060 - DNA, 25 bp, mus musculus
tgccctgacccagggcctcagcatg

SEQ ID NO: 90061 - DNA, 25 bp, mus musculus
cctcagcatggcctacaagtattga

SEQ ID NO: 90062 - DNA, 25 bp, mus musculus
catggcctacaagtattgaggctcc

SEQ ID NO: 90063 - DNA, 25 bp, mus musculus
tgggctccaacccttgcctcttctg

SEQ ID NO: 90064 - DNA, 25 bp, mus musculus
tggcccagtatcgcgctctgctcca

SEQ ID NO: 90065 - DNA, 25 bp, mus musculus
cccagtatcgcgctctgctccaggg

SEQ ID NO: 90066 - DNA, 25 bp, mus musculus
gcatctacgacctgggccttcggcg

SEQ ID NO: 90067 - DNA, 25 bp, mus musculus
tctacgacctgggccttcggcgcct

SEQ ID NO: 90068 - DNA, 25 bp, mus musculus
gcccgacggcctatgaggacgaggt

SEQ ID NO: 90069 - DNA, 25 bp, mus musculus
cgacggcctatgaggacgaggtgtc

SEQ ID NO: 90070 - DNA, 25 bp, mus musculus
ccttcctggacgtgcacagccgcta

SEQ ID NO: 90071 - DNA, 25 bp, mus musculus
gccgctaccacacgctgcaagagct

SEQ ID NO: 90072 - DNA, 25 bp, mus musculus
gaccctcgctgagaactgacttcac

SEQ ID NO: 90073 - DNA, 25 bp, mus musculus
cctcgctgagaactgacttcacata

SEQ ID NO: 90074 - DNA, 25 bp, mus musculus
gaactgacttcacataaagtgtggg

SEQ ID NO: 90075 - DNA, 25 bp, mus musculus
ctgacttcacataaagtgtgggaac

SEQ ID NO: 90076 - DNA, 25 bp, mus musculus
agtatcgcgctctgctccagggcgc

SEQ ID NO: 90077 - DNA, 25 bp, mus musculus
ttcgagaactttctccctgggctgc

SEQ ID NO: 90078 - DNA, 25 bp, mus musculus
gagaactttctccctgggctgcccg

SEQ ID NO: 90079 - DNA, 25 bp, mus musculus
tgggctacacgtcggatgagaccgt

SEQ ID NO: 90080 - DNA, 25 bp, mus musculus
gctacacgtcggatgagaccgtgct

SEQ ID NO: 90081 - DNA, 25 bp, mus musculus
acacgtcggatgagaccgtgctgtt

SEQ ID NO: 90082 - DNA, 25 bp, mus musculus
cggccatccgcatctacgacctggg

SEQ ID NO: 90083 - DNA, 25 bp, mus musculus
tccgcatctacgacctgggccttcg

SEQ ID NO: 90084 - DNA, 25 bp, mus musculus
ggctgccgtcatgggagcattcatc

SEQ ID NO: 90085 - DNA, 25 bp, mus musculus
cgtctgctggtttccttacttcact

SEQ ID NO: 90086 - DNA, 25 bp, mus musculus
caactctcacaaaacttccctgagg

SEQ ID NO: 90087 - DNA, 25 bp, mus musculus
caactctctgctgtccaggagccaa

SEQ ID NO: 90088 - DNA, 25 bp, mus musculus
tctgctgtccaggagccaaagccga

SEQ ID NO: 90089 - DNA, 25 bp, mus musculus
tgatgctgagaccggttcgtgagca

SEQ ID NO: 90090 - DNA, 25 bp, mus musculus
attttacagaaatcatctctcatcc

SEQ ID NO: 90091 - DNA, 25 bp, mus musculus
cagaaatcatctctcatcctcttag

SEQ ID NO: 90092 - DNA, 25 bp, mus musculus
ctcatcctcttaggtagaccattta

SEQ ID NO: 90093 - DNA, 25 bp, mus musculus
agatcttaccaagatccacggagct

SEQ ID NO: 90094 - DNA, 25 bp, mus musculus
taccaagatccacggagcttgacag

SEQ ID NO: 90095 - DNA, 25 bp, mus musculus
gatccacggagcttgacagaatgtt

SEQ ID NO: 90096 - DNA, 25 bp, mus musculus
tgccttcgtttaccgtggactgaga

SEQ ID NO: 90097 - DNA, 25 bp, mus musculus
cgtcctatggttgggttatgccaat

SEQ ID NO: 90098 - DNA, 25 bp, mus musculus
cagagacttccgcatggcgtaccaa

SEQ ID NO: 90099 - DNA, 25 bp, mus musculus
cttccgcatggcgtaccaacagctc

SEQ ID NO: 90100 - DNA, 25 bp, mus musculus
acagctcttccactgcaagcttgca

SEQ ID NO: 90101 - DNA, 25 bp, mus musculus
cttccactgcaagcttgcaagccac

SEQ ID NO: 90102 - DNA, 25 bp, mus musculus
ctgcaagcttgcaagccacaactct

SEQ ID NO: 90103 - DNA, 25 bp, mus musculus
gcttgcaagccacaactctcacaaa

SEQ ID NO: 90104 - DNA, 25 bp, mus musculus
gctctaggtatcgcagcaggaaccg

SEQ ID NO: 90105 - DNA, 25 bp, mus musculus
ctctaggtatcgcagcaggaaccga

SEQ ID NO: 90106 - DNA, 25 bp, mus musculus
gggcctggcttccgatctttggaga

SEQ ID NO: 90107 - DNA, 25 bp, mus musculus
ggcctggcttccgatctttggagaa

SEQ ID NO: 90108 - DNA, 25 bp, mus musculus
gcctggcttccgatctttggagaat

SEQ ID NO: 90109 - DNA, 25 bp, mus musculus
cctggcttccgatctttggagaatg

SEQ ID NO: 90110 - DNA, 25 bp, mus musculus
ctggcttccgatctttggagaatgt

SEQ ID NO: 90111 - DNA, 25 bp, mus musculus
tggcttccgatctttggagaatgtg

SEQ ID NO: 90112 - DNA, 25 bp, mus musculus
ggcttccgatctttggagaatgtga

SEQ ID NO: 90113 - DNA, 25 bp, mus musculus
gcttccgatctttggagaatgtgaa

SEQ ID NO: 90114 - DNA, 25 bp, mus musculus
ttccgatctttggagaatgtgaagg

SEQ ID NO: 90115 - DNA, 25 bp, mus musculus
taagtcctgaattgatgtggctcgg

SEQ ID NO: 90116 - DNA, 25 bp, mus musculus
aggtatcgcagcaggaaccgaagta

SEQ ID NO: 90117 - DNA, 25 bp, mus musculus
ggtatcgcagcaggaaccgaagtac

SEQ ID NO: 90118 - DNA, 25 bp, mus musculus
gtatcgcagcaggaaccgaagtacg

SEQ ID NO: 90119 - DNA, 25 bp, mus musculus
tatcgcagcaggaaccgaagtacgc

SEQ ID NO: 90120 - DNA, 25 bp, mus musculus
atcgcagcaggaaccgaagtacgcc

SEQ ID NO: 90121 - DNA, 25 bp, mus musculus
accattgggcctggcttccgatctt

SEQ ID NO: 90122 - DNA, 25 bp, mus musculus
cattgggcctggcttccgatctttg

SEQ ID NO: 90123 - DNA, 25 bp, mus musculus
tgggcctggcttccgatctttggag

SEQ ID NO: 90124 - DNA, 25 bp, mus musculus
tccccgtctgctgcaaccaggcagg

SEQ ID NO: 90125 - DNA, 25 bp, mus musculus
tctgctgcaaccaggcaggcaacta

SEQ ID NO: 90126 - DNA, 25 bp, mus musculus
tgaacaaacttggtgtccagcaggg

SEQ ID NO: 90127 - DNA, 25 bp, mus musculus
gtctgcaggcacttctgggtcttcc

SEQ ID NO: 90128 - DNA, 25 bp, mus musculus
aggcacttctgggtcttccgtgatg

SEQ ID NO: 90129 - DNA, 25 bp, mus musculus
ttctgggtcttccgtgatgggtctg

SEQ ID NO: 90130 - DNA, 25 bp, mus musculus
tgggtcttccgtgatgggtctgtca

SEQ ID NO: 90131 - DNA, 25 bp, mus musculus
gggtctgtcagggcatccagcagga

SEQ ID NO: 90132 - DNA, 25 bp, mus musculus
agggcatccagcaggaccggggcaa

SEQ ID NO: 90133 - DNA, 25 bp, mus musculus
aggaccggggcaatggctgcatgtc

SEQ ID NO: 90134 - DNA, 25 bp, mus musculus
accggggcaatggctgcatgtcaca

SEQ ID NO: 90135 - DNA, 25 bp, mus musculus
atggctgcatgtcacaggaagatag

SEQ ID NO: 90136 - DNA, 25 bp, mus musculus
gcaaccaggcaggcaactaccttct

SEQ ID NO: 90137 - DNA, 25 bp, mus musculus
aggcaggcaactaccttctggtctg

SEQ ID NO: 90138 - DNA, 25 bp, mus musculus
caggcaactaccttctggtctgtca

SEQ ID NO: 90139 - DNA, 25 bp, mus musculus
gcaactaccttctggtctgtcaggg

SEQ ID NO: 90140 - DNA, 25 bp, mus musculus
ttctggtctgtcagggagtacatgt

SEQ ID NO: 90141 - DNA, 25 bp, mus musculus
atgttgccaataatctgcgctgcca

SEQ ID NO: 90142 - DNA, 25 bp, mus musculus
ttgccaataatctgcgctgccatct

SEQ ID NO: 90143 - DNA, 25 bp, mus musculus
aaggctctctggacaatgggcatga

SEQ ID NO: 90144 - DNA, 25 bp, mus musculus
tctgcagtccctgacagacccttca

SEQ ID NO: 90145 - DNA, 25 bp, mus musculus
ctgcagtccctgacagacccttcat

SEQ ID NO: 90146 - DNA, 25 bp, mus musculus
cctgtttcactcccaagtagcttga

SEQ ID NO: 90147 - DNA, 25 bp, mus musculus
ctgtttcactcccaagtagcttgaa

SEQ ID NO: 90148 - DNA, 25 bp, mus musculus
tgtttcactcccaagtagcttgaaa

SEQ ID NO: 90149 - DNA, 25 bp, mus musculus
ttcactcccaagtagcttgaaaaag

SEQ ID NO: 90150 - DNA, 25 bp, mus musculus
tcactcccaagtagcttgaaaaagg

SEQ ID NO: 90151 - DNA, 25 bp, mus musculus
tgcagtccctgacagacccttcatc

SEQ ID NO: 90152 - DNA, 25 bp, mus musculus
cctgacagacccttcatcccagggt

SEQ ID NO: 90153 - DNA, 25 bp, mus musculus
tgacagacccttcatcccagggttt

SEQ ID NO: 90154 - DNA, 25 bp, mus musculus
cttcatcccagggtttctagtcctg

SEQ ID NO: 90155 - DNA, 25 bp, mus musculus
ttcatcccagggtttctagtcctgt

SEQ ID NO: 90156 - DNA, 25 bp, mus musculus
tcatcccagggtttctagtcctgtt

SEQ ID NO: 90157 - DNA, 25 bp, mus musculus
gtcctgtttcactcccaagtagctt

SEQ ID NO: 90158 - DNA, 25 bp, mus musculus
tcctgtttcactcccaagtagcttg

SEQ ID NO: 90159 - DNA, 25 bp, mus musculus
tagtcagggactcctcccctctgca

SEQ ID NO: 90160 - DNA, 25 bp, mus musculus
agtcagggactcctcccctctgcag

SEQ ID NO: 90161 - DNA, 25 bp, mus musculus
gtccctgacagacccttcatcccag

SEQ ID NO: 90162 - DNA, 25 bp, mus musculus
cctgacagacccttcatcccagggt

SEQ ID NO: 90163 - DNA, 25 bp, mus musculus
cttcatcccagggtttctagtcctg

SEQ ID NO: 90164 - DNA, 25 bp, mus musculus
ttcatcccagggtttctagtcctgt

SEQ ID NO: 90165 - DNA, 25 bp, mus musculus
tcatcccagggtttctagtcctgtt

SEQ ID NO: 90166 - DNA, 25 bp, mus musculus
tcctgtttcactcccaagtagcttg

SEQ ID NO: 90167 - DNA, 25 bp, mus musculus
cctgtttcactcccaagtagcttga

SEQ ID NO: 90168 - DNA, 25 bp, mus musculus
ctgtttcactcccaagtagcttgaa

SEQ ID NO: 90169 - DNA, 25 bp, mus musculus
ttcactcccaagtagcttgaaaaag

SEQ ID NO: 90170 - DNA, 25 bp, mus musculus
tcactcccaagtagcttgaaaaagg

SEQ ID NO: 90171 - DNA, 25 bp, mus musculus
cccctctgcagtccctgacagaccc

SEQ ID NO: 90172 - DNA, 25 bp, mus musculus
ccctctgcagtccctgacagaccct

SEQ ID NO: 90173 - DNA, 25 bp, mus musculus
cctctgcagtccctgacagaccctt

SEQ ID NO: 90174 - DNA, 25 bp, mus musculus
tctgcagtccctgacagacccttca

SEQ ID NO: 90175 - DNA, 25 bp, mus musculus
ctgcagtccctgacagacccttcat

SEQ ID NO: 90176 - DNA, 25 bp, mus musculus
tgcagtccctgacagacccttcatc

SEQ ID NO: 90177 - DNA, 25 bp, mus musculus
cagtccctgacagacccttcatccc

SEQ ID NO: 90178 - DNA, 25 bp, mus musculus
agtccctgacagacccttcatccca

SEQ ID NO: 90179 - DNA, 25 bp, mus musculus
cacatcaacatcttcctaatcgcaa

SEQ ID NO: 90180 - DNA, 25 bp, mus musculus
catcaacatcttcctaatcgcaaac

SEQ ID NO: 90181 - DNA, 25 bp, mus musculus
cgacaaccggtcaactgatgtagag

SEQ ID NO: 90182 - DNA, 25 bp, mus musculus
aaccggtcaactgatgtagagatgt

SEQ ID NO: 90183 - DNA, 25 bp, mus musculus
gctgcttcgattgtgcctgtgtctt

SEQ ID NO: 90184 - DNA, 25 bp, mus musculus
cttcgattgtgcctgtgtcttagag

SEQ ID NO: 90185 - DNA, 25 bp, mus musculus
tcgattgtgcctgtgtcttagagaa

SEQ ID NO: 90186 - DNA, 25 bp, mus musculus
gtgcctgtgtcttagagaagctgaa

SEQ ID NO: 90187 - DNA, 25 bp, mus musculus
agactatgctgacgatcagtgagtg

SEQ ID NO: 90188 - DNA, 25 bp, mus musculus
actatgctgacgatcagtgagtggc

SEQ ID NO: 90189 - DNA, 25 bp, mus musculus
tatgctgacgatcagtgagtggccc

SEQ ID NO: 90190 - DNA, 25 bp, mus musculus
tgctgacgatcagtgagtggcccca

SEQ ID NO: 90191 - DNA, 25 bp, mus musculus
catcttcctaatcgcaaacgtagat

SEQ ID NO: 90192 - DNA, 25 bp, mus musculus
tcttcctaatcgcaaacgtagattg

SEQ ID NO: 90193 - DNA, 25 bp, mus musculus
ttcctaatcgcaaacgtagattgtg

SEQ ID NO: 90194 - DNA, 25 bp, mus musculus
atcgcaaacgtagattgtggcaagt

SEQ ID NO: 90195 - DNA, 25 bp, mus musculus
ggcaagtgcacgacaaccggtcaac

SEQ ID NO: 90196 - DNA, 25 bp, mus musculus
caagtgcacgacaaccggtcaactg

SEQ ID NO: 90197 - DNA, 25 bp, mus musculus
agtgcacgacaaccggtcaactgat

SEQ ID NO: 90198 - DNA, 25 bp, mus musculus
tgcacgacaaccggtcaactgatgt

SEQ ID NO: 90199 - DNA, 25 bp, mus musculus
agattctccatgctcaaacactgaa

SEQ ID NO: 90200 - DNA, 25 bp, mus musculus
attctccatgctcaaacactgaaaa

SEQ ID NO: 90201 - DNA, 25 bp, mus musculus
taacaaccttcacgcacttatggct

SEQ ID NO: 90202 - DNA, 25 bp, mus musculus
cttatggctgtggtttctggcttac

SEQ ID NO: 90203 - DNA, 25 bp, mus musculus
tatggctgtggtttctggcttacag

SEQ ID NO: 90204 - DNA, 25 bp, mus musculus
gtttctggcttacagagtgcgccga

SEQ ID NO: 90205 - DNA, 25 bp, mus musculus
ggcttacagagtgcgccgattttca

SEQ ID NO: 90206 - DNA, 25 bp, mus musculus
cttacagagtgcgccgattttcagg

SEQ ID NO: 90207 - DNA, 25 bp, mus musculus
tacagagtgcgccgattttcaggtt

SEQ ID NO: 90208 - DNA, 25 bp, mus musculus
cagagtgcgccgattttcaggttga

SEQ ID NO: 90209 - DNA, 25 bp, mus musculus
gtgcgccgattttcaggttgactaa

SEQ ID NO: 90210 - DNA, 25 bp, mus musculus
cgattttcaggttgactaagacgtg

SEQ ID NO: 90211 - DNA, 25 bp, mus musculus
tccatgctcaaacactgaaaataag

SEQ ID NO: 90212 - DNA, 25 bp, mus musculus
catgctcaaacactgaaaataagag

SEQ ID NO: 90213 - DNA, 25 bp, mus musculus
tgctcaaacactgaaaataagagca

SEQ ID NO: 90214 - DNA, 25 bp, mus musculus
gttttgagccactatattaagactg

SEQ ID NO: 90215 - DNA, 25 bp, mus musculus
tttgagccactatattaagactgct

SEQ ID NO: 90216 - DNA, 25 bp, mus musculus
tatatgaacttaacaaccttcacgc

SEQ ID NO: 90217 - DNA, 25 bp, mus musculus
tgaacttaacaaccttcacgcactt

SEQ ID NO: 90218 - DNA, 25 bp, mus musculus
cttaacaaccttcacgcacttatgg

SEQ ID NO: 90219 - DNA, 25 bp, mus musculus
atctgcctcaggcagcctagccgtt

SEQ ID NO: 90220 - DNA, 25 bp, mus musculus
tctgcctcaggcagcctagccgttt

SEQ ID NO: 90221 - DNA, 25 bp, mus musculus
tggtgagatccacgggcagtgcatg

SEQ ID NO: 90222 - DNA, 25 bp, mus musculus
gtgagatccacgggcagtgcatgag

SEQ ID NO: 90223 - DNA, 25 bp, mus musculus
tgagatccacgggcagtgcatgagg

SEQ ID NO: 90224 - DNA, 25 bp, mus musculus
gagatccacgggcagtgcatgaggt

SEQ ID NO: 90225 - DNA, 25 bp, mus musculus
atacgggggtttcctgcaggagcag

SEQ ID NO: 90226 - DNA, 25 bp, mus musculus
ggggtttcctgcaggagcagtattg

SEQ ID NO: 90227 - DNA, 25 bp, mus musculus
gggtttcctgcaggagcagtattgt

SEQ ID NO: 90228 - DNA, 25 bp, mus musculus
ggtttcctgcaggagcagtattgtg

SEQ ID NO: 90229 - DNA, 25 bp, mus musculus
tttcctgcaggagcagtattgtggc

SEQ ID NO: 90230 - DNA, 25 bp, mus musculus
ttcctgcaggagcagtattgtggct

SEQ ID NO: 90231 - DNA, 25 bp, mus musculus
tgcctcaggcagcctagccgtttgg

SEQ ID NO: 90232 - DNA, 25 bp, mus musculus
gcctcaggcagcctagccgtttgga

SEQ ID NO: 90233 - DNA, 25 bp, mus musculus
cctcaggcagcctagccgtttggag

SEQ ID NO: 90234 - DNA, 25 bp, mus musculus
tcaggcagcctagccgtttggagct

SEQ ID NO: 90235 - DNA, 25 bp, mus musculus
caggcagcctagccgtttggagctt

SEQ ID NO: 90236 - DNA, 25 bp, mus musculus
aggcagcctagccgtttggagcttg

SEQ ID NO: 90237 - DNA, 25 bp, mus musculus
agcttggggcagcgctcgagatatg

SEQ ID NO: 90238 - DNA, 25 bp, mus musculus
gcagcgctcgagatatgtggtgaga

SEQ ID NO: 90239 - DNA, 25 bp, mus musculus
tcctggacactgtcatcaagtacct

SEQ ID NO: 90240 - DNA, 25 bp, mus musculus
tggacactgtcatcaagtacctgcc

SEQ ID NO: 90241 - DNA, 25 bp, mus musculus
ggctaccagtcagggcctaaactca

SEQ ID NO: 90242 - DNA, 25 bp, mus musculus
tcagggcctaaactcaggagcacag

SEQ ID NO: 90243 - DNA, 25 bp, mus musculus
cctaaactcaggagcacagccatag

SEQ ID NO: 90244 - DNA, 25 bp, mus musculus
ctcaggagcacagccatagtggggt

SEQ ID NO: 90245 - DNA, 25 bp, mus musculus
agtccattgccccagtttctggact

SEQ ID NO: 90246 - DNA, 25 bp, mus musculus
ccattgccccagtttctggacttgt

SEQ ID NO: 90247 - DNA, 25 bp, mus musculus
gacttgttggacctgctggaccatt

SEQ ID NO: 90248 - DNA, 25 bp, mus musculus
ttgttggacctgctggaccattcgc

SEQ ID NO: 90249 - DNA, 25 bp, mus musculus
ctgctggaccattcgctctgtcttc

SEQ ID NO: 90250 - DNA, 25 bp, mus musculus
tgtcttcctgtctgtgagctaccac

SEQ ID NO: 90251 - DNA, 25 bp, mus musculus
acactgtcatcaagtacctgcctgg

SEQ ID NO: 90252 - DNA, 25 bp, mus musculus
tcatcaagtacctgcctgggccact

SEQ ID NO: 90253 - DNA, 25 bp, mus musculus
agtacctgcctgggccactgcagga

SEQ ID NO: 90254 - DNA, 25 bp, mus musculus
gatattgggtcagcaccaggagccc

SEQ ID NO: 90255 - DNA, 25 bp, mus musculus
aagccatagtcctagatctatcctg

SEQ ID NO: 90256 - DNA, 25 bp, mus musculus
ccatagtcctagatctatcctgccc

SEQ ID NO: 90257 - DNA, 25 bp, mus musculus
gtgtgaccctcaggcccctgtgctg

SEQ ID NO: 90258 - DNA, 25 bp, mus musculus
cccacagagcctgcccaaggtcagg

SEQ ID NO: 90259 - DNA, 25 bp, mus musculus
cttctgaagtccttgtgccatgtat

SEQ ID NO: 90260 - DNA, 25 bp, mus musculus
ctgaagtccttgtgccatgtatcta

SEQ ID NO: 90261 - DNA, 25 bp, mus musculus
cctgcttcattttgcagtaaatatg

SEQ ID NO: 90262 - DNA, 25 bp, mus musculus
atgcctaagaggcctgcatatgatt

SEQ ID NO: 90263 - DNA, 25 bp, mus musculus
cctaagaggcctgcatatgattgag

SEQ ID NO: 90264 - DNA, 25 bp, mus musculus
aggcttctgattgtatgtgactgtg

SEQ ID NO: 90265 - DNA, 25 bp, mus musculus
cttctgattgtatgtgactgtgata

SEQ ID NO: 90266 - DNA, 25 bp, mus musculus
tttatcattgacatgtgagttacag

SEQ ID NO: 90267 - DNA, 25 bp, mus musculus
aatattgtcctgtgtaattgtgtaa

SEQ ID NO: 90268 - DNA, 25 bp, mus musculus
tggacactttaccatttctgaaaat

SEQ ID NO: 90269 - DNA, 25 bp, mus musculus
atttcatattctgttcattcactga

SEQ ID NO: 90270 - DNA, 25 bp, mus musculus
tcatattctgttcattcactgaaaa

SEQ ID NO: 90271 - DNA, 25 bp, mus musculus
attaatctgtggctgtgaatattat

SEQ ID NO: 90272 - DNA, 25 bp, mus musculus
tggaaacctacctaagagtgctttg

SEQ ID NO: 90273 - DNA, 25 bp, mus musculus
cctacctaagagtgctttgctattt

SEQ ID NO: 90274 - DNA, 25 bp, mus musculus
cttatcctcttagtgctttggccaa

SEQ ID NO: 90275 - DNA, 25 bp, mus musculus
atcctcttagtgctttggccaattg

SEQ ID NO: 90276 - DNA, 25 bp, mus musculus
ctcttagtgctttggccaattgact

SEQ ID NO: 90277 - DNA, 25 bp, mus musculus
gtgctttggccaattgactttattg

SEQ ID NO: 90278 - DNA, 25 bp, mus musculus
ctttggccaattgactttattgtgc

SEQ ID NO: 90279 - DNA, 25 bp, mus musculus
agctgtactaccaggctgtctctgt

SEQ ID NO: 90280 - DNA, 25 bp, mus musculus
ctgtactaccaggctgtctctgtga

SEQ ID NO: 90281 - DNA, 25 bp, mus musculus
tctctgtgatcaacttcaggaagag

SEQ ID NO: 90282 - DNA, 25 bp, mus musculus
tctgtgatcaacttcaggaagagaa

SEQ ID NO: 90283 - DNA, 25 bp, mus musculus
ctgtgatcaacttcaggaagagaag

SEQ ID NO: 90284 - DNA, 25 bp, mus musculus
aaggtctttgacgatggtgagatga

SEQ ID NO: 90285 - DNA, 25 bp, mus musculus
tctttgacgatggtgagatgaacag

SEQ ID NO: 90286 - DNA, 25 bp, mus musculus
aacagattttgccagggagatgcca

SEQ ID NO: 90287 - DNA, 25 bp, mus musculus
acagattttgccagggagatgccat

SEQ ID NO: 90288 - DNA, 25 bp, mus musculus
agattttgccagggagatgccattg

SEQ ID NO: 90289 - DNA, 25 bp, mus musculus
ttttgccagggagatgccattgggt

SEQ ID NO: 90290 - DNA, 25 bp, mus musculus
aggaggtccccatcacctatgctgg

SEQ ID NO: 90291 - DNA, 25 bp, mus musculus
tgtactaccaggctgtctctgtgat

SEQ ID NO: 90292 - DNA, 25 bp, mus musculus
tactaccaggctgtctctgtgatca

SEQ ID NO: 90293 - DNA, 25 bp, mus musculus
actaccaggctgtctctgtgatcaa

SEQ ID NO: 90294 - DNA, 25 bp, mus musculus
taccaggctgtctctgtgatcaact

SEQ ID NO: 90295 - DNA, 25 bp, mus musculus
caggctgtctctgtgatcaacttca

SEQ ID NO: 90296 - DNA, 25 bp, mus musculus
aggctgtctctgtgatcaacttcag

SEQ ID NO: 90297 - DNA, 25 bp, mus musculus
ctgtctctgtgatcaacttcaggaa

SEQ ID NO: 90298 - DNA, 25 bp, mus musculus
gtctctgtgatcaacttcaggaaga

SEQ ID NO: 90299 - DNA, 25 bp, mus musculus
ccgagcggccaccatggtttacaca

SEQ ID NO: 90300 - DNA, 25 bp, mus musculus
agcggccaccatggtttacacagag

SEQ ID NO: 90301 - DNA, 25 bp, mus musculus
ggaagccttgtcatctttcaatact

SEQ ID NO: 90302 - DNA, 25 bp, mus musculus
cttgtcatctttcaatactctgggc

SEQ ID NO: 90303 - DNA, 25 bp, mus musculus
gtcatctttcaatactctgggccat

SEQ ID NO: 90304 - DNA, 25 bp, mus musculus
atctttcaatactctgggccatggt

SEQ ID NO: 90305 - DNA, 25 bp, mus musculus
tttcaatactctgggccatggtggg

SEQ ID NO: 90306 - DNA, 25 bp, mus musculus
ctccaccttttcatctgcttcgttt

SEQ ID NO: 90307 - DNA, 25 bp, mus musculus
caccttttcatctgcttcgtttggt

SEQ ID NO: 90308 - DNA, 25 bp, mus musculus
cttttcatctgcttcgtttggtggc

SEQ ID NO: 90309 - DNA, 25 bp, mus musculus
tggctctggcagctcagggttcaag

SEQ ID NO: 90310 - DNA, 25 bp, mus musculus
taaagtgatcaccaagcgaatcatt

SEQ ID NO: 90311 - DNA, 25 bp, mus musculus
ttacacagagtcttcccttcgggca

SEQ ID NO: 90312 - DNA, 25 bp, mus musculus
cacagagtcttcccttcgggcattt

SEQ ID NO: 90313 - DNA, 25 bp, mus musculus
tggtgagttcccagccttcatggaa

SEQ ID NO: 90314 - DNA, 25 bp, mus musculus
gttcccagccttcatggaagccttg

SEQ ID NO: 90315 - DNA, 25 bp, mus musculus
cccagccttcatggaagccttgtca

SEQ ID NO: 90316 - DNA, 25 bp, mus musculus
agccttcatggaagccttgtcatct

SEQ ID NO: 90317 - DNA, 25 bp, mus musculus
cttcatggaagccttgtcatctttc

SEQ ID NO: 90318 - DNA, 25 bp, mus musculus
catggaagccttgtcatctttcaat

SEQ ID NO: 90319 - DNA, 25 bp, mus musculus
ctgctgctcgcaactagtaagacct

SEQ ID NO: 90320 - DNA, 25 bp, mus musculus
gctgctcgcaactagtaagacctgg

SEQ ID NO: 90321 - DNA, 25 bp, mus musculus
atgtctaccgagctacgcgccgcct

SEQ ID NO: 90322 - DNA, 25 bp, mus musculus
cgcctgctgctgctaggatactaga

SEQ ID NO: 90323 - DNA, 25 bp, mus musculus
cctgctgctgctaggatactagaga

SEQ ID NO: 90324 - DNA, 25 bp, mus musculus
tgctgctgctaggatactagagagt

SEQ ID NO: 90325 - DNA, 25 bp, mus musculus
cgaataggactcgcagctggcaagg

SEQ ID NO: 90326 - DNA, 25 bp, mus musculus
taggactcgcagctggcaaggaacg

SEQ ID NO: 90327 - DNA, 25 bp, mus musculus
ggactcgcagctggcaaggaacgac

SEQ ID NO: 90328 - DNA, 25 bp, mus musculus
actcgcagctggcaaggaacgacat

SEQ ID NO: 90329 - DNA, 25 bp, mus musculus
gccactgcagtgcaggtgcgtcgta

SEQ ID NO: 90330 - DNA, 25 bp, mus musculus
cactgcagtgcaggtgcgtcgtaag

SEQ ID NO: 90331 - DNA, 25 bp, mus musculus
tgctcgcaactagtaagacctggga

SEQ ID NO: 90332 - DNA, 25 bp, mus musculus
tagtaagacctgggaccagcgcaac

SEQ ID NO: 90333 - DNA, 25 bp, mus musculus
atcgtgaatcagctgcagaaggagc

SEQ ID NO: 90334 - DNA, 25 bp, mus musculus
cgtgaatcagctgcagaaggagcag

SEQ ID NO: 90335 - DNA, 25 bp, mus musculus
tgaatcagctgcagaaggagcagca

SEQ ID NO: 90336 - DNA, 25 bp, mus musculus
ggagcagcatgtctaccgagctacg

SEQ ID NO: 90337 - DNA, 25 bp, mus musculus
agcagcatgtctaccgagctacgcg

SEQ ID NO: 90338 - DNA, 25 bp, mus musculus
cagcatgtctaccgagctacgcgcc

SEQ ID NO: 90339 - DNA, 25 bp, mus musculus
aggacccaccaagtatccggcatag

SEQ ID NO: 90340 - DNA, 25 bp, mus musculus
ctgaacccgagtctgatgcacattt

SEQ ID NO: 90341 - DNA, 25 bp, mus musculus
agctgtcggaagacctgggagtctt

SEQ ID NO: 90342 - DNA, 25 bp, mus musculus
agaactcaccattgtctttgccagc

SEQ ID NO: 90343 - DNA, 25 bp, mus musculus
caccattgtctttgccagccctgaa

SEQ ID NO: 90344 - DNA, 25 bp, mus musculus
aagatgacagcctgcccagtacctc

SEQ ID NO: 90345 - DNA, 25 bp, mus musculus
tgcccagtacctccttggtctccgt

SEQ ID NO: 90346 - DNA, 25 bp, mus musculus
ccttggtctccgtgtatactagcta

SEQ ID NO: 90347 - DNA, 25 bp, mus musculus
tctccgtgtatactagctatcccta

SEQ ID NO: 90348 - DNA, 25 bp, mus musculus
tgtatactagctatccctactaccc

SEQ ID NO: 90349 - DNA, 25 bp, mus musculus
cctacctgtactgtctgggcagctg

SEQ ID NO: 90350 - DNA, 25 bp, mus musculus
tgtactgtctgggcagctggcatcc

SEQ ID NO: 90351 - DNA, 25 bp, mus musculus
aacataatccaggggacttagcaag

SEQ ID NO: 90352 - DNA, 25 bp, mus musculus
cagctggcatccatctttctggtag

SEQ ID NO: 90353 - DNA, 25 bp, mus musculus
cccaggtcaccaagcagccacagaa

SEQ ID NO: 90354 - DNA, 25 bp, mus musculus
agcagccacagaagcgctcccgggc

SEQ ID NO: 90355 - DNA, 25 bp, mus musculus
tctctcacactcaggtgattgagtt

SEQ ID NO: 90356 - DNA, 25 bp, mus musculus
acactcaggtgattgagttggagag

SEQ ID NO: 90357 - DNA, 25 bp, mus musculus
tggccaagaacctcaaactcaccga

SEQ ID NO: 90358 - DNA, 25 bp, mus musculus
tcaccgaaacccaagtcaaaatatg

SEQ ID NO: 90359 - DNA, 25 bp, mus musculus
ggttccagaacagacgctataagac

SEQ ID NO: 90360 - DNA, 25 bp, mus musculus
cgctccatcatcatgagagagaact

SEQ ID NO: 90361 - DNA, 25 bp, mus musculus
tccatcatcatgagagagaacttca

SEQ ID NO: 90362 - DNA, 25 bp, mus musculus
gagatcgtcaaccgggcttccctgg

SEQ ID NO: 90363 - DNA, 25 bp, mus musculus
gtcaaccgggcttccctggcttgtg

SEQ ID NO: 90364 - DNA, 25 bp, mus musculus
tccctggcttgtggtcctatggtga

SEQ ID NO: 90365 - DNA, 25 bp, mus musculus
gcgattgcacagctcaattatgcag

SEQ ID NO: 90366 - DNA, 25 bp, mus musculus
attgcacagctcaattatgcagaca

SEQ ID NO: 90367 - DNA, 25 bp, mus musculus
gcacagctcaattatgcagacatgt

SEQ ID NO: 90368 - DNA, 25 bp, mus musculus
gtggagcccctgaggaatgagctgc

SEQ ID NO: 90369 - DNA, 25 bp, mus musculus
gatgacgccaaggacaaccagcaga

SEQ ID NO: 90370 - DNA, 25 bp, mus musculus
gacgccaaggacaaccagcagaaag

SEQ ID NO: 90371 - DNA, 25 bp, mus musculus
gccaaggacaaccagcagaaagcca

SEQ ID NO: 90372 - DNA, 25 bp, mus musculus
accatcgtcaacttctcggctgagg

SEQ ID NO: 90373 - DNA, 25 bp, mus musculus
atcgtcaacttctcggctgaggaga

SEQ ID NO: 90374 - DNA, 25 bp, mus musculus
gtcaacttctcggctgaggagatca

SEQ ID NO: 90375 - DNA, 25 bp, mus musculus
ttctcggctgaggagatcagtgatg

SEQ ID NO: 90376 - DNA, 25 bp, mus musculus
atcagtgatgccatacgagagaaga

SEQ ID NO: 90377 - DNA, 25 bp, mus musculus
aaccccagttacaactatgagatcg

SEQ ID NO: 90378 - DNA, 25 bp, mus musculus
cccagttacaactatgagatcgtca

SEQ ID NO: 90379 - DNA, 25 bp, mus musculus
tatgagatcgtcaaccgggcttccc

SEQ ID NO: 90380 - DNA, 25 bp, mus musculus
gccttcagttgccacttttcagatg

SEQ ID NO: 90381 - DNA, 25 bp, mus musculus
agttgccacttttcagatgtgttgg

SEQ ID NO: 90382 - DNA, 25 bp, mus musculus
agttttccctcatacagagctctgg

SEQ ID NO: 90383 - DNA, 25 bp, mus musculus
ccctcatacagagctctggacaaag

SEQ ID NO: 90384 - DNA, 25 bp, mus musculus
tcatacagagctctggacaaaggat

SEQ ID NO: 90385 - DNA, 25 bp, mus musculus
tacagagctctggacaaaggatgct

SEQ ID NO: 90386 - DNA, 25 bp, mus musculus
gtatcttagcacatgctctatgaga

SEQ ID NO: 90387 - DNA, 25 bp, mus musculus
tcttagcacatgctctatgagagtt

SEQ ID NO: 90388 - DNA, 25 bp, mus musculus
tagcacatgctctatgagagttgag

SEQ ID NO: 90389 - DNA, 25 bp, mus musculus
atgctctatgagagttgaggcagaa

SEQ ID NO: 90390 - DNA, 25 bp, mus musculus
taatttaccatgtaatattgctgta

SEQ ID NO: 90391 - DNA, 25 bp, mus musculus
tattgcttttgtatggaatgataat

SEQ ID NO: 90392 - DNA, 25 bp, mus musculus
gattttaaccatgtgtctatgggac

SEQ ID NO: 90393 - DNA, 25 bp, mus musculus
aaccatgtgtctatgggaccaattt

SEQ ID NO: 90394 - DNA, 25 bp, mus musculus
tagaatcagttgcctttcaggtaac

SEQ ID NO: 90395 - DNA, 25 bp, mus musculus
cagttgcctttcaggtaactgataa

SEQ ID NO: 90396 - DNA, 25 bp, mus musculus
tctcagtcaggcagctgcaatgact

SEQ ID NO: 90397 - DNA, 25 bp, mus musculus
agctgcaatgactctgtaaaaactt

SEQ ID NO: 90398 - DNA, 25 bp, mus musculus
gaatgtagttttccctcatacagag

SEQ ID NO: 90399 - DNA, 25 bp, mus musculus
tgtagttttccctcatacagagctc

SEQ ID NO: 90400 - DNA, 25 bp, mus musculus
cacatctgtcctcacgctgtgggac

SEQ ID NO: 90401 - DNA, 25 bp, mus musculus
tgtcctcacgctgtgggaccgcctg

SEQ ID NO: 90402 - DNA, 25 bp, mus musculus
gcccttgtttacagtgaggacttgg

SEQ ID NO: 90403 - DNA, 25 bp, mus musculus
gtcactgtgtctctgtttcctgaaa

SEQ ID NO: 90404 - DNA, 25 bp, mus musculus
gtgtctctgtttcctgaaatatgaa

SEQ ID NO: 90405 - DNA, 25 bp, mus musculus
attgtagcgaccccagactgtagag

SEQ ID NO: 90406 - DNA, 25 bp, mus musculus
gcgaccccagactgtagagattttt

SEQ ID NO: 90407 - DNA, 25 bp, mus musculus
tttgggtacatctgctgtgtggaaa

SEQ ID NO: 90408 - DNA, 25 bp, mus musculus
gaactgtactctagtggctgttcat

SEQ ID NO: 90409 - DNA, 25 bp, mus musculus
tactctagtggctgttcatgctctg

SEQ ID NO: 90410 - DNA, 25 bp, mus musculus
tgttcatgctctgagtttaggtatt

SEQ ID NO: 90411 - DNA, 25 bp, mus musculus
atgaatactatccatgtaataagca

SEQ ID NO: 90412 - DNA, 25 bp, mus musculus
acatacacacaccttacctctcatg

SEQ ID NO: 90413 - DNA, 25 bp, mus musculus
cttacctctcatgcgtgttttacct

SEQ ID NO: 90414 - DNA, 25 bp, mus musculus
tctcatgcgtgttttacctgtgctg

SEQ ID NO: 90415 - DNA, 25 bp, mus musculus
agtggctcactgcctgggatcttta

SEQ ID NO: 90416 - DNA, 25 bp, mus musculus
tcactgcctgggatctttacctcgg

SEQ ID NO: 90417 - DNA, 25 bp, mus musculus
gggtcaccacagtctctctctagga

SEQ ID NO: 90418 - DNA, 25 bp, mus musculus
ccacagtctctctctaggaacagct

SEQ ID NO: 90419 - DNA, 25 bp, mus musculus
tctctctctaggaacagctgcttct

SEQ ID NO: 90420 - DNA, 25 bp, mus musculus
aggagcttcaccaagatgtcgtctt

SEQ ID NO: 90421 - DNA, 25 bp, mus musculus
ttcaccaagatgtcgtctttgaatg

SEQ ID NO: 90422 - DNA, 25 bp, mus musculus
ccgagcttctacaacaggagcaggg

SEQ ID NO: 90423 - DNA, 25 bp, mus musculus
ctgtgaccaacatacaggccaacat

SEQ ID NO: 90424 - DNA, 25 bp, mus musculus
tacacgatgtcgccgtgcatgccct

SEQ ID NO: 90425 - DNA, 25 bp, mus musculus
atgccctgaacatgctgcgcagttt

SEQ ID NO: 90426 - DNA, 25 bp, mus musculus
tgaacatgctgcgcagttttcgtgg

SEQ ID NO: 90427 - DNA, 25 bp, mus musculus
gaagttaccgcaaacccattgcaga

SEQ ID NO: 90428 - DNA, 25 bp, mus musculus
accgcaaacccattgcagacctgtt

SEQ ID NO: 90429 - DNA, 25 bp, mus musculus
aacccattgcagacctgttatggca

SEQ ID NO: 90430 - DNA, 25 bp, mus musculus
caacatcctccaagaccttgacttt

SEQ ID NO: 90431 - DNA, 25 bp, mus musculus
agaccttgactttggatttcagaag

SEQ ID NO: 90432 - DNA, 25 bp, mus musculus
gagaccagtaccctctgaacctcac

SEQ ID NO: 90433 - DNA, 25 bp, mus musculus
ctctgaacctcacctgggaatgtcc

SEQ ID NO: 90434 - DNA, 25 bp, mus musculus
ttgtctccggaagtgggagacatgc

SEQ ID NO: 90435 - DNA, 25 bp, mus musculus
gggaatgctccaacgcccactgaat

SEQ ID NO: 90436 - DNA, 25 bp, mus musculus
acgcccactgaattttgcacaaggc

SEQ ID NO: 90437 - DNA, 25 bp, mus musculus
acaaggcggctcatgttttaagtgg

SEQ ID NO: 90438 - DNA, 25 bp, mus musculus
actcttccagtaaaatggcaggcaa

SEQ ID NO: 90439 - DNA, 25 bp, mus musculus
caggcaagcaacccgagcttctaca

SEQ ID NO: 90440 - DNA, 25 bp, mus musculus
agtacagactttctgttggcaccag

SEQ ID NO: 90441 - DNA, 25 bp, mus musculus
acagactttctgttggcaccagtga

SEQ ID NO: 90442 - DNA, 25 bp, mus musculus
gccactggataaacccagtcacaga

SEQ ID NO: 90443 - DNA, 25 bp, mus musculus
actggataaacccagtcacagaagt

SEQ ID NO: 90444 - DNA, 25 bp, mus musculus
ggataaacccagtcacagaagtctc

SEQ ID NO: 90445 - DNA, 25 bp, mus musculus
acccagtcacagaagtctctctgca

SEQ ID NO: 90446 - DNA, 25 bp, mus musculus
cagtcacagaagtctctctgcaggc

SEQ ID NO: 90447 - DNA, 25 bp, mus musculus
aagtctctctgcaggcatttaggta

SEQ ID NO: 90448 - DNA, 25 bp, mus musculus
tctctctgcaggcatttaggtactg

SEQ ID NO: 90449 - DNA, 25 bp, mus musculus
ctctgtggctgtttggagcagggat

SEQ ID NO: 90450 - DNA, 25 bp, mus musculus
caactttaatccataatgatcgaca

SEQ ID NO: 90451 - DNA, 25 bp, mus musculus
ctttaatccataatgatcgacactg

SEQ ID NO: 90452 - DNA, 25 bp, mus musculus
ctgttggcaccagtgagaagataca

SEQ ID NO: 90453 - DNA, 25 bp, mus musculus
tcatcgccgcttttcaagtcaccag

SEQ ID NO: 90454 - DNA, 25 bp, mus musculus
cttttcaagtcaccagagacctgat

SEQ ID NO: 90455 - DNA, 25 bp, mus musculus
ttcaagtcaccagagacctgatagt

SEQ ID NO: 90456 - DNA, 25 bp, mus musculus
aagtcaccagagacctgatagttgc

SEQ ID NO: 90457 - DNA, 25 bp, mus musculus
tagttgcagaggcctagaagctctg

SEQ ID NO: 90458 - DNA, 25 bp, mus musculus
agaagctctgaggcctggcccctgg

SEQ ID NO: 90459 - DNA, 25 bp, mus musculus
acagaggacatgctgccctgggcca

SEQ ID NO: 90460 - DNA, 25 bp, mus musculus
aacagagcatccttttctacttcga

SEQ ID NO: 90461 - DNA, 25 bp, mus musculus
agagcatccttttctacttcgatgt

SEQ ID NO: 90462 - DNA, 25 bp, mus musculus
agtctcttgattcataatgactaag

SEQ ID NO: 90463 - DNA, 25 bp, mus musculus
cataatgactaagcacacttgacat

SEQ ID NO: 90464 - DNA, 25 bp, mus musculus
aatgactaagcacacttgacatcaa

SEQ ID NO: 90465 - DNA, 25 bp, mus musculus
gcacacttgacatcaactgcatcaa

SEQ ID NO: 90466 - DNA, 25 bp, mus musculus
ttgacatcaactgcatcaagatgtg

SEQ ID NO: 90467 - DNA, 25 bp, mus musculus
tcaactgcatcaagatgtgacctgt

SEQ ID NO: 90468 - DNA, 25 bp, mus musculus
gtattttcacagacaaactggcttt

SEQ ID NO: 90469 - DNA, 25 bp, mus musculus
tttttcaaagccaaatatgtaaatg

SEQ ID NO: 90470 - DNA, 25 bp, mus musculus
aatgtatcctgttctttaacatttg

SEQ ID NO: 90471 - DNA, 25 bp, mus musculus
gtatcctgttctttaacatttggtg

SEQ ID NO: 90472 - DNA, 25 bp, mus musculus
tctacttcgatgtcagaggaagcgt

SEQ ID NO: 90473 - DNA, 25 bp, mus musculus
acatgcacagctaacatggaagtac

SEQ ID NO: 90474 - DNA, 25 bp, mus musculus
gaagtactatcacttaactgaagtc

SEQ ID NO: 90475 - DNA, 25 bp, mus musculus
ctatcacttaactgaagtctttgta

SEQ ID NO: 90476 - DNA, 25 bp, mus musculus
gtttccgcagccactattgttagtc

SEQ ID NO: 90477 - DNA, 25 bp, mus musculus
tccgcagccactattgttagtctct

SEQ ID NO: 90478 - DNA, 25 bp, mus musculus
actattgttagtctcttgattcata

SEQ ID NO: 90479 - DNA, 25 bp, mus musculus
attgttagtctcttgattcataatg

SEQ ID NO: 90480 - DNA, 25 bp, mus musculus
ttccctcatcctttgactagaccac

SEQ ID NO: 90481 - DNA, 25 bp, mus musculus
tccctcatcctttgactagaccact

SEQ ID NO: 90482 - DNA, 25 bp, mus musculus
tagaccacttttgccagcccacctt

SEQ ID NO: 90483 - DNA, 25 bp, mus musculus
agaccacttttgccagcccaccttg

SEQ ID NO: 90484 - DNA, 25 bp, mus musculus
gaccacttttgccagcccaccttga

SEQ ID NO: 90485 - DNA, 25 bp, mus musculus
accacttttgccagcccaccttgat

SEQ ID NO: 90486 - DNA, 25 bp, mus musculus
cacttttgccagcccaccttgatca

SEQ ID NO: 90487 - DNA, 25 bp, mus musculus
cttttgccagcccaccttgatcatg

SEQ ID NO: 90488 - DNA, 25 bp, mus musculus
tttgccagcccaccttgatcatgtt

SEQ ID NO: 90489 - DNA, 25 bp, mus musculus
tgccagcccaccttgatcatgttgc

SEQ ID NO: 90490 - DNA, 25 bp, mus musculus
caccttgatcatgttgcctgcattc

SEQ ID NO: 90491 - DNA, 25 bp, mus musculus
accttgatcatgttgcctgcattcc

SEQ ID NO: 90492 - DNA, 25 bp, mus musculus
ccctcatcctttgactagaccactt

SEQ ID NO: 90493 - DNA, 25 bp, mus musculus
cctcatcctttgactagaccacttt

SEQ ID NO: 90494 - DNA, 25 bp, mus musculus
tcatcctttgactagaccacttttg

SEQ ID NO: 90495 - DNA, 25 bp, mus musculus
tcctttgactagaccacttttgcca

SEQ ID NO: 90496 - DNA, 25 bp, mus musculus
ctttgactagaccacttttgccagc

SEQ ID NO: 90497 - DNA, 25 bp, mus musculus
tttgactagaccacttttgccagcc

SEQ ID NO: 90498 - DNA, 25 bp, mus musculus
ttgactagaccacttttgccagccc

SEQ ID NO: 90499 - DNA, 25 bp, mus musculus
tgactagaccacttttgccagccca

SEQ ID NO: 90500 - DNA, 25 bp, mus musculus
tcacggctgttctgaagaatgaaaa

SEQ ID NO: 90501 - DNA, 25 bp, mus musculus
agatcagccacttagaattcaaatt

SEQ ID NO: 90502 - DNA, 25 bp, mus musculus
atatatagtggcctttcaggactgt

SEQ ID NO: 90503 - DNA, 25 bp, mus musculus
agtggcctttcaggactgtcacagt

SEQ ID NO: 90504 - DNA, 25 bp, mus musculus
ggcctttcaggactgtcacagtaac

SEQ ID NO: 90505 - DNA, 25 bp, mus musculus
ctttcaggactgtcacagtaacact

SEQ ID NO: 90506 - DNA, 25 bp, mus musculus
ggactgtcacagtaacactttattt

SEQ ID NO: 90507 - DNA, 25 bp, mus musculus
ctgtcacagtaacactttatttaca

SEQ ID NO: 90508 - DNA, 25 bp, mus musculus
tcacagtaacactttatttacagag

SEQ ID NO: 90509 - DNA, 25 bp, mus musculus
cactttatttacagagctaatgttt

SEQ ID NO: 90510 - DNA, 25 bp, mus musculus
atcttgtgtgtggttactgcctaat

SEQ ID NO: 90511 - DNA, 25 bp, mus musculus
tgtgtggttactgcctaatgctttt

SEQ ID NO: 90512 - DNA, 25 bp, mus musculus
agcctagccatctggctcaatctgt

SEQ ID NO: 90513 - DNA, 25 bp, mus musculus
ctagccatctggctcaatctgttta

SEQ ID NO: 90514 - DNA, 25 bp, mus musculus
atctggctcaatctgtttaaatctg

SEQ ID NO: 90515 - DNA, 25 bp, mus musculus
gttctgcttcttataccactattct

SEQ ID NO: 90516 - DNA, 25 bp, mus musculus
cataatcataaggacctcaacactt

SEQ ID NO: 90517 - DNA, 25 bp, mus musculus
cataaggacctcaacacttgaatac

SEQ ID NO: 90518 - DNA, 25 bp, mus musculus
gacctcaacacttgaatacataatc

SEQ ID NO: 90519 - DNA, 25 bp, mus musculus
ctcaacacttgaatacataatctaa

SEQ ID NO: 90520 - DNA, 25 bp, mus musculus
tatcatacttgataaacttagtact

SEQ ID NO: 90521 - DNA, 25 bp, mus musculus
ttttgtcttgtgctactagtagtcc

SEQ ID NO: 90522 - DNA, 25 bp, mus musculus
tcttccttacttataggcagtgtga

SEQ ID NO: 90523 - DNA, 25 bp, mus musculus
ccttacttataggcagtgtgacaga

SEQ ID NO: 90524 - DNA, 25 bp, mus musculus
gaaagtcaagcttctcaaaagaaga

SEQ ID NO: 90525 - DNA, 25 bp, mus musculus
gtcaagcttctcaaaagaagaagca

SEQ ID NO: 90526 - DNA, 25 bp, mus musculus
aagcaacttgtgccatgtggggttg

SEQ ID NO: 90527 - DNA, 25 bp, mus musculus
gcaacttgtgccatgtggggttgta

SEQ ID NO: 90528 - DNA, 25 bp, mus musculus
cttgtgccatgtggggttgtaccca

SEQ ID NO: 90529 - DNA, 25 bp, mus musculus
atttatagctacttccatatttgca

SEQ ID NO: 90530 - DNA, 25 bp, mus musculus
ttatagctacttccatatttgcact

SEQ ID NO: 90531 - DNA, 25 bp, mus musculus
atagctacttccatatttgcactaa

SEQ ID NO: 90532 - DNA, 25 bp, mus musculus
ttgtcttgtgctactagtagtccag

SEQ ID NO: 90533 - DNA, 25 bp, mus musculus
tgtgctactagtagtccagcagtat

SEQ ID NO: 90534 - DNA, 25 bp, mus musculus
tgctactagtagtccagcagtattc

SEQ ID NO: 90535 - DNA, 25 bp, mus musculus
ctactagtagtccagcagtattcca

SEQ ID NO: 90536 - DNA, 25 bp, mus musculus
actagtagtccagcagtattccatg

SEQ ID NO: 90537 - DNA, 25 bp, mus musculus
cagcagtattccatgtcccatcttc

SEQ ID NO: 90538 - DNA, 25 bp, mus musculus
gtcccatcttccttacttataggca

SEQ ID NO: 90539 - DNA, 25 bp, mus musculus
cccatcttccttacttataggcagt

SEQ ID NO: 90540 - DNA, 25 bp, mus musculus
taatactcagggatgcgacgaatac

SEQ ID NO: 90541 - DNA, 25 bp, mus musculus
atactcagggatgcgacgaatacaa

SEQ ID NO: 90542 - DNA, 25 bp, mus musculus
agcccctgctggcagagcagtgcaa

SEQ ID NO: 90543 - DNA, 25 bp, mus musculus
gcccctgctggcagagcagtgcaac

SEQ ID NO: 90544 - DNA, 25 bp, mus musculus
ccctgctggcagagcagtgcaacaa

SEQ ID NO: 90545 - DNA, 25 bp, mus musculus
cctgctggcagagcagtgcaacaaa

SEQ ID NO: 90546 - DNA, 25 bp, mus musculus
agcagtgcaacaaactcacagtgga

SEQ ID NO: 90547 - DNA, 25 bp, mus musculus
gcagtgcaacaaactcacagtggac

SEQ ID NO: 90548 - DNA, 25 bp, mus musculus
gtgcaacaaactcacagtggacaca

SEQ ID NO: 90549 - DNA, 25 bp, mus musculus
gcaacaaactcacagtggacacaga

SEQ ID NO: 90550 - DNA, 25 bp, mus musculus
caaactcacagtggacacagatatc

SEQ ID NO: 90551 - DNA, 25 bp, mus musculus
actcacagtggacacagatatccgc

SEQ ID NO: 90552 - DNA, 25 bp, mus musculus
ggaaactcctgcataccgagtacct

SEQ ID NO: 90553 - DNA, 25 bp, mus musculus
gaaactcctgcataccgagtacctg

SEQ ID NO: 90554 - DNA, 25 bp, mus musculus
aactcctgcataccgagtacctgaa

SEQ ID NO: 90555 - DNA, 25 bp, mus musculus
tcctgcataccgagtacctgaagcc

SEQ ID NO: 90556 - DNA, 25 bp, mus musculus
cctgcataccgagtacctgaagccc

SEQ ID NO: 90557 - DNA, 25 bp, mus musculus
gcataccgagtacctgaagcccctg

SEQ ID NO: 90558 - DNA, 25 bp, mus musculus
ataccgagtacctgaagcccctgct

SEQ ID NO: 90559 - DNA, 25 bp, mus musculus
taccgagtacctgaagcccctgctg

SEQ ID NO: 90560 - DNA, 25 bp, mus musculus
tcctcatcggtgttgctgatattac

SEQ ID NO: 90561 - DNA, 25 bp, mus musculus
tcatcggtgttgctgatattacata

SEQ ID NO: 90562 - DNA, 25 bp, mus musculus
ttctacttagtgtggctgaaatgtt

SEQ ID NO: 90563 - DNA, 25 bp, mus musculus
tgttgctgatgcacagacctctagg

SEQ ID NO: 90564 - DNA, 25 bp, mus musculus
tgctgatgcacagacctctagggag

SEQ ID NO: 90565 - DNA, 25 bp, mus musculus
tgatgcacagacctctagggagaag

SEQ ID NO: 90566 - DNA, 25 bp, mus musculus
acagacctctagggagaagatgagg

SEQ ID NO: 90567 - DNA, 25 bp, mus musculus
tcttagcagctagtctacgcttacg

SEQ ID NO: 90568 - DNA, 25 bp, mus musculus
tagcagctagtctacgcttacggat

SEQ ID NO: 90569 - DNA, 25 bp, mus musculus
ctagtctacgcttacggatgggaag

SEQ ID NO: 90570 - DNA, 25 bp, mus musculus
gtctacgcttacggatgggaagcag

SEQ ID NO: 90571 - DNA, 25 bp, mus musculus
tacgcttacggatgggaagcaggtc

SEQ ID NO: 90572 - DNA, 25 bp, mus musculus
catatccatcactgataatcccatc

SEQ ID NO: 90573 - DNA, 25 bp, mus musculus
atccatcactgataatcccatcctc

SEQ ID NO: 90574 - DNA, 25 bp, mus musculus
gtaattcagcgcgtttacagtcttt

SEQ ID NO: 90575 - DNA, 25 bp, mus musculus
attcagcgcgtttacagtctttcag

SEQ ID NO: 90576 - DNA, 25 bp, mus musculus
tacagtctttcagatactgtcctgt

SEQ ID NO: 90577 - DNA, 25 bp, mus musculus
tcagatactgtcctgttctacttag

SEQ ID NO: 90578 - DNA, 25 bp, mus musculus
gatactgtcctgttctacttagtgt

SEQ ID NO: 90579 - DNA, 25 bp, mus musculus
ctgttctacttagtgtggctgaaat

SEQ ID NO: 90580 - DNA, 25 bp, mus musculus
ttcggatccatgcggctctacgacc

SEQ ID NO: 90581 - DNA, 25 bp, mus musculus
atgcggctctacgaccttgtgatcg

SEQ ID NO: 90582 - DNA, 25 bp, mus musculus
gtgccttggaaccttatgtgtatgc

SEQ ID NO: 90583 - DNA, 25 bp, mus musculus
aaccttatgtgtatgcctggacagc

SEQ ID NO: 90584 - DNA, 25 bp, mus musculus
gtgcggacgactctgggcttcaaga

SEQ ID NO: 90585 - DNA, 25 bp, mus musculus
cggacgactctgggcttcaagaaga

SEQ ID NO: 90586 - DNA, 25 bp, mus musculus
acgactctgggcttcaagaagaagg

SEQ ID NO: 90587 - DNA, 25 bp, mus musculus
ggctatagcaagccacctgtggccg

SEQ ID NO: 90588 - DNA, 25 bp, mus musculus
aagccacctgtggccgtgacgctta

SEQ ID NO: 90589 - DNA, 25 bp, mus musculus
ccacctgtggccgtgacgcttatgc

SEQ ID NO: 90590 - DNA, 25 bp, mus musculus
cctgtggccgtgacgcttatgcaac

SEQ ID NO: 90591 - DNA, 25 bp, mus musculus
acgcttatgcaacagctcaaggcca

SEQ ID NO: 90592 - DNA, 25 bp, mus musculus
ctctacgaccttgtgatcgacctac

SEQ ID NO: 90593 - DNA, 25 bp, mus musculus
atgcaacagctcaaggccatgctgg

SEQ ID NO: 90594 - DNA, 25 bp, mus musculus
gaccttgtgatcgacctacgcaccc

SEQ ID NO: 90595 - DNA, 25 bp, mus musculus
accttcacctgaacgtgacagcaga

SEQ ID NO: 90596 - DNA, 25 bp, mus musculus
acctgaacgtgacagcagaggcctt

SEQ ID NO: 90597 - DNA, 25 bp, mus musculus
cagaggcctttagccgggagttgct

SEQ ID NO: 90598 - DNA, 25 bp, mus musculus
ttagccgggagttgctcggtgcctt

SEQ ID NO: 90599 - DNA, 25 bp, mus musculus
tgctcggtgccttggaaccttatgt

SEQ ID NO: 90600 - DNA, 25 bp, mus musculus
tcggtgccttggaaccttatgtgta

SEQ ID NO: 90601 - DNA, 25 bp, mus musculus
actattgtctcacctgatgctggtg

SEQ ID NO: 90602 - DNA, 25 bp, mus musculus
agagtgacctccattgcagaccggc

SEQ ID NO: 90603 - DNA, 25 bp, mus musculus
gctgacacttgcggtacaatctgtc

SEQ ID NO: 90604 - DNA, 25 bp, mus musculus
gacacttgcggtacaatctgtcacg

SEQ ID NO: 90605 - DNA, 25 bp, mus musculus
acttgcggtacaatctgtcacgccg

SEQ ID NO: 90606 - DNA, 25 bp, mus musculus
acaatctgtcacgccgctgacaaac

SEQ ID NO: 90607 - DNA, 25 bp, mus musculus
atctgtcacgccgctgacaaacttc

SEQ ID NO: 90608 - DNA, 25 bp, mus musculus
gctgacaaacttctctcagctggcg

SEQ ID NO: 90609 - DNA, 25 bp, mus musculus
aaacttctctcagctggcgctacca

SEQ ID NO: 90610 - DNA, 25 bp, mus musculus
cttctctcagctggcgctaccagag

SEQ ID NO: 90611 - DNA, 25 bp, mus musculus
ctctcagctggcgctaccagagttt

SEQ ID NO: 90612 - DNA, 25 bp, mus musculus
tcagctggcgctaccagagtttatg

SEQ ID NO: 90613 - DNA, 25 bp, mus musculus
gtgacctccattgcagaccggctga

SEQ ID NO: 90614 - DNA, 25 bp, mus musculus
acctccattgcagaccggctgaatg

SEQ ID NO: 90615 - DNA, 25 bp, mus musculus
attgcagaccggctgaatgtggatt

SEQ ID NO: 90616 - DNA, 25 bp, mus musculus
tttgctttgattcacaaggaacgga

SEQ ID NO: 90617 - DNA, 25 bp, mus musculus
cgcatggtacttgtgggagatgtga

SEQ ID NO: 90618 - DNA, 25 bp, mus musculus
gatgacatggctgacacttgcggta

SEQ ID NO: 90619 - DNA, 25 bp, mus musculus
gacatggctgacacttgcggtacaa

SEQ ID NO: 90620 - DNA, 25 bp, mus musculus
atggctgacacttgcggtacaatct

SEQ ID NO: 90621 - DNA, 25 bp, mus musculus
actccaagcctaccacagatgcctg

SEQ ID NO: 90622 - DNA, 25 bp, mus musculus
agcctaccacagatgcctgaagaag

SEQ ID NO: 90623 - DNA, 25 bp, mus musculus
tgttcctgactgtttcctctgccag

SEQ ID NO: 90624 - DNA, 25 bp, mus musculus
ctgccagacaatgaactctggagat

SEQ ID NO: 90625 - DNA, 25 bp, mus musculus
gcacgcacgtgcatgcacatgctat

SEQ ID NO: 90626 - DNA, 25 bp, mus musculus
acgtgcatgcacatgctatgtattg

SEQ ID NO: 90627 - DNA, 25 bp, mus musculus
atgcacatgctatgtattgggtccc

SEQ ID NO: 90628 - DNA, 25 bp, mus musculus
tgtattgggtccctccaaggatgaa

SEQ ID NO: 90629 - DNA, 25 bp, mus musculus
ggatgaaccctctctttggcttaga

SEQ ID NO: 90630 - DNA, 25 bp, mus musculus
gtgttattcgtgctcacggaaagtt

SEQ ID NO: 90631 - DNA, 25 bp, mus musculus
gaaagtttcttactcatccctgtga

SEQ ID NO: 90632 - DNA, 25 bp, mus musculus
ctcatccctgtgactttggctttat

SEQ ID NO: 90633 - DNA, 25 bp, mus musculus
gaagaagttcctcactatctgcaaa

SEQ ID NO: 90634 - DNA, 25 bp, mus musculus
cactatctgcaaatgtggctctcag

SEQ ID NO: 90635 - DNA, 25 bp, mus musculus
atgtggctctcaggcccttcctgat

SEQ ID NO: 90636 - DNA, 25 bp, mus musculus
ctctcaggcccttcctgatgtgatg

SEQ ID NO: 90637 - DNA, 25 bp, mus musculus
ggcccttcctgatgtgatgaatgaa

SEQ ID NO: 90638 - DNA, 25 bp, mus musculus
atctactaatcatttcttgaccatt

SEQ ID NO: 90639 - DNA, 25 bp, mus musculus
tcattttatcacttctaaccttgaa

SEQ ID NO: 90640 - DNA, 25 bp, mus musculus
ttctaaccttgaaacatgtggaagt

SEQ ID NO: 90641 - DNA, 25 bp, mus musculus
gaggcgacagctgctgtagtgtata

SEQ ID NO: 90642 - DNA, 25 bp, mus musculus
gcgacagctgctgtagtgtataagg

SEQ ID NO: 90643 - DNA, 25 bp, mus musculus
gatggtctagcgcttagtagccaag

SEQ ID NO: 90644 - DNA, 25 bp, mus musculus
cttagtagccaagttgcccagatct

SEQ ID NO: 90645 - DNA, 25 bp, mus musculus
agccaagttgcccagatcttcactg

SEQ ID NO: 90646 - DNA, 25 bp, mus musculus
caagttgcccagatcttcactgtgc

SEQ ID NO: 90647 - DNA, 25 bp, mus musculus
gttgcccagatcttcactgtgcact

SEQ ID NO: 90648 - DNA, 25 bp, mus musculus
cagatcttcactgtgcactgggtct

SEQ ID NO: 90649 - DNA, 25 bp, mus musculus
atcttcactgtgcactgggtctgga

SEQ ID NO: 90650 - DNA, 25 bp, mus musculus
ttcactgtgcactgggtctggaaga

SEQ ID NO: 90651 - DNA, 25 bp, mus musculus
atggtaagtgctctggccaggcctt

SEQ ID NO: 90652 - DNA, 25 bp, mus musculus
agtgctctggccaggccttggcgag

SEQ ID NO: 90653 - DNA, 25 bp, mus musculus
catcatggaagaccactttgacatg

SEQ ID NO: 90654 - DNA, 25 bp, mus musculus
ccactttgacatgctacacttgttc

SEQ ID NO: 90655 - DNA, 25 bp, mus musculus
ctttgacatgctacacttgttcggc

SEQ ID NO: 90656 - DNA, 25 bp, mus musculus
catgctacacttgttcggctacaac

SEQ ID NO: 90657 - DNA, 25 bp, mus musculus
gctacacttgttcggctacaactat

SEQ ID NO: 90658 - DNA, 25 bp, mus musculus
acacttgttcggctacaactatggc

SEQ ID NO: 90659 - DNA, 25 bp, mus musculus
gttcggctacaactatggcaaatac

SEQ ID NO: 90660 - DNA, 25 bp, mus musculus
caaatacatggcacactggctgatg

SEQ ID NO: 90661 - DNA, 25 bp, mus musculus
gaggccctcagggaaagctggacta

SEQ ID NO: 90662 - DNA, 25 bp, mus musculus
actggatggctcacacagtacggaa

SEQ ID NO: 90663 - DNA, 25 bp, mus musculus
attttgcacttgcactattgaacat

SEQ ID NO: 90664 - DNA, 25 bp, mus musculus
tgcacttgcactattgaacatgacc

SEQ ID NO: 90665 - DNA, 25 bp, mus musculus
cacttgcactattgaacatgaccct

SEQ ID NO: 90666 - DNA, 25 bp, mus musculus
cactattgaacatgaccctgccaga

SEQ ID NO: 90667 - DNA, 25 bp, mus musculus
aacatgaccctgccagaaatgcaaa

SEQ ID NO: 90668 - DNA, 25 bp, mus musculus
catgaccctgccagaaatgcaaagg

SEQ ID NO: 90669 - DNA, 25 bp, mus musculus
tgaccctgccagaaatgcaaaggga

SEQ ID NO: 90670 - DNA, 25 bp, mus musculus
accctgccagaaatgcaaagggaat

SEQ ID NO: 90671 - DNA, 25 bp, mus musculus
atcctgaagctcagagtgaagttca

SEQ ID NO: 90672 - DNA, 25 bp, mus musculus
gttcaaaccacggcgtcccgcagag

SEQ ID NO: 90673 - DNA, 25 bp, mus musculus
gatggctcacacagtacggaaagac

SEQ ID NO: 90674 - DNA, 25 bp, mus musculus
gctcacacagtacggaaagactaca

SEQ ID NO: 90675 - DNA, 25 bp, mus musculus
ctgccgcacttgcctgttcgtttcc

SEQ ID NO: 90676 - DNA, 25 bp, mus musculus
gccgcacttgcctgttcgtttcctt

SEQ ID NO: 90677 - DNA, 25 bp, mus musculus
tttcctttccattttgcacttgcac

SEQ ID NO: 90678 - DNA, 25 bp, mus musculus
tcctttccattttgcacttgcacta

SEQ ID NO: 90679 - DNA, 25 bp, mus musculus
ctttccattttgcacttgcactatt

SEQ ID NO: 90680 - DNA, 25 bp, mus musculus
ttccattttgcacttgcactattga

SEQ ID NO: 90681 - DNA, 25 bp, mus musculus
gcaattagcgcttgtcagcttacct

SEQ ID NO: 90682 - DNA, 25 bp, mus musculus
attagcgcttgtcagcttaccttac

SEQ ID NO: 90683 - DNA, 25 bp, mus musculus
ccatgtggtcacagcctgccagcag

SEQ ID NO: 90684 - DNA, 25 bp, mus musculus
tgtggtcacagcctgccagcagcaa

SEQ ID NO: 90685 - DNA, 25 bp, mus musculus
agcctgccagcagcaagacacctgg

SEQ ID NO: 90686 - DNA, 25 bp, mus musculus
ctgccagcagcaagacacctgggtc

SEQ ID NO: 90687 - DNA, 25 bp, mus musculus
cacctcagtggaagtagcagaatgc

SEQ ID NO: 90688 - DNA, 25 bp, mus musculus
gctcttagggactcttgctgctatg

SEQ ID NO: 90689 - DNA, 25 bp, mus musculus
cttagggactcttgctgctatgctt

SEQ ID NO: 90690 - DNA, 25 bp, mus musculus
agggactcttgctgctatgcttgcc

SEQ ID NO: 90691 - DNA, 25 bp, mus musculus
gactcttgctgctatgcttgccagc

SEQ ID NO: 90692 - DNA, 25 bp, mus musculus
tgctgctatgcttgccagcaaatgg

SEQ ID NO: 90693 - DNA, 25 bp, mus musculus
agcgcttgtcagcttaccttacaac

SEQ ID NO: 90694 - DNA, 25 bp, mus musculus
gcttgtcagcttaccttacaacaca

SEQ ID NO: 90695 - DNA, 25 bp, mus musculus
tgtcagcttaccttacaacacagag

SEQ ID NO: 90696 - DNA, 25 bp, mus musculus
cagcttaccttacaacacagagggt

SEQ ID NO: 90697 - DNA, 25 bp, mus musculus
accttacaacacagagggtccagct

SEQ ID NO: 90698 - DNA, 25 bp, mus musculus
ttacaacacagagggtccagctgtt

SEQ ID NO: 90699 - DNA, 25 bp, mus musculus
caacacagagggtccagctgttcac

SEQ ID NO: 90700 - DNA, 25 bp, mus musculus
cagccatgtggtcacagcctgccag

SEQ ID NO: 90701 - DNA, 25 bp, mus musculus
aagatgcttcccttgtcgctgctga

SEQ ID NO: 90702 - DNA, 25 bp, mus musculus
cccttgtcgctgctgaagacagcgc

SEQ ID NO: 90703 - DNA, 25 bp, mus musculus
atgcctgagtgctacatccgtggca

SEQ ID NO: 90704 - DNA, 25 bp, mus musculus
gagtgctacatccgtggcagcacca

SEQ ID NO: 90705 - DNA, 25 bp, mus musculus
tgctacatccgtggcagcaccatca

SEQ ID NO: 90706 - DNA, 25 bp, mus musculus
tacatccgtggcagcaccatcaagt

SEQ ID NO: 90707 - DNA, 25 bp, mus musculus
cgtggcagcaccatcaagtacctgc

SEQ ID NO: 90708 - DNA, 25 bp, mus musculus
ggcagcaccatcaagtacctgcgca

SEQ ID NO: 90709 - DNA, 25 bp, mus musculus
agcaccatcaagtacctgcgcatcc

SEQ ID NO: 90710 - DNA, 25 bp, mus musculus
atcaagtacctgcgcatccctgatg

SEQ ID NO: 90711 - DNA, 25 bp, mus musculus
aagtacctgcgcatccctgatgaga

SEQ ID NO: 90712 - DNA, 25 bp, mus musculus
tacctgcgcatccctgatgagatca

SEQ ID NO: 90713 - DNA, 25 bp, mus musculus
aagacagcgcagaatcaccccatgc

SEQ ID NO: 90714 - DNA, 25 bp, mus musculus
cgcatccctgatgagatcattgaca

SEQ ID NO: 90715 - DNA, 25 bp, mus musculus
gcgcagaatcaccccatgctggtgg

SEQ ID NO: 90716 - DNA, 25 bp, mus musculus
gagacctacaacgggcatctggtga

SEQ ID NO: 90717 - DNA, 25 bp, mus musculus
acctacaacgggcatctggtgagct

SEQ ID NO: 90718 - DNA, 25 bp, mus musculus
aacgggcatctggtgagctgtgaca

SEQ ID NO: 90719 - DNA, 25 bp, mus musculus
catctggtgagctgtgacaactgga

SEQ ID NO: 90720 - DNA, 25 bp, mus musculus
tggatgaacatcaacctccgggagg

SEQ ID NO: 90721 - DNA, 25 bp, mus musculus
atctgcacgtcgcgggatggtgaca

SEQ ID NO: 90722 - DNA, 25 bp, mus musculus
gaatggcctgccttacaatgacaga

SEQ ID NO: 90723 - DNA, 25 bp, mus musculus
atggcctgccttacaatgacagaaa

SEQ ID NO: 90724 - DNA, 25 bp, mus musculus
atattcctggaagtgctaattctgt

SEQ ID NO: 90725 - DNA, 25 bp, mus musculus
agatagagccagtccttcaagtgta

SEQ ID NO: 90726 - DNA, 25 bp, mus musculus
agagccagtccttcaagtgtatctg

SEQ ID NO: 90727 - DNA, 25 bp, mus musculus
agccagtccttcaagtgtatctgta

SEQ ID NO: 90728 - DNA, 25 bp, mus musculus
ccagtccttcaagtgtatctgtacc

SEQ ID NO: 90729 - DNA, 25 bp, mus musculus
agtccttcaagtgtatctgtaccat

SEQ ID NO: 90730 - DNA, 25 bp, mus musculus
gtgtatctgtaccattctcttgggc

SEQ ID NO: 90731 - DNA, 25 bp, mus musculus
gtaccattctcttgggcaagctgaa

SEQ ID NO: 90732 - DNA, 25 bp, mus musculus
accattctcttgggcaagctgaagg

SEQ ID NO: 90733 - DNA, 25 bp, mus musculus
ttctcttgggcaagctgaaggagag

SEQ ID NO: 90734 - DNA, 25 bp, mus musculus
ggcctgccttacaatgacagaaatg

SEQ ID NO: 90735 - DNA, 25 bp, mus musculus
cctgccttacaatgacagaaatgga

SEQ ID NO: 90736 - DNA, 25 bp, mus musculus
atggaggcaacctccacatctcctg

SEQ ID NO: 90737 - DNA, 25 bp, mus musculus
cctccacatctcctgtacatcagaa

SEQ ID NO: 90738 - DNA, 25 bp, mus musculus
catctcctgtacatcagaatggtga

SEQ ID NO: 90739 - DNA, 25 bp, mus musculus
tctcctgtacatcagaatggtgata

SEQ ID NO: 90740 - DNA, 25 bp, mus musculus
tcctgtacatcagaatggtgatatt

SEQ ID NO: 90741 - DNA, 25 bp, mus musculus
tgatattcctggaagtgctaattct

SEQ ID NO: 90742 - DNA, 25 bp, mus musculus
tacttaacattcctccagtgaatcc

SEQ ID NO: 90743 - DNA, 25 bp, mus musculus
acattcctccagtgaatcctggcta

SEQ ID NO: 90744 - DNA, 25 bp, mus musculus
gaacagtccttcagtgactgaatca

SEQ ID NO: 90745 - DNA, 25 bp, mus musculus
tccttcagtgactgaatcatgtcat

SEQ ID NO: 90746 - DNA, 25 bp, mus musculus
atgtcatccagaagacagtctcctt

SEQ ID NO: 90747 - DNA, 25 bp, mus musculus
tccagaagacagtctccttgcataa

SEQ ID NO: 90748 - DNA, 25 bp, mus musculus
agacagtctccttgcataaagctct

SEQ ID NO: 90749 - DNA, 25 bp, mus musculus
tctccttgcataaagctctcaaggt

SEQ ID NO: 90750 - DNA, 25 bp, mus musculus
tgcataaagctctcaaggtcgtgca

SEQ ID NO: 90751 - DNA, 25 bp, mus musculus
aagctctcaaggtcgtgcagtgact

SEQ ID NO: 90752 - DNA, 25 bp, mus musculus
ttgtttattctgtgatctgtgaccc

SEQ ID NO: 90753 - DNA, 25 bp, mus musculus
gtgaccctgttctgtggaaagttgt

SEQ ID NO: 90754 - DNA, 25 bp, mus musculus
tgaatcctggctaagtatttgcaca

SEQ ID NO: 90755 - DNA, 25 bp, mus musculus
cactagaacgttcctagcctacata

SEQ ID NO: 90756 - DNA, 25 bp, mus musculus
atatcttacaaagaagcttagtctc

SEQ ID NO: 90757 - DNA, 25 bp, mus musculus
gaagcttagtctcttctggaaatca

SEQ ID NO: 90758 - DNA, 25 bp, mus musculus
gaaatcatttctactagagcctcat

SEQ ID NO: 90759 - DNA, 25 bp, mus musculus
atttctactagagcctcataatccg

SEQ ID NO: 90760 - DNA, 25 bp, mus musculus
actagagcctcataatccgaacagt

SEQ ID NO: 90761 - DNA, 25 bp, mus musculus
taatccgaacagtccttcagtgact

SEQ ID NO: 90762 - DNA, 25 bp, mus musculus
agtagagctgcacacctgtactcca

SEQ ID NO: 90763 - DNA, 25 bp, mus musculus
tagagctgcacacctgtactccaaa

SEQ ID NO: 90764 - DNA, 25 bp, mus musculus
tttatttgcagcctgtcgatatccc

SEQ ID NO: 90765 - DNA, 25 bp, mus musculus
tatttgcagcctgtcgatatcccca

SEQ ID NO: 90766 - DNA, 25 bp, mus musculus
atttgcagcctgtcgatatccccac

SEQ ID NO: 90767 - DNA, 25 bp, mus musculus
tttgcagcctgtcgatatccccact

SEQ ID NO: 90768 - DNA, 25 bp, mus musculus
ttgcagcctgtcgatatccccactg

SEQ ID NO: 90769 - DNA, 25 bp, mus musculus
gcagcctgtcgatatccccactggg

SEQ ID NO: 90770 - DNA, 25 bp, mus musculus
cagcctgtcgatatccccactgggc

SEQ ID NO: 90771 - DNA, 25 bp, mus musculus
agcctgtcgatatccccactgggca

SEQ ID NO: 90772 - DNA, 25 bp, mus musculus
gcctgtcgatatccccactgggcac

SEQ ID NO: 90773 - DNA, 25 bp, mus musculus
tgtcgatatccccactgggcacccg

SEQ ID NO: 90774 - DNA, 25 bp, mus musculus
agagctgcacacctgtactccaaaa

SEQ ID NO: 90775 - DNA, 25 bp, mus musculus
gagctgcacacctgtactccaaaaa

SEQ ID NO: 90776 - DNA, 25 bp, mus musculus
agctgcacacctgtactccaaaaac

SEQ ID NO: 90777 - DNA, 25 bp, mus musculus
ctgcacacctgtactccaaaaacca

SEQ ID NO: 90778 - DNA, 25 bp, mus musculus
tgcacacctgtactccaaaaaccag

SEQ ID NO: 90779 - DNA, 25 bp, mus musculus
gcacacctgtactccaaaaaccagc

SEQ ID NO: 90780 - DNA, 25 bp, mus musculus
cacacctgtactccaaaaaccagca

SEQ ID NO: 90781 - DNA, 25 bp, mus musculus
ctgtactccaaaaaccagcaaagct

SEQ ID NO: 90782 - DNA, 25 bp, mus musculus
agtttgtggagcccagccggcagtt

SEQ ID NO: 90783 - DNA, 25 bp, mus musculus
ggagcccagccggcagtttgtattg

SEQ ID NO: 90784 - DNA, 25 bp, mus musculus
tactcaattcggctggttaaaagat

SEQ ID NO: 90785 - DNA, 25 bp, mus musculus
actcaattcggctggttaaaagatg

SEQ ID NO: 90786 - DNA, 25 bp, mus musculus
tcaattcggctggttaaaagatgca

SEQ ID NO: 90787 - DNA, 25 bp, mus musculus
caattcggctggttaaaagatgcac

SEQ ID NO: 90788 - DNA, 25 bp, mus musculus
aagatgcaccaaacccgacagagaa

SEQ ID NO: 90789 - DNA, 25 bp, mus musculus
agatgcaccaaacccgacagagaag

SEQ ID NO: 90790 - DNA, 25 bp, mus musculus
atgcaccaaacccgacagagaagaa

SEQ ID NO: 90791 - DNA, 25 bp, mus musculus
tgcaccaaacccgacagagaagaat

SEQ ID NO: 90792 - DNA, 25 bp, mus musculus
gcaccaaacccgacagagaagaatt

SEQ ID NO: 90793 - DNA, 25 bp, mus musculus
caaacccgacagagaagaattccag

SEQ ID NO: 90794 - DNA, 25 bp, mus musculus
gagcccagccggcagtttgtattgt

SEQ ID NO: 90795 - DNA, 25 bp, mus musculus
agcccagccggcagtttgtattgta

SEQ ID NO: 90796 - DNA, 25 bp, mus musculus
cccagccggcagtttgtattgtact

SEQ ID NO: 90797 - DNA, 25 bp, mus musculus
ccagccggcagtttgtattgtactc

SEQ ID NO: 90798 - DNA, 25 bp, mus musculus
cagccggcagtttgtattgtactca

SEQ ID NO: 90799 - DNA, 25 bp, mus musculus
ttgtattgtactcaattcggctggt

SEQ ID NO: 90800 - DNA, 25 bp, mus musculus
tgtattgtactcaattcggctggtt

SEQ ID NO: 90801 - DNA, 25 bp, mus musculus
tattgtactcaattcggctggttaa

SEQ ID NO: 90802 - DNA, 25 bp, mus musculus
caagcgctgttgcttcgagctactc

SEQ ID NO: 90803 - DNA, 25 bp, mus musculus
cgctgttgcttcgagctactcccag

SEQ ID NO: 90804 - DNA, 25 bp, mus musculus
aagttacttccaaagtgctgtggag

SEQ ID NO: 90805 - DNA, 25 bp, mus musculus
tacttccaaagtgctgtggaggcac

SEQ ID NO: 90806 - DNA, 25 bp, mus musculus
cttccaaagtgctgtggaggcacaa

SEQ ID NO: 90807 - DNA, 25 bp, mus musculus
tggaggcacaatcaccggtgcggac

SEQ ID NO: 90808 - DNA, 25 bp, mus musculus
ggcacaatcaccggtgcggacacag

SEQ ID NO: 90809 - DNA, 25 bp, mus musculus
cacaatcaccggtgcggacacagag

SEQ ID NO: 90810 - DNA, 25 bp, mus musculus
caatcaccggtgcggacacagagct

SEQ ID NO: 90811 - DNA, 25 bp, mus musculus
atcaccggtgcggacacagagctct

SEQ ID NO: 90812 - DNA, 25 bp, mus musculus
gccgtttccagggcaacagagtcgg

SEQ ID NO: 90813 - DNA, 25 bp, mus musculus
tttccagggcaacagagtcggagac

SEQ ID NO: 90814 - DNA, 25 bp, mus musculus
ctgttgcttcgagctactcccaggc

SEQ ID NO: 90815 - DNA, 25 bp, mus musculus
tgcttcgagctactcccaggcttct

SEQ ID NO: 90816 - DNA, 25 bp, mus musculus
cttcgagctactcccaggcttctga

SEQ ID NO: 90817 - DNA, 25 bp, mus musculus
tcgagctactcccaggcttctgaag

SEQ ID NO: 90818 - DNA, 25 bp, mus musculus
gagctactcccaggcttctgaagtt

SEQ ID NO: 90819 - DNA, 25 bp, mus musculus
tactcccaggcttctgaagttactt

SEQ ID NO: 90820 - DNA, 25 bp, mus musculus
cttctgaagttacttccaaagtgct

SEQ ID NO: 90821 - DNA, 25 bp, mus musculus
tgaagttacttccaaagtgctgtgg

SEQ ID NO: 90822 - DNA, 25 bp, mus musculus
tgccaatgatgcctctgcccgggct

SEQ ID NO: 90823 - DNA, 25 bp, mus musculus
caatgatgcctctgcccgggctgta

SEQ ID NO: 90824 - DNA, 25 bp, mus musculus
atgctgatgtaccaacaccaaaagg

SEQ ID NO: 90825 - DNA, 25 bp, mus musculus
ctgatgtaccaacaccaaaaggcac

SEQ ID NO: 90826 - DNA, 25 bp, mus musculus
atgtaccaacaccaaaaggcacctg

SEQ ID NO: 90827 - DNA, 25 bp, mus musculus
taccaacaccaaaaggcacctgagc

SEQ ID NO: 90828 - DNA, 25 bp, mus musculus
caacaccaaaaggcacctgagcgat

SEQ ID NO: 90829 - DNA, 25 bp, mus musculus
caccaaaaggcacctgagcgatttg

SEQ ID NO: 90830 - DNA, 25 bp, mus musculus
aaggcacctgagcgatttgatgtca

SEQ ID NO: 90831 - DNA, 25 bp, mus musculus
gcacctgagcgatttgatgtcattg

SEQ ID NO: 90832 - DNA, 25 bp, mus musculus
ttcctggatgcagcagtgcaggctg

SEQ ID NO: 90833 - DNA, 25 bp, mus musculus
tgcagcagtgcaggctgtgagtgat

SEQ ID NO: 90834 - DNA, 25 bp, mus musculus
tgcccgggctgtagagcttatgcac

SEQ ID NO: 90835 - DNA, 25 bp, mus musculus
tgtggcacatcttgttcagcccaac

SEQ ID NO: 90836 - DNA, 25 bp, mus musculus
ggcacatcttgttcagcccaaccag

SEQ ID NO: 90837 - DNA, 25 bp, mus musculus
acatcttgttcagcccaaccaggca

SEQ ID NO: 90838 - DNA, 25 bp, mus musculus
tcttgttcagcccaaccaggcagat

SEQ ID NO: 90839 - DNA, 25 bp, mus musculus
tgttcagcccaaccaggcagatgcc

SEQ ID NO: 90840 - DNA, 25 bp, mus musculus
gcccaaccaggcagatgccggatgc

SEQ ID NO: 90841 - DNA, 25 bp, mus musculus
agatgccggatgctgatgtaccaac

SEQ ID NO: 90842 - DNA, 25 bp, mus musculus
ggacatgccgttcacttgcgaagga

SEQ ID NO: 90843 - DNA, 25 bp, mus musculus
catgccgttcacttgcgaaggataa

SEQ ID NO: 90844 - DNA, 25 bp, mus musculus
attggtgacgctactccatttaatg

SEQ ID NO: 90845 - DNA, 25 bp, mus musculus
ggtgacgctactccatttaatgatg

SEQ ID NO: 90846 - DNA, 25 bp, mus musculus
gacgctactccatttaatgatgctg

SEQ ID NO: 90847 - DNA, 25 bp, mus musculus
gctactccatttaatgatgctgtca

SEQ ID NO: 90848 - DNA, 25 bp, mus musculus
actccatttaatgatgctgtcaatg

SEQ ID NO: 90849 - DNA, 25 bp, mus musculus
aatcttttgtctgactatggctacc

SEQ ID NO: 90850 - DNA, 25 bp, mus musculus
cttttgtctgactatggctaccatc

SEQ ID NO: 90851 - DNA, 25 bp, mus musculus
gactatggctaccatctcagaggga

SEQ ID NO: 90852 - DNA, 25 bp, mus musculus
taccatctcagagggaacgaggtgc

SEQ ID NO: 90853 - DNA, 25 bp, mus musculus
ctctacaatggattcactggacgaa

SEQ ID NO: 90854 - DNA, 25 bp, mus musculus
gccgttcacttgcgaaggataactc

SEQ ID NO: 90855 - DNA, 25 bp, mus musculus
aggataactcctgacatcatcataa

SEQ ID NO: 90856 - DNA, 25 bp, mus musculus
ataactcctgacatcatcataaacc

SEQ ID NO: 90857 - DNA, 25 bp, mus musculus
attggtcacttgatcgaatgtctcc

SEQ ID NO: 90858 - DNA, 25 bp, mus musculus
cacttgatcgaatgtctccaaggga

SEQ ID NO: 90859 - DNA, 25 bp, mus musculus
atcgaatgtctccaagggaaggtct

SEQ ID NO: 90860 - DNA, 25 bp, mus musculus
gaatgtctccaagggaaggtctctg

SEQ ID NO: 90861 - DNA, 25 bp, mus musculus
gtctctgccaacaagggtgaaattg

SEQ ID NO: 90862 - DNA, 25 bp, mus musculus
gtgtaaggcacctaagccagatgca

SEQ ID NO: 90863 - DNA, 25 bp, mus musculus
tgtaaggcacctaagccagatgcac

SEQ ID NO: 90864 - DNA, 25 bp, mus musculus
tgatcgacgtggcagaggaggatat

SEQ ID NO: 90865 - DNA, 25 bp, mus musculus
agagagcggtttggccctggcaaga

SEQ ID NO: 90866 - DNA, 25 bp, mus musculus
agcggtttggccctggcaagatgga

SEQ ID NO: 90867 - DNA, 25 bp, mus musculus
cggtttggccctggcaagatggact

SEQ ID NO: 90868 - DNA, 25 bp, mus musculus
ggtttggccctggcaagatggactc

SEQ ID NO: 90869 - DNA, 25 bp, mus musculus
tggccctggcaagatggactccagg

SEQ ID NO: 90870 - DNA, 25 bp, mus musculus
agcacagacaggatcgcagggaact

SEQ ID NO: 90871 - DNA, 25 bp, mus musculus
gcacagacaggatcgcagggaactg

SEQ ID NO: 90872 - DNA, 25 bp, mus musculus
ggaactgtcatattagcctggctcc

SEQ ID NO: 90873 - DNA, 25 bp, mus musculus
gtaaggcacctaagccagatgcacc

SEQ ID NO: 90874 - DNA, 25 bp, mus musculus
taaggcacctaagccagatgcacca

SEQ ID NO: 90875 - DNA, 25 bp, mus musculus
aaggcacctaagccagatgcaccag

SEQ ID NO: 90876 - DNA, 25 bp, mus musculus
aggcacctaagccagatgcaccagg

SEQ ID NO: 90877 - DNA, 25 bp, mus musculus
ggcacctaagccagatgcaccagga

SEQ ID NO: 90878 - DNA, 25 bp, mus musculus
gcacctaagccagatgcaccaggag

SEQ ID NO: 90879 - DNA, 25 bp, mus musculus
cacctaagccagatgcaccaggagg

SEQ ID NO: 90880 - DNA, 25 bp, mus musculus
atgatcgacgtggcagaggaggata

SEQ ID NO: 90881 - DNA, 25 bp, mus musculus
aattgtagggctcaaccacagcagt

SEQ ID NO: 90882 - DNA, 25 bp, mus musculus
attgtagggctcaaccacagcagtg

SEQ ID NO: 90883 - DNA, 25 bp, mus musculus
accgccttattagccagattgtgtc

SEQ ID NO: 90884 - DNA, 25 bp, mus musculus
ccgccttattagccagattgtgtct

SEQ ID NO: 90885 - DNA, 25 bp, mus musculus
gccttattagccagattgtgtcttc

SEQ ID NO: 90886 - DNA, 25 bp, mus musculus
ccttattagccagattgtgtcttcc

SEQ ID NO: 90887 - DNA, 25 bp, mus musculus
cttattagccagattgtgtcttcca

SEQ ID NO: 90888 - DNA, 25 bp, mus musculus
ttattagccagattgtgtcttccat

SEQ ID NO: 90889 - DNA, 25 bp, mus musculus
tgatttggccctgaatggtgatctt

SEQ ID NO: 90890 - DNA, 25 bp, mus musculus
gatttggccctgaatggtgatctta

SEQ ID NO: 90891 - DNA, 25 bp, mus musculus
atttggccctgaatggtgatcttac

SEQ ID NO: 90892 - DNA, 25 bp, mus musculus
ttggccctgaatggtgatcttacag

SEQ ID NO: 90893 - DNA, 25 bp, mus musculus
ttgtagggctcaaccacagcagtgg

SEQ ID NO: 90894 - DNA, 25 bp, mus musculus
gtagggctcaaccacagcagtggaa

SEQ ID NO: 90895 - DNA, 25 bp, mus musculus
tcaaccacagcagtggaaacctggg

SEQ ID NO: 90896 - DNA, 25 bp, mus musculus
caaccacagcagtggaaacctgggg

SEQ ID NO: 90897 - DNA, 25 bp, mus musculus
atggagaactccaattccatccgca

SEQ ID NO: 90898 - DNA, 25 bp, mus musculus
gagaactccaattccatccgcacca

SEQ ID NO: 90899 - DNA, 25 bp, mus musculus
cttaaccgccttattagccagattg

SEQ ID NO: 90900 - DNA, 25 bp, mus musculus
taaccgccttattagccagattgtg

SEQ ID NO: 90901 - DNA, 25 bp, mus musculus
tgctgcgaccaccggagcagaggga

SEQ ID NO: 90902 - DNA, 25 bp, mus musculus
agctgcggacattttgctgctgaag

SEQ ID NO: 90903 - DNA, 25 bp, mus musculus
tgattgcatcaatgactgtgggcaa

SEQ ID NO: 90904 - DNA, 25 bp, mus musculus
attgcatcaatgactgtgggcaaag

SEQ ID NO: 90905 - DNA, 25 bp, mus musculus
gatgtcagtgctctcttccctgatg

SEQ ID NO: 90906 - DNA, 25 bp, mus musculus
tgtcagtgctctcttccctgatgtg

SEQ ID NO: 90907 - DNA, 25 bp, mus musculus
tcagtgctctcttccctgatgtggt

SEQ ID NO: 90908 - DNA, 25 bp, mus musculus
agtgctctcttccctgatgtggtga

SEQ ID NO: 90909 - DNA, 25 bp, mus musculus
ctctcttccctgatgtggtgaactg

SEQ ID NO: 90910 - DNA, 25 bp, mus musculus
ctcttccctgatgtggtgaactgca

SEQ ID NO: 90911 - DNA, 25 bp, mus musculus
cttccctgatgtggtgaactgcatg

SEQ ID NO: 90912 - DNA, 25 bp, mus musculus
tccctgatgtggtgaactgcatgca

SEQ ID NO: 90913 - DNA, 25 bp, mus musculus
ctgcggacattttgctgctgaagca

SEQ ID NO: 90914 - DNA, 25 bp, mus musculus
ggacattttgctgctgaagcagagc

SEQ ID NO: 90915 - DNA, 25 bp, mus musculus
acattttgctgctgaagcagagccg

SEQ ID NO: 90916 - DNA, 25 bp, mus musculus
attttgctgctgaagcagagccgag

SEQ ID NO: 90917 - DNA, 25 bp, mus musculus
tttgtggagtctggccacagataaa

SEQ ID NO: 90918 - DNA, 25 bp, mus musculus
tggagtctggccacagataaaggaa

SEQ ID NO: 90919 - DNA, 25 bp, mus musculus
tcaaaatacttcaccacaaccaaga

SEQ ID NO: 90920 - DNA, 25 bp, mus musculus
gatctttgagctgaaggcagagctt

SEQ ID NO: 90921 - DNA, 25 bp, mus musculus
ctctctgagtgtgaggccagcctgt

SEQ ID NO: 90922 - DNA, 25 bp, mus musculus
agcctgtctacagagggagtcccat

SEQ ID NO: 90923 - DNA, 25 bp, mus musculus
tttgtgtttgtagcagtgagcccag

SEQ ID NO: 90924 - DNA, 25 bp, mus musculus
tttgtagcagtgagcccagacaagg

SEQ ID NO: 90925 - DNA, 25 bp, mus musculus
ctctgctgtgcccttgcaggctagg

SEQ ID NO: 90926 - DNA, 25 bp, mus musculus
cttgcaggctaggtgtgccagggct

SEQ ID NO: 90927 - DNA, 25 bp, mus musculus
tgccagggctggctcctctaggatc

SEQ ID NO: 90928 - DNA, 25 bp, mus musculus
tggctcctctaggatcaggggtagt

SEQ ID NO: 90929 - DNA, 25 bp, mus musculus
ctctaggatcaggggtagtgttcag

SEQ ID NO: 90930 - DNA, 25 bp, mus musculus
tgtctggtgtttgggccgagccagt

SEQ ID NO: 90931 - DNA, 25 bp, mus musculus
gtgtttgggccgagccagtcagtct

SEQ ID NO: 90932 - DNA, 25 bp, mus musculus
tttgggccgagccagtcagtctctg

SEQ ID NO: 90933 - DNA, 25 bp, mus musculus
ggagtcccataccagtcctcacctt

SEQ ID NO: 90934 - DNA, 25 bp, mus musculus
ccgagccagtcagtctctgagtgct

SEQ ID NO: 90935 - DNA, 25 bp, mus musculus
cagtcctcaccttgacctgtctggg

SEQ ID NO: 90936 - DNA, 25 bp, mus musculus
tcctcaccttgacctgtctgggcct

SEQ ID NO: 90937 - DNA, 25 bp, mus musculus
tcaccttgacctgtctgggcctcct

SEQ ID NO: 90938 - DNA, 25 bp, mus musculus
ccttgacctgtctgggcctcctgga

SEQ ID NO: 90939 - DNA, 25 bp, mus musculus
tggagctacctgttgtttgtgtttg

SEQ ID NO: 90940 - DNA, 25 bp, mus musculus
agctacctgttgtttgtgtttgtag

SEQ ID NO: 90941 - DNA, 25 bp, mus musculus
tacctgttgtttgtgtttgtagcag

SEQ ID NO: 90942 - DNA, 25 bp, mus musculus
tggatagctttcttgctgcagcaga

SEQ ID NO: 90943 - DNA, 25 bp, mus musculus
gctttcttgctgcagcagagaccct

SEQ ID NO: 90944 - DNA, 25 bp, mus musculus
atgctccccggctgattgaagagtc

SEQ ID NO: 90945 - DNA, 25 bp, mus musculus
tggtcactaacacgatcccacacga

SEQ ID NO: 90946 - DNA, 25 bp, mus musculus
acacgatcccacacgagatccagaa

SEQ ID NO: 90947 - DNA, 25 bp, mus musculus
cacacgagatccagaagctgcagtg

SEQ ID NO: 90948 - DNA, 25 bp, mus musculus
gccccaagatcaagactgtggacat

SEQ ID NO: 90949 - DNA, 25 bp, mus musculus
gcatgatcctctcagaagccatccg

SEQ ID NO: 90950 - DNA, 25 bp, mus musculus
tgatcctctcagaagccatccgccg

SEQ ID NO: 90951 - DNA, 25 bp, mus musculus
gccgaattcacaacggggagtccat

SEQ ID NO: 90952 - DNA, 25 bp, mus musculus
gggagtccatgtcctaccttttcag

SEQ ID NO: 90953 - DNA, 25 bp, mus musculus
ccatgtcctaccttttcagaaacat

SEQ ID NO: 90954 - DNA, 25 bp, mus musculus
ttcttgctgcagcagagaccctgaa

SEQ ID NO: 90955 - DNA, 25 bp, mus musculus
ttgctgcagcagagaccctgaagga

SEQ ID NO: 90956 - DNA, 25 bp, mus musculus
tctttgtgatggccactcacggctt

SEQ ID NO: 90957 - DNA, 25 bp, mus musculus
ttgtgatggccactcacggcttgtt

SEQ ID NO: 90958 - DNA, 25 bp, mus musculus
ccactcacggcttgttatcctctga

SEQ ID NO: 90959 - DNA, 25 bp, mus musculus
ctcacggcttgttatcctctgatgc

SEQ ID NO: 90960 - DNA, 25 bp, mus musculus
acggcttgttatcctctgatgctcc

SEQ ID NO: 90961 - DNA, 25 bp, mus musculus
cctctgatgctccccggctgattga

SEQ ID NO: 90962 - DNA, 25 bp, mus musculus
atgccacatccaaggagatcgcaga

SEQ ID NO: 90963 - DNA, 25 bp, mus musculus
tgccacatccaaggagatcgcagac

SEQ ID NO: 90964 - DNA, 25 bp, mus musculus
ccattcgaggtgtgctggagatgcc

SEQ ID NO: 90965 - DNA, 25 bp, mus musculus
cattcgaggtgtgctggagatgccg

SEQ ID NO: 90966 - DNA, 25 bp, mus musculus
attcgaggtgtgctggagatgccgt

SEQ ID NO: 90967 - DNA, 25 bp, mus musculus
ttcgaggtgtgctggagatgccgtc

SEQ ID NO: 90968 - DNA, 25 bp, mus musculus
gtccctgcgatgcagccagagactc

SEQ ID NO: 90969 - DNA, 25 bp, mus musculus
tccctgcgatgcagccagagactcc

SEQ ID NO: 90970 - DNA, 25 bp, mus musculus
ccctgcgatgcagccagagactccg

SEQ ID NO: 90971 - DNA, 25 bp, mus musculus
cctgcgatgcagccagagactccgt

SEQ ID NO: 90972 - DNA, 25 bp, mus musculus
ctgcgatgcagccagagactccgtc

SEQ ID NO: 90973 - DNA, 25 bp, mus musculus
gccacatccaaggagatcgcagaca

SEQ ID NO: 90974 - DNA, 25 bp, mus musculus
ccacatccaaggagatcgcagacac

SEQ ID NO: 90975 - DNA, 25 bp, mus musculus
cacatccaaggagatcgcagacact

SEQ ID NO: 90976 - DNA, 25 bp, mus musculus
acatccaaggagatcgcagacactt

SEQ ID NO: 90977 - DNA, 25 bp, mus musculus
cagcagaggtccattcgaggtgtgc

SEQ ID NO: 90978 - DNA, 25 bp, mus musculus
agcagaggtccattcgaggtgtgct

SEQ ID NO: 90979 - DNA, 25 bp, mus musculus
gtccattcgaggtgtgctggagatg

SEQ ID NO: 90980 - DNA, 25 bp, mus musculus
tccattcgaggtgtgctggagatgc

SEQ ID NO: 90981 - DNA, 25 bp, mus musculus
tgaaggctctcgtaactgtaccggc

SEQ ID NO: 90982 - DNA, 25 bp, mus musculus
aggctctcgtaactgtaccggcatg

SEQ ID NO: 90983 - DNA, 25 bp, mus musculus
catcgggaggctcagcttcgacaca

SEQ ID NO: 90984 - DNA, 25 bp, mus musculus
gaggctcagcttcgacacaaccgac

SEQ ID NO: 90985 - DNA, 25 bp, mus musculus
tcggagatccgaacgccaggacgat

SEQ ID NO: 90986 - DNA, 25 bp, mus musculus
gagatccgaacgccaggacgatcca

SEQ ID NO: 90987 - DNA, 25 bp, mus musculus
atccgaacgccaggacgatccaggg

SEQ ID NO: 90988 - DNA, 25 bp, mus musculus
cacgcgtgccactgtggagagaagt

SEQ ID NO: 90989 - DNA, 25 bp, mus musculus
gcgtgccactgtggagagaagttga

SEQ ID NO: 90990 - DNA, 25 bp, mus musculus
agtgcaatatcacacaagttggatc

SEQ ID NO: 90991 - DNA, 25 bp, mus musculus
gcaatatcacacaagttggatcgta

SEQ ID NO: 90992 - DNA, 25 bp, mus musculus
atatcacacaagttggatcgtaagg

SEQ ID NO: 90993 - DNA, 25 bp, mus musculus
ctctcgtaactgtaccggcatgtct

SEQ ID NO: 90994 - DNA, 25 bp, mus musculus
tcgtaactgtaccggcatgtctaag

SEQ ID NO: 90995 - DNA, 25 bp, mus musculus
gcctgaacagctgcggaactcgttc

SEQ ID NO: 90996 - DNA, 25 bp, mus musculus
acagctgcggaactcgttcatcggg

SEQ ID NO: 90997 - DNA, 25 bp, mus musculus
gcggaactcgttcatcgggaggctc

SEQ ID NO: 90998 - DNA, 25 bp, mus musculus
gaactcgttcatcgggaggctcagc

SEQ ID NO: 90999 - DNA, 25 bp, mus musculus
ctcgttcatcgggaggctcagcttc

SEQ ID NO: 91000 - DNA, 25 bp, mus musculus
gttcatcgggaggctcagcttcgac

SEQ ID NO: 91001 - DNA, 25 bp, mus musculus
atgcaaactgcaaagcaaggccgct

SEQ ID NO: 91002 - DNA, 25 bp, mus musculus
caaactgcaaagcaaggccgctctg

SEQ ID NO: 91003 - DNA, 25 bp, mus musculus
gtgtccaggacagtgactgcgcatc

SEQ ID NO: 91004 - DNA, 25 bp, mus musculus
acagtgactgcgcatctgcacaaac

SEQ ID NO: 91005 - DNA, 25 bp, mus musculus
gtgactgcgcatctgcacaaactct

SEQ ID NO: 91006 - DNA, 25 bp, mus musculus
gcgcatctgcacaaactctttctaa

SEQ ID NO: 91007 - DNA, 25 bp, mus musculus
catctgcacaaactctttctaagta

SEQ ID NO: 91008 - DNA, 25 bp, mus musculus
ctgcacaaactctttctaagtatct

SEQ ID NO: 91009 - DNA, 25 bp, mus musculus
aaactctttctaagtatctagcaat

SEQ ID NO: 91010 - DNA, 25 bp, mus musculus
ctctttctaagtatctagcaatgtt

SEQ ID NO: 91011 - DNA, 25 bp, mus musculus
atctagcaatgttactctttcagac

SEQ ID NO: 91012 - DNA, 25 bp, mus musculus
tagcaatgttactctttcagacact

SEQ ID NO: 91013 - DNA, 25 bp, mus musculus
gcaaagcaaggccgctctggaacaa

SEQ ID NO: 91014 - DNA, 25 bp, mus musculus
caaggccgctctggaacaagatgca

SEQ ID NO: 91015 - DNA, 25 bp, mus musculus
gaaggccccagagaagccagaagat

SEQ ID NO: 91016 - DNA, 25 bp, mus musculus
tgatgagagcccaggatctggagac

SEQ ID NO: 91017 - DNA, 25 bp, mus musculus
tgagagcccaggatctggagacgcc

SEQ ID NO: 91018 - DNA, 25 bp, mus musculus
gagcccaggatctggagacgcccca

SEQ ID NO: 91019 - DNA, 25 bp, mus musculus
cccactgaagtcattgcggaagagg

SEQ ID NO: 91020 - DNA, 25 bp, mus musculus
tctagagtcagggtgtccaggacag

SEQ ID NO: 91021 - DNA, 25 bp, mus musculus
atctactactcagagaagttacttg

SEQ ID NO: 91022 - DNA, 25 bp, mus musculus
ttacccagagaactctcctaagcaa

SEQ ID NO: 91023 - DNA, 25 bp, mus musculus
tgtcacacagagtctaggaatgggt

SEQ ID NO: 91024 - DNA, 25 bp, mus musculus
caatgattcatgagcccagaacccg

SEQ ID NO: 91025 - DNA, 25 bp, mus musculus
atgattcatgagcccagaacccgca

SEQ ID NO: 91026 - DNA, 25 bp, mus musculus
gattcatgagcccagaacccgcata

SEQ ID NO: 91027 - DNA, 25 bp, mus musculus
catgagcccagaacccgcatatttc

SEQ ID NO: 91028 - DNA, 25 bp, mus musculus
tgagcccagaacccgcatatttctt

SEQ ID NO: 91029 - DNA, 25 bp, mus musculus
agcccagaacccgcatatttcttct

SEQ ID NO: 91030 - DNA, 25 bp, mus musculus
cccagaacccgcatatttcttctct

SEQ ID NO: 91031 - DNA, 25 bp, mus musculus
ccgcatatttcttctctttaagacg

SEQ ID NO: 91032 - DNA, 25 bp, mus musculus
gcatatttcttctctttaagacgac

SEQ ID NO: 91033 - DNA, 25 bp, mus musculus
acccagagaactctcctaagcaagt

SEQ ID NO: 91034 - DNA, 25 bp, mus musculus
ctctcctaagcaagtacccaagact

SEQ ID NO: 91035 - DNA, 25 bp, mus musculus
ctcctaagcaagtacccaagactca

SEQ ID NO: 91036 - DNA, 25 bp, mus musculus
tacccaagactcatctgatgttccg

SEQ ID NO: 91037 - DNA, 25 bp, mus musculus
agactcatctgatgttccgaagaga

SEQ ID NO: 91038 - DNA, 25 bp, mus musculus
actcatctgatgttccgaagagaat

SEQ ID NO: 91039 - DNA, 25 bp, mus musculus
tcatctgatgttccgaagagaattg

SEQ ID NO: 91040 - DNA, 25 bp, mus musculus
tgtgtcacacagagtctaggaatgg

SEQ ID NO: 91041 - DNA, 25 bp, mus musculus
cctccactgactgcaggaactacaa

SEQ ID NO: 91042 - DNA, 25 bp, mus musculus
tccactgactgcaggaactacaaga

SEQ ID NO: 91043 - DNA, 25 bp, mus musculus
catcatgtctctggaaatggagctg

SEQ ID NO: 91044 - DNA, 25 bp, mus musculus
atcatgtctctggaaatggagctgg

SEQ ID NO: 91045 - DNA, 25 bp, mus musculus
gtctctggaaatggagctggtgacc

SEQ ID NO: 91046 - DNA, 25 bp, mus musculus
tgtgcacttcaccatggaggagtgg

SEQ ID NO: 91047 - DNA, 25 bp, mus musculus
tgggctctgctggatctatcccaaa

SEQ ID NO: 91048 - DNA, 25 bp, mus musculus
ggctctgctggatctatcccaaaag

SEQ ID NO: 91049 - DNA, 25 bp, mus musculus
gctctgctggatctatcccaaaagg

SEQ ID NO: 91050 - DNA, 25 bp, mus musculus
tctgctggatctatcccaaaaggag

SEQ ID NO: 91051 - DNA, 25 bp, mus musculus
ctgctggatctatcccaaaaggagc

SEQ ID NO: 91052 - DNA, 25 bp, mus musculus
aatgtggtttccataggagacataa

SEQ ID NO: 91053 - DNA, 25 bp, mus musculus
ccactgactgcaggaactacaagag

SEQ ID NO: 91054 - DNA, 25 bp, mus musculus
actgactgcaggaactacaagagga

SEQ ID NO: 91055 - DNA, 25 bp, mus musculus
ctgactgcaggaactacaagaggac

SEQ ID NO: 91056 - DNA, 25 bp, mus musculus
cactaggacatcatgtctctggaaa

SEQ ID NO: 91057 - DNA, 25 bp, mus musculus
ctaggacatcatgtctctggaaatg

SEQ ID NO: 91058 - DNA, 25 bp, mus musculus
taggacatcatgtctctggaaatgg

SEQ ID NO: 91059 - DNA, 25 bp, mus musculus
ggacatcatgtctctggaaatggag

SEQ ID NO: 91060 - DNA, 25 bp, mus musculus
gacatcatgtctctggaaatggagc

SEQ ID NO: 91061 - DNA, 25 bp, mus musculus
tctactacaattcagccactgggaa

SEQ ID NO: 91062 - DNA, 25 bp, mus musculus
ctactacaattcagccactgggaaa

SEQ ID NO: 91063 - DNA, 25 bp, mus musculus
atgccaccgatttaactacactgga

SEQ ID NO: 91064 - DNA, 25 bp, mus musculus
gccaccgatttaactacactggatg

SEQ ID NO: 91065 - DNA, 25 bp, mus musculus
ccaccgatttaactacactggatgt

SEQ ID NO: 91066 - DNA, 25 bp, mus musculus
accgatttaactacactggatgtgg

SEQ ID NO: 91067 - DNA, 25 bp, mus musculus
ccgatttaactacactggatgtggg

SEQ ID NO: 91068 - DNA, 25 bp, mus musculus
taattttactaccagaaggagatgt

SEQ ID NO: 91069 - DNA, 25 bp, mus musculus
attttactaccagaaggagatgtct

SEQ ID NO: 91070 - DNA, 25 bp, mus musculus
ttttactaccagaaggagatgtctg

SEQ ID NO: 91071 - DNA, 25 bp, mus musculus
ggcgcccttcgtgaaagttgtatat

SEQ ID NO: 91072 - DNA, 25 bp, mus musculus
cgcccttcgtgaaagttgtatatga

SEQ ID NO: 91073 - DNA, 25 bp, mus musculus
actacaattcagccactgggaaatg

SEQ ID NO: 91074 - DNA, 25 bp, mus musculus
ctacaattcagccactgggaaatgc

SEQ ID NO: 91075 - DNA, 25 bp, mus musculus
acaattcagccactgggaaatgcca

SEQ ID NO: 91076 - DNA, 25 bp, mus musculus
caattcagccactgggaaatgccac

SEQ ID NO: 91077 - DNA, 25 bp, mus musculus
attcagccactgggaaatgccaccg

SEQ ID NO: 91078 - DNA, 25 bp, mus musculus
ttcagccactgggaaatgccaccga

SEQ ID NO: 91079 - DNA, 25 bp, mus musculus
gaaatgccaccgatttaactacact

SEQ ID NO: 91080 - DNA, 25 bp, mus musculus
aatgccaccgatttaactacactgg

SEQ ID NO: 91081 - DNA, 25 bp, mus musculus
atgtggcatgtgacctctcagattg

SEQ ID NO: 91082 - DNA, 25 bp, mus musculus
gtgacctctcagattgtggagctga

SEQ ID NO: 91083 - DNA, 25 bp, mus musculus
ctgctgccccagctgacaggagctg

SEQ ID NO: 91084 - DNA, 25 bp, mus musculus
ccccagctgacaggagctgaaaatg

SEQ ID NO: 91085 - DNA, 25 bp, mus musculus
aaacgaatgaccatcattggggtga

SEQ ID NO: 91086 - DNA, 25 bp, mus musculus
accatcattggggtgattctcagtt

SEQ ID NO: 91087 - DNA, 25 bp, mus musculus
attctcagttttagggccatggcga

SEQ ID NO: 91088 - DNA, 25 bp, mus musculus
actgcccttttctcatgggccccat

SEQ ID NO: 91089 - DNA, 25 bp, mus musculus
cttttctcatgggccccattgagtg

SEQ ID NO: 91090 - DNA, 25 bp, mus musculus
tcatgggccccattgagtgcctgaa

SEQ ID NO: 91091 - DNA, 25 bp, mus musculus
tgggccccattgagtgcctgaagga

SEQ ID NO: 91092 - DNA, 25 bp, mus musculus
aggagtttgtcacccctgacacaga

SEQ ID NO: 91093 - DNA, 25 bp, mus musculus
acctctcagattgtggagctgaaga

SEQ ID NO: 91094 - DNA, 25 bp, mus musculus
cccctgacacagacattaaggtcac

SEQ ID NO: 91095 - DNA, 25 bp, mus musculus
gatattctggtccagatcagatcca

SEQ ID NO: 91096 - DNA, 25 bp, mus musculus
attctggtccagatcagatccaact

SEQ ID NO: 91097 - DNA, 25 bp, mus musculus
cagatcagatccaacttcagcaagc

SEQ ID NO: 91098 - DNA, 25 bp, mus musculus
atcagatccaacttcagcaagccag

SEQ ID NO: 91099 - DNA, 25 bp, mus musculus
agatccaacttcagcaagccagaat

SEQ ID NO: 91100 - DNA, 25 bp, mus musculus
aacttcagcaagccagaattaatgg

SEQ ID NO: 91101 - DNA, 25 bp, mus musculus
ttaatggcatctctgctgccccagc

SEQ ID NO: 91102 - DNA, 25 bp, mus musculus
cccatgcactgcagtcagcacggca

SEQ ID NO: 91103 - DNA, 25 bp, mus musculus
ctgcagtcagcacggcatgactgtt

SEQ ID NO: 91104 - DNA, 25 bp, mus musculus
ggcattcacgaggcacaagaacctg

SEQ ID NO: 91105 - DNA, 25 bp, mus musculus
cattcacgaggcacaagaacctgaa

SEQ ID NO: 91106 - DNA, 25 bp, mus musculus
aaacttgtctcaagctctacgattc

SEQ ID NO: 91107 - DNA, 25 bp, mus musculus
acttgtctcaagctctacgattcag

SEQ ID NO: 91108 - DNA, 25 bp, mus musculus
ttgtctcaagctctacgattcagag

SEQ ID NO: 91109 - DNA, 25 bp, mus musculus
gtctcaagctctacgattcagagaa

SEQ ID NO: 91110 - DNA, 25 bp, mus musculus
ctcaagctctacgattcagagaagc

SEQ ID NO: 91111 - DNA, 25 bp, mus musculus
caagctctacgattcagagaagcca

SEQ ID NO: 91112 - DNA, 25 bp, mus musculus
agctctacgattcagagaagccatt

SEQ ID NO: 91113 - DNA, 25 bp, mus musculus
ccattagagcctgtaaacgcaatgt

SEQ ID NO: 91114 - DNA, 25 bp, mus musculus
gcagtcagcacggcatgactgttaa

SEQ ID NO: 91115 - DNA, 25 bp, mus musculus
agtcagcacggcatgactgttaact

SEQ ID NO: 91116 - DNA, 25 bp, mus musculus
taagcaagttctgttcaaggcccat

SEQ ID NO: 91117 - DNA, 25 bp, mus musculus
tcaaggcccatttcgaagttggcca

SEQ ID NO: 91118 - DNA, 25 bp, mus musculus
ggcccatttcgaagttggccaattg

SEQ ID NO: 91119 - DNA, 25 bp, mus musculus
gggccgacggcattcacgaggcaca

SEQ ID NO: 91120 - DNA, 25 bp, mus musculus
cgacggcattcacgaggcacaagaa

SEQ ID NO: 91121 - DNA, 25 bp, mus musculus
acggcattcacgaggcacaagaacc

SEQ ID NO: 91122 - DNA, 25 bp, mus musculus
caaagctacaccttcttcttggact

SEQ ID NO: 91123 - DNA, 25 bp, mus musculus
tacaccttcttcttggactgactta

SEQ ID NO: 91124 - DNA, 25 bp, mus musculus
tctggtacagcttggtaatgatagg

SEQ ID NO: 91125 - DNA, 25 bp, mus musculus
tgcagactttctccagttctttctg

SEQ ID NO: 91126 - DNA, 25 bp, mus musculus
agactttctccagttctttctgctg

SEQ ID NO: 91127 - DNA, 25 bp, mus musculus
ctttctccagttctttctgctgatg

SEQ ID NO: 91128 - DNA, 25 bp, mus musculus
gatgctcaaattcttccttctctgc

SEQ ID NO: 91129 - DNA, 25 bp, mus musculus
attcttccttctctgcagtctggtt

SEQ ID NO: 91130 - DNA, 25 bp, mus musculus
ccttctctgcagtctggttcttaat

SEQ ID NO: 91131 - DNA, 25 bp, mus musculus
tctctgcagtctggttcttaatcaa

SEQ ID NO: 91132 - DNA, 25 bp, mus musculus
ctgcagtctggttcttaatcaagca

SEQ ID NO: 91133 - DNA, 25 bp, mus musculus
cagtctggttcttaatcaagcagct

SEQ ID NO: 91134 - DNA, 25 bp, mus musculus
ttcttcttggactgacttaatccac

SEQ ID NO: 91135 - DNA, 25 bp, mus musculus
tctggttcttaatcaagcagctgat

SEQ ID NO: 91136 - DNA, 25 bp, mus musculus
gactgacttaatccacctcttcaat

SEQ ID NO: 91137 - DNA, 25 bp, mus musculus
tgacttaatccacctcttcaatggt

SEQ ID NO: 91138 - DNA, 25 bp, mus musculus
cttaatccacctcttcaatggtggg

SEQ ID NO: 91139 - DNA, 25 bp, mus musculus
caggcatgccacctgcactctggta

SEQ ID NO: 91140 - DNA, 25 bp, mus musculus
gcatgccacctgcactctggtacag

SEQ ID NO: 91141 - DNA, 25 bp, mus musculus
tgccacctgcactctggtacagctt

SEQ ID NO: 91142 - DNA, 25 bp, mus musculus
ctgcactctggtacagcttggtaat

SEQ ID NO: 91143 - DNA, 25 bp, mus musculus
gaccttccaggtcctggtcatgctg

SEQ ID NO: 91144 - DNA, 25 bp, mus musculus
cctggtcatgctggagatgacccct

SEQ ID NO: 91145 - DNA, 25 bp, mus musculus
cactccgactcagagtctagcatgg

SEQ ID NO: 91146 - DNA, 25 bp, mus musculus
gactcagagtctagcatggtactat

SEQ ID NO: 91147 - DNA, 25 bp, mus musculus
cctcagctcttgtgatctggagtcc

SEQ ID NO: 91148 - DNA, 25 bp, mus musculus
ctcttgtgatctggagtcccccagt

SEQ ID NO: 91149 - DNA, 25 bp, mus musculus
ggagtcccccagtctctgtctgtag

SEQ ID NO: 91150 - DNA, 25 bp, mus musculus
tctctgtctgtagctctgctccttg

SEQ ID NO: 91151 - DNA, 25 bp, mus musculus
tctgtagctctgctccttggtgatt

SEQ ID NO: 91152 - DNA, 25 bp, mus musculus
ggtgattccagagactccatctgtg

SEQ ID NO: 91153 - DNA, 25 bp, mus musculus
tccagagactccatctgtgtacagc

SEQ ID NO: 91154 - DNA, 25 bp, mus musculus
gactccatctgtgtacagccgcacc

SEQ ID NO: 91155 - DNA, 25 bp, mus musculus
cctgaagagccccatcactgtggag

SEQ ID NO: 91156 - DNA, 25 bp, mus musculus
ggcacagtctgagtctgcctggagc

SEQ ID NO: 91157 - DNA, 25 bp, mus musculus
gtctgcctggagcaagatgttgagc

SEQ ID NO: 91158 - DNA, 25 bp, mus musculus
ggtgatcttcctcgggcttggcctt

SEQ ID NO: 91159 - DNA, 25 bp, mus musculus
agggctcctgcagtgactcagagtg

SEQ ID NO: 91160 - DNA, 25 bp, mus musculus
gttttgactcagttgactgtctcag

SEQ ID NO: 91161 - DNA, 25 bp, mus musculus
aagacctgaatgtctctgctccgaa

SEQ ID NO: 91162 - DNA, 25 bp, mus musculus
ctccgaattcctgactgccagtcca

SEQ ID NO: 91163 - DNA, 25 bp, mus musculus
gaaaccacactatgacatctggggc

SEQ ID NO: 91164 - DNA, 25 bp, mus musculus
ctatgacatctggggcaatacggtc

SEQ ID NO: 91165 - DNA, 25 bp, mus musculus
catccttcgagagtacggcttccgc

SEQ ID NO: 91166 - DNA, 25 bp, mus musculus
agagtacggcttccgctttgtgagg

SEQ ID NO: 91167 - DNA, 25 bp, mus musculus
ccgctttgtgaggcgaggtcccatc

SEQ ID NO: 91168 - DNA, 25 bp, mus musculus
ctttgtgaggcgaggtcccatcttt

SEQ ID NO: 91169 - DNA, 25 bp, mus musculus
cttccccaatggctcctctgttaca

SEQ ID NO: 91170 - DNA, 25 bp, mus musculus
caatggctcctctgttacactgccc

SEQ ID NO: 91171 - DNA, 25 bp, mus musculus
ggtggacaacccctgagcgacctct

SEQ ID NO: 91172 - DNA, 25 bp, mus musculus
ctgagcgacctctggctccacagtg

SEQ ID NO: 91173 - DNA, 25 bp, mus musculus
ctctggctccacagtggtccacata

SEQ ID NO: 91174 - DNA, 25 bp, mus musculus
ctggctccacagtggtccacatagg

SEQ ID NO: 91175 - DNA, 25 bp, mus musculus
ggaatccacaggagtcatgggcaac

SEQ ID NO: 91176 - DNA, 25 bp, mus musculus
tggctccacagtggtccacatagga

SEQ ID NO: 91177 - DNA, 25 bp, mus musculus
atccacaggagtcatgggcaacatc

SEQ ID NO: 91178 - DNA, 25 bp, mus musculus
agtcatgggcaacatccaggtggta

SEQ ID NO: 91179 - DNA, 25 bp, mus musculus
catgggcaacatccaggtggtagaa

SEQ ID NO: 91180 - DNA, 25 bp, mus musculus
caacatccaggtggtagaagagacg

SEQ ID NO: 91181 - DNA, 25 bp, mus musculus
gacgcaggtcatccttcgagagtac

SEQ ID NO: 91182 - DNA, 25 bp, mus musculus
gcaggtcatccttcgagagtacggc

SEQ ID NO: 91183 - DNA, 25 bp, mus musculus
ggtcatccttcgagagtacggcttc

SEQ ID NO: 91184 - DNA, 25 bp, mus musculus
acgccaaaatcggttacagccatga

SEQ ID NO: 91185 - DNA, 25 bp, mus musculus
ccaaaatcggttacagccatgacag

SEQ ID NO: 91186 - DNA, 25 bp, mus musculus
cggttattcccaattgtcagttcag

SEQ ID NO: 91187 - DNA, 25 bp, mus musculus
ttattcccaattgtcagttcagatc

SEQ ID NO: 91188 - DNA, 25 bp, mus musculus
ttcccaattgtcagttcagatccaa

SEQ ID NO: 91189 - DNA, 25 bp, mus musculus
attgtcagttcagatccaaaacagc

SEQ ID NO: 91190 - DNA, 25 bp, mus musculus
tcagatccaaaacagcacgtcttaa

SEQ ID NO: 91191 - DNA, 25 bp, mus musculus
cagcacgtcttaaaacatttactgc

SEQ ID NO: 91192 - DNA, 25 bp, mus musculus
catttactgctaaccagattgatga

SEQ ID NO: 91193 - DNA, 25 bp, mus musculus
ttactgctaaccagattgatgaaat

SEQ ID NO: 91194 - DNA, 25 bp, mus musculus
atgtccagcgacaagtttgggatta

SEQ ID NO: 91195 - DNA, 25 bp, mus musculus
tccagcgacaagtttgggattatct

SEQ ID NO: 91196 - DNA, 25 bp, mus musculus
aaatcggttacagccatgacagtgt

SEQ ID NO: 91197 - DNA, 25 bp, mus musculus
tcggttacagccatgacagtgtctc

SEQ ID NO: 91198 - DNA, 25 bp, mus musculus
gttacagccatgacagtgtctcggt

SEQ ID NO: 91199 - DNA, 25 bp, mus musculus
acagccatgacagtgtctcggttat

SEQ ID NO: 91200 - DNA, 25 bp, mus musculus
gccatgacagtgtctcggttattcc

SEQ ID NO: 91201 - DNA, 25 bp, mus musculus
atgacagtgtctcggttattcccaa

SEQ ID NO: 91202 - DNA, 25 bp, mus musculus
acagtgtctcggttattcccaattg

SEQ ID NO: 91203 - DNA, 25 bp, mus musculus
tctcggttattcccaattgtcagtt

SEQ ID NO: 91204 - DNA, 25 bp, mus musculus
tcttggactctgcagacaacccctt

SEQ ID NO: 91205 - DNA, 25 bp, mus musculus
ggactctgcagacaaccccttgacg

SEQ ID NO: 91206 - DNA, 25 bp, mus musculus
aggatggctcctgcaatggcttaca

SEQ ID NO: 91207 - DNA, 25 bp, mus musculus
gatggctcctgcaatggcttacagc

SEQ ID NO: 91208 - DNA, 25 bp, mus musculus
tggctcctgcaatggcttacagcat

SEQ ID NO: 91209 - DNA, 25 bp, mus musculus
gctcctgcaatggcttacagcatta

SEQ ID NO: 91210 - DNA, 25 bp, mus musculus
tcctgcaatggcttacagcattacg

SEQ ID NO: 91211 - DNA, 25 bp, mus musculus
tggcttacagcattacgccgcacta

SEQ ID NO: 91212 - DNA, 25 bp, mus musculus
gcttacagcattacgccgcactagg

SEQ ID NO: 91213 - DNA, 25 bp, mus musculus
ttacagcattacgccgcactaggcc

SEQ ID NO: 91214 - DNA, 25 bp, mus musculus
gccgcactaggccgagacagtgtgg

SEQ ID NO: 91215 - DNA, 25 bp, mus musculus
tgctgcctcagtcaacctaacgccg

SEQ ID NO: 91216 - DNA, 25 bp, mus musculus
actctgcagacaaccccttgacggg

SEQ ID NO: 91217 - DNA, 25 bp, mus musculus
tctgcagacaaccccttgacgggcc

SEQ ID NO: 91218 - DNA, 25 bp, mus musculus
tgcagacaaccccttgacgggccgg

SEQ ID NO: 91219 - DNA, 25 bp, mus musculus
aagctgatgagccctggcagaccct

SEQ ID NO: 91220 - DNA, 25 bp, mus musculus
atgagccctggcagaccctggcctg

SEQ ID NO: 91221 - DNA, 25 bp, mus musculus
tgccagttcaccaggatggctcctg

SEQ ID NO: 91222 - DNA, 25 bp, mus musculus
ccagttcaccaggatggctcctgca

SEQ ID NO: 91223 - DNA, 25 bp, mus musculus
agttcaccaggatggctcctgcaat

SEQ ID NO: 91224 - DNA, 25 bp, mus musculus
actggttccatgcactgtgcatggt

SEQ ID NO: 91225 - DNA, 25 bp, mus musculus
ggttccatgcactgtgcatggttgc

SEQ ID NO: 91226 - DNA, 25 bp, mus musculus
tgggcacacccttgtacctgctgcg

SEQ ID NO: 91227 - DNA, 25 bp, mus musculus
tgctgcgcacaccgccacagaagaa

SEQ ID NO: 91228 - DNA, 25 bp, mus musculus
gcacaccgccacagaagaaacactc

SEQ ID NO: 91229 - DNA, 25 bp, mus musculus
caccgccacagaagaaacactcaga

SEQ ID NO: 91230 - DNA, 25 bp, mus musculus
aacactcagagaaggccagcaggca

SEQ ID NO: 91231 - DNA, 25 bp, mus musculus
agaaggccagcaggcagcaggatga

SEQ ID NO: 91232 - DNA, 25 bp, mus musculus
aggacacggacaagcttctggcctc

SEQ ID NO: 91233 - DNA, 25 bp, mus musculus
cccctgatgcatccaccttggagaa

SEQ ID NO: 91234 - DNA, 25 bp, mus musculus
catccaccttggagaacagctggag

SEQ ID NO: 91235 - DNA, 25 bp, mus musculus
ccaccttggagaacagctggagccc

SEQ ID NO: 91236 - DNA, 25 bp, mus musculus
atgcactgtgcatggttgccttgtt

SEQ ID NO: 91237 - DNA, 25 bp, mus musculus
cactgtgcatggttgccttgttttc

SEQ ID NO: 91238 - DNA, 25 bp, mus musculus
tttcttgcccacaggaagtggtaca

SEQ ID NO: 91239 - DNA, 25 bp, mus musculus
cttgcccacaggaagtggtacagta

SEQ ID NO: 91240 - DNA, 25 bp, mus musculus
tcctggctttggctaccgttcctat

SEQ ID NO: 91241 - DNA, 25 bp, mus musculus
tggctaccgttcctatcctgttgct

SEQ ID NO: 91242 - DNA, 25 bp, mus musculus
ccgttcctatcctgttgctgggcac

SEQ ID NO: 91243 - DNA, 25 bp, mus musculus
tgttgctgggcacacccttgtacct

SEQ ID NO: 91244 - DNA, 25 bp, mus musculus
gcttactctgctctccgaagctacg

SEQ ID NO: 91245 - DNA, 25 bp, mus musculus
tactctgctctccgaagctacggca

SEQ ID NO: 91246 - DNA, 25 bp, mus musculus
gatctccctgattcgaaaatatgct

SEQ ID NO: 91247 - DNA, 25 bp, mus musculus
ctccctgattcgaaaatatgctggt

SEQ ID NO: 91248 - DNA, 25 bp, mus musculus
cattacaataaggtctccagacaat

SEQ ID NO: 91249 - DNA, 25 bp, mus musculus
aaggtctccagacaatgcagacaca

SEQ ID NO: 91250 - DNA, 25 bp, mus musculus
gtctccagacaatgcagacacattc

SEQ ID NO: 91251 - DNA, 25 bp, mus musculus
cacattcgcactagtattcgccgca

SEQ ID NO: 91252 - DNA, 25 bp, mus musculus
cgcactagtattcgccgcacaaatc

SEQ ID NO: 91253 - DNA, 25 bp, mus musculus
agtattcgccgcacaaatccagaga

SEQ ID NO: 91254 - DNA, 25 bp, mus musculus
attcgccgcacaaatccagagaaag

SEQ ID NO: 91255 - DNA, 25 bp, mus musculus
gtggcctacttggaatcccatatca

SEQ ID NO: 91256 - DNA, 25 bp, mus musculus
tctgctctccgaagctacggcactt

SEQ ID NO: 91257 - DNA, 25 bp, mus musculus
cgaagctacggcacttaccgctgcg

SEQ ID NO: 91258 - DNA, 25 bp, mus musculus
agctacggcacttaccgctgcgacc

SEQ ID NO: 91259 - DNA, 25 bp, mus musculus
gaccgtgacctagccatggtcgtgc

SEQ ID NO: 91260 - DNA, 25 bp, mus musculus
ctagccatggtcgtgcaacctcacc

SEQ ID NO: 91261 - DNA, 25 bp, mus musculus
gccatggtcgtgcaacctcaccagg

SEQ ID NO: 91262 - DNA, 25 bp, mus musculus
atggtcgtgcaacctcaccaggatc

SEQ ID NO: 91263 - DNA, 25 bp, mus musculus
caacctcaccaggatctccctgatt

SEQ ID NO: 91264 - DNA, 25 bp, mus musculus
ttgtctcgtcgataattaccctcta

SEQ ID NO: 91265 - DNA, 25 bp, mus musculus
tgtctcgtcgataattaccctctat

SEQ ID NO: 91266 - DNA, 25 bp, mus musculus
attaccctctatagctgatgtcaac

SEQ ID NO: 91267 - DNA, 25 bp, mus musculus
taccctctatagctgatgtcaacta

SEQ ID NO: 91268 - DNA, 25 bp, mus musculus
accctctatagctgatgtcaactaa

SEQ ID NO: 91269 - DNA, 25 bp, mus musculus
ccctctatagctgatgtcaactaaa

SEQ ID NO: 91270 - DNA, 25 bp, mus musculus
ctctatagctgatgtcaactaaaag

SEQ ID NO: 91271 - DNA, 25 bp, mus musculus
actaaaagtatcgtctcgagcattg

SEQ ID NO: 91272 - DNA, 25 bp, mus musculus
aaagtatcgtctcgagcattgccac

SEQ ID NO: 91273 - DNA, 25 bp, mus musculus
tcgagcattgccactggcaccttca

SEQ ID NO: 91274 - DNA, 25 bp, mus musculus
ttcaccaaaataactagcacccatg

SEQ ID NO: 91275 - DNA, 25 bp, mus musculus
tcaccaaaataactagcacccatga

SEQ ID NO: 91276 - DNA, 25 bp, mus musculus
gtctcgtcgataattaccctctata

SEQ ID NO: 91277 - DNA, 25 bp, mus musculus
ctcgtcgataattaccctctatagc

SEQ ID NO: 91278 - DNA, 25 bp, mus musculus
tcgtcgataattaccctctatagct

SEQ ID NO: 91279 - DNA, 25 bp, mus musculus
tcgataattaccctctatagctgat

SEQ ID NO: 91280 - DNA, 25 bp, mus musculus
cgataattaccctctatagctgatg

SEQ ID NO: 91281 - DNA, 25 bp, mus musculus
gataattaccctctatagctgatgt

SEQ ID NO: 91282 - DNA, 25 bp, mus musculus
taattaccctctatagctgatgtca

SEQ ID NO: 91283 - DNA, 25 bp, mus musculus
aattaccctctatagctgatgtcaa

SEQ ID NO: 91284 - DNA, 25 bp, mus musculus
ggctacacacacctttctgcaggag

SEQ ID NO: 91285 - DNA, 25 bp, mus musculus
ctacacacacctttctgcaggagag

SEQ ID NO: 91286 - DNA, 25 bp, mus musculus
agaatccagactcacagtatggtga

SEQ ID NO: 91287 - DNA, 25 bp, mus musculus
aatccagactcacagtatggtgaac

SEQ ID NO: 91288 - DNA, 25 bp, mus musculus
cagactcacagtatggtgaacttat

SEQ ID NO: 91289 - DNA, 25 bp, mus musculus
ggaccaaacaatggctgccaatgct

SEQ ID NO: 91290 - DNA, 25 bp, mus musculus
accaaacaatggctgccaatgctca

SEQ ID NO: 91291 - DNA, 25 bp, mus musculus
caaacaatggctgccaatgctcaga

SEQ ID NO: 91292 - DNA, 25 bp, mus musculus
atggctgccaatgctcagaagaata

SEQ ID NO: 91293 - DNA, 25 bp, mus musculus
ggctgccaatgctcagaagaataaa

SEQ ID NO: 91294 - DNA, 25 bp, mus musculus
ctgccaatgctcagaagaataaatt

SEQ ID NO: 91295 - DNA, 25 bp, mus musculus
caagaaatcaagacaacctttcaag

SEQ ID NO: 91296 - DNA, 25 bp, mus musculus
acacacacctttctgcaggagagct

SEQ ID NO: 91297 - DNA, 25 bp, mus musculus
acacacctttctgcaggagagcttc

SEQ ID NO: 91298 - DNA, 25 bp, mus musculus
acacctttctgcaggagagcttctt

SEQ ID NO: 91299 - DNA, 25 bp, mus musculus
acctttctgcaggagagcttcttcg

SEQ ID NO: 91300 - DNA, 25 bp, mus musculus
ctttctgcaggagagcttcttcgtg

SEQ ID NO: 91301 - DNA, 25 bp, mus musculus
gagagcttcttcgtgatgaaaggaa

SEQ ID NO: 91302 - DNA, 25 bp, mus musculus
gagcttcttcgtgatgaaaggaaga

SEQ ID NO: 91303 - DNA, 25 bp, mus musculus
gaagaatccagactcacagtatggt

SEQ ID NO: 91304 - DNA, 25 bp, mus musculus
tggagcccatcagagatcacaaagt

SEQ ID NO: 91305 - DNA, 25 bp, mus musculus
ccatcagagatcacaaagtgtgaga

SEQ ID NO: 91306 - DNA, 25 bp, mus musculus
ccgtcagacgcaaactcatatagat

SEQ ID NO: 91307 - DNA, 25 bp, mus musculus
gtcagacgcaaactcatatagattg

SEQ ID NO: 91308 - DNA, 25 bp, mus musculus
cagacgcaaactcatatagattgta

SEQ ID NO: 91309 - DNA, 25 bp, mus musculus
gacgcaaactcatatagattgtaac

SEQ ID NO: 91310 - DNA, 25 bp, mus musculus
cagcctcctggctgggtttaaacag

SEQ ID NO: 91311 - DNA, 25 bp, mus musculus
tcactgtcgcagatccgccttgggt

SEQ ID NO: 91312 - DNA, 25 bp, mus musculus
tgtcgcagatccgccttgggtttga

SEQ ID NO: 91313 - DNA, 25 bp, mus musculus
tcgcagatccgccttgggtttgaca

SEQ ID NO: 91314 - DNA, 25 bp, mus musculus
gcagatccgccttgggtttgacatt

SEQ ID NO: 91315 - DNA, 25 bp, mus musculus
ccgccttgggtttgacattactcat

SEQ ID NO: 91316 - DNA, 25 bp, mus musculus
tgggaacatctccggaccgtcagac

SEQ ID NO: 91317 - DNA, 25 bp, mus musculus
ggaacatctccggaccgtcagacgc

SEQ ID NO: 91318 - DNA, 25 bp, mus musculus
aacatctccggaccgtcagacgcaa

SEQ ID NO: 91319 - DNA, 25 bp, mus musculus
catctccggaccgtcagacgcaaac

SEQ ID NO: 91320 - DNA, 25 bp, mus musculus
tctccggaccgtcagacgcaaactc

SEQ ID NO: 91321 - DNA, 25 bp, mus musculus
tccggaccgtcagacgcaaactcat

SEQ ID NO: 91322 - DNA, 25 bp, mus musculus
cggaccgtcagacgcaaactcatat

SEQ ID NO: 91323 - DNA, 25 bp, mus musculus
gaccgtcagacgcaaactcatatag

SEQ ID NO: 91324 - DNA, 25 bp, mus musculus
ggtgcccctgggccagcattcagag

SEQ ID NO: 91325 - DNA, 25 bp, mus musculus
cccaaaccctgaggccaaagctgtg

SEQ ID NO: 91326 - DNA, 25 bp, mus musculus
tgccagtgtggaacccttttccaag

SEQ ID NO: 91327 - DNA, 25 bp, mus musculus
ttccaagagcccgctttccatagtc

SEQ ID NO: 91328 - DNA, 25 bp, mus musculus
caagagcccgctttccatagtctgc

SEQ ID NO: 91329 - DNA, 25 bp, mus musculus
gctttccatagtctgctgtagtgaa

SEQ ID NO: 91330 - DNA, 25 bp, mus musculus
ttccatagtctgctgtagtgaacac

SEQ ID NO: 91331 - DNA, 25 bp, mus musculus
acattgttacacatcgtctatgaat

SEQ ID NO: 91332 - DNA, 25 bp, mus musculus
ttgttacacatcgtctatgaatcaa

SEQ ID NO: 91333 - DNA, 25 bp, mus musculus
ttacacatcgtctatgaatcaaata

SEQ ID NO: 91334 - DNA, 25 bp, mus musculus
aatagatctcaagccttaatagagt

SEQ ID NO: 91335 - DNA, 25 bp, mus musculus
agatctcaagccttaatagagtcta

SEQ ID NO: 91336 - DNA, 25 bp, mus musculus
tgaggccaaagctgtgctgaagaag

SEQ ID NO: 91337 - DNA, 25 bp, mus musculus
gctggctgccttggataaggaaatt

SEQ ID NO: 91338 - DNA, 25 bp, mus musculus
cttggacataccttatgagtacctg

SEQ ID NO: 91339 - DNA, 25 bp, mus musculus
accttatgagtacctgcggcccagc

SEQ ID NO: 91340 - DNA, 25 bp, mus musculus
tttaatcaagaccactcaagtgcat

SEQ ID NO: 91341 - DNA, 25 bp, mus musculus
caagaccactcaagtgcatccctgt

SEQ ID NO: 91342 - DNA, 25 bp, mus musculus
gaccactcaagtgcatccctgtgct

SEQ ID NO: 91343 - DNA, 25 bp, mus musculus
agtgcatccctgtgctggagccccg

SEQ ID NO: 91344 - DNA, 25 bp, mus musculus
gatgtcaatgcacctcctgtgcctt

SEQ ID NO: 91345 - DNA, 25 bp, mus musculus
gcacctcctgtgccttcctcaagag

SEQ ID NO: 91346 - DNA, 25 bp, mus musculus
gacaaaggccactacaaattctgtg

SEQ ID NO: 91347 - DNA, 25 bp, mus musculus
aaaggccactacaaattctgtgagc

SEQ ID NO: 91348 - DNA, 25 bp, mus musculus
ggaaatacaccactttggctggcat

SEQ ID NO: 91349 - DNA, 25 bp, mus musculus
acaccactttggctggcatccaatg

SEQ ID NO: 91350 - DNA, 25 bp, mus musculus
ctttggctggcatccaatggtggtc

SEQ ID NO: 91351 - DNA, 25 bp, mus musculus
tggctggcatccaatggtggtcatt

SEQ ID NO: 91352 - DNA, 25 bp, mus musculus
ctggcatccaatggtggtcattttg

SEQ ID NO: 91353 - DNA, 25 bp, mus musculus
caattgctagtgcaagcaggtgctg

SEQ ID NO: 91354 - DNA, 25 bp, mus musculus
ttgctagtgcaagcaggtgctgatg

SEQ ID NO: 91355 - DNA, 25 bp, mus musculus
caagcaggtgctgatgtggatgcag

SEQ ID NO: 91356 - DNA, 25 bp, mus musculus
cctcctgtgccttcctcaagagaca

SEQ ID NO: 91357 - DNA, 25 bp, mus musculus
cgaaaaatcacacctcttatgtcag

SEQ ID NO: 91358 - DNA, 25 bp, mus musculus
cctgtgccttcctcaagagacactg

SEQ ID NO: 91359 - DNA, 25 bp, mus musculus
ccttcctcaagagacactgctttaa

SEQ ID NO: 91360 - DNA, 25 bp, mus musculus
tcctcaagagacactgctttaacca

SEQ ID NO: 91361 - DNA, 25 bp, mus musculus
gacactgctttaaccatagcagcag

SEQ ID NO: 91362 - DNA, 25 bp, mus musculus
actgctttaaccatagcagcagaca

SEQ ID NO: 91363 - DNA, 25 bp, mus musculus
gctttaaccatagcagcagacaaag

SEQ ID NO: 91364 - DNA, 25 bp, mus musculus
accatagcagcagacaaaggccact

SEQ ID NO: 91365 - DNA, 25 bp, mus musculus
gacaaattgaccttgactttcaagc

SEQ ID NO: 91366 - DNA, 25 bp, mus musculus
caaattgaccttgactttcaagcgc

SEQ ID NO: 91367 - DNA, 25 bp, mus musculus
gattgaaatcatctctggggctgct

SEQ ID NO: 91368 - DNA, 25 bp, mus musculus
ttgaaatcatctctggggctgctgc

SEQ ID NO: 91369 - DNA, 25 bp, mus musculus
tgaaatcatctctggggctgctgct

SEQ ID NO: 91370 - DNA, 25 bp, mus musculus
gaaatcatctctggggctgctgctc

SEQ ID NO: 91371 - DNA, 25 bp, mus musculus
aaatcatctctggggctgctgctct

SEQ ID NO: 91372 - DNA, 25 bp, mus musculus
atcatctctggggctgctgctctgg

SEQ ID NO: 91373 - DNA, 25 bp, mus musculus
tcatctctggggctgctgctctgga

SEQ ID NO: 91374 - DNA, 25 bp, mus musculus
catctctggggctgctgctctggat

SEQ ID NO: 91375 - DNA, 25 bp, mus musculus
atctctggggctgctgctctggatt

SEQ ID NO: 91376 - DNA, 25 bp, mus musculus
tctctggggctgctgctctggatta

SEQ ID NO: 91377 - DNA, 25 bp, mus musculus
tgaccttgactttcaagcgcacccg

SEQ ID NO: 91378 - DNA, 25 bp, mus musculus
acccgccaggctgtcatcacaaaga

SEQ ID NO: 91379 - DNA, 25 bp, mus musculus
ccgccaggctgtcatcacaaagaga

SEQ ID NO: 91380 - DNA, 25 bp, mus musculus
cgccaggctgtcatcacaaagagag

SEQ ID NO: 91381 - DNA, 25 bp, mus musculus
gccaggctgtcatcacaaagagagt

SEQ ID NO: 91382 - DNA, 25 bp, mus musculus
ccaggctgtcatcacaaagagagtt

SEQ ID NO: 91383 - DNA, 25 bp, mus musculus
ggctgtcatcacaaagagagttgat

SEQ ID NO: 91384 - DNA, 25 bp, mus musculus
tgattgaaatcatctctggggctgc

SEQ ID NO: 91385 - DNA, 25 bp, mus musculus
atttacttatggctgtgcttctgcc

SEQ ID NO: 91386 - DNA, 25 bp, mus musculus
tctccccagagggaatgtctggtct

SEQ ID NO: 91387 - DNA, 25 bp, mus musculus
gttggcttcttttccagataacact

SEQ ID NO: 91388 - DNA, 25 bp, mus musculus
ttcttttccagataacactgcactt

SEQ ID NO: 91389 - DNA, 25 bp, mus musculus
tgcacttgcgtctctctgcctgcat

SEQ ID NO: 91390 - DNA, 25 bp, mus musculus
tgcgtctctctgcctgcatacatcg

SEQ ID NO: 91391 - DNA, 25 bp, mus musculus
gtctctctgcctgcatacatcgtct

SEQ ID NO: 91392 - DNA, 25 bp, mus musculus
tctctgcctgcatacatcgtctttg

SEQ ID NO: 91393 - DNA, 25 bp, mus musculus
cctgcatacatcgtctttgtttgtt

SEQ ID NO: 91394 - DNA, 25 bp, mus musculus
gtctttgtttgttcttctagcaaga

SEQ ID NO: 91395 - DNA, 25 bp, mus musculus
tttgtttgttcttctagcaagatgc

SEQ ID NO: 91396 - DNA, 25 bp, mus musculus
tcttctagcaagatgcagtctaggg

SEQ ID NO: 91397 - DNA, 25 bp, mus musculus
gaatgtctggtctgtctttgcctct

SEQ ID NO: 91398 - DNA, 25 bp, mus musculus
tgtctggtctgtctttgcctctcca

SEQ ID NO: 91399 - DNA, 25 bp, mus musculus
gtctgtctttgcctctccaggcaat

SEQ ID NO: 91400 - DNA, 25 bp, mus musculus
ctttgcctctccaggcaatcctagc

SEQ ID NO: 91401 - DNA, 25 bp, mus musculus
ctctccaggcaatcctagcctgaat

SEQ ID NO: 91402 - DNA, 25 bp, mus musculus
tccaggcaatcctagcctgaatttt

SEQ ID NO: 91403 - DNA, 25 bp, mus musculus
tcctagcctgaattttcaagcccct

SEQ ID NO: 91404 - DNA, 25 bp, mus musculus
ttcctggttggcttcttttccagat

SEQ ID NO: 91405 - DNA, 25 bp, mus musculus
tgggaactgacccgacatctggaga

SEQ ID NO: 91406 - DNA, 25 bp, mus musculus
gaactgacccgacatctggagactc

SEQ ID NO: 91407 - DNA, 25 bp, mus musculus
agttcacagtgccgagcagcccaag

SEQ ID NO: 91408 - DNA, 25 bp, mus musculus
tcacagtgccgagcagcccaaggat

SEQ ID NO: 91409 - DNA, 25 bp, mus musculus
cagtgccgagcagcccaaggatgtg

SEQ ID NO: 91410 - DNA, 25 bp, mus musculus
tgccgagcagcccaaggatgtgatg

SEQ ID NO: 91411 - DNA, 25 bp, mus musculus
cgcagagaagccatcgcttggcagt

SEQ ID NO: 91412 - DNA, 25 bp, mus musculus
agagaagccatcgcttggcagtccg

SEQ ID NO: 91413 - DNA, 25 bp, mus musculus
gccatcgcttggcagtccgatgcta

SEQ ID NO: 91414 - DNA, 25 bp, mus musculus
atcgcttggcagtccgatgctattg

SEQ ID NO: 91415 - DNA, 25 bp, mus musculus
gcttggcagtccgatgctattgaac

SEQ ID NO: 91416 - DNA, 25 bp, mus musculus
tggcagtccgatgctattgaacatg

SEQ ID NO: 91417 - DNA, 25 bp, mus musculus
ctgacccgacatctggagactccat

SEQ ID NO: 91418 - DNA, 25 bp, mus musculus
cagtccgatgctattgaacatgaga

SEQ ID NO: 91419 - DNA, 25 bp, mus musculus
cgacatctggagactccatactgga

SEQ ID NO: 91420 - DNA, 25 bp, mus musculus
catctggagactccatactggagaa

SEQ ID NO: 91421 - DNA, 25 bp, mus musculus
ctggagactccatactggagaaaag

SEQ ID NO: 91422 - DNA, 25 bp, mus musculus
taaatgtcaggagtgctggaaggcc

SEQ ID NO: 91423 - DNA, 25 bp, mus musculus
atgtcaggagtgctggaaggccttt

SEQ ID NO: 91424 - DNA, 25 bp, mus musculus
ctggaaggcctttgcttctgcgtca

SEQ ID NO: 91425 - DNA, 25 bp, mus musculus
ctttattcaacagtcacacctcatt

SEQ ID NO: 91426 - DNA, 25 bp, mus musculus
aagtgcttagctcctagggtgcaca

SEQ ID NO: 91427 - DNA, 25 bp, mus musculus
ttagctcctagggtgcacagctgga

SEQ ID NO: 91428 - DNA, 25 bp, mus musculus
agctccacaggaaccggatccattc

SEQ ID NO: 91429 - DNA, 25 bp, mus musculus
tccacaggaaccggatccattcacc

SEQ ID NO: 91430 - DNA, 25 bp, mus musculus
ggatccattcacctacgattaccac

SEQ ID NO: 91431 - DNA, 25 bp, mus musculus
tatcgctgggatcctcttcatcttg

SEQ ID NO: 91432 - DNA, 25 bp, mus musculus
cctcttcatcttgggcatccttatc

SEQ ID NO: 91433 - DNA, 25 bp, mus musculus
cttcatcttgggcatccttatcatc

SEQ ID NO: 91434 - DNA, 25 bp, mus musculus
cttgggcatccttatcatccttagc

SEQ ID NO: 91435 - DNA, 25 bp, mus musculus
gggcatccttatcatccttagcaag

SEQ ID NO: 91436 - DNA, 25 bp, mus musculus
catccttatcatccttagcaagaga

SEQ ID NO: 91437 - DNA, 25 bp, mus musculus
tatcatccttagcaagagatgtcga

SEQ ID NO: 91438 - DNA, 25 bp, mus musculus
gctcctagggtgcacagctggacat

SEQ ID NO: 91439 - DNA, 25 bp, mus musculus
gtgcacagctggacatttgggggtc

SEQ ID NO: 91440 - DNA, 25 bp, mus musculus
cacagctggacatttgggggtcttc

SEQ ID NO: 91441 - DNA, 25 bp, mus musculus
acatttgggggtcttctgtcaacag

SEQ ID NO: 91442 - DNA, 25 bp, mus musculus
cttctgtcaacaggggacagcgtga

SEQ ID NO: 91443 - DNA, 25 bp, mus musculus
ctgtcaacaggggacagcgtgaatg

SEQ ID NO: 91444 - DNA, 25 bp, mus musculus
cctctccatggccagtgcagaagct

SEQ ID NO: 91445 - DNA, 25 bp, mus musculus
tgcagaagctccacaggaaccggat

SEQ ID NO: 91446 - DNA, 25 bp, mus musculus
agctctgccatttcctcaccatgtg

SEQ ID NO: 91447 - DNA, 25 bp, mus musculus
tcctcaccatgtgtgttttcacatg

SEQ ID NO: 91448 - DNA, 25 bp, mus musculus
gtcgcctgcagccagacatggtacc

SEQ ID NO: 91449 - DNA, 25 bp, mus musculus
tgcagccagacatggtacctctagg

SEQ ID NO: 91450 - DNA, 25 bp, mus musculus
tggtacctctaggacaccacacaga

SEQ ID NO: 91451 - DNA, 25 bp, mus musculus
ccaaagctgtgctcagccaatttca

SEQ ID NO: 91452 - DNA, 25 bp, mus musculus
ctgtgctcagccaatttcaagcaga

SEQ ID NO: 91453 - DNA, 25 bp, mus musculus
tcagccaatttcaagcagatttgga

SEQ ID NO: 91454 - DNA, 25 bp, mus musculus
ttacagcccggaatgagcaacttga

SEQ ID NO: 91455 - DNA, 25 bp, mus musculus
atgagcaacttgacctgccttatga

SEQ ID NO: 91456 - DNA, 25 bp, mus musculus
cttatgaatacctcaagcccagccg

SEQ ID NO: 91457 - DNA, 25 bp, mus musculus
tcaagcccagccgcatagagaacag

SEQ ID NO: 91458 - DNA, 25 bp, mus musculus
cccagcatgctgccatcaaccaggg

SEQ ID NO: 91459 - DNA, 25 bp, mus musculus
atgctgccatcaaccagggccagct

SEQ ID NO: 91460 - DNA, 25 bp, mus musculus
ccatcaaccagggccagctggactg

SEQ ID NO: 91461 - DNA, 25 bp, mus musculus
tacctaatgctccatgcacaatgag

SEQ ID NO: 91462 - DNA, 25 bp, mus musculus
tggggtcgctacctgatgtgcagaa

SEQ ID NO: 91463 - DNA, 25 bp, mus musculus
cgctacctgatgtgcagaaggcctg

SEQ ID NO: 91464 - DNA, 25 bp, mus musculus
tgcagaaggcctgtcttcagatgac

SEQ ID NO: 91465 - DNA, 25 bp, mus musculus
ctatcacatggcacctgggtcgcct

SEQ ID NO: 91466 - DNA, 25 bp, mus musculus
ttatctgccctaagtcttctgttat

SEQ ID NO: 91467 - DNA, 25 bp, mus musculus
tctgccctaagtcttctgttatgtt

SEQ ID NO: 91468 - DNA, 25 bp, mus musculus
tctcttcatcatagagctctatatc

SEQ ID NO: 91469 - DNA, 25 bp, mus musculus
cttcatcatagagctctatatcttg

SEQ ID NO: 91470 - DNA, 25 bp, mus musculus
catcatagagctctatatcttggtt

SEQ ID NO: 91471 - DNA, 25 bp, mus musculus
agagctctatatcttggttaatgaa

SEQ ID NO: 91472 - DNA, 25 bp, mus musculus
gctctatatcttggttaatgaagta

SEQ ID NO: 91473 - DNA, 25 bp, mus musculus
cttggcacactttaacaatttcaat

SEQ ID NO: 91474 - DNA, 25 bp, mus musculus
tcaaaacctgcagaactattatcat

SEQ ID NO: 91475 - DNA, 25 bp, mus musculus
agctgccatcagactcgggaacatc

SEQ ID NO: 91476 - DNA, 25 bp, mus musculus
tgccatcagactcgggaacatcaaa

SEQ ID NO: 91477 - DNA, 25 bp, mus musculus
catcagactcgggaacatcaaatag

SEQ ID NO: 91478 - DNA, 25 bp, mus musculus
ctaagtcttctgttatgttcagagc

SEQ ID NO: 91479 - DNA, 25 bp, mus musculus
ttttctcttgatagcgccgaaccca

SEQ ID NO: 91480 - DNA, 25 bp, mus musculus
agtcttctgttatgttcagagctcg

SEQ ID NO: 91481 - DNA, 25 bp, mus musculus
cttctgttatgttcagagctcggca

SEQ ID NO: 91482 - DNA, 25 bp, mus musculus
ttatgttcagagctcggcactgcag

SEQ ID NO: 91483 - DNA, 25 bp, mus musculus
ggcactgcagctgtgaatctgtctc

SEQ ID NO: 91484 - DNA, 25 bp, mus musculus
gctgtgaatctgtctcttcatcata

SEQ ID NO: 91485 - DNA, 25 bp, mus musculus
gtgaatctgtctcttcatcatagag

SEQ ID NO: 91486 - DNA, 25 bp, mus musculus
aatctgtctcttcatcatagagctc

SEQ ID NO: 91487 - DNA, 25 bp, mus musculus
taacttcctagctgctaaggagaaa

SEQ ID NO: 91488 - DNA, 25 bp, mus musculus
cttcctagctgctaaggagaaatcc

SEQ ID NO: 91489 - DNA, 25 bp, mus musculus
ttacctcagaagcacctattctgac

SEQ ID NO: 91490 - DNA, 25 bp, mus musculus
cctcagaagcacctattctgactcc

SEQ ID NO: 91491 - DNA, 25 bp, mus musculus
cagaagcacctattctgactccacc

SEQ ID NO: 91492 - DNA, 25 bp, mus musculus
cacctattctgactccacctcgaga

SEQ ID NO: 91493 - DNA, 25 bp, mus musculus
ttctgactccacctcgagaaccaag

SEQ ID NO: 91494 - DNA, 25 bp, mus musculus
ctccacctcgagaaccaaggatact

SEQ ID NO: 91495 - DNA, 25 bp, mus musculus
cacctcgagaaccaaggatactctt

SEQ ID NO: 91496 - DNA, 25 bp, mus musculus
agatgttccacgattttgactacgt

SEQ ID NO: 91497 - DNA, 25 bp, mus musculus
tccacgattttgactacgttgctga

SEQ ID NO: 91498 - DNA, 25 bp, mus musculus
attttgactacgttgctgattggtg

SEQ ID NO: 91499 - DNA, 25 bp, mus musculus
gaaatcctgagcggcgcctgggagc

SEQ ID NO: 91500 - DNA, 25 bp, mus musculus
actacgttgctgattggtgttaagt

SEQ ID NO: 91501 - DNA, 25 bp, mus musculus
tccggctaaccgactggagtgctct

SEQ ID NO: 91502 - DNA, 25 bp, mus musculus
taaccgactggagtgctctaatgga

SEQ ID NO: 91503 - DNA, 25 bp, mus musculus
ccgactggagtgctctaatggacaa

SEQ ID NO: 91504 - DNA, 25 bp, mus musculus
agccaccatttgtacctaccattag

SEQ ID NO: 91505 - DNA, 25 bp, mus musculus
caccatttgtacctaccattagagg

SEQ ID NO: 91506 - DNA, 25 bp, mus musculus
catttgtacctaccattagaggacg

SEQ ID NO: 91507 - DNA, 25 bp, mus musculus
atgaatttacctcagaagcacctat

SEQ ID NO: 91508 - DNA, 25 bp, mus musculus
ggcttggtgctcagagaggacaagt

SEQ ID NO: 91509 - DNA, 25 bp, mus musculus
tctcagctaggaagacacggcgctg

SEQ ID NO: 91510 - DNA, 25 bp, mus musculus
tgtcttcagcacgatgtacctgaat

SEQ ID NO: 91511 - DNA, 25 bp, mus musculus
cacgatgtacctgaatctgtgctgc

SEQ ID NO: 91512 - DNA, 25 bp, mus musculus
gatgtacctgaatctgtgctgcctt

SEQ ID NO: 91513 - DNA, 25 bp, mus musculus
gaatctgtgctgccttggattcctg

SEQ ID NO: 91514 - DNA, 25 bp, mus musculus
tctgtgctgccttggattcctggcg

SEQ ID NO: 91515 - DNA, 25 bp, mus musculus
ctgccttggattcctggcgctggtc

SEQ ID NO: 91516 - DNA, 25 bp, mus musculus
ccttggattcctggcgctggtccac

SEQ ID NO: 91517 - DNA, 25 bp, mus musculus
tggattcctggcgctggtccactct

SEQ ID NO: 91518 - DNA, 25 bp, mus musculus
ccactctgtcaaggcccgagaccag

SEQ ID NO: 91519 - DNA, 25 bp, mus musculus
tgtcaaggcccgagaccagaagatg

SEQ ID NO: 91520 - DNA, 25 bp, mus musculus
agacacggcgctggaacccatggac

SEQ ID NO: 91521 - DNA, 25 bp, mus musculus
gctggaacccatggacacttcatat

SEQ ID NO: 91522 - DNA, 25 bp, mus musculus
tccatcatcccgcaaggctgatgct

SEQ ID NO: 91523 - DNA, 25 bp, mus musculus
atcccgcaaggctgatgctgcagcc

SEQ ID NO: 91524 - DNA, 25 bp, mus musculus
ctccatgggaacacctggccctaca

SEQ ID NO: 91525 - DNA, 25 bp, mus musculus
tcacatgctctggtctgtcttcagc

SEQ ID NO: 91526 - DNA, 25 bp, mus musculus
ctggtctgtcttcagcacgatgtac

SEQ ID NO: 91527 - DNA, 25 bp, mus musculus
gtctgtcttcagcacgatgtacctg

SEQ ID NO: 91528 - DNA, 25 bp, mus musculus
ctctcttacatcctactacactaca

SEQ ID NO: 91529 - DNA, 25 bp, mus musculus
tctcttacatcctactacactacaa

SEQ ID NO: 91530 - DNA, 25 bp, mus musculus
cactacaacattatcatcactcaaa

SEQ ID NO: 91531 - DNA, 25 bp, mus musculus
actacaacattatcatcactcaaaa

SEQ ID NO: 91532 - DNA, 25 bp, mus musculus
tacaacattatcatcactcaaaaca

SEQ ID NO: 91533 - DNA, 25 bp, mus musculus
acaacattatcatcactcaaaacat

SEQ ID NO: 91534 - DNA, 25 bp, mus musculus
aacattatcatcactcaaaacatcc

SEQ ID NO: 91535 - DNA, 25 bp, mus musculus
acattatcatcactcaaaacatccc

SEQ ID NO: 91536 - DNA, 25 bp, mus musculus
ttatcatcactcaaaacatccctta

SEQ ID NO: 91537 - DNA, 25 bp, mus musculus
atcatcactcaaaacatcccttaaa

SEQ ID NO: 91538 - DNA, 25 bp, mus musculus
tcatcactcaaaacatcccttaaaa

SEQ ID NO: 91539 - DNA, 25 bp, mus musculus
tttcacaaacactacatctcccatc

SEQ ID NO: 91540 - DNA, 25 bp, mus musculus
tcttacatcctactacactacaaca

SEQ ID NO: 91541 - DNA, 25 bp, mus musculus
cttacatcctactacactacaacat

SEQ ID NO: 91542 - DNA, 25 bp, mus musculus
acatcctactacactacaacattat

SEQ ID NO: 91543 - DNA, 25 bp, mus musculus
atcctactacactacaacattatca

SEQ ID NO: 91544 - DNA, 25 bp, mus musculus
tcctactacactacaacattatcat

SEQ ID NO: 91545 - DNA, 25 bp, mus musculus
ctactacactacaacattatcatca

SEQ ID NO: 91546 - DNA, 25 bp, mus musculus
ctacactacaacattatcatcactc

SEQ ID NO: 91547 - DNA, 25 bp, mus musculus
tacactacaacattatcatcactca

SEQ ID NO: 91548 - DNA, 25 bp, mus musculus
aaaccctgcaacagtagcattggtg

SEQ ID NO: 91549 - DNA, 25 bp, mus musculus
aatggtgccaccatgctgaacccaa

SEQ ID NO: 91550 - DNA, 25 bp, mus musculus
aaatgccattccaattgacacaagg

SEQ ID NO: 91551 - DNA, 25 bp, mus musculus
atgccattccaattgacacaaggct

SEQ ID NO: 91552 - DNA, 25 bp, mus musculus
gccattccaattgacacaaggctgt

SEQ ID NO: 91553 - DNA, 25 bp, mus musculus
cattccaattgacacaaggctgtct

SEQ ID NO: 91554 - DNA, 25 bp, mus musculus
aattgacacaaggctgtctgaacct

SEQ ID NO: 91555 - DNA, 25 bp, mus musculus
ttgacacaaggctgtctgaaccttg

SEQ ID NO: 91556 - DNA, 25 bp, mus musculus
caaggctgtctgaaccttgtgaatg

SEQ ID NO: 91557 - DNA, 25 bp, mus musculus
aggctgtctgaaccttgtgaatggt

SEQ ID NO: 91558 - DNA, 25 bp, mus musculus
tgtctgaaccttgtgaatggtacct

SEQ ID NO: 91559 - DNA, 25 bp, mus musculus
tcaaattgaaaggcccctgagattg

SEQ ID NO: 91560 - DNA, 25 bp, mus musculus
tggtgccaccatgctgaacccaatt

SEQ ID NO: 91561 - DNA, 25 bp, mus musculus
gtgccaccatgctgaacccaattgc

SEQ ID NO: 91562 - DNA, 25 bp, mus musculus
ccatgctgaacccaattgctaaaat

SEQ ID NO: 91563 - DNA, 25 bp, mus musculus
atgctgaacccaattgctaaaatgc

SEQ ID NO: 91564 - DNA, 25 bp, mus musculus
gctgaacccaattgctaaaatgcct

SEQ ID NO: 91565 - DNA, 25 bp, mus musculus
ctaaaatgcctgggtccaaggaatg

SEQ ID NO: 91566 - DNA, 25 bp, mus musculus
tgcctgggtccaaggaatggaaatt

SEQ ID NO: 91567 - DNA, 25 bp, mus musculus
tcacccgaaaaaatgccattccaat

SEQ ID NO: 91568 - DNA, 25 bp, mus musculus
caaatcagtgctggcacgctcccgt

SEQ ID NO: 91569 - DNA, 25 bp, mus musculus
acacagaccacatatcgtgtaagtt

SEQ ID NO: 91570 - DNA, 25 bp, mus musculus
tgtccccaaatcttcaagtctggga

SEQ ID NO: 91571 - DNA, 25 bp, mus musculus
ccccaaatcttcaagtctgggatgc

SEQ ID NO: 91572 - DNA, 25 bp, mus musculus
caaatcttcaagtctgggatgctgc

SEQ ID NO: 91573 - DNA, 25 bp, mus musculus
atcttcaagtctgggatgctgccac

SEQ ID NO: 91574 - DNA, 25 bp, mus musculus
aagtctgggatgctgccacagtgga

SEQ ID NO: 91575 - DNA, 25 bp, mus musculus
atatgatctccgtaagaacccatgt

SEQ ID NO: 91576 - DNA, 25 bp, mus musculus
tgatctccgtaagaacccatgtgtt

SEQ ID NO: 91577 - DNA, 25 bp, mus musculus
tctccgtaagaacccatgtgttgag

SEQ ID NO: 91578 - DNA, 25 bp, mus musculus
ccgtaagaacccatgtgttgagaga

SEQ ID NO: 91579 - DNA, 25 bp, mus musculus
taagaacccatgtgttgagagatgc

SEQ ID NO: 91580 - DNA, 25 bp, mus musculus
cagaccacatatcgtgtaagtttgc

SEQ ID NO: 91581 - DNA, 25 bp, mus musculus
accacatatcgtgtaagtttgctca

SEQ ID NO: 91582 - DNA, 25 bp, mus musculus
ttgctcagctttaagagaagatcta

SEQ ID NO: 91583 - DNA, 25 bp, mus musculus
agaagatctatcaccgtgctcgtat

SEQ ID NO: 91584 - DNA, 25 bp, mus musculus
tctatcaccgtgctcgtataagctg

SEQ ID NO: 91585 - DNA, 25 bp, mus musculus
atcaccgtgctcgtataagctgtag

SEQ ID NO: 91586 - DNA, 25 bp, mus musculus
accgtgctcgtataagctgtaggat

SEQ ID NO: 91587 - DNA, 25 bp, mus musculus
gtaggatgtccccaaatcttcaagt

SEQ ID NO: 91588 - DNA, 25 bp, mus musculus
attcggatccatgatccagacagca

SEQ ID NO: 91589 - DNA, 25 bp, mus musculus
catcaccaactacctggcaccagtg

SEQ ID NO: 91590 - DNA, 25 bp, mus musculus
tgtcagcagtgccaacgggactgtg

SEQ ID NO: 91591 - DNA, 25 bp, mus musculus
tgccaacgggactgtgctcaagagt

SEQ ID NO: 91592 - DNA, 25 bp, mus musculus
caacgggactgtgctcaagagtaca

SEQ ID NO: 91593 - DNA, 25 bp, mus musculus
ctcctctgggggccttatgcagctg

SEQ ID NO: 91594 - DNA, 25 bp, mus musculus
gggccttatgcagctgcctaccagc

SEQ ID NO: 91595 - DNA, 25 bp, mus musculus
caggtccctgtgcaggccattcatg

SEQ ID NO: 91596 - DNA, 25 bp, mus musculus
gtccctgtgcaggccattcatgtgc

SEQ ID NO: 91597 - DNA, 25 bp, mus musculus
cctgtgcaggccattcatgtgcacc

SEQ ID NO: 91598 - DNA, 25 bp, mus musculus
caggccattcatgtgcaccaggccc

SEQ ID NO: 91599 - DNA, 25 bp, mus musculus
attcatgtgcaccaggccccacagc

SEQ ID NO: 91600 - DNA, 25 bp, mus musculus
caccaactacctggcaccagtgtct

SEQ ID NO: 91601 - DNA, 25 bp, mus musculus
ctacctggcaccagtgtctgctagt

SEQ ID NO: 91602 - DNA, 25 bp, mus musculus
cctggcaccagtgtctgctagtgtc

SEQ ID NO: 91603 - DNA, 25 bp, mus musculus
ggcaccagtgtctgctagtgtcagc

SEQ ID NO: 91604 - DNA, 25 bp, mus musculus
gtctgctagtgtcagccccagcgct

SEQ ID NO: 91605 - DNA, 25 bp, mus musculus
tgctagtgtcagccccagcgctgtc

SEQ ID NO: 91606 - DNA, 25 bp, mus musculus
tgtcagccccagcgctgtcagcagt

SEQ ID NO: 91607 - DNA, 25 bp, mus musculus
cgctgtcagcagtgccaacgggact

SEQ ID NO: 91608 - DNA, 25 bp, mus musculus
tctcaacggttaccatggcaagacc

SEQ ID NO: 91609 - DNA, 25 bp, mus musculus
ttaccatggcaagacccttggagga

SEQ ID NO: 91610 - DNA, 25 bp, mus musculus
tctttgagggctgcccagataagga

SEQ ID NO: 91611 - DNA, 25 bp, mus musculus
agtgaagactcctcagatgaagtgt

SEQ ID NO: 91612 - DNA, 25 bp, mus musculus
gatcttccctgttggctgtgagata

SEQ ID NO: 91613 - DNA, 25 bp, mus musculus
ccctgttggctgtgagatagtgcct

SEQ ID NO: 91614 - DNA, 25 bp, mus musculus
tgagatagtgccttactctggcttc

SEQ ID NO: 91615 - DNA, 25 bp, mus musculus
gatagtgccttactctggcttcttc

SEQ ID NO: 91616 - DNA, 25 bp, mus musculus
ttactctggcttcttcgcacatgtg

SEQ ID NO: 91617 - DNA, 25 bp, mus musculus
tggcttcttcgcacatgtgcacagt

SEQ ID NO: 91618 - DNA, 25 bp, mus musculus
cgcacatgtgcacagtgctgagcaa

SEQ ID NO: 91619 - DNA, 25 bp, mus musculus
acatgtgcacagtgctgagcaaatt

SEQ ID NO: 91620 - DNA, 25 bp, mus musculus
taattgtgtccaccttccacaaata

SEQ ID NO: 91621 - DNA, 25 bp, mus musculus
ttgtgtccaccttccacaaatactc

SEQ ID NO: 91622 - DNA, 25 bp, mus musculus
aagctgcattccagaaggtgatgag

SEQ ID NO: 91623 - DNA, 25 bp, mus musculus
aagttgacttccaggagtactgtgt

SEQ ID NO: 91624 - DNA, 25 bp, mus musculus
gtgtcttcctgtcctgcattgccat

SEQ ID NO: 91625 - DNA, 25 bp, mus musculus
tcttcctgtcctgcattgccatgat

SEQ ID NO: 91626 - DNA, 25 bp, mus musculus
gcattgccatgatgtgcaatgaatt

SEQ ID NO: 91627 - DNA, 25 bp, mus musculus
aattctttgagggctgcccagataa

SEQ ID NO: 91628 - DNA, 25 bp, mus musculus
ctaacatccctgggctttgtagtgt

SEQ ID NO: 91629 - DNA, 25 bp, mus musculus
aagtgccactgcgtctgccctttgt

SEQ ID NO: 91630 - DNA, 25 bp, mus musculus
cttagcagcttctgatttcccacgt

SEQ ID NO: 91631 - DNA, 25 bp, mus musculus
tttgtatagcccaggccagcctcag

SEQ ID NO: 91632 - DNA, 25 bp, mus musculus
tcagtcactcagcagaggattcctg

SEQ ID NO: 91633 - DNA, 25 bp, mus musculus
cagaggattcctgaccctctgggat

SEQ ID NO: 91634 - DNA, 25 bp, mus musculus
aggattcctgaccctctgggattat

SEQ ID NO: 91635 - DNA, 25 bp, mus musculus
cctgaccctctgggattatgtctcc

SEQ ID NO: 91636 - DNA, 25 bp, mus musculus
gaccctctgggattatgtctcctga

SEQ ID NO: 91637 - DNA, 25 bp, mus musculus
ggattatgtctcctgacattgggaa

SEQ ID NO: 91638 - DNA, 25 bp, mus musculus
ttatgtctcctgacattgggaacac

SEQ ID NO: 91639 - DNA, 25 bp, mus musculus
tgtctcctgacattgggaacacatg

SEQ ID NO: 91640 - DNA, 25 bp, mus musculus
cctttgtagagcactcacccgaggg

SEQ ID NO: 91641 - DNA, 25 bp, mus musculus
gttttcagttttgcttcctggtgag

SEQ ID NO: 91642 - DNA, 25 bp, mus musculus
tttgcttcctggtgaggctggaagt

SEQ ID NO: 91643 - DNA, 25 bp, mus musculus
ctttcatttgagcagagggctcttg

SEQ ID NO: 91644 - DNA, 25 bp, mus musculus
ccgctgcctaaagcgtggagtcttc

SEQ ID NO: 91645 - DNA, 25 bp, mus musculus
cctggctctttgtctgaggagagcc

SEQ ID NO: 91646 - DNA, 25 bp, mus musculus
ggctctttgtctgaggagagcctta

SEQ ID NO: 91647 - DNA, 25 bp, mus musculus
tctttgtctgaggagagccttaagt

SEQ ID NO: 91648 - DNA, 25 bp, mus musculus
taatgtaccatgtaactttgagtga

SEQ ID NO: 91649 - DNA, 25 bp, mus musculus
atgttgctggtgagaccacaaaagg

SEQ ID NO: 91650 - DNA, 25 bp, mus musculus
acagatcacatagcatccacgtgtg

SEQ ID NO: 91651 - DNA, 25 bp, mus musculus
cagatcacatagcatccacgtgtgc

SEQ ID NO: 91652 - DNA, 25 bp, mus musculus
atcacatagcatccacgtgtgctga

SEQ ID NO: 91653 - DNA, 25 bp, mus musculus
gcatccacgtgtgctgagcttatag

SEQ ID NO: 91654 - DNA, 25 bp, mus musculus
catccacgtgtgctgagcttataga

SEQ ID NO: 91655 - DNA, 25 bp, mus musculus
tccacgtgtgctgagcttatagaaa

SEQ ID NO: 91656 - DNA, 25 bp, mus musculus
ccacgtgtgctgagcttatagaaaa

SEQ ID NO: 91657 - DNA, 25 bp, mus musculus
aagatggatcgtcgttctcgtggga

SEQ ID NO: 91658 - DNA, 25 bp, mus musculus
agatggatcgtcgttctcgtgggaa

SEQ ID NO: 91659 - DNA, 25 bp, mus musculus
atggatcgtcgttctcgtgggaagc

SEQ ID NO: 91660 - DNA, 25 bp, mus musculus
gaccacaaaaggagcaccaatggaa

SEQ ID NO: 91661 - DNA, 25 bp, mus musculus
tggatcgtcgttctcgtgggaagct

SEQ ID NO: 91662 - DNA, 25 bp, mus musculus
ggaagcagctggcttcactgtgtac

SEQ ID NO: 91663 - DNA, 25 bp, mus musculus
tggcttcactgtgtacgtgagtatc

SEQ ID NO: 91664 - DNA, 25 bp, mus musculus
tgagtatcctgaatcatctaggggg

SEQ ID NO: 91665 - DNA, 25 bp, mus musculus
ttctcggtcttgggggtcatacaga

SEQ ID NO: 91666 - DNA, 25 bp, mus musculus
ctcggtcttgggggtcatacagatc

SEQ ID NO: 91667 - DNA, 25 bp, mus musculus
gtcatacagatcacatagcatccac

SEQ ID NO: 91668 - DNA, 25 bp, mus musculus
catacagatcacatagcatccacgt

SEQ ID NO: 91669 - DNA, 25 bp, mus musculus
tactggagccaccaaaactgagcgg

SEQ ID NO: 91670 - DNA, 25 bp, mus musculus
tggagccaccaaaactgagcggagt

SEQ ID NO: 91671 - DNA, 25 bp, mus musculus
catgtccaacagtttgcattccatc

SEQ ID NO: 91672 - DNA, 25 bp, mus musculus
gtccaacagtttgcattccatcaag

SEQ ID NO: 91673 - DNA, 25 bp, mus musculus
cagtttgcattccatcaagtctgtg

SEQ ID NO: 91674 - DNA, 25 bp, mus musculus
tttgcattccatcaagtctgtgagg

SEQ ID NO: 91675 - DNA, 25 bp, mus musculus
catcaagtctgtgaggtccagcacc

SEQ ID NO: 91676 - DNA, 25 bp, mus musculus
gacaggcacatcatctacagactct

SEQ ID NO: 91677 - DNA, 25 bp, mus musculus
aggcacatcatctacagactctgga

SEQ ID NO: 91678 - DNA, 25 bp, mus musculus
cacatcatctacagactctggagga

SEQ ID NO: 91679 - DNA, 25 bp, mus musculus
atctacagactctggaggacagcac

SEQ ID NO: 91680 - DNA, 25 bp, mus musculus
tacagactctggaggacagcacctg

SEQ ID NO: 91681 - DNA, 25 bp, mus musculus
agccaccaaaactgagcggagtggc

SEQ ID NO: 91682 - DNA, 25 bp, mus musculus
tggcatcaccagactgaggagtgag

SEQ ID NO: 91683 - DNA, 25 bp, mus musculus
catcaccagactgaggagtgagatg

SEQ ID NO: 91684 - DNA, 25 bp, mus musculus
gttctttcctttgggccagaccatg

SEQ ID NO: 91685 - DNA, 25 bp, mus musculus
tcctttgggccagaccatgtccaac

SEQ ID NO: 91686 - DNA, 25 bp, mus musculus
tttgggccagaccatgtccaacagt

SEQ ID NO: 91687 - DNA, 25 bp, mus musculus
gggccagaccatgtccaacagtttg

SEQ ID NO: 91688 - DNA, 25 bp, mus musculus
gaccatgtccaacagtttgcattcc

SEQ ID NO: 91689 - DNA, 25 bp, mus musculus
tgtcatctccagcattcgacagcac

SEQ ID NO: 91690 - DNA, 25 bp, mus musculus
gtcatctccagcattcgacagcaca

SEQ ID NO: 91691 - DNA, 25 bp, mus musculus
cagcacaacgtgaggcatgagaagc

SEQ ID NO: 91692 - DNA, 25 bp, mus musculus
aagcagcagcagatgcgcgaagcgt

SEQ ID NO: 91693 - DNA, 25 bp, mus musculus
cagcagatgcgcgaagcgtaccgtg

SEQ ID NO: 91694 - DNA, 25 bp, mus musculus
gatgcgcgaagcgtaccgtgacaag

SEQ ID NO: 91695 - DNA, 25 bp, mus musculus
atgcgcgaagcgtaccgtgacaaga

SEQ ID NO: 91696 - DNA, 25 bp, mus musculus
agcgtaccgtgacaagattgaggct

SEQ ID NO: 91697 - DNA, 25 bp, mus musculus
gattgaggctgactgccaggacatc

SEQ ID NO: 91698 - DNA, 25 bp, mus musculus
attgaggctgactgccaggacatct

SEQ ID NO: 91699 - DNA, 25 bp, mus musculus
ctgccaggacatcttgaacgatgtt

SEQ ID NO: 91700 - DNA, 25 bp, mus musculus
tgccaggacatcttgaacgatgttc

SEQ ID NO: 91701 - DNA, 25 bp, mus musculus
catctccagcattcgacagcacaac

SEQ ID NO: 91702 - DNA, 25 bp, mus musculus
atctccagcattcgacagcacaacg

SEQ ID NO: 91703 - DNA, 25 bp, mus musculus
ctccagcattcgacagcacaacgtg

SEQ ID NO: 91704 - DNA, 25 bp, mus musculus
tccagcattcgacagcacaacgtga

SEQ ID NO: 91705 - DNA, 25 bp, mus musculus
cagcattcgacagcacaacgtgagg

SEQ ID NO: 91706 - DNA, 25 bp, mus musculus
agcattcgacagcacaacgtgaggc

SEQ ID NO: 91707 - DNA, 25 bp, mus musculus
cattcgacagcacaacgtgaggcat

SEQ ID NO: 91708 - DNA, 25 bp, mus musculus
acagcacaacgtgaggcatgagaag

SEQ ID NO: 91709 - DNA, 25 bp, mus musculus
tttggatccatgccctgaagaagat

SEQ ID NO: 91710 - DNA, 25 bp, mus musculus
ggatccatgccctgaagaagatagg

SEQ ID NO: 91711 - DNA, 25 bp, mus musculus
tattaatgctgattcttccatagaa

SEQ ID NO: 91712 - DNA, 25 bp, mus musculus
tgctgattcttccatagaaggaaat

SEQ ID NO: 91713 - DNA, 25 bp, mus musculus
tgattcttccatagaaggaaattac

SEQ ID NO: 91714 - DNA, 25 bp, mus musculus
ttacactctaagagttgattgcaca

SEQ ID NO: 91715 - DNA, 25 bp, mus musculus
agttgattgcacaccactgatgtac

SEQ ID NO: 91716 - DNA, 25 bp, mus musculus
tgattgcacaccactgatgtacagc

SEQ ID NO: 91717 - DNA, 25 bp, mus musculus
ttgcacaccactgatgtacagctta

SEQ ID NO: 91718 - DNA, 25 bp, mus musculus
agtgtacaacctaacaaaagagctg

SEQ ID NO: 91719 - DNA, 25 bp, mus musculus
caacctaacaaaagagctgcaaagc

SEQ ID NO: 91720 - DNA, 25 bp, mus musculus
gctgcaaagcccagatgaaggtttt

SEQ ID NO: 91721 - DNA, 25 bp, mus musculus
tttgtttgcaagctgggatgcagaa

SEQ ID NO: 91722 - DNA, 25 bp, mus musculus
gtttgcaagctgggatgcagaagaa

SEQ ID NO: 91723 - DNA, 25 bp, mus musculus
ccttcttggttctactgagtgggca

SEQ ID NO: 91724 - DNA, 25 bp, mus musculus
tggttctactgagtgggcagaggaa

SEQ ID NO: 91725 - DNA, 25 bp, mus musculus
ggaacattcaagactcctacaagag

SEQ ID NO: 91726 - DNA, 25 bp, mus musculus
acattcaagactcctacaagagcga

SEQ ID NO: 91727 - DNA, 25 bp, mus musculus
actcctacaagagcgaggtgtggct

SEQ ID NO: 91728 - DNA, 25 bp, mus musculus
cctacaagagcgaggtgtggcttat

SEQ ID NO: 91729 - DNA, 25 bp, mus musculus
aacatctgcaaggtagtggcagtcc

SEQ ID NO: 91730 - DNA, 25 bp, mus musculus
acatctgcaaggtagtggcagtccg

SEQ ID NO: 91731 - DNA, 25 bp, mus musculus
tcatctcactgcaggtgaattgaga

SEQ ID NO: 91732 - DNA, 25 bp, mus musculus
catctcactgcaggtgaattgagaa

SEQ ID NO: 91733 - DNA, 25 bp, mus musculus
atctcactgcaggtgaattgagaaa

SEQ ID NO: 91734 - DNA, 25 bp, mus musculus
tctcactgcaggtgaattgagaaaa

SEQ ID NO: 91735 - DNA, 25 bp, mus musculus
ctcactgcaggtgaattgagaaaag

SEQ ID NO: 91736 - DNA, 25 bp, mus musculus
ttcctggtgccggaagtggacaata

SEQ ID NO: 91737 - DNA, 25 bp, mus musculus
tcctggtgccggaagtggacaatag

SEQ ID NO: 91738 - DNA, 25 bp, mus musculus
gacaatagtggctccattggcagca

SEQ ID NO: 91739 - DNA, 25 bp, mus musculus
acaatagtggctccattggcagcaa

SEQ ID NO: 91740 - DNA, 25 bp, mus musculus
caatagtggctccattggcagcaag

SEQ ID NO: 91741 - DNA, 25 bp, mus musculus
catctgcaaggtagtggcagtccgc

SEQ ID NO: 91742 - DNA, 25 bp, mus musculus
atctgcaaggtagtggcagtccgca

SEQ ID NO: 91743 - DNA, 25 bp, mus musculus
tagtggcagtccgcagctagatcta

SEQ ID NO: 91744 - DNA, 25 bp, mus musculus
cagtccgcagctagatctaaattga

SEQ ID NO: 91745 - DNA, 25 bp, mus musculus
agtccgcagctagatctaaattgac

SEQ ID NO: 91746 - DNA, 25 bp, mus musculus
gtccgcagctagatctaaattgacg

SEQ ID NO: 91747 - DNA, 25 bp, mus musculus
tccgcagctagatctaaattgacga

SEQ ID NO: 91748 - DNA, 25 bp, mus musculus
gctcatctcactgcaggtgaattga

SEQ ID NO: 91749 - DNA, 25 bp, mus musculus
gaacttaatcccaaatatatgaaag

SEQ ID NO: 91750 - DNA, 25 bp, mus musculus
ttaatcccaaatatatgaaagccct

SEQ ID NO: 91751 - DNA, 25 bp, mus musculus
gacgtcacagctgtgtgtatattag

SEQ ID NO: 91752 - DNA, 25 bp, mus musculus
atacaagaaccgtgaacctctgatg

SEQ ID NO: 91753 - DNA, 25 bp, mus musculus
acaagaaccgtgaacctctgatgcc

SEQ ID NO: 91754 - DNA, 25 bp, mus musculus
gaaccgtgaacctctgatgccatct

SEQ ID NO: 91755 - DNA, 25 bp, mus musculus
cgtgaacctctgatgccatctccac

SEQ ID NO: 91756 - DNA, 25 bp, mus musculus
tgaacctctgatgccatctccacag

SEQ ID NO: 91757 - DNA, 25 bp, mus musculus
aacctctgatgccatctccacagtt

SEQ ID NO: 91758 - DNA, 25 bp, mus musculus
cctctgatgccatctccacagttta

SEQ ID NO: 91759 - DNA, 25 bp, mus musculus
tgatgccatctccacagtttattaa

SEQ ID NO: 91760 - DNA, 25 bp, mus musculus
tcttacttcagttctttcaccgatg

SEQ ID NO: 91761 - DNA, 25 bp, mus musculus
atatatgaaagccctctttagacgt

SEQ ID NO: 91762 - DNA, 25 bp, mus musculus
ttacttcagttctttcaccgatgat

SEQ ID NO: 91763 - DNA, 25 bp, mus musculus
atgaaagccctctttagacgtgcaa

SEQ ID NO: 91764 - DNA, 25 bp, mus musculus
tagacgtgcaaaagcccatgagaag

SEQ ID NO: 91765 - DNA, 25 bp, mus musculus
gacgtgcaaaagcccatgagaagct

SEQ ID NO: 91766 - DNA, 25 bp, mus musculus
tgcaaaagcccatgagaagctagac

SEQ ID NO: 91767 - DNA, 25 bp, mus musculus
ttagaagacgtcacagctgtgtgta

SEQ ID NO: 91768 - DNA, 25 bp, mus musculus
agaagacgtcacagctgtgtgtata

SEQ ID NO: 91769 - DNA, 25 bp, mus musculus
aagacgtcacagctgtgtgtatatt

SEQ ID NO: 91770 - DNA, 25 bp, mus musculus
aaagtgcagctgcttccctcgcaca

SEQ ID NO: 91771 - DNA, 25 bp, mus musculus
cttccctcgcacaaacggacagaca

SEQ ID NO: 91772 - DNA, 25 bp, mus musculus
ctcttcattccggacgtgcatttta

SEQ ID NO: 91773 - DNA, 25 bp, mus musculus
ttcattccggacgtgcattttacca

SEQ ID NO: 91774 - DNA, 25 bp, mus musculus
gacgtgcattttaccaacctgcagc

SEQ ID NO: 91775 - DNA, 25 bp, mus musculus
gtgcattttaccaacctgcagcggg

SEQ ID NO: 91776 - DNA, 25 bp, mus musculus
cattttaccaacctgcagcggggca

SEQ ID NO: 91777 - DNA, 25 bp, mus musculus
tttaccaacctgcagcggggcagtc

SEQ ID NO: 91778 - DNA, 25 bp, mus musculus
accaacctgcagcggggcagtcatg

SEQ ID NO: 91779 - DNA, 25 bp, mus musculus
aacctgcagcggggcagtcatgttc

SEQ ID NO: 91780 - DNA, 25 bp, mus musculus
ctgcagcggggcagtcatgttcttt

SEQ ID NO: 91781 - DNA, 25 bp, mus musculus
ccattcggaaccgaagatgactttg

SEQ ID NO: 91782 - DNA, 25 bp, mus musculus
ccctcgcacaaacggacagacatca

SEQ ID NO: 91783 - DNA, 25 bp, mus musculus
cctgctaagctgactcggacagaag

SEQ ID NO: 91784 - DNA, 25 bp, mus musculus
aaacggacagacatcacagtgttca

SEQ ID NO: 91785 - DNA, 25 bp, mus musculus
acagacatcacagtgttcaagccct

SEQ ID NO: 91786 - DNA, 25 bp, mus musculus
ttcctggacctcgacactcagcctg

SEQ ID NO: 91787 - DNA, 25 bp, mus musculus
gacactcagcctgtcctcttcattc

SEQ ID NO: 91788 - DNA, 25 bp, mus musculus
actcagcctgtcctcttcattccgg

SEQ ID NO: 91789 - DNA, 25 bp, mus musculus
cagcctgtcctcttcattccggacg

SEQ ID NO: 91790 - DNA, 25 bp, mus musculus
cctgtcctcttcattccggacgtgc

SEQ ID NO: 91791 - DNA, 25 bp, mus musculus
attggcgcttttgggtacatggagt

SEQ ID NO: 91792 - DNA, 25 bp, mus musculus
tgttcagcaaagaccaaagatggag

SEQ ID NO: 91793 - DNA, 25 bp, mus musculus
ctctgcaagctagacgtgggaagaa

SEQ ID NO: 91794 - DNA, 25 bp, mus musculus
aagtctgggtgcctcatcttgtgaa

SEQ ID NO: 91795 - DNA, 25 bp, mus musculus
gtctgggtgcctcatcttgtgaagc

SEQ ID NO: 91796 - DNA, 25 bp, mus musculus
ctgggtgcctcatcttgtgaagcct

SEQ ID NO: 91797 - DNA, 25 bp, mus musculus
gggtgcctcatcttgtgaagccttg

SEQ ID NO: 91798 - DNA, 25 bp, mus musculus
gtgcctcatcttgtgaagccttgtg

SEQ ID NO: 91799 - DNA, 25 bp, mus musculus
gcctcatcttgtgaagccttgtgaa

SEQ ID NO: 91800 - DNA, 25 bp, mus musculus
ctcatcttgtgaagccttgtgaacg

SEQ ID NO: 91801 - DNA, 25 bp, mus musculus
catcttgtgaagccttgtgaacgca

SEQ ID NO: 91802 - DNA, 25 bp, mus musculus
tactggccttttcatttatctataa

SEQ ID NO: 91803 - DNA, 25 bp, mus musculus
tttttgagatggccacgagagctgc

SEQ ID NO: 91804 - DNA, 25 bp, mus musculus
taatttacctaagattacaaatcag

SEQ ID NO: 91805 - DNA, 25 bp, mus musculus
tgagatggccacgagagctgctctg

SEQ ID NO: 91806 - DNA, 25 bp, mus musculus
agatggccacgagagctgctctgca

SEQ ID NO: 91807 - DNA, 25 bp, mus musculus
atggccacgagagctgctctgcaag

SEQ ID NO: 91808 - DNA, 25 bp, mus musculus
ccacgagagctgctctgcaagctag

SEQ ID NO: 91809 - DNA, 25 bp, mus musculus
gagagctgctctgcaagctagacgt

SEQ ID NO: 91810 - DNA, 25 bp, mus musculus
gagctgctctgcaagctagacgtgg

SEQ ID NO: 91811 - DNA, 25 bp, mus musculus
tgctctgcaagctagacgtgggaag

SEQ ID NO: 91812 - DNA, 25 bp, mus musculus
gaatgcccagctttccggagattgt

SEQ ID NO: 91813 - DNA, 25 bp, mus musculus
tgcccagctttccggagattgtttg

SEQ ID NO: 91814 - DNA, 25 bp, mus musculus
tcctgaagcagctgtgcagcagaac

SEQ ID NO: 91815 - DNA, 25 bp, mus musculus
tgaagcagctgtgcagcagaactct

SEQ ID NO: 91816 - DNA, 25 bp, mus musculus
gcagcagaactctctatcaacttct

SEQ ID NO: 91817 - DNA, 25 bp, mus musculus
gcagaactctctatcaacttctggt

SEQ ID NO: 91818 - DNA, 25 bp, mus musculus
gaactctctatcaacttctggtagg

SEQ ID NO: 91819 - DNA, 25 bp, mus musculus
ctctctatcaacttctggtaggccg

SEQ ID NO: 91820 - DNA, 25 bp, mus musculus
tctatcaacttctggtaggccgctg

SEQ ID NO: 91821 - DNA, 25 bp, mus musculus
atcaacttctggtaggccgctgagt

SEQ ID NO: 91822 - DNA, 25 bp, mus musculus
aacttctggtaggccgctgagtgct

SEQ ID NO: 91823 - DNA, 25 bp, mus musculus
ttctggtaggccgctgagtgctgca

SEQ ID NO: 91824 - DNA, 25 bp, mus musculus
ccagctttccggagattgtttgaga

SEQ ID NO: 91825 - DNA, 25 bp, mus musculus
gcagaccccgcagctcttggcaagt

SEQ ID NO: 91826 - DNA, 25 bp, mus musculus
gaccccgcagctcttggcaagtatg

SEQ ID NO: 91827 - DNA, 25 bp, mus musculus
cccgcagctcttggcaagtatgagg

SEQ ID NO: 91828 - DNA, 25 bp, mus musculus
gcagctcttggcaagtatgaggtaa

SEQ ID NO: 91829 - DNA, 25 bp, mus musculus
gtaaaggcctcctgaagcagctgtg

SEQ ID NO: 91830 - DNA, 25 bp, mus musculus
aaggcctcctgaagcagctgtgcag

SEQ ID NO: 91831 - DNA, 25 bp, mus musculus
gcctcctgaagcagctgtgcagcag

SEQ ID NO: 91832 - DNA, 25 bp, mus musculus
agatctttgggccggtgatgcccat

SEQ ID NO: 91833 - DNA, 25 bp, mus musculus
tgcccattgtgtgtgttcgaagctt

SEQ ID NO: 91834 - DNA, 25 bp, mus musculus
acatcactgtgcccactttgccctt

SEQ ID NO: 91835 - DNA, 25 bp, mus musculus
tgaggtctctgcggaatgaagaagc

SEQ ID NO: 91836 - DNA, 25 bp, mus musculus
gcccagccaagatgccccggcattg

SEQ ID NO: 91837 - DNA, 25 bp, mus musculus
gacacttgttttgctggctgtcctg

SEQ ID NO: 91838 - DNA, 25 bp, mus musculus
tgttttgctggctgtcctgtccttg

SEQ ID NO: 91839 - DNA, 25 bp, mus musculus
tgtcctgtccttgaagaattgctca

SEQ ID NO: 91840 - DNA, 25 bp, mus musculus
ttgctcacggagcctcatcctggct

SEQ ID NO: 91841 - DNA, 25 bp, mus musculus
acggagcctcatcctggcttctctc

SEQ ID NO: 91842 - DNA, 25 bp, mus musculus
catgctcaactacccgaaggctctc

SEQ ID NO: 91843 - DNA, 25 bp, mus musculus
ctgctgtttgctgagcacagagacc

SEQ ID NO: 91844 - DNA, 25 bp, mus musculus
ttgtgtgtgttcgaagcttggatga

SEQ ID NO: 91845 - DNA, 25 bp, mus musculus
gtgttcgaagcttggatgaggccat

SEQ ID NO: 91846 - DNA, 25 bp, mus musculus
ttatcaaccagcgcgagaagcccct

SEQ ID NO: 91847 - DNA, 25 bp, mus musculus
tggcactctatgtgttctccaacaa

SEQ ID NO: 91848 - DNA, 25 bp, mus musculus
tctatgtgttctccaacaatgacaa

SEQ ID NO: 91849 - DNA, 25 bp, mus musculus
tgttctccaacaatgacaaggtgat

SEQ ID NO: 91850 - DNA, 25 bp, mus musculus
acgtcattgttcacatcactgtgcc

SEQ ID NO: 91851 - DNA, 25 bp, mus musculus
ttgttcacatcactgtgcccacttt

SEQ ID NO: 91852 - DNA, 25 bp, mus musculus
caacattcccaacaagcagacaccg

SEQ ID NO: 91853 - DNA, 25 bp, mus musculus
aacattcccaacaagcagacaccga

SEQ ID NO: 91854 - DNA, 25 bp, mus musculus
ccgactttcaacaactaatcctgca

SEQ ID NO: 91855 - DNA, 25 bp, mus musculus
gactttcaacaactaatcctgcaac

SEQ ID NO: 91856 - DNA, 25 bp, mus musculus
ctttcaacaactaatcctgcaacca

SEQ ID NO: 91857 - DNA, 25 bp, mus musculus
tttcaacaactaatcctgcaaccaa

SEQ ID NO: 91858 - DNA, 25 bp, mus musculus
tcaacaactaatcctgcaaccaacc

SEQ ID NO: 91859 - DNA, 25 bp, mus musculus
caacaactaatcctgcaaccaacct

SEQ ID NO: 91860 - DNA, 25 bp, mus musculus
acaactaatcctgcaaccaaccttg

SEQ ID NO: 91861 - DNA, 25 bp, mus musculus
aactaatcctgcaaccaaccttgtg

SEQ ID NO: 91862 - DNA, 25 bp, mus musculus
ctaatcctgcaaccaaccttgtgta

SEQ ID NO: 91863 - DNA, 25 bp, mus musculus
taatcctgcaaccaaccttgtgtaa

SEQ ID NO: 91864 - DNA, 25 bp, mus musculus
acattcccaacaagcagacaccgac

SEQ ID NO: 91865 - DNA, 25 bp, mus musculus
aatcctgcaaccaaccttgtgtaat

SEQ ID NO: 91866 - DNA, 25 bp, mus musculus
attcccaacaagcagacaccgactt

SEQ ID NO: 91867 - DNA, 25 bp, mus musculus
ttcccaacaagcagacaccgacttt

SEQ ID NO: 91868 - DNA, 25 bp, mus musculus
tcccaacaagcagacaccgactttc

SEQ ID NO: 91869 - DNA, 25 bp, mus musculus
caacaagcagacaccgactttcaac

SEQ ID NO: 91870 - DNA, 25 bp, mus musculus
acaagcagacaccgactttcaacaa

SEQ ID NO: 91871 - DNA, 25 bp, mus musculus
caagcagacaccgactttcaacaac

SEQ ID NO: 91872 - DNA, 25 bp, mus musculus
caccgactttcaacaactaatcctg

SEQ ID NO: 91873 - DNA, 25 bp, mus musculus
tcaacatcggcatcgggggctctga

SEQ ID NO: 91874 - DNA, 25 bp, mus musculus
caacatcggcatcgggggctctgac

SEQ ID NO: 91875 - DNA, 25 bp, mus musculus
atggtgactgacactcccaagccct

SEQ ID NO: 91876 - DNA, 25 bp, mus musculus
tggtgactgacactcccaagcccta

SEQ ID NO: 91877 - DNA, 25 bp, mus musculus
ggtgactgacactcccaagccctac

SEQ ID NO: 91878 - DNA, 25 bp, mus musculus
gtgactgacactcccaagccctact

SEQ ID NO: 91879 - DNA, 25 bp, mus musculus
gagcccttccaattccagacaccga

SEQ ID NO: 91880 - DNA, 25 bp, mus musculus
gcccttccaattccagacaccgaag

SEQ ID NO: 91881 - DNA, 25 bp, mus musculus
cttccaattccagacaccgaaggag

SEQ ID NO: 91882 - DNA, 25 bp, mus musculus
ttccaattccagacaccgaaggagg

SEQ ID NO: 91883 - DNA, 25 bp, mus musculus
tccaattccagacaccgaaggaggg

SEQ ID NO: 91884 - DNA, 25 bp, mus musculus
aacatcggcatcgggggctctgacc

SEQ ID NO: 91885 - DNA, 25 bp, mus musculus
ctgacctgggacccctcatggtgac

SEQ ID NO: 91886 - DNA, 25 bp, mus musculus
tgacctgggacccctcatggtgact

SEQ ID NO: 91887 - DNA, 25 bp, mus musculus
acctgggacccctcatggtgactga

SEQ ID NO: 91888 - DNA, 25 bp, mus musculus
cctgggacccctcatggtgactgac

SEQ ID NO: 91889 - DNA, 25 bp, mus musculus
tgggacccctcatggtgactgacac

SEQ ID NO: 91890 - DNA, 25 bp, mus musculus
gggacccctcatggtgactgacact

SEQ ID NO: 91891 - DNA, 25 bp, mus musculus
catggtgactgacactcccaagccc

SEQ ID NO: 91892 - DNA, 25 bp, mus musculus
gtctccgtcgagactgtgtgcatac

SEQ ID NO: 91893 - DNA, 25 bp, mus musculus
ccgtcgagactgtgtgcatactaag

SEQ ID NO: 91894 - DNA, 25 bp, mus musculus
agtgtgcttcctttaatagaattag

SEQ ID NO: 91895 - DNA, 25 bp, mus musculus
atgaaggtccatctacggagagact

SEQ ID NO: 91896 - DNA, 25 bp, mus musculus
tagaatcttgtctatggcgtattct

SEQ ID NO: 91897 - DNA, 25 bp, mus musculus
atcttgtctatggcgtattctgaag

SEQ ID NO: 91898 - DNA, 25 bp, mus musculus
cttgtctatggcgtattctgaagca

SEQ ID NO: 91899 - DNA, 25 bp, mus musculus
gtattctgaagcattcactaaaggt

SEQ ID NO: 91900 - DNA, 25 bp, mus musculus
tctgaagcattcactaaaggttcac

SEQ ID NO: 91901 - DNA, 25 bp, mus musculus
ggttcacagttgttcagctgtactg

SEQ ID NO: 91902 - DNA, 25 bp, mus musculus
ttcacagttgttcagctgtactgcc

SEQ ID NO: 91903 - DNA, 25 bp, mus musculus
cacagttgttcagctgtactgccaa

SEQ ID NO: 91904 - DNA, 25 bp, mus musculus
cagtacatcatacaactttcgatct

SEQ ID NO: 91905 - DNA, 25 bp, mus musculus
cagttgttcagctgtactgccaaga

SEQ ID NO: 91906 - DNA, 25 bp, mus musculus
gtacatcatacaactttcgatctct

SEQ ID NO: 91907 - DNA, 25 bp, mus musculus
atcatacaactttcgatctctgatg

SEQ ID NO: 91908 - DNA, 25 bp, mus musculus
catacaactttcgatctctgatgac

SEQ ID NO: 91909 - DNA, 25 bp, mus musculus
caactttcgatctctgatgactgga

SEQ ID NO: 91910 - DNA, 25 bp, mus musculus
tcgatctctgatgactggagagata

SEQ ID NO: 91911 - DNA, 25 bp, mus musculus
gatctctgatgactggagagatagg

SEQ ID NO: 91912 - DNA, 25 bp, mus musculus
tgagtgtgcttcctttaatagaatt

SEQ ID NO: 91913 - DNA, 25 bp, mus musculus
gctaaatatccaatcaagcagtctc

SEQ ID NO: 91914 - DNA, 25 bp, mus musculus
aatatccaatcaagcagtctctgaa

SEQ ID NO: 91915 - DNA, 25 bp, mus musculus
gaacgctggcggaaatcgtgaagaa

SEQ ID NO: 91916 - DNA, 25 bp, mus musculus
tgactttgttcttgattcggagtat

SEQ ID NO: 91917 - DNA, 25 bp, mus musculus
actttgttcttgattcggagtatct

SEQ ID NO: 91918 - DNA, 25 bp, mus musculus
agtatcttgtcacattgctggtggt

SEQ ID NO: 91919 - DNA, 25 bp, mus musculus
tcttgtcacattgctggtggtagtt

SEQ ID NO: 91920 - DNA, 25 bp, mus musculus
ttgtcacattgctggtggtagttcc

SEQ ID NO: 91921 - DNA, 25 bp, mus musculus
tcccaagctgaaccacaatgactgg

SEQ ID NO: 91922 - DNA, 25 bp, mus musculus
ccaagctgaaccacaatgactggat

SEQ ID NO: 91923 - DNA, 25 bp, mus musculus
gctgaaccacaatgactggattaag

SEQ ID NO: 91924 - DNA, 25 bp, mus musculus
tgaaccacaatgactggattaagca

SEQ ID NO: 91925 - DNA, 25 bp, mus musculus
tatccaatcaagcagtctctgaaaa

SEQ ID NO: 91926 - DNA, 25 bp, mus musculus
caatcaagcagtctctgaaaaatat

SEQ ID NO: 91927 - DNA, 25 bp, mus musculus
aatgacctaaagtctcgggcgtctg

SEQ ID NO: 91928 - DNA, 25 bp, mus musculus
acctaaagtctcgggcgtctgcata

SEQ ID NO: 91929 - DNA, 25 bp, mus musculus
ctaaagtctcgggcgtctgcataca

SEQ ID NO: 91930 - DNA, 25 bp, mus musculus
agtctcgggcgtctgcatacaataa

SEQ ID NO: 91931 - DNA, 25 bp, mus musculus
tctcgggcgtctgcatacaataacc

SEQ ID NO: 91932 - DNA, 25 bp, mus musculus
gcgtctgcatacaataacctgaaag

SEQ ID NO: 91933 - DNA, 25 bp, mus musculus
cgcaacccaactgaaacgcccgatg

SEQ ID NO: 91934 - DNA, 25 bp, mus musculus
caacccaactgaaacgcccgatgca

SEQ ID NO: 91935 - DNA, 25 bp, mus musculus
tagcacctggcctaggcggctagga

SEQ ID NO: 91936 - DNA, 25 bp, mus musculus
cttagaggagacgctggcggccaca

SEQ ID NO: 91937 - DNA, 25 bp, mus musculus
agacgctggcggccacaaagtacct

SEQ ID NO: 91938 - DNA, 25 bp, mus musculus
acgctggcggccacaaagtacctga

SEQ ID NO: 91939 - DNA, 25 bp, mus musculus
ctggcggccacaaagtacctgatgg

SEQ ID NO: 91940 - DNA, 25 bp, mus musculus
tggcggccacaaagtacctgatggt

SEQ ID NO: 91941 - DNA, 25 bp, mus musculus
cggccacaaagtacctgatggtgga

SEQ ID NO: 91942 - DNA, 25 bp, mus musculus
ggccacaaagtacctgatggtggag

SEQ ID NO: 91943 - DNA, 25 bp, mus musculus
tgccagagctgccgcaaggctgacg

SEQ ID NO: 91944 - DNA, 25 bp, mus musculus
agagctgccgcaaggctgacggcag

SEQ ID NO: 91945 - DNA, 25 bp, mus musculus
aacccaactgaaacgcccgatgcag

SEQ ID NO: 91946 - DNA, 25 bp, mus musculus
tgcattgctgtacctagcacctggc

SEQ ID NO: 91947 - DNA, 25 bp, mus musculus
cattgctgtacctagcacctggcct

SEQ ID NO: 91948 - DNA, 25 bp, mus musculus
attgctgtacctagcacctggccta

SEQ ID NO: 91949 - DNA, 25 bp, mus musculus
ttgctgtacctagcacctggcctag

SEQ ID NO: 91950 - DNA, 25 bp, mus musculus
gctgtacctagcacctggcctaggc

SEQ ID NO: 91951 - DNA, 25 bp, mus musculus
tgtacctagcacctggcctaggcgg

SEQ ID NO: 91952 - DNA, 25 bp, mus musculus
tacctagcacctggcctaggcggct

SEQ ID NO: 91953 - DNA, 25 bp, mus musculus
cgccacagtgttcgtgtttgctgtc

SEQ ID NO: 91954 - DNA, 25 bp, mus musculus
cacagtgttcgtgtttgctgtcgtc

SEQ ID NO: 91955 - DNA, 25 bp, mus musculus
gctcttctacacgtcgaatattccc

SEQ ID NO: 91956 - DNA, 25 bp, mus musculus
ctacacgtcgaatattcccataatc

SEQ ID NO: 91957 - DNA, 25 bp, mus musculus
gtcgaatattcccataatcctccag

SEQ ID NO: 91958 - DNA, 25 bp, mus musculus
cataatcctccagtctgccctagtt

SEQ ID NO: 91959 - DNA, 25 bp, mus musculus
aatcctccagtctgccctagtttca

SEQ ID NO: 91960 - DNA, 25 bp, mus musculus
aaacttgtacgtcatttcccagatg

SEQ ID NO: 91961 - DNA, 25 bp, mus musculus
cttgtacgtcatttcccagatgctg

SEQ ID NO: 91962 - DNA, 25 bp, mus musculus
ttcccagatgctgtctgttcgattt

SEQ ID NO: 91963 - DNA, 25 bp, mus musculus
gatgctgtctgttcgatttagtggc

SEQ ID NO: 91964 - DNA, 25 bp, mus musculus
gctgtctgttcgatttagtggcaac

SEQ ID NO: 91965 - DNA, 25 bp, mus musculus
tgctgtcgtcatctattttcagggg

SEQ ID NO: 91966 - DNA, 25 bp, mus musculus
tgttgacttgcccattaagtcggca

SEQ ID NO: 91967 - DNA, 25 bp, mus musculus
cttgcccattaagtcggcacggtat

SEQ ID NO: 91968 - DNA, 25 bp, mus musculus
cattaagtcggcacggtatcgtgga

SEQ ID NO: 91969 - DNA, 25 bp, mus musculus
taagtcggcacggtatcgtggacag

SEQ ID NO: 91970 - DNA, 25 bp, mus musculus
gtacagtagctatcctatcaagctc

SEQ ID NO: 91971 - DNA, 25 bp, mus musculus
cagtagctatcctatcaagctcttc

SEQ ID NO: 91972 - DNA, 25 bp, mus musculus
tatcaagctcttctacacgtcgaat

SEQ ID NO: 91973 - DNA, 25 bp, mus musculus
aatcctagaatcagagtcgagtctc

SEQ ID NO: 91974 - DNA, 25 bp, mus musculus
gagtctcttctggtgactgccatta

SEQ ID NO: 91975 - DNA, 25 bp, mus musculus
caggacaacacctatcctgagatcc

SEQ ID NO: 91976 - DNA, 25 bp, mus musculus
gacaacacctatcctgagatcctgc

SEQ ID NO: 91977 - DNA, 25 bp, mus musculus
acctatcctgagatcctgcgctcta

SEQ ID NO: 91978 - DNA, 25 bp, mus musculus
tatcctgagatcctgcgctctaacc

SEQ ID NO: 91979 - DNA, 25 bp, mus musculus
cctgagatcctgcgctctaacctag

SEQ ID NO: 91980 - DNA, 25 bp, mus musculus
gagatcctgcgctctaacctaggat

SEQ ID NO: 91981 - DNA, 25 bp, mus musculus
ctgcgctctaacctaggatcggttg

SEQ ID NO: 91982 - DNA, 25 bp, mus musculus
cgctctaacctaggatcggttgtgt

SEQ ID NO: 91983 - DNA, 25 bp, mus musculus
tctaacctaggatcggttgtgttgc

SEQ ID NO: 91984 - DNA, 25 bp, mus musculus
aacctaggatcggttgtgttgcagc

SEQ ID NO: 91985 - DNA, 25 bp, mus musculus
tctcttctggtgactgccattagta

SEQ ID NO: 91986 - DNA, 25 bp, mus musculus
cttctggtgactgccattagtaaag

SEQ ID NO: 91987 - DNA, 25 bp, mus musculus
aaagcttcagctcagcaaagggcgg

SEQ ID NO: 91988 - DNA, 25 bp, mus musculus
ggacggaccagacctgggaaatgct

SEQ ID NO: 91989 - DNA, 25 bp, mus musculus
cggaccagacctgggaaatgcttca

SEQ ID NO: 91990 - DNA, 25 bp, mus musculus
aaatgcttcaggctttatacagaga

SEQ ID NO: 91991 - DNA, 25 bp, mus musculus
tgcttcaggctttatacagagaaag

SEQ ID NO: 91992 - DNA, 25 bp, mus musculus
atgcaggacaacacctatcctgaga

SEQ ID NO: 91993 - DNA, 25 bp, mus musculus
tgcttgcatgccagaaaggagaact

SEQ ID NO: 91994 - DNA, 25 bp, mus musculus
gcttgcatgccagaaaggagaactt

SEQ ID NO: 91995 - DNA, 25 bp, mus musculus
gcacagcccgcttggtcttacaagt

SEQ ID NO: 91996 - DNA, 25 bp, mus musculus
cacagcccgcttggtcttacaagtt

SEQ ID NO: 91997 - DNA, 25 bp, mus musculus
gtccttcctgacaacactgaattca

SEQ ID NO: 91998 - DNA, 25 bp, mus musculus
cttcctgacaacactgaattcaaac

SEQ ID NO: 91999 - DNA, 25 bp, mus musculus
ttcctgacaacactgaattcaaaca

SEQ ID NO: 92000 - DNA, 25 bp, mus musculus
cctgacaacactgaattcaaacaaa

SEQ ID NO: 92001 - DNA, 25 bp, mus musculus
aagtgtgacctctatgtgagagcta

SEQ ID NO: 92002 - DNA, 25 bp, mus musculus
gtgtgacctctatgtgagagctaag

SEQ ID NO: 92003 - DNA, 25 bp, mus musculus
tgacctctatgtgagagctaagtag

SEQ ID NO: 92004 - DNA, 25 bp, mus musculus
gacctctatgtgagagctaagtagt

SEQ ID NO: 92005 - DNA, 25 bp, mus musculus
ttaaacctttgaagacattgactga

SEQ ID NO: 92006 - DNA, 25 bp, mus musculus
ttgttttctggttcaagcgatggaa

SEQ ID NO: 92007 - DNA, 25 bp, mus musculus
tgttttctggttcaagcgatggaac

SEQ ID NO: 92008 - DNA, 25 bp, mus musculus
ttttctggttcaagcgatggaactt

SEQ ID NO: 92009 - DNA, 25 bp, mus musculus
tttctggttcaagcgatggaactta

SEQ ID NO: 92010 - DNA, 25 bp, mus musculus
gtctcaagaagcactaggcacagcc

SEQ ID NO: 92011 - DNA, 25 bp, mus musculus
agaagcactaggcacagcccgcttg

SEQ ID NO: 92012 - DNA, 25 bp, mus musculus
taggcacagcccgcttggtcttaca

SEQ ID NO: 92013 - DNA, 25 bp, mus musculus
caaattgatgcgggctcggcagtat

SEQ ID NO: 92014 - DNA, 25 bp, mus musculus
aaattgatgcgggctcggcagtatc

SEQ ID NO: 92015 - DNA, 25 bp, mus musculus
atgctgattcgggtcaacatggagg

SEQ ID NO: 92016 - DNA, 25 bp, mus musculus
tgctgattcgggtcaacatggagga

SEQ ID NO: 92017 - DNA, 25 bp, mus musculus
gctgattcgggtcaacatggaggat

SEQ ID NO: 92018 - DNA, 25 bp, mus musculus
ctgattcgggtcaacatggaggatc

SEQ ID NO: 92019 - DNA, 25 bp, mus musculus
gattcgggtcaacatggaggatctg

SEQ ID NO: 92020 - DNA, 25 bp, mus musculus
tcaacatggaggatctgcgggacag

SEQ ID NO: 92021 - DNA, 25 bp, mus musculus
caacatggaggatctgcgggacaga

SEQ ID NO: 92022 - DNA, 25 bp, mus musculus
aacatggaggatctgcgggacagac

SEQ ID NO: 92023 - DNA, 25 bp, mus musculus
aattgatgcgggctcggcagtatcc

SEQ ID NO: 92024 - DNA, 25 bp, mus musculus
attgatgcgggctcggcagtatcct

SEQ ID NO: 92025 - DNA, 25 bp, mus musculus
ttgatgcgggctcggcagtatcctt

SEQ ID NO: 92026 - DNA, 25 bp, mus musculus
tgatgcgggctcggcagtatccttg

SEQ ID NO: 92027 - DNA, 25 bp, mus musculus
ggctcggcagtatccttgggggact

SEQ ID NO: 92028 - DNA, 25 bp, mus musculus
tgaaaacgaggctcactgcgacttt

SEQ ID NO: 92029 - DNA, 25 bp, mus musculus
aaacgaggctcactgcgactttgtg

SEQ ID NO: 92030 - DNA, 25 bp, mus musculus
tgaagctgcgggagatgctgattcg

SEQ ID NO: 92031 - DNA, 25 bp, mus musculus
cactcagcagccagaggcaccggca

SEQ ID NO: 92032 - DNA, 25 bp, mus musculus
agacagatcgcagctctgtagacaa

SEQ ID NO: 92033 - DNA, 25 bp, mus musculus
cagacgaccctaatctggtgaacga

SEQ ID NO: 92034 - DNA, 25 bp, mus musculus
atccctctacagacgatacagctct

SEQ ID NO: 92035 - DNA, 25 bp, mus musculus
cctctacagacgatacagctctggc

SEQ ID NO: 92036 - DNA, 25 bp, mus musculus
ctacagacgatacagctctggctga

SEQ ID NO: 92037 - DNA, 25 bp, mus musculus
atacagctctggctgatatcacacc

SEQ ID NO: 92038 - DNA, 25 bp, mus musculus
cagctctggctgatatcacaccttc

SEQ ID NO: 92039 - DNA, 25 bp, mus musculus
ctgatatcacaccttccacagatga

SEQ ID NO: 92040 - DNA, 25 bp, mus musculus
caccttccacagatgacctagctgg

SEQ ID NO: 92041 - DNA, 25 bp, mus musculus
ccacagatgacctagctggtgacaa

SEQ ID NO: 92042 - DNA, 25 bp, mus musculus
ctactgcagagtgccgggatgagaa

SEQ ID NO: 92043 - DNA, 25 bp, mus musculus
cagatcgcagctctgtagacaatat

SEQ ID NO: 92044 - DNA, 25 bp, mus musculus
acaatatgctgttcttggggcagaa

SEQ ID NO: 92045 - DNA, 25 bp, mus musculus
tgctgttcttggggcagaaggcctt

SEQ ID NO: 92046 - DNA, 25 bp, mus musculus
tcttggggcagaaggccttgctgct

SEQ ID NO: 92047 - DNA, 25 bp, mus musculus
ttgtcttggcaatcagcatcccctc

SEQ ID NO: 92048 - DNA, 25 bp, mus musculus
tcttggcaatcagcatcccctctga

SEQ ID NO: 92049 - DNA, 25 bp, mus musculus
ctgactggctacccctaggggtcag

SEQ ID NO: 92050 - DNA, 25 bp, mus musculus
atgtgcctgagacattcacagacga

SEQ ID NO: 92051 - DNA, 25 bp, mus musculus
aatcacgagaactctcagaatctcg

SEQ ID NO: 92052 - DNA, 25 bp, mus musculus
atcacgagaactctcagaatctcga

SEQ ID NO: 92053 - DNA, 25 bp, mus musculus
tcagagctctttcgcgataatacac

SEQ ID NO: 92054 - DNA, 25 bp, mus musculus
agagctctttcgcgataatacacat

SEQ ID NO: 92055 - DNA, 25 bp, mus musculus
gagctctttcgcgataatacacatg

SEQ ID NO: 92056 - DNA, 25 bp, mus musculus
agctctttcgcgataatacacatgt

SEQ ID NO: 92057 - DNA, 25 bp, mus musculus
ctctttcgcgataatacacatgtgt

SEQ ID NO: 92058 - DNA, 25 bp, mus musculus
tctttcgcgataatacacatgtgtc

SEQ ID NO: 92059 - DNA, 25 bp, mus musculus
ctttcgcgataatacacatgtgtct

SEQ ID NO: 92060 - DNA, 25 bp, mus musculus
tgttgtttctcaagagcacttctac

SEQ ID NO: 92061 - DNA, 25 bp, mus musculus
gttgtttctcaagagcacttctaca

SEQ ID NO: 92062 - DNA, 25 bp, mus musculus
tgtttctcaagagcacttctacacc

SEQ ID NO: 92063 - DNA, 25 bp, mus musculus
cacgagaactctcagaatctcgaaa

SEQ ID NO: 92064 - DNA, 25 bp, mus musculus
gtttctcaagagcacttctacacca

SEQ ID NO: 92065 - DNA, 25 bp, mus musculus
acgagaactctcagaatctcgaaaa

SEQ ID NO: 92066 - DNA, 25 bp, mus musculus
cgagaactctcagaatctcgaaaaa

SEQ ID NO: 92067 - DNA, 25 bp, mus musculus
agaactctcagaatctcgaaaaact

SEQ ID NO: 92068 - DNA, 25 bp, mus musculus
gaactctcagaatctcgaaaaactt

SEQ ID NO: 92069 - DNA, 25 bp, mus musculus
ctctcagaatctcgaaaaactttca

SEQ ID NO: 92070 - DNA, 25 bp, mus musculus
ctcagaatctcgaaaaactttcaga

SEQ ID NO: 92071 - DNA, 25 bp, mus musculus
atctcgaaaaactttcagagctctt

SEQ ID NO: 92072 - DNA, 25 bp, mus musculus
ttggcttccagtcaggttaatcttt

SEQ ID NO: 92073 - DNA, 25 bp, mus musculus
gcttccagtcaggttaatctttgca

SEQ ID NO: 92074 - DNA, 25 bp, mus musculus
cgcagaaaccaagatctcatttgca

SEQ ID NO: 92075 - DNA, 25 bp, mus musculus
aaccaagatctcatttgcagcttct

SEQ ID NO: 92076 - DNA, 25 bp, mus musculus
caagatctcatttgcagcttcttca

SEQ ID NO: 92077 - DNA, 25 bp, mus musculus
ttcttcacctggttctcggaccaca

SEQ ID NO: 92078 - DNA, 25 bp, mus musculus
ttcacctggttctcggaccacagcc

SEQ ID NO: 92079 - DNA, 25 bp, mus musculus
tggttctcggaccacagccttccag

SEQ ID NO: 92080 - DNA, 25 bp, mus musculus
ttctcggaccacagccttccagaat

SEQ ID NO: 92081 - DNA, 25 bp, mus musculus
tcggaccacagccttccagaatctg

SEQ ID NO: 92082 - DNA, 25 bp, mus musculus
gaccacagccttccagaatctgaca

SEQ ID NO: 92083 - DNA, 25 bp, mus musculus
gaatctgacagaatcgctgagatta

SEQ ID NO: 92084 - DNA, 25 bp, mus musculus
ccctacttcagaaacaagctgattg

SEQ ID NO: 92085 - DNA, 25 bp, mus musculus
agatcatctggtcgagtggtgtctc

SEQ ID NO: 92086 - DNA, 25 bp, mus musculus
tccactccaatcatttggcggagag

SEQ ID NO: 92087 - DNA, 25 bp, mus musculus
gggcatgagccccagtccttcattc

SEQ ID NO: 92088 - DNA, 25 bp, mus musculus
catgagccccagtccttcattcgca

SEQ ID NO: 92089 - DNA, 25 bp, mus musculus
gagccccagtccttcattcgcagaa

SEQ ID NO: 92090 - DNA, 25 bp, mus musculus
cagtccttcattcgcagaaaccaag

SEQ ID NO: 92091 - DNA, 25 bp, mus musculus
ttcattcgcagaaaccaagatctca

SEQ ID NO: 92092 - DNA, 25 bp, mus musculus
ttgttaacccattcgaatatacaga

SEQ ID NO: 92093 - DNA, 25 bp, mus musculus
acccattcgaatatacagatctggc

SEQ ID NO: 92094 - DNA, 25 bp, mus musculus
attctggaaagccttggcatggttc

SEQ ID NO: 92095 - DNA, 25 bp, mus musculus
gaaagccttggcatggttctgtaaa

SEQ ID NO: 92096 - DNA, 25 bp, mus musculus
ctgtaaagctcttgtaccgctggag

SEQ ID NO: 92097 - DNA, 25 bp, mus musculus
tgtaccgctggagaaacggcatcac

SEQ ID NO: 92098 - DNA, 25 bp, mus musculus
gcatcactataagctatgagttgaa

SEQ ID NO: 92099 - DNA, 25 bp, mus musculus
actgtttctgtcaagtatgtcttgt

SEQ ID NO: 92100 - DNA, 25 bp, mus musculus
tctgtcaagtatgtcttgtgtccac

SEQ ID NO: 92101 - DNA, 25 bp, mus musculus
aagtatgtcttgtgtccacacatgg

SEQ ID NO: 92102 - DNA, 25 bp, mus musculus
gtcttgtgtccacacatggtttgga

SEQ ID NO: 92103 - DNA, 25 bp, mus musculus
tagaatccagattccctgagtgtga

SEQ ID NO: 92104 - DNA, 25 bp, mus musculus
atctggcagtcatagcttggcacca

SEQ ID NO: 92105 - DNA, 25 bp, mus musculus
gggacccatggtgcatttgtaataa

SEQ ID NO: 92106 - DNA, 25 bp, mus musculus
cagtcatagcttggcaccaaattcc

SEQ ID NO: 92107 - DNA, 25 bp, mus musculus
tagcttggcaccaaattcccgaaag

SEQ ID NO: 92108 - DNA, 25 bp, mus musculus
ccgaaagacctctcgaaagcatgaa

SEQ ID NO: 92109 - DNA, 25 bp, mus musculus
gcatgaatttcctgactgtgccaag

SEQ ID NO: 92110 - DNA, 25 bp, mus musculus
tgactgtgccaaggcctgataaagg

SEQ ID NO: 92111 - DNA, 25 bp, mus musculus
tgccaaggcctgataaagggaacta

SEQ ID NO: 92112 - DNA, 25 bp, mus musculus
tcttggagctcacaaatgtgaatca

SEQ ID NO: 92113 - DNA, 25 bp, mus musculus
tgtgcatcccgcgatgattggcgct

SEQ ID NO: 92114 - DNA, 25 bp, mus musculus
ctgtccgctccatgcacgaattctc

SEQ ID NO: 92115 - DNA, 25 bp, mus musculus
catcgtcaccaacgtggcctcgcaa

SEQ ID NO: 92116 - DNA, 25 bp, mus musculus
tcgtcaccaacgtggcctcgcaatg

SEQ ID NO: 92117 - DNA, 25 bp, mus musculus
cgtcaccaacgtggcctcgcaatga

SEQ ID NO: 92118 - DNA, 25 bp, mus musculus
tcaccaacgtggcctcgcaatgagg

SEQ ID NO: 92119 - DNA, 25 bp, mus musculus
tggcctcgcaatgaggcaaaactga

SEQ ID NO: 92120 - DNA, 25 bp, mus musculus
aactgacgtaaactacactcagcta

SEQ ID NO: 92121 - DNA, 25 bp, mus musculus
ctgacgtaaactacactcagctagt

SEQ ID NO: 92122 - DNA, 25 bp, mus musculus
tgacgtaaactacactcagctagtc

SEQ ID NO: 92123 - DNA, 25 bp, mus musculus
acgtaaactacactcagctagtcga

SEQ ID NO: 92124 - DNA, 25 bp, mus musculus
cgtaaactacactcagctagtcgat

SEQ ID NO: 92125 - DNA, 25 bp, mus musculus
tgtccgctccatgcacgaattctca

SEQ ID NO: 92126 - DNA, 25 bp, mus musculus
tccgctccatgcacgaattctcagc

SEQ ID NO: 92127 - DNA, 25 bp, mus musculus
gtttcgtgtgcatcgtcaccaacgt

SEQ ID NO: 92128 - DNA, 25 bp, mus musculus
tttcgtgtgcatcgtcaccaacgtg

SEQ ID NO: 92129 - DNA, 25 bp, mus musculus
tcgtgtgcatcgtcaccaacgtggc

SEQ ID NO: 92130 - DNA, 25 bp, mus musculus
cgtgtgcatcgtcaccaacgtggcc

SEQ ID NO: 92131 - DNA, 25 bp, mus musculus
gtgcatcgtcaccaacgtggcctcg

SEQ ID NO: 92132 - DNA, 25 bp, mus musculus
gcatcgtcaccaacgtggcctcgca

SEQ ID NO: 92133 - DNA, 25 bp, mus musculus
gcacgagcggcacgagccaaggctg

SEQ ID NO: 92134 - DNA, 25 bp, mus musculus
aaggctgacacgctgaccctggagg

SEQ ID NO: 92135 - DNA, 25 bp, mus musculus
ctgctgtccaacggcattgacgtgt

SEQ ID NO: 92136 - DNA, 25 bp, mus musculus
tgtccaacggcattgacgtgtaccc

SEQ ID NO: 92137 - DNA, 25 bp, mus musculus
tccaacggcattgacgtgtacccgc

SEQ ID NO: 92138 - DNA, 25 bp, mus musculus
acggcattgacgtgtacccgcagaa

SEQ ID NO: 92139 - DNA, 25 bp, mus musculus
ttgacgtgtacccgcagaaggagtt

SEQ ID NO: 92140 - DNA, 25 bp, mus musculus
tgtacccgcagaaggagtttgatga

SEQ ID NO: 92141 - DNA, 25 bp, mus musculus
gagatgatcccatttgctgtggtgg

SEQ ID NO: 92142 - DNA, 25 bp, mus musculus
gttgagaataccactcactgtgaat

SEQ ID NO: 92143 - DNA, 25 bp, mus musculus
ccactcactgtgaatttgcttacct

SEQ ID NO: 92144 - DNA, 25 bp, mus musculus
actcactgtgaatttgcttacctgc

SEQ ID NO: 92145 - DNA, 25 bp, mus musculus
ctgacacgctgaccctggaggagag

SEQ ID NO: 92146 - DNA, 25 bp, mus musculus
gggtctacttcaaacagcggatcac

SEQ ID NO: 92147 - DNA, 25 bp, mus musculus
acttcaaacagcggatcactgcaga

SEQ ID NO: 92148 - DNA, 25 bp, mus musculus
ttcaaacagcggatcactgcagacc

SEQ ID NO: 92149 - DNA, 25 bp, mus musculus
aacagcggatcactgcagacctgct

SEQ ID NO: 92150 - DNA, 25 bp, mus musculus
atcactgcagacctgctgtccaacg

SEQ ID NO: 92151 - DNA, 25 bp, mus musculus
ctgcagacctgctgtccaacggcat

SEQ ID NO: 92152 - DNA, 25 bp, mus musculus
gcagacctgctgtccaacggcattg

SEQ ID NO: 92153 - DNA, 25 bp, mus musculus
tgcacgacacagtcatctcaaagtg

SEQ ID NO: 92154 - DNA, 25 bp, mus musculus
gcacgacacagtcatctcaaagtgc

SEQ ID NO: 92155 - DNA, 25 bp, mus musculus
aagcccttgcatatcatagtacact

SEQ ID NO: 92156 - DNA, 25 bp, mus musculus
gcccttgcatatcatagtacactcc

SEQ ID NO: 92157 - DNA, 25 bp, mus musculus
tgcatatcatagtacactccaagta

SEQ ID NO: 92158 - DNA, 25 bp, mus musculus
gcatatcatagtacactccaagtac

SEQ ID NO: 92159 - DNA, 25 bp, mus musculus
atatcatagtacactccaagtacat

SEQ ID NO: 92160 - DNA, 25 bp, mus musculus
tatcatagtacactccaagtacatc

SEQ ID NO: 92161 - DNA, 25 bp, mus musculus
atcatagtacactccaagtacatca

SEQ ID NO: 92162 - DNA, 25 bp, mus musculus
catagtacactccaagtacatcaaa

SEQ ID NO: 92163 - DNA, 25 bp, mus musculus
atagtacactccaagtacatcaaag

SEQ ID NO: 92164 - DNA, 25 bp, mus musculus
ggcaaagcctttgcaaatcaaagtt

SEQ ID NO: 92165 - DNA, 25 bp, mus musculus
acgacacagtcatctcaaagtgcat

SEQ ID NO: 92166 - DNA, 25 bp, mus musculus
cgacacagtcatctcaaagtgcata

SEQ ID NO: 92167 - DNA, 25 bp, mus musculus
gacacagtcatctcaaagtgcataa

SEQ ID NO: 92168 - DNA, 25 bp, mus musculus
cacagtcatctcaaagtgcataaaa

SEQ ID NO: 92169 - DNA, 25 bp, mus musculus
acagtcatctcaaagtgcataaaat

SEQ ID NO: 92170 - DNA, 25 bp, mus musculus
cagtcatctcaaagtgcataaaata

SEQ ID NO: 92171 - DNA, 25 bp, mus musculus
taaagcccttgcatatcatagtaca

SEQ ID NO: 92172 - DNA, 25 bp, mus musculus
aaagcccttgcatatcatagtacac

SEQ ID NO: 92173 - DNA, 25 bp, mus musculus
tacaatattacaatcaactcttaag

SEQ ID NO: 92174 - DNA, 25 bp, mus musculus
tattacaatcaactcttaagggact

SEQ ID NO: 92175 - DNA, 25 bp, mus musculus
gcttgcagactttggagtcgcaggt

SEQ ID NO: 92176 - DNA, 25 bp, mus musculus
agactttggagtcgcaggtcaactt

SEQ ID NO: 92177 - DNA, 25 bp, mus musculus
ctttggagtcgcaggtcaacttaca

SEQ ID NO: 92178 - DNA, 25 bp, mus musculus
aggtcaacttacagataccatggca

SEQ ID NO: 92179 - DNA, 25 bp, mus musculus
tcaacttacagataccatggcaaag

SEQ ID NO: 92180 - DNA, 25 bp, mus musculus
aacttacagataccatggcaaagag

SEQ ID NO: 92181 - DNA, 25 bp, mus musculus
cagataccatggcaaagaggaatac

SEQ ID NO: 92182 - DNA, 25 bp, mus musculus
ggctcctgaagttattcaggaaatt

SEQ ID NO: 92183 - DNA, 25 bp, mus musculus
acatctggtctctgggaataactgc

SEQ ID NO: 92184 - DNA, 25 bp, mus musculus
aactgccatagaaatggctgaagga

SEQ ID NO: 92185 - DNA, 25 bp, mus musculus
tacaatcaactcttaagggactaga

SEQ ID NO: 92186 - DNA, 25 bp, mus musculus
actagaataccttcattttatgaga

SEQ ID NO: 92187 - DNA, 25 bp, mus musculus
tagaataccttcattttatgagaaa

SEQ ID NO: 92188 - DNA, 25 bp, mus musculus
tacaccgagatatcaaggcgggaaa

SEQ ID NO: 92189 - DNA, 25 bp, mus musculus
acaccgagatatcaaggcgggaaat

SEQ ID NO: 92190 - DNA, 25 bp, mus musculus
atattttgctaaacacagaaggcca

SEQ ID NO: 92191 - DNA, 25 bp, mus musculus
tattttgctaaacacagaaggccat

SEQ ID NO: 92192 - DNA, 25 bp, mus musculus
gctaaacacagaaggccatgcaaag

SEQ ID NO: 92193 - DNA, 25 bp, mus musculus
aaagctctccaagatgggtgaaagt

SEQ ID NO: 92194 - DNA, 25 bp, mus musculus
agctctccaagatgggtgaaagttc

SEQ ID NO: 92195 - DNA, 25 bp, mus musculus
atttcagggaagctctccgtgttag

SEQ ID NO: 92196 - DNA, 25 bp, mus musculus
ttcagggaagctctccgtgttagtg

SEQ ID NO: 92197 - DNA, 25 bp, mus musculus
cagggaagctctccgtgttagtgag

SEQ ID NO: 92198 - DNA, 25 bp, mus musculus
gggaagctctccgtgttagtgagcc

SEQ ID NO: 92199 - DNA, 25 bp, mus musculus
gaagctctccgtgttagtgagccta

SEQ ID NO: 92200 - DNA, 25 bp, mus musculus
agctctccgtgttagtgagcctaaa

SEQ ID NO: 92201 - DNA, 25 bp, mus musculus
ctctccgtgttagtgagcctaaagc

SEQ ID NO: 92202 - DNA, 25 bp, mus musculus
ctccgtgttagtgagcctaaagcac

SEQ ID NO: 92203 - DNA, 25 bp, mus musculus
tagtgagcctaaagcacccaaggca

SEQ ID NO: 92204 - DNA, 25 bp, mus musculus
gtgagcctaaagcacccaaggcacc

SEQ ID NO: 92205 - DNA, 25 bp, mus musculus
ctctccaagatgggtgaaagttcac

SEQ ID NO: 92206 - DNA, 25 bp, mus musculus
tggacacagagtccagtgtttataa

SEQ ID NO: 92207 - DNA, 25 bp, mus musculus
gacacagagtccagtgtttataact

SEQ ID NO: 92208 - DNA, 25 bp, mus musculus
aagattgcattcacagagtggattg

SEQ ID NO: 92209 - DNA, 25 bp, mus musculus
gattgcattcacagagtggattgaa

SEQ ID NO: 92210 - DNA, 25 bp, mus musculus
ttgcattcacagagtggattgaacc

SEQ ID NO: 92211 - DNA, 25 bp, mus musculus
gccaactatgctgttgatgcatatt

SEQ ID NO: 92212 - DNA, 25 bp, mus musculus
caactatgctgttgatgcatatttc

SEQ ID NO: 92213 - DNA, 25 bp, mus musculus
agctcctttatcaagcgtcaccctg

SEQ ID NO: 92214 - DNA, 25 bp, mus musculus
gtcaccctgaacgtagaatccaggt

SEQ ID NO: 92215 - DNA, 25 bp, mus musculus
acagtcctcttcacagacagactcc

SEQ ID NO: 92216 - DNA, 25 bp, mus musculus
agtcctcttcacagacagactcctc

SEQ ID NO: 92217 - DNA, 25 bp, mus musculus
ctcttcacagacagactcctcagag

SEQ ID NO: 92218 - DNA, 25 bp, mus musculus
cttcacagacagactcctcagaggc

SEQ ID NO: 92219 - DNA, 25 bp, mus musculus
tcacagacagactcctcagaggcgg

SEQ ID NO: 92220 - DNA, 25 bp, mus musculus
ttttagccaggcaaatgtatatgtc

SEQ ID NO: 92221 - DNA, 25 bp, mus musculus
atgtatatgtccacatatctctgga

SEQ ID NO: 92222 - DNA, 25 bp, mus musculus
gtatatgtccacatatctctggatg

SEQ ID NO: 92223 - DNA, 25 bp, mus musculus
atatgtccacatatctctggatgct

SEQ ID NO: 92224 - DNA, 25 bp, mus musculus
atgtccacatatctctggatgctgc

SEQ ID NO: 92225 - DNA, 25 bp, mus musculus
caccctgaacgtagaatccaggtat

SEQ ID NO: 92226 - DNA, 25 bp, mus musculus
gtccacatatctctggatgctgcat

SEQ ID NO: 92227 - DNA, 25 bp, mus musculus
agaatccaggtatgcacatgcctat

SEQ ID NO: 92228 - DNA, 25 bp, mus musculus
tccaggtatgcacatgcctatatta

SEQ ID NO: 92229 - DNA, 25 bp, mus musculus
ttatacagagcgacagtcctcttca

SEQ ID NO: 92230 - DNA, 25 bp, mus musculus
atacagagcgacagtcctcttcaca

SEQ ID NO: 92231 - DNA, 25 bp, mus musculus
acagagcgacagtcctcttcacaga

SEQ ID NO: 92232 - DNA, 25 bp, mus musculus
agcgacagtcctcttcacagacaga

SEQ ID NO: 92233 - DNA, 25 bp, mus musculus
cgacagtcctcttcacagacagact

SEQ ID NO: 92234 - DNA, 25 bp, mus musculus
ataccaattctagcaccttaattgt

SEQ ID NO: 92235 - DNA, 25 bp, mus musculus
ctagcaccttaattgtaccctggct

SEQ ID NO: 92236 - DNA, 25 bp, mus musculus
cgtctgatagtgcccgccaacacac

SEQ ID NO: 92237 - DNA, 25 bp, mus musculus
aacacacagcactgacaaattcatt

SEQ ID NO: 92238 - DNA, 25 bp, mus musculus
catcttctttccgatctttgtctaa

SEQ ID NO: 92239 - DNA, 25 bp, mus musculus
tgtctaatacactcttaacggtatc

SEQ ID NO: 92240 - DNA, 25 bp, mus musculus
tctcacttccacacgctatataatc

SEQ ID NO: 92241 - DNA, 25 bp, mus musculus
cacttccacacgctatataatctcc

SEQ ID NO: 92242 - DNA, 25 bp, mus musculus
ttccacacgctatataatctccatt

SEQ ID NO: 92243 - DNA, 25 bp, mus musculus
acgctatataatctccattggaagc

SEQ ID NO: 92244 - DNA, 25 bp, mus musculus
ctatataatctccattggaagcaag

SEQ ID NO: 92245 - DNA, 25 bp, mus musculus
tataatctccattggaagcaaggcc

SEQ ID NO: 92246 - DNA, 25 bp, mus musculus
ttgtaccctggctgttagcagcaat

SEQ ID NO: 92247 - DNA, 25 bp, mus musculus
taccctggctgttagcagcaatcag

SEQ ID NO: 92248 - DNA, 25 bp, mus musculus
tgttagcagcaatcagcacattgga

SEQ ID NO: 92249 - DNA, 25 bp, mus musculus
tagcagcaatcagcacattggactc

SEQ ID NO: 92250 - DNA, 25 bp, mus musculus
cagcaatcagcacattggactcccc

SEQ ID NO: 92251 - DNA, 25 bp, mus musculus
tcagcacattggactccccgtctga

SEQ ID NO: 92252 - DNA, 25 bp, mus musculus
gcacattggactccccgtctgatag

SEQ ID NO: 92253 - DNA, 25 bp, mus musculus
cattggactccccgtctgatagtgc

SEQ ID NO: 92254 - DNA, 25 bp, mus musculus
agaatatgcctatggtgcagaggaa

SEQ ID NO: 92255 - DNA, 25 bp, mus musculus
gaatatgcctatggtgcagaggaag

SEQ ID NO: 92256 - DNA, 25 bp, mus musculus
agctgtccgagtatacaggagtcga

SEQ ID NO: 92257 - DNA, 25 bp, mus musculus
actggaatgctaccactaggaacga

SEQ ID NO: 92258 - DNA, 25 bp, mus musculus
tggaatgctaccactaggaacgact

SEQ ID NO: 92259 - DNA, 25 bp, mus musculus
gctaccactaggaacgactcttgga

SEQ ID NO: 92260 - DNA, 25 bp, mus musculus
ccactaggaacgactcttggaacag

SEQ ID NO: 92261 - DNA, 25 bp, mus musculus
actaggaacgactcttggaacagcg

SEQ ID NO: 92262 - DNA, 25 bp, mus musculus
aacgactcttggaacagcgagagct

SEQ ID NO: 92263 - DNA, 25 bp, mus musculus
acgactcttggaacagcgagagctc

SEQ ID NO: 92264 - DNA, 25 bp, mus musculus
gactcttggaacagcgagagctctg

SEQ ID NO: 92265 - DNA, 25 bp, mus musculus
actcttggaacagcgagagctctgc

SEQ ID NO: 92266 - DNA, 25 bp, mus musculus
atatgcctatggtgcagaggaaggg

SEQ ID NO: 92267 - DNA, 25 bp, mus musculus
tgcctatggtgcagaggaagggctc

SEQ ID NO: 92268 - DNA, 25 bp, mus musculus
gggctccgaagattcctagaacgct

SEQ ID NO: 92269 - DNA, 25 bp, mus musculus
aagattcctagaacgctaaacatgt

SEQ ID NO: 92270 - DNA, 25 bp, mus musculus
agattcctagaacgctaaacatgta

SEQ ID NO: 92271 - DNA, 25 bp, mus musculus
attcctagaacgctaaacatgtata

SEQ ID NO: 92272 - DNA, 25 bp, mus musculus
ttcctagaacgctaaacatgtatat

SEQ ID NO: 92273 - DNA, 25 bp, mus musculus
cctagaacgctaaacatgtatatga

SEQ ID NO: 92274 - DNA, 25 bp, mus musculus
tacgtccctcggtctgctcaccaag

SEQ ID NO: 92275 - DNA, 25 bp, mus musculus
gtccctcggtctgctcaccaagaag

SEQ ID NO: 92276 - DNA, 25 bp, mus musculus
cctgagccagtctcctgatggggtc

SEQ ID NO: 92277 - DNA, 25 bp, mus musculus
ccagtctcctgatggggtcctggat

SEQ ID NO: 92278 - DNA, 25 bp, mus musculus
gtctcctgatggggtcctggatctg

SEQ ID NO: 92279 - DNA, 25 bp, mus musculus
tgatggggtcctggatctgaacaag

SEQ ID NO: 92280 - DNA, 25 bp, mus musculus
ggaaggcatccacctcattaagaag

SEQ ID NO: 92281 - DNA, 25 bp, mus musculus
aggcatccacctcattaagaagaag

SEQ ID NO: 92282 - DNA, 25 bp, mus musculus
catccacctcattaagaagaagtct

SEQ ID NO: 92283 - DNA, 25 bp, mus musculus
taagaacaacgtccagtggatgggc

SEQ ID NO: 92284 - DNA, 25 bp, mus musculus
gaacaacgtccagtggatgggctgc

SEQ ID NO: 92285 - DNA, 25 bp, mus musculus
caacgtccagtggatgggctgcagt

SEQ ID NO: 92286 - DNA, 25 bp, mus musculus
cctcggtctgctcaccaagaagttc

SEQ ID NO: 92287 - DNA, 25 bp, mus musculus
catgctggccagtgtcaaggcctgt

SEQ ID NO: 92288 - DNA, 25 bp, mus musculus
cggtctgctcaccaagaagttcatt

SEQ ID NO: 92289 - DNA, 25 bp, mus musculus
tctgctcaccaagaagttcattcag

SEQ ID NO: 92290 - DNA, 25 bp, mus musculus
gaagttcattcagctcctgagccag

SEQ ID NO: 92291 - DNA, 25 bp, mus musculus
gttcattcagctcctgagccagtct

SEQ ID NO: 92292 - DNA, 25 bp, mus musculus
cattcagctcctgagccagtctcct

SEQ ID NO: 92293 - DNA, 25 bp, mus musculus
tcagctcctgagccagtctcctgat

SEQ ID NO: 92294 - DNA, 25 bp, mus musculus
gctcctgagccagtctcctgatggg

SEQ ID NO: 92295 - DNA, 25 bp, mus musculus
tcttttaacatgtcaaactctggag

SEQ ID NO: 92296 - DNA, 25 bp, mus musculus
tttaacatgtcaaactctggagatt

SEQ ID NO: 92297 - DNA, 25 bp, mus musculus
cagccaatatgccaccaggtggatt

SEQ ID NO: 92298 - DNA, 25 bp, mus musculus
ccaatatgccaccaggtggattcag

SEQ ID NO: 92299 - DNA, 25 bp, mus musculus
tgccaccaggtggattcagtagagt

SEQ ID NO: 92300 - DNA, 25 bp, mus musculus
tgtaccagccttcagttttctcagc

SEQ ID NO: 92301 - DNA, 25 bp, mus musculus
agccttcagttttctcagcgtcctg

SEQ ID NO: 92302 - DNA, 25 bp, mus musculus
cagttttctcagcgtcctgctcctg

SEQ ID NO: 92303 - DNA, 25 bp, mus musculus
tctcagcgtcctgctcctgtctgga

SEQ ID NO: 92304 - DNA, 25 bp, mus musculus
cgtcctgctcctgtctggacagaaa

SEQ ID NO: 92305 - DNA, 25 bp, mus musculus
cctgctcctgtctggacagaaagaa

SEQ ID NO: 92306 - DNA, 25 bp, mus musculus
gctcctgtctggacagaaagaagga

SEQ ID NO: 92307 - DNA, 25 bp, mus musculus
aacatgtcaaactctggagatttgt

SEQ ID NO: 92308 - DNA, 25 bp, mus musculus
gatttgttcatgagcgtgcagtcac

SEQ ID NO: 92309 - DNA, 25 bp, mus musculus
ttgttcatgagcgtgcagtcactca

SEQ ID NO: 92310 - DNA, 25 bp, mus musculus
ttcatgagcgtgcagtcactcaatg

SEQ ID NO: 92311 - DNA, 25 bp, mus musculus
agcgtgcagtcactcaatggggatt

SEQ ID NO: 92312 - DNA, 25 bp, mus musculus
cagtcactcaatggggattcttacc

SEQ ID NO: 92313 - DNA, 25 bp, mus musculus
gtagggacccagccaatatgccacc

SEQ ID NO: 92314 - DNA, 25 bp, mus musculus
acccagccaatatgccaccaggtgg

SEQ ID NO: 92315 - DNA, 25 bp, mus musculus
tgcagctggcgcctcatcagaacaa

SEQ ID NO: 92316 - DNA, 25 bp, mus musculus
agctggcgcctcatcagaacaatga

SEQ ID NO: 92317 - DNA, 25 bp, mus musculus
ttcctctcagttcaaggtacaggaa

SEQ ID NO: 92318 - DNA, 25 bp, mus musculus
taaagagtcgcccttgcttgtggtg

SEQ ID NO: 92319 - DNA, 25 bp, mus musculus
agagtcgcccttgcttgtggtgata

SEQ ID NO: 92320 - DNA, 25 bp, mus musculus
gagtcgcccttgcttgtggtgatac

SEQ ID NO: 92321 - DNA, 25 bp, mus musculus
gtcgcccttgcttgtggtgatacaa

SEQ ID NO: 92322 - DNA, 25 bp, mus musculus
gcccttgcttgtggtgatacaacga

SEQ ID NO: 92323 - DNA, 25 bp, mus musculus
cccttgcttgtggtgatacaacgag

SEQ ID NO: 92324 - DNA, 25 bp, mus musculus
gatacaacgagggcagcctaagttc

SEQ ID NO: 92325 - DNA, 25 bp, mus musculus
atacaacgagggcagcctaagttcg

SEQ ID NO: 92326 - DNA, 25 bp, mus musculus
acaacgagggcagcctaagttcgag

SEQ ID NO: 92327 - DNA, 25 bp, mus musculus
gctggcgcctcatcagaacaatgac

SEQ ID NO: 92328 - DNA, 25 bp, mus musculus
tggcgcctcatcagaacaatgacac

SEQ ID NO: 92329 - DNA, 25 bp, mus musculus
cactcaggctgctgttcctgggctc

SEQ ID NO: 92330 - DNA, 25 bp, mus musculus
ctcaggctgctgttcctgggctctc

SEQ ID NO: 92331 - DNA, 25 bp, mus musculus
aggctgctgttcctgggctctcaac

SEQ ID NO: 92332 - DNA, 25 bp, mus musculus
ggctgctgttcctgggctctcaact

SEQ ID NO: 92333 - DNA, 25 bp, mus musculus
ctgctgttcctgggctctcaacttc

SEQ ID NO: 92334 - DNA, 25 bp, mus musculus
ctgttcctgggctctcaacttcctc

SEQ ID NO: 92335 - DNA, 25 bp, mus musculus
aagccaattccagtgttggacgtga

SEQ ID NO: 92336 - DNA, 25 bp, mus musculus
tcaaggtgtctcctctcagtgcagg

SEQ ID NO: 92337 - DNA, 25 bp, mus musculus
tccaacaattctgctctggttattt

SEQ ID NO: 92338 - DNA, 25 bp, mus musculus
aattctgctctggttatttcattga

SEQ ID NO: 92339 - DNA, 25 bp, mus musculus
aagacatctttgcacatgtgaccat

SEQ ID NO: 92340 - DNA, 25 bp, mus musculus
tctttgcacatgtgaccatgctgtg

SEQ ID NO: 92341 - DNA, 25 bp, mus musculus
cacatgtgaccatgctgtgttaggg

SEQ ID NO: 92342 - DNA, 25 bp, mus musculus
ggctgtgttccagggactggactcg

SEQ ID NO: 92343 - DNA, 25 bp, mus musculus
gttccagggactggactcgaagcta

SEQ ID NO: 92344 - DNA, 25 bp, mus musculus
ggactcgaagctagaactggcagaa

SEQ ID NO: 92345 - DNA, 25 bp, mus musculus
tcttcatcagaagacaagggaacga

SEQ ID NO: 92346 - DNA, 25 bp, mus musculus
tcagataataccactggttaaaata

SEQ ID NO: 92347 - DNA, 25 bp, mus musculus
gcgaggaccctgaatcatttggagc

SEQ ID NO: 92348 - DNA, 25 bp, mus musculus
aatcatttggagcccagaaggaggc

SEQ ID NO: 92349 - DNA, 25 bp, mus musculus
ggccaggtctcaccacctcagtgtg

SEQ ID NO: 92350 - DNA, 25 bp, mus musculus
gtctcaccacctcagtgtgcagttc

SEQ ID NO: 92351 - DNA, 25 bp, mus musculus
ccacctcagtgtgcagttcaactcc

SEQ ID NO: 92352 - DNA, 25 bp, mus musculus
catgccatcccatcaagatgggtta

SEQ ID NO: 92353 - DNA, 25 bp, mus musculus
atcccatcaagatgggttagtagca

SEQ ID NO: 92354 - DNA, 25 bp, mus musculus
gtgatttccaacaattctgctctgg

SEQ ID NO: 92355 - DNA, 25 bp, mus musculus
catcacaggaggcaccaccgacagc

SEQ ID NO: 92356 - DNA, 25 bp, mus musculus
aggaggcaccaccgacagctgccca

SEQ ID NO: 92357 - DNA, 25 bp, mus musculus
cattatcagttctttgaggatgttt

SEQ ID NO: 92358 - DNA, 25 bp, mus musculus
tatcagttctttgaggatgtttgac

SEQ ID NO: 92359 - DNA, 25 bp, mus musculus
gcttccaactgggcctctgtcgtgt

SEQ ID NO: 92360 - DNA, 25 bp, mus musculus
gtgaaatataccaacaacgaggcca

SEQ ID NO: 92361 - DNA, 25 bp, mus musculus
tataccaacaacgaggccaattcga

SEQ ID NO: 92362 - DNA, 25 bp, mus musculus
aacgaggccaattcgatgtggtgga

SEQ ID NO: 92363 - DNA, 25 bp, mus musculus
agatatacgcatcattgacaagtca

SEQ ID NO: 92364 - DNA, 25 bp, mus musculus
tatacgcatcattgacaagtcaggt

SEQ ID NO: 92365 - DNA, 25 bp, mus musculus
acgcatcattgacaagtcaggttcc

SEQ ID NO: 92366 - DNA, 25 bp, mus musculus
tgacaagtcaggttccacagtcacc

SEQ ID NO: 92367 - DNA, 25 bp, mus musculus
aggcaccaccgacagctgcccagtt

SEQ ID NO: 92368 - DNA, 25 bp, mus musculus
gtcaggttccacagtcaccgctgct

SEQ ID NO: 92369 - DNA, 25 bp, mus musculus
caccaccgacagctgcccagttgga

SEQ ID NO: 92370 - DNA, 25 bp, mus musculus
caccgacagctgcccagttggaagc

SEQ ID NO: 92371 - DNA, 25 bp, mus musculus
cagctgcccagttggaagctggtcc

SEQ ID NO: 92372 - DNA, 25 bp, mus musculus
ccccacattggtgcttcctgtgatg

SEQ ID NO: 92373 - DNA, 25 bp, mus musculus
ggtgcttcctgtgatggtgttgacc

SEQ ID NO: 92374 - DNA, 25 bp, mus musculus
gcttcctgtgatggtgttgaccact

SEQ ID NO: 92375 - DNA, 25 bp, mus musculus
gaccactgtccggagaatagtggga

SEQ ID NO: 92376 - DNA, 25 bp, mus musculus
taatctatcagctcgtggcaggact

SEQ ID NO: 92377 - DNA, 25 bp, mus musculus
tcccaccattcagagccgggaatga

SEQ ID NO: 92378 - DNA, 25 bp, mus musculus
ggcctctcaaagctcatccattctt

SEQ ID NO: 92379 - DNA, 25 bp, mus musculus
ctctcaaagctcatccattctttga

SEQ ID NO: 92380 - DNA, 25 bp, mus musculus
tcaaagctcatccattctttgagac

SEQ ID NO: 92381 - DNA, 25 bp, mus musculus
aagctcatccattctttgagaccat

SEQ ID NO: 92382 - DNA, 25 bp, mus musculus
ctcatccattctttgagaccatcac

SEQ ID NO: 92383 - DNA, 25 bp, mus musculus
atccattctttgagaccatcacttg

SEQ ID NO: 92384 - DNA, 25 bp, mus musculus
cattctttgagaccatcacttggga

SEQ ID NO: 92385 - DNA, 25 bp, mus musculus
tctttgagaccatcacttgggagaa

SEQ ID NO: 92386 - DNA, 25 bp, mus musculus
ttgagaccatcacttgggagaattt

SEQ ID NO: 92387 - DNA, 25 bp, mus musculus
ccatcacttgggagaatttgcacca

SEQ ID NO: 92388 - DNA, 25 bp, mus musculus
caccattcagagccgggaatgaata

SEQ ID NO: 92389 - DNA, 25 bp, mus musculus
agaatttgcaccagcagacacctcc

SEQ ID NO: 92390 - DNA, 25 bp, mus musculus
cattcagagccgggaatgaatatct

SEQ ID NO: 92391 - DNA, 25 bp, mus musculus
tggaatatcatttcccagaaaaatt

SEQ ID NO: 92392 - DNA, 25 bp, mus musculus
aattcttccctaaggctagagatct

SEQ ID NO: 92393 - DNA, 25 bp, mus musculus
ttttagatgccacaaagcgtttagg

SEQ ID NO: 92394 - DNA, 25 bp, mus musculus
tagatgccacaaagcgtttaggctg

SEQ ID NO: 92395 - DNA, 25 bp, mus musculus
atgccacaaagcgtttaggctgtga

SEQ ID NO: 92396 - DNA, 25 bp, mus musculus
acgggcctctcaaagctcatccatt

SEQ ID NO: 92397 - DNA, 25 bp, mus musculus
cgcccgcgaactcagagtccactga

SEQ ID NO: 92398 - DNA, 25 bp, mus musculus
gcccgcgaactcagagtccactgac

SEQ ID NO: 92399 - DNA, 25 bp, mus musculus
tcagagtccactgacttttccgcca

SEQ ID NO: 92400 - DNA, 25 bp, mus musculus
tttgacagtgccaacgtcaagcaag

SEQ ID NO: 92401 - DNA, 25 bp, mus musculus
ttgacagtgccaacgtcaagcaagt

SEQ ID NO: 92402 - DNA, 25 bp, mus musculus
tgacagtgccaacgtcaagcaagtg

SEQ ID NO: 92403 - DNA, 25 bp, mus musculus
gacagtgccaacgtcaagcaagtgg

SEQ ID NO: 92404 - DNA, 25 bp, mus musculus
acagtgccaacgtcaagcaagtgga

SEQ ID NO: 92405 - DNA, 25 bp, mus musculus
cagtgccaacgtcaagcaagtggac

SEQ ID NO: 92406 - DNA, 25 bp, mus musculus
agtgccaacgtcaagcaagtggacg

SEQ ID NO: 92407 - DNA, 25 bp, mus musculus
gtgccaacgtcaagcaagtggacgt

SEQ ID NO: 92408 - DNA, 25 bp, mus musculus
tgccaacgtcaagcaagtggacgtg

SEQ ID NO: 92409 - DNA, 25 bp, mus musculus
ccgcgaactcagagtccactgactt

SEQ ID NO: 92410 - DNA, 25 bp, mus musculus
cgcgaactcagagtccactgacttt

SEQ ID NO: 92411 - DNA, 25 bp, mus musculus
gcgaactcagagtccactgactttt

SEQ ID NO: 92412 - DNA, 25 bp, mus musculus
cgaactcagagtccactgacttttc

SEQ ID NO: 92413 - DNA, 25 bp, mus musculus
gaactcagagtccactgacttttcc

SEQ ID NO: 92414 - DNA, 25 bp, mus musculus
aactcagagtccactgacttttccg

SEQ ID NO: 92415 - DNA, 25 bp, mus musculus
actcagagtccactgacttttccgc

SEQ ID NO: 92416 - DNA, 25 bp, mus musculus
ctcagagtccactgacttttccgcc

SEQ ID NO: 92417 - DNA, 25 bp, mus musculus
caattcggttcggaggcgtcacagt

SEQ ID NO: 92418 - DNA, 25 bp, mus musculus
attcggttcggaggcgtcacagtga

SEQ ID NO: 92419 - DNA, 25 bp, mus musculus
tccctgagggcacactttccgtgga

SEQ ID NO: 92420 - DNA, 25 bp, mus musculus
cgtttcgcaaagcagtcacgcactg

SEQ ID NO: 92421 - DNA, 25 bp, mus musculus
gtttcgcaaagcagtcacgcactga

SEQ ID NO: 92422 - DNA, 25 bp, mus musculus
tttcgcaaagcagtcacgcactgag

SEQ ID NO: 92423 - DNA, 25 bp, mus musculus
gcaaagcagtcacgcactgagcgcg

SEQ ID NO: 92424 - DNA, 25 bp, mus musculus
aaagcagtcacgcactgagcgcgga

SEQ ID NO: 92425 - DNA, 25 bp, mus musculus
aagcagtcacgcactgagcgcggat

SEQ ID NO: 92426 - DNA, 25 bp, mus musculus
agcagtcacgcactgagcgcggatc

SEQ ID NO: 92427 - DNA, 25 bp, mus musculus
cagtcacgcactgagcgcggatctc

SEQ ID NO: 92428 - DNA, 25 bp, mus musculus
agtcacgcactgagcgcggatctca

SEQ ID NO: 92429 - DNA, 25 bp, mus musculus
ttcggttcggaggcgtcacagtgaa

SEQ ID NO: 92430 - DNA, 25 bp, mus musculus
gtcacgcactgagcgcggatctcaa

SEQ ID NO: 92431 - DNA, 25 bp, mus musculus
tcggttcggaggcgtcacagtgaag

SEQ ID NO: 92432 - DNA, 25 bp, mus musculus
ttgttgagatcactggcaagcacga

SEQ ID NO: 92433 - DNA, 25 bp, mus musculus
tttccctatccctgagggcacactt

SEQ ID NO: 92434 - DNA, 25 bp, mus musculus
tccctatccctgagggcacactttc

SEQ ID NO: 92435 - DNA, 25 bp, mus musculus
cctatccctgagggcacactttccg

SEQ ID NO: 92436 - DNA, 25 bp, mus musculus
tatccctgagggcacactttccgtg

SEQ ID NO: 92437 - DNA, 25 bp, mus musculus
atccctgagggcacactttccgtgg

SEQ ID NO: 92438 - DNA, 25 bp, mus musculus
tgatggttcctggatagatgccctt

SEQ ID NO: 92439 - DNA, 25 bp, mus musculus
ttcctggatagatgcccttctgcct

SEQ ID NO: 92440 - DNA, 25 bp, mus musculus
atctggcacactaggtgttactttc

SEQ ID NO: 92441 - DNA, 25 bp, mus musculus
ccttgttgcttctaagttttcacat

SEQ ID NO: 92442 - DNA, 25 bp, mus musculus
tgcttctaagttttcacattctaat

SEQ ID NO: 92443 - DNA, 25 bp, mus musculus
taagttttcacattctaatttgcca

SEQ ID NO: 92444 - DNA, 25 bp, mus musculus
gttttcacattctaatttgccatct

SEQ ID NO: 92445 - DNA, 25 bp, mus musculus
ttcacattctaatttgccatctgac

SEQ ID NO: 92446 - DNA, 25 bp, mus musculus
atctgaccagagttcaggccattag

SEQ ID NO: 92447 - DNA, 25 bp, mus musculus
tgaccagagttcaggccattagggg

SEQ ID NO: 92448 - DNA, 25 bp, mus musculus
ttcaggccattaggggaaaggccag

SEQ ID NO: 92449 - DNA, 25 bp, mus musculus
aggccaggttgtgtaggaggattat

SEQ ID NO: 92450 - DNA, 25 bp, mus musculus
agatgcccttctgcctcagttcatt

SEQ ID NO: 92451 - DNA, 25 bp, mus musculus
tgcccttctgcctcagttcattgct

SEQ ID NO: 92452 - DNA, 25 bp, mus musculus
tctgcctcagttcattgcttcatga

SEQ ID NO: 92453 - DNA, 25 bp, mus musculus
tcagttcattgcttcatgattctgc

SEQ ID NO: 92454 - DNA, 25 bp, mus musculus
cattgcttcatgattctgctgttga

SEQ ID NO: 92455 - DNA, 25 bp, mus musculus
tgcttcatgattctgctgttgaagg

SEQ ID NO: 92456 - DNA, 25 bp, mus musculus
attctgctgttgaaggtttgctgga

SEQ ID NO: 92457 - DNA, 25 bp, mus musculus
tagacaatctggcacactaggtgtt

SEQ ID NO: 92458 - DNA, 25 bp, mus musculus
tttctaccacagagagactgaaaat

SEQ ID NO: 92459 - DNA, 25 bp, mus musculus
agaacagacccagctgacacaaaac

SEQ ID NO: 92460 - DNA, 25 bp, mus musculus
atacctaccttctaatttgctcaag

SEQ ID NO: 92461 - DNA, 25 bp, mus musculus
gaaatttcggagctctacttcttct

SEQ ID NO: 92462 - DNA, 25 bp, mus musculus
tcggagctctacttcttcttccctg

SEQ ID NO: 92463 - DNA, 25 bp, mus musculus
ttcttccctgggggacaagtcagag

SEQ ID NO: 92464 - DNA, 25 bp, mus musculus
ttccctgggggacaagtcagagtat

SEQ ID NO: 92465 - DNA, 25 bp, mus musculus
caactgttctaatgcaaaggctgtg

SEQ ID NO: 92466 - DNA, 25 bp, mus musculus
ctgttctaatgcaaaggctgtggag

SEQ ID NO: 92467 - DNA, 25 bp, mus musculus
ttctaatgcaaaggctgtggagact

SEQ ID NO: 92468 - DNA, 25 bp, mus musculus
caaacgattgcactgcatacagtaa

SEQ ID NO: 92469 - DNA, 25 bp, mus musculus
acgattgcactgcatacagtaatat

SEQ ID NO: 92470 - DNA, 25 bp, mus musculus
acagacccagctgacacaaaacgca

SEQ ID NO: 92471 - DNA, 25 bp, mus musculus
ccagctgacacaaaacgcagtcagt

SEQ ID NO: 92472 - DNA, 25 bp, mus musculus
gctgacacaaaacgcagtcagttgt

SEQ ID NO: 92473 - DNA, 25 bp, mus musculus
gacacaaaacgcagtcagttgtcca

SEQ ID NO: 92474 - DNA, 25 bp, mus musculus
aaacgcagtcagttgtccataccta

SEQ ID NO: 92475 - DNA, 25 bp, mus musculus
agtcagttgtccatacctaccttct

SEQ ID NO: 92476 - DNA, 25 bp, mus musculus
ttgtccatacctaccttctaatttg

SEQ ID NO: 92477 - DNA, 25 bp, mus musculus
tccatacctaccttctaatttgctc

SEQ ID NO: 92478 - DNA, 25 bp, mus musculus
tcttaaaagattcctggcaggtggc

SEQ ID NO: 92479 - DNA, 25 bp, mus musculus
cttaaaagattcctggcaggtggca

SEQ ID NO: 92480 - DNA, 25 bp, mus musculus
gcagagctattcccctttcaggaag

SEQ ID NO: 92481 - DNA, 25 bp, mus musculus
cagagctattcccctttcaggaagg

SEQ ID NO: 92482 - DNA, 25 bp, mus musculus
ttacttgaccacgtgattcgggaat

SEQ ID NO: 92483 - DNA, 25 bp, mus musculus
tacttgaccacgtgattcgggaatt

SEQ ID NO: 92484 - DNA, 25 bp, mus musculus
ttgaccacgtgattcgggaattaca

SEQ ID NO: 92485 - DNA, 25 bp, mus musculus
tgaccacgtgattcgggaattacac

SEQ ID NO: 92486 - DNA, 25 bp, mus musculus
gccttaaagaccaggtccaggcgat

SEQ ID NO: 92487 - DNA, 25 bp, mus musculus
gaccaggtccaggcgatttttctag

SEQ ID NO: 92488 - DNA, 25 bp, mus musculus
ttaaaagattcctggcaggtggcat

SEQ ID NO: 92489 - DNA, 25 bp, mus musculus
aagattcctggcaggtggcatcgcg

SEQ ID NO: 92490 - DNA, 25 bp, mus musculus
agtgaaaatccccaagggcagagct

SEQ ID NO: 92491 - DNA, 25 bp, mus musculus
gtgaaaatccccaagggcagagcta

SEQ ID NO: 92492 - DNA, 25 bp, mus musculus
tgaaaatccccaagggcagagctat

SEQ ID NO: 92493 - DNA, 25 bp, mus musculus
tccccaagggcagagctattcccct

SEQ ID NO: 92494 - DNA, 25 bp, mus musculus
gggcagagctattcccctttcagga

SEQ ID NO: 92495 - DNA, 25 bp, mus musculus
ggcagagctattcccctttcaggaa

SEQ ID NO: 92496 - DNA, 25 bp, mus musculus
aatgcttccgcttaaggtacggcag

SEQ ID NO: 92497 - DNA, 25 bp, mus musculus
gcttccgcttaaggtacggcagtgg

SEQ ID NO: 92498 - DNA, 25 bp, mus musculus
gcatagtaatcacctgttttgcaca

SEQ ID NO: 92499 - DNA, 25 bp, mus musculus
atagtaatcacctgttttgcacatg

SEQ ID NO: 92500 - DNA, 25 bp, mus musculus
tagtaatcacctgttttgcacatgg

SEQ ID NO: 92501 - DNA, 25 bp, mus musculus
gtaatcacctgttttgcacatggtt

SEQ ID NO: 92502 - DNA, 25 bp, mus musculus
atcacctgttttgcacatggttctg

SEQ ID NO: 92503 - DNA, 25 bp, mus musculus
tcacctgttttgcacatggttctga

SEQ ID NO: 92504 - DNA, 25 bp, mus musculus
cctgttttgcacatggttctgaaca

SEQ ID NO: 92505 - DNA, 25 bp, mus musculus
tgttttgcacatggttctgaacaca

SEQ ID NO: 92506 - DNA, 25 bp, mus musculus
gttttgcacatggttctgaacacag

SEQ ID NO: 92507 - DNA, 25 bp, mus musculus
tttgcacatggttctgaacacagtc

SEQ ID NO: 92508 - DNA, 25 bp, mus musculus
ccgcttaaggtacggcagtggagag

SEQ ID NO: 92509 - DNA, 25 bp, mus musculus
cacatggttctgaacacagtcactt

SEQ ID NO: 92510 - DNA, 25 bp, mus musculus
tggagagttccgcctgcatagtaat

SEQ ID NO: 92511 - DNA, 25 bp, mus musculus
gagagttccgcctgcatagtaatca

SEQ ID NO: 92512 - DNA, 25 bp, mus musculus
agagttccgcctgcatagtaatcac

SEQ ID NO: 92513 - DNA, 25 bp, mus musculus
agttccgcctgcatagtaatcacct

SEQ ID NO: 92514 - DNA, 25 bp, mus musculus
tccgcctgcatagtaatcacctgtt

SEQ ID NO: 92515 - DNA, 25 bp, mus musculus
ccgcctgcatagtaatcacctgttt

SEQ ID NO: 92516 - DNA, 25 bp, mus musculus
cctgcatagtaatcacctgttttgc

SEQ ID NO: 92517 - DNA, 25 bp, mus musculus
agggtgttccggactgtatgaccag

SEQ ID NO: 92518 - DNA, 25 bp, mus musculus
tgttccggactgtatgaccagtctt

SEQ ID NO: 92519 - DNA, 25 bp, mus musculus
aatgtcgtctactttgtcggaatgt

SEQ ID NO: 92520 - DNA, 25 bp, mus musculus
tgtcgtctactttgtcggaatgtgg

SEQ ID NO: 92521 - DNA, 25 bp, mus musculus
tcgtctactttgtcggaatgtggga

SEQ ID NO: 92522 - DNA, 25 bp, mus musculus
agcgaattcatggcagtgggcacta

SEQ ID NO: 92523 - DNA, 25 bp, mus musculus
cgaattcatggcagtgggcactacg

SEQ ID NO: 92524 - DNA, 25 bp, mus musculus
aattcatggcagtgggcactacggg

SEQ ID NO: 92525 - DNA, 25 bp, mus musculus
ttcatggcagtgggcactacgggtg

SEQ ID NO: 92526 - DNA, 25 bp, mus musculus
tggcagtgggcactacgggtgctcc

SEQ ID NO: 92527 - DNA, 25 bp, mus musculus
ggcactacgggtgctccattccgac

SEQ ID NO: 92528 - DNA, 25 bp, mus musculus
cactacgggtgctccattccgactg

SEQ ID NO: 92529 - DNA, 25 bp, mus musculus
ttccggactgtatgaccagtcttgt

SEQ ID NO: 92530 - DNA, 25 bp, mus musculus
tacgggtgctccattccgactgagt

SEQ ID NO: 92531 - DNA, 25 bp, mus musculus
actgtatgaccagtcttgtgctggt

SEQ ID NO: 92532 - DNA, 25 bp, mus musculus
tgtatgaccagtcttgtgctggtga

SEQ ID NO: 92533 - DNA, 25 bp, mus musculus
tatgaccagtcttgtgctggtgaat

SEQ ID NO: 92534 - DNA, 25 bp, mus musculus
tgaccagtcttgtgctggtgaatgt

SEQ ID NO: 92535 - DNA, 25 bp, mus musculus
accagtcttgtgctggtgaatgtcg

SEQ ID NO: 92536 - DNA, 25 bp, mus musculus
cagtcttgtgctggtgaatgtcgtc

SEQ ID NO: 92537 - DNA, 25 bp, mus musculus
tgaatgtcgtctactttgtcggaat

SEQ ID NO: 92538 - DNA, 25 bp, mus musculus
atttgtttaacgcatctcagttaag

SEQ ID NO: 92539 - DNA, 25 bp, mus musculus
ttgtttaacgcatctcagttaagtg

SEQ ID NO: 92540 - DNA, 25 bp, mus musculus
gttctccaagctgatgtgaatagga

SEQ ID NO: 92541 - DNA, 25 bp, mus musculus
aatgctttctgatcttttgtcatga

SEQ ID NO: 92542 - DNA, 25 bp, mus musculus
tgatcttttgtcatgattaggctca

SEQ ID NO: 92543 - DNA, 25 bp, mus musculus
gatcttttgtcatgattaggctcat

SEQ ID NO: 92544 - DNA, 25 bp, mus musculus
tcttttgtcatgattaggctcatct

SEQ ID NO: 92545 - DNA, 25 bp, mus musculus
tcatgattaggctcatctccctaac

SEQ ID NO: 92546 - DNA, 25 bp, mus musculus
ttaggctcatctccctaactgttgt

SEQ ID NO: 92547 - DNA, 25 bp, mus musculus
aggctcatctccctaactgttgtat

SEQ ID NO: 92548 - DNA, 25 bp, mus musculus
ggctcatctccctaactgttgtata

SEQ ID NO: 92549 - DNA, 25 bp, mus musculus
ctcatctccctaactgttgtataat

SEQ ID NO: 92550 - DNA, 25 bp, mus musculus
tgtttaacgcatctcagttaagtga

SEQ ID NO: 92551 - DNA, 25 bp, mus musculus
tttaacgcatctcagttaagtgaac

SEQ ID NO: 92552 - DNA, 25 bp, mus musculus
ttaacgcatctcagttaagtgaact

SEQ ID NO: 92553 - DNA, 25 bp, mus musculus
atatctgatttgttcgttctccaag

SEQ ID NO: 92554 - DNA, 25 bp, mus musculus
ttgttcgttctccaagctgatgtga

SEQ ID NO: 92555 - DNA, 25 bp, mus musculus
tgttcgttctccaagctgatgtgaa

SEQ ID NO: 92556 - DNA, 25 bp, mus musculus
ttcgttctccaagctgatgtgaata

SEQ ID NO: 92557 - DNA, 25 bp, mus musculus
tcgttctccaagctgatgtgaatag

SEQ ID NO: 92558 - DNA, 25 bp, mus musculus
ctaactccgctgcagcatttgtcat

SEQ ID NO: 92559 - DNA, 25 bp, mus musculus
ccgctgcagcatttgtcatctggga

SEQ ID NO: 92560 - DNA, 25 bp, mus musculus
tatatgggattggccacctgcctgg

SEQ ID NO: 92561 - DNA, 25 bp, mus musculus
tgcctggacacctcacctcacagag

SEQ ID NO: 92562 - DNA, 25 bp, mus musculus
gttcttcacatcttcctggatgccc

SEQ ID NO: 92563 - DNA, 25 bp, mus musculus
cacatcttcctggatgccccagagg

SEQ ID NO: 92564 - DNA, 25 bp, mus musculus
gatgccccagaggcccagagtttct

SEQ ID NO: 92565 - DNA, 25 bp, mus musculus
ccagaggcccagagtttcttagttg

SEQ ID NO: 92566 - DNA, 25 bp, mus musculus
gcccagagtttcttagttggccgca

SEQ ID NO: 92567 - DNA, 25 bp, mus musculus
tcctcgtgctaaccactgggacctg

SEQ ID NO: 92568 - DNA, 25 bp, mus musculus
tcgtgctaaccactgggacctggag

SEQ ID NO: 92569 - DNA, 25 bp, mus musculus
tgctaaccactgggacctggagttg

SEQ ID NO: 92570 - DNA, 25 bp, mus musculus
ctgcagcatttgtcatctgggagtc

SEQ ID NO: 92571 - DNA, 25 bp, mus musculus
ccactgggacctggagttgctgacc

SEQ ID NO: 92572 - DNA, 25 bp, mus musculus
cagcatttgtcatctgggagtccac

SEQ ID NO: 92573 - DNA, 25 bp, mus musculus
ttgtcatctgggagtccacacagta

SEQ ID NO: 92574 - DNA, 25 bp, mus musculus
agtccacacagtatgaggggccgtc

SEQ ID NO: 92575 - DNA, 25 bp, mus musculus
ccacacagtatgaggggccgtcctt

SEQ ID NO: 92576 - DNA, 25 bp, mus musculus
ccttccctgctcttagtctatatgg

SEQ ID NO: 92577 - DNA, 25 bp, mus musculus
tccctgctcttagtctatatgggat

SEQ ID NO: 92578 - DNA, 25 bp, mus musculus
ctgctcttagtctatatgggattgg

SEQ ID NO: 92579 - DNA, 25 bp, mus musculus
cggaatacttggcctccatcttcgg

SEQ ID NO: 92580 - DNA, 25 bp, mus musculus
gaatacttggcctccatcttcggca

SEQ ID NO: 92581 - DNA, 25 bp, mus musculus
tgcacaataaaccaacctttagcca

SEQ ID NO: 92582 - DNA, 25 bp, mus musculus
acctttagccagaccattgccctct

SEQ ID NO: 92583 - DNA, 25 bp, mus musculus
ctttagccagaccattgccctcttg

SEQ ID NO: 92584 - DNA, 25 bp, mus musculus
ttagccagaccattgccctcttgaa

SEQ ID NO: 92585 - DNA, 25 bp, mus musculus
agccagaccattgccctcttgaaca

SEQ ID NO: 92586 - DNA, 25 bp, mus musculus
agaccattgccctcttgaacattta

SEQ ID NO: 92587 - DNA, 25 bp, mus musculus
cattgccctcttgaacatttaccgt

SEQ ID NO: 92588 - DNA, 25 bp, mus musculus
cctcaaaactcttcccagtctgctg

SEQ ID NO: 92589 - DNA, 25 bp, mus musculus
tcaaaactcttcccagtctgctgac

SEQ ID NO: 92590 - DNA, 25 bp, mus musculus
gtttgcgctgtgctgtgagcgacgt

SEQ ID NO: 92591 - DNA, 25 bp, mus musculus
acttggcctccatcttcggcaccga

SEQ ID NO: 92592 - DNA, 25 bp, mus musculus
ttggcctccatcttcggcaccgaaa

SEQ ID NO: 92593 - DNA, 25 bp, mus musculus
tatttcaaaatcggagcatgtcgtc

SEQ ID NO: 92594 - DNA, 25 bp, mus musculus
tcggagcatgtcgtcatggagacag

SEQ ID NO: 92595 - DNA, 25 bp, mus musculus
catgtcgtcatggagacagatgttc

SEQ ID NO: 92596 - DNA, 25 bp, mus musculus
cagatgttctcggttgcacaataaa

SEQ ID NO: 92597 - DNA, 25 bp, mus musculus
gatgttctcggttgcacaataaacc

SEQ ID NO: 92598 - DNA, 25 bp, mus musculus
tgttctcggttgcacaataaaccaa

SEQ ID NO: 92599 - DNA, 25 bp, mus musculus
gatatttcccaaatgtcctccagtc

SEQ ID NO: 92600 - DNA, 25 bp, mus musculus
atttcccaaatgtcctccagtctgg

SEQ ID NO: 92601 - DNA, 25 bp, mus musculus
tgaattattcactgcctgtcagaag

SEQ ID NO: 92602 - DNA, 25 bp, mus musculus
attcactgcctgtcagaagcctcag

SEQ ID NO: 92603 - DNA, 25 bp, mus musculus
cactgcctgtcagaagcctcagtgt

SEQ ID NO: 92604 - DNA, 25 bp, mus musculus
ctgtcagaagcctcagtgtggccta

SEQ ID NO: 92605 - DNA, 25 bp, mus musculus
gcctcagtgtggcctaagatactcc

SEQ ID NO: 92606 - DNA, 25 bp, mus musculus
cctaagatactcctatttaccattg

SEQ ID NO: 92607 - DNA, 25 bp, mus musculus
aagatactcctatttaccattgtga

SEQ ID NO: 92608 - DNA, 25 bp, mus musculus
atactcctatttaccattgtgaagt

SEQ ID NO: 92609 - DNA, 25 bp, mus musculus
ctcctatttaccattgtgaagttgt

SEQ ID NO: 92610 - DNA, 25 bp, mus musculus
aacctaagctagcaattcagttagg

SEQ ID NO: 92611 - DNA, 25 bp, mus musculus
tcccaaatgtcctccagtctggttt

SEQ ID NO: 92612 - DNA, 25 bp, mus musculus
atttgatacagtctcatcataagaa

SEQ ID NO: 92613 - DNA, 25 bp, mus musculus
tgatacagtctcatcataagaaggg

SEQ ID NO: 92614 - DNA, 25 bp, mus musculus
ttcataaatacagcaaacaagttga

SEQ ID NO: 92615 - DNA, 25 bp, mus musculus
gttccatcacatgtgagtcatgtaa

SEQ ID NO: 92616 - DNA, 25 bp, mus musculus
ccatcacatgtgagtcatgtaaaat

SEQ ID NO: 92617 - DNA, 25 bp, mus musculus
ttcacctaagaaccatggtcttgaa

SEQ ID NO: 92618 - DNA, 25 bp, mus musculus
tcttgaattattcactgcctgtcag

SEQ ID NO: 92619 - DNA, 25 bp, mus musculus
aaatctgcggcaatcatgaacttac

SEQ ID NO: 92620 - DNA, 25 bp, mus musculus
atctgcggcaatcatgaacttacta

SEQ ID NO: 92621 - DNA, 25 bp, mus musculus
cagcaccttgagttgtgaaatggta

SEQ ID NO: 92622 - DNA, 25 bp, mus musculus
aagactggtatgccaccaatggtca

SEQ ID NO: 92623 - DNA, 25 bp, mus musculus
gactggtatgccaccaatggtcaat

SEQ ID NO: 92624 - DNA, 25 bp, mus musculus
ctggtatgccaccaatggtcaatct

SEQ ID NO: 92625 - DNA, 25 bp, mus musculus
tatgccaccaatggtcaatctggag

SEQ ID NO: 92626 - DNA, 25 bp, mus musculus
tgccaccaatggtcaatctggagcc

SEQ ID NO: 92627 - DNA, 25 bp, mus musculus
ccaccaatggtcaatctggagccca

SEQ ID NO: 92628 - DNA, 25 bp, mus musculus
atggtcaatctggagcccaaccagg

SEQ ID NO: 92629 - DNA, 25 bp, mus musculus
ggtcaatctggagcccaaccaggta

SEQ ID NO: 92630 - DNA, 25 bp, mus musculus
tcaatctggagcccaaccaggtacc

SEQ ID NO: 92631 - DNA, 25 bp, mus musculus
caatcatgaacttactaccacagca

SEQ ID NO: 92632 - DNA, 25 bp, mus musculus
atcatgaacttactaccacagcacc

SEQ ID NO: 92633 - DNA, 25 bp, mus musculus
catgaacttactaccacagcacctt

SEQ ID NO: 92634 - DNA, 25 bp, mus musculus
tgaacttactaccacagcaccttga

SEQ ID NO: 92635 - DNA, 25 bp, mus musculus
cttactaccacagcaccttgagttg

SEQ ID NO: 92636 - DNA, 25 bp, mus musculus
tactaccacagcaccttgagttgtg

SEQ ID NO: 92637 - DNA, 25 bp, mus musculus
ctaccacagcaccttgagttgtgaa

SEQ ID NO: 92638 - DNA, 25 bp, mus musculus
accacagcaccttgagttgtgaaat

SEQ ID NO: 92639 - DNA, 25 bp, mus musculus
gaggaccttattcccagtcttcagg

SEQ ID NO: 92640 - DNA, 25 bp, mus musculus
ccttattcccagtcttcaggaagcg

SEQ ID NO: 92641 - DNA, 25 bp, mus musculus
cctttttggctgccaacaagctcga

SEQ ID NO: 92642 - DNA, 25 bp, mus musculus
tttttggctgccaacaagctcgatt

SEQ ID NO: 92643 - DNA, 25 bp, mus musculus
ttttggctgccaacaagctcgatta

SEQ ID NO: 92644 - DNA, 25 bp, mus musculus
tttggctgccaacaagctcgattaa

SEQ ID NO: 92645 - DNA, 25 bp, mus musculus
tggctgccaacaagctcgattaagg

SEQ ID NO: 92646 - DNA, 25 bp, mus musculus
ggctgccaacaagctcgattaagga

SEQ ID NO: 92647 - DNA, 25 bp, mus musculus
gctgccaacaagctcgattaaggaa

SEQ ID NO: 92648 - DNA, 25 bp, mus musculus
tgccaacaagctcgattaaggaagc

SEQ ID NO: 92649 - DNA, 25 bp, mus musculus
aagctgcaaggagcactctgagtct

SEQ ID NO: 92650 - DNA, 25 bp, mus musculus
agctgcaaggagcactctgagtctg

SEQ ID NO: 92651 - DNA, 25 bp, mus musculus
tattcccagtcttcaggaagcgcct

SEQ ID NO: 92652 - DNA, 25 bp, mus musculus
attcccagtcttcaggaagcgccta

SEQ ID NO: 92653 - DNA, 25 bp, mus musculus
ttcccagtcttcaggaagcgcctag

SEQ ID NO: 92654 - DNA, 25 bp, mus musculus
tggagtcctttttggctgccaacaa

SEQ ID NO: 92655 - DNA, 25 bp, mus musculus
ggagtcctttttggctgccaacaag

SEQ ID NO: 92656 - DNA, 25 bp, mus musculus
gagtcctttttggctgccaacaagc

SEQ ID NO: 92657 - DNA, 25 bp, mus musculus
gtcctttttggctgccaacaagctc

SEQ ID NO: 92658 - DNA, 25 bp, mus musculus
tcctttttggctgccaacaagctcg

SEQ ID NO: 92659 - DNA, 25 bp, mus musculus
aatggattcaccgagccacatacag

SEQ ID NO: 92660 - DNA, 25 bp, mus musculus
tggattcaccgagccacatacagtc

SEQ ID NO: 92661 - DNA, 25 bp, mus musculus
aaagtcactcgcaaagatggaattc

SEQ ID NO: 92662 - DNA, 25 bp, mus musculus
aattcagtggaccaagctgctggga

SEQ ID NO: 92663 - DNA, 25 bp, mus musculus
ttcagtggaccaagctgctgggagc

SEQ ID NO: 92664 - DNA, 25 bp, mus musculus
tgtattctaccaacaacttcgtcaa

SEQ ID NO: 92665 - DNA, 25 bp, mus musculus
tattctaccaacaacttcgtcaact

SEQ ID NO: 92666 - DNA, 25 bp, mus musculus
ctaccaacaacttcgtcaacttgca

SEQ ID NO: 92667 - DNA, 25 bp, mus musculus
caacaacttcgtcaacttgcaaagc

SEQ ID NO: 92668 - DNA, 25 bp, mus musculus
cttcgtcaacttgcaaagccctgcg

SEQ ID NO: 92669 - DNA, 25 bp, mus musculus
gtcaacttgcaaagccctgcgactt

SEQ ID NO: 92670 - DNA, 25 bp, mus musculus
caacttgcaaagccctgcgacttcg

SEQ ID NO: 92671 - DNA, 25 bp, mus musculus
ttcaccgagccacatacagtcagaa

SEQ ID NO: 92672 - DNA, 25 bp, mus musculus
caccgagccacatacagtcagaaga

SEQ ID NO: 92673 - DNA, 25 bp, mus musculus
gagccacatacagtcagaagagata

SEQ ID NO: 92674 - DNA, 25 bp, mus musculus
aattggctaaaccctgacacagttg

SEQ ID NO: 92675 - DNA, 25 bp, mus musculus
ttggctaaaccctgacacagttgca

SEQ ID NO: 92676 - DNA, 25 bp, mus musculus
ctaaaccctgacacagttgcatttg

SEQ ID NO: 92677 - DNA, 25 bp, mus musculus
aacatgcttggagcaagtgctaata

SEQ ID NO: 92678 - DNA, 25 bp, mus musculus
gtgctaatatcctttgttccaagga

SEQ ID NO: 92679 - DNA, 25 bp, mus musculus
tggtctgtgcctcaaatcccgggag

SEQ ID NO: 92680 - DNA, 25 bp, mus musculus
ggtctgtgcctcaaatcccgggaga

SEQ ID NO: 92681 - DNA, 25 bp, mus musculus
tccagagagcaactacctcttcttg

SEQ ID NO: 92682 - DNA, 25 bp, mus musculus
cagagagcaactacctcttcttggg

SEQ ID NO: 92683 - DNA, 25 bp, mus musculus
agagagcaactacctcttcttgggg

SEQ ID NO: 92684 - DNA, 25 bp, mus musculus
gagagcaactacctcttcttggggg

SEQ ID NO: 92685 - DNA, 25 bp, mus musculus
gagcaactacctcttcttgggggat

SEQ ID NO: 92686 - DNA, 25 bp, mus musculus
cctcttcttgggggattatgtagat

SEQ ID NO: 92687 - DNA, 25 bp, mus musculus
ctcttcttgggggattatgtagatc

SEQ ID NO: 92688 - DNA, 25 bp, mus musculus
tcttcttgggggattatgtagatcg

SEQ ID NO: 92689 - DNA, 25 bp, mus musculus
cagtctttggagaccatctgcctgt

SEQ ID NO: 92690 - DNA, 25 bp, mus musculus
agtctttggagaccatctgcctgtt

SEQ ID NO: 92691 - DNA, 25 bp, mus musculus
gtctgtgcctcaaatcccgggagat

SEQ ID NO: 92692 - DNA, 25 bp, mus musculus
tctgtgcctcaaatcccgggagatt

SEQ ID NO: 92693 - DNA, 25 bp, mus musculus
ctgtgcctcaaatcccgggagattt

SEQ ID NO: 92694 - DNA, 25 bp, mus musculus
tgtgcctcaaatcccgggagatttt

SEQ ID NO: 92695 - DNA, 25 bp, mus musculus
tcaaatcccgggagattttcctgag

SEQ ID NO: 92696 - DNA, 25 bp, mus musculus
gacatccatggccagtactatgacc

SEQ ID NO: 92697 - DNA, 25 bp, mus musculus
cctccagagagcaactacctcttct

SEQ ID NO: 92698 - DNA, 25 bp, mus musculus
ctccagagagcaactacctcttctt

SEQ ID NO: 92699 - DNA, 25 bp, mus musculus
gcaaaaagctccaagatcatggaat

SEQ ID NO: 92700 - DNA, 25 bp, mus musculus
atcatggaatccttcaagaacatgg

SEQ ID NO: 92701 - DNA, 25 bp, mus musculus
cggatccctgctgatcttagaatca

SEQ ID NO: 92702 - DNA, 25 bp, mus musculus
atccctgctgatcttagaatcatat

SEQ ID NO: 92703 - DNA, 25 bp, mus musculus
agaatcatatctgcaaacggctgca

SEQ ID NO: 92704 - DNA, 25 bp, mus musculus
atcatatctgcaaacggctgcaagg

SEQ ID NO: 92705 - DNA, 25 bp, mus musculus
atatctgcaaacggctgcaaggtgg

SEQ ID NO: 92706 - DNA, 25 bp, mus musculus
tctgcaaacggctgcaaggtggata

SEQ ID NO: 92707 - DNA, 25 bp, mus musculus
gcaaacggctgcaaggtggataact

SEQ ID NO: 92708 - DNA, 25 bp, mus musculus
aactcctcactcactggtgaatcag

SEQ ID NO: 92709 - DNA, 25 bp, mus musculus
tcctcactcactggtgaatcagaac

SEQ ID NO: 92710 - DNA, 25 bp, mus musculus
tcactcactggtgaatcagaacccc

SEQ ID NO: 92711 - DNA, 25 bp, mus musculus
atggaatccttcaagaacatggtcc

SEQ ID NO: 92712 - DNA, 25 bp, mus musculus
ttcaagaacatggtccctcagcaag

SEQ ID NO: 92713 - DNA, 25 bp, mus musculus
gtccctcagcaagcccttgtgattc

SEQ ID NO: 92714 - DNA, 25 bp, mus musculus
cctcagcaagcccttgtgattcgaa

SEQ ID NO: 92715 - DNA, 25 bp, mus musculus
cagcaagcccttgtgattcgaaatg

SEQ ID NO: 92716 - DNA, 25 bp, mus musculus
caagcccttgtgattcgaaatggag

SEQ ID NO: 92717 - DNA, 25 bp, mus musculus
gcccttgtgattcgaaatggagaga

SEQ ID NO: 92718 - DNA, 25 bp, mus musculus
gaccggatccctgctgatcttagaa

SEQ ID NO: 92719 - DNA, 25 bp, mus musculus
atgctggccagctaatgaattttgg

SEQ ID NO: 92720 - DNA, 25 bp, mus musculus
tgctggccagctaatgaattttggc

SEQ ID NO: 92721 - DNA, 25 bp, mus musculus
aggccttccagattgcggccagacc

SEQ ID NO: 92722 - DNA, 25 bp, mus musculus
gccttccagattgcggccagacccg

SEQ ID NO: 92723 - DNA, 25 bp, mus musculus
ccttccagattgcggccagacccgg

SEQ ID NO: 92724 - DNA, 25 bp, mus musculus
cttccagattgcggccagacccggt

SEQ ID NO: 92725 - DNA, 25 bp, mus musculus
ttccagattgcggccagacccggtg

SEQ ID NO: 92726 - DNA, 25 bp, mus musculus
tcctttggcgggaccgagaataatg

SEQ ID NO: 92727 - DNA, 25 bp, mus musculus
tggaccccattgctaattccccaat

SEQ ID NO: 92728 - DNA, 25 bp, mus musculus
ggtaaccaaggccttccagattgcg

SEQ ID NO: 92729 - DNA, 25 bp, mus musculus
gtaaccaaggccttccagattgcgg

SEQ ID NO: 92730 - DNA, 25 bp, mus musculus
taaccaaggccttccagattgcggc

SEQ ID NO: 92731 - DNA, 25 bp, mus musculus
accaaggccttccagattgcggcca

SEQ ID NO: 92732 - DNA, 25 bp, mus musculus
ccaaggccttccagattgcggccag

SEQ ID NO: 92733 - DNA, 25 bp, mus musculus
caaggccttccagattgcggccaga

SEQ ID NO: 92734 - DNA, 25 bp, mus musculus
aaggccttccagattgcggccagac

SEQ ID NO: 92735 - DNA, 25 bp, mus musculus
ttctgacgcaggtgctgatgagtta

SEQ ID NO: 92736 - DNA, 25 bp, mus musculus
tcatcaaagatgacatctggccaaa

SEQ ID NO: 92737 - DNA, 25 bp, mus musculus
caaatcccttgcagtactacctggt

SEQ ID NO: 92738 - DNA, 25 bp, mus musculus
tgcagtactacctggttcccgacat

SEQ ID NO: 92739 - DNA, 25 bp, mus musculus
gcagtactacctggttcccgacatg

SEQ ID NO: 92740 - DNA, 25 bp, mus musculus
actacctggttcccgacatggatga

SEQ ID NO: 92741 - DNA, 25 bp, mus musculus
ctacctggttcccgacatggatgat

SEQ ID NO: 92742 - DNA, 25 bp, mus musculus
acctggttcccgacatggatgatga

SEQ ID NO: 92743 - DNA, 25 bp, mus musculus
cctggttcccgacatggatgatgaa

SEQ ID NO: 92744 - DNA, 25 bp, mus musculus
tggttcccgacatggatgatgaaga

SEQ ID NO: 92745 - DNA, 25 bp, mus musculus
ggttcccgacatggatgatgaagaa

SEQ ID NO: 92746 - DNA, 25 bp, mus musculus
ttcccgacatggatgatgaagaagg

SEQ ID NO: 92747 - DNA, 25 bp, mus musculus
agatgacatctggccaaatcccttg

SEQ ID NO: 92748 - DNA, 25 bp, mus musculus
tgacatctggccaaatcccttgcag

SEQ ID NO: 92749 - DNA, 25 bp, mus musculus
acatctggccaaatcccttgcagta

SEQ ID NO: 92750 - DNA, 25 bp, mus musculus
catctggccaaatcccttgcagtac

SEQ ID NO: 92751 - DNA, 25 bp, mus musculus
tctggccaaatcccttgcagtacta

SEQ ID NO: 92752 - DNA, 25 bp, mus musculus
ctggccaaatcccttgcagtactac

SEQ ID NO: 92753 - DNA, 25 bp, mus musculus
ggccaaatcccttgcagtactacct

SEQ ID NO: 92754 - DNA, 25 bp, mus musculus
gccaaatcccttgcagtactacctg

SEQ ID NO: 92755 - DNA, 25 bp, mus musculus
agccttttcacatggtagttatcta

SEQ ID NO: 92756 - DNA, 25 bp, mus musculus
gccttttcacatggtagttatctaa

SEQ ID NO: 92757 - DNA, 25 bp, mus musculus
agatagaaaccctgcaaacatagtc

SEQ ID NO: 92758 - DNA, 25 bp, mus musculus
atagaaaccctgcaaacatagtcag

SEQ ID NO: 92759 - DNA, 25 bp, mus musculus
tagaaaccctgcaaacatagtcagt

SEQ ID NO: 92760 - DNA, 25 bp, mus musculus
aaaccctgcaaacatagtcagtgtg

SEQ ID NO: 92761 - DNA, 25 bp, mus musculus
accctgcaaacatagtcagtgtgag

SEQ ID NO: 92762 - DNA, 25 bp, mus musculus
ggaagccttttcacaatagtagcct

SEQ ID NO: 92763 - DNA, 25 bp, mus musculus
agccttttcacaatagtagcctcta

SEQ ID NO: 92764 - DNA, 25 bp, mus musculus
gccttttcacaatagtagcctctaa

SEQ ID NO: 92765 - DNA, 25 bp, mus musculus
cttttcacaatagtagcctctaaat

SEQ ID NO: 92766 - DNA, 25 bp, mus musculus
ttttcacaatagtagcctctaaatt

SEQ ID NO: 92767 - DNA, 25 bp, mus musculus
ttttcacatggtagttatctaatac

SEQ ID NO: 92768 - DNA, 25 bp, mus musculus
atacctaaaaggacactcaccagat

SEQ ID NO: 92769 - DNA, 25 bp, mus musculus
cctaaaaggacactcaccagataga

SEQ ID NO: 92770 - DNA, 25 bp, mus musculus
aggacactcaccagatagaaaccct

SEQ ID NO: 92771 - DNA, 25 bp, mus musculus
gacactcaccagatagaaaccctgc

SEQ ID NO: 92772 - DNA, 25 bp, mus musculus
acactcaccagatagaaaccctgca

SEQ ID NO: 92773 - DNA, 25 bp, mus musculus
ctcaccagatagaaaccctgcaaac

SEQ ID NO: 92774 - DNA, 25 bp, mus musculus
caccagatagaaaccctgcaaacat

SEQ ID NO: 92775 - DNA, 25 bp, mus musculus
attcatgacagattccactaaccga

SEQ ID NO: 92776 - DNA, 25 bp, mus musculus
ttcatgacagattccactaaccgac

SEQ ID NO: 92777 - DNA, 25 bp, mus musculus
gccaacgtctgctttgtggagcgat

SEQ ID NO: 92778 - DNA, 25 bp, mus musculus
ccaacgtctgctttgtggagcgatt

SEQ ID NO: 92779 - DNA, 25 bp, mus musculus
caacgtctgctttgtggagcgattg

SEQ ID NO: 92780 - DNA, 25 bp, mus musculus
acgtctgctttgtggagcgattgct

SEQ ID NO: 92781 - DNA, 25 bp, mus musculus
cgtctgctttgtggagcgattgctg

SEQ ID NO: 92782 - DNA, 25 bp, mus musculus
gtctgctttgtggagcgattgctga

SEQ ID NO: 92783 - DNA, 25 bp, mus musculus
ctgctttgtggagcgattgctgaac

SEQ ID NO: 92784 - DNA, 25 bp, mus musculus
tatcacttagcctattgacgaatat

SEQ ID NO: 92785 - DNA, 25 bp, mus musculus
atcacttagcctattgacgaatatt

SEQ ID NO: 92786 - DNA, 25 bp, mus musculus
cacttagcctattgacgaatattgc

SEQ ID NO: 92787 - DNA, 25 bp, mus musculus
catgacagattccactaaccgacgc

SEQ ID NO: 92788 - DNA, 25 bp, mus musculus
atgacagattccactaaccgacgcc

SEQ ID NO: 92789 - DNA, 25 bp, mus musculus
tgacagattccactaaccgacgccg

SEQ ID NO: 92790 - DNA, 25 bp, mus musculus
agcaagtggccaacgtctgctttgt

SEQ ID NO: 92791 - DNA, 25 bp, mus musculus
gcaagtggccaacgtctgctttgtg

SEQ ID NO: 92792 - DNA, 25 bp, mus musculus
caagtggccaacgtctgctttgtgg

SEQ ID NO: 92793 - DNA, 25 bp, mus musculus
gtggccaacgtctgctttgtggagc

SEQ ID NO: 92794 - DNA, 25 bp, mus musculus
tggccaacgtctgctttgtggagcg

SEQ ID NO: 92795 - DNA, 25 bp, mus musculus
cggagtctcccagctgacattctat

SEQ ID NO: 92796 - DNA, 25 bp, mus musculus
agtctcccagctgacattctatatg

SEQ ID NO: 92797 - DNA, 25 bp, mus musculus
caggctcctgtgcactttctggtca

SEQ ID NO: 92798 - DNA, 25 bp, mus musculus
gctcctgtgcactttctggtcattc

SEQ ID NO: 92799 - DNA, 25 bp, mus musculus
cctgtgcactttctggtcattccta

SEQ ID NO: 92800 - DNA, 25 bp, mus musculus
gtgcactttctggtcattcctagga

SEQ ID NO: 92801 - DNA, 25 bp, mus musculus
cactttctggtcattcctaggaagc

SEQ ID NO: 92802 - DNA, 25 bp, mus musculus
ctggtcattcctaggaagcccattc

SEQ ID NO: 92803 - DNA, 25 bp, mus musculus
cccattcctcgaattagccaggctg

SEQ ID NO: 92804 - DNA, 25 bp, mus musculus
attcctcgaattagccaggctgaag

SEQ ID NO: 92805 - DNA, 25 bp, mus musculus
cgaattagccaggctgaagaggacg

SEQ ID NO: 92806 - DNA, 25 bp, mus musculus
attagccaggctgaagaggacgacc

SEQ ID NO: 92807 - DNA, 25 bp, mus musculus
ctcccagctgacattctatatgaag

SEQ ID NO: 92808 - DNA, 25 bp, mus musculus
ccagctgacattctatatgaagatc

SEQ ID NO: 92809 - DNA, 25 bp, mus musculus
cagtgccttgtgttccgtgacgtag

SEQ ID NO: 92810 - DNA, 25 bp, mus musculus
cttgtgttccgtgacgtagctcctc

SEQ ID NO: 92811 - DNA, 25 bp, mus musculus
gtgttccgtgacgtagctcctcagg

SEQ ID NO: 92812 - DNA, 25 bp, mus musculus
ttccgtgacgtagctcctcaggctc

SEQ ID NO: 92813 - DNA, 25 bp, mus musculus
gtagctcctcaggctcctgtgcact

SEQ ID NO: 92814 - DNA, 25 bp, mus musculus
cctcaggctcctgtgcactttctgg

SEQ ID NO: 92815 - DNA, 25 bp, mus musculus
cacacagcaggttcattgcagaaga

SEQ ID NO: 92816 - DNA, 25 bp, mus musculus
ccacagcctccggggccaagtgtgt

SEQ ID NO: 92817 - DNA, 25 bp, mus musculus
ggttccccactgtggcagttagcat

SEQ ID NO: 92818 - DNA, 25 bp, mus musculus
tccccactgtggcagttagcatcgg

SEQ ID NO: 92819 - DNA, 25 bp, mus musculus
ttagcatcggatttgctgttcacca

SEQ ID NO: 92820 - DNA, 25 bp, mus musculus
tcggatttgctgttcaccaggagct

SEQ ID NO: 92821 - DNA, 25 bp, mus musculus
ttgctgttcaccaggagctggaatt

SEQ ID NO: 92822 - DNA, 25 bp, mus musculus
ctgttcaccaggagctggaatttgg

SEQ ID NO: 92823 - DNA, 25 bp, mus musculus
tgattcaccactgcacagaggagcg

SEQ ID NO: 92824 - DNA, 25 bp, mus musculus
ttcaccactgcacagaggagcggct

SEQ ID NO: 92825 - DNA, 25 bp, mus musculus
accactgcacagaggagcggctgta

SEQ ID NO: 92826 - DNA, 25 bp, mus musculus
actgcacagaggagcggctgtacac

SEQ ID NO: 92827 - DNA, 25 bp, mus musculus
cagcctccggggccaagtgtgtgct

SEQ ID NO: 92828 - DNA, 25 bp, mus musculus
cctccggggccaagtgtgtgctcac

SEQ ID NO: 92829 - DNA, 25 bp, mus musculus
ccatcgacggcacctgcaactttgt

SEQ ID NO: 92830 - DNA, 25 bp, mus musculus
tcgacggcacctgcaactttgtgca

SEQ ID NO: 92831 - DNA, 25 bp, mus musculus
acggcacctgcaactttgtgcacag

SEQ ID NO: 92832 - DNA, 25 bp, mus musculus
gcacctgcaactttgtgcacaggtt

SEQ ID NO: 92833 - DNA, 25 bp, mus musculus
gcaactttgtgcacaggttccccac

SEQ ID NO: 92834 - DNA, 25 bp, mus musculus
ttgtgcacaggttccccactgtggc

SEQ ID NO: 92835 - DNA, 25 bp, mus musculus
cttcgcaagtccaggcagctatgaa

SEQ ID NO: 92836 - DNA, 25 bp, mus musculus
tcgcaagtccaggcagctatgaaag

SEQ ID NO: 92837 - DNA, 25 bp, mus musculus
tatgcccaggcattaacagatcaac

SEQ ID NO: 92838 - DNA, 25 bp, mus musculus
tgcccaggcattaacagatcaacaa

SEQ ID NO: 92839 - DNA, 25 bp, mus musculus
cagatcaacaacagtttggtaaagc

SEQ ID NO: 92840 - DNA, 25 bp, mus musculus
gataatgctacaacttatgttcata

SEQ ID NO: 92841 - DNA, 25 bp, mus musculus
taatgctacaacttatgttcataaa

SEQ ID NO: 92842 - DNA, 25 bp, mus musculus
atgctacaacttatgttcataaagg

SEQ ID NO: 92843 - DNA, 25 bp, mus musculus
gtttacttcaacttcagtggaagca

SEQ ID NO: 92844 - DNA, 25 bp, mus musculus
acttcaacttcagtggaagcaagat

SEQ ID NO: 92845 - DNA, 25 bp, mus musculus
ttcaacttcagtggaagcaagattt

SEQ ID NO: 92846 - DNA, 25 bp, mus musculus
gcttatcagcaaggctattgaaatt

SEQ ID NO: 92847 - DNA, 25 bp, mus musculus
aagtccaggcagctatgaaaggttt

SEQ ID NO: 92848 - DNA, 25 bp, mus musculus
gtccaggcagctatgaaaggttttg

SEQ ID NO: 92849 - DNA, 25 bp, mus musculus
gaaatttccaagatgtgctgaaggc

SEQ ID NO: 92850 - DNA, 25 bp, mus musculus
aatttccaagatgtgctgaaggcta

SEQ ID NO: 92851 - DNA, 25 bp, mus musculus
tttccaagatgtgctgaaggctatg

SEQ ID NO: 92852 - DNA, 25 bp, mus musculus
ctatgcactttatgcccaggcatta

SEQ ID NO: 92853 - DNA, 25 bp, mus musculus
atgcactttatgcccaggcattaac

SEQ ID NO: 92854 - DNA, 25 bp, mus musculus
tttatgcccaggcattaacagatca

SEQ ID NO: 92855 - DNA, 25 bp, mus musculus
tccggcaggcatgcaccttaccaga

SEQ ID NO: 92856 - DNA, 25 bp, mus musculus
ggcaggcatgcaccttaccagacat

SEQ ID NO: 92857 - DNA, 25 bp, mus musculus
aatcaggcaccagaggattcataca

SEQ ID NO: 92858 - DNA, 25 bp, mus musculus
accctatacctgtcacgagtgtgga

SEQ ID NO: 92859 - DNA, 25 bp, mus musculus
ctatacctgtcacgagtgtggagac

SEQ ID NO: 92860 - DNA, 25 bp, mus musculus
agacagtttctctcacagttccaac

SEQ ID NO: 92861 - DNA, 25 bp, mus musculus
ctctcacagttccaaccggattcgt

SEQ ID NO: 92862 - DNA, 25 bp, mus musculus
cagttccaaccggattcgtcacctg

SEQ ID NO: 92863 - DNA, 25 bp, mus musculus
ccggattcgtcacctgagaacccat

SEQ ID NO: 92864 - DNA, 25 bp, mus musculus
gattcgtcacctgagaacccataca

SEQ ID NO: 92865 - DNA, 25 bp, mus musculus
tcacctgagaacccatacaggagaa

SEQ ID NO: 92866 - DNA, 25 bp, mus musculus
cctgagaacccatacaggagaaaga

SEQ ID NO: 92867 - DNA, 25 bp, mus musculus
aggcatgcaccttaccagacatcag

SEQ ID NO: 92868 - DNA, 25 bp, mus musculus
gcaccttaccagacatcagagaaca

SEQ ID NO: 92869 - DNA, 25 bp, mus musculus
ccttaccagacatcagagaacacac

SEQ ID NO: 92870 - DNA, 25 bp, mus musculus
ggaaaacttctctcatagatctaac

SEQ ID NO: 92871 - DNA, 25 bp, mus musculus
aaacttctctcatagatctaactta

SEQ ID NO: 92872 - DNA, 25 bp, mus musculus
ctctcatagatctaacttaatcagg

SEQ ID NO: 92873 - DNA, 25 bp, mus musculus
taacttaatcaggcaccagaggatt

SEQ ID NO: 92874 - DNA, 25 bp, mus musculus
cttaatcaggcaccagaggattcat

SEQ ID NO: 92875 - DNA, 25 bp, mus musculus
gccctgcgccgaaagcatcagctgt

SEQ ID NO: 92876 - DNA, 25 bp, mus musculus
ctgcgccgaaagcatcagctgtgaa

SEQ ID NO: 92877 - DNA, 25 bp, mus musculus
caaagaatggcgcctcctgctggcg

SEQ ID NO: 92878 - DNA, 25 bp, mus musculus
agctcagaagctgcagggattgaga

SEQ ID NO: 92879 - DNA, 25 bp, mus musculus
attgagagctcctggcatacaaact

SEQ ID NO: 92880 - DNA, 25 bp, mus musculus
ttgagagctcctggcatacaaactg

SEQ ID NO: 92881 - DNA, 25 bp, mus musculus
gctcctggcatacaaactggtggtc

SEQ ID NO: 92882 - DNA, 25 bp, mus musculus
cctggcatacaaactggtggtctta

SEQ ID NO: 92883 - DNA, 25 bp, mus musculus
cctctcacctagcctaatgaccagg

SEQ ID NO: 92884 - DNA, 25 bp, mus musculus
tctcacctagcctaatgaccaggtc

SEQ ID NO: 92885 - DNA, 25 bp, mus musculus
ctcacctagcctaatgaccaggtcc

SEQ ID NO: 92886 - DNA, 25 bp, mus musculus
cacctagcctaatgaccaggtcccg

SEQ ID NO: 92887 - DNA, 25 bp, mus musculus
tgcgccgaaagcatcagctgtgaag

SEQ ID NO: 92888 - DNA, 25 bp, mus musculus
aagcatcagctgtgaagcggcgccg

SEQ ID NO: 92889 - DNA, 25 bp, mus musculus
agcatcagctgtgaagcggcgccgc

SEQ ID NO: 92890 - DNA, 25 bp, mus musculus
tcttgtgtttccgcctgtccgctaa

SEQ ID NO: 92891 - DNA, 25 bp, mus musculus
tgtgtttccgcctgtccgctaatcc

SEQ ID NO: 92892 - DNA, 25 bp, mus musculus
tgtttccgcctgtccgctaatccaa

SEQ ID NO: 92893 - DNA, 25 bp, mus musculus
tccgctaatccaaagaatggcgcct

SEQ ID NO: 92894 - DNA, 25 bp, mus musculus
ccaaagaatggcgcctcctgctggc

SEQ ID NO: 92895 - DNA, 25 bp, mus musculus
acggctgcagagctggggaagaact

SEQ ID NO: 92896 - DNA, 25 bp, mus musculus
gggaagaactcgcccttcgtgtgct

SEQ ID NO: 92897 - DNA, 25 bp, mus musculus
catcttggctgatgaccctggtcct

SEQ ID NO: 92898 - DNA, 25 bp, mus musculus
gacagaagcagcgactcttatggaa

SEQ ID NO: 92899 - DNA, 25 bp, mus musculus
acagaagcagcgactcttatggaaa

SEQ ID NO: 92900 - DNA, 25 bp, mus musculus
agaagcagcgactcttatggaaaac

SEQ ID NO: 92901 - DNA, 25 bp, mus musculus
gaagcagcgactcttatggaaaact

SEQ ID NO: 92902 - DNA, 25 bp, mus musculus
aagcagcgactcttatggaaaactg

SEQ ID NO: 92903 - DNA, 25 bp, mus musculus
agcagcgactcttatggaaaactgg

SEQ ID NO: 92904 - DNA, 25 bp, mus musculus
aactggacaacttctatcacgggca

SEQ ID NO: 92905 - DNA, 25 bp, mus musculus
actggacaacttctatcacgggcat

SEQ ID NO: 92906 - DNA, 25 bp, mus musculus
ctggacaacttctatcacgggcatg

SEQ ID NO: 92907 - DNA, 25 bp, mus musculus
gaagaactcgcccttcgtgtgctgc

SEQ ID NO: 92908 - DNA, 25 bp, mus musculus
tggacaacttctatcacgggcatga

SEQ ID NO: 92909 - DNA, 25 bp, mus musculus
agaactcgcccttcgtgtgctgctg

SEQ ID NO: 92910 - DNA, 25 bp, mus musculus
aagatgtgcatcttggctgatgacc

SEQ ID NO: 92911 - DNA, 25 bp, mus musculus
gatgtgcatcttggctgatgaccct

SEQ ID NO: 92912 - DNA, 25 bp, mus musculus
atgtgcatcttggctgatgaccctg

SEQ ID NO: 92913 - DNA, 25 bp, mus musculus
tgtgcatcttggctgatgaccctgg

SEQ ID NO: 92914 - DNA, 25 bp, mus musculus
gtgcatcttggctgatgaccctggt

SEQ ID NO: 92915 - DNA, 25 bp, mus musculus
gcatcttggctgatgaccctggtcc

SEQ ID NO: 92916 - DNA, 25 bp, mus musculus
tgttcttattcttccctcctacagc

SEQ ID NO: 92917 - DNA, 25 bp, mus musculus
ctacagctggcctaaccactcttga

SEQ ID NO: 92918 - DNA, 25 bp, mus musculus
gcccagattcccagactaagacact

SEQ ID NO: 92919 - DNA, 25 bp, mus musculus
attcccagactaagacactgtgaca

SEQ ID NO: 92920 - DNA, 25 bp, mus musculus
cccagactaagacactgtgacagtt

SEQ ID NO: 92921 - DNA, 25 bp, mus musculus
tgtgacagttgtctgtcggtccact

SEQ ID NO: 92922 - DNA, 25 bp, mus musculus
ctgtcggtccactgtgtttagttgc

SEQ ID NO: 92923 - DNA, 25 bp, mus musculus
tcggtccactgtgtttagttgcaaa

SEQ ID NO: 92924 - DNA, 25 bp, mus musculus
ggtccactgtgtttagttgcaaaga

SEQ ID NO: 92925 - DNA, 25 bp, mus musculus
gtccactgtgtttagttgcaaagat

SEQ ID NO: 92926 - DNA, 25 bp, mus musculus
tccactgtgtttagttgcaaagatt

SEQ ID NO: 92927 - DNA, 25 bp, mus musculus
ttgttactgtcttaaagggtgcaca

SEQ ID NO: 92928 - DNA, 25 bp, mus musculus
ctggcctaaccactcttgagtcggg

SEQ ID NO: 92929 - DNA, 25 bp, mus musculus
tgtgcttttcataggcttccctttg

SEQ ID NO: 92930 - DNA, 25 bp, mus musculus
tttgccttaaacctgaagatgtctc

SEQ ID NO: 92931 - DNA, 25 bp, mus musculus
aacctgaagatgtctcctcaagcct

SEQ ID NO: 92932 - DNA, 25 bp, mus musculus
aagatgtctcctcaagcctgtgggc

SEQ ID NO: 92933 - DNA, 25 bp, mus musculus
atgtctcctcaagcctgtgggcagc

SEQ ID NO: 92934 - DNA, 25 bp, mus musculus
cctcaagcctgtgggcagcatgccc

SEQ ID NO: 92935 - DNA, 25 bp, mus musculus
caagcctgtgggcagcatgcccaga

SEQ ID NO: 92936 - DNA, 25 bp, mus musculus
cacattgggctcctgctcaccaatt

SEQ ID NO: 92937 - DNA, 25 bp, mus musculus
ttgggctcctgctcaccaattctcc

SEQ ID NO: 92938 - DNA, 25 bp, mus musculus
tctgctcttcatgaagaattgtcaa

SEQ ID NO: 92939 - DNA, 25 bp, mus musculus
ctgctcttcatgaagaattgtcaaa

SEQ ID NO: 92940 - DNA, 25 bp, mus musculus
gcgtttttgggacctgcagaaatct

SEQ ID NO: 92941 - DNA, 25 bp, mus musculus
tttaactttcgtattctgctgtagc

SEQ ID NO: 92942 - DNA, 25 bp, mus musculus
taactttcgtattctgctgtagctg

SEQ ID NO: 92943 - DNA, 25 bp, mus musculus
aactttcgtattctgctgtagctga

SEQ ID NO: 92944 - DNA, 25 bp, mus musculus
actttcgtattctgctgtagctgaa

SEQ ID NO: 92945 - DNA, 25 bp, mus musculus
tttcgtattctgctgtagctgaata

SEQ ID NO: 92946 - DNA, 25 bp, mus musculus
ttcgtattctgctgtagctgaatat

SEQ ID NO: 92947 - DNA, 25 bp, mus musculus
tattctgctgtagctgaatatgcag

SEQ ID NO: 92948 - DNA, 25 bp, mus musculus
tgggctcctgctcaccaattctcca

SEQ ID NO: 92949 - DNA, 25 bp, mus musculus
attctgctgtagctgaatatgcaga

SEQ ID NO: 92950 - DNA, 25 bp, mus musculus
gggctcctgctcaccaattctccag

SEQ ID NO: 92951 - DNA, 25 bp, mus musculus
gctcctgctcaccaattctccaggt

SEQ ID NO: 92952 - DNA, 25 bp, mus musculus
ctcctgctcaccaattctccaggtg

SEQ ID NO: 92953 - DNA, 25 bp, mus musculus
tcctgctcaccaattctccaggtga

SEQ ID NO: 92954 - DNA, 25 bp, mus musculus
ctgctcaccaattctccaggtgacc

SEQ ID NO: 92955 - DNA, 25 bp, mus musculus
tgctcaccaattctccaggtgaccc

SEQ ID NO: 92956 - DNA, 25 bp, mus musculus
gtctgctcttcatgaagaattgtca

SEQ ID NO: 92957 - DNA, 25 bp, mus musculus
tgcactctcaaagtctgaagtgatt

SEQ ID NO: 92958 - DNA, 25 bp, mus musculus
cactctcaaagtctgaagtgattaa

SEQ ID NO: 92959 - DNA, 25 bp, mus musculus
gcaacccatccattgcatgtattaa

SEQ ID NO: 92960 - DNA, 25 bp, mus musculus
aacccatccattgcatgtattaatg

SEQ ID NO: 92961 - DNA, 25 bp, mus musculus
cccatccattgcatgtattaatgct

SEQ ID NO: 92962 - DNA, 25 bp, mus musculus
gtattaatgctgatcctatgactgt

SEQ ID NO: 92963 - DNA, 25 bp, mus musculus
attaatgctgatcctatgactgtag

SEQ ID NO: 92964 - DNA, 25 bp, mus musculus
taatgctgatcctatgactgtagtg

SEQ ID NO: 92965 - DNA, 25 bp, mus musculus
atgctgatcctatgactgtagtggt

SEQ ID NO: 92966 - DNA, 25 bp, mus musculus
tgatcctatgactgtagtggtggct

SEQ ID NO: 92967 - DNA, 25 bp, mus musculus
atcctatgactgtagtggtggctta

SEQ ID NO: 92968 - DNA, 25 bp, mus musculus
cctatgactgtagtggtggcttaga

SEQ ID NO: 92969 - DNA, 25 bp, mus musculus
tgattaatatccacgtgtagctgca

SEQ ID NO: 92970 - DNA, 25 bp, mus musculus
attaatatccacgtgtagctgcaac

SEQ ID NO: 92971 - DNA, 25 bp, mus musculus
taatatccacgtgtagctgcaaccc

SEQ ID NO: 92972 - DNA, 25 bp, mus musculus
atatccacgtgtagctgcaacccat

SEQ ID NO: 92973 - DNA, 25 bp, mus musculus
acgtgtagctgcaacccatccattg

SEQ ID NO: 92974 - DNA, 25 bp, mus musculus
gtgtagctgcaacccatccattgca

SEQ ID NO: 92975 - DNA, 25 bp, mus musculus
gtagctgcaacccatccattgcatg

SEQ ID NO: 92976 - DNA, 25 bp, mus musculus
ctgcaacccatccattgcatgtatt

SEQ ID NO: 92977 - DNA, 25 bp, mus musculus
tagatgccaggctgaagttaagcga

SEQ ID NO: 92978 - DNA, 25 bp, mus musculus
gattgaagcccaagcctattgatgt

SEQ ID NO: 92979 - DNA, 25 bp, mus musculus
cgcctgagttctaccaagtatgcca

SEQ ID NO: 92980 - DNA, 25 bp, mus musculus
agttctaccaagtatgccacaccaa

SEQ ID NO: 92981 - DNA, 25 bp, mus musculus
tatgccacaccaaaaaggattatga

SEQ ID NO: 92982 - DNA, 25 bp, mus musculus
gccacaccaaaaaggattatgaaga

SEQ ID NO: 92983 - DNA, 25 bp, mus musculus
aaattggacctagcatttgtcgtca

SEQ ID NO: 92984 - DNA, 25 bp, mus musculus
ttggacctagcatttgtcgtcacaa

SEQ ID NO: 92985 - DNA, 25 bp, mus musculus
ctagcatttgtcgtcacaatccagt

SEQ ID NO: 92986 - DNA, 25 bp, mus musculus
tttgtcgtcacaatccagtgtttgg

SEQ ID NO: 92987 - DNA, 25 bp, mus musculus
gtcacaatccagtgtttggagtcat

SEQ ID NO: 92988 - DNA, 25 bp, mus musculus
acaatccagtgtttggagtcatgtc

SEQ ID NO: 92989 - DNA, 25 bp, mus musculus
tgaagcccaagcctattgatgtaca

SEQ ID NO: 92990 - DNA, 25 bp, mus musculus
agcccaagcctattgatgtacaagt

SEQ ID NO: 92991 - DNA, 25 bp, mus musculus
tacaagttattacacaccatatgca

SEQ ID NO: 92992 - DNA, 25 bp, mus musculus
ttattacacaccatatgcagcggta

SEQ ID NO: 92993 - DNA, 25 bp, mus musculus
accatatgcagcggtatgcagtctg

SEQ ID NO: 92994 - DNA, 25 bp, mus musculus
atgcagtctggtttggagggtcaat

SEQ ID NO: 92995 - DNA, 25 bp, mus musculus
caatgctggcttccacgcctgagtt

SEQ ID NO: 92996 - DNA, 25 bp, mus musculus
cttccacgcctgagttctaccaagt

SEQ ID NO: 92997 - DNA, 25 bp, mus musculus
aatgtgcaaattccttgtgaaatta

SEQ ID NO: 92998 - DNA, 25 bp, mus musculus
tgtgcaaattccttgtgaaattaac

SEQ ID NO: 92999 - DNA, 25 bp, mus musculus
atctggctctacaacggatatgtac

SEQ ID NO: 93000 - DNA, 25 bp, mus musculus
ctggctctacaacggatatgtacac

SEQ ID NO: 93001 - DNA, 25 bp, mus musculus
ggctctacaacggatatgtacacat

SEQ ID NO: 93002 - DNA, 25 bp, mus musculus
cacatggcctgaaactacatgggca

SEQ ID NO: 93003 - DNA, 25 bp, mus musculus
gtatactacggagagcagcgaaaca

SEQ ID NO: 93004 - DNA, 25 bp, mus musculus
atactacggagagcagcgaaacagg

SEQ ID NO: 93005 - DNA, 25 bp, mus musculus
gagtcttcaagatcatcttcctcac

SEQ ID NO: 93006 - DNA, 25 bp, mus musculus
gtcttcaagatcatcttcctcacca

SEQ ID NO: 93007 - DNA, 25 bp, mus musculus
cttcaagatcatcttcctcaccatc

SEQ ID NO: 93008 - DNA, 25 bp, mus musculus
tcaagatcatcttcctcaccatcaa

SEQ ID NO: 93009 - DNA, 25 bp, mus musculus
cataaccgcggcttctacaaaggca

SEQ ID NO: 93010 - DNA, 25 bp, mus musculus
taaccgcggcttctacaaaggcatg

SEQ ID NO: 93011 - DNA, 25 bp, mus musculus
accgcggcttctacaaaggcatgaa

SEQ ID NO: 93012 - DNA, 25 bp, mus musculus
cgcggcttctacaaaggcatgaact

SEQ ID NO: 93013 - DNA, 25 bp, mus musculus
aggcatgaactcccagatacctgaa

SEQ ID NO: 93014 - DNA, 25 bp, mus musculus
gcatgaactcccagatacctgaagc

SEQ ID NO: 93015 - DNA, 25 bp, mus musculus
gaactcccagatacctgaagctgca

SEQ ID NO: 93016 - DNA, 25 bp, mus musculus
acagtccacagaaataccagatctg

SEQ ID NO: 93017 - DNA, 25 bp, mus musculus
gatcatcggacggacgacaatataa

SEQ ID NO: 93018 - DNA, 25 bp, mus musculus
aatccagagagccttcctagataat

SEQ ID NO: 93019 - DNA, 25 bp, mus musculus
ctgctcaaggggtgctgagtttcca

SEQ ID NO: 93020 - DNA, 25 bp, mus musculus
tgctgagtttccagacgaggaactg

SEQ ID NO: 93021 - DNA, 25 bp, mus musculus
gccctttagagccttcaccgatgtc

SEQ ID NO: 93022 - DNA, 25 bp, mus musculus
ctttagagccttcaccgatgtcagg

SEQ ID NO: 93023 - DNA, 25 bp, mus musculus
agccttcaccgatgtcaggaatggg

SEQ ID NO: 93024 - DNA, 25 bp, mus musculus
cttgaccttgcgagggcactagtgc

SEQ ID NO: 93025 - DNA, 25 bp, mus musculus
gaccttgcgagggcactagtgctat

SEQ ID NO: 93026 - DNA, 25 bp, mus musculus
gcactagtgctatgagcgtagagtg

SEQ ID NO: 93027 - DNA, 25 bp, mus musculus
aggcctgagtacaccaaactgtatc

SEQ ID NO: 93028 - DNA, 25 bp, mus musculus
cctgagtacaccaaactgtatctca

SEQ ID NO: 93029 - DNA, 25 bp, mus musculus
ccagagagccttcctagataatcag

SEQ ID NO: 93030 - DNA, 25 bp, mus musculus
gagtacaccaaactgtatctcaaga

SEQ ID NO: 93031 - DNA, 25 bp, mus musculus
gagagccttcctagataatcaggag

SEQ ID NO: 93032 - DNA, 25 bp, mus musculus
agccttcctagataatcaggagtag

SEQ ID NO: 93033 - DNA, 25 bp, mus musculus
agcaacatgacgacatgctaaggat

SEQ ID NO: 93034 - DNA, 25 bp, mus musculus
aacatgacgacatgctaaggatcga

SEQ ID NO: 93035 - DNA, 25 bp, mus musculus
tgctaaggatcgacaccactgctca

SEQ ID NO: 93036 - DNA, 25 bp, mus musculus
tcgacaccactgctcaaggggtgct

SEQ ID NO: 93037 - DNA, 25 bp, mus musculus
ccactgctcaaggggtgctgagttt

SEQ ID NO: 93038 - DNA, 25 bp, mus musculus
ttcacggcagagtccaccgacaacc

SEQ ID NO: 93039 - DNA, 25 bp, mus musculus
tcacggcagagtccaccgacaacct

SEQ ID NO: 93040 - DNA, 25 bp, mus musculus
ccaccgtgagtctacaagatgtggg

SEQ ID NO: 93041 - DNA, 25 bp, mus musculus
gacatctccctgtggaaattccgag

SEQ ID NO: 93042 - DNA, 25 bp, mus musculus
acatctccctgtggaaattccgaga

SEQ ID NO: 93043 - DNA, 25 bp, mus musculus
atctccctgtggaaattccgagaca

SEQ ID NO: 93044 - DNA, 25 bp, mus musculus
tctccctgtggaaattccgagacag

SEQ ID NO: 93045 - DNA, 25 bp, mus musculus
gcccagtacacagagacttcatgag

SEQ ID NO: 93046 - DNA, 25 bp, mus musculus
ccagtacacagagacttcatgagag

SEQ ID NO: 93047 - DNA, 25 bp, mus musculus
cagtacacagagacttcatgagaga

SEQ ID NO: 93048 - DNA, 25 bp, mus musculus
gtacacagagacttcatgagagaca

SEQ ID NO: 93049 - DNA, 25 bp, mus musculus
tacacagagacttcatgagagacat

SEQ ID NO: 93050 - DNA, 25 bp, mus musculus
acggcagagtccaccgacaacctgg

SEQ ID NO: 93051 - DNA, 25 bp, mus musculus
cggcagagtccaccgacaacctggc

SEQ ID NO: 93052 - DNA, 25 bp, mus musculus
gcagagtccaccgacaacctggcca

SEQ ID NO: 93053 - DNA, 25 bp, mus musculus
ccgacaacctggccaccgtgagtct

SEQ ID NO: 93054 - DNA, 25 bp, mus musculus
aacctggccaccgtgagtctacaag

SEQ ID NO: 93055 - DNA, 25 bp, mus musculus
acctggccaccgtgagtctacaaga

SEQ ID NO: 93056 - DNA, 25 bp, mus musculus
tggccaccgtgagtctacaagatgt

SEQ ID NO: 93057 - DNA, 25 bp, mus musculus
gccaccgtgagtctacaagatgtgg

SEQ ID NO: 93058 - DNA, 25 bp, mus musculus
tggtgctggacctggatttgtttcg

SEQ ID NO: 93059 - DNA, 25 bp, mus musculus
ggtgctggacctggatttgtttcgg

SEQ ID NO: 93060 - DNA, 25 bp, mus musculus
acaacttgaacaagctgaagaattt

SEQ ID NO: 93061 - DNA, 25 bp, mus musculus
acgagtccgtcccagagaacgtgct

SEQ ID NO: 93062 - DNA, 25 bp, mus musculus
gtccgtcccagagaacgtgctgaat

SEQ ID NO: 93063 - DNA, 25 bp, mus musculus
ccgtcccagagaacgtgctgaattt

SEQ ID NO: 93064 - DNA, 25 bp, mus musculus
tgaatttcgatgacctcactgcaga

SEQ ID NO: 93065 - DNA, 25 bp, mus musculus
gaatttcgatgacctcactgcagac

SEQ ID NO: 93066 - DNA, 25 bp, mus musculus
atttcgatgacctcactgcagacgc

SEQ ID NO: 93067 - DNA, 25 bp, mus musculus
tcgatgacctcactgcagacgcgct

SEQ ID NO: 93068 - DNA, 25 bp, mus musculus
cgatgacctcactgcagacgcgcta

SEQ ID NO: 93069 - DNA, 25 bp, mus musculus
atgacctcactgcagacgcgctagt

SEQ ID NO: 93070 - DNA, 25 bp, mus musculus
cagccctcattcgagagacgcagga

SEQ ID NO: 93071 - DNA, 25 bp, mus musculus
tgacctcactgcagacgcgctagtg

SEQ ID NO: 93072 - DNA, 25 bp, mus musculus
agccctcattcgagagacgcaggag

SEQ ID NO: 93073 - DNA, 25 bp, mus musculus
ccctcattcgagagacgcaggagaa

SEQ ID NO: 93074 - DNA, 25 bp, mus musculus
cctcattcgagagacgcaggagaag

SEQ ID NO: 93075 - DNA, 25 bp, mus musculus
cattcgagagacgcaggagaagcgc

SEQ ID NO: 93076 - DNA, 25 bp, mus musculus
acgatgcagatttcgggcagacaac

SEQ ID NO: 93077 - DNA, 25 bp, mus musculus
atgcagatttcgggcagacaacttg

SEQ ID NO: 93078 - DNA, 25 bp, mus musculus
gatttcgggcagacaacttgaacaa

SEQ ID NO: 93079 - DNA, 25 bp, mus musculus
cctcttcctgaggcttttatgccct

SEQ ID NO: 93080 - DNA, 25 bp, mus musculus
cttcctgaggcttttatgccctgcc

SEQ ID NO: 93081 - DNA, 25 bp, mus musculus
aactcttacactcatcgccaaggtc

SEQ ID NO: 93082 - DNA, 25 bp, mus musculus
tcttacactcatcgccaaggtcatc

SEQ ID NO: 93083 - DNA, 25 bp, mus musculus
actcatcgccaaggtcatccagaac

SEQ ID NO: 93084 - DNA, 25 bp, mus musculus
ggtcatccagaacctcgccaactgt

SEQ ID NO: 93085 - DNA, 25 bp, mus musculus
ggaagcctacatggcgtttatgaat

SEQ ID NO: 93086 - DNA, 25 bp, mus musculus
gaatagcttcctggaagatcatgga

SEQ ID NO: 93087 - DNA, 25 bp, mus musculus
agatcatggaccagccatgcaacac

SEQ ID NO: 93088 - DNA, 25 bp, mus musculus
tggaccagccatgcaacacttcctg

SEQ ID NO: 93089 - DNA, 25 bp, mus musculus
accagccatgcaacacttcctggac

SEQ ID NO: 93090 - DNA, 25 bp, mus musculus
agccatgcaacacttcctggaccag

SEQ ID NO: 93091 - DNA, 25 bp, mus musculus
cctgaggcttttatgccctgccatc

SEQ ID NO: 93092 - DNA, 25 bp, mus musculus
gcaacacttcctggaccaggtagct

SEQ ID NO: 93093 - DNA, 25 bp, mus musculus
tttatgccctgccatcttggcacct

SEQ ID NO: 93094 - DNA, 25 bp, mus musculus
atgccctgccatcttggcacctagc

SEQ ID NO: 93095 - DNA, 25 bp, mus musculus
catcttggcacctagcctctttggc

SEQ ID NO: 93096 - DNA, 25 bp, mus musculus
cttggcacctagcctctttggcctg

SEQ ID NO: 93097 - DNA, 25 bp, mus musculus
acctagcctctttggcctggcacca

SEQ ID NO: 93098 - DNA, 25 bp, mus musculus
cctctttggcctggcaccagagcac

SEQ ID NO: 93099 - DNA, 25 bp, mus musculus
aggcccagccagaactcttacactc

SEQ ID NO: 93100 - DNA, 25 bp, mus musculus
tcatcattttcacctgcaaatttgc

SEQ ID NO: 93101 - DNA, 25 bp, mus musculus
tcattttcacctgcaaatttgcacg

SEQ ID NO: 93102 - DNA, 25 bp, mus musculus
acatcagatcagtgtgcctgaatgc

SEQ ID NO: 93103 - DNA, 25 bp, mus musculus
tcagatcagtgtgcctgaatgccac

SEQ ID NO: 93104 - DNA, 25 bp, mus musculus
tgtgcctgaatgccacccggacaag

SEQ ID NO: 93105 - DNA, 25 bp, mus musculus
gcctgaatgccacccggacaagaga

SEQ ID NO: 93106 - DNA, 25 bp, mus musculus
atgccacccggacaagagaagaatg

SEQ ID NO: 93107 - DNA, 25 bp, mus musculus
catcctcagatggcaacctttcttt

SEQ ID NO: 93108 - DNA, 25 bp, mus musculus
cagatggcaacctttctttgaagtc

SEQ ID NO: 93109 - DNA, 25 bp, mus musculus
tttctttgaagtccttcacctgaca

SEQ ID NO: 93110 - DNA, 25 bp, mus musculus
ctttgaagtccttcacctgacagtg

SEQ ID NO: 93111 - DNA, 25 bp, mus musculus
tgaagtccttcacctgacagtgggc

SEQ ID NO: 93112 - DNA, 25 bp, mus musculus
tcacctgcaaatttgcacgactaca

SEQ ID NO: 93113 - DNA, 25 bp, mus musculus
aagtccttcacctgacagtgggctc

SEQ ID NO: 93114 - DNA, 25 bp, mus musculus
cctgcaaatttgcacgactacaaag

SEQ ID NO: 93115 - DNA, 25 bp, mus musculus
gcaaatttgcacgactacaaagcat

SEQ ID NO: 93116 - DNA, 25 bp, mus musculus
ttgcacgactacaaagcattttccc

SEQ ID NO: 93117 - DNA, 25 bp, mus musculus
cacgactacaaagcattttcccaga

SEQ ID NO: 93118 - DNA, 25 bp, mus musculus
gactacaaagcattttcccagatat

SEQ ID NO: 93119 - DNA, 25 bp, mus musculus
gcaaacatttggggccagtgaccct

SEQ ID NO: 93120 - DNA, 25 bp, mus musculus
ggccagtgacccttcctaagacaga

SEQ ID NO: 93121 - DNA, 25 bp, mus musculus
ctcttcaaatggaccaattacatca

SEQ ID NO: 93122 - DNA, 25 bp, mus musculus
aaatggaccaattacatcagaggct

SEQ ID NO: 93123 - DNA, 25 bp, mus musculus
ttcatcatctccaatggcggtgctc

SEQ ID NO: 93124 - DNA, 25 bp, mus musculus
atctccaatggcggtgctcagacct

SEQ ID NO: 93125 - DNA, 25 bp, mus musculus
ggtgctcagacctaccacttgaagg

SEQ ID NO: 93126 - DNA, 25 bp, mus musculus
cagacctaccacttgaaggccagct

SEQ ID NO: 93127 - DNA, 25 bp, mus musculus
taccacttgaaggccagctccgaag

SEQ ID NO: 93128 - DNA, 25 bp, mus musculus
ttgaaggccagctccgaagtagagc

SEQ ID NO: 93129 - DNA, 25 bp, mus musculus
gtagagcgtcagctcgggtgacagc

SEQ ID NO: 93130 - DNA, 25 bp, mus musculus
cgtcagctcgggtgacagccttaga

SEQ ID NO: 93131 - DNA, 25 bp, mus musculus
ccttagaactcggcaaggcaatggc

SEQ ID NO: 93132 - DNA, 25 bp, mus musculus
aactcggcaaggcaatggctgtgaa

SEQ ID NO: 93133 - DNA, 25 bp, mus musculus
accaattacatcagaggctaccagc

SEQ ID NO: 93134 - DNA, 25 bp, mus musculus
tacatcagaggctaccagcggcgat

SEQ ID NO: 93135 - DNA, 25 bp, mus musculus
taccagcggcgatggttcgtgctga

SEQ ID NO: 93136 - DNA, 25 bp, mus musculus
gggctcctaagctactacaggtcca

SEQ ID NO: 93137 - DNA, 25 bp, mus musculus
tactacaggtccaaggcagagatga

SEQ ID NO: 93138 - DNA, 25 bp, mus musculus
agacacacctgccgaggtaccagca

SEQ ID NO: 93139 - DNA, 25 bp, mus musculus
gccacagccaacatcactgtggagg

SEQ ID NO: 93140 - DNA, 25 bp, mus musculus
tgcaacttcatcatctccaatggcg

SEQ ID NO: 93141 - DNA, 25 bp, mus musculus
ccatcctggtagacgacatggccga

SEQ ID NO: 93142 - DNA, 25 bp, mus musculus
tagacgacatggccgatacatgtgg

SEQ ID NO: 93143 - DNA, 25 bp, mus musculus
gatcctggctgaagccattcgaaga

SEQ ID NO: 93144 - DNA, 25 bp, mus musculus
agccattcgaagaacccacaatggg

SEQ ID NO: 93145 - DNA, 25 bp, mus musculus
ggaatccgtgtcctatctgttcagc

SEQ ID NO: 93146 - DNA, 25 bp, mus musculus
gttcagccatgtcccactgtagtct

SEQ ID NO: 93147 - DNA, 25 bp, mus musculus
cagccatgtcccactgtagtctgga

SEQ ID NO: 93148 - DNA, 25 bp, mus musculus
ccatgtcccactgtagtctggattg

SEQ ID NO: 93149 - DNA, 25 bp, mus musculus
cccactgtagtctggattggaatat

SEQ ID NO: 93150 - DNA, 25 bp, mus musculus
tctttgtctgcctgctgttttagaa

SEQ ID NO: 93151 - DNA, 25 bp, mus musculus
ttgtctgcctgctgttttagaatta

SEQ ID NO: 93152 - DNA, 25 bp, mus musculus
tctgcctgctgttttagaattagga

SEQ ID NO: 93153 - DNA, 25 bp, mus musculus
acgacatggccgatacatgtggtac

SEQ ID NO: 93154 - DNA, 25 bp, mus musculus
acatggccgatacatgtggtaccat

SEQ ID NO: 93155 - DNA, 25 bp, mus musculus
atacatgtggtaccatctgccatgc

SEQ ID NO: 93156 - DNA, 25 bp, mus musculus
catgtggtaccatctgccatgctgc

SEQ ID NO: 93157 - DNA, 25 bp, mus musculus
gtaccatctgccatgctgcagataa

SEQ ID NO: 93158 - DNA, 25 bp, mus musculus
tctgccatgctgcagataagtgatt

SEQ ID NO: 93159 - DNA, 25 bp, mus musculus
ttcgatgatcctggctgaagccatt

SEQ ID NO: 93160 - DNA, 25 bp, mus musculus
gatgatcctggctgaagccattcga

SEQ ID NO: 93161 - DNA, 25 bp, mus musculus
tatttagctctggaatgggtaccat

SEQ ID NO: 93162 - DNA, 25 bp, mus musculus
tttagctctggaatgggtaccatct

SEQ ID NO: 93163 - DNA, 25 bp, mus musculus
tacaaagttccatattccatgtaca

SEQ ID NO: 93164 - DNA, 25 bp, mus musculus
caaagttccatattccatgtacatt

SEQ ID NO: 93165 - DNA, 25 bp, mus musculus
aagttccatattccatgtacattaa

SEQ ID NO: 93166 - DNA, 25 bp, mus musculus
tccatattccatgtacattaagagt

SEQ ID NO: 93167 - DNA, 25 bp, mus musculus
catattccatgtacattaagagtgt

SEQ ID NO: 93168 - DNA, 25 bp, mus musculus
tgtgacacttagttgcctcagctta

SEQ ID NO: 93169 - DNA, 25 bp, mus musculus
tgacacttagttgcctcagcttata

SEQ ID NO: 93170 - DNA, 25 bp, mus musculus
acttagttgcctcagcttatagctg

SEQ ID NO: 93171 - DNA, 25 bp, mus musculus
agttgcctcagcttatagctggggt

SEQ ID NO: 93172 - DNA, 25 bp, mus musculus
ctcagcttatagctggggtaatttg

SEQ ID NO: 93173 - DNA, 25 bp, mus musculus
ttttcctcattaaaggctcaaccag

SEQ ID NO: 93174 - DNA, 25 bp, mus musculus
ttcctcattaaaggctcaaccagca

SEQ ID NO: 93175 - DNA, 25 bp, mus musculus
cctcattaaaggctcaaccagcact

SEQ ID NO: 93176 - DNA, 25 bp, mus musculus
attaaaggctcaaccagcactgtgt

SEQ ID NO: 93177 - DNA, 25 bp, mus musculus
ggctcaaccagcactgtgtggctat

SEQ ID NO: 93178 - DNA, 25 bp, mus musculus
caaccagcactgtgtggctatgtac

SEQ ID NO: 93179 - DNA, 25 bp, mus musculus
accagcactgtgtggctatgtacaa

SEQ ID NO: 93180 - DNA, 25 bp, mus musculus
cagcactgtgtggctatgtacaaag

SEQ ID NO: 93181 - DNA, 25 bp, mus musculus
aggttctcagagcacacatattgcc

SEQ ID NO: 93182 - DNA, 25 bp, mus musculus
tcagagcacacatattgccattgac

SEQ ID NO: 93183 - DNA, 25 bp, mus musculus
aggagctgcacaccctggagggcca

SEQ ID NO: 93184 - DNA, 25 bp, mus musculus
agctgcacaccctggagggccacaa

SEQ ID NO: 93185 - DNA, 25 bp, mus musculus
acaccctggagggccacaagaatgt

SEQ ID NO: 93186 - DNA, 25 bp, mus musculus
atgccatagccttcaacaatcctta

SEQ ID NO: 93187 - DNA, 25 bp, mus musculus
tagccttcaacaatccttacggtga

SEQ ID NO: 93188 - DNA, 25 bp, mus musculus
cttttgacaagacctgtaaactctg

SEQ ID NO: 93189 - DNA, 25 bp, mus musculus
acaagacctgtaaactctggagtgc

SEQ ID NO: 93190 - DNA, 25 bp, mus musculus
agacctgtaaactctggagtgctga

SEQ ID NO: 93191 - DNA, 25 bp, mus musculus
cctgtaaactctggagtgctgagac

SEQ ID NO: 93192 - DNA, 25 bp, mus musculus
accataccttcaggggccacacagc

SEQ ID NO: 93193 - DNA, 25 bp, mus musculus
gagcacacatattgccattgaccaa

SEQ ID NO: 93194 - DNA, 25 bp, mus musculus
ccttcaggggccacacagcagagat

SEQ ID NO: 93195 - DNA, 25 bp, mus musculus
cacacatattgccattgaccaacgt

SEQ ID NO: 93196 - DNA, 25 bp, mus musculus
tgccattgaccaacgtggcactcaa

SEQ ID NO: 93197 - DNA, 25 bp, mus musculus
cattgaccaacgtggcactcaacaa

SEQ ID NO: 93198 - DNA, 25 bp, mus musculus
ccaacgtggcactcaacaaagcagg

SEQ ID NO: 93199 - DNA, 25 bp, mus musculus
tggcactcaacaaagcaggctcctg

SEQ ID NO: 93200 - DNA, 25 bp, mus musculus
gctttatcaccggaagctatgatcg

SEQ ID NO: 93201 - DNA, 25 bp, mus musculus
tcaccggaagctatgatcggacctg

SEQ ID NO: 93202 - DNA, 25 bp, mus musculus
tctagcacgtctcagctgaatgagc

SEQ ID NO: 93203 - DNA, 25 bp, mus musculus
atgatggcttcccagacgacattgc

SEQ ID NO: 93204 - DNA, 25 bp, mus musculus
gtaccgactgccagagagaagtgcc

SEQ ID NO: 93205 - DNA, 25 bp, mus musculus
gagaagtgccctcgatgttggaagc

SEQ ID NO: 93206 - DNA, 25 bp, mus musculus
aagtgccctcgatgttggaagcata

SEQ ID NO: 93207 - DNA, 25 bp, mus musculus
aagcatacctctgagactgcagacg

SEQ ID NO: 93208 - DNA, 25 bp, mus musculus
catacctctgagactgcagacgctc

SEQ ID NO: 93209 - DNA, 25 bp, mus musculus
acctctgagactgcagacgctctct

SEQ ID NO: 93210 - DNA, 25 bp, mus musculus
actgcagacgctctctgtcctcggt

SEQ ID NO: 93211 - DNA, 25 bp, mus musculus
aagtagcaacctgatgtcaacagac

SEQ ID NO: 93212 - DNA, 25 bp, mus musculus
tagcaacctgatgtcaacagacgac

SEQ ID NO: 93213 - DNA, 25 bp, mus musculus
caacctgatgtcaacagacgacgac

SEQ ID NO: 93214 - DNA, 25 bp, mus musculus
tcccagacgacattgctggctcagg

SEQ ID NO: 93215 - DNA, 25 bp, mus musculus
cagacgacattgctggctcaggagc

SEQ ID NO: 93216 - DNA, 25 bp, mus musculus
ggtgacattgagctcacggggacat

SEQ ID NO: 93217 - DNA, 25 bp, mus musculus
gacattgagctcacggggacattcg

SEQ ID NO: 93218 - DNA, 25 bp, mus musculus
attgagctcacggggacattcgtca

SEQ ID NO: 93219 - DNA, 25 bp, mus musculus
gggacattcgtcatcaatctagaag

SEQ ID NO: 93220 - DNA, 25 bp, mus musculus
ttcgtcatcaatctagaaggtggtg

SEQ ID NO: 93221 - DNA, 25 bp, mus musculus
gtcattgtggtaccgactgccagag

SEQ ID NO: 93222 - DNA, 25 bp, mus musculus
cccggctccacgggcagcggagcga

SEQ ID NO: 93223 - DNA, 25 bp, mus musculus
gctccacgggcagcggagcgaagta

SEQ ID NO: 93224 - DNA, 25 bp, mus musculus
tcatcaacaggaatacaccaaggag

SEQ ID NO: 93225 - DNA, 25 bp, mus musculus
catcaacaggaatacaccaaggagg

SEQ ID NO: 93226 - DNA, 25 bp, mus musculus
gagactgccatgaacaagaataacg

SEQ ID NO: 93227 - DNA, 25 bp, mus musculus
acaagaataacgccaggaggtagct

SEQ ID NO: 93228 - DNA, 25 bp, mus musculus
ataacgccaggaggtagcttcgcag

SEQ ID NO: 93229 - DNA, 25 bp, mus musculus
aggtagcttcgcagtgtaggagata

SEQ ID NO: 93230 - DNA, 25 bp, mus musculus
ggtagcttcgcagtgtaggagatag

SEQ ID NO: 93231 - DNA, 25 bp, mus musculus
tagcttcgcagtgtaggagatagaa

SEQ ID NO: 93232 - DNA, 25 bp, mus musculus
agcttcgcagtgtaggagatagaaa

SEQ ID NO: 93233 - DNA, 25 bp, mus musculus
ctccacgggcagcggagcgaagtag

SEQ ID NO: 93234 - DNA, 25 bp, mus musculus
tccacgggcagcggagcgaagtagt

SEQ ID NO: 93235 - DNA, 25 bp, mus musculus
gtgacgtcacatcggcggcgccgca

SEQ ID NO: 93236 - DNA, 25 bp, mus musculus
cgccgcagcgcggtacgaagaaggt

SEQ ID NO: 93237 - DNA, 25 bp, mus musculus
ccgcagcgcggtacgaagaaggtca

SEQ ID NO: 93238 - DNA, 25 bp, mus musculus
tacggtttcatcaacaggaatacac

SEQ ID NO: 93239 - DNA, 25 bp, mus musculus
gtttcatcaacaggaatacaccaag

SEQ ID NO: 93240 - DNA, 25 bp, mus musculus
ttcatcaacaggaatacaccaagga

SEQ ID NO: 93241 - DNA, 25 bp, mus musculus
actgtccctgatggtgaaggagcaa

SEQ ID NO: 93242 - DNA, 25 bp, mus musculus
gtccctgatggtgaaggagcaagac

SEQ ID NO: 93243 - DNA, 25 bp, mus musculus
aggcatcctgtccagcccaaacatg

SEQ ID NO: 93244 - DNA, 25 bp, mus musculus
aagggcctccttggagacttctatg

SEQ ID NO: 93245 - DNA, 25 bp, mus musculus
ctccttggagacttctatggaagcc

SEQ ID NO: 93246 - DNA, 25 bp, mus musculus
ttctatggaagcccgattccgagtg

SEQ ID NO: 93247 - DNA, 25 bp, mus musculus
tatggaagcccgattccgagtgtct

SEQ ID NO: 93248 - DNA, 25 bp, mus musculus
ccgattccgagtgtctcacttaagc

SEQ ID NO: 93249 - DNA, 25 bp, mus musculus
attccgagtgtctcacttaagcttc

SEQ ID NO: 93250 - DNA, 25 bp, mus musculus
ccgagtgtctcacttaagcttctct

SEQ ID NO: 93251 - DNA, 25 bp, mus musculus
ctctcaaacatcaattctgtcttcc

SEQ ID NO: 93252 - DNA, 25 bp, mus musculus
tcaaacatcaattctgtcttcctga

SEQ ID NO: 93253 - DNA, 25 bp, mus musculus
tgttaccacagtgcaccacggccaa

SEQ ID NO: 93254 - DNA, 25 bp, mus musculus
atcaattctgtcttcctgaccaaca

SEQ ID NO: 93255 - DNA, 25 bp, mus musculus
taccacagtgcaccacggccaaact

SEQ ID NO: 93256 - DNA, 25 bp, mus musculus
agtgcaccacggccaaacttggatg

SEQ ID NO: 93257 - DNA, 25 bp, mus musculus
gcaccacggccaaacttggatggag

SEQ ID NO: 93258 - DNA, 25 bp, mus musculus
agccaaaatctcagaaaatggctcc

SEQ ID NO: 93259 - DNA, 25 bp, mus musculus
ctcagaaaatggctcctcggtggca

SEQ ID NO: 93260 - DNA, 25 bp, mus musculus
ctcctcggtggcaggcatcctgtcc

SEQ ID NO: 93261 - DNA, 25 bp, mus musculus
ctcggtggcaggcatcctgtccagc

SEQ ID NO: 93262 - DNA, 25 bp, mus musculus
gtcactctcgggcagccgcatcttt

SEQ ID NO: 93263 - DNA, 25 bp, mus musculus
cgtcaggatcttgccactttggatg

SEQ ID NO: 93264 - DNA, 25 bp, mus musculus
ggtcatgttgctcatggaaaatcta

SEQ ID NO: 93265 - DNA, 25 bp, mus musculus
gtaaaagccatttctggtgttcaca

SEQ ID NO: 93266 - DNA, 25 bp, mus musculus
aaagccatttctggtgttcacactg

SEQ ID NO: 93267 - DNA, 25 bp, mus musculus
gccatttctggtgttcacactgtcc

SEQ ID NO: 93268 - DNA, 25 bp, mus musculus
ggtgttcacactgtccgattcaaaa

SEQ ID NO: 93269 - DNA, 25 bp, mus musculus
gttcacactgtccgattcaaaaatg

SEQ ID NO: 93270 - DNA, 25 bp, mus musculus
cacactgtccgattcaaaaatgaac

SEQ ID NO: 93271 - DNA, 25 bp, mus musculus
actgtccgattcaaaaatgaactag

SEQ ID NO: 93272 - DNA, 25 bp, mus musculus
aatattaccataaaacttggatatg

SEQ ID NO: 93273 - DNA, 25 bp, mus musculus
tataagcttgatgactccagttgtc

SEQ ID NO: 93274 - DNA, 25 bp, mus musculus
caggatcttgccactttggatgtta

SEQ ID NO: 93275 - DNA, 25 bp, mus musculus
gatcttgccactttggatgttacca

SEQ ID NO: 93276 - DNA, 25 bp, mus musculus
cttgccactttggatgttaccaagt

SEQ ID NO: 93277 - DNA, 25 bp, mus musculus
ttgactccgctttcacgtgaaatta

SEQ ID NO: 93278 - DNA, 25 bp, mus musculus
actccgctttcacgtgaaattatca

SEQ ID NO: 93279 - DNA, 25 bp, mus musculus
ccgctttcacgtgaaattatcagca

SEQ ID NO: 93280 - DNA, 25 bp, mus musculus
attatcagcagacaagccacaatta

SEQ ID NO: 93281 - DNA, 25 bp, mus musculus
attggtcatgttgctcatggaaaat

SEQ ID NO: 93282 - DNA, 25 bp, mus musculus
cctttagaggcatttgctgtgttgt

SEQ ID NO: 93283 - DNA, 25 bp, mus musculus
gcatttgctgtgttgttttatagca

SEQ ID NO: 93284 - DNA, 25 bp, mus musculus
ctcccgagtctcagtgttggatggt

SEQ ID NO: 93285 - DNA, 25 bp, mus musculus
ttcagtggtatgctgcagaggttct

SEQ ID NO: 93286 - DNA, 25 bp, mus musculus
cagaggttctctgtacaggaagtgg

SEQ ID NO: 93287 - DNA, 25 bp, mus musculus
gtggacttctgcagacagcaagggg

SEQ ID NO: 93288 - DNA, 25 bp, mus musculus
gacttctgcagacagcaaggggata

SEQ ID NO: 93289 - DNA, 25 bp, mus musculus
tcattcctgagttcaattcactggt

SEQ ID NO: 93290 - DNA, 25 bp, mus musculus
gactacccacaaatttctcatgatg

SEQ ID NO: 93291 - DNA, 25 bp, mus musculus
ccacaaatttctcatgatgaacccc

SEQ ID NO: 93292 - DNA, 25 bp, mus musculus
atttctcatgatgaaccccaagcac

SEQ ID NO: 93293 - DNA, 25 bp, mus musculus
tctcatgatgaaccccaagcaccct

SEQ ID NO: 93294 - DNA, 25 bp, mus musculus
agaacatcagttctcatcaagctat

SEQ ID NO: 93295 - DNA, 25 bp, mus musculus
tcagttctcatcaagctataaaacc

SEQ ID NO: 93296 - DNA, 25 bp, mus musculus
ctcatcaagctataaaaccagaaga

SEQ ID NO: 93297 - DNA, 25 bp, mus musculus
agttcctgcccagggattccatggt

SEQ ID NO: 93298 - DNA, 25 bp, mus musculus
tgcccagggattccatggtaggagt

SEQ ID NO: 93299 - DNA, 25 bp, mus musculus
gaagccattggcaagtccaggatga

SEQ ID NO: 93300 - DNA, 25 bp, mus musculus
attggcaagtccaggatgagaagta

SEQ ID NO: 93301 - DNA, 25 bp, mus musculus
agtctcccgagtctcagtgttggat

SEQ ID NO: 93302 - DNA, 25 bp, mus musculus
cacattgaattcctgctctccaatc

SEQ ID NO: 93303 - DNA, 25 bp, mus musculus
acattgaattcctgctctccaatca

SEQ ID NO: 93304 - DNA, 25 bp, mus musculus
tgctctccaatcatccaggtgactc

SEQ ID NO: 93305 - DNA, 25 bp, mus musculus
ctctccaatcatccaggtgactcgc

SEQ ID NO: 93306 - DNA, 25 bp, mus musculus
tctccaatcatccaggtgactcgca

SEQ ID NO: 93307 - DNA, 25 bp, mus musculus
ctccaatcatccaggtgactcgcag

SEQ ID NO: 93308 - DNA, 25 bp, mus musculus
tccaatcatccaggtgactcgcagc

SEQ ID NO: 93309 - DNA, 25 bp, mus musculus
ggtgcccaccatgcccgagatgcag

SEQ ID NO: 93310 - DNA, 25 bp, mus musculus
accatgcccgagatgcagttggtgc

SEQ ID NO: 93311 - DNA, 25 bp, mus musculus
catgcccgagatgcagttggtgccc

SEQ ID NO: 93312 - DNA, 25 bp, mus musculus
atgcccgagatgcagttggtgccca

SEQ ID NO: 93313 - DNA, 25 bp, mus musculus
tgcccgagatgcagttggtgcccaa

SEQ ID NO: 93314 - DNA, 25 bp, mus musculus
cattgaattcctgctctccaatcat

SEQ ID NO: 93315 - DNA, 25 bp, mus musculus
attgaattcctgctctccaatcatc

SEQ ID NO: 93316 - DNA, 25 bp, mus musculus
tgaattcctgctctccaatcatcca

SEQ ID NO: 93317 - DNA, 25 bp, mus musculus
aattcctgctctccaatcatccagg

SEQ ID NO: 93318 - DNA, 25 bp, mus musculus
attcctgctctccaatcatccaggt

SEQ ID NO: 93319 - DNA, 25 bp, mus musculus
tcctgctctccaatcatccaggtga

SEQ ID NO: 93320 - DNA, 25 bp, mus musculus
cctgctctccaatcatccaggtgac

SEQ ID NO: 93321 - DNA, 25 bp, mus musculus
ctgctctccaatcatccaggtgact

SEQ ID NO: 93322 - DNA, 25 bp, mus musculus
gcagacagacacactcatgcagagg

SEQ ID NO: 93323 - DNA, 25 bp, mus musculus
cacactcatgcagagggacatgtgt

SEQ ID NO: 93324 - DNA, 25 bp, mus musculus
gactcaggtccagccaacaggcagc

SEQ ID NO: 93325 - DNA, 25 bp, mus musculus
ggtccagccaacaggcagcagtcag

SEQ ID NO: 93326 - DNA, 25 bp, mus musculus
ccagccaacaggcagcagtcagtgg

SEQ ID NO: 93327 - DNA, 25 bp, mus musculus
gccaacaggcagcagtcagtgggga

SEQ ID NO: 93328 - DNA, 25 bp, mus musculus
agaagaagtcaccctggactgttca

SEQ ID NO: 93329 - DNA, 25 bp, mus musculus
agaagtcaccctggactgttcatat

SEQ ID NO: 93330 - DNA, 25 bp, mus musculus
agtcaccctggactgttcatatgag

SEQ ID NO: 93331 - DNA, 25 bp, mus musculus
caccctggactgttcatatgagaca

SEQ ID NO: 93332 - DNA, 25 bp, mus musculus
gtacaggcagctttttagtggagag

SEQ ID NO: 93333 - DNA, 25 bp, mus musculus
ttaccaaccttcttttgacactcag

SEQ ID NO: 93334 - DNA, 25 bp, mus musculus
gcctcctcagagcctgctctgtgtg

SEQ ID NO: 93335 - DNA, 25 bp, mus musculus
accttcttttgacactcagaaccag

SEQ ID NO: 93336 - DNA, 25 bp, mus musculus
tcctcagagcctgctctgtgtgctg

SEQ ID NO: 93337 - DNA, 25 bp, mus musculus
tcagagcctgctctgtgtgctggtg

SEQ ID NO: 93338 - DNA, 25 bp, mus musculus
cttggctttctctggatgcaatgtg

SEQ ID NO: 93339 - DNA, 25 bp, mus musculus
ggctttctctggatgcaatgtggcc

SEQ ID NO: 93340 - DNA, 25 bp, mus musculus
tttctctggatgcaatgtggcccag

SEQ ID NO: 93341 - DNA, 25 bp, mus musculus
atgcaatgtggcccagagagtgact

SEQ ID NO: 93342 - DNA, 25 bp, mus musculus
agtgactcaggtccagccaacaggc

SEQ ID NO: 93343 - DNA, 25 bp, mus musculus
tcgatccatggcgccgaggacaagg

SEQ ID NO: 93344 - DNA, 25 bp, mus musculus
cgatccatggcgccgaggacaaggc

SEQ ID NO: 93345 - DNA, 25 bp, mus musculus
atcgaccgcaacttgcggaggacgg

SEQ ID NO: 93346 - DNA, 25 bp, mus musculus
tcgaccgcaacttgcggaggacggg

SEQ ID NO: 93347 - DNA, 25 bp, mus musculus
ctcggcgctggagaatctggtaaaa

SEQ ID NO: 93348 - DNA, 25 bp, mus musculus
aaagtaccatcgtgaaacagatgaa

SEQ ID NO: 93349 - DNA, 25 bp, mus musculus
aagtaccatcgtgaaacagatgaaa

SEQ ID NO: 93350 - DNA, 25 bp, mus musculus
agtaccatcgtgaaacagatgaaaa

SEQ ID NO: 93351 - DNA, 25 bp, mus musculus
aaatcattcatgaggacggctattc

SEQ ID NO: 93352 - DNA, 25 bp, mus musculus
aatcattcatgaggacggctattca

SEQ ID NO: 93353 - DNA, 25 bp, mus musculus
atcattcatgaggacggctattcag

SEQ ID NO: 93354 - DNA, 25 bp, mus musculus
tcattcatgaggacggctattcaga

SEQ ID NO: 93355 - DNA, 25 bp, mus musculus
gatccatggcgccgaggacaaggcg

SEQ ID NO: 93356 - DNA, 25 bp, mus musculus
atccatggcgccgaggacaaggcgg

SEQ ID NO: 93357 - DNA, 25 bp, mus musculus
aagatgatcgaccgcaacttgcgga

SEQ ID NO: 93358 - DNA, 25 bp, mus musculus
agatgatcgaccgcaacttgcggag

SEQ ID NO: 93359 - DNA, 25 bp, mus musculus
gatgatcgaccgcaacttgcggagg

SEQ ID NO: 93360 - DNA, 25 bp, mus musculus
atgatcgaccgcaacttgcggagga

SEQ ID NO: 93361 - DNA, 25 bp, mus musculus
tgatcgaccgcaacttgcggaggac

SEQ ID NO: 93362 - DNA, 25 bp, mus musculus
gatcgaccgcaacttgcggaggacg

SEQ ID NO: 93363 - DNA, 25 bp, mus musculus
atcaactacagtagcctcagtatag

SEQ ID NO: 93364 - DNA, 25 bp, mus musculus
aactacagtagcctcagtatagcta

SEQ ID NO: 93365 - DNA, 25 bp, mus musculus
ggtgcctcaggcagaacctacaatt

SEQ ID NO: 93366 - DNA, 25 bp, mus musculus
gcctcaggcagaacctacaattctt

SEQ ID NO: 93367 - DNA, 25 bp, mus musculus
ggcagaacctacaattcttccattc

SEQ ID NO: 93368 - DNA, 25 bp, mus musculus
ctatgactcctatcactctggctac

SEQ ID NO: 93369 - DNA, 25 bp, mus musculus
ttgtatcgcagattcacaatatcgt

SEQ ID NO: 93370 - DNA, 25 bp, mus musculus
tatcgcagattcacaatatcgtatc

SEQ ID NO: 93371 - DNA, 25 bp, mus musculus
agattcacaatatcgtatctagcgt

SEQ ID NO: 93372 - DNA, 25 bp, mus musculus
ttcacaatatcgtatctagcgtaga

SEQ ID NO: 93373 - DNA, 25 bp, mus musculus
acaatatcgtatctagcgtagatct

SEQ ID NO: 93374 - DNA, 25 bp, mus musculus
agaccattgcacttcgtgaagagaa

SEQ ID NO: 93375 - DNA, 25 bp, mus musculus
tacagtagcctcagtatagctatca

SEQ ID NO: 93376 - DNA, 25 bp, mus musculus
agtatagctatcatcatctcatcaa

SEQ ID NO: 93377 - DNA, 25 bp, mus musculus
gctatcatcatctcatcaatcctac

SEQ ID NO: 93378 - DNA, 25 bp, mus musculus
atcatcatctcatcaatcctacagg

SEQ ID NO: 93379 - DNA, 25 bp, mus musculus
atcatctcatcaatcctacagggtg

SEQ ID NO: 93380 - DNA, 25 bp, mus musculus
tcatcaatcctacagggtgcctcag

SEQ ID NO: 93381 - DNA, 25 bp, mus musculus
tcaatcctacagggtgcctcaggca

SEQ ID NO: 93382 - DNA, 25 bp, mus musculus
atcctacagggtgcctcaggcagaa

SEQ ID NO: 93383 - DNA, 25 bp, mus musculus
acagcagagccttaattcttgcttg

SEQ ID NO: 93384 - DNA, 25 bp, mus musculus
cagagccttaattcttgcttgttac

SEQ ID NO: 93385 - DNA, 25 bp, mus musculus
gctttccaaggccatcatccaggtg

SEQ ID NO: 93386 - DNA, 25 bp, mus musculus
tccaaggccatcatccaggtgaagt

SEQ ID NO: 93387 - DNA, 25 bp, mus musculus
caaggccatcatccaggtgaagtgt

SEQ ID NO: 93388 - DNA, 25 bp, mus musculus
gccatcatccaggtgaagtgtgaca

SEQ ID NO: 93389 - DNA, 25 bp, mus musculus
catcatccaggtgaagtgtgacaag

SEQ ID NO: 93390 - DNA, 25 bp, mus musculus
tgtgacaagcctgtttcttaaccca

SEQ ID NO: 93391 - DNA, 25 bp, mus musculus
tgacaagcctgtttcttaacccacg

SEQ ID NO: 93392 - DNA, 25 bp, mus musculus
gccctcactttcctttctcaggtgc

SEQ ID NO: 93393 - DNA, 25 bp, mus musculus
tcactttcctttctcaggtgctgga

SEQ ID NO: 93394 - DNA, 25 bp, mus musculus
actttcctttctcaggtgctggaga

SEQ ID NO: 93395 - DNA, 25 bp, mus musculus
ttgcttgttactctatggtgagata

SEQ ID NO: 93396 - DNA, 25 bp, mus musculus
ttgttactctatggtgagatacttc

SEQ ID NO: 93397 - DNA, 25 bp, mus musculus
gtttttcactgcgtcgtcatgtgaa

SEQ ID NO: 93398 - DNA, 25 bp, mus musculus
ttttcactgcgtcgtcatgtgaagg

SEQ ID NO: 93399 - DNA, 25 bp, mus musculus
cactgcgtcgtcatgtgaaggaggt

SEQ ID NO: 93400 - DNA, 25 bp, mus musculus
ctgcgtcgtcatgtgaaggaggttt

SEQ ID NO: 93401 - DNA, 25 bp, mus musculus
ttgtgtgctgcttctgctgctttcc

SEQ ID NO: 93402 - DNA, 25 bp, mus musculus
ctgctttccaaggccatcatccagg

SEQ ID NO: 93403 - DNA, 25 bp, mus musculus
cagctgacccggcaccagcgttttg

SEQ ID NO: 93404 - DNA, 25 bp, mus musculus
caccagcgttttgtgcaccggctag

SEQ ID NO: 93405 - DNA, 25 bp, mus musculus
catgtgcggaaccatctgcgtacac

SEQ ID NO: 93406 - DNA, 25 bp, mus musculus
cggaaccatctgcgtacacacactg

SEQ ID NO: 93407 - DNA, 25 bp, mus musculus
aaccatctgcgtacacacactgggg

SEQ ID NO: 93408 - DNA, 25 bp, mus musculus
cctgactgctctaagcctttcaact

SEQ ID NO: 93409 - DNA, 25 bp, mus musculus
gactgctctaagcctttcaactcac

SEQ ID NO: 93410 - DNA, 25 bp, mus musculus
tctaagcctttcaactcaccagcca

SEQ ID NO: 93411 - DNA, 25 bp, mus musculus
gccttcacgcagagctccactctga

SEQ ID NO: 93412 - DNA, 25 bp, mus musculus
ttcacgcagagctccactctgaggc

SEQ ID NO: 93413 - DNA, 25 bp, mus musculus
acgcagagctccactctgaggcagc

SEQ ID NO: 93414 - DNA, 25 bp, mus musculus
cagagctccactctgaggcagcatc

SEQ ID NO: 93415 - DNA, 25 bp, mus musculus
cgttttgtgcaccggctagagcggc

SEQ ID NO: 93416 - DNA, 25 bp, mus musculus
agctccactctgaggcagcatcgcc

SEQ ID NO: 93417 - DNA, 25 bp, mus musculus
tttgtgcaccggctagagcggcgcc

SEQ ID NO: 93418 - DNA, 25 bp, mus musculus
caccggctagagcggcgccataagt

SEQ ID NO: 93419 - DNA, 25 bp, mus musculus
cggctagagcggcgccataagtgca

SEQ ID NO: 93420 - DNA, 25 bp, mus musculus
ctagagcggcgccataagtgcagca

SEQ ID NO: 93421 - DNA, 25 bp, mus musculus
cgccataagtgcagcatttgtggca

SEQ ID NO: 93422 - DNA, 25 bp, mus musculus
cataagtgcagcatttgtggcaaga

SEQ ID NO: 93423 - DNA, 25 bp, mus musculus
aagtctcatgtgcggaaccatctgc

SEQ ID NO: 93424 - DNA, 25 bp, mus musculus
accacatgggctcctatggaccggc

SEQ ID NO: 93425 - DNA, 25 bp, mus musculus
tgggctcctatggaccggccttcta

SEQ ID NO: 93426 - DNA, 25 bp, mus musculus
tcgcccactcggactttcagagtgg

SEQ ID NO: 93427 - DNA, 25 bp, mus musculus
actcggactttcagagtgggctgat

SEQ ID NO: 93428 - DNA, 25 bp, mus musculus
actttcagagtgggctgatgagcat

SEQ ID NO: 93429 - DNA, 25 bp, mus musculus
tttccatgatcaaagctcatctgga

SEQ ID NO: 93430 - DNA, 25 bp, mus musculus
tgatcaaagctcatctggacatctt

SEQ ID NO: 93431 - DNA, 25 bp, mus musculus
acatcttggtggaacgctccaaccg

SEQ ID NO: 93432 - DNA, 25 bp, mus musculus
tggtggaacgctccaaccgaaccag

SEQ ID NO: 93433 - DNA, 25 bp, mus musculus
aacgctccaaccgaaccagagctgt

SEQ ID NO: 93434 - DNA, 25 bp, mus musculus
gctccaaccgaaccagagctgtcag

SEQ ID NO: 93435 - DNA, 25 bp, mus musculus
ccaaccgaaccagagctgtcagcgt

SEQ ID NO: 93436 - DNA, 25 bp, mus musculus
tctaccaatcttacgacgcttctgg

SEQ ID NO: 93437 - DNA, 25 bp, mus musculus
gaaccagagctgtcagcgtgcctcc

SEQ ID NO: 93438 - DNA, 25 bp, mus musculus
accaatcttacgacgcttctggaca

SEQ ID NO: 93439 - DNA, 25 bp, mus musculus
cttacgacgcttctggacagttcac

SEQ ID NO: 93440 - DNA, 25 bp, mus musculus
acgacgcttctggacagttcacaca

SEQ ID NO: 93441 - DNA, 25 bp, mus musculus
acgcttctggacagttcacacacga

SEQ ID NO: 93442 - DNA, 25 bp, mus musculus
ttttctccgtggatctgaagaacga

SEQ ID NO: 93443 - DNA, 25 bp, mus musculus
ggcgtctgcctgagtttggagactt

SEQ ID NO: 93444 - DNA, 25 bp, mus musculus
ttggagacttcgcccactcggactt

SEQ ID NO: 93445 - DNA, 25 bp, mus musculus
gttgccttaatcttcttaagcagat

SEQ ID NO: 93446 - DNA, 25 bp, mus musculus
tgccttaatcttcttaagcagattg

SEQ ID NO: 93447 - DNA, 25 bp, mus musculus
caggacatccttaactcttcatgga

SEQ ID NO: 93448 - DNA, 25 bp, mus musculus
ggacatccttaactcttcatggagc

SEQ ID NO: 93449 - DNA, 25 bp, mus musculus
ccttaactcttcatggagcatctta

SEQ ID NO: 93450 - DNA, 25 bp, mus musculus
gtacacttgacagcagatgccaaag

SEQ ID NO: 93451 - DNA, 25 bp, mus musculus
acttgacagcagatgccaaagtggc

SEQ ID NO: 93452 - DNA, 25 bp, mus musculus
tatctacaccaggaaaccccagaga

SEQ ID NO: 93453 - DNA, 25 bp, mus musculus
ccccagagaacttcaagtgggctgt

SEQ ID NO: 93454 - DNA, 25 bp, mus musculus
agaacttcaagtgggctgtgatttt

SEQ ID NO: 93455 - DNA, 25 bp, mus musculus
aacttcaagtgggctgtgattttcg

SEQ ID NO: 93456 - DNA, 25 bp, mus musculus
cttcaagtgggctgtgattttcgca

SEQ ID NO: 93457 - DNA, 25 bp, mus musculus
ttgaaaaatccaactctatccagga

SEQ ID NO: 93458 - DNA, 25 bp, mus musculus
aatccaactctatccaggacatcct

SEQ ID NO: 93459 - DNA, 25 bp, mus musculus
tccaactctatccaggacatcctta

SEQ ID NO: 93460 - DNA, 25 bp, mus musculus
caactctatccaggacatccttaac

SEQ ID NO: 93461 - DNA, 25 bp, mus musculus
actctatccaggacatccttaactc

SEQ ID NO: 93462 - DNA, 25 bp, mus musculus
tctatccaggacatccttaactctt

SEQ ID NO: 93463 - DNA, 25 bp, mus musculus
tatccaggacatccttaactcttca

SEQ ID NO: 93464 - DNA, 25 bp, mus musculus
tccaggacatccttaactcttcatg

SEQ ID NO: 93465 - DNA, 25 bp, mus musculus
cacatttgagccctgctcaccaatc

SEQ ID NO: 93466 - DNA, 25 bp, mus musculus
acatttgagccctgctcaccaatca

SEQ ID NO: 93467 - DNA, 25 bp, mus musculus
gttctgctcttcaagatgcagccgt

SEQ ID NO: 93468 - DNA, 25 bp, mus musculus
ttctgctcttcaagatgcagccgta

SEQ ID NO: 93469 - DNA, 25 bp, mus musculus
ctgctcttcaagatgcagccgtagg

SEQ ID NO: 93470 - DNA, 25 bp, mus musculus
tgctcttcaagatgcagccgtagga

SEQ ID NO: 93471 - DNA, 25 bp, mus musculus
ctcttcaagatgcagccgtaggaat

SEQ ID NO: 93472 - DNA, 25 bp, mus musculus
tcttcaagatgcagccgtaggaatg

SEQ ID NO: 93473 - DNA, 25 bp, mus musculus
ttcaagatgcagccgtaggaatggc

SEQ ID NO: 93474 - DNA, 25 bp, mus musculus
tcaagatgcagccgtaggaatggct

SEQ ID NO: 93475 - DNA, 25 bp, mus musculus
aagatgcagccgtaggaatggctcg

SEQ ID NO: 93476 - DNA, 25 bp, mus musculus
agatgcagccgtaggaatggctcgg

SEQ ID NO: 93477 - DNA, 25 bp, mus musculus
atttgagccctgctcaccaatcatc

SEQ ID NO: 93478 - DNA, 25 bp, mus musculus
tttgagccctgctcaccaatcatcc

SEQ ID NO: 93479 - DNA, 25 bp, mus musculus
gagccctgctcaccaatcatccagg

SEQ ID NO: 93480 - DNA, 25 bp, mus musculus
ccctgctcaccaatcatccaggtga

SEQ ID NO: 93481 - DNA, 25 bp, mus musculus
ctgctcaccaatcatccaggtgatt

SEQ ID NO: 93482 - DNA, 25 bp, mus musculus
ctcaccaatcatccaggtgattccc

SEQ ID NO: 93483 - DNA, 25 bp, mus musculus
tcaccaatcatccaggtgattccca

SEQ ID NO: 93484 - DNA, 25 bp, mus musculus
cccagccatgaagaaacttgttctt

SEQ ID NO: 93485 - DNA, 25 bp, mus musculus
atcgtgcctattgtggagcctcaga

SEQ ID NO: 93486 - DNA, 25 bp, mus musculus
gtgcctattgtggagcctcagattc

SEQ ID NO: 93487 - DNA, 25 bp, mus musculus
gaccatcatgtatacctcgaaggga

SEQ ID NO: 93488 - DNA, 25 bp, mus musculus
catcatgtatacctcgaagggactc

SEQ ID NO: 93489 - DNA, 25 bp, mus musculus
tacctcgaagggactctgctcaagc

SEQ ID NO: 93490 - DNA, 25 bp, mus musculus
actctgctcaagcccaatatggtga

SEQ ID NO: 93491 - DNA, 25 bp, mus musculus
ctgctcaagcccaatatggtgaccc

SEQ ID NO: 93492 - DNA, 25 bp, mus musculus
ggccatgcctgtcccatcaagtata

SEQ ID NO: 93493 - DNA, 25 bp, mus musculus
gcctgtcccatcaagtatagcccag

SEQ ID NO: 93494 - DNA, 25 bp, mus musculus
tgtcccatcaagtatagcccagaag

SEQ ID NO: 93495 - DNA, 25 bp, mus musculus
gcaactgtcactgccctgcgtcgta

SEQ ID NO: 93496 - DNA, 25 bp, mus musculus
actgtcactgccctgcgtcgtactg

SEQ ID NO: 93497 - DNA, 25 bp, mus musculus
cctattgtggagcctcagattctgc

SEQ ID NO: 93498 - DNA, 25 bp, mus musculus
gagcctcagattctgcctgacggag

SEQ ID NO: 93499 - DNA, 25 bp, mus musculus
cctcagattctgcctgacggagacc

SEQ ID NO: 93500 - DNA, 25 bp, mus musculus
ctgcctgacggagaccatgacctca

SEQ ID NO: 93501 - DNA, 25 bp, mus musculus
ggagaccatgacctcaaacgttgcc

SEQ ID NO: 93502 - DNA, 25 bp, mus musculus
ctcaaacgttgccagtatgttacag

SEQ ID NO: 93503 - DNA, 25 bp, mus musculus
gtatacaaggccctgagtgaccatc

SEQ ID NO: 93504 - DNA, 25 bp, mus musculus
aaggccctgagtgaccatcatgtat

SEQ ID NO: 93505 - DNA, 25 bp, mus musculus
tgttgctctagacttcgagcaagag

SEQ ID NO: 93506 - DNA, 25 bp, mus musculus
ttgctctagacttcgagcaagagat

SEQ ID NO: 93507 - DNA, 25 bp, mus musculus
atacactggactatcattctaatcc

SEQ ID NO: 93508 - DNA, 25 bp, mus musculus
acactggactatcattctaatccat

SEQ ID NO: 93509 - DNA, 25 bp, mus musculus
tggactatcattctaatccatcatg

SEQ ID NO: 93510 - DNA, 25 bp, mus musculus
gactatcattctaatccatcatgta

SEQ ID NO: 93511 - DNA, 25 bp, mus musculus
ctatcattctaatccatcatgtagt

SEQ ID NO: 93512 - DNA, 25 bp, mus musculus
atcattctaatccatcatgtagtgt

SEQ ID NO: 93513 - DNA, 25 bp, mus musculus
cattctaatccatcatgtagtgtga

SEQ ID NO: 93514 - DNA, 25 bp, mus musculus
ttctaatccatcatgtagtgtgacg

SEQ ID NO: 93515 - DNA, 25 bp, mus musculus
ctaatccatcatgtagtgtgacgtt

SEQ ID NO: 93516 - DNA, 25 bp, mus musculus
cacagtgctgtgtggtggtacacaa

SEQ ID NO: 93517 - DNA, 25 bp, mus musculus
gctctagacttcgagcaagagatgt

SEQ ID NO: 93518 - DNA, 25 bp, mus musculus
tctagacttcgagcaagagatgtgc

SEQ ID NO: 93519 - DNA, 25 bp, mus musculus
atggcggaatctcctccttcctgga

SEQ ID NO: 93520 - DNA, 25 bp, mus musculus
tccttcctggaggagaactatgagc

SEQ ID NO: 93521 - DNA, 25 bp, mus musculus
gaactatgagctggctgaagggcaa

SEQ ID NO: 93522 - DNA, 25 bp, mus musculus
gaatcctgtgtgatacactggacta

SEQ ID NO: 93523 - DNA, 25 bp, mus musculus
atcctgtgtgatacactggactatc

SEQ ID NO: 93524 - DNA, 25 bp, mus musculus
tgatacactggactatcattctaat

SEQ ID NO: 93525 - DNA, 25 bp, mus musculus
agatccatgcgccgacccgggatgt

SEQ ID NO: 93526 - DNA, 25 bp, mus musculus
aagttggcttgacttcttgccaagg

SEQ ID NO: 93527 - DNA, 25 bp, mus musculus
gctaccgcacagtgaagcagcagca

SEQ ID NO: 93528 - DNA, 25 bp, mus musculus
tgaagcagcagcagacagtgtttat

SEQ ID NO: 93529 - DNA, 25 bp, mus musculus
actcctctctctttgaacaacagcc

SEQ ID NO: 93530 - DNA, 25 bp, mus musculus
cctctctctttgaacaacagccacg

SEQ ID NO: 93531 - DNA, 25 bp, mus musculus
tctttgaacaacagccacgctggtt

SEQ ID NO: 93532 - DNA, 25 bp, mus musculus
cacgctggttgctctaccatgagct

SEQ ID NO: 93533 - DNA, 25 bp, mus musculus
gctggttgctctaccatgagcttgt

SEQ ID NO: 93534 - DNA, 25 bp, mus musculus
tgctctaccatgagcttgtcttgac

SEQ ID NO: 93535 - DNA, 25 bp, mus musculus
tctaccatgagcttgtcttgaccac

SEQ ID NO: 93536 - DNA, 25 bp, mus musculus
agcttgtcttgaccacaaaggaatt

SEQ ID NO: 93537 - DNA, 25 bp, mus musculus
gcttgacttcttgccaaggtgacta

SEQ ID NO: 93538 - DNA, 25 bp, mus musculus
tgacttcttgccaaggtgactacgt

SEQ ID NO: 93539 - DNA, 25 bp, mus musculus
tttaccacactgcgaggctgactcg

SEQ ID NO: 93540 - DNA, 25 bp, mus musculus
accacactgcgaggctgactcggag

SEQ ID NO: 93541 - DNA, 25 bp, mus musculus
acactgcgaggctgactcggagcgg

SEQ ID NO: 93542 - DNA, 25 bp, mus musculus
ggctgactcggagcggctaccgcac

SEQ ID NO: 93543 - DNA, 25 bp, mus musculus
tgactcggagcggctaccgcacagt

SEQ ID NO: 93544 - DNA, 25 bp, mus musculus
gcggctaccgcacagtgaagcagca

SEQ ID NO: 93545 - DNA, 25 bp, mus musculus
tgcaggcctggtctccacaagctcc

SEQ ID NO: 93546 - DNA, 25 bp, mus musculus
ggcctggtctccacaagctccatgt

SEQ ID NO: 93547 - DNA, 25 bp, mus musculus
tccccattcaactgccaagtcaggg

SEQ ID NO: 93548 - DNA, 25 bp, mus musculus
cccattcaactgccaagtcagggtt

SEQ ID NO: 93549 - DNA, 25 bp, mus musculus
cattcaactgccaagtcagggttat

SEQ ID NO: 93550 - DNA, 25 bp, mus musculus
caactgccaagtcagggttatgtca

SEQ ID NO: 93551 - DNA, 25 bp, mus musculus
actgccaagtcagggttatgtcaac

SEQ ID NO: 93552 - DNA, 25 bp, mus musculus
aatgggcacatgtgcctttggggaa

SEQ ID NO: 93553 - DNA, 25 bp, mus musculus
tgggcacatgtgcctttggggaaac

SEQ ID NO: 93554 - DNA, 25 bp, mus musculus
tcaaggaattggcctccaagtagag

SEQ ID NO: 93555 - DNA, 25 bp, mus musculus
aaggaattggcctccaagtagagct

SEQ ID NO: 93556 - DNA, 25 bp, mus musculus
ggaattggcctccaagtagagcttt

SEQ ID NO: 93557 - DNA, 25 bp, mus musculus
gtctccacaagctccatgtcctggg

SEQ ID NO: 93558 - DNA, 25 bp, mus musculus
ctccacaagctccatgtcctggggc

SEQ ID NO: 93559 - DNA, 25 bp, mus musculus
ccacaagctccatgtcctggggcaa

SEQ ID NO: 93560 - DNA, 25 bp, mus musculus
gctccatgtcctggggcaagtctcc

SEQ ID NO: 93561 - DNA, 25 bp, mus musculus
tccatgtcctggggcaagtctcccc

SEQ ID NO: 93562 - DNA, 25 bp, mus musculus
catgtcctggggcaagtctccccat

SEQ ID NO: 93563 - DNA, 25 bp, mus musculus
tgtcctggggcaagtctccccattc

SEQ ID NO: 93564 - DNA, 25 bp, mus musculus
tctccccattcaactgccaagtcag

SEQ ID NO: 93565 - DNA, 25 bp, mus musculus
gtcccctgtgcatccagagctcgcg

SEQ ID NO: 93566 - DNA, 25 bp, mus musculus
cctgtgcatccagagctcgcgccta

SEQ ID NO: 93567 - DNA, 25 bp, mus musculus
tcgaccgcgctgacagggccgaagc

SEQ ID NO: 93568 - DNA, 25 bp, mus musculus
accgcgctgacagggccgaagccag

SEQ ID NO: 93569 - DNA, 25 bp, mus musculus
cgctgacagggccgaagccagcaaa

SEQ ID NO: 93570 - DNA, 25 bp, mus musculus
gctgacagggccgaagccagcaaaa

SEQ ID NO: 93571 - DNA, 25 bp, mus musculus
acagggccgaagccagcaaaaagca

SEQ ID NO: 93572 - DNA, 25 bp, mus musculus
gaaggttgccgagtccgtgaacgat

SEQ ID NO: 93573 - DNA, 25 bp, mus musculus
aaggttgccgagtccgtgaacgatg

SEQ ID NO: 93574 - DNA, 25 bp, mus musculus
aggttgccgagtccgtgaacgatgg

SEQ ID NO: 93575 - DNA, 25 bp, mus musculus
ggttgccgagtccgtgaacgatggc

SEQ ID NO: 93576 - DNA, 25 bp, mus musculus
atccagagctcgcgcctagcccagt

SEQ ID NO: 93577 - DNA, 25 bp, mus musculus
agagctcgcgcctagcccagtctac

SEQ ID NO: 93578 - DNA, 25 bp, mus musculus
agaatgccatcgaccgcgctgacag

SEQ ID NO: 93579 - DNA, 25 bp, mus musculus
gaatgccatcgaccgcgctgacagg

SEQ ID NO: 93580 - DNA, 25 bp, mus musculus
gccatcgaccgcgctgacagggccg

SEQ ID NO: 93581 - DNA, 25 bp, mus musculus
ccatcgaccgcgctgacagggccga

SEQ ID NO: 93582 - DNA, 25 bp, mus musculus
catcgaccgcgctgacagggccgaa

SEQ ID NO: 93583 - DNA, 25 bp, mus musculus
atcgaccgcgctgacagggccgaag

SEQ ID NO: 93584 - DNA, 25 bp, mus musculus
gcatccattatactggccacgaggc

SEQ ID NO: 93585 - DNA, 25 bp, mus musculus
attatactggccacgaggcgcaaat

SEQ ID NO: 93586 - DNA, 25 bp, mus musculus
tgaccatcgtggccgacagcctcaa

SEQ ID NO: 93587 - DNA, 25 bp, mus musculus
ccatcgtggccgacagcctcaaatt

SEQ ID NO: 93588 - DNA, 25 bp, mus musculus
tcgtggccgacagcctcaaattccg

SEQ ID NO: 93589 - DNA, 25 bp, mus musculus
ccgacagcctcaaattccgtggcca

SEQ ID NO: 93590 - DNA, 25 bp, mus musculus
acagcctcaaattccgtggccacaa

SEQ ID NO: 93591 - DNA, 25 bp, mus musculus
gcctcaaattccgtggccacaaggt

SEQ ID NO: 93592 - DNA, 25 bp, mus musculus
aattccgtggccacaaggtcatcct

SEQ ID NO: 93593 - DNA, 25 bp, mus musculus
tccgtggccacaaggtcatcctggc

SEQ ID NO: 93594 - DNA, 25 bp, mus musculus
gtggccacaaggtcatcctggccgc

SEQ ID NO: 93595 - DNA, 25 bp, mus musculus
agttcttgctgaaccccagttctga

SEQ ID NO: 93596 - DNA, 25 bp, mus musculus
atactggccacgaggcgcaaatgtt

SEQ ID NO: 93597 - DNA, 25 bp, mus musculus
cgcaaatgttgcgtcacatgaacca

SEQ ID NO: 93598 - DNA, 25 bp, mus musculus
tgttgcgtcacatgaaccagctccg

SEQ ID NO: 93599 - DNA, 25 bp, mus musculus
tgcgtcacatgaaccagctccgtgc

SEQ ID NO: 93600 - DNA, 25 bp, mus musculus
gtcacatgaaccagctccgtgcaga

SEQ ID NO: 93601 - DNA, 25 bp, mus musculus
agctccgtgcagaggagcggttctg

SEQ ID NO: 93602 - DNA, 25 bp, mus musculus
aggagcggttctgtgatgtgaccat

SEQ ID NO: 93603 - DNA, 25 bp, mus musculus
tctgtgatgtgaccatcgtggccga

SEQ ID NO: 93604 - DNA, 25 bp, mus musculus
aacatgcactgttgagcggccagag

SEQ ID NO: 93605 - DNA, 25 bp, mus musculus
acatgcactgttgagcggccagaga

SEQ ID NO: 93606 - DNA, 25 bp, mus musculus
cccctgagcagacacaaggctctcg

SEQ ID NO: 93607 - DNA, 25 bp, mus musculus
ccctgagcagacacaaggctctcgt

SEQ ID NO: 93608 - DNA, 25 bp, mus musculus
gagcagacacaaggctctcgtgggg

SEQ ID NO: 93609 - DNA, 25 bp, mus musculus
agcagacacaaggctctcgtgggga

SEQ ID NO: 93610 - DNA, 25 bp, mus musculus
cagacacaaggctctcgtggggaac

SEQ ID NO: 93611 - DNA, 25 bp, mus musculus
agacacaaggctctcgtggggaaca

SEQ ID NO: 93612 - DNA, 25 bp, mus musculus
gacacaaggctctcgtggggaacag

SEQ ID NO: 93613 - DNA, 25 bp, mus musculus
cacaaggctctcgtggggaacagct

SEQ ID NO: 93614 - DNA, 25 bp, mus musculus
aggctctcgtggggaacagctgcat

SEQ ID NO: 93615 - DNA, 25 bp, mus musculus
ctttcctgttatgaatacatttgca

SEQ ID NO: 93616 - DNA, 25 bp, mus musculus
catgcactgttgagcggccagagaa

SEQ ID NO: 93617 - DNA, 25 bp, mus musculus
tgcactgttgagcggccagagaagg

SEQ ID NO: 93618 - DNA, 25 bp, mus musculus
tggtatgtcccctgagcagacacaa

SEQ ID NO: 93619 - DNA, 25 bp, mus musculus
ggtatgtcccctgagcagacacaag

SEQ ID NO: 93620 - DNA, 25 bp, mus musculus
gtatgtcccctgagcagacacaagg

SEQ ID NO: 93621 - DNA, 25 bp, mus musculus
atgtcccctgagcagacacaaggct

SEQ ID NO: 93622 - DNA, 25 bp, mus musculus
tgtcccctgagcagacacaaggctc

SEQ ID NO: 93623 - DNA, 25 bp, mus musculus
gtcccctgagcagacacaaggctct

SEQ ID NO: 93624 - DNA, 25 bp, mus musculus
cttgaagccagcatgctcagacagt

SEQ ID NO: 93625 - DNA, 25 bp, mus musculus
gaagccagcatgctcagacagtgtc

SEQ ID NO: 93626 - DNA, 25 bp, mus musculus
aggtgactctcgtcattctccaaga

SEQ ID NO: 93627 - DNA, 25 bp, mus musculus
tcattctccaagaagcatacaagca

SEQ ID NO: 93628 - DNA, 25 bp, mus musculus
ttctccaagaagcatacaagcagta

SEQ ID NO: 93629 - DNA, 25 bp, mus musculus
atgcaacgttaaaccgcttctctgt

SEQ ID NO: 93630 - DNA, 25 bp, mus musculus
accgcttctctgtgaacttccagaa

SEQ ID NO: 93631 - DNA, 25 bp, mus musculus
tctctgtgaacttccagaaagcagc

SEQ ID NO: 93632 - DNA, 25 bp, mus musculus
ctgtgaacttccagaaagcagctaa

SEQ ID NO: 93633 - DNA, 25 bp, mus musculus
tgaacttccagaaagcagctaagtc

SEQ ID NO: 93634 - DNA, 25 bp, mus musculus
aagcagctaagtccttcagcctgga

SEQ ID NO: 93635 - DNA, 25 bp, mus musculus
ctaagtccttcagcctggagatctc

SEQ ID NO: 93636 - DNA, 25 bp, mus musculus
agcatgctcagacagtgtctcagcc

SEQ ID NO: 93637 - DNA, 25 bp, mus musculus
ctcagacagtgtctcagcctcagaa

SEQ ID NO: 93638 - DNA, 25 bp, mus musculus
aatcagcaaccctggactgcaccta

SEQ ID NO: 93639 - DNA, 25 bp, mus musculus
tggactgcacctatgacacaagtga

SEQ ID NO: 93640 - DNA, 25 bp, mus musculus
gcacctatgacacaagtgatactaa

SEQ ID NO: 93641 - DNA, 25 bp, mus musculus
gtgatactaattacctcttgttctg

SEQ ID NO: 93642 - DNA, 25 bp, mus musculus
acctcttgttctggtacaaacagca

SEQ ID NO: 93643 - DNA, 25 bp, mus musculus
tcttgttctggtacaaacagcaagg

SEQ ID NO: 93644 - DNA, 25 bp, mus musculus
agtcacagaatggcccttcttcagg

SEQ ID NO: 93645 - DNA, 25 bp, mus musculus
atggcccttcttcaggaaagagcaa

SEQ ID NO: 93646 - DNA, 25 bp, mus musculus
tacactgatgtctatccagaaatca

SEQ ID NO: 93647 - DNA, 25 bp, mus musculus
gtctatccagaaatcattgagcgcg

SEQ ID NO: 93648 - DNA, 25 bp, mus musculus
gaaatcattgagcgcgcatgctttg

SEQ ID NO: 93649 - DNA, 25 bp, mus musculus
attgagcgcgcatgctttgtcctgg

SEQ ID NO: 93650 - DNA, 25 bp, mus musculus
catctgtatattctcatcagtaccc

SEQ ID NO: 93651 - DNA, 25 bp, mus musculus
attctcatcagtacccctgagtccc

SEQ ID NO: 93652 - DNA, 25 bp, mus musculus
ctcatcagtacccctgagtccctgg

SEQ ID NO: 93653 - DNA, 25 bp, mus musculus
acccctgagtccctggctggcatac

SEQ ID NO: 93654 - DNA, 25 bp, mus musculus
cctgagtccctggctggcatactgg

SEQ ID NO: 93655 - DNA, 25 bp, mus musculus
gagtccctggctggcatactgggaa

SEQ ID NO: 93656 - DNA, 25 bp, mus musculus
gcccttcttcaggaaagagcaaata

SEQ ID NO: 93657 - DNA, 25 bp, mus musculus
gtcaagtacctgatgcttaaagact

SEQ ID NO: 93658 - DNA, 25 bp, mus musculus
aagtacctgatgcttaaagactaca

SEQ ID NO: 93659 - DNA, 25 bp, mus musculus
acgaaggtgcccatcaagcgctcag

SEQ ID NO: 93660 - DNA, 25 bp, mus musculus
aaggtgcccatcaagcgctcagaaa

SEQ ID NO: 93661 - DNA, 25 bp, mus musculus
cccatcaagcgctcagaaatgctga

SEQ ID NO: 93662 - DNA, 25 bp, mus musculus
gatatcatccgagaatacactgatg

SEQ ID NO: 93663 - DNA, 25 bp, mus musculus
atcatccgagaatacactgatgtct

SEQ ID NO: 93664 - DNA, 25 bp, mus musculus
agatgactcctttcagtgctattgg

SEQ ID NO: 93665 - DNA, 25 bp, mus musculus
tgactcctttcagtgctattggttt

SEQ ID NO: 93666 - DNA, 25 bp, mus musculus
tgactgtagctttgccagtgttcct

SEQ ID NO: 93667 - DNA, 25 bp, mus musculus
tagctttgccagtgttccttgtgat

SEQ ID NO: 93668 - DNA, 25 bp, mus musculus
ctttgccagtgttccttgtgatcct

SEQ ID NO: 93669 - DNA, 25 bp, mus musculus
tgttccttgtgatcctcttctgctg

SEQ ID NO: 93670 - DNA, 25 bp, mus musculus
tcttctgctgttctggaaagaaaca

SEQ ID NO: 93671 - DNA, 25 bp, mus musculus
aacagtccaatgctatggagtacaa

SEQ ID NO: 93672 - DNA, 25 bp, mus musculus
ttactggcagtcaagatgaggaaga

SEQ ID NO: 93673 - DNA, 25 bp, mus musculus
atagcaagcctaaagcagaggagga

SEQ ID NO: 93674 - DNA, 25 bp, mus musculus
ttttgaacagatcgccaagaaacag

SEQ ID NO: 93675 - DNA, 25 bp, mus musculus
acagatcgccaagaaacagaaagcc

SEQ ID NO: 93676 - DNA, 25 bp, mus musculus
tcagtgctattggtttggagctctg

SEQ ID NO: 93677 - DNA, 25 bp, mus musculus
ctattggtttggagctctggtccat

SEQ ID NO: 93678 - DNA, 25 bp, mus musculus
agctctggtccatgacatccgacat

SEQ ID NO: 93679 - DNA, 25 bp, mus musculus
ggtccatgacatccgacatcttttt

SEQ ID NO: 93680 - DNA, 25 bp, mus musculus
ttgacaactttatcattagtggtga

SEQ ID NO: 93681 - DNA, 25 bp, mus musculus
tagtgctgcagatgctggaggcagc

SEQ ID NO: 93682 - DNA, 25 bp, mus musculus
catggctttgggtggtctatatttt

SEQ ID NO: 93683 - DNA, 25 bp, mus musculus
atattttgactgtagctttgccagt

SEQ ID NO: 93684 - DNA, 25 bp, mus musculus
agctcgcagctaggtgtcgcatcag

SEQ ID NO: 93685 - DNA, 25 bp, mus musculus
cagctaggtgtcgcatcagagaacc

SEQ ID NO: 93686 - DNA, 25 bp, mus musculus
tgtcatgcaccagagaactcacact

SEQ ID NO: 93687 - DNA, 25 bp, mus musculus
gaaatccttcagtcagagctacgtc

SEQ ID NO: 93688 - DNA, 25 bp, mus musculus
atccttcagtcagagctacgtcctc

SEQ ID NO: 93689 - DNA, 25 bp, mus musculus
cagtcagagctacgtcctcgtcgtt

SEQ ID NO: 93690 - DNA, 25 bp, mus musculus
cgtcgttcatcagaggacgcacact

SEQ ID NO: 93691 - DNA, 25 bp, mus musculus
caggcagagctcctgctttactcag

SEQ ID NO: 93692 - DNA, 25 bp, mus musculus
gcagagctcctgctttactcagcat

SEQ ID NO: 93693 - DNA, 25 bp, mus musculus
gagctcctgctttactcagcatcag

SEQ ID NO: 93694 - DNA, 25 bp, mus musculus
ctgctttactcagcatcagaggact

SEQ ID NO: 93695 - DNA, 25 bp, mus musculus
ctttactcagcatcagaggactcac

SEQ ID NO: 93696 - DNA, 25 bp, mus musculus
ctaggtgtcgcatcagagaacccac

SEQ ID NO: 93697 - DNA, 25 bp, mus musculus
gaagtcattcaaccggagctcacac

SEQ ID NO: 93698 - DNA, 25 bp, mus musculus
gtcattcaaccggagctcacacctt

SEQ ID NO: 93699 - DNA, 25 bp, mus musculus
caaccggagctcacaccttgtcatg

SEQ ID NO: 93700 - DNA, 25 bp, mus musculus
ccggagctcacaccttgtcatgcac

SEQ ID NO: 93701 - DNA, 25 bp, mus musculus
gagctcacaccttgtcatgcaccag

SEQ ID NO: 93702 - DNA, 25 bp, mus musculus
acaccttgtcatgcaccagagaact

SEQ ID NO: 93703 - DNA, 25 bp, mus musculus
ccttgtcatgcaccagagaactcac

SEQ ID NO: 93704 - DNA, 25 bp, mus musculus
aaacgctgtacatccaagcaaacaa

SEQ ID NO: 93705 - DNA, 25 bp, mus musculus
acgctgtacatccaagcaaacaact

SEQ ID NO: 93706 - DNA, 25 bp, mus musculus
cagcgtatctcaacggaaactggct

SEQ ID NO: 93707 - DNA, 25 bp, mus musculus
gcgtatctcaacggaaactggctct

SEQ ID NO: 93708 - DNA, 25 bp, mus musculus
gtatctcaacggaaactggctctgc

SEQ ID NO: 93709 - DNA, 25 bp, mus musculus
atctcaacggaaactggctctgctg

SEQ ID NO: 93710 - DNA, 25 bp, mus musculus
ctcaacggaaactggctctgctgcc

SEQ ID NO: 93711 - DNA, 25 bp, mus musculus
caacggaaactggctctgctgccag

SEQ ID NO: 93712 - DNA, 25 bp, mus musculus
acggaaactggctctgctgccagga

SEQ ID NO: 93713 - DNA, 25 bp, mus musculus
aaactggctctgctgccaggagacg

SEQ ID NO: 93714 - DNA, 25 bp, mus musculus
actggctctgctgccaggagacgag

SEQ ID NO: 93715 - DNA, 25 bp, mus musculus
gtgaaagcacaccaggctgcaacgt

SEQ ID NO: 93716 - DNA, 25 bp, mus musculus
tgtcctgtgcagggtgagcagatgc

SEQ ID NO: 93717 - DNA, 25 bp, mus musculus
tcctgtgcagggtgagcagatgcaa

SEQ ID NO: 93718 - DNA, 25 bp, mus musculus
agcagatgcaaccacaacaggctca

SEQ ID NO: 93719 - DNA, 25 bp, mus musculus
cagatgcaaccacaacaggctcagc

SEQ ID NO: 93720 - DNA, 25 bp, mus musculus
gatgcaaccacaacaggctcagctc

SEQ ID NO: 93721 - DNA, 25 bp, mus musculus
tgcaaccacaacaggctcagctctt

SEQ ID NO: 93722 - DNA, 25 bp, mus musculus
caaccacaacaggctcagctctttc

SEQ ID NO: 93723 - DNA, 25 bp, mus musculus
ccctcagcgtatctcaacggaaact

SEQ ID NO: 93724 - DNA, 25 bp, mus musculus
gtgtaagcttacacctggctcatgt

SEQ ID NO: 93725 - DNA, 25 bp, mus musculus
gcttacacctggctcatgtacccag

SEQ ID NO: 93726 - DNA, 25 bp, mus musculus
gtacctcctggacaacactcaatat

SEQ ID NO: 93727 - DNA, 25 bp, mus musculus
cctggacaacactcaatatgacatt

SEQ ID NO: 93728 - DNA, 25 bp, mus musculus
caacactcaatatgacattgttatc

SEQ ID NO: 93729 - DNA, 25 bp, mus musculus
tgttatccgtgttctgtaaggcagc

SEQ ID NO: 93730 - DNA, 25 bp, mus musculus
aggcagcagctttgcttgttaaggc

SEQ ID NO: 93731 - DNA, 25 bp, mus musculus
tgcttgttaaggctgggcgccccag

SEQ ID NO: 93732 - DNA, 25 bp, mus musculus
gccccagaattccatccatctcata

SEQ ID NO: 93733 - DNA, 25 bp, mus musculus
gaattccatccatctcataccaagg

SEQ ID NO: 93734 - DNA, 25 bp, mus musculus
catccatctcataccaaggagacct

SEQ ID NO: 93735 - DNA, 25 bp, mus musculus
tctcataccaaggagacctcatcca

SEQ ID NO: 93736 - DNA, 25 bp, mus musculus
acctggctcatgtacccagcctgtc

SEQ ID NO: 93737 - DNA, 25 bp, mus musculus
tacccagcctgtctgtgtttgacat

SEQ ID NO: 93738 - DNA, 25 bp, mus musculus
ctgtgtttgacatccttgcttcctg

SEQ ID NO: 93739 - DNA, 25 bp, mus musculus
ttgacatccttgcttcctgtgggca

SEQ ID NO: 93740 - DNA, 25 bp, mus musculus
cttcctgtgggcaggactgtccact

SEQ ID NO: 93741 - DNA, 25 bp, mus musculus
aggactgtccactctgaagtttctg

SEQ ID NO: 93742 - DNA, 25 bp, mus musculus
gtccactctgaagtttctgtacctc

SEQ ID NO: 93743 - DNA, 25 bp, mus musculus
gtttctgtacctcctggacaacact

SEQ ID NO: 93744 - DNA, 25 bp, mus musculus
aatgtactctacaggactgccttag

SEQ ID NO: 93745 - DNA, 25 bp, mus musculus
tacaggactgccttagataattttc

SEQ ID NO: 93746 - DNA, 25 bp, mus musculus
tagtgcacctgaaacgattttccta

SEQ ID NO: 93747 - DNA, 25 bp, mus musculus
tgcacctgaaacgattttcctatga

SEQ ID NO: 93748 - DNA, 25 bp, mus musculus
aacgattttcctatgacggcaggtg

SEQ ID NO: 93749 - DNA, 25 bp, mus musculus
gattttcctatgacggcaggtggaa

SEQ ID NO: 93750 - DNA, 25 bp, mus musculus
tttcctatgacggcaggtggaagca

SEQ ID NO: 93751 - DNA, 25 bp, mus musculus
agaagctgcaaacatccgtggattt

SEQ ID NO: 93752 - DNA, 25 bp, mus musculus
tgcaaacatccgtggatttcccatt

SEQ ID NO: 93753 - DNA, 25 bp, mus musculus
tggatttcccattggaaaatcttga

SEQ ID NO: 93754 - DNA, 25 bp, mus musculus
atcttgacctgtcacagtacgttat

SEQ ID NO: 93755 - DNA, 25 bp, mus musculus
tgtcacagtacgttattggtccaaa

SEQ ID NO: 93756 - DNA, 25 bp, mus musculus
acagattttactgcagccattgccg

SEQ ID NO: 93757 - DNA, 25 bp, mus musculus
gattttactgcagccattgccgagc

SEQ ID NO: 93758 - DNA, 25 bp, mus musculus
tctggaaattacctcctgtgctgtt

SEQ ID NO: 93759 - DNA, 25 bp, mus musculus
ggaaattacctcctgtgctgttagt

SEQ ID NO: 93760 - DNA, 25 bp, mus musculus
aattacctcctgtgctgttagtgca

SEQ ID NO: 93761 - DNA, 25 bp, mus musculus
ctcctgtgctgttagtgcacctgaa

SEQ ID NO: 93762 - DNA, 25 bp, mus musculus
ctgtgctgttagtgcacctgaaacg

SEQ ID NO: 93763 - DNA, 25 bp, mus musculus
tgctgttagtgcacctgaaacgatt

SEQ ID NO: 93764 - DNA, 25 bp, mus musculus
attcccttaatatcagatcccaagc

SEQ ID NO: 93765 - DNA, 25 bp, mus musculus
ttaatatcagatcccaagcgcacca

SEQ ID NO: 93766 - DNA, 25 bp, mus musculus
catttttctgccaggcagcattgag

SEQ ID NO: 93767 - DNA, 25 bp, mus musculus
aactcttgtactctactcgtgctta

SEQ ID NO: 93768 - DNA, 25 bp, mus musculus
ctactcgtgcttaaacacatgatgt

SEQ ID NO: 93769 - DNA, 25 bp, mus musculus
gattccagataagcctttcctacag

SEQ ID NO: 93770 - DNA, 25 bp, mus musculus
agataagcctttcctacagggctgg

SEQ ID NO: 93771 - DNA, 25 bp, mus musculus
gatagcctttcttccactattggta

SEQ ID NO: 93772 - DNA, 25 bp, mus musculus
aatggtctgagctgtgttttgggca

SEQ ID NO: 93773 - DNA, 25 bp, mus musculus
ctgagctgtgttttgggcagaccaa

SEQ ID NO: 93774 - DNA, 25 bp, mus musculus
ttgggcagaccaatcttctatcagt

SEQ ID NO: 93775 - DNA, 25 bp, mus musculus
tcacagaaaacaacctgttaattct

SEQ ID NO: 93776 - DNA, 25 bp, mus musculus
tcagatcccaagcgcaccattgctc

SEQ ID NO: 93777 - DNA, 25 bp, mus musculus
cgcaccattgctcaggattatggag

SEQ ID NO: 93778 - DNA, 25 bp, mus musculus
ggccgctctgtggatgagattatac

SEQ ID NO: 93779 - DNA, 25 bp, mus musculus
gataccatcaagcctgatgtcaata

SEQ ID NO: 93780 - DNA, 25 bp, mus musculus
atcaagcctgatgtcaataagagca

SEQ ID NO: 93781 - DNA, 25 bp, mus musculus
tatttctctaagcagaagtgagcac

SEQ ID NO: 93782 - DNA, 25 bp, mus musculus
tgagcactggaccatttttctgcca

SEQ ID NO: 93783 - DNA, 25 bp, mus musculus
ctggaccatttttctgccaggcagc

SEQ ID NO: 93784 - DNA, 25 bp, mus musculus
gaagctaacatgctttcgctactgg

SEQ ID NO: 93785 - DNA, 25 bp, mus musculus
gctaacatgctttcgctactggagg

SEQ ID NO: 93786 - DNA, 25 bp, mus musculus
gctgtcatcggccatgctgccgatc

SEQ ID NO: 93787 - DNA, 25 bp, mus musculus
gtcatcggccatgctgccgatcata

SEQ ID NO: 93788 - DNA, 25 bp, mus musculus
ggccatgctgccgatcatactcgcc

SEQ ID NO: 93789 - DNA, 25 bp, mus musculus
tccagccatgtcccgctgttctgta

SEQ ID NO: 93790 - DNA, 25 bp, mus musculus
catgtcccgctgttctgtaaatacc

SEQ ID NO: 93791 - DNA, 25 bp, mus musculus
gtcccgctgttctgtaaatacctgg

SEQ ID NO: 93792 - DNA, 25 bp, mus musculus
tacctggtgctaacatcccatgtcg

SEQ ID NO: 93793 - DNA, 25 bp, mus musculus
gcccagttcagggctggtccaggaa

SEQ ID NO: 93794 - DNA, 25 bp, mus musculus
cagttcagggctggtccaggaatgg

SEQ ID NO: 93795 - DNA, 25 bp, mus musculus
ttcagggctggtccaggaatggatg

SEQ ID NO: 93796 - DNA, 25 bp, mus musculus
tgccgctgttctgaaaccatctggc

SEQ ID NO: 93797 - DNA, 25 bp, mus musculus
cgctgttctgaaaccatctggctgg

SEQ ID NO: 93798 - DNA, 25 bp, mus musculus
tgttctgaaaccatctggctggctt

SEQ ID NO: 93799 - DNA, 25 bp, mus musculus
tctgaaaccatctggctggctttct

SEQ ID NO: 93800 - DNA, 25 bp, mus musculus
gaaaccatctggctggctttctgag

SEQ ID NO: 93801 - DNA, 25 bp, mus musculus
accatctggctggctttctgaggtc

SEQ ID NO: 93802 - DNA, 25 bp, mus musculus
tggctggctttctgaggtcaggctg

SEQ ID NO: 93803 - DNA, 25 bp, mus musculus
ctggctttctgaggtcaggctgggt

SEQ ID NO: 93804 - DNA, 25 bp, mus musculus
gttttcacatgcatgaaagaactca

SEQ ID NO: 93805 - DNA, 25 bp, mus musculus
ttttcacatgcatgaaagaactcat

SEQ ID NO: 93806 - DNA, 25 bp, mus musculus
ttgcatattgctgccatcttcaaag

SEQ ID NO: 93807 - DNA, 25 bp, mus musculus
gcatattgctgccatcttcaaaggc

SEQ ID NO: 93808 - DNA, 25 bp, mus musculus
catattgctgccatcttcaaaggca

SEQ ID NO: 93809 - DNA, 25 bp, mus musculus
atattgctgccatcttcaaaggcat

SEQ ID NO: 93810 - DNA, 25 bp, mus musculus
attgctgccatcttcaaaggcatga

SEQ ID NO: 93811 - DNA, 25 bp, mus musculus
ctgccatcttcaaaggcatgaaagg

SEQ ID NO: 93812 - DNA, 25 bp, mus musculus
tgccatcttcaaaggcatgaaaggt

SEQ ID NO: 93813 - DNA, 25 bp, mus musculus
gccatcttcaaaggcatgaaaggtg

SEQ ID NO: 93814 - DNA, 25 bp, mus musculus
catcttcaaaggcatgaaaggtgtc

SEQ ID NO: 93815 - DNA, 25 bp, mus musculus
atcttcaaaggcatgaaaggtgtca

SEQ ID NO: 93816 - DNA, 25 bp, mus musculus
ggtaaagcctttgcatattgctgcc

SEQ ID NO: 93817 - DNA, 25 bp, mus musculus
gtaaagcctttgcatattgctgcca

SEQ ID NO: 93818 - DNA, 25 bp, mus musculus
taaagcctttgcatattgctgccat

SEQ ID NO: 93819 - DNA, 25 bp, mus musculus
aagcctttgcatattgctgccatct

SEQ ID NO: 93820 - DNA, 25 bp, mus musculus
agcctttgcatattgctgccatctt

SEQ ID NO: 93821 - DNA, 25 bp, mus musculus
gcctttgcatattgctgccatcttc

SEQ ID NO: 93822 - DNA, 25 bp, mus musculus
ctttgcatattgctgccatcttcaa

SEQ ID NO: 93823 - DNA, 25 bp, mus musculus
tttgcatattgctgccatcttcaaa

SEQ ID NO: 93824 - DNA, 25 bp, mus musculus
agccatgcattccctcagagcagcc

SEQ ID NO: 93825 - DNA, 25 bp, mus musculus
ccatgcattccctcagagcagccaa

SEQ ID NO: 93826 - DNA, 25 bp, mus musculus
ttgtatgtgccgcaagacagccagt

SEQ ID NO: 93827 - DNA, 25 bp, mus musculus
agacagccagtgggtatatgctaca

SEQ ID NO: 93828 - DNA, 25 bp, mus musculus
tatatgctacagtgtgagctctaga

SEQ ID NO: 93829 - DNA, 25 bp, mus musculus
tatgctacagtgtgagctctagaaa

SEQ ID NO: 93830 - DNA, 25 bp, mus musculus
agactggttccataacagctgtgtt

SEQ ID NO: 93831 - DNA, 25 bp, mus musculus
actggttccataacagctgtgttcc

SEQ ID NO: 93832 - DNA, 25 bp, mus musculus
tggttccataacagctgtgttcccc

SEQ ID NO: 93833 - DNA, 25 bp, mus musculus
gttccataacagctgtgttcccctt

SEQ ID NO: 93834 - DNA, 25 bp, mus musculus
gggatccagctggcaggctaaagat

SEQ ID NO: 93835 - DNA, 25 bp, mus musculus
gatccagctggcaggctaaagatgt

SEQ ID NO: 93836 - DNA, 25 bp, mus musculus
gcattccctcagagcagccaaccta

SEQ ID NO: 93837 - DNA, 25 bp, mus musculus
attccctcagagcagccaacctagc

SEQ ID NO: 93838 - DNA, 25 bp, mus musculus
cctcagagcagccaacctagccaag

SEQ ID NO: 93839 - DNA, 25 bp, mus musculus
agagcagccaacctagccaagatga

SEQ ID NO: 93840 - DNA, 25 bp, mus musculus
cagccaacctagccaagatgacaat

SEQ ID NO: 93841 - DNA, 25 bp, mus musculus
gccaacctagccaagatgacaattg

SEQ ID NO: 93842 - DNA, 25 bp, mus musculus
acctagccaagatgacaattgtgga

SEQ ID NO: 93843 - DNA, 25 bp, mus musculus
aattttgtatgtgccgcaagacagc

SEQ ID NO: 93844 - DNA, 25 bp, mus musculus
ctctatgccaccagggaccttgcag

SEQ ID NO: 93845 - DNA, 25 bp, mus musculus
tatgccaccagggaccttgcagctg

SEQ ID NO: 93846 - DNA, 25 bp, mus musculus
atacatcgcatggacaagtacaatt

SEQ ID NO: 93847 - DNA, 25 bp, mus musculus
atttatgtcgcagacaaagggcaaa

SEQ ID NO: 93848 - DNA, 25 bp, mus musculus
cattttcagcaagtgttccaaatgc

SEQ ID NO: 93849 - DNA, 25 bp, mus musculus
aagatcatgggctacgactgggcgg

SEQ ID NO: 93850 - DNA, 25 bp, mus musculus
atcatgggctacgactgggcggaaa

SEQ ID NO: 93851 - DNA, 25 bp, mus musculus
tacgactgggcggaaaggtgccagc

SEQ ID NO: 93852 - DNA, 25 bp, mus musculus
aggtgccagcatgtcccctttggga

SEQ ID NO: 93853 - DNA, 25 bp, mus musculus
tgccagcatgtcccctttgggatag

SEQ ID NO: 93854 - DNA, 25 bp, mus musculus
cagcatgtcccctttgggatagtaa

SEQ ID NO: 93855 - DNA, 25 bp, mus musculus
gtcacttttctggaagatgtcttaa

SEQ ID NO: 93856 - DNA, 25 bp, mus musculus
gccaccagggaccttgcagctgcta

SEQ ID NO: 93857 - DNA, 25 bp, mus musculus
ctacagaacatggcttccattaaga

SEQ ID NO: 93858 - DNA, 25 bp, mus musculus
accagggaccttgcagctgctatac

SEQ ID NO: 93859 - DNA, 25 bp, mus musculus
agggaccttgcagctgctatacatc

SEQ ID NO: 93860 - DNA, 25 bp, mus musculus
gaccttgcagctgctatacatcgca

SEQ ID NO: 93861 - DNA, 25 bp, mus musculus
cttgcagctgctatacatcgcatgg

SEQ ID NO: 93862 - DNA, 25 bp, mus musculus
gcagctgctatacatcgcatggaca

SEQ ID NO: 93863 - DNA, 25 bp, mus musculus
gctgctatacatcgcatggacaagt

SEQ ID NO: 93864 - DNA, 25 bp, mus musculus
gctatacatcgcatggacaagtaca

SEQ ID NO: 93865 - DNA, 25 bp, mus musculus
ccgaggcgccatgggcttcatccta

SEQ ID NO: 93866 - DNA, 25 bp, mus musculus
tgacatcaccattgaggagtcatta

SEQ ID NO: 93867 - DNA, 25 bp, mus musculus
cagagcttgcccggaatctggctga

SEQ ID NO: 93868 - DNA, 25 bp, mus musculus
gagcttgcccggaatctggctgacc

SEQ ID NO: 93869 - DNA, 25 bp, mus musculus
gcttgcccggaatctggctgaccac

SEQ ID NO: 93870 - DNA, 25 bp, mus musculus
ttgcccggaatctggctgaccacct

SEQ ID NO: 93871 - DNA, 25 bp, mus musculus
gcccggaatctggctgaccacctgg

SEQ ID NO: 93872 - DNA, 25 bp, mus musculus
ggaatctggctgaccacctgggctt

SEQ ID NO: 93873 - DNA, 25 bp, mus musculus
tggctgaccacctgggctttgagtt

SEQ ID NO: 93874 - DNA, 25 bp, mus musculus
gctgaccacctgggctttgagttct

SEQ ID NO: 93875 - DNA, 25 bp, mus musculus
tgaccacctgggctttgagttcttt

SEQ ID NO: 93876 - DNA, 25 bp, mus musculus
cacctgggctttgagttctttgagg

SEQ ID NO: 93877 - DNA, 25 bp, mus musculus
atcaccattgaggagtcattaaatg

SEQ ID NO: 93878 - DNA, 25 bp, mus musculus
ccactcagatcaaaacttactggtg

SEQ ID NO: 93879 - DNA, 25 bp, mus musculus
gggacaatgcccaggtgctgctgtt

SEQ ID NO: 93880 - DNA, 25 bp, mus musculus
atgcccaggtgctgctgttgggaaa

SEQ ID NO: 93881 - DNA, 25 bp, mus musculus
atgacgcgattggtgcctcagagct

SEQ ID NO: 93882 - DNA, 25 bp, mus musculus
gtgcctcagagcttgcccggaatct

SEQ ID NO: 93883 - DNA, 25 bp, mus musculus
gcctcagagcttgcccggaatctgg

SEQ ID NO: 93884 - DNA, 25 bp, mus musculus
ctcagagcttgcccggaatctggct

SEQ ID NO: 93885 - DNA, 25 bp, mus musculus
ctgtataccaatcttttgtggcgta

SEQ ID NO: 93886 - DNA, 25 bp, mus musculus
gtataccaatcttttgtggcgtatt

SEQ ID NO: 93887 - DNA, 25 bp, mus musculus
taacttgtctggttccgtgaacaat

SEQ ID NO: 93888 - DNA, 25 bp, mus musculus
cttgtctggttccgtgaacaatggc

SEQ ID NO: 93889 - DNA, 25 bp, mus musculus
ttgtctggttccgtgaacaatggca

SEQ ID NO: 93890 - DNA, 25 bp, mus musculus
tctggttccgtgaacaatggcaatc

SEQ ID NO: 93891 - DNA, 25 bp, mus musculus
gtgaacaatggcaatcccttggcgt

SEQ ID NO: 93892 - DNA, 25 bp, mus musculus
gaacaatggcaatcccttggcgtac

SEQ ID NO: 93893 - DNA, 25 bp, mus musculus
caatggcaatcccttggcgtaccta

SEQ ID NO: 93894 - DNA, 25 bp, mus musculus
tggcaatcccttggcgtacctaata

SEQ ID NO: 93895 - DNA, 25 bp, mus musculus
ggcaatcccttggcgtacctaatag

SEQ ID NO: 93896 - DNA, 25 bp, mus musculus
caatcccttggcgtacctaatagtg

SEQ ID NO: 93897 - DNA, 25 bp, mus musculus
taccaatcttttgtggcgtatttca

SEQ ID NO: 93898 - DNA, 25 bp, mus musculus
caatcttttgtggcgtatttcaatt

SEQ ID NO: 93899 - DNA, 25 bp, mus musculus
aatcttttgtggcgtatttcaattg

SEQ ID NO: 93900 - DNA, 25 bp, mus musculus
tcaattgttcctaagattttcattc

SEQ ID NO: 93901 - DNA, 25 bp, mus musculus
agcgcatttgaacttgctgtgtaac

SEQ ID NO: 93902 - DNA, 25 bp, mus musculus
gcatttgaacttgctgtgtaacttg

SEQ ID NO: 93903 - DNA, 25 bp, mus musculus
catttgaacttgctgtgtaacttgt

SEQ ID NO: 93904 - DNA, 25 bp, mus musculus
tttgaacttgctgtgtaacttgtct

SEQ ID NO: 93905 - DNA, 25 bp, mus musculus
cgttgggactcctggaccagcagcc

SEQ ID NO: 93906 - DNA, 25 bp, mus musculus
tgggactcctggaccagcagccgga

SEQ ID NO: 93907 - DNA, 25 bp, mus musculus
gtgcccagcttccatgcccatggat

SEQ ID NO: 93908 - DNA, 25 bp, mus musculus
catgcccatggataccaggaaaagg

SEQ ID NO: 93909 - DNA, 25 bp, mus musculus
taccctggctaccgtgggctgcagt

SEQ ID NO: 93910 - DNA, 25 bp, mus musculus
ccccaggtgcagtctgtgcgtcgca

SEQ ID NO: 93911 - DNA, 25 bp, mus musculus
cgcatccgtgacatgcagtggcacc

SEQ ID NO: 93912 - DNA, 25 bp, mus musculus
atccgtgacatgcagtggcaccagc

SEQ ID NO: 93913 - DNA, 25 bp, mus musculus
gacatgcagtggcaccagcgaggtg

SEQ ID NO: 93914 - DNA, 25 bp, mus musculus
atgcagtggcaccagcgaggtgcct

SEQ ID NO: 93915 - DNA, 25 bp, mus musculus
cagtggcaccagcgaggtgccttcc

SEQ ID NO: 93916 - DNA, 25 bp, mus musculus
ctgacacccagagtgaagaataaag

SEQ ID NO: 93917 - DNA, 25 bp, mus musculus
tcctggaccagcagccggaggacag

SEQ ID NO: 93918 - DNA, 25 bp, mus musculus
tggaccagcagccggaggacagact

SEQ ID NO: 93919 - DNA, 25 bp, mus musculus
cggaggacagactccctcagctctc

SEQ ID NO: 93920 - DNA, 25 bp, mus musculus
tctctgaggcccatcaaagtggaca

SEQ ID NO: 93921 - DNA, 25 bp, mus musculus
aggcccatcaaagtggacagccaag

SEQ ID NO: 93922 - DNA, 25 bp, mus musculus
tatgagaaccccaactttactggca

SEQ ID NO: 93923 - DNA, 25 bp, mus musculus
gacgacgatgtgcccagcttccatg

SEQ ID NO: 93924 - DNA, 25 bp, mus musculus
gatgtgcccagcttccatgcccatg

SEQ ID NO: 93925 - DNA, 25 bp, mus musculus
cccagctacctctgaaacttgagtc

SEQ ID NO: 93926 - DNA, 25 bp, mus musculus
agctacctctgaaacttgagtctga

SEQ ID NO: 93927 - DNA, 25 bp, mus musculus
tgatccaggagaccatccgggaagc

SEQ ID NO: 93928 - DNA, 25 bp, mus musculus
catttgcggactgcaccatgctgac

SEQ ID NO: 93929 - DNA, 25 bp, mus musculus
cggactgcaccatgctgaccattgc

SEQ ID NO: 93930 - DNA, 25 bp, mus musculus
actgcaccatgctgaccattgccca

SEQ ID NO: 93931 - DNA, 25 bp, mus musculus
gcaccatgctgaccattgcccatcg

SEQ ID NO: 93932 - DNA, 25 bp, mus musculus
gcctgcacacagttctgggctctga

SEQ ID NO: 93933 - DNA, 25 bp, mus musculus
acacagttctgggctctgacaggat

SEQ ID NO: 93934 - DNA, 25 bp, mus musculus
cagttctgggctctgacaggatcat

SEQ ID NO: 93935 - DNA, 25 bp, mus musculus
gctctgacaggatcatggtgctggc

SEQ ID NO: 93936 - DNA, 25 bp, mus musculus
tcatggtgctggcccagggacaggt

SEQ ID NO: 93937 - DNA, 25 bp, mus musculus
tacctctgaaacttgagtctgaagt

SEQ ID NO: 93938 - DNA, 25 bp, mus musculus
aacggcagctgttgtgcatagcaag

SEQ ID NO: 93939 - DNA, 25 bp, mus musculus
gcatagcaagagccctgctgcgtca

SEQ ID NO: 93940 - DNA, 25 bp, mus musculus
gagccctgctgcgtcactgtaagat

SEQ ID NO: 93941 - DNA, 25 bp, mus musculus
ccctgctgcgtcactgtaagattct

SEQ ID NO: 93942 - DNA, 25 bp, mus musculus
tgcgtcactgtaagattctgatttt

SEQ ID NO: 93943 - DNA, 25 bp, mus musculus
atgaagctacagccgctatggacac

SEQ ID NO: 93944 - DNA, 25 bp, mus musculus
cagccgctatggacacagagacaga

SEQ ID NO: 93945 - DNA, 25 bp, mus musculus
agcaaccagggatcgtactgcaggg

SEQ ID NO: 93946 - DNA, 25 bp, mus musculus
ggatcgtactgcaggggcaatcggc

SEQ ID NO: 93947 - DNA, 25 bp, mus musculus
tcaacagcctctgattacaacatgg

SEQ ID NO: 93948 - DNA, 25 bp, mus musculus
gcctctgattacaacatggctgaga

SEQ ID NO: 93949 - DNA, 25 bp, mus musculus
tctgattacaacatggctgagatca

SEQ ID NO: 93950 - DNA, 25 bp, mus musculus
gattacaacatggctgagatcacaa

SEQ ID NO: 93951 - DNA, 25 bp, mus musculus
atcacaaatatacgccccagctttg

SEQ ID NO: 93952 - DNA, 25 bp, mus musculus
tcaccggtagcggctggcctcatcg

SEQ ID NO: 93953 - DNA, 25 bp, mus musculus
actgtctttgtgtggacgtgctgcc

SEQ ID NO: 93954 - DNA, 25 bp, mus musculus
tggacgtgctgccaccagcaggcag

SEQ ID NO: 93955 - DNA, 25 bp, mus musculus
acgtgctgccaccagcaggcagaga

SEQ ID NO: 93956 - DNA, 25 bp, mus musculus
tgctgccaccagcaggcagagaaga

SEQ ID NO: 93957 - DNA, 25 bp, mus musculus
tcgtactgcaggggcaatcggccat

SEQ ID NO: 93958 - DNA, 25 bp, mus musculus
gaggtctacagccgcggcctcggta

SEQ ID NO: 93959 - DNA, 25 bp, mus musculus
cgagattcccaaagttgtctgacct

SEQ ID NO: 93960 - DNA, 25 bp, mus musculus
gattcccaaagttgtctgacctctg

SEQ ID NO: 93961 - DNA, 25 bp, mus musculus
tcccaaagttgtctgacctctgcaa

SEQ ID NO: 93962 - DNA, 25 bp, mus musculus
ctgacctctgcaaaagtgtttctat

SEQ ID NO: 93963 - DNA, 25 bp, mus musculus
tttctatcaacagcctctgattaca

SEQ ID NO: 93964 - DNA, 25 bp, mus musculus
ctatcaacagcctctgattacaaca

SEQ ID NO: 93965 - DNA, 25 bp, mus musculus
actggagcgcccatcctgacagacg

SEQ ID NO: 93966 - DNA, 25 bp, mus musculus
gcgcccatcctgacagacgatgtca

SEQ ID NO: 93967 - DNA, 25 bp, mus musculus
tctagtgcctcttaagctggtggcc

SEQ ID NO: 93968 - DNA, 25 bp, mus musculus
agtgcctcttaagctggtggccccg

SEQ ID NO: 93969 - DNA, 25 bp, mus musculus
acaatgctgtcagattgtgctcacg

SEQ ID NO: 93970 - DNA, 25 bp, mus musculus
tcagattgtgctcacgttgttgata

SEQ ID NO: 93971 - DNA, 25 bp, mus musculus
gattgtgctcacgttgttgatagcg

SEQ ID NO: 93972 - DNA, 25 bp, mus musculus
gctcacgttgttgatagcgtcctag

SEQ ID NO: 93973 - DNA, 25 bp, mus musculus
gatagcgtcctagcaacattcacct

SEQ ID NO: 93974 - DNA, 25 bp, mus musculus
agcgtcctagcaacattcacctttc

SEQ ID NO: 93975 - DNA, 25 bp, mus musculus
gtcctagcaacattcacctttcggg

SEQ ID NO: 93976 - DNA, 25 bp, mus musculus
atgtatgtcttcaggctataatacg

SEQ ID NO: 93977 - DNA, 25 bp, mus musculus
atcctgacagacgatgtcagcctac

SEQ ID NO: 93978 - DNA, 25 bp, mus musculus
acagacgatgtcagcctacaggtgt

SEQ ID NO: 93979 - DNA, 25 bp, mus musculus
gatgtcagcctacaggtgttcatgg

SEQ ID NO: 93980 - DNA, 25 bp, mus musculus
gtcagcctacaggtgttcatggatc

SEQ ID NO: 93981 - DNA, 25 bp, mus musculus
agcctacaggtgttcatggatcacc

SEQ ID NO: 93982 - DNA, 25 bp, mus musculus
ttcatggatcacctgaagaagctgg

SEQ ID NO: 93983 - DNA, 25 bp, mus musculus
aagctggctgtgtctagtgcctctt

SEQ ID NO: 93984 - DNA, 25 bp, mus musculus
gctgtgtctagtgcctcttaagctg

SEQ ID NO: 93985 - DNA, 25 bp, mus musculus
tgcaagattgcccagctgcccttga

SEQ ID NO: 93986 - DNA, 25 bp, mus musculus
attgcccagctgcccttgacaggaa

SEQ ID NO: 93987 - DNA, 25 bp, mus musculus
aagactatccaagctgtgctgactg

SEQ ID NO: 93988 - DNA, 25 bp, mus musculus
actatccaagctgtgctgactgtcc

SEQ ID NO: 93989 - DNA, 25 bp, mus musculus
ggcgaacttaccaagtctctgcagg

SEQ ID NO: 93990 - DNA, 25 bp, mus musculus
accaagtctctgcaggacatgaagc

SEQ ID NO: 93991 - DNA, 25 bp, mus musculus
aagtctctgcaggacatgaagctac

SEQ ID NO: 93992 - DNA, 25 bp, mus musculus
aagctacagtcgttgtttgaatcac

SEQ ID NO: 93993 - DNA, 25 bp, mus musculus
ttgtttgaatcacccgacttcagca

SEQ ID NO: 93994 - DNA, 25 bp, mus musculus
tttgaatcacccgacttcagcaaga

SEQ ID NO: 93995 - DNA, 25 bp, mus musculus
cccgacttcagcaagattactggca

SEQ ID NO: 93996 - DNA, 25 bp, mus musculus
gacttcagcaagattactggcaaac

SEQ ID NO: 93997 - DNA, 25 bp, mus musculus
cagctgcccttgacaggaagtatga

SEQ ID NO: 93998 - DNA, 25 bp, mus musculus
ctgcccttgacaggaagtatgagca

SEQ ID NO: 93999 - DNA, 25 bp, mus musculus
agtatgagcatcatcttcttcctgc

SEQ ID NO: 94000 - DNA, 25 bp, mus musculus
accgtgacccagaacttgaccatga

SEQ ID NO: 94001 - DNA, 25 bp, mus musculus
gtgacccagaacttgaccatgatag

SEQ ID NO: 94002 - DNA, 25 bp, mus musculus
ctcacctctgagttcattcatgaca

SEQ ID NO: 94003 - DNA, 25 bp, mus musculus
attcatgacatcgaccgagaactga

SEQ ID NO: 94004 - DNA, 25 bp, mus musculus
ctgaagactatccaagctgtgctga

SEQ ID NO: 94005 - DNA, 25 bp, mus musculus
tgaggccatcgcagagcttgataca

SEQ ID NO: 94006 - DNA, 25 bp, mus musculus
ggccatcgcagagcttgatacactg

SEQ ID NO: 94007 - DNA, 25 bp, mus musculus
cccttttagcatctcattccttaat

SEQ ID NO: 94008 - DNA, 25 bp, mus musculus
ttttagcatctcattccttaatccc

SEQ ID NO: 94009 - DNA, 25 bp, mus musculus
tagcatctcattccttaatcccact

SEQ ID NO: 94010 - DNA, 25 bp, mus musculus
catctcattccttaatcccactgga

SEQ ID NO: 94011 - DNA, 25 bp, mus musculus
ctcattccttaatcccactggagat

SEQ ID NO: 94012 - DNA, 25 bp, mus musculus
attccttaatcccactggagattct

SEQ ID NO: 94013 - DNA, 25 bp, mus musculus
ccttaatcccactggagattctctt

SEQ ID NO: 94014 - DNA, 25 bp, mus musculus
taatcccactggagattctcttgga

SEQ ID NO: 94015 - DNA, 25 bp, mus musculus
tcccactggagattctcttggaagg

SEQ ID NO: 94016 - DNA, 25 bp, mus musculus
gaagcgacttctgtgtataggatca

SEQ ID NO: 94017 - DNA, 25 bp, mus musculus
tacactgaacgaagactccttcaaa

SEQ ID NO: 94018 - DNA, 25 bp, mus musculus
gaacgaagactccttcaaaagacag

SEQ ID NO: 94019 - DNA, 25 bp, mus musculus
cgaagactccttcaaaagacagcac

SEQ ID NO: 94020 - DNA, 25 bp, mus musculus
agactccttcaaaagacagcaccct

SEQ ID NO: 94021 - DNA, 25 bp, mus musculus
gcaccctcatcatgcagttgcttgg

SEQ ID NO: 94022 - DNA, 25 bp, mus musculus
cttaaggccatccagggcacaaact

SEQ ID NO: 94023 - DNA, 25 bp, mus musculus
gccatccagggcacaaacttccttc

SEQ ID NO: 94024 - DNA, 25 bp, mus musculus
ttcaggaaacccttttagcatctca

SEQ ID NO: 94025 - DNA, 25 bp, mus musculus
caacccagaccagttcagaactctt

SEQ ID NO: 94026 - DNA, 25 bp, mus musculus
cccagaccagttcagaactcttggt

SEQ ID NO: 94027 - DNA, 25 bp, mus musculus
tgaacgtgctgttcgacaagttttt

SEQ ID NO: 94028 - DNA, 25 bp, mus musculus
acgtgctgttcgacaagtttttcag

SEQ ID NO: 94029 - DNA, 25 bp, mus musculus
tcgacaagtttttcagcgagccaag

SEQ ID NO: 94030 - DNA, 25 bp, mus musculus
agtttttcagcgagccaagaactca

SEQ ID NO: 94031 - DNA, 25 bp, mus musculus
ttttcagcgagccaagaactcagcc

SEQ ID NO: 94032 - DNA, 25 bp, mus musculus
ggatgctttatgtcctcggagatca

SEQ ID NO: 94033 - DNA, 25 bp, mus musculus
tgctttatgtcctcggagatcagac

SEQ ID NO: 94034 - DNA, 25 bp, mus musculus
tttatgtcctcggagatcagaccga

SEQ ID NO: 94035 - DNA, 25 bp, mus musculus
atgtcctcggagatcagaccgagaa

SEQ ID NO: 94036 - DNA, 25 bp, mus musculus
tcctcggagatcagaccgagaaaca

SEQ ID NO: 94037 - DNA, 25 bp, mus musculus
tcttggtttggggactccagctggc

SEQ ID NO: 94038 - DNA, 25 bp, mus musculus
gactccagctggcatcctcctagct

SEQ ID NO: 94039 - DNA, 25 bp, mus musculus
aactctgctagcaaaggctgtggca

SEQ ID NO: 94040 - DNA, 25 bp, mus musculus
tctgctagcaaaggctgtggcaaat

SEQ ID NO: 94041 - DNA, 25 bp, mus musculus
ttttatatctgtcaaaggccctgaa

SEQ ID NO: 94042 - DNA, 25 bp, mus musculus
atctgtcaaaggccctgaattattg

SEQ ID NO: 94043 - DNA, 25 bp, mus musculus
tgtcaaaggccctgaattattgaat

SEQ ID NO: 94044 - DNA, 25 bp, mus musculus
caaaggccctgaattattgaatatg

SEQ ID NO: 94045 - DNA, 25 bp, mus musculus
ctttcaacaaatctctctatgaggg

SEQ ID NO: 94046 - DNA, 25 bp, mus musculus
tcactgtcatcttcctgaaagagga

SEQ ID NO: 94047 - DNA, 25 bp, mus musculus
atcaacaactgaacttggagagcac

SEQ ID NO: 94048 - DNA, 25 bp, mus musculus
acagtctgctccaagattagccccc

SEQ ID NO: 94049 - DNA, 25 bp, mus musculus
ttactctccttaggacgatcaagca

SEQ ID NO: 94050 - DNA, 25 bp, mus musculus
gttcatagccacacactatgcccac

SEQ ID NO: 94051 - DNA, 25 bp, mus musculus
acactatgcccacagtgtcttgtga

SEQ ID NO: 94052 - DNA, 25 bp, mus musculus
tgcccacagtgtcttgtgaattgag

SEQ ID NO: 94053 - DNA, 25 bp, mus musculus
ttttacagcagtgcctttaatgagc

SEQ ID NO: 94054 - DNA, 25 bp, mus musculus
cacggttcccagtttgccatgcgtt

SEQ ID NO: 94055 - DNA, 25 bp, mus musculus
tcccagtttgccatgcgttttgatg

SEQ ID NO: 94056 - DNA, 25 bp, mus musculus
tttgccatgcgttttgatgactgat

SEQ ID NO: 94057 - DNA, 25 bp, mus musculus
tcatcttcctgaaagaggaggagac

SEQ ID NO: 94058 - DNA, 25 bp, mus musculus
cacgctctttgcctctcatcattgg

SEQ ID NO: 94059 - DNA, 25 bp, mus musculus
ctttgcctctcatcattggcagcag

SEQ ID NO: 94060 - DNA, 25 bp, mus musculus
ctctcatcattggcagcagcatcgg

SEQ ID NO: 94061 - DNA, 25 bp, mus musculus
tcattggcagcagcatcggaggcct

SEQ ID NO: 94062 - DNA, 25 bp, mus musculus
gaggcctcctggtcttggttgtgat

SEQ ID NO: 94063 - DNA, 25 bp, mus musculus
tcctggtcttggttgtgattatagc

SEQ ID NO: 94064 - DNA, 25 bp, mus musculus
ttatagccattttgttcaagtgtgg

SEQ ID NO: 94065 - DNA, 25 bp, mus musculus
cccttcaaatgtgatcaatgtgata

SEQ ID NO: 94066 - DNA, 25 bp, mus musculus
taaagctttgacacaacactctact

SEQ ID NO: 94067 - DNA, 25 bp, mus musculus
acactctactcttcagactcataga

SEQ ID NO: 94068 - DNA, 25 bp, mus musculus
cactctactcttcagactcatagaa

SEQ ID NO: 94069 - DNA, 25 bp, mus musculus
actctactcttcagactcatagaag

SEQ ID NO: 94070 - DNA, 25 bp, mus musculus
ctctactcttcagactcatagaaga

SEQ ID NO: 94071 - DNA, 25 bp, mus musculus
tctactcttcagactcatagaagaa

SEQ ID NO: 94072 - DNA, 25 bp, mus musculus
ctactcttcagactcatagaagaac

SEQ ID NO: 94073 - DNA, 25 bp, mus musculus
tactcttcagactcatagaagaaca

SEQ ID NO: 94074 - DNA, 25 bp, mus musculus
actcttcagactcatagaagaacac

SEQ ID NO: 94075 - DNA, 25 bp, mus musculus
ctcttcagactcatagaagaacaca

SEQ ID NO: 94076 - DNA, 25 bp, mus musculus
tcttcagactcatagaagaacacat

SEQ ID NO: 94077 - DNA, 25 bp, mus musculus
aaagctttgacacaacactctactc

SEQ ID NO: 94078 - DNA, 25 bp, mus musculus
aagctttgacacaacactctactct

SEQ ID NO: 94079 - DNA, 25 bp, mus musculus
agctttgacacaacactctactctt

SEQ ID NO: 94080 - DNA, 25 bp, mus musculus
gacacaacactctactcttcagact

SEQ ID NO: 94081 - DNA, 25 bp, mus musculus
cacaacactctactcttcagactca

SEQ ID NO: 94082 - DNA, 25 bp, mus musculus
acaacactctactcttcagactcat

SEQ ID NO: 94083 - DNA, 25 bp, mus musculus
caacactctactcttcagactcata

SEQ ID NO: 94084 - DNA, 25 bp, mus musculus
aacactctactcttcagactcatag

SEQ ID NO: 94085 - DNA, 25 bp, mus musculus
cgtaatggttgctgctagtgttggt

SEQ ID NO: 94086 - DNA, 25 bp, mus musculus
tgaagctggcatctccagaacaggt

SEQ ID NO: 94087 - DNA, 25 bp, mus musculus
acctatacaatcacaagagatacga

SEQ ID NO: 94088 - DNA, 25 bp, mus musculus
ctatacaatcacaagagatacgagt

SEQ ID NO: 94089 - DNA, 25 bp, mus musculus
aggagctcattacctagatgtagaa

SEQ ID NO: 94090 - DNA, 25 bp, mus musculus
gctcattacctagatgtagaagatt

SEQ ID NO: 94091 - DNA, 25 bp, mus musculus
tcattacctagatgtagaagattgg

SEQ ID NO: 94092 - DNA, 25 bp, mus musculus
tggctacaacgtctgacacagtaga

SEQ ID NO: 94093 - DNA, 25 bp, mus musculus
gctacaacgtctgacacagtagaat

SEQ ID NO: 94094 - DNA, 25 bp, mus musculus
caacgtctgacacagtagaataggt

SEQ ID NO: 94095 - DNA, 25 bp, mus musculus
acgtctgacacagtagaataggtgc

SEQ ID NO: 94096 - DNA, 25 bp, mus musculus
caaatttctcgtaggaatggtgaca

SEQ ID NO: 94097 - DNA, 25 bp, mus musculus
aagctggcatctccagaacaggtag

SEQ ID NO: 94098 - DNA, 25 bp, mus musculus
gctggcatctccagaacaggtagac

SEQ ID NO: 94099 - DNA, 25 bp, mus musculus
tggcatctccagaacaggtagaccc

SEQ ID NO: 94100 - DNA, 25 bp, mus musculus
atctccagaacaggtagacccgcga

SEQ ID NO: 94101 - DNA, 25 bp, mus musculus
aatggattcgacctatccacctata

SEQ ID NO: 94102 - DNA, 25 bp, mus musculus
tggattcgacctatccacctataca

SEQ ID NO: 94103 - DNA, 25 bp, mus musculus
gattcgacctatccacctatacaat

SEQ ID NO: 94104 - DNA, 25 bp, mus musculus
atccacctatacaatcacaagagat

SEQ ID NO: 94105 - DNA, 25 bp, mus musculus
ggcaattgtaccctgtagagaacgg

SEQ ID NO: 94106 - DNA, 25 bp, mus musculus
tgtaccctgtagagaacggccatcg

SEQ ID NO: 94107 - DNA, 25 bp, mus musculus
tgtccaggcagcggttcgaactgga

SEQ ID NO: 94108 - DNA, 25 bp, mus musculus
caggcagcggttcgaactggagaca

SEQ ID NO: 94109 - DNA, 25 bp, mus musculus
aagtctcaaaggtttcagcgtgatc

SEQ ID NO: 94110 - DNA, 25 bp, mus musculus
gtctcaaaggtttcagcgtgatcgg

SEQ ID NO: 94111 - DNA, 25 bp, mus musculus
aaggtttcagcgtgatcggcacttg

SEQ ID NO: 94112 - DNA, 25 bp, mus musculus
tttcagcgtgatcggcacttggttg

SEQ ID NO: 94113 - DNA, 25 bp, mus musculus
tcagcgtgatcggcacttggttgtc

SEQ ID NO: 94114 - DNA, 25 bp, mus musculus
cgtgatcggcacttggttgtcaatc

SEQ ID NO: 94115 - DNA, 25 bp, mus musculus
tgatcggcacttggttgtcaatcct

SEQ ID NO: 94116 - DNA, 25 bp, mus musculus
caatcctattgcgcatgggactgga

SEQ ID NO: 94117 - DNA, 25 bp, mus musculus
taccctgtagagaacggccatcgag

SEQ ID NO: 94118 - DNA, 25 bp, mus musculus
cctattgcgcatgggactggaactg

SEQ ID NO: 94119 - DNA, 25 bp, mus musculus
agaacggccatcgagagatcaagct

SEQ ID NO: 94120 - DNA, 25 bp, mus musculus
aacggccatcgagagatcaagctgg

SEQ ID NO: 94121 - DNA, 25 bp, mus musculus
aaacttgtgtatcactgcttcaata

SEQ ID NO: 94122 - DNA, 25 bp, mus musculus
acttgtgtatcactgcttcaataga

SEQ ID NO: 94123 - DNA, 25 bp, mus musculus
gtgtatcactgcttcaatagacaag

SEQ ID NO: 94124 - DNA, 25 bp, mus musculus
gtatcactgcttcaatagacaagag

SEQ ID NO: 94125 - DNA, 25 bp, mus musculus
gctgtccaggcagcggttcgaactg

SEQ ID NO: 94126 - DNA, 25 bp, mus musculus
agcatatgtgccaatttctgcgttg

SEQ ID NO: 94127 - DNA, 25 bp, mus musculus
tatgtgccaatttctgcgttggaat

SEQ ID NO: 94128 - DNA, 25 bp, mus musculus
atagaccacagctgctggaagctct

SEQ ID NO: 94129 - DNA, 25 bp, mus musculus
cacagctgctggaagctctggatag

SEQ ID NO: 94130 - DNA, 25 bp, mus musculus
cagctgctggaagctctggatagta

SEQ ID NO: 94131 - DNA, 25 bp, mus musculus
taccacgaactcgtccacactgaca

SEQ ID NO: 94132 - DNA, 25 bp, mus musculus
acgaactcgtccacactgacaacac

SEQ ID NO: 94133 - DNA, 25 bp, mus musculus
gtccacactgacaacacccttcgaa

SEQ ID NO: 94134 - DNA, 25 bp, mus musculus
ccacactgacaacacccttcgaatg

SEQ ID NO: 94135 - DNA, 25 bp, mus musculus
acactgacaacacccttcgaatgcc

SEQ ID NO: 94136 - DNA, 25 bp, mus musculus
gaggcattgcacattgccgttggcc

SEQ ID NO: 94137 - DNA, 25 bp, mus musculus
ggcattgcacattgccgttggcctg

SEQ ID NO: 94138 - DNA, 25 bp, mus musculus
tttctgcgttggaatggtgacatac

SEQ ID NO: 94139 - DNA, 25 bp, mus musculus
catacatgctagagccaagtgctaa

SEQ ID NO: 94140 - DNA, 25 bp, mus musculus
gatggaacgtcaccgcaaagatcgt

SEQ ID NO: 94141 - DNA, 25 bp, mus musculus
tggaacgtcaccgcaaagatcgtag

SEQ ID NO: 94142 - DNA, 25 bp, mus musculus
gaacgtcaccgcaaagatcgtagct

SEQ ID NO: 94143 - DNA, 25 bp, mus musculus
gtcaccgcaaagatcgtagctgcaa

SEQ ID NO: 94144 - DNA, 25 bp, mus musculus
tgcaatagaccacagctgctggaag

SEQ ID NO: 94145 - DNA, 25 bp, mus musculus
caatagaccacagctgctggaagct

SEQ ID NO: 94146 - DNA, 25 bp, mus musculus
cgctgcgtacaccgtgacctggctg

SEQ ID NO: 94147 - DNA, 25 bp, mus musculus
gcgcgcaacatcttggtggagagcg

SEQ ID NO: 94148 - DNA, 25 bp, mus musculus
aagagctgcagcccatccgctgagt

SEQ ID NO: 94149 - DNA, 25 bp, mus musculus
tgcagcccatccgctgagttcctgc

SEQ ID NO: 94150 - DNA, 25 bp, mus musculus
gctgagttcctgcgcatgatggggc

SEQ ID NO: 94151 - DNA, 25 bp, mus musculus
ttcctgcgcatgatggggcctgagc

SEQ ID NO: 94152 - DNA, 25 bp, mus musculus
ctcctggagctgctggcagagggcc

SEQ ID NO: 94153 - DNA, 25 bp, mus musculus
gagctcatgcagctgtgcgtggcgc

SEQ ID NO: 94154 - DNA, 25 bp, mus musculus
gaccccggatagcagccaggggcga

SEQ ID NO: 94155 - DNA, 25 bp, mus musculus
agctgctgcagtggctagagcagag

SEQ ID NO: 94156 - DNA, 25 bp, mus musculus
agcagagacatctcctgcacgcgct

SEQ ID NO: 94157 - DNA, 25 bp, mus musculus
gacatctcctgcacgcgctggtggc

SEQ ID NO: 94158 - DNA, 25 bp, mus musculus
aagatcgcggacttcggcctcgcta

SEQ ID NO: 94159 - DNA, 25 bp, mus musculus
acatctcctgcacgcgctggtggcc

SEQ ID NO: 94160 - DNA, 25 bp, mus musculus
gcggacttcggcctcgctaagctgc

SEQ ID NO: 94161 - DNA, 25 bp, mus musculus
ctcgctaagctgctgcccctgggaa

SEQ ID NO: 94162 - DNA, 25 bp, mus musculus
aagctgctgcccctgggaaaggact

SEQ ID NO: 94163 - DNA, 25 bp, mus musculus
tatgccccggagtccctatctgaca

SEQ ID NO: 94164 - DNA, 25 bp, mus musculus
cgccaatctgacgtgtggagcttcg

SEQ ID NO: 94165 - DNA, 25 bp, mus musculus
agcttcggagtggtgttgtacgagc

SEQ ID NO: 94166 - DNA, 25 bp, mus musculus
acctactgcgacaagagctgcagcc

SEQ ID NO: 94167 - DNA, 25 bp, mus musculus
ttcggatccatgcagaattttccag

SEQ ID NO: 94168 - DNA, 25 bp, mus musculus
tccatgcagaattttccagttccag

SEQ ID NO: 94169 - DNA, 25 bp, mus musculus
ctggctgggactcctgagaattgca

SEQ ID NO: 94170 - DNA, 25 bp, mus musculus
aattgcagcttcaacattcggactt

SEQ ID NO: 94171 - DNA, 25 bp, mus musculus
tgcagcttcaacattcggacttttg

SEQ ID NO: 94172 - DNA, 25 bp, mus musculus
ttcaatgctaacctctccgtaaact

SEQ ID NO: 94173 - DNA, 25 bp, mus musculus
attctgagtcgccaagacatcgccg

SEQ ID NO: 94174 - DNA, 25 bp, mus musculus
ctgagtcgccaagacatcgccggta

SEQ ID NO: 94175 - DNA, 25 bp, mus musculus
cgccaagacatcgccggtaatccag

SEQ ID NO: 94176 - DNA, 25 bp, mus musculus
caagacatcgccggtaatccagagg

SEQ ID NO: 94177 - DNA, 25 bp, mus musculus
gacatcgccggtaatccagaggtca

SEQ ID NO: 94178 - DNA, 25 bp, mus musculus
atcgccggtaatccagaggtcagag

SEQ ID NO: 94179 - DNA, 25 bp, mus musculus
cagaattttccagttccagtgcaga

SEQ ID NO: 94180 - DNA, 25 bp, mus musculus
aattttccagttccagtgcagactc

SEQ ID NO: 94181 - DNA, 25 bp, mus musculus
ccagttccagtgcagactcaggggg

SEQ ID NO: 94182 - DNA, 25 bp, mus musculus
gtgcagactcagggggctcatcata

SEQ ID NO: 94183 - DNA, 25 bp, mus musculus
cgtctcagattggctttcaggatgc

SEQ ID NO: 94184 - DNA, 25 bp, mus musculus
ctcagattggctttcaggatgcggt

SEQ ID NO: 94185 - DNA, 25 bp, mus musculus
agattggctttcaggatgcggtaca

SEQ ID NO: 94186 - DNA, 25 bp, mus musculus
cagctggctgggactcctgagaatt

SEQ ID NO: 94187 - DNA, 25 bp, mus musculus
cccaccaatggaaacagctaggatc

SEQ ID NO: 94188 - DNA, 25 bp, mus musculus
aacagctaggatcactgctcaagtg

SEQ ID NO: 94189 - DNA, 25 bp, mus musculus
tatggtacctggcaacgccagtgtg

SEQ ID NO: 94190 - DNA, 25 bp, mus musculus
atggtacctggcaacgccagtgtgt

SEQ ID NO: 94191 - DNA, 25 bp, mus musculus
tggtacctggcaacgccagtgtgtc

SEQ ID NO: 94192 - DNA, 25 bp, mus musculus
tacctggcaacgccagtgtgtcgag

SEQ ID NO: 94193 - DNA, 25 bp, mus musculus
acctggcaacgccagtgtgtcgaga

SEQ ID NO: 94194 - DNA, 25 bp, mus musculus
cctggcaacgccagtgtgtcgagag

SEQ ID NO: 94195 - DNA, 25 bp, mus musculus
tggcaacgccagtgtgtcgagagct

SEQ ID NO: 94196 - DNA, 25 bp, mus musculus
ggcaacgccagtgtgtcgagagctt

SEQ ID NO: 94197 - DNA, 25 bp, mus musculus
gcaacgccagtgtgtcgagagcttc

SEQ ID NO: 94198 - DNA, 25 bp, mus musculus
caacgccagtgtgtcgagagcttct

SEQ ID NO: 94199 - DNA, 25 bp, mus musculus
acagctaggatcactgctcaagtga

SEQ ID NO: 94200 - DNA, 25 bp, mus musculus
aacgccagtgtgtcgagagcttctc

SEQ ID NO: 94201 - DNA, 25 bp, mus musculus
cagctaggatcactgctcaagtgat

SEQ ID NO: 94202 - DNA, 25 bp, mus musculus
agctaggatcactgctcaagtgatt

SEQ ID NO: 94203 - DNA, 25 bp, mus musculus
gaacgacacacagcccacatagcaa

SEQ ID NO: 94204 - DNA, 25 bp, mus musculus
aacgacacacagcccacatagcaag

SEQ ID NO: 94205 - DNA, 25 bp, mus musculus
agcaagtctgctgagcttaaagcag

SEQ ID NO: 94206 - DNA, 25 bp, mus musculus
tgatatggtacctggcaacgccagt

SEQ ID NO: 94207 - DNA, 25 bp, mus musculus
atatggtacctggcaacgccagtgt

SEQ ID NO: 94208 - DNA, 25 bp, mus musculus
ggcctgcagctgctggatgctctgg

SEQ ID NO: 94209 - DNA, 25 bp, mus musculus
gttcacgggaacctgacagctgaga

SEQ ID NO: 94210 - DNA, 25 bp, mus musculus
cacgtggcctacaaagaaggcagca

SEQ ID NO: 94211 - DNA, 25 bp, mus musculus
aggagtccacacgatggggacttgg

SEQ ID NO: 94212 - DNA, 25 bp, mus musculus
agtccacacgatggggacttggagt

SEQ ID NO: 94213 - DNA, 25 bp, mus musculus
ccacacgatggggacttggagttca

SEQ ID NO: 94214 - DNA, 25 bp, mus musculus
ggacctgcacaagggatgcggacct

SEQ ID NO: 94215 - DNA, 25 bp, mus musculus
cgccgcagcgatctccagaccttgg

SEQ ID NO: 94216 - DNA, 25 bp, mus musculus
cgcagcgatctccagaccttgggct

SEQ ID NO: 94217 - DNA, 25 bp, mus musculus
gatctccagaccttgggctactgta

SEQ ID NO: 94218 - DNA, 25 bp, mus musculus
ctccagaccttgggctactgtatgc

SEQ ID NO: 94219 - DNA, 25 bp, mus musculus
cagaccttgggctactgtatgctca

SEQ ID NO: 94220 - DNA, 25 bp, mus musculus
cacgggaacctgacagctgagaatg

SEQ ID NO: 94221 - DNA, 25 bp, mus musculus
aatgtctttgtgaatccagaggatc

SEQ ID NO: 94222 - DNA, 25 bp, mus musculus
caggtgaccctggtgggctatggct

SEQ ID NO: 94223 - DNA, 25 bp, mus musculus
tatggcttcacctaccgatactgcc

SEQ ID NO: 94224 - DNA, 25 bp, mus musculus
ttcacctaccgatactgcccaggtg

SEQ ID NO: 94225 - DNA, 25 bp, mus musculus
taccgatactgcccaggtggcaaac

SEQ ID NO: 94226 - DNA, 25 bp, mus musculus
cgatactgcccaggtggcaaacacg

SEQ ID NO: 94227 - DNA, 25 bp, mus musculus
tactgcccaggtggcaaacacgtgg

SEQ ID NO: 94228 - DNA, 25 bp, mus musculus
gagcgcagacaccctctggggaatc

SEQ ID NO: 94229 - DNA, 25 bp, mus musculus
acttcactgtccaggctgcagcagg

SEQ ID NO: 94230 - DNA, 25 bp, mus musculus
ctgcaccaaacagcctaggccgacg

SEQ ID NO: 94231 - DNA, 25 bp, mus musculus
aagtcgtataacctggctccagtgt

SEQ ID NO: 94232 - DNA, 25 bp, mus musculus
ctggctccagtgtgtacgtccatga

SEQ ID NO: 94233 - DNA, 25 bp, mus musculus
ccagtgtgtacgtccatgatgcata

SEQ ID NO: 94234 - DNA, 25 bp, mus musculus
tgtacgtccatgatgcatatcttgt

SEQ ID NO: 94235 - DNA, 25 bp, mus musculus
tccatgatgcatatcttgtgcataa

SEQ ID NO: 94236 - DNA, 25 bp, mus musculus
attatatgtgtctgtagtgtgcatt

SEQ ID NO: 94237 - DNA, 25 bp, mus musculus
tgtgtctgtagtgtgcattgcaata

SEQ ID NO: 94238 - DNA, 25 bp, mus musculus
tgatggaaccaaccacccaagtgtc

SEQ ID NO: 94239 - DNA, 25 bp, mus musculus
ccacccaagtgtcatgccaaataaa

SEQ ID NO: 94240 - DNA, 25 bp, mus musculus
ctgtccaggctgcagcagggcttct

SEQ ID NO: 94241 - DNA, 25 bp, mus musculus
cctgctgccaagtggtacttgtgta

SEQ ID NO: 94242 - DNA, 25 bp, mus musculus
agtggtgacctggttagtgtgacag

SEQ ID NO: 94243 - DNA, 25 bp, mus musculus
ctgtctctgagacacactgccaact

SEQ ID NO: 94244 - DNA, 25 bp, mus musculus
ctgagacacactgccaactgcaggc

SEQ ID NO: 94245 - DNA, 25 bp, mus musculus
cacactgccaactgcaggcttcgat

SEQ ID NO: 94246 - DNA, 25 bp, mus musculus
gccaactgcaggcttcgattacccc

SEQ ID NO: 94247 - DNA, 25 bp, mus musculus
cttcgattacccctgtgagcctgct

SEQ ID NO: 94248 - DNA, 25 bp, mus musculus
cccctgtcagtcgagttctcgggag

SEQ ID NO: 94249 - DNA, 25 bp, mus musculus
cctgtcagtcgagttctcgggagag

SEQ ID NO: 94250 - DNA, 25 bp, mus musculus
tcattttggtggtcctgttgattcg

SEQ ID NO: 94251 - DNA, 25 bp, mus musculus
attttggtggtcctgttgattcgag

SEQ ID NO: 94252 - DNA, 25 bp, mus musculus
tttggtggtcctgttgattcgagga

SEQ ID NO: 94253 - DNA, 25 bp, mus musculus
gtggtcctgttgattcgaggagtga

SEQ ID NO: 94254 - DNA, 25 bp, mus musculus
ggtcctgttgattcgaggagtgaca

SEQ ID NO: 94255 - DNA, 25 bp, mus musculus
tcctgttgattcgaggagtgacact

SEQ ID NO: 94256 - DNA, 25 bp, mus musculus
agtgacactgcccggagcagcccaa

SEQ ID NO: 94257 - DNA, 25 bp, mus musculus
actgcccggagcagcccaaggaatt

SEQ ID NO: 94258 - DNA, 25 bp, mus musculus
cccggagcagcccaaggaattcagt

SEQ ID NO: 94259 - DNA, 25 bp, mus musculus
gagcagcccaaggaattcagtttta

SEQ ID NO: 94260 - DNA, 25 bp, mus musculus
ggcgagtcctgaagctctcggatgg

SEQ ID NO: 94261 - DNA, 25 bp, mus musculus
cgagtcctgaagctctcggatggca

SEQ ID NO: 94262 - DNA, 25 bp, mus musculus
agtcctgaagctctcggatggcatc

SEQ ID NO: 94263 - DNA, 25 bp, mus musculus
agctctcggatggcatccagcacct

SEQ ID NO: 94264 - DNA, 25 bp, mus musculus
ctctcggatggcatccagcacctgg

SEQ ID NO: 94265 - DNA, 25 bp, mus musculus
gatggcatccagcacctggggtccc

SEQ ID NO: 94266 - DNA, 25 bp, mus musculus
aactggtcctgtgcctcctgctcgc

SEQ ID NO: 94267 - DNA, 25 bp, mus musculus
cctcattttggtggtcctgttgatt

SEQ ID NO: 94268 - DNA, 25 bp, mus musculus
gtttttcgcgagactgagccacgcg

SEQ ID NO: 94269 - DNA, 25 bp, mus musculus
ttttcgcgagactgagccacgcgtc

SEQ ID NO: 94270 - DNA, 25 bp, mus musculus
ccacgcgtctatcttctgtcccagg

SEQ ID NO: 94271 - DNA, 25 bp, mus musculus
cacgcgtctatcttctgtcccaggg

SEQ ID NO: 94272 - DNA, 25 bp, mus musculus
gcgtctatcttctgtcccagggccg

SEQ ID NO: 94273 - DNA, 25 bp, mus musculus
cgtctatcttctgtcccagggccgc

SEQ ID NO: 94274 - DNA, 25 bp, mus musculus
gtctatcttctgtcccagggccgcc

SEQ ID NO: 94275 - DNA, 25 bp, mus musculus
atcttctgtcccagggccgccgtca

SEQ ID NO: 94276 - DNA, 25 bp, mus musculus
ttgagcagcgcgccttcccaagcta

SEQ ID NO: 94277 - DNA, 25 bp, mus musculus
tgagcagcgcgccttcccaagctat

SEQ ID NO: 94278 - DNA, 25 bp, mus musculus
agcgcgccttcccaagctatttcag

SEQ ID NO: 94279 - DNA, 25 bp, mus musculus
cgcgccttcccaagctatttcagca

SEQ ID NO: 94280 - DNA, 25 bp, mus musculus
tttcgcgagactgagccacgcgtct

SEQ ID NO: 94281 - DNA, 25 bp, mus musculus
ttcgcgagactgagccacgcgtcta

SEQ ID NO: 94282 - DNA, 25 bp, mus musculus
tcgcgagactgagccacgcgtctat

SEQ ID NO: 94283 - DNA, 25 bp, mus musculus
agactgagccacgcgtctatcttct

SEQ ID NO: 94284 - DNA, 25 bp, mus musculus
actgagccacgcgtctatcttctgt

SEQ ID NO: 94285 - DNA, 25 bp, mus musculus
ctgagccacgcgtctatcttctgtc

SEQ ID NO: 94286 - DNA, 25 bp, mus musculus
tgagccacgcgtctatcttctgtcc

SEQ ID NO: 94287 - DNA, 25 bp, mus musculus
gccacgcgtctatcttctgtcccag

SEQ ID NO: 94288 - DNA, 25 bp, mus musculus
gagtgcacctggctgatattccagt

SEQ ID NO: 94289 - DNA, 25 bp, mus musculus
acctggctgatattccagttctctg

SEQ ID NO: 94290 - DNA, 25 bp, mus musculus
ttcccccagggcagttcacggccat

SEQ ID NO: 94291 - DNA, 25 bp, mus musculus
ggcagttcacggccatcttcggggc

SEQ ID NO: 94292 - DNA, 25 bp, mus musculus
cggccatcttcggggccgtgcagct

SEQ ID NO: 94293 - DNA, 25 bp, mus musculus
tgtgtgcgccgcatggtcagtttca

SEQ ID NO: 94294 - DNA, 25 bp, mus musculus
gtgcgccgcatggtcagtttcatgc

SEQ ID NO: 94295 - DNA, 25 bp, mus musculus
cgccgcatggtcagtttcatgctca

SEQ ID NO: 94296 - DNA, 25 bp, mus musculus
atggtcagtttcatgctcagacgtc

SEQ ID NO: 94297 - DNA, 25 bp, mus musculus
gtcagtttcatgctcagacgtctgc

SEQ ID NO: 94298 - DNA, 25 bp, mus musculus
agtttcatgctcagacgtctgccga

SEQ ID NO: 94299 - DNA, 25 bp, mus musculus
ttcatgctcagacgtctgccgagag

SEQ ID NO: 94300 - DNA, 25 bp, mus musculus
atattccagttctctgtcccctgtt

SEQ ID NO: 94301 - DNA, 25 bp, mus musculus
atgctcagacgtctgccgagagcca

SEQ ID NO: 94302 - DNA, 25 bp, mus musculus
gtcccctgttgtggctctcatcaca

SEQ ID NO: 94303 - DNA, 25 bp, mus musculus
tgttgtggctctcatcacaggtctt

SEQ ID NO: 94304 - DNA, 25 bp, mus musculus
tgtggctctcatcacaggtcttcac

SEQ ID NO: 94305 - DNA, 25 bp, mus musculus
ggctctcatcacaggtcttcacagc

SEQ ID NO: 94306 - DNA, 25 bp, mus musculus
tctcatcacaggtcttcacagcttc

SEQ ID NO: 94307 - DNA, 25 bp, mus musculus
cacaggtcttcacagcttcttctcc

SEQ ID NO: 94308 - DNA, 25 bp, mus musculus
gcattcccccagggcagttcacggc

SEQ ID NO: 94309 - DNA, 25 bp, mus musculus
gatttagtcaggcctggaacctcca

SEQ ID NO: 94310 - DNA, 25 bp, mus musculus
ggtctggtctccaaatccatcagag

SEQ ID NO: 94311 - DNA, 25 bp, mus musculus
ttattgctcaccggagagtccacac

SEQ ID NO: 94312 - DNA, 25 bp, mus musculus
attgctcaccggagagtccacacgg

SEQ ID NO: 94313 - DNA, 25 bp, mus musculus
ttgctcaccggagagtccacacggg

SEQ ID NO: 94314 - DNA, 25 bp, mus musculus
agtcttgcctcaagtctacggactc

SEQ ID NO: 94315 - DNA, 25 bp, mus musculus
cttgcctcaagtctacggactcatc

SEQ ID NO: 94316 - DNA, 25 bp, mus musculus
cctcaagtctacggactcatcagag

SEQ ID NO: 94317 - DNA, 25 bp, mus musculus
caagtctacggactcatcagagagt

SEQ ID NO: 94318 - DNA, 25 bp, mus musculus
agtctacggactcatcagagagttc

SEQ ID NO: 94319 - DNA, 25 bp, mus musculus
gtctacggactcatcagagagttca

SEQ ID NO: 94320 - DNA, 25 bp, mus musculus
ctacggactcatcagagagttcaca

SEQ ID NO: 94321 - DNA, 25 bp, mus musculus
gaattcagcttgaattccgggctta

SEQ ID NO: 94322 - DNA, 25 bp, mus musculus
tacggactcatcagagagttcacac

SEQ ID NO: 94323 - DNA, 25 bp, mus musculus
aattcagcttgaattccgggcttat

SEQ ID NO: 94324 - DNA, 25 bp, mus musculus
tcagcttgaattccgggcttattgc

SEQ ID NO: 94325 - DNA, 25 bp, mus musculus
agcttgaattccgggcttattgctc

SEQ ID NO: 94326 - DNA, 25 bp, mus musculus
ttgaattccgggcttattgctcacc

SEQ ID NO: 94327 - DNA, 25 bp, mus musculus
tgaattccgggcttattgctcaccg

SEQ ID NO: 94328 - DNA, 25 bp, mus musculus
gggcttattgctcaccggagagtcc

SEQ ID NO: 94329 - DNA, 25 bp, mus musculus
cttattgctcaccggagagtccaca

SEQ ID NO: 94330 - DNA, 25 bp, mus musculus
tccaaggatctcgtctgagcatctc

SEQ ID NO: 94331 - DNA, 25 bp, mus musculus
aaggatctcgtctgagcatctctag

SEQ ID NO: 94332 - DNA, 25 bp, mus musculus
tttagctccaagtcctggcagggtg

SEQ ID NO: 94333 - DNA, 25 bp, mus musculus
ggggcacctatctgaggcagggttt

SEQ ID NO: 94334 - DNA, 25 bp, mus musculus
ctggctgccgctgctgttacttcag

SEQ ID NO: 94335 - DNA, 25 bp, mus musculus
gccgctgctgttacttcaggatgaa

SEQ ID NO: 94336 - DNA, 25 bp, mus musculus
cccccgttaacagcactatgagtat

SEQ ID NO: 94337 - DNA, 25 bp, mus musculus
ccgttaacagcactatgagtattgg

SEQ ID NO: 94338 - DNA, 25 bp, mus musculus
gtattggtcaagcacgcaagatggt

SEQ ID NO: 94339 - DNA, 25 bp, mus musculus
gtcaagcacgcaagatggtggaaca

SEQ ID NO: 94340 - DNA, 25 bp, mus musculus
agattgaggccagcttgtgccggat

SEQ ID NO: 94341 - DNA, 25 bp, mus musculus
aggccagcttgtgccggataaaggt

SEQ ID NO: 94342 - DNA, 25 bp, mus musculus
gatctcgtctgagcatctctagtga

SEQ ID NO: 94343 - DNA, 25 bp, mus musculus
tgagcatctctagtgaccttctctg

SEQ ID NO: 94344 - DNA, 25 bp, mus musculus
gcatctctagtgaccttctctgcat

SEQ ID NO: 94345 - DNA, 25 bp, mus musculus
ctagtgaccttctctgcattaactg

SEQ ID NO: 94346 - DNA, 25 bp, mus musculus
accttctctgcattaactgtcagtg

SEQ ID NO: 94347 - DNA, 25 bp, mus musculus
tctgcattaactgtcagtgctacgg

SEQ ID NO: 94348 - DNA, 25 bp, mus musculus
gcattaactgtcagtgctacggata

SEQ ID NO: 94349 - DNA, 25 bp, mus musculus
atttttagctccaagtcctggcagg

SEQ ID NO: 94350 - DNA, 25 bp, mus musculus
gttctctccaaagaatttcatctga

SEQ ID NO: 94351 - DNA, 25 bp, mus musculus
tctctccaaagaatttcatctgaac

SEQ ID NO: 94352 - DNA, 25 bp, mus musculus
ttgacaaaacgctcaggtcaagcgc

SEQ ID NO: 94353 - DNA, 25 bp, mus musculus
gacaaaacgctcaggtcaagcgcaa

SEQ ID NO: 94354 - DNA, 25 bp, mus musculus
aaacgctcaggtcaagcgcaaagta

SEQ ID NO: 94355 - DNA, 25 bp, mus musculus
acgctcaggtcaagcgcaaagtagg

SEQ ID NO: 94356 - DNA, 25 bp, mus musculus
agcgcaaagtaggcccacaggaaga

SEQ ID NO: 94357 - DNA, 25 bp, mus musculus
cgcaaagtaggcccacaggaagagg

SEQ ID NO: 94358 - DNA, 25 bp, mus musculus
caaagtaggcccacaggaagaggca

SEQ ID NO: 94359 - DNA, 25 bp, mus musculus
aagtaggcccacaggaagaggcagc

SEQ ID NO: 94360 - DNA, 25 bp, mus musculus
aggagccagagggctccttaacctg

SEQ ID NO: 94361 - DNA, 25 bp, mus musculus
attctgaggcaggtgctgaggatgt

SEQ ID NO: 94362 - DNA, 25 bp, mus musculus
tctccaaagaatttcatctgaacga

SEQ ID NO: 94363 - DNA, 25 bp, mus musculus
gaatttcatctgaacgagagtggtg

SEQ ID NO: 94364 - DNA, 25 bp, mus musculus
atttcatctgaacgagagtggtgac

SEQ ID NO: 94365 - DNA, 25 bp, mus musculus
ttcatctgaacgagagtggtgaccc

SEQ ID NO: 94366 - DNA, 25 bp, mus musculus
tcttcaaagtccaccgaaatcaaat

SEQ ID NO: 94367 - DNA, 25 bp, mus musculus
ttcaaagtccaccgaaatcaaatgg

SEQ ID NO: 94368 - DNA, 25 bp, mus musculus
gtccaccgaaatcaaatggaaatct

SEQ ID NO: 94369 - DNA, 25 bp, mus musculus
atttgacaaaacgctcaggtcaagc

SEQ ID NO: 94370 - DNA, 25 bp, mus musculus
gcctccatcacacagaggcaggacc

SEQ ID NO: 94371 - DNA, 25 bp, mus musculus
atcacacagaggcaggaccctgggg

SEQ ID NO: 94372 - DNA, 25 bp, mus musculus
ggatatcttccatggccagcttatg

SEQ ID NO: 94373 - DNA, 25 bp, mus musculus
cttccatggccagcttatgacctta

SEQ ID NO: 94374 - DNA, 25 bp, mus musculus
tggccagcttatgaccttagcagct

SEQ ID NO: 94375 - DNA, 25 bp, mus musculus
gcttatgaccttagcagcttaggtc

SEQ ID NO: 94376 - DNA, 25 bp, mus musculus
gaccttagcagcttaggtcttggtg

SEQ ID NO: 94377 - DNA, 25 bp, mus musculus
catcacgtgaagtcttgcagtccca

SEQ ID NO: 94378 - DNA, 25 bp, mus musculus
gtgaagtcttgcagtcccagggagt

SEQ ID NO: 94379 - DNA, 25 bp, mus musculus
ctggcgtccagtttcctagttgtgg

SEQ ID NO: 94380 - DNA, 25 bp, mus musculus
tccagtttcctagttgtggttgctg

SEQ ID NO: 94381 - DNA, 25 bp, mus musculus
ttgctccaattggttggaatttctt

SEQ ID NO: 94382 - DNA, 25 bp, mus musculus
gatctccagcctggaatcagaagtg

SEQ ID NO: 94383 - DNA, 25 bp, mus musculus
taccggcagctctggttcctgctgg

SEQ ID NO: 94384 - DNA, 25 bp, mus musculus
ctgctggactggattctgtggctgg

SEQ ID NO: 94385 - DNA, 25 bp, mus musculus
gactggattctgtggctggtcttgg

SEQ ID NO: 94386 - DNA, 25 bp, mus musculus
acaagctttgactcctctgccttct

SEQ ID NO: 94387 - DNA, 25 bp, mus musculus
tcctctgccttcttctttgaaattc

SEQ ID NO: 94388 - DNA, 25 bp, mus musculus
gccttcttctttgaaattctggcca

SEQ ID NO: 94389 - DNA, 25 bp, mus musculus
gaaattctggccatgagaccccagt

SEQ ID NO: 94390 - DNA, 25 bp, mus musculus
tggtgactcttttactggcttagca

SEQ ID NO: 94391 - DNA, 25 bp, mus musculus
gactcttttactggcttagcagttc

SEQ ID NO: 94392 - DNA, 25 bp, mus musculus
gttagttccaacactgatgcgcaga

SEQ ID NO: 94393 - DNA, 25 bp, mus musculus
tagttccaacactgatgcgcagatc

SEQ ID NO: 94394 - DNA, 25 bp, mus musculus
gttccaacactgatgcgcagatctt

SEQ ID NO: 94395 - DNA, 25 bp, mus musculus
tccaacactgatgcgcagatcttct

SEQ ID NO: 94396 - DNA, 25 bp, mus musculus
caacactgatgcgcagatcttcttg

SEQ ID NO: 94397 - DNA, 25 bp, mus musculus
tatcatgaagctggacgttggcaca

SEQ ID NO: 94398 - DNA, 25 bp, mus musculus
agctggacgttggcacacgtatcca

SEQ ID NO: 94399 - DNA, 25 bp, mus musculus
gttggcacacgtatccaggacgtgg

SEQ ID NO: 94400 - DNA, 25 bp, mus musculus
tggcacacgtatccaggacgtggct

SEQ ID NO: 94401 - DNA, 25 bp, mus musculus
gcacacgtatccaggacgtggctct

SEQ ID NO: 94402 - DNA, 25 bp, mus musculus
ctcttttactggcttagcagttcat

SEQ ID NO: 94403 - DNA, 25 bp, mus musculus
tctcgtttgcccacgtttgttctga

SEQ ID NO: 94404 - DNA, 25 bp, mus musculus
cttttactggcttagcagttcattg

SEQ ID NO: 94405 - DNA, 25 bp, mus musculus
tttactggcttagcagttcattggc

SEQ ID NO: 94406 - DNA, 25 bp, mus musculus
tactggcttagcagttcattggcac

SEQ ID NO: 94407 - DNA, 25 bp, mus musculus
ctggcttagcagttcattggcacac

SEQ ID NO: 94408 - DNA, 25 bp, mus musculus
cttagcagttcattggcacacaggc

SEQ ID NO: 94409 - DNA, 25 bp, mus musculus
tagcagttcattggcacacaggctg

SEQ ID NO: 94410 - DNA, 25 bp, mus musculus
agatgttagttccaacactgatgcg

SEQ ID NO: 94411 - DNA, 25 bp, mus musculus
agctctgcccattccaagaaaagat

SEQ ID NO: 94412 - DNA, 25 bp, mus musculus
gcccattccaagaaaagattcggag

SEQ ID NO: 94413 - DNA, 25 bp, mus musculus
cgtggcaatcccggcgcctgatgaa

SEQ ID NO: 94414 - DNA, 25 bp, mus musculus
ggcaatcccggcgcctgatgaagaa

SEQ ID NO: 94415 - DNA, 25 bp, mus musculus
cccggcgcctgatgaagaagacgtg

SEQ ID NO: 94416 - DNA, 25 bp, mus musculus
tttatggtgctcacaggttttgtgg

SEQ ID NO: 94417 - DNA, 25 bp, mus musculus
gtgctcacaggttttgtgggttgaa

SEQ ID NO: 94418 - DNA, 25 bp, mus musculus
acttacctgcagtcactctggaaac

SEQ ID NO: 94419 - DNA, 25 bp, mus musculus
tacctgcagtcactctggaaacctg

SEQ ID NO: 94420 - DNA, 25 bp, mus musculus
cagtcactctggaaacctggctgaa

SEQ ID NO: 94421 - DNA, 25 bp, mus musculus
tcactctggaaacctggctgaagac

SEQ ID NO: 94422 - DNA, 25 bp, mus musculus
ctctggaaacctggctgaagacaag

SEQ ID NO: 94423 - DNA, 25 bp, mus musculus
atttaagcacaaatctggtaagtca

SEQ ID NO: 94424 - DNA, 25 bp, mus musculus
agatgctgcagacagcctacaacaa

SEQ ID NO: 94425 - DNA, 25 bp, mus musculus
tgctgcagacagcctacaacaagct

SEQ ID NO: 94426 - DNA, 25 bp, mus musculus
tgcagacagcctacaacaagctcca

SEQ ID NO: 94427 - DNA, 25 bp, mus musculus
cagcctacaacaagctccacgcgtg

SEQ ID NO: 94428 - DNA, 25 bp, mus musculus
cctacaacaagctccacgcgtggca

SEQ ID NO: 94429 - DNA, 25 bp, mus musculus
acaacaagctccacgcgtggcaatc

SEQ ID NO: 94430 - DNA, 25 bp, mus musculus
acaagctccacgcgtggcaatcccg

SEQ ID NO: 94431 - DNA, 25 bp, mus musculus
aagcctactccaagcatccttggta

SEQ ID NO: 94432 - DNA, 25 bp, mus musculus
actccaagcatccttggtatggcca

SEQ ID NO: 94433 - DNA, 25 bp, mus musculus
tttatctaagggacagctgttggat

SEQ ID NO: 94434 - DNA, 25 bp, mus musculus
acagctgttggatactcaggccaat

SEQ ID NO: 94435 - DNA, 25 bp, mus musculus
tactcaggccaattctaaatcctag

SEQ ID NO: 94436 - DNA, 25 bp, mus musculus
caattctaaatcctagactgtcatg

SEQ ID NO: 94437 - DNA, 25 bp, mus musculus
ttctaaatcctagactgtcatgact

SEQ ID NO: 94438 - DNA, 25 bp, mus musculus
atcctagactgtcatgacttaaata

SEQ ID NO: 94439 - DNA, 25 bp, mus musculus
aagagcccagagctttctggtgtaa

SEQ ID NO: 94440 - DNA, 25 bp, mus musculus
agcccagagctttctggtgtaaatt

SEQ ID NO: 94441 - DNA, 25 bp, mus musculus
aattcacaattatatgcataagcca

SEQ ID NO: 94442 - DNA, 25 bp, mus musculus
gcttttccttaaatacttgacagag

SEQ ID NO: 94443 - DNA, 25 bp, mus musculus
agcatccttggtatggccagatttt

SEQ ID NO: 94444 - DNA, 25 bp, mus musculus
tttttatagcctctaagatggaatt

SEQ ID NO: 94445 - DNA, 25 bp, mus musculus
ttatagcctctaagatggaatttaa

SEQ ID NO: 94446 - DNA, 25 bp, mus musculus
aatttaatctaatttctctcaggct

SEQ ID NO: 94447 - DNA, 25 bp, mus musculus
atctaatttctctcaggcttttcct

SEQ ID NO: 94448 - DNA, 25 bp, mus musculus
ctctcaggcttttcctttatctaag

SEQ ID NO: 94449 - DNA, 25 bp, mus musculus
ttttcctttatctaagggacagctg

SEQ ID NO: 94450 - DNA, 25 bp, mus musculus
tcctttatctaagggacagctgttg

SEQ ID NO: 94451 - DNA, 25 bp, mus musculus
gtcactacagtcgatgtcaccgatg

SEQ ID NO: 94452 - DNA, 25 bp, mus musculus
ctacagtcgatgtcaccgatggacg

SEQ ID NO: 94453 - DNA, 25 bp, mus musculus
caatgtcatcgcatgttgctcaggt

SEQ ID NO: 94454 - DNA, 25 bp, mus musculus
atgtcatcgcatgttgctcaggttc

SEQ ID NO: 94455 - DNA, 25 bp, mus musculus
tgctcaggttctgagcaagcctctg

SEQ ID NO: 94456 - DNA, 25 bp, mus musculus
ctcaggttctgagcaagcctctgat

SEQ ID NO: 94457 - DNA, 25 bp, mus musculus
ggttctgagcaagcctctgatcagg

SEQ ID NO: 94458 - DNA, 25 bp, mus musculus
ttctgagcaagcctctgatcaggac

SEQ ID NO: 94459 - DNA, 25 bp, mus musculus
ctgagcaagcctctgatcaggacaa

SEQ ID NO: 94460 - DNA, 25 bp, mus musculus
gagcaagcctctgatcaggacaaca

SEQ ID NO: 94461 - DNA, 25 bp, mus musculus
gcaagcctctgatcaggacaacaac

SEQ ID NO: 94462 - DNA, 25 bp, mus musculus
atcgagtcaagtcagctggatgaat

SEQ ID NO: 94463 - DNA, 25 bp, mus musculus
acagtcgatgtcaccgatggacgag

SEQ ID NO: 94464 - DNA, 25 bp, mus musculus
agtcgatgtcaccgatggacgaggt

SEQ ID NO: 94465 - DNA, 25 bp, mus musculus
tcgatgtcaccgatggacgaggtga

SEQ ID NO: 94466 - DNA, 25 bp, mus musculus
gatgtcaccgatggacgaggtgata

SEQ ID NO: 94467 - DNA, 25 bp, mus musculus
tgtcaccgatggacgaggtgatagc

SEQ ID NO: 94468 - DNA, 25 bp, mus musculus
agtctcgtcaatgtcatcgcatgtt

SEQ ID NO: 94469 - DNA, 25 bp, mus musculus
tctcgtcaatgtcatcgcatgttgc

SEQ ID NO: 94470 - DNA, 25 bp, mus musculus
tcgtcaatgtcatcgcatgttgctc

SEQ ID NO: 94471 - DNA, 25 bp, mus musculus
gaacaccttcagacaggactgtgaa

SEQ ID NO: 94472 - DNA, 25 bp, mus musculus
tgaacggccaattcaacgaggatgg

SEQ ID NO: 94473 - DNA, 25 bp, mus musculus
tctttaagctctgtgccaatgtcta

SEQ ID NO: 94474 - DNA, 25 bp, mus musculus
ttaagctctgtgccaatgtctaatc

SEQ ID NO: 94475 - DNA, 25 bp, mus musculus
agctctgtgccaatgtctaatctct

SEQ ID NO: 94476 - DNA, 25 bp, mus musculus
tctgtgccaatgtctaatctctctg

SEQ ID NO: 94477 - DNA, 25 bp, mus musculus
gtgccaatgtctaatctctctggaa

SEQ ID NO: 94478 - DNA, 25 bp, mus musculus
tctaatctctctggaatggttttcc

SEQ ID NO: 94479 - DNA, 25 bp, mus musculus
ctctctggaatggttttcctgaaca

SEQ ID NO: 94480 - DNA, 25 bp, mus musculus
atggttttcctgaacacctgtcatc

SEQ ID NO: 94481 - DNA, 25 bp, mus musculus
gttttcctgaacacctgtcatccct

SEQ ID NO: 94482 - DNA, 25 bp, mus musculus
ctgaacacctgtcatccctctcata

SEQ ID NO: 94483 - DNA, 25 bp, mus musculus
aggatggctcctttattggccaata

SEQ ID NO: 94484 - DNA, 25 bp, mus musculus
atggctcctttattggccaatacag

SEQ ID NO: 94485 - DNA, 25 bp, mus musculus
ttattggccaatacagtggtaagaa

SEQ ID NO: 94486 - DNA, 25 bp, mus musculus
aaagctcagaggccccttctcctgt

SEQ ID NO: 94487 - DNA, 25 bp, mus musculus
cttctcctgtcaacgcaatgaactc

SEQ ID NO: 94488 - DNA, 25 bp, mus musculus
ctgtcaacgcaatgaactcctttgt

SEQ ID NO: 94489 - DNA, 25 bp, mus musculus
tcaacgcaatgaactcctttgttta

SEQ ID NO: 94490 - DNA, 25 bp, mus musculus
tttaagtctttaagctctgtgccaa

SEQ ID NO: 94491 - DNA, 25 bp, mus musculus
tctacctatcatatgctgtctatat

SEQ ID NO: 94492 - DNA, 25 bp, mus musculus
atgctgtctatatcatctacctatc

SEQ ID NO: 94493 - DNA, 25 bp, mus musculus
gcatactattatacctggctttaca

SEQ ID NO: 94494 - DNA, 25 bp, mus musculus
tattatacctggctttacatgggtt

SEQ ID NO: 94495 - DNA, 25 bp, mus musculus
ctttacatgggttctggagatttga

SEQ ID NO: 94496 - DNA, 25 bp, mus musculus
agcccaagtctttatgtttgcatag

SEQ ID NO: 94497 - DNA, 25 bp, mus musculus
aaagctcacatgagtcctcatttta

SEQ ID NO: 94498 - DNA, 25 bp, mus musculus
cacatgagtcctcattttagtatga

SEQ ID NO: 94499 - DNA, 25 bp, mus musculus
taatatgttatctccttttagactc

SEQ ID NO: 94500 - DNA, 25 bp, mus musculus
tagactcttctgtatacttaagctg

SEQ ID NO: 94501 - DNA, 25 bp, mus musculus
cttctgtatacttaagctgttgttg

SEQ ID NO: 94502 - DNA, 25 bp, mus musculus
tatacttaagctgttgttgggctct

SEQ ID NO: 94503 - DNA, 25 bp, mus musculus
tctatatcatctacctatcatatgt

SEQ ID NO: 94504 - DNA, 25 bp, mus musculus
ttgttgggctctgaaggtggtgttt

SEQ ID NO: 94505 - DNA, 25 bp, mus musculus
acctatcatatgtctgtctactcat

SEQ ID NO: 94506 - DNA, 25 bp, mus musculus
tctgtctactcatctatctacctat

SEQ ID NO: 94507 - DNA, 25 bp, mus musculus
agccttgagctacatttcttgcctt

SEQ ID NO: 94508 - DNA, 25 bp, mus musculus
gagctacatttcttgccttccattt

SEQ ID NO: 94509 - DNA, 25 bp, mus musculus
catttcttgccttccatttggttca

SEQ ID NO: 94510 - DNA, 25 bp, mus musculus
gggagtctcctgtctctgctgtagg

SEQ ID NO: 94511 - DNA, 25 bp, mus musculus
tctctgctgtagggactcagagatt

SEQ ID NO: 94512 - DNA, 25 bp, mus musculus
catcaagactccaatcctgataaga

SEQ ID NO: 94513 - DNA, 25 bp, mus musculus
gactccaatcctgataagaagtctc

SEQ ID NO: 94514 - DNA, 25 bp, mus musculus
tgtctgtgttctgtctttgtaaaca

SEQ ID NO: 94515 - DNA, 25 bp, mus musculus
tgttctgtctttgtaaacagcctat

SEQ ID NO: 94516 - DNA, 25 bp, mus musculus
tagattatgatctctttgggatact

SEQ ID NO: 94517 - DNA, 25 bp, mus musculus
atgatctctttgggatactgcctgg

SEQ ID NO: 94518 - DNA, 25 bp, mus musculus
ggatactgcctggcttatgatggtg

SEQ ID NO: 94519 - DNA, 25 bp, mus musculus
tgcctggcttatgatggtgcaccat

SEQ ID NO: 94520 - DNA, 25 bp, mus musculus
gatggtgcaccatacctttgatata

SEQ ID NO: 94521 - DNA, 25 bp, mus musculus
ctagttggcaatcgccaatttcata

SEQ ID NO: 94522 - DNA, 25 bp, mus musculus
tttcataaaagccatccaccttgta

SEQ ID NO: 94523 - DNA, 25 bp, mus musculus
agctgtagtaacttctccactgact

SEQ ID NO: 94524 - DNA, 25 bp, mus musculus
ctggtcaacctctgggtactcacta

SEQ ID NO: 94525 - DNA, 25 bp, mus musculus
aacctctgggtactcactatcctgt

SEQ ID NO: 94526 - DNA, 25 bp, mus musculus
tgggtactcactatcctgtccataa

SEQ ID NO: 94527 - DNA, 25 bp, mus musculus
atcctgtccataaagtggtgctttc

SEQ ID NO: 94528 - DNA, 25 bp, mus musculus
tgctttctgtgaaagccttaagaaa

SEQ ID NO: 94529 - DNA, 25 bp, mus musculus
gcatatttggcttctaccagagaaa

SEQ ID NO: 94530 - DNA, 25 bp, mus musculus
ttggcttctaccagagaaaacatct

SEQ ID NO: 94531 - DNA, 25 bp, mus musculus
aacatctgtctgtgttctgtctttg

SEQ ID NO: 94532 - DNA, 25 bp, mus musculus
atatcaaaaattgtccacaagtcct

SEQ ID NO: 94533 - DNA, 25 bp, mus musculus
gccgctgctacaggaggcattgcta

SEQ ID NO: 94534 - DNA, 25 bp, mus musculus
ttcttcattcggcacaatcccacat

SEQ ID NO: 94535 - DNA, 25 bp, mus musculus
ttcattcggcacaatcccacatcta

SEQ ID NO: 94536 - DNA, 25 bp, mus musculus
cggcacaatcccacatctaatgtgc

SEQ ID NO: 94537 - DNA, 25 bp, mus musculus
cacaatcccacatctaatgtgctct

SEQ ID NO: 94538 - DNA, 25 bp, mus musculus
aatcccacatctaatgtgctcttcc

SEQ ID NO: 94539 - DNA, 25 bp, mus musculus
cccacatctaatgtgctcttccttg

SEQ ID NO: 94540 - DNA, 25 bp, mus musculus
tctaatgtgctcttccttggcaggg

SEQ ID NO: 94541 - DNA, 25 bp, mus musculus
aatgtgctcttccttggcagggttt

SEQ ID NO: 94542 - DNA, 25 bp, mus musculus
tgttccccatagaagaaggagactt

SEQ ID NO: 94543 - DNA, 25 bp, mus musculus
gcttagagtttcattccctgagatt

SEQ ID NO: 94544 - DNA, 25 bp, mus musculus
ggcattgctacattctgtatgttgt

SEQ ID NO: 94545 - DNA, 25 bp, mus musculus
attgctacattctgtatgttgttgc

SEQ ID NO: 94546 - DNA, 25 bp, mus musculus
gaattcacagtggaccatccgttca

SEQ ID NO: 94547 - DNA, 25 bp, mus musculus
acagtggaccatccgttcattttct

SEQ ID NO: 94548 - DNA, 25 bp, mus musculus
gtggaccatccgttcattttcttca

SEQ ID NO: 94549 - DNA, 25 bp, mus musculus
catccgttcattttcttcattcggc

SEQ ID NO: 94550 - DNA, 25 bp, mus musculus
ttcattttcttcattcggcacaatc

SEQ ID NO: 94551 - DNA, 25 bp, mus musculus
attttcttcattcggcacaatccca

SEQ ID NO: 94552 - DNA, 25 bp, mus musculus
cagctgccacgagcagctcgccaag

SEQ ID NO: 94553 - DNA, 25 bp, mus musculus
agctgccacgagcagctcgccaaga

SEQ ID NO: 94554 - DNA, 25 bp, mus musculus
gattcgtttcttgcagacataaatt

SEQ ID NO: 94555 - DNA, 25 bp, mus musculus
attcgtttcttgcagacataaatta

SEQ ID NO: 94556 - DNA, 25 bp, mus musculus
ttcgtttcttgcagacataaattac

SEQ ID NO: 94557 - DNA, 25 bp, mus musculus
tcgtttcttgcagacataaattact

SEQ ID NO: 94558 - DNA, 25 bp, mus musculus
cgtttcttgcagacataaattactg

SEQ ID NO: 94559 - DNA, 25 bp, mus musculus
gtttcttgcagacataaattactgg

SEQ ID NO: 94560 - DNA, 25 bp, mus musculus
aaatgttgccaagactgctaataag

SEQ ID NO: 94561 - DNA, 25 bp, mus musculus
aatgttgccaagactgctaataagg

SEQ ID NO: 94562 - DNA, 25 bp, mus musculus
atgttgccaagactgctaataagga

SEQ ID NO: 94563 - DNA, 25 bp, mus musculus
tgttgccaagactgctaataaggac

SEQ ID NO: 94564 - DNA, 25 bp, mus musculus
gctgccacgagcagctcgccaagaa

SEQ ID NO: 94565 - DNA, 25 bp, mus musculus
ctgccacgagcagctcgccaagaag

SEQ ID NO: 94566 - DNA, 25 bp, mus musculus
tgccacgagcagctcgccaagaagg

SEQ ID NO: 94567 - DNA, 25 bp, mus musculus
gccacgagcagctcgccaagaagga

SEQ ID NO: 94568 - DNA, 25 bp, mus musculus
ttcagattcgtttcttgcagacata

SEQ ID NO: 94569 - DNA, 25 bp, mus musculus
tcagattcgtttcttgcagacataa

SEQ ID NO: 94570 - DNA, 25 bp, mus musculus
cagattcgtttcttgcagacataaa

SEQ ID NO: 94571 - DNA, 25 bp, mus musculus
agattcgtttcttgcagacataaat

SEQ ID NO: 94572 - DNA, 25 bp, mus musculus
cagatatcccacagcgatggtgaat

SEQ ID NO: 94573 - DNA, 25 bp, mus musculus
atatcccacagcgatggtgaatgtc

SEQ ID NO: 94574 - DNA, 25 bp, mus musculus
tctgctggtggacaagcttgaacag

SEQ ID NO: 94575 - DNA, 25 bp, mus musculus
gattcggaccaagccatcaaccctt

SEQ ID NO: 94576 - DNA, 25 bp, mus musculus
ccaagccatcaaccctttaggaatg

SEQ ID NO: 94577 - DNA, 25 bp, mus musculus
caagccatcaaccctttaggaatgc

SEQ ID NO: 94578 - DNA, 25 bp, mus musculus
gccatcaaccctttaggaatgcggg

SEQ ID NO: 94579 - DNA, 25 bp, mus musculus
ttaaggatccattcgggaggccata

SEQ ID NO: 94580 - DNA, 25 bp, mus musculus
aaggatccattcgggaggccataga

SEQ ID NO: 94581 - DNA, 25 bp, mus musculus
aggatccattcgggaggccatagag

SEQ ID NO: 94582 - DNA, 25 bp, mus musculus
gatccattcgggaggccatagagaa

SEQ ID NO: 94583 - DNA, 25 bp, mus musculus
atccattcgggaggccatagagaag

SEQ ID NO: 94584 - DNA, 25 bp, mus musculus
atcccacagcgatggtgaatgtctc

SEQ ID NO: 94585 - DNA, 25 bp, mus musculus
tgaatgtctcaaaaccttgcaagag

SEQ ID NO: 94586 - DNA, 25 bp, mus musculus
gaatgtctcaaaaccttgcaagagg

SEQ ID NO: 94587 - DNA, 25 bp, mus musculus
atgtctcaaaaccttgcaagaggaa

SEQ ID NO: 94588 - DNA, 25 bp, mus musculus
tgtctcaaaaccttgcaagaggaaa

SEQ ID NO: 94589 - DNA, 25 bp, mus musculus
ctcaaaaccttgcaagaggaaatcg

SEQ ID NO: 94590 - DNA, 25 bp, mus musculus
gaagctctgctggtggacaagcttg

SEQ ID NO: 94591 - DNA, 25 bp, mus musculus
agctctgctggtggacaagcttgaa

SEQ ID NO: 94592 - DNA, 25 bp, mus musculus
tggtctcatcctcaactcaaccaca

SEQ ID NO: 94593 - DNA, 25 bp, mus musculus
ctcaaccacaatcatggctcagatg

SEQ ID NO: 94594 - DNA, 25 bp, mus musculus
ctgccttaagtacagccagaagaaa

SEQ ID NO: 94595 - DNA, 25 bp, mus musculus
ctacagtattgtccgaggctatagg

SEQ ID NO: 94596 - DNA, 25 bp, mus musculus
cagtattgtccgaggctataggaag

SEQ ID NO: 94597 - DNA, 25 bp, mus musculus
tattgtccgaggctataggaagcaa

SEQ ID NO: 94598 - DNA, 25 bp, mus musculus
ccggaagcactctaagcctgagcta

SEQ ID NO: 94599 - DNA, 25 bp, mus musculus
gaagcactctaagcctgagctatgt

SEQ ID NO: 94600 - DNA, 25 bp, mus musculus
gcactctaagcctgagctatgtgca

SEQ ID NO: 94601 - DNA, 25 bp, mus musculus
ctctaagcctgagctatgtgcaaac

SEQ ID NO: 94602 - DNA, 25 bp, mus musculus
tgagctatgtgcaaaccctgaggaa

SEQ ID NO: 94603 - DNA, 25 bp, mus musculus
gctatgtgcaaaccctgaggaaggc

SEQ ID NO: 94604 - DNA, 25 bp, mus musculus
aaccacaatcatggctcagatgatg

SEQ ID NO: 94605 - DNA, 25 bp, mus musculus
cacaatcatggctcagatgatgact

SEQ ID NO: 94606 - DNA, 25 bp, mus musculus
aatcatggctcagatgatgactctg

SEQ ID NO: 94607 - DNA, 25 bp, mus musculus
gatgactctgagcctccttagcctg

SEQ ID NO: 94608 - DNA, 25 bp, mus musculus
tctgagcctccttagcctggtcctg

SEQ ID NO: 94609 - DNA, 25 bp, mus musculus
cccctggacccaaggcagtgatgga

SEQ ID NO: 94610 - DNA, 25 bp, mus musculus
acaggactgctgccttaagtacagc

SEQ ID NO: 94611 - DNA, 25 bp, mus musculus
ggactgctgccttaagtacagccag

SEQ ID NO: 94612 - DNA, 25 bp, mus musculus
cacagctgccctctggagaagtttg

SEQ ID NO: 94613 - DNA, 25 bp, mus musculus
agctgccctctggagaagtttgcgg

SEQ ID NO: 94614 - DNA, 25 bp, mus musculus
agccccgctggaaatgcctgatgtc

SEQ ID NO: 94615 - DNA, 25 bp, mus musculus
cccgctggaaatgcctgatgtcaag

SEQ ID NO: 94616 - DNA, 25 bp, mus musculus
aatgcctgatgtcaagcgggtttca

SEQ ID NO: 94617 - DNA, 25 bp, mus musculus
ttcaaaggaagcctaccagttagcg

SEQ ID NO: 94618 - DNA, 25 bp, mus musculus
agcctaccagttagcgcacctgcat

SEQ ID NO: 94619 - DNA, 25 bp, mus musculus
ctaccagttagcgcacctgcatgaa

SEQ ID NO: 94620 - DNA, 25 bp, mus musculus
ccagttagcgcacctgcatgaaaaa

SEQ ID NO: 94621 - DNA, 25 bp, mus musculus
agaagctgctgatcccaggctaagg

SEQ ID NO: 94622 - DNA, 25 bp, mus musculus
tgatcccaggctaaggggcgaagga

SEQ ID NO: 94623 - DNA, 25 bp, mus musculus
aacagcactcacctgttcctgcctt

SEQ ID NO: 94624 - DNA, 25 bp, mus musculus
tgccctctggagaagtttgcggacg

SEQ ID NO: 94625 - DNA, 25 bp, mus musculus
gtactggacccggtgatctcccagg

SEQ ID NO: 94626 - DNA, 25 bp, mus musculus
ctggacccggtgatctcccaggact

SEQ ID NO: 94627 - DNA, 25 bp, mus musculus
tcccaggactgggccacggagtgta

SEQ ID NO: 94628 - DNA, 25 bp, mus musculus
atggccacaagcagccaccaaggac

SEQ ID NO: 94629 - DNA, 25 bp, mus musculus
gccacaagcagccaccaaggacgga

SEQ ID NO: 94630 - DNA, 25 bp, mus musculus
acaagcagccaccaaggacggaatt

SEQ ID NO: 94631 - DNA, 25 bp, mus musculus
taaagccccgctggaaatgcctgat

SEQ ID NO: 94632 - DNA, 25 bp, mus musculus
gcagtcccctgcaagttccatgtaa

SEQ ID NO: 94633 - DNA, 25 bp, mus musculus
ccctgcaagttccatgtaaggaatg

SEQ ID NO: 94634 - DNA, 25 bp, mus musculus
tccttggtgcctggcctcaaagagg

SEQ ID NO: 94635 - DNA, 25 bp, mus musculus
ggctcagcctgcactagagcaggtc

SEQ ID NO: 94636 - DNA, 25 bp, mus musculus
gcctgcactagagcaggtctacatg

SEQ ID NO: 94637 - DNA, 25 bp, mus musculus
actagagcaggtctacatggcttct

SEQ ID NO: 94638 - DNA, 25 bp, mus musculus
tccgagccatcaccaccagagtaga

SEQ ID NO: 94639 - DNA, 25 bp, mus musculus
tggagtagatcccacctagcagcca

SEQ ID NO: 94640 - DNA, 25 bp, mus musculus
gcagccaccacgtggaacaggggtc

SEQ ID NO: 94641 - DNA, 25 bp, mus musculus
cccacatcaggttgcaccatgacaa

SEQ ID NO: 94642 - DNA, 25 bp, mus musculus
tcaggttgcaccatgacaacttcct

SEQ ID NO: 94643 - DNA, 25 bp, mus musculus
atgacaacttcctgagcctcctcgg

SEQ ID NO: 94644 - DNA, 25 bp, mus musculus
atatacttactatgcaggccaaagg

SEQ ID NO: 94645 - DNA, 25 bp, mus musculus
cacggactcacccagggacataatc

SEQ ID NO: 94646 - DNA, 25 bp, mus musculus
cttttcctcacatctgttcatcttc

SEQ ID NO: 94647 - DNA, 25 bp, mus musculus
ctcacatctgttcatcttctcaatc

SEQ ID NO: 94648 - DNA, 25 bp, mus musculus
tctgttcatcttctcaatctcaagt

SEQ ID NO: 94649 - DNA, 25 bp, mus musculus
catcttctcaatctcaagttatctg

SEQ ID NO: 94650 - DNA, 25 bp, mus musculus
ctcaagttatctggccgcatctctt

SEQ ID NO: 94651 - DNA, 25 bp, mus musculus
gtcaagtccttggtgcctggcctca

SEQ ID NO: 94652 - DNA, 25 bp, mus musculus
accccagagaccttctctaccatat

SEQ ID NO: 94653 - DNA, 25 bp, mus musculus
cagagaccttctctaccatatcagt

SEQ ID NO: 94654 - DNA, 25 bp, mus musculus
agaagcgccattacctcttcgatgt

SEQ ID NO: 94655 - DNA, 25 bp, mus musculus
aagcgccattacctcttcgatgtgc

SEQ ID NO: 94656 - DNA, 25 bp, mus musculus
gcgccattacctcttcgatgtgcag

SEQ ID NO: 94657 - DNA, 25 bp, mus musculus
cattacctcttcgatgtgcagagga

SEQ ID NO: 94658 - DNA, 25 bp, mus musculus
acctcttcgatgtgcagaggaataa

SEQ ID NO: 94659 - DNA, 25 bp, mus musculus
ctcttcgatgtgcagaggaataaca

SEQ ID NO: 94660 - DNA, 25 bp, mus musculus
taacattgccctggccttggaggtc

SEQ ID NO: 94661 - DNA, 25 bp, mus musculus
attgccctggccttggaggtcactt

SEQ ID NO: 94662 - DNA, 25 bp, mus musculus
tgccctggccttggaggtcacttac

SEQ ID NO: 94663 - DNA, 25 bp, mus musculus
taccgggaacggctacataaagcat

SEQ ID NO: 94664 - DNA, 25 bp, mus musculus
gagaccttctctaccatatcagtag

SEQ ID NO: 94665 - DNA, 25 bp, mus musculus
gaccttctctaccatatcagtagta

SEQ ID NO: 94666 - DNA, 25 bp, mus musculus
aaatccaggatgcaatcgacatgga

SEQ ID NO: 94667 - DNA, 25 bp, mus musculus
aaggcacagcaggcactggttcaga

SEQ ID NO: 94668 - DNA, 25 bp, mus musculus
ggcacagcaggcactggttcagaag

SEQ ID NO: 94669 - DNA, 25 bp, mus musculus
cacagcaggcactggttcagaagcg

SEQ ID NO: 94670 - DNA, 25 bp, mus musculus
cagcaggcactggttcagaagcgcc

SEQ ID NO: 94671 - DNA, 25 bp, mus musculus
tcagaagcgccattacctcttcgat

SEQ ID NO: 94672 - DNA, 25 bp, mus musculus
aattcggatccatgcatctccagta

SEQ ID NO: 94673 - DNA, 25 bp, mus musculus
attcggatccatgcatctccagtat

SEQ ID NO: 94674 - DNA, 25 bp, mus musculus
tgccttctccgcgttcttgctgact

SEQ ID NO: 94675 - DNA, 25 bp, mus musculus
gccttctccgcgttcttgctgactg

SEQ ID NO: 94676 - DNA, 25 bp, mus musculus
ccttctccgcgttcttgctgactgg

SEQ ID NO: 94677 - DNA, 25 bp, mus musculus
cttctccgcgttcttgctgactggg

SEQ ID NO: 94678 - DNA, 25 bp, mus musculus
ttctccgcgttcttgctgactgggg

SEQ ID NO: 94679 - DNA, 25 bp, mus musculus
ccctgcggggcacaggtgctgctca

SEQ ID NO: 94680 - DNA, 25 bp, mus musculus
cctgcggggcacaggtgctgctcat

SEQ ID NO: 94681 - DNA, 25 bp, mus musculus
ctgcggggcacaggtgctgctcatt

SEQ ID NO: 94682 - DNA, 25 bp, mus musculus
tggaatcaattccgacacccggaga

SEQ ID NO: 94683 - DNA, 25 bp, mus musculus
ttcggatccatgcatctccagtatg

SEQ ID NO: 94684 - DNA, 25 bp, mus musculus
tcggatccatgcatctccagtatgt

SEQ ID NO: 94685 - DNA, 25 bp, mus musculus
ccgtgtatgccttctccgcgttctt

SEQ ID NO: 94686 - DNA, 25 bp, mus musculus
cgtgtatgccttctccgcgttcttg

SEQ ID NO: 94687 - DNA, 25 bp, mus musculus
gtgtatgccttctccgcgttcttgc

SEQ ID NO: 94688 - DNA, 25 bp, mus musculus
tgtatgccttctccgcgttcttgct

SEQ ID NO: 94689 - DNA, 25 bp, mus musculus
tatgccttctccgcgttcttgctga

SEQ ID NO: 94690 - DNA, 25 bp, mus musculus
atgccttctccgcgttcttgctgac

SEQ ID NO: 94691 - DNA, 25 bp, mus musculus
catgttactgtgtctctgtgactag

SEQ ID NO: 94692 - DNA, 25 bp, mus musculus
gttactgtgtctctgtgactagtat

SEQ ID NO: 94693 - DNA, 25 bp, mus musculus
tctttggctttctgaatatgatact

SEQ ID NO: 94694 - DNA, 25 bp, mus musculus
aggagaccagcttacacagtccgtc

SEQ ID NO: 94695 - DNA, 25 bp, mus musculus
agaccagcttacacagtccgtcaaa

SEQ ID NO: 94696 - DNA, 25 bp, mus musculus
ccagcttacacagtccgtcaaatac

SEQ ID NO: 94697 - DNA, 25 bp, mus musculus
gcttacacagtccgtcaaatacgtc

SEQ ID NO: 94698 - DNA, 25 bp, mus musculus
acagtccgtcaaatacgtcagcttc

SEQ ID NO: 94699 - DNA, 25 bp, mus musculus
gtccgtcaaatacgtcagcttccca

SEQ ID NO: 94700 - DNA, 25 bp, mus musculus
cgtcaaatacgtcagcttcccacag

SEQ ID NO: 94701 - DNA, 25 bp, mus musculus
caaatacgtcagcttcccacagcca

SEQ ID NO: 94702 - DNA, 25 bp, mus musculus
cacccacttctggaatgtaactaag

SEQ ID NO: 94703 - DNA, 25 bp, mus musculus
actgtgtctctgtgactagtatggg

SEQ ID NO: 94704 - DNA, 25 bp, mus musculus
tgactagtatgggctccctgaatgt

SEQ ID NO: 94705 - DNA, 25 bp, mus musculus
ctagtatgggctccctgaatgtatc

SEQ ID NO: 94706 - DNA, 25 bp, mus musculus
gtatgggctccctgaatgtatccgt

SEQ ID NO: 94707 - DNA, 25 bp, mus musculus
gctccctgaatgtatccgtgatctt

SEQ ID NO: 94708 - DNA, 25 bp, mus musculus
atgtatccgtgatctttggctttct

SEQ ID NO: 94709 - DNA, 25 bp, mus musculus
ccgtgatctttggctttctgaatat

SEQ ID NO: 94710 - DNA, 25 bp, mus musculus
tgatctttggctttctgaatatgat

SEQ ID NO: 94711 - DNA, 25 bp, mus musculus
taagactggggccccagcattcgcc

SEQ ID NO: 94712 - DNA, 25 bp, mus musculus
aagactggggccccagcattcgcct

SEQ ID NO: 94713 - DNA, 25 bp, mus musculus
agtgcctggacatcagctccctgtt

SEQ ID NO: 94714 - DNA, 25 bp, mus musculus
tgcctggacatcagctccctgttct

SEQ ID NO: 94715 - DNA, 25 bp, mus musculus
gcctggacatcagctccctgttctt

SEQ ID NO: 94716 - DNA, 25 bp, mus musculus
cctggacatcagctccctgttcttc

SEQ ID NO: 94717 - DNA, 25 bp, mus musculus
ctggacatcagctccctgttcttca

SEQ ID NO: 94718 - DNA, 25 bp, mus musculus
tggacatcagctccctgttcttcag

SEQ ID NO: 94719 - DNA, 25 bp, mus musculus
ggacatcagctccctgttcttcagc

SEQ ID NO: 94720 - DNA, 25 bp, mus musculus
gacatcagctccctgttcttcagca

SEQ ID NO: 94721 - DNA, 25 bp, mus musculus
acatcagctccctgttcttcagcat

SEQ ID NO: 94722 - DNA, 25 bp, mus musculus
catcagctccctgttcttcagcatc

SEQ ID NO: 94723 - DNA, 25 bp, mus musculus
cctccagcggcaagtgcctggacat

SEQ ID NO: 94724 - DNA, 25 bp, mus musculus
ctccagcggcaagtgcctggacatc

SEQ ID NO: 94725 - DNA, 25 bp, mus musculus
tccagcggcaagtgcctggacatca

SEQ ID NO: 94726 - DNA, 25 bp, mus musculus
cagcggcaagtgcctggacatcagc

SEQ ID NO: 94727 - DNA, 25 bp, mus musculus
ggcaagtgcctggacatcagctccc

SEQ ID NO: 94728 - DNA, 25 bp, mus musculus
gcaagtgcctggacatcagctccct

SEQ ID NO: 94729 - DNA, 25 bp, mus musculus
caagtgcctggacatcagctccctg

SEQ ID NO: 94730 - DNA, 25 bp, mus musculus
aagtgcctggacatcagctccctgt

SEQ ID NO: 94731 - DNA, 25 bp, mus musculus
cgcggctaacttggcatctgatcca

SEQ ID NO: 94732 - DNA, 25 bp, mus musculus
ggctaacttggcatctgatccaccc

SEQ ID NO: 94733 - DNA, 25 bp, mus musculus
agacaccttggaacctcctatacag

SEQ ID NO: 94734 - DNA, 25 bp, mus musculus
caccttggaacctcctatacaggca

SEQ ID NO: 94735 - DNA, 25 bp, mus musculus
cttggaacctcctatacaggcaaca

SEQ ID NO: 94736 - DNA, 25 bp, mus musculus
ggaacctcctatacaggcaacaggc

SEQ ID NO: 94737 - DNA, 25 bp, mus musculus
ggcaacaggccagcgtaggggacaa

SEQ ID NO: 94738 - DNA, 25 bp, mus musculus
gactgcagcagctgtgacagggctg

SEQ ID NO: 94739 - DNA, 25 bp, mus musculus
agcagctgtgacagggctgtgacag

SEQ ID NO: 94740 - DNA, 25 bp, mus musculus
cgagaatgaccctgactgaagcgca

SEQ ID NO: 94741 - DNA, 25 bp, mus musculus
gaatgaccctgactgaagcgcaggg

SEQ ID NO: 94742 - DNA, 25 bp, mus musculus
ccctgactgaagcgcagggcattcg

SEQ ID NO: 94743 - DNA, 25 bp, mus musculus
taacttggcatctgatccacccatt

SEQ ID NO: 94744 - DNA, 25 bp, mus musculus
cttggcatctgatccacccattcgt

SEQ ID NO: 94745 - DNA, 25 bp, mus musculus
atctgatccacccattcgtttatta

SEQ ID NO: 94746 - DNA, 25 bp, mus musculus
tgatccacccattcgtttattagca

SEQ ID NO: 94747 - DNA, 25 bp, mus musculus
tccacccattcgtttattagcatgg

SEQ ID NO: 94748 - DNA, 25 bp, mus musculus
tttattagcatggttcaagagagct

SEQ ID NO: 94749 - DNA, 25 bp, mus musculus
gagagctccagacaccttggaacct

SEQ ID NO: 94750 - DNA, 25 bp, mus musculus
agctccagacaccttggaacctcct

SEQ ID NO: 94751 - DNA, 25 bp, mus musculus
atggatctcctgaaggtgctgtccc

SEQ ID NO: 94752 - DNA, 25 bp, mus musculus
aaggtgctgtcccagatgattctgt

SEQ ID NO: 94753 - DNA, 25 bp, mus musculus
catatctcaagctgctttgggcaca

SEQ ID NO: 94754 - DNA, 25 bp, mus musculus
tcaagctgctttgggcacaagatag

SEQ ID NO: 94755 - DNA, 25 bp, mus musculus
gaccggatcggatccgtcagtcgtt

SEQ ID NO: 94756 - DNA, 25 bp, mus musculus
agtcgtttgggctgtaacgcactga

SEQ ID NO: 94757 - DNA, 25 bp, mus musculus
gaagacctcctggctgcaggagact

SEQ ID NO: 94758 - DNA, 25 bp, mus musculus
ctcctggctgcaggagactccagtt

SEQ ID NO: 94759 - DNA, 25 bp, mus musculus
tccagtttctgactctgcctgggtc

SEQ ID NO: 94760 - DNA, 25 bp, mus musculus
caagactgtttcttatcttggagca

SEQ ID NO: 94761 - DNA, 25 bp, mus musculus
ttatcttggagcacaaacttgccac

SEQ ID NO: 94762 - DNA, 25 bp, mus musculus
ttgccacaacataataaacatagcg

SEQ ID NO: 94763 - DNA, 25 bp, mus musculus
cactcctatcctctgggaagtccta

SEQ ID NO: 94764 - DNA, 25 bp, mus musculus
agtcctagccagtctccagagcaat

SEQ ID NO: 94765 - DNA, 25 bp, mus musculus
agccagtctccagagcaattcaaga

SEQ ID NO: 94766 - DNA, 25 bp, mus musculus
tctccagagcaattcaagatgcaga

SEQ ID NO: 94767 - DNA, 25 bp, mus musculus
aagctgctggagctgataagagaaa

SEQ ID NO: 94768 - DNA, 25 bp, mus musculus
atggcccagagacagctcttgaagg

SEQ ID NO: 94769 - DNA, 25 bp, mus musculus
agagtccttcggtctcaaggcagca

SEQ ID NO: 94770 - DNA, 25 bp, mus musculus
cgggtccagcagagacctcaaaatt

SEQ ID NO: 94771 - DNA, 25 bp, mus musculus
gaaacacctcttaaagcctcaggat

SEQ ID NO: 94772 - DNA, 25 bp, mus musculus
tcaattcagcgttttcaaaacacag

SEQ ID NO: 94773 - DNA, 25 bp, mus musculus
cccgcctggaatcctgctgcagaag

SEQ ID NO: 94774 - DNA, 25 bp, mus musculus
gcctggaatcctgctgcagaagatc

SEQ ID NO: 94775 - DNA, 25 bp, mus musculus
aatcctgctgcagaagatcagtgct

SEQ ID NO: 94776 - DNA, 25 bp, mus musculus
gatcagtgctttgaccggtgccatc

SEQ ID NO: 94777 - DNA, 25 bp, mus musculus
gaccggtgccatcgacttggccaga

SEQ ID NO: 94778 - DNA, 25 bp, mus musculus
cggtgccatcgacttggccagaagc

SEQ ID NO: 94779 - DNA, 25 bp, mus musculus
catcgacttggccagaagcaagagg

SEQ ID NO: 94780 - DNA, 25 bp, mus musculus
cgacttggccagaagcaagaggtga

SEQ ID NO: 94781 - DNA, 25 bp, mus musculus
gtgatcatcacaaaattcattgtga

SEQ ID NO: 94782 - DNA, 25 bp, mus musculus
atcatcacaaaattcattgtgaagg

SEQ ID NO: 94783 - DNA, 25 bp, mus musculus
tttcaaaacacagaagcaggatctc

SEQ ID NO: 94784 - DNA, 25 bp, mus musculus
gaagcaggatctcctacgataatgc

SEQ ID NO: 94785 - DNA, 25 bp, mus musculus
ggatctcctacgataatgctactgt

SEQ ID NO: 94786 - DNA, 25 bp, mus musculus
ataatgctactgtccttaaaagcag

SEQ ID NO: 94787 - DNA, 25 bp, mus musculus
atgctactgtccttaaaagcaggtg

SEQ ID NO: 94788 - DNA, 25 bp, mus musculus
aatctctgcgcacgttctcgagtgt

SEQ ID NO: 94789 - DNA, 25 bp, mus musculus
gcacgttctcgagtgttcttaatgg

SEQ ID NO: 94790 - DNA, 25 bp, mus musculus
ttcttaatggatcccgcctggaatc

SEQ ID NO: 94791 - DNA, 25 bp, mus musculus
tatttctgagtcttaatgagcatcc

SEQ ID NO: 94792 - DNA, 25 bp, mus musculus
atcccccaggatggactgttttcat

SEQ ID NO: 94793 - DNA, 25 bp, mus musculus
tcctgctgacagagcttcccacatc

SEQ ID NO: 94794 - DNA, 25 bp, mus musculus
tgacagagcttcccacatcagacgc

SEQ ID NO: 94795 - DNA, 25 bp, mus musculus
cagagcttcccacatcagacgcaca

SEQ ID NO: 94796 - DNA, 25 bp, mus musculus
agcttcccacatcagacgcacagga

SEQ ID NO: 94797 - DNA, 25 bp, mus musculus
aggagctccctcaggtggattctct

SEQ ID NO: 94798 - DNA, 25 bp, mus musculus
agctccctcaggtggattctctgat

SEQ ID NO: 94799 - DNA, 25 bp, mus musculus
gttttcctacattcttgacattcaa

SEQ ID NO: 94800 - DNA, 25 bp, mus musculus
ttcctacattcttgacattcaaatc

SEQ ID NO: 94801 - DNA, 25 bp, mus musculus
cattcaaatcgtttctcacttccgt

SEQ ID NO: 94802 - DNA, 25 bp, mus musculus
ttctcacttccgtgagttacctgat

SEQ ID NO: 94803 - DNA, 25 bp, mus musculus
aactgctacacatcaggcactacag

SEQ ID NO: 94804 - DNA, 25 bp, mus musculus
tgctacacatcaggcactacagacc

SEQ ID NO: 94805 - DNA, 25 bp, mus musculus
tacacatcaggcactacagaccctg

SEQ ID NO: 94806 - DNA, 25 bp, mus musculus
tcaggcactacagaccctgcaatgg

SEQ ID NO: 94807 - DNA, 25 bp, mus musculus
ctggtgccagctgatggttcctgct

SEQ ID NO: 94808 - DNA, 25 bp, mus musculus
ccagctgatggttcctgctgacaga

SEQ ID NO: 94809 - DNA, 25 bp, mus musculus
gatggttcctgctgacagagcttcc

SEQ ID NO: 94810 - DNA, 25 bp, mus musculus
ggttcctgctgacagagcttcccac

SEQ ID NO: 94811 - DNA, 25 bp, mus musculus
aaatgtttatgttccttctgaatgc

SEQ ID NO: 94812 - DNA, 25 bp, mus musculus
aatgtttatgttccttctgaatgct

SEQ ID NO: 94813 - DNA, 25 bp, mus musculus
tcttccctggagtctggtaccagtg

SEQ ID NO: 94814 - DNA, 25 bp, mus musculus
cttccctggagtctggtaccagtga

SEQ ID NO: 94815 - DNA, 25 bp, mus musculus
ccctggagtctggtaccagtgagaa

SEQ ID NO: 94816 - DNA, 25 bp, mus musculus
ccccaaatctaggcaacaggtgtct

SEQ ID NO: 94817 - DNA, 25 bp, mus musculus
cccaaatctaggcaacaggtgtctg

SEQ ID NO: 94818 - DNA, 25 bp, mus musculus
caaatctaggcaacaggtgtctgag

SEQ ID NO: 94819 - DNA, 25 bp, mus musculus
gcaacaggtgtctgaggtggagcaa

SEQ ID NO: 94820 - DNA, 25 bp, mus musculus
caacaggtgtctgaggtggagcaat

SEQ ID NO: 94821 - DNA, 25 bp, mus musculus
aatccatcaggaaaacagaaggcag

SEQ ID NO: 94822 - DNA, 25 bp, mus musculus
gagaggtacctgcttcctgtcctcc

SEQ ID NO: 94823 - DNA, 25 bp, mus musculus
gtttatgttccttctgaatgctggc

SEQ ID NO: 94824 - DNA, 25 bp, mus musculus
tatgttccttctgaatgctggcctc

SEQ ID NO: 94825 - DNA, 25 bp, mus musculus
tgttccttctgaatgctggcctctt

SEQ ID NO: 94826 - DNA, 25 bp, mus musculus
tccttctgaatgctggcctcttgga

SEQ ID NO: 94827 - DNA, 25 bp, mus musculus
ccttctgaatgctggcctcttggac

SEQ ID NO: 94828 - DNA, 25 bp, mus musculus
tgaatgctggcctcttggacagctc

SEQ ID NO: 94829 - DNA, 25 bp, mus musculus
tatttggtcaacacaaggtacccat

SEQ ID NO: 94830 - DNA, 25 bp, mus musculus
aatcttccctggagtctggtaccag

SEQ ID NO: 94831 - DNA, 25 bp, mus musculus
gaatctactggcaaggtggtctatt

SEQ ID NO: 94832 - DNA, 25 bp, mus musculus
gtggtctatttcaccacgtcactgc

SEQ ID NO: 94833 - DNA, 25 bp, mus musculus
atgttcacacctaagattgagcagc

SEQ ID NO: 94834 - DNA, 25 bp, mus musculus
ttcacacctaagattgagcagctag

SEQ ID NO: 94835 - DNA, 25 bp, mus musculus
gccgtgttcggggcagttatgcaga

SEQ ID NO: 94836 - DNA, 25 bp, mus musculus
atgttcggctcactgggcttagggt

SEQ ID NO: 94837 - DNA, 25 bp, mus musculus
tgtggtggcctgattgcttttgcca

SEQ ID NO: 94838 - DNA, 25 bp, mus musculus
attgcttttgccagctacaacgaac

SEQ ID NO: 94839 - DNA, 25 bp, mus musculus
tttgccagctacaacgaaccctcca

SEQ ID NO: 94840 - DNA, 25 bp, mus musculus
ccctccaacgactgccagaagcatg

SEQ ID NO: 94841 - DNA, 25 bp, mus musculus
aacgactgccagaagcatgccctca

SEQ ID NO: 94842 - DNA, 25 bp, mus musculus
tgccagaagcatgccctcattgtgt

SEQ ID NO: 94843 - DNA, 25 bp, mus musculus
gtctatttcaccacgtcactgcctt

SEQ ID NO: 94844 - DNA, 25 bp, mus musculus
aagcatgccctcattgtgtctgtca

SEQ ID NO: 94845 - DNA, 25 bp, mus musculus
ttcaccacgtcactgccttactttg

SEQ ID NO: 94846 - DNA, 25 bp, mus musculus
acgtcactgccttactttgtgctca

SEQ ID NO: 94847 - DNA, 25 bp, mus musculus
ctgccttactttgtgctcatcatct

SEQ ID NO: 94848 - DNA, 25 bp, mus musculus
ccttactttgtgctcatcatctacc

SEQ ID NO: 94849 - DNA, 25 bp, mus musculus
gtgctcatcatctacctggtccggg

SEQ ID NO: 94850 - DNA, 25 bp, mus musculus
gccaccaatggcctggcatacatgt

SEQ ID NO: 94851 - DNA, 25 bp, mus musculus
tacatgttcacacctaagattgagc

SEQ ID NO: 94852 - DNA, 25 bp, mus musculus
ggacttcgtgcagtgtgtgatgaga

SEQ ID NO: 94853 - DNA, 25 bp, mus musculus
acttcgtgcagtgtgtgatgagacc

SEQ ID NO: 94854 - DNA, 25 bp, mus musculus
gtgtcagagctgctggatgactaat

SEQ ID NO: 94855 - DNA, 25 bp, mus musculus
ctaatgtggacctgatggctacgtt

SEQ ID NO: 94856 - DNA, 25 bp, mus musculus
tgtggacctgatggctacgttacat

SEQ ID NO: 94857 - DNA, 25 bp, mus musculus
tggacctgatggctacgttacatct

SEQ ID NO: 94858 - DNA, 25 bp, mus musculus
gacctgatggctacgttacatctgt

SEQ ID NO: 94859 - DNA, 25 bp, mus musculus
atggctacgttacatctgtagagtt

SEQ ID NO: 94860 - DNA, 25 bp, mus musculus
ggctacgttacatctgtagagttct

SEQ ID NO: 94861 - DNA, 25 bp, mus musculus
ctacgttacatctgtagagttctgt

SEQ ID NO: 94862 - DNA, 25 bp, mus musculus
tacatctgtagagttctgtggagga

SEQ ID NO: 94863 - DNA, 25 bp, mus musculus
catctacggaattctacccacgcag

SEQ ID NO: 94864 - DNA, 25 bp, mus musculus
ttcgtgcagtgtgtgatgagaccta

SEQ ID NO: 94865 - DNA, 25 bp, mus musculus
tgagacctattttgaggctgttcga

SEQ ID NO: 94866 - DNA, 25 bp, mus musculus
agacctattttgaggctgttcgagt

SEQ ID NO: 94867 - DNA, 25 bp, mus musculus
acctattttgaggctgttcgagtag

SEQ ID NO: 94868 - DNA, 25 bp, mus musculus
ctattttgaggctgttcgagtagtc

SEQ ID NO: 94869 - DNA, 25 bp, mus musculus
tagtctacagatgggtcgaagtgtc

SEQ ID NO: 94870 - DNA, 25 bp, mus musculus
cgaagtgtcagagctgctggatgac

SEQ ID NO: 94871 - DNA, 25 bp, mus musculus
aagtgtcagagctgctggatgacta

SEQ ID NO: 94872 - DNA, 25 bp, mus musculus
tggcctgggacaggggcacaatctg

SEQ ID NO: 94873 - DNA, 25 bp, mus musculus
caatctgcagctcagtggcttcctg

SEQ ID NO: 94874 - DNA, 25 bp, mus musculus
tgatcgcagcgctgatgagcttcct

SEQ ID NO: 94875 - DNA, 25 bp, mus musculus
gtcagctcttccagacagccgtgga

SEQ ID NO: 94876 - DNA, 25 bp, mus musculus
tcttccagacagccgtggaggctgc

SEQ ID NO: 94877 - DNA, 25 bp, mus musculus
agacagccgtggaggctgcgcccac

SEQ ID NO: 94878 - DNA, 25 bp, mus musculus
ggctgtctctagaacacatcttatg

SEQ ID NO: 94879 - DNA, 25 bp, mus musculus
aacacatcttatggccatttaccag

SEQ ID NO: 94880 - DNA, 25 bp, mus musculus
tcttatggccatttaccagactcgg

SEQ ID NO: 94881 - DNA, 25 bp, mus musculus
gactgacgtgcagctcaatgtaccc

SEQ ID NO: 94882 - DNA, 25 bp, mus musculus
cgtgcagctcaatgtacccttggat

SEQ ID NO: 94883 - DNA, 25 bp, mus musculus
taatgagctttctgagtgagaggca

SEQ ID NO: 94884 - DNA, 25 bp, mus musculus
gcagctcagtggcttcctgggtcac

SEQ ID NO: 94885 - DNA, 25 bp, mus musculus
ctcacctgcaggcgtccttcagaag

SEQ ID NO: 94886 - DNA, 25 bp, mus musculus
tgcaggcgtccttcagaagagccaa

SEQ ID NO: 94887 - DNA, 25 bp, mus musculus
cgtccttcagaagagccaacagagc

SEQ ID NO: 94888 - DNA, 25 bp, mus musculus
cactctggctcacggggctcatcat

SEQ ID NO: 94889 - DNA, 25 bp, mus musculus
ggctcacggggctcatcatcatact

SEQ ID NO: 94890 - DNA, 25 bp, mus musculus
cggggctcatcatcatactgatcgc

SEQ ID NO: 94891 - DNA, 25 bp, mus musculus
tcatactgatcgcagcgctgatgag

SEQ ID NO: 94892 - DNA, 25 bp, mus musculus
ccagatcttgtggtttagaggcctg

SEQ ID NO: 94893 - DNA, 25 bp, mus musculus
ctgaacagaatccaaacacagatcc

SEQ ID NO: 94894 - DNA, 25 bp, mus musculus
gcatttcgtagttctttatacgaag

SEQ ID NO: 94895 - DNA, 25 bp, mus musculus
agttcaatccacaactttatgacac

SEQ ID NO: 94896 - DNA, 25 bp, mus musculus
ttcaatccacaactttatgacacac

SEQ ID NO: 94897 - DNA, 25 bp, mus musculus
caatccacaactttatgacacaccc

SEQ ID NO: 94898 - DNA, 25 bp, mus musculus
atccacaactttatgacacaccctg

SEQ ID NO: 94899 - DNA, 25 bp, mus musculus
ccacaactttatgacacaccctgag

SEQ ID NO: 94900 - DNA, 25 bp, mus musculus
acaactttatgacacaccctgagtt

SEQ ID NO: 94901 - DNA, 25 bp, mus musculus
ctttatgacacaccctgagtttagg

SEQ ID NO: 94902 - DNA, 25 bp, mus musculus
ttatgacacaccctgagtttaggat

SEQ ID NO: 94903 - DNA, 25 bp, mus musculus
atgctgaagacgacgccccaacaaa

SEQ ID NO: 94904 - DNA, 25 bp, mus musculus
gaacagaatccaaacacagatccga

SEQ ID NO: 94905 - DNA, 25 bp, mus musculus
acagaatccaaacacagatccgagt

SEQ ID NO: 94906 - DNA, 25 bp, mus musculus
agaatccaaacacagatccgagtgg

SEQ ID NO: 94907 - DNA, 25 bp, mus musculus
aatccaaacacagatccgagtggtg

SEQ ID NO: 94908 - DNA, 25 bp, mus musculus
tccaaacacagatccgagtggtgaa

SEQ ID NO: 94909 - DNA, 25 bp, mus musculus
caaacacagatccgagtggtgaatg

SEQ ID NO: 94910 - DNA, 25 bp, mus musculus
aacacagatccgagtggtgaatgca

SEQ ID NO: 94911 - DNA, 25 bp, mus musculus
atgcatttcgtagttctttatacga

SEQ ID NO: 94912 - DNA, 25 bp, mus musculus
gctattgtggacctaacaggactct

SEQ ID NO: 94913 - DNA, 25 bp, mus musculus
gctgtcacattaggccagccaggcc

SEQ ID NO: 94914 - DNA, 25 bp, mus musculus
agcccgctggggagcttctcagctt

SEQ ID NO: 94915 - DNA, 25 bp, mus musculus
agcttctcagctttccaataggaaa

SEQ ID NO: 94916 - DNA, 25 bp, mus musculus
tcagctttccaataggaaagctcct

SEQ ID NO: 94917 - DNA, 25 bp, mus musculus
taggaaagctcctgctgtctcctct

SEQ ID NO: 94918 - DNA, 25 bp, mus musculus
ggcctctccagagagagtctcaaga

SEQ ID NO: 94919 - DNA, 25 bp, mus musculus
ctcaagagctgcagcaggagcaaag

SEQ ID NO: 94920 - DNA, 25 bp, mus musculus
agctctctgagacataggccctcac

SEQ ID NO: 94921 - DNA, 25 bp, mus musculus
ctgagacataggccctcactggaga

SEQ ID NO: 94922 - DNA, 25 bp, mus musculus
cataggccctcactggagaagggcc

SEQ ID NO: 94923 - DNA, 25 bp, mus musculus
cacagccttgccaggtggcctgtat

SEQ ID NO: 94924 - DNA, 25 bp, mus musculus
agggcctcagcctagagccaatcac

SEQ ID NO: 94925 - DNA, 25 bp, mus musculus
tcagcctagagccaatcaccatcac

SEQ ID NO: 94926 - DNA, 25 bp, mus musculus
tagagccaatcaccatcacacagaa

SEQ ID NO: 94927 - DNA, 25 bp, mus musculus
caatcaccatcacacagaaaggcag

SEQ ID NO: 94928 - DNA, 25 bp, mus musculus
ccatcacacagaaaggcaggaagaa

SEQ ID NO: 94929 - DNA, 25 bp, mus musculus
gccttcagctggcaaactgagttgg

SEQ ID NO: 94930 - DNA, 25 bp, mus musculus
ccactgagctcaagggcctggtgga

SEQ ID NO: 94931 - DNA, 25 bp, mus musculus
agctcaagggcctggtggagcccgc

SEQ ID NO: 94932 - DNA, 25 bp, mus musculus
tgttcttatggaactgtcagggcaa

SEQ ID NO: 94933 - DNA, 25 bp, mus musculus
tcttatggaactgtcagggcaagat

SEQ ID NO: 94934 - DNA, 25 bp, mus musculus
aggagatcagactcctagtgaacca

SEQ ID NO: 94935 - DNA, 25 bp, mus musculus
agatcagactcctagtgaaccacag

SEQ ID NO: 94936 - DNA, 25 bp, mus musculus
gactcctagtgaaccacagacttct

SEQ ID NO: 94937 - DNA, 25 bp, mus musculus
tcctagtgaaccacagacttctgca

SEQ ID NO: 94938 - DNA, 25 bp, mus musculus
tagtgaaccacagacttctgcagaa

SEQ ID NO: 94939 - DNA, 25 bp, mus musculus
tgaaccacagacttctgcagaaaga

SEQ ID NO: 94940 - DNA, 25 bp, mus musculus
acagacttctgcagaaagactgaca

SEQ ID NO: 94941 - DNA, 25 bp, mus musculus
agatggctcaagtgtagaggaggtc

SEQ ID NO: 94942 - DNA, 25 bp, mus musculus
ggaagctatgctacctgtagaagag

SEQ ID NO: 94943 - DNA, 25 bp, mus musculus
tatgctacctgtagaagagtctgag

SEQ ID NO: 94944 - DNA, 25 bp, mus musculus
agcatcaccagtcgtggctgcagag

SEQ ID NO: 94945 - DNA, 25 bp, mus musculus
atcaccagtcgtggctgcagaggcc

SEQ ID NO: 94946 - DNA, 25 bp, mus musculus
accagtcgtggctgcagaggccgga

SEQ ID NO: 94947 - DNA, 25 bp, mus musculus
tgcagaggccggagctgaagtctct

SEQ ID NO: 94948 - DNA, 25 bp, mus musculus
tgaagtctctgagaagccagggcag

SEQ ID NO: 94949 - DNA, 25 bp, mus musculus
tacagttattcccaacaatggtcca

SEQ ID NO: 94950 - DNA, 25 bp, mus musculus
caacaatggtccagttgttggacaa

SEQ ID NO: 94951 - DNA, 25 bp, mus musculus
caatggtccagttgttggacaatca

SEQ ID NO: 94952 - DNA, 25 bp, mus musculus
accaggagccatggagcccgacaac

SEQ ID NO: 94953 - DNA, 25 bp, mus musculus
cgacaacagcccacggaagatccag

SEQ ID NO: 94954 - DNA, 25 bp, mus musculus
caactcacttctcaagtccaccttg

SEQ ID NO: 94955 - DNA, 25 bp, mus musculus
actcacttctcaagtccaccttgtc

SEQ ID NO: 94956 - DNA, 25 bp, mus musculus
tcacttctcaagtccaccttgtcaa

SEQ ID NO: 94957 - DNA, 25 bp, mus musculus
acttctcaagtccaccttgtcaatg

SEQ ID NO: 94958 - DNA, 25 bp, mus musculus
ttctcaagtccaccttgtcaatgtc

SEQ ID NO: 94959 - DNA, 25 bp, mus musculus
ctcaagtccaccttgtcaatgtctc

SEQ ID NO: 94960 - DNA, 25 bp, mus musculus
caagtccaccttgtcaatgtctcca

SEQ ID NO: 94961 - DNA, 25 bp, mus musculus
agtccaccttgtcaatgtctccacg

SEQ ID NO: 94962 - DNA, 25 bp, mus musculus
tccaccttgtcaatgtctccacggc

SEQ ID NO: 94963 - DNA, 25 bp, mus musculus
caccttgtcaatgtctccacggcaa

SEQ ID NO: 94964 - DNA, 25 bp, mus musculus
acaacagcccacggaagatccagtt

SEQ ID NO: 94965 - DNA, 25 bp, mus musculus
ccttgtcaatgtctccacggcaacg

SEQ ID NO: 94966 - DNA, 25 bp, mus musculus
gatccagtttacggtcccgctgctg

SEQ ID NO: 94967 - DNA, 25 bp, mus musculus
cagtttacggtcccgctgctggagc

SEQ ID NO: 94968 - DNA, 25 bp, mus musculus
ccacacttgtgctgaccagtgatca

SEQ ID NO: 94969 - DNA, 25 bp, mus musculus
acacttgtgctgaccagtgatcagt

SEQ ID NO: 94970 - DNA, 25 bp, mus musculus
acttgtgctgaccagtgatcagtcc

SEQ ID NO: 94971 - DNA, 25 bp, mus musculus
ttgtgctgaccagtgatcagtcctc

SEQ ID NO: 94972 - DNA, 25 bp, mus musculus
atgaagaccggatccccaactcact

SEQ ID NO: 94973 - DNA, 25 bp, mus musculus
catgttttcctggatggaagtcagt

SEQ ID NO: 94974 - DNA, 25 bp, mus musculus
agtcagttactgttgtctgttcctt

SEQ ID NO: 94975 - DNA, 25 bp, mus musculus
ttcacctattcctaggaggttggat

SEQ ID NO: 94976 - DNA, 25 bp, mus musculus
tattcctaggaggttggatagtcct

SEQ ID NO: 94977 - DNA, 25 bp, mus musculus
ggatagtcctctggttggaagcgac

SEQ ID NO: 94978 - DNA, 25 bp, mus musculus
tagtcctctggttggaagcgacaaa

SEQ ID NO: 94979 - DNA, 25 bp, mus musculus
caaacttcatataaactaatccaag

SEQ ID NO: 94980 - DNA, 25 bp, mus musculus
aaactaatccaagtagttctgctag

SEQ ID NO: 94981 - DNA, 25 bp, mus musculus
ctaatccaagtagttctgctagagc

SEQ ID NO: 94982 - DNA, 25 bp, mus musculus
gtagttctgctagagctatgatccc

SEQ ID NO: 94983 - DNA, 25 bp, mus musculus
ctatgatccccaaacctgaaatcaa

SEQ ID NO: 94984 - DNA, 25 bp, mus musculus
ccgtgcactggctcacatgccatga

SEQ ID NO: 94985 - DNA, 25 bp, mus musculus
ttgtctgttccttccagctgtgagt

SEQ ID NO: 94986 - DNA, 25 bp, mus musculus
gttccttccagctgtgagtcgtgaa

SEQ ID NO: 94987 - DNA, 25 bp, mus musculus
tccagctgtgagtcgtgaagacctg

SEQ ID NO: 94988 - DNA, 25 bp, mus musculus
tagacaactgtattcttccatttct

SEQ ID NO: 94989 - DNA, 25 bp, mus musculus
acaactgtattcttccatttctgac

SEQ ID NO: 94990 - DNA, 25 bp, mus musculus
ttccatttctgacttccaagttaca

SEQ ID NO: 94991 - DNA, 25 bp, mus musculus
catttctgacttccaagttacagtc

SEQ ID NO: 94992 - DNA, 25 bp, mus musculus
tgacttccaagttacagtccgtcac

SEQ ID NO: 94993 - DNA, 25 bp, mus musculus
cctgcgccgtctgatgcttcacggc

SEQ ID NO: 94994 - DNA, 25 bp, mus musculus
tgcgccgtctgatgcttcacggcgt

SEQ ID NO: 94995 - DNA, 25 bp, mus musculus
gcaccccatgtccacatactacagg

SEQ ID NO: 94996 - DNA, 25 bp, mus musculus
accccatgtccacatactacaggtc

SEQ ID NO: 94997 - DNA, 25 bp, mus musculus
catgtccacatactacaggtcctaa

SEQ ID NO: 94998 - DNA, 25 bp, mus musculus
tgtccacatactacaggtcctaagg

SEQ ID NO: 94999 - DNA, 25 bp, mus musculus
tccacatactacaggtcctaaggcc

SEQ ID NO: 95000 - DNA, 25 bp, mus musculus
cacatactacaggtcctaaggcctg

SEQ ID NO: 95001 - DNA, 25 bp, mus musculus
catactacaggtcctaaggcctgtg

SEQ ID NO: 95002 - DNA, 25 bp, mus musculus
ctacaggtcctaaggcctgtggtgg

SEQ ID NO: 95003 - DNA, 25 bp, mus musculus
taaggcctgtggtggtagtggttca

SEQ ID NO: 95004 - DNA, 25 bp, mus musculus
aggcctgtggtggtagtggttcaca

SEQ ID NO: 95005 - DNA, 25 bp, mus musculus
ccgtctgatgcttcacggcgtacat

SEQ ID NO: 95006 - DNA, 25 bp, mus musculus
gtctgatgcttcacggcgtacatac

SEQ ID NO: 95007 - DNA, 25 bp, mus musculus
ctgatgcttcacggcgtacatacgc

SEQ ID NO: 95008 - DNA, 25 bp, mus musculus
gatgcttcacggcgtacatacgctg

SEQ ID NO: 95009 - DNA, 25 bp, mus musculus
tctttgacagtgccaggttaagcaa

SEQ ID NO: 95010 - DNA, 25 bp, mus musculus
acagtgccaggttaagcaagtggac

SEQ ID NO: 95011 - DNA, 25 bp, mus musculus
cgctgactggagcctttgcactctt

SEQ ID NO: 95012 - DNA, 25 bp, mus musculus
ctgactggagcctttgcactcttgg

SEQ ID NO: 95013 - DNA, 25 bp, mus musculus
gagatgattctccatgcccttaatt

SEQ ID NO: 95014 - DNA, 25 bp, mus musculus
tgattctccatgcccttaatttcag

SEQ ID NO: 95015 - DNA, 25 bp, mus musculus
tgtcacctctgaggagtaatggact

SEQ ID NO: 95016 - DNA, 25 bp, mus musculus
tcacctctgaggagtaatggactgt

SEQ ID NO: 95017 - DNA, 25 bp, mus musculus
tatcactgggcccttttcgtcttca

SEQ ID NO: 95018 - DNA, 25 bp, mus musculus
tcactgggcccttttcgtcttcata

SEQ ID NO: 95019 - DNA, 25 bp, mus musculus
tcgtcttcataacgagaactcttgg

SEQ ID NO: 95020 - DNA, 25 bp, mus musculus
gtcttcataacgagaactcttggcc

SEQ ID NO: 95021 - DNA, 25 bp, mus musculus
cttcataacgagaactcttggccaa

SEQ ID NO: 95022 - DNA, 25 bp, mus musculus
tggtgccgcacaccagtgtcctttt

SEQ ID NO: 95023 - DNA, 25 bp, mus musculus
gtgccgcacaccagtgtccttttaa

SEQ ID NO: 95024 - DNA, 25 bp, mus musculus
gccgcacaccagtgtccttttaaag

SEQ ID NO: 95025 - DNA, 25 bp, mus musculus
attctccatgcccttaatttcagaa

SEQ ID NO: 95026 - DNA, 25 bp, mus musculus
tctccatgcccttaatttcagaacc

SEQ ID NO: 95027 - DNA, 25 bp, mus musculus
tccatgcccttaatttcagaaccat

SEQ ID NO: 95028 - DNA, 25 bp, mus musculus
tttacaagttctgtaatgtggtaga

SEQ ID NO: 95029 - DNA, 25 bp, mus musculus
ggcctgcttctgtcacctctgagga

SEQ ID NO: 95030 - DNA, 25 bp, mus musculus
cctgcttctgtcacctctgaggagt

SEQ ID NO: 95031 - DNA, 25 bp, mus musculus
tgcttctgtcacctctgaggagtaa

SEQ ID NO: 95032 - DNA, 25 bp, mus musculus
cttctgtcacctctgaggagtaatg

SEQ ID NO: 95033 - DNA, 25 bp, mus musculus
tatcatcgagccagtatacattcag

SEQ ID NO: 95034 - DNA, 25 bp, mus musculus
tcatcgagccagtatacattcagaa

SEQ ID NO: 95035 - DNA, 25 bp, mus musculus
actcgctaatgatggcagtgcagtg

SEQ ID NO: 95036 - DNA, 25 bp, mus musculus
cagtgagatcacgctgctggtagct

SEQ ID NO: 95037 - DNA, 25 bp, mus musculus
gtgagatcacgctgctggtagcttt

SEQ ID NO: 95038 - DNA, 25 bp, mus musculus
gagatcacgctgctggtagctttgg

SEQ ID NO: 95039 - DNA, 25 bp, mus musculus
ccactagctcgtccaactgataagt

SEQ ID NO: 95040 - DNA, 25 bp, mus musculus
actagctcgtccaactgataagtcc

SEQ ID NO: 95041 - DNA, 25 bp, mus musculus
tagctcgtccaactgataagtccct

SEQ ID NO: 95042 - DNA, 25 bp, mus musculus
gataagtccctgcgactgccactct

SEQ ID NO: 95043 - DNA, 25 bp, mus musculus
agtccctgcgactgccactctacga

SEQ ID NO: 95044 - DNA, 25 bp, mus musculus
tccctgcgactgccactctacgatg

SEQ ID NO: 95045 - DNA, 25 bp, mus musculus
aggatgtcagcatctacgttaagat

SEQ ID NO: 95046 - DNA, 25 bp, mus musculus
gatgtcagcatctacgttaagataa

SEQ ID NO: 95047 - DNA, 25 bp, mus musculus
tgtcagcatctacgttaagataatt

SEQ ID NO: 95048 - DNA, 25 bp, mus musculus
caacatgctgaagccacgtgttatt

SEQ ID NO: 95049 - DNA, 25 bp, mus musculus
gctgaagccacgtgttattgggccg

SEQ ID NO: 95050 - DNA, 25 bp, mus musculus
ggatagtcactcgctaatgatggca

SEQ ID NO: 95051 - DNA, 25 bp, mus musculus
atagtcactcgctaatgatggcagt

SEQ ID NO: 95052 - DNA, 25 bp, mus musculus
tcactcgctaatgatggcagtgcag

SEQ ID NO: 95053 - DNA, 25 bp, mus musculus
cccagtgcaaccacagaaggttata

SEQ ID NO: 95054 - DNA, 25 bp, mus musculus
agtgcaaccacagaaggttatagaa

SEQ ID NO: 95055 - DNA, 25 bp, mus musculus
gtctctcagtgtcaaatgcctgtca

SEQ ID NO: 95056 - DNA, 25 bp, mus musculus
cagtgtcaaatgcctgtcaacaccc

SEQ ID NO: 95057 - DNA, 25 bp, mus musculus
tgtcaaatgcctgtcaacaccctgc

SEQ ID NO: 95058 - DNA, 25 bp, mus musculus
caaatgcctgtcaacaccctgccat

SEQ ID NO: 95059 - DNA, 25 bp, mus musculus
ctgccatacttcgggacacatctgt

SEQ ID NO: 95060 - DNA, 25 bp, mus musculus
ccatacttcgggacacatctgttac

SEQ ID NO: 95061 - DNA, 25 bp, mus musculus
tacttcgggacacatctgttacttt

SEQ ID NO: 95062 - DNA, 25 bp, mus musculus
gggacacatctgttactttgtgagc

SEQ ID NO: 95063 - DNA, 25 bp, mus musculus
acacatctgttactttgtgagcaag

SEQ ID NO: 95064 - DNA, 25 bp, mus musculus
catctgttactttgtgagcaagcct

SEQ ID NO: 95065 - DNA, 25 bp, mus musculus
aaagcaccgtgtcaaactgaccaca

SEQ ID NO: 95066 - DNA, 25 bp, mus musculus
gcaccaccactgggaccacgctggt

SEQ ID NO: 95067 - DNA, 25 bp, mus musculus
ccacgctggtgggaacgagaagctg

SEQ ID NO: 95068 - DNA, 25 bp, mus musculus
aggtgatgaccgcatcggagccttg

SEQ ID NO: 95069 - DNA, 25 bp, mus musculus
tgatgaccgcatcggagccttgact

SEQ ID NO: 95070 - DNA, 25 bp, mus musculus
catcggagccttgactcacaaggtc

SEQ ID NO: 95071 - DNA, 25 bp, mus musculus
cttgactcacaaggtcacacacctc

SEQ ID NO: 95072 - DNA, 25 bp, mus musculus
ggggtctctcagtgtcaaatgcctg

SEQ ID NO: 95073 - DNA, 25 bp, mus musculus
tgacttcagcgccacagcatgctgg

SEQ ID NO: 95074 - DNA, 25 bp, mus musculus
cagcgccacagcatgctggttatgg

SEQ ID NO: 95075 - DNA, 25 bp, mus musculus
cactcctaccaggacattctctcga

SEQ ID NO: 95076 - DNA, 25 bp, mus musculus
taccaggacattctctcgaggtcag

SEQ ID NO: 95077 - DNA, 25 bp, mus musculus
ctctcgaggtcagggcataactgga

SEQ ID NO: 95078 - DNA, 25 bp, mus musculus
ctgttcagactcaaaactagaacca

SEQ ID NO: 95079 - DNA, 25 bp, mus musculus
agaaccacagggcagaagggtcaga

SEQ ID NO: 95080 - DNA, 25 bp, mus musculus
cctgccctggactgagttcctatgt

SEQ ID NO: 95081 - DNA, 25 bp, mus musculus
tgagttcctatgttaacagacacgc

SEQ ID NO: 95082 - DNA, 25 bp, mus musculus
cccagaaactgccctgggaaatgct

SEQ ID NO: 95083 - DNA, 25 bp, mus musculus
aaatgctttctggctgcatctggag

SEQ ID NO: 95084 - DNA, 25 bp, mus musculus
tttctggctgcatctggagatcttt

SEQ ID NO: 95085 - DNA, 25 bp, mus musculus
cagaagtgctcttttcacacagact

SEQ ID NO: 95086 - DNA, 25 bp, mus musculus
acagactacacgacaccaggaggcc

SEQ ID NO: 95087 - DNA, 25 bp, mus musculus
acaccaggaggccagcatgccagca

SEQ ID NO: 95088 - DNA, 25 bp, mus musculus
cagcatgccagcagcttctgaatgt

SEQ ID NO: 95089 - DNA, 25 bp, mus musculus
gccagcagcttctgaatgttgagac

SEQ ID NO: 95090 - DNA, 25 bp, mus musculus
ttgagaccagcctagatcaggatga

SEQ ID NO: 95091 - DNA, 25 bp, mus musculus
gccaggcctgaggcttggacattga

SEQ ID NO: 95092 - DNA, 25 bp, mus musculus
agccaaggctatggggcctaagtgg

SEQ ID NO: 95093 - DNA, 25 bp, mus musculus
tcaatcagaagcccagggtccaggt

SEQ ID NO: 95094 - DNA, 25 bp, mus musculus
agcccagggtccaggtgacgaagag

SEQ ID NO: 95095 - DNA, 25 bp, mus musculus
cagaagccaaggccagctacctgac

SEQ ID NO: 95096 - DNA, 25 bp, mus musculus
aagccaaggccagctacctgacgct

SEQ ID NO: 95097 - DNA, 25 bp, mus musculus
ccagctacctgacgcttcagagact

SEQ ID NO: 95098 - DNA, 25 bp, mus musculus
gctacctgacgcttcagagactgat

SEQ ID NO: 95099 - DNA, 25 bp, mus musculus
acctgacgcttcagagactgatgtc

SEQ ID NO: 95100 - DNA, 25 bp, mus musculus
cgcttcagagactgatgtcgaggct

SEQ ID NO: 95101 - DNA, 25 bp, mus musculus
ttcagagactgatgtcgaggcttga

SEQ ID NO: 95102 - DNA, 25 bp, mus musculus
gctacttcataccagacctttccct

SEQ ID NO: 95103 - DNA, 25 bp, mus musculus
tttccctaggagaagccaagaatgc

SEQ ID NO: 95104 - DNA, 25 bp, mus musculus
taatgatgcaacacttctcactgca

SEQ ID NO: 95105 - DNA, 25 bp, mus musculus
tgacgaagaggcccaggtggagaac

SEQ ID NO: 95106 - DNA, 25 bp, mus musculus
gaacctcatcactacaaacgctgcg

SEQ ID NO: 95107 - DNA, 25 bp, mus musculus
catcactacaaacgctgcgggccca

SEQ ID NO: 95108 - DNA, 25 bp, mus musculus
tacaaacgctgcgggcccagaaggc

SEQ ID NO: 95109 - DNA, 25 bp, mus musculus
aaacgctgcgggcccagaaggcaga

SEQ ID NO: 95110 - DNA, 25 bp, mus musculus
cagcctccagcgtgaagcctccaga

SEQ ID NO: 95111 - DNA, 25 bp, mus musculus
cctccagcgtgaagcctccagaagc

SEQ ID NO: 95112 - DNA, 25 bp, mus musculus
agcctccagaagccaaggccagcta

SEQ ID NO: 95113 - DNA, 25 bp, mus musculus
atctcaaaattccttcagttccagc

SEQ ID NO: 95114 - DNA, 25 bp, mus musculus
ttccttcagttccagcttactgtta

SEQ ID NO: 95115 - DNA, 25 bp, mus musculus
tcgccacttaaggcggtgcagatgc

SEQ ID NO: 95116 - DNA, 25 bp, mus musculus
ccacttaaggcggtgcagatgctct

SEQ ID NO: 95117 - DNA, 25 bp, mus musculus
tgggtaaacctcatcatggacacgc

SEQ ID NO: 95118 - DNA, 25 bp, mus musculus
aacctcatcatggacacgctggctt

SEQ ID NO: 95119 - DNA, 25 bp, mus musculus
ctcatcatggacacgctggcttccc

SEQ ID NO: 95120 - DNA, 25 bp, mus musculus
tccctggctctggctacggaaccac

SEQ ID NO: 95121 - DNA, 25 bp, mus musculus
ctggctctggctacggaaccaccca

SEQ ID NO: 95122 - DNA, 25 bp, mus musculus
gagtcactcctgcttcggaagcctt

SEQ ID NO: 95123 - DNA, 25 bp, mus musculus
ctcctgcttcggaagccttatggta

SEQ ID NO: 95124 - DNA, 25 bp, mus musculus
ctgcttcggaagccttatggtagaa

SEQ ID NO: 95125 - DNA, 25 bp, mus musculus
cttcagttccagcttactgttaatg

SEQ ID NO: 95126 - DNA, 25 bp, mus musculus
cagttccagcttactgttaatgtag

SEQ ID NO: 95127 - DNA, 25 bp, mus musculus
gtgattgttgctttcacgggcgctt

SEQ ID NO: 95128 - DNA, 25 bp, mus musculus
gttgctttcacgggcgcttgtatta

SEQ ID NO: 95129 - DNA, 25 bp, mus musculus
ttcacgggcgcttgtattactcaag

SEQ ID NO: 95130 - DNA, 25 bp, mus musculus
tgtattactcaagactcgccactta

SEQ ID NO: 95131 - DNA, 25 bp, mus musculus
attactcaagactcgccacttaagg

SEQ ID NO: 95132 - DNA, 25 bp, mus musculus
gactcgccacttaaggcggtgcaga

SEQ ID NO: 95133 - DNA, 25 bp, mus musculus
gtactcaaaattcacacctagctag

SEQ ID NO: 95134 - DNA, 25 bp, mus musculus
acctagctagtcaccgtggagttca

SEQ ID NO: 95135 - DNA, 25 bp, mus musculus
caaatcttgcaagacattggagagt

SEQ ID NO: 95136 - DNA, 25 bp, mus musculus
cttttagtgtgcgttctagcctgat

SEQ ID NO: 95137 - DNA, 25 bp, mus musculus
gtgtgcgttctagcctgattgccca

SEQ ID NO: 95138 - DNA, 25 bp, mus musculus
tgcgttctagcctgattgcccatca

SEQ ID NO: 95139 - DNA, 25 bp, mus musculus
gttctagcctgattgcccatcaagt

SEQ ID NO: 95140 - DNA, 25 bp, mus musculus
ctagcctgattgcccatcaagtaat

SEQ ID NO: 95141 - DNA, 25 bp, mus musculus
tgattgcccatcaagtaatccatac

SEQ ID NO: 95142 - DNA, 25 bp, mus musculus
ttgcccatcaagtaatccatactgg

SEQ ID NO: 95143 - DNA, 25 bp, mus musculus
tcagtcagacttcaagcctttcaat

SEQ ID NO: 95144 - DNA, 25 bp, mus musculus
gtcagacttcaagcctttcaatcca

SEQ ID NO: 95145 - DNA, 25 bp, mus musculus
ctagtcaccgtggagttcacagtgg

SEQ ID NO: 95146 - DNA, 25 bp, mus musculus
agacttcaagcctttcaatccatca

SEQ ID NO: 95147 - DNA, 25 bp, mus musculus
gtcaccgtggagttcacagtgggga

SEQ ID NO: 95148 - DNA, 25 bp, mus musculus
gtggcaaactcttcagccaaacttc

SEQ ID NO: 95149 - DNA, 25 bp, mus musculus
gcaaactcttcagccaaacttcaaa

SEQ ID NO: 95150 - DNA, 25 bp, mus musculus
tcttcagccaaacttcaaatcttgc

SEQ ID NO: 95151 - DNA, 25 bp, mus musculus
tcagccaaacttcaaatcttgcaag

SEQ ID NO: 95152 - DNA, 25 bp, mus musculus
gccaaacttcaaatcttgcaagaca

SEQ ID NO: 95153 - DNA, 25 bp, mus musculus
aaacttcaaatcttgcaagacattg

SEQ ID NO: 95154 - DNA, 25 bp, mus musculus
tccctcatacaactagaccgaagcg

SEQ ID NO: 95155 - DNA, 25 bp, mus musculus
atacaactagaccgaagcgtgacta

SEQ ID NO: 95156 - DNA, 25 bp, mus musculus
accatctgtatgggacgagcgtgca

SEQ ID NO: 95157 - DNA, 25 bp, mus musculus
atctgtatgggacgagcgtgcagtc

SEQ ID NO: 95158 - DNA, 25 bp, mus musculus
tgcagtccgtgcgagcagtggcaga

SEQ ID NO: 95159 - DNA, 25 bp, mus musculus
agtccgtgcgagcagtggcagagaa

SEQ ID NO: 95160 - DNA, 25 bp, mus musculus
gcaaacattgtatccttgatgtgtc

SEQ ID NO: 95161 - DNA, 25 bp, mus musculus
attgtatccttgatgtgtctggaaa

SEQ ID NO: 95162 - DNA, 25 bp, mus musculus
gtatccttgatgtgtctggaaatgc

SEQ ID NO: 95163 - DNA, 25 bp, mus musculus
agattgcacagctttatccaatatc

SEQ ID NO: 95164 - DNA, 25 bp, mus musculus
cacagctttatccaatatctatttt

SEQ ID NO: 95165 - DNA, 25 bp, mus musculus
aacccaaatccatggaaaatatcat

SEQ ID NO: 95166 - DNA, 25 bp, mus musculus
ctagaccgaagcgtgactatgaggt

SEQ ID NO: 95167 - DNA, 25 bp, mus musculus
attatcattttgtgacttcaaggga

SEQ ID NO: 95168 - DNA, 25 bp, mus musculus
attttgtgacttcaagggaacagat

SEQ ID NO: 95169 - DNA, 25 bp, mus musculus
tcattgaagccggccagtataacaa

SEQ ID NO: 95170 - DNA, 25 bp, mus musculus
ttgaagccggccagtataacaacca

SEQ ID NO: 95171 - DNA, 25 bp, mus musculus
gccagtataacaaccatctgtatgg

SEQ ID NO: 95172 - DNA, 25 bp, mus musculus
agtataacaaccatctgtatgggac

SEQ ID NO: 95173 - DNA, 25 bp, mus musculus
acaaccatctgtatgggacgagcgt

SEQ ID NO: 95174 - DNA, 25 bp, mus musculus
tcacaccatcgaggatgaagctctc

SEQ ID NO: 95175 - DNA, 25 bp, mus musculus
ggatgaagctctctacaacagacta

SEQ ID NO: 95176 - DNA, 25 bp, mus musculus
tgataaggccaactactcactcaac

SEQ ID NO: 95177 - DNA, 25 bp, mus musculus
agaataccaatagccaccacagact

SEQ ID NO: 95178 - DNA, 25 bp, mus musculus
ataccaatagccaccacagactgac

SEQ ID NO: 95179 - DNA, 25 bp, mus musculus
ggccaggtctgtcctctgattggat

SEQ ID NO: 95180 - DNA, 25 bp, mus musculus
tgtcctctgattggatatcctggct

SEQ ID NO: 95181 - DNA, 25 bp, mus musculus
attggatatcctggctaggtcccag

SEQ ID NO: 95182 - DNA, 25 bp, mus musculus
ggatatcctggctaggtcccagggg

SEQ ID NO: 95183 - DNA, 25 bp, mus musculus
tatcctggctaggtcccaggggact

SEQ ID NO: 95184 - DNA, 25 bp, mus musculus
taggtcccaggggacttgacaatca

SEQ ID NO: 95185 - DNA, 25 bp, mus musculus
gacttgacaatcatgcacatgaatt

SEQ ID NO: 95186 - DNA, 25 bp, mus musculus
tgaagctctctacaacagactactg

SEQ ID NO: 95187 - DNA, 25 bp, mus musculus
agctctctacaacagactactgaaa

SEQ ID NO: 95188 - DNA, 25 bp, mus musculus
catgcactttgaggtctgcccctgg

SEQ ID NO: 95189 - DNA, 25 bp, mus musculus
gtccagctacctcacaggcgcctgg

SEQ ID NO: 95190 - DNA, 25 bp, mus musculus
cagctacctcacaggcgcctgggat

SEQ ID NO: 95191 - DNA, 25 bp, mus musculus
cgcctgggatcccaaaacgacgcat

SEQ ID NO: 95192 - DNA, 25 bp, mus musculus
ggatcccaaaacgacgcatgcggtt

SEQ ID NO: 95193 - DNA, 25 bp, mus musculus
tgttcgcttcaagaatgataaggcc

SEQ ID NO: 95194 - DNA, 25 bp, mus musculus
tgatgagatcctgttcctcttcctt

SEQ ID NO: 95195 - DNA, 25 bp, mus musculus
tgagatcctgttcctcttccttatc

SEQ ID NO: 95196 - DNA, 25 bp, mus musculus
caaatccgtcatcttcttcagaagc

SEQ ID NO: 95197 - DNA, 25 bp, mus musculus
atccgtcatcttcttcagaagccct

SEQ ID NO: 95198 - DNA, 25 bp, mus musculus
cgtcatcttcttcagaagccctttc

SEQ ID NO: 95199 - DNA, 25 bp, mus musculus
catcttcttcagaagccctttcgac

SEQ ID NO: 95200 - DNA, 25 bp, mus musculus
cttcttcagaagccctttcgacagg

SEQ ID NO: 95201 - DNA, 25 bp, mus musculus
aagactgtgccaccgggctcagctc

SEQ ID NO: 95202 - DNA, 25 bp, mus musculus
ccatcttccactcagtggtaagaca

SEQ ID NO: 95203 - DNA, 25 bp, mus musculus
tggtaagacaccttctctccctgga

SEQ ID NO: 95204 - DNA, 25 bp, mus musculus
taagacaccttctctccctggagct

SEQ ID NO: 95205 - DNA, 25 bp, mus musculus
tctccctggagctcctccatcttgg

SEQ ID NO: 95206 - DNA, 25 bp, mus musculus
cctgttcctcttccttatccagctt

SEQ ID NO: 95207 - DNA, 25 bp, mus musculus
cttccttatccagctttttgaccag

SEQ ID NO: 95208 - DNA, 25 bp, mus musculus
ccttatccagctttttgaccagtgg

SEQ ID NO: 95209 - DNA, 25 bp, mus musculus
tatccagctttttgaccagtggggc

SEQ ID NO: 95210 - DNA, 25 bp, mus musculus
gctttttgaccagtggggcactaat

SEQ ID NO: 95211 - DNA, 25 bp, mus musculus
ggatgtccacaaatccgtcatcttc

SEQ ID NO: 95212 - DNA, 25 bp, mus musculus
tgtccacaaatccgtcatcttcttc

SEQ ID NO: 95213 - DNA, 25 bp, mus musculus
ccacaaatccgtcatcttcttcaga

SEQ ID NO: 95214 - DNA, 25 bp, mus musculus
catcggtgactctgtagtagctagt

SEQ ID NO: 95215 - DNA, 25 bp, mus musculus
catcatgagagtcggtcctgccagc

SEQ ID NO: 95216 - DNA, 25 bp, mus musculus
aaagtgcagtctgatgtggctgctg

SEQ ID NO: 95217 - DNA, 25 bp, mus musculus
gtgcagtctgatgtggctgctgact

SEQ ID NO: 95218 - DNA, 25 bp, mus musculus
tgcagtctgatgtggctgctgactt

SEQ ID NO: 95219 - DNA, 25 bp, mus musculus
gcagtctgatgtggctgctgactta

SEQ ID NO: 95220 - DNA, 25 bp, mus musculus
cagtctgatgtggctgctgacttag

SEQ ID NO: 95221 - DNA, 25 bp, mus musculus
agtctgatgtggctgctgacttagt

SEQ ID NO: 95222 - DNA, 25 bp, mus musculus
tctgatgtggctgctgacttagtac

SEQ ID NO: 95223 - DNA, 25 bp, mus musculus
ctgatgtggctgctgacttagtacg

SEQ ID NO: 95224 - DNA, 25 bp, mus musculus
atgtggctgctgacttagtacgctg

SEQ ID NO: 95225 - DNA, 25 bp, mus musculus
gctgctgacttagtacgctgaaagt

SEQ ID NO: 95226 - DNA, 25 bp, mus musculus
atcatgagagtcggtcctgccagcc

SEQ ID NO: 95227 - DNA, 25 bp, mus musculus
ctgctgacttagtacgctgaaagtc

SEQ ID NO: 95228 - DNA, 25 bp, mus musculus
cctgccagcctggccagtccaggag

SEQ ID NO: 95229 - DNA, 25 bp, mus musculus
tgccagcctggccagtccaggagcg

SEQ ID NO: 95230 - DNA, 25 bp, mus musculus
gccagcctggccagtccaggagcga

SEQ ID NO: 95231 - DNA, 25 bp, mus musculus
ctggccagtccaggagcgagaatgt

SEQ ID NO: 95232 - DNA, 25 bp, mus musculus
ccagtccaggagcgagaatgttcaa

SEQ ID NO: 95233 - DNA, 25 bp, mus musculus
tcaaagtgcagtctgatgtggctgc

SEQ ID NO: 95234 - DNA, 25 bp, mus musculus
caaagtgcagtctgatgtggctgct

SEQ ID NO: 95235 - DNA, 25 bp, mus musculus
agacttcaccattgagtgcacggtg

SEQ ID NO: 95236 - DNA, 25 bp, mus musculus
cttcaccattgagtgcacggtgtcc

SEQ ID NO: 95237 - DNA, 25 bp, mus musculus
tctcaacttttcctgccaggctgag

SEQ ID NO: 95238 - DNA, 25 bp, mus musculus
caacttttcctgccaggctgagctg

SEQ ID NO: 95239 - DNA, 25 bp, mus musculus
cttttcctgccaggctgagctggat

SEQ ID NO: 95240 - DNA, 25 bp, mus musculus
ctgccaggctgagctggatctacgg

SEQ ID NO: 95241 - DNA, 25 bp, mus musculus
acggccccatggatggtatatcatc

SEQ ID NO: 95242 - DNA, 25 bp, mus musculus
atggtatatcatccgcagcatctcg

SEQ ID NO: 95243 - DNA, 25 bp, mus musculus
gtatatcatccgcagcatctcggag

SEQ ID NO: 95244 - DNA, 25 bp, mus musculus
catccgcagcatctcggagtaacag

SEQ ID NO: 95245 - DNA, 25 bp, mus musculus
ccgcagcatctcggagtaacagatt

SEQ ID NO: 95246 - DNA, 25 bp, mus musculus
cagcatctcggagtaacagattctt

SEQ ID NO: 95247 - DNA, 25 bp, mus musculus
tctgctccgtggcagagagaccctg

SEQ ID NO: 95248 - DNA, 25 bp, mus musculus
agaggccacagccacgttcaacagc

SEQ ID NO: 95249 - DNA, 25 bp, mus musculus
cacagccacgttcaacagcacagct

SEQ ID NO: 95250 - DNA, 25 bp, mus musculus
cacgttcaacagcacagctctgaaa

SEQ ID NO: 95251 - DNA, 25 bp, mus musculus
gttcaacagcacagctctgaaaaag

SEQ ID NO: 95252 - DNA, 25 bp, mus musculus
caacagcacagctctgaaaaaggac

SEQ ID NO: 95253 - DNA, 25 bp, mus musculus
cagcacagctctgaaaaaggacggt

SEQ ID NO: 95254 - DNA, 25 bp, mus musculus
cggtctcaacttttcctgccaggct

SEQ ID NO: 95255 - DNA, 25 bp, mus musculus
aatctattgatgtcaggaggaagat

SEQ ID NO: 95256 - DNA, 25 bp, mus musculus
agatcatcaaagacaaactcctctg

SEQ ID NO: 95257 - DNA, 25 bp, mus musculus
tgggcttcttcaatatgtaaaacaa

SEQ ID NO: 95258 - DNA, 25 bp, mus musculus
acaaggctgctgacctgacgaaggc

SEQ ID NO: 95259 - DNA, 25 bp, mus musculus
aggctgctgacctgacgaaggcgtt

SEQ ID NO: 95260 - DNA, 25 bp, mus musculus
ctgctgacctgacgaaggcgtttat

SEQ ID NO: 95261 - DNA, 25 bp, mus musculus
ctgacctgacgaaggcgtttattag

SEQ ID NO: 95262 - DNA, 25 bp, mus musculus
aatgcttgcagacctttcatccaat

SEQ ID NO: 95263 - DNA, 25 bp, mus musculus
agacctttcatccaatcctctgctt

SEQ ID NO: 95264 - DNA, 25 bp, mus musculus
cctttcatccaatcctctgcttgtt

SEQ ID NO: 95265 - DNA, 25 bp, mus musculus
ttcatccaatcctctgcttgttctg

SEQ ID NO: 95266 - DNA, 25 bp, mus musculus
atccaatcctctgcttgttctggag

SEQ ID NO: 95267 - DNA, 25 bp, mus musculus
tcatcaaagacaaactcctctgacc

SEQ ID NO: 95268 - DNA, 25 bp, mus musculus
caatcctctgcttgttctggagttt

SEQ ID NO: 95269 - DNA, 25 bp, mus musculus
tcaaagacaaactcctctgaccata

SEQ ID NO: 95270 - DNA, 25 bp, mus musculus
aagacaaactcctctgaccatactg

SEQ ID NO: 95271 - DNA, 25 bp, mus musculus
tctgaccatactgggttttgcccct

SEQ ID NO: 95272 - DNA, 25 bp, mus musculus
tcccttgcatgagtttttgctactt

SEQ ID NO: 95273 - DNA, 25 bp, mus musculus
gctacttggacgctattcaagtaga

SEQ ID NO: 95274 - DNA, 25 bp, mus musculus
acttggacgctattcaagtagatgt

SEQ ID NO: 95275 - DNA, 25 bp, mus musculus
ttatgggcttcttcaatatgtaaaa

SEQ ID NO: 95276 - DNA, 25 bp, mus musculus
gtcaactatgccagcgtcaccagga

SEQ ID NO: 95277 - DNA, 25 bp, mus musculus
aactatgccagcgtcaccaggaacc

SEQ ID NO: 95278 - DNA, 25 bp, mus musculus
tgtcattgactgtggcaatgctggc

SEQ ID NO: 95279 - DNA, 25 bp, mus musculus
tggcaatgctggctcttgtgaaggg

SEQ ID NO: 95280 - DNA, 25 bp, mus musculus
gtatgcccacaagcatggcatcccc

SEQ ID NO: 95281 - DNA, 25 bp, mus musculus
tgcccacaagcatggcatccccgat

SEQ ID NO: 95282 - DNA, 25 bp, mus musculus
caagcatggcatccccgatgagacc

SEQ ID NO: 95283 - DNA, 25 bp, mus musculus
gcatggcatccccgatgagacctgc

SEQ ID NO: 95284 - DNA, 25 bp, mus musculus
tggcatccccgatgagacctgcaac

SEQ ID NO: 95285 - DNA, 25 bp, mus musculus
cgatgagacctgcaacaactaccag

SEQ ID NO: 95286 - DNA, 25 bp, mus musculus
tgagacctgcaacaactaccaggcc

SEQ ID NO: 95287 - DNA, 25 bp, mus musculus
ctgcaacaactaccaggccaaggac

SEQ ID NO: 95288 - DNA, 25 bp, mus musculus
gccagcgtcaccaggaaccagcaca

SEQ ID NO: 95289 - DNA, 25 bp, mus musculus
aggaaccagcacatcccacagtact

SEQ ID NO: 95290 - DNA, 25 bp, mus musculus
cagcacatcccacagtactgtggtt

SEQ ID NO: 95291 - DNA, 25 bp, mus musculus
tgggcccacggagcaccagtgccat

SEQ ID NO: 95292 - DNA, 25 bp, mus musculus
gcccacggagcaccagtgccatgga

SEQ ID NO: 95293 - DNA, 25 bp, mus musculus
cacggagcaccagtgccatggagac

SEQ ID NO: 95294 - DNA, 25 bp, mus musculus
gcaccagtgccatggagaccgaatc

SEQ ID NO: 95295 - DNA, 25 bp, mus musculus
ccagtgccatggagaccgaatcaac

SEQ ID NO: 95296 - DNA, 25 bp, mus musculus
cactctgtacctggctgcgggcgcc

SEQ ID NO: 95297 - DNA, 25 bp, mus musculus
gcctgcttctggccaccgcgcggat

SEQ ID NO: 95298 - DNA, 25 bp, mus musculus
cattcttaccggagagtcttgattt

SEQ ID NO: 95299 - DNA, 25 bp, mus musculus
ttcttaccggagagtcttgatttat

SEQ ID NO: 95300 - DNA, 25 bp, mus musculus
cttaccggagagtcttgatttattg

SEQ ID NO: 95301 - DNA, 25 bp, mus musculus
tcctggaatgtaccctccgaatagc

SEQ ID NO: 95302 - DNA, 25 bp, mus musculus
ctggaatgtaccctccgaatagcaa

SEQ ID NO: 95303 - DNA, 25 bp, mus musculus
ggaatgtaccctccgaatagcaaat

SEQ ID NO: 95304 - DNA, 25 bp, mus musculus
aatgtaccctccgaatagcaaatgt

SEQ ID NO: 95305 - DNA, 25 bp, mus musculus
tgtaccctccgaatagcaaatgtac

SEQ ID NO: 95306 - DNA, 25 bp, mus musculus
taccctccgaatagcaaatgtactt

SEQ ID NO: 95307 - DNA, 25 bp, mus musculus
ccctccgaatagcaaatgtacttgg

SEQ ID NO: 95308 - DNA, 25 bp, mus musculus
ctgcttctggccaccgcgcggatgg

SEQ ID NO: 95309 - DNA, 25 bp, mus musculus
agacgccagagagacctgttttcgc

SEQ ID NO: 95310 - DNA, 25 bp, mus musculus
gacctgttttcgcatgtggcggcat

SEQ ID NO: 95311 - DNA, 25 bp, mus musculus
cctgttttcgcatgtggcggcattc

SEQ ID NO: 95312 - DNA, 25 bp, mus musculus
cgcatgtggcggcattcttaccgga

SEQ ID NO: 95313 - DNA, 25 bp, mus musculus
tggcggcattcttaccggagagtct

SEQ ID NO: 95314 - DNA, 25 bp, mus musculus
gcggcattcttaccggagagtcttg

SEQ ID NO: 95315 - DNA, 25 bp, mus musculus
ggcattcttaccggagagtcttgat

SEQ ID NO: 95316 - DNA, 25 bp, mus musculus
gttcccaggtacaacaaacgctcat

SEQ ID NO: 95317 - DNA, 25 bp, mus musculus
cccaggtacaacaaacgctcattag

SEQ ID NO: 95318 - DNA, 25 bp, mus musculus
tcacctgcacaagggaggctacaaa

SEQ ID NO: 95319 - DNA, 25 bp, mus musculus
ctacaaaccttccagcctgacttga

SEQ ID NO: 95320 - DNA, 25 bp, mus musculus
caaaccttccagcctgacttgaggc

SEQ ID NO: 95321 - DNA, 25 bp, mus musculus
accttccagcctgacttgaggctaa

SEQ ID NO: 95322 - DNA, 25 bp, mus musculus
cagcctgacttgaggctaagagcat

SEQ ID NO: 95323 - DNA, 25 bp, mus musculus
ttgggtcaggggcagccaagctgct

SEQ ID NO: 95324 - DNA, 25 bp, mus musculus
tgcccggctcactgggaacactggg

SEQ ID NO: 95325 - DNA, 25 bp, mus musculus
gctcactgggaacactggggccagg

SEQ ID NO: 95326 - DNA, 25 bp, mus musculus
tctatactagggggaccaggccttg

SEQ ID NO: 95327 - DNA, 25 bp, mus musculus
cccctggagctgggacctgaatcta

SEQ ID NO: 95328 - DNA, 25 bp, mus musculus
tacaacaaacgctcattagatgata

SEQ ID NO: 95329 - DNA, 25 bp, mus musculus
ccctggcagccttggccagggagag

SEQ ID NO: 95330 - DNA, 25 bp, mus musculus
gaaatggtctctaagcccgctaggc

SEQ ID NO: 95331 - DNA, 25 bp, mus musculus
atggtctctaagcccgctaggcctt

SEQ ID NO: 95332 - DNA, 25 bp, mus musculus
tctaagcccgctaggcctttccctg

SEQ ID NO: 95333 - DNA, 25 bp, mus musculus
aggcctttccctggtccatcacctg

SEQ ID NO: 95334 - DNA, 25 bp, mus musculus
ttccctggtccatcacctgcacaag

SEQ ID NO: 95335 - DNA, 25 bp, mus musculus
ccatcacctgcacaagggaggctac

SEQ ID NO: 95336 - DNA, 25 bp, mus musculus
agactgttggacactgtggcatctc

SEQ ID NO: 95337 - DNA, 25 bp, mus musculus
actgtggcatctcagactacttggc

SEQ ID NO: 95338 - DNA, 25 bp, mus musculus
tgtctacctcgttaacaaacagcac

SEQ ID NO: 95339 - DNA, 25 bp, mus musculus
cctcgttaacaaacagcactggtgt

SEQ ID NO: 95340 - DNA, 25 bp, mus musculus
taacaaacagcactggtgttccaac

SEQ ID NO: 95341 - DNA, 25 bp, mus musculus
acagcactggtgttccaactcctgc

SEQ ID NO: 95342 - DNA, 25 bp, mus musculus
cccccaaaacaatcattgctgcttc

SEQ ID NO: 95343 - DNA, 25 bp, mus musculus
ccaaaacaatcattgctgcttcttt

SEQ ID NO: 95344 - DNA, 25 bp, mus musculus
tcattgctgcttctttgttcatggc

SEQ ID NO: 95345 - DNA, 25 bp, mus musculus
gtgtcatcagcaacggcctctatct

SEQ ID NO: 95346 - DNA, 25 bp, mus musculus
tcatcagcaacggcctctatctatg

SEQ ID NO: 95347 - DNA, 25 bp, mus musculus
tcagcaacggcctctatctatggat

SEQ ID NO: 95348 - DNA, 25 bp, mus musculus
gtggcatctcagactacttggcatg

SEQ ID NO: 95349 - DNA, 25 bp, mus musculus
acggcctctatctatggatgctgca

SEQ ID NO: 95350 - DNA, 25 bp, mus musculus
tctcagactacttggcatgaagaca

SEQ ID NO: 95351 - DNA, 25 bp, mus musculus
cagactacttggcatgaagacacag

SEQ ID NO: 95352 - DNA, 25 bp, mus musculus
catgaagacacagctctgaggtaat

SEQ ID NO: 95353 - DNA, 25 bp, mus musculus
gaagacacagctctgaggtaattat

SEQ ID NO: 95354 - DNA, 25 bp, mus musculus
ccactcatgtgatcaatgtgtctac

SEQ ID NO: 95355 - DNA, 25 bp, mus musculus
tcaatgtgtctacctcgttaacaaa

SEQ ID NO: 95356 - DNA, 25 bp, mus musculus
atgtgtctacctcgttaacaaacag

SEQ ID NO: 95357 - DNA, 25 bp, mus musculus
agccaatacaactgatccagggagg

SEQ ID NO: 95358 - DNA, 25 bp, mus musculus
ccaatacaactgatccagggaggaa

SEQ ID NO: 95359 - DNA, 25 bp, mus musculus
aagtagcttgtggcgctggtcgaga

SEQ ID NO: 95360 - DNA, 25 bp, mus musculus
agcttgtggcgctggtcgagagcac

SEQ ID NO: 95361 - DNA, 25 bp, mus musculus
cttgtggcgctggtcgagagcacac

SEQ ID NO: 95362 - DNA, 25 bp, mus musculus
tggcgctggtcgagagcacacaata

SEQ ID NO: 95363 - DNA, 25 bp, mus musculus
cacacaatagcgaattcccaaggag

SEQ ID NO: 95364 - DNA, 25 bp, mus musculus
cacaatagcgaattcccaaggagcc

SEQ ID NO: 95365 - DNA, 25 bp, mus musculus
aggagcctaccaagaggcgtcttga

SEQ ID NO: 95366 - DNA, 25 bp, mus musculus
gagcctaccaagaggcgtcttgata

SEQ ID NO: 95367 - DNA, 25 bp, mus musculus
gcctaccaagaggcgtcttgatatc

SEQ ID NO: 95368 - DNA, 25 bp, mus musculus
ctaccaagaggcgtcttgatatcag

SEQ ID NO: 95369 - DNA, 25 bp, mus musculus
aatacaactgatccagggaggaagg

SEQ ID NO: 95370 - DNA, 25 bp, mus musculus
tacaactgatccagggaggaaggtc

SEQ ID NO: 95371 - DNA, 25 bp, mus musculus
caactgatccagggaggaaggtctg

SEQ ID NO: 95372 - DNA, 25 bp, mus musculus
gaaggtctgctgtctggaagtgaag

SEQ ID NO: 95373 - DNA, 25 bp, mus musculus
gattaggtccggtagcttgatgaag

SEQ ID NO: 95374 - DNA, 25 bp, mus musculus
ttaggtccggtagcttgatgaagta

SEQ ID NO: 95375 - DNA, 25 bp, mus musculus
aggtccggtagcttgatgaagtagc

SEQ ID NO: 95376 - DNA, 25 bp, mus musculus
tgaagtagcttgtggcgctggtcga

SEQ ID NO: 95377 - DNA, 25 bp, mus musculus
cagccttgcgggatggaggcgactt

SEQ ID NO: 95378 - DNA, 25 bp, mus musculus
actttggagcagcatttggaggaca

SEQ ID NO: 95379 - DNA, 25 bp, mus musculus
ctgtcggatgagcacgctggagtca

SEQ ID NO: 95380 - DNA, 25 bp, mus musculus
tcggatgagcacgctggagtcatat

SEQ ID NO: 95381 - DNA, 25 bp, mus musculus
gatgagcacgctggagtcatatctg

SEQ ID NO: 95382 - DNA, 25 bp, mus musculus
gtcatatctgttctagcccagcagg

SEQ ID NO: 95383 - DNA, 25 bp, mus musculus
atatctgttctagcccagcaggcag

SEQ ID NO: 95384 - DNA, 25 bp, mus musculus
tctgttctagcccagcaggcagcta

SEQ ID NO: 95385 - DNA, 25 bp, mus musculus
gcccagcaggcagctaggctaacct

SEQ ID NO: 95386 - DNA, 25 bp, mus musculus
gcagctaggctaacctctgacccca

SEQ ID NO: 95387 - DNA, 25 bp, mus musculus
cccaccgacatccctgtggtatgtt

SEQ ID NO: 95388 - DNA, 25 bp, mus musculus
gacatccctgtggtatgtttagaat

SEQ ID NO: 95389 - DNA, 25 bp, mus musculus
ccatccattgttggagtcctatgca

SEQ ID NO: 95390 - DNA, 25 bp, mus musculus
tccattgttggagtcctatgcacag

SEQ ID NO: 95391 - DNA, 25 bp, mus musculus
ctatgcacagattcacaaggactta

SEQ ID NO: 95392 - DNA, 25 bp, mus musculus
ggacttaatctgggctgccgtggta

SEQ ID NO: 95393 - DNA, 25 bp, mus musculus
aatctgggctgccgtggtaccctgt

SEQ ID NO: 95394 - DNA, 25 bp, mus musculus
tgccgtggtaccctgtcggatgagc

SEQ ID NO: 95395 - DNA, 25 bp, mus musculus
ggtaccctgtcggatgagcacgctg

SEQ ID NO: 95396 - DNA, 25 bp, mus musculus
accctgtcggatgagcacgctggag

SEQ ID NO: 95397 - DNA, 25 bp, mus musculus
tttgtgctattgctaactgcgcaaa

SEQ ID NO: 95398 - DNA, 25 bp, mus musculus
ctattgctaactgcgcaaacatacc

SEQ ID NO: 95399 - DNA, 25 bp, mus musculus
tttaaactcagaggatctggaaggc

SEQ ID NO: 95400 - DNA, 25 bp, mus musculus
aggcattctttcttcaatacatctg

SEQ ID NO: 95401 - DNA, 25 bp, mus musculus
cattctttcttcaatacatctgaat

SEQ ID NO: 95402 - DNA, 25 bp, mus musculus
aatacatctgaatggctaaggtttg

SEQ ID NO: 95403 - DNA, 25 bp, mus musculus
cacagtcactgtatacaggaggaag

SEQ ID NO: 95404 - DNA, 25 bp, mus musculus
gttataagatgcccacttcagtttg

SEQ ID NO: 95405 - DNA, 25 bp, mus musculus
agatgcccacttcagtttgaattcc

SEQ ID NO: 95406 - DNA, 25 bp, mus musculus
ccacttcagtttgaattccagataa

SEQ ID NO: 95407 - DNA, 25 bp, mus musculus
gatttgtctctgtgaaacatctgga

SEQ ID NO: 95408 - DNA, 25 bp, mus musculus
ttgtctctgtgaaacatctggaaca

SEQ ID NO: 95409 - DNA, 25 bp, mus musculus
ttgctaactgcgcaaacataccctg

SEQ ID NO: 95410 - DNA, 25 bp, mus musculus
ctaactgcgcaaacataccctgtat

SEQ ID NO: 95411 - DNA, 25 bp, mus musculus
aatttgcatcctcatgtattttatg

SEQ ID NO: 95412 - DNA, 25 bp, mus musculus
ttgcatcctcatgtattttatgtaa

SEQ ID NO: 95413 - DNA, 25 bp, mus musculus
tatgtaacctgtgcacatgcatttt

SEQ ID NO: 95414 - DNA, 25 bp, mus musculus
acctgtgcacatgcatttttatcac

SEQ ID NO: 95415 - DNA, 25 bp, mus musculus
atgcaatctttcacatgtgttataa

SEQ ID NO: 95416 - DNA, 25 bp, mus musculus
agcaacacttatttccatcagggtt

SEQ ID NO: 95417 - DNA, 25 bp, mus musculus
tagagagcttgcgctatgtgctcat

SEQ ID NO: 95418 - DNA, 25 bp, mus musculus
tgcgctatgtgctcatgtacgtcaa

SEQ ID NO: 95419 - DNA, 25 bp, mus musculus
cgctgcacgcacagcgctcgaaagc

SEQ ID NO: 95420 - DNA, 25 bp, mus musculus
tgcacgcacagcgctcgaaagcagc

SEQ ID NO: 95421 - DNA, 25 bp, mus musculus
cacagcgctcgaaagcagctgccag

SEQ ID NO: 95422 - DNA, 25 bp, mus musculus
cgaaagcagctgccaggcgtcagaa

SEQ ID NO: 95423 - DNA, 25 bp, mus musculus
cagctgccaggcgtcagaagtacga

SEQ ID NO: 95424 - DNA, 25 bp, mus musculus
ctgccaggcgtcagaagtacgagcg

SEQ ID NO: 95425 - DNA, 25 bp, mus musculus
agtacgagcgcattagcgacaagag

SEQ ID NO: 95426 - DNA, 25 bp, mus musculus
tgtctgcgccaatcgatggcgtatg

SEQ ID NO: 95427 - DNA, 25 bp, mus musculus
ctgcgccaatcgatggcgtatgcaa

SEQ ID NO: 95428 - DNA, 25 bp, mus musculus
cgccaatcgatggcgtatgcaaacg

SEQ ID NO: 95429 - DNA, 25 bp, mus musculus
gctatgtgctcatgtacgtcaacct

SEQ ID NO: 95430 - DNA, 25 bp, mus musculus
atgtgctcatgtacgtcaacctagg

SEQ ID NO: 95431 - DNA, 25 bp, mus musculus
tcatgtacgtcaacctaggatcgct

SEQ ID NO: 95432 - DNA, 25 bp, mus musculus
tgtacgtcaacctaggatcgctgca

SEQ ID NO: 95433 - DNA, 25 bp, mus musculus
acgtcaacctaggatcgctgcacgc

SEQ ID NO: 95434 - DNA, 25 bp, mus musculus
tcaacctaggatcgctgcacgcaca

SEQ ID NO: 95435 - DNA, 25 bp, mus musculus
taggatcgctgcacgcacagcgctc

SEQ ID NO: 95436 - DNA, 25 bp, mus musculus
gatcgctgcacgcacagcgctcgaa

SEQ ID NO: 95437 - DNA, 25 bp, mus musculus
catagtgctcgtagcaacgctctgt

SEQ ID NO: 95438 - DNA, 25 bp, mus musculus
tgccacctcattcatttactgaaat

SEQ ID NO: 95439 - DNA, 25 bp, mus musculus
tagagtccacggctgttgatcaccg

SEQ ID NO: 95440 - DNA, 25 bp, mus musculus
agtccacggctgttgatcaccgcta

SEQ ID NO: 95441 - DNA, 25 bp, mus musculus
ctgttgatcaccgctaccagtgtag

SEQ ID NO: 95442 - DNA, 25 bp, mus musculus
ttgatcaccgctaccagtgtagcaa

SEQ ID NO: 95443 - DNA, 25 bp, mus musculus
accgctaccagtgtagcaatcgttc

SEQ ID NO: 95444 - DNA, 25 bp, mus musculus
gtagcaatcgttcaggttcgcagag

SEQ ID NO: 95445 - DNA, 25 bp, mus musculus
gcaatcgttcaggttcgcagagcag

SEQ ID NO: 95446 - DNA, 25 bp, mus musculus
caggttcgcagagcagtcgagttac

SEQ ID NO: 95447 - DNA, 25 bp, mus musculus
gttcgcagagcagtcgagttactgg

SEQ ID NO: 95448 - DNA, 25 bp, mus musculus
gagttactggacgtctggggtcagc

SEQ ID NO: 95449 - DNA, 25 bp, mus musculus
tagatatcactcaagacttactgga

SEQ ID NO: 95450 - DNA, 25 bp, mus musculus
atatcactcaagacttactggatcc

SEQ ID NO: 95451 - DNA, 25 bp, mus musculus
tcactcaagacttactggatcctct

SEQ ID NO: 95452 - DNA, 25 bp, mus musculus
acttactggatcctcttgaagaatg

SEQ ID NO: 95453 - DNA, 25 bp, mus musculus
tactggatcctcttgaagaatggaa

SEQ ID NO: 95454 - DNA, 25 bp, mus musculus
aagtgcattcttggttagagtccac

SEQ ID NO: 95455 - DNA, 25 bp, mus musculus
attcttggttagagtccacggctgt

SEQ ID NO: 95456 - DNA, 25 bp, mus musculus
ggttagagtccacggctgttgatca

SEQ ID NO: 95457 - DNA, 25 bp, mus musculus
ctgacatcactgctggacccactga

SEQ ID NO: 95458 - DNA, 25 bp, mus musculus
tcactgctggacccactgatattgc

SEQ ID NO: 95459 - DNA, 25 bp, mus musculus
ttgccagaacagcactgatctttac

SEQ ID NO: 95460 - DNA, 25 bp, mus musculus
gaacagcactgatctttacgagacc

SEQ ID NO: 95461 - DNA, 25 bp, mus musculus
ccagcgctggccggaggtttgcatg

SEQ ID NO: 95462 - DNA, 25 bp, mus musculus
ctggccggaggtttgcatggcagca

SEQ ID NO: 95463 - DNA, 25 bp, mus musculus
gctccccggaaggctctcttcaagt

SEQ ID NO: 95464 - DNA, 25 bp, mus musculus
cggaaggctctcttcaagtgattgt

SEQ ID NO: 95465 - DNA, 25 bp, mus musculus
tgctgctttgcagctgctcaagagt

SEQ ID NO: 95466 - DNA, 25 bp, mus musculus
tttgcagctgctcaagagtttcctc

SEQ ID NO: 95467 - DNA, 25 bp, mus musculus
caagagtttcctcagtcggattcga

SEQ ID NO: 95468 - DNA, 25 bp, mus musculus
gattcgaggtctccttcataatgga

SEQ ID NO: 95469 - DNA, 25 bp, mus musculus
ccactgatattgctgctagtaagtt

SEQ ID NO: 95470 - DNA, 25 bp, mus musculus
ttgtggcccaaattttcaggcatgg

SEQ ID NO: 95471 - DNA, 25 bp, mus musculus
cccaaattttcaggcatggtgataa

SEQ ID NO: 95472 - DNA, 25 bp, mus musculus
gtgataatctctggtgcatcaaaaa

SEQ ID NO: 95473 - DNA, 25 bp, mus musculus
aactgattctcgtcatcttcatcgc

SEQ ID NO: 95474 - DNA, 25 bp, mus musculus
tcatcttcatcgctcatgtgccctt

SEQ ID NO: 95475 - DNA, 25 bp, mus musculus
tcatcgctcatgtgccctttgccag

SEQ ID NO: 95476 - DNA, 25 bp, mus musculus
tgccctttgccagaacagcactgat

SEQ ID NO: 95477 - DNA, 25 bp, mus musculus
ggatgacacctgtcacctgggaggt

SEQ ID NO: 95478 - DNA, 25 bp, mus musculus
tgacacctgtcacctgggaggtata

SEQ ID NO: 95479 - DNA, 25 bp, mus musculus
gagcatccagtccagtatattggca

SEQ ID NO: 95480 - DNA, 25 bp, mus musculus
tatattggcaatgtccgtcttgagt

SEQ ID NO: 95481 - DNA, 25 bp, mus musculus
attggcaatgtccgtcttgagtggg

SEQ ID NO: 95482 - DNA, 25 bp, mus musculus
tgtcaccttcccaaaggccatattg

SEQ ID NO: 95483 - DNA, 25 bp, mus musculus
catattggtactctgaaggatgttc

SEQ ID NO: 95484 - DNA, 25 bp, mus musculus
gatgttcaaagcccttcgcatgtcc

SEQ ID NO: 95485 - DNA, 25 bp, mus musculus
gttcaaagcccttcgcatgtcccca

SEQ ID NO: 95486 - DNA, 25 bp, mus musculus
ccttcgcatgtccccactggacaga

SEQ ID NO: 95487 - DNA, 25 bp, mus musculus
tcgcatgtccccactggacagagtg

SEQ ID NO: 95488 - DNA, 25 bp, mus musculus
catgtccccactggacagagtgaca

SEQ ID NO: 95489 - DNA, 25 bp, mus musculus
cacctgtcacctgggaggtataggt

SEQ ID NO: 95490 - DNA, 25 bp, mus musculus
tcacctgggaggtataggtgctggc

SEQ ID NO: 95491 - DNA, 25 bp, mus musculus
ccctgagccctaaacctagcagcag

SEQ ID NO: 95492 - DNA, 25 bp, mus musculus
tgagccctaaacctagcagcagttg

SEQ ID NO: 95493 - DNA, 25 bp, mus musculus
gccctaaacctagcagcagttgccc

SEQ ID NO: 95494 - DNA, 25 bp, mus musculus
ctagcagcagttgcccaaaaggata

SEQ ID NO: 95495 - DNA, 25 bp, mus musculus
ctgattgagcatccagtccagtata

SEQ ID NO: 95496 - DNA, 25 bp, mus musculus
attgagcatccagtccagtatattg

SEQ ID NO: 95497 - DNA, 25 bp, mus musculus
gaaatgtaccctgatgcaactaatc

SEQ ID NO: 95498 - DNA, 25 bp, mus musculus
aaatgtaccctgatgcaactaatca

SEQ ID NO: 95499 - DNA, 25 bp, mus musculus
ctataaatcaactactgaatgatcc

SEQ ID NO: 95500 - DNA, 25 bp, mus musculus
taaatcaactactgaatgatcccaa

SEQ ID NO: 95501 - DNA, 25 bp, mus musculus
atcaactactgaatgatcccaaagt

SEQ ID NO: 95502 - DNA, 25 bp, mus musculus
caactactgaatgatcccaaagtat

SEQ ID NO: 95503 - DNA, 25 bp, mus musculus
aactactgaatgatcccaaagtata

SEQ ID NO: 95504 - DNA, 25 bp, mus musculus
ctactgaatgatcccaaagtatata

SEQ ID NO: 95505 - DNA, 25 bp, mus musculus
tactgaatgatcccaaagtatatat

SEQ ID NO: 95506 - DNA, 25 bp, mus musculus
aatgatcccaaagtatatatgacta

SEQ ID NO: 95507 - DNA, 25 bp, mus musculus
atgatcccaaagtatatatgactat

SEQ ID NO: 95508 - DNA, 25 bp, mus musculus
ttaaactcagagtcagagtgaatag

SEQ ID NO: 95509 - DNA, 25 bp, mus musculus
atgtaccctgatgcaactaatcaga

SEQ ID NO: 95510 - DNA, 25 bp, mus musculus
tgtaccctgatgcaactaatcagaa

SEQ ID NO: 95511 - DNA, 25 bp, mus musculus
taccctgatgcaactaatcagaata

SEQ ID NO: 95512 - DNA, 25 bp, mus musculus
accctgatgcaactaatcagaataa

SEQ ID NO: 95513 - DNA, 25 bp, mus musculus
atatcaattatgatctggtgcctat

SEQ ID NO: 95514 - DNA, 25 bp, mus musculus
tatgatctggtgcctataaatcaac

SEQ ID NO: 95515 - DNA, 25 bp, mus musculus
tgcctataaatcaactactgaatga

SEQ ID NO: 95516 - DNA, 25 bp, mus musculus
cctataaatcaactactgaatgatc

SEQ ID NO: 95517 - DNA, 25 bp, mus musculus
accacttctcaggttaatggacact

SEQ ID NO: 95518 - DNA, 25 bp, mus musculus
tgtagtcattgttctgtgcaactgc

SEQ ID NO: 95519 - DNA, 25 bp, mus musculus
gaaagatgcccatcagcctgggatt

SEQ ID NO: 95520 - DNA, 25 bp, mus musculus
tgcccatcagcctgggattcgctga

SEQ ID NO: 95521 - DNA, 25 bp, mus musculus
agtactgaccagctgatttttgtgg

SEQ ID NO: 95522 - DNA, 25 bp, mus musculus
gaccagctgatttttgtgggcagaa

SEQ ID NO: 95523 - DNA, 25 bp, mus musculus
aatttgaacttgctgcctgctgagt

SEQ ID NO: 95524 - DNA, 25 bp, mus musculus
aacttgctgcctgctgagtccagta

SEQ ID NO: 95525 - DNA, 25 bp, mus musculus
ctgcctgctgagtccagtagttgtg

SEQ ID NO: 95526 - DNA, 25 bp, mus musculus
gtgtgccactgacctgtgcctccaa

SEQ ID NO: 95527 - DNA, 25 bp, mus musculus
cctgtgcctccaagtgatgttctga

SEQ ID NO: 95528 - DNA, 25 bp, mus musculus
gttctgacagcctttctgaggcaat

SEQ ID NO: 95529 - DNA, 25 bp, mus musculus
cattgttctgtgcaactgcgagcaa

SEQ ID NO: 95530 - DNA, 25 bp, mus musculus
tctgtgcaactgcgagcaatgtctt

SEQ ID NO: 95531 - DNA, 25 bp, mus musculus
caactgcgagcaatgtcttaaggaa

SEQ ID NO: 95532 - DNA, 25 bp, mus musculus
agatagtttcccagctggccagctg

SEQ ID NO: 95533 - DNA, 25 bp, mus musculus
tgactgactactgctccttctaatt

SEQ ID NO: 95534 - DNA, 25 bp, mus musculus
actactgctccttctaatttcactg

SEQ ID NO: 95535 - DNA, 25 bp, mus musculus
tctaatttcactgtccctgaaagat

SEQ ID NO: 95536 - DNA, 25 bp, mus musculus
gtccctgaaagatgcccatcagcct

SEQ ID NO: 95537 - DNA, 25 bp, mus musculus
tgaggctactctgaagcgacccagc

SEQ ID NO: 95538 - DNA, 25 bp, mus musculus
ggctactctgaagcgacccagcggt

SEQ ID NO: 95539 - DNA, 25 bp, mus musculus
aggctggactcagctacatccggtt

SEQ ID NO: 95540 - DNA, 25 bp, mus musculus
ctggactcagctacatccggttttc

SEQ ID NO: 95541 - DNA, 25 bp, mus musculus
tcagctacatccggttttcccagat

SEQ ID NO: 95542 - DNA, 25 bp, mus musculus
gctacatccggttttcccagatctg

SEQ ID NO: 95543 - DNA, 25 bp, mus musculus
acatccggttttcccagatctgtgc

SEQ ID NO: 95544 - DNA, 25 bp, mus musculus
tccggttttcccagatctgtgcaaa

SEQ ID NO: 95545 - DNA, 25 bp, mus musculus
tttcccagatctgtgcaaaagcagt

SEQ ID NO: 95546 - DNA, 25 bp, mus musculus
atgccctgaagaccgagttcaaagc

SEQ ID NO: 95547 - DNA, 25 bp, mus musculus
agaagacttcgggcagcagcataaa

SEQ ID NO: 95548 - DNA, 25 bp, mus musculus
agacttcgggcagcagcataaaaat

SEQ ID NO: 95549 - DNA, 25 bp, mus musculus
tctgaagcgacccagcggttctgcc

SEQ ID NO: 95550 - DNA, 25 bp, mus musculus
gaagcgacccagcggttctgcccga

SEQ ID NO: 95551 - DNA, 25 bp, mus musculus
ccgctcgagacaccatggtggcgta

SEQ ID NO: 95552 - DNA, 25 bp, mus musculus
ctcgagacaccatggtggcgtactg

SEQ ID NO: 95553 - DNA, 25 bp, mus musculus
gagacaccatggtggcgtactggcg

SEQ ID NO: 95554 - DNA, 25 bp, mus musculus
ccatggtggcgtactggcgacaggc

SEQ ID NO: 95555 - DNA, 25 bp, mus musculus
tggcgtactggcgacaggctggact

SEQ ID NO: 95556 - DNA, 25 bp, mus musculus
cgtactggcgacaggctggactcag

SEQ ID NO: 95557 - DNA, 25 bp, mus musculus
gaacttcaccaagaaaatacagctc

SEQ ID NO: 95558 - DNA, 25 bp, mus musculus
caagaaaatacagctccctgcagaa

SEQ ID NO: 95559 - DNA, 25 bp, mus musculus
ctcaccctttggagagagcagcttc

SEQ ID NO: 95560 - DNA, 25 bp, mus musculus
cttcaacaacgagcttcctcaagac

SEQ ID NO: 95561 - DNA, 25 bp, mus musculus
caacaacgagcttcctcaagacaac

SEQ ID NO: 95562 - DNA, 25 bp, mus musculus
cgagcttcctcaagacaaccaggaa

SEQ ID NO: 95563 - DNA, 25 bp, mus musculus
gcttcctcaagacaaccaggaagtc

SEQ ID NO: 95564 - DNA, 25 bp, mus musculus
tcctcaagacaaccaggaagtcacc

SEQ ID NO: 95565 - DNA, 25 bp, mus musculus
agtcacctgttcctaagacgtcagc

SEQ ID NO: 95566 - DNA, 25 bp, mus musculus
ctgttcctaagacgtcagccttggt

SEQ ID NO: 95567 - DNA, 25 bp, mus musculus
ctaagacgtcagccttggtccttct

SEQ ID NO: 95568 - DNA, 25 bp, mus musculus
agacgtcagccttggtccttcttcg

SEQ ID NO: 95569 - DNA, 25 bp, mus musculus
aatacagctccctgcagaagtggat

SEQ ID NO: 95570 - DNA, 25 bp, mus musculus
gctccctgcagaagtggatccagcc

SEQ ID NO: 95571 - DNA, 25 bp, mus musculus
ggatccagccactgtatttgcctcg

SEQ ID NO: 95572 - DNA, 25 bp, mus musculus
atttgcctcgctttctccagagggc

SEQ ID NO: 95573 - DNA, 25 bp, mus musculus
ctcgctttctccagagggcctgctc

SEQ ID NO: 95574 - DNA, 25 bp, mus musculus
gctttctccagagggcctgctcatc

SEQ ID NO: 95575 - DNA, 25 bp, mus musculus
gggcctgctcatcatcgaggctccc

SEQ ID NO: 95576 - DNA, 25 bp, mus musculus
tccgtactcaccctttggagagagc

SEQ ID NO: 95577 - DNA, 25 bp, mus musculus
tgctgacctgttccgtggcaacact

SEQ ID NO: 95578 - DNA, 25 bp, mus musculus
gacctgttccgtggcaacacttgga

SEQ ID NO: 95579 - DNA, 25 bp, mus musculus
tgaaatggtcttgttgggtggtcta

SEQ ID NO: 95580 - DNA, 25 bp, mus musculus
aatggtcttgttgggtggtctacag

SEQ ID NO: 95581 - DNA, 25 bp, mus musculus
gtcttgttgggtggtctacaggatt

SEQ ID NO: 95582 - DNA, 25 bp, mus musculus
tcttgttgggtggtctacaggattc

SEQ ID NO: 95583 - DNA, 25 bp, mus musculus
tggtctacaggattccccaggattc

SEQ ID NO: 95584 - DNA, 25 bp, mus musculus
ggtctacaggattccccaggattcg

SEQ ID NO: 95585 - DNA, 25 bp, mus musculus
gtctacaggattccccaggattcgg

SEQ ID NO: 95586 - DNA, 25 bp, mus musculus
agacctgaccaggagcattaacccg

SEQ ID NO: 95587 - DNA, 25 bp, mus musculus
caaggcagcaattctatctggaaaa

SEQ ID NO: 95588 - DNA, 25 bp, mus musculus
ggcagcaattctatctggaaaaaat

SEQ ID NO: 95589 - DNA, 25 bp, mus musculus
tgttccgtggcaacacttggaccct

SEQ ID NO: 95590 - DNA, 25 bp, mus musculus
ttccgtggcaacacttggaccctgt

SEQ ID NO: 95591 - DNA, 25 bp, mus musculus
tccgtggcaacacttggaccctgta

SEQ ID NO: 95592 - DNA, 25 bp, mus musculus
gtggcaacacttggaccctgtagag

SEQ ID NO: 95593 - DNA, 25 bp, mus musculus
tggcaacacttggaccctgtagaga

SEQ ID NO: 95594 - DNA, 25 bp, mus musculus
ggcaacacttggaccctgtagagaa

SEQ ID NO: 95595 - DNA, 25 bp, mus musculus
caacacttggaccctgtagagaagg

SEQ ID NO: 95596 - DNA, 25 bp, mus musculus
gacaattcacggatcaatgaaatgg

SEQ ID NO: 95597 - DNA, 25 bp, mus musculus
ggatccatttgtagtcttggtgctt

SEQ ID NO: 95598 - DNA, 25 bp, mus musculus
gatccatttgtagtcttggtgcttt

SEQ ID NO: 95599 - DNA, 25 bp, mus musculus
aattaccacctgatagatatgaagg

SEQ ID NO: 95600 - DNA, 25 bp, mus musculus
attaccacctgatagatatgaagga

SEQ ID NO: 95601 - DNA, 25 bp, mus musculus
acattgggcagtgcttaccaatttt

SEQ ID NO: 95602 - DNA, 25 bp, mus musculus
ttggctcacagcctattgtggtatt

SEQ ID NO: 95603 - DNA, 25 bp, mus musculus
tggctcacagcctattgtggtatta

SEQ ID NO: 95604 - DNA, 25 bp, mus musculus
gctcacagcctattgtggtattaca

SEQ ID NO: 95605 - DNA, 25 bp, mus musculus
ctcacagcctattgtggtattacat

SEQ ID NO: 95606 - DNA, 25 bp, mus musculus
caattaaagaagccctcattgacca

SEQ ID NO: 95607 - DNA, 25 bp, mus musculus
aattaaagaagccctcattgaccat

SEQ ID NO: 95608 - DNA, 25 bp, mus musculus
aagccctcattgaccatggagaaga

SEQ ID NO: 95609 - DNA, 25 bp, mus musculus
ccatttgtagtcttggtgctttgtc

SEQ ID NO: 95610 - DNA, 25 bp, mus musculus
agccctcattgaccatggagaagag

SEQ ID NO: 95611 - DNA, 25 bp, mus musculus
tgtagtcttggtgctttgtctgtcc

SEQ ID NO: 95612 - DNA, 25 bp, mus musculus
gtagtcttggtgctttgtctgtcct

SEQ ID NO: 95613 - DNA, 25 bp, mus musculus
ctgtcctttctgcttgtcctgtcat

SEQ ID NO: 95614 - DNA, 25 bp, mus musculus
tgtcctgtcattgtggagacagaga

SEQ ID NO: 95615 - DNA, 25 bp, mus musculus
cctgtcattgtggagacagagatct

SEQ ID NO: 95616 - DNA, 25 bp, mus musculus
ttggaaattaccacctgatagatat

SEQ ID NO: 95617 - DNA, 25 bp, mus musculus
ggaaattaccacctgatagatatga

SEQ ID NO: 95618 - DNA, 25 bp, mus musculus
agaagacagcgcatacagtgtgcga

SEQ ID NO: 95619 - DNA, 25 bp, mus musculus
agacagcgcatacagtgtgcgattc

SEQ ID NO: 95620 - DNA, 25 bp, mus musculus
cactgtgggtccgctaggtgaaggt

SEQ ID NO: 95621 - DNA, 25 bp, mus musculus
tggtgcccacaaggtgcgagctgga

SEQ ID NO: 95622 - DNA, 25 bp, mus musculus
ccacaaggtgcgagctggaggcaca

SEQ ID NO: 95623 - DNA, 25 bp, mus musculus
cacaaggtgcgagctggaggcacag

SEQ ID NO: 95624 - DNA, 25 bp, mus musculus
gctggtgtgccagctgagtttagca

SEQ ID NO: 95625 - DNA, 25 bp, mus musculus
tggtgtgccagctgagtttagcatc

SEQ ID NO: 95626 - DNA, 25 bp, mus musculus
tgtgccagctgagtttagcatctgg

SEQ ID NO: 95627 - DNA, 25 bp, mus musculus
gagtttagcatctggacccgagaag

SEQ ID NO: 95628 - DNA, 25 bp, mus musculus
gtttagcatctggacccgagaagct

SEQ ID NO: 95629 - DNA, 25 bp, mus musculus
tttagcatctggacccgagaagctg

SEQ ID NO: 95630 - DNA, 25 bp, mus musculus
gacagcgcatacagtgtgcgattcg

SEQ ID NO: 95631 - DNA, 25 bp, mus musculus
cagcgcatacagtgtgcgattcgtg

SEQ ID NO: 95632 - DNA, 25 bp, mus musculus
cgcatacagtgtgcgattcgtgccc

SEQ ID NO: 95633 - DNA, 25 bp, mus musculus
gcgattcgtgccccaggagatgggt

SEQ ID NO: 95634 - DNA, 25 bp, mus musculus
tgtcaagtaccgcggccaacacgtg

SEQ ID NO: 95635 - DNA, 25 bp, mus musculus
ggaagcccttttcagttcactgtgg

SEQ ID NO: 95636 - DNA, 25 bp, mus musculus
ttttcagttcactgtgggtccgcta

SEQ ID NO: 95637 - DNA, 25 bp, mus musculus
tcagttcactgtgggtccgctaggt

SEQ ID NO: 95638 - DNA, 25 bp, mus musculus
catgtatgacttctttcttggacgg

SEQ ID NO: 95639 - DNA, 25 bp, mus musculus
gtatgacttctttcttggacgggag

SEQ ID NO: 95640 - DNA, 25 bp, mus musculus
cctcattggctgggtatgctgacat

SEQ ID NO: 95641 - DNA, 25 bp, mus musculus
atgctgacatgctggacttaattct

SEQ ID NO: 95642 - DNA, 25 bp, mus musculus
ctgacatgctggacttaattctgct

SEQ ID NO: 95643 - DNA, 25 bp, mus musculus
acatgctggacttaattctgctgga

SEQ ID NO: 95644 - DNA, 25 bp, mus musculus
tgctggacttaattctgctggactt

SEQ ID NO: 95645 - DNA, 25 bp, mus musculus
acttaattctgctggacttgggcca

SEQ ID NO: 95646 - DNA, 25 bp, mus musculus
taattctgctggacttgggccagga

SEQ ID NO: 95647 - DNA, 25 bp, mus musculus
tcattcatttgccaatatgttgctg

SEQ ID NO: 95648 - DNA, 25 bp, mus musculus
ttcatttgccaatatgttgctgtgt

SEQ ID NO: 95649 - DNA, 25 bp, mus musculus
caatatgttgctgtgttatgaacct

SEQ ID NO: 95650 - DNA, 25 bp, mus musculus
tgacttctttcttggacgggagctg

SEQ ID NO: 95651 - DNA, 25 bp, mus musculus
tgacttcaaatatttctgtgagctg

SEQ ID NO: 95652 - DNA, 25 bp, mus musculus
caaatatttctgtgagctgagacct

SEQ ID NO: 95653 - DNA, 25 bp, mus musculus
atatttctgtgagctgagacctggc

SEQ ID NO: 95654 - DNA, 25 bp, mus musculus
tttctgtgagctgagacctggcctc

SEQ ID NO: 95655 - DNA, 25 bp, mus musculus
tgagctgagacctggcctcattggc

SEQ ID NO: 95656 - DNA, 25 bp, mus musculus
acctggcctcattggctgggtatgc

SEQ ID NO: 95657 - DNA, 25 bp, mus musculus
tggcctcattggctgggtatgctga

SEQ ID NO: 95658 - DNA, 25 bp, mus musculus
ggaaaccaggctgccagcggagact

SEQ ID NO: 95659 - DNA, 25 bp, mus musculus
aaaccaggctgccagcggagactct

SEQ ID NO: 95660 - DNA, 25 bp, mus musculus
gattcacgagacccggcgattcagg

SEQ ID NO: 95661 - DNA, 25 bp, mus musculus
attcacgagacccggcgattcaggt

SEQ ID NO: 95662 - DNA, 25 bp, mus musculus
ttcacgagacccggcgattcaggtg

SEQ ID NO: 95663 - DNA, 25 bp, mus musculus
agcaggatgcgttcacggtgcaccg

SEQ ID NO: 95664 - DNA, 25 bp, mus musculus
atgcgttcacggtgcaccgtctctg

SEQ ID NO: 95665 - DNA, 25 bp, mus musculus
gcgttcacggtgcaccgtctctgcc

SEQ ID NO: 95666 - DNA, 25 bp, mus musculus
cgttcacggtgcaccgtctctgccg

SEQ ID NO: 95667 - DNA, 25 bp, mus musculus
gttcacggtgcaccgtctctgccgt

SEQ ID NO: 95668 - DNA, 25 bp, mus musculus
tcacggtgcaccgtctctgccgtcg

SEQ ID NO: 95669 - DNA, 25 bp, mus musculus
cacggtgcaccgtctctgccgtcgg

SEQ ID NO: 95670 - DNA, 25 bp, mus musculus
aaccaggctgccagcggagactctt

SEQ ID NO: 95671 - DNA, 25 bp, mus musculus
aggctgccagcggagactcttcggg

SEQ ID NO: 95672 - DNA, 25 bp, mus musculus
ggctgccagcggagactcttcgggt

SEQ ID NO: 95673 - DNA, 25 bp, mus musculus
agccgcgcgcactgcccgtgtatgc

SEQ ID NO: 95674 - DNA, 25 bp, mus musculus
tgcccgtgtatgcccagagaagctc

SEQ ID NO: 95675 - DNA, 25 bp, mus musculus
cccgtgtatgcccagagaagctcgg

SEQ ID NO: 95676 - DNA, 25 bp, mus musculus
ccgtgtatgcccagagaagctcgga

SEQ ID NO: 95677 - DNA, 25 bp, mus musculus
gggattcacgagacccggcgattca

SEQ ID NO: 95678 - DNA, 25 bp, mus musculus
attcggatccatgctggctttggga

SEQ ID NO: 95679 - DNA, 25 bp, mus musculus
ttcggatccatgctggctttgggaa

SEQ ID NO: 95680 - DNA, 25 bp, mus musculus
tggatgtcaccaagacagagagtat

SEQ ID NO: 95681 - DNA, 25 bp, mus musculus
gatgtcaccaagacagagagtattg

SEQ ID NO: 95682 - DNA, 25 bp, mus musculus
atgtcaccaagacagagagtattgt

SEQ ID NO: 95683 - DNA, 25 bp, mus musculus
gcagccactcagtgggtgaaggagc

SEQ ID NO: 95684 - DNA, 25 bp, mus musculus
cagccactcagtgggtgaaggagcg

SEQ ID NO: 95685 - DNA, 25 bp, mus musculus
acagaggactctggggcctggtcaa

SEQ ID NO: 95686 - DNA, 25 bp, mus musculus
agaggactctggggcctggtcaaca

SEQ ID NO: 95687 - DNA, 25 bp, mus musculus
ctggtcaacaacgctggcatctccg

SEQ ID NO: 95688 - DNA, 25 bp, mus musculus
tggtcaacaacgctggcatctccgt

SEQ ID NO: 95689 - DNA, 25 bp, mus musculus
gtcaacaacgctggcatctccgtcc

SEQ ID NO: 95690 - DNA, 25 bp, mus musculus
cggatccatgctggctttgggaacc

SEQ ID NO: 95691 - DNA, 25 bp, mus musculus
ggatccatgctggctttgggaacct

SEQ ID NO: 95692 - DNA, 25 bp, mus musculus
tccatgctggctttgggaacctgct

SEQ ID NO: 95693 - DNA, 25 bp, mus musculus
catgctggctttgggaacctgctgg

SEQ ID NO: 95694 - DNA, 25 bp, mus musculus
gtgatcctggatgtcaccaagacag

SEQ ID NO: 95695 - DNA, 25 bp, mus musculus
tgatcctggatgtcaccaagacaga

SEQ ID NO: 95696 - DNA, 25 bp, mus musculus
atcctggatgtcaccaagacagaga

SEQ ID NO: 95697 - DNA, 25 bp, mus musculus
ctggatgtcaccaagacagagagta

SEQ ID NO: 95698 - DNA, 25 bp, mus musculus
gcacggacgacgccagcgtcttcag

SEQ ID NO: 95699 - DNA, 25 bp, mus musculus
acggacgacgccagcgtcttcagcc

SEQ ID NO: 95700 - DNA, 25 bp, mus musculus
gccagcgttatccgctggtctgaaa

SEQ ID NO: 95701 - DNA, 25 bp, mus musculus
agcgttatccgctggtctgaaagag

SEQ ID NO: 95702 - DNA, 25 bp, mus musculus
gcgttatccgctggtctgaaagagg

SEQ ID NO: 95703 - DNA, 25 bp, mus musculus
gttatccgctggtctgaaagaggga

SEQ ID NO: 95704 - DNA, 25 bp, mus musculus
ttatccgctggtctgaaagagggaa

SEQ ID NO: 95705 - DNA, 25 bp, mus musculus
aaggaggtcttcatctctgggtcct

SEQ ID NO: 95706 - DNA, 25 bp, mus musculus
aggaggtcttcatctctgggtcctt

SEQ ID NO: 95707 - DNA, 25 bp, mus musculus
aggtcttcatctctgggtccttcaa

SEQ ID NO: 95708 - DNA, 25 bp, mus musculus
ttcatctctgggtccttcaacaatt

SEQ ID NO: 95709 - DNA, 25 bp, mus musculus
tcatctctgggtccttcaacaattg

SEQ ID NO: 95710 - DNA, 25 bp, mus musculus
cggacgacgccagcgtcttcagcct

SEQ ID NO: 95711 - DNA, 25 bp, mus musculus
acgacgccagcgtcttcagcctggc

SEQ ID NO: 95712 - DNA, 25 bp, mus musculus
gacgccagcgtcttcagcctggccg

SEQ ID NO: 95713 - DNA, 25 bp, mus musculus
gccagcgtcttcagcctggccgact

SEQ ID NO: 95714 - DNA, 25 bp, mus musculus
agcgtcttcagcctggccgactcca

SEQ ID NO: 95715 - DNA, 25 bp, mus musculus
gcgtcttcagcctggccgactccaa

SEQ ID NO: 95716 - DNA, 25 bp, mus musculus
taccctggcagcaggatttggatga

SEQ ID NO: 95717 - DNA, 25 bp, mus musculus
cggccagcgttatccgctggtctga

SEQ ID NO: 95718 - DNA, 25 bp, mus musculus
aagtagctcctgaagcttccgcatc

SEQ ID NO: 95719 - DNA, 25 bp, mus musculus
tagctcctgaagcttccgcatccag

SEQ ID NO: 95720 - DNA, 25 bp, mus musculus
tgattgctcctacgcaagtaacaga

SEQ ID NO: 95721 - DNA, 25 bp, mus musculus
gtactgtgaactcggacatttgcgg

SEQ ID NO: 95722 - DNA, 25 bp, mus musculus
tgaactcggacatttgcggcgagga

SEQ ID NO: 95723 - DNA, 25 bp, mus musculus
cggacatttgcggcgaggacactgc

SEQ ID NO: 95724 - DNA, 25 bp, mus musculus
tacgtgcatatgctacgaggtctag

SEQ ID NO: 95725 - DNA, 25 bp, mus musculus
catatgctacgaggtctagaagttc

SEQ ID NO: 95726 - DNA, 25 bp, mus musculus
atgctacgaggtctagaagttcagt

SEQ ID NO: 95727 - DNA, 25 bp, mus musculus
gttcagtgaacagctggggaaatgt

SEQ ID NO: 95728 - DNA, 25 bp, mus musculus
ctcccagggtcgctgtgagaagaca

SEQ ID NO: 95729 - DNA, 25 bp, mus musculus
aagtttcctgtgtgtgtgctcggta

SEQ ID NO: 95730 - DNA, 25 bp, mus musculus
ctgaagcttccgcatccagtgccag

SEQ ID NO: 95731 - DNA, 25 bp, mus musculus
aagcttccgcatccagtgccagcca

SEQ ID NO: 95732 - DNA, 25 bp, mus musculus
cttccgcatccagtgccagccaagt

SEQ ID NO: 95733 - DNA, 25 bp, mus musculus
catccagtgccagccaagtgattgc

SEQ ID NO: 95734 - DNA, 25 bp, mus musculus
ccagtgccagccaagtgattgctcc

SEQ ID NO: 95735 - DNA, 25 bp, mus musculus
gtgccagccaagtgattgctcctac

SEQ ID NO: 95736 - DNA, 25 bp, mus musculus
gccaagtgattgctcctacgcaagt

SEQ ID NO: 95737 - DNA, 25 bp, mus musculus
aagtgattgctcctacgcaagtaac

SEQ ID NO: 95738 - DNA, 25 bp, mus musculus
caatttgtattgtccttggagcagg

SEQ ID NO: 95739 - DNA, 25 bp, mus musculus
gtattgtccttggagcaggcatggt

SEQ ID NO: 95740 - DNA, 25 bp, mus musculus
aatgtgcacaataaacccacatcct

SEQ ID NO: 95741 - DNA, 25 bp, mus musculus
tgaccatggtcaacaccttaatata

SEQ ID NO: 95742 - DNA, 25 bp, mus musculus
tggtcaacaccttaatatacttgag

SEQ ID NO: 95743 - DNA, 25 bp, mus musculus
ccctggctgtgaggctagggatcag

SEQ ID NO: 95744 - DNA, 25 bp, mus musculus
tgaatctctgagcctgcttctagca

SEQ ID NO: 95745 - DNA, 25 bp, mus musculus
tctgagcctgcttctagcacagctt

SEQ ID NO: 95746 - DNA, 25 bp, mus musculus
cctgcttctagcacagcttatgcca

SEQ ID NO: 95747 - DNA, 25 bp, mus musculus
cattgaccaaactagctggagtaac

SEQ ID NO: 95748 - DNA, 25 bp, mus musculus
ttccaccctgtagatgggaggaaag

SEQ ID NO: 95749 - DNA, 25 bp, mus musculus
caccctgtagatgggaggaaagtga

SEQ ID NO: 95750 - DNA, 25 bp, mus musculus
tccttggagcaggcatggtatttca

SEQ ID NO: 95751 - DNA, 25 bp, mus musculus
tatttcaaatcttctatacttggag

SEQ ID NO: 95752 - DNA, 25 bp, mus musculus
aaatcttctatacttggagctgtct

SEQ ID NO: 95753 - DNA, 25 bp, mus musculus
tctatacttggagctgtcttgtaaa

SEQ ID NO: 95754 - DNA, 25 bp, mus musculus
tgcgttttcctgtatagacctgcta

SEQ ID NO: 95755 - DNA, 25 bp, mus musculus
ttcctgtatagacctgctaatgtgc

SEQ ID NO: 95756 - DNA, 25 bp, mus musculus
tatagacctgctaatgtgcacaata

SEQ ID NO: 95757 - DNA, 25 bp, mus musculus
cctgctaatgtgcacaataaaccca

SEQ ID NO: 95758 - DNA, 25 bp, mus musculus
aacgcctccttggcattcattccgt

SEQ ID NO: 95759 - DNA, 25 bp, mus musculus
tccttggcattcattccgtattttg

SEQ ID NO: 95760 - DNA, 25 bp, mus musculus
tgtcttcctggtgtaccctctgtac

SEQ ID NO: 95761 - DNA, 25 bp, mus musculus
gtaccctctgtactggtgctgctgg

SEQ ID NO: 95762 - DNA, 25 bp, mus musculus
acagtacactaggcagcagtggaaa

SEQ ID NO: 95763 - DNA, 25 bp, mus musculus
ggcccacaatgcctcacactattgg

SEQ ID NO: 95764 - DNA, 25 bp, mus musculus
caatgcctcacactattggatgtga

SEQ ID NO: 95765 - DNA, 25 bp, mus musculus
ctcacactattggatgtgaacatgt

SEQ ID NO: 95766 - DNA, 25 bp, mus musculus
tattttgttactactgtgttaagag

SEQ ID NO: 95767 - DNA, 25 bp, mus musculus
gtagcttcctatttgacatatactt

SEQ ID NO: 95768 - DNA, 25 bp, mus musculus
ttgacatatactttacgtgcccgaa

SEQ ID NO: 95769 - DNA, 25 bp, mus musculus
tatactttacgtgcccgaagtgtgg

SEQ ID NO: 95770 - DNA, 25 bp, mus musculus
gcattcattccgtattttgcaagcc

SEQ ID NO: 95771 - DNA, 25 bp, mus musculus
tattttgcaagccccagaacatgcg

SEQ ID NO: 95772 - DNA, 25 bp, mus musculus
gcaagccccagaacatgcgcgaagt

SEQ ID NO: 95773 - DNA, 25 bp, mus musculus
cccagaacatgcgcgaagttggctt

SEQ ID NO: 95774 - DNA, 25 bp, mus musculus
aacttctctggcatggctttgctga

SEQ ID NO: 95775 - DNA, 25 bp, mus musculus
tgatttttctcttaccacttatcaa

SEQ ID NO: 95776 - DNA, 25 bp, mus musculus
ttctcttaccacttatcaatatcca

SEQ ID NO: 95777 - DNA, 25 bp, mus musculus
taccacttatcaatatccagaagtt

SEQ ID NO: 95778 - DNA, 25 bp, mus musculus
gatccatggcccgaggaagatcctg

SEQ ID NO: 95779 - DNA, 25 bp, mus musculus
tccatggcccgaggaagatcctgag

SEQ ID NO: 95780 - DNA, 25 bp, mus musculus
agtgccaccatggcaactgcaccgt

SEQ ID NO: 95781 - DNA, 25 bp, mus musculus
gtgccaccatggcaactgcaccgta

SEQ ID NO: 95782 - DNA, 25 bp, mus musculus
tgccaccatggcaactgcaccgtac

SEQ ID NO: 95783 - DNA, 25 bp, mus musculus
gccaccatggcaactgcaccgtaca

SEQ ID NO: 95784 - DNA, 25 bp, mus musculus
ccaccatggcaactgcaccgtacaa

SEQ ID NO: 95785 - DNA, 25 bp, mus musculus
caccatggcaactgcaccgtacaac

SEQ ID NO: 95786 - DNA, 25 bp, mus musculus
catggcaactgcaccgtacaactac

SEQ ID NO: 95787 - DNA, 25 bp, mus musculus
atattactagttgtgacacgggtgc

SEQ ID NO: 95788 - DNA, 25 bp, mus musculus
tattactagttgtgacacgggtgca

SEQ ID NO: 95789 - DNA, 25 bp, mus musculus
attactagttgtgacacgggtgcag

SEQ ID NO: 95790 - DNA, 25 bp, mus musculus
atggcccgaggaagatcctgaggga

SEQ ID NO: 95791 - DNA, 25 bp, mus musculus
ttactagttgtgacacgggtgcagg

SEQ ID NO: 95792 - DNA, 25 bp, mus musculus
aagatcctgagggagccgcaggagc

SEQ ID NO: 95793 - DNA, 25 bp, mus musculus
agatcctgagggagccgcaggagca

SEQ ID NO: 95794 - DNA, 25 bp, mus musculus
accgcgactgccacccgagtgtctg

SEQ ID NO: 95795 - DNA, 25 bp, mus musculus
ctacctgccagggcctcggctgacg

SEQ ID NO: 95796 - DNA, 25 bp, mus musculus
tacctgccagggcctcggctgacgg

SEQ ID NO: 95797 - DNA, 25 bp, mus musculus
ggaaagctgcccagccaccagcaac

SEQ ID NO: 95798 - DNA, 25 bp, mus musculus
cagtgccaccatggcaactgcaccg

SEQ ID NO: 95799 - DNA, 25 bp, mus musculus
gcggcccacggagcaatacagtgac

SEQ ID NO: 95800 - DNA, 25 bp, mus musculus
gcaatacagtgacatcgggggcctg

SEQ ID NO: 95801 - DNA, 25 bp, mus musculus
tgcccgagcctgtgctgctcagacc

SEQ ID NO: 95802 - DNA, 25 bp, mus musculus
ctgtgctgctcagaccaaggccacc

SEQ ID NO: 95803 - DNA, 25 bp, mus musculus
tgctgctcagaccaaggccaccttc

SEQ ID NO: 95804 - DNA, 25 bp, mus musculus
tcagaccaaggccaccttcttgaag

SEQ ID NO: 95805 - DNA, 25 bp, mus musculus
caccttcttgaagctggcaggccct

SEQ ID NO: 95806 - DNA, 25 bp, mus musculus
cttgaagctggcaggccctcagctg

SEQ ID NO: 95807 - DNA, 25 bp, mus musculus
aggccctcagctggtacagatgttt

SEQ ID NO: 95808 - DNA, 25 bp, mus musculus
ccctcagctggtacagatgtttatt

SEQ ID NO: 95809 - DNA, 25 bp, mus musculus
tggcgccaagctggtccgtgatgct

SEQ ID NO: 95810 - DNA, 25 bp, mus musculus
cgccaagctggtccgtgatgctttt

SEQ ID NO: 95811 - DNA, 25 bp, mus musculus
atacagtgacatcgggggcctggac

SEQ ID NO: 95812 - DNA, 25 bp, mus musculus
caagctggtccgtgatgcttttgcc

SEQ ID NO: 95813 - DNA, 25 bp, mus musculus
gatccaggagctggtggaagccatt

SEQ ID NO: 95814 - DNA, 25 bp, mus musculus
agccattgtcttgcctatgaaccac

SEQ ID NO: 95815 - DNA, 25 bp, mus musculus
cattgtcttgcctatgaaccacaaa

SEQ ID NO: 95816 - DNA, 25 bp, mus musculus
tgtcttgcctatgaaccacaaagag

SEQ ID NO: 95817 - DNA, 25 bp, mus musculus
gcctatgaaccacaaagagaagttt

SEQ ID NO: 95818 - DNA, 25 bp, mus musculus
gcccccaaaaggagtgctgatgtat

SEQ ID NO: 95819 - DNA, 25 bp, mus musculus
gaagactctgcttgcccgagcctgt

SEQ ID NO: 95820 - DNA, 25 bp, mus musculus
gagctcaataaacccgccatgatct

SEQ ID NO: 95821 - DNA, 25 bp, mus musculus
aaacccgccatgatctattgttctc

SEQ ID NO: 95822 - DNA, 25 bp, mus musculus
ctctctgaatctactttcaatcata

SEQ ID NO: 95823 - DNA, 25 bp, mus musculus
tctgaatctactttcaatcataaac

SEQ ID NO: 95824 - DNA, 25 bp, mus musculus
gaatctactttcaatcataaacatt

SEQ ID NO: 95825 - DNA, 25 bp, mus musculus
actttcaatcataaacattattttg

SEQ ID NO: 95826 - DNA, 25 bp, mus musculus
ttcaatcataaacattattttgatt

SEQ ID NO: 95827 - DNA, 25 bp, mus musculus
tgttactgaaatctctatgttatgt

SEQ ID NO: 95828 - DNA, 25 bp, mus musculus
tttaacatcttatccaggaatgtct

SEQ ID NO: 95829 - DNA, 25 bp, mus musculus
atcttatccaggaatgtcttaaatg

SEQ ID NO: 95830 - DNA, 25 bp, mus musculus
tgttatacagttttccattaaggat

SEQ ID NO: 95831 - DNA, 25 bp, mus musculus
tatacagttttccattaaggatatc

SEQ ID NO: 95832 - DNA, 25 bp, mus musculus
gtacatgcccagtcgatggatttgg

SEQ ID NO: 95833 - DNA, 25 bp, mus musculus
acactcatccacttgtcagaaggaa

SEQ ID NO: 95834 - DNA, 25 bp, mus musculus
ctcatccacttgtcagaaggaagca

SEQ ID NO: 95835 - DNA, 25 bp, mus musculus
agagcattgcaaactcccaaaagaa

SEQ ID NO: 95836 - DNA, 25 bp, mus musculus
aaagtcttgactcctgccaagaaat

SEQ ID NO: 95837 - DNA, 25 bp, mus musculus
ttgactcctgccaagaaatccttcc

SEQ ID NO: 95838 - DNA, 25 bp, mus musculus
tccttccttagaagactgtttgatt

SEQ ID NO: 95839 - DNA, 25 bp, mus musculus
tttagcaaaagcccctcagactcag

SEQ ID NO: 95840 - DNA, 25 bp, mus musculus
tgtcgtcagctgtgtcaatgagatc

SEQ ID NO: 95841 - DNA, 25 bp, mus musculus
gatcgagcagcgaggcctgactgag

SEQ ID NO: 95842 - DNA, 25 bp, mus musculus
cctgaccttctggctgagcaaagcc

SEQ ID NO: 95843 - DNA, 25 bp, mus musculus
gaccttctggctgagcaaagccttc

SEQ ID NO: 95844 - DNA, 25 bp, mus musculus
gctgagcaaagccttcatggaggca

SEQ ID NO: 95845 - DNA, 25 bp, mus musculus
gagcaaagccttcatggaggcagca

SEQ ID NO: 95846 - DNA, 25 bp, mus musculus
agccttcatggaggcagcagagata

SEQ ID NO: 95847 - DNA, 25 bp, mus musculus
cttcatggaggcagcagagataaca

SEQ ID NO: 95848 - DNA, 25 bp, mus musculus
tgaagacaacagcacagccgccatg

SEQ ID NO: 95849 - DNA, 25 bp, mus musculus
caacagcacagccgccatgtaccag

SEQ ID NO: 95850 - DNA, 25 bp, mus musculus
cagcacagccgccatgtaccaggct

SEQ ID NO: 95851 - DNA, 25 bp, mus musculus
cacagccgccatgtaccaggctgtc

SEQ ID NO: 95852 - DNA, 25 bp, mus musculus
cctgactgaggcaggcttgtacagg

SEQ ID NO: 95853 - DNA, 25 bp, mus musculus
cgccatgtaccaggctgtcagtgag

SEQ ID NO: 95854 - DNA, 25 bp, mus musculus
cttgtacaggatctcaggctgtgac

SEQ ID NO: 95855 - DNA, 25 bp, mus musculus
ctgtgaccgcacagtgaaagaactg

SEQ ID NO: 95856 - DNA, 25 bp, mus musculus
ggacgatatccacgtcatctgcagc

SEQ ID NO: 95857 - DNA, 25 bp, mus musculus
cgatatccacgtcatctgcagcctc

SEQ ID NO: 95858 - DNA, 25 bp, mus musculus
tatccacgtcatctgcagcctcctg

SEQ ID NO: 95859 - DNA, 25 bp, mus musculus
catctgcagcctcctgaaggacttc

SEQ ID NO: 95860 - DNA, 25 bp, mus musculus
cctgaaggacttcctgcgcaacctc

SEQ ID NO: 95861 - DNA, 25 bp, mus musculus
atctgtcatttagtgttggatggtc

SEQ ID NO: 95862 - DNA, 25 bp, mus musculus
ctttaaactgcgaattgtcttcatt

SEQ ID NO: 95863 - DNA, 25 bp, mus musculus
ggatttctgcttcctctttcttaag

SEQ ID NO: 95864 - DNA, 25 bp, mus musculus
ctgcttcctctttcttaagatgatc

SEQ ID NO: 95865 - DNA, 25 bp, mus musculus
cttcctctttcttaagatgatctaa

SEQ ID NO: 95866 - DNA, 25 bp, mus musculus
cctctttcttaagatgatctaatct

SEQ ID NO: 95867 - DNA, 25 bp, mus musculus
tgaagatttccttctgttcatggta

SEQ ID NO: 95868 - DNA, 25 bp, mus musculus
agatttccttctgttcatggtactc

SEQ ID NO: 95869 - DNA, 25 bp, mus musculus
ccttctgttcatggtactcggctaa

SEQ ID NO: 95870 - DNA, 25 bp, mus musculus
tctgttcatggtactcggctaacgt

SEQ ID NO: 95871 - DNA, 25 bp, mus musculus
ttaacgtttcattttcagctccatt

SEQ ID NO: 95872 - DNA, 25 bp, mus musculus
ctccattagtcttgcttttccgttg

SEQ ID NO: 95873 - DNA, 25 bp, mus musculus
actgcgaattgtcttcattatgtat

SEQ ID NO: 95874 - DNA, 25 bp, mus musculus
ttaattccctgatgtgtagattcct

SEQ ID NO: 95875 - DNA, 25 bp, mus musculus
attccctgatgtgtagattcctaac

SEQ ID NO: 95876 - DNA, 25 bp, mus musculus
tgtgtagattcctaaccctttccag

SEQ ID NO: 95877 - DNA, 25 bp, mus musculus
tttccagcctttccagctctgcctg

SEQ ID NO: 95878 - DNA, 25 bp, mus musculus
ccagcctttccagctctgcctggat

SEQ ID NO: 95879 - DNA, 25 bp, mus musculus
gcctttccagctctgcctggatttc

SEQ ID NO: 95880 - DNA, 25 bp, mus musculus
tttccagctctgcctggatttctgc

SEQ ID NO: 95881 - DNA, 25 bp, mus musculus
gctccaccaggtatgtgatgaaaca

SEQ ID NO: 95882 - DNA, 25 bp, mus musculus
aaaggcttgcctgtcctcaattcag

SEQ ID NO: 95883 - DNA, 25 bp, mus musculus
tgagcccaaagttgtcacaggttcc

SEQ ID NO: 95884 - DNA, 25 bp, mus musculus
aaagttgtcacaggttccgatgaga

SEQ ID NO: 95885 - DNA, 25 bp, mus musculus
agttgtcacaggttccgatgagact

SEQ ID NO: 95886 - DNA, 25 bp, mus musculus
tgtcacaggttccgatgagactgga

SEQ ID NO: 95887 - DNA, 25 bp, mus musculus
cacaggttccgatgagactggactt

SEQ ID NO: 95888 - DNA, 25 bp, mus musculus
acaggttccgatgagactggacttg

SEQ ID NO: 95889 - DNA, 25 bp, mus musculus
ttccgatgagactggacttggaagg

SEQ ID NO: 95890 - DNA, 25 bp, mus musculus
tccgatgagactggacttggaaggc

SEQ ID NO: 95891 - DNA, 25 bp, mus musculus
aaattccgaagttgattgagatgat

SEQ ID NO: 95892 - DNA, 25 bp, mus musculus
tgagatttacctttttgcgaacact

SEQ ID NO: 95893 - DNA, 25 bp, mus musculus
aaggcttgcctgtcctcaattcagg

SEQ ID NO: 95894 - DNA, 25 bp, mus musculus
gcttgcctgtcctcaattcagggta

SEQ ID NO: 95895 - DNA, 25 bp, mus musculus
ttgcctgtcctcaattcagggtatg

SEQ ID NO: 95896 - DNA, 25 bp, mus musculus
gtcctcaattcagggtatggcagtt

SEQ ID NO: 95897 - DNA, 25 bp, mus musculus
tcctcaattcagggtatggcagtta

SEQ ID NO: 95898 - DNA, 25 bp, mus musculus
ctcaattcagggtatggcagttaac

SEQ ID NO: 95899 - DNA, 25 bp, mus musculus
tcaattcagggtatggcagttaacc

SEQ ID NO: 95900 - DNA, 25 bp, mus musculus
attgagcccaaagttgtcacaggtt

SEQ ID NO: 95901 - DNA, 25 bp, mus musculus
agggccacacatggttgaaagatga

SEQ ID NO: 95902 - DNA, 25 bp, mus musculus
agaaggacttctccatttctcggag

SEQ ID NO: 95903 - DNA, 25 bp, mus musculus
acacctgctctagcaacgagctggc

SEQ ID NO: 95904 - DNA, 25 bp, mus musculus
gctctagcaacgagctggccctgcc

SEQ ID NO: 95905 - DNA, 25 bp, mus musculus
cctcctaccctaagccagtgcgtgt

SEQ ID NO: 95906 - DNA, 25 bp, mus musculus
gtgacagctgccataccctgctact

SEQ ID NO: 95907 - DNA, 25 bp, mus musculus
acagctgccataccctgctactgca

SEQ ID NO: 95908 - DNA, 25 bp, mus musculus
gccataccctgctactgcagcgctg

SEQ ID NO: 95909 - DNA, 25 bp, mus musculus
ataccctgctactgcagcgctgctc

SEQ ID NO: 95910 - DNA, 25 bp, mus musculus
cagcagggaccttgacctgttgacc

SEQ ID NO: 95911 - DNA, 25 bp, mus musculus
tgacctgttgacctccatcctcaga

SEQ ID NO: 95912 - DNA, 25 bp, mus musculus
cctgttgacctccatcctcagagtg

SEQ ID NO: 95913 - DNA, 25 bp, mus musculus
ggaagcaccactgccgaaactgtgg

SEQ ID NO: 95914 - DNA, 25 bp, mus musculus
gacctccatcctcagagtggaggaa

SEQ ID NO: 95915 - DNA, 25 bp, mus musculus
agcaccactgccgaaactgtggcca

SEQ ID NO: 95916 - DNA, 25 bp, mus musculus
actgccgaaactgtggccacatttt

SEQ ID NO: 95917 - DNA, 25 bp, mus musculus
gaaactgtggccacattttctgcaa

SEQ ID NO: 95918 - DNA, 25 bp, mus musculus
gtggccacattttctgcaacacctg

SEQ ID NO: 95919 - DNA, 25 bp, mus musculus
gccacattttctgcaacacctgctc

SEQ ID NO: 95920 - DNA, 25 bp, mus musculus
acattttctgcaacacctgctctag

SEQ ID NO: 95921 - DNA, 25 bp, mus musculus
gcaacacctgctctagcaacgagct

SEQ ID NO: 95922 - DNA, 25 bp, mus musculus
catataagggttccaccattacaca

SEQ ID NO: 95923 - DNA, 25 bp, mus musculus
tataagggttccaccattacacaga

SEQ ID NO: 95924 - DNA, 25 bp, mus musculus
gaaacatagtccatggcaaatgatg

SEQ ID NO: 95925 - DNA, 25 bp, mus musculus
acatagtccatggcaaatgatggaa

SEQ ID NO: 95926 - DNA, 25 bp, mus musculus
catagtccatggcaaatgatggaac

SEQ ID NO: 95927 - DNA, 25 bp, mus musculus
caaacggatcccagttatttatcag

SEQ ID NO: 95928 - DNA, 25 bp, mus musculus
ggatcccagttatttatcagaacag

SEQ ID NO: 95929 - DNA, 25 bp, mus musculus
gatcccagttatttatcagaacagc

SEQ ID NO: 95930 - DNA, 25 bp, mus musculus
ttatttatcagaacagcacagaatg

SEQ ID NO: 95931 - DNA, 25 bp, mus musculus
tatttatcagaacagcacagaatga

SEQ ID NO: 95932 - DNA, 25 bp, mus musculus
tttatcagaacagcacagaatgaat

SEQ ID NO: 95933 - DNA, 25 bp, mus musculus
ttatcagaacagcacagaatgaatg

SEQ ID NO: 95934 - DNA, 25 bp, mus musculus
ggttccaccattacacagaattatt

SEQ ID NO: 95935 - DNA, 25 bp, mus musculus
gttccaccattacacagaattattc

SEQ ID NO: 95936 - DNA, 25 bp, mus musculus
tccaccattacacagaattattcca

SEQ ID NO: 95937 - DNA, 25 bp, mus musculus
ccaccattacacagaattattccag

SEQ ID NO: 95938 - DNA, 25 bp, mus musculus
accattacacagaattattccagga

SEQ ID NO: 95939 - DNA, 25 bp, mus musculus
gacatttacaagccaaaatggaaca

SEQ ID NO: 95940 - DNA, 25 bp, mus musculus
catttacaagccaaaatggaacatg

SEQ ID NO: 95941 - DNA, 25 bp, mus musculus
atttacaagccaaaatggaacatgg

SEQ ID NO: 95942 - DNA, 25 bp, mus musculus
gcggacttcgcgagacctcactctc

SEQ ID NO: 95943 - DNA, 25 bp, mus musculus
cggacttcgcgagacctcactctcg

SEQ ID NO: 95944 - DNA, 25 bp, mus musculus
ggttctcgcggctgagcagggattt

SEQ ID NO: 95945 - DNA, 25 bp, mus musculus
ttctcgcggctgagcagggatttaa

SEQ ID NO: 95946 - DNA, 25 bp, mus musculus
tctcgcggctgagcagggatttaac

SEQ ID NO: 95947 - DNA, 25 bp, mus musculus
cgccaccatgtctagcaaaagggca

SEQ ID NO: 95948 - DNA, 25 bp, mus musculus
gcacgacatgctggcgtcaatggga

SEQ ID NO: 95949 - DNA, 25 bp, mus musculus
acgacatgctggcgtcaatgggaaa

SEQ ID NO: 95950 - DNA, 25 bp, mus musculus
cgacatgctggcgtcaatgggaaaa

SEQ ID NO: 95951 - DNA, 25 bp, mus musculus
gacatgctggcgtcaatgggaaaaa

SEQ ID NO: 95952 - DNA, 25 bp, mus musculus
acatgctggcgtcaatgggaaaaaa

SEQ ID NO: 95953 - DNA, 25 bp, mus musculus
catgctggcgtcaatgggaaaaaac

SEQ ID NO: 95954 - DNA, 25 bp, mus musculus
acttcgcgagacctcactctcggtt

SEQ ID NO: 95955 - DNA, 25 bp, mus musculus
ttcgcgagacctcactctcggttct

SEQ ID NO: 95956 - DNA, 25 bp, mus musculus
tcgcgagacctcactctcggttctc

SEQ ID NO: 95957 - DNA, 25 bp, mus musculus
cgcgagacctcactctcggttctcg

SEQ ID NO: 95958 - DNA, 25 bp, mus musculus
gagacctcactctcggttctcgcgg

SEQ ID NO: 95959 - DNA, 25 bp, mus musculus
acctcactctcggttctcgcggctg

SEQ ID NO: 95960 - DNA, 25 bp, mus musculus
cctcactctcggttctcgcggctga

SEQ ID NO: 95961 - DNA, 25 bp, mus musculus
cggttctcgcggctgagcagggatt

SEQ ID NO: 95962 - DNA, 25 bp, mus musculus
tacgagaactcctgcaatcgatgct

SEQ ID NO: 95963 - DNA, 25 bp, mus musculus
cgagaactcctgcaatcgatgctcg

SEQ ID NO: 95964 - DNA, 25 bp, mus musculus
acacctttgtcagcgctgatgtaca

SEQ ID NO: 95965 - DNA, 25 bp, mus musculus
acctttgtcagcgctgatgtacact

SEQ ID NO: 95966 - DNA, 25 bp, mus musculus
ctttgtcagcgctgatgtacactac

SEQ ID NO: 95967 - DNA, 25 bp, mus musculus
ttgtcagcgctgatgtacactacct

SEQ ID NO: 95968 - DNA, 25 bp, mus musculus
gtcagcgctgatgtacactaccttc

SEQ ID NO: 95969 - DNA, 25 bp, mus musculus
gctgatgtacactaccttctgaatt

SEQ ID NO: 95970 - DNA, 25 bp, mus musculus
gcatattgtgcagtggcaggctact

SEQ ID NO: 95971 - DNA, 25 bp, mus musculus
atattgtgcagtggcaggctactct

SEQ ID NO: 95972 - DNA, 25 bp, mus musculus
attgtgcagtggcaggctactctaa

SEQ ID NO: 95973 - DNA, 25 bp, mus musculus
tgcagtggcaggctactctaatgcc

SEQ ID NO: 95974 - DNA, 25 bp, mus musculus
agaactcctgcaatcgatgctcgat

SEQ ID NO: 95975 - DNA, 25 bp, mus musculus
caggctactctaatgcctagcctct

SEQ ID NO: 95976 - DNA, 25 bp, mus musculus
ctcctgcaatcgatgctcgatgctg

SEQ ID NO: 95977 - DNA, 25 bp, mus musculus
cctgcaatcgatgctcgatgctgtc

SEQ ID NO: 95978 - DNA, 25 bp, mus musculus
aggaccaaagtgctgcgagtctcat

SEQ ID NO: 95979 - DNA, 25 bp, mus musculus
ccaaagtgctgcgagtctcatggag

SEQ ID NO: 95980 - DNA, 25 bp, mus musculus
aaagtgctgcgagtctcatggagta

SEQ ID NO: 95981 - DNA, 25 bp, mus musculus
agtgctgcgagtctcatggagtatt

SEQ ID NO: 95982 - DNA, 25 bp, mus musculus
ctacacctttgtcagcgctgatgta

SEQ ID NO: 95983 - DNA, 25 bp, mus musculus
tcgccatgttatcagccagacagga

SEQ ID NO: 95984 - DNA, 25 bp, mus musculus
cggactcgcagccagtcagatgtac

SEQ ID NO: 95985 - DNA, 25 bp, mus musculus
acgctgaagcggtcagactggaggt

SEQ ID NO: 95986 - DNA, 25 bp, mus musculus
caatcagcaaacacaataagagtct

SEQ ID NO: 95987 - DNA, 25 bp, mus musculus
acaataagagtctccttctcttctc

SEQ ID NO: 95988 - DNA, 25 bp, mus musculus
gctatttcagccaatctggacactt

SEQ ID NO: 95989 - DNA, 25 bp, mus musculus
tcagccaatctggacacttctttat

SEQ ID NO: 95990 - DNA, 25 bp, mus musculus
aatctggacacttctttatactctc

SEQ ID NO: 95991 - DNA, 25 bp, mus musculus
gcctccagctgtcagactggtttct

SEQ ID NO: 95992 - DNA, 25 bp, mus musculus
agctgtcagactggtttctgtcatc

SEQ ID NO: 95993 - DNA, 25 bp, mus musculus
tggcccctgctctctgttatagacg

SEQ ID NO: 95994 - DNA, 25 bp, mus musculus
tctgttatagacgcccggtccctgc

SEQ ID NO: 95995 - DNA, 25 bp, mus musculus
gatgtacagtccgcagggcatcagt

SEQ ID NO: 95996 - DNA, 25 bp, mus musculus
cagtccgcagggcatcagtgctaat

SEQ ID NO: 95997 - DNA, 25 bp, mus musculus
ccctacagaaggccctggcagtgtt

SEQ ID NO: 95998 - DNA, 25 bp, mus musculus
ccctggcagtgttcactctgatacc

SEQ ID NO: 95999 - DNA, 25 bp, mus musculus
cagtgttcactctgatacctccaac

SEQ ID NO: 96000 - DNA, 25 bp, mus musculus
tcactctgatacctccaactgatct

SEQ ID NO: 96001 - DNA, 25 bp, mus musculus
tgatacctccaactgatctcccagc

SEQ ID NO: 96002 - DNA, 25 bp, mus musculus
ctcccaacgctgaagcggtcagact

SEQ ID NO: 96003 - DNA, 25 bp, mus musculus
agatttgcagctgaaccttttcaca

SEQ ID NO: 96004 - DNA, 25 bp, mus musculus
gcagctgaaccttttcacaagggct

SEQ ID NO: 96005 - DNA, 25 bp, mus musculus
tgcgcagattccattttgtggggaa

SEQ ID NO: 96006 - DNA, 25 bp, mus musculus
aattgcctgtgaggactggattcaa

SEQ ID NO: 96007 - DNA, 25 bp, mus musculus
gactgccagggatcaagatgtggaa

SEQ ID NO: 96008 - DNA, 25 bp, mus musculus
gggtgttccatccatgggagccaaa

SEQ ID NO: 96009 - DNA, 25 bp, mus musculus
tgttccatccatgggagccaaaagc

SEQ ID NO: 96010 - DNA, 25 bp, mus musculus
cctttgcattccgttcaaccctctg

SEQ ID NO: 96011 - DNA, 25 bp, mus musculus
tccgttcaaccctctgtgtaaactg

SEQ ID NO: 96012 - DNA, 25 bp, mus musculus
gttcaaccctctgtgtaaactgcag

SEQ ID NO: 96013 - DNA, 25 bp, mus musculus
ccctctgtgtaaactgcagccgcgg

SEQ ID NO: 96014 - DNA, 25 bp, mus musculus
tctgtgtaaactgcagccgcgggcc

SEQ ID NO: 96015 - DNA, 25 bp, mus musculus
tttcacaagggcttctgaagacctt

SEQ ID NO: 96016 - DNA, 25 bp, mus musculus
aacccacatggttgtgtctaatgca

SEQ ID NO: 96017 - DNA, 25 bp, mus musculus
ccacatggttgtgtctaatgcactg

SEQ ID NO: 96018 - DNA, 25 bp, mus musculus
tgtgtctaatgcactggaggacttc

SEQ ID NO: 96019 - DNA, 25 bp, mus musculus
gtctaatgcactggaggacttccag

SEQ ID NO: 96020 - DNA, 25 bp, mus musculus
tgcactggaggacttccagaaggtg

SEQ ID NO: 96021 - DNA, 25 bp, mus musculus
cttccagaaggtgctagatgctgga

SEQ ID NO: 96022 - DNA, 25 bp, mus musculus
ggttgcgcagattccattttgtggg

SEQ ID NO: 96023 - DNA, 25 bp, mus musculus
ggacccacaggcatgtgctccaaga

SEQ ID NO: 96024 - DNA, 25 bp, mus musculus
atgtgctccaagaccacctgaagcc

SEQ ID NO: 96025 - DNA, 25 bp, mus musculus
ccattgatgacagcagcaagctcca

SEQ ID NO: 96026 - DNA, 25 bp, mus musculus
atgacagcagcaagctccatttgct

SEQ ID NO: 96027 - DNA, 25 bp, mus musculus
gcagcaagctccatttgctgtcccc

SEQ ID NO: 96028 - DNA, 25 bp, mus musculus
tcaaacaggccctggttacacagct

SEQ ID NO: 96029 - DNA, 25 bp, mus musculus
aggccctggttacacagctccagca

SEQ ID NO: 96030 - DNA, 25 bp, mus musculus
tggttacacagctccagcaaccggg

SEQ ID NO: 96031 - DNA, 25 bp, mus musculus
aaccgggctccaaatccactgtctg

SEQ ID NO: 96032 - DNA, 25 bp, mus musculus
gctccaaatccactgtctgtacagt

SEQ ID NO: 96033 - DNA, 25 bp, mus musculus
ctgtctgtacagtgcagcacatgag

SEQ ID NO: 96034 - DNA, 25 bp, mus musculus
tgcagcacatgagcagcaatgctgt

SEQ ID NO: 96035 - DNA, 25 bp, mus musculus
tccaagaccacctgaagcctcagtc

SEQ ID NO: 96036 - DNA, 25 bp, mus musculus
tgaagcctcagtcccatcatggttg

SEQ ID NO: 96037 - DNA, 25 bp, mus musculus
ctcagtcccatcatggttgtcagcc

SEQ ID NO: 96038 - DNA, 25 bp, mus musculus
cccatcatggttgtcagccagctca

SEQ ID NO: 96039 - DNA, 25 bp, mus musculus
atggttgtcagccagctcaccaagg

SEQ ID NO: 96040 - DNA, 25 bp, mus musculus
gtcagccagctcaccaaggatggat

SEQ ID NO: 96041 - DNA, 25 bp, mus musculus
cagctcaccaaggatggattcaccc

SEQ ID NO: 96042 - DNA, 25 bp, mus musculus
attcgaccattgatgacagcagcaa

SEQ ID NO: 96043 - DNA, 25 bp, mus musculus
aactttacgatcacagttgagaact

SEQ ID NO: 96044 - DNA, 25 bp, mus musculus
ctttacgatcacagttgagaacttc

SEQ ID NO: 96045 - DNA, 25 bp, mus musculus
tctttatttgatgctttccatgcgg

SEQ ID NO: 96046 - DNA, 25 bp, mus musculus
tttatttgatgctttccatgcgggc

SEQ ID NO: 96047 - DNA, 25 bp, mus musculus
tttgatgctttccatgcgggctttc

SEQ ID NO: 96048 - DNA, 25 bp, mus musculus
tgatgctttccatgcgggctttcat

SEQ ID NO: 96049 - DNA, 25 bp, mus musculus
atgctttccatgcgggctttcataa

SEQ ID NO: 96050 - DNA, 25 bp, mus musculus
catgcgggctttcataaggtctgtg

SEQ ID NO: 96051 - DNA, 25 bp, mus musculus
ttcataaggtctgtggaggaaaagt

SEQ ID NO: 96052 - DNA, 25 bp, mus musculus
ctcttccagcctaatgaattacaag

SEQ ID NO: 96053 - DNA, 25 bp, mus musculus
cttccagcctaatgaattacaagct

SEQ ID NO: 96054 - DNA, 25 bp, mus musculus
ttacaagctatggttattgggaata

SEQ ID NO: 96055 - DNA, 25 bp, mus musculus
agctggttctgaacggggcagacac

SEQ ID NO: 96056 - DNA, 25 bp, mus musculus
ggttctgaacggggcagacactgct

SEQ ID NO: 96057 - DNA, 25 bp, mus musculus
ggcagacactgctgttaatagacag

SEQ ID NO: 96058 - DNA, 25 bp, mus musculus
cagacactgctgttaatagacagaa

SEQ ID NO: 96059 - DNA, 25 bp, mus musculus
gaatcggcaggagtttgttgatgcc

SEQ ID NO: 96060 - DNA, 25 bp, mus musculus
ttgttgatgcctatgtggattacat

SEQ ID NO: 96061 - DNA, 25 bp, mus musculus
aaatcagtggcatctttatttgatg

SEQ ID NO: 96062 - DNA, 25 bp, mus musculus
atcagtggcatctttatttgatgct

SEQ ID NO: 96063 - DNA, 25 bp, mus musculus
tacgtgtgtcccttgtgtgggaaag

SEQ ID NO: 96064 - DNA, 25 bp, mus musculus
gggaaagccttcaaccacagcaccg

SEQ ID NO: 96065 - DNA, 25 bp, mus musculus
gcaccagcggtcacaccggggagaa

SEQ ID NO: 96066 - DNA, 25 bp, mus musculus
agccctacacgtgcagcgagtgcgg

SEQ ID NO: 96067 - DNA, 25 bp, mus musculus
aaggccttcagcgaccgctccgtgc

SEQ ID NO: 96068 - DNA, 25 bp, mus musculus
ctcatccaacatcacaacgtacaca

SEQ ID NO: 96069 - DNA, 25 bp, mus musculus
tccaacatcacaacgtacacaccgg

SEQ ID NO: 96070 - DNA, 25 bp, mus musculus
caacatcacaacgtacacaccggga

SEQ ID NO: 96071 - DNA, 25 bp, mus musculus
aaagcgtacgagtgcacagtgcgga

SEQ ID NO: 96072 - DNA, 25 bp, mus musculus
cgtacgagtgcacagtgcggaagac

SEQ ID NO: 96073 - DNA, 25 bp, mus musculus
tacgagtgcacagtgcggaagacct

SEQ ID NO: 96074 - DNA, 25 bp, mus musculus
cgagtgcacagtgcggaagaccttt

SEQ ID NO: 96075 - DNA, 25 bp, mus musculus
gaaagccttcaaccacagcaccgtc

SEQ ID NO: 96076 - DNA, 25 bp, mus musculus
gtcctgcggaccaccagagggtgca

SEQ ID NO: 96077 - DNA, 25 bp, mus musculus
cctgcggaccaccagagggtgcaca

SEQ ID NO: 96078 - DNA, 25 bp, mus musculus
ggaagaccttcagcgtgaagaggac

SEQ ID NO: 96079 - DNA, 25 bp, mus musculus
aagaccttcagcgtgaagaggacgc

SEQ ID NO: 96080 - DNA, 25 bp, mus musculus
cgctgctgcagcaccagcggtcaca

SEQ ID NO: 96081 - DNA, 25 bp, mus musculus
gctgcagcaccagcggtcacaccgg

SEQ ID NO: 96082 - DNA, 25 bp, mus musculus
cagcaccagcggtcacaccggggag

SEQ ID NO: 96083 - DNA, 25 bp, mus musculus
agccagcctcaagagaccagacaca

SEQ ID NO: 96084 - DNA, 25 bp, mus musculus
cctcaagagaccagacacaggagcc

SEQ ID NO: 96085 - DNA, 25 bp, mus musculus
ctcttgcaccctgcagtctggtcaa

SEQ ID NO: 96086 - DNA, 25 bp, mus musculus
caccctgcagtctggtcaaagagca

SEQ ID NO: 96087 - DNA, 25 bp, mus musculus
ttgtaggctccctacacaaagcaca

SEQ ID NO: 96088 - DNA, 25 bp, mus musculus
gctccctacacaaagcacacctgtt

SEQ ID NO: 96089 - DNA, 25 bp, mus musculus
tacacaaagcacacctgttagcaga

SEQ ID NO: 96090 - DNA, 25 bp, mus musculus
aagcacacctgttagcagagtgtgg

SEQ ID NO: 96091 - DNA, 25 bp, mus musculus
agcctcaaaggtttcacctctgaca

SEQ ID NO: 96092 - DNA, 25 bp, mus musculus
aaaggtttcacctctgacatcatta

SEQ ID NO: 96093 - DNA, 25 bp, mus musculus
ttcacctctgacatcattacataag

SEQ ID NO: 96094 - DNA, 25 bp, mus musculus
tctgacatcattacataagtgctac

SEQ ID NO: 96095 - DNA, 25 bp, mus musculus
gaatggtttccctggtcagatggga

SEQ ID NO: 96096 - DNA, 25 bp, mus musculus
tttccctggtcagatgggaatccgt

SEQ ID NO: 96097 - DNA, 25 bp, mus musculus
aatccgtggtctcccaggcattaag

SEQ ID NO: 96098 - DNA, 25 bp, mus musculus
ccctggtgctcttggcttaagagga

SEQ ID NO: 96099 - DNA, 25 bp, mus musculus
taagggtttgcctggagcgataggt

SEQ ID NO: 96100 - DNA, 25 bp, mus musculus
aggtgacccaggccctgccagctat

SEQ ID NO: 96101 - DNA, 25 bp, mus musculus
cccaggccctgccagctatgggaaa

SEQ ID NO: 96102 - DNA, 25 bp, mus musculus
ccctgccagctatgggaaaaatggc

SEQ ID NO: 96103 - DNA, 25 bp, mus musculus
cagcccagtcaaattctctcctggg

SEQ ID NO: 96104 - DNA, 25 bp, mus musculus
tctcctggggatttctggggacgag

SEQ ID NO: 96105 - DNA, 25 bp, mus musculus
gcaaatcctcagacccctgtggaat

SEQ ID NO: 96106 - DNA, 25 bp, mus musculus
tcagacccctgtggaatacccaatg

SEQ ID NO: 96107 - DNA, 25 bp, mus musculus
ggaagcatcagcgccacttccaatc

SEQ ID NO: 96108 - DNA, 25 bp, mus musculus
acaagcttttcctatgatctccaaa

SEQ ID NO: 96109 - DNA, 25 bp, mus musculus
ttttcctatgatctccaaacggcca

SEQ ID NO: 96110 - DNA, 25 bp, mus musculus
cctatgatctccaaacggccagagc

SEQ ID NO: 96111 - DNA, 25 bp, mus musculus
tatgatctccaaacggccagagcac

SEQ ID NO: 96112 - DNA, 25 bp, mus musculus
atctccaaacggccagagcacctgc

SEQ ID NO: 96113 - DNA, 25 bp, mus musculus
ctccaaacggccagagcacctgcgg

SEQ ID NO: 96114 - DNA, 25 bp, mus musculus
aaacggccagagcacctgcggatga

SEQ ID NO: 96115 - DNA, 25 bp, mus musculus
ggatttctggggacgaggtgcttca

SEQ ID NO: 96116 - DNA, 25 bp, mus musculus
ttctggggacgaggtgcttcagcca

SEQ ID NO: 96117 - DNA, 25 bp, mus musculus
ggtgcttcagccagcacggcaaatc

SEQ ID NO: 96118 - DNA, 25 bp, mus musculus
tgcttcagccagcacggcaaatcct

SEQ ID NO: 96119 - DNA, 25 bp, mus musculus
tcagccagcacggcaaatcctcaga

SEQ ID NO: 96120 - DNA, 25 bp, mus musculus
agccagcacggcaaatcctcagacc

SEQ ID NO: 96121 - DNA, 25 bp, mus musculus
agcacggcaaatcctcagacccctg

SEQ ID NO: 96122 - DNA, 25 bp, mus musculus
cacggcaaatcctcagacccctgtg

SEQ ID NO: 96123 - DNA, 25 bp, mus musculus
gtggtgtccaccagccagtaggagc

SEQ ID NO: 96124 - DNA, 25 bp, mus musculus
gagtgctctctccaggttaaggtga

SEQ ID NO: 96125 - DNA, 25 bp, mus musculus
gatacccaccaaagaaccacgtcag

SEQ ID NO: 96126 - DNA, 25 bp, mus musculus
caccaaagaaccacgtcagcgatgc

SEQ ID NO: 96127 - DNA, 25 bp, mus musculus
agaaccacgtcagcgatgcaaagaa

SEQ ID NO: 96128 - DNA, 25 bp, mus musculus
ggatttttcacagtctgagcaagac

SEQ ID NO: 96129 - DNA, 25 bp, mus musculus
ttcacagtctgagcaagactgtttt

SEQ ID NO: 96130 - DNA, 25 bp, mus musculus
gaaacatttccagatggtttcatat

SEQ ID NO: 96131 - DNA, 25 bp, mus musculus
acatttccagatggtttcatatccc

SEQ ID NO: 96132 - DNA, 25 bp, mus musculus
gatggtttcatatccccacaagagc

SEQ ID NO: 96133 - DNA, 25 bp, mus musculus
atatccccacaagagcaggtcgtct

SEQ ID NO: 96134 - DNA, 25 bp, mus musculus
tccccacaagagcaggtcgtctcgt

SEQ ID NO: 96135 - DNA, 25 bp, mus musculus
tgctctctccaggttaaggtgatag

SEQ ID NO: 96136 - DNA, 25 bp, mus musculus
agcaggtcgtctcgttccaagatct

SEQ ID NO: 96137 - DNA, 25 bp, mus musculus
tacatgttgcctaaaactgtctctc

SEQ ID NO: 96138 - DNA, 25 bp, mus musculus
ttgcctaaaactgtctctcatctca

SEQ ID NO: 96139 - DNA, 25 bp, mus musculus
gcaacaaggtgcactcttttcctgg

SEQ ID NO: 96140 - DNA, 25 bp, mus musculus
tgcactcttttcctggcccctgaat

SEQ ID NO: 96141 - DNA, 25 bp, mus musculus
gcccctgaatacacataaaagacaa

SEQ ID NO: 96142 - DNA, 25 bp, mus musculus
ttcaaagaactacctagggactatg

SEQ ID NO: 96143 - DNA, 25 bp, mus musculus
gactatgatacccaccaaagaacca

SEQ ID NO: 96144 - DNA, 25 bp, mus musculus
accattttcatatgacgtgacagaa

SEQ ID NO: 96145 - DNA, 25 bp, mus musculus
cattttcatatgacgtgacagaaga

SEQ ID NO: 96146 - DNA, 25 bp, mus musculus
ccatctcaaactatgttggctgcaa

SEQ ID NO: 96147 - DNA, 25 bp, mus musculus
atctcaaactatgttggctgcaatg

SEQ ID NO: 96148 - DNA, 25 bp, mus musculus
ctcaaactatgttggctgcaatggg

SEQ ID NO: 96149 - DNA, 25 bp, mus musculus
caaactatgttggctgcaatgggtt

SEQ ID NO: 96150 - DNA, 25 bp, mus musculus
atatatacagtgcatctagtgtgtc

SEQ ID NO: 96151 - DNA, 25 bp, mus musculus
atatacagtgcatctagtgtgtcag

SEQ ID NO: 96152 - DNA, 25 bp, mus musculus
atacagtgcatctagtgtgtcagag

SEQ ID NO: 96153 - DNA, 25 bp, mus musculus
acagtgcatctagtgtgtcagaggt

SEQ ID NO: 96154 - DNA, 25 bp, mus musculus
agtgcatctagtgtgtcagaggtaa

SEQ ID NO: 96155 - DNA, 25 bp, mus musculus
tgcatctagtgtgtcagaggtaaat

SEQ ID NO: 96156 - DNA, 25 bp, mus musculus
ttttcatatgacgtgacagaagaga

SEQ ID NO: 96157 - DNA, 25 bp, mus musculus
aagatgttccatgccaccgtggcta

SEQ ID NO: 96158 - DNA, 25 bp, mus musculus
gatgttccatgccaccgtggctacg

SEQ ID NO: 96159 - DNA, 25 bp, mus musculus
ccatgccaccgtggctacggaaaca

SEQ ID NO: 96160 - DNA, 25 bp, mus musculus
gccaccgtggctacggaaacagaat

SEQ ID NO: 96161 - DNA, 25 bp, mus musculus
acattgtcctgaaggagaagttcat

SEQ ID NO: 96162 - DNA, 25 bp, mus musculus
cttaccatctcaaactatgttggct

SEQ ID NO: 96163 - DNA, 25 bp, mus musculus
taccatctcaaactatgttggctgc

SEQ ID NO: 96164 - DNA, 25 bp, mus musculus
ttcttcagtcccataaactgggatg

SEQ ID NO: 96165 - DNA, 25 bp, mus musculus
gatctgtaccacaagaggctgactc

SEQ ID NO: 96166 - DNA, 25 bp, mus musculus
tccaagtccattggctgcacccctg

SEQ ID NO: 96167 - DNA, 25 bp, mus musculus
attggctgcacccctgacaccgtgg

SEQ ID NO: 96168 - DNA, 25 bp, mus musculus
cctgacaccgtggccagcagttctg

SEQ ID NO: 96169 - DNA, 25 bp, mus musculus
gacaccgtggccagcagttctgggg

SEQ ID NO: 96170 - DNA, 25 bp, mus musculus
accgtggccagcagttctggggctt

SEQ ID NO: 96171 - DNA, 25 bp, mus musculus
agcagttctggggcttcaagtgcat

SEQ ID NO: 96172 - DNA, 25 bp, mus musculus
gcattccttggattttcctatgcac

SEQ ID NO: 96173 - DNA, 25 bp, mus musculus
ttccttggattttcctatgcacagg

SEQ ID NO: 96174 - DNA, 25 bp, mus musculus
ttttcctatgcacaggatgatgatg

SEQ ID NO: 96175 - DNA, 25 bp, mus musculus
tcctatgcacaggatgatgatgaca

SEQ ID NO: 96176 - DNA, 25 bp, mus musculus
ctgtaccacaagaggctgactccac

SEQ ID NO: 96177 - DNA, 25 bp, mus musculus
gacattttggactcttgagagacgt

SEQ ID NO: 96178 - DNA, 25 bp, mus musculus
ggacctgctgacttgaaacactttg

SEQ ID NO: 96179 - DNA, 25 bp, mus musculus
cctgctgacttgaaacactttgacc

SEQ ID NO: 96180 - DNA, 25 bp, mus musculus
ttgaaacactttgacccagagttca

SEQ ID NO: 96181 - DNA, 25 bp, mus musculus
ccagagttcacccaggaagctgtgt

SEQ ID NO: 96182 - DNA, 25 bp, mus musculus
gagttcacccaggaagctgtgtcca

SEQ ID NO: 96183 - DNA, 25 bp, mus musculus
acccaggaagctgtgtccaagtcca

SEQ ID NO: 96184 - DNA, 25 bp, mus musculus
gaagctgtgtccaagtccattggct

SEQ ID NO: 96185 - DNA, 25 bp, mus musculus
tcatctgtgatcacccacagatcat

SEQ ID NO: 96186 - DNA, 25 bp, mus musculus
atcacccacagatcatgagtccttt

SEQ ID NO: 96187 - DNA, 25 bp, mus musculus
gctttgagctgtttgtcatgaagaa

SEQ ID NO: 96188 - DNA, 25 bp, mus musculus
gcaatgcctatactgagctgaatga

SEQ ID NO: 96189 - DNA, 25 bp, mus musculus
atgcctatactgagctgaatgaccc

SEQ ID NO: 96190 - DNA, 25 bp, mus musculus
accccgtgcggcagaggcagctgtt

SEQ ID NO: 96191 - DNA, 25 bp, mus musculus
aggagcaggccaaggccaaggctgc

SEQ ID NO: 96192 - DNA, 25 bp, mus musculus
ccaaggccaaggctgccggtgatga

SEQ ID NO: 96193 - DNA, 25 bp, mus musculus
aggccaaggctgccggtgatgacga

SEQ ID NO: 96194 - DNA, 25 bp, mus musculus
acttctgtactgccctggaatacgg

SEQ ID NO: 96195 - DNA, 25 bp, mus musculus
tctgtactgccctggaatacgggct

SEQ ID NO: 96196 - DNA, 25 bp, mus musculus
gtactgccctggaatacgggctgcc

SEQ ID NO: 96197 - DNA, 25 bp, mus musculus
acccacagatcatgagtcctttggc

SEQ ID NO: 96198 - DNA, 25 bp, mus musculus
atcggctcaccatgtttctcaccga

SEQ ID NO: 96199 - DNA, 25 bp, mus musculus
cacagatcatgagtcctttggccaa

SEQ ID NO: 96200 - DNA, 25 bp, mus musculus
tcatgagtcctttggccaaatggca

SEQ ID NO: 96201 - DNA, 25 bp, mus musculus
tggccaaatggcaccgctccaaaga

SEQ ID NO: 96202 - DNA, 25 bp, mus musculus
ccaaatggcaccgctccaaagaggg

SEQ ID NO: 96203 - DNA, 25 bp, mus musculus
gctccaaagagggtctcacggagcg

SEQ ID NO: 96204 - DNA, 25 bp, mus musculus
tcacggagcgctttgagctgtttgt

SEQ ID NO: 96205 - DNA, 25 bp, mus musculus
agcgctttgagctgtttgtcatgaa

SEQ ID NO: 96206 - DNA, 25 bp, mus musculus
gtaatagcgcatgcacacgaactct

SEQ ID NO: 96207 - DNA, 25 bp, mus musculus
aatagcgcatgcacacgaactctcc

SEQ ID NO: 96208 - DNA, 25 bp, mus musculus
atgcaggacgtctgcgacgatgagc

SEQ ID NO: 96209 - DNA, 25 bp, mus musculus
gacgtctgcgacgatgagctagagc

SEQ ID NO: 96210 - DNA, 25 bp, mus musculus
cgtctgcgacgatgagctagagctg

SEQ ID NO: 96211 - DNA, 25 bp, mus musculus
gacaaatatctcattctcagtgcca

SEQ ID NO: 96212 - DNA, 25 bp, mus musculus
aatatctcattctcagtgccaccca

SEQ ID NO: 96213 - DNA, 25 bp, mus musculus
tatctcattctcagtgccacccagg

SEQ ID NO: 96214 - DNA, 25 bp, mus musculus
tcattctcagtgccacccaggcaga

SEQ ID NO: 96215 - DNA, 25 bp, mus musculus
attctcagtgccacccaggcagaaa

SEQ ID NO: 96216 - DNA, 25 bp, mus musculus
tctcagtgccacccaggcagaaagc

SEQ ID NO: 96217 - DNA, 25 bp, mus musculus
tcagtgccacccaggcagaaagcag

SEQ ID NO: 96218 - DNA, 25 bp, mus musculus
tgtggactactagagcgtggtaggt

SEQ ID NO: 96219 - DNA, 25 bp, mus musculus
agtgccacccaggcagaaagcagag

SEQ ID NO: 96220 - DNA, 25 bp, mus musculus
ctactagagcgtggtaggtgcccga

SEQ ID NO: 96221 - DNA, 25 bp, mus musculus
tctccagcatcgaacacaaaaccga

SEQ ID NO: 96222 - DNA, 25 bp, mus musculus
tccagcatcgaacacaaaaccgaga

SEQ ID NO: 96223 - DNA, 25 bp, mus musculus
cagcatcgaacacaaaaccgagagg

SEQ ID NO: 96224 - DNA, 25 bp, mus musculus
gcatcgaacacaaaaccgagaggac

SEQ ID NO: 96225 - DNA, 25 bp, mus musculus
cacaaaaccgagaggactgacaaga

SEQ ID NO: 96226 - DNA, 25 bp, mus musculus
cgatgcaggacgtctgcgacgatga

SEQ ID NO: 96227 - DNA, 25 bp, mus musculus
tgcatggctacacagccacgtatct

SEQ ID NO: 96228 - DNA, 25 bp, mus musculus
cagccacgtatctgcctgcttgaaa

SEQ ID NO: 96229 - DNA, 25 bp, mus musculus
tccttcctgaaggaccctcctgagc

SEQ ID NO: 96230 - DNA, 25 bp, mus musculus
cctgagaccagccaagacaactgtg

SEQ ID NO: 96231 - DNA, 25 bp, mus musculus
accagccaagacaactgtgagcgcg

SEQ ID NO: 96232 - DNA, 25 bp, mus musculus
caagacaactgtgagcgcgatggcc

SEQ ID NO: 96233 - DNA, 25 bp, mus musculus
aactgtgagcgcgatggccgtgtac

SEQ ID NO: 96234 - DNA, 25 bp, mus musculus
cccctgagcccgtctgtggtgccag

SEQ ID NO: 96235 - DNA, 25 bp, mus musculus
agcccgtctgtggtgccagccctta

SEQ ID NO: 96236 - DNA, 25 bp, mus musculus
gcccttagtgcattcaggcttaggc

SEQ ID NO: 96237 - DNA, 25 bp, mus musculus
agtgcattcaggcttaggctcccag

SEQ ID NO: 96238 - DNA, 25 bp, mus musculus
ttcaggcttaggctcccaggcaggg

SEQ ID NO: 96239 - DNA, 25 bp, mus musculus
cgtatctgcctgcttgaaacccagg

SEQ ID NO: 96240 - DNA, 25 bp, mus musculus
cttgaaacccagggatggtccatct

SEQ ID NO: 96241 - DNA, 25 bp, mus musculus
acccagggatggtccatctgtgttt

SEQ ID NO: 96242 - DNA, 25 bp, mus musculus
tacggcttggcacaacaccctcata

SEQ ID NO: 96243 - DNA, 25 bp, mus musculus
tttctgttccaaatgagcccaaagg

SEQ ID NO: 96244 - DNA, 25 bp, mus musculus
ctcaaacctgaacatcattcttggg

SEQ ID NO: 96245 - DNA, 25 bp, mus musculus
cctgaacatcattcttggggccagc

SEQ ID NO: 96246 - DNA, 25 bp, mus musculus
catcattcttggggccagcatctcc

SEQ ID NO: 96247 - DNA, 25 bp, mus musculus
ggactgtaactacccctgtggctca

SEQ ID NO: 96248 - DNA, 25 bp, mus musculus
taactacccctgtggctcatcacca

SEQ ID NO: 96249 - DNA, 25 bp, mus musculus
gctgtcacagaacctcaggtggcag

SEQ ID NO: 96250 - DNA, 25 bp, mus musculus
tgtcacagaacctcaggtggcagaa

SEQ ID NO: 96251 - DNA, 25 bp, mus musculus
tcacagaacctcaggtggcagaaga

SEQ ID NO: 96252 - DNA, 25 bp, mus musculus
agaacctcaggtggcagaagagaaa

SEQ ID NO: 96253 - DNA, 25 bp, mus musculus
aacctcaggtggcagaagagaaaat

SEQ ID NO: 96254 - DNA, 25 bp, mus musculus
gatttgctgaccaaggagctggagg

SEQ ID NO: 96255 - DNA, 25 bp, mus musculus
tttgctgaccaaggagctggaggac

SEQ ID NO: 96256 - DNA, 25 bp, mus musculus
tgctgaccaaggagctggaggactt

SEQ ID NO: 96257 - DNA, 25 bp, mus musculus
ctgaccaaggagctggaggactttg

SEQ ID NO: 96258 - DNA, 25 bp, mus musculus
gctgctgctcgagctgtcaccggtg

SEQ ID NO: 96259 - DNA, 25 bp, mus musculus
actacccctgtggctcatcaccatg

SEQ ID NO: 96260 - DNA, 25 bp, mus musculus
ccatgccttccgacctggccaagaa

SEQ ID NO: 96261 - DNA, 25 bp, mus musculus
atgccttccgacctggccaagaaga

SEQ ID NO: 96262 - DNA, 25 bp, mus musculus
cgacctggccaagaagaaggcagcc

SEQ ID NO: 96263 - DNA, 25 bp, mus musculus
caaagcccgacagcgacccagaaag

SEQ ID NO: 96264 - DNA, 25 bp, mus musculus
ccgacagcgacccagaaagggacat

SEQ ID NO: 96265 - DNA, 25 bp, mus musculus
gacagcgacccagaaagggacatga

SEQ ID NO: 96266 - DNA, 25 bp, mus musculus
atgctgtcacagaacctcaggtggc

SEQ ID NO: 96267 - DNA, 25 bp, mus musculus
tctcatagccgacattgtgtcagga

SEQ ID NO: 96268 - DNA, 25 bp, mus musculus
agaagtatttccgtgtgtgcagagt

SEQ ID NO: 96269 - DNA, 25 bp, mus musculus
acatcgttaagctagcggcctgcca

SEQ ID NO: 96270 - DNA, 25 bp, mus musculus
tcgttaagctagcggcctgccaatt

SEQ ID NO: 96271 - DNA, 25 bp, mus musculus
agctagcggcctgccaatttgtaag

SEQ ID NO: 96272 - DNA, 25 bp, mus musculus
tagcggcctgccaatttgtaagact

SEQ ID NO: 96273 - DNA, 25 bp, mus musculus
ttgtaagactgctacttcttcgatc

SEQ ID NO: 96274 - DNA, 25 bp, mus musculus
gactgctacttcttcgatcactccc

SEQ ID NO: 96275 - DNA, 25 bp, mus musculus
tgctacttcttcgatcactccctca

SEQ ID NO: 96276 - DNA, 25 bp, mus musculus
ctcactctcgtgcatgccatctaag

SEQ ID NO: 96277 - DNA, 25 bp, mus musculus
actctcgtgcatgccatctaaggga

SEQ ID NO: 96278 - DNA, 25 bp, mus musculus
ctcgtgcatgccatctaagggatga

SEQ ID NO: 96279 - DNA, 25 bp, mus musculus
atttccgtgtgtgcagagtttgagg

SEQ ID NO: 96280 - DNA, 25 bp, mus musculus
tttgaggcctgcatttgtgagtcgg

SEQ ID NO: 96281 - DNA, 25 bp, mus musculus
gaggctgacacgtgccctgatggga

SEQ ID NO: 96282 - DNA, 25 bp, mus musculus
acgtgccctgatgggatctgtctta

SEQ ID NO: 96283 - DNA, 25 bp, mus musculus
tgccctgatgggatctgtcttagct

SEQ ID NO: 96284 - DNA, 25 bp, mus musculus
atctgtcttagcttaaaccgacact

SEQ ID NO: 96285 - DNA, 25 bp, mus musculus
gtgtgacctacatcgttaagctagc

SEQ ID NO: 96286 - DNA, 25 bp, mus musculus
cctacatcgttaagctagcggcctg

SEQ ID NO: 96287 - DNA, 25 bp, mus musculus
cctgaacttccggacactacagagc

SEQ ID NO: 96288 - DNA, 25 bp, mus musculus
gaacttccggacactacagagcatt

SEQ ID NO: 96289 - DNA, 25 bp, mus musculus
ctgtctcgtgacttagcagcattgc

SEQ ID NO: 96290 - DNA, 25 bp, mus musculus
tctcgtgacttagcagcattgcatg

SEQ ID NO: 96291 - DNA, 25 bp, mus musculus
gacttagcagcattgcatgagattt

SEQ ID NO: 96292 - DNA, 25 bp, mus musculus
tgtgtagctcattcagatgaactga

SEQ ID NO: 96293 - DNA, 25 bp, mus musculus
ctgagaacactcagcaatgagcgtg

SEQ ID NO: 96294 - DNA, 25 bp, mus musculus
agaacactcagcaatgagcgtggtg

SEQ ID NO: 96295 - DNA, 25 bp, mus musculus
acactcagcaatgagcgtggtgtac

SEQ ID NO: 96296 - DNA, 25 bp, mus musculus
ctcagcaatgagcgtggtgtacagc

SEQ ID NO: 96297 - DNA, 25 bp, mus musculus
gtacagcagcacgtactgaaaaagc

SEQ ID NO: 96298 - DNA, 25 bp, mus musculus
aagcttctggcgataacagaactgc

SEQ ID NO: 96299 - DNA, 25 bp, mus musculus
cttccggacactacagagcattcta

SEQ ID NO: 96300 - DNA, 25 bp, mus musculus
ccggacactacagagcattctagaa

SEQ ID NO: 96301 - DNA, 25 bp, mus musculus
gacactacagagcattctagaactg

SEQ ID NO: 96302 - DNA, 25 bp, mus musculus
cattctagaactgacctgtctcgtg

SEQ ID NO: 96303 - DNA, 25 bp, mus musculus
tctagaactgacctgtctcgtgact

SEQ ID NO: 96304 - DNA, 25 bp, mus musculus
agaactgacctgtctcgtgacttag

SEQ ID NO: 96305 - DNA, 25 bp, mus musculus
actgacctgtctcgtgacttagcag

SEQ ID NO: 96306 - DNA, 25 bp, mus musculus
gacctgtctcgtgacttagcagcat

SEQ ID NO: 96307 - DNA, 25 bp, mus musculus
cttgaagaaatctctctctgccatg

SEQ ID NO: 96308 - DNA, 25 bp, mus musculus
ttgaagaaatctctctctgccatgg

SEQ ID NO: 96309 - DNA, 25 bp, mus musculus
ccagactgcacccaacaaggacgtg

SEQ ID NO: 96310 - DNA, 25 bp, mus musculus
gactgcacccaacaaggacgtgcag

SEQ ID NO: 96311 - DNA, 25 bp, mus musculus
actgcacccaacaaggacgtgcaga

SEQ ID NO: 96312 - DNA, 25 bp, mus musculus
gcacccaacaaggacgtgcagaggg

SEQ ID NO: 96313 - DNA, 25 bp, mus musculus
caacaaggacgtgcagagggaaatt

SEQ ID NO: 96314 - DNA, 25 bp, mus musculus
ggaaattgctgacctcggtgaggcc

SEQ ID NO: 96315 - DNA, 25 bp, mus musculus
tgacctcggtgaggccctggccact

SEQ ID NO: 96316 - DNA, 25 bp, mus musculus
atcccccagtggcagaaagatgaac

SEQ ID NO: 96317 - DNA, 25 bp, mus musculus
cccccagtggcagaaagatgaacaa

SEQ ID NO: 96318 - DNA, 25 bp, mus musculus
agagactctgaagtccctgaagaaa

SEQ ID NO: 96319 - DNA, 25 bp, mus musculus
gaaatctctctctgccatggaggcc

SEQ ID NO: 96320 - DNA, 25 bp, mus musculus
aaatctctctctgccatggaggcca

SEQ ID NO: 96321 - DNA, 25 bp, mus musculus
atctctctctgccatggaggccaaa

SEQ ID NO: 96322 - DNA, 25 bp, mus musculus
tctctctctgccatggaggccaaag

SEQ ID NO: 96323 - DNA, 25 bp, mus musculus
gaaggcccagactgcacccaacaag

SEQ ID NO: 96324 - DNA, 25 bp, mus musculus
aaggcccagactgcacccaacaagg

SEQ ID NO: 96325 - DNA, 25 bp, mus musculus
ggcccagactgcacccaacaaggac

SEQ ID NO: 96326 - DNA, 25 bp, mus musculus
gcccagactgcacccaacaaggacg

SEQ ID NO: 96327 - DNA, 25 bp, mus musculus
agctcatcatcgaggatgcctctta

SEQ ID NO: 96328 - DNA, 25 bp, mus musculus
tcatcatcgaggatgcctcttattg

SEQ ID NO: 96329 - DNA, 25 bp, mus musculus
tcgacatcatgtatcagcaatgcct

SEQ ID NO: 96330 - DNA, 25 bp, mus musculus
acatcatgtatcagcaatgccttat

SEQ ID NO: 96331 - DNA, 25 bp, mus musculus
tcatgtatcagcaatgccttatgtg

SEQ ID NO: 96332 - DNA, 25 bp, mus musculus
tgtatcagcaatgccttatgtgctg

SEQ ID NO: 96333 - DNA, 25 bp, mus musculus
agcaatgccttatgtgctgcaatgc

SEQ ID NO: 96334 - DNA, 25 bp, mus musculus
aatgccttatgtgctgcaatgcctt

SEQ ID NO: 96335 - DNA, 25 bp, mus musculus
gccttatgtgctgcaatgccttcct

SEQ ID NO: 96336 - DNA, 25 bp, mus musculus
ttatgtgctgcaatgccttcctgca

SEQ ID NO: 96337 - DNA, 25 bp, mus musculus
tgtgctgcaatgccttcctgcagaa

SEQ ID NO: 96338 - DNA, 25 bp, mus musculus
gctgcaatgccttcctgcagaatac

SEQ ID NO: 96339 - DNA, 25 bp, mus musculus
atgcctcttattgcaatgactctga

SEQ ID NO: 96340 - DNA, 25 bp, mus musculus
ctgcaatgccttcctgcagaatact

SEQ ID NO: 96341 - DNA, 25 bp, mus musculus
cctcttattgcaatgactctgactt

SEQ ID NO: 96342 - DNA, 25 bp, mus musculus
cttattgcaatgactctgacttcga

SEQ ID NO: 96343 - DNA, 25 bp, mus musculus
attgcaatgactctgacttcgacat

SEQ ID NO: 96344 - DNA, 25 bp, mus musculus
gcaatgactctgacttcgacatcat

SEQ ID NO: 96345 - DNA, 25 bp, mus musculus
atgactctgacttcgacatcatgta

SEQ ID NO: 96346 - DNA, 25 bp, mus musculus
ctgacttcgacatcatgtatcagca

SEQ ID NO: 96347 - DNA, 25 bp, mus musculus
acttcgacatcatgtatcagcaatg

SEQ ID NO: 96348 - DNA, 25 bp, mus musculus
tggcagctaaacgctcccgggatgc

SEQ ID NO: 96349 - DNA, 25 bp, mus musculus
ggcagctaaacgctcccgggatgcc

SEQ ID NO: 96350 - DNA, 25 bp, mus musculus
agaccatcgtgtccaagtacgagac

SEQ ID NO: 96351 - DNA, 25 bp, mus musculus
gaccatcgtgtccaagtacgagacc

SEQ ID NO: 96352 - DNA, 25 bp, mus musculus
accatcgtgtccaagtacgagacca

SEQ ID NO: 96353 - DNA, 25 bp, mus musculus
ccatcgtgtccaagtacgagaccaa

SEQ ID NO: 96354 - DNA, 25 bp, mus musculus
catcgtgtccaagtacgagaccaag

SEQ ID NO: 96355 - DNA, 25 bp, mus musculus
atcgtgtccaagtacgagaccaagt

SEQ ID NO: 96356 - DNA, 25 bp, mus musculus
tgtccaagtacgagaccaagtacgg

SEQ ID NO: 96357 - DNA, 25 bp, mus musculus
ctcagacctctgcctggggcttcct

SEQ ID NO: 96358 - DNA, 25 bp, mus musculus
tcagacctctgcctggggcttcctg

SEQ ID NO: 96359 - DNA, 25 bp, mus musculus
cagacctctgcctggggcttcctgg

SEQ ID NO: 96360 - DNA, 25 bp, mus musculus
gcagctaaacgctcccgggatgcca

SEQ ID NO: 96361 - DNA, 25 bp, mus musculus
cagctaaacgctcccgggatgccag

SEQ ID NO: 96362 - DNA, 25 bp, mus musculus
catccgggcagcgttcctggagaag

SEQ ID NO: 96363 - DNA, 25 bp, mus musculus
agcgttcctggagaaggagaacaca

SEQ ID NO: 96364 - DNA, 25 bp, mus musculus
ctgcggacggaggttgccgagcttc

SEQ ID NO: 96365 - DNA, 25 bp, mus musculus
aagtgcaagaccatcgtgtccaagt

SEQ ID NO: 96366 - DNA, 25 bp, mus musculus
agtgcaagaccatcgtgtccaagta

SEQ ID NO: 96367 - DNA, 25 bp, mus musculus
gtgcaagaccatcgtgtccaagtac

SEQ ID NO: 96368 - DNA, 25 bp, mus musculus
caattccacatccaaggtgataccc

SEQ ID NO: 96369 - DNA, 25 bp, mus musculus
ttccacatccaaggtgatacccccg

SEQ ID NO: 96370 - DNA, 25 bp, mus musculus
gacattggcccgtagctggccgaga

SEQ ID NO: 96371 - DNA, 25 bp, mus musculus
attggcccgtagctggccgagaagt

SEQ ID NO: 96372 - DNA, 25 bp, mus musculus
ggcccgtagctggccgagaagtcat

SEQ ID NO: 96373 - DNA, 25 bp, mus musculus
ccgtagctggccgagaagtcatgcc

SEQ ID NO: 96374 - DNA, 25 bp, mus musculus
tagctggccgagaagtcatgccgaa

SEQ ID NO: 96375 - DNA, 25 bp, mus musculus
aggaaagccttacttatgtgtgagg

SEQ ID NO: 96376 - DNA, 25 bp, mus musculus
aaagccttacttatgtgtgaggcct

SEQ ID NO: 96377 - DNA, 25 bp, mus musculus
ttacttatgtgtgaggcctgcagag

SEQ ID NO: 96378 - DNA, 25 bp, mus musculus
agagtgcagcaatacccttttacgg

SEQ ID NO: 96379 - DNA, 25 bp, mus musculus
gtgcagcaatacccttttacggaag

SEQ ID NO: 96380 - DNA, 25 bp, mus musculus
aagcaggtgcctggcagttcgtgtg

SEQ ID NO: 96381 - DNA, 25 bp, mus musculus
tcgtgtgcctgctcccagcatcgaa

SEQ ID NO: 96382 - DNA, 25 bp, mus musculus
tgtgcctgctcccagcatcgaagat

SEQ ID NO: 96383 - DNA, 25 bp, mus musculus
cagtgtactatccactgtctgcagg

SEQ ID NO: 96384 - DNA, 25 bp, mus musculus
tgtactatccactgtctgcaggaag

SEQ ID NO: 96385 - DNA, 25 bp, mus musculus
atccactgtctgcaggaaggaaggt

SEQ ID NO: 96386 - DNA, 25 bp, mus musculus
cactgtctgcaggaaggaaggtctg

SEQ ID NO: 96387 - DNA, 25 bp, mus musculus
aggtctggctctcccttcgacattg

SEQ ID NO: 96388 - DNA, 25 bp, mus musculus
tcttatcccaggttcctgaaatcaa

SEQ ID NO: 96389 - DNA, 25 bp, mus musculus
ttatcccaggttcctgaaatcaaat

SEQ ID NO: 96390 - DNA, 25 bp, mus musculus
atgagactgcctgccagaccaacct

SEQ ID NO: 96391 - DNA, 25 bp, mus musculus
gagactgcctgccagaccaacctgg

SEQ ID NO: 96392 - DNA, 25 bp, mus musculus
ctgccagaccaacctggcctacttg

SEQ ID NO: 96393 - DNA, 25 bp, mus musculus
gccagaccaacctggcctacttggg

SEQ ID NO: 96394 - DNA, 25 bp, mus musculus
cagaccaacctggcctacttgggtg

SEQ ID NO: 96395 - DNA, 25 bp, mus musculus
ctacttgggtggctcaggaggccca

SEQ ID NO: 96396 - DNA, 25 bp, mus musculus
ctcaggaggcccagtggaagtacag

SEQ ID NO: 96397 - DNA, 25 bp, mus musculus
gattaacacaaggtatccaggtaga

SEQ ID NO: 96398 - DNA, 25 bp, mus musculus
ttaacacaaggtatccaggtagaga

SEQ ID NO: 96399 - DNA, 25 bp, mus musculus
aacacaaggtatccaggtagagact

SEQ ID NO: 96400 - DNA, 25 bp, mus musculus
taaatcttctaaatgaccttcaggc

SEQ ID NO: 96401 - DNA, 25 bp, mus musculus
aatcttctaaatgaccttcaggcaa

SEQ ID NO: 96402 - DNA, 25 bp, mus musculus
ttctaaatgaccttcaggcaaatac

SEQ ID NO: 96403 - DNA, 25 bp, mus musculus
ctaaatgaccttcaggcaaatactt

SEQ ID NO: 96404 - DNA, 25 bp, mus musculus
tgagtgattcctggctgacaggaat

SEQ ID NO: 96405 - DNA, 25 bp, mus musculus
tgattcctggctgacaggaattaaa

SEQ ID NO: 96406 - DNA, 25 bp, mus musculus
acatgccaatgagactgcctgccag

SEQ ID NO: 96407 - DNA, 25 bp, mus musculus
atgccaatgagactgcctgccagac

SEQ ID NO: 96408 - DNA, 25 bp, mus musculus
atagtcacagtatctgaccatgaac

SEQ ID NO: 96409 - DNA, 25 bp, mus musculus
catgaacttctggcagctaaacact

SEQ ID NO: 96410 - DNA, 25 bp, mus musculus
gtcagcagactgcatcaggttccac

SEQ ID NO: 96411 - DNA, 25 bp, mus musculus
agactgcatcaggttccacgctctc

SEQ ID NO: 96412 - DNA, 25 bp, mus musculus
catcaggttccacgctctccctgag

SEQ ID NO: 96413 - DNA, 25 bp, mus musculus
cgctctccctgagggcaggctaaag

SEQ ID NO: 96414 - DNA, 25 bp, mus musculus
gctaaagctttgacacaccaggtgg

SEQ ID NO: 96415 - DNA, 25 bp, mus musculus
gctttgacacaccaggtggatgaga

SEQ ID NO: 96416 - DNA, 25 bp, mus musculus
acacaccaggtggatgagagtggct

SEQ ID NO: 96417 - DNA, 25 bp, mus musculus
agtggcttcgagctctcatctaggc

SEQ ID NO: 96418 - DNA, 25 bp, mus musculus
ctctcatctaggcctagtgcaggct

SEQ ID NO: 96419 - DNA, 25 bp, mus musculus
cctagtgcaggctctcagaccaggc

SEQ ID NO: 96420 - DNA, 25 bp, mus musculus
cttctggcagctaaacactcatcat

SEQ ID NO: 96421 - DNA, 25 bp, mus musculus
gcaggctctcagaccaggcaggctt

SEQ ID NO: 96422 - DNA, 25 bp, mus musculus
gcagctaaacactcatcattcgtgg

SEQ ID NO: 96423 - DNA, 25 bp, mus musculus
tcatcattcgtggtgcgatgctcat

SEQ ID NO: 96424 - DNA, 25 bp, mus musculus
tgagctcctggaacaacagcttgca

SEQ ID NO: 96425 - DNA, 25 bp, mus musculus
acaacagcttgcacgcgtacggcat

SEQ ID NO: 96426 - DNA, 25 bp, mus musculus
acgcgtacggcattcgcaccaagga

SEQ ID NO: 96427 - DNA, 25 bp, mus musculus
acggcattcgcaccaaggaaatctg

SEQ ID NO: 96428 - DNA, 25 bp, mus musculus
ttcgcaccaaggaaatctgcagaga

SEQ ID NO: 96429 - DNA, 25 bp, mus musculus
atgactctgctttggattataatga

SEQ ID NO: 96430 - DNA, 25 bp, mus musculus
ctgctctcacgtgcctggtggagaa

SEQ ID NO: 96431 - DNA, 25 bp, mus musculus
gttcactctggagttttcacgggat

SEQ ID NO: 96432 - DNA, 25 bp, mus musculus
tcactctggagttttcacgggatag

SEQ ID NO: 96433 - DNA, 25 bp, mus musculus
atcaatgtccgtctattgtacccca

SEQ ID NO: 96434 - DNA, 25 bp, mus musculus
ccaaacaagccaagccggacatcca

SEQ ID NO: 96435 - DNA, 25 bp, mus musculus
acaagccaagccggacatccatgag

SEQ ID NO: 96436 - DNA, 25 bp, mus musculus
gccaagccggacatccatgagcaag

SEQ ID NO: 96437 - DNA, 25 bp, mus musculus
caagccggacatccatgagcaagat

SEQ ID NO: 96438 - DNA, 25 bp, mus musculus
agccggacatccatgagcaagatgt

SEQ ID NO: 96439 - DNA, 25 bp, mus musculus
ccggacatccatgagcaagatgttt

SEQ ID NO: 96440 - DNA, 25 bp, mus musculus
acatccatgagcaagatgtttgtga

SEQ ID NO: 96441 - DNA, 25 bp, mus musculus
gctctcacgtgcctggtggagaaga

SEQ ID NO: 96442 - DNA, 25 bp, mus musculus
tctcacgtgcctggtggagaagatg

SEQ ID NO: 96443 - DNA, 25 bp, mus musculus
gagcgtgcaaacgcctgcaactcgg

SEQ ID NO: 96444 - DNA, 25 bp, mus musculus
gtgcaaacgcctgcaactcggtcat

SEQ ID NO: 96445 - DNA, 25 bp, mus musculus
gcaaacgcctgcaactcggtcataa

SEQ ID NO: 96446 - DNA, 25 bp, mus musculus
ctgcaactcggtcataaagcagctg

SEQ ID NO: 96447 - DNA, 25 bp, mus musculus
gcaactcggtcataaagcagctgat

SEQ ID NO: 96448 - DNA, 25 bp, mus musculus
aggagttcactctggagttttcacg

SEQ ID NO: 96449 - DNA, 25 bp, mus musculus
gcaggcatggccaagcccaacatga

SEQ ID NO: 96450 - DNA, 25 bp, mus musculus
caggcatggccaagcccaacatgat

SEQ ID NO: 96451 - DNA, 25 bp, mus musculus
gatgaaatcaccgcagacgacagga

SEQ ID NO: 96452 - DNA, 25 bp, mus musculus
atgaaatcaccgcagacgacaggaa

SEQ ID NO: 96453 - DNA, 25 bp, mus musculus
tgaaatcaccgcagacgacaggaag

SEQ ID NO: 96454 - DNA, 25 bp, mus musculus
gaaatcaccgcagacgacaggaagg

SEQ ID NO: 96455 - DNA, 25 bp, mus musculus
aaatcaccgcagacgacaggaaggt

SEQ ID NO: 96456 - DNA, 25 bp, mus musculus
aatcaccgcagacgacaggaaggtg

SEQ ID NO: 96457 - DNA, 25 bp, mus musculus
atcaccgcagacgacaggaaggtga

SEQ ID NO: 96458 - DNA, 25 bp, mus musculus
aggcatggccaagcccaacatgatc

SEQ ID NO: 96459 - DNA, 25 bp, mus musculus
ggcatggccaagcccaacatgatca

SEQ ID NO: 96460 - DNA, 25 bp, mus musculus
gcatggccaagcccaacatgatcat

SEQ ID NO: 96461 - DNA, 25 bp, mus musculus
catggccaagcccaacatgatcatc

SEQ ID NO: 96462 - DNA, 25 bp, mus musculus
atggccaagcccaacatgatcatca

SEQ ID NO: 96463 - DNA, 25 bp, mus musculus
attcgatgaaatcaccgcagacgac

SEQ ID NO: 96464 - DNA, 25 bp, mus musculus
ttcgatgaaatcaccgcagacgaca

SEQ ID NO: 96465 - DNA, 25 bp, mus musculus
cgatgaaatcaccgcagacgacagg

SEQ ID NO: 96466 - DNA, 25 bp, mus musculus
ccacctgacctacctgaatgtctac

SEQ ID NO: 96467 - DNA, 25 bp, mus musculus
gacctacctgaatgtctacctgcag

SEQ ID NO: 96468 - DNA, 25 bp, mus musculus
gagcctggcctcatgtggcaccgac

SEQ ID NO: 96469 - DNA, 25 bp, mus musculus
gtgtatctgtgctgcctatttccac

SEQ ID NO: 96470 - DNA, 25 bp, mus musculus
tgctgcctatttccaccaggcagcc

SEQ ID NO: 96471 - DNA, 25 bp, mus musculus
tgcctatttccaccaggcagccaag

SEQ ID NO: 96472 - DNA, 25 bp, mus musculus
tttccaccaggcagccaagctcaag

SEQ ID NO: 96473 - DNA, 25 bp, mus musculus
ccaggcagccaagctcaaggggatt

SEQ ID NO: 96474 - DNA, 25 bp, mus musculus
caagctcaaggggattggggaatat

SEQ ID NO: 96475 - DNA, 25 bp, mus musculus
atatgtgaacatccgcacagggatg

SEQ ID NO: 96476 - DNA, 25 bp, mus musculus
tgtgaacatccgcacagggatgccc

SEQ ID NO: 96477 - DNA, 25 bp, mus musculus
gaacatccgcacagggatgccctgc

SEQ ID NO: 96478 - DNA, 25 bp, mus musculus
ctacctgaatgtctacctgcagtgg

SEQ ID NO: 96479 - DNA, 25 bp, mus musculus
cctgaatgtctacctgcagtggaag

SEQ ID NO: 96480 - DNA, 25 bp, mus musculus
gaacaacaattactccaccatctgg

SEQ ID NO: 96481 - DNA, 25 bp, mus musculus
caattactccaccatctggtgcaat

SEQ ID NO: 96482 - DNA, 25 bp, mus musculus
ttactccaccatctggtgcaatgac

SEQ ID NO: 96483 - DNA, 25 bp, mus musculus
gtgcaatgaccacttcatccacgcc

SEQ ID NO: 96484 - DNA, 25 bp, mus musculus
cttcatccacgccaaggccatgcgg

SEQ ID NO: 96485 - DNA, 25 bp, mus musculus
tattatggtgcagcagcggatgagc

SEQ ID NO: 96486 - DNA, 25 bp, mus musculus
tctcccgcactgggcgcatggatct

SEQ ID NO: 96487 - DNA, 25 bp, mus musculus
cccgcactgggcgcatggatctggc

SEQ ID NO: 96488 - DNA, 25 bp, mus musculus
gtcacacttgtggcacacgaaaggt

SEQ ID NO: 96489 - DNA, 25 bp, mus musculus
gaaaggtttctccccagcgtgcagc

SEQ ID NO: 96490 - DNA, 25 bp, mus musculus
gtgcagcctctcatgcctttggatg

SEQ ID NO: 96491 - DNA, 25 bp, mus musculus
atgcctttggatgcttgacttacat

SEQ ID NO: 96492 - DNA, 25 bp, mus musculus
gatgcttgacttacatctgaaagtc

SEQ ID NO: 96493 - DNA, 25 bp, mus musculus
gcttgacttacatctgaaagtcttt

SEQ ID NO: 96494 - DNA, 25 bp, mus musculus
cttacatctgaaagtcttttcacac

SEQ ID NO: 96495 - DNA, 25 bp, mus musculus
gcaccggtacctggagtttgcctcg

SEQ ID NO: 96496 - DNA, 25 bp, mus musculus
cttctggtgcttgagaagggctact

SEQ ID NO: 96497 - DNA, 25 bp, mus musculus
aagggctactttgcaagcgaagact

SEQ ID NO: 96498 - DNA, 25 bp, mus musculus
gcactgggcgcatggatctggccta

SEQ ID NO: 96499 - DNA, 25 bp, mus musculus
ggctactttgcaagcgaagactttc

SEQ ID NO: 96500 - DNA, 25 bp, mus musculus
tggatctggcctatctccagagtgg

SEQ ID NO: 96501 - DNA, 25 bp, mus musculus
atctggcctatctccagagtggatt

SEQ ID NO: 96502 - DNA, 25 bp, mus musculus
tggcctatctccagagtggattttc

SEQ ID NO: 96503 - DNA, 25 bp, mus musculus
cctatctccagagtggattttcaag

SEQ ID NO: 96504 - DNA, 25 bp, mus musculus
atctccagagtggattttcaagtga

SEQ ID NO: 96505 - DNA, 25 bp, mus musculus
agtgaaacctttgtcacacttgtgg

SEQ ID NO: 96506 - DNA, 25 bp, mus musculus
acctttgtcacacttgtggcacacg

SEQ ID NO: 96507 - DNA, 25 bp, mus musculus
cagtctcctcatgtttcaaggaacc

SEQ ID NO: 96508 - DNA, 25 bp, mus musculus
tacatggaacctgtcagatattcaa

SEQ ID NO: 96509 - DNA, 25 bp, mus musculus
cctttgcgttgcctttgttcatggc

SEQ ID NO: 96510 - DNA, 25 bp, mus musculus
ctttgtttcctgacctctggtctca

SEQ ID NO: 96511 - DNA, 25 bp, mus musculus
ttcctgacctctggtctcaagaaca

SEQ ID NO: 96512 - DNA, 25 bp, mus musculus
acctctggtctcaagaacacttgtc

SEQ ID NO: 96513 - DNA, 25 bp, mus musculus
acttgtctgaggctgactccatgct

SEQ ID NO: 96514 - DNA, 25 bp, mus musculus
ctgaggctgactccatgctgtttgt

SEQ ID NO: 96515 - DNA, 25 bp, mus musculus
ccatgctgtttgtacttccagtttt

SEQ ID NO: 96516 - DNA, 25 bp, mus musculus
taagtatcttactttcagctctgaa

SEQ ID NO: 96517 - DNA, 25 bp, mus musculus
attcactttttacactgtgcatgcc

SEQ ID NO: 96518 - DNA, 25 bp, mus musculus
attcaagaccaatcataattgtttt

SEQ ID NO: 96519 - DNA, 25 bp, mus musculus
aatgtttctctcaatgtgcttttgc

SEQ ID NO: 96520 - DNA, 25 bp, mus musculus
aatgtgcttttgctggcattatgca

SEQ ID NO: 96521 - DNA, 25 bp, mus musculus
cttttgctggcattatgcatcaatc

SEQ ID NO: 96522 - DNA, 25 bp, mus musculus
ttatgcatcaatccttatcctcatt

SEQ ID NO: 96523 - DNA, 25 bp, mus musculus
ccttatcctcattggagtaaaatat

SEQ ID NO: 96524 - DNA, 25 bp, mus musculus
agtcaagtctaggctgaggaagggc

SEQ ID NO: 96525 - DNA, 25 bp, mus musculus
ctgcacctcagaagttggactcctg

SEQ ID NO: 96526 - DNA, 25 bp, mus musculus
atcttgaagtctttcttgataagcc

SEQ ID NO: 96527 - DNA, 25 bp, mus musculus
gaatgccgaggagctgtgagatgaa

SEQ ID NO: 96528 - DNA, 25 bp, mus musculus
aatgccgaggagctgtgagatgaag

SEQ ID NO: 96529 - DNA, 25 bp, mus musculus
atcagcacaactatcttccccaggt

SEQ ID NO: 96530 - DNA, 25 bp, mus musculus
agcacaactatcttccccaggtctg

SEQ ID NO: 96531 - DNA, 25 bp, mus musculus
ttccccaggtctgaggagatggaga

SEQ ID NO: 96532 - DNA, 25 bp, mus musculus
tccccaggtctgaggagatggagaa

SEQ ID NO: 96533 - DNA, 25 bp, mus musculus
gacaagccgcggcaaaatgggtgtg

SEQ ID NO: 96534 - DNA, 25 bp, mus musculus
acaagccgcggcaaaatgggtgtgc

SEQ ID NO: 96535 - DNA, 25 bp, mus musculus
ggaaatgaatcctcctgtaagggtg

SEQ ID NO: 96536 - DNA, 25 bp, mus musculus
aatgaatcctcctgtaagggtggat

SEQ ID NO: 96537 - DNA, 25 bp, mus musculus
atgaatcctcctgtaagggtggata

SEQ ID NO: 96538 - DNA, 25 bp, mus musculus
gaatcctcctgtaagggtggatagg

SEQ ID NO: 96539 - DNA, 25 bp, mus musculus
tgccgaggagctgtgagatgaagta

SEQ ID NO: 96540 - DNA, 25 bp, mus musculus
actgctctgagcagggtttgaagaa

SEQ ID NO: 96541 - DNA, 25 bp, mus musculus
aacagtcagggtcatcagcacaact

SEQ ID NO: 96542 - DNA, 25 bp, mus musculus
agggtcatcagcacaactatcttcc

SEQ ID NO: 96543 - DNA, 25 bp, mus musculus
gggtcatcagcacaactatcttccc

SEQ ID NO: 96544 - DNA, 25 bp, mus musculus
ggtcatcagcacaactatcttcccc

SEQ ID NO: 96545 - DNA, 25 bp, mus musculus
tcatcagcacaactatcttccccag

SEQ ID NO: 96546 - DNA, 25 bp, mus musculus
catcagcacaactatcttccccagg

SEQ ID NO: 96547 - DNA, 25 bp, mus musculus
aactgctggtagccaagcgagatgc

SEQ ID NO: 96548 - DNA, 25 bp, mus musculus
gtagccaagcgagatgcctttatca

SEQ ID NO: 96549 - DNA, 25 bp, mus musculus
cttccttcaaatgagacaagagcta

SEQ ID NO: 96550 - DNA, 25 bp, mus musculus
aactactttgattccaaggcagatg

SEQ ID NO: 96551 - DNA, 25 bp, mus musculus
ctactttgattccaaggcagatgtt

SEQ ID NO: 96552 - DNA, 25 bp, mus musculus
actttgattccaaggcagatgttgt

SEQ ID NO: 96553 - DNA, 25 bp, mus musculus
tttgattccaaggcagatgttgttg

SEQ ID NO: 96554 - DNA, 25 bp, mus musculus
tgattccaaggcagatgttgttgaa

SEQ ID NO: 96555 - DNA, 25 bp, mus musculus
tgttgaaacacttctacagacggat

SEQ ID NO: 96556 - DNA, 25 bp, mus musculus
ttgaaacacttctacagacggatca

SEQ ID NO: 96557 - DNA, 25 bp, mus musculus
gaaacacttctacagacggatcagt

SEQ ID NO: 96558 - DNA, 25 bp, mus musculus
aacacttctacagacggatcagtca

SEQ ID NO: 96559 - DNA, 25 bp, mus musculus
tggatgtctcatcagctcgttgctc

SEQ ID NO: 96560 - DNA, 25 bp, mus musculus
gatgtctcatcagctcgttgctcag

SEQ ID NO: 96561 - DNA, 25 bp, mus musculus
tgtctcatcagctcgttgctcagac

SEQ ID NO: 96562 - DNA, 25 bp, mus musculus
tgctcagacttgctggaggatattt

SEQ ID NO: 96563 - DNA, 25 bp, mus musculus
ctcagacttgctggaggatattttt

SEQ ID NO: 96564 - DNA, 25 bp, mus musculus
tactacctcttccttcaaatgagac

SEQ ID NO: 96565 - DNA, 25 bp, mus musculus
ctacctcttccttcaaatgagacaa

SEQ ID NO: 96566 - DNA, 25 bp, mus musculus
acctcttccttcaaatgagacaaga

SEQ ID NO: 96567 - DNA, 25 bp, mus musculus
tatggtcatcatccccaacatccaa

SEQ ID NO: 96568 - DNA, 25 bp, mus musculus
catccaaggcgccaacctggatgag

SEQ ID NO: 96569 - DNA, 25 bp, mus musculus
agatggaaccctgccttccctgcag

SEQ ID NO: 96570 - DNA, 25 bp, mus musculus
gccttatgctggcatcaatctcccg

SEQ ID NO: 96571 - DNA, 25 bp, mus musculus
cagaaacctggcgccccaagaccag

SEQ ID NO: 96572 - DNA, 25 bp, mus musculus
gccccaagaccagggtgagcgtcct

SEQ ID NO: 96573 - DNA, 25 bp, mus musculus
gcgtccttgacaggataggacgagt

SEQ ID NO: 96574 - DNA, 25 bp, mus musculus
cggtggctcttctctactggggtgt

SEQ ID NO: 96575 - DNA, 25 bp, mus musculus
aggtaggcagcaggctcaggtgccc

SEQ ID NO: 96576 - DNA, 25 bp, mus musculus
tggaagtttctgggacggagcttca

SEQ ID NO: 96577 - DNA, 25 bp, mus musculus
agcttcatttccgtgaagggcacag

SEQ ID NO: 96578 - DNA, 25 bp, mus musculus
tcgaagcccttccagtggtaccagc

SEQ ID NO: 96579 - DNA, 25 bp, mus musculus
aggcgccaacctggatgagatggtt

SEQ ID NO: 96580 - DNA, 25 bp, mus musculus
cgaagcccttccagtggtaccagct

SEQ ID NO: 96581 - DNA, 25 bp, mus musculus
ttgggaactgcccagcaagttctgg

SEQ ID NO: 96582 - DNA, 25 bp, mus musculus
cagcaagttctggccagatcgcttc

SEQ ID NO: 96583 - DNA, 25 bp, mus musculus
gttctggccagatcgcttcctggaa

SEQ ID NO: 96584 - DNA, 25 bp, mus musculus
tcgcttcctggaacctgggaagaat

SEQ ID NO: 96585 - DNA, 25 bp, mus musculus
gaagaatcccagaacaccatccttt

SEQ ID NO: 96586 - DNA, 25 bp, mus musculus
tcccagaacaccatcctttggctgt

SEQ ID NO: 96587 - DNA, 25 bp, mus musculus
aacaccatcctttggctgtggggca

SEQ ID NO: 96588 - DNA, 25 bp, mus musculus
gattttcggcgggtaggctctcgca

SEQ ID NO: 96589 - DNA, 25 bp, mus musculus
gtaggctctcgcacgctcattgctt

SEQ ID NO: 96590 - DNA, 25 bp, mus musculus
tgctcggaagatgccgcggccgtct

SEQ ID NO: 96591 - DNA, 25 bp, mus musculus
gcggccgtctctgcctccaagaggg

SEQ ID NO: 96592 - DNA, 25 bp, mus musculus
gccgtctctgcctccaagagggctc

SEQ ID NO: 96593 - DNA, 25 bp, mus musculus
cgtctctgcctccaagagggctcga

SEQ ID NO: 96594 - DNA, 25 bp, mus musculus
gtctctgcctccaagagggctcgag

SEQ ID NO: 96595 - DNA, 25 bp, mus musculus
ctctgcctccaagagggctcgagcg

SEQ ID NO: 96596 - DNA, 25 bp, mus musculus
tctgcctccaagagggctcgagcgg

SEQ ID NO: 96597 - DNA, 25 bp, mus musculus
tgcctccaagagggctcgagcggag

SEQ ID NO: 96598 - DNA, 25 bp, mus musculus
tggcgcttctctgcgcttcgtgcgg

SEQ ID NO: 96599 - DNA, 25 bp, mus musculus
ggcgcttctctgcgcttcgtgcggc

SEQ ID NO: 96600 - DNA, 25 bp, mus musculus
taggctctcgcacgctcattgcttt

SEQ ID NO: 96601 - DNA, 25 bp, mus musculus
ggctctcgcacgctcattgctttct

SEQ ID NO: 96602 - DNA, 25 bp, mus musculus
gctctcgcacgctcattgctttctt

SEQ ID NO: 96603 - DNA, 25 bp, mus musculus
tctcgcacgctcattgctttcttct

SEQ ID NO: 96604 - DNA, 25 bp, mus musculus
cgcacgctcattgctttcttctttt

SEQ ID NO: 96605 - DNA, 25 bp, mus musculus
gccgccatgccctgctcggaagatg

SEQ ID NO: 96606 - DNA, 25 bp, mus musculus
cgccatgccctgctcggaagatgcc

SEQ ID NO: 96607 - DNA, 25 bp, mus musculus
catgccctgctcggaagatgccgcg

SEQ ID NO: 96608 - DNA, 25 bp, mus musculus
tgttgccaaaatgtcgcgtttccaa

SEQ ID NO: 96609 - DNA, 25 bp, mus musculus
gccaaaatgtcgcgtttccaacaag

SEQ ID NO: 96610 - DNA, 25 bp, mus musculus
tgtgccgagcgtcgaattctgcgtg

SEQ ID NO: 96611 - DNA, 25 bp, mus musculus
ccgagcgtcgaattctgcgtggata

SEQ ID NO: 96612 - DNA, 25 bp, mus musculus
gagcgtcgaattctgcgtggataat

SEQ ID NO: 96613 - DNA, 25 bp, mus musculus
gcgtcgaattctgcgtggataatgg

SEQ ID NO: 96614 - DNA, 25 bp, mus musculus
gccagttgctgctgaacttcaaatc

SEQ ID NO: 96615 - DNA, 25 bp, mus musculus
cagttgctgctgaacttcaaatctc

SEQ ID NO: 96616 - DNA, 25 bp, mus musculus
tgctgctgaacttcaaatctctgct

SEQ ID NO: 96617 - DNA, 25 bp, mus musculus
ctgctgaacttcaaatctctgctgg

SEQ ID NO: 96618 - DNA, 25 bp, mus musculus
gctgaacttcaaatctctgctgggc

SEQ ID NO: 96619 - DNA, 25 bp, mus musculus
tgaacttcaaatctctgctgggcaa

SEQ ID NO: 96620 - DNA, 25 bp, mus musculus
cgcgtttccaacaagctgacttttg

SEQ ID NO: 96621 - DNA, 25 bp, mus musculus
agagcaactgcataacatacgacca

SEQ ID NO: 96622 - DNA, 25 bp, mus musculus
caactgcataacatacgaccaaagg

SEQ ID NO: 96623 - DNA, 25 bp, mus musculus
actgcataacatacgaccaaaggat

SEQ ID NO: 96624 - DNA, 25 bp, mus musculus
tgcataacatacgaccaaaggatga

SEQ ID NO: 96625 - DNA, 25 bp, mus musculus
cataacatacgaccaaaggatgaag

SEQ ID NO: 96626 - DNA, 25 bp, mus musculus
ctgctgtgccgagcgtcgaattctg

SEQ ID NO: 96627 - DNA, 25 bp, mus musculus
gctgtgccgagcgtcgaattctgcg

SEQ ID NO: 96628 - DNA, 25 bp, mus musculus
gtcttccccttcttgaaatccatgc

SEQ ID NO: 96629 - DNA, 25 bp, mus musculus
ttccccttcttgaaatccatgccga

SEQ ID NO: 96630 - DNA, 25 bp, mus musculus
ggaatctccggttccattccaggct

SEQ ID NO: 96631 - DNA, 25 bp, mus musculus
tccggttccattccaggcttggaag

SEQ ID NO: 96632 - DNA, 25 bp, mus musculus
ggttccattccaggcttggaagagg

SEQ ID NO: 96633 - DNA, 25 bp, mus musculus
tccattccaggcttggaagagggag

SEQ ID NO: 96634 - DNA, 25 bp, mus musculus
ggtacagatccctggaccttctctc

SEQ ID NO: 96635 - DNA, 25 bp, mus musculus
gatccctggaccttctctccgctga

SEQ ID NO: 96636 - DNA, 25 bp, mus musculus
ccctggaccttctctccgctgaaga

SEQ ID NO: 96637 - DNA, 25 bp, mus musculus
accttctctccgctgaagaacgctg

SEQ ID NO: 96638 - DNA, 25 bp, mus musculus
ttctctccgctgaagaacgctgacc

SEQ ID NO: 96639 - DNA, 25 bp, mus musculus
aacgctgaccaactgaaagaggttg

SEQ ID NO: 96640 - DNA, 25 bp, mus musculus
cccttcttgaaatccatgccgaatt

SEQ ID NO: 96641 - DNA, 25 bp, mus musculus
ttcttgaaatccatgccgaattccc

SEQ ID NO: 96642 - DNA, 25 bp, mus musculus
ttgaaatccatgccgaattccctcg

SEQ ID NO: 96643 - DNA, 25 bp, mus musculus
cctactctggatgcctttgacctgg

SEQ ID NO: 96644 - DNA, 25 bp, mus musculus
gatgcctttgacctggtggaccgga

SEQ ID NO: 96645 - DNA, 25 bp, mus musculus
tttgacctggtggaccggagtctga

SEQ ID NO: 96646 - DNA, 25 bp, mus musculus
gacctggtggaccggagtctgagaa

SEQ ID NO: 96647 - DNA, 25 bp, mus musculus
ctggtggaccggagtctgagaaatg

SEQ ID NO: 96648 - DNA, 25 bp, mus musculus
gaatggtaccagattccaagagtac

SEQ ID NO: 96649 - DNA, 25 bp, mus musculus
atggtaccagattccaagagtactc

SEQ ID NO: 96650 - DNA, 25 bp, mus musculus
gcacaatcagccactggtggcgctg

SEQ ID NO: 96651 - DNA, 25 bp, mus musculus
acaatcagccactggtggcgctgag

SEQ ID NO: 96652 - DNA, 25 bp, mus musculus
agccactggtggcgctgagctgaca

SEQ ID NO: 96653 - DNA, 25 bp, mus musculus
ctgagctgacagccaaaccctgtga

SEQ ID NO: 96654 - DNA, 25 bp, mus musculus
gagctgacagccaaaccctgtgaca

SEQ ID NO: 96655 - DNA, 25 bp, mus musculus
gctgacagccaaaccctgtgacacg

SEQ ID NO: 96656 - DNA, 25 bp, mus musculus
acagccaaaccctgtgacacggctc

SEQ ID NO: 96657 - DNA, 25 bp, mus musculus
agccaaaccctgtgacacggctcgg

SEQ ID NO: 96658 - DNA, 25 bp, mus musculus
ccaaaccctgtgacacggctcggcg

SEQ ID NO: 96659 - DNA, 25 bp, mus musculus
tgtgacacggctcggcggcgaacga

SEQ ID NO: 96660 - DNA, 25 bp, mus musculus
caagagtactcacatcgtcatcaag

SEQ ID NO: 96661 - DNA, 25 bp, mus musculus
agagtactcacatcgtcatcaagtc

SEQ ID NO: 96662 - DNA, 25 bp, mus musculus
tactcacatcgtcatcaagtcgaag

SEQ ID NO: 96663 - DNA, 25 bp, mus musculus
ctcacatcgtcatcaagtcgaagac

SEQ ID NO: 96664 - DNA, 25 bp, mus musculus
cacatcgtcatcaagtcgaagactg

SEQ ID NO: 96665 - DNA, 25 bp, mus musculus
catcgtcatcaagtcgaagactgca

SEQ ID NO: 96666 - DNA, 25 bp, mus musculus
tcgtcatcaagtcgaagactgcaca

SEQ ID NO: 96667 - DNA, 25 bp, mus musculus
aagactgcacaatcagccactggtg

SEQ ID NO: 96668 - DNA, 25 bp, mus musculus
tgcccgtcatggtgtgtgaactctg

SEQ ID NO: 96669 - DNA, 25 bp, mus musculus
tgtcttcacggttcaactagatgca

SEQ ID NO: 96670 - DNA, 25 bp, mus musculus
acacatacacacaagagaggaccct

SEQ ID NO: 96671 - DNA, 25 bp, mus musculus
tcttctgcccatgacccaagacaga

SEQ ID NO: 96672 - DNA, 25 bp, mus musculus
ccctatgacacagaaactattccct

SEQ ID NO: 96673 - DNA, 25 bp, mus musculus
gacacagaaactattccctgccaca

SEQ ID NO: 96674 - DNA, 25 bp, mus musculus
tgccacacatggacatgaacactga

SEQ ID NO: 96675 - DNA, 25 bp, mus musculus
gtagcaacgatcagctttatcacat

SEQ ID NO: 96676 - DNA, 25 bp, mus musculus
agctttatcacatttagttaaatca

SEQ ID NO: 96677 - DNA, 25 bp, mus musculus
attgtggtttcctttctgagacatg

SEQ ID NO: 96678 - DNA, 25 bp, mus musculus
gtttcctttctgagacatgaatttg

SEQ ID NO: 96679 - DNA, 25 bp, mus musculus
cacacgctgtcgtggaactcacagg

SEQ ID NO: 96680 - DNA, 25 bp, mus musculus
tgagcacttactacatatgctacat

SEQ ID NO: 96681 - DNA, 25 bp, mus musculus
cttactacatatgctacatgattca

SEQ ID NO: 96682 - DNA, 25 bp, mus musculus
acatatgctacatgattcagatgtt

SEQ ID NO: 96683 - DNA, 25 bp, mus musculus
agatgttcagcagtggttagagcaa

SEQ ID NO: 96684 - DNA, 25 bp, mus musculus
aagcctaactgctaggctttttgat

SEQ ID NO: 96685 - DNA, 25 bp, mus musculus
aactgctaggctttttgatgcaagt

SEQ ID NO: 96686 - DNA, 25 bp, mus musculus
ccttccaggtctcttcttacacata

SEQ ID NO: 96687 - DNA, 25 bp, mus musculus
aggtctcttcttacacatacacaca

SEQ ID NO: 96688 - DNA, 25 bp, mus musculus
gctcttcgggcgcagcttgttgacc

SEQ ID NO: 96689 - DNA, 25 bp, mus musculus
ctgggactcggcgatgtgcgccctc

SEQ ID NO: 96690 - DNA, 25 bp, mus musculus
agcctggcgcttgtagtccttcacc

SEQ ID NO: 96691 - DNA, 25 bp, mus musculus
gcgcttgtagtccttcaccatcagc

SEQ ID NO: 96692 - DNA, 25 bp, mus musculus
gtagtccttcaccatcagctgcatc

SEQ ID NO: 96693 - DNA, 25 bp, mus musculus
catcagctgcatcctgtccatcagg

SEQ ID NO: 96694 - DNA, 25 bp, mus musculus
ctgcatcctgtccatcaggtcctgc

SEQ ID NO: 96695 - DNA, 25 bp, mus musculus
catcaggtcctgcagccgcagtagg

SEQ ID NO: 96696 - DNA, 25 bp, mus musculus
ttcctctgtctggtaggtgagctcc

SEQ ID NO: 96697 - DNA, 25 bp, mus musculus
gagctccttgatgcgccgatcactc

SEQ ID NO: 96698 - DNA, 25 bp, mus musculus
catgcccttcacagactctgcactg

SEQ ID NO: 96699 - DNA, 25 bp, mus musculus
cttcacagactctgcactgcgcttt

SEQ ID NO: 96700 - DNA, 25 bp, mus musculus
atccagctcgtgctgcaccttgctg

SEQ ID NO: 96701 - DNA, 25 bp, mus musculus
agactctgcactgcgcttttgctca

SEQ ID NO: 96702 - DNA, 25 bp, mus musculus
ctcgtgctgcaccttgctgaacttg

SEQ ID NO: 96703 - DNA, 25 bp, mus musculus
ctgcaccttgctgaacttggacagg

SEQ ID NO: 96704 - DNA, 25 bp, mus musculus
cttgctgaacttggacaggttggtg

SEQ ID NO: 96705 - DNA, 25 bp, mus musculus
gttgacctgctcctgagactcctca

SEQ ID NO: 96706 - DNA, 25 bp, mus musculus
ctgctcctgagactcctcagcctgg

SEQ ID NO: 96707 - DNA, 25 bp, mus musculus
ctgagactcctcagcctggcgcttg

SEQ ID NO: 96708 - DNA, 25 bp, mus musculus
ctcctcagcctggcgcttgtagtcc

SEQ ID NO: 96709 - DNA, 25 bp, mus musculus
ggagattttcctcggcgaggttgat

SEQ ID NO: 96710 - DNA, 25 bp, mus musculus
gagattttcctcggcgaggttgatc

SEQ ID NO: 96711 - DNA, 25 bp, mus musculus
tgtttcagatgccctgaacaaggat

SEQ ID NO: 96712 - DNA, 25 bp, mus musculus
gtttcagatgccctgaacaaggatt

SEQ ID NO: 96713 - DNA, 25 bp, mus musculus
tttcagatgccctgaacaaggattc

SEQ ID NO: 96714 - DNA, 25 bp, mus musculus
ttcagatgccctgaacaaggattcg

SEQ ID NO: 96715 - DNA, 25 bp, mus musculus
cagatgccctgaacaaggattcgat

SEQ ID NO: 96716 - DNA, 25 bp, mus musculus
agatgccctgaacaaggattcgata

SEQ ID NO: 96717 - DNA, 25 bp, mus musculus
atgccctgaacaaggattcgatatg

SEQ ID NO: 96718 - DNA, 25 bp, mus musculus
tgccctgaacaaggattcgatatga

SEQ ID NO: 96719 - DNA, 25 bp, mus musculus
cgatatgagacgcttgacggaccct

SEQ ID NO: 96720 - DNA, 25 bp, mus musculus
atatgagacgcttgacggaccctcc

SEQ ID NO: 96721 - DNA, 25 bp, mus musculus
agattttcctcggcgaggttgatct

SEQ ID NO: 96722 - DNA, 25 bp, mus musculus
gattttcctcggcgaggttgatctc

SEQ ID NO: 96723 - DNA, 25 bp, mus musculus
attttcctcggcgaggttgatctct

SEQ ID NO: 96724 - DNA, 25 bp, mus musculus
ttttcctcggcgaggttgatctcta

SEQ ID NO: 96725 - DNA, 25 bp, mus musculus
tttcctcggcgaggttgatctctaa

SEQ ID NO: 96726 - DNA, 25 bp, mus musculus
ttcctcggcgaggttgatctctaat

SEQ ID NO: 96727 - DNA, 25 bp, mus musculus
tcctcggcgaggttgatctctaatg

SEQ ID NO: 96728 - DNA, 25 bp, mus musculus
atgtttcagatgccctgaacaagga

SEQ ID NO: 96729 - DNA, 25 bp, mus musculus
cattcttgctagcgaaactgggaga

SEQ ID NO: 96730 - DNA, 25 bp, mus musculus
gagattgccacacattactgaagtc

SEQ ID NO: 96731 - DNA, 25 bp, mus musculus
acttgatctgttgtctgctcgttac

SEQ ID NO: 96732 - DNA, 25 bp, mus musculus
gttgtctgctcgttacatgaggcag

SEQ ID NO: 96733 - DNA, 25 bp, mus musculus
aattactgtgcgtttaatcaaatct

SEQ ID NO: 96734 - DNA, 25 bp, mus musculus
atctgtggacaactaggcagctcga

SEQ ID NO: 96735 - DNA, 25 bp, mus musculus
ggacaactaggcagctcgaacttga

SEQ ID NO: 96736 - DNA, 25 bp, mus musculus
ctaggcagctcgaacttgaaaagtc

SEQ ID NO: 96737 - DNA, 25 bp, mus musculus
caccaagtcatactagaaagctcac

SEQ ID NO: 96738 - DNA, 25 bp, mus musculus
ctagaaagctcactacgctagtatg

SEQ ID NO: 96739 - DNA, 25 bp, mus musculus
gaaagctcactacgctagtatggat

SEQ ID NO: 96740 - DNA, 25 bp, mus musculus
agctcactacgctagtatggatatc

SEQ ID NO: 96741 - DNA, 25 bp, mus musculus
attgccacacattactgaagtcttg

SEQ ID NO: 96742 - DNA, 25 bp, mus musculus
acacattactgaagtcttggtaagg

SEQ ID NO: 96743 - DNA, 25 bp, mus musculus
tactgaagtcttggtaagggctatt

SEQ ID NO: 96744 - DNA, 25 bp, mus musculus
tatgatcgctgcaaaaccgatgtct

SEQ ID NO: 96745 - DNA, 25 bp, mus musculus
gatcgctgcaaaaccgatgtctgtt

SEQ ID NO: 96746 - DNA, 25 bp, mus musculus
cgctgcaaaaccgatgtctgttgag

SEQ ID NO: 96747 - DNA, 25 bp, mus musculus
tgactagtctccacttgatctgttg

SEQ ID NO: 96748 - DNA, 25 bp, mus musculus
ctagtctccacttgatctgttgtct

SEQ ID NO: 96749 - DNA, 25 bp, mus musculus
ctatgaccaaggacaacaaccgtgc

SEQ ID NO: 96750 - DNA, 25 bp, mus musculus
accgtgcctgtttagtacgagctca

SEQ ID NO: 96751 - DNA, 25 bp, mus musculus
gacatcgatgccaaaggattctaaa

SEQ ID NO: 96752 - DNA, 25 bp, mus musculus
taaatgagtctgctttacagaagca

SEQ ID NO: 96753 - DNA, 25 bp, mus musculus
ctttacagaagcagacacggtagga

SEQ ID NO: 96754 - DNA, 25 bp, mus musculus
agatcaggatcacgatcacgagtgg

SEQ ID NO: 96755 - DNA, 25 bp, mus musculus
tcaggatcacgatcacgagtggcat

SEQ ID NO: 96756 - DNA, 25 bp, mus musculus
ggatcacgatcacgagtggcatggg

SEQ ID NO: 96757 - DNA, 25 bp, mus musculus
cgatcacgagtggcatgggacgctt

SEQ ID NO: 96758 - DNA, 25 bp, mus musculus
gcatgggacgcttgagtcaggtaga

SEQ ID NO: 96759 - DNA, 25 bp, mus musculus
atactgaactcatggtcccagaagc

SEQ ID NO: 96760 - DNA, 25 bp, mus musculus
ctgaactcatggtcccagaagctga

SEQ ID NO: 96761 - DNA, 25 bp, mus musculus
tagtacgagctcactggcatctgtt

SEQ ID NO: 96762 - DNA, 25 bp, mus musculus
tacgagctcactggcatctgtttag

SEQ ID NO: 96763 - DNA, 25 bp, mus musculus
gagctcactggcatctgtttagcac

SEQ ID NO: 96764 - DNA, 25 bp, mus musculus
actggcatctgtttagcacaacgag

SEQ ID NO: 96765 - DNA, 25 bp, mus musculus
ggcatctgtttagcacaacgagggt

SEQ ID NO: 96766 - DNA, 25 bp, mus musculus
atctgtttagcacaacgagggtctt

SEQ ID NO: 96767 - DNA, 25 bp, mus musculus
ttagcacaacgagggtcttctcaga

SEQ ID NO: 96768 - DNA, 25 bp, mus musculus
catgacatcgatgccaaaggattct

SEQ ID NO: 96769 - DNA, 25 bp, mus musculus
tgagcccatggggaagccaggtcag

SEQ ID NO: 96770 - DNA, 25 bp, mus musculus
cacatgtccccaggtcaccttgcta

SEQ ID NO: 96771 - DNA, 25 bp, mus musculus
cactctgacacctaggctctgacag

SEQ ID NO: 96772 - DNA, 25 bp, mus musculus
tctgacacctaggctctgacaggca

SEQ ID NO: 96773 - DNA, 25 bp, mus musculus
acctaggctctgacaggcaggcgtg

SEQ ID NO: 96774 - DNA, 25 bp, mus musculus
acaggcaggcgtgtgtcactttctc

SEQ ID NO: 96775 - DNA, 25 bp, mus musculus
gtgtcactttctcacacttccttcc

SEQ ID NO: 96776 - DNA, 25 bp, mus musculus
tccttccaccaagggactgactatt

SEQ ID NO: 96777 - DNA, 25 bp, mus musculus
ctgacctcagcaatcagctctgtgc

SEQ ID NO: 96778 - DNA, 25 bp, mus musculus
acctcagcaatcagctctgtgctgg

SEQ ID NO: 96779 - DNA, 25 bp, mus musculus
gcaatcagctctgtgctggccctga

SEQ ID NO: 96780 - DNA, 25 bp, mus musculus
agctctgtgctggccctgagaggat

SEQ ID NO: 96781 - DNA, 25 bp, mus musculus
atgtccccaggtcaccttgctatgg

SEQ ID NO: 96782 - DNA, 25 bp, mus musculus
gtgctggccctgagaggatattgtc

SEQ ID NO: 96783 - DNA, 25 bp, mus musculus
tccccaggtcaccttgctatggcct

SEQ ID NO: 96784 - DNA, 25 bp, mus musculus
ggtcaccttgctatggcctatagcc

SEQ ID NO: 96785 - DNA, 25 bp, mus musculus
caccttgctatggcctatagccctc

SEQ ID NO: 96786 - DNA, 25 bp, mus musculus
cttgctatggcctatagccctcact

SEQ ID NO: 96787 - DNA, 25 bp, mus musculus
atggcctatagccctcactctgaca

SEQ ID NO: 96788 - DNA, 25 bp, mus musculus
tatagccctcactctgacacctagg

SEQ ID NO: 96789 - DNA, 25 bp, mus musculus
cctcactctgacacctaggctctga

SEQ ID NO: 96790 - DNA, 25 bp, mus musculus
gatccatgcagaaaactcatagagg

SEQ ID NO: 96791 - DNA, 25 bp, mus musculus
atccatgcagaaaactcatagaggt

SEQ ID NO: 96792 - DNA, 25 bp, mus musculus
caaccctcactgaacatcagcgaat

SEQ ID NO: 96793 - DNA, 25 bp, mus musculus
aaccctcactgaacatcagcgaatt

SEQ ID NO: 96794 - DNA, 25 bp, mus musculus
accctcactgaacatcagcgaattc

SEQ ID NO: 96795 - DNA, 25 bp, mus musculus
ccctcactgaacatcagcgaattca

SEQ ID NO: 96796 - DNA, 25 bp, mus musculus
cactgaacatcagcgaattcatacc

SEQ ID NO: 96797 - DNA, 25 bp, mus musculus
actgaacatcagcgaattcataccg

SEQ ID NO: 96798 - DNA, 25 bp, mus musculus
ctgaacatcagcgaattcataccgg

SEQ ID NO: 96799 - DNA, 25 bp, mus musculus
tgaacatcagcgaattcataccggc

SEQ ID NO: 96800 - DNA, 25 bp, mus musculus
attataagtcaaccctcactgaaca

SEQ ID NO: 96801 - DNA, 25 bp, mus musculus
ttataagtcaaccctcactgaacat

SEQ ID NO: 96802 - DNA, 25 bp, mus musculus
tataagtcaaccctcactgaacatc

SEQ ID NO: 96803 - DNA, 25 bp, mus musculus
ataagtcaaccctcactgaacatca

SEQ ID NO: 96804 - DNA, 25 bp, mus musculus
taagtcaaccctcactgaacatcag

SEQ ID NO: 96805 - DNA, 25 bp, mus musculus
agtcaaccctcactgaacatcagcg

SEQ ID NO: 96806 - DNA, 25 bp, mus musculus
gtcaaccctcactgaacatcagcga

SEQ ID NO: 96807 - DNA, 25 bp, mus musculus
tcaaccctcactgaacatcagcgaa

SEQ ID NO: 96808 - DNA, 25 bp, mus musculus
tctcaatcttcctcgtcactacaag

SEQ ID NO: 96809 - DNA, 25 bp, mus musculus
tcctcgtcactacaagtccatcagt

SEQ ID NO: 96810 - DNA, 25 bp, mus musculus
agccatttgtactgggaccactgtt

SEQ ID NO: 96811 - DNA, 25 bp, mus musculus
catttgtactgggaccactgtttgc

SEQ ID NO: 96812 - DNA, 25 bp, mus musculus
tgggaccactgtttgccatggaaag

SEQ ID NO: 96813 - DNA, 25 bp, mus musculus
gaccactgtttgccatggaaagcag

SEQ ID NO: 96814 - DNA, 25 bp, mus musculus
catctgcaaatggacccctgtaaat

SEQ ID NO: 96815 - DNA, 25 bp, mus musculus
ctgcaaatggacccctgtaaatact

SEQ ID NO: 96816 - DNA, 25 bp, mus musculus
tgtaaatactggcaactccagtacc

SEQ ID NO: 96817 - DNA, 25 bp, mus musculus
tggcaactccagtaccacggccact

SEQ ID NO: 96818 - DNA, 25 bp, mus musculus
caccctgaatcatgaaatcctttat

SEQ ID NO: 96819 - DNA, 25 bp, mus musculus
tgaaatcctttatgaccctgtgaaa

SEQ ID NO: 96820 - DNA, 25 bp, mus musculus
tcgtcactacaagtccatcagtgat

SEQ ID NO: 96821 - DNA, 25 bp, mus musculus
ttatgaccctgtgaaaggtgctctc

SEQ ID NO: 96822 - DNA, 25 bp, mus musculus
caagtccatcagtgattttcccaaa

SEQ ID NO: 96823 - DNA, 25 bp, mus musculus
gtccatcagtgattttcccaaacac

SEQ ID NO: 96824 - DNA, 25 bp, mus musculus
catccagccaatcacacttagaaca

SEQ ID NO: 96825 - DNA, 25 bp, mus musculus
gccaatcacacttagaacacgtgat

SEQ ID NO: 96826 - DNA, 25 bp, mus musculus
aatcacacttagaacacgtgataaa

SEQ ID NO: 96827 - DNA, 25 bp, mus musculus
cacacttagaacacgtgataaagaa

SEQ ID NO: 96828 - DNA, 25 bp, mus musculus
actggcagccatttgtactgggacc

SEQ ID NO: 96829 - DNA, 25 bp, mus musculus
cgacattcctgggaacgagtctcag

SEQ ID NO: 96830 - DNA, 25 bp, mus musculus
tcctgggaacgagtctcaggaggcg

SEQ ID NO: 96831 - DNA, 25 bp, mus musculus
cctgatggccacattttcttggaag

SEQ ID NO: 96832 - DNA, 25 bp, mus musculus
cacattttcttggaagccttctctc

SEQ ID NO: 96833 - DNA, 25 bp, mus musculus
attttcttggaagccttctctccag

SEQ ID NO: 96834 - DNA, 25 bp, mus musculus
ttcttggaagccttctctccagttt

SEQ ID NO: 96835 - DNA, 25 bp, mus musculus
ttggaagccttctctccagtttaca

SEQ ID NO: 96836 - DNA, 25 bp, mus musculus
gaagccttctctccagtttacaaat

SEQ ID NO: 96837 - DNA, 25 bp, mus musculus
gccttctctccagtttacaaatatg

SEQ ID NO: 96838 - DNA, 25 bp, mus musculus
ttctctccagtttacaaatatgccc

SEQ ID NO: 96839 - DNA, 25 bp, mus musculus
tacaaatatgcccaagacttcctgg

SEQ ID NO: 96840 - DNA, 25 bp, mus musculus
tatgcccaagacttcctggtggcaa

SEQ ID NO: 96841 - DNA, 25 bp, mus musculus
tccgccgctgggaaacaggtggacg

SEQ ID NO: 96842 - DNA, 25 bp, mus musculus
gcccaagacttcctggtggcaattg

SEQ ID NO: 96843 - DNA, 25 bp, mus musculus
gacgagtccagcaccaaagtggatg

SEQ ID NO: 96844 - DNA, 25 bp, mus musculus
gagtccagcaccaaagtggatgagt

SEQ ID NO: 96845 - DNA, 25 bp, mus musculus
tccagcaccaaagtggatgagtatg

SEQ ID NO: 96846 - DNA, 25 bp, mus musculus
tacagacagcagatgccactaaagg

SEQ ID NO: 96847 - DNA, 25 bp, mus musculus
agacagcagatgccactaaagggtg

SEQ ID NO: 96848 - DNA, 25 bp, mus musculus
cagcagatgccactaaagggtgacc

SEQ ID NO: 96849 - DNA, 25 bp, mus musculus
ctctgggtggctcctgatggccaca

SEQ ID NO: 96850 - DNA, 25 bp, mus musculus
ctttaagtctacagatgcagagtga

SEQ ID NO: 96851 - DNA, 25 bp, mus musculus
gtttcctgggtgcctggaatctgtc

SEQ ID NO: 96852 - DNA, 25 bp, mus musculus
gcttcagcttgcttgagagcgactg

SEQ ID NO: 96853 - DNA, 25 bp, mus musculus
gcttgcttgagagcgactgttctcc

SEQ ID NO: 96854 - DNA, 25 bp, mus musculus
agagcgactgttctccaaggcttcg

SEQ ID NO: 96855 - DNA, 25 bp, mus musculus
gttctccaaggcttcgtgttgagga

SEQ ID NO: 96856 - DNA, 25 bp, mus musculus
ctccaaggcttcgtgttgaggacaa

SEQ ID NO: 96857 - DNA, 25 bp, mus musculus
cctctgccagtttgcgctgcctctg

SEQ ID NO: 96858 - DNA, 25 bp, mus musculus
ccagtttgcgctgcctctgggtctg

SEQ ID NO: 96859 - DNA, 25 bp, mus musculus
tcggaattgcactttccttcccttg

SEQ ID NO: 96860 - DNA, 25 bp, mus musculus
gaattgcactttccttcccttgtct

SEQ ID NO: 96861 - DNA, 25 bp, mus musculus
gcctcgtgcggctgagagaaagaaa

SEQ ID NO: 96862 - DNA, 25 bp, mus musculus
cctggaatctgtccagctgggcctg

SEQ ID NO: 96863 - DNA, 25 bp, mus musculus
ctctgcggctttggccagaggttct

SEQ ID NO: 96864 - DNA, 25 bp, mus musculus
tcactcagctgaagtccttttggaa

SEQ ID NO: 96865 - DNA, 25 bp, mus musculus
tgttgcttgttgtttagaggttcag

SEQ ID NO: 96866 - DNA, 25 bp, mus musculus
aattccaataagctagtcaggactc

SEQ ID NO: 96867 - DNA, 25 bp, mus musculus
aagctagtcaggactccaggatggg

SEQ ID NO: 96868 - DNA, 25 bp, mus musculus
ctagtcaggactccaggatgggtgg

SEQ ID NO: 96869 - DNA, 25 bp, mus musculus
agaggaacactgccaagatgtcagg

SEQ ID NO: 96870 - DNA, 25 bp, mus musculus
ggtccctagctcatggcagtctaga

SEQ ID NO: 96871 - DNA, 25 bp, mus musculus
tagctcatggcagtctagacccagc

SEQ ID NO: 96872 - DNA, 25 bp, mus musculus
tttaggctttgcttcttagatcatg

SEQ ID NO: 96873 - DNA, 25 bp, mus musculus
ctttgcttcttagatcatgtagtat

SEQ ID NO: 96874 - DNA, 25 bp, mus musculus
cctttttgcctcagacttactgcta

SEQ ID NO: 96875 - DNA, 25 bp, mus musculus
tgcctcagacttactgctacagtta

SEQ ID NO: 96876 - DNA, 25 bp, mus musculus
agacttactgctacagttataggca

SEQ ID NO: 96877 - DNA, 25 bp, mus musculus
ataggcatgtgccttcatgcctagc

SEQ ID NO: 96878 - DNA, 25 bp, mus musculus
cttcatgcctagctggcgtatatca

SEQ ID NO: 96879 - DNA, 25 bp, mus musculus
tatatcaatctacataatgttctca

SEQ ID NO: 96880 - DNA, 25 bp, mus musculus
aatctacataatgttctcaaggtgg

SEQ ID NO: 96881 - DNA, 25 bp, mus musculus
cataatgttctcaaggtggaactgt

SEQ ID NO: 96882 - DNA, 25 bp, mus musculus
ccaccataccttgctctttctactg

SEQ ID NO: 96883 - DNA, 25 bp, mus musculus
aagacatctaattatcctttggcct

SEQ ID NO: 96884 - DNA, 25 bp, mus musculus
agtataaacttcactagcactgaaa

SEQ ID NO: 96885 - DNA, 25 bp, mus musculus
tttggatctgaccaatacaatccct

SEQ ID NO: 96886 - DNA, 25 bp, mus musculus
caatacaatcccttactctgagttc

SEQ ID NO: 96887 - DNA, 25 bp, mus musculus
ttactctgagttctaagtctttggt

SEQ ID NO: 96888 - DNA, 25 bp, mus musculus
ctttggtagccattccattctctgc

SEQ ID NO: 96889 - DNA, 25 bp, mus musculus
tagccattccattctctgcttggag

SEQ ID NO: 96890 - DNA, 25 bp, mus musculus
ttccattctctgcttggagttcagc

SEQ ID NO: 96891 - DNA, 25 bp, mus musculus
aaattcttcagctgcaagaggagct

SEQ ID NO: 96892 - DNA, 25 bp, mus musculus
attcttcagctgcaagaggagctgg

SEQ ID NO: 96893 - DNA, 25 bp, mus musculus
cgccaacagcgcctctggaaagtct

SEQ ID NO: 96894 - DNA, 25 bp, mus musculus
aacagcgcctctggaaagtctgcgc

SEQ ID NO: 96895 - DNA, 25 bp, mus musculus
gcctctggaaagtctgcgctgttgg

SEQ ID NO: 96896 - DNA, 25 bp, mus musculus
ctctggaaagtctgcgctgttggat

SEQ ID NO: 96897 - DNA, 25 bp, mus musculus
ctggaaagtctgcgctgttggatga

SEQ ID NO: 96898 - DNA, 25 bp, mus musculus
ggaaagtctgcgctgttggatgaga

SEQ ID NO: 96899 - DNA, 25 bp, mus musculus
aaagtctgcgctgttggatgagaag

SEQ ID NO: 96900 - DNA, 25 bp, mus musculus
aagtctgcgctgttggatgagaagc

SEQ ID NO: 96901 - DNA, 25 bp, mus musculus
agtctgcgctgttggatgagaagcg

SEQ ID NO: 96902 - DNA, 25 bp, mus musculus
gcgcggatccacagctggaagagga

SEQ ID NO: 96903 - DNA, 25 bp, mus musculus
tcttcagctgcaagaggagctggcc

SEQ ID NO: 96904 - DNA, 25 bp, mus musculus
aggagctggcctcatccgagcgagc

SEQ ID NO: 96905 - DNA, 25 bp, mus musculus
cgccgacacgcagagcaggagcgag

SEQ ID NO: 96906 - DNA, 25 bp, mus musculus
ccgacacgcagagcaggagcgagac

SEQ ID NO: 96907 - DNA, 25 bp, mus musculus
gacacgcagagcaggagcgagacga

SEQ ID NO: 96908 - DNA, 25 bp, mus musculus
tgagatcgccaacagcgcctctgga

SEQ ID NO: 96909 - DNA, 25 bp, mus musculus
agatcgccaacagcgcctctggaaa

SEQ ID NO: 96910 - DNA, 25 bp, mus musculus
atcgccaacagcgcctctggaaagt

SEQ ID NO: 96911 - DNA, 25 bp, mus musculus
ctcgcaccttcacgcggacgagtca

SEQ ID NO: 96912 - DNA, 25 bp, mus musculus
cgcaccttcacgcggacgagtcata

SEQ ID NO: 96913 - DNA, 25 bp, mus musculus
ctgctgttttcggcgattttctagg

SEQ ID NO: 96914 - DNA, 25 bp, mus musculus
ggaacgcctgggctccttcggcagc

SEQ ID NO: 96915 - DNA, 25 bp, mus musculus
ttcggcagcatcacccggcagcagg

SEQ ID NO: 96916 - DNA, 25 bp, mus musculus
gcagcatcacccggcagcaggaagg

SEQ ID NO: 96917 - DNA, 25 bp, mus musculus
agcatcacccggcagcaggaaggtg

SEQ ID NO: 96918 - DNA, 25 bp, mus musculus
catcacccggcagcaggaaggtgag

SEQ ID NO: 96919 - DNA, 25 bp, mus musculus
tcacccggcagcaggaaggtgaggc

SEQ ID NO: 96920 - DNA, 25 bp, mus musculus
acccggcagcaggaaggtgaggcca

SEQ ID NO: 96921 - DNA, 25 bp, mus musculus
gaggccagctctcaggacatgacag

SEQ ID NO: 96922 - DNA, 25 bp, mus musculus
ggccagctctcaggacatgacagcc

SEQ ID NO: 96923 - DNA, 25 bp, mus musculus
caccttcacgcggacgagtcatacg

SEQ ID NO: 96924 - DNA, 25 bp, mus musculus
ccttcacgcggacgagtcatacgta

SEQ ID NO: 96925 - DNA, 25 bp, mus musculus
ttcacgcggacgagtcatacgtaca

SEQ ID NO: 96926 - DNA, 25 bp, mus musculus
cgagtcatacgtacacccgcacaga

SEQ ID NO: 96927 - DNA, 25 bp, mus musculus
agtcatacgtacacccgcacagagc

SEQ ID NO: 96928 - DNA, 25 bp, mus musculus
tcatacgtacacccgcacagagcgg

SEQ ID NO: 96929 - DNA, 25 bp, mus musculus
atacgtacacccgcacagagcggac

SEQ ID NO: 96930 - DNA, 25 bp, mus musculus
gtacacccgcacagagcggacagag

SEQ ID NO: 96931 - DNA, 25 bp, mus musculus
gtttgctggaggctccctcatcagc

SEQ ID NO: 96932 - DNA, 25 bp, mus musculus
cagccaccgatgggtgttgactgcg

SEQ ID NO: 96933 - DNA, 25 bp, mus musculus
cctggtcccagtccaggacatcatt

SEQ ID NO: 96934 - DNA, 25 bp, mus musculus
ggtcccagtccaggacatcattttc

SEQ ID NO: 96935 - DNA, 25 bp, mus musculus
cccagtccaggacatcattttccct

SEQ ID NO: 96936 - DNA, 25 bp, mus musculus
ttccaactttgacattcaaaccatg

SEQ ID NO: 96937 - DNA, 25 bp, mus musculus
ctttgacattcaaaccatgaggaat

SEQ ID NO: 96938 - DNA, 25 bp, mus musculus
cattgcccttgctctgctgtacttc

SEQ ID NO: 96939 - DNA, 25 bp, mus musculus
tctgctgtacttccccgtgaattac

SEQ ID NO: 96940 - DNA, 25 bp, mus musculus
cgtgaattactcctcgctcatccag

SEQ ID NO: 96941 - DNA, 25 bp, mus musculus
ccagcccgtgtgcattcccgaagag

SEQ ID NO: 96942 - DNA, 25 bp, mus musculus
gtgcattcccgaagagcccttccga

SEQ ID NO: 96943 - DNA, 25 bp, mus musculus
ccaccgatgggtgttgactgcggcc

SEQ ID NO: 96944 - DNA, 25 bp, mus musculus
gttgactgcggcccactgcatatat

SEQ ID NO: 96945 - DNA, 25 bp, mus musculus
tgcggcccactgcatatatgagcag

SEQ ID NO: 96946 - DNA, 25 bp, mus musculus
ggcccactgcatatatgagcaggag

SEQ ID NO: 96947 - DNA, 25 bp, mus musculus
tgacgacatgctgcattctgaatct

SEQ ID NO: 96948 - DNA, 25 bp, mus musculus
catgctgcattctgaatctgaaagt

SEQ ID NO: 96949 - DNA, 25 bp, mus musculus
aagtgtgaccctggtcccagtccag

SEQ ID NO: 96950 - DNA, 25 bp, mus musculus
tgtgaccctggtcccagtccaggac

SEQ ID NO: 96951 - DNA, 25 bp, mus musculus
gtgagtttccatggcaggtgagcat

SEQ ID NO: 96952 - DNA, 25 bp, mus musculus
agtttccatggcaggtgagcattca

SEQ ID NO: 96953 - DNA, 25 bp, mus musculus
tggcccactgcttctatgctcagca

SEQ ID NO: 96954 - DNA, 25 bp, mus musculus
cccactgcttctatgctcagcagct

SEQ ID NO: 96955 - DNA, 25 bp, mus musculus
actgcttctatgctcagcagctttc

SEQ ID NO: 96956 - DNA, 25 bp, mus musculus
gcttctatgctcagcagctttcccc

SEQ ID NO: 96957 - DNA, 25 bp, mus musculus
tctatgctcagcagctttccccaac

SEQ ID NO: 96958 - DNA, 25 bp, mus musculus
atgctcagcagctttccccaacaga

SEQ ID NO: 96959 - DNA, 25 bp, mus musculus
ctcagcagctttccccaacagatct

SEQ ID NO: 96960 - DNA, 25 bp, mus musculus
agcagctttccccaacagatctcag

SEQ ID NO: 96961 - DNA, 25 bp, mus musculus
agctttccccaacagatctcagatt

SEQ ID NO: 96962 - DNA, 25 bp, mus musculus
tttccccaacagatctcagattcgg

SEQ ID NO: 96963 - DNA, 25 bp, mus musculus
aaagtgaccaccatttctgcggcgg

SEQ ID NO: 96964 - DNA, 25 bp, mus musculus
ttccccaacagatctcagattcgga

SEQ ID NO: 96965 - DNA, 25 bp, mus musculus
accatttctgcggcggctccattct

SEQ ID NO: 96966 - DNA, 25 bp, mus musculus
atttctgcggcggctccattctcag

SEQ ID NO: 96967 - DNA, 25 bp, mus musculus
ccattctcagtaagtgttggatcct

SEQ ID NO: 96968 - DNA, 25 bp, mus musculus
gttggatcctaaccgtggcccactg

SEQ ID NO: 96969 - DNA, 25 bp, mus musculus
ggatcctaaccgtggcccactgctt

SEQ ID NO: 96970 - DNA, 25 bp, mus musculus
tcctaaccgtggcccactgcttcta

SEQ ID NO: 96971 - DNA, 25 bp, mus musculus
ccgtggcccactgcttctatgctca

SEQ ID NO: 96972 - DNA, 25 bp, mus musculus
gatgacactcatgccgacctgcata

SEQ ID NO: 96973 - DNA, 25 bp, mus musculus
tgacactcatgccgacctgcatacg

SEQ ID NO: 96974 - DNA, 25 bp, mus musculus
gatgacctgtctctggaaataatcc

SEQ ID NO: 96975 - DNA, 25 bp, mus musculus
tgacctgtctctggaaataatcctg

SEQ ID NO: 96976 - DNA, 25 bp, mus musculus
acctgtctctggaaataatcctgca

SEQ ID NO: 96977 - DNA, 25 bp, mus musculus
ggaaataatcctgcatcgttgctcc

SEQ ID NO: 96978 - DNA, 25 bp, mus musculus
ataatcctgcatcgttgctccttga

SEQ ID NO: 96979 - DNA, 25 bp, mus musculus
aatcctgcatcgttgctccttgagc

SEQ ID NO: 96980 - DNA, 25 bp, mus musculus
tcctgcatcgttgctccttgagcct

SEQ ID NO: 96981 - DNA, 25 bp, mus musculus
gacacaaatcagagcattcagtgag

SEQ ID NO: 96982 - DNA, 25 bp, mus musculus
cacaaatcagagcattcagtgaggg

SEQ ID NO: 96983 - DNA, 25 bp, mus musculus
aatcagagcattcagtgagggagag

SEQ ID NO: 96984 - DNA, 25 bp, mus musculus
acactcatgccgacctgcatacgta

SEQ ID NO: 96985 - DNA, 25 bp, mus musculus
atgccgacctgcatacgtagtacac

SEQ ID NO: 96986 - DNA, 25 bp, mus musculus
gccgacctgcatacgtagtacacta

SEQ ID NO: 96987 - DNA, 25 bp, mus musculus
cgacctgcatacgtagtacactagt

SEQ ID NO: 96988 - DNA, 25 bp, mus musculus
acctgcatacgtagtacactagtgg

SEQ ID NO: 96989 - DNA, 25 bp, mus musculus
atacgtagtacactagtggacgcag

SEQ ID NO: 96990 - DNA, 25 bp, mus musculus
tacactagtggacgcagatgacctg

SEQ ID NO: 96991 - DNA, 25 bp, mus musculus
cagatgacctgtctctggaaataat

SEQ ID NO: 96992 - DNA, 25 bp, mus musculus
acaacaatgaccatggcatagtcac

SEQ ID NO: 96993 - DNA, 25 bp, mus musculus
atgaccatggcatagtcaccgacat

SEQ ID NO: 96994 - DNA, 25 bp, mus musculus
gaacccagagagacaccaaacaatg

SEQ ID NO: 96995 - DNA, 25 bp, mus musculus
cccagagagacaccaaacaatgcat

SEQ ID NO: 96996 - DNA, 25 bp, mus musculus
gagacaccaaacaatgcatcatgaa

SEQ ID NO: 96997 - DNA, 25 bp, mus musculus
gcatcatgaaacacagctaaaccca

SEQ ID NO: 96998 - DNA, 25 bp, mus musculus
gaaacatacgatatgcctgactgta

SEQ ID NO: 96999 - DNA, 25 bp, mus musculus
tacgatatgcctgactgtatgtggc

SEQ ID NO: 97000 - DNA, 25 bp, mus musculus
gatatgcctgactgtatgtggccta

SEQ ID NO: 97001 - DNA, 25 bp, mus musculus
gactgtatgtggcctacagacaatc

SEQ ID NO: 97002 - DNA, 25 bp, mus musculus
tgtatgtggcctacagacaatctgt

SEQ ID NO: 97003 - DNA, 25 bp, mus musculus
atgtggcctacagacaatctgtata

SEQ ID NO: 97004 - DNA, 25 bp, mus musculus
accatggcatagtcaccgacatgag

SEQ ID NO: 97005 - DNA, 25 bp, mus musculus
tggcctacagacaatctgtataata

SEQ ID NO: 97006 - DNA, 25 bp, mus musculus
atggcatagtcaccgacatgagttg

SEQ ID NO: 97007 - DNA, 25 bp, mus musculus
gcatagtcaccgacatgagttgacg

SEQ ID NO: 97008 - DNA, 25 bp, mus musculus
tcaccgacatgagttgacgtgggga

SEQ ID NO: 97009 - DNA, 25 bp, mus musculus
agagatcttagccccatacatacat

SEQ ID NO: 97010 - DNA, 25 bp, mus musculus
agccccatacatacatccaatagag

SEQ ID NO: 97011 - DNA, 25 bp, mus musculus
atacatacatccaatagagaacagt

SEQ ID NO: 97012 - DNA, 25 bp, mus musculus
acatccaatagagaacagtgtgaac

SEQ ID NO: 97013 - DNA, 25 bp, mus musculus
acagccagtggtggatggtgccttc

SEQ ID NO: 97014 - DNA, 25 bp, mus musculus
ggatatctagctttcgtactatcga

SEQ ID NO: 97015 - DNA, 25 bp, mus musculus
acacatgagtgtcccacggagatta

SEQ ID NO: 97016 - DNA, 25 bp, mus musculus
tgtcccacggagattatcgcgataa

SEQ ID NO: 97017 - DNA, 25 bp, mus musculus
attatcgcgataagcgactatgctt

SEQ ID NO: 97018 - DNA, 25 bp, mus musculus
ataagcgactatgcttgagacttcc

SEQ ID NO: 97019 - DNA, 25 bp, mus musculus
gactatgcttgagacttccgaaatg

SEQ ID NO: 97020 - DNA, 25 bp, mus musculus
tatgcttgagacttccgaaatgcta

SEQ ID NO: 97021 - DNA, 25 bp, mus musculus
tgagacttccgaaatgctacgctgc

SEQ ID NO: 97022 - DNA, 25 bp, mus musculus
gacttccgaaatgctacgctgcgat

SEQ ID NO: 97023 - DNA, 25 bp, mus musculus
ttccgaaatgctacgctgcgatgag

SEQ ID NO: 97024 - DNA, 25 bp, mus musculus
cgaaatgctacgctgcgatgagctg

SEQ ID NO: 97025 - DNA, 25 bp, mus musculus
gctttcgtactatcgagcggcgtaa

SEQ ID NO: 97026 - DNA, 25 bp, mus musculus
ttcgtactatcgagcggcgtaagtg

SEQ ID NO: 97027 - DNA, 25 bp, mus musculus
gtactatcgagcggcgtaagtggtg

SEQ ID NO: 97028 - DNA, 25 bp, mus musculus
agtggtgctctctatgacctcactg

SEQ ID NO: 97029 - DNA, 25 bp, mus musculus
ggtgctctctatgacctcactgaat

SEQ ID NO: 97030 - DNA, 25 bp, mus musculus
gctctctatgacctcactgaattca

SEQ ID NO: 97031 - DNA, 25 bp, mus musculus
tatgacctcactgaattcacacatg

SEQ ID NO: 97032 - DNA, 25 bp, mus musculus
gacctcactgaattcacacatgagt

SEQ ID NO: 97033 - DNA, 25 bp, mus musculus
atcaacttgtctctttgcccctttg

SEQ ID NO: 97034 - DNA, 25 bp, mus musculus
tgcccctttgttcattcttgtccct

SEQ ID NO: 97035 - DNA, 25 bp, mus musculus
aaacctcatgaatctaagaaatgtt

SEQ ID NO: 97036 - DNA, 25 bp, mus musculus
tgttccatatcttgctctgggtagt

SEQ ID NO: 97037 - DNA, 25 bp, mus musculus
tcttgctctgggtagtatatctgta

SEQ ID NO: 97038 - DNA, 25 bp, mus musculus
tagcaagccctgtatgtagtatttt

SEQ ID NO: 97039 - DNA, 25 bp, mus musculus
ttccagaacaaaatctgcaggaata

SEQ ID NO: 97040 - DNA, 25 bp, mus musculus
agcaacgaaaccaggtcatccacca

SEQ ID NO: 97041 - DNA, 25 bp, mus musculus
aggtcatccaccaacattttgcctt

SEQ ID NO: 97042 - DNA, 25 bp, mus musculus
tcatccaccaacattttgccttaga

SEQ ID NO: 97043 - DNA, 25 bp, mus musculus
tccaccaacattttgccttagattt

SEQ ID NO: 97044 - DNA, 25 bp, mus musculus
ttctaatatttcagcatatgagtag

SEQ ID NO: 97045 - DNA, 25 bp, mus musculus
gttcattcttgtcccttatgagtcc

SEQ ID NO: 97046 - DNA, 25 bp, mus musculus
tgtcccttatgagtccttcatatta

SEQ ID NO: 97047 - DNA, 25 bp, mus musculus
cccttatgagtccttcatattacaa

SEQ ID NO: 97048 - DNA, 25 bp, mus musculus
gtccttcatattacaaccaggttgg

SEQ ID NO: 97049 - DNA, 25 bp, mus musculus
cttcatattacaaccaggttggatt

SEQ ID NO: 97050 - DNA, 25 bp, mus musculus
catattacaaccaggttggattatt

SEQ ID NO: 97051 - DNA, 25 bp, mus musculus
attaatttgctcatttaaagcttat

SEQ ID NO: 97052 - DNA, 25 bp, mus musculus
aatttgctcatttaaagcttatatt

SEQ ID NO: 97053 - DNA, 25 bp, mus musculus
tgaagacagtctaccgccatgagaa

SEQ ID NO: 97054 - DNA, 25 bp, mus musculus
agacagtctaccgccatgagaagcg

SEQ ID NO: 97055 - DNA, 25 bp, mus musculus
aggagtccttcaatgctgtccagga

SEQ ID NO: 97056 - DNA, 25 bp, mus musculus
ggagtccttcaatgctgtccaggac

SEQ ID NO: 97057 - DNA, 25 bp, mus musculus
gtccttcaatgctgtccaggactgg

SEQ ID NO: 97058 - DNA, 25 bp, mus musculus
ccttcaatgctgtccaggactgggc

SEQ ID NO: 97059 - DNA, 25 bp, mus musculus
cttcaatgctgtccaggactgggct

SEQ ID NO: 97060 - DNA, 25 bp, mus musculus
tcaatgctgtccaggactgggctac

SEQ ID NO: 97061 - DNA, 25 bp, mus musculus
caatgctgtccaggactgggctact

SEQ ID NO: 97062 - DNA, 25 bp, mus musculus
atgctgtccaggactgggctactca

SEQ ID NO: 97063 - DNA, 25 bp, mus musculus
tgctgtccaggactgggctactcag

SEQ ID NO: 97064 - DNA, 25 bp, mus musculus
tgtccaggactgggctactcagatt

SEQ ID NO: 97065 - DNA, 25 bp, mus musculus
agtctaccgccatgagaagcgtgtg

SEQ ID NO: 97066 - DNA, 25 bp, mus musculus
tctaccgccatgagaagcgtgtgaa

SEQ ID NO: 97067 - DNA, 25 bp, mus musculus
ctaccgccatgagaagcgtgtgaag

SEQ ID NO: 97068 - DNA, 25 bp, mus musculus
accgccatgagaagcgtgtgaagct

SEQ ID NO: 97069 - DNA, 25 bp, mus musculus
catcaccaacgaggagtccttcaat

SEQ ID NO: 97070 - DNA, 25 bp, mus musculus
tcaccaacgaggagtccttcaatgc

SEQ ID NO: 97071 - DNA, 25 bp, mus musculus
caccaacgaggagtccttcaatgct

SEQ ID NO: 97072 - DNA, 25 bp, mus musculus
ccaacgaggagtccttcaatgctgt

SEQ ID NO: 97073 - DNA, 25 bp, mus musculus
tggggcttctgaccattctgaagaa

SEQ ID NO: 97074 - DNA, 25 bp, mus musculus
ggcttctgaccattctgaagaagat

SEQ ID NO: 97075 - DNA, 25 bp, mus musculus
gacactgggcttcaacatcaagacc

SEQ ID NO: 97076 - DNA, 25 bp, mus musculus
actgggcttcaacatcaagaccctg

SEQ ID NO: 97077 - DNA, 25 bp, mus musculus
gggcttcaacatcaagaccctggag

SEQ ID NO: 97078 - DNA, 25 bp, mus musculus
caacatcaagaccctggagcaccgc

SEQ ID NO: 97079 - DNA, 25 bp, mus musculus
gaccctggagcaccgcggattcaag

SEQ ID NO: 97080 - DNA, 25 bp, mus musculus
caagctgaacatctgggatgtaggt

SEQ ID NO: 97081 - DNA, 25 bp, mus musculus
ccagaagtctctgcgctcctactgg

SEQ ID NO: 97082 - DNA, 25 bp, mus musculus
gcgctcctactggaggaactacttt

SEQ ID NO: 97083 - DNA, 25 bp, mus musculus
gaactactttgagagcacggatggc

SEQ ID NO: 97084 - DNA, 25 bp, mus musculus
ctactttgagagcacggatggcctc

SEQ ID NO: 97085 - DNA, 25 bp, mus musculus
ttctgaccattctgaagaagatata

SEQ ID NO: 97086 - DNA, 25 bp, mus musculus
gctgctcatgcttggcttggacaac

SEQ ID NO: 97087 - DNA, 25 bp, mus musculus
catgcttggcttggacaacgctggc

SEQ ID NO: 97088 - DNA, 25 bp, mus musculus
gcttggcttggacaacgctggcaaa

SEQ ID NO: 97089 - DNA, 25 bp, mus musculus
tggcttggacaacgctggcaaaaca

SEQ ID NO: 97090 - DNA, 25 bp, mus musculus
cgctggcaaaacaaccatcctcaag

SEQ ID NO: 97091 - DNA, 25 bp, mus musculus
tggcaaaacaaccatcctcaagaag

SEQ ID NO: 97092 - DNA, 25 bp, mus musculus
cccgacactgggcttcaacatcaag

SEQ ID NO: 97093 - DNA, 25 bp, mus musculus
ccagacctgctaagcaagagacttc

SEQ ID NO: 97094 - DNA, 25 bp, mus musculus
agcaagagacttcaccatggagcaa

SEQ ID NO: 97095 - DNA, 25 bp, mus musculus
catttcttctgccttggccatggtc

SEQ ID NO: 97096 - DNA, 25 bp, mus musculus
ttcttctgccttggccatggtcatt

SEQ ID NO: 97097 - DNA, 25 bp, mus musculus
gcagctcagctttctaagacttttc

SEQ ID NO: 97098 - DNA, 25 bp, mus musculus
gctcagctttctaagacttttcatt

SEQ ID NO: 97099 - DNA, 25 bp, mus musculus
tctaagacttttcattttgactctg

SEQ ID NO: 97100 - DNA, 25 bp, mus musculus
cattttgactctgttgaggacatcc

SEQ ID NO: 97101 - DNA, 25 bp, mus musculus
gacatccattcacgcttccaaagcc

SEQ ID NO: 97102 - DNA, 25 bp, mus musculus
cgcttccaaagcctgaatgctgaag

SEQ ID NO: 97103 - DNA, 25 bp, mus musculus
cgtggagcatctcacactctgaaac

SEQ ID NO: 97104 - DNA, 25 bp, mus musculus
ggagcatctcacactctgaaacttg

SEQ ID NO: 97105 - DNA, 25 bp, mus musculus
aagagacttcaccatggagcaactg

SEQ ID NO: 97106 - DNA, 25 bp, mus musculus
tctcacactctgaaacttgctaaca

SEQ ID NO: 97107 - DNA, 25 bp, mus musculus
cttcaccatggagcaactgagttca

SEQ ID NO: 97108 - DNA, 25 bp, mus musculus
actgagttcagccaacaccctcttc

SEQ ID NO: 97109 - DNA, 25 bp, mus musculus
caccctcttcgccttggagctgttc

SEQ ID NO: 97110 - DNA, 25 bp, mus musculus
cgccttggagctgttccaaaccctg

SEQ ID NO: 97111 - DNA, 25 bp, mus musculus
gctgttccaaaccctgaatgaaagc

SEQ ID NO: 97112 - DNA, 25 bp, mus musculus
gttccaaaccctgaatgaaagcagc

SEQ ID NO: 97113 - DNA, 25 bp, mus musculus
gaatgaaagcagccccacaggaaac

SEQ ID NO: 97114 - DNA, 25 bp, mus musculus
ccaccttaaaattcacatgcgaatc

SEQ ID NO: 97115 - DNA, 25 bp, mus musculus
ggaaagccttcagtcactccacttc

SEQ ID NO: 97116 - DNA, 25 bp, mus musculus
ttcatctgtcccagttccttcagga

SEQ ID NO: 97117 - DNA, 25 bp, mus musculus
ccagttccttcaggattcatgaaat

SEQ ID NO: 97118 - DNA, 25 bp, mus musculus
ttccttcaggattcatgaaataagt

SEQ ID NO: 97119 - DNA, 25 bp, mus musculus
atgaaataagtcacacccacactga

SEQ ID NO: 97120 - DNA, 25 bp, mus musculus
gaaataagtcacacccacactgaag

SEQ ID NO: 97121 - DNA, 25 bp, mus musculus
agtcacacccacactgaagagaaac

SEQ ID NO: 97122 - DNA, 25 bp, mus musculus
tcacacccacactgaagagaaaccc

SEQ ID NO: 97123 - DNA, 25 bp, mus musculus
aaagcctacagtcatcctcgttcac

SEQ ID NO: 97124 - DNA, 25 bp, mus musculus
agcctacagtcatcctcgttcactt

SEQ ID NO: 97125 - DNA, 25 bp, mus musculus
tacagtcatcctcgttcacttcgca

SEQ ID NO: 97126 - DNA, 25 bp, mus musculus
aaagccttcagtcactccacttcat

SEQ ID NO: 97127 - DNA, 25 bp, mus musculus
cagtcatcctcgttcacttcgcaga

SEQ ID NO: 97128 - DNA, 25 bp, mus musculus
ttcagtcactccacttcatttcaga

SEQ ID NO: 97129 - DNA, 25 bp, mus musculus
cagtcactccacttcatttcagatc

SEQ ID NO: 97130 - DNA, 25 bp, mus musculus
gtcactccacttcatttcagatcca

SEQ ID NO: 97131 - DNA, 25 bp, mus musculus
ctccacttcatttcagatccatgaa

SEQ ID NO: 97132 - DNA, 25 bp, mus musculus
ccacttcatttcagatccatgaaag

SEQ ID NO: 97133 - DNA, 25 bp, mus musculus
aaagccttcatctgtcccagttcct

SEQ ID NO: 97134 - DNA, 25 bp, mus musculus
agccttcatctgtcccagttccttc

SEQ ID NO: 97135 - DNA, 25 bp, mus musculus
aacccgacgtcacagtcagtgatgt

SEQ ID NO: 97136 - DNA, 25 bp, mus musculus
cccctctgctcgatccagagaggtt

SEQ ID NO: 97137 - DNA, 25 bp, mus musculus
caactctgtgcctaggaagttgcca

SEQ ID NO: 97138 - DNA, 25 bp, mus musculus
gaagttgccaatcggactgatgctt

SEQ ID NO: 97139 - DNA, 25 bp, mus musculus
gccaatcggactgatgcttgcttca

SEQ ID NO: 97140 - DNA, 25 bp, mus musculus
aatcggactgatgcttgcttcaatc

SEQ ID NO: 97141 - DNA, 25 bp, mus musculus
cggactgatgcttgcttcaatcgag

SEQ ID NO: 97142 - DNA, 25 bp, mus musculus
actgatgcttgcttcaatcgagtta

SEQ ID NO: 97143 - DNA, 25 bp, mus musculus
gatgcttgcttcaatcgagttattg

SEQ ID NO: 97144 - DNA, 25 bp, mus musculus
gcttgcttcaatcgagttattgggt

SEQ ID NO: 97145 - DNA, 25 bp, mus musculus
tgcttcaatcgagttattgggtctg

SEQ ID NO: 97146 - DNA, 25 bp, mus musculus
gttattgggtctgagctcgtacaga

SEQ ID NO: 97147 - DNA, 25 bp, mus musculus
ctctgctcgatccagagaggttttg

SEQ ID NO: 97148 - DNA, 25 bp, mus musculus
atcgagcgtccaaaggggtgtactg

SEQ ID NO: 97149 - DNA, 25 bp, mus musculus
gggtgtactgctgtttgggccacca

SEQ ID NO: 97150 - DNA, 25 bp, mus musculus
tgtactgctgtttgggccaccaggc

SEQ ID NO: 97151 - DNA, 25 bp, mus musculus
tgggccaccaggcacaaggcaagac

SEQ ID NO: 97152 - DNA, 25 bp, mus musculus
gccaccaggcacaaggcaagacaac

SEQ ID NO: 97153 - DNA, 25 bp, mus musculus
gcaagacaactctgtgcctaggaag

SEQ ID NO: 97154 - DNA, 25 bp, mus musculus
agacaactctgtgcctaggaagttg

SEQ ID NO: 97155 - DNA, 25 bp, mus musculus
ttaatttcttcaggaacacttggca

SEQ ID NO: 97156 - DNA, 25 bp, mus musculus
tttcttcaggaacacttggcaacga

SEQ ID NO: 97157 - DNA, 25 bp, mus musculus
tcgattggttgccggtttacaactg

SEQ ID NO: 97158 - DNA, 25 bp, mus musculus
gcagcgttcagggaggcaaggtctc

SEQ ID NO: 97159 - DNA, 25 bp, mus musculus
aggtctctagtggtgaaccgattca

SEQ ID NO: 97160 - DNA, 25 bp, mus musculus
gtctctagtggtgaaccgattcaag

SEQ ID NO: 97161 - DNA, 25 bp, mus musculus
gaaccgattcaaggctgagcattat

SEQ ID NO: 97162 - DNA, 25 bp, mus musculus
attcaaggctgagcattatgcactc

SEQ ID NO: 97163 - DNA, 25 bp, mus musculus
ctgagcattatgcactctcagagag

SEQ ID NO: 97164 - DNA, 25 bp, mus musculus
gagcattatgcactctcagagagct

SEQ ID NO: 97165 - DNA, 25 bp, mus musculus
attatgcactctcagagagctctta

SEQ ID NO: 97166 - DNA, 25 bp, mus musculus
tgcactctcagagagctcttatgtc

SEQ ID NO: 97167 - DNA, 25 bp, mus musculus
aacacttggcaacgagctgtggtga

SEQ ID NO: 97168 - DNA, 25 bp, mus musculus
cttggcaacgagctgtggtgaagtt

SEQ ID NO: 97169 - DNA, 25 bp, mus musculus
tggcaacgagctgtggtgaagtttg

SEQ ID NO: 97170 - DNA, 25 bp, mus musculus
aagtttgctgctgcacaggagccaa

SEQ ID NO: 97171 - DNA, 25 bp, mus musculus
gtttgctgctgcacaggagccaatt

SEQ ID NO: 97172 - DNA, 25 bp, mus musculus
ttgctgctgcacaggagccaattcg

SEQ ID NO: 97173 - DNA, 25 bp, mus musculus
gctgctgcacaggagccaattcgat

SEQ ID NO: 97174 - DNA, 25 bp, mus musculus
ctgcacaggagccaattcgattggt

SEQ ID NO: 97175 - DNA, 25 bp, mus musculus
tctactgagcaccaccaatgtccag

SEQ ID NO: 97176 - DNA, 25 bp, mus musculus
gagcaccaccaatgtccaggtaaga

SEQ ID NO: 97177 - DNA, 25 bp, mus musculus
tggctggagcctcaatttgaaagcc

SEQ ID NO: 97178 - DNA, 25 bp, mus musculus
caatttgaaagccccaattagcaat

SEQ ID NO: 97179 - DNA, 25 bp, mus musculus
gaaagccccaattagcaattattga

SEQ ID NO: 97180 - DNA, 25 bp, mus musculus
tgtgagcagcccctagtccagcttg

SEQ ID NO: 97181 - DNA, 25 bp, mus musculus
ggtcaagcttactctagagcaggtc

SEQ ID NO: 97182 - DNA, 25 bp, mus musculus
ttcttacagatgacctggccagagt

SEQ ID NO: 97183 - DNA, 25 bp, mus musculus
cagatgacctggccagagtgaagtg

SEQ ID NO: 97184 - DNA, 25 bp, mus musculus
acagtggcatccacgtacccccaag

SEQ ID NO: 97185 - DNA, 25 bp, mus musculus
ctgcacagccgtctagactggactt

SEQ ID NO: 97186 - DNA, 25 bp, mus musculus
agccgtctagactggactttttctg

SEQ ID NO: 97187 - DNA, 25 bp, mus musculus
caccaatgtccaggtaagagagcta

SEQ ID NO: 97188 - DNA, 25 bp, mus musculus
actgagagcagccctaatgtgtggt

SEQ ID NO: 97189 - DNA, 25 bp, mus musculus
agcagccctaatgtgtggtctttag

SEQ ID NO: 97190 - DNA, 25 bp, mus musculus
tctttagtgttcagggcacaggctg

SEQ ID NO: 97191 - DNA, 25 bp, mus musculus
gctgagtgacctcactggaagagat

SEQ ID NO: 97192 - DNA, 25 bp, mus musculus
tgacctcactggaagagatagctaa

SEQ ID NO: 97193 - DNA, 25 bp, mus musculus
ggatccacctggatctgtcaatctt

SEQ ID NO: 97194 - DNA, 25 bp, mus musculus
acctggatctgtcaatcttggctgg

SEQ ID NO: 97195 - DNA, 25 bp, mus musculus
cagttcctaaagaactctacctcag

SEQ ID NO: 97196 - DNA, 25 bp, mus musculus
tctacctcagttcttcactaaaaga

SEQ ID NO: 97197 - DNA, 25 bp, mus musculus
gacctgatttcaagcaacagcagga

SEQ ID NO: 97198 - DNA, 25 bp, mus musculus
ctgatttcaagcaacagcaggatta

SEQ ID NO: 97199 - DNA, 25 bp, mus musculus
atttcaagcaacagcaggattatta

SEQ ID NO: 97200 - DNA, 25 bp, mus musculus
attattatctgtcagtacttggacc

SEQ ID NO: 97201 - DNA, 25 bp, mus musculus
attatctgtcagtacttggacctgc

SEQ ID NO: 97202 - DNA, 25 bp, mus musculus
atctgtcagtacttggacctgcaag

SEQ ID NO: 97203 - DNA, 25 bp, mus musculus
tgtcagtacttggacctgcaagcat

SEQ ID NO: 97204 - DNA, 25 bp, mus musculus
cagtacttggacctgcaagcatcaa

SEQ ID NO: 97205 - DNA, 25 bp, mus musculus
ttggacctgcaagcatcaaagaagc

SEQ ID NO: 97206 - DNA, 25 bp, mus musculus
gacctgcaagcatcaaagaagctat

SEQ ID NO: 97207 - DNA, 25 bp, mus musculus
tcagttcttcactaaaagacctcaa

SEQ ID NO: 97208 - DNA, 25 bp, mus musculus
ctgagaaaaccagcaccaagaatta

SEQ ID NO: 97209 - DNA, 25 bp, mus musculus
attatatacacagcgcgcagaagat

SEQ ID NO: 97210 - DNA, 25 bp, mus musculus
atatacacagcgcgcagaagatctt

SEQ ID NO: 97211 - DNA, 25 bp, mus musculus
tacacagcgcgcagaagatcttcaa

SEQ ID NO: 97212 - DNA, 25 bp, mus musculus
agatcttcaagacagcagaagaatg

SEQ ID NO: 97213 - DNA, 25 bp, mus musculus
tttataatctgatcgcaaagagacc

SEQ ID NO: 97214 - DNA, 25 bp, mus musculus
ataatctgatcgcaaagagacctga

SEQ ID NO: 97215 - DNA, 25 bp, mus musculus
ttaatcatgccaatggctcacgttg

SEQ ID NO: 97216 - DNA, 25 bp, mus musculus
atcatgccaatggctcacgttggtg

SEQ ID NO: 97217 - DNA, 25 bp, mus musculus
ccagcacctcgtagagcgagcgaca

SEQ ID NO: 97218 - DNA, 25 bp, mus musculus
cagcacctcgtagagcgagcgacat

SEQ ID NO: 97219 - DNA, 25 bp, mus musculus
gcacctcgtagagcgagcgacatgt

SEQ ID NO: 97220 - DNA, 25 bp, mus musculus
cacctcgtagagcgagcgacatgtc

SEQ ID NO: 97221 - DNA, 25 bp, mus musculus
ctcgtagagcgagcgacatgtcact

SEQ ID NO: 97222 - DNA, 25 bp, mus musculus
ccccagactacttcctgtgatgaga

SEQ ID NO: 97223 - DNA, 25 bp, mus musculus
cccagactacttcctgtgatgagaa

SEQ ID NO: 97224 - DNA, 25 bp, mus musculus
agactacttcctgtgatgagaatgt

SEQ ID NO: 97225 - DNA, 25 bp, mus musculus
actacttcctgtgatgagaatgtca

SEQ ID NO: 97226 - DNA, 25 bp, mus musculus
acttcctgtgatgagaatgtcaact

SEQ ID NO: 97227 - DNA, 25 bp, mus musculus
ttaagtattcattcttgcagctgtg

SEQ ID NO: 97228 - DNA, 25 bp, mus musculus
agtattcattcttgcagctgtgacc

SEQ ID NO: 97229 - DNA, 25 bp, mus musculus
gtattcattcttgcagctgtgaccc

SEQ ID NO: 97230 - DNA, 25 bp, mus musculus
attcattcttgcagctgtgacccag

SEQ ID NO: 97231 - DNA, 25 bp, mus musculus
ttcattcttgcagctgtgacccagc

SEQ ID NO: 97232 - DNA, 25 bp, mus musculus
gcagctgtgacccagcacctcgtag

SEQ ID NO: 97233 - DNA, 25 bp, mus musculus
agctgtgacccagcacctcgtagag

SEQ ID NO: 97234 - DNA, 25 bp, mus musculus
gacccagcacctcgtagagcgagcg

SEQ ID NO: 97235 - DNA, 25 bp, mus musculus
ctgcagccatggtcaacccaccgtg

SEQ ID NO: 97236 - DNA, 25 bp, mus musculus
caccgtgttttcgacatcacgggcg

SEQ ID NO: 97237 - DNA, 25 bp, mus musculus
tccttttacagaattatccaggaat

SEQ ID NO: 97238 - DNA, 25 bp, mus musculus
cttttacagaattatccaggaatca

SEQ ID NO: 97239 - DNA, 25 bp, mus musculus
attatccaggaatcatgtgccagag

SEQ ID NO: 97240 - DNA, 25 bp, mus musculus
tgacttttaacgccataattggact

SEQ ID NO: 97241 - DNA, 25 bp, mus musculus
ttttaacgccataattggacttgcg

SEQ ID NO: 97242 - DNA, 25 bp, mus musculus
ttaacgccataattggacttgcggc

SEQ ID NO: 97243 - DNA, 25 bp, mus musculus
cgccataattggacttgcggcaagg

SEQ ID NO: 97244 - DNA, 25 bp, mus musculus
ataattggacttgcggcaaggtcaa

SEQ ID NO: 97245 - DNA, 25 bp, mus musculus
ttggacttgcggcaaggtcaacttc

SEQ ID NO: 97246 - DNA, 25 bp, mus musculus
acttgcggcaaggtcaacttccgag

SEQ ID NO: 97247 - DNA, 25 bp, mus musculus
ccgtgttttcgacatcacgggcgat

SEQ ID NO: 97248 - DNA, 25 bp, mus musculus
gcgcggttccttcgagcttgttgca

SEQ ID NO: 97249 - DNA, 25 bp, mus musculus
gcggttccttcgagcttgttgcaga

SEQ ID NO: 97250 - DNA, 25 bp, mus musculus
aactttcgagctctgacacttgaga

SEQ ID NO: 97251 - DNA, 25 bp, mus musculus
ctttcgagctctgacacttgagaga

SEQ ID NO: 97252 - DNA, 25 bp, mus musculus
ttcgagctctgacacttgagagaaa

SEQ ID NO: 97253 - DNA, 25 bp, mus musculus
agctctgacacttgagagaaaggat

SEQ ID NO: 97254 - DNA, 25 bp, mus musculus
ctctgacacttgagagaaaggattt

SEQ ID NO: 97255 - DNA, 25 bp, mus musculus
catctgcactgagtgtggcaaaagc

SEQ ID NO: 97256 - DNA, 25 bp, mus musculus
cagccactggtcgaagctgacacga

SEQ ID NO: 97257 - DNA, 25 bp, mus musculus
accgactgcggcaagaccttctcgc

SEQ ID NO: 97258 - DNA, 25 bp, mus musculus
aagaccttctcgcagagctcgcatt

SEQ ID NO: 97259 - DNA, 25 bp, mus musculus
accttctcgcagagctcgcatttgg

SEQ ID NO: 97260 - DNA, 25 bp, mus musculus
ttctcgcagagctcgcatttggtgc

SEQ ID NO: 97261 - DNA, 25 bp, mus musculus
tcgcagagctcgcatttggtgcagc

SEQ ID NO: 97262 - DNA, 25 bp, mus musculus
cagagctcgcatttggtgcagcacc

SEQ ID NO: 97263 - DNA, 25 bp, mus musculus
aagcgatatgcctgctcagagtgcg

SEQ ID NO: 97264 - DNA, 25 bp, mus musculus
cgatatgcctgctcagagtgcggca

SEQ ID NO: 97265 - DNA, 25 bp, mus musculus
tatgcctgctcagagtgcggcaagc

SEQ ID NO: 97266 - DNA, 25 bp, mus musculus
tgctcagagtgcggcaagcgcttta

SEQ ID NO: 97267 - DNA, 25 bp, mus musculus
ccactggtcgaagctgacacgacac

SEQ ID NO: 97268 - DNA, 25 bp, mus musculus
gaagctgacacgacaccagcgcacg

SEQ ID NO: 97269 - DNA, 25 bp, mus musculus
gagcggcccaatgcctgtaccgact

SEQ ID NO: 97270 - DNA, 25 bp, mus musculus
cggcccaatgcctgtaccgactgcg

SEQ ID NO: 97271 - DNA, 25 bp, mus musculus
cccaatgcctgtaccgactgcggca

SEQ ID NO: 97272 - DNA, 25 bp, mus musculus
aatgcctgtaccgactgcggcaaga

SEQ ID NO: 97273 - DNA, 25 bp, mus musculus
gcctgtaccgactgcggcaagacct

SEQ ID NO: 97274 - DNA, 25 bp, mus musculus
tgtaccgactgcggcaagaccttct

SEQ ID NO: 97275 - DNA, 25 bp, mus musculus
ctaacttcctacaaacatctgcctg

SEQ ID NO: 97276 - DNA, 25 bp, mus musculus
acttcctacaaacatctgcctgaag

SEQ ID NO: 97277 - DNA, 25 bp, mus musculus
attcagcacctttgactggttttga

SEQ ID NO: 97278 - DNA, 25 bp, mus musculus
cagcacctttgactggttttgagtg

SEQ ID NO: 97279 - DNA, 25 bp, mus musculus
atactgttaccagtggcagtttgct

SEQ ID NO: 97280 - DNA, 25 bp, mus musculus
ttaccagtggcagtttgctttacag

SEQ ID NO: 97281 - DNA, 25 bp, mus musculus
gcagtttgctttacagaggggccca

SEQ ID NO: 97282 - DNA, 25 bp, mus musculus
ggttccattctcagaagtgaattgc

SEQ ID NO: 97283 - DNA, 25 bp, mus musculus
tccattctcagaagtgaattgcaga

SEQ ID NO: 97284 - DNA, 25 bp, mus musculus
agcttcattagcatgggctcaagct

SEQ ID NO: 97285 - DNA, 25 bp, mus musculus
gtacctgaactctgtccctctcgtg

SEQ ID NO: 97286 - DNA, 25 bp, mus musculus
tctcgtgccgcctctgtctggaaat

SEQ ID NO: 97287 - DNA, 25 bp, mus musculus
tacaaacatctgcctgaagattagt

SEQ ID NO: 97288 - DNA, 25 bp, mus musculus
ccgcctctgtctggaaattggacca

SEQ ID NO: 97289 - DNA, 25 bp, mus musculus
catctgcctgaagattagtagaatc

SEQ ID NO: 97290 - DNA, 25 bp, mus musculus
tagaatcctaattctaggctggaat

SEQ ID NO: 97291 - DNA, 25 bp, mus musculus
aatcctaattctaggctggaatgag

SEQ ID NO: 97292 - DNA, 25 bp, mus musculus
tcccctgctgaatgctctatacaaa

SEQ ID NO: 97293 - DNA, 25 bp, mus musculus
cctgctgaatgctctatacaaattc

SEQ ID NO: 97294 - DNA, 25 bp, mus musculus
tgctctatacaaattcagcaccttt

SEQ ID NO: 97295 - DNA, 25 bp, mus musculus
tctatacaaattcagcacctttgac

SEQ ID NO: 97296 - DNA, 25 bp, mus musculus
gcgctctgttgtctcgccttgccgt

SEQ ID NO: 97297 - DNA, 25 bp, mus musculus
ctctgttgtctcgccttgccgtgca

SEQ ID NO: 97298 - DNA, 25 bp, mus musculus
gcctgcatggaactgcgacgcgagc

SEQ ID NO: 97299 - DNA, 25 bp, mus musculus
tgcatggaactgcgacgcgagcttt

SEQ ID NO: 97300 - DNA, 25 bp, mus musculus
gcatggaactgcgacgcgagctttc

SEQ ID NO: 97301 - DNA, 25 bp, mus musculus
tggaactgcgacgcgagctttcccg

SEQ ID NO: 97302 - DNA, 25 bp, mus musculus
gaactgcgacgcgagctttcccgct

SEQ ID NO: 97303 - DNA, 25 bp, mus musculus
aactgcgacgcgagctttcccgctc

SEQ ID NO: 97304 - DNA, 25 bp, mus musculus
ctgcgacgcgagctttcccgctcat

SEQ ID NO: 97305 - DNA, 25 bp, mus musculus
tcatccccatagtggtggagcagac

SEQ ID NO: 97306 - DNA, 25 bp, mus musculus
catccccatagtggtggagcagacg

SEQ ID NO: 97307 - DNA, 25 bp, mus musculus
cgagcgcgcttatgacatatactcg

SEQ ID NO: 97308 - DNA, 25 bp, mus musculus
tctgttgtctcgccttgccgtgcat

SEQ ID NO: 97309 - DNA, 25 bp, mus musculus
gccatggactgctgtgagctgctca

SEQ ID NO: 97310 - DNA, 25 bp, mus musculus
catggactgctgtgagctgctcacc

SEQ ID NO: 97311 - DNA, 25 bp, mus musculus
atggactgctgtgagctgctcaccc

SEQ ID NO: 97312 - DNA, 25 bp, mus musculus
ccctgcggaggagcctgcatggaac

SEQ ID NO: 97313 - DNA, 25 bp, mus musculus
cctgcggaggagcctgcatggaact

SEQ ID NO: 97314 - DNA, 25 bp, mus musculus
ggagcctgcatggaactgcgacgcg

SEQ ID NO: 97315 - DNA, 25 bp, mus musculus
gagcctgcatggaactgcgacgcga

SEQ ID NO: 97316 - DNA, 25 bp, mus musculus
tgtccacagctttgatgacaccaca

SEQ ID NO: 97317 - DNA, 25 bp, mus musculus
cagctttgatgacaccacagcaact

SEQ ID NO: 97318 - DNA, 25 bp, mus musculus
cattgcagcaatcgcaaacttcaag

SEQ ID NO: 97319 - DNA, 25 bp, mus musculus
tgcagcaatcgcaaacttcaagaac

SEQ ID NO: 97320 - DNA, 25 bp, mus musculus
agcaatcgcaaacttcaagaacttt

SEQ ID NO: 97321 - DNA, 25 bp, mus musculus
cagcctcctaacaagacggagattg

SEQ ID NO: 97322 - DNA, 25 bp, mus musculus
cttaagcttagccaacctggaatgc

SEQ ID NO: 97323 - DNA, 25 bp, mus musculus
aagcttagccaacctggaatgcaag

SEQ ID NO: 97324 - DNA, 25 bp, mus musculus
caacctggaatgcaagttggccgtt

SEQ ID NO: 97325 - DNA, 25 bp, mus musculus
gaccagaaccttacacacaattgat

SEQ ID NO: 97326 - DNA, 25 bp, mus musculus
cagaaccttacacacaattgatttg

SEQ ID NO: 97327 - DNA, 25 bp, mus musculus
cttacacacaattgatttggcctga

SEQ ID NO: 97328 - DNA, 25 bp, mus musculus
tgatgacaccacagcaactgtctgc

SEQ ID NO: 97329 - DNA, 25 bp, mus musculus
tgatttggcctgaatggttcaggat

SEQ ID NO: 97330 - DNA, 25 bp, mus musculus
aactgtctgcctcatgtcacaacaa

SEQ ID NO: 97331 - DNA, 25 bp, mus musculus
tgtctgcctcatgtcacaacaagca

SEQ ID NO: 97332 - DNA, 25 bp, mus musculus
cctcatgtcacaacaagcaaacgac

SEQ ID NO: 97333 - DNA, 25 bp, mus musculus
gtcacaacaagcaaacgaccaagtt

SEQ ID NO: 97334 - DNA, 25 bp, mus musculus
gagaagtcttcacacccaatggcct

SEQ ID NO: 97335 - DNA, 25 bp, mus musculus
cacccaatggccttcaaggaacata

SEQ ID NO: 97336 - DNA, 25 bp, mus musculus
cataaccaccattgcagcaatcgca

SEQ ID NO: 97337 - DNA, 25 bp, mus musculus
acaagtcctggttgatcgctagacc

SEQ ID NO: 97338 - DNA, 25 bp, mus musculus
gtcctggttgatcgctagaccactt

SEQ ID NO: 97339 - DNA, 25 bp, mus musculus
tccctcacgagcactaacgaagcga

SEQ ID NO: 97340 - DNA, 25 bp, mus musculus
cctcacgagcactaacgaagcgatg

SEQ ID NO: 97341 - DNA, 25 bp, mus musculus
tcacgagcactaacgaagcgatgat

SEQ ID NO: 97342 - DNA, 25 bp, mus musculus
gttgcggcactgaaaccggacctgt

SEQ ID NO: 97343 - DNA, 25 bp, mus musculus
cggcactgaaaccggacctgtgtgc

SEQ ID NO: 97344 - DNA, 25 bp, mus musculus
gcactgaaaccggacctgtgtgcct

SEQ ID NO: 97345 - DNA, 25 bp, mus musculus
tgaaaccggacctgtgtgccttagg

SEQ ID NO: 97346 - DNA, 25 bp, mus musculus
taatccttcttgtatgacatccatt

SEQ ID NO: 97347 - DNA, 25 bp, mus musculus
atccttcttgtatgacatccattta

SEQ ID NO: 97348 - DNA, 25 bp, mus musculus
ccttcttgtatgacatccatttaat

SEQ ID NO: 97349 - DNA, 25 bp, mus musculus
tggttgatcgctagaccacttcaat

SEQ ID NO: 97350 - DNA, 25 bp, mus musculus
ttcttgtatgacatccatttaatac

SEQ ID NO: 97351 - DNA, 25 bp, mus musculus
gttgatcgctagaccacttcaatgt

SEQ ID NO: 97352 - DNA, 25 bp, mus musculus
atcgctagaccacttcaatgttgcg

SEQ ID NO: 97353 - DNA, 25 bp, mus musculus
cgctagaccacttcaatgttgcggt

SEQ ID NO: 97354 - DNA, 25 bp, mus musculus
ctagaccacttcaatgttgcggtca

SEQ ID NO: 97355 - DNA, 25 bp, mus musculus
ggatgatatatccctcacgagcact

SEQ ID NO: 97356 - DNA, 25 bp, mus musculus
atgatatatccctcacgagcactaa

SEQ ID NO: 97357 - DNA, 25 bp, mus musculus
tatatccctcacgagcactaacgaa

SEQ ID NO: 97358 - DNA, 25 bp, mus musculus
atctgtaatcacgtgaaccacttat

SEQ ID NO: 97359 - DNA, 25 bp, mus musculus
ttatccgttctccgacgtgagctag

SEQ ID NO: 97360 - DNA, 25 bp, mus musculus
tgtactatgcagtctgaacaagtgc

SEQ ID NO: 97361 - DNA, 25 bp, mus musculus
ttaccatggaagcatcggctccact

SEQ ID NO: 97362 - DNA, 25 bp, mus musculus
aagcatcggctccacttcccatttg

SEQ ID NO: 97363 - DNA, 25 bp, mus musculus
ctccacttcccatttgactgctcaa

SEQ ID NO: 97364 - DNA, 25 bp, mus musculus
ttcccatttgactgctcaagtccgg

SEQ ID NO: 97365 - DNA, 25 bp, mus musculus
tttgactgctcaagtccgggtcgtc

SEQ ID NO: 97366 - DNA, 25 bp, mus musculus
ccgggtcgtcccaactgcaagcttg

SEQ ID NO: 97367 - DNA, 25 bp, mus musculus
ggtcgtcccaactgcaagcttgccc

SEQ ID NO: 97368 - DNA, 25 bp, mus musculus
cccaactgcaagcttgccctatggt

SEQ ID NO: 97369 - DNA, 25 bp, mus musculus
aactgcaagcttgccctatggtctt

SEQ ID NO: 97370 - DNA, 25 bp, mus musculus
tccgttctccgacgtgagctagcgg

SEQ ID NO: 97371 - DNA, 25 bp, mus musculus
ctccgacgtgagctagcggtagtcc

SEQ ID NO: 97372 - DNA, 25 bp, mus musculus
ttagcccagtcaaattctcgccctg

SEQ ID NO: 97373 - DNA, 25 bp, mus musculus
tctcgccctgggatttctagctacg

SEQ ID NO: 97374 - DNA, 25 bp, mus musculus
cgccctgggatttctagctacgtgg

SEQ ID NO: 97375 - DNA, 25 bp, mus musculus
gggatttctagctacgtggtgtatc

SEQ ID NO: 97376 - DNA, 25 bp, mus musculus
ctcggactgctgtgtactatgcagt

SEQ ID NO: 97377 - DNA, 25 bp, mus musculus
ctgtgtactatgcagtctgaacaag

SEQ ID NO: 97378 - DNA, 25 bp, mus musculus
ccttcatatttcgctgagagacttt

SEQ ID NO: 97379 - DNA, 25 bp, mus musculus
aaatccatgaagggcttaggcactg

SEQ ID NO: 97380 - DNA, 25 bp, mus musculus
tctttgtactctttcatcaagggtg

SEQ ID NO: 97381 - DNA, 25 bp, mus musculus
tactctttcatcaagggtgacactt

SEQ ID NO: 97382 - DNA, 25 bp, mus musculus
tctttcatcaagggtgacacttccg

SEQ ID NO: 97383 - DNA, 25 bp, mus musculus
ggtgacacttccggagactacagga

SEQ ID NO: 97384 - DNA, 25 bp, mus musculus
gacacttccggagactacaggaagg

SEQ ID NO: 97385 - DNA, 25 bp, mus musculus
aaggttctgctcgttctctgtggag

SEQ ID NO: 97386 - DNA, 25 bp, mus musculus
gttctgctcgttctctgtggaggag

SEQ ID NO: 97387 - DNA, 25 bp, mus musculus
ctcgttctctgtggaggagatgatt

SEQ ID NO: 97388 - DNA, 25 bp, mus musculus
gattaacacaagacgccgcagacag

SEQ ID NO: 97389 - DNA, 25 bp, mus musculus
taacacaagacgccgcagacagaag

SEQ ID NO: 97390 - DNA, 25 bp, mus musculus
gatgacaacaccctcatcagagtga

SEQ ID NO: 97391 - DNA, 25 bp, mus musculus
gacaacaccctcatcagagtgatgg

SEQ ID NO: 97392 - DNA, 25 bp, mus musculus
aacaccctcatcagagtgatggtct

SEQ ID NO: 97393 - DNA, 25 bp, mus musculus
accctcatcagagtgatggtctcaa

SEQ ID NO: 97394 - DNA, 25 bp, mus musculus
gacatgctggacatccgggcgagct

SEQ ID NO: 97395 - DNA, 25 bp, mus musculus
atgctggacatccgggcgagcttca

SEQ ID NO: 97396 - DNA, 25 bp, mus musculus
ctggacatccgggcgagcttcaaga

SEQ ID NO: 97397 - DNA, 25 bp, mus musculus
ttcaagaggctctacgggaagtctt

SEQ ID NO: 97398 - DNA, 25 bp, mus musculus
aggccagcatgaagccctatgtgga

SEQ ID NO: 97399 - DNA, 25 bp, mus musculus
gcatgaagccctatgtggatggcaa

SEQ ID NO: 97400 - DNA, 25 bp, mus musculus
tatctatctatcacctttgctgcat

SEQ ID NO: 97401 - DNA, 25 bp, mus musculus
tctatcacctttgctgcatgtcact

SEQ ID NO: 97402 - DNA, 25 bp, mus musculus
gctgcatgtcacttcctctgctttc

SEQ ID NO: 97403 - DNA, 25 bp, mus musculus
ttcctctgctttcaaggagaatatt

SEQ ID NO: 97404 - DNA, 25 bp, mus musculus
gaatattccagacagtgttactttc

SEQ ID NO: 97405 - DNA, 25 bp, mus musculus
cagtgttactttccagtgtaaccat

SEQ ID NO: 97406 - DNA, 25 bp, mus musculus
tactttccagtgtaaccataagcct

SEQ ID NO: 97407 - DNA, 25 bp, mus musculus
ccagtgtaaccataagcctgcttag

SEQ ID NO: 97408 - DNA, 25 bp, mus musculus
taaccataagcctgcttagcttggg

SEQ ID NO: 97409 - DNA, 25 bp, mus musculus
taagcctgcttagcttggggtaaga

SEQ ID NO: 97410 - DNA, 25 bp, mus musculus
gagaacttccaactgccttcgacta

SEQ ID NO: 97411 - DNA, 25 bp, mus musculus
ttccaactgccttcgactacgtcga

SEQ ID NO: 97412 - DNA, 25 bp, mus musculus
attgatcaatcctcttggcttgtag

SEQ ID NO: 97413 - DNA, 25 bp, mus musculus
caatcctcttggcttgtaggcaagc

SEQ ID NO: 97414 - DNA, 25 bp, mus musculus
cctgacctacactgcttgccctgtt

SEQ ID NO: 97415 - DNA, 25 bp, mus musculus
ctacactgcttgccctgttatctct

SEQ ID NO: 97416 - DNA, 25 bp, mus musculus
tgcttgccctgttatctctatctat

SEQ ID NO: 97417 - DNA, 25 bp, mus musculus
ccctgttatctctatctatctatca

SEQ ID NO: 97418 - DNA, 25 bp, mus musculus
ttctcctgttccgaatgtggcaaga

SEQ ID NO: 97419 - DNA, 25 bp, mus musculus
tctcctgttccgaatgtggcaagag

SEQ ID NO: 97420 - DNA, 25 bp, mus musculus
gaagccttcagctgcagcgatgtgt

SEQ ID NO: 97421 - DNA, 25 bp, mus musculus
aagccttcagctgcagcgatgtgtg

SEQ ID NO: 97422 - DNA, 25 bp, mus musculus
agccttcagctgcagcgatgtgtgg

SEQ ID NO: 97423 - DNA, 25 bp, mus musculus
gccttcagctgcagcgatgtgtggc

SEQ ID NO: 97424 - DNA, 25 bp, mus musculus
ccttcagctgcagcgatgtgtggca

SEQ ID NO: 97425 - DNA, 25 bp, mus musculus
cttcagctgcagcgatgtgtggcaa

SEQ ID NO: 97426 - DNA, 25 bp, mus musculus
ttcagctgcagcgatgtgtggcaag

SEQ ID NO: 97427 - DNA, 25 bp, mus musculus
tcagctgcagcgatgtgtggcaaga

SEQ ID NO: 97428 - DNA, 25 bp, mus musculus
cagctgcagcgatgtgtggcaagag

SEQ ID NO: 97429 - DNA, 25 bp, mus musculus
agctgcagcgatgtgtggcaagagc

SEQ ID NO: 97430 - DNA, 25 bp, mus musculus
tcctgttccgaatgtggcaagagct

SEQ ID NO: 97431 - DNA, 25 bp, mus musculus
ctgcagcgatgtgtggcaagagctt

SEQ ID NO: 97432 - DNA, 25 bp, mus musculus
cctgttccgaatgtggcaagagctt

SEQ ID NO: 97433 - DNA, 25 bp, mus musculus
ctgttccgaatgtggcaagagcttt

SEQ ID NO: 97434 - DNA, 25 bp, mus musculus
tgttccgaatgtggcaagagcttta

SEQ ID NO: 97435 - DNA, 25 bp, mus musculus
ctttaccggagcgcctacctggctg

SEQ ID NO: 97436 - DNA, 25 bp, mus musculus
cgagaagccttcagctgcagcgatg

SEQ ID NO: 97437 - DNA, 25 bp, mus musculus
gagaagccttcagctgcagcgatgt

SEQ ID NO: 97438 - DNA, 25 bp, mus musculus
agaagccttcagctgcagcgatgtg

SEQ ID NO: 97439 - DNA, 25 bp, mus musculus
atgcgcgttctcttcagaatctgga

SEQ ID NO: 97440 - DNA, 25 bp, mus musculus
gcgcgttctcttcagaatctggatt

SEQ ID NO: 97441 - DNA, 25 bp, mus musculus
atttcccttgatacagtgaatatca

SEQ ID NO: 97442 - DNA, 25 bp, mus musculus
agtgaatatcatgctccaagctgtg

SEQ ID NO: 97443 - DNA, 25 bp, mus musculus
aatatcatgctccaagctgtgactc

SEQ ID NO: 97444 - DNA, 25 bp, mus musculus
tatcatgctccaagctgtgactctt

SEQ ID NO: 97445 - DNA, 25 bp, mus musculus
tcatgctccaagctgtgactcttat

SEQ ID NO: 97446 - DNA, 25 bp, mus musculus
gctccaagctgtgactcttatggac

SEQ ID NO: 97447 - DNA, 25 bp, mus musculus
tccaagctgtgactcttatggaccg

SEQ ID NO: 97448 - DNA, 25 bp, mus musculus
caagctgtgactcttatggaccgtg

SEQ ID NO: 97449 - DNA, 25 bp, mus musculus
agctgtgactcttatggaccgtgag

SEQ ID NO: 97450 - DNA, 25 bp, mus musculus
ctgtgactcttatggaccgtgaggc

SEQ ID NO: 97451 - DNA, 25 bp, mus musculus
gcgttctcttcagaatctggatttc

SEQ ID NO: 97452 - DNA, 25 bp, mus musculus
gttctcttcagaatctggatttccc

SEQ ID NO: 97453 - DNA, 25 bp, mus musculus
tctcttcagaatctggatttccctt

SEQ ID NO: 97454 - DNA, 25 bp, mus musculus
cagaatctggatttcccttgataca

SEQ ID NO: 97455 - DNA, 25 bp, mus musculus
gaatctggatttcccttgatacagt

SEQ ID NO: 97456 - DNA, 25 bp, mus musculus
atctggatttcccttgatacagtga

SEQ ID NO: 97457 - DNA, 25 bp, mus musculus
ctggatttcccttgatacagtgaat

SEQ ID NO: 97458 - DNA, 25 bp, mus musculus
ggatttcccttgatacagtgaatat

SEQ ID NO: 97459 - DNA, 25 bp, mus musculus
ctctggtccatttggcattattctt

SEQ ID NO: 97460 - DNA, 25 bp, mus musculus
tggcattattcttgagtgggcacag

SEQ ID NO: 97461 - DNA, 25 bp, mus musculus
tccctatcatggctttaaagcatga

SEQ ID NO: 97462 - DNA, 25 bp, mus musculus
cttacttatcagggcgtcaagtctg

SEQ ID NO: 97463 - DNA, 25 bp, mus musculus
tatcagggcgtcaagtctggtttcc

SEQ ID NO: 97464 - DNA, 25 bp, mus musculus
tggaactgctcatttccacattttt

SEQ ID NO: 97465 - DNA, 25 bp, mus musculus
aagcaaatcatcttgcatagatgcc

SEQ ID NO: 97466 - DNA, 25 bp, mus musculus
atcatcttgcatagatgcctgagac

SEQ ID NO: 97467 - DNA, 25 bp, mus musculus
agatgcctgagacttttctgccacc

SEQ ID NO: 97468 - DNA, 25 bp, mus musculus
acttccctaacactcagcttcatca

SEQ ID NO: 97469 - DNA, 25 bp, mus musculus
ctaacactcagcttcatcagccaat

SEQ ID NO: 97470 - DNA, 25 bp, mus musculus
ttcatcagccaatgggagcagggga

SEQ ID NO: 97471 - DNA, 25 bp, mus musculus
tattcttgagtgggcacagcctggc

SEQ ID NO: 97472 - DNA, 25 bp, mus musculus
atcctgtttccaacaccaattcatc

SEQ ID NO: 97473 - DNA, 25 bp, mus musculus
tttccaacaccaattcatctgagca

SEQ ID NO: 97474 - DNA, 25 bp, mus musculus
acaccaattcatctgagcaacccca

SEQ ID NO: 97475 - DNA, 25 bp, mus musculus
attcatctgagcaaccccagtctct

SEQ ID NO: 97476 - DNA, 25 bp, mus musculus
tgctgaagaccacgtctgtctctct

SEQ ID NO: 97477 - DNA, 25 bp, mus musculus
tctctctgactttcccctatcatgg

SEQ ID NO: 97478 - DNA, 25 bp, mus musculus
tcccctatcatggcttttaaagcat

SEQ ID NO: 97479 - DNA, 25 bp, mus musculus
gagtcgtgatcgaccgacatttggc

SEQ ID NO: 97480 - DNA, 25 bp, mus musculus
tgatcgaccgacatttggctgcccg

SEQ ID NO: 97481 - DNA, 25 bp, mus musculus
acatgccttcggactatatactgca

SEQ ID NO: 97482 - DNA, 25 bp, mus musculus
actatatactgcatgagctgctcca

SEQ ID NO: 97483 - DNA, 25 bp, mus musculus
atatactgcatgagctgctccagaa

SEQ ID NO: 97484 - DNA, 25 bp, mus musculus
cgatactcgacagtcacatacacac

SEQ ID NO: 97485 - DNA, 25 bp, mus musculus
tactcgacagtcacatacacactac

SEQ ID NO: 97486 - DNA, 25 bp, mus musculus
acagtcacatacacactacctagag

SEQ ID NO: 97487 - DNA, 25 bp, mus musculus
gtcacatacacactacctagagtcg

SEQ ID NO: 97488 - DNA, 25 bp, mus musculus
acatacacactacctagagtcgatc

SEQ ID NO: 97489 - DNA, 25 bp, mus musculus
tacacactacctagagtcgatcaga

SEQ ID NO: 97490 - DNA, 25 bp, mus musculus
ctacctagagtcgatcagatgtgct

SEQ ID NO: 97491 - DNA, 25 bp, mus musculus
tcgaccgacatttggctgcccggtc

SEQ ID NO: 97492 - DNA, 25 bp, mus musculus
tacctagagtcgatcagatgtgctc

SEQ ID NO: 97493 - DNA, 25 bp, mus musculus
accgacatttggctgcccggtcaag

SEQ ID NO: 97494 - DNA, 25 bp, mus musculus
gacatttggctgcccggtcaagcta

SEQ ID NO: 97495 - DNA, 25 bp, mus musculus
ctgcccggtcaagctacaatcacat

SEQ ID NO: 97496 - DNA, 25 bp, mus musculus
cccggtcaagctacaatcacatgcc

SEQ ID NO: 97497 - DNA, 25 bp, mus musculus
ggtcaagctacaatcacatgccttc

SEQ ID NO: 97498 - DNA, 25 bp, mus musculus
gctacaatcacatgccttcggacta

SEQ ID NO: 97499 - DNA, 25 bp, mus musculus
atcacatgccttcggactatatact

SEQ ID NO: 97500 - DNA, 25 bp, mus musculus
ttcggcacgatgagagcctggaacc

SEQ ID NO: 97501 - DNA, 25 bp, mus musculus
tcggcacgatgagagcctggaaccc

SEQ ID NO: 97502 - DNA, 25 bp, mus musculus
tctaccttggggcagctcaggcacc

SEQ ID NO: 97503 - DNA, 25 bp, mus musculus
ctaccttggggcagctcaggcacca

SEQ ID NO: 97504 - DNA, 25 bp, mus musculus
tacgcagttgagttctcccacgctc

SEQ ID NO: 97505 - DNA, 25 bp, mus musculus
cagttgagttctcccacgctctggc

SEQ ID NO: 97506 - DNA, 25 bp, mus musculus
agttgagttctcccacgctctggcc

SEQ ID NO: 97507 - DNA, 25 bp, mus musculus
ttgagttctcccacgctctggccgt

SEQ ID NO: 97508 - DNA, 25 bp, mus musculus
tgagttctcccacgctctggccgtg

SEQ ID NO: 97509 - DNA, 25 bp, mus musculus
aagctggcagcagctatccatgggc

SEQ ID NO: 97510 - DNA, 25 bp, mus musculus
agctggcagcagctatccatgggcg

SEQ ID NO: 97511 - DNA, 25 bp, mus musculus
gctggcagcagctatccatgggcgg

SEQ ID NO: 97512 - DNA, 25 bp, mus musculus
ctggcagcagctatccatgggcggc

SEQ ID NO: 97513 - DNA, 25 bp, mus musculus
ggtgctctaccttggggcagctcag

SEQ ID NO: 97514 - DNA, 25 bp, mus musculus
tgctctaccttggggcagctcaggc

SEQ ID NO: 97515 - DNA, 25 bp, mus musculus
gctctaccttggggcagctcaggca

SEQ ID NO: 97516 - DNA, 25 bp, mus musculus
ctctaccttggggcagctcaggcac

SEQ ID NO: 97517 - DNA, 25 bp, mus musculus
tctcaggactcagtcaagaggatct

SEQ ID NO: 97518 - DNA, 25 bp, mus musculus
ctcaggactcagtcaagaggatctg

SEQ ID NO: 97519 - DNA, 25 bp, mus musculus
tcatgacggcggaactctcgtggca

SEQ ID NO: 97520 - DNA, 25 bp, mus musculus
tgacggcggaactctcgtggcagct

SEQ ID NO: 97521 - DNA, 25 bp, mus musculus
cggcggaactctcgtggcagctcgc

SEQ ID NO: 97522 - DNA, 25 bp, mus musculus
ctctcgtggcagctcgcagagcagc

SEQ ID NO: 97523 - DNA, 25 bp, mus musculus
tctcgtggcagctcgcagagcagcg

SEQ ID NO: 97524 - DNA, 25 bp, mus musculus
cgtggcagctcgcagagcagcgcga

SEQ ID NO: 97525 - DNA, 25 bp, mus musculus
cagctcgcagagcagcgcgatcatg

SEQ ID NO: 97526 - DNA, 25 bp, mus musculus
agctcgcagagcagcgcgatcatga

SEQ ID NO: 97527 - DNA, 25 bp, mus musculus
ctcgcagagcagcgcgatcatgaga

SEQ ID NO: 97528 - DNA, 25 bp, mus musculus
cagagcagcgcgatcatgagataga

SEQ ID NO: 97529 - DNA, 25 bp, mus musculus
ttcagcgtccaaagaagaaggacct

SEQ ID NO: 97530 - DNA, 25 bp, mus musculus
gagacgcaagtctcatgacggcgga

SEQ ID NO: 97531 - DNA, 25 bp, mus musculus
gacgcaagtctcatgacggcggaac

SEQ ID NO: 97532 - DNA, 25 bp, mus musculus
acgcaagtctcatgacggcggaact

SEQ ID NO: 97533 - DNA, 25 bp, mus musculus
gcaagtctcatgacggcggaactct

SEQ ID NO: 97534 - DNA, 25 bp, mus musculus
caagtctcatgacggcggaactctc

SEQ ID NO: 97535 - DNA, 25 bp, mus musculus
agtctcatgacggcggaactctcgt

SEQ ID NO: 97536 - DNA, 25 bp, mus musculus
ctcatgacggcggaactctcgtggc

SEQ ID NO: 97537 - DNA, 25 bp, mus musculus
ttcttctggctcgaaaataaggatg

SEQ ID NO: 97538 - DNA, 25 bp, mus musculus
cttctggctcgaaaataaggatgtc

SEQ ID NO: 97539 - DNA, 25 bp, mus musculus
ctttacacactcatgactcgctgct

SEQ ID NO: 97540 - DNA, 25 bp, mus musculus
acacactcatgactcgctgctggga

SEQ ID NO: 97541 - DNA, 25 bp, mus musculus
acactcatgactcgctgctgggact

SEQ ID NO: 97542 - DNA, 25 bp, mus musculus
actcatgactcgctgctgggactac

SEQ ID NO: 97543 - DNA, 25 bp, mus musculus
tcatgactcgctgctgggactacga

SEQ ID NO: 97544 - DNA, 25 bp, mus musculus
gactcgctgctgggactacgacccc

SEQ ID NO: 97545 - DNA, 25 bp, mus musculus
ttcacggagcttgtgtgcagcctca

SEQ ID NO: 97546 - DNA, 25 bp, mus musculus
gtgtgcagcctcagtgacatttatc

SEQ ID NO: 97547 - DNA, 25 bp, mus musculus
gtgcagcctcagtgacatttatcag

SEQ ID NO: 97548 - DNA, 25 bp, mus musculus
gcagcctcagtgacatttatcagat

SEQ ID NO: 97549 - DNA, 25 bp, mus musculus
ggatgtcatcggagtgctggagaaa

SEQ ID NO: 97550 - DNA, 25 bp, mus musculus
atgtcatcggagtgctggagaaagg

SEQ ID NO: 97551 - DNA, 25 bp, mus musculus
gacaggctgcccaagcccgaactct

SEQ ID NO: 97552 - DNA, 25 bp, mus musculus
caggctgcccaagcccgaactctgt

SEQ ID NO: 97553 - DNA, 25 bp, mus musculus
actctgtccgcctgtcctttacaca

SEQ ID NO: 97554 - DNA, 25 bp, mus musculus
cctgtcctttacacactcatgactc

SEQ ID NO: 97555 - DNA, 25 bp, mus musculus
tgtcctttacacactcatgactcgc

SEQ ID NO: 97556 - DNA, 25 bp, mus musculus
tcctttacacactcatgactcgctg

SEQ ID NO: 97557 - DNA, 25 bp, mus musculus
gatgctccactaatgcagtacaaca

SEQ ID NO: 97558 - DNA, 25 bp, mus musculus
gctccactaatgcagtacaacatcg

SEQ ID NO: 97559 - DNA, 25 bp, mus musculus
tagccctaacaatggcaaaccaggc

SEQ ID NO: 97560 - DNA, 25 bp, mus musculus
ccctaacaatggcaaaccaggcaat

SEQ ID NO: 97561 - DNA, 25 bp, mus musculus
caatggcaaaccaggcaatgatcta

SEQ ID NO: 97562 - DNA, 25 bp, mus musculus
caaaccaggcaatgatctaaccaag

SEQ ID NO: 97563 - DNA, 25 bp, mus musculus
caatgatctaaccaagaaggggcgc

SEQ ID NO: 97564 - DNA, 25 bp, mus musculus
ctggttgcctaagcagtgggaaact

SEQ ID NO: 97565 - DNA, 25 bp, mus musculus
tctcctaatcatcctggtaggacat

SEQ ID NO: 97566 - DNA, 25 bp, mus musculus
cctaatcatcctggtaggacatcac

SEQ ID NO: 97567 - DNA, 25 bp, mus musculus
aatcatcctggtaggacatcacttt

SEQ ID NO: 97568 - DNA, 25 bp, mus musculus
catcctggtaggacatcactttact

SEQ ID NO: 97569 - DNA, 25 bp, mus musculus
ccactaatgcagtacaacatcggat

SEQ ID NO: 97570 - DNA, 25 bp, mus musculus
ctaatgcagtacaacatcggatgaa

SEQ ID NO: 97571 - DNA, 25 bp, mus musculus
atgcagtacaacatcggatgaaaat

SEQ ID NO: 97572 - DNA, 25 bp, mus musculus
tgaaaatctcccggaaattcagcaa

SEQ ID NO: 97573 - DNA, 25 bp, mus musculus
tctcccggaaattcagcaacctggg

SEQ ID NO: 97574 - DNA, 25 bp, mus musculus
aattcagcaacctgggaataagtgg

SEQ ID NO: 97575 - DNA, 25 bp, mus musculus
gtgcattagccctaacaatggcaaa

SEQ ID NO: 97576 - DNA, 25 bp, mus musculus
cattagccctaacaatggcaaacca

SEQ ID NO: 97577 - DNA, 25 bp, mus musculus
ctagctccaaaagacgtgaagatca

SEQ ID NO: 97578 - DNA, 25 bp, mus musculus
tcaggatatctgcaccccaggagag

SEQ ID NO: 97579 - DNA, 25 bp, mus musculus
tgcttccctggacacctttaagaag

SEQ ID NO: 97580 - DNA, 25 bp, mus musculus
tccctggacacctttaagaagatgt

SEQ ID NO: 97581 - DNA, 25 bp, mus musculus
cctggacacctttaagaagatgtgg

SEQ ID NO: 97582 - DNA, 25 bp, mus musculus
acggtgcccgatccatccacaggaa

SEQ ID NO: 97583 - DNA, 25 bp, mus musculus
tgcccgatccatccacaggaaaacc

SEQ ID NO: 97584 - DNA, 25 bp, mus musculus
cgatccatccacaggaaaaccttct

SEQ ID NO: 97585 - DNA, 25 bp, mus musculus
accttctaacgttgcaacatcacca

SEQ ID NO: 97586 - DNA, 25 bp, mus musculus
cttctaacgttgcaacatcaccacc

SEQ ID NO: 97587 - DNA, 25 bp, mus musculus
tctaacgttgcaacatcaccacctc

SEQ ID NO: 97588 - DNA, 25 bp, mus musculus
gttgcaacatcaccacctctctctg

SEQ ID NO: 97589 - DNA, 25 bp, mus musculus
aggatatctgcaccccaggagagac

SEQ ID NO: 97590 - DNA, 25 bp, mus musculus
gatatctgcaccccaggagagactg

SEQ ID NO: 97591 - DNA, 25 bp, mus musculus
tctgcaccccaggagagactgtatt

SEQ ID NO: 97592 - DNA, 25 bp, mus musculus
tgcaccccaggagagactgtattcc

SEQ ID NO: 97593 - DNA, 25 bp, mus musculus
caccccaggagagactgtattccac

SEQ ID NO: 97594 - DNA, 25 bp, mus musculus
gagactgtattccacatggattgga

SEQ ID NO: 97595 - DNA, 25 bp, mus musculus
gtattccacatggattggaggttct

SEQ ID NO: 97596 - DNA, 25 bp, mus musculus
attccacatggattggaggttctat

SEQ ID NO: 97597 - DNA, 25 bp, mus musculus
gaattctggtttctctctcatgatt

SEQ ID NO: 97598 - DNA, 25 bp, mus musculus
tttacacaacagtggcttctgtcac

SEQ ID NO: 97599 - DNA, 25 bp, mus musculus
tgaggtcaccctgtagcttggcggt

SEQ ID NO: 97600 - DNA, 25 bp, mus musculus
tggggccttcaggttgcagatgtac

SEQ ID NO: 97601 - DNA, 25 bp, mus musculus
gctgtagtcacggaacccacaggta

SEQ ID NO: 97602 - DNA, 25 bp, mus musculus
ggtactcagaggcatcagctggcca

SEQ ID NO: 97603 - DNA, 25 bp, mus musculus
actcagaggcatcagctggccatcc

SEQ ID NO: 97604 - DNA, 25 bp, mus musculus
aggcatcagctggccatccggctga

SEQ ID NO: 97605 - DNA, 25 bp, mus musculus
catcagctggccatccggctgaagg

SEQ ID NO: 97606 - DNA, 25 bp, mus musculus
gccatccggctgaaggttgcagtgc

SEQ ID NO: 97607 - DNA, 25 bp, mus musculus
atccggctgaaggttgcagtgcacc

SEQ ID NO: 97608 - DNA, 25 bp, mus musculus
aaggttgcagtgcaccgtggactca

SEQ ID NO: 97609 - DNA, 25 bp, mus musculus
acacaacagtggcttctgtcacctc

SEQ ID NO: 97610 - DNA, 25 bp, mus musculus
tggcttctgtcacctcaacagcaat

SEQ ID NO: 97611 - DNA, 25 bp, mus musculus
cttctgtcacctcaacagcaatgcc

SEQ ID NO: 97612 - DNA, 25 bp, mus musculus
ctgtcacctcaacagcaatgccatc

SEQ ID NO: 97613 - DNA, 25 bp, mus musculus
cctcaacagcaatgccatcatcacg

SEQ ID NO: 97614 - DNA, 25 bp, mus musculus
cagcaatgccatcatcacgtcaaat

SEQ ID NO: 97615 - DNA, 25 bp, mus musculus
tgccatcatcacgtcaaatgaggtc

SEQ ID NO: 97616 - DNA, 25 bp, mus musculus
catcatcacgtcaaatgaggtcacc

SEQ ID NO: 97617 - DNA, 25 bp, mus musculus
cgaaggtcccggaccagtatgcaga

SEQ ID NO: 97618 - DNA, 25 bp, mus musculus
aggtcccggaccagtatgcagatgg

SEQ ID NO: 97619 - DNA, 25 bp, mus musculus
tgcgccacgacgggtgccacagggt

SEQ ID NO: 97620 - DNA, 25 bp, mus musculus
gccacagggtgctggacgtagcctg

SEQ ID NO: 97621 - DNA, 25 bp, mus musculus
tgctggacgtagcctgtgcacagga

SEQ ID NO: 97622 - DNA, 25 bp, mus musculus
acgtagcctgtgcacaggagtggac

SEQ ID NO: 97623 - DNA, 25 bp, mus musculus
cctgtgcacaggagtggactccatc

SEQ ID NO: 97624 - DNA, 25 bp, mus musculus
agtggactccatcatgctggtggaa

SEQ ID NO: 97625 - DNA, 25 bp, mus musculus
ggactccatcatgctggtggaagag

SEQ ID NO: 97626 - DNA, 25 bp, mus musculus
ctccatcatgctggtggaagagggc

SEQ ID NO: 97627 - DNA, 25 bp, mus musculus
cgtggacgccagcgacaagatgctg

SEQ ID NO: 97628 - DNA, 25 bp, mus musculus
atatgcgcttaaggagcgctggaac

SEQ ID NO: 97629 - DNA, 25 bp, mus musculus
aggccgcacgtgtgtggcagctgta

SEQ ID NO: 97630 - DNA, 25 bp, mus musculus
tgcgcttaaggagcgctggaaccgg

SEQ ID NO: 97631 - DNA, 25 bp, mus musculus
ccgcacgtgtgtggcagctgtacat

SEQ ID NO: 97632 - DNA, 25 bp, mus musculus
agctgtacatcggggacacccgcag

SEQ ID NO: 97633 - DNA, 25 bp, mus musculus
cccgcagccgtaccgcagagtacaa

SEQ ID NO: 97634 - DNA, 25 bp, mus musculus
gccgtaccgcagagtacaaggcgtg

SEQ ID NO: 97635 - DNA, 25 bp, mus musculus
gtaccgcagagtacaaggcgtggtt

SEQ ID NO: 97636 - DNA, 25 bp, mus musculus
acaaggcgtggttgcttgggctgtt

SEQ ID NO: 97637 - DNA, 25 bp, mus musculus
tgttgcgccacgacgggtgccacag

SEQ ID NO: 97638 - DNA, 25 bp, mus musculus
tcacctgagttcccttcaagcttca

SEQ ID NO: 97639 - DNA, 25 bp, mus musculus
ttcccttcaagcttcagtctaggag

SEQ ID NO: 97640 - DNA, 25 bp, mus musculus
ccccaatctctgacagtctgggaag

SEQ ID NO: 97641 - DNA, 25 bp, mus musculus
caatctctgacagtctgggaaggag

SEQ ID NO: 97642 - DNA, 25 bp, mus musculus
tctctgacagtctgggaaggagaga

SEQ ID NO: 97643 - DNA, 25 bp, mus musculus
accgcaattctgaactgcagttatg

SEQ ID NO: 97644 - DNA, 25 bp, mus musculus
attctgaactgcagttatgaggaca

SEQ ID NO: 97645 - DNA, 25 bp, mus musculus
ttcccatggtaccagcagttccctg

SEQ ID NO: 97646 - DNA, 25 bp, mus musculus
cctgcactcctgatatccatacgtt

SEQ ID NO: 97647 - DNA, 25 bp, mus musculus
gcactcctgatatccatacgttcag

SEQ ID NO: 97648 - DNA, 25 bp, mus musculus
ctcctgatatccatacgttcagtgt

SEQ ID NO: 97649 - DNA, 25 bp, mus musculus
atatccatacgttcagtgtccgata

SEQ ID NO: 97650 - DNA, 25 bp, mus musculus
tcaagcttcagtctaggaggaatgg

SEQ ID NO: 97651 - DNA, 25 bp, mus musculus
gacaagatcctgacagcaacgtttt

SEQ ID NO: 97652 - DNA, 25 bp, mus musculus
ctaggccttcacctagctggggtga

SEQ ID NO: 97653 - DNA, 25 bp, mus musculus
ggccttcacctagctggggtgaatg

SEQ ID NO: 97654 - DNA, 25 bp, mus musculus
aaacgtgaccagcagcaggtgagac

SEQ ID NO: 97655 - DNA, 25 bp, mus musculus
gtgagacaaagtccccaatctctga

SEQ ID NO: 97656 - DNA, 25 bp, mus musculus
agacaaagtccccaatctctgacag

SEQ ID NO: 97657 - DNA, 25 bp, mus musculus
caaagtccccaatctctgacagtct

SEQ ID NO: 97658 - DNA, 25 bp, mus musculus
ccaatcaggtcaacctcatcaccaa

SEQ ID NO: 97659 - DNA, 25 bp, mus musculus
atcaggtcaacctcatcaccaacca

SEQ ID NO: 97660 - DNA, 25 bp, mus musculus
tccttacgcagagtatctgtttgct

SEQ ID NO: 97661 - DNA, 25 bp, mus musculus
gtatctgtttgcttgcagagtggct

SEQ ID NO: 97662 - DNA, 25 bp, mus musculus
gtttgcttgcagagtggctttctgg

SEQ ID NO: 97663 - DNA, 25 bp, mus musculus
tgcttgcagagtggctttctggctt

SEQ ID NO: 97664 - DNA, 25 bp, mus musculus
agtggctttctggcttgctgccagc

SEQ ID NO: 97665 - DNA, 25 bp, mus musculus
tgccagcctgtgcatggtccatgct

SEQ ID NO: 97666 - DNA, 25 bp, mus musculus
cctgtgcatggtccatgcttatgag

SEQ ID NO: 97667 - DNA, 25 bp, mus musculus
gtgcatggtccatgcttatgagttc

SEQ ID NO: 97668 - DNA, 25 bp, mus musculus
catggtccatgcttatgagttcagg

SEQ ID NO: 97669 - DNA, 25 bp, mus musculus
ccatgcttatgagttcaggatctat

SEQ ID NO: 97670 - DNA, 25 bp, mus musculus
cagttgagttccagatcctatacaa

SEQ ID NO: 97671 - DNA, 25 bp, mus musculus
agttccagatcctatacaaattaag

SEQ ID NO: 97672 - DNA, 25 bp, mus musculus
tccagatcctatacaaattaagaag

SEQ ID NO: 97673 - DNA, 25 bp, mus musculus
agatcctatacaaattaagaagtca

SEQ ID NO: 97674 - DNA, 25 bp, mus musculus
gactttcaatgtgtgctatgaattt

SEQ ID NO: 97675 - DNA, 25 bp, mus musculus
gtgctatgaatttcctccttacgca

SEQ ID NO: 97676 - DNA, 25 bp, mus musculus
ctatgaatttcctccttacgcagag

SEQ ID NO: 97677 - DNA, 25 bp, mus musculus
atttcctccttacgcagagtatctg

SEQ ID NO: 97678 - DNA, 25 bp, mus musculus
tcaccagctggggccacgtggtcac

SEQ ID NO: 97679 - DNA, 25 bp, mus musculus
gccacgtggtcactgggtgccaagg

SEQ ID NO: 97680 - DNA, 25 bp, mus musculus
atagacctgccaggccttgcatcct

SEQ ID NO: 97681 - DNA, 25 bp, mus musculus
gacctgccaggccttgcatcctttg

SEQ ID NO: 97682 - DNA, 25 bp, mus musculus
ctgccaggccttgcatcctttggct

SEQ ID NO: 97683 - DNA, 25 bp, mus musculus
ggccttgcatcctttggctggtttt

SEQ ID NO: 97684 - DNA, 25 bp, mus musculus
gcatcctttggctggttttaaagct

SEQ ID NO: 97685 - DNA, 25 bp, mus musculus
ttttaaagcttgtcctgtcacgcta

SEQ ID NO: 97686 - DNA, 25 bp, mus musculus
taaagcttgtcctgtcacgctatgt

SEQ ID NO: 97687 - DNA, 25 bp, mus musculus
agcttgtcctgtcacgctatgtccc

SEQ ID NO: 97688 - DNA, 25 bp, mus musculus
ttatcctcggcgttaagacaagagc

SEQ ID NO: 97689 - DNA, 25 bp, mus musculus
tcctcggcgttaagacaagagcatg

SEQ ID NO: 97690 - DNA, 25 bp, mus musculus
acgtggtcactgggtgccaaggagc

SEQ ID NO: 97691 - DNA, 25 bp, mus musculus
tggtcactgggtgccaaggagctgt

SEQ ID NO: 97692 - DNA, 25 bp, mus musculus
tcactgggtgccaaggagctgtgca

SEQ ID NO: 97693 - DNA, 25 bp, mus musculus
cctgaagaaggctcccttggtatag

SEQ ID NO: 97694 - DNA, 25 bp, mus musculus
ggctcccttggtatagacctgccag

SEQ ID NO: 97695 - DNA, 25 bp, mus musculus
tcccttggtatagacctgccaggcc

SEQ ID NO: 97696 - DNA, 25 bp, mus musculus
cttggtatagacctgccaggccttg

SEQ ID NO: 97697 - DNA, 25 bp, mus musculus
ggtatagacctgccaggccttgcat

SEQ ID NO: 97698 - DNA, 25 bp, mus musculus
ttacaacctgcctcttgagctcgag

SEQ ID NO: 97699 - DNA, 25 bp, mus musculus
acaacctgcctcttgagctcgagaa

SEQ ID NO: 97700 - DNA, 25 bp, mus musculus
aatatcttattgttggaaggccagg

SEQ ID NO: 97701 - DNA, 25 bp, mus musculus
gaaatcatttctgtgaatggatgta

SEQ ID NO: 97702 - DNA, 25 bp, mus musculus
aatcatttctgtgaatggatgtatg

SEQ ID NO: 97703 - DNA, 25 bp, mus musculus
gagaagtatcctttcttcagagcga

SEQ ID NO: 97704 - DNA, 25 bp, mus musculus
gaagtatcctttcttcagagcgaac

SEQ ID NO: 97705 - DNA, 25 bp, mus musculus
agtatcctttcttcagagcgaacat

SEQ ID NO: 97706 - DNA, 25 bp, mus musculus
tatcctttcttcagagcgaacattc

SEQ ID NO: 97707 - DNA, 25 bp, mus musculus
tcctttcttcagagcgaacattcag

SEQ ID NO: 97708 - DNA, 25 bp, mus musculus
ctttcttcagagcgaacattcagaa

SEQ ID NO: 97709 - DNA, 25 bp, mus musculus
tccttcccgaaaacaacagctccat

SEQ ID NO: 97710 - DNA, 25 bp, mus musculus
aacctgcctcttgagctcgagaacc

SEQ ID NO: 97711 - DNA, 25 bp, mus musculus
gaacctgaggtcattgctgcagtat

SEQ ID NO: 97712 - DNA, 25 bp, mus musculus
acctgaggtcattgctgcagtatac

SEQ ID NO: 97713 - DNA, 25 bp, mus musculus
gcagtatactagatctccagttgta

SEQ ID NO: 97714 - DNA, 25 bp, mus musculus
agtatactagatctccagttgtatt

SEQ ID NO: 97715 - DNA, 25 bp, mus musculus
tatactagatctccagttgtatttt

SEQ ID NO: 97716 - DNA, 25 bp, mus musculus
agatctccagttgtattttgtcata

SEQ ID NO: 97717 - DNA, 25 bp, mus musculus
atctccagttgtattttgtcataat

SEQ ID NO: 97718 - DNA, 25 bp, mus musculus
ggagcttacgacgattccaagaagc

SEQ ID NO: 97719 - DNA, 25 bp, mus musculus
gcttacgacgattccaagaagcact

SEQ ID NO: 97720 - DNA, 25 bp, mus musculus
atggtgccccaatccagacagagta

SEQ ID NO: 97721 - DNA, 25 bp, mus musculus
gtgccccaatccagacagagtattt

SEQ ID NO: 97722 - DNA, 25 bp, mus musculus
ccccaatccagacagagtatttacg

SEQ ID NO: 97723 - DNA, 25 bp, mus musculus
cataatctggatcttccagtctgct

SEQ ID NO: 97724 - DNA, 25 bp, mus musculus
ctggatcttccagtctgctgtgagc

SEQ ID NO: 97725 - DNA, 25 bp, mus musculus
gatcttccagtctgctgtgagccac

SEQ ID NO: 97726 - DNA, 25 bp, mus musculus
gtctgctgtgagccactgcagtgat

SEQ ID NO: 97727 - DNA, 25 bp, mus musculus
tgctgtgagccactgcagtgatttc

SEQ ID NO: 97728 - DNA, 25 bp, mus musculus
tgtgagccactgcagtgatttcctt

SEQ ID NO: 97729 - DNA, 25 bp, mus musculus
cagtgatttccttttgcatacgatc

SEQ ID NO: 97730 - DNA, 25 bp, mus musculus
gattccaagaagcactatacggtca

SEQ ID NO: 97731 - DNA, 25 bp, mus musculus
tttccttttgcatacgatcggcaat

SEQ ID NO: 97732 - DNA, 25 bp, mus musculus
aagcactatacggtcatcctgaata

SEQ ID NO: 97733 - DNA, 25 bp, mus musculus
tatacggtcatcctgaatataaggt

SEQ ID NO: 97734 - DNA, 25 bp, mus musculus
cagatgcacttgcggtggacaatgg

SEQ ID NO: 97735 - DNA, 25 bp, mus musculus
atgcacttgcggtggacaatggatg

SEQ ID NO: 97736 - DNA, 25 bp, mus musculus
gatgggcctgcctcatcatactcta

SEQ ID NO: 97737 - DNA, 25 bp, mus musculus
gcctcatcatactctagcttgctga

SEQ ID NO: 97738 - DNA, 25 bp, mus musculus
cacatttgctggaaggtggacagag

SEQ ID NO: 97739 - DNA, 25 bp, mus musculus
gaagcagcagccaagaccttcacag

SEQ ID NO: 97740 - DNA, 25 bp, mus musculus
aagcagcagccaagaccttcacagc

SEQ ID NO: 97741 - DNA, 25 bp, mus musculus
agacttcagggattggctcaacttt

SEQ ID NO: 97742 - DNA, 25 bp, mus musculus
gattggctcaactttatgttcctgt

SEQ ID NO: 97743 - DNA, 25 bp, mus musculus
attggctcaactttatgttcctgtg

SEQ ID NO: 97744 - DNA, 25 bp, mus musculus
tggctcaactttatgttcctgtgga

SEQ ID NO: 97745 - DNA, 25 bp, mus musculus
ggctcaactttatgttcctgtggag

SEQ ID NO: 97746 - DNA, 25 bp, mus musculus
caactttatgttcctgtggaggtca

SEQ ID NO: 97747 - DNA, 25 bp, mus musculus
aactttatgttcctgtggaggtcat

SEQ ID NO: 97748 - DNA, 25 bp, mus musculus
actttatgttcctgtggaggtcatt

SEQ ID NO: 97749 - DNA, 25 bp, mus musculus
ctttatgttcctgtggaggtcattt

SEQ ID NO: 97750 - DNA, 25 bp, mus musculus
ttatgttcctgtggaggtcatttca

SEQ ID NO: 97751 - DNA, 25 bp, mus musculus
gcagcagccaagaccttcacagcat

SEQ ID NO: 97752 - DNA, 25 bp, mus musculus
cagcagccaagaccttcacagcatg

SEQ ID NO: 97753 - DNA, 25 bp, mus musculus
agcagccaagaccttcacagcatgg

SEQ ID NO: 97754 - DNA, 25 bp, mus musculus
gcagccaagaccttcacagcatggt

SEQ ID NO: 97755 - DNA, 25 bp, mus musculus
agccaagaccttcacagcatggtgc

SEQ ID NO: 97756 - DNA, 25 bp, mus musculus
agtatccgatgagacttcagggatt

SEQ ID NO: 97757 - DNA, 25 bp, mus musculus
gtatccgatgagacttcagggattg

SEQ ID NO: 97758 - DNA, 25 bp, mus musculus
tatccgatgagacttcagggattgg

SEQ ID NO: 97759 - DNA, 25 bp, mus musculus
ttcttaccagcaattagcagccctg

SEQ ID NO: 97760 - DNA, 25 bp, mus musculus
ccagcaattagcagccctggcaggc

SEQ ID NO: 97761 - DNA, 25 bp, mus musculus
ctggctcaagtcatccttcgagtcg

SEQ ID NO: 97762 - DNA, 25 bp, mus musculus
atccttcgagtcgaccagctctgag

SEQ ID NO: 97763 - DNA, 25 bp, mus musculus
gaccagctctgagccgtctggccga

SEQ ID NO: 97764 - DNA, 25 bp, mus musculus
ctctgagccgtctggccgaaattga

SEQ ID NO: 97765 - DNA, 25 bp, mus musculus
acgtaacgcgtgtcggaagcggatg

SEQ ID NO: 97766 - DNA, 25 bp, mus musculus
tggctgccctttcttgtttctacat

SEQ ID NO: 97767 - DNA, 25 bp, mus musculus
cttgtttctacattttacagcagaa

SEQ ID NO: 97768 - DNA, 25 bp, mus musculus
tctacattttacagcagaatgagtt

SEQ ID NO: 97769 - DNA, 25 bp, mus musculus
cctctgacatggttattgttctatt

SEQ ID NO: 97770 - DNA, 25 bp, mus musculus
tgagccttagggcccctttgtatga

SEQ ID NO: 97771 - DNA, 25 bp, mus musculus
attagcagccctggcaggcaacccc

SEQ ID NO: 97772 - DNA, 25 bp, mus musculus
agccctggcaggcaaccccaaagcg

SEQ ID NO: 97773 - DNA, 25 bp, mus musculus
ctgccacagggtggttcgcagtgac

SEQ ID NO: 97774 - DNA, 25 bp, mus musculus
ggttcgcagtgacggtgccatcggc

SEQ ID NO: 97775 - DNA, 25 bp, mus musculus
cggtgccatcggccattactccgga

SEQ ID NO: 97776 - DNA, 25 bp, mus musculus
gcttctggcccatgagggcatcccg

SEQ ID NO: 97777 - DNA, 25 bp, mus musculus
ggcccatgagggcatcccgaccgga

SEQ ID NO: 97778 - DNA, 25 bp, mus musculus
gaccggacagccagcctccaagggc

SEQ ID NO: 97779 - DNA, 25 bp, mus musculus
gtttccggcagttccaccacaatcg

SEQ ID NO: 97780 - DNA, 25 bp, mus musculus
atagaatatggctccttcccgttca

SEQ ID NO: 97781 - DNA, 25 bp, mus musculus
ggaaattcgacgaccagcgtctact

SEQ ID NO: 97782 - DNA, 25 bp, mus musculus
aaattcgacgaccagcgtctactat

SEQ ID NO: 97783 - DNA, 25 bp, mus musculus
aattcgacgaccagcgtctactatg

SEQ ID NO: 97784 - DNA, 25 bp, mus musculus
ttcgacgaccagcgtctactatgtc

SEQ ID NO: 97785 - DNA, 25 bp, mus musculus
tcgacgaccagcgtctactatgtct

SEQ ID NO: 97786 - DNA, 25 bp, mus musculus
gacgaccagcgtctactatgtctcc

SEQ ID NO: 97787 - DNA, 25 bp, mus musculus
acgaccagcgtctactatgtctcca

SEQ ID NO: 97788 - DNA, 25 bp, mus musculus
gaccagcgtctactatgtctccatc

SEQ ID NO: 97789 - DNA, 25 bp, mus musculus
accagcgtctactatgtctccatca

SEQ ID NO: 97790 - DNA, 25 bp, mus musculus
cagcgtctactatgtctccatcatt

SEQ ID NO: 97791 - DNA, 25 bp, mus musculus
gaatatggctccttcccgttcacct

SEQ ID NO: 97792 - DNA, 25 bp, mus musculus
agcgtctactatgtctccatcattg

SEQ ID NO: 97793 - DNA, 25 bp, mus musculus
aggttatcactgtcgacatctctct

SEQ ID NO: 97794 - DNA, 25 bp, mus musculus
gttatcactgtcgacatctctctgt

SEQ ID NO: 97795 - DNA, 25 bp, mus musculus
ttatcactgtcgacatctctctgtg

SEQ ID NO: 97796 - DNA, 25 bp, mus musculus
acatctctctgtggaaattcgacga

SEQ ID NO: 97797 - DNA, 25 bp, mus musculus
atctctctgtggaaattcgacgacc

SEQ ID NO: 97798 - DNA, 25 bp, mus musculus
tctctctgtggaaattcgacgacca

SEQ ID NO: 97799 - DNA, 25 bp, mus musculus
tggaaattcgacgaccagcgtctac

SEQ ID NO: 97800 - DNA, 25 bp, mus musculus
atcccgccggaagcgccaggacaat

SEQ ID NO: 97801 - DNA, 25 bp, mus musculus
tcccgccggaagcgccaggacaatg

SEQ ID NO: 97802 - DNA, 25 bp, mus musculus
ggctcagatgctggacactggtggc

SEQ ID NO: 97803 - DNA, 25 bp, mus musculus
ctcagatgctggacactggtggcca

SEQ ID NO: 97804 - DNA, 25 bp, mus musculus
tcagatgctggacactggtggccag

SEQ ID NO: 97805 - DNA, 25 bp, mus musculus
agatgctggacactggtggccagga

SEQ ID NO: 97806 - DNA, 25 bp, mus musculus
ctaccgtggcattagctctgcgtag

SEQ ID NO: 97807 - DNA, 25 bp, mus musculus
accgtggcattagctctgcgtagta

SEQ ID NO: 97808 - DNA, 25 bp, mus musculus
ccgtggcattagctctgcgtagtag

SEQ ID NO: 97809 - DNA, 25 bp, mus musculus
tggcattagctctgcgtagtagcgt

SEQ ID NO: 97810 - DNA, 25 bp, mus musculus
ggcattagctctgcgtagtagcgtg

SEQ ID NO: 97811 - DNA, 25 bp, mus musculus
gcattagctctgcgtagtagcgtgg

SEQ ID NO: 97812 - DNA, 25 bp, mus musculus
gcaagaccgtcaaggctcagatgct

SEQ ID NO: 97813 - DNA, 25 bp, mus musculus
caagaccgtcaaggctcagatgctg

SEQ ID NO: 97814 - DNA, 25 bp, mus musculus
agaccgtcaaggctcagatgctgga

SEQ ID NO: 97815 - DNA, 25 bp, mus musculus
gaccgtcaaggctcagatgctggac

SEQ ID NO: 97816 - DNA, 25 bp, mus musculus
ccgtcaaggctcagatgctggacac

SEQ ID NO: 97817 - DNA, 25 bp, mus musculus
cgtcaaggctcagatgctggacact

SEQ ID NO: 97818 - DNA, 25 bp, mus musculus
tcaaggctcagatgctggacactgg

SEQ ID NO: 97819 - DNA, 25 bp, mus musculus
aggctcagatgctggacactggtgg

SEQ ID NO: 97820 - DNA, 25 bp, mus musculus
acatgataggtctcatccatactca

SEQ ID NO: 97821 - DNA, 25 bp, mus musculus
ggtctcatccatactcatcatggca

SEQ ID NO: 97822 - DNA, 25 bp, mus musculus
attgtcaaactctccacagtattta

SEQ ID NO: 97823 - DNA, 25 bp, mus musculus
tgtcaaactctccacagtatttagg

SEQ ID NO: 97824 - DNA, 25 bp, mus musculus
tcaaactctccacagtatttaggag

SEQ ID NO: 97825 - DNA, 25 bp, mus musculus
actctccacagtatttaggagctga

SEQ ID NO: 97826 - DNA, 25 bp, mus musculus
tctccacagtatttaggagctgagc

SEQ ID NO: 97827 - DNA, 25 bp, mus musculus
gtcgacagctgtctcttggcagata

SEQ ID NO: 97828 - DNA, 25 bp, mus musculus
cgacagctgtctcttggcagatagc

SEQ ID NO: 97829 - DNA, 25 bp, mus musculus
acagctgtctcttggcagatagccc

SEQ ID NO: 97830 - DNA, 25 bp, mus musculus
atcttttacagctgatgtagtctca

SEQ ID NO: 97831 - DNA, 25 bp, mus musculus
atgtagtctcacatgatgatcaatc

SEQ ID NO: 97832 - DNA, 25 bp, mus musculus
tctcatccatactcatcatggcagc

SEQ ID NO: 97833 - DNA, 25 bp, mus musculus
tcatccatactcatcatggcagcag

SEQ ID NO: 97834 - DNA, 25 bp, mus musculus
atactcatcatggcagcagcattgt

SEQ ID NO: 97835 - DNA, 25 bp, mus musculus
actcatcatggcagcagcattgtca

SEQ ID NO: 97836 - DNA, 25 bp, mus musculus
tcatcatggcagcagcattgtcaaa

SEQ ID NO: 97837 - DNA, 25 bp, mus musculus
catggcagcagcattgtcaaactct

SEQ ID NO: 97838 - DNA, 25 bp, mus musculus
agcagcattgtcaaactctccacag

SEQ ID NO: 97839 - DNA, 25 bp, mus musculus
gcattgtcaaactctccacagtatt

SEQ ID NO: 97840 - DNA, 25 bp, mus musculus
cgcttccgtcatgcttgacttcttc

SEQ ID NO: 97841 - DNA, 25 bp, mus musculus
ttccgtcatgcttgacttcttcacc

SEQ ID NO: 97842 - DNA, 25 bp, mus musculus
gtaacaactctttcactcatgaggc

SEQ ID NO: 97843 - DNA, 25 bp, mus musculus
tcactcatgaggctctcacactcaa

SEQ ID NO: 97844 - DNA, 25 bp, mus musculus
aggctctcacactcaagtatagact

SEQ ID NO: 97845 - DNA, 25 bp, mus musculus
ctctcacactcaagtatagactgga

SEQ ID NO: 97846 - DNA, 25 bp, mus musculus
gactggacaaccagtttgagctggt

SEQ ID NO: 97847 - DNA, 25 bp, mus musculus
tggacaaccagtttgagctggtgtt

SEQ ID NO: 97848 - DNA, 25 bp, mus musculus
tgtttgtggttggctttcagaagat

SEQ ID NO: 97849 - DNA, 25 bp, mus musculus
gctttcagaagatcctcacgctgac

SEQ ID NO: 97850 - DNA, 25 bp, mus musculus
ttcagaagatcctcacgctgaccta

SEQ ID NO: 97851 - DNA, 25 bp, mus musculus
agaagatcctcacgctgacctatgt

SEQ ID NO: 97852 - DNA, 25 bp, mus musculus
cgtcatgcttgacttcttcaccatc

SEQ ID NO: 97853 - DNA, 25 bp, mus musculus
tcctcacgctgacctatgtagacaa

SEQ ID NO: 97854 - DNA, 25 bp, mus musculus
gcttgacttcttcaccatcttctcg

SEQ ID NO: 97855 - DNA, 25 bp, mus musculus
tgacttcttcaccatcttctcgaag

SEQ ID NO: 97856 - DNA, 25 bp, mus musculus
cgggcttgtgctctggtgtttccag

SEQ ID NO: 97857 - DNA, 25 bp, mus musculus
tcaacgcgttgattcgttccgtact

SEQ ID NO: 97858 - DNA, 25 bp, mus musculus
acgcgttgattcgttccgtactgct

SEQ ID NO: 97859 - DNA, 25 bp, mus musculus
cgttgattcgttccgtactgctgca

SEQ ID NO: 97860 - DNA, 25 bp, mus musculus
ttcgttccgtactgctgcaggaacg

SEQ ID NO: 97861 - DNA, 25 bp, mus musculus
aagcaaaccggatgtacatgaaggg

SEQ ID NO: 97862 - DNA, 25 bp, mus musculus
gacgagactgctcagcagagctcaa

SEQ ID NO: 97863 - DNA, 25 bp, mus musculus
tacgtgatcgctacatgagcgataa

SEQ ID NO: 97864 - DNA, 25 bp, mus musculus
gtgatcgctacatgagcgataagta

SEQ ID NO: 97865 - DNA, 25 bp, mus musculus
gccccaacattctcatcgagattat

SEQ ID NO: 97866 - DNA, 25 bp, mus musculus
ccccaacattctcatcgagattatc

SEQ ID NO: 97867 - DNA, 25 bp, mus musculus
cccaacattctcatcgagattatca

SEQ ID NO: 97868 - DNA, 25 bp, mus musculus
ccaacattctcatcgagattatcaa

SEQ ID NO: 97869 - DNA, 25 bp, mus musculus
caacattctcatcgagattatcaag

SEQ ID NO: 97870 - DNA, 25 bp, mus musculus
aacattctcatcgagattatcaagg

SEQ ID NO: 97871 - DNA, 25 bp, mus musculus
acattctcatcgagattatcaaggg

SEQ ID NO: 97872 - DNA, 25 bp, mus musculus
cattctcatcgagattatcaagggt

SEQ ID NO: 97873 - DNA, 25 bp, mus musculus
acgagactgctcagcagagctcaag

SEQ ID NO: 97874 - DNA, 25 bp, mus musculus
gagactgctcagcagagctcaaggt

SEQ ID NO: 97875 - DNA, 25 bp, mus musculus
agactgctcagcagagctcaaggta

SEQ ID NO: 97876 - DNA, 25 bp, mus musculus
actgctcagcagagctcaaggtacg

SEQ ID NO: 97877 - DNA, 25 bp, mus musculus
ctgctcagcagagctcaaggtacgt

SEQ ID NO: 97878 - DNA, 25 bp, mus musculus
agcagagctcaaggtacgtgatcgc

SEQ ID NO: 97879 - DNA, 25 bp, mus musculus
aggtacgtgatcgctacatgagcga

SEQ ID NO: 97880 - DNA, 25 bp, mus musculus
ggtacgtgatcgctacatgagcgat

SEQ ID NO: 97881 - DNA, 25 bp, mus musculus
ctaccaatccggtgcagccccaatg

SEQ ID NO: 97882 - DNA, 25 bp, mus musculus
taccaatccggtgcagccccaatgg

SEQ ID NO: 97883 - DNA, 25 bp, mus musculus
agcgcagatggccggttctagacgg

SEQ ID NO: 97884 - DNA, 25 bp, mus musculus
cagatggccggttctagacgggaca

SEQ ID NO: 97885 - DNA, 25 bp, mus musculus
cggttctagacgggacaccgatgct

SEQ ID NO: 97886 - DNA, 25 bp, mus musculus
ggttctagacgggacaccgatgctg

SEQ ID NO: 97887 - DNA, 25 bp, mus musculus
gttctagacgggacaccgatgctgg

SEQ ID NO: 97888 - DNA, 25 bp, mus musculus
tagacgggacaccgatgctggcgag

SEQ ID NO: 97889 - DNA, 25 bp, mus musculus
atccggtgcagccccaatgggtgtt

SEQ ID NO: 97890 - DNA, 25 bp, mus musculus
tccggtgcagccccaatgggtgtta

SEQ ID NO: 97891 - DNA, 25 bp, mus musculus
cggtgcagccccaatgggtgttatc

SEQ ID NO: 97892 - DNA, 25 bp, mus musculus
ggtgcagccccaatgggtgttatcc

SEQ ID NO: 97893 - DNA, 25 bp, mus musculus
gtgcagccccaatgggtgttatccg

SEQ ID NO: 97894 - DNA, 25 bp, mus musculus
tgcagccccaatgggtgttatccgg

SEQ ID NO: 97895 - DNA, 25 bp, mus musculus
gcagccccaatgggtgttatccggg

SEQ ID NO: 97896 - DNA, 25 bp, mus musculus
tggagcgcagatggccggttctaga

SEQ ID NO: 97897 - DNA, 25 bp, mus musculus
actgatgcccaatcccatgcttcaa

SEQ ID NO: 97898 - DNA, 25 bp, mus musculus
tgatgcccaatcccatgcttcaacc

SEQ ID NO: 97899 - DNA, 25 bp, mus musculus
atccttgctctggtcatctccctca

SEQ ID NO: 97900 - DNA, 25 bp, mus musculus
ttgctctggtcatctccctcatctt

SEQ ID NO: 97901 - DNA, 25 bp, mus musculus
gctctggtcatctccctcatcttct

SEQ ID NO: 97902 - DNA, 25 bp, mus musculus
tctggtcatctccctcatcttctac

SEQ ID NO: 97903 - DNA, 25 bp, mus musculus
tctccctcatcttctacatcatgct

SEQ ID NO: 97904 - DNA, 25 bp, mus musculus
tccctcatcttctacatcatgctta

SEQ ID NO: 97905 - DNA, 25 bp, mus musculus
cctcatcttctacatcatgcttatc

SEQ ID NO: 97906 - DNA, 25 bp, mus musculus
atcttctacatcatgcttatcgttt

SEQ ID NO: 97907 - DNA, 25 bp, mus musculus
tctacatcatgcttatcgttttata

SEQ ID NO: 97908 - DNA, 25 bp, mus musculus
tacatcatgcttatcgttttataca

SEQ ID NO: 97909 - DNA, 25 bp, mus musculus
aatcccatgcttcaaccgccaagat

SEQ ID NO: 97910 - DNA, 25 bp, mus musculus
atcatgcttatcgttttatacagct

SEQ ID NO: 97911 - DNA, 25 bp, mus musculus
atgcttcaaccgccaagattctgaa

SEQ ID NO: 97912 - DNA, 25 bp, mus musculus
ttcaaccgccaagattctgaacatc

SEQ ID NO: 97913 - DNA, 25 bp, mus musculus
caaccgccaagattctgaacatcct

SEQ ID NO: 97914 - DNA, 25 bp, mus musculus
ccaagattctgaacatccttgctct

SEQ ID NO: 97915 - DNA, 25 bp, mus musculus
aagattctgaacatccttgctctgg

SEQ ID NO: 97916 - DNA, 25 bp, mus musculus
gattctgaacatccttgctctggtc

SEQ ID NO: 97917 - DNA, 25 bp, mus musculus
gaacatccttgctctggtcatctcc

SEQ ID NO: 97918 - DNA, 25 bp, mus musculus
accatggcagcggcatcggagcagg

SEQ ID NO: 97919 - DNA, 25 bp, mus musculus
tggcagcggcatcggagcaggtccc

SEQ ID NO: 97920 - DNA, 25 bp, mus musculus
cctctcgtacagaggatgaaagcac

SEQ ID NO: 97921 - DNA, 25 bp, mus musculus
gagatagttcgctctgcttatgaga

SEQ ID NO: 97922 - DNA, 25 bp, mus musculus
tagttcgctctgcttatgagaaatg

SEQ ID NO: 97923 - DNA, 25 bp, mus musculus
gttcgctctgcttatgagaaatgtc

SEQ ID NO: 97924 - DNA, 25 bp, mus musculus
gagcaccagacctacttgtaaaggt

SEQ ID NO: 97925 - DNA, 25 bp, mus musculus
tgtaaaggtaccctgggcgagatca

SEQ ID NO: 97926 - DNA, 25 bp, mus musculus
ggtaccctgggcgagatcaaaatct

SEQ ID NO: 97927 - DNA, 25 bp, mus musculus
taccctgggcgagatcaaaatctta

SEQ ID NO: 97928 - DNA, 25 bp, mus musculus
agatacagattccgggacagaccat

SEQ ID NO: 97929 - DNA, 25 bp, mus musculus
atacagattccgggacagaccatta

SEQ ID NO: 97930 - DNA, 25 bp, mus musculus
gcatcggagcaggtcccggagtata

SEQ ID NO: 97931 - DNA, 25 bp, mus musculus
agattccgggacagaccattagcaa

SEQ ID NO: 97932 - DNA, 25 bp, mus musculus
gagcaggtcccggagtatagtacgc

SEQ ID NO: 97933 - DNA, 25 bp, mus musculus
atagtacgcgagcaagtgttctacg

SEQ ID NO: 97934 - DNA, 25 bp, mus musculus
ttctacgtaaggccgcgctacgaca

SEQ ID NO: 97935 - DNA, 25 bp, mus musculus
gcgctacgacaacctctcgtacaga

SEQ ID NO: 97936 - DNA, 25 bp, mus musculus
tacgacaacctctcgtacagaggat

SEQ ID NO: 97937 - DNA, 25 bp, mus musculus
cgacaacctctcgtacagaggatga

SEQ ID NO: 97938 - DNA, 25 bp, mus musculus
aacctctcgtacagaggatgaaagc

SEQ ID NO: 97939 - DNA, 25 bp, mus musculus
tactggttagcacacattggtgttg

SEQ ID NO: 97940 - DNA, 25 bp, mus musculus
ttagcacacattggtgttgatacag

SEQ ID NO: 97941 - DNA, 25 bp, mus musculus
gccatttgcagacaacatttacaag

SEQ ID NO: 97942 - DNA, 25 bp, mus musculus
atctgtcacactaagaggtgattct

SEQ ID NO: 97943 - DNA, 25 bp, mus musculus
cagcttaattcgccatcatttatta

SEQ ID NO: 97944 - DNA, 25 bp, mus musculus
aatccctcacttgtatggataagag

SEQ ID NO: 97945 - DNA, 25 bp, mus musculus
gaatttatcgcacatgtagtatggg

SEQ ID NO: 97946 - DNA, 25 bp, mus musculus
atcgcacatgtagtatgggatcatc

SEQ ID NO: 97947 - DNA, 25 bp, mus musculus
atatgaggtctcgtgtacagttaaa

SEQ ID NO: 97948 - DNA, 25 bp, mus musculus
agttaaagctcgtgtcctgtgattt

SEQ ID NO: 97949 - DNA, 25 bp, mus musculus
agctcgtgtcctgtgatttcctgta

SEQ ID NO: 97950 - DNA, 25 bp, mus musculus
tgtcctgtgatttcctgtatggata

SEQ ID NO: 97951 - DNA, 25 bp, mus musculus
tatcatacctgaacatcatctcccc

SEQ ID NO: 97952 - DNA, 25 bp, mus musculus
acctgaacatcatctccccaaattg

SEQ ID NO: 97953 - DNA, 25 bp, mus musculus
atacaggctttctttgacattctgc

SEQ ID NO: 97954 - DNA, 25 bp, mus musculus
gctttctttgacattctgctctgaa

SEQ ID NO: 97955 - DNA, 25 bp, mus musculus
tttgacattctgctctgaaatgtgt

SEQ ID NO: 97956 - DNA, 25 bp, mus musculus
attctgctctgaaatgtgttcagtg

SEQ ID NO: 97957 - DNA, 25 bp, mus musculus
gcctatgaaactgaccttcagcctc

SEQ ID NO: 97958 - DNA, 25 bp, mus musculus
cagcctccaaaggcagtgtgctctt

SEQ ID NO: 97959 - DNA, 25 bp, mus musculus
gtcccagatgcccaagtgtctacca

SEQ ID NO: 97960 - DNA, 25 bp, mus musculus
gatgcccaagtgtctaccaggccca

SEQ ID NO: 97961 - DNA, 25 bp, mus musculus
gtgccgactccctctgaaatccgtg

SEQ ID NO: 97962 - DNA, 25 bp, mus musculus
tctgaaatccgtgctgccccaaggc

SEQ ID NO: 97963 - DNA, 25 bp, mus musculus
gaaatccgtgctgccccaaggctaa

SEQ ID NO: 97964 - DNA, 25 bp, mus musculus
cgtgctgccccaaggctaaggactg

SEQ ID NO: 97965 - DNA, 25 bp, mus musculus
gctgccccaaggctaaggactgtgc

SEQ ID NO: 97966 - DNA, 25 bp, mus musculus
gccccaaggctaaggactgtgctcc

SEQ ID NO: 97967 - DNA, 25 bp, mus musculus
aggactgtgctccatcccttgggga

SEQ ID NO: 97968 - DNA, 25 bp, mus musculus
actgtgctccatcccttggggaagc

SEQ ID NO: 97969 - DNA, 25 bp, mus musculus
gtgctccatcccttggggaagccaa

SEQ ID NO: 97970 - DNA, 25 bp, mus musculus
agcagttagcacagcagcctgctaa

SEQ ID NO: 97971 - DNA, 25 bp, mus musculus
gcccaagtgtctaccaggcccagtc

SEQ ID NO: 97972 - DNA, 25 bp, mus musculus
agttagcacagcagcctgctaatgg

SEQ ID NO: 97973 - DNA, 25 bp, mus musculus
accaggcccagtcagtctgctggga

SEQ ID NO: 97974 - DNA, 25 bp, mus musculus
aggcccagtcagtctgctgggaatg

SEQ ID NO: 97975 - DNA, 25 bp, mus musculus
cccagtcagtctgctgggaatgctg

SEQ ID NO: 97976 - DNA, 25 bp, mus musculus
agtcagtctgctgggaatgctgacg

SEQ ID NO: 97977 - DNA, 25 bp, mus musculus
tggaagccctctaaggaggctgctg

SEQ ID NO: 97978 - DNA, 25 bp, mus musculus
ccctctaaggaggctgctgtcccaa

SEQ ID NO: 97979 - DNA, 25 bp, mus musculus
gactcgagaacacctcctgtgccga

SEQ ID NO: 97980 - DNA, 25 bp, mus musculus
ttgagttatccatgggacagtttta

SEQ ID NO: 97981 - DNA, 25 bp, mus musculus
gccactcattgtgagcaggagaaat

SEQ ID NO: 97982 - DNA, 25 bp, mus musculus
tgaccagggcagcctgaagctcaat

SEQ ID NO: 97983 - DNA, 25 bp, mus musculus
gcagcctgaagctcaataacctgag

SEQ ID NO: 97984 - DNA, 25 bp, mus musculus
tgaagctcaataacctgagcagaag

SEQ ID NO: 97985 - DNA, 25 bp, mus musculus
aagctcaataacctgagcagaagtc

SEQ ID NO: 97986 - DNA, 25 bp, mus musculus
gctcaataacctgagcagaagtcca

SEQ ID NO: 97987 - DNA, 25 bp, mus musculus
tcaataacctgagcagaagtccaga

SEQ ID NO: 97988 - DNA, 25 bp, mus musculus
taacctgagcagaagtccagactca

SEQ ID NO: 97989 - DNA, 25 bp, mus musculus
agaagtccagactcagctccacttg

SEQ ID NO: 97990 - DNA, 25 bp, mus musculus
aagtccagactcagctccacttgat

SEQ ID NO: 97991 - DNA, 25 bp, mus musculus
gtccagactcagctccacttgatgt

SEQ ID NO: 97992 - DNA, 25 bp, mus musculus
cactcattgtgagcaggagaaatgt

SEQ ID NO: 97993 - DNA, 25 bp, mus musculus
aatgtccagaggtgtactctgcctg

SEQ ID NO: 97994 - DNA, 25 bp, mus musculus
tgtactctgcctggatacagcctgt

SEQ ID NO: 97995 - DNA, 25 bp, mus musculus
tactctgcctggatacagcctgtgt

SEQ ID NO: 97996 - DNA, 25 bp, mus musculus
ctgcctggatacagcctgtgtccac

SEQ ID NO: 97997 - DNA, 25 bp, mus musculus
gcctggatacagcctgtgtccacag

SEQ ID NO: 97998 - DNA, 25 bp, mus musculus
ctggatacagcctgtgtccacagtg

SEQ ID NO: 97999 - DNA, 25 bp, mus musculus
acagcctgtgtccacagtgggaacg

SEQ ID NO: 98000 - DNA, 25 bp, mus musculus
cagcagtaatcttggccgcgttaga

SEQ ID NO: 98001 - DNA, 25 bp, mus musculus
gcagtaatcttggccgcgttagacc

SEQ ID NO: 98002 - DNA, 25 bp, mus musculus
cccttcagcccagaagccaagttgt

SEQ ID NO: 98003 - DNA, 25 bp, mus musculus
ccttcagcccagaagccaagttgtc

SEQ ID NO: 98004 - DNA, 25 bp, mus musculus
cttcagcccagaagccaagttgtct

SEQ ID NO: 98005 - DNA, 25 bp, mus musculus
ttcagcccagaagccaagttgtcta

SEQ ID NO: 98006 - DNA, 25 bp, mus musculus
tcagcccagaagccaagttgtctaa

SEQ ID NO: 98007 - DNA, 25 bp, mus musculus
cagcccagaagccaagttgtctaac

SEQ ID NO: 98008 - DNA, 25 bp, mus musculus
agcccagaagccaagttgtctaact

SEQ ID NO: 98009 - DNA, 25 bp, mus musculus
caagttgtctaacttggggcaagct

SEQ ID NO: 98010 - DNA, 25 bp, mus musculus
ttgtctaacttggggcaagcttaag

SEQ ID NO: 98011 - DNA, 25 bp, mus musculus
tgtctaacttggggcaagcttaagg

SEQ ID NO: 98012 - DNA, 25 bp, mus musculus
cagtaatcttggccgcgttagaccg

SEQ ID NO: 98013 - DNA, 25 bp, mus musculus
gtaatcttggccgcgttagaccgat

SEQ ID NO: 98014 - DNA, 25 bp, mus musculus
taatcttggccgcgttagaccgatt

SEQ ID NO: 98015 - DNA, 25 bp, mus musculus
ttagaccgattccccttcagcccag

SEQ ID NO: 98016 - DNA, 25 bp, mus musculus
tagaccgattccccttcagcccaga

SEQ ID NO: 98017 - DNA, 25 bp, mus musculus
attccccttcagcccagaagccaag

SEQ ID NO: 98018 - DNA, 25 bp, mus musculus
ttccccttcagcccagaagccaagt

SEQ ID NO: 98019 - DNA, 25 bp, mus musculus
ccccttcagcccagaagccaagttg

SEQ ID NO: 98020 - DNA, 25 bp, mus musculus
gaccaggctactatggctggagtgt

SEQ ID NO: 98021 - DNA, 25 bp, mus musculus
caggctactatggctggagtgtccc

SEQ ID NO: 98022 - DNA, 25 bp, mus musculus
ccaacctgcagctcagcaaccgaag

SEQ ID NO: 98023 - DNA, 25 bp, mus musculus
tgcagctcagcaaccgaaggctgga

SEQ ID NO: 98024 - DNA, 25 bp, mus musculus
atgagcatctgtcactgacggacca

SEQ ID NO: 98025 - DNA, 25 bp, mus musculus
agcatctgtcactgacggaccagaa

SEQ ID NO: 98026 - DNA, 25 bp, mus musculus
aggaccagctgagcttgcgcctgaa

SEQ ID NO: 98027 - DNA, 25 bp, mus musculus
accagctgagcttgcgcctgaaagc

SEQ ID NO: 98028 - DNA, 25 bp, mus musculus
tgagcttgcgcctgaaagccatgaa

SEQ ID NO: 98029 - DNA, 25 bp, mus musculus
gcttgcgcctgaaagccatgaagcg

SEQ ID NO: 98030 - DNA, 25 bp, mus musculus
tgcgcctgaaagccatgaagcgcca

SEQ ID NO: 98031 - DNA, 25 bp, mus musculus
tgaaagccatgaagcgccaggtgga

SEQ ID NO: 98032 - DNA, 25 bp, mus musculus
actatggctggagtgtcccatctcc

SEQ ID NO: 98033 - DNA, 25 bp, mus musculus
ccagcctgcgctccctggagtgctg

SEQ ID NO: 98034 - DNA, 25 bp, mus musculus
tgcgctccctggagtgctgagactt

SEQ ID NO: 98035 - DNA, 25 bp, mus musculus
gctccctggagtgctgagacttaga

SEQ ID NO: 98036 - DNA, 25 bp, mus musculus
gtgctgctttctctactcccaggga

SEQ ID NO: 98037 - DNA, 25 bp, mus musculus
ctgctttctctactcccagggatcg

SEQ ID NO: 98038 - DNA, 25 bp, mus musculus
atcgggccaacctgcagctcagcaa

SEQ ID NO: 98039 - DNA, 25 bp, mus musculus
gggccaacctgcagctcagcaaccg

SEQ ID NO: 98040 - DNA, 25 bp, mus musculus
tgaaggcaaacctggccaagcagga

SEQ ID NO: 98041 - DNA, 25 bp, mus musculus
cgcttggtgtggcaatgtggaatta

SEQ ID NO: 98042 - DNA, 25 bp, mus musculus
tggacctgctcaatgatgccgacat

SEQ ID NO: 98043 - DNA, 25 bp, mus musculus
ggacctgctcaatgatgccgacatg

SEQ ID NO: 98044 - DNA, 25 bp, mus musculus
acctgctcaatgatgccgacatgtg

SEQ ID NO: 98045 - DNA, 25 bp, mus musculus
caatgatgccgacatgtgcaggaag

SEQ ID NO: 98046 - DNA, 25 bp, mus musculus
atgatgccgacatgtgcaggaagaa

SEQ ID NO: 98047 - DNA, 25 bp, mus musculus
tgatgccgacatgtgcaggaagaag

SEQ ID NO: 98048 - DNA, 25 bp, mus musculus
atgccgacatgtgcaggaagaagat

SEQ ID NO: 98049 - DNA, 25 bp, mus musculus
tgccgacatgtgcaggaagaagatg

SEQ ID NO: 98050 - DNA, 25 bp, mus musculus
agcctccacgctcattgatggcctg

SEQ ID NO: 98051 - DNA, 25 bp, mus musculus
cacgctcattgatggcctgagtggg

SEQ ID NO: 98052 - DNA, 25 bp, mus musculus
agtgcaggccaagtttgacgccgcg

SEQ ID NO: 98053 - DNA, 25 bp, mus musculus
ccaagtttgacgccgcgatgaagga

SEQ ID NO: 98054 - DNA, 25 bp, mus musculus
caagtttgacgccgcgatgaaggag

SEQ ID NO: 98055 - DNA, 25 bp, mus musculus
agtttgacgccgcgatgaaggagaa

SEQ ID NO: 98056 - DNA, 25 bp, mus musculus
ttgacgccgcgatgaaggagaaaat

SEQ ID NO: 98057 - DNA, 25 bp, mus musculus
tgacgccgcgatgaaggagaaaatg

SEQ ID NO: 98058 - DNA, 25 bp, mus musculus
aaatggacctgctcaatgatgccga

SEQ ID NO: 98059 - DNA, 25 bp, mus musculus
aatggacctgctcaatgatgccgac

SEQ ID NO: 98060 - DNA, 25 bp, mus musculus
gaacatcctcctagatgaatatggg

SEQ ID NO: 98061 - DNA, 25 bp, mus musculus
catcctcctagatgaatatgggcac

SEQ ID NO: 98062 - DNA, 25 bp, mus musculus
ggatactatgcgctcccggagtgtg

SEQ ID NO: 98063 - DNA, 25 bp, mus musculus
tactatgcgctcccggagtgtgttt

SEQ ID NO: 98064 - DNA, 25 bp, mus musculus
tatgcgctcccggagtgtgtttgca

SEQ ID NO: 98065 - DNA, 25 bp, mus musculus
ctcccggagtgtgtttgcaagaagg

SEQ ID NO: 98066 - DNA, 25 bp, mus musculus
aaactgtgcgtagtgacgagcaggc

SEQ ID NO: 98067 - DNA, 25 bp, mus musculus
gtgacgagcaggccgccgatctggt

SEQ ID NO: 98068 - DNA, 25 bp, mus musculus
acgagcaggccgccgatctggtttc

SEQ ID NO: 98069 - DNA, 25 bp, mus musculus
agcaggccgccgatctggtttctcc

SEQ ID NO: 98070 - DNA, 25 bp, mus musculus
cagcataaacccaaagacaggcatg

SEQ ID NO: 98071 - DNA, 25 bp, mus musculus
cataaacccaaagacaggcatgaga

SEQ ID NO: 98072 - DNA, 25 bp, mus musculus
gatatcggatctcggccttgcctgt

SEQ ID NO: 98073 - DNA, 25 bp, mus musculus
aaacccaaagacaggcatgagatag

SEQ ID NO: 98074 - DNA, 25 bp, mus musculus
atcggatctcggccttgcctgtgat

SEQ ID NO: 98075 - DNA, 25 bp, mus musculus
ggatctcggccttgcctgtgatttc

SEQ ID NO: 98076 - DNA, 25 bp, mus musculus
tctcggccttgcctgtgatttctcc

SEQ ID NO: 98077 - DNA, 25 bp, mus musculus
cggccttgcctgtgatttctccaaa

SEQ ID NO: 98078 - DNA, 25 bp, mus musculus
ccttgcctgtgatttctccaaaaag

SEQ ID NO: 98079 - DNA, 25 bp, mus musculus
gcctcatgccagcgtgggcacccag

SEQ ID NO: 98080 - DNA, 25 bp, mus musculus
tcatgccagcgtgggcacccagtgg

SEQ ID NO: 98081 - DNA, 25 bp, mus musculus
caactggcatagggatctggtacgg

SEQ ID NO: 98082 - DNA, 25 bp, mus musculus
gtgtgaaaacatccccattgtgctg

SEQ ID NO: 98083 - DNA, 25 bp, mus musculus
ttacgacatttcagccaaaagcaac

SEQ ID NO: 98084 - DNA, 25 bp, mus musculus
cgacatttcagccaaaagcaactac

SEQ ID NO: 98085 - DNA, 25 bp, mus musculus
catttcagccaaaagcaactacaac

SEQ ID NO: 98086 - DNA, 25 bp, mus musculus
ttcagccaaaagcaactacaacttt

SEQ ID NO: 98087 - DNA, 25 bp, mus musculus
ctccagaagactcactggagactct

SEQ ID NO: 98088 - DNA, 25 bp, mus musculus
aagactcactggagactctaacttg

SEQ ID NO: 98089 - DNA, 25 bp, mus musculus
actcactggagactctaacttggag

SEQ ID NO: 98090 - DNA, 25 bp, mus musculus
cactggagactctaacttggagttc

SEQ ID NO: 98091 - DNA, 25 bp, mus musculus
ctctaacttggagttcgttgccatg

SEQ ID NO: 98092 - DNA, 25 bp, mus musculus
cccacctgaggtggtcatggaccca

SEQ ID NO: 98093 - DNA, 25 bp, mus musculus
tgaaaacatccccattgtgctgtgt

SEQ ID NO: 98094 - DNA, 25 bp, mus musculus
gaagtctattgtcttccaccgcaag

SEQ ID NO: 98095 - DNA, 25 bp, mus musculus
gtctattgtcttccaccgcaagaag

SEQ ID NO: 98096 - DNA, 25 bp, mus musculus
cttccaccgcaagaagaaccttcag

SEQ ID NO: 98097 - DNA, 25 bp, mus musculus
ccaccgcaagaagaaccttcagtat

SEQ ID NO: 98098 - DNA, 25 bp, mus musculus
gaagaaccttcagtattacgacatt

SEQ ID NO: 98099 - DNA, 25 bp, mus musculus
gaaccttcagtattacgacatttca

SEQ ID NO: 98100 - DNA, 25 bp, mus musculus
ccttcagtattacgacatttcagcc

SEQ ID NO: 98101 - DNA, 25 bp, mus musculus
tggaattccaatgaccatccttccc

SEQ ID NO: 98102 - DNA, 25 bp, mus musculus
ccgaatccggagttcttctgagatc

SEQ ID NO: 98103 - DNA, 25 bp, mus musculus
ctgtgtcttcaggacggacaagcta

SEQ ID NO: 98104 - DNA, 25 bp, mus musculus
gtgtcttcaggacggacaagctaaa

SEQ ID NO: 98105 - DNA, 25 bp, mus musculus
tgtcttcaggacggacaagctaaaa

SEQ ID NO: 98106 - DNA, 25 bp, mus musculus
gtcttcaggacggacaagctaaaag

SEQ ID NO: 98107 - DNA, 25 bp, mus musculus
gtaacacaggccagaagtgtgtaaa

SEQ ID NO: 98108 - DNA, 25 bp, mus musculus
taacacaggccagaagtgtgtaaac

SEQ ID NO: 98109 - DNA, 25 bp, mus musculus
aacacaggccagaagtgtgtaaact

SEQ ID NO: 98110 - DNA, 25 bp, mus musculus
gtaaactctgaacatggccttctga

SEQ ID NO: 98111 - DNA, 25 bp, mus musculus
taaactctgaacatggccttctgac

SEQ ID NO: 98112 - DNA, 25 bp, mus musculus
aaactctgaacatggccttctgacc

SEQ ID NO: 98113 - DNA, 25 bp, mus musculus
cgaatccggagttcttctgagatct

SEQ ID NO: 98114 - DNA, 25 bp, mus musculus
gatctatggcctagtgaaaagtggc

SEQ ID NO: 98115 - DNA, 25 bp, mus musculus
tgctttggtgggacaactgtgtctt

SEQ ID NO: 98116 - DNA, 25 bp, mus musculus
tgggacaactgtgtcttcaggacgg

SEQ ID NO: 98117 - DNA, 25 bp, mus musculus
ggacaactgtgtcttcaggacggac

SEQ ID NO: 98118 - DNA, 25 bp, mus musculus
gacaactgtgtcttcaggacggaca

SEQ ID NO: 98119 - DNA, 25 bp, mus musculus
acaactgtgtcttcaggacggacaa

SEQ ID NO: 98120 - DNA, 25 bp, mus musculus
aactgtgtcttcaggacggacaagc

SEQ ID NO: 98121 - DNA, 25 bp, mus musculus
cggtccagcagtcgtctgagctagg

SEQ ID NO: 98122 - DNA, 25 bp, mus musculus
tccagcagtcgtctgagctaggact

SEQ ID NO: 98123 - DNA, 25 bp, mus musculus
acagccttgaacatggcattcacgc

SEQ ID NO: 98124 - DNA, 25 bp, mus musculus
gcgacagaaccatttgcggtggtga

SEQ ID NO: 98125 - DNA, 25 bp, mus musculus
acagaaccatttgcggtggtgacga

SEQ ID NO: 98126 - DNA, 25 bp, mus musculus
gaaccatttgcggtggtgacgactc

SEQ ID NO: 98127 - DNA, 25 bp, mus musculus
agactggatccgacaagcacgctcc

SEQ ID NO: 98128 - DNA, 25 bp, mus musculus
gatccgacaagcacgctcccagagc

SEQ ID NO: 98129 - DNA, 25 bp, mus musculus
ccgacaagcacgctcccagagcagt

SEQ ID NO: 98130 - DNA, 25 bp, mus musculus
agcacgctcccagagcagtttttgt

SEQ ID NO: 98131 - DNA, 25 bp, mus musculus
acgctcccagagcagtttttgtgga

SEQ ID NO: 98132 - DNA, 25 bp, mus musculus
ctcccagagcagtttttgtggacct

SEQ ID NO: 98133 - DNA, 25 bp, mus musculus
agtcgtctgagctaggactccgaat

SEQ ID NO: 98134 - DNA, 25 bp, mus musculus
ctgagctaggactccgaatttcagc

SEQ ID NO: 98135 - DNA, 25 bp, mus musculus
agctaggactccgaatttcagcgat

SEQ ID NO: 98136 - DNA, 25 bp, mus musculus
taggactccgaatttcagcgatgcg

SEQ ID NO: 98137 - DNA, 25 bp, mus musculus
gactccgaatttcagcgatgcgtga

SEQ ID NO: 98138 - DNA, 25 bp, mus musculus
gaatttcagcgatgcgtgagagtat

SEQ ID NO: 98139 - DNA, 25 bp, mus musculus
tttcagcgatgcgtgagagtatcac

SEQ ID NO: 98140 - DNA, 25 bp, mus musculus
tcactatccacgtgtcgcaagcagg

SEQ ID NO: 98141 - DNA, 25 bp, mus musculus
aagacgatcaggagctggagagaaa

SEQ ID NO: 98142 - DNA, 25 bp, mus musculus
attgaagacctcaatggctgaaggc

SEQ ID NO: 98143 - DNA, 25 bp, mus musculus
accatacactaggaaactgtctgcg

SEQ ID NO: 98144 - DNA, 25 bp, mus musculus
gaaactgtctgcggtacataatcat

SEQ ID NO: 98145 - DNA, 25 bp, mus musculus
aactgtctgcggtacataatcatga

SEQ ID NO: 98146 - DNA, 25 bp, mus musculus
taatcatgaagaacccggaagtgga

SEQ ID NO: 98147 - DNA, 25 bp, mus musculus
ttacactacgacccatccttcagag

SEQ ID NO: 98148 - DNA, 25 bp, mus musculus
actacgacccatccttcagagagca

SEQ ID NO: 98149 - DNA, 25 bp, mus musculus
tacgacccatccttcagagagcaaa

SEQ ID NO: 98150 - DNA, 25 bp, mus musculus
cgacccatccttcagagagcaaaat

SEQ ID NO: 98151 - DNA, 25 bp, mus musculus
acccatccttcagagagcaaaatta

SEQ ID NO: 98152 - DNA, 25 bp, mus musculus
tgcgaattcagacccggggtgccct

SEQ ID NO: 98153 - DNA, 25 bp, mus musculus
tgaagacctcaatggctgaaggcga

SEQ ID NO: 98154 - DNA, 25 bp, mus musculus
aagacctcaatggctgaaggcgaga

SEQ ID NO: 98155 - DNA, 25 bp, mus musculus
gacctcaatggctgaaggcgagagg

SEQ ID NO: 98156 - DNA, 25 bp, mus musculus
cctcaatggctgaaggcgagaggaa

SEQ ID NO: 98157 - DNA, 25 bp, mus musculus
atggtccaggcagctggaacagata

SEQ ID NO: 98158 - DNA, 25 bp, mus musculus
ggtccaggcagctggaacagataga

SEQ ID NO: 98159 - DNA, 25 bp, mus musculus
tgtgacatttgtcctgcacgaggag

SEQ ID NO: 98160 - DNA, 25 bp, mus musculus
tgacatttgtcctgcacgaggagga

SEQ ID NO: 98161 - DNA, 25 bp, mus musculus
ccctacagctacttctccaaagagg

SEQ ID NO: 98162 - DNA, 25 bp, mus musculus
agctacttctccaaagaggcagccc

SEQ ID NO: 98163 - DNA, 25 bp, mus musculus
agccccagctctgatgggagacaga

SEQ ID NO: 98164 - DNA, 25 bp, mus musculus
cccagctctgatgggagacagaaaa

SEQ ID NO: 98165 - DNA, 25 bp, mus musculus
gtgtaccagacactgcccgccaaac

SEQ ID NO: 98166 - DNA, 25 bp, mus musculus
cccgccaaactgctctggaggaaat

SEQ ID NO: 98167 - DNA, 25 bp, mus musculus
gccaaactgctctggaggaaatacc

SEQ ID NO: 98168 - DNA, 25 bp, mus musculus
aggaaatacccactgccggagaatg

SEQ ID NO: 98169 - DNA, 25 bp, mus musculus
tacccactgccggagaatgcggaga

SEQ ID NO: 98170 - DNA, 25 bp, mus musculus
ccactgccggagaatgcggagaaca

SEQ ID NO: 98171 - DNA, 25 bp, mus musculus
aacatgtactatttctccgagctag

SEQ ID NO: 98172 - DNA, 25 bp, mus musculus
tactatttctccgagctagccctga

SEQ ID NO: 98173 - DNA, 25 bp, mus musculus
tacttctccaaagaggcagcccgaa

SEQ ID NO: 98174 - DNA, 25 bp, mus musculus
ttctccaaagaggcagcccgaaagg

SEQ ID NO: 98175 - DNA, 25 bp, mus musculus
tccaaagaggcagcccgaaaggtga

SEQ ID NO: 98176 - DNA, 25 bp, mus musculus
agtgacagccagggcaaggccgact

SEQ ID NO: 98177 - DNA, 25 bp, mus musculus
gacagccagggcaaggccgactacg

SEQ ID NO: 98178 - DNA, 25 bp, mus musculus
gccgactacgtgctgtcaggttcgt

SEQ ID NO: 98179 - DNA, 25 bp, mus musculus
ctgtcaggttcgtgggatgaccaga

SEQ ID NO: 98180 - DNA, 25 bp, mus musculus
agcagccccagctctgatgggagac

SEQ ID NO: 98181 - DNA, 25 bp, mus musculus
cttcttcagctacagcctgggggcc

SEQ ID NO: 98182 - DNA, 25 bp, mus musculus
cttcagctacagcctgggggccatc

SEQ ID NO: 98183 - DNA, 25 bp, mus musculus
cctttgccggcagtggacccagact

SEQ ID NO: 98184 - DNA, 25 bp, mus musculus
gtggacccagactggctggtgagcc

SEQ ID NO: 98185 - DNA, 25 bp, mus musculus
ccgcagtctatgtgaccatttccct

SEQ ID NO: 98186 - DNA, 25 bp, mus musculus
tgaccatttccctggggcccatttg

SEQ ID NO: 98187 - DNA, 25 bp, mus musculus
ccatttccctggggcccatttgcag

SEQ ID NO: 98188 - DNA, 25 bp, mus musculus
caaatgtgctgttcccaggggccca

SEQ ID NO: 98189 - DNA, 25 bp, mus musculus
tgctgttcccaggggcccatttgaa

SEQ ID NO: 98190 - DNA, 25 bp, mus musculus
tgaaaccttcccttgctgactgtac

SEQ ID NO: 98191 - DNA, 25 bp, mus musculus
aaccttcccttgctgactgtactgt

SEQ ID NO: 98192 - DNA, 25 bp, mus musculus
cccttgctgactgtactgtgggata

SEQ ID NO: 98193 - DNA, 25 bp, mus musculus
ctacagcctgggggccatctgccca

SEQ ID NO: 98194 - DNA, 25 bp, mus musculus
acagcactgcaaggtaccccatggc

SEQ ID NO: 98195 - DNA, 25 bp, mus musculus
gcactgcaaggtaccccatggcctc

SEQ ID NO: 98196 - DNA, 25 bp, mus musculus
tggctactgcaacagctctttgaat

SEQ ID NO: 98197 - DNA, 25 bp, mus musculus
cagctctttgaatcctgtcatctac

SEQ ID NO: 98198 - DNA, 25 bp, mus musculus
ctctttgaatcctgtcatctacacc

SEQ ID NO: 98199 - DNA, 25 bp, mus musculus
tttgaatcctgtcatctacaccatc

SEQ ID NO: 98200 - DNA, 25 bp, mus musculus
gatcctttgccggcagtggacccag

SEQ ID NO: 98201 - DNA, 25 bp, mus musculus
gagatcaacctgtcgagaggacctt

SEQ ID NO: 98202 - DNA, 25 bp, mus musculus
agatcaacctgtcgagaggaccttc

SEQ ID NO: 98203 - DNA, 25 bp, mus musculus
gtctccaacgacagtcgcatctacg

SEQ ID NO: 98204 - DNA, 25 bp, mus musculus
tctccaacgacagtcgcatctacgt

SEQ ID NO: 98205 - DNA, 25 bp, mus musculus
tccaacgacagtcgcatctacgtca

SEQ ID NO: 98206 - DNA, 25 bp, mus musculus
ccaacgacagtcgcatctacgtcag

SEQ ID NO: 98207 - DNA, 25 bp, mus musculus
acgacagtcgcatctacgtcagccg

SEQ ID NO: 98208 - DNA, 25 bp, mus musculus
gacagtcgcatctacgtcagccgta

SEQ ID NO: 98209 - DNA, 25 bp, mus musculus
agtcgcatctacgtcagccgtatca

SEQ ID NO: 98210 - DNA, 25 bp, mus musculus
gtcgcatctacgtcagccgtatcaa

SEQ ID NO: 98211 - DNA, 25 bp, mus musculus
tctacgtcagccgtatcaaagagga

SEQ ID NO: 98212 - DNA, 25 bp, mus musculus
tacgtcagccgtatcaaagaggatg

SEQ ID NO: 98213 - DNA, 25 bp, mus musculus
tcaacctgtcgagaggaccttcggg

SEQ ID NO: 98214 - DNA, 25 bp, mus musculus
ggcttcaacatcgtcggtgggacag

SEQ ID NO: 98215 - DNA, 25 bp, mus musculus
gcttcaacatcgtcggtgggacaga

SEQ ID NO: 98216 - DNA, 25 bp, mus musculus
ttcaacatcgtcggtgggacagatc

SEQ ID NO: 98217 - DNA, 25 bp, mus musculus
tcaacatcgtcggtgggacagatca

SEQ ID NO: 98218 - DNA, 25 bp, mus musculus
acatcgtcggtgggacagatcaaca

SEQ ID NO: 98219 - DNA, 25 bp, mus musculus
caacagtatgtctccaacgacagtc

SEQ ID NO: 98220 - DNA, 25 bp, mus musculus
aacagtatgtctccaacgacagtcg

SEQ ID NO: 98221 - DNA, 25 bp, mus musculus
ggatccctgcgcacggagtgataaa

SEQ ID NO: 98222 - DNA, 25 bp, mus musculus
tccctgcgcacggagtgataaaggc

SEQ ID NO: 98223 - DNA, 25 bp, mus musculus
gctgctcctggaccatggggctgac

SEQ ID NO: 98224 - DNA, 25 bp, mus musculus
gctcctggaccatggggctgacccc

SEQ ID NO: 98225 - DNA, 25 bp, mus musculus
caaccaacaggatggtctgggcaac

SEQ ID NO: 98226 - DNA, 25 bp, mus musculus
tctgggcaacacgccattgcacctg

SEQ ID NO: 98227 - DNA, 25 bp, mus musculus
gggcaacacgccattgcacctggcg

SEQ ID NO: 98228 - DNA, 25 bp, mus musculus
attgcacctggcggcctgcaccaac

SEQ ID NO: 98229 - DNA, 25 bp, mus musculus
ctgcaccaaccatgttcctgtcatc

SEQ ID NO: 98230 - DNA, 25 bp, mus musculus
caaccatgttcctgtcatcaccaca

SEQ ID NO: 98231 - DNA, 25 bp, mus musculus
ccatgttcctgtcatcaccacactg

SEQ ID NO: 98232 - DNA, 25 bp, mus musculus
tcctgtcatcaccacactgcttcga

SEQ ID NO: 98233 - DNA, 25 bp, mus musculus
aggcagaactgccctccattttgct

SEQ ID NO: 98234 - DNA, 25 bp, mus musculus
tgccctccattttgcttcctgcaat

SEQ ID NO: 98235 - DNA, 25 bp, mus musculus
cctccattttgcttcctgcaatggc

SEQ ID NO: 98236 - DNA, 25 bp, mus musculus
ccattttgcttcctgcaatggcaat

SEQ ID NO: 98237 - DNA, 25 bp, mus musculus
tgcttcctgcaatggcaatgaccag

SEQ ID NO: 98238 - DNA, 25 bp, mus musculus
ttcctgcaatggcaatgaccagatt

SEQ ID NO: 98239 - DNA, 25 bp, mus musculus
tgaccagattgtgcagctgctcctg

SEQ ID NO: 98240 - DNA, 25 bp, mus musculus
gcagctgctcctggaccatggggct

SEQ ID NO: 98241 - DNA, 25 bp, mus musculus
gtacctggtcacctgtgctgatgat

SEQ ID NO: 98242 - DNA, 25 bp, mus musculus
tacctggtcacctgtgctgatgatg

SEQ ID NO: 98243 - DNA, 25 bp, mus musculus
agtgctgcaggacttctggacaaac

SEQ ID NO: 98244 - DNA, 25 bp, mus musculus
tgctgcaggacttctggacaaacat

SEQ ID NO: 98245 - DNA, 25 bp, mus musculus
ggacaaacatttgccaactccaatt

SEQ ID NO: 98246 - DNA, 25 bp, mus musculus
caaacatttgccaactccaattcct

SEQ ID NO: 98247 - DNA, 25 bp, mus musculus
acgcctgcttccagattcttcttcg

SEQ ID NO: 98248 - DNA, 25 bp, mus musculus
gcctgcttccagattcttcttcgaa

SEQ ID NO: 98249 - DNA, 25 bp, mus musculus
cctgcttccagattcttcttcgaac

SEQ ID NO: 98250 - DNA, 25 bp, mus musculus
tgcttccagattcttcttcgaacta

SEQ ID NO: 98251 - DNA, 25 bp, mus musculus
gcttccagattcttcttcgaactaa

SEQ ID NO: 98252 - DNA, 25 bp, mus musculus
ttccagattcttcttcgaactaaag

SEQ ID NO: 98253 - DNA, 25 bp, mus musculus
cctggtcacctgtgctgatgatgtc

SEQ ID NO: 98254 - DNA, 25 bp, mus musculus
ctggtcacctgtgctgatgatgtca

SEQ ID NO: 98255 - DNA, 25 bp, mus musculus
ggtcacctgtgctgatgatgtcatc

SEQ ID NO: 98256 - DNA, 25 bp, mus musculus
cacctgtgctgatgatgtcatcaag

SEQ ID NO: 98257 - DNA, 25 bp, mus musculus
atgatcaacatgggcagtgctgcag

SEQ ID NO: 98258 - DNA, 25 bp, mus musculus
gatcaacatgggcagtgctgcagga

SEQ ID NO: 98259 - DNA, 25 bp, mus musculus
caacatgggcagtgctgcaggactt

SEQ ID NO: 98260 - DNA, 25 bp, mus musculus
cagtgctgcaggacttctggacaaa

SEQ ID NO: 98261 - DNA, 25 bp, mus musculus
ccaaaagacccacaatgtctctcca

SEQ ID NO: 98262 - DNA, 25 bp, mus musculus
gacccacaatgtctctccaatggtt

SEQ ID NO: 98263 - DNA, 25 bp, mus musculus
cattgacctgttcggcattgacgag

SEQ ID NO: 98264 - DNA, 25 bp, mus musculus
agaggctacgcagtacgcagagaag

SEQ ID NO: 98265 - DNA, 25 bp, mus musculus
tacgcagtacgcagagaagaaggca

SEQ ID NO: 98266 - DNA, 25 bp, mus musculus
gcaaagaagcccacactggtggcaa

SEQ ID NO: 98267 - DNA, 25 bp, mus musculus
aagcccacactggtggcaaaatcct

SEQ ID NO: 98268 - DNA, 25 bp, mus musculus
gcccacactggtggcaaaatcctcc

SEQ ID NO: 98269 - DNA, 25 bp, mus musculus
actgacatggcccagctagagactt

SEQ ID NO: 98270 - DNA, 25 bp, mus musculus
tgacatggcccagctagagacttgt

SEQ ID NO: 98271 - DNA, 25 bp, mus musculus
atggcccagctagagacttgtgtgc

SEQ ID NO: 98272 - DNA, 25 bp, mus musculus
cccagctagagacttgtgtgcgtac

SEQ ID NO: 98273 - DNA, 25 bp, mus musculus
cccacaatgtctctccaatggttaa

SEQ ID NO: 98274 - DNA, 25 bp, mus musculus
caatgtctctccaatggttaaattg

SEQ ID NO: 98275 - DNA, 25 bp, mus musculus
atgtctctccaatggttaaattgaa

SEQ ID NO: 98276 - DNA, 25 bp, mus musculus
aggagccacaccagcagaggacgat

SEQ ID NO: 98277 - DNA, 25 bp, mus musculus
gagccacaccagcagaggacgatga

SEQ ID NO: 98278 - DNA, 25 bp, mus musculus
cacaccagcagaggacgatgaggac

SEQ ID NO: 98279 - DNA, 25 bp, mus musculus
caatgacattgacctgttcggcatt

SEQ ID NO: 98280 - DNA, 25 bp, mus musculus
atgacattgacctgttcggcattga

SEQ ID NO: 98281 - DNA, 25 bp, mus musculus
actgaccctgatcaacatccggcag

SEQ ID NO: 98282 - DNA, 25 bp, mus musculus
gatcaacatccggcagtattacgtg

SEQ ID NO: 98283 - DNA, 25 bp, mus musculus
catcaacattggccaagccattatc

SEQ ID NO: 98284 - DNA, 25 bp, mus musculus
cattatcttctgccagacacgtcga

SEQ ID NO: 98285 - DNA, 25 bp, mus musculus
cttctgccagacacgtcgaaatgcc

SEQ ID NO: 98286 - DNA, 25 bp, mus musculus
aaatgccaagtggctgactgtggag

SEQ ID NO: 98287 - DNA, 25 bp, mus musculus
gtccctgctaagtggggaactcaca

SEQ ID NO: 98288 - DNA, 25 bp, mus musculus
ggaactcacagtggagcagcgagct

SEQ ID NO: 98289 - DNA, 25 bp, mus musculus
actcacagtggagcagcgagcttcc

SEQ ID NO: 98290 - DNA, 25 bp, mus musculus
gcagcgagcttccatcattcagaga

SEQ ID NO: 98291 - DNA, 25 bp, mus musculus
ttccatcattcagagattccgagat

SEQ ID NO: 98292 - DNA, 25 bp, mus musculus
catcattcagagattccgagatggc

SEQ ID NO: 98293 - DNA, 25 bp, mus musculus
catccggcagtattacgtgttgtgt

SEQ ID NO: 98294 - DNA, 25 bp, mus musculus
ggttctcataacgaccaatgtctgt

SEQ ID NO: 98295 - DNA, 25 bp, mus musculus
gcagtattacgtgttgtgtgagaac

SEQ ID NO: 98296 - DNA, 25 bp, mus musculus
gtattacgtgttgtgtgagaacagg

SEQ ID NO: 98297 - DNA, 25 bp, mus musculus
ataccaagccctctgtaacatctac

SEQ ID NO: 98298 - DNA, 25 bp, mus musculus
ccaagccctctgtaacatctacggt

SEQ ID NO: 98299 - DNA, 25 bp, mus musculus
ctgtaacatctacggtggcatcaac

SEQ ID NO: 98300 - DNA, 25 bp, mus musculus
taacatctacggtggcatcaacatt

SEQ ID NO: 98301 - DNA, 25 bp, mus musculus
tggcatcaacattggccaagccatt

SEQ ID NO: 98302 - DNA, 25 bp, mus musculus
ccacttcccaggttccctgatgtca

SEQ ID NO: 98303 - DNA, 25 bp, mus musculus
cccaggttccctgatgtcagtgaac

SEQ ID NO: 98304 - DNA, 25 bp, mus musculus
cactttgaccgagacctgcacacaa

SEQ ID NO: 98305 - DNA, 25 bp, mus musculus
gacctgcacacaaacagccccaggt

SEQ ID NO: 98306 - DNA, 25 bp, mus musculus
ctgcacacaaacagccccaggtaca

SEQ ID NO: 98307 - DNA, 25 bp, mus musculus
agccccaggtacagcaagggctcct

SEQ ID NO: 98308 - DNA, 25 bp, mus musculus
aggtacagcaagggctcctacaatg

SEQ ID NO: 98309 - DNA, 25 bp, mus musculus
tacagcaagggctcctacaatgacc

SEQ ID NO: 98310 - DNA, 25 bp, mus musculus
ggctcctacaatgacctgagctttg

SEQ ID NO: 98311 - DNA, 25 bp, mus musculus
tcctacaatgacctgagctttgtaa

SEQ ID NO: 98312 - DNA, 25 bp, mus musculus
tacaatgacctgagctttgtaacac

SEQ ID NO: 98313 - DNA, 25 bp, mus musculus
agctttgtaacacatgccaacaagg

SEQ ID NO: 98314 - DNA, 25 bp, mus musculus
ttccctgatgtcagtgaaccctggc

SEQ ID NO: 98315 - DNA, 25 bp, mus musculus
gtaacacatgccaacaaggagggca

SEQ ID NO: 98316 - DNA, 25 bp, mus musculus
cctgatgtcagtgaaccctggcatg

SEQ ID NO: 98317 - DNA, 25 bp, mus musculus
gaaccctggcatggccgatggatca

SEQ ID NO: 98318 - DNA, 25 bp, mus musculus
ccctggcatggccgatggatcaaag

SEQ ID NO: 98319 - DNA, 25 bp, mus musculus
gagctcttttgtcacaatgagcgtg

SEQ ID NO: 98320 - DNA, 25 bp, mus musculus
ttttgtcacaatgagcgtgtagtcc

SEQ ID NO: 98321 - DNA, 25 bp, mus musculus
catgggttcttctcgttgacagcag

SEQ ID NO: 98322 - DNA, 25 bp, mus musculus
atccactttgaccgagacctgcaca

SEQ ID NO: 98323 - DNA, 25 bp, mus musculus
tgttctgggtccttgagaacacatg

SEQ ID NO: 98324 - DNA, 25 bp, mus musculus
ccctatgtgtgtgaccagtgtggat

SEQ ID NO: 98325 - DNA, 25 bp, mus musculus
cctcgatctgcgtctcttcaaagac

SEQ ID NO: 98326 - DNA, 25 bp, mus musculus
cgatctgcgtctcttcaaagacatg

SEQ ID NO: 98327 - DNA, 25 bp, mus musculus
tctgcgtctcttcaaagacatgtca

SEQ ID NO: 98328 - DNA, 25 bp, mus musculus
gcgtctcttcaaagacatgtcaaaa

SEQ ID NO: 98329 - DNA, 25 bp, mus musculus
tctcttcaaagacatgtcaaaattc

SEQ ID NO: 98330 - DNA, 25 bp, mus musculus
ggcgttgcttccctagttctgctga

SEQ ID NO: 98331 - DNA, 25 bp, mus musculus
gttgcttccctagttctgctgacct

SEQ ID NO: 98332 - DNA, 25 bp, mus musculus
tccctagttctgctgacctcttaga

SEQ ID NO: 98333 - DNA, 25 bp, mus musculus
ctagttctgctgacctcttagaaca

SEQ ID NO: 98334 - DNA, 25 bp, mus musculus
gttctgctgacctcttagaacacga

SEQ ID NO: 98335 - DNA, 25 bp, mus musculus
tatgtgtgtgaccagtgtggatata

SEQ ID NO: 98336 - DNA, 25 bp, mus musculus
gagaagccctacgtgtgtaatcatt

SEQ ID NO: 98337 - DNA, 25 bp, mus musculus
aagccctacgtgtgtaatcattgtg

SEQ ID NO: 98338 - DNA, 25 bp, mus musculus
ccctacgtgtgtaatcattgtggga

SEQ ID NO: 98339 - DNA, 25 bp, mus musculus
gggaagactttccctcgatctgcgt

SEQ ID NO: 98340 - DNA, 25 bp, mus musculus
aagactttccctcgatctgcgtctc

SEQ ID NO: 98341 - DNA, 25 bp, mus musculus
actttccctcgatctgcgtctcttc

SEQ ID NO: 98342 - DNA, 25 bp, mus musculus
ttccctcgatctgcgtctcttcaaa

SEQ ID NO: 98343 - DNA, 25 bp, mus musculus
tgacatctctgaaccacaaatattt

SEQ ID NO: 98344 - DNA, 25 bp, mus musculus
catctctgaaccacaaatatttccg

SEQ ID NO: 98345 - DNA, 25 bp, mus musculus
ttatcaaatcaggcactgctttcaa

SEQ ID NO: 98346 - DNA, 25 bp, mus musculus
tcaaatcaggcactgctttcaaggt

SEQ ID NO: 98347 - DNA, 25 bp, mus musculus
aatcaggcactgctttcaaggtgaa

SEQ ID NO: 98348 - DNA, 25 bp, mus musculus
gtgacatcatggacacgtttaaact

SEQ ID NO: 98349 - DNA, 25 bp, mus musculus
cccctgagatcaacgccaagacgtc

SEQ ID NO: 98350 - DNA, 25 bp, mus musculus
ctgagatcaacgccaagacgtccgt

SEQ ID NO: 98351 - DNA, 25 bp, mus musculus
agatcaacgccaagacgtccgtcat

SEQ ID NO: 98352 - DNA, 25 bp, mus musculus
acgccaagacgtccgtcattgattt

SEQ ID NO: 98353 - DNA, 25 bp, mus musculus
ccaagacgtccgtcattgatttcac

SEQ ID NO: 98354 - DNA, 25 bp, mus musculus
agacgtccgtcattgatttcaccgt

SEQ ID NO: 98355 - DNA, 25 bp, mus musculus
tgaaccacaaatatttccgcacaca

SEQ ID NO: 98356 - DNA, 25 bp, mus musculus
ccgtcattgatttcaccgtcaccat

SEQ ID NO: 98357 - DNA, 25 bp, mus musculus
accacaaatatttccgcacacacct

SEQ ID NO: 98358 - DNA, 25 bp, mus musculus
atttccgcacacacctggaggacag

SEQ ID NO: 98359 - DNA, 25 bp, mus musculus
tccgcacacacctggaggacagcct

SEQ ID NO: 98360 - DNA, 25 bp, mus musculus
gcacacacctggaggacagcctctc

SEQ ID NO: 98361 - DNA, 25 bp, mus musculus
acctggaggacagcctctcgttggg

SEQ ID NO: 98362 - DNA, 25 bp, mus musculus
cccttctcatcgaggatattcgaga

SEQ ID NO: 98363 - DNA, 25 bp, mus musculus
acccagctctggataatgtgctgga

SEQ ID NO: 98364 - DNA, 25 bp, mus musculus
tatcacatacatagccccttagccc

SEQ ID NO: 98365 - DNA, 25 bp, mus musculus
ctcctacgtattcttttcctgatca

SEQ ID NO: 98366 - DNA, 25 bp, mus musculus
atacacattgatttctttgtgcctg

SEQ ID NO: 98367 - DNA, 25 bp, mus musculus
gttttatgtgcacacattaggcatt

SEQ ID NO: 98368 - DNA, 25 bp, mus musculus
tgtgcacacattaggcattgagaat

SEQ ID NO: 98369 - DNA, 25 bp, mus musculus
attatccctgttcatcataagcact

SEQ ID NO: 98370 - DNA, 25 bp, mus musculus
cctgttcatcataagcacttttacg

SEQ ID NO: 98371 - DNA, 25 bp, mus musculus
ttctgctggtctccaattaccaaga

SEQ ID NO: 98372 - DNA, 25 bp, mus musculus
cttatgccatgatagctttctacac

SEQ ID NO: 98373 - DNA, 25 bp, mus musculus
ccatgatagctttctacactgtatt

SEQ ID NO: 98374 - DNA, 25 bp, mus musculus
tagctttctacactgtattacataa

SEQ ID NO: 98375 - DNA, 25 bp, mus musculus
ctttctacactgtattacataaata

SEQ ID NO: 98376 - DNA, 25 bp, mus musculus
cgtattcttttcctgatcactatgc

SEQ ID NO: 98377 - DNA, 25 bp, mus musculus
cttttcctgatcactatgcattttg

SEQ ID NO: 98378 - DNA, 25 bp, mus musculus
ctgatcactatgcattttgaacatt

SEQ ID NO: 98379 - DNA, 25 bp, mus musculus
ttccatgactgcatcttactgtaca

SEQ ID NO: 98380 - DNA, 25 bp, mus musculus
gactgcatcttactgtacagattgc

SEQ ID NO: 98381 - DNA, 25 bp, mus musculus
atcttactgtacagattgctgcttc

SEQ ID NO: 98382 - DNA, 25 bp, mus musculus
ctgtacagattgctgcttctgctct

SEQ ID NO: 98383 - DNA, 25 bp, mus musculus
ctgctctctttgtgatataggaata

SEQ ID NO: 98384 - DNA, 25 bp, mus musculus
gactcaaggctgcaatccaagtatc

SEQ ID NO: 98385 - DNA, 25 bp, mus musculus
ctcaaggctgcaatccaagtatcaa

SEQ ID NO: 98386 - DNA, 25 bp, mus musculus
catgagtcacttcgggtcggccatg

SEQ ID NO: 98387 - DNA, 25 bp, mus musculus
tgagtcacttcgggtcggccatgat

SEQ ID NO: 98388 - DNA, 25 bp, mus musculus
gagtcacttcgggtcggccatgatg

SEQ ID NO: 98389 - DNA, 25 bp, mus musculus
gtcacttcgggtcggccatgatgta

SEQ ID NO: 98390 - DNA, 25 bp, mus musculus
tcacttcgggtcggccatgatgtat

SEQ ID NO: 98391 - DNA, 25 bp, mus musculus
acttcgggtcggccatgatgtatct

SEQ ID NO: 98392 - DNA, 25 bp, mus musculus
cttcgggtcggccatgatgtatctc

SEQ ID NO: 98393 - DNA, 25 bp, mus musculus
tcgggtcggccatgatgtatctcta

SEQ ID NO: 98394 - DNA, 25 bp, mus musculus
tgatgtatctctatgccatacaagt

SEQ ID NO: 98395 - DNA, 25 bp, mus musculus
gatgtatctctatgccatacaagta

SEQ ID NO: 98396 - DNA, 25 bp, mus musculus
tcaaggctgcaatccaagtatcaag

SEQ ID NO: 98397 - DNA, 25 bp, mus musculus
gctgcaatccaagtatcaagcactg

SEQ ID NO: 98398 - DNA, 25 bp, mus musculus
ctgcaatccaagtatcaagcactgt

SEQ ID NO: 98399 - DNA, 25 bp, mus musculus
tagttctcatgagtcacttcgggtc

SEQ ID NO: 98400 - DNA, 25 bp, mus musculus
agttctcatgagtcacttcgggtcg

SEQ ID NO: 98401 - DNA, 25 bp, mus musculus
ttctcatgagtcacttcgggtcggc

SEQ ID NO: 98402 - DNA, 25 bp, mus musculus
tctcatgagtcacttcgggtcggcc

SEQ ID NO: 98403 - DNA, 25 bp, mus musculus
tcatgagtcacttcgggtcggccat

SEQ ID NO: 98404 - DNA, 25 bp, mus musculus
aaagttcagccctgagaacacaagg

SEQ ID NO: 98405 - DNA, 25 bp, mus musculus
gttcagccctgagaacacaaggaag

SEQ ID NO: 98406 - DNA, 25 bp, mus musculus
tccgcaccgaggatggcttcagtct

SEQ ID NO: 98407 - DNA, 25 bp, mus musculus
ccgcaccgaggatggcttcagtctg

SEQ ID NO: 98408 - DNA, 25 bp, mus musculus
gcaccgaggatggcttcagtctgaa

SEQ ID NO: 98409 - DNA, 25 bp, mus musculus
aggatggcttcagtctgaaggagca

SEQ ID NO: 98410 - DNA, 25 bp, mus musculus
tgcaagacatgggcctcattgatct

SEQ ID NO: 98411 - DNA, 25 bp, mus musculus
acatgggcctcattgatctcttcag

SEQ ID NO: 98412 - DNA, 25 bp, mus musculus
tcattgatctcttcagccctgaaaa

SEQ ID NO: 98413 - DNA, 25 bp, mus musculus
cattgatctcttcagccctgaaaag

SEQ ID NO: 98414 - DNA, 25 bp, mus musculus
atctcttcagccctgaaaagtccca

SEQ ID NO: 98415 - DNA, 25 bp, mus musculus
tcttcagccctgaaaagtcccaact

SEQ ID NO: 98416 - DNA, 25 bp, mus musculus
ttcagccctgagaacacaaggaagg

SEQ ID NO: 98417 - DNA, 25 bp, mus musculus
accgttctataaggtcgatgggcag

SEQ ID NO: 98418 - DNA, 25 bp, mus musculus
agtgcctatgatgtaccagggagtg

SEQ ID NO: 98419 - DNA, 25 bp, mus musculus
agactatgcttgtggtccacatgcc

SEQ ID NO: 98420 - DNA, 25 bp, mus musculus
ctatgcttgtggtccacatgccccg

SEQ ID NO: 98421 - DNA, 25 bp, mus musculus
tatgcttgtggtccacatgccccgc

SEQ ID NO: 98422 - DNA, 25 bp, mus musculus
cccgcttccgcaccgaggatggctt

SEQ ID NO: 98423 - DNA, 25 bp, mus musculus
gcttccgcaccgaggatggcttcag

SEQ ID NO: 98424 - DNA, 25 bp, mus musculus
ggctacttccgtatccgcagaggaa

SEQ ID NO: 98425 - DNA, 25 bp, mus musculus
ttccgtatccgcagaggaactgatg

SEQ ID NO: 98426 - DNA, 25 bp, mus musculus
gatttagtcacatgctgaagacttt

SEQ ID NO: 98427 - DNA, 25 bp, mus musculus
ttagtcacatgctgaagactttttc

SEQ ID NO: 98428 - DNA, 25 bp, mus musculus
gtcacatgctgaagactttttcaga

SEQ ID NO: 98429 - DNA, 25 bp, mus musculus
ctttttcagagcaatatcagaagct

SEQ ID NO: 98430 - DNA, 25 bp, mus musculus
aatatcagaagcttaccactaagca

SEQ ID NO: 98431 - DNA, 25 bp, mus musculus
atcagaagcttaccactaagcatct

SEQ ID NO: 98432 - DNA, 25 bp, mus musculus
agcttaccactaagcatctttaaag

SEQ ID NO: 98433 - DNA, 25 bp, mus musculus
ttaccactaagcatctttaaagaat

SEQ ID NO: 98434 - DNA, 25 bp, mus musculus
tgaacttaaaaccatccttgatgtt

SEQ ID NO: 98435 - DNA, 25 bp, mus musculus
aaccatccttgatgtttctgctttt

SEQ ID NO: 98436 - DNA, 25 bp, mus musculus
cgtatccgcagaggaactgatgaat

SEQ ID NO: 98437 - DNA, 25 bp, mus musculus
agtatagccgtggcgccataccgat

SEQ ID NO: 98438 - DNA, 25 bp, mus musculus
gtggcgccataccgattcctaaatt

SEQ ID NO: 98439 - DNA, 25 bp, mus musculus
tagctcccagtgttacatacgggtc

SEQ ID NO: 98440 - DNA, 25 bp, mus musculus
gtgttacatacgggtctttatcact

SEQ ID NO: 98441 - DNA, 25 bp, mus musculus
ttacatacgggtctttatcactcac

SEQ ID NO: 98442 - DNA, 25 bp, mus musculus
acgggtctttatcactcacagagtg

SEQ ID NO: 98443 - DNA, 25 bp, mus musculus
tatcactcacagagtgatttagtca

SEQ ID NO: 98444 - DNA, 25 bp, mus musculus
agagacttcaacctcaaagtgttat

SEQ ID NO: 98445 - DNA, 25 bp, mus musculus
agacttcaacctcaaagtgttatca

SEQ ID NO: 98446 - DNA, 25 bp, mus musculus
tgtgctgtcctgattagttgcagct

SEQ ID NO: 98447 - DNA, 25 bp, mus musculus
tgctgtcctgattagttgcagctgg

SEQ ID NO: 98448 - DNA, 25 bp, mus musculus
gctgtcctgattagttgcagctggt

SEQ ID NO: 98449 - DNA, 25 bp, mus musculus
tgtcctgattagttgcagctggtag

SEQ ID NO: 98450 - DNA, 25 bp, mus musculus
gtcctgattagttgcagctggtaga

SEQ ID NO: 98451 - DNA, 25 bp, mus musculus
attagttgcagctggtagatggaag

SEQ ID NO: 98452 - DNA, 25 bp, mus musculus
tagttgcagctggtagatggaagaa

SEQ ID NO: 98453 - DNA, 25 bp, mus musculus
tgaatgctggctatctccaagaatc

SEQ ID NO: 98454 - DNA, 25 bp, mus musculus
gaatgctggctatctccaagaatcg

SEQ ID NO: 98455 - DNA, 25 bp, mus musculus
atgctggctatctccaagaatcgga

SEQ ID NO: 98456 - DNA, 25 bp, mus musculus
gacttcaacctcaaagtgttatcag

SEQ ID NO: 98457 - DNA, 25 bp, mus musculus
tctccaagaatcggagcagactccg

SEQ ID NO: 98458 - DNA, 25 bp, mus musculus
cttcaacctcaaagtgttatcaggc

SEQ ID NO: 98459 - DNA, 25 bp, mus musculus
ttcaacctcaaagtgttatcaggca

SEQ ID NO: 98460 - DNA, 25 bp, mus musculus
caacctcaaagtgttatcaggcaga

SEQ ID NO: 98461 - DNA, 25 bp, mus musculus
aacctcaaagtgttatcaggcagat

SEQ ID NO: 98462 - DNA, 25 bp, mus musculus
tgactgtgctgtcctgattagttgc

SEQ ID NO: 98463 - DNA, 25 bp, mus musculus
gactgtgctgtcctgattagttgca

SEQ ID NO: 98464 - DNA, 25 bp, mus musculus
ctgtgctgtcctgattagttgcagc

SEQ ID NO: 98465 - DNA, 25 bp, mus musculus
aattgcagccctacgatcagagctg

SEQ ID NO: 98466 - DNA, 25 bp, mus musculus
tgcagccctacgatcagagctgaga

SEQ ID NO: 98467 - DNA, 25 bp, mus musculus
agatattgcctacttgggcatcaca

SEQ ID NO: 98468 - DNA, 25 bp, mus musculus
tgcctacttgggcatcacagatgtg

SEQ ID NO: 98469 - DNA, 25 bp, mus musculus
cttgggcatcacagatgtgagggtt

SEQ ID NO: 98470 - DNA, 25 bp, mus musculus
ggagcccaacaacacgggcgatggg

SEQ ID NO: 98471 - DNA, 25 bp, mus musculus
atgtgaattctctgactgagggtgc

SEQ ID NO: 98472 - DNA, 25 bp, mus musculus
tgaattctctgactgagggtgcttg

SEQ ID NO: 98473 - DNA, 25 bp, mus musculus
tctcagccctccttgattctttagg

SEQ ID NO: 98474 - DNA, 25 bp, mus musculus
tccttgattctttagggtactcctg

SEQ ID NO: 98475 - DNA, 25 bp, mus musculus
caacattggttacccaatgcattct

SEQ ID NO: 98476 - DNA, 25 bp, mus musculus
ttacccaatgcattctcttgtgaag

SEQ ID NO: 98477 - DNA, 25 bp, mus musculus
agccctacgatcagagctgagagcc

SEQ ID NO: 98478 - DNA, 25 bp, mus musculus
atcagagctgagagccctgagaaac

SEQ ID NO: 98479 - DNA, 25 bp, mus musculus
cttctctctgagtgaaaaagttgga

SEQ ID NO: 98480 - DNA, 25 bp, mus musculus
cctgtgctccgaattccagggctct

SEQ ID NO: 98481 - DNA, 25 bp, mus musculus
cgaattccagggctctgtggccact

SEQ ID NO: 98482 - DNA, 25 bp, mus musculus
cactcccaggaatgctgaggaaaac

SEQ ID NO: 98483 - DNA, 25 bp, mus musculus
ggaaaactcggccatccagaaagtg

SEQ ID NO: 98484 - DNA, 25 bp, mus musculus
ctcggccatccagaaagtggccaaa

SEQ ID NO: 98485 - DNA, 25 bp, mus musculus
caacaatgtcctatctggaggcacc

SEQ ID NO: 98486 - DNA, 25 bp, mus musculus
tcctatctggaggcaccaccatgta

SEQ ID NO: 98487 - DNA, 25 bp, mus musculus
gagatgtctctctcttagcctacct

SEQ ID NO: 98488 - DNA, 25 bp, mus musculus
gatgtctctctcttagcctacctta

SEQ ID NO: 98489 - DNA, 25 bp, mus musculus
tctctctcttagcctaccttatatt

SEQ ID NO: 98490 - DNA, 25 bp, mus musculus
tcttagcctaccttatattcaggat

SEQ ID NO: 98491 - DNA, 25 bp, mus musculus
tgaccgtattgtgcttcttggaatc

SEQ ID NO: 98492 - DNA, 25 bp, mus musculus
accgtattgtgcttcttggaatcct

SEQ ID NO: 98493 - DNA, 25 bp, mus musculus
cgtattgtgcttcttggaatcctct

SEQ ID NO: 98494 - DNA, 25 bp, mus musculus
tattgtgcttcttggaatcctctga

SEQ ID NO: 98495 - DNA, 25 bp, mus musculus
gcttcttggaatcctctgagccccc

SEQ ID NO: 98496 - DNA, 25 bp, mus musculus
ccccatctctcatcagtcattgtac

SEQ ID NO: 98497 - DNA, 25 bp, mus musculus
cctggtattgccgatcgtatgcaaa

SEQ ID NO: 98498 - DNA, 25 bp, mus musculus
cccatctctcatcagtcattgtacg

SEQ ID NO: 98499 - DNA, 25 bp, mus musculus
gtattgccgatcgtatgcaaaagga

SEQ ID NO: 98500 - DNA, 25 bp, mus musculus
attgccgatcgtatgcaaaaggaaa

SEQ ID NO: 98501 - DNA, 25 bp, mus musculus
cgtaaatactctgtctggattgggg

SEQ ID NO: 98502 - DNA, 25 bp, mus musculus
taaatactctgtctggattgggggc

SEQ ID NO: 98503 - DNA, 25 bp, mus musculus
ccgcaagtgcttctgagatgtctct

SEQ ID NO: 98504 - DNA, 25 bp, mus musculus
ttctgagatgtctctctcttagcct

SEQ ID NO: 98505 - DNA, 25 bp, mus musculus
ctgagatgtctctctcttagcctac

SEQ ID NO: 98506 - DNA, 25 bp, mus musculus
tcatcgccccatgacaataagtcgt

SEQ ID NO: 98507 - DNA, 25 bp, mus musculus
atgatcgccaccgcagaagaattct

SEQ ID NO: 98508 - DNA, 25 bp, mus musculus
ctcgacctggaggcctggttcccag

SEQ ID NO: 98509 - DNA, 25 bp, mus musculus
ttggtgtcctgttctaattgcacgg

SEQ ID NO: 98510 - DNA, 25 bp, mus musculus
gtgtcctgttctaattgcacggatt

SEQ ID NO: 98511 - DNA, 25 bp, mus musculus
tcctgttctaattgcacggattacc

SEQ ID NO: 98512 - DNA, 25 bp, mus musculus
tctaattgcacggattaccaagctc

SEQ ID NO: 98513 - DNA, 25 bp, mus musculus
aattgcacggattaccaagctcgcc

SEQ ID NO: 98514 - DNA, 25 bp, mus musculus
tgcacggattaccaagctcgccgcc

SEQ ID NO: 98515 - DNA, 25 bp, mus musculus
gattaccaagctcgccgcctgagaa

SEQ ID NO: 98516 - DNA, 25 bp, mus musculus
taccaagctcgccgcctgagaatcc

SEQ ID NO: 98517 - DNA, 25 bp, mus musculus
cgcctgagaatccgatatgggcaga

SEQ ID NO: 98518 - DNA, 25 bp, mus musculus
atcgccaccgcagaagaattctacc

SEQ ID NO: 98519 - DNA, 25 bp, mus musculus
gggatcccttaccacattgtgaata

SEQ ID NO: 98520 - DNA, 25 bp, mus musculus
atcccttaccacattgtgaatatta

SEQ ID NO: 98521 - DNA, 25 bp, mus musculus
ccttaccacattgtgaatattagct

SEQ ID NO: 98522 - DNA, 25 bp, mus musculus
attagctcaggctccttgaatcacg

SEQ ID NO: 98523 - DNA, 25 bp, mus musculus
agctcaggctccttgaatcacgctg

SEQ ID NO: 98524 - DNA, 25 bp, mus musculus
tcaggctccttgaatcacgctgcca

SEQ ID NO: 98525 - DNA, 25 bp, mus musculus
ttgaatcacgctgccagtaagaagc

SEQ ID NO: 98526 - DNA, 25 bp, mus musculus
attgttctacagaaaccatgcccat

SEQ ID NO: 98527 - DNA, 25 bp, mus musculus
tgttctacagaaaccatgcccatca

SEQ ID NO: 98528 - DNA, 25 bp, mus musculus
gatgacaacaacgaccctggagagg

SEQ ID NO: 98529 - DNA, 25 bp, mus musculus
tgacaacaacgaccctggagaggac

SEQ ID NO: 98530 - DNA, 25 bp, mus musculus
ctgtctgtcctcaatcaggctatgg

SEQ ID NO: 98531 - DNA, 25 bp, mus musculus
gtctgtcctcaatcaggctatggca

SEQ ID NO: 98532 - DNA, 25 bp, mus musculus
ctgtcctcaatcaggctatggcagt

SEQ ID NO: 98533 - DNA, 25 bp, mus musculus
gtcctcaatcaggctatggcagtta

SEQ ID NO: 98534 - DNA, 25 bp, mus musculus
cctcaatcaggctatggcagttatc

SEQ ID NO: 98535 - DNA, 25 bp, mus musculus
tcaatcaggctatggcagttatcaa

SEQ ID NO: 98536 - DNA, 25 bp, mus musculus
gagcccaaagtggtcacagatacag

SEQ ID NO: 98537 - DNA, 25 bp, mus musculus
agcccaaagtggtcacagatacaga

SEQ ID NO: 98538 - DNA, 25 bp, mus musculus
ttctacagaaaccatgcccatcaag

SEQ ID NO: 98539 - DNA, 25 bp, mus musculus
ctacagaaaccatgcccatcaagat

SEQ ID NO: 98540 - DNA, 25 bp, mus musculus
acagaaaccatgcccatcaagatta

SEQ ID NO: 98541 - DNA, 25 bp, mus musculus
aaaccatgcccatcaagattaatct

SEQ ID NO: 98542 - DNA, 25 bp, mus musculus
accatgcccatcaagattaatctaa

SEQ ID NO: 98543 - DNA, 25 bp, mus musculus
catgcccatcaagattaatctaata

SEQ ID NO: 98544 - DNA, 25 bp, mus musculus
tgcccatcaagattaatctaatagc

SEQ ID NO: 98545 - DNA, 25 bp, mus musculus
gtgatgacaacaacgaccctggaga

SEQ ID NO: 98546 - DNA, 25 bp, mus musculus
cgagcagctatccgaggggatgccc

SEQ ID NO: 98547 - DNA, 25 bp, mus musculus
gcagctatccgaggggatgcccggc

SEQ ID NO: 98548 - DNA, 25 bp, mus musculus
tacgacatcgccaagcaactgttag

SEQ ID NO: 98549 - DNA, 25 bp, mus musculus
gacatcgccaagcaactgttagccg

SEQ ID NO: 98550 - DNA, 25 bp, mus musculus
aagcaactgttagccgctggtgcag

SEQ ID NO: 98551 - DNA, 25 bp, mus musculus
caactgttagccgctggtgcagagg

SEQ ID NO: 98552 - DNA, 25 bp, mus musculus
ttagccgctggtgcagaggtgaaca

SEQ ID NO: 98553 - DNA, 25 bp, mus musculus
actaagggcctggatgatgacacac

SEQ ID NO: 98554 - DNA, 25 bp, mus musculus
gatgacacacctttgcatgatgccg

SEQ ID NO: 98555 - DNA, 25 bp, mus musculus
cctttgcatgatgccgccaacaacg

SEQ ID NO: 98556 - DNA, 25 bp, mus musculus
ttgcatgatgccgccaacaacgggc

SEQ ID NO: 98557 - DNA, 25 bp, mus musculus
catgatgccgccaacaacgggcact

SEQ ID NO: 98558 - DNA, 25 bp, mus musculus
atccgaggggatgcccggcgcatca

SEQ ID NO: 98559 - DNA, 25 bp, mus musculus
gccgccaacaacgggcactacaagg

SEQ ID NO: 98560 - DNA, 25 bp, mus musculus
cgcatcatggaactcatcagtgagg

SEQ ID NO: 98561 - DNA, 25 bp, mus musculus
aacgtcaaggactttgcaggctgga

SEQ ID NO: 98562 - DNA, 25 bp, mus musculus
gactttgcaggctggactgcactgc

SEQ ID NO: 98563 - DNA, 25 bp, mus musculus
tttgcaggctggactgcactgcacg

SEQ ID NO: 98564 - DNA, 25 bp, mus musculus
tggactgcactgcacgaggcgtgta

SEQ ID NO: 98565 - DNA, 25 bp, mus musculus
tgtaaccggggctattacgacatcg

SEQ ID NO: 98566 - DNA, 25 bp, mus musculus
tattacgacatcgccaagcaactgt

SEQ ID NO: 98567 - DNA, 25 bp, mus musculus
aagacctgccacagtttcatcatta

SEQ ID NO: 98568 - DNA, 25 bp, mus musculus
acctgccacagtttcatcattaatg

SEQ ID NO: 98569 - DNA, 25 bp, mus musculus
tatgactcaatcagtatggagacac

SEQ ID NO: 98570 - DNA, 25 bp, mus musculus
ctggatctacccactgttcactcca

SEQ ID NO: 98571 - DNA, 25 bp, mus musculus
gatctacccactgttcactccatca

SEQ ID NO: 98572 - DNA, 25 bp, mus musculus
gaattgatggcttccctggaccagc

SEQ ID NO: 98573 - DNA, 25 bp, mus musculus
ttgatggcttccctggaccagccga

SEQ ID NO: 98574 - DNA, 25 bp, mus musculus
gcttccctggaccagccgacacaga

SEQ ID NO: 98575 - DNA, 25 bp, mus musculus
tccctggaccagccgacacagactg

SEQ ID NO: 98576 - DNA, 25 bp, mus musculus
gaccagccgacacagactgtggtga

SEQ ID NO: 98577 - DNA, 25 bp, mus musculus
cagccgacacagactgtggtgatgc

SEQ ID NO: 98578 - DNA, 25 bp, mus musculus
ccgacacagactgtggtgatgcacc

SEQ ID NO: 98579 - DNA, 25 bp, mus musculus
cacagtttcatcattaatgaaaaga

SEQ ID NO: 98580 - DNA, 25 bp, mus musculus
gaccttttccctgaggctgacaaag

SEQ ID NO: 98581 - DNA, 25 bp, mus musculus
ttccctgaggctgacaaagttcgca

SEQ ID NO: 98582 - DNA, 25 bp, mus musculus
gacaaagttcgcaccatgctagttc

SEQ ID NO: 98583 - DNA, 25 bp, mus musculus
aaagttcgcaccatgctagttcgga

SEQ ID NO: 98584 - DNA, 25 bp, mus musculus
gttcgcaccatgctagttcggaaga

SEQ ID NO: 98585 - DNA, 25 bp, mus musculus
tacctttttacctacagcagtgtct

SEQ ID NO: 98586 - DNA, 25 bp, mus musculus
gtctatgactcaatcagtatggaga

SEQ ID NO: 98587 - DNA, 25 bp, mus musculus
tggatctacagaggacgaggaagat

SEQ ID NO: 98588 - DNA, 25 bp, mus musculus
ggagaaccctgacaagaatgttgaa

SEQ ID NO: 98589 - DNA, 25 bp, mus musculus
accctgcttgcaattggacaagcac

SEQ ID NO: 98590 - DNA, 25 bp, mus musculus
cctgcttgcaattggacaagcaccc

SEQ ID NO: 98591 - DNA, 25 bp, mus musculus
caattggacaagcaccctatggctg

SEQ ID NO: 98592 - DNA, 25 bp, mus musculus
attggacaagcaccctatggctgga

SEQ ID NO: 98593 - DNA, 25 bp, mus musculus
tggacaagcaccctatggctggatc

SEQ ID NO: 98594 - DNA, 25 bp, mus musculus
caagcaccctatggctggatcagca

SEQ ID NO: 98595 - DNA, 25 bp, mus musculus
agcaccctatggctggatcagcaca

SEQ ID NO: 98596 - DNA, 25 bp, mus musculus
ccctatggctggatcagcacacatg

SEQ ID NO: 98597 - DNA, 25 bp, mus musculus
ctggatcagcacacatggaacggat

SEQ ID NO: 98598 - DNA, 25 bp, mus musculus
ggatcagcacacatggaacggatca

SEQ ID NO: 98599 - DNA, 25 bp, mus musculus
agggtacaatctccaattaggcttg

SEQ ID NO: 98600 - DNA, 25 bp, mus musculus
ggtacaatctccaattaggcttgtg

SEQ ID NO: 98601 - DNA, 25 bp, mus musculus
tacaatctccaattaggcttgtgtc

SEQ ID NO: 98602 - DNA, 25 bp, mus musculus
caatctccaattaggcttgtgtcgt

SEQ ID NO: 98603 - DNA, 25 bp, mus musculus
ctccaattaggcttgtgtcgtcacc

SEQ ID NO: 98604 - DNA, 25 bp, mus musculus
gcttgtgtcgtcaccctgcttgcaa

SEQ ID NO: 98605 - DNA, 25 bp, mus musculus
ttgtgtcgtcaccctgcttgcaatt

SEQ ID NO: 98606 - DNA, 25 bp, mus musculus
gtgtcgtcaccctgcttgcaattgg

SEQ ID NO: 98607 - DNA, 25 bp, mus musculus
ccaatttccatttcttcaaatatca

SEQ ID NO: 98608 - DNA, 25 bp, mus musculus
atttcttcaaatatcagtgtgagtc

SEQ ID NO: 98609 - DNA, 25 bp, mus musculus
tctgcaacagcgtccctcacagtgc

SEQ ID NO: 98610 - DNA, 25 bp, mus musculus
ctcacagtgctccctctggtggaag

SEQ ID NO: 98611 - DNA, 25 bp, mus musculus
gtgctccctctggtggaagaaccac

SEQ ID NO: 98612 - DNA, 25 bp, mus musculus
aatacgagcagtgacgtgagcttgc

SEQ ID NO: 98613 - DNA, 25 bp, mus musculus
cacggaagcgtctcgtctcagtcag

SEQ ID NO: 98614 - DNA, 25 bp, mus musculus
agcgtctcgtctcagtcagtccaaa

SEQ ID NO: 98615 - DNA, 25 bp, mus musculus
gtctcgtctcagtcagtccaaatgt

SEQ ID NO: 98616 - DNA, 25 bp, mus musculus
cagtcagtccaaatgtctgcctcta

SEQ ID NO: 98617 - DNA, 25 bp, mus musculus
tcagtccaaatgtctgcctctaagc

SEQ ID NO: 98618 - DNA, 25 bp, mus musculus
gtccaaatgtctgcctctaagcagg

SEQ ID NO: 98619 - DNA, 25 bp, mus musculus
tcttcaaatatcagtgtgagtcgct

SEQ ID NO: 98620 - DNA, 25 bp, mus musculus
agtcgctccagaaacgtgtacactc

SEQ ID NO: 98621 - DNA, 25 bp, mus musculus
cgctccagaaacgtgtacactcttg

SEQ ID NO: 98622 - DNA, 25 bp, mus musculus
gtgtacactcttgaaatccgaaatg

SEQ ID NO: 98623 - DNA, 25 bp, mus musculus
tacactcttgaaatccgaaatgcgg

SEQ ID NO: 98624 - DNA, 25 bp, mus musculus
gaaatccgaaatgcggctgtaagtg

SEQ ID NO: 98625 - DNA, 25 bp, mus musculus
atccgaaatgcggctgtaagtgaca

SEQ ID NO: 98626 - DNA, 25 bp, mus musculus
gctaagaatttccacggccagtgct

SEQ ID NO: 98627 - DNA, 25 bp, mus musculus
cgctaagcagccagatttagatcat

SEQ ID NO: 98628 - DNA, 25 bp, mus musculus
agatttagatcatgccttggaacgc

SEQ ID NO: 98629 - DNA, 25 bp, mus musculus
ctctggacaaactgtcctgtgtgga

SEQ ID NO: 98630 - DNA, 25 bp, mus musculus
tattcatgaccgtatcaagagggag

SEQ ID NO: 98631 - DNA, 25 bp, mus musculus
tcatgaccgtatcaagagggagtat

SEQ ID NO: 98632 - DNA, 25 bp, mus musculus
ctatctagggcctctgcaggtggca

SEQ ID NO: 98633 - DNA, 25 bp, mus musculus
tctagggcctctgcaggtggcatac

SEQ ID NO: 98634 - DNA, 25 bp, mus musculus
gcctctgcaggtggcataccgggaa

SEQ ID NO: 98635 - DNA, 25 bp, mus musculus
catcttaaactcagttcgcgccaca

SEQ ID NO: 98636 - DNA, 25 bp, mus musculus
cttaaactcagttcgcgccacagac

SEQ ID NO: 98637 - DNA, 25 bp, mus musculus
agttcgcgccacagacaccctcgat

SEQ ID NO: 98638 - DNA, 25 bp, mus musculus
agacaccctcgatagggtgcttgga

SEQ ID NO: 98639 - DNA, 25 bp, mus musculus
tttagatcatgccttggaacgcctt

SEQ ID NO: 98640 - DNA, 25 bp, mus musculus
tcatgccttggaacgccttcagcgc

SEQ ID NO: 98641 - DNA, 25 bp, mus musculus
tgccttggaacgccttcagcgcgaa

SEQ ID NO: 98642 - DNA, 25 bp, mus musculus
cttggaacgccttcagcgcgaagat

SEQ ID NO: 98643 - DNA, 25 bp, mus musculus
agtgaaactcgatcctgactctgga

SEQ ID NO: 98644 - DNA, 25 bp, mus musculus
actcgatcctgactctggacaaact

SEQ ID NO: 98645 - DNA, 25 bp, mus musculus
cgatcctgactctggacaaactgtc

SEQ ID NO: 98646 - DNA, 25 bp, mus musculus
tcctgactctggacaaactgtcctg

SEQ ID NO: 98647 - DNA, 25 bp, mus musculus
tttatcggtatggagtctgcgggga

SEQ ID NO: 98648 - DNA, 25 bp, mus musculus
taccctggtatcgctgaccgcatgc

SEQ ID NO: 98649 - DNA, 25 bp, mus musculus
tctcctcaggacgacaatcgacaat

SEQ ID NO: 98650 - DNA, 25 bp, mus musculus
cctcaggacgacaatcgacaatcgt

SEQ ID NO: 98651 - DNA, 25 bp, mus musculus
gacaatcgacaatcgtgctgtggtt

SEQ ID NO: 98652 - DNA, 25 bp, mus musculus
ccactgcagccggcgcctgtttttg

SEQ ID NO: 98653 - DNA, 25 bp, mus musculus
ctgcagccggcgcctgtttttgacg

SEQ ID NO: 98654 - DNA, 25 bp, mus musculus
gcgcctgtttttgacgtgtacatag

SEQ ID NO: 98655 - DNA, 25 bp, mus musculus
gattgactcgttttacctcattttg

SEQ ID NO: 98656 - DNA, 25 bp, mus musculus
aagcattaaagccagccattctgtt

SEQ ID NO: 98657 - DNA, 25 bp, mus musculus
cattaaagccagccattctgttttg

SEQ ID NO: 98658 - DNA, 25 bp, mus musculus
taaagccagccattctgttttgctc

SEQ ID NO: 98659 - DNA, 25 bp, mus musculus
cctggtatcgctgaccgcatgcaga

SEQ ID NO: 98660 - DNA, 25 bp, mus musculus
gccagccattctgttttgctccaat

SEQ ID NO: 98661 - DNA, 25 bp, mus musculus
ggtatcgctgaccgcatgcagaagg

SEQ ID NO: 98662 - DNA, 25 bp, mus musculus
atcaccaagcaggagtacgacgagg

SEQ ID NO: 98663 - DNA, 25 bp, mus musculus
caccgcaaatgcttctaggcgcacc

SEQ ID NO: 98664 - DNA, 25 bp, mus musculus
cgcaaatgcttctaggcgcaccgca

SEQ ID NO: 98665 - DNA, 25 bp, mus musculus
aaatgcttctaggcgcaccgcatct

SEQ ID NO: 98666 - DNA, 25 bp, mus musculus
ttctaggcgcaccgcatctgcgttc

SEQ ID NO: 98667 - DNA, 25 bp, mus musculus
ctctctcctcaggacgacaatcgac

SEQ ID NO: 98668 - DNA, 25 bp, mus musculus
ggaagaacctactgcggctgcagac

SEQ ID NO: 98669 - DNA, 25 bp, mus musculus
agaacctactgcggctgcagacctg

SEQ ID NO: 98670 - DNA, 25 bp, mus musculus
agctgcacctggaagttaaagccta

SEQ ID NO: 98671 - DNA, 25 bp, mus musculus
gcctaccaacggcaagcttaagaag

SEQ ID NO: 98672 - DNA, 25 bp, mus musculus
cgaagaacaagcccacaaccaactg

SEQ ID NO: 98673 - DNA, 25 bp, mus musculus
acaagcccacaaccaactgttccag

SEQ ID NO: 98674 - DNA, 25 bp, mus musculus
caagcccacaaccaactgttccagt

SEQ ID NO: 98675 - DNA, 25 bp, mus musculus
caaccaactgttccagttccgcaag

SEQ ID NO: 98676 - DNA, 25 bp, mus musculus
caactgttccagttccgcaaggtca

SEQ ID NO: 98677 - DNA, 25 bp, mus musculus
tccagttccgcaaggtcaacaagaa

SEQ ID NO: 98678 - DNA, 25 bp, mus musculus
ttccgcaaggtcaacaagaactcta

SEQ ID NO: 98679 - DNA, 25 bp, mus musculus
gtcaacaagaactctattaagccga

SEQ ID NO: 98680 - DNA, 25 bp, mus musculus
aacctactgcggctgcagacctggt

SEQ ID NO: 98681 - DNA, 25 bp, mus musculus
ctactgcggctgcagacctggtgga

SEQ ID NO: 98682 - DNA, 25 bp, mus musculus
tactgcggctgcagacctggtggac

SEQ ID NO: 98683 - DNA, 25 bp, mus musculus
ctgcggctgcagacctggtggacaa

SEQ ID NO: 98684 - DNA, 25 bp, mus musculus
tgcggctgcagacctggtggacaag

SEQ ID NO: 98685 - DNA, 25 bp, mus musculus
gacaagctgcacctggaagttaaag

SEQ ID NO: 98686 - DNA, 25 bp, mus musculus
acaagctgcacctggaagttaaagc

SEQ ID NO: 98687 - DNA, 25 bp, mus musculus
caagctgcacctggaagttaaagcc

SEQ ID NO: 98688 - DNA, 25 bp, mus musculus
tttagtccatggccaggcaagggtt

SEQ ID NO: 98689 - DNA, 25 bp, mus musculus
ggttccttcctgaacgtctgcttag

SEQ ID NO: 98690 - DNA, 25 bp, mus musculus
gccatctatgaccagagatctcttc

SEQ ID NO: 98691 - DNA, 25 bp, mus musculus
atctatgaccagagatctcttcccc

SEQ ID NO: 98692 - DNA, 25 bp, mus musculus
cagagatctcttccccatagagtta

SEQ ID NO: 98693 - DNA, 25 bp, mus musculus
agatctcttccccatagagttacag

SEQ ID NO: 98694 - DNA, 25 bp, mus musculus
tctcttccccatagagttacaggcg

SEQ ID NO: 98695 - DNA, 25 bp, mus musculus
tccccatctctccagggtagcaatt

SEQ ID NO: 98696 - DNA, 25 bp, mus musculus
ccatctctccagggtagcaatttgg

SEQ ID NO: 98697 - DNA, 25 bp, mus musculus
tctctccagggtagcaatttgggac

SEQ ID NO: 98698 - DNA, 25 bp, mus musculus
gcataccccatttcctgaaagtgag

SEQ ID NO: 98699 - DNA, 25 bp, mus musculus
cccatttcctgaaagtgaggtatca

SEQ ID NO: 98700 - DNA, 25 bp, mus musculus
tccttcctgaacgtctgcttagtca

SEQ ID NO: 98701 - DNA, 25 bp, mus musculus
ctgaacgtctgcttagtcaccatct

SEQ ID NO: 98702 - DNA, 25 bp, mus musculus
gtctgcttagtcaccatctcattag

SEQ ID NO: 98703 - DNA, 25 bp, mus musculus
ttagtcaccatctcattaggactgt

SEQ ID NO: 98704 - DNA, 25 bp, mus musculus
gtcaccatctcattaggactgtgca

SEQ ID NO: 98705 - DNA, 25 bp, mus musculus
accatctcattaggactgtgcatta

SEQ ID NO: 98706 - DNA, 25 bp, mus musculus
tgcattacaacggccatctatgacc

SEQ ID NO: 98707 - DNA, 25 bp, mus musculus
attacaacggccatctatgaccaga

SEQ ID NO: 98708 - DNA, 25 bp, mus musculus
gcagtgttcctgcttgggctgattg

SEQ ID NO: 98709 - DNA, 25 bp, mus musculus
gtgttcctgcttgggctgattgtct

SEQ ID NO: 98710 - DNA, 25 bp, mus musculus
cctggcaatgaggcctcaagagaga

SEQ ID NO: 98711 - DNA, 25 bp, mus musculus
gagagtctccattctcaaccctagt

SEQ ID NO: 98712 - DNA, 25 bp, mus musculus
agtctccattctcaaccctagtaag

SEQ ID NO: 98713 - DNA, 25 bp, mus musculus
ctccattctcaaccctagtaagatc

SEQ ID NO: 98714 - DNA, 25 bp, mus musculus
cattctcaaccctagtaagatccta

SEQ ID NO: 98715 - DNA, 25 bp, mus musculus
tctcaaccctagtaagatcctaatg

SEQ ID NO: 98716 - DNA, 25 bp, mus musculus
tcccccagagcctgaagaagtgtga

SEQ ID NO: 98717 - DNA, 25 bp, mus musculus
aaaggatgctggctcttcagtctgt

SEQ ID NO: 98718 - DNA, 25 bp, mus musculus
ctcttcagtctgtgagatgtggtca

SEQ ID NO: 98719 - DNA, 25 bp, mus musculus
ttcagtctgtgagatgtggtcatgg

SEQ ID NO: 98720 - DNA, 25 bp, mus musculus
ttcctgcttgggctgattgtcttcc

SEQ ID NO: 98721 - DNA, 25 bp, mus musculus
ctgcttgggctgattgtcttcctgg

SEQ ID NO: 98722 - DNA, 25 bp, mus musculus
gttgttatccatctcaaggctcaga

SEQ ID NO: 98723 - DNA, 25 bp, mus musculus
gttatccatctcaaggctcagaaag

SEQ ID NO: 98724 - DNA, 25 bp, mus musculus
atccatctcaaggctcagaaagcat

SEQ ID NO: 98725 - DNA, 25 bp, mus musculus
catctcaaggctcagaaagcatctg

SEQ ID NO: 98726 - DNA, 25 bp, mus musculus
tctgtggagactcagcctggcaatg

SEQ ID NO: 98727 - DNA, 25 bp, mus musculus
gagactcagcctggcaatgaggcct

SEQ ID NO: 98728 - DNA, 25 bp, mus musculus
tgggtccttaaacacctgcacgcat

SEQ ID NO: 98729 - DNA, 25 bp, mus musculus
cttaaacacctgcacgcatcttcct

SEQ ID NO: 98730 - DNA, 25 bp, mus musculus
agaaccctggtctacggcagaatgt

SEQ ID NO: 98731 - DNA, 25 bp, mus musculus
accctggtctacggcagaatgtgtt

SEQ ID NO: 98732 - DNA, 25 bp, mus musculus
gtctacggcagaatgtgttgtgtgg

SEQ ID NO: 98733 - DNA, 25 bp, mus musculus
gtggtgccattacaccccagcagat

SEQ ID NO: 98734 - DNA, 25 bp, mus musculus
gtgccattacaccccagcagatagc

SEQ ID NO: 98735 - DNA, 25 bp, mus musculus
ttacaccccagcagatagctgtgat

SEQ ID NO: 98736 - DNA, 25 bp, mus musculus
caccccagcagatagctgtgatgac

SEQ ID NO: 98737 - DNA, 25 bp, mus musculus
agattcgcaaggccatgactaagga

SEQ ID NO: 98738 - DNA, 25 bp, mus musculus
ttcgcaaggccatgactaaggaggc

SEQ ID NO: 98739 - DNA, 25 bp, mus musculus
accagatggcccgtacaggtggcac

SEQ ID NO: 98740 - DNA, 25 bp, mus musculus
cacctgcacgcatcttcctggacgt

SEQ ID NO: 98741 - DNA, 25 bp, mus musculus
cacgcatcttcctggacgtgggaaa

SEQ ID NO: 98742 - DNA, 25 bp, mus musculus
gcatcttcctggacgtgggaaatac

SEQ ID NO: 98743 - DNA, 25 bp, mus musculus
ggacgcgaatctctaacctgaaaga

SEQ ID NO: 98744 - DNA, 25 bp, mus musculus
cgcgaatctctaacctgaaagatgc

SEQ ID NO: 98745 - DNA, 25 bp, mus musculus
gaatctctaacctgaaagatgccaa

SEQ ID NO: 98746 - DNA, 25 bp, mus musculus
tctctaacctgaaagatgccaagaa

SEQ ID NO: 98747 - DNA, 25 bp, mus musculus
aagatgccaagaaccctggtctacg

SEQ ID NO: 98748 - DNA, 25 bp, mus musculus
tccataaagcccatcctgcaggtca

SEQ ID NO: 98749 - DNA, 25 bp, mus musculus
aagcccatcctgcaggtcattaaca

SEQ ID NO: 98750 - DNA, 25 bp, mus musculus
gaacacgctttcctcggtccagctt

SEQ ID NO: 98751 - DNA, 25 bp, mus musculus
cacgctttcctcggtccagcttggc

SEQ ID NO: 98752 - DNA, 25 bp, mus musculus
ccagcaagctggaccaccttggtga

SEQ ID NO: 98753 - DNA, 25 bp, mus musculus
gcaagctggaccaccttggtgaagg

SEQ ID NO: 98754 - DNA, 25 bp, mus musculus
agctggaccaccttggtgaaggaag

SEQ ID NO: 98755 - DNA, 25 bp, mus musculus
tggaccaccttggtgaaggaaggca

SEQ ID NO: 98756 - DNA, 25 bp, mus musculus
attgtgtctgcaaggtccagaggtt

SEQ ID NO: 98757 - DNA, 25 bp, mus musculus
ggttcatggtcacaaccctgaagga

SEQ ID NO: 98758 - DNA, 25 bp, mus musculus
tcatggtcacaaccctgaaggacgg

SEQ ID NO: 98759 - DNA, 25 bp, mus musculus
tggtcacaaccctgaaggacggaag

SEQ ID NO: 98760 - DNA, 25 bp, mus musculus
cccatcctgcaggtcattaacatcc

SEQ ID NO: 98761 - DNA, 25 bp, mus musculus
caggtcattaacatccgtcccattt

SEQ ID NO: 98762 - DNA, 25 bp, mus musculus
gtcattaacatccgtcccatttcta

SEQ ID NO: 98763 - DNA, 25 bp, mus musculus
aggtcacccggtaccgactgctcat

SEQ ID NO: 98764 - DNA, 25 bp, mus musculus
tcacccggtaccgactgctcatgag

SEQ ID NO: 98765 - DNA, 25 bp, mus musculus
cccggtaccgactgctcatgagtga

SEQ ID NO: 98766 - DNA, 25 bp, mus musculus
ggtaccgactgctcatgagtgatgg

SEQ ID NO: 98767 - DNA, 25 bp, mus musculus
gactgctcatgagtgatggttgaac

SEQ ID NO: 98768 - DNA, 25 bp, mus musculus
tcgagaaacaaaccctcatcaccca

SEQ ID NO: 98769 - DNA, 25 bp, mus musculus
cccaccagcttggattgcatcagct

SEQ ID NO: 98770 - DNA, 25 bp, mus musculus
agctaggttacagcctggggacaca

SEQ ID NO: 98771 - DNA, 25 bp, mus musculus
gttacagcctggggacacagccaag

SEQ ID NO: 98772 - DNA, 25 bp, mus musculus
acagcctggggacacagccaaggct

SEQ ID NO: 98773 - DNA, 25 bp, mus musculus
agccaaggctgtggtggcacaagct

SEQ ID NO: 98774 - DNA, 25 bp, mus musculus
caaggctgtggtggcacaagctgtc

SEQ ID NO: 98775 - DNA, 25 bp, mus musculus
acaagctgtccgtcatctcccgcag

SEQ ID NO: 98776 - DNA, 25 bp, mus musculus
agctgtccgtcatctcccgcagtct

SEQ ID NO: 98777 - DNA, 25 bp, mus musculus
tcatctcccgcagtctgttaggatt

SEQ ID NO: 98778 - DNA, 25 bp, mus musculus
catcagagcagcagagctagaaaca

SEQ ID NO: 98779 - DNA, 25 bp, mus musculus
aacagacattcgagcaaagaagcgt

SEQ ID NO: 98780 - DNA, 25 bp, mus musculus
accagcttggattgcatcagctcgc

SEQ ID NO: 98781 - DNA, 25 bp, mus musculus
ttggattgcatcagctcgcctggaa

SEQ ID NO: 98782 - DNA, 25 bp, mus musculus
gattgcatcagctcgcctggaagaa

SEQ ID NO: 98783 - DNA, 25 bp, mus musculus
tgcatcagctcgcctggaagaagtc

SEQ ID NO: 98784 - DNA, 25 bp, mus musculus
atcagctcgcctggaagaagtcact

SEQ ID NO: 98785 - DNA, 25 bp, mus musculus
agagatgtgccccaagagtgaagat

SEQ ID NO: 98786 - DNA, 25 bp, mus musculus
gatgtgccccaagagtgaagatgtc

SEQ ID NO: 98787 - DNA, 25 bp, mus musculus
agcagctaggttacagcctggggac

SEQ ID NO: 98788 - DNA, 25 bp, mus musculus
gaattatgtgcaccggatcggcaga

SEQ ID NO: 98789 - DNA, 25 bp, mus musculus
attatgtgcaccggatcggcagagt

SEQ ID NO: 98790 - DNA, 25 bp, mus musculus
ataacactagactcaaggaagatgg

SEQ ID NO: 98791 - DNA, 25 bp, mus musculus
taacactagactcaaggaagatggc

SEQ ID NO: 98792 - DNA, 25 bp, mus musculus
atggcggctgtactatctggtacaa

SEQ ID NO: 98793 - DNA, 25 bp, mus musculus
aaatgcagctactttccgagataga

SEQ ID NO: 98794 - DNA, 25 bp, mus musculus
aatgcagctactttccgagatagaa

SEQ ID NO: 98795 - DNA, 25 bp, mus musculus
atgcagctactttccgagatagaag

SEQ ID NO: 98796 - DNA, 25 bp, mus musculus
tgcagctactttccgagatagaaga

SEQ ID NO: 98797 - DNA, 25 bp, mus musculus
gcagctactttccgagatagaagag

SEQ ID NO: 98798 - DNA, 25 bp, mus musculus
cagctactttccgagatagaagagc

SEQ ID NO: 98799 - DNA, 25 bp, mus musculus
agctactttccgagatagaagagca

SEQ ID NO: 98800 - DNA, 25 bp, mus musculus
ttatgtgcaccggatcggcagagtg

SEQ ID NO: 98801 - DNA, 25 bp, mus musculus
gctactttccgagatagaagagcac

SEQ ID NO: 98802 - DNA, 25 bp, mus musculus
tgggcctggctatttccctggtggc

SEQ ID NO: 98803 - DNA, 25 bp, mus musculus
gggcctggctatttccctggtggca

SEQ ID NO: 98804 - DNA, 25 bp, mus musculus
tggctatttccctggtggcaaccga

SEQ ID NO: 98805 - DNA, 25 bp, mus musculus
ggctatttccctggtggcaaccgag

SEQ ID NO: 98806 - DNA, 25 bp, mus musculus
atgctataacactagactcaaggaa

SEQ ID NO: 98807 - DNA, 25 bp, mus musculus
gctataacactagactcaaggaaga

SEQ ID NO: 98808 - DNA, 25 bp, mus musculus
ctataacactagactcaaggaagat

SEQ ID NO: 98809 - DNA, 25 bp, mus musculus
cttacgctgtttcttcagattaact

SEQ ID NO: 98810 - DNA, 25 bp, mus musculus
tacgctgtttcttcagattaactac

SEQ ID NO: 98811 - DNA, 25 bp, mus musculus
gcagaacctatgcttcaggcatcct

SEQ ID NO: 98812 - DNA, 25 bp, mus musculus
cctatgcttcaggcatcctatagaa

SEQ ID NO: 98813 - DNA, 25 bp, mus musculus
tatgcttcaggcatcctatagaaga

SEQ ID NO: 98814 - DNA, 25 bp, mus musculus
tgcttcaggcatcctatagaagaag

SEQ ID NO: 98815 - DNA, 25 bp, mus musculus
gattattcttcaggggatctggata

SEQ ID NO: 98816 - DNA, 25 bp, mus musculus
ttattcttcaggggatctggataaa

SEQ ID NO: 98817 - DNA, 25 bp, mus musculus
ggatggaccttcctccgaagtgcct

SEQ ID NO: 98818 - DNA, 25 bp, mus musculus
atggaccttcctccgaagtgcctgg

SEQ ID NO: 98819 - DNA, 25 bp, mus musculus
tgcctggtaatccccagatttgagg

SEQ ID NO: 98820 - DNA, 25 bp, mus musculus
cctggtaatccccagatttgaggag

SEQ ID NO: 98821 - DNA, 25 bp, mus musculus
gtttcttcagattaactactgtctg

SEQ ID NO: 98822 - DNA, 25 bp, mus musculus
ttcttcagattaactactgtctgta

SEQ ID NO: 98823 - DNA, 25 bp, mus musculus
actactgtctgtagtgggttttcag

SEQ ID NO: 98824 - DNA, 25 bp, mus musculus
tactgtctgtagtgggttttcagtg

SEQ ID NO: 98825 - DNA, 25 bp, mus musculus
ggttttcagtggatgtggtggcatc

SEQ ID NO: 98826 - DNA, 25 bp, mus musculus
gcatcagcagaacctatgcttcagg

SEQ ID NO: 98827 - DNA, 25 bp, mus musculus
atcagcagaacctatgcttcaggca

SEQ ID NO: 98828 - DNA, 25 bp, mus musculus
cagcagaacctatgcttcaggcatc

SEQ ID NO: 98829 - DNA, 25 bp, mus musculus
caaatcttccagtatgatgcctttc

SEQ ID NO: 98830 - DNA, 25 bp, mus musculus
tatgatgcctttcccctttgggctt

SEQ ID NO: 98831 - DNA, 25 bp, mus musculus
catgtctctctattcattctatgga

SEQ ID NO: 98832 - DNA, 25 bp, mus musculus
ttcattctatggagcctctgtttta

SEQ ID NO: 98833 - DNA, 25 bp, mus musculus
tgttttacctaaaggcttgactgct

SEQ ID NO: 98834 - DNA, 25 bp, mus musculus
aggcttgactgctattttagagtag

SEQ ID NO: 98835 - DNA, 25 bp, mus musculus
acaccatatagaggccaatgattca

SEQ ID NO: 98836 - DNA, 25 bp, mus musculus
ggccaatgattcatcttgagttgtc

SEQ ID NO: 98837 - DNA, 25 bp, mus musculus
agttgtctactgcatattagatagc

SEQ ID NO: 98838 - DNA, 25 bp, mus musculus
agatagcatagcatccttccttaag

SEQ ID NO: 98839 - DNA, 25 bp, mus musculus
gctaacctttcctagacagattctt

SEQ ID NO: 98840 - DNA, 25 bp, mus musculus
tttttctaaattccagttgcatcat

SEQ ID NO: 98841 - DNA, 25 bp, mus musculus
tgggcttactttccacaggatatgc

SEQ ID NO: 98842 - DNA, 25 bp, mus musculus
gctgtccttaacaccttcaagccca

SEQ ID NO: 98843 - DNA, 25 bp, mus musculus
cttaacaccttcaagcccattgtct

SEQ ID NO: 98844 - DNA, 25 bp, mus musculus
accttcaagcccattgtctccaagg

SEQ ID NO: 98845 - DNA, 25 bp, mus musculus
attaagacatctctcaggaactcca

SEQ ID NO: 98846 - DNA, 25 bp, mus musculus
acatctctcaggaactccacagtta

SEQ ID NO: 98847 - DNA, 25 bp, mus musculus
ctcaggaactccacagttataacat

SEQ ID NO: 98848 - DNA, 25 bp, mus musculus
ataacatttgatgtgactggaccct

SEQ ID NO: 98849 - DNA, 25 bp, mus musculus
aatcttcatatcaataaatcttaat

SEQ ID NO: 98850 - DNA, 25 bp, mus musculus
cttcatatcaataaatcttaatcat

SEQ ID NO: 98851 - DNA, 25 bp, mus musculus
atccttgtctctgattcataaaaat

SEQ ID NO: 98852 - DNA, 25 bp, mus musculus
atgaagtctagctttcaccatttct

SEQ ID NO: 98853 - DNA, 25 bp, mus musculus
tctagctttcaccatttctttagaa

SEQ ID NO: 98854 - DNA, 25 bp, mus musculus
agctttcaccatttctttagaaatg

SEQ ID NO: 98855 - DNA, 25 bp, mus musculus
tttcaccatttctttagaaatgcat

SEQ ID NO: 98856 - DNA, 25 bp, mus musculus
taatagcaaacgtacctcacaacac

SEQ ID NO: 98857 - DNA, 25 bp, mus musculus
tagcaaacgtacctcacaacacaaa

SEQ ID NO: 98858 - DNA, 25 bp, mus musculus
gatttactgtggcacaggaagcccc

SEQ ID NO: 98859 - DNA, 25 bp, mus musculus
acccaaagtagtttctctgagatgt

SEQ ID NO: 98860 - DNA, 25 bp, mus musculus
agtttctctgagatgtttgacattg

SEQ ID NO: 98861 - DNA, 25 bp, mus musculus
atcaataaatcttaatcatacttca

SEQ ID NO: 98862 - DNA, 25 bp, mus musculus
tcttaatcatacttcaaacgtctat

SEQ ID NO: 98863 - DNA, 25 bp, mus musculus
tcatacttcaaacgtctatctaagc

SEQ ID NO: 98864 - DNA, 25 bp, mus musculus
tacttcaaacgtctatctaagcata

SEQ ID NO: 98865 - DNA, 25 bp, mus musculus
ttcaaacgtctatctaagcatatcc

SEQ ID NO: 98866 - DNA, 25 bp, mus musculus
aaacgtctatctaagcatatccttg

SEQ ID NO: 98867 - DNA, 25 bp, mus musculus
ctatctaagcatatccttgtctctg

SEQ ID NO: 98868 - DNA, 25 bp, mus musculus
catatccttgtctctgattcataaa

SEQ ID NO: 98869 - DNA, 25 bp, mus musculus
tctatggtgaccaccagaggttcgt

SEQ ID NO: 98870 - DNA, 25 bp, mus musculus
atggtgaccaccagaggttcgtaga

SEQ ID NO: 98871 - DNA, 25 bp, mus musculus
gtggtcatcgcctggggactgcaga

SEQ ID NO: 98872 - DNA, 25 bp, mus musculus
atcgcctggggactgcagagattga

SEQ ID NO: 98873 - DNA, 25 bp, mus musculus
caatggctgaccatcccgctgttcc

SEQ ID NO: 98874 - DNA, 25 bp, mus musculus
accatcccgctgttccagagactgc

SEQ ID NO: 98875 - DNA, 25 bp, mus musculus
ctgttccagagactgctgtcattgg

SEQ ID NO: 98876 - DNA, 25 bp, mus musculus
ttccagagactgctgtcattgggta

SEQ ID NO: 98877 - DNA, 25 bp, mus musculus
cagagactgctgtcattgggtaccc

SEQ ID NO: 98878 - DNA, 25 bp, mus musculus
ctgctgtcattgggtaccctcatga

SEQ ID NO: 98879 - DNA, 25 bp, mus musculus
ctgtcattgggtaccctcatgatat

SEQ ID NO: 98880 - DNA, 25 bp, mus musculus
tcattgggtaccctcatgatatcaa

SEQ ID NO: 98881 - DNA, 25 bp, mus musculus
tagatgcctacttcagagcgtaccc

SEQ ID NO: 98882 - DNA, 25 bp, mus musculus
ggtaccctcatgatatcaaaggaga

SEQ ID NO: 98883 - DNA, 25 bp, mus musculus
atgcctacttcagagcgtacccagg

SEQ ID NO: 98884 - DNA, 25 bp, mus musculus
caggttattacttcactggagacgg

SEQ ID NO: 98885 - DNA, 25 bp, mus musculus
attacttcactggagacggagctca

SEQ ID NO: 98886 - DNA, 25 bp, mus musculus
accagatcacggggcgcatggatga

SEQ ID NO: 98887 - DNA, 25 bp, mus musculus
agatcacggggcgcatggatgatgt

SEQ ID NO: 98888 - DNA, 25 bp, mus musculus
atgtcatcaatatcagtggtcatcg

SEQ ID NO: 98889 - DNA, 25 bp, mus musculus
atatcagtggtcatcgcctggggac

SEQ ID NO: 98890 - DNA, 25 bp, mus musculus
cttcggacttcagagcactttatgt

SEQ ID NO: 98891 - DNA, 25 bp, mus musculus
acttcagagcactttatgtagttga

SEQ ID NO: 98892 - DNA, 25 bp, mus musculus
aatctgtttgtcttacacgtctctc

SEQ ID NO: 98893 - DNA, 25 bp, mus musculus
tttgtcttacacgtctctcagggaa

SEQ ID NO: 98894 - DNA, 25 bp, mus musculus
atgcagtcttcaagcatcttccatg

SEQ ID NO: 98895 - DNA, 25 bp, mus musculus
agcatcttccatgtacattctatct

SEQ ID NO: 98896 - DNA, 25 bp, mus musculus
ttccatgtacattctatctgggtga

SEQ ID NO: 98897 - DNA, 25 bp, mus musculus
gtacattctatctgggtgaacacct

SEQ ID NO: 98898 - DNA, 25 bp, mus musculus
tctatctgggtgaacaccttcattc

SEQ ID NO: 98899 - DNA, 25 bp, mus musculus
aacaccttcattctggtagagcacc

SEQ ID NO: 98900 - DNA, 25 bp, mus musculus
ttcattctggtagagcacctaacac

SEQ ID NO: 98901 - DNA, 25 bp, mus musculus
gagcacctaacactttaacagctgt

SEQ ID NO: 98902 - DNA, 25 bp, mus musculus
ggttagcctctcataacccagccat

SEQ ID NO: 98903 - DNA, 25 bp, mus musculus
cctctcataacccagccatggaagt

SEQ ID NO: 98904 - DNA, 25 bp, mus musculus
ttactaggagcctgacttcccagct

SEQ ID NO: 98905 - DNA, 25 bp, mus musculus
aggtccagggccatgaagacttgga

SEQ ID NO: 98906 - DNA, 25 bp, mus musculus
gcatgtggtctgagtgctgactaga

SEQ ID NO: 98907 - DNA, 25 bp, mus musculus
agttgaggcacatccttcagagaag

SEQ ID NO: 98908 - DNA, 25 bp, mus musculus
ggcacatccttcagagaagagggag

SEQ ID NO: 98909 - DNA, 25 bp, mus musculus
ggctctcagcaaaatctgtttgtct

SEQ ID NO: 98910 - DNA, 25 bp, mus musculus
gaattatgccaaagcagtggaacta

SEQ ID NO: 98911 - DNA, 25 bp, mus musculus
attatgccaaagcagtggaactact

SEQ ID NO: 98912 - DNA, 25 bp, mus musculus
ccattaagatccccaacaggcgtgt

SEQ ID NO: 98913 - DNA, 25 bp, mus musculus
cattaagatccccaacaggcgtgtt

SEQ ID NO: 98914 - DNA, 25 bp, mus musculus
taagatccccaacaggcgtgttaat

SEQ ID NO: 98915 - DNA, 25 bp, mus musculus
aagatccccaacaggcgtgttaatg

SEQ ID NO: 98916 - DNA, 25 bp, mus musculus
agatccccaacaggcgtgttaatgc

SEQ ID NO: 98917 - DNA, 25 bp, mus musculus
gatccccaacaggcgtgttaatgca

SEQ ID NO: 98918 - DNA, 25 bp, mus musculus
atccccaacaggcgtgttaatgcaa

SEQ ID NO: 98919 - DNA, 25 bp, mus musculus
tccccaacaggcgtgttaatgcaat

SEQ ID NO: 98920 - DNA, 25 bp, mus musculus
ccccaacaggcgtgttaatgcaatg

SEQ ID NO: 98921 - DNA, 25 bp, mus musculus
cccaacaggcgtgttaatgcaatgg

SEQ ID NO: 98922 - DNA, 25 bp, mus musculus
ggaactggcttccctgcagacttcc

SEQ ID NO: 98923 - DNA, 25 bp, mus musculus
aactggcttccctgcagacttccct

SEQ ID NO: 98924 - DNA, 25 bp, mus musculus
cttccctgcagacttcccttgttag

SEQ ID NO: 98925 - DNA, 25 bp, mus musculus
ttccctgcagacttcccttgttaga

SEQ ID NO: 98926 - DNA, 25 bp, mus musculus
tccctgcagacttcccttgttagac

SEQ ID NO: 98927 - DNA, 25 bp, mus musculus
gaagccattaagatccccaacaggc

SEQ ID NO: 98928 - DNA, 25 bp, mus musculus
aagccattaagatccccaacaggcg

SEQ ID NO: 98929 - DNA, 25 bp, mus musculus
agccattaagatccccaacaggcgt

SEQ ID NO: 98930 - DNA, 25 bp, mus musculus
tcgggacagccacgagcttctgctc

SEQ ID NO: 98931 - DNA, 25 bp, mus musculus
ggacagccacgagcttctgctcctg

SEQ ID NO: 98932 - DNA, 25 bp, mus musculus
ctacggagcctcagcctaaggaggg

SEQ ID NO: 98933 - DNA, 25 bp, mus musculus
tagcaatcttcagttatgaggctgc

SEQ ID NO: 98934 - DNA, 25 bp, mus musculus
caatcttcagttatgaggctgccca

SEQ ID NO: 98935 - DNA, 25 bp, mus musculus
tcagttatgaggctgcccagccaga

SEQ ID NO: 98936 - DNA, 25 bp, mus musculus
atgaggctgcccagccagaagacct

SEQ ID NO: 98937 - DNA, 25 bp, mus musculus
aggctgcccagccagaagacctgga

SEQ ID NO: 98938 - DNA, 25 bp, mus musculus
ctgcccagccagaagacctggaatt

SEQ ID NO: 98939 - DNA, 25 bp, mus musculus
cccagccagaagacctggaatttgt

SEQ ID NO: 98940 - DNA, 25 bp, mus musculus
atgtaatcctggtactgtcacatgt

SEQ ID NO: 98941 - DNA, 25 bp, mus musculus
taatcctggtactgtcacatgtgaa

SEQ ID NO: 98942 - DNA, 25 bp, mus musculus
tctgctcctgtccgaagaaagcatg

SEQ ID NO: 98943 - DNA, 25 bp, mus musculus
tcctggtactgtcacatgtgaatga

SEQ ID NO: 98944 - DNA, 25 bp, mus musculus
gctcctgtccgaagaaagcatgaag

SEQ ID NO: 98945 - DNA, 25 bp, mus musculus
actactgcctgactctgtggtgtga

SEQ ID NO: 98946 - DNA, 25 bp, mus musculus
ttattgatgaacccatacaaaggga

SEQ ID NO: 98947 - DNA, 25 bp, mus musculus
gggaaaactcagacgccagtaagca

SEQ ID NO: 98948 - DNA, 25 bp, mus musculus
actcagacgccagtaagcagactac

SEQ ID NO: 98949 - DNA, 25 bp, mus musculus
agcagactacggagcctcagcctaa

SEQ ID NO: 98950 - DNA, 25 bp, mus musculus
agactacggagcctcagcctaagga

SEQ ID NO: 98951 - DNA, 25 bp, mus musculus
tcccatcctcagaacgcctaaatct

SEQ ID NO: 98952 - DNA, 25 bp, mus musculus
ccatcctcagaacgcctaaatctca

SEQ ID NO: 98953 - DNA, 25 bp, mus musculus
aatctcaagcgtctccattctatcc

SEQ ID NO: 98954 - DNA, 25 bp, mus musculus
atctcaagcgtctccattctatcca

SEQ ID NO: 98955 - DNA, 25 bp, mus musculus
attctatccaacactggctagttcg

SEQ ID NO: 98956 - DNA, 25 bp, mus musculus
tctatccaacactggctagttcgag

SEQ ID NO: 98957 - DNA, 25 bp, mus musculus
atccaacactggctagttcgagtta

SEQ ID NO: 98958 - DNA, 25 bp, mus musculus
tccaacactggctagttcgagttat

SEQ ID NO: 98959 - DNA, 25 bp, mus musculus
caacactggctagttcgagttatta

SEQ ID NO: 98960 - DNA, 25 bp, mus musculus
aacactggctagttcgagttattat

SEQ ID NO: 98961 - DNA, 25 bp, mus musculus
ataatgctaatccacacaccaaaat

SEQ ID NO: 98962 - DNA, 25 bp, mus musculus
taatgctaatccacacaccaaaatc

SEQ ID NO: 98963 - DNA, 25 bp, mus musculus
tcctcagaacgcctaaatctcaagc

SEQ ID NO: 98964 - DNA, 25 bp, mus musculus
aatgctaatccacacaccaaaatcg

SEQ ID NO: 98965 - DNA, 25 bp, mus musculus
cctcagaacgcctaaatctcaagcg

SEQ ID NO: 98966 - DNA, 25 bp, mus musculus
tcagaacgcctaaatctcaagcgtc

SEQ ID NO: 98967 - DNA, 25 bp, mus musculus
cagaacgcctaaatctcaagcgtct

SEQ ID NO: 98968 - DNA, 25 bp, mus musculus
aacgcctaaatctcaagcgtctcca

SEQ ID NO: 98969 - DNA, 25 bp, mus musculus
cgcctaaatctcaagcgtctccatt

SEQ ID NO: 98970 - DNA, 25 bp, mus musculus
ctaaatctcaagcgtctccattcta

SEQ ID NO: 98971 - DNA, 25 bp, mus musculus
taaatctcaagcgtctccattctat

SEQ ID NO: 98972 - DNA, 25 bp, mus musculus
tctacgtaaaccttgtcccacatct

SEQ ID NO: 98973 - DNA, 25 bp, mus musculus
cacatctccctgtgttgaagtcttt

SEQ ID NO: 98974 - DNA, 25 bp, mus musculus
atgttcagccattcagatcagacaa

SEQ ID NO: 98975 - DNA, 25 bp, mus musculus
agccattcagatcagacaagcagct

SEQ ID NO: 98976 - DNA, 25 bp, mus musculus
agacatcatgtcaggactgcactgg

SEQ ID NO: 98977 - DNA, 25 bp, mus musculus
catgtcaggactgcactggatggta

SEQ ID NO: 98978 - DNA, 25 bp, mus musculus
ggcaggcttaacccatctgtgctcc

SEQ ID NO: 98979 - DNA, 25 bp, mus musculus
cttaacccatctgtgctcccataat

SEQ ID NO: 98980 - DNA, 25 bp, mus musculus
ccatctgtgctcccataatccatta

SEQ ID NO: 98981 - DNA, 25 bp, mus musculus
gtgctcccataatccattattgact

SEQ ID NO: 98982 - DNA, 25 bp, mus musculus
ccataatccattattgactacacag

SEQ ID NO: 98983 - DNA, 25 bp, mus musculus
tccattattgactacacagagaact

SEQ ID NO: 98984 - DNA, 25 bp, mus musculus
atgacgcatgttgcccagggacatt

SEQ ID NO: 98985 - DNA, 25 bp, mus musculus
ttgactacacagagaactggaattc

SEQ ID NO: 98986 - DNA, 25 bp, mus musculus
catgttgcccagggacattggggtc

SEQ ID NO: 98987 - DNA, 25 bp, mus musculus
cattgctcagggttcttagtctcag

SEQ ID NO: 98988 - DNA, 25 bp, mus musculus
ttcttagtctcagtggtaagacagt

SEQ ID NO: 98989 - DNA, 25 bp, mus musculus
tttacttgagcttacaggcaaaact

SEQ ID NO: 98990 - DNA, 25 bp, mus musculus
tgagcttacaggcaaaactgagcta

SEQ ID NO: 98991 - DNA, 25 bp, mus musculus
atttgagccaacatgttcagccatt

SEQ ID NO: 98992 - DNA, 25 bp, mus musculus
gccaacatgttcagccattcagatc

SEQ ID NO: 98993 - DNA, 25 bp, mus musculus
cagctccaggagacgctgctgcggg

SEQ ID NO: 98994 - DNA, 25 bp, mus musculus
gctcttcgggctctggtgctgaaga

SEQ ID NO: 98995 - DNA, 25 bp, mus musculus
accctgaacaacatgcattccgaga

SEQ ID NO: 98996 - DNA, 25 bp, mus musculus
cctgaacaacatgcattccgagaag

SEQ ID NO: 98997 - DNA, 25 bp, mus musculus
tgaacaacatgcattccgagaagct

SEQ ID NO: 98998 - DNA, 25 bp, mus musculus
atgcattccgagaagctgctgtcct

SEQ ID NO: 98999 - DNA, 25 bp, mus musculus
gcattccgagaagctgctgtccttc

SEQ ID NO: 99000 - DNA, 25 bp, mus musculus
attccgagaagctgctgtccttccg

SEQ ID NO: 99001 - DNA, 25 bp, mus musculus
gcccccttgtacagaatcgaactct

SEQ ID NO: 99002 - DNA, 25 bp, mus musculus
gaactctgcacttctctctccttta

SEQ ID NO: 99003 - DNA, 25 bp, mus musculus
actctgcacttctctctcctttacg

SEQ ID NO: 99004 - DNA, 25 bp, mus musculus
tctctctcctttacgagacgaaaag

SEQ ID NO: 99005 - DNA, 25 bp, mus musculus
ttcgggctctggtgctgaagaaccg

SEQ ID NO: 99006 - DNA, 25 bp, mus musculus
tgctgaagaaccggccctcggagac

SEQ ID NO: 99007 - DNA, 25 bp, mus musculus
ttcaccaagctgctgctcaagctgc

SEQ ID NO: 99008 - DNA, 25 bp, mus musculus
tgctgctcaagctgccggacctgcg

SEQ ID NO: 99009 - DNA, 25 bp, mus musculus
ctgctcaagctgccggacctgcgga

SEQ ID NO: 99010 - DNA, 25 bp, mus musculus
ggacctgcggaccctgaacaacatg

SEQ ID NO: 99011 - DNA, 25 bp, mus musculus
acctgcggaccctgaacaacatgca

SEQ ID NO: 99012 - DNA, 25 bp, mus musculus
ctgcggaccctgaacaacatgcatt

SEQ ID NO: 99013 - DNA, 25 bp, mus musculus
ggacctggcgatggctactaaatcc

SEQ ID NO: 99014 - DNA, 25 bp, mus musculus
gctactaaatccaagcccagtgtag

SEQ ID NO: 99015 - DNA, 25 bp, mus musculus
tgtgtgaaaacaaccccaatgtatt

SEQ ID NO: 99016 - DNA, 25 bp, mus musculus
gtgtgaaaacaaccccaatgtattg

SEQ ID NO: 99017 - DNA, 25 bp, mus musculus
tgtgaaaacaaccccaatgtattgt

SEQ ID NO: 99018 - DNA, 25 bp, mus musculus
gtgaaaacaaccccaatgtattgtg

SEQ ID NO: 99019 - DNA, 25 bp, mus musculus
tgaaaacaaccccaatgtattgtgt

SEQ ID NO: 99020 - DNA, 25 bp, mus musculus
acaaccccaatgtattgtgttgcaa

SEQ ID NO: 99021 - DNA, 25 bp, mus musculus
caaccccaatgtattgtgttgcaac

SEQ ID NO: 99022 - DNA, 25 bp, mus musculus
aaccccaatgtattgtgttgcaaca

SEQ ID NO: 99023 - DNA, 25 bp, mus musculus
accccaatgtattgtgttgcaacaa

SEQ ID NO: 99024 - DNA, 25 bp, mus musculus
ctactaaatccaagcccagtgtagc

SEQ ID NO: 99025 - DNA, 25 bp, mus musculus
tactaaatccaagcccagtgtagca

SEQ ID NO: 99026 - DNA, 25 bp, mus musculus
actaaatccaagcccagtgtagcat

SEQ ID NO: 99027 - DNA, 25 bp, mus musculus
ctaaatccaagcccagtgtagcatt

SEQ ID NO: 99028 - DNA, 25 bp, mus musculus
taaatccaagcccagtgtagcatta

SEQ ID NO: 99029 - DNA, 25 bp, mus musculus
aaatccaagcccagtgtagcattat

SEQ ID NO: 99030 - DNA, 25 bp, mus musculus
aatccaagcccagtgtagcattata

SEQ ID NO: 99031 - DNA, 25 bp, mus musculus
tcactggcatagagatctggtacga

SEQ ID NO: 99032 - DNA, 25 bp, mus musculus
cacgtatatgtcgcgagccttgcca

SEQ ID NO: 99033 - DNA, 25 bp, mus musculus
cgtatatgtcgcgagccttgccaca

SEQ ID NO: 99034 - DNA, 25 bp, mus musculus
tgagataccctgcgaagaatatggg

SEQ ID NO: 99035 - DNA, 25 bp, mus musculus
agataccctgcgaagaatatggggt

SEQ ID NO: 99036 - DNA, 25 bp, mus musculus
taaatttctgcaactggagagcttt

SEQ ID NO: 99037 - DNA, 25 bp, mus musculus
aatttctgcaactggagagctttgc

SEQ ID NO: 99038 - DNA, 25 bp, mus musculus
tctgcaactggagagctttgcgata

SEQ ID NO: 99039 - DNA, 25 bp, mus musculus
caactggagagctttgcgatatggg

SEQ ID NO: 99040 - DNA, 25 bp, mus musculus
actaagtgttctcacacagtaatga

SEQ ID NO: 99041 - DNA, 25 bp, mus musculus
agtgttctcacacagtaatgatggt

SEQ ID NO: 99042 - DNA, 25 bp, mus musculus
tgttctcacacagtaatgatggtga

SEQ ID NO: 99043 - DNA, 25 bp, mus musculus
ttctcacacagtaatgatggtgaaa

SEQ ID NO: 99044 - DNA, 25 bp, mus musculus
tatatgtcgcgagccttgccacatt

SEQ ID NO: 99045 - DNA, 25 bp, mus musculus
tgtcgcgagccttgccacatttgag

SEQ ID NO: 99046 - DNA, 25 bp, mus musculus
tcgcgagccttgccacatttgagat

SEQ ID NO: 99047 - DNA, 25 bp, mus musculus
gagccttgccacatttgagatactc

SEQ ID NO: 99048 - DNA, 25 bp, mus musculus
cttgccacatttgagatactcttgt

SEQ ID NO: 99049 - DNA, 25 bp, mus musculus
ccacatttgagatactcttgtgaga

SEQ ID NO: 99050 - DNA, 25 bp, mus musculus
tactcttgtgagataccctgcgaag

SEQ ID NO: 99051 - DNA, 25 bp, mus musculus
cttgtgagataccctgcgaagaata

SEQ ID NO: 99052 - DNA, 25 bp, mus musculus
gccagactgtatcaccacgtgtcga

SEQ ID NO: 99053 - DNA, 25 bp, mus musculus
cagactgtatcaccacgtgtcgatg

SEQ ID NO: 99054 - DNA, 25 bp, mus musculus
aatatctaggtcacatccgagagca

SEQ ID NO: 99055 - DNA, 25 bp, mus musculus
atatctaggtcacatccgagagcac

SEQ ID NO: 99056 - DNA, 25 bp, mus musculus
atctaggtcacatccgagagcacag

SEQ ID NO: 99057 - DNA, 25 bp, mus musculus
tctaggtcacatccgagagcacagt

SEQ ID NO: 99058 - DNA, 25 bp, mus musculus
taggtcacatccgagagcacagtga

SEQ ID NO: 99059 - DNA, 25 bp, mus musculus
gtcacgacagctgatggcagacata

SEQ ID NO: 99060 - DNA, 25 bp, mus musculus
tcacgacagctgatggcagacatac

SEQ ID NO: 99061 - DNA, 25 bp, mus musculus
agacatactgcgactgtctgcgcct

SEQ ID NO: 99062 - DNA, 25 bp, mus musculus
gacatactgcgactgtctgcgcctt

SEQ ID NO: 99063 - DNA, 25 bp, mus musculus
atactgcgactgtctgcgccttcga

SEQ ID NO: 99064 - DNA, 25 bp, mus musculus
agactgtatcaccacgtgtcgatgg

SEQ ID NO: 99065 - DNA, 25 bp, mus musculus
actgtatcaccacgtgtcgatggca

SEQ ID NO: 99066 - DNA, 25 bp, mus musculus
ctgtatcaccacgtgtcgatggcaa

SEQ ID NO: 99067 - DNA, 25 bp, mus musculus
gtatcaccacgtgtcgatggcaaga

SEQ ID NO: 99068 - DNA, 25 bp, mus musculus
tatcaccacgtgtcgatggcaagaa

SEQ ID NO: 99069 - DNA, 25 bp, mus musculus
tcaccacgtgtcgatggcaagaata

SEQ ID NO: 99070 - DNA, 25 bp, mus musculus
caccacgtgtcgatggcaagaatat

SEQ ID NO: 99071 - DNA, 25 bp, mus musculus
ccacgtgtcgatggcaagaatatct

SEQ ID NO: 99072 - DNA, 25 bp, mus musculus
gttctgctttgagaggcccaagtgc

SEQ ID NO: 99073 - DNA, 25 bp, mus musculus
gagaggcccaagtgctccgagacat

SEQ ID NO: 99074 - DNA, 25 bp, mus musculus
cttggaagccacgtctgaacacttc

SEQ ID NO: 99075 - DNA, 25 bp, mus musculus
tggaagccacgtctgaacacttcaa

SEQ ID NO: 99076 - DNA, 25 bp, mus musculus
gaagccacgtctgaacacttcaaga

SEQ ID NO: 99077 - DNA, 25 bp, mus musculus
agccacgtctgaacacttcaagaca

SEQ ID NO: 99078 - DNA, 25 bp, mus musculus
ccacgtctgaacacttcaagacaac

SEQ ID NO: 99079 - DNA, 25 bp, mus musculus
gtctgaacacttcaagacaacgtcc

SEQ ID NO: 99080 - DNA, 25 bp, mus musculus
ctgaacacttcaagacaacgtccca

SEQ ID NO: 99081 - DNA, 25 bp, mus musculus
gaacacttcaagacaacgtcccaga

SEQ ID NO: 99082 - DNA, 25 bp, mus musculus
acacttcaagacaacgtcccagaag

SEQ ID NO: 99083 - DNA, 25 bp, mus musculus
ttcaagacaacgtcccagaaggtgg

SEQ ID NO: 99084 - DNA, 25 bp, mus musculus
ggcccaagtgctccgagacatggag

SEQ ID NO: 99085 - DNA, 25 bp, mus musculus
cccaagtgctccgagacatggagga

SEQ ID NO: 99086 - DNA, 25 bp, mus musculus
agttaggaacctgcagagtgaggtg

SEQ ID NO: 99087 - DNA, 25 bp, mus musculus
ttaggaacctgcagagtgaggtgga

SEQ ID NO: 99088 - DNA, 25 bp, mus musculus
atattatgacccagaatgtggagcg

SEQ ID NO: 99089 - DNA, 25 bp, mus musculus
attatgacccagaatgtggagcgga

SEQ ID NO: 99090 - DNA, 25 bp, mus musculus
tgacccagaatgtggagcggatctt

SEQ ID NO: 99091 - DNA, 25 bp, mus musculus
gacttggaagccacgtctgaacact

SEQ ID NO: 99092 - DNA, 25 bp, mus musculus
ctcatgaatatcctcaacaaggtcg

SEQ ID NO: 99093 - DNA, 25 bp, mus musculus
catgaatatcctcaacaaggtcgtg

SEQ ID NO: 99094 - DNA, 25 bp, mus musculus
attgacacttgtcggagcatggtgg

SEQ ID NO: 99095 - DNA, 25 bp, mus musculus
tgacacttgtcggagcatggtggcc

SEQ ID NO: 99096 - DNA, 25 bp, mus musculus
gacacttgtcggagcatggtggccg

SEQ ID NO: 99097 - DNA, 25 bp, mus musculus
ttgtcggagcatggtggccgtcatg

SEQ ID NO: 99098 - DNA, 25 bp, mus musculus
gagcatggtggccgtcatggatagc

SEQ ID NO: 99099 - DNA, 25 bp, mus musculus
atggtggccgtcatggatagcgaca

SEQ ID NO: 99100 - DNA, 25 bp, mus musculus
gtggccgtcatggatagcgacacca

SEQ ID NO: 99101 - DNA, 25 bp, mus musculus
cgacaccacaggcaagctgggcttt

SEQ ID NO: 99102 - DNA, 25 bp, mus musculus
gacaccacaggcaagctgggctttg

SEQ ID NO: 99103 - DNA, 25 bp, mus musculus
caccacaggcaagctgggctttgag

SEQ ID NO: 99104 - DNA, 25 bp, mus musculus
atgaatatcctcaacaaggtcgtga

SEQ ID NO: 99105 - DNA, 25 bp, mus musculus
gaatatcctcaacaaggtcgtgacc

SEQ ID NO: 99106 - DNA, 25 bp, mus musculus
tatcctcaacaaggtcgtgacccga

SEQ ID NO: 99107 - DNA, 25 bp, mus musculus
ttttggcattgacacttgtcggagc

SEQ ID NO: 99108 - DNA, 25 bp, mus musculus
tttggcattgacacttgtcggagca

SEQ ID NO: 99109 - DNA, 25 bp, mus musculus
tggcattgacacttgtcggagcatg

SEQ ID NO: 99110 - DNA, 25 bp, mus musculus
ggcattgacacttgtcggagcatgg

SEQ ID NO: 99111 - DNA, 25 bp, mus musculus
cattgacacttgtcggagcatggtg

SEQ ID NO: 99112 - DNA, 25 bp, mus musculus
ccacctacatcccgtaattgatgaa

SEQ ID NO: 99113 - DNA, 25 bp, mus musculus
tgaatgcctggcacactgccaatct

SEQ ID NO: 99114 - DNA, 25 bp, mus musculus
gattcaatatcttcacctacatatc

SEQ ID NO: 99115 - DNA, 25 bp, mus musculus
tcaatatcttcacctacatatccag

SEQ ID NO: 99116 - DNA, 25 bp, mus musculus
atatcttcacctacatatccagcct

SEQ ID NO: 99117 - DNA, 25 bp, mus musculus
tcacctacatatccagcctgggtca

SEQ ID NO: 99118 - DNA, 25 bp, mus musculus
cctacatatccagcctgggtcaaag

SEQ ID NO: 99119 - DNA, 25 bp, mus musculus
acatatccagcctgggtcaaagttg

SEQ ID NO: 99120 - DNA, 25 bp, mus musculus
ccagcctgggtcaaagttgtacagt

SEQ ID NO: 99121 - DNA, 25 bp, mus musculus
cctgacccagttggtccaagcagca

SEQ ID NO: 99122 - DNA, 25 bp, mus musculus
gacccagttggtccaagcagcaaaa

SEQ ID NO: 99123 - DNA, 25 bp, mus musculus
ccagttggtccaagcagcaaaatat

SEQ ID NO: 99124 - DNA, 25 bp, mus musculus
atgcctggcacactgccaatcttat

SEQ ID NO: 99125 - DNA, 25 bp, mus musculus
cctggcacactgccaatcttatcta

SEQ ID NO: 99126 - DNA, 25 bp, mus musculus
ctgccaatcttatctacttcatcca

SEQ ID NO: 99127 - DNA, 25 bp, mus musculus
ccaatcttatctacttcatccagaa

SEQ ID NO: 99128 - DNA, 25 bp, mus musculus
acttcatccagaaagacaattcctt

SEQ ID NO: 99129 - DNA, 25 bp, mus musculus
tccagaaagacaattccttgttgtg

SEQ ID NO: 99130 - DNA, 25 bp, mus musculus
ttctctacattgtaattggcatctt

SEQ ID NO: 99131 - DNA, 25 bp, mus musculus
taattggcatcttggagtagtttgg

SEQ ID NO: 99132 - DNA, 25 bp, mus musculus
gtgccctgcttctcctgacactctt

SEQ ID NO: 99133 - DNA, 25 bp, mus musculus
ccctgcttctcctgacactctttgg

SEQ ID NO: 99134 - DNA, 25 bp, mus musculus
aatgccggccagttaggagacctga

SEQ ID NO: 99135 - DNA, 25 bp, mus musculus
ccaacctcatctcactgaacgagaa

SEQ ID NO: 99136 - DNA, 25 bp, mus musculus
acctcatctcactgaacgagaaaga

SEQ ID NO: 99137 - DNA, 25 bp, mus musculus
tcatctcactgaacgagaaagaaga

SEQ ID NO: 99138 - DNA, 25 bp, mus musculus
aaactctgaccaccagtgtctggat

SEQ ID NO: 99139 - DNA, 25 bp, mus musculus
actggcacgactatcggctcaacta

SEQ ID NO: 99140 - DNA, 25 bp, mus musculus
ggcacgactatcggctcaactacag

SEQ ID NO: 99141 - DNA, 25 bp, mus musculus
actatcggctcaactacagcaagga

SEQ ID NO: 99142 - DNA, 25 bp, mus musculus
atcggctcaactacagcaaggacga

SEQ ID NO: 99143 - DNA, 25 bp, mus musculus
ggctcaactacagcaaggacgattt

SEQ ID NO: 99144 - DNA, 25 bp, mus musculus
ttctcctgacactctttggcagaag

SEQ ID NO: 99145 - DNA, 25 bp, mus musculus
tgacactctttggcagaagccaggg

SEQ ID NO: 99146 - DNA, 25 bp, mus musculus
tctttggcagaagccagggaaagaa

SEQ ID NO: 99147 - DNA, 25 bp, mus musculus
tgtatcaccatctcttcgacaatta

SEQ ID NO: 99148 - DNA, 25 bp, mus musculus
atcaccatctcttcgacaattatga

SEQ ID NO: 99149 - DNA, 25 bp, mus musculus
atctcttcgacaattatgatccaga

SEQ ID NO: 99150 - DNA, 25 bp, mus musculus
attatgatccagaatgccggccagt

SEQ ID NO: 99151 - DNA, 25 bp, mus musculus
atgatccagaatgccggccagttag

SEQ ID NO: 99152 - DNA, 25 bp, mus musculus
cccgccatattgtcgtcctgtgtct

SEQ ID NO: 99153 - DNA, 25 bp, mus musculus
cgccatattgtcgtcctgtgtcttt

SEQ ID NO: 99154 - DNA, 25 bp, mus musculus
gaatcgcaggaggtcacctggacac

SEQ ID NO: 99155 - DNA, 25 bp, mus musculus
gtcacctggacacccggtgactgga

SEQ ID NO: 99156 - DNA, 25 bp, mus musculus
cctggacacccggtgactggaaatg

SEQ ID NO: 99157 - DNA, 25 bp, mus musculus
tggacacccggtgactggaaatgga

SEQ ID NO: 99158 - DNA, 25 bp, mus musculus
ctatgctgaatgcatcccaaaagga

SEQ ID NO: 99159 - DNA, 25 bp, mus musculus
ggacaccttgaggaacctgtcctat

SEQ ID NO: 99160 - DNA, 25 bp, mus musculus
acaccttgaggaacctgtcctatat

SEQ ID NO: 99161 - DNA, 25 bp, mus musculus
caccttgaggaacctgtcctatata

SEQ ID NO: 99162 - DNA, 25 bp, mus musculus
cttgaggaacctgtcctatatagga

SEQ ID NO: 99163 - DNA, 25 bp, mus musculus
tgaggaacctgtcctatataggaaa

SEQ ID NO: 99164 - DNA, 25 bp, mus musculus
gccatattgtcgtcctgtgtctttg

SEQ ID NO: 99165 - DNA, 25 bp, mus musculus
atattgtcgtcctgtgtctttgact

SEQ ID NO: 99166 - DNA, 25 bp, mus musculus
attgtcgtcctgtgtctttgactgc

SEQ ID NO: 99167 - DNA, 25 bp, mus musculus
ttgtcgtcctgtgtctttgactgcg

SEQ ID NO: 99168 - DNA, 25 bp, mus musculus
gtcgtcctgtgtctttgactgcggc

SEQ ID NO: 99169 - DNA, 25 bp, mus musculus
cctactgacagcgggaatcgcagga

SEQ ID NO: 99170 - DNA, 25 bp, mus musculus
tactgacagcgggaatcgcaggagg

SEQ ID NO: 99171 - DNA, 25 bp, mus musculus
actgacagcgggaatcgcaggaggt

SEQ ID NO: 99172 - DNA, 25 bp, mus musculus
aatgtcctaccttctctaccagatg

SEQ ID NO: 99173 - DNA, 25 bp, mus musculus
catcaagcatctgcattcagctggt

SEQ ID NO: 99174 - DNA, 25 bp, mus musculus
cctggcgcgaacagcctgtaccaac

SEQ ID NO: 99175 - DNA, 25 bp, mus musculus
ggcgcgaacagcctgtaccaacttt

SEQ ID NO: 99176 - DNA, 25 bp, mus musculus
aacagcctgtaccaactttatgatg

SEQ ID NO: 99177 - DNA, 25 bp, mus musculus
ctgtaccaactttatgatgactccc

SEQ ID NO: 99178 - DNA, 25 bp, mus musculus
caactttatgatgactccctatgtg

SEQ ID NO: 99179 - DNA, 25 bp, mus musculus
gactccctatgtggtaactcgatac

SEQ ID NO: 99180 - DNA, 25 bp, mus musculus
tccctatgtggtaactcgatactat

SEQ ID NO: 99181 - DNA, 25 bp, mus musculus
ggtaactcgatactatcgggctcca

SEQ ID NO: 99182 - DNA, 25 bp, mus musculus
aactcgatactatcgggctccagaa

SEQ ID NO: 99183 - DNA, 25 bp, mus musculus
tcgatactatcgggctccagaagtc

SEQ ID NO: 99184 - DNA, 25 bp, mus musculus
caagcatctgcattcagctggtatc

SEQ ID NO: 99185 - DNA, 25 bp, mus musculus
ctatcgggctccagaagtcatcctg

SEQ ID NO: 99186 - DNA, 25 bp, mus musculus
gcattcagctggtatcattcataga

SEQ ID NO: 99187 - DNA, 25 bp, mus musculus
ttcagctggtatcattcatagagat

SEQ ID NO: 99188 - DNA, 25 bp, mus musculus
gaagcctagcaacattgtagtaaaa

SEQ ID NO: 99189 - DNA, 25 bp, mus musculus
ctgtaccctcaagatccttgacttt

SEQ ID NO: 99190 - DNA, 25 bp, mus musculus
taccctcaagatccttgactttggc

SEQ ID NO: 99191 - DNA, 25 bp, mus musculus
cctcaagatccttgactttggcctg

SEQ ID NO: 99192 - DNA, 25 bp, mus musculus
tgactttggcctggcgcgaacagcc

SEQ ID NO: 99193 - DNA, 25 bp, mus musculus
cttagcacagatgcagcagtaagta

SEQ ID NO: 99194 - DNA, 25 bp, mus musculus
aaggctactccttctcagtcgtcat

SEQ ID NO: 99195 - DNA, 25 bp, mus musculus
gatgcctcaacaggacccctggaag

SEQ ID NO: 99196 - DNA, 25 bp, mus musculus
tgttggagacggcgcacttgtctgt

SEQ ID NO: 99197 - DNA, 25 bp, mus musculus
cggcgcacttgtctgtgaaggaact

SEQ ID NO: 99198 - DNA, 25 bp, mus musculus
cgcacttgtctgtgaaggaactctc

SEQ ID NO: 99199 - DNA, 25 bp, mus musculus
tgaaggaactctcacttccatggcc

SEQ ID NO: 99200 - DNA, 25 bp, mus musculus
cacttccatggccccgagcgcgtgg

SEQ ID NO: 99201 - DNA, 25 bp, mus musculus
tcgaaaaactccatgttctgcatgt

SEQ ID NO: 99202 - DNA, 25 bp, mus musculus
aactccatgttctgcatgtaagaaa

SEQ ID NO: 99203 - DNA, 25 bp, mus musculus
gaaacacgatgccttgccctgctca

SEQ ID NO: 99204 - DNA, 25 bp, mus musculus
acacgatgccttgccctgctcagtt

SEQ ID NO: 99205 - DNA, 25 bp, mus musculus
ccttctcagtcgtcatccatcaatg

SEQ ID NO: 99206 - DNA, 25 bp, mus musculus
tgccttgccctgctcagttccagta

SEQ ID NO: 99207 - DNA, 25 bp, mus musculus
tctcagtcgtcatccatcaatgaca

SEQ ID NO: 99208 - DNA, 25 bp, mus musculus
tcgtcatccatcaatgacatctcat

SEQ ID NO: 99209 - DNA, 25 bp, mus musculus
tccatcaatgacatctcatccatgt

SEQ ID NO: 99210 - DNA, 25 bp, mus musculus
tccatgtccactgagcacaccctgg

SEQ ID NO: 99211 - DNA, 25 bp, mus musculus
accctggcctcagacacagacagca

SEQ ID NO: 99212 - DNA, 25 bp, mus musculus
tcagacacagacagcagtctcgatg

SEQ ID NO: 99213 - DNA, 25 bp, mus musculus
agcagtctcgatgcctcaacaggac

SEQ ID NO: 99214 - DNA, 25 bp, mus musculus
gaaggttcgcaccacagagacccaa

SEQ ID NO: 99215 - DNA, 25 bp, mus musculus
gttcgcaccacagagacccaagtgt

SEQ ID NO: 99216 - DNA, 25 bp, mus musculus
taacccagctgcactattgtgagaa

SEQ ID NO: 99217 - DNA, 25 bp, mus musculus
ccagctgcactattgtgagaaagcc

SEQ ID NO: 99218 - DNA, 25 bp, mus musculus
gagaaagccgacattcctctgatgg

SEQ ID NO: 99219 - DNA, 25 bp, mus musculus
gaaagccgacattcctctgatggtc

SEQ ID NO: 99220 - DNA, 25 bp, mus musculus
aagccgacattcctctgatggtcat

SEQ ID NO: 99221 - DNA, 25 bp, mus musculus
gccgacattcctctgatggtcatta

SEQ ID NO: 99222 - DNA, 25 bp, mus musculus
cgacattcctctgatggtcattaat

SEQ ID NO: 99223 - DNA, 25 bp, mus musculus
acattcctctgatggtcattaatgg

SEQ ID NO: 99224 - DNA, 25 bp, mus musculus
attcctctgatggtcattaatggtg

SEQ ID NO: 99225 - DNA, 25 bp, mus musculus
tcctctgatggtcattaatggtgag

SEQ ID NO: 99226 - DNA, 25 bp, mus musculus
gcaccacagagacccaagtgtttgt

SEQ ID NO: 99227 - DNA, 25 bp, mus musculus
gagacccaagtgtttgtggccacac

SEQ ID NO: 99228 - DNA, 25 bp, mus musculus
tctccaagaacgtttgaagataatt

SEQ ID NO: 99229 - DNA, 25 bp, mus musculus
tttgggatgccgggatcaaggcaca

SEQ ID NO: 99230 - DNA, 25 bp, mus musculus
atcaaggcacagatgccttataaaa

SEQ ID NO: 99231 - DNA, 25 bp, mus musculus
cccaaactgttaacccagctgcact

SEQ ID NO: 99232 - DNA, 25 bp, mus musculus
aactgttaacccagctgcactattg

SEQ ID NO: 99233 - DNA, 25 bp, mus musculus
gttaacccagctgcactattgtgag

SEQ ID NO: 99234 - DNA, 25 bp, mus musculus
atgctctgaacaagaacccaaatta

SEQ ID NO: 99235 - DNA, 25 bp, mus musculus
tgctctgaacaagaacccaaattac

SEQ ID NO: 99236 - DNA, 25 bp, mus musculus
gatcccagctgaacatttctaaacc

SEQ ID NO: 99237 - DNA, 25 bp, mus musculus
atcccagctgaacatttctaaacca

SEQ ID NO: 99238 - DNA, 25 bp, mus musculus
gcatagaacctgcaggctgcataaa

SEQ ID NO: 99239 - DNA, 25 bp, mus musculus
catagaacctgcaggctgcataaac

SEQ ID NO: 99240 - DNA, 25 bp, mus musculus
atagaacctgcaggctgcataaacg

SEQ ID NO: 99241 - DNA, 25 bp, mus musculus
tagaacctgcaggctgcataaacga

SEQ ID NO: 99242 - DNA, 25 bp, mus musculus
agaacctgcaggctgcataaacgaa

SEQ ID NO: 99243 - DNA, 25 bp, mus musculus
ggagccagatcctccctaactagat

SEQ ID NO: 99244 - DNA, 25 bp, mus musculus
gagccagatcctccctaactagatg

SEQ ID NO: 99245 - DNA, 25 bp, mus musculus
gctctgaacaagaacccaaattacg

SEQ ID NO: 99246 - DNA, 25 bp, mus musculus
ataactgacagatcccagctgaaca

SEQ ID NO: 99247 - DNA, 25 bp, mus musculus
taactgacagatcccagctgaacat

SEQ ID NO: 99248 - DNA, 25 bp, mus musculus
aactgacagatcccagctgaacatt

SEQ ID NO: 99249 - DNA, 25 bp, mus musculus
gacagatcccagctgaacatttcta

SEQ ID NO: 99250 - DNA, 25 bp, mus musculus
acagatcccagctgaacatttctaa

SEQ ID NO: 99251 - DNA, 25 bp, mus musculus
cagatcccagctgaacatttctaaa

SEQ ID NO: 99252 - DNA, 25 bp, mus musculus
agatcccagctgaacatttctaaac

SEQ ID NO: 99253 - DNA, 25 bp, mus musculus
agtcagaccaggagtccaataacgc

SEQ ID NO: 99254 - DNA, 25 bp, mus musculus
agtccaataacgccgctgaggaatg

SEQ ID NO: 99255 - DNA, 25 bp, mus musculus
agccatagccatcgctaggaaagat

SEQ ID NO: 99256 - DNA, 25 bp, mus musculus
gtctccttgaatcctttcacactta

SEQ ID NO: 99257 - DNA, 25 bp, mus musculus
cctttcacacttaccaaacatgcag

SEQ ID NO: 99258 - DNA, 25 bp, mus musculus
acacttaccaaacatgcagtgttct

SEQ ID NO: 99259 - DNA, 25 bp, mus musculus
accaaacatgcagtgttctacatgt

SEQ ID NO: 99260 - DNA, 25 bp, mus musculus
gtgttctacatgtcctacatgttaa

SEQ ID NO: 99261 - DNA, 25 bp, mus musculus
tacatgtcctacatgttaatgagag

SEQ ID NO: 99262 - DNA, 25 bp, mus musculus
tctgctcacacggctgtattcttga

SEQ ID NO: 99263 - DNA, 25 bp, mus musculus
cacacggctgtattcttgaagtgtc

SEQ ID NO: 99264 - DNA, 25 bp, mus musculus
tctgtttgtattgccatggctagtt

SEQ ID NO: 99265 - DNA, 25 bp, mus musculus
tgatggatcacatcctcctcggagt

SEQ ID NO: 99266 - DNA, 25 bp, mus musculus
tcctcctcggagtctttatgctggt

SEQ ID NO: 99267 - DNA, 25 bp, mus musculus
tctttatgctggtgtgtctcatcgg

SEQ ID NO: 99268 - DNA, 25 bp, mus musculus
tcatcgggacgctggctgtgtttgc

SEQ ID NO: 99269 - DNA, 25 bp, mus musculus
tgtttgcaggtcggctcattgagtt

SEQ ID NO: 99270 - DNA, 25 bp, mus musculus
caggtcggctcattgagttacatca

SEQ ID NO: 99271 - DNA, 25 bp, mus musculus
taagcctacctctgtcccagccata

SEQ ID NO: 99272 - DNA, 25 bp, mus musculus
tgtcccagccatagccatcgctagg

SEQ ID NO: 99273 - DNA, 25 bp, mus musculus
aagcttagcctctgtctgctttgaa

SEQ ID NO: 99274 - DNA, 25 bp, mus musculus
ttagcctctgtctgctttgaactga

SEQ ID NO: 99275 - DNA, 25 bp, mus musculus
ttgaaacagctcaaagctcactctc

SEQ ID NO: 99276 - DNA, 25 bp, mus musculus
aacagctcaaagctcactctcatgg

SEQ ID NO: 99277 - DNA, 25 bp, mus musculus
cagctcaaagctcactctcatggat

SEQ ID NO: 99278 - DNA, 25 bp, mus musculus
gctcaaagctcactctcatggatcc

SEQ ID NO: 99279 - DNA, 25 bp, mus musculus
tcaaagctcactctcatggatccct

SEQ ID NO: 99280 - DNA, 25 bp, mus musculus
ctcactctcatggatccctgaacaa

SEQ ID NO: 99281 - DNA, 25 bp, mus musculus
catggatccctgaacaacaatggta

SEQ ID NO: 99282 - DNA, 25 bp, mus musculus
tggatccctgaacaacaatggtaat

SEQ ID NO: 99283 - DNA, 25 bp, mus musculus
gatccctgaacaacaatggtaatga

SEQ ID NO: 99284 - DNA, 25 bp, mus musculus
aatgatgctgtgctgagaagctgca

SEQ ID NO: 99285 - DNA, 25 bp, mus musculus
aggtcatccaggctaggaagagaga

SEQ ID NO: 99286 - DNA, 25 bp, mus musculus
gtcatccaggctaggaagagagact

SEQ ID NO: 99287 - DNA, 25 bp, mus musculus
agagactatgaacttcccaatgttc

SEQ ID NO: 99288 - DNA, 25 bp, mus musculus
agactatgaacttcccaatgttcat

SEQ ID NO: 99289 - DNA, 25 bp, mus musculus
tgaacttcccaatgttcatgcaatt

SEQ ID NO: 99290 - DNA, 25 bp, mus musculus
aacttcccaatgttcatgcaattat

SEQ ID NO: 99291 - DNA, 25 bp, mus musculus
cttcccaatgttcatgcaattattg

SEQ ID NO: 99292 - DNA, 25 bp, mus musculus
tcccaatgttcatgcaattattgaa

SEQ ID NO: 99293 - DNA, 25 bp, mus musculus
cggccacagcggctacggtgaacgg

SEQ ID NO: 99294 - DNA, 25 bp, mus musculus
gccacagcggctacggtgaacgggt

SEQ ID NO: 99295 - DNA, 25 bp, mus musculus
ctgggccgcctgaagttggttctgc

SEQ ID NO: 99296 - DNA, 25 bp, mus musculus
gccgcctgaagttggttctgcttga

SEQ ID NO: 99297 - DNA, 25 bp, mus musculus
aagttggttctgcttgagctcaatc

SEQ ID NO: 99298 - DNA, 25 bp, mus musculus
gttggttctgcttgagctcaatctc

SEQ ID NO: 99299 - DNA, 25 bp, mus musculus
ttggttctgcttgagctcaatctcc

SEQ ID NO: 99300 - DNA, 25 bp, mus musculus
tggttctgcttgagctcaatctcct

SEQ ID NO: 99301 - DNA, 25 bp, mus musculus
ttctgcttgagctcaatctcctctt

SEQ ID NO: 99302 - DNA, 25 bp, mus musculus
tctgcttgagctcaatctcctcttc

SEQ ID NO: 99303 - DNA, 25 bp, mus musculus
tgcttgagctcaatctcctcttcct

SEQ ID NO: 99304 - DNA, 25 bp, mus musculus
gcttgagctcaatctcctcttcctg

SEQ ID NO: 99305 - DNA, 25 bp, mus musculus
cacagcggctacggtgaacgggtcg

SEQ ID NO: 99306 - DNA, 25 bp, mus musculus
gcatgtacgagcaactcaaggacga

SEQ ID NO: 99307 - DNA, 25 bp, mus musculus
atgtacgagcaactcaaggacgagt

SEQ ID NO: 99308 - DNA, 25 bp, mus musculus
tgtacgagcaactcaaggacgagtg

SEQ ID NO: 99309 - DNA, 25 bp, mus musculus
gtacgagcaactcaaggacgagtgg

SEQ ID NO: 99310 - DNA, 25 bp, mus musculus
acgagcaactcaaggacgagtggaa

SEQ ID NO: 99311 - DNA, 25 bp, mus musculus
gaagaactgggccgcctgaagttgg

SEQ ID NO: 99312 - DNA, 25 bp, mus musculus
actgggccgcctgaagttggttctg

SEQ ID NO: 99313 - DNA, 25 bp, mus musculus
agacttgagggctacgccattacca

SEQ ID NO: 99314 - DNA, 25 bp, mus musculus
gacttgagggctacgccattaccag

SEQ ID NO: 99315 - DNA, 25 bp, mus musculus
ccattaccagcttgcttagcggggt

SEQ ID NO: 99316 - DNA, 25 bp, mus musculus
cattaccagcttgcttagcggggtc

SEQ ID NO: 99317 - DNA, 25 bp, mus musculus
ttaccagcttgcttagcggggtcct

SEQ ID NO: 99318 - DNA, 25 bp, mus musculus
gggtccttgctgctactccatttgt

SEQ ID NO: 99319 - DNA, 25 bp, mus musculus
ggtccttgctgctactccatttgta

SEQ ID NO: 99320 - DNA, 25 bp, mus musculus
tccttgctgctactccatttgtaga

SEQ ID NO: 99321 - DNA, 25 bp, mus musculus
ccttgctgctactccatttgtagaa

SEQ ID NO: 99322 - DNA, 25 bp, mus musculus
cttgctgctactccatttgtagaag

SEQ ID NO: 99323 - DNA, 25 bp, mus musculus
ttgctgctactccatttgtagaagg

SEQ ID NO: 99324 - DNA, 25 bp, mus musculus
tgctgctactccatttgtagaaggc

SEQ ID NO: 99325 - DNA, 25 bp, mus musculus
gagggctacgccattaccagcttgc

SEQ ID NO: 99326 - DNA, 25 bp, mus musculus
agggctacgccattaccagcttgct

SEQ ID NO: 99327 - DNA, 25 bp, mus musculus
ggctacgccattaccagcttgctta

SEQ ID NO: 99328 - DNA, 25 bp, mus musculus
gctacgccattaccagcttgcttag

SEQ ID NO: 99329 - DNA, 25 bp, mus musculus
tacgccattaccagcttgcttagcg

SEQ ID NO: 99330 - DNA, 25 bp, mus musculus
acgccattaccagcttgcttagcgg

SEQ ID NO: 99331 - DNA, 25 bp, mus musculus
cgccattaccagcttgcttagcggg

SEQ ID NO: 99332 - DNA, 25 bp, mus musculus
gccattaccagcttgcttagcgggg

SEQ ID NO: 99333 - DNA, 25 bp, mus musculus
caggtaacagcctatacttcagcct

SEQ ID NO: 99334 - DNA, 25 bp, mus musculus
ggtaacagcctatacttcagccttt

SEQ ID NO: 99335 - DNA, 25 bp, mus musculus
ttccccgtagaggcagaggagaagg

SEQ ID NO: 99336 - DNA, 25 bp, mus musculus
gggcattctcttgatgcagtactgg

SEQ ID NO: 99337 - DNA, 25 bp, mus musculus
gcattctcttgatgcagtactgggc

SEQ ID NO: 99338 - DNA, 25 bp, mus musculus
attctcttgatgcagtactgggcct

SEQ ID NO: 99339 - DNA, 25 bp, mus musculus
tcttgatgcagtactgggcctgatc

SEQ ID NO: 99340 - DNA, 25 bp, mus musculus
ttgatgcagtactgggcctgatccg

SEQ ID NO: 99341 - DNA, 25 bp, mus musculus
gatgcagtactgggcctgatccgga

SEQ ID NO: 99342 - DNA, 25 bp, mus musculus
tgcagtactgggcctgatccggagc

SEQ ID NO: 99343 - DNA, 25 bp, mus musculus
tgatccggagcagctctcgacgaag

SEQ ID NO: 99344 - DNA, 25 bp, mus musculus
atccggagcagctctcgacgaagct

SEQ ID NO: 99345 - DNA, 25 bp, mus musculus
agcctatacttcagcctttattgca

SEQ ID NO: 99346 - DNA, 25 bp, mus musculus
tctcgacgaagctcctctgccaaga

SEQ ID NO: 99347 - DNA, 25 bp, mus musculus
cctatacttcagcctttattgcatt

SEQ ID NO: 99348 - DNA, 25 bp, mus musculus
tatacttcagcctttattgcattct

SEQ ID NO: 99349 - DNA, 25 bp, mus musculus
cttcagcctttattgcattctgata

SEQ ID NO: 99350 - DNA, 25 bp, mus musculus
tcagcctttattgcattctgatagg

SEQ ID NO: 99351 - DNA, 25 bp, mus musculus
agcctttattgcattctgatagggt

SEQ ID NO: 99352 - DNA, 25 bp, mus musculus
cctttattgcattctgatagggtag

SEQ ID NO: 99353 - DNA, 25 bp, mus musculus
cgctttccccgtagaggcagaggag

SEQ ID NO: 99354 - DNA, 25 bp, mus musculus
ggactcgaagcctgcccgagtgtat

SEQ ID NO: 99355 - DNA, 25 bp, mus musculus
gactcgaagcctgcccgagtgtatg

SEQ ID NO: 99356 - DNA, 25 bp, mus musculus
aagcacctcattattggtgtgtcct

SEQ ID NO: 99357 - DNA, 25 bp, mus musculus
acctcattattggtgtgtcctcaga

SEQ ID NO: 99358 - DNA, 25 bp, mus musculus
attattggtgtgtcctcagatagag

SEQ ID NO: 99359 - DNA, 25 bp, mus musculus
tattggtgtgtcctcagatagaggg

SEQ ID NO: 99360 - DNA, 25 bp, mus musculus
attggtgtgtcctcagatagagggc

SEQ ID NO: 99361 - DNA, 25 bp, mus musculus
ttggtgtgtcctcagatagagggct

SEQ ID NO: 99362 - DNA, 25 bp, mus musculus
tggtgtgtcctcagatagagggctt

SEQ ID NO: 99363 - DNA, 25 bp, mus musculus
tgtgtcctcagatagagggctttgt

SEQ ID NO: 99364 - DNA, 25 bp, mus musculus
tcctcagatagagggctttgtggtg

SEQ ID NO: 99365 - DNA, 25 bp, mus musculus
actcgaagcctgcccgagtgtatgg

SEQ ID NO: 99366 - DNA, 25 bp, mus musculus
cgaagcctgcccgagtgtatgggac

SEQ ID NO: 99367 - DNA, 25 bp, mus musculus
gaagcctgcccgagtgtatgggaca

SEQ ID NO: 99368 - DNA, 25 bp, mus musculus
aagcctgcccgagtgtatgggacag

SEQ ID NO: 99369 - DNA, 25 bp, mus musculus
tgcccgagtgtatgggacaggttct

SEQ ID NO: 99370 - DNA, 25 bp, mus musculus
gaagaagcacctcattattggtgtg

SEQ ID NO: 99371 - DNA, 25 bp, mus musculus
agaagcacctcattattggtgtgtc

SEQ ID NO: 99372 - DNA, 25 bp, mus musculus
gaagcacctcattattggtgtgtcc

SEQ ID NO: 99373 - DNA, 25 bp, mus musculus
ggcacttccgagatccaccagatcg

SEQ ID NO: 99374 - DNA, 25 bp, mus musculus
acttccgagatccaccagatcgact

SEQ ID NO: 99375 - DNA, 25 bp, mus musculus
tccaagctgccactggccggccagt

SEQ ID NO: 99376 - DNA, 25 bp, mus musculus
ctgccactggccggccagtacagct

SEQ ID NO: 99377 - DNA, 25 bp, mus musculus
ccactggccggccagtacagcttga

SEQ ID NO: 99378 - DNA, 25 bp, mus musculus
ctggccggccagtacagcttgagga

SEQ ID NO: 99379 - DNA, 25 bp, mus musculus
ccctataacaacctcaagcacaagt

SEQ ID NO: 99380 - DNA, 25 bp, mus musculus
tataacaacctcaagcacaagttcc

SEQ ID NO: 99381 - DNA, 25 bp, mus musculus
ctcaagcacaagttcccgtggctct

SEQ ID NO: 99382 - DNA, 25 bp, mus musculus
aagcacaagttcccgtggctctcag

SEQ ID NO: 99383 - DNA, 25 bp, mus musculus
cacaagttcccgtggctctcagagg

SEQ ID NO: 99384 - DNA, 25 bp, mus musculus
ccgtggctctcagaggccggactcc

SEQ ID NO: 99385 - DNA, 25 bp, mus musculus
tccgagatccaccagatcgacttga

SEQ ID NO: 99386 - DNA, 25 bp, mus musculus
atccaccagatcgacttgattgtac

SEQ ID NO: 99387 - DNA, 25 bp, mus musculus
caccagatcgacttgattgtacagc

SEQ ID NO: 99388 - DNA, 25 bp, mus musculus
ttgattgtacagctgttggggacac

SEQ ID NO: 99389 - DNA, 25 bp, mus musculus
attgtacagctgttggggacaccga

SEQ ID NO: 99390 - DNA, 25 bp, mus musculus
ctgttggggacaccgagtgagaata

SEQ ID NO: 99391 - DNA, 25 bp, mus musculus
atctggccgggtttctccaagctgc

SEQ ID NO: 99392 - DNA, 25 bp, mus musculus
ggtttctccaagctgccactggccg

SEQ ID NO: 99393 - DNA, 25 bp, mus musculus
caaatgctgcaggtactctcaagct

SEQ ID NO: 99394 - DNA, 25 bp, mus musculus
ctgcaggtactctcaagctcaatac

SEQ ID NO: 99395 - DNA, 25 bp, mus musculus
gttacttccttagcctagcaattgt

SEQ ID NO: 99396 - DNA, 25 bp, mus musculus
tccttagcctagcaattgttggaat

SEQ ID NO: 99397 - DNA, 25 bp, mus musculus
ttggaatcacagacctggtaaacca

SEQ ID NO: 99398 - DNA, 25 bp, mus musculus
tcacagacctggtaaaccagcacac

SEQ ID NO: 99399 - DNA, 25 bp, mus musculus
taaaccagcacacttggagtttgtt

SEQ ID NO: 99400 - DNA, 25 bp, mus musculus
cagcttagatctctagtgaaataga

SEQ ID NO: 99401 - DNA, 25 bp, mus musculus
gactgtaagccttttgaggacagga

SEQ ID NO: 99402 - DNA, 25 bp, mus musculus
agatctgttggctactgaattatcc

SEQ ID NO: 99403 - DNA, 25 bp, mus musculus
attatccccagcaatgtgtacaggt

SEQ ID NO: 99404 - DNA, 25 bp, mus musculus
tacaggtcctagcccataagtgctt

SEQ ID NO: 99405 - DNA, 25 bp, mus musculus
tcaagctcaatacgcttggcgcttg

SEQ ID NO: 99406 - DNA, 25 bp, mus musculus
tcaatacgcttggcgcttgtaagaa

SEQ ID NO: 99407 - DNA, 25 bp, mus musculus
cgcttggcgcttgtaagaatcttgt

SEQ ID NO: 99408 - DNA, 25 bp, mus musculus
aggctgagcatggtgccttggaccc

SEQ ID NO: 99409 - DNA, 25 bp, mus musculus
ggcccaggctagcctggaactgtgg

SEQ ID NO: 99410 - DNA, 25 bp, mus musculus
actgtggcgtccaggctggtctcaa

SEQ ID NO: 99411 - DNA, 25 bp, mus musculus
gtctcaaactcccaacatgttactt

SEQ ID NO: 99412 - DNA, 25 bp, mus musculus
caacatgttacttccttagcctagc

SEQ ID NO: 99413 - DNA, 25 bp, mus musculus
cttgtagctctgatcagttttacct

SEQ ID NO: 99414 - DNA, 25 bp, mus musculus
gctctgatcagttttacctctggga

SEQ ID NO: 99415 - DNA, 25 bp, mus musculus
atttccctaataggaactgctcgcg

SEQ ID NO: 99416 - DNA, 25 bp, mus musculus
tccctaataggaactgctcgcgtta

SEQ ID NO: 99417 - DNA, 25 bp, mus musculus
ctaataggaactgctcgcgttactg

SEQ ID NO: 99418 - DNA, 25 bp, mus musculus
ggaactgctcgcgttactgaaatct

SEQ ID NO: 99419 - DNA, 25 bp, mus musculus
actgctcgcgttactgaaatctcaa

SEQ ID NO: 99420 - DNA, 25 bp, mus musculus
gaaatctcaaagtctgctgggagaa

SEQ ID NO: 99421 - DNA, 25 bp, mus musculus
atctcaaagtctgctgggagaaaga

SEQ ID NO: 99422 - DNA, 25 bp, mus musculus
tcaaagtctgctgggagaaagaagg

SEQ ID NO: 99423 - DNA, 25 bp, mus musculus
gaacctcggcgttcagcagtcaggg

SEQ ID NO: 99424 - DNA, 25 bp, mus musculus
cctcggcgttcagcagtcagggatg

SEQ ID NO: 99425 - DNA, 25 bp, mus musculus
ctgatcagttttacctctgggaatt

SEQ ID NO: 99426 - DNA, 25 bp, mus musculus
tttacctctgggaattcacatcact

SEQ ID NO: 99427 - DNA, 25 bp, mus musculus
acctctgggaattcacatcactaaa

SEQ ID NO: 99428 - DNA, 25 bp, mus musculus
aattcacatcactaaagcaactttg

SEQ ID NO: 99429 - DNA, 25 bp, mus musculus
tcacatcactaaagcaactttgttg

SEQ ID NO: 99430 - DNA, 25 bp, mus musculus
cactaaagcaactttgttgtggcga

SEQ ID NO: 99431 - DNA, 25 bp, mus musculus
tttgttgtggcgatttccctaatag

SEQ ID NO: 99432 - DNA, 25 bp, mus musculus
gcgatttccctaataggaactgctc

SEQ ID NO: 99433 - DNA, 25 bp, mus musculus
caagcttataagcctttgcaacggt

SEQ ID NO: 99434 - DNA, 25 bp, mus musculus
gcctttgcaacggtttcttcaatgg

SEQ ID NO: 99435 - DNA, 25 bp, mus musculus
tcaaaattcacctgctaaaacctgc

SEQ ID NO: 99436 - DNA, 25 bp, mus musculus
aaattcacctgctaaaacctgctgg

SEQ ID NO: 99437 - DNA, 25 bp, mus musculus
aattcacctgctaaaacctgctgga

SEQ ID NO: 99438 - DNA, 25 bp, mus musculus
tcacctgctaaaacctgctggaatc

SEQ ID NO: 99439 - DNA, 25 bp, mus musculus
acctgctaaaacctgctggaatcct

SEQ ID NO: 99440 - DNA, 25 bp, mus musculus
cctgctaaaacctgctggaatcctt

SEQ ID NO: 99441 - DNA, 25 bp, mus musculus
tgctaaaacctgctggaatccttaa

SEQ ID NO: 99442 - DNA, 25 bp, mus musculus
aacctgctggaatccttaaatggct

SEQ ID NO: 99443 - DNA, 25 bp, mus musculus
acctgctggaatccttaaatggctt

SEQ ID NO: 99444 - DNA, 25 bp, mus musculus
gaatccttaaatggcttcctcaaag

SEQ ID NO: 99445 - DNA, 25 bp, mus musculus
gtttcttcaatgggtcccaccatgt

SEQ ID NO: 99446 - DNA, 25 bp, mus musculus
tttcttcaatgggtcccaccatgta

SEQ ID NO: 99447 - DNA, 25 bp, mus musculus
tcaatgggtcccaccatgtagaagg

SEQ ID NO: 99448 - DNA, 25 bp, mus musculus
caatgggtcccaccatgtagaaggc

SEQ ID NO: 99449 - DNA, 25 bp, mus musculus
tgggtcccaccatgtagaaggcttg

SEQ ID NO: 99450 - DNA, 25 bp, mus musculus
ggtcccaccatgtagaaggcttgtt

SEQ ID NO: 99451 - DNA, 25 bp, mus musculus
gtcccaccatgtagaaggcttgttc

SEQ ID NO: 99452 - DNA, 25 bp, mus musculus
cccaccatgtagaaggcttgttctg

SEQ ID NO: 99453 - DNA, 25 bp, mus musculus
ttcggatccatggttctcgatactt

SEQ ID NO: 99454 - DNA, 25 bp, mus musculus
tccatggttctcgatacttcgttgt

SEQ ID NO: 99455 - DNA, 25 bp, mus musculus
ggagcaccatgcctacgataaagtt

SEQ ID NO: 99456 - DNA, 25 bp, mus musculus
ccatgcctacgataaagttgcagag

SEQ ID NO: 99457 - DNA, 25 bp, mus musculus
ttgccaaacaatctgtgactatcaa

SEQ ID NO: 99458 - DNA, 25 bp, mus musculus
ccaaacaatctgtgactatcaagac

SEQ ID NO: 99459 - DNA, 25 bp, mus musculus
ctgtgactatcaagaccatgctgga

SEQ ID NO: 99460 - DNA, 25 bp, mus musculus
ctatcaagaccatgctggaagattt

SEQ ID NO: 99461 - DNA, 25 bp, mus musculus
tcaagaccatgctggaagatttggg

SEQ ID NO: 99462 - DNA, 25 bp, mus musculus
atgatgatcctgttcctttaccaaa

SEQ ID NO: 99463 - DNA, 25 bp, mus musculus
atgatcctgttcctttaccaaatgt

SEQ ID NO: 99464 - DNA, 25 bp, mus musculus
ttcctttaccaaatgttaatgcagc

SEQ ID NO: 99465 - DNA, 25 bp, mus musculus
atggttctcgatacttcgttgtggt

SEQ ID NO: 99466 - DNA, 25 bp, mus musculus
gttctcgatacttcgttgtggttgt

SEQ ID NO: 99467 - DNA, 25 bp, mus musculus
ctcgatacttcgttgtggttgtgaa

SEQ ID NO: 99468 - DNA, 25 bp, mus musculus
acttcgttgtggttgtgaactctgt

SEQ ID NO: 99469 - DNA, 25 bp, mus musculus
tggttgtgaactctgtccggcagcc

SEQ ID NO: 99470 - DNA, 25 bp, mus musculus
tgaactctgtccggcagcctcgggc

SEQ ID NO: 99471 - DNA, 25 bp, mus musculus
tcttgagacggagcaccatgcctac

SEQ ID NO: 99472 - DNA, 25 bp, mus musculus
gacggagcaccatgcctacgataaa

SEQ ID NO: 99473 - DNA, 25 bp, mus musculus
cacagctcttgagcggcctaaggca

SEQ ID NO: 99474 - DNA, 25 bp, mus musculus
acagctcttgagcggcctaaggcac

SEQ ID NO: 99475 - DNA, 25 bp, mus musculus
cctaaggcacctgactgcggcgtgc

SEQ ID NO: 99476 - DNA, 25 bp, mus musculus
gcttacctgctctttgaacaagcag

SEQ ID NO: 99477 - DNA, 25 bp, mus musculus
tacctgctctttgaacaagcagtgg

SEQ ID NO: 99478 - DNA, 25 bp, mus musculus
acctgctctttgaacaagcagtggc

SEQ ID NO: 99479 - DNA, 25 bp, mus musculus
cctgctctttgaacaagcagtggcg

SEQ ID NO: 99480 - DNA, 25 bp, mus musculus
ctgctctttgaacaagcagtggcgt

SEQ ID NO: 99481 - DNA, 25 bp, mus musculus
tgaacaagcagtggcgttgacatcg

SEQ ID NO: 99482 - DNA, 25 bp, mus musculus
tcaatttggacaggtgcacgcatgg

SEQ ID NO: 99483 - DNA, 25 bp, mus musculus
aatttggacaggtgcacgcatggat

SEQ ID NO: 99484 - DNA, 25 bp, mus musculus
acaggtgcacgcatggatcataggt

SEQ ID NO: 99485 - DNA, 25 bp, mus musculus
cagctcttgagcggcctaaggcacc

SEQ ID NO: 99486 - DNA, 25 bp, mus musculus
agctcttgagcggcctaaggcacct

SEQ ID NO: 99487 - DNA, 25 bp, mus musculus
gctcttgagcggcctaaggcacctg

SEQ ID NO: 99488 - DNA, 25 bp, mus musculus
ctcttgagcggcctaaggcacctga

SEQ ID NO: 99489 - DNA, 25 bp, mus musculus
tcttgagcggcctaaggcacctgac

SEQ ID NO: 99490 - DNA, 25 bp, mus musculus
ttgagcggcctaaggcacctgactg

SEQ ID NO: 99491 - DNA, 25 bp, mus musculus
tgagcggcctaaggcacctgactgc

SEQ ID NO: 99492 - DNA, 25 bp, mus musculus
gcctaaggcacctgactgcggcgtg

SEQ ID NO: 99493 - DNA, 25 bp, mus musculus
ggggcaaacttcatcgtcaaccata

SEQ ID NO: 99494 - DNA, 25 bp, mus musculus
gcaaacttcatcgtcaaccatatga

SEQ ID NO: 99495 - DNA, 25 bp, mus musculus
ttcctgcagggtgtctacaaccagc

SEQ ID NO: 99496 - DNA, 25 bp, mus musculus
ttctcctatagcgaacaggacaagc

SEQ ID NO: 99497 - DNA, 25 bp, mus musculus
gacaagcgcttcatctagagcaggc

SEQ ID NO: 99498 - DNA, 25 bp, mus musculus
aagcgcttcatctagagcaggcatg

SEQ ID NO: 99499 - DNA, 25 bp, mus musculus
cggcacgtagttcctgcccttgagc

SEQ ID NO: 99500 - DNA, 25 bp, mus musculus
cacgtagttcctgcccttgagcttg

SEQ ID NO: 99501 - DNA, 25 bp, mus musculus
gcccttgagcttgtgcctagcgggt

SEQ ID NO: 99502 - DNA, 25 bp, mus musculus
cagaggccatggtcgggagagctcc

SEQ ID NO: 99503 - DNA, 25 bp, mus musculus
ggctccagggttgtgaagagaagca

SEQ ID NO: 99504 - DNA, 25 bp, mus musculus
gcttcctgggaacagtcctgtgaga

SEQ ID NO: 99505 - DNA, 25 bp, mus musculus
aacttcatcgtcaaccatatgagag

SEQ ID NO: 99506 - DNA, 25 bp, mus musculus
aactggaaccaggtggcccgcacag

SEQ ID NO: 99507 - DNA, 25 bp, mus musculus
tggaaccaggtggcccgcacagtgg

SEQ ID NO: 99508 - DNA, 25 bp, mus musculus
cgcacagtggaccgtctctgcctgt

SEQ ID NO: 99509 - DNA, 25 bp, mus musculus
tgcctgtttgtggtgacacccgtca

SEQ ID NO: 99510 - DNA, 25 bp, mus musculus
ctgtttgtggtgacacccgtcatgg

SEQ ID NO: 99511 - DNA, 25 bp, mus musculus
gtgggcacagcctggatcttcctgc

SEQ ID NO: 99512 - DNA, 25 bp, mus musculus
tggatcttcctgcagggtgtctaca

SEQ ID NO: 99513 - DNA, 25 bp, mus musculus
cacactagcaaacgcttggctggac

SEQ ID NO: 99514 - DNA, 25 bp, mus musculus
gctggacccataaggtcggatgaca

SEQ ID NO: 99515 - DNA, 25 bp, mus musculus
ccttggtacagctcatttataagat

SEQ ID NO: 99516 - DNA, 25 bp, mus musculus
ataagatcagcctgttctgtgtgct

SEQ ID NO: 99517 - DNA, 25 bp, mus musculus
ttctgttccaaagcatcaaacataa

SEQ ID NO: 99518 - DNA, 25 bp, mus musculus
gcatcaaacataacacggtacagtt

SEQ ID NO: 99519 - DNA, 25 bp, mus musculus
tacagttcttgtacatcatgctgtt

SEQ ID NO: 99520 - DNA, 25 bp, mus musculus
acatcatgctgtttccaagcctcac

SEQ ID NO: 99521 - DNA, 25 bp, mus musculus
tgctgtttccaagcctcactgctat

SEQ ID NO: 99522 - DNA, 25 bp, mus musculus
tcccatccaaagctccttgtaacat

SEQ ID NO: 99523 - DNA, 25 bp, mus musculus
ctccttgtaacatctgtggtctcaa

SEQ ID NO: 99524 - DNA, 25 bp, mus musculus
gtaacatctgtggtctcaattgctc

SEQ ID NO: 99525 - DNA, 25 bp, mus musculus
gtgtcaattctccagccttcataac

SEQ ID NO: 99526 - DNA, 25 bp, mus musculus
tctgtggtctcaattgctctcgttt

SEQ ID NO: 99527 - DNA, 25 bp, mus musculus
attctccagccttcataaccgcatt

SEQ ID NO: 99528 - DNA, 25 bp, mus musculus
cagccttcataaccgcattccagac

SEQ ID NO: 99529 - DNA, 25 bp, mus musculus
tcataaccgcattccagacacctca

SEQ ID NO: 99530 - DNA, 25 bp, mus musculus
tccagacacctcacataatctttca

SEQ ID NO: 99531 - DNA, 25 bp, mus musculus
cacctcacataatctttcagcttgc

SEQ ID NO: 99532 - DNA, 25 bp, mus musculus
acataatctttcagcttgccttggt

SEQ ID NO: 99533 - DNA, 25 bp, mus musculus
tctttcagcttgccttggtacagct

SEQ ID NO: 99534 - DNA, 25 bp, mus musculus
ggattccaaactgatccgtgtccct

SEQ ID NO: 99535 - DNA, 25 bp, mus musculus
attccaaactgatccgtgtccctct

SEQ ID NO: 99536 - DNA, 25 bp, mus musculus
atcttaaacccactgaatggatggg

SEQ ID NO: 99537 - DNA, 25 bp, mus musculus
taaacccactgaatggatgggaaca

SEQ ID NO: 99538 - DNA, 25 bp, mus musculus
aacccactgaatggatgggaacagc

SEQ ID NO: 99539 - DNA, 25 bp, mus musculus
acagctggcagagctttctaggacc

SEQ ID NO: 99540 - DNA, 25 bp, mus musculus
agctggcagagctttctaggacctc

SEQ ID NO: 99541 - DNA, 25 bp, mus musculus
tctccaagttcatgaacacccagta

SEQ ID NO: 99542 - DNA, 25 bp, mus musculus
tccaagttcatgaacacccagtatt

SEQ ID NO: 99543 - DNA, 25 bp, mus musculus
caagttcatgaacacccagtatttt

SEQ ID NO: 99544 - DNA, 25 bp, mus musculus
agttcatgaacacccagtattttgg

SEQ ID NO: 99545 - DNA, 25 bp, mus musculus
ggttccgtccacgagatgtcatttc

SEQ ID NO: 99546 - DNA, 25 bp, mus musculus
caaactgatccgtgtccctcttcaa

SEQ ID NO: 99547 - DNA, 25 bp, mus musculus
aactgatccgtgtccctcttcaacg

SEQ ID NO: 99548 - DNA, 25 bp, mus musculus
ctgatccgtgtccctcttcaacgaa

SEQ ID NO: 99549 - DNA, 25 bp, mus musculus
gatccgtgtccctcttcaacgaatc

SEQ ID NO: 99550 - DNA, 25 bp, mus musculus
tccctcttcaacgaatccaccttgg

SEQ ID NO: 99551 - DNA, 25 bp, mus musculus
ttcaacgaatccaccttggacacag

SEQ ID NO: 99552 - DNA, 25 bp, mus musculus
caacgaatccaccttggacacagaa

SEQ ID NO: 99553 - DNA, 25 bp, mus musculus
acgaatccaccttggacacagaatc

SEQ ID NO: 99554 - DNA, 25 bp, mus musculus
actgatgtgctactctgtggccaac

SEQ ID NO: 99555 - DNA, 25 bp, mus musculus
gtgctactctgtggccaaccataac

SEQ ID NO: 99556 - DNA, 25 bp, mus musculus
cagggcttcctgcatcaatgccata

SEQ ID NO: 99557 - DNA, 25 bp, mus musculus
ttcctgcatcaatgccatagaaggg

SEQ ID NO: 99558 - DNA, 25 bp, mus musculus
ctgcatcaatgccatagaagggaag

SEQ ID NO: 99559 - DNA, 25 bp, mus musculus
gagacttgcccaggatgtgagagcc

SEQ ID NO: 99560 - DNA, 25 bp, mus musculus
acttgcccaggatgtgagagccaag

SEQ ID NO: 99561 - DNA, 25 bp, mus musculus
agccaaggctacctggagtgctcag

SEQ ID NO: 99562 - DNA, 25 bp, mus musculus
tacctggagtgctcagccctcagca

SEQ ID NO: 99563 - DNA, 25 bp, mus musculus
tcagccctcagcaaccggggagtac

SEQ ID NO: 99564 - DNA, 25 bp, mus musculus
gccctcagcaaccggggagtacagc

SEQ ID NO: 99565 - DNA, 25 bp, mus musculus
tgtgctgtccgaacagctgtcaacc

SEQ ID NO: 99566 - DNA, 25 bp, mus musculus
ctactctgtggccaaccataactcg

SEQ ID NO: 99567 - DNA, 25 bp, mus musculus
gctgtccgaacagctgtcaaccagg

SEQ ID NO: 99568 - DNA, 25 bp, mus musculus
ctctgtggccaaccataactcgttc

SEQ ID NO: 99569 - DNA, 25 bp, mus musculus
tgtggccaaccataactcgttcctg

SEQ ID NO: 99570 - DNA, 25 bp, mus musculus
caaccataactcgttcctgaacttg

SEQ ID NO: 99571 - DNA, 25 bp, mus musculus
ccataactcgttcctgaacttgaag

SEQ ID NO: 99572 - DNA, 25 bp, mus musculus
taccccggtgctggttgtggccaca

SEQ ID NO: 99573 - DNA, 25 bp, mus musculus
cccggtgctggttgtggccacacag

SEQ ID NO: 99574 - DNA, 25 bp, mus musculus
ggccacacagacggaccagagagag

SEQ ID NO: 99575 - DNA, 25 bp, mus musculus
tcctcccagtagcagtggaaacaga

SEQ ID NO: 99576 - DNA, 25 bp, mus musculus
ccagctgcagctctctctggcaatt

SEQ ID NO: 99577 - DNA, 25 bp, mus musculus
tgtgatccagagtctgtgatctccc

SEQ ID NO: 99578 - DNA, 25 bp, mus musculus
ccagagtctgtgatctcccaaagcc

SEQ ID NO: 99579 - DNA, 25 bp, mus musculus
gagtctgtgatctcccaaagccact

SEQ ID NO: 99580 - DNA, 25 bp, mus musculus
tctgtgatctcccaaagccactcct

SEQ ID NO: 99581 - DNA, 25 bp, mus musculus
tcatcctcatcagaggtgactggcc

SEQ ID NO: 99582 - DNA, 25 bp, mus musculus
tcctcatcagaggtgactggcccct

SEQ ID NO: 99583 - DNA, 25 bp, mus musculus
aacagtatcaaagtccacttatgcc

SEQ ID NO: 99584 - DNA, 25 bp, mus musculus
atcaaagtccacttatgccattact

SEQ ID NO: 99585 - DNA, 25 bp, mus musculus
aaagtccacttatgccattactgtg

SEQ ID NO: 99586 - DNA, 25 bp, mus musculus
gtccacttatgccattactgtgggg

SEQ ID NO: 99587 - DNA, 25 bp, mus musculus
gctgcagctctctctggcaattggg

SEQ ID NO: 99588 - DNA, 25 bp, mus musculus
gcagctctctctggcaattgggcta

SEQ ID NO: 99589 - DNA, 25 bp, mus musculus
ctctctggcaattgggctagatgat

SEQ ID NO: 99590 - DNA, 25 bp, mus musculus
tctggcaattgggctagatgatggc

SEQ ID NO: 99591 - DNA, 25 bp, mus musculus
gagcaccagaagcccccagtgtcca

SEQ ID NO: 99592 - DNA, 25 bp, mus musculus
cagaagcccccagtgtccatcaagc

SEQ ID NO: 99593 - DNA, 25 bp, mus musculus
aagcccccagtgtccatcaagcagg

SEQ ID NO: 99594 - DNA, 25 bp, mus musculus
ccagtgtccatcaagcaggagagat

SEQ ID NO: 99595 - DNA, 25 bp, mus musculus
ctgctcggagccctttgaagagact

SEQ ID NO: 99596 - DNA, 25 bp, mus musculus
tgaagagacttcccagaaaggagac

SEQ ID NO: 99597 - DNA, 25 bp, mus musculus
ggtgaaactcaacgcctgatggcag

SEQ ID NO: 99598 - DNA, 25 bp, mus musculus
gaaactcaacgcctgatggcagcta

SEQ ID NO: 99599 - DNA, 25 bp, mus musculus
actcaacgcctgatggcagctatgt

SEQ ID NO: 99600 - DNA, 25 bp, mus musculus
cgcctgatggcagctatgtacacat

SEQ ID NO: 99601 - DNA, 25 bp, mus musculus
tacacatgtgacatcatgggcacca

SEQ ID NO: 99602 - DNA, 25 bp, mus musculus
tgtgacatcatgggcaccagtgatg

SEQ ID NO: 99603 - DNA, 25 bp, mus musculus
atcatgggcaccagtgatgtcctcg

SEQ ID NO: 99604 - DNA, 25 bp, mus musculus
agtgatgtcctcggccgagtctatg

SEQ ID NO: 99605 - DNA, 25 bp, mus musculus
gtctatgccgtgctgtcaaagcgag

SEQ ID NO: 99606 - DNA, 25 bp, mus musculus
tatgccgtgctgtcaaagcgagaag

SEQ ID NO: 99607 - DNA, 25 bp, mus musculus
agagacttcccagaaaggagactct

SEQ ID NO: 99608 - DNA, 25 bp, mus musculus
agactctccggttattgactgctat

SEQ ID NO: 99609 - DNA, 25 bp, mus musculus
ctctccggttattgactgctatgga

SEQ ID NO: 99610 - DNA, 25 bp, mus musculus
tattgactgctatggacccttctcc

SEQ ID NO: 99611 - DNA, 25 bp, mus musculus
acccttctccgggcagctaattgct

SEQ ID NO: 99612 - DNA, 25 bp, mus musculus
cttctccgggcagctaattgctacc

SEQ ID NO: 99613 - DNA, 25 bp, mus musculus
gctaattgctaccatgaaagaagcc

SEQ ID NO: 99614 - DNA, 25 bp, mus musculus
agccctgcgctacgctctgcaggtg

SEQ ID NO: 99615 - DNA, 25 bp, mus musculus
acagtcaagaggcccaccaagaaag

SEQ ID NO: 99616 - DNA, 25 bp, mus musculus
aagaccttctcactggtcaaggaga

SEQ ID NO: 99617 - DNA, 25 bp, mus musculus
gactgtgttccagaaaccctatggg

SEQ ID NO: 99618 - DNA, 25 bp, mus musculus
gaaaccctatgggagctgggctact

SEQ ID NO: 99619 - DNA, 25 bp, mus musculus
agcactgtcaaccccatgtgctacg

SEQ ID NO: 99620 - DNA, 25 bp, mus musculus
gtcaaccccatgtgctacgcttctt

SEQ ID NO: 99621 - DNA, 25 bp, mus musculus
cccatgtgctacgcttcttgcaaca

SEQ ID NO: 99622 - DNA, 25 bp, mus musculus
tgctacgcttcttgcaacaaagcct

SEQ ID NO: 99623 - DNA, 25 bp, mus musculus
tgcaacaaagccttccgggaccatt

SEQ ID NO: 99624 - DNA, 25 bp, mus musculus
ttccgggaccatttccgcctgctgt

SEQ ID NO: 99625 - DNA, 25 bp, mus musculus
gaccatttccgcctgctgttgctct

SEQ ID NO: 99626 - DNA, 25 bp, mus musculus
tgggacaagcggcgctggcgaaaaa

SEQ ID NO: 99627 - DNA, 25 bp, mus musculus
ttctcactggtcaaggagaagaagg

SEQ ID NO: 99628 - DNA, 25 bp, mus musculus
atcctcacctggacaccatataaca

SEQ ID NO: 99629 - DNA, 25 bp, mus musculus
acctggacaccatataacatcatgg

SEQ ID NO: 99630 - DNA, 25 bp, mus musculus
tataacatcatggtgctggtgtcta

SEQ ID NO: 99631 - DNA, 25 bp, mus musculus
atcatggtgctggtgtctacattct

SEQ ID NO: 99632 - DNA, 25 bp, mus musculus
gtgctggtgtctacattctgcaagg

SEQ ID NO: 99633 - DNA, 25 bp, mus musculus
gtgtctacattctgcaaggactgtg

SEQ ID NO: 99634 - DNA, 25 bp, mus musculus
tgcaaggactgtgttccagaaaccc

SEQ ID NO: 99635 - DNA, 25 bp, mus musculus
ggagaacgcatcagtccaaaagaca

SEQ ID NO: 99636 - DNA, 25 bp, mus musculus
agaacgcatcagtccaaaagacaga

SEQ ID NO: 99637 - DNA, 25 bp, mus musculus
tgctgttttacaaggcgaggagaag

SEQ ID NO: 99638 - DNA, 25 bp, mus musculus
agaagaccttttcatgtgtatggac

SEQ ID NO: 99639 - DNA, 25 bp, mus musculus
gaagaccttttcatgtgtatggaca

SEQ ID NO: 99640 - DNA, 25 bp, mus musculus
gaccttttcatgtgtatggacatac

SEQ ID NO: 99641 - DNA, 25 bp, mus musculus
aagcattgtgcggcttccaaaagcc

SEQ ID NO: 99642 - DNA, 25 bp, mus musculus
gcattgtgcggcttccaaaagccaa

SEQ ID NO: 99643 - DNA, 25 bp, mus musculus
cattgtgcggcttccaaaagccaat

SEQ ID NO: 99644 - DNA, 25 bp, mus musculus
attgtgcggcttccaaaagccaata

SEQ ID NO: 99645 - DNA, 25 bp, mus musculus
tgtgcggcttccaaaagccaatatc

SEQ ID NO: 99646 - DNA, 25 bp, mus musculus
gtgcggcttccaaaagccaatatct

SEQ ID NO: 99647 - DNA, 25 bp, mus musculus
gcatcagtccaaaagacagatgtaa

SEQ ID NO: 99648 - DNA, 25 bp, mus musculus
catcagtccaaaagacagatgtaaa

SEQ ID NO: 99649 - DNA, 25 bp, mus musculus
gaagataacattccacggtgaagga

SEQ ID NO: 99650 - DNA, 25 bp, mus musculus
agataacattccacggtgaaggaga

SEQ ID NO: 99651 - DNA, 25 bp, mus musculus
taacattccacggtgaaggagacca

SEQ ID NO: 99652 - DNA, 25 bp, mus musculus
aaggaccatgctgttttacaaggcg

SEQ ID NO: 99653 - DNA, 25 bp, mus musculus
aggaccatgctgttttacaaggcga

SEQ ID NO: 99654 - DNA, 25 bp, mus musculus
ccatgctgttttacaaggcgaggag

SEQ ID NO: 99655 - DNA, 25 bp, mus musculus
aacccagacctacgagcgactccat

SEQ ID NO: 99656 - DNA, 25 bp, mus musculus
ctacgagcgactccatatacctgcc

SEQ ID NO: 99657 - DNA, 25 bp, mus musculus
ctgaagccactgctggaggccggca

SEQ ID NO: 99658 - DNA, 25 bp, mus musculus
aagccactgctggaggccggcaccc

SEQ ID NO: 99659 - DNA, 25 bp, mus musculus
agtgtttgtgccctatgtgacagaa

SEQ ID NO: 99660 - DNA, 25 bp, mus musculus
agaagcctacagaggtcctgcctcg

SEQ ID NO: 99661 - DNA, 25 bp, mus musculus
agcctacagaggtcctgcctcggat

SEQ ID NO: 99662 - DNA, 25 bp, mus musculus
cagaggtcctgcctcggatgcagct

SEQ ID NO: 99663 - DNA, 25 bp, mus musculus
aggtcctgcctcggatgcagcttct

SEQ ID NO: 99664 - DNA, 25 bp, mus musculus
ctcggatgcagcttctgaggatgct

SEQ ID NO: 99665 - DNA, 25 bp, mus musculus
ggatgcagcttctgaggatgctccc

SEQ ID NO: 99666 - DNA, 25 bp, mus musculus
tgcagcttctgaggatgctccctac

SEQ ID NO: 99667 - DNA, 25 bp, mus musculus
gcgactccatatacctgcccactgg

SEQ ID NO: 99668 - DNA, 25 bp, mus musculus
atctacgatgacagctttttctcca

SEQ ID NO: 99669 - DNA, 25 bp, mus musculus
tacgatgacagctttttctccaggg

SEQ ID NO: 99670 - DNA, 25 bp, mus musculus
aacggtgttgttgctgctttggaca

SEQ ID NO: 99671 - DNA, 25 bp, mus musculus
agcttccaggcccggcactatgtcg

SEQ ID NO: 99672 - DNA, 25 bp, mus musculus
gctgctcgatgcacccactatctga

SEQ ID NO: 99673 - DNA, 25 bp, mus musculus
cgatgcacccactatctgaagccac

SEQ ID NO: 99674 - DNA, 25 bp, mus musculus
tgcacccactatctgaagccactgc

SEQ ID NO: 99675 - DNA, 25 bp, mus musculus
catttgggatcccctgtcaacctca

SEQ ID NO: 99676 - DNA, 25 bp, mus musculus
ttgggatcccctgtcaacctcacag

SEQ ID NO: 99677 - DNA, 25 bp, mus musculus
tttacttaaatctattgttgcaaga

SEQ ID NO: 99678 - DNA, 25 bp, mus musculus
tattcctctatacccaaagagctct

SEQ ID NO: 99679 - DNA, 25 bp, mus musculus
tcctctatacccaaagagctctgaa

SEQ ID NO: 99680 - DNA, 25 bp, mus musculus
tctatacccaaagagctctgaagaa

SEQ ID NO: 99681 - DNA, 25 bp, mus musculus
aatgtcaccacactccaagttccaa

SEQ ID NO: 99682 - DNA, 25 bp, mus musculus
acagttctggggagctctaaagctc

SEQ ID NO: 99683 - DNA, 25 bp, mus musculus
agctctaaagctcttccgaaatatt

SEQ ID NO: 99684 - DNA, 25 bp, mus musculus
tctaaagctcttccgaaatattctt

SEQ ID NO: 99685 - DNA, 25 bp, mus musculus
gctcttccgaaatattcttctttgg

SEQ ID NO: 99686 - DNA, 25 bp, mus musculus
tccgaaatattcttctttggaatgg

SEQ ID NO: 99687 - DNA, 25 bp, mus musculus
tcccctgtcaacctcacagacaaga

SEQ ID NO: 99688 - DNA, 25 bp, mus musculus
cctgtcaacctcacagacaagaagt

SEQ ID NO: 99689 - DNA, 25 bp, mus musculus
gtcaacctcacagacaagaagttta

SEQ ID NO: 99690 - DNA, 25 bp, mus musculus
tttaacagtgcactgcagagtggct

SEQ ID NO: 99691 - DNA, 25 bp, mus musculus
agtgcactgcagagtggcttttgaa

SEQ ID NO: 99692 - DNA, 25 bp, mus musculus
gcactgcagagtggcttttgaacag

SEQ ID NO: 99693 - DNA, 25 bp, mus musculus
tgaacagttcgcttctgaaaatgaa

SEQ ID NO: 99694 - DNA, 25 bp, mus musculus
acagttcgcttctgaaaatgaagtt

SEQ ID NO: 99695 - DNA, 25 bp, mus musculus
gcaaccaagcaggcataacgtgact

SEQ ID NO: 99696 - DNA, 25 bp, mus musculus
caaccaagcaggcataacgtgactc

SEQ ID NO: 99697 - DNA, 25 bp, mus musculus
tgaaatgatactgcccatcaacttc

SEQ ID NO: 99698 - DNA, 25 bp, mus musculus
gaaatgatactgcccatcaacttca

SEQ ID NO: 99699 - DNA, 25 bp, mus musculus
aaatgatactgcccatcaacttcac

SEQ ID NO: 99700 - DNA, 25 bp, mus musculus
aatgatactgcccatcaacttcacc

SEQ ID NO: 99701 - DNA, 25 bp, mus musculus
atgatactgcccatcaacttcaccg

SEQ ID NO: 99702 - DNA, 25 bp, mus musculus
tgatactgcccatcaacttcaccgt

SEQ ID NO: 99703 - DNA, 25 bp, mus musculus
gatactgcccatcaacttcaccgtc

SEQ ID NO: 99704 - DNA, 25 bp, mus musculus
atactgcccatcaacttcaccgtct

SEQ ID NO: 99705 - DNA, 25 bp, mus musculus
tactgcccatcaacttcaccgtctt

SEQ ID NO: 99706 - DNA, 25 bp, mus musculus
actgcccatcaacttcaccgtcttt

SEQ ID NO: 99707 - DNA, 25 bp, mus musculus
taagtgttccggagaacgagctgga

SEQ ID NO: 99708 - DNA, 25 bp, mus musculus
agaacgagctggacagcatgctgca

SEQ ID NO: 99709 - DNA, 25 bp, mus musculus
acgagctggacagcatgctgcatga

SEQ ID NO: 99710 - DNA, 25 bp, mus musculus
agctggacagcatgctgcatgaaat

SEQ ID NO: 99711 - DNA, 25 bp, mus musculus
gctggacagcatgctgcatgaaatg

SEQ ID NO: 99712 - DNA, 25 bp, mus musculus
ctggacagcatgctgcatgaaatga

SEQ ID NO: 99713 - DNA, 25 bp, mus musculus
tggacagcatgctgcatgaaatgat

SEQ ID NO: 99714 - DNA, 25 bp, mus musculus
acagcatgctgcatgaaatgatact

SEQ ID NO: 99715 - DNA, 25 bp, mus musculus
ccatatttcctctttgctcctactc

SEQ ID NO: 99716 - DNA, 25 bp, mus musculus
atatttcctctttgctcctactctc

SEQ ID NO: 99717 - DNA, 25 bp, mus musculus
atttcatccagaattttcagccctg

SEQ ID NO: 99718 - DNA, 25 bp, mus musculus
ttcatccagaattttcagccctgcc

SEQ ID NO: 99719 - DNA, 25 bp, mus musculus
catccagaattttcagccctgcctt

SEQ ID NO: 99720 - DNA, 25 bp, mus musculus
tttcagccctgccttaaccacttga

SEQ ID NO: 99721 - DNA, 25 bp, mus musculus
ccctgccttaaccacttgataacat

SEQ ID NO: 99722 - DNA, 25 bp, mus musculus
ctgccttaaccacttgataacatgt

SEQ ID NO: 99723 - DNA, 25 bp, mus musculus
gccttaaccacttgataacatgtga

SEQ ID NO: 99724 - DNA, 25 bp, mus musculus
taaccacttgataacatgtgaaaag

SEQ ID NO: 99725 - DNA, 25 bp, mus musculus
ggctcctaacactagagaaagttca

SEQ ID NO: 99726 - DNA, 25 bp, mus musculus
ctcctaacactagagaaagttcaag

SEQ ID NO: 99727 - DNA, 25 bp, mus musculus
ccgctttacttctgatagattgccc

SEQ ID NO: 99728 - DNA, 25 bp, mus musculus
gctttacttctgatagattgccctg

SEQ ID NO: 99729 - DNA, 25 bp, mus musculus
tacttctgatagattgccctgaatt

SEQ ID NO: 99730 - DNA, 25 bp, mus musculus
cttctgatagattgccctgaatttc

SEQ ID NO: 99731 - DNA, 25 bp, mus musculus
tgatagattgccctgaatttcatcc

SEQ ID NO: 99732 - DNA, 25 bp, mus musculus
tgccctgaatttcatccagaatttt

SEQ ID NO: 99733 - DNA, 25 bp, mus musculus
ccctgaatttcatccagaattttca

SEQ ID NO: 99734 - DNA, 25 bp, mus musculus
gaatttcatccagaattttcagccc

SEQ ID NO: 99735 - DNA, 25 bp, mus musculus
gcgcaagcgcttgatgcgggatgcc

SEQ ID NO: 99736 - DNA, 25 bp, mus musculus
cgccgagcgcggtgtgagtgccatc

SEQ ID NO: 99737 - DNA, 25 bp, mus musculus
atccttctcctgtcctgcaacaaca

SEQ ID NO: 99738 - DNA, 25 bp, mus musculus
ctgtcctgcaacaacatccatatcc

SEQ ID NO: 99739 - DNA, 25 bp, mus musculus
tcctgcaacaacatccatatccagc

SEQ ID NO: 99740 - DNA, 25 bp, mus musculus
tgcaacaacatccatatccagccag

SEQ ID NO: 99741 - DNA, 25 bp, mus musculus
atccatatccagccaggtggccctg

SEQ ID NO: 99742 - DNA, 25 bp, mus musculus
catatccagccaggtggccctgtct

SEQ ID NO: 99743 - DNA, 25 bp, mus musculus
atccagccaggtggccctgtctcaa

SEQ ID NO: 99744 - DNA, 25 bp, mus musculus
ctctggtggcccttgcttaataaag

SEQ ID NO: 99745 - DNA, 25 bp, mus musculus
tggtggcccttgcttaataaagatt

SEQ ID NO: 99746 - DNA, 25 bp, mus musculus
tggcccttgcttaataaagattctc

SEQ ID NO: 99747 - DNA, 25 bp, mus musculus
cgcccaggcttttggtgaccgcatc

SEQ ID NO: 99748 - DNA, 25 bp, mus musculus
aatacgcctgcaggcggagatcttc

SEQ ID NO: 99749 - DNA, 25 bp, mus musculus
gatacaggcctctgtggctaccaac

SEQ ID NO: 99750 - DNA, 25 bp, mus musculus
catcaccccagtggcccaggagaat

SEQ ID NO: 99751 - DNA, 25 bp, mus musculus
caccccagtggcccaggagaatcaa

SEQ ID NO: 99752 - DNA, 25 bp, mus musculus
cccagtggcccaggagaatcaatga

SEQ ID NO: 99753 - DNA, 25 bp, mus musculus
atgagtatccttctcctgtcctgca

SEQ ID NO: 99754 - DNA, 25 bp, mus musculus
agtatccttctcctgtcctgcaaca

SEQ ID NO: 99755 - DNA, 25 bp, mus musculus
tgaccaaccatgagaagatgccctt

SEQ ID NO: 99756 - DNA, 25 bp, mus musculus
tgcccttttccaaagtgaagtctct

SEQ ID NO: 99757 - DNA, 25 bp, mus musculus
taggcatcacggacgaggcgactga

SEQ ID NO: 99758 - DNA, 25 bp, mus musculus
ggctcacctacagcaactggaaaaa

SEQ ID NO: 99759 - DNA, 25 bp, mus musculus
cctacagcaactggaaaaaggatga

SEQ ID NO: 99760 - DNA, 25 bp, mus musculus
agccaaataaccatggctctgggga

SEQ ID NO: 99761 - DNA, 25 bp, mus musculus
atgacatttcctgtcaagcttcctt

SEQ ID NO: 99762 - DNA, 25 bp, mus musculus
tttcctgtcaagcttccttcaaggc

SEQ ID NO: 99763 - DNA, 25 bp, mus musculus
tcccagcctgaggaaacgagtgcct

SEQ ID NO: 99764 - DNA, 25 bp, mus musculus
gaaacgagtgcctccatattctcct

SEQ ID NO: 99765 - DNA, 25 bp, mus musculus
agtgcctccatattctccttgcctc

SEQ ID NO: 99766 - DNA, 25 bp, mus musculus
tggactctcacttgcttccaaagaa

SEQ ID NO: 99767 - DNA, 25 bp, mus musculus
agtctctgtgcacagagctccaagg

SEQ ID NO: 99768 - DNA, 25 bp, mus musculus
tgtgcacagagctccaaggcactgt

SEQ ID NO: 99769 - DNA, 25 bp, mus musculus
cagagctccaaggcactgtggctat

SEQ ID NO: 99770 - DNA, 25 bp, mus musculus
tggctatccccaggaatgctgaaga

SEQ ID NO: 99771 - DNA, 25 bp, mus musculus
tccccaggaatgctgaagagaacaa

SEQ ID NO: 99772 - DNA, 25 bp, mus musculus
agaacaaggccattcaagaagtggc

SEQ ID NO: 99773 - DNA, 25 bp, mus musculus
gcattgccttcctaggcatcacgga

SEQ ID NO: 99774 - DNA, 25 bp, mus musculus
ccttcctaggcatcacggacgaggc

SEQ ID NO: 99775 - DNA, 25 bp, mus musculus
agcagatcgccctcaagggcggcaa

SEQ ID NO: 99776 - DNA, 25 bp, mus musculus
cagatcgccctcaagggcggcaaga

SEQ ID NO: 99777 - DNA, 25 bp, mus musculus
gccaagagccgggacattggtgcca

SEQ ID NO: 99778 - DNA, 25 bp, mus musculus
caagagccgggacattggtgccaag

SEQ ID NO: 99779 - DNA, 25 bp, mus musculus
agccgggacattggtgccaagaaga

SEQ ID NO: 99780 - DNA, 25 bp, mus musculus
cgaggaataacctctccagcagacc

SEQ ID NO: 99781 - DNA, 25 bp, mus musculus
aggaataacctctccagcagaccct

SEQ ID NO: 99782 - DNA, 25 bp, mus musculus
tccagcagaccctcgctgtggccaa

SEQ ID NO: 99783 - DNA, 25 bp, mus musculus
agaccctcgctgtggccaatacaca

SEQ ID NO: 99784 - DNA, 25 bp, mus musculus
tcgctgtggccaatacacaataaac

SEQ ID NO: 99785 - DNA, 25 bp, mus musculus
gccaatacacaataaacataacgtt

SEQ ID NO: 99786 - DNA, 25 bp, mus musculus
caatacacaataaacataacgttcg

SEQ ID NO: 99787 - DNA, 25 bp, mus musculus
aagcagctgcagaagctggaggcgc

SEQ ID NO: 99788 - DNA, 25 bp, mus musculus
aaagcgcaatgcagagtcggtgaag

SEQ ID NO: 99789 - DNA, 25 bp, mus musculus
catcaaggagctcacctaccagaca

SEQ ID NO: 99790 - DNA, 25 bp, mus musculus
cacctaccagacagaggaagacaag

SEQ ID NO: 99791 - DNA, 25 bp, mus musculus
aacttaatgcggctgcaggacctgg

SEQ ID NO: 99792 - DNA, 25 bp, mus musculus
cttaatgcggctgcaggacctggtg

SEQ ID NO: 99793 - DNA, 25 bp, mus musculus
tgaaggcctacaagcgccaggctga

SEQ ID NO: 99794 - DNA, 25 bp, mus musculus
ctgcgggccaagagccgggacattg

SEQ ID NO: 99795 - DNA, 25 bp, mus musculus
gcgcattcgcaatgcggctgacatc

SEQ ID NO: 99796 - DNA, 25 bp, mus musculus
cattcgcaatgcggctgacatctca

SEQ ID NO: 99797 - DNA, 25 bp, mus musculus
taccgttggaggcttcttcctggca

SEQ ID NO: 99798 - DNA, 25 bp, mus musculus
aggcttcttcctggcaggccgaagt

SEQ ID NO: 99799 - DNA, 25 bp, mus musculus
cttcctggcaggccgaagtatggtg

SEQ ID NO: 99800 - DNA, 25 bp, mus musculus
agcctctctctttgccagtaacatt

SEQ ID NO: 99801 - DNA, 25 bp, mus musculus
ctctctctttgccagtaacattgga

SEQ ID NO: 99802 - DNA, 25 bp, mus musculus
tctctttgccagtaacattggaagt

SEQ ID NO: 99803 - DNA, 25 bp, mus musculus
ctttgccagtaacattggaagtggt

SEQ ID NO: 99804 - DNA, 25 bp, mus musculus
cacaggagcagccgcacgtctgcca

SEQ ID NO: 99805 - DNA, 25 bp, mus musculus
acgtctgccatgggtggctttgaat

SEQ ID NO: 99806 - DNA, 25 bp, mus musculus
tgtgctgggctggatatttgtcccg

SEQ ID NO: 99807 - DNA, 25 bp, mus musculus
tcgcaatgcggctgacatctcagtc

SEQ ID NO: 99808 - DNA, 25 bp, mus musculus
caatgcggctgacatctcagtcatc

SEQ ID NO: 99809 - DNA, 25 bp, mus musculus
tgcggctgacatctcagtcatcgtc

SEQ ID NO: 99810 - DNA, 25 bp, mus musculus
ggctgacatctcagtcatcgtcatc

SEQ ID NO: 99811 - DNA, 25 bp, mus musculus
tgacatctcagtcatcgtcatctac

SEQ ID NO: 99812 - DNA, 25 bp, mus musculus
catctcagtcatcgtcatctacttc

SEQ ID NO: 99813 - DNA, 25 bp, mus musculus
ctacttcgtggtggtgatggctgtc

SEQ ID NO: 99814 - DNA, 25 bp, mus musculus
ggccatgttttccactaatcgtggt

SEQ ID NO: 99815 - DNA, 25 bp, mus musculus
cattacttgtgtctcctcgtataga

SEQ ID NO: 99816 - DNA, 25 bp, mus musculus
attacttgtgtctcctcgtatagag

SEQ ID NO: 99817 - DNA, 25 bp, mus musculus
gcgcttgtcatgctattcactcctc

SEQ ID NO: 99818 - DNA, 25 bp, mus musculus
cgcttgtcatgctattcactcctca

SEQ ID NO: 99819 - DNA, 25 bp, mus musculus
gcttgtcatgctattcactcctcag

SEQ ID NO: 99820 - DNA, 25 bp, mus musculus
cttgtcatgctattcactcctcagt

SEQ ID NO: 99821 - DNA, 25 bp, mus musculus
ttgtcatgctattcactcctcagtg

SEQ ID NO: 99822 - DNA, 25 bp, mus musculus
tgtcatgctattcactcctcagtgg

SEQ ID NO: 99823 - DNA, 25 bp, mus musculus
gtcatgctattcactcctcagtggc

SEQ ID NO: 99824 - DNA, 25 bp, mus musculus
tcatgctattcactcctcagtggct

SEQ ID NO: 99825 - DNA, 25 bp, mus musculus
ttcactcctcagtggctacacagat

SEQ ID NO: 99826 - DNA, 25 bp, mus musculus
tcactcctcagtggctacacagatg

SEQ ID NO: 99827 - DNA, 25 bp, mus musculus
ctcctcgtatagaggcgcttgtcat

SEQ ID NO: 99828 - DNA, 25 bp, mus musculus
tcctcgtatagaggcgcttgtcatg

SEQ ID NO: 99829 - DNA, 25 bp, mus musculus
cctcgtatagaggcgcttgtcatgc

SEQ ID NO: 99830 - DNA, 25 bp, mus musculus
gtatagaggcgcttgtcatgctatt

SEQ ID NO: 99831 - DNA, 25 bp, mus musculus
tatagaggcgcttgtcatgctattc

SEQ ID NO: 99832 - DNA, 25 bp, mus musculus
agaggcgcttgtcatgctattcact

SEQ ID NO: 99833 - DNA, 25 bp, mus musculus
aggcgcttgtcatgctattcactcc

SEQ ID NO: 99834 - DNA, 25 bp, mus musculus
ggcgcttgtcatgctattcactcct

SEQ ID NO: 99835 - DNA, 25 bp, mus musculus
taggtgcatacggacccggagtgac

SEQ ID NO: 99836 - DNA, 25 bp, mus musculus
gtgcatacggacccggagtgactct

SEQ ID NO: 99837 - DNA, 25 bp, mus musculus
gcttcgagctggacctcatgtagac

SEQ ID NO: 99838 - DNA, 25 bp, mus musculus
tcgagctggacctcatgtagacata

SEQ ID NO: 99839 - DNA, 25 bp, mus musculus
agctggacctcatgtagacatacct

SEQ ID NO: 99840 - DNA, 25 bp, mus musculus
acctcatgtagacatacctgtgcag

SEQ ID NO: 99841 - DNA, 25 bp, mus musculus
tgtagacatacctgtgcagcaccgt

SEQ ID NO: 99842 - DNA, 25 bp, mus musculus
catacctgtgcagcaccgtcaagtc

SEQ ID NO: 99843 - DNA, 25 bp, mus musculus
acctgtgcagcaccgtcaagtccgt

SEQ ID NO: 99844 - DNA, 25 bp, mus musculus
tgtgcagcaccgtcaagtccgtaca

SEQ ID NO: 99845 - DNA, 25 bp, mus musculus
gcaccgtcaagtccgtacatgacgt

SEQ ID NO: 99846 - DNA, 25 bp, mus musculus
ccgtcaagtccgtacatgacgtgtc

SEQ ID NO: 99847 - DNA, 25 bp, mus musculus
gctgcttctagttcagcacagcttc

SEQ ID NO: 99848 - DNA, 25 bp, mus musculus
tctagttcagcacagcttcaagtcg

SEQ ID NO: 99849 - DNA, 25 bp, mus musculus
agttcagcacagcttcaagtcgtgc

SEQ ID NO: 99850 - DNA, 25 bp, mus musculus
tcagcacagcttcaagtcgtgccaa

SEQ ID NO: 99851 - DNA, 25 bp, mus musculus
cagcttcaagtcgtgccaaccgtct

SEQ ID NO: 99852 - DNA, 25 bp, mus musculus
accgtctgagccgtgtcatcgttga

SEQ ID NO: 99853 - DNA, 25 bp, mus musculus
tgagccgtgtcatcgttgaagagtg

SEQ ID NO: 99854 - DNA, 25 bp, mus musculus
tccgcagcttcgagctggacctcat

SEQ ID NO: 99855 - DNA, 25 bp, mus musculus
atttaatctcatctatagtcctcct

SEQ ID NO: 99856 - DNA, 25 bp, mus musculus
catctatagtcctccttaggaaaat

SEQ ID NO: 99857 - DNA, 25 bp, mus musculus
gtcttgatcctctcactgcgttcct

SEQ ID NO: 99858 - DNA, 25 bp, mus musculus
ttgatcctctcactgcgttccttct

SEQ ID NO: 99859 - DNA, 25 bp, mus musculus
gcagccagctcctcttcaatcttct

SEQ ID NO: 99860 - DNA, 25 bp, mus musculus
gccagctcctcttcaatcttctgct

SEQ ID NO: 99861 - DNA, 25 bp, mus musculus
tcttcaatcttctgctcaagatgcg

SEQ ID NO: 99862 - DNA, 25 bp, mus musculus
tcaatcttctgctcaagatgcgctc

SEQ ID NO: 99863 - DNA, 25 bp, mus musculus
atcttctgctcaagatgcgctctga

SEQ ID NO: 99864 - DNA, 25 bp, mus musculus
tctgctctagcttctgtagctcgcg

SEQ ID NO: 99865 - DNA, 25 bp, mus musculus
gggcctccgtttgcatcttgatttt

SEQ ID NO: 99866 - DNA, 25 bp, mus musculus
cctccgtttgcatcttgattttgct

SEQ ID NO: 99867 - DNA, 25 bp, mus musculus
ttcccaaagcccattctgaggctct

SEQ ID NO: 99868 - DNA, 25 bp, mus musculus
attctgaggctctccatgtcaaaag

SEQ ID NO: 99869 - DNA, 25 bp, mus musculus
ctctccatgtcaaaagtctcggtct

SEQ ID NO: 99870 - DNA, 25 bp, mus musculus
tccatgtcaaaagtctcggtctctc

SEQ ID NO: 99871 - DNA, 25 bp, mus musculus
tcaaaagtctcggtctctcgctctt

SEQ ID NO: 99872 - DNA, 25 bp, mus musculus
tgtctctccaggagagtcttgatcc

SEQ ID NO: 99873 - DNA, 25 bp, mus musculus
ctctccaggagagtcttgatcctct

SEQ ID NO: 99874 - DNA, 25 bp, mus musculus
agagtcttgatcctctcactgcgtt

SEQ ID NO: 99875 - DNA, 25 bp, mus musculus
ccatccattactaatgttttagtgc

SEQ ID NO: 99876 - DNA, 25 bp, mus musculus
catccattactaatgttttagtgca

SEQ ID NO: 99877 - DNA, 25 bp, mus musculus
tctctaacgcactgtctccaagagt

SEQ ID NO: 99878 - DNA, 25 bp, mus musculus
tctaacgcactgtctccaagagtga

SEQ ID NO: 99879 - DNA, 25 bp, mus musculus
ctaacgcactgtctccaagagtgat

SEQ ID NO: 99880 - DNA, 25 bp, mus musculus
taacgcactgtctccaagagtgatt

SEQ ID NO: 99881 - DNA, 25 bp, mus musculus
acgcactgtctccaagagtgattag

SEQ ID NO: 99882 - DNA, 25 bp, mus musculus
cgcactgtctccaagagtgattagg

SEQ ID NO: 99883 - DNA, 25 bp, mus musculus
gcactgtctccaagagtgattagga

SEQ ID NO: 99884 - DNA, 25 bp, mus musculus
actgtctccaagagtgattaggaac

SEQ ID NO: 99885 - DNA, 25 bp, mus musculus
ctgtctccaagagtgattaggaaca

SEQ ID NO: 99886 - DNA, 25 bp, mus musculus
tgtctccaagagtgattaggaacat

SEQ ID NO: 99887 - DNA, 25 bp, mus musculus
tttagtgcagggcaaacaggtaact

SEQ ID NO: 99888 - DNA, 25 bp, mus musculus
gtaactctaggtgcctttggacatg

SEQ ID NO: 99889 - DNA, 25 bp, mus musculus
taactctaggtgcctttggacatga

SEQ ID NO: 99890 - DNA, 25 bp, mus musculus
actctaggtgcctttggacatgaag

SEQ ID NO: 99891 - DNA, 25 bp, mus musculus
ctctaggtgcctttggacatgaaga

SEQ ID NO: 99892 - DNA, 25 bp, mus musculus
tctaggtgcctttggacatgaagag

SEQ ID NO: 99893 - DNA, 25 bp, mus musculus
aggtgcctttggacatgaagaggag

SEQ ID NO: 99894 - DNA, 25 bp, mus musculus
tgcctttggacatgaagaggaggtc

SEQ ID NO: 99895 - DNA, 25 bp, mus musculus
atcagaaccttggtctgatcatcct

SEQ ID NO: 99896 - DNA, 25 bp, mus musculus
agaaccttggtctgatcatcctgtt

SEQ ID NO: 99897 - DNA, 25 bp, mus musculus
gagccactttagacaacaccacctc

SEQ ID NO: 99898 - DNA, 25 bp, mus musculus
ccctggactccagggctgacagctt

SEQ ID NO: 99899 - DNA, 25 bp, mus musculus
tggactccagggctgacagcttcga

SEQ ID NO: 99900 - DNA, 25 bp, mus musculus
actccagggctgacagcttcgaaaa

SEQ ID NO: 99901 - DNA, 25 bp, mus musculus
ctgacagcttcgaaaaagggatcag

SEQ ID NO: 99902 - DNA, 25 bp, mus musculus
atcacaggcaggaactcgaggcagg

SEQ ID NO: 99903 - DNA, 25 bp, mus musculus
aggaactcgaggcaggccgagactt

SEQ ID NO: 99904 - DNA, 25 bp, mus musculus
aactcgaggcaggccgagacttgag

SEQ ID NO: 99905 - DNA, 25 bp, mus musculus
tcgaggcaggccgagacttgagcca

SEQ ID NO: 99906 - DNA, 25 bp, mus musculus
caggccgagacttgagccagaaggt

SEQ ID NO: 99907 - DNA, 25 bp, mus musculus
accttggtctgatcatcctgttgtc

SEQ ID NO: 99908 - DNA, 25 bp, mus musculus
gtctgatcatcctgttgtccttatc

SEQ ID NO: 99909 - DNA, 25 bp, mus musculus
tgatcatcctgttgtccttatcaga

SEQ ID NO: 99910 - DNA, 25 bp, mus musculus
tcatcctgttgtccttatcagattc

SEQ ID NO: 99911 - DNA, 25 bp, mus musculus
tgttgtccttatcagattcccagtt

SEQ ID NO: 99912 - DNA, 25 bp, mus musculus
ccttatcagattcccagttaaggag

SEQ ID NO: 99913 - DNA, 25 bp, mus musculus
taggcaccctgagagccactttaga

SEQ ID NO: 99914 - DNA, 25 bp, mus musculus
ccctgagagccactttagacaacac

SEQ ID NO: 99915 - DNA, 25 bp, mus musculus
ctgatatcagcactggatcgtagaa

SEQ ID NO: 99916 - DNA, 25 bp, mus musculus
tgctgatttttgaccttgtattcaa

SEQ ID NO: 99917 - DNA, 25 bp, mus musculus
gtattaaccaacagcagacttccag

SEQ ID NO: 99918 - DNA, 25 bp, mus musculus
accaacagcagacttccaggatttc

SEQ ID NO: 99919 - DNA, 25 bp, mus musculus
ggatttcctgaggctggcaagggtt

SEQ ID NO: 99920 - DNA, 25 bp, mus musculus
accagttaccactccttcttgccag

SEQ ID NO: 99921 - DNA, 25 bp, mus musculus
taccactccttcttgccagtctaac

SEQ ID NO: 99922 - DNA, 25 bp, mus musculus
tccttcttgccagtctaacagggtg

SEQ ID NO: 99923 - DNA, 25 bp, mus musculus
caccatcggttgttagttgccttga

SEQ ID NO: 99924 - DNA, 25 bp, mus musculus
gaacgtttgcatcgacacctgtaaa

SEQ ID NO: 99925 - DNA, 25 bp, mus musculus
ttgcatcgacacctgtaaatgtatt

SEQ ID NO: 99926 - DNA, 25 bp, mus musculus
cccagcaacacgtcattgtgtaaag

SEQ ID NO: 99927 - DNA, 25 bp, mus musculus
tattcaagttaactgctcccttggt

SEQ ID NO: 99928 - DNA, 25 bp, mus musculus
ctgctcccttggtatatgtttaata

SEQ ID NO: 99929 - DNA, 25 bp, mus musculus
tatatgtttaataccctgtgcatat

SEQ ID NO: 99930 - DNA, 25 bp, mus musculus
tttagtccttagttcatgtggctcg

SEQ ID NO: 99931 - DNA, 25 bp, mus musculus
ccttagttcatgtggctcggtcact

SEQ ID NO: 99932 - DNA, 25 bp, mus musculus
ggatctctgtgagcaccactgagtg

SEQ ID NO: 99933 - DNA, 25 bp, mus musculus
ctgtgagcaccactgagtgatctgt

SEQ ID NO: 99934 - DNA, 25 bp, mus musculus
gcaccactgagtgatctgtgcaggg

SEQ ID NO: 99935 - DNA, 25 bp, mus musculus
gtcccttcagagaagcagggcttcg

SEQ ID NO: 99936 - DNA, 25 bp, mus musculus
cttcgaagcagccagcatcaaggag

SEQ ID NO: 99937 - DNA, 25 bp, mus musculus
gcctctgtgctgcacaacctgaggg

SEQ ID NO: 99938 - DNA, 25 bp, mus musculus
ctctgtgctgcacaacctgagggag

SEQ ID NO: 99939 - DNA, 25 bp, mus musculus
gctgcacaacctgagggagcgatac

SEQ ID NO: 99940 - DNA, 25 bp, mus musculus
tgcacaacctgagggagcgatactt

SEQ ID NO: 99941 - DNA, 25 bp, mus musculus
cacaacctgagggagcgatacttct

SEQ ID NO: 99942 - DNA, 25 bp, mus musculus
gatacttctcaggcctcatctatac

SEQ ID NO: 99943 - DNA, 25 bp, mus musculus
tcaggcctcatctatacctactctg

SEQ ID NO: 99944 - DNA, 25 bp, mus musculus
aggcctcatctatacctactctggc

SEQ ID NO: 99945 - DNA, 25 bp, mus musculus
cctactctggcctcttctgtgtggt

SEQ ID NO: 99946 - DNA, 25 bp, mus musculus
ggcctcttctgtgtggtggtcaacc

SEQ ID NO: 99947 - DNA, 25 bp, mus musculus
tcgaagcagccagcatcaaggagga

SEQ ID NO: 99948 - DNA, 25 bp, mus musculus
tcttctgtgtggtggtcaaccccta

SEQ ID NO: 99949 - DNA, 25 bp, mus musculus
agcagccagcatcaaggaggagaag

SEQ ID NO: 99950 - DNA, 25 bp, mus musculus
cagccagcatcaaggaggagaaggg

SEQ ID NO: 99951 - DNA, 25 bp, mus musculus
gactgacgtgcctcaatgaggcctc

SEQ ID NO: 99952 - DNA, 25 bp, mus musculus
cgtgcctcaatgaggcctctgtgct

SEQ ID NO: 99953 - DNA, 25 bp, mus musculus
tgcctcaatgaggcctctgtgctgc

SEQ ID NO: 99954 - DNA, 25 bp, mus musculus
cctcaatgaggcctctgtgctgcac

SEQ ID NO: 99955 - DNA, 25 bp, mus musculus
aggcctctgtgctgcacaacctgag

SEQ ID NO: 99956 - DNA, 25 bp, mus musculus
acctcacagttgcgcgtttcgtgga

SEQ ID NO: 99957 - DNA, 25 bp, mus musculus
ctcacagttgcgcgtttcgtggacg

SEQ ID NO: 99958 - DNA, 25 bp, mus musculus
tctgtgacatcccaacgcgtgcctc

SEQ ID NO: 99959 - DNA, 25 bp, mus musculus
tgtgacatcccaacgcgtgcctcaa

SEQ ID NO: 99960 - DNA, 25 bp, mus musculus
acatcccaacgcgtgcctcaagatg

SEQ ID NO: 99961 - DNA, 25 bp, mus musculus
atcccaacgcgtgcctcaagatggc

SEQ ID NO: 99962 - DNA, 25 bp, mus musculus
cccaacgcgtgcctcaagatggcag

SEQ ID NO: 99963 - DNA, 25 bp, mus musculus
caacgcgtgcctcaagatggcagtc

SEQ ID NO: 99964 - DNA, 25 bp, mus musculus
gcgtgcctcaagatggcagtcacct

SEQ ID NO: 99965 - DNA, 25 bp, mus musculus
atctctgagcagtttacggcctatg

SEQ ID NO: 99966 - DNA, 25 bp, mus musculus
gagcagtttacggcctatgttccgc

SEQ ID NO: 99967 - DNA, 25 bp, mus musculus
gcagtttacggcctatgttccgccg

SEQ ID NO: 99968 - DNA, 25 bp, mus musculus
cacagttgcgcgtttcgtggacgat

SEQ ID NO: 99969 - DNA, 25 bp, mus musculus
cagttgcgcgtttcgtggacgatgt

SEQ ID NO: 99970 - DNA, 25 bp, mus musculus
tttcgtggacgatgtcatgaaggag

SEQ ID NO: 99971 - DNA, 25 bp, mus musculus
tgagcagatgctcaaccgtgcagaa

SEQ ID NO: 99972 - DNA, 25 bp, mus musculus
cagatgctcaaccgtgcagaacaag

SEQ ID NO: 99973 - DNA, 25 bp, mus musculus
gatgctcaaccgtgcagaacaagaa

SEQ ID NO: 99974 - DNA, 25 bp, mus musculus
tgctcaaccgtgcagaacaagaata

SEQ ID NO: 99975 - DNA, 25 bp, mus musculus
ctcaaccgtgcagaacaagaatagc

SEQ ID NO: 99976 - DNA, 25 bp, mus musculus
ctgaggctcgctctgccgtacgcta

SEQ ID NO: 99977 - DNA, 25 bp, mus musculus
gctctgccgtacgctaggcttggta

SEQ ID NO: 99978 - DNA, 25 bp, mus musculus
atacggcgccatccgacatcgacct

SEQ ID NO: 99979 - DNA, 25 bp, mus musculus
tacggcgccatccgacatcgacctg

SEQ ID NO: 99980 - DNA, 25 bp, mus musculus
acggcgccatccgacatcgacctga

SEQ ID NO: 99981 - DNA, 25 bp, mus musculus
cggcgccatccgacatcgacctgaa

SEQ ID NO: 99982 - DNA, 25 bp, mus musculus
ggcgccatccgacatcgacctgaag

SEQ ID NO: 99983 - DNA, 25 bp, mus musculus
gcgccatccgacatcgacctgaaga

SEQ ID NO: 99984 - DNA, 25 bp, mus musculus
cgccatccgacatcgacctgaagaa

SEQ ID NO: 99985 - DNA, 25 bp, mus musculus
gccatccgacatcgacctgaagaac

SEQ ID NO: 99986 - DNA, 25 bp, mus musculus
ccatccgacatcgacctgaagaacc

SEQ ID NO: 99987 - DNA, 25 bp, mus musculus
catccgacatcgacctgaagaaccg

SEQ ID NO: 99988 - DNA, 25 bp, mus musculus
tgccgtacgctaggcttggtaggaa

SEQ ID NO: 99989 - DNA, 25 bp, mus musculus
gccgtacgctaggcttggtaggaag

SEQ ID NO: 99990 - DNA, 25 bp, mus musculus
gggaacaacgactgccactacgtgg

SEQ ID NO: 99991 - DNA, 25 bp, mus musculus
ggaacaacgactgccactacgtggg

SEQ ID NO: 99992 - DNA, 25 bp, mus musculus
gaacaacgactgccactacgtgggt

SEQ ID NO: 99993 - DNA, 25 bp, mus musculus
tacaaatacggcgccatccgacatc

SEQ ID NO: 99994 - DNA, 25 bp, mus musculus
caaatacggcgccatccgacatcga

SEQ ID NO: 99995 - DNA, 25 bp, mus musculus
aatacggcgccatccgacatcgacc

SEQ ID NO: 99996 - DNA, 25 bp, mus musculus
cgttcagccttcctggctgccatgt

SEQ ID NO: 99997 - DNA, 25 bp, mus musculus
ttcctggctgccatgtagaggttgc

SEQ ID NO: 99998 - DNA, 25 bp, mus musculus
tttagctccacttcttcagcttccc

SEQ ID NO: 99999 - DNA, 25 bp, mus musculus
tcttcagcttcccacttttcaaact

SEQ ID NO: 100000 - DNA, 25 bp, mus musculus
tcccacttttcaaactggccagtga

SEQ ID NO: 100001 - DNA, 25 bp, mus musculus
tcaaactggccagtgatgtctacag

SEQ ID NO: 100002 - DNA, 25 bp, mus musculus
tggccagtgatgtctacaggggctc

SEQ ID NO: 100003 - DNA, 25 bp, mus musculus
atgtctacaggggctcggaggatgt

SEQ ID NO: 100004 - DNA, 25 bp, mus musculus
ttttcatactgaagagcagactcca

SEQ ID NO: 100005 - DNA, 25 bp, mus musculus
agagcagactccatagtgttgctgg

SEQ ID NO: 100006 - DNA, 25 bp, mus musculus
gcagactccatagtgttgctggaat

SEQ ID NO: 100007 - DNA, 25 bp, mus musculus
gactccatagtgttgctggaatagt

SEQ ID NO: 100008 - DNA, 25 bp, mus musculus
ctggctgccatgtagaggttgcact

SEQ ID NO: 100009 - DNA, 25 bp, mus musculus
gaatagtccagtgtgtctttccatg

SEQ ID NO: 100010 - DNA, 25 bp, mus musculus
aggttgcactgactgaccaaagccc

SEQ ID NO: 100011 - DNA, 25 bp, mus musculus
tgactgaccaaagcccgcatctctt

SEQ ID NO: 100012 - DNA, 25 bp, mus musculus
aaagcccgcatctcttccatgacag

SEQ ID NO: 100013 - DNA, 25 bp, mus musculus
atgttatcacacaaggcttcgtgaa

SEQ ID NO: 100014 - DNA, 25 bp, mus musculus
ttatcacacaaggcttcgtgaactg

SEQ ID NO: 100015 - DNA, 25 bp, mus musculus
tcacacaaggcttcgtgaactgcgg

SEQ ID NO: 100016 - DNA, 25 bp, mus musculus
tcgtgaactgcggtcttcttgccat

SEQ ID NO: 100017 - DNA, 25 bp, mus musculus
actccattcggaagcagtataaact

SEQ ID NO: 100018 - DNA, 25 bp, mus musculus
cgaccctctcaggccagcagagtga

SEQ ID NO: 100019 - DNA, 25 bp, mus musculus
tcctacctccgaagcatttcacaga

SEQ ID NO: 100020 - DNA, 25 bp, mus musculus
ctccgaagcatttcacagaagatgg

SEQ ID NO: 100021 - DNA, 25 bp, mus musculus
gcaatgtcctgcagcttgccaacct

SEQ ID NO: 100022 - DNA, 25 bp, mus musculus
atgtcctgcagcttgccaacctgcc

SEQ ID NO: 100023 - DNA, 25 bp, mus musculus
agcttgccaacctgccagatctata

SEQ ID NO: 100024 - DNA, 25 bp, mus musculus
ttgccaacctgccagatctatacaa

SEQ ID NO: 100025 - DNA, 25 bp, mus musculus
ccaacctgccagatctatacaaagt

SEQ ID NO: 100026 - DNA, 25 bp, mus musculus
acctgccagatctatacaaagtctt

SEQ ID NO: 100027 - DNA, 25 bp, mus musculus
atctatacaaagtctttgagcggtg

SEQ ID NO: 100028 - DNA, 25 bp, mus musculus
tatacaaagtctttgagcggtgtta

SEQ ID NO: 100029 - DNA, 25 bp, mus musculus
tctcaggccagcagagtgacatgcc

SEQ ID NO: 100030 - DNA, 25 bp, mus musculus
gtgacatgcctggctccacgtcaaa

SEQ ID NO: 100031 - DNA, 25 bp, mus musculus
acatgcctggctccacgtcaaagcc

SEQ ID NO: 100032 - DNA, 25 bp, mus musculus
tgcctggctccacgtcaaagccctg

SEQ ID NO: 100033 - DNA, 25 bp, mus musculus
ctggctccacgtcaaagccctggaa

SEQ ID NO: 100034 - DNA, 25 bp, mus musculus
acattatctataaagccttccgctc

SEQ ID NO: 100035 - DNA, 25 bp, mus musculus
ttatctataaagccttccgctcaca

SEQ ID NO: 100036 - DNA, 25 bp, mus musculus
tctataaagccttccgctcacacct

SEQ ID NO: 100037 - DNA, 25 bp, mus musculus
aagtaccacatagacctagatctac

SEQ ID NO: 100038 - DNA, 25 bp, mus musculus
accacatagacctagatctacactt

SEQ ID NO: 100039 - DNA, 25 bp, mus musculus
tgggacaacattcacggacgtgctg

SEQ ID NO: 100040 - DNA, 25 bp, mus musculus
acaacattcacggacgtgctgggaa

SEQ ID NO: 100041 - DNA, 25 bp, mus musculus
cattcacggacgtgctgggaaacac

SEQ ID NO: 100042 - DNA, 25 bp, mus musculus
ttcacggacgtgctgggaaacactt

SEQ ID NO: 100043 - DNA, 25 bp, mus musculus
gggaaacacttatccatagcgacca

SEQ ID NO: 100044 - DNA, 25 bp, mus musculus
gaaacacttatccatagcgaccaca

SEQ ID NO: 100045 - DNA, 25 bp, mus musculus
aacacttatccatagcgaccacacg

SEQ ID NO: 100046 - DNA, 25 bp, mus musculus
tatccatagcgaccacacgcacctt

SEQ ID NO: 100047 - DNA, 25 bp, mus musculus
tccatagcgaccacacgcaccttgt

SEQ ID NO: 100048 - DNA, 25 bp, mus musculus
catagcgaccacacgcaccttgtca

SEQ ID NO: 100049 - DNA, 25 bp, mus musculus
cacatagacctagatctacacttca

SEQ ID NO: 100050 - DNA, 25 bp, mus musculus
catagacctagatctacacttcaat

SEQ ID NO: 100051 - DNA, 25 bp, mus musculus
tagacctagatctacacttcaatga

SEQ ID NO: 100052 - DNA, 25 bp, mus musculus
cctagatctacacttcaatgatatg

SEQ ID NO: 100053 - DNA, 25 bp, mus musculus
tagatctacacttcaatgatatggt

SEQ ID NO: 100054 - DNA, 25 bp, mus musculus
gatctacacttcaatgatatggtgg

SEQ ID NO: 100055 - DNA, 25 bp, mus musculus
tctacacttcaatgatatggtggga

SEQ ID NO: 100056 - DNA, 25 bp, mus musculus
cacttcaatgatatggtgggacaac

SEQ ID NO: 100057 - DNA, 25 bp, mus musculus
cggaccttgtgagcgcgcaggccag

SEQ ID NO: 100058 - DNA, 25 bp, mus musculus
gaccttgtgagcgcgcaggccaggc

SEQ ID NO: 100059 - DNA, 25 bp, mus musculus
ctccggcaagggcaccgtgtcgtca

SEQ ID NO: 100060 - DNA, 25 bp, mus musculus
gcaccgtgtcgtcacgcatcaccaa

SEQ ID NO: 100061 - DNA, 25 bp, mus musculus
caccgtgtcgtcacgcatcaccaaa

SEQ ID NO: 100062 - DNA, 25 bp, mus musculus
ccgtgtcgtcacgcatcaccaaaca

SEQ ID NO: 100063 - DNA, 25 bp, mus musculus
cgtgtcgtcacgcatcaccaaacac

SEQ ID NO: 100064 - DNA, 25 bp, mus musculus
tgtcgtcacgcatcaccaaacactt

SEQ ID NO: 100065 - DNA, 25 bp, mus musculus
gtcgtcacgcatcaccaaacacttc

SEQ ID NO: 100066 - DNA, 25 bp, mus musculus
cgtcacgcatcaccaaacacttcga

SEQ ID NO: 100067 - DNA, 25 bp, mus musculus
gtcacgcatcaccaaacacttcgag

SEQ ID NO: 100068 - DNA, 25 bp, mus musculus
cacgcatcaccaaacacttcgagct

SEQ ID NO: 100069 - DNA, 25 bp, mus musculus
accttgtgagcgcgcaggccaggcc

SEQ ID NO: 100070 - DNA, 25 bp, mus musculus
acgcatcaccaaacacttcgagctg

SEQ ID NO: 100071 - DNA, 25 bp, mus musculus
caggccaggccacagaccagcgtct

SEQ ID NO: 100072 - DNA, 25 bp, mus musculus
aggccaggccacagaccagcgtctg

SEQ ID NO: 100073 - DNA, 25 bp, mus musculus
aggccacagaccagcgtctgcgacg

SEQ ID NO: 100074 - DNA, 25 bp, mus musculus
ggccacagaccagcgtctgcgacgt

SEQ ID NO: 100075 - DNA, 25 bp, mus musculus
ccacagaccagcgtctgcgacgtcg

SEQ ID NO: 100076 - DNA, 25 bp, mus musculus
cacagaccagcgtctgcgacgtcgg

SEQ ID NO: 100077 - DNA, 25 bp, mus musculus
gctccggcaagggcaccgtgtcgtc

SEQ ID NO: 100078 - DNA, 25 bp, mus musculus
aatatcactgtggtggttctgcact

SEQ ID NO: 100079 - DNA, 25 bp, mus musculus
gttctgcactcccttgagagcatta

SEQ ID NO: 100080 - DNA, 25 bp, mus musculus
cgaatgactcactaccagagcttgc

SEQ ID NO: 100081 - DNA, 25 bp, mus musculus
atgactcactaccagagcttgccct

SEQ ID NO: 100082 - DNA, 25 bp, mus musculus
tgacttttgcctcctaccatcctca

SEQ ID NO: 100083 - DNA, 25 bp, mus musculus
gtcactttattacccaaaattgatg

SEQ ID NO: 100084 - DNA, 25 bp, mus musculus
gatgagactccagtgcacaactgtg

SEQ ID NO: 100085 - DNA, 25 bp, mus musculus
gagactccagtgcacaactgtgaag

SEQ ID NO: 100086 - DNA, 25 bp, mus musculus
attggaactcgaccagacctcacag

SEQ ID NO: 100087 - DNA, 25 bp, mus musculus
ggaactcgaccagacctcacagatc

SEQ ID NO: 100088 - DNA, 25 bp, mus musculus
actcgaccagacctcacagatcagc

SEQ ID NO: 100089 - DNA, 25 bp, mus musculus
cgaccagacctcacagatcagccgt

SEQ ID NO: 100090 - DNA, 25 bp, mus musculus
ctgcactcccttgagagcattatca

SEQ ID NO: 100091 - DNA, 25 bp, mus musculus
gaccagacctcacagatcagccgtg

SEQ ID NO: 100092 - DNA, 25 bp, mus musculus
cactcccttgagagcattatcagga

SEQ ID NO: 100093 - DNA, 25 bp, mus musculus
tcccttgagagcattatcaggaagc

SEQ ID NO: 100094 - DNA, 25 bp, mus musculus
atcaggaagctgccagaccgctgga

SEQ ID NO: 100095 - DNA, 25 bp, mus musculus
atgaccaatgctcgaatgactcact

SEQ ID NO: 100096 - DNA, 25 bp, mus musculus
accaatgctcgaatgactcactacc

SEQ ID NO: 100097 - DNA, 25 bp, mus musculus
aatgctcgaatgactcactaccaga

SEQ ID NO: 100098 - DNA, 25 bp, mus musculus
gctcgaatgactcactaccagagct

SEQ ID NO: 100099 - DNA, 25 bp, mus musculus
atttgctgttgtttctataaatgac

SEQ ID NO: 100100 - DNA, 25 bp, mus musculus
ctattgtaatgccaacatgacacag

SEQ ID NO: 100101 - DNA, 25 bp, mus musculus
ttaattacaaattcactgtgttatt

SEQ ID NO: 100102 - DNA, 25 bp, mus musculus
ttacaaattcactgtgttatttaag

SEQ ID NO: 100103 - DNA, 25 bp, mus musculus
ctatgcttagtgccaatagtaagtg

SEQ ID NO: 100104 - DNA, 25 bp, mus musculus
ttcttctactggcttgtaatttagg

SEQ ID NO: 100105 - DNA, 25 bp, mus musculus
catacttatatcaaggtcccaaaat

SEQ ID NO: 100106 - DNA, 25 bp, mus musculus
tacttatatcaaggtcccaaaatat

SEQ ID NO: 100107 - DNA, 25 bp, mus musculus
cttttccatttcaaagacagcactt

SEQ ID NO: 100108 - DNA, 25 bp, mus musculus
tttccatttcaaagacagcactttg

SEQ ID NO: 100109 - DNA, 25 bp, mus musculus
tccatttcaaagacagcactttgaa

SEQ ID NO: 100110 - DNA, 25 bp, mus musculus
catttcaaagacagcactttgaaaa

SEQ ID NO: 100111 - DNA, 25 bp, mus musculus
attgtaatgccaacatgacacagct

SEQ ID NO: 100112 - DNA, 25 bp, mus musculus
tgtaatgccaacatgacacagcttg

SEQ ID NO: 100113 - DNA, 25 bp, mus musculus
taatgccaacatgacacagcttgtg

SEQ ID NO: 100114 - DNA, 25 bp, mus musculus
gccaacatgacacagcttgtgaatg

SEQ ID NO: 100115 - DNA, 25 bp, mus musculus
acatgacacagcttgtgaatgtgta

SEQ ID NO: 100116 - DNA, 25 bp, mus musculus
tgctgctgttctgtgtacatagtca

SEQ ID NO: 100117 - DNA, 25 bp, mus musculus
ctgctgttctgtgtacatagtcatc

SEQ ID NO: 100118 - DNA, 25 bp, mus musculus
aaatcagtccatgttttataacaag

SEQ ID NO: 100119 - DNA, 25 bp, mus musculus
acccaaaatctcgtttctagcagag

SEQ ID NO: 100120 - DNA, 25 bp, mus musculus
ccaaaatctcgtttctagcagaggt

SEQ ID NO: 100121 - DNA, 25 bp, mus musculus
ccactctgtgcccatatgcatgtca

SEQ ID NO: 100122 - DNA, 25 bp, mus musculus
actctgtgcccatatgcatgtcaga

SEQ ID NO: 100123 - DNA, 25 bp, mus musculus
tgtgcccatatgcatgtcagatgaa

SEQ ID NO: 100124 - DNA, 25 bp, mus musculus
tgcccatatgcatgtcagatgaata

SEQ ID NO: 100125 - DNA, 25 bp, mus musculus
cccatatgcatgtcagatgaatatg

SEQ ID NO: 100126 - DNA, 25 bp, mus musculus
acaactctcttctgaagcaatagat

SEQ ID NO: 100127 - DNA, 25 bp, mus musculus
ctcttctgaagcaatagatgctgct

SEQ ID NO: 100128 - DNA, 25 bp, mus musculus
tgctgctcgtatttgtgccaacctg

SEQ ID NO: 100129 - DNA, 25 bp, mus musculus
ctgctcgtatttgtgccaacctgta

SEQ ID NO: 100130 - DNA, 25 bp, mus musculus
tcgtatttgtgccaacctgtacatg

SEQ ID NO: 100131 - DNA, 25 bp, mus musculus
aatctcgtttctagcagaggtgtcc

SEQ ID NO: 100132 - DNA, 25 bp, mus musculus
tcgtttctagcagaggtgtccctga

SEQ ID NO: 100133 - DNA, 25 bp, mus musculus
atccgaatcagtgatttgtgacggt

SEQ ID NO: 100134 - DNA, 25 bp, mus musculus
aagtagatgaactcccactctgtgc

SEQ ID NO: 100135 - DNA, 25 bp, mus musculus
gtagatgaactcccactctgtgccc

SEQ ID NO: 100136 - DNA, 25 bp, mus musculus
agatgaactcccactctgtgcccat

SEQ ID NO: 100137 - DNA, 25 bp, mus musculus
actcccactctgtgcccatatgcat

SEQ ID NO: 100138 - DNA, 25 bp, mus musculus
tcccactctgtgcccatatgcatgt

SEQ ID NO: 100139 - DNA, 25 bp, mus musculus
caggccctcaacatttatagggctt

SEQ ID NO: 100140 - DNA, 25 bp, mus musculus
ggccctcaacatttatagggcttct

SEQ ID NO: 100141 - DNA, 25 bp, mus musculus
tcccgtgcctgcttcttccagcgag

SEQ ID NO: 100142 - DNA, 25 bp, mus musculus
gcctgcttcttccagcgagcaccaa

SEQ ID NO: 100143 - DNA, 25 bp, mus musculus
cctgcttcttccagcgagcaccaaa

SEQ ID NO: 100144 - DNA, 25 bp, mus musculus
tgcttcttccagcgagcaccaaaac

SEQ ID NO: 100145 - DNA, 25 bp, mus musculus
gcttcttccagcgagcaccaaaaca

SEQ ID NO: 100146 - DNA, 25 bp, mus musculus
cttcttccagcgagcaccaaaacag

SEQ ID NO: 100147 - DNA, 25 bp, mus musculus
ttcttccagcgagcaccaaaacagc

SEQ ID NO: 100148 - DNA, 25 bp, mus musculus
cttccagcgagcaccaaaacagcgg

SEQ ID NO: 100149 - DNA, 25 bp, mus musculus
cgagcaccaaaacagcggttcttgg

SEQ ID NO: 100150 - DNA, 25 bp, mus musculus
gagcaccaaaacagcggttcttggc

SEQ ID NO: 100151 - DNA, 25 bp, mus musculus
gccctcaacatttatagggcttctg

SEQ ID NO: 100152 - DNA, 25 bp, mus musculus
acatttatagggcttctggacacca

SEQ ID NO: 100153 - DNA, 25 bp, mus musculus
catttatagggcttctggacaccac

SEQ ID NO: 100154 - DNA, 25 bp, mus musculus
atttatagggcttctggacaccact

SEQ ID NO: 100155 - DNA, 25 bp, mus musculus
ggcttctggacaccactctacgacc

SEQ ID NO: 100156 - DNA, 25 bp, mus musculus
ttctggacaccactctacgacccgg

SEQ ID NO: 100157 - DNA, 25 bp, mus musculus
cgggcagcaccagtgatgttggcag

SEQ ID NO: 100158 - DNA, 25 bp, mus musculus
gggcagcaccagtgatgttggcagc

SEQ ID NO: 100159 - DNA, 25 bp, mus musculus
gccacgtcttccgaaatctctttca

SEQ ID NO: 100160 - DNA, 25 bp, mus musculus
tcttccgaaatctctttcaccggca

SEQ ID NO: 100161 - DNA, 25 bp, mus musculus
tcaaattcgtgagtcaccggcagcc

SEQ ID NO: 100162 - DNA, 25 bp, mus musculus
aattcgtgagtcaccggcagccaag

SEQ ID NO: 100163 - DNA, 25 bp, mus musculus
gtcaccggcagccaaggcgggcttg

SEQ ID NO: 100164 - DNA, 25 bp, mus musculus
gcaggccctgactcataaggccaga

SEQ ID NO: 100165 - DNA, 25 bp, mus musculus
cctgactcataaggccagagtgacc

SEQ ID NO: 100166 - DNA, 25 bp, mus musculus
gactcataaggccagagtgacctgg

SEQ ID NO: 100167 - DNA, 25 bp, mus musculus
ggggctcccattaaatgggagatat

SEQ ID NO: 100168 - DNA, 25 bp, mus musculus
ctccagccaccttggcatagacagg

SEQ ID NO: 100169 - DNA, 25 bp, mus musculus
cagccaccttggcatagacagggca

SEQ ID NO: 100170 - DNA, 25 bp, mus musculus
ccaccttggcatagacagggcatgt

SEQ ID NO: 100171 - DNA, 25 bp, mus musculus
tccgaaatctctttcaccggcaggt

SEQ ID NO: 100172 - DNA, 25 bp, mus musculus
gaaatctctttcaccggcaggtctt

SEQ ID NO: 100173 - DNA, 25 bp, mus musculus
ttcaccggcaggtcttctcctacga

SEQ ID NO: 100174 - DNA, 25 bp, mus musculus
tctcctacgactacgtcttcgactg

SEQ ID NO: 100175 - DNA, 25 bp, mus musculus
acgactacgtcttcgactggaacat

SEQ ID NO: 100176 - DNA, 25 bp, mus musculus
actacgtcttcgactggaacatgct

SEQ ID NO: 100177 - DNA, 25 bp, mus musculus
ggaacatgctcaaattcgtgagtca

SEQ ID NO: 100178 - DNA, 25 bp, mus musculus
tgctcaaattcgtgagtcaccggca

SEQ ID NO: 100179 - DNA, 25 bp, mus musculus
gctagtatccagaaggcccagtctc

SEQ ID NO: 100180 - DNA, 25 bp, mus musculus
agtatccagaaggcccagtctctga

SEQ ID NO: 100181 - DNA, 25 bp, mus musculus
agcggatacctctcaggttttcaag

SEQ ID NO: 100182 - DNA, 25 bp, mus musculus
ctctcaggttttcaagctagaaatg

SEQ ID NO: 100183 - DNA, 25 bp, mus musculus
gctagaaatgcccttcttcagtcaa

SEQ ID NO: 100184 - DNA, 25 bp, mus musculus
aatgcccttcttcagtcaaatctct

SEQ ID NO: 100185 - DNA, 25 bp, mus musculus
cttcttcagtcaaatctctctcaaa

SEQ ID NO: 100186 - DNA, 25 bp, mus musculus
cagtcaaatctctctcaaactcagc

SEQ ID NO: 100187 - DNA, 25 bp, mus musculus
tcaaatctctctcaaactcagctag

SEQ ID NO: 100188 - DNA, 25 bp, mus musculus
tctcaaactcagctagctactattt

SEQ ID NO: 100189 - DNA, 25 bp, mus musculus
ctagctactatttggactctggctg

SEQ ID NO: 100190 - DNA, 25 bp, mus musculus
actatttggactctggctgacatcg

SEQ ID NO: 100191 - DNA, 25 bp, mus musculus
aaggcccagtctctgattgatttag

SEQ ID NO: 100192 - DNA, 25 bp, mus musculus
tggactctggctgacatcgatggtg

SEQ ID NO: 100193 - DNA, 25 bp, mus musculus
gcccagtctctgattgatttaggat

SEQ ID NO: 100194 - DNA, 25 bp, mus musculus
ggatctagtagctcaacttcctcaa

SEQ ID NO: 100195 - DNA, 25 bp, mus musculus
tcaactgcttccctctcagggaact

SEQ ID NO: 100196 - DNA, 25 bp, mus musculus
tcacctaagacagggacctcagagt

SEQ ID NO: 100197 - DNA, 25 bp, mus musculus
gcagttcctcagccttcaagattaa

SEQ ID NO: 100198 - DNA, 25 bp, mus musculus
gttcctcagccttcaagattaaagt

SEQ ID NO: 100199 - DNA, 25 bp, mus musculus
atgagcggatacctctcaggttttc

SEQ ID NO: 100200 - DNA, 25 bp, mus musculus
cgtcatgatcgaggacatggagatg

SEQ ID NO: 100201 - DNA, 25 bp, mus musculus
gatgctgaccttgcatgacgatccg

SEQ ID NO: 100202 - DNA, 25 bp, mus musculus
atatggcctattctgcgtcaccgtc

SEQ ID NO: 100203 - DNA, 25 bp, mus musculus
attctgcgtcaccgtcaaggcctat

SEQ ID NO: 100204 - DNA, 25 bp, mus musculus
ctgcgtcaccgtcaaggcctatcag

SEQ ID NO: 100205 - DNA, 25 bp, mus musculus
cgtcaccgtcaaggcctatcagtag

SEQ ID NO: 100206 - DNA, 25 bp, mus musculus
caaggcctatcagtaggtgactgtg

SEQ ID NO: 100207 - DNA, 25 bp, mus musculus
ctatcagtaggtgactgtgtacgat

SEQ ID NO: 100208 - DNA, 25 bp, mus musculus
gtacgattcggaactggtggctgac

SEQ ID NO: 100209 - DNA, 25 bp, mus musculus
cgattcggaactggtggctgactct

SEQ ID NO: 100210 - DNA, 25 bp, mus musculus
ggctgactctcgcggtaagatgagg

SEQ ID NO: 100211 - DNA, 25 bp, mus musculus
tgactctcgcggtaagatgaggtgc

SEQ ID NO: 100212 - DNA, 25 bp, mus musculus
gctgaccttgcatgacgatccggat

SEQ ID NO: 100213 - DNA, 25 bp, mus musculus
gaccttgcatgacgatccggatgat

SEQ ID NO: 100214 - DNA, 25 bp, mus musculus
tgacgatccggatgatgtgtacaat

SEQ ID NO: 100215 - DNA, 25 bp, mus musculus
ttaccggcctgggatgatctatacc

SEQ ID NO: 100216 - DNA, 25 bp, mus musculus
gatctatacctaatatggcctattc

SEQ ID NO: 100217 - DNA, 25 bp, mus musculus
ctatacctaatatggcctattctgc

SEQ ID NO: 100218 - DNA, 25 bp, mus musculus
tacctaatatggcctattctgcgtc

SEQ ID NO: 100219 - DNA, 25 bp, mus musculus
ctaatatggcctattctgcgtcacc

SEQ ID NO: 100220 - DNA, 25 bp, mus musculus
tggctgacttcggcctggctgttcg

SEQ ID NO: 100221 - DNA, 25 bp, mus musculus
gcctggctgttcggtttgagccagg

SEQ ID NO: 100222 - DNA, 25 bp, mus musculus
agatgaggcccacgattaaggatca

SEQ ID NO: 100223 - DNA, 25 bp, mus musculus
gcctggcccagctctgcgtgaccat

SEQ ID NO: 100224 - DNA, 25 bp, mus musculus
cccagctctgcgtgaccatcgagga

SEQ ID NO: 100225 - DNA, 25 bp, mus musculus
cagaggctcgcctttctgcaggctg

SEQ ID NO: 100226 - DNA, 25 bp, mus musculus
ctcgcctttctgcaggctgtgtaga

SEQ ID NO: 100227 - DNA, 25 bp, mus musculus
tcaacggcactacctcggactgtct

SEQ ID NO: 100228 - DNA, 25 bp, mus musculus
tgctccctaaagagtccagcatcta

SEQ ID NO: 100229 - DNA, 25 bp, mus musculus
ctaaagagtccagcatctaagcccg

SEQ ID NO: 100230 - DNA, 25 bp, mus musculus
agtccagcatctaagcccgggacac

SEQ ID NO: 100231 - DNA, 25 bp, mus musculus
ccagactcagtggatctgaagaaaa

SEQ ID NO: 100232 - DNA, 25 bp, mus musculus
ttggcaccagacggtacatggcccc

SEQ ID NO: 100233 - DNA, 25 bp, mus musculus
acgccttcctgcgtatcgacatgta

SEQ ID NO: 100234 - DNA, 25 bp, mus musculus
tcctgcgtatcgacatgtacgccat

SEQ ID NO: 100235 - DNA, 25 bp, mus musculus
agctcgtctctcggtgcaaggctgc

SEQ ID NO: 100236 - DNA, 25 bp, mus musculus
aggctgcagacgggcctgtcgatga

SEQ ID NO: 100237 - DNA, 25 bp, mus musculus
tgctgcccttcgaggaggagattgg

SEQ ID NO: 100238 - DNA, 25 bp, mus musculus
agattggccagcacccttcgctgga

SEQ ID NO: 100239 - DNA, 25 bp, mus musculus
ttgtccacaagaagatgaggcccac

SEQ ID NO: 100240 - DNA, 25 bp, mus musculus
gcctccagtgggacagatgccaaga

SEQ ID NO: 100241 - DNA, 25 bp, mus musculus
acagatgccaagaactcctcaagag

SEQ ID NO: 100242 - DNA, 25 bp, mus musculus
gaagtacacacttcagcccctttgg

SEQ ID NO: 100243 - DNA, 25 bp, mus musculus
gacgccagcttagctcctcatgata

SEQ ID NO: 100244 - DNA, 25 bp, mus musculus
agcttagctcctcatgataccatca

SEQ ID NO: 100245 - DNA, 25 bp, mus musculus
gctcctcatgataccatcatcagta

SEQ ID NO: 100246 - DNA, 25 bp, mus musculus
catgataccatcatcagtacaacca

SEQ ID NO: 100247 - DNA, 25 bp, mus musculus
accatcatcagtacaaccacagaat

SEQ ID NO: 100248 - DNA, 25 bp, mus musculus
acagaatttccaaatgtcctcacaa

SEQ ID NO: 100249 - DNA, 25 bp, mus musculus
tttccaaatgtcctcacaactgcaa

SEQ ID NO: 100250 - DNA, 25 bp, mus musculus
aatgtcctcacaactgcaaatggaa

SEQ ID NO: 100251 - DNA, 25 bp, mus musculus
ctcacaactgcaaatggaactacta

SEQ ID NO: 100252 - DNA, 25 bp, mus musculus
gccaagaactcctcaagagctgctg

SEQ ID NO: 100253 - DNA, 25 bp, mus musculus
aactcctcaagagctgctgcttctt

SEQ ID NO: 100254 - DNA, 25 bp, mus musculus
tcaagagctgctgcttcttctaaaa

SEQ ID NO: 100255 - DNA, 25 bp, mus musculus
gctgctgcttcttctaaaagtggat

SEQ ID NO: 100256 - DNA, 25 bp, mus musculus
tccactggaccccaagaaccagact

SEQ ID NO: 100257 - DNA, 25 bp, mus musculus
caagaaccagactccccagtttcat

SEQ ID NO: 100258 - DNA, 25 bp, mus musculus
ccagactccccagtttcatggatac

SEQ ID NO: 100259 - DNA, 25 bp, mus musculus
tccccagtttcatggatacccagtg

SEQ ID NO: 100260 - DNA, 25 bp, mus musculus
atagctcattagggttccacgctcc

SEQ ID NO: 100261 - DNA, 25 bp, mus musculus
gctcattagggttccacgctccgtc

SEQ ID NO: 100262 - DNA, 25 bp, mus musculus
gctctgctttgggatcccttcctta

SEQ ID NO: 100263 - DNA, 25 bp, mus musculus
gatcccttccttaacgactgcctca

SEQ ID NO: 100264 - DNA, 25 bp, mus musculus
aacgactgcctcacttaggtaacat

SEQ ID NO: 100265 - DNA, 25 bp, mus musculus
gactgcctcacttaggtaacatcct

SEQ ID NO: 100266 - DNA, 25 bp, mus musculus
tgcctcacttaggtaacatccttag

SEQ ID NO: 100267 - DNA, 25 bp, mus musculus
taggtaacatccttagggatgcaga

SEQ ID NO: 100268 - DNA, 25 bp, mus musculus
gtaacatccttagggatgcagagaa

SEQ ID NO: 100269 - DNA, 25 bp, mus musculus
acatccttagggatgcagagaaagg

SEQ ID NO: 100270 - DNA, 25 bp, mus musculus
gtgggccttggaggcgtgaacatca

SEQ ID NO: 100271 - DNA, 25 bp, mus musculus
ctcagatcctggtggcgctgagaca

SEQ ID NO: 100272 - DNA, 25 bp, mus musculus
cccactgtagcccagtctttctaga

SEQ ID NO: 100273 - DNA, 25 bp, mus musculus
actgtagcccagtctttctagagtt

SEQ ID NO: 100274 - DNA, 25 bp, mus musculus
gtagcccagtctttctagagttcta

SEQ ID NO: 100275 - DNA, 25 bp, mus musculus
gcccagtctttctagagttctatat

SEQ ID NO: 100276 - DNA, 25 bp, mus musculus
ttctagagttctatatcgagctctt

SEQ ID NO: 100277 - DNA, 25 bp, mus musculus
agttctatatcgagctcttgagagt

SEQ ID NO: 100278 - DNA, 25 bp, mus musculus
atatcgagctcttgagagtaagtgg

SEQ ID NO: 100279 - DNA, 25 bp, mus musculus
taagtggctctgctttgggatccct

SEQ ID NO: 100280 - DNA, 25 bp, mus musculus
gtacttgtcttgggccttagacacg

SEQ ID NO: 100281 - DNA, 25 bp, mus musculus
ttgtcttgggccttagacacgaatc

SEQ ID NO: 100282 - DNA, 25 bp, mus musculus
agatgctcctggccatacgagtatt

SEQ ID NO: 100283 - DNA, 25 bp, mus musculus
atgctcctggccatacgagtattgt

SEQ ID NO: 100284 - DNA, 25 bp, mus musculus
gctcctggccatacgagtattgtcc

SEQ ID NO: 100285 - DNA, 25 bp, mus musculus
tgattggtggagcctcctagctgac

SEQ ID NO: 100286 - DNA, 25 bp, mus musculus
ggagcctcctagctgacttggctgt

SEQ ID NO: 100287 - DNA, 25 bp, mus musculus
agcctcctagctgacttggctgtac

SEQ ID NO: 100288 - DNA, 25 bp, mus musculus
cctcctagctgacttggctgtactg

SEQ ID NO: 100289 - DNA, 25 bp, mus musculus
tcctagctgacttggctgtactggt

SEQ ID NO: 100290 - DNA, 25 bp, mus musculus
ctagctgacttggctgtactggtaa

SEQ ID NO: 100291 - DNA, 25 bp, mus musculus
agctgacttggctgtactggtaact

SEQ ID NO: 100292 - DNA, 25 bp, mus musculus
gtcttgggccttagacacgaatcag

SEQ ID NO: 100293 - DNA, 25 bp, mus musculus
ctgacttggctgtactggtaactcg

SEQ ID NO: 100294 - DNA, 25 bp, mus musculus
cttgggccttagacacgaatcagga

SEQ ID NO: 100295 - DNA, 25 bp, mus musculus
ggccttagacacgaatcaggaagat

SEQ ID NO: 100296 - DNA, 25 bp, mus musculus
ccttagacacgaatcaggaagatcg

SEQ ID NO: 100297 - DNA, 25 bp, mus musculus
acaattctagatgctcctggccata

SEQ ID NO: 100298 - DNA, 25 bp, mus musculus
aattctagatgctcctggccatacg

SEQ ID NO: 100299 - DNA, 25 bp, mus musculus
ttctagatgctcctggccatacgag

SEQ ID NO: 100300 - DNA, 25 bp, mus musculus
ctagatgctcctggccatacgagta

SEQ ID NO: 100301 - DNA, 25 bp, mus musculus
tctcaattatcattgctctataggg

SEQ ID NO: 100302 - DNA, 25 bp, mus musculus
tcaattatcattgctctatagggaa

SEQ ID NO: 100303 - DNA, 25 bp, mus musculus
tcatttgcttttgcaagaatggatt

SEQ ID NO: 100304 - DNA, 25 bp, mus musculus
atttgcttttgcaagaatggattat

SEQ ID NO: 100305 - DNA, 25 bp, mus musculus
ttaacctatgttccaatatttctgc

SEQ ID NO: 100306 - DNA, 25 bp, mus musculus
cctatgttccaatatttctgctgct

SEQ ID NO: 100307 - DNA, 25 bp, mus musculus
tatgttccaatatttctgctgctcc

SEQ ID NO: 100308 - DNA, 25 bp, mus musculus
aatatttctgctgctccttttagat

SEQ ID NO: 100309 - DNA, 25 bp, mus musculus
tatttctgctgctccttttagatgc

SEQ ID NO: 100310 - DNA, 25 bp, mus musculus
tttctgctgctccttttagatgcag

SEQ ID NO: 100311 - DNA, 25 bp, mus musculus
ctgctccttttagatgcaggcaagt

SEQ ID NO: 100312 - DNA, 25 bp, mus musculus
gctccttttagatgcaggcaagtca

SEQ ID NO: 100313 - DNA, 25 bp, mus musculus
aattatcattgctctatagggaatc

SEQ ID NO: 100314 - DNA, 25 bp, mus musculus
ttatcattgctctatagggaatcac

SEQ ID NO: 100315 - DNA, 25 bp, mus musculus
tctatagggaatcacccttgtttat

SEQ ID NO: 100316 - DNA, 25 bp, mus musculus
gaatcacccttgtttattgtacatg

SEQ ID NO: 100317 - DNA, 25 bp, mus musculus
atcacccttgtttattgtacatggg

SEQ ID NO: 100318 - DNA, 25 bp, mus musculus
cccttgtttattgtacatgggagag

SEQ ID NO: 100319 - DNA, 25 bp, mus musculus
ccaaattctattacaggttcatttg

SEQ ID NO: 100320 - DNA, 25 bp, mus musculus
gttcatttgcttttgcaagaatgga

SEQ ID NO: 100321 - DNA, 25 bp, mus musculus
aaggacgtccttgcgagtctcctga

SEQ ID NO: 100322 - DNA, 25 bp, mus musculus
aggacgtccttgcgagtctcctgat

SEQ ID NO: 100323 - DNA, 25 bp, mus musculus
catgtttccagatggtacggttggc

SEQ ID NO: 100324 - DNA, 25 bp, mus musculus
tgtttccagatggtacggttggctc

SEQ ID NO: 100325 - DNA, 25 bp, mus musculus
gtttccagatggtacggttggctca

SEQ ID NO: 100326 - DNA, 25 bp, mus musculus
tttccagatggtacggttggctcat

SEQ ID NO: 100327 - DNA, 25 bp, mus musculus
tggtacggttggctcatctggacta

SEQ ID NO: 100328 - DNA, 25 bp, mus musculus
gtacggttggctcatctggactacc

SEQ ID NO: 100329 - DNA, 25 bp, mus musculus
tacggttggctcatctggactaccg

SEQ ID NO: 100330 - DNA, 25 bp, mus musculus
ggttggctcatctggactaccgtga

SEQ ID NO: 100331 - DNA, 25 bp, mus musculus
gttggctcatctggactaccgtgaa

SEQ ID NO: 100332 - DNA, 25 bp, mus musculus
ttggctcatctggactaccgtgaag

SEQ ID NO: 100333 - DNA, 25 bp, mus musculus
gacgtccttgcgagtctcctgatta

SEQ ID NO: 100334 - DNA, 25 bp, mus musculus
acgtccttgcgagtctcctgattac

SEQ ID NO: 100335 - DNA, 25 bp, mus musculus
cgtccttgcgagtctcctgattacc

SEQ ID NO: 100336 - DNA, 25 bp, mus musculus
tccttgcgagtctcctgattaccag

SEQ ID NO: 100337 - DNA, 25 bp, mus musculus
ccttgcgagtctcctgattaccagt

SEQ ID NO: 100338 - DNA, 25 bp, mus musculus
cttgcgagtctcctgattaccagtt

SEQ ID NO: 100339 - DNA, 25 bp, mus musculus
gcgagtctcctgattaccagttttt

SEQ ID NO: 100340 - DNA, 25 bp, mus musculus
acatgtttccagatggtacggttgg

SEQ ID NO: 100341 - DNA, 25 bp, mus musculus
atctgccttgctctacctcatgagg

SEQ ID NO: 100342 - DNA, 25 bp, mus musculus
tctgccttgctctacctcatgagga

SEQ ID NO: 100343 - DNA, 25 bp, mus musculus
taaagctggacgaggcctgttgagt

SEQ ID NO: 100344 - DNA, 25 bp, mus musculus
aaagctggacgaggcctgttgagtt

SEQ ID NO: 100345 - DNA, 25 bp, mus musculus
aagctggacgaggcctgttgagttt

SEQ ID NO: 100346 - DNA, 25 bp, mus musculus
agctggacgaggcctgttgagtttg

SEQ ID NO: 100347 - DNA, 25 bp, mus musculus
ccctcactgctcgtgctgaagctgg

SEQ ID NO: 100348 - DNA, 25 bp, mus musculus
ctcactgctcgtgctgaagctggga

SEQ ID NO: 100349 - DNA, 25 bp, mus musculus
tcactgctcgtgctgaagctgggag

SEQ ID NO: 100350 - DNA, 25 bp, mus musculus
tgccttgctctacctcatgaggact

SEQ ID NO: 100351 - DNA, 25 bp, mus musculus
gccttgctctacctcatgaggacta

SEQ ID NO: 100352 - DNA, 25 bp, mus musculus
ccttgctctacctcatgaggactag

SEQ ID NO: 100353 - DNA, 25 bp, mus musculus
cttgctctacctcatgaggactagc

SEQ ID NO: 100354 - DNA, 25 bp, mus musculus
ttgctctacctcatgaggactagcc

SEQ ID NO: 100355 - DNA, 25 bp, mus musculus
tgctctacctcatgaggactagccg

SEQ ID NO: 100356 - DNA, 25 bp, mus musculus
gctctacctcatgaggactagccgg

SEQ ID NO: 100357 - DNA, 25 bp, mus musculus
ctctacctcatgaggactagccggg

SEQ ID NO: 100358 - DNA, 25 bp, mus musculus
atgtgtctgtcgacgtcacctggga

SEQ ID NO: 100359 - DNA, 25 bp, mus musculus
gtgtctgtcgacgtcacctgggatg

SEQ ID NO: 100360 - DNA, 25 bp, mus musculus
atgcatgagacctacagcaacctgc

SEQ ID NO: 100361 - DNA, 25 bp, mus musculus
tgcatgagacctacagcaacctgct

SEQ ID NO: 100362 - DNA, 25 bp, mus musculus
catgagacctacagcaacctgctgt

SEQ ID NO: 100363 - DNA, 25 bp, mus musculus
atgagacctacagcaacctgctgtc

SEQ ID NO: 100364 - DNA, 25 bp, mus musculus
gagacctacagcaacctgctgtcct

SEQ ID NO: 100365 - DNA, 25 bp, mus musculus
agacctacagcaacctgctgtcctt

SEQ ID NO: 100366 - DNA, 25 bp, mus musculus
acctacagcaacctgctgtccttga

SEQ ID NO: 100367 - DNA, 25 bp, mus musculus
cctacagcaacctgctgtccttgag

SEQ ID NO: 100368 - DNA, 25 bp, mus musculus
tacagcaacctgctgtccttgagtg

SEQ ID NO: 100369 - DNA, 25 bp, mus musculus
acagcaacctgctgtccttgagtgc

SEQ ID NO: 100370 - DNA, 25 bp, mus musculus
tgtctgtcgacgtcacctgggatga

SEQ ID NO: 100371 - DNA, 25 bp, mus musculus
tctgtcgacgtcacctgggatgagt

SEQ ID NO: 100372 - DNA, 25 bp, mus musculus
ctgtcgacgtcacctgggatgagtg

SEQ ID NO: 100373 - DNA, 25 bp, mus musculus
acgtcacctgggatgagtggcagga

SEQ ID NO: 100374 - DNA, 25 bp, mus musculus
tcacctgggatgagtggcaggacct

SEQ ID NO: 100375 - DNA, 25 bp, mus musculus
tggcaggacctggatgacagtcaga

SEQ ID NO: 100376 - DNA, 25 bp, mus musculus
aagctctacagggacgtgatgcatg

SEQ ID NO: 100377 - DNA, 25 bp, mus musculus
agctctacagggacgtgatgcatga

SEQ ID NO: 100378 - DNA, 25 bp, mus musculus
catgtcgactgatgatcttagacgt

SEQ ID NO: 100379 - DNA, 25 bp, mus musculus
tcttagacgtgggcaggaaaggcag

SEQ ID NO: 100380 - DNA, 25 bp, mus musculus
ccactgggcgcttgattagccaagg

SEQ ID NO: 100381 - DNA, 25 bp, mus musculus
gagccatatcctagccttggatagg

SEQ ID NO: 100382 - DNA, 25 bp, mus musculus
gggactactagacgccattggggca

SEQ ID NO: 100383 - DNA, 25 bp, mus musculus
cagggagaccttggctttgggtctg

SEQ ID NO: 100384 - DNA, 25 bp, mus musculus
cttggctttgggtctgcttcttgcc

SEQ ID NO: 100385 - DNA, 25 bp, mus musculus
taccacagtgccagccagtcatgtc

SEQ ID NO: 100386 - DNA, 25 bp, mus musculus
gccagccagtcatgtccctctctga

SEQ ID NO: 100387 - DNA, 25 bp, mus musculus
tgtccctctctgagttaccgtagcc

SEQ ID NO: 100388 - DNA, 25 bp, mus musculus
ccctctctgagttaccgtagccact

SEQ ID NO: 100389 - DNA, 25 bp, mus musculus
tgacgtaccatgtatttcagtgaaa

SEQ ID NO: 100390 - DNA, 25 bp, mus musculus
ctgtactttggcccttcctcaagct

SEQ ID NO: 100391 - DNA, 25 bp, mus musculus
tgccacccattctctgcagaggcct

SEQ ID NO: 100392 - DNA, 25 bp, mus musculus
gcctgggttctggtttggtactgct

SEQ ID NO: 100393 - DNA, 25 bp, mus musculus
tggtactgctttcctggaaatctcc

SEQ ID NO: 100394 - DNA, 25 bp, mus musculus
tgctttcctggaaatctccatgtac

SEQ ID NO: 100395 - DNA, 25 bp, mus musculus
tttcctggaaatctccatgtaccaa

SEQ ID NO: 100396 - DNA, 25 bp, mus musculus
cctggaaatctccatgtaccaatcg

SEQ ID NO: 100397 - DNA, 25 bp, mus musculus
ctccatgtaccaatcggtggaccac

SEQ ID NO: 100398 - DNA, 25 bp, mus musculus
acctcgcctcacatcaaagatgcag

SEQ ID NO: 100399 - DNA, 25 bp, mus musculus
cgcctcacatcaaagatgcagagaa

SEQ ID NO: 100400 - DNA, 25 bp, mus musculus
gaagttgcaaccatcgacagaagga

SEQ ID NO: 100401 - DNA, 25 bp, mus musculus
agttgcaaccatcgacagaaggagg

SEQ ID NO: 100402 - DNA, 25 bp, mus musculus
ttgcaaccatcgacagaaggaggaa

SEQ ID NO: 100403 - DNA, 25 bp, mus musculus
gtgtctcacgcaggagcgtcaatgt

SEQ ID NO: 100404 - DNA, 25 bp, mus musculus
gtctcacgcaggagcgtcaatgtcc

SEQ ID NO: 100405 - DNA, 25 bp, mus musculus
ctcacgcaggagcgtcaatgtcctc

SEQ ID NO: 100406 - DNA, 25 bp, mus musculus
agcgtcaatgtcctctgcttcatca

SEQ ID NO: 100407 - DNA, 25 bp, mus musculus
cgtcaatgtcctctgcttcatcaga

SEQ ID NO: 100408 - DNA, 25 bp, mus musculus
tcaatgtcctctgcttcatcagaca

SEQ ID NO: 100409 - DNA, 25 bp, mus musculus
aatgtcctctgcttcatcagacact

SEQ ID NO: 100410 - DNA, 25 bp, mus musculus
cctcacatcaaagatgcagagaagg

SEQ ID NO: 100411 - DNA, 25 bp, mus musculus
tgtcctctgcttcatcagacactgg

SEQ ID NO: 100412 - DNA, 25 bp, mus musculus
catacaagtggagcttccagctcaa

SEQ ID NO: 100413 - DNA, 25 bp, mus musculus
agtggagcttccagctcaatgaatt

SEQ ID NO: 100414 - DNA, 25 bp, mus musculus
tggagcttccagctcaatgaattag

SEQ ID NO: 100415 - DNA, 25 bp, mus musculus
gagcttccagctcaatgaattagat

SEQ ID NO: 100416 - DNA, 25 bp, mus musculus
ttccagctcaatgaattagataata

SEQ ID NO: 100417 - DNA, 25 bp, mus musculus
gagagaatctcttttctccaagaaa

SEQ ID NO: 100418 - DNA, 25 bp, mus musculus
atactacatgtctttgaagtctgaa

SEQ ID NO: 100419 - DNA, 25 bp, mus musculus
ttatcaatcaaataatgctaatcca

SEQ ID NO: 100420 - DNA, 25 bp, mus musculus
atcaaataatgctaatccacacacc

SEQ ID NO: 100421 - DNA, 25 bp, mus musculus
ccacacaccagaaggtcggacatgc

SEQ ID NO: 100422 - DNA, 25 bp, mus musculus
cacacaccagaaggtcggacatgca

SEQ ID NO: 100423 - DNA, 25 bp, mus musculus
acacaccagaaggtcggacatgcac

SEQ ID NO: 100424 - DNA, 25 bp, mus musculus
acaccagaaggtcggacatgcaccc

SEQ ID NO: 100425 - DNA, 25 bp, mus musculus
aggtcggacatgcaccctaataatt

SEQ ID NO: 100426 - DNA, 25 bp, mus musculus
ggtcggacatgcaccctaataattg

SEQ ID NO: 100427 - DNA, 25 bp, mus musculus
gtcggacatgcaccctaataattgt

SEQ ID NO: 100428 - DNA, 25 bp, mus musculus
cggacatgcaccctaataattgtgt

SEQ ID NO: 100429 - DNA, 25 bp, mus musculus
ggacatgcaccctaataattgtgtc

SEQ ID NO: 100430 - DNA, 25 bp, mus musculus
gacatgcaccctaataattgtgtcc

SEQ ID NO: 100431 - DNA, 25 bp, mus musculus
caaataatgctaatccacacaccag

SEQ ID NO: 100432 - DNA, 25 bp, mus musculus
ataatgctaatccacacaccagaag

SEQ ID NO: 100433 - DNA, 25 bp, mus musculus
atgctaatccacacaccagaaggtc

SEQ ID NO: 100434 - DNA, 25 bp, mus musculus
tgctaatccacacaccagaaggtcg

SEQ ID NO: 100435 - DNA, 25 bp, mus musculus
gctaatccacacaccagaaggtcgg

SEQ ID NO: 100436 - DNA, 25 bp, mus musculus
taatccacacaccagaaggtcggac

SEQ ID NO: 100437 - DNA, 25 bp, mus musculus
aatccacacaccagaaggtcggaca

SEQ ID NO: 100438 - DNA, 25 bp, mus musculus
atccacacaccagaaggtcggacat

SEQ ID NO: 100439 - DNA, 25 bp, mus musculus
acatctactccgtattccgcaatgc

SEQ ID NO: 100440 - DNA, 25 bp, mus musculus
ttgttaacaacacgcctctcaactg

SEQ ID NO: 100441 - DNA, 25 bp, mus musculus
cagcttcttagaaccaagggcctca

SEQ ID NO: 100442 - DNA, 25 bp, mus musculus
cttagaaccaagggcctcattatgg

SEQ ID NO: 100443 - DNA, 25 bp, mus musculus
accaagggcctcattatggtcactc

SEQ ID NO: 100444 - DNA, 25 bp, mus musculus
ggcctcattatggtcactcacagct

SEQ ID NO: 100445 - DNA, 25 bp, mus musculus
gtcactcacagctcagttatggtct

SEQ ID NO: 100446 - DNA, 25 bp, mus musculus
ggaacctaaaagctcagatgcactt

SEQ ID NO: 100447 - DNA, 25 bp, mus musculus
ctcagatgcacttacagtcttgtct

SEQ ID NO: 100448 - DNA, 25 bp, mus musculus
tacagtcttgtctgtggcctttgta

SEQ ID NO: 100449 - DNA, 25 bp, mus musculus
tgtaaacgtctgtctggaccgaata

SEQ ID NO: 100450 - DNA, 25 bp, mus musculus
cgtctgtctggaccgaataaagatt

SEQ ID NO: 100451 - DNA, 25 bp, mus musculus
cgcctctcaactggctggtaggtcc

SEQ ID NO: 100452 - DNA, 25 bp, mus musculus
atcctcagtctaccgaggtgaacaa

SEQ ID NO: 100453 - DNA, 25 bp, mus musculus
tgaacaaggccagcctgaaggtcca

SEQ ID NO: 100454 - DNA, 25 bp, mus musculus
aggccagcctgaaggtccagcagtc

SEQ ID NO: 100455 - DNA, 25 bp, mus musculus
ctccttgtcaccagagcatgatgtt

SEQ ID NO: 100456 - DNA, 25 bp, mus musculus
gtcaccagagcatgatgttgctggc

SEQ ID NO: 100457 - DNA, 25 bp, mus musculus
tgatgttgctggccagatgacccct

SEQ ID NO: 100458 - DNA, 25 bp, mus musculus
ccagatgaccccttttgctgtattg

SEQ ID NO: 100459 - DNA, 25 bp, mus musculus
atgtccatggctcccatctactcaa

SEQ ID NO: 100460 - DNA, 25 bp, mus musculus
atggctcccatctactcaatggcgt

SEQ ID NO: 100461 - DNA, 25 bp, mus musculus
gcagctcgtaggtctacgtatacgt

SEQ ID NO: 100462 - DNA, 25 bp, mus musculus
tctacgtatacgttaacttccagca

SEQ ID NO: 100463 - DNA, 25 bp, mus musculus
tatacgttaacttccagcatccggt

SEQ ID NO: 100464 - DNA, 25 bp, mus musculus
tccagcatccggtggacgcgaaaag

SEQ ID NO: 100465 - DNA, 25 bp, mus musculus
agcatccggtggacgcgaaaagtgc

SEQ ID NO: 100466 - DNA, 25 bp, mus musculus
atgttatataccgctagctactatg

SEQ ID NO: 100467 - DNA, 25 bp, mus musculus
ttatataccgctagctactatgtgt

SEQ ID NO: 100468 - DNA, 25 bp, mus musculus
tataccgctagctactatgtgtcat

SEQ ID NO: 100469 - DNA, 25 bp, mus musculus
gctagctactatgtgtcatgacgtc

SEQ ID NO: 100470 - DNA, 25 bp, mus musculus
agctactatgtgtcatgacgtctca

SEQ ID NO: 100471 - DNA, 25 bp, mus musculus
gctcccatctactcaatggcgtctc

SEQ ID NO: 100472 - DNA, 25 bp, mus musculus
gtgtcatgacgtctcagagtgatgc

SEQ ID NO: 100473 - DNA, 25 bp, mus musculus
cccatctactcaatggcgtctctgt

SEQ ID NO: 100474 - DNA, 25 bp, mus musculus
gacctgcagcactgtgctgacacga

SEQ ID NO: 100475 - DNA, 25 bp, mus musculus
cactgtgctgacacgaggcgatggt

SEQ ID NO: 100476 - DNA, 25 bp, mus musculus
tgtgctgacacgaggcgatggtcta

SEQ ID NO: 100477 - DNA, 25 bp, mus musculus
tctacgagacgttgagcccggcggt

SEQ ID NO: 100478 - DNA, 25 bp, mus musculus
tgaagcgcagctcgtaggtctacgt

SEQ ID NO: 100479 - DNA, 25 bp, mus musculus
agcgcagctcgtaggtctacgtata

SEQ ID NO: 100480 - DNA, 25 bp, mus musculus
aactgagtgcatcaaccctcaagac

SEQ ID NO: 100481 - DNA, 25 bp, mus musculus
gtgcatcaaccctcaagactacagc

SEQ ID NO: 100482 - DNA, 25 bp, mus musculus
agattctgtccctaaacttgtggct

SEQ ID NO: 100483 - DNA, 25 bp, mus musculus
tgacttcatggctaagaagtttccg

SEQ ID NO: 100484 - DNA, 25 bp, mus musculus
tgacctgcttcgttctggaaagagc

SEQ ID NO: 100485 - DNA, 25 bp, mus musculus
catccgtaccgtcctgactttctga

SEQ ID NO: 100486 - DNA, 25 bp, mus musculus
taccgtcctgactttctgagatcat

SEQ ID NO: 100487 - DNA, 25 bp, mus musculus
tttctgagatcatgtggatgccttc

SEQ ID NO: 100488 - DNA, 25 bp, mus musculus
aaaccagactgattcaagcaccagc

SEQ ID NO: 100489 - DNA, 25 bp, mus musculus
ccacatcacagccttaatctttgct

SEQ ID NO: 100490 - DNA, 25 bp, mus musculus
tctttagagacacagccaataaagt

SEQ ID NO: 100491 - DNA, 25 bp, mus musculus
gagacacagccaataaagtacttgt

SEQ ID NO: 100492 - DNA, 25 bp, mus musculus
tcaagactacagcaaacccatccag

SEQ ID NO: 100493 - DNA, 25 bp, mus musculus
caaacccatccaggaagttctccag

SEQ ID NO: 100494 - DNA, 25 bp, mus musculus
tctccaggagatgaccgacggaggg

SEQ ID NO: 100495 - DNA, 25 bp, mus musculus
agtcatcggccgccttgacaccatg

SEQ ID NO: 100496 - DNA, 25 bp, mus musculus
cggccgccttgacaccatgacttct

SEQ ID NO: 100497 - DNA, 25 bp, mus musculus
gacttctgccctgctgagctgccat

SEQ ID NO: 100498 - DNA, 25 bp, mus musculus
gctgagctgccatgcagcatgtggt

SEQ ID NO: 100499 - DNA, 25 bp, mus musculus
gaacctctccatgaaccccatgttg

SEQ ID NO: 100500 - DNA, 25 bp, mus musculus
tgacattagctctgagacgtctgga

SEQ ID NO: 100501 - DNA, 25 bp, mus musculus
cattagctctgagacgtctggagac

SEQ ID NO: 100502 - DNA, 25 bp, mus musculus
gatttttcactttctgtgaaacgat

SEQ ID NO: 100503 - DNA, 25 bp, mus musculus
ttcatgcacatgacatttgctttac

SEQ ID NO: 100504 - DNA, 25 bp, mus musculus
atgacatttgctttaccatgatcta

SEQ ID NO: 100505 - DNA, 25 bp, mus musculus
gctttaccatgatctataaaacatt

SEQ ID NO: 100506 - DNA, 25 bp, mus musculus
gtggcgatctaaccacaacaaaatg

SEQ ID NO: 100507 - DNA, 25 bp, mus musculus
gcgatctaaccacaacaaaatgcct

SEQ ID NO: 100508 - DNA, 25 bp, mus musculus
ccacaacaaaatgccttggttggct

SEQ ID NO: 100509 - DNA, 25 bp, mus musculus
gccttggttggctcagatcggtcta

SEQ ID NO: 100510 - DNA, 25 bp, mus musculus
ttggttggctcagatcggtctacag

SEQ ID NO: 100511 - DNA, 25 bp, mus musculus
gttggctcagatcggtctacagatt

SEQ ID NO: 100512 - DNA, 25 bp, mus musculus
tagctctgagacgtctggagacttc

SEQ ID NO: 100513 - DNA, 25 bp, mus musculus
gacgtctggagacttccggaaagct

SEQ ID NO: 100514 - DNA, 25 bp, mus musculus
agacttccggaaagctctgctgact

SEQ ID NO: 100515 - DNA, 25 bp, mus musculus
agctctgctgactctggcagatgta

SEQ ID NO: 100516 - DNA, 25 bp, mus musculus
tctgctgactctggcagatgtaagg

SEQ ID NO: 100517 - DNA, 25 bp, mus musculus
tgactgtttattctctgcttcccct

SEQ ID NO: 100518 - DNA, 25 bp, mus musculus
cagaacctaggaccatgagattttt

SEQ ID NO: 100519 - DNA, 25 bp, mus musculus
tgagatttttcactttctgtgaaac

SEQ ID NO: 100520 - DNA, 25 bp, mus musculus
gtcagtctgcttttctcgtcccctg

SEQ ID NO: 100521 - DNA, 25 bp, mus musculus
agtctgcttttctcgtcccctgata

SEQ ID NO: 100522 - DNA, 25 bp, mus musculus
tgctgcctctctcaatgaccacttg

SEQ ID NO: 100523 - DNA, 25 bp, mus musculus
cttgccccagcacacgtttcgtgtc

SEQ ID NO: 100524 - DNA, 25 bp, mus musculus
gccccagcacacgtttcgtgtcatc

SEQ ID NO: 100525 - DNA, 25 bp, mus musculus
ccagcacacgtttcgtgtcatctgg

SEQ ID NO: 100526 - DNA, 25 bp, mus musculus
gcacacgtttcgtgtcatctggaca

SEQ ID NO: 100527 - DNA, 25 bp, mus musculus
gtttcgtgtcatctggacaggaagc

SEQ ID NO: 100528 - DNA, 25 bp, mus musculus
tcgtgtcatctggacaggaagcgat

SEQ ID NO: 100529 - DNA, 25 bp, mus musculus
tgtcatctggacaggaagcgatacc

SEQ ID NO: 100530 - DNA, 25 bp, mus musculus
aagcgatacccagaaggagtgtgtg

SEQ ID NO: 100531 - DNA, 25 bp, mus musculus
cgatacccagaaggagtgtgtgctt

SEQ ID NO: 100532 - DNA, 25 bp, mus musculus
ctgcttttctcgtcccctgatagtg

SEQ ID NO: 100533 - DNA, 25 bp, mus musculus
tcgtcccctgatagtgggctccaag

SEQ ID NO: 100534 - DNA, 25 bp, mus musculus
tcccctgatagtgggctccaagatg

SEQ ID NO: 100535 - DNA, 25 bp, mus musculus
gaccttgctactcacggttgacgag

SEQ ID NO: 100536 - DNA, 25 bp, mus musculus
cttgctactcacggttgacgaggca

SEQ ID NO: 100537 - DNA, 25 bp, mus musculus
gctactcacggttgacgaggcacct

SEQ ID NO: 100538 - DNA, 25 bp, mus musculus
actcacggttgacgaggcacctttg

SEQ ID NO: 100539 - DNA, 25 bp, mus musculus
cgaggcacctttgagtgtggaatgg

SEQ ID NO: 100540 - DNA, 25 bp, mus musculus
tcgtggtcttcccagcaccattgtg

SEQ ID NO: 100541 - DNA, 25 bp, mus musculus
tcttcccagcaccattgtggcccag

SEQ ID NO: 100542 - DNA, 25 bp, mus musculus
tgcccacttggaacaccttggagag

SEQ ID NO: 100543 - DNA, 25 bp, mus musculus
cttggaacaccttggagagatgctt

SEQ ID NO: 100544 - DNA, 25 bp, mus musculus
tcttgattccagctaccaagtcctc

SEQ ID NO: 100545 - DNA, 25 bp, mus musculus
tgattccagctaccaagtcctctgg

SEQ ID NO: 100546 - DNA, 25 bp, mus musculus
ctaccaagtcctctggctcggcttc

SEQ ID NO: 100547 - DNA, 25 bp, mus musculus
ccaagtcctctggctcggcttcaaa

SEQ ID NO: 100548 - DNA, 25 bp, mus musculus
cctctggctcggcttcaaagtactc

SEQ ID NO: 100549 - DNA, 25 bp, mus musculus
gctcggcttcaaagtactcgttcct

SEQ ID NO: 100550 - DNA, 25 bp, mus musculus
cttcaaagtactcgttcctgagagc

SEQ ID NO: 100551 - DNA, 25 bp, mus musculus
cacaccagtaggagggcataaggaa

SEQ ID NO: 100552 - DNA, 25 bp, mus musculus
tcccagcaccattgtggcccaggag

SEQ ID NO: 100553 - DNA, 25 bp, mus musculus
ctgttatctgtccttcgtagaggtt

SEQ ID NO: 100554 - DNA, 25 bp, mus musculus
tctgtccttcgtagaggttcagggt

SEQ ID NO: 100555 - DNA, 25 bp, mus musculus
gtccttcgtagaggttcagggtcag

SEQ ID NO: 100556 - DNA, 25 bp, mus musculus
ggtctctgatgcccatcttgtcctt

SEQ ID NO: 100557 - DNA, 25 bp, mus musculus
ctctgatgcccatcttgtccttatt

SEQ ID NO: 100558 - DNA, 25 bp, mus musculus
ccatcttgtccttattgcccacttg

SEQ ID NO: 100559 - DNA, 25 bp, mus musculus
tcttgtccttattgcccacttggaa

SEQ ID NO: 100560 - DNA, 25 bp, mus musculus
tacagctaatgcacagcagaaatgc

SEQ ID NO: 100561 - DNA, 25 bp, mus musculus
ctaagggccaagactcacatcgaga

SEQ ID NO: 100562 - DNA, 25 bp, mus musculus
catctgtatctacgaatgtggtgta

SEQ ID NO: 100563 - DNA, 25 bp, mus musculus
ctgtatctacgaatgtggtgtactc

SEQ ID NO: 100564 - DNA, 25 bp, mus musculus
actcgatcagtggcacatcgcaaag

SEQ ID NO: 100565 - DNA, 25 bp, mus musculus
cgatcagtggcacatcgcaaagttt

SEQ ID NO: 100566 - DNA, 25 bp, mus musculus
tcagtggcacatcgcaaagtttgag

SEQ ID NO: 100567 - DNA, 25 bp, mus musculus
caagtgcgcctgggtcttacacagc

SEQ ID NO: 100568 - DNA, 25 bp, mus musculus
ctgggtcttacacagcctgacagct

SEQ ID NO: 100569 - DNA, 25 bp, mus musculus
ggtcttacacagcctgacagctgtg

SEQ ID NO: 100570 - DNA, 25 bp, mus musculus
cttacacagcctgacagctgtgcat

SEQ ID NO: 100571 - DNA, 25 bp, mus musculus
cctgacagctgtgcatgagtgtgat

SEQ ID NO: 100572 - DNA, 25 bp, mus musculus
gccaagactcacatcgagatcgtcg

SEQ ID NO: 100573 - DNA, 25 bp, mus musculus
cacgtagattccgacgcttacaaca

SEQ ID NO: 100574 - DNA, 25 bp, mus musculus
gtagattccgacgcttacaacacga

SEQ ID NO: 100575 - DNA, 25 bp, mus musculus
tccgacgcttacaacacgatcggcc

SEQ ID NO: 100576 - DNA, 25 bp, mus musculus
gacgcttacaacacgatcggccatc

SEQ ID NO: 100577 - DNA, 25 bp, mus musculus
gcttacaacacgatcggccatctgt

SEQ ID NO: 100578 - DNA, 25 bp, mus musculus
acgatcggccatctgtatctacgaa

SEQ ID NO: 100579 - DNA, 25 bp, mus musculus
atcggccatctgtatctacgaatgt

SEQ ID NO: 100580 - DNA, 25 bp, mus musculus
ggcccagcatttgggggacagcacg

SEQ ID NO: 100581 - DNA, 25 bp, mus musculus
attgctatcgatggcactgaagggc

SEQ ID NO: 100582 - DNA, 25 bp, mus musculus
aatctctgttggtcctgagaccttc

SEQ ID NO: 100583 - DNA, 25 bp, mus musculus
ggtcctgagaccttcggcagaatca

SEQ ID NO: 100584 - DNA, 25 bp, mus musculus
tcctgagaccttcggcagaatcatg

SEQ ID NO: 100585 - DNA, 25 bp, mus musculus
gagaccttcggcagaatcatgaatg

SEQ ID NO: 100586 - DNA, 25 bp, mus musculus
gaccttcggcagaatcatgaatgtc

SEQ ID NO: 100587 - DNA, 25 bp, mus musculus
gagtcctagcaaagcacgcaattct

SEQ ID NO: 100588 - DNA, 25 bp, mus musculus
gtcctagcaaagcacgcaattctgc

SEQ ID NO: 100589 - DNA, 25 bp, mus musculus
cctagcaaagcacgcaattctgccc

SEQ ID NO: 100590 - DNA, 25 bp, mus musculus
aaagcacgcaattctgccctattca

SEQ ID NO: 100591 - DNA, 25 bp, mus musculus
agcacgcaattctgccctattcatg

SEQ ID NO: 100592 - DNA, 25 bp, mus musculus
atcgatggcactgaagggcttgcta

SEQ ID NO: 100593 - DNA, 25 bp, mus musculus
cacgcaattctgccctattcatgct

SEQ ID NO: 100594 - DNA, 25 bp, mus musculus
cgatggcactgaagggcttgctaga

SEQ ID NO: 100595 - DNA, 25 bp, mus musculus
cactgaagggcttgctagaggccag

SEQ ID NO: 100596 - DNA, 25 bp, mus musculus
cttgctagaggccagacagtactgg

SEQ ID NO: 100597 - DNA, 25 bp, mus musculus
ggcgacaatcaaaatctctgttggt

SEQ ID NO: 100598 - DNA, 25 bp, mus musculus
cgacaatcaaaatctctgttggtcc

SEQ ID NO: 100599 - DNA, 25 bp, mus musculus
acaatcaaaatctctgttggtcctg

SEQ ID NO: 100600 - DNA, 25 bp, mus musculus
tcaaaatctctgttggtcctgagac

SEQ ID NO: 100601 - DNA, 25 bp, mus musculus
ctgcatctccacacaggagttcctc

SEQ ID NO: 100602 - DNA, 25 bp, mus musculus
ctccacacaggagttcctctcatgc

SEQ ID NO: 100603 - DNA, 25 bp, mus musculus
gtcagctacgtcgcctcacaaccag

SEQ ID NO: 100604 - DNA, 25 bp, mus musculus
tacgtcgcctcacaaccagatggga

SEQ ID NO: 100605 - DNA, 25 bp, mus musculus
gcctcacaaccagatgggaaacaag

SEQ ID NO: 100606 - DNA, 25 bp, mus musculus
caagtgcagggcctttcaagtgctt

SEQ ID NO: 100607 - DNA, 25 bp, mus musculus
ggcctttcaagtgcttctcatgtaa

SEQ ID NO: 100608 - DNA, 25 bp, mus musculus
ctttcaagtgcttctcatgtaagta

SEQ ID NO: 100609 - DNA, 25 bp, mus musculus
tcaagtgcttctcatgtaagtaata

SEQ ID NO: 100610 - DNA, 25 bp, mus musculus
agtgcttctcatgtaagtaataaca

SEQ ID NO: 100611 - DNA, 25 bp, mus musculus
aatacacaagtgttgcctgctccat

SEQ ID NO: 100612 - DNA, 25 bp, mus musculus
acacaagtgttgcctgctccatcag

SEQ ID NO: 100613 - DNA, 25 bp, mus musculus
cacacaggagttcctctcatgcagg

SEQ ID NO: 100614 - DNA, 25 bp, mus musculus
acaggagttcctctcatgcaggtag

SEQ ID NO: 100615 - DNA, 25 bp, mus musculus
ggagttcctctcatgcaggtagctg

SEQ ID NO: 100616 - DNA, 25 bp, mus musculus
caggtagctgcccctgcaagtatac

SEQ ID NO: 100617 - DNA, 25 bp, mus musculus
cctgcaagtatacctcagggaccgc

SEQ ID NO: 100618 - DNA, 25 bp, mus musculus
ccatcccagcaggtcagctacgtcg

SEQ ID NO: 100619 - DNA, 25 bp, mus musculus
tcccagcaggtcagctacgtcgcct

SEQ ID NO: 100620 - DNA, 25 bp, mus musculus
caggtcagctacgtcgcctcacaac

SEQ ID NO: 100621 - DNA, 25 bp, mus musculus
ctggcatgtgccagtcacaatttac

SEQ ID NO: 100622 - DNA, 25 bp, mus musculus
ggcatgtgccagtcacaatttactc

SEQ ID NO: 100623 - DNA, 25 bp, mus musculus
tttactcccaatcagcatacagtag

SEQ ID NO: 100624 - DNA, 25 bp, mus musculus
tactcccaatcagcatacagtagaa

SEQ ID NO: 100625 - DNA, 25 bp, mus musculus
ctcccaatcagcatacagtagaaga

SEQ ID NO: 100626 - DNA, 25 bp, mus musculus
cccaatcagcatacagtagaagaca

SEQ ID NO: 100627 - DNA, 25 bp, mus musculus
ctctgcgttaggcctcctctgctgc

SEQ ID NO: 100628 - DNA, 25 bp, mus musculus
ctgcgttaggcctcctctgctgcct

SEQ ID NO: 100629 - DNA, 25 bp, mus musculus
gttcatatagctctcagcttcggtg

SEQ ID NO: 100630 - DNA, 25 bp, mus musculus
tcatatagctctcagcttcggtgaa

SEQ ID NO: 100631 - DNA, 25 bp, mus musculus
atatagctctcagcttcggtgaact

SEQ ID NO: 100632 - DNA, 25 bp, mus musculus
atagctctcagcttcggtgaactcc

SEQ ID NO: 100633 - DNA, 25 bp, mus musculus
catgtgccagtcacaatttactccc

SEQ ID NO: 100634 - DNA, 25 bp, mus musculus
tgtgccagtcacaatttactcccaa

SEQ ID NO: 100635 - DNA, 25 bp, mus musculus
tgccagtcacaatttactcccaatc

SEQ ID NO: 100636 - DNA, 25 bp, mus musculus
ccagtcacaatttactcccaatcag

SEQ ID NO: 100637 - DNA, 25 bp, mus musculus
agtcacaatttactcccaatcagca

SEQ ID NO: 100638 - DNA, 25 bp, mus musculus
tcacaatttactcccaatcagcata

SEQ ID NO: 100639 - DNA, 25 bp, mus musculus
acaatttactcccaatcagcataca

SEQ ID NO: 100640 - DNA, 25 bp, mus musculus
aatttactcccaatcagcatacagt

SEQ ID NO: 100641 - DNA, 25 bp, mus musculus
cgagaagcgcttcaccttcgtgttg

SEQ ID NO: 100642 - DNA, 25 bp, mus musculus
cttcttcagctacagcctgtatggc

SEQ ID NO: 100643 - DNA, 25 bp, mus musculus
tatcctctttcgaaggaggagaagg

SEQ ID NO: 100644 - DNA, 25 bp, mus musculus
ggacctggacccactgacgtcctgg

SEQ ID NO: 100645 - DNA, 25 bp, mus musculus
actgacgtcctggacagctctgaac

SEQ ID NO: 100646 - DNA, 25 bp, mus musculus
gtcctggacagctctgaactcgggt

SEQ ID NO: 100647 - DNA, 25 bp, mus musculus
gacagctctgaactcgggtagacag

SEQ ID NO: 100648 - DNA, 25 bp, mus musculus
tctgaactcgggtagacagagagac

SEQ ID NO: 100649 - DNA, 25 bp, mus musculus
ccaacagtgtggtctctccagagtc

SEQ ID NO: 100650 - DNA, 25 bp, mus musculus
cagagtcccagggtggacttcaggg

SEQ ID NO: 100651 - DNA, 25 bp, mus musculus
gagacctttgccttcccatctcagc

SEQ ID NO: 100652 - DNA, 25 bp, mus musculus
ttgtggatccagttcctgagaaggc

SEQ ID NO: 100653 - DNA, 25 bp, mus musculus
cagcctgtatggcatctgccgtgag

SEQ ID NO: 100654 - DNA, 25 bp, mus musculus
tgtggatccagttcctgagaaggct

SEQ ID NO: 100655 - DNA, 25 bp, mus musculus
catctgccgtgaggcctgccagttg

SEQ ID NO: 100656 - DNA, 25 bp, mus musculus
ggcctgccagttgccagaaccgctc

SEQ ID NO: 100657 - DNA, 25 bp, mus musculus
ccagttgccagaaccgctctttaag

SEQ ID NO: 100658 - DNA, 25 bp, mus musculus
ggtcatctacactgtcttcaatcag

SEQ ID NO: 100659 - DNA, 25 bp, mus musculus
tgtcttcaatcaggacttcaggcgc

SEQ ID NO: 100660 - DNA, 25 bp, mus musculus
caggcgctctttcaagcatatcctc

SEQ ID NO: 100661 - DNA, 25 bp, mus musculus
ctctttcaagcatatcctctttcga

SEQ ID NO: 100662 - DNA, 25 bp, mus musculus
tcgccctggttcaggtgtccgaccg

SEQ ID NO: 100663 - DNA, 25 bp, mus musculus
gccctggttcaggtgtccgaccgtg

SEQ ID NO: 100664 - DNA, 25 bp, mus musculus
cagccccactagactatgagaccac

SEQ ID NO: 100665 - DNA, 25 bp, mus musculus
tgagaccacccgggagttcaacgtg

SEQ ID NO: 100666 - DNA, 25 bp, mus musculus
agtagctgtggactctggcagtccc

SEQ ID NO: 100667 - DNA, 25 bp, mus musculus
tgtggactctggcagtcccagcctc

SEQ ID NO: 100668 - DNA, 25 bp, mus musculus
cagcctctccagcaacaattccttg

SEQ ID NO: 100669 - DNA, 25 bp, mus musculus
gcctctccagcaacaattccttggt

SEQ ID NO: 100670 - DNA, 25 bp, mus musculus
ctccagcaacaattccttggtggtc

SEQ ID NO: 100671 - DNA, 25 bp, mus musculus
ccagcaacaattccttggtggtcaa

SEQ ID NO: 100672 - DNA, 25 bp, mus musculus
agcaacaattccttggtggtcaagg

SEQ ID NO: 100673 - DNA, 25 bp, mus musculus
caacaattccttggtggtcaaggtg

SEQ ID NO: 100674 - DNA, 25 bp, mus musculus
gtgtccgaccgtgaccaaggcgaga

SEQ ID NO: 100675 - DNA, 25 bp, mus musculus
gtagtcacctgtaccgtagtgggag

SEQ ID NO: 100676 - DNA, 25 bp, mus musculus
cctttccagcttaagccagccagcg

SEQ ID NO: 100677 - DNA, 25 bp, mus musculus
tttccagcttaagccagccagcgac

SEQ ID NO: 100678 - DNA, 25 bp, mus musculus
gcttaagccagccagcgacacagaa

SEQ ID NO: 100679 - DNA, 25 bp, mus musculus
cagccagcgacacagaaggcgatca

SEQ ID NO: 100680 - DNA, 25 bp, mus musculus
gccagcgacacagaaggcgatcaaa

SEQ ID NO: 100681 - DNA, 25 bp, mus musculus
atcagccccactagactatgagacc

SEQ ID NO: 100682 - DNA, 25 bp, mus musculus
ccgtgctctgtatgccgcgttctcc

SEQ ID NO: 100683 - DNA, 25 bp, mus musculus
gtgctctgtatgccgcgttctcccg

SEQ ID NO: 100684 - DNA, 25 bp, mus musculus
aggccaccaagatgcctcagtccaa

SEQ ID NO: 100685 - DNA, 25 bp, mus musculus
gccaccaagatgcctcagtccaagt

SEQ ID NO: 100686 - DNA, 25 bp, mus musculus
caccaagatgcctcagtccaagtcc

SEQ ID NO: 100687 - DNA, 25 bp, mus musculus
ccaagatgcctcagtccaagtcccg

SEQ ID NO: 100688 - DNA, 25 bp, mus musculus
aagatgcctcagtccaagtcccgga

SEQ ID NO: 100689 - DNA, 25 bp, mus musculus
gatgcctcagtccaagtcccggaag

SEQ ID NO: 100690 - DNA, 25 bp, mus musculus
tgcctcagtccaagtcccggaagat

SEQ ID NO: 100691 - DNA, 25 bp, mus musculus
aaagtcctcattgacaattcagttt

SEQ ID NO: 100692 - DNA, 25 bp, mus musculus
tcctcattgacaattcagtttgttg

SEQ ID NO: 100693 - DNA, 25 bp, mus musculus
ctcattgacaattcagtttgttgaa

SEQ ID NO: 100694 - DNA, 25 bp, mus musculus
gctctgtatgccgcgttctcccggc

SEQ ID NO: 100695 - DNA, 25 bp, mus musculus
cgcagcctgcctgatagtctgagcc

SEQ ID NO: 100696 - DNA, 25 bp, mus musculus
cagcctgcctgatagtctgagccgg

SEQ ID NO: 100697 - DNA, 25 bp, mus musculus
ctgatagtctgagccggagagccgc

SEQ ID NO: 100698 - DNA, 25 bp, mus musculus
gatagtctgagccggagagccgccg

SEQ ID NO: 100699 - DNA, 25 bp, mus musculus
ctgagcaggccaccaagatgcctca

SEQ ID NO: 100700 - DNA, 25 bp, mus musculus
gagcaggccaccaagatgcctcagt

SEQ ID NO: 100701 - DNA, 25 bp, mus musculus
gcaggccaccaagatgcctcagtcc

SEQ ID NO: 100702 - DNA, 25 bp, mus musculus
aatttggaagccttcacagcggata

SEQ ID NO: 100703 - DNA, 25 bp, mus musculus
tttggaagccttcacagcggataaa

SEQ ID NO: 100704 - DNA, 25 bp, mus musculus
tattaccagtgataaaccagctgct

SEQ ID NO: 100705 - DNA, 25 bp, mus musculus
cagtgataaaccagctgctgcagtc

SEQ ID NO: 100706 - DNA, 25 bp, mus musculus
agtgataaaccagctgctgcagtcg

SEQ ID NO: 100707 - DNA, 25 bp, mus musculus
tgataaaccagctgctgcagtcgga

SEQ ID NO: 100708 - DNA, 25 bp, mus musculus
tagttttaccgatgctgaaagaaga

SEQ ID NO: 100709 - DNA, 25 bp, mus musculus
ttttaccgatgctgaaagaagaaag

SEQ ID NO: 100710 - DNA, 25 bp, mus musculus
tttaccgatgctgaaagaagaaagt

SEQ ID NO: 100711 - DNA, 25 bp, mus musculus
gagattaaccaacaaagccaattgg

SEQ ID NO: 100712 - DNA, 25 bp, mus musculus
taaccaacaaagccaattggtagag

SEQ ID NO: 100713 - DNA, 25 bp, mus musculus
gacacaaatgctggatcaggaagag

SEQ ID NO: 100714 - DNA, 25 bp, mus musculus
ttggaagccttcacagcggataaag

SEQ ID NO: 100715 - DNA, 25 bp, mus musculus
ggaagccttcacagcggataaagat

SEQ ID NO: 100716 - DNA, 25 bp, mus musculus
gaagccttcacagcggataaagata

SEQ ID NO: 100717 - DNA, 25 bp, mus musculus
gccttcacagcggataaagatactg

SEQ ID NO: 100718 - DNA, 25 bp, mus musculus
taaagatactgctattaccagtgat

SEQ ID NO: 100719 - DNA, 25 bp, mus musculus
agatactgctattaccagtgataaa

SEQ ID NO: 100720 - DNA, 25 bp, mus musculus
gatactgctattaccagtgataaac

SEQ ID NO: 100721 - DNA, 25 bp, mus musculus
actgctattaccagtgataaaccag

SEQ ID NO: 100722 - DNA, 25 bp, mus musculus
tccaccaactaaggacaactcggct

SEQ ID NO: 100723 - DNA, 25 bp, mus musculus
aactaaggacaactcggctgtacat

SEQ ID NO: 100724 - DNA, 25 bp, mus musculus
tctggtgctttgggcatgatctgac

SEQ ID NO: 100725 - DNA, 25 bp, mus musculus
atgatctgactggccccaacatctc

SEQ ID NO: 100726 - DNA, 25 bp, mus musculus
atctgactggccccaacatctctcg

SEQ ID NO: 100727 - DNA, 25 bp, mus musculus
tgactggccccaacatctctcgacg

SEQ ID NO: 100728 - DNA, 25 bp, mus musculus
acatctctcgacgacatcacctatg

SEQ ID NO: 100729 - DNA, 25 bp, mus musculus
tctctcgacgacatcacctatggtg

SEQ ID NO: 100730 - DNA, 25 bp, mus musculus
ctcgacgacatcacctatggtgtgc

SEQ ID NO: 100731 - DNA, 25 bp, mus musculus
gacgacatcacctatggtgtgcatt

SEQ ID NO: 100732 - DNA, 25 bp, mus musculus
atcacctatggtgtgcattacccga

SEQ ID NO: 100733 - DNA, 25 bp, mus musculus
ctatggtgtgcattacccgaatgag

SEQ ID NO: 100734 - DNA, 25 bp, mus musculus
taaggacaactcggctgtacatgaa

SEQ ID NO: 100735 - DNA, 25 bp, mus musculus
ggacaactcggctgtacatgaaggc

SEQ ID NO: 100736 - DNA, 25 bp, mus musculus
aattccctgatggcctggtagatcg

SEQ ID NO: 100737 - DNA, 25 bp, mus musculus
tagatcgcatcgatgagggtgagat

SEQ ID NO: 100738 - DNA, 25 bp, mus musculus
atcgcatcgatgagggtgagatgtc

SEQ ID NO: 100739 - DNA, 25 bp, mus musculus
gagttcaaggcacgtggcgctacct

SEQ ID NO: 100740 - DNA, 25 bp, mus musculus
ttcaaggcacgtggcgctacctgga

SEQ ID NO: 100741 - DNA, 25 bp, mus musculus
agatctggtgctttgggcatgatct

SEQ ID NO: 100742 - DNA, 25 bp, mus musculus
ctccaagtcaacaatctaagcacgg

SEQ ID NO: 100743 - DNA, 25 bp, mus musculus
caagtcaacaatctaagcacgggag

SEQ ID NO: 100744 - DNA, 25 bp, mus musculus
tcatcacctattgactgttcagaaa

SEQ ID NO: 100745 - DNA, 25 bp, mus musculus
tcacctattgactgttcagaaaagt

SEQ ID NO: 100746 - DNA, 25 bp, mus musculus
catgctgttatcattccttggttat

SEQ ID NO: 100747 - DNA, 25 bp, mus musculus
gctgttatcattccttggttataaa

SEQ ID NO: 100748 - DNA, 25 bp, mus musculus
gagttgctaactgctgtgtttcatc

SEQ ID NO: 100749 - DNA, 25 bp, mus musculus
ttgctaactgctgtgtttcatctgt

SEQ ID NO: 100750 - DNA, 25 bp, mus musculus
ctaactgctgtgtttcatctgttca

SEQ ID NO: 100751 - DNA, 25 bp, mus musculus
actgctgtgtttcatctgttcaata

SEQ ID NO: 100752 - DNA, 25 bp, mus musculus
gtgtttcatctgttcaatagggaag

SEQ ID NO: 100753 - DNA, 25 bp, mus musculus
tttcatctgttcaatagggaagcca

SEQ ID NO: 100754 - DNA, 25 bp, mus musculus
gtcaacaatctaagcacgggagatg

SEQ ID NO: 100755 - DNA, 25 bp, mus musculus
aatctaagcacgggagatgaagatg

SEQ ID NO: 100756 - DNA, 25 bp, mus musculus
gggcagatcccattgttggtgtcat

SEQ ID NO: 100757 - DNA, 25 bp, mus musculus
cagatcccattgttggtgtcatcac

SEQ ID NO: 100758 - DNA, 25 bp, mus musculus
atcccattgttggtgtcatcaccta

SEQ ID NO: 100759 - DNA, 25 bp, mus musculus
ttgttggtgtcatcacctattgact

SEQ ID NO: 100760 - DNA, 25 bp, mus musculus
ttggtgtcatcacctattgactgtt

SEQ ID NO: 100761 - DNA, 25 bp, mus musculus
gtgtcatcacctattgactgttcag

SEQ ID NO: 100762 - DNA, 25 bp, mus musculus
tcagctgtagctctgactatattgt

SEQ ID NO: 100763 - DNA, 25 bp, mus musculus
gctgtagctctgactatattgtgca

SEQ ID NO: 100764 - DNA, 25 bp, mus musculus
tcacttaattagacaccagagaagc

SEQ ID NO: 100765 - DNA, 25 bp, mus musculus
cttaattagacaccagagaagccat

SEQ ID NO: 100766 - DNA, 25 bp, mus musculus
gaaacctttccggtgcacagaatgt

SEQ ID NO: 100767 - DNA, 25 bp, mus musculus
acctttccggtgcacagaatgtggc

SEQ ID NO: 100768 - DNA, 25 bp, mus musculus
caagggcttcagcgttagttctgac

SEQ ID NO: 100769 - DNA, 25 bp, mus musculus
cttcagcgttagttctgactgtatt

SEQ ID NO: 100770 - DNA, 25 bp, mus musculus
ctgtattatacatcagactgtccat

SEQ ID NO: 100771 - DNA, 25 bp, mus musculus
tatacatcagactgtccatacttgg

SEQ ID NO: 100772 - DNA, 25 bp, mus musculus
acatcagactgtccatacttggaag

SEQ ID NO: 100773 - DNA, 25 bp, mus musculus
tcagactgtccatacttggaagaaa

SEQ ID NO: 100774 - DNA, 25 bp, mus musculus
ctgactatattgtgcaccagaggat

SEQ ID NO: 100775 - DNA, 25 bp, mus musculus
actatattgtgcaccagaggatcca

SEQ ID NO: 100776 - DNA, 25 bp, mus musculus
gagagaaaccctttcagtgtggcga

SEQ ID NO: 100777 - DNA, 25 bp, mus musculus
ttcagtgtggcgagtgtggcaaagc

SEQ ID NO: 100778 - DNA, 25 bp, mus musculus
gcaaagcttccacgtcaatgctcac

SEQ ID NO: 100779 - DNA, 25 bp, mus musculus
cttccacgtcaatgctcacttaatt

SEQ ID NO: 100780 - DNA, 25 bp, mus musculus
ccacgtcaatgctcacttaattaga

SEQ ID NO: 100781 - DNA, 25 bp, mus musculus
cgtcaatgctcacttaattagacac

SEQ ID NO: 100782 - DNA, 25 bp, mus musculus
catacgagccagcagcattactagg

SEQ ID NO: 100783 - DNA, 25 bp, mus musculus
acgagccagcagcattactagggcc

SEQ ID NO: 100784 - DNA, 25 bp, mus musculus
gtggcatcacttgtagcattgggca

SEQ ID NO: 100785 - DNA, 25 bp, mus musculus
tcacttgtagcattgggcatgcgtc

SEQ ID NO: 100786 - DNA, 25 bp, mus musculus
ggctgaatttcgctgatgggattca

SEQ ID NO: 100787 - DNA, 25 bp, mus musculus
atttcgctgatgggattcatgagta

SEQ ID NO: 100788 - DNA, 25 bp, mus musculus
aatatgcagagtccattgagcatgt

SEQ ID NO: 100789 - DNA, 25 bp, mus musculus
agcatgtgcgtgcacgcatacgaag

SEQ ID NO: 100790 - DNA, 25 bp, mus musculus
tgcgtgcacgcatacgaagctttgc

SEQ ID NO: 100791 - DNA, 25 bp, mus musculus
gtgcacgcatacgaagctttgcatc

SEQ ID NO: 100792 - DNA, 25 bp, mus musculus
cacgcatacgaagctttgcatctga

SEQ ID NO: 100793 - DNA, 25 bp, mus musculus
tacgaagctttgcatctgatgccaa

SEQ ID NO: 100794 - DNA, 25 bp, mus musculus
cattactagggccatggttgaaaca

SEQ ID NO: 100795 - DNA, 25 bp, mus musculus
catctgatgccaatctccatcgtcg

SEQ ID NO: 100796 - DNA, 25 bp, mus musculus
tgaaacactccgggaacacatgtgc

SEQ ID NO: 100797 - DNA, 25 bp, mus musculus
aacactccgggaacacatgtgccgc

SEQ ID NO: 100798 - DNA, 25 bp, mus musculus
ctctgcacccatcgagggccgtaac

SEQ ID NO: 100799 - DNA, 25 bp, mus musculus
tgcacccatcgagggccgtaacacg

SEQ ID NO: 100800 - DNA, 25 bp, mus musculus
catcgagggccgtaacacgtggcat

SEQ ID NO: 100801 - DNA, 25 bp, mus musculus
taacacgtggcatcacttgtagcat

SEQ ID NO: 100802 - DNA, 25 bp, mus musculus
cacgtggcatcacttgtagcattgg

SEQ ID NO: 100803 - DNA, 25 bp, mus musculus
gatcccattggctgtactcttcggg

SEQ ID NO: 100804 - DNA, 25 bp, mus musculus
atcactgtctggtatccaattgtcc

SEQ ID NO: 100805 - DNA, 25 bp, mus musculus
catccagctgggctgcattgcactt

SEQ ID NO: 100806 - DNA, 25 bp, mus musculus
ctgcattgcacttctctgggtggtc

SEQ ID NO: 100807 - DNA, 25 bp, mus musculus
tgcacttctctgggtggtcaagtca

SEQ ID NO: 100808 - DNA, 25 bp, mus musculus
tttcctgctcttgctcacggtgcct

SEQ ID NO: 100809 - DNA, 25 bp, mus musculus
ttggcgattcacagaccctaggaac

SEQ ID NO: 100810 - DNA, 25 bp, mus musculus
taggaacccagcaccagggccaggc

SEQ ID NO: 100811 - DNA, 25 bp, mus musculus
accagggccaggcattcctcagacc

SEQ ID NO: 100812 - DNA, 25 bp, mus musculus
tcagacccagggatgtgcctggagt

SEQ ID NO: 100813 - DNA, 25 bp, mus musculus
atgtgcctggagtcactgcccatgc

SEQ ID NO: 100814 - DNA, 25 bp, mus musculus
cagtggccccttgactttcacagcc

SEQ ID NO: 100815 - DNA, 25 bp, mus musculus
tatccaattgtcccaacgtctgctg

SEQ ID NO: 100816 - DNA, 25 bp, mus musculus
aagtcattacaacacactccgtgtg

SEQ ID NO: 100817 - DNA, 25 bp, mus musculus
attgtcccaacgtctgctgctcatt

SEQ ID NO: 100818 - DNA, 25 bp, mus musculus
tctgctgctcattttcatgccagca

SEQ ID NO: 100819 - DNA, 25 bp, mus musculus
gctcattttcatgccagcaaagcac

SEQ ID NO: 100820 - DNA, 25 bp, mus musculus
tttcatgccagcaaagcaccatcct

SEQ ID NO: 100821 - DNA, 25 bp, mus musculus
tgagcagccctacgtgaccaaggtg

SEQ ID NO: 100822 - DNA, 25 bp, mus musculus
gatcgacctgttcacctgcatccag

SEQ ID NO: 100823 - DNA, 25 bp, mus musculus
cctgttcacctgcatccagctgggc

SEQ ID NO: 100824 - DNA, 25 bp, mus musculus
atgcttctgcaagtgcttccggaga

SEQ ID NO: 100825 - DNA, 25 bp, mus musculus
cttctgcaagtgcttccggagaggt

SEQ ID NO: 100826 - DNA, 25 bp, mus musculus
tccctggagcacgagatcctcctgc

SEQ ID NO: 100827 - DNA, 25 bp, mus musculus
ctgcacccacgatacttcggtccaa

SEQ ID NO: 100828 - DNA, 25 bp, mus musculus
cgatacttcggtccaaacttgctca

SEQ ID NO: 100829 - DNA, 25 bp, mus musculus
tacttcggtccaaacttgctcaaca

SEQ ID NO: 100830 - DNA, 25 bp, mus musculus
acctgcactgggaaatatggctttg

SEQ ID NO: 100831 - DNA, 25 bp, mus musculus
gtaattgctgtcaccaccatcgaca

SEQ ID NO: 100832 - DNA, 25 bp, mus musculus
attgctgtcaccaccatcgacaata

SEQ ID NO: 100833 - DNA, 25 bp, mus musculus
gtcaccaccatcgacaatattggtg

SEQ ID NO: 100834 - DNA, 25 bp, mus musculus
atcgacaatattggtgctggtgtga

SEQ ID NO: 100835 - DNA, 25 bp, mus musculus
aatattggtgctggtgtgatccagc

SEQ ID NO: 100836 - DNA, 25 bp, mus musculus
ctgcaagtgcttccggagaggtctc

SEQ ID NO: 100837 - DNA, 25 bp, mus musculus
cttccggagaggtctctgcgtggga

SEQ ID NO: 100838 - DNA, 25 bp, mus musculus
gagaggtctctgcgtgggaagttct

SEQ ID NO: 100839 - DNA, 25 bp, mus musculus
ttctgggcgctgcgggccaagcttc

SEQ ID NO: 100840 - DNA, 25 bp, mus musculus
ctgcgggccaagcttctgcagaaga

SEQ ID NO: 100841 - DNA, 25 bp, mus musculus
ttttatcacatttccctggagcacg

SEQ ID NO: 100842 - DNA, 25 bp, mus musculus
tatcacatttccctggagcacgaga

SEQ ID NO: 100843 - DNA, 25 bp, mus musculus
atttccctggagcacgagatcctcc

SEQ ID NO: 100844 - DNA, 25 bp, mus musculus
cttgaacacacagaacggagactat

SEQ ID NO: 100845 - DNA, 25 bp, mus musculus
agactatgcctagtgtaggttttgc

SEQ ID NO: 100846 - DNA, 25 bp, mus musculus
ggtcacctgcattccatagcattgt

SEQ ID NO: 100847 - DNA, 25 bp, mus musculus
cacctgcattccatagcattgtgct

SEQ ID NO: 100848 - DNA, 25 bp, mus musculus
tccatagcattgtgcttgtacttgt

SEQ ID NO: 100849 - DNA, 25 bp, mus musculus
gcattgtgcttgtacttgtgctcac

SEQ ID NO: 100850 - DNA, 25 bp, mus musculus
ttgtgcttgtacttgtgctcacacg

SEQ ID NO: 100851 - DNA, 25 bp, mus musculus
ttgtacttgtgctcacacggttacc

SEQ ID NO: 100852 - DNA, 25 bp, mus musculus
tacttgtgctcacacggttacctag

SEQ ID NO: 100853 - DNA, 25 bp, mus musculus
ttgtgctcacacggttacctagggt

SEQ ID NO: 100854 - DNA, 25 bp, mus musculus
tgctcacacggttacctagggtagg

SEQ ID NO: 100855 - DNA, 25 bp, mus musculus
tacctagggtaggctgggagccatt

SEQ ID NO: 100856 - DNA, 25 bp, mus musculus
ctatgcctagtgtaggttttgcagt

SEQ ID NO: 100857 - DNA, 25 bp, mus musculus
ttaatggcctgaatgctagatatca

SEQ ID NO: 100858 - DNA, 25 bp, mus musculus
ctagatatcagatcacctgtttcgc

SEQ ID NO: 100859 - DNA, 25 bp, mus musculus
cctgtttcgctgtgggaacaggaga

SEQ ID NO: 100860 - DNA, 25 bp, mus musculus
catccgctgcatggtcacagtagag

SEQ ID NO: 100861 - DNA, 25 bp, mus musculus
ccgctgcatggtcacagtagagccc

SEQ ID NO: 100862 - DNA, 25 bp, mus musculus
agagcccccgtgactcgcctgtctt

SEQ ID NO: 100863 - DNA, 25 bp, mus musculus
ttgggtcacctgcattccatagcat

SEQ ID NO: 100864 - DNA, 25 bp, mus musculus
gaactgctcctttcactaccatggt

SEQ ID NO: 100865 - DNA, 25 bp, mus musculus
ccatggtttccacttctcagaactg

SEQ ID NO: 100866 - DNA, 25 bp, mus musculus
tcaaatttctgcgtcagtatgggtt

SEQ ID NO: 100867 - DNA, 25 bp, mus musculus
aatttctgcgtcagtatgggtttga

SEQ ID NO: 100868 - DNA, 25 bp, mus musculus
ttctgcgtcagtatgggtttgatgg

SEQ ID NO: 100869 - DNA, 25 bp, mus musculus
atggactggacctggactgggaata

SEQ ID NO: 100870 - DNA, 25 bp, mus musculus
gactggacctggactgggaatacca

SEQ ID NO: 100871 - DNA, 25 bp, mus musculus
aataccaggctcacgtgggagcctc

SEQ ID NO: 100872 - DNA, 25 bp, mus musculus
caggacaagcatctcttcactgtcc

SEQ ID NO: 100873 - DNA, 25 bp, mus musculus
aacaggcccagactgatggttactg

SEQ ID NO: 100874 - DNA, 25 bp, mus musculus
ctgatggttactgctgctgtagctg

SEQ ID NO: 100875 - DNA, 25 bp, mus musculus
atggttactgctgctgtagctggtg

SEQ ID NO: 100876 - DNA, 25 bp, mus musculus
tggtttccacttctcagaactgcca

SEQ ID NO: 100877 - DNA, 25 bp, mus musculus
actgctgctgtagctggtgggattt

SEQ ID NO: 100878 - DNA, 25 bp, mus musculus
tttccacttctcagaactgccagac

SEQ ID NO: 100879 - DNA, 25 bp, mus musculus
cttctcagaactgccagaccttcat

SEQ ID NO: 100880 - DNA, 25 bp, mus musculus
ctcagaactgccagaccttcattac

SEQ ID NO: 100881 - DNA, 25 bp, mus musculus
agaactgccagaccttcattacctc

SEQ ID NO: 100882 - DNA, 25 bp, mus musculus
agaccttcattacctcagtcatcaa

SEQ ID NO: 100883 - DNA, 25 bp, mus musculus
ttacctcagtcatcaaatttctgcg

SEQ ID NO: 100884 - DNA, 25 bp, mus musculus
cagtcatcaaatttctgcgtcagta

SEQ ID NO: 100885 - DNA, 25 bp, mus musculus
cggagctctctccatgtttgagctc

SEQ ID NO: 100886 - DNA, 25 bp, mus musculus
gagctctctccatgtttgagctcga

SEQ ID NO: 100887 - DNA, 25 bp, mus musculus
tgagctcgagttcttctatgaggag

SEQ ID NO: 100888 - DNA, 25 bp, mus musculus
gagctcgagttcttctatgaggagc

SEQ ID NO: 100889 - DNA, 25 bp, mus musculus
agctcgagttcttctatgaggagca

SEQ ID NO: 100890 - DNA, 25 bp, mus musculus
ctcgagttcttctatgaggagcagg

SEQ ID NO: 100891 - DNA, 25 bp, mus musculus
tcgagttcttctatgaggagcaggc

SEQ ID NO: 100892 - DNA, 25 bp, mus musculus
cgagttcttctatgaggagcaggcc

SEQ ID NO: 100893 - DNA, 25 bp, mus musculus
agttcttctatgaggagcaggccca

SEQ ID NO: 100894 - DNA, 25 bp, mus musculus
gttcttctatgaggagcaggcccag

SEQ ID NO: 100895 - DNA, 25 bp, mus musculus
ttcttctatgaggagcaggcccagc

SEQ ID NO: 100896 - DNA, 25 bp, mus musculus
tctatgaggagcaggcccagcgcat

SEQ ID NO: 100897 - DNA, 25 bp, mus musculus
agctctctccatgtttgagctcgag

SEQ ID NO: 100898 - DNA, 25 bp, mus musculus
gctctctccatgtttgagctcgagt

SEQ ID NO: 100899 - DNA, 25 bp, mus musculus
ctctccatgtttgagctcgagttct

SEQ ID NO: 100900 - DNA, 25 bp, mus musculus
tctccatgtttgagctcgagttctt

SEQ ID NO: 100901 - DNA, 25 bp, mus musculus
tccatgtttgagctcgagttcttct

SEQ ID NO: 100902 - DNA, 25 bp, mus musculus
catgtttgagctcgagttcttctat

SEQ ID NO: 100903 - DNA, 25 bp, mus musculus
tgtttgagctcgagttcttctatga

SEQ ID NO: 100904 - DNA, 25 bp, mus musculus
tttgagctcgagttcttctatgagg

SEQ ID NO: 100905 - DNA, 25 bp, mus musculus
tttagtagcccgagagagttgcacg

SEQ ID NO: 100906 - DNA, 25 bp, mus musculus
cacggctaagcactgcaatggaaag

SEQ ID NO: 100907 - DNA, 25 bp, mus musculus
ctcaagagctaatcctgtacatggc

SEQ ID NO: 100908 - DNA, 25 bp, mus musculus
taatcctgtacatggctcctttgac

SEQ ID NO: 100909 - DNA, 25 bp, mus musculus
tcctgtacatggctcctttgaccta

SEQ ID NO: 100910 - DNA, 25 bp, mus musculus
tgtacatggctcctttgacctacac

SEQ ID NO: 100911 - DNA, 25 bp, mus musculus
tggctcctttgacctacacactggg

SEQ ID NO: 100912 - DNA, 25 bp, mus musculus
ctcctttgacctacacactggggat

SEQ ID NO: 100913 - DNA, 25 bp, mus musculus
ctttgacctacacactggggatttg

SEQ ID NO: 100914 - DNA, 25 bp, mus musculus
ggatttgacctctatctccactctc

SEQ ID NO: 100915 - DNA, 25 bp, mus musculus
tttgacctctatctccactctcatt

SEQ ID NO: 100916 - DNA, 25 bp, mus musculus
tatctccactctcattaatatgggt

SEQ ID NO: 100917 - DNA, 25 bp, mus musculus
tggaaaggctctgcggcatatatga

SEQ ID NO: 100918 - DNA, 25 bp, mus musculus
ggctctgcggcatatatgagcctat

SEQ ID NO: 100919 - DNA, 25 bp, mus musculus
tatatgagcctattctagggagaca

SEQ ID NO: 100920 - DNA, 25 bp, mus musculus
atgagcctattctagggagacatgt

SEQ ID NO: 100921 - DNA, 25 bp, mus musculus
atgtcatctttcatgaaggttcagt

SEQ ID NO: 100922 - DNA, 25 bp, mus musculus
aacgacacggagcaggtcagggttg

SEQ ID NO: 100923 - DNA, 25 bp, mus musculus
cctgtgagcctcaagagctaatcct

SEQ ID NO: 100924 - DNA, 25 bp, mus musculus
agcctcaagagctaatcctgtacat

SEQ ID NO: 100925 - DNA, 25 bp, mus musculus
gtggctccggatctcttcgtctttg

SEQ ID NO: 100926 - DNA, 25 bp, mus musculus
tggctccggatctcttcgtctttgc

SEQ ID NO: 100927 - DNA, 25 bp, mus musculus
agcagccatgtcgaagccccatagt

SEQ ID NO: 100928 - DNA, 25 bp, mus musculus
gcagccatgtcgaagccccatagtg

SEQ ID NO: 100929 - DNA, 25 bp, mus musculus
agccatgtcgaagccccatagtgaa

SEQ ID NO: 100930 - DNA, 25 bp, mus musculus
gccatgtcgaagccccatagtgaag

SEQ ID NO: 100931 - DNA, 25 bp, mus musculus
catgtcgaagccccatagtgaagcc

SEQ ID NO: 100932 - DNA, 25 bp, mus musculus
gtcgaagccccatagtgaagccggg

SEQ ID NO: 100933 - DNA, 25 bp, mus musculus
tcgaagccccatagtgaagccggga

SEQ ID NO: 100934 - DNA, 25 bp, mus musculus
aagccccatagtgaagccgggactg

SEQ ID NO: 100935 - DNA, 25 bp, mus musculus
ccagcttcccgatcagtggagacgt

SEQ ID NO: 100936 - DNA, 25 bp, mus musculus
agcttcccgatcagtggagacgttg

SEQ ID NO: 100937 - DNA, 25 bp, mus musculus
gctccggatctcttcgtctttgcag

SEQ ID NO: 100938 - DNA, 25 bp, mus musculus
tcttcgtctttgcagcgtacgccga

SEQ ID NO: 100939 - DNA, 25 bp, mus musculus
cgtacgccgagtcggtcagcgccgg

SEQ ID NO: 100940 - DNA, 25 bp, mus musculus
tacgccgagtcggtcagcgccggag

SEQ ID NO: 100941 - DNA, 25 bp, mus musculus
gccggagacctcagcagccatgtcg

SEQ ID NO: 100942 - DNA, 25 bp, mus musculus
ccggagacctcagcagccatgtcga

SEQ ID NO: 100943 - DNA, 25 bp, mus musculus
ggagacctcagcagccatgtcgaag

SEQ ID NO: 100944 - DNA, 25 bp, mus musculus
gacctcagcagccatgtcgaagccc

SEQ ID NO: 100945 - DNA, 25 bp, mus musculus
cttcttgtcggcttgaaaggacttg

SEQ ID NO: 100946 - DNA, 25 bp, mus musculus
tcttgtcggcttgaaaggacttggg

SEQ ID NO: 100947 - DNA, 25 bp, mus musculus
tcgtactgggtctgttggccgaaat

SEQ ID NO: 100948 - DNA, 25 bp, mus musculus
gtactgggtctgttggccgaaatag

SEQ ID NO: 100949 - DNA, 25 bp, mus musculus
taggcctgaacctcttttggagcga

SEQ ID NO: 100950 - DNA, 25 bp, mus musculus
tgaacctcttttggagcgagctcag

SEQ ID NO: 100951 - DNA, 25 bp, mus musculus
aacctcttttggagcgagctcagaa

SEQ ID NO: 100952 - DNA, 25 bp, mus musculus
tcttttggagcgagctcagaatctc

SEQ ID NO: 100953 - DNA, 25 bp, mus musculus
cgagctcagaatctcaaccccatgg

SEQ ID NO: 100954 - DNA, 25 bp, mus musculus
agctcagaatctcaaccccatggtg

SEQ ID NO: 100955 - DNA, 25 bp, mus musculus
ctcagaatctcaaccccatggtgga

SEQ ID NO: 100956 - DNA, 25 bp, mus musculus
cagaatctcaaccccatggtggatg

SEQ ID NO: 100957 - DNA, 25 bp, mus musculus
tctcatcttggcaggagtgaaagga

SEQ ID NO: 100958 - DNA, 25 bp, mus musculus
gaatctcaaccccatggtggatgtg

SEQ ID NO: 100959 - DNA, 25 bp, mus musculus
tcatcttggcaggagtgaaaggaca

SEQ ID NO: 100960 - DNA, 25 bp, mus musculus
atcttggcaggagtgaaaggacatg

SEQ ID NO: 100961 - DNA, 25 bp, mus musculus
gaaaggacatgccatgctggatcac

SEQ ID NO: 100962 - DNA, 25 bp, mus musculus
aaggacatgccatgctggatcacga

SEQ ID NO: 100963 - DNA, 25 bp, mus musculus
ggacatgccatgctggatcacgaac

SEQ ID NO: 100964 - DNA, 25 bp, mus musculus
acatgccatgctggatcacgaacag

SEQ ID NO: 100965 - DNA, 25 bp, mus musculus
atgccatgctggatcacgaacaggt

SEQ ID NO: 100966 - DNA, 25 bp, mus musculus
agatacggggttgctcttttgctca

SEQ ID NO: 100967 - DNA, 25 bp, mus musculus
tcttttgctcataagaggggcttcg

SEQ ID NO: 100968 - DNA, 25 bp, mus musculus
aattaagatcctcaattggctggag

SEQ ID NO: 100969 - DNA, 25 bp, mus musculus
aagatcctcaattggctggagggca

SEQ ID NO: 100970 - DNA, 25 bp, mus musculus
gatcctcaattggctggagggcaga

SEQ ID NO: 100971 - DNA, 25 bp, mus musculus
tcctcaattggctggagggcagatc

SEQ ID NO: 100972 - DNA, 25 bp, mus musculus
ctcaattggctggagggcagatctc

SEQ ID NO: 100973 - DNA, 25 bp, mus musculus
gggcagatctcgcgagtagggcaac

SEQ ID NO: 100974 - DNA, 25 bp, mus musculus
gcagatctcgcgagtagggcaacgc

SEQ ID NO: 100975 - DNA, 25 bp, mus musculus
agatctcgcgagtagggcaacgcgg

SEQ ID NO: 100976 - DNA, 25 bp, mus musculus
atctcgcgagtagggcaacgcggta

SEQ ID NO: 100977 - DNA, 25 bp, mus musculus
cagctgcccaagggcgttcgtaacg

SEQ ID NO: 100978 - DNA, 25 bp, mus musculus
tcataagaggggcttcgctggcagt

SEQ ID NO: 100979 - DNA, 25 bp, mus musculus
cttcgctggcagtctgaacggcaag

SEQ ID NO: 100980 - DNA, 25 bp, mus musculus
tcgctggcagtctgaacggcaagct

SEQ ID NO: 100981 - DNA, 25 bp, mus musculus
agtctgaacggcaagcttgagtcag

SEQ ID NO: 100982 - DNA, 25 bp, mus musculus
aacggcaagcttgagtcaggaccct

SEQ ID NO: 100983 - DNA, 25 bp, mus musculus
ttgagtcaggacccttaattaagat

SEQ ID NO: 100984 - DNA, 25 bp, mus musculus
ccttaattaagatcctcaattggct

SEQ ID NO: 100985 - DNA, 25 bp, mus musculus
ttaattaagatcctcaattggctgg

SEQ ID NO: 100986 - DNA, 25 bp, mus musculus
cacggacgaactgcgcaccgtcatt

SEQ ID NO: 100987 - DNA, 25 bp, mus musculus
acggacgaactgcgcaccgtcattg

SEQ ID NO: 100988 - DNA, 25 bp, mus musculus
ctgcgcaccgtcattgaggacatgc

SEQ ID NO: 100989 - DNA, 25 bp, mus musculus
tgcgcaccgtcattgaggacatgct

SEQ ID NO: 100990 - DNA, 25 bp, mus musculus
gcgcaccgtcattgaggacatgctg

SEQ ID NO: 100991 - DNA, 25 bp, mus musculus
cgtcattgaggacatgctggctatg

SEQ ID NO: 100992 - DNA, 25 bp, mus musculus
aggacatgctggctatgccaaggcg

SEQ ID NO: 100993 - DNA, 25 bp, mus musculus
ctatgccaaggcggcgctgctcaac

SEQ ID NO: 100994 - DNA, 25 bp, mus musculus
tatgccaaggcggcgctgctcaacg

SEQ ID NO: 100995 - DNA, 25 bp, mus musculus
cggacgaactgcgcaccgtcattga

SEQ ID NO: 100996 - DNA, 25 bp, mus musculus
ggacgaactgcgcaccgtcattgag

SEQ ID NO: 100997 - DNA, 25 bp, mus musculus
gacgaactgcgcaccgtcattgagg

SEQ ID NO: 100998 - DNA, 25 bp, mus musculus
acgaactgcgcaccgtcattgagga

SEQ ID NO: 100999 - DNA, 25 bp, mus musculus
cgaactgcgcaccgtcattgaggac

SEQ ID NO: 101000 - DNA, 25 bp, mus musculus
gaactgcgcaccgtcattgaggaca

SEQ ID NO: 101001 - DNA, 25 bp, mus musculus
aactgcgcaccgtcattgaggacat

SEQ ID NO: 101002 - DNA, 25 bp, mus musculus
actgcgcaccgtcattgaggacatg

SEQ ID NO: 101003 - DNA, 25 bp, mus musculus
gaatgtaattcctccacacactcca

SEQ ID NO: 101004 - DNA, 25 bp, mus musculus
aatgtaattcctccacacactccag

SEQ ID NO: 101005 - DNA, 25 bp, mus musculus
aattttacaacttgcacaggtgatt

SEQ ID NO: 101006 - DNA, 25 bp, mus musculus
attttacaacttgcacaggtgattc

SEQ ID NO: 101007 - DNA, 25 bp, mus musculus
ttttacaacttgcacaggtgattcc

SEQ ID NO: 101008 - DNA, 25 bp, mus musculus
tttacaacttgcacaggtgattcca

SEQ ID NO: 101009 - DNA, 25 bp, mus musculus
ttacaacttgcacaggtgattccaa

SEQ ID NO: 101010 - DNA, 25 bp, mus musculus
tacaacttgcacaggtgattccaaa

SEQ ID NO: 101011 - DNA, 25 bp, mus musculus
acaacttgcacaggtgattccaaaa

SEQ ID NO: 101012 - DNA, 25 bp, mus musculus
caacttgcacaggtgattccaaaag

SEQ ID NO: 101013 - DNA, 25 bp, mus musculus
aacttgcacaggtgattccaaaagg

SEQ ID NO: 101014 - DNA, 25 bp, mus musculus
acttgcacaggtgattccaaaagga

SEQ ID NO: 101015 - DNA, 25 bp, mus musculus
atgtaattcctccacacactccagt

SEQ ID NO: 101016 - DNA, 25 bp, mus musculus
tgatttcctaattttacaacttgca

SEQ ID NO: 101017 - DNA, 25 bp, mus musculus
tttcctaattttacaacttgcacag

SEQ ID NO: 101018 - DNA, 25 bp, mus musculus
ttcctaattttacaacttgcacagg

SEQ ID NO: 101019 - DNA, 25 bp, mus musculus
tcctaattttacaacttgcacaggt

SEQ ID NO: 101020 - DNA, 25 bp, mus musculus
cctaattttacaacttgcacaggtg

SEQ ID NO: 101021 - DNA, 25 bp, mus musculus
ctaattttacaacttgcacaggtga

SEQ ID NO: 101022 - DNA, 25 bp, mus musculus
taattttacaacttgcacaggtgat

SEQ ID NO: 101023 - DNA, 25 bp, mus musculus
cagtggtccctgctattccagtgag

SEQ ID NO: 101024 - DNA, 25 bp, mus musculus
tccctgctattccagtgagtcagtg

SEQ ID NO: 101025 - DNA, 25 bp, mus musculus
agccctgaaacctcattccatgctg

SEQ ID NO: 101026 - DNA, 25 bp, mus musculus
cctgaaacctcattccatgctgtcc

SEQ ID NO: 101027 - DNA, 25 bp, mus musculus
gaaacctcattccatgctgtcccaa

SEQ ID NO: 101028 - DNA, 25 bp, mus musculus
acctcattccatgctgtcccaagtc

SEQ ID NO: 101029 - DNA, 25 bp, mus musculus
tcattccatgctgtcccaagtccag

SEQ ID NO: 101030 - DNA, 25 bp, mus musculus
gtcccaagtccagctgattacttgt

SEQ ID NO: 101031 - DNA, 25 bp, mus musculus
ccaagtccagctgattacttgtctc

SEQ ID NO: 101032 - DNA, 25 bp, mus musculus
agtccagctgattacttgtctcatc

SEQ ID NO: 101033 - DNA, 25 bp, mus musculus
ccagctgattacttgtctcatcgtg

SEQ ID NO: 101034 - DNA, 25 bp, mus musculus
gctgattacttgtctcatcgtgcta

SEQ ID NO: 101035 - DNA, 25 bp, mus musculus
ctgctattccagtgagtcagtgact

SEQ ID NO: 101036 - DNA, 25 bp, mus musculus
gattacttgtctcatcgtgctagtg

SEQ ID NO: 101037 - DNA, 25 bp, mus musculus
ctattccagtgagtcagtgacttgg

SEQ ID NO: 101038 - DNA, 25 bp, mus musculus
gtcagtgacttggctcttaggtctt

SEQ ID NO: 101039 - DNA, 25 bp, mus musculus
agctgttcctgcatggctcctttcg

SEQ ID NO: 101040 - DNA, 25 bp, mus musculus
tgttcctgcatggctcctttcgccc

SEQ ID NO: 101041 - DNA, 25 bp, mus musculus
ctttaggccagccctgaaacctcat

SEQ ID NO: 101042 - DNA, 25 bp, mus musculus
taggccagccctgaaacctcattcc

SEQ ID NO: 101043 - DNA, 25 bp, mus musculus
gccagccctgaaacctcattccatg

SEQ ID NO: 101044 - DNA, 25 bp, mus musculus
tacctggcctgcatcgaggttggaa

SEQ ID NO: 101045 - DNA, 25 bp, mus musculus
acctggcctgcatcgaggttggaac

SEQ ID NO: 101046 - DNA, 25 bp, mus musculus
cgcagtcctagcagacatcatgaaa

SEQ ID NO: 101047 - DNA, 25 bp, mus musculus
gcagtcctagcagacatcatgaaat

SEQ ID NO: 101048 - DNA, 25 bp, mus musculus
cagtcctagcagacatcatgaaata

SEQ ID NO: 101049 - DNA, 25 bp, mus musculus
agtcctagcagacatcatgaaatac

SEQ ID NO: 101050 - DNA, 25 bp, mus musculus
tcctagcagacatcatgaaatacgt

SEQ ID NO: 101051 - DNA, 25 bp, mus musculus
acaacttttggatgaccagacaaga

SEQ ID NO: 101052 - DNA, 25 bp, mus musculus
agggtgtccgtgtgctggagaaact

SEQ ID NO: 101053 - DNA, 25 bp, mus musculus
gtgtccgtgtgctggagaaacttgg

SEQ ID NO: 101054 - DNA, 25 bp, mus musculus
tgtccgtgtgctggagaaacttggt

SEQ ID NO: 101055 - DNA, 25 bp, mus musculus
ccatcacgcctctaatgctttttct

SEQ ID NO: 101056 - DNA, 25 bp, mus musculus
cctggcctgcatcgaggttggaacg

SEQ ID NO: 101057 - DNA, 25 bp, mus musculus
gcctgcatcgaggttggaacgagag

SEQ ID NO: 101058 - DNA, 25 bp, mus musculus
cctgcatcgaggttggaacgagagc

SEQ ID NO: 101059 - DNA, 25 bp, mus musculus
tgcatcgaggttggaacgagagctt

SEQ ID NO: 101060 - DNA, 25 bp, mus musculus
acagctttacttagaacgagttctg

SEQ ID NO: 101061 - DNA, 25 bp, mus musculus
gaagcacatggtgttcttgggtggc

SEQ ID NO: 101062 - DNA, 25 bp, mus musculus
tggcgcagtcctagcagacatcatg

SEQ ID NO: 101063 - DNA, 25 bp, mus musculus
ggcgcagtcctagcagacatcatga

SEQ ID NO: 101064 - DNA, 25 bp, mus musculus
tgcatgcctggttctctgcgtctgc

SEQ ID NO: 101065 - DNA, 25 bp, mus musculus
atgcctggttctctgcgtctgcaaa

SEQ ID NO: 101066 - DNA, 25 bp, mus musculus
tgtcttctgagtctgggcagcagtc

SEQ ID NO: 101067 - DNA, 25 bp, mus musculus
cttctgagtctgggcagcagtccct

SEQ ID NO: 101068 - DNA, 25 bp, mus musculus
ctccactgacagccatgtgtcttct

SEQ ID NO: 101069 - DNA, 25 bp, mus musculus
cactgacagccatgtgtcttctcct

SEQ ID NO: 101070 - DNA, 25 bp, mus musculus
tgacagccatgtgtcttctcctcga

SEQ ID NO: 101071 - DNA, 25 bp, mus musculus
ccatgtgtcttctcctcgagccaaa

SEQ ID NO: 101072 - DNA, 25 bp, mus musculus
tgtgtcttctcctcgagccaaagaa

SEQ ID NO: 101073 - DNA, 25 bp, mus musculus
tcgtctttggagggtccttatcaca

SEQ ID NO: 101074 - DNA, 25 bp, mus musculus
tctttggagggtccttatcacagga

SEQ ID NO: 101075 - DNA, 25 bp, mus musculus
ggtccttatcacaggacctctgagg

SEQ ID NO: 101076 - DNA, 25 bp, mus musculus
cctggttctctgcgtctgcaaaggt

SEQ ID NO: 101077 - DNA, 25 bp, mus musculus
gtccttatcacaggacctctgaggg

SEQ ID NO: 101078 - DNA, 25 bp, mus musculus
tctctgcgtctgcaaaggtgtcatg

SEQ ID NO: 101079 - DNA, 25 bp, mus musculus
gcagctcatttgccatggggcagta

SEQ ID NO: 101080 - DNA, 25 bp, mus musculus
tggatgcctacacacacacacatat

SEQ ID NO: 101081 - DNA, 25 bp, mus musculus
atgcctacacacacacacatatgtc

SEQ ID NO: 101082 - DNA, 25 bp, mus musculus
cacacacacatatgtcttctgagtc

SEQ ID NO: 101083 - DNA, 25 bp, mus musculus
acacacatatgtcttctgagtctgg

SEQ ID NO: 101084 - DNA, 25 bp, mus musculus
cacatatgtcttctgagtctgggca

SEQ ID NO: 101085 - DNA, 25 bp, mus musculus
actctctagtcaggcttatcacatc

SEQ ID NO: 101086 - DNA, 25 bp, mus musculus
tagtcaggcttatcacatcccacca

SEQ ID NO: 101087 - DNA, 25 bp, mus musculus
catatagttcctgtgtaatggtcag

SEQ ID NO: 101088 - DNA, 25 bp, mus musculus
tggtcagtcatcttttgtagctcta

SEQ ID NO: 101089 - DNA, 25 bp, mus musculus
gtcatcttttgtagctctacctagt

SEQ ID NO: 101090 - DNA, 25 bp, mus musculus
agctctacctagttaagtctctctg

SEQ ID NO: 101091 - DNA, 25 bp, mus musculus
ttaagtctctctgaagaaaattcac

SEQ ID NO: 101092 - DNA, 25 bp, mus musculus
ctcactattcattattcttcacatt

SEQ ID NO: 101093 - DNA, 25 bp, mus musculus
attcattattcttcacattcaacat

SEQ ID NO: 101094 - DNA, 25 bp, mus musculus
tattcttcacattcaacataatcag

SEQ ID NO: 101095 - DNA, 25 bp, mus musculus
tcacattcaacataatcagtggttt

SEQ ID NO: 101096 - DNA, 25 bp, mus musculus
tttgcttgttcaggggacaatgacc

SEQ ID NO: 101097 - DNA, 25 bp, mus musculus
ggcttatcacatcccaccaagaata

SEQ ID NO: 101098 - DNA, 25 bp, mus musculus
gcagatatcatttaccccaaatatt

SEQ ID NO: 101099 - DNA, 25 bp, mus musculus
tctgtgacacattcatgaagtcaaa

SEQ ID NO: 101100 - DNA, 25 bp, mus musculus
agtcaaatctagccaatgactatac

SEQ ID NO: 101101 - DNA, 25 bp, mus musculus
atctagccaatgactatacattgtc

SEQ ID NO: 101102 - DNA, 25 bp, mus musculus
actatacattgtctgtatgactaaa

SEQ ID NO: 101103 - DNA, 25 bp, mus musculus
agtcactaaaactcatatgactaat

SEQ ID NO: 101104 - DNA, 25 bp, mus musculus
tgttccaagagcacaatgaagtaag

SEQ ID NO: 101105 - DNA, 25 bp, mus musculus
gccttccttctccagcatggtgagc

SEQ ID NO: 101106 - DNA, 25 bp, mus musculus
tccttctccagcatggtgagctgcg

SEQ ID NO: 101107 - DNA, 25 bp, mus musculus
tgcgggaccgccaacatgagctgca

SEQ ID NO: 101108 - DNA, 25 bp, mus musculus
cgggaccgccaacatgagctgcaat

SEQ ID NO: 101109 - DNA, 25 bp, mus musculus
accgccaacatgagctgcaatggac

SEQ ID NO: 101110 - DNA, 25 bp, mus musculus
cgccaacatgagctgcaatggacat

SEQ ID NO: 101111 - DNA, 25 bp, mus musculus
aagacctgcttgctgatgagctacg

SEQ ID NO: 101112 - DNA, 25 bp, mus musculus
gacctgcttgctgatgagctacgcc

SEQ ID NO: 101113 - DNA, 25 bp, mus musculus
tgcttgctgatgagctacgccaacg

SEQ ID NO: 101114 - DNA, 25 bp, mus musculus
cttgctgatgagctacgccaacgac

SEQ ID NO: 101115 - DNA, 25 bp, mus musculus
ctgatgagctacgccaacgacgcct

SEQ ID NO: 101116 - DNA, 25 bp, mus musculus
gatgagctacgccaacgacgccttc

SEQ ID NO: 101117 - DNA, 25 bp, mus musculus
cttctccagcatggtgagctgcggg

SEQ ID NO: 101118 - DNA, 25 bp, mus musculus
gacgccttcccagaggaatacgtgc

SEQ ID NO: 101119 - DNA, 25 bp, mus musculus
tccagcatggtgagctgcggggctc

SEQ ID NO: 101120 - DNA, 25 bp, mus musculus
tcaggccgcctgagctccagcctgg

SEQ ID NO: 101121 - DNA, 25 bp, mus musculus
tccatgcactgcagaagccccagca

SEQ ID NO: 101122 - DNA, 25 bp, mus musculus
catgcactgcagaagccccagcagc

SEQ ID NO: 101123 - DNA, 25 bp, mus musculus
cactgcagaagccccagcagctgct

SEQ ID NO: 101124 - DNA, 25 bp, mus musculus
ctgcagaagccccagcagctgctgc

SEQ ID NO: 101125 - DNA, 25 bp, mus musculus
cagcagctgctgcgggaccgccaac

SEQ ID NO: 101126 - DNA, 25 bp, mus musculus
cactccggggcgcacgatgatggag

SEQ ID NO: 101127 - DNA, 25 bp, mus musculus
gcccaccgtgatggttttcatcagc

SEQ ID NO: 101128 - DNA, 25 bp, mus musculus
cagtcgtagcctcaccatcgcagag

SEQ ID NO: 101129 - DNA, 25 bp, mus musculus
gtcgtagcctcaccatcgcagagtt

SEQ ID NO: 101130 - DNA, 25 bp, mus musculus
caccatcgcagagttcaagtgtaaa

SEQ ID NO: 101131 - DNA, 25 bp, mus musculus
ccatcgcagagttcaagtgtaaact

SEQ ID NO: 101132 - DNA, 25 bp, mus musculus
ggcagccctgcttcctgcatggaac

SEQ ID NO: 101133 - DNA, 25 bp, mus musculus
cagccctgcttcctgcatggaactg

SEQ ID NO: 101134 - DNA, 25 bp, mus musculus
tgcttcctgcatggaactggagcta

SEQ ID NO: 101135 - DNA, 25 bp, mus musculus
cttcctgcatggaactggagctata

SEQ ID NO: 101136 - DNA, 25 bp, mus musculus
acaagttctacagcaagttggatca

SEQ ID NO: 101137 - DNA, 25 bp, mus musculus
aagttctacagcaagttggatcagg

SEQ ID NO: 101138 - DNA, 25 bp, mus musculus
atggttttcatcagcagctccctca

SEQ ID NO: 101139 - DNA, 25 bp, mus musculus
ttttcatcagcagctccctcaacag

SEQ ID NO: 101140 - DNA, 25 bp, mus musculus
ttcatcagcagctccctcaacagct

SEQ ID NO: 101141 - DNA, 25 bp, mus musculus
cagcttccgttcggagaagcgatac

SEQ ID NO: 101142 - DNA, 25 bp, mus musculus
gcttccgttcggagaagcgatacag

SEQ ID NO: 101143 - DNA, 25 bp, mus musculus
gcgatacagtcgtagcctcaccatc

SEQ ID NO: 101144 - DNA, 25 bp, mus musculus
gatacagtcgtagcctcaccatcgc

SEQ ID NO: 101145 - DNA, 25 bp, mus musculus
tacagtcgtagcctcaccatcgcag

SEQ ID NO: 101146 - DNA, 25 bp, mus musculus
ggctgcgcgctacgtttgtacacac

SEQ ID NO: 101147 - DNA, 25 bp, mus musculus
tgcgcgctacgtttgtacacacaga

SEQ ID NO: 101148 - DNA, 25 bp, mus musculus
gcagccaggccttcagaggttcatg

SEQ ID NO: 101149 - DNA, 25 bp, mus musculus
aggccttcagaggttcatggagaca

SEQ ID NO: 101150 - DNA, 25 bp, mus musculus
ctgagaacaccagagtctccttgct

SEQ ID NO: 101151 - DNA, 25 bp, mus musculus
ccccaagtgcctgtggccgctgtgt

SEQ ID NO: 101152 - DNA, 25 bp, mus musculus
caagtgcctgtggccgctgtgtggc

SEQ ID NO: 101153 - DNA, 25 bp, mus musculus
ctaccaggtcccttagggctcaatg

SEQ ID NO: 101154 - DNA, 25 bp, mus musculus
ccaggtcccttagggctcaatggag

SEQ ID NO: 101155 - DNA, 25 bp, mus musculus
gggcatctccattatccgtgcgtgc

SEQ ID NO: 101156 - DNA, 25 bp, mus musculus
catctccattatccgtgcgtgccta

SEQ ID NO: 101157 - DNA, 25 bp, mus musculus
ctccattatccgtgcgtgcctagct

SEQ ID NO: 101158 - DNA, 25 bp, mus musculus
gcgctacgtttgtacacacagactc

SEQ ID NO: 101159 - DNA, 25 bp, mus musculus
ctacgtttgtacacacagactcttc

SEQ ID NO: 101160 - DNA, 25 bp, mus musculus
tacacacagactcttccggatacct

SEQ ID NO: 101161 - DNA, 25 bp, mus musculus
acacagactcttccggataccttct

SEQ ID NO: 101162 - DNA, 25 bp, mus musculus
cagactcttccggataccttcttgt

SEQ ID NO: 101163 - DNA, 25 bp, mus musculus
ccggataccttcttgtctggcccag

SEQ ID NO: 101164 - DNA, 25 bp, mus musculus
gataccttcttgtctggcccagcag

SEQ ID NO: 101165 - DNA, 25 bp, mus musculus
accttcttgtctggcccagcaggga

SEQ ID NO: 101166 - DNA, 25 bp, mus musculus
ctcttttcagctgacttactgtata

SEQ ID NO: 101167 - DNA, 25 bp, mus musculus
cttttcagctgacttactgtatatc

SEQ ID NO: 101168 - DNA, 25 bp, mus musculus
tctgaccttgcggtgattacaaaac

SEQ ID NO: 101169 - DNA, 25 bp, mus musculus
ctgaccttgcggtgattacaaaaca

SEQ ID NO: 101170 - DNA, 25 bp, mus musculus
agaaggtccatatcagcctctgagc

SEQ ID NO: 101171 - DNA, 25 bp, mus musculus
gaaggtccatatcagcctctgagct

SEQ ID NO: 101172 - DNA, 25 bp, mus musculus
aggtccatatcagcctctgagctcg

SEQ ID NO: 101173 - DNA, 25 bp, mus musculus
ggtccatatcagcctctgagctcgg

SEQ ID NO: 101174 - DNA, 25 bp, mus musculus
cagcctctgagctcggcaagcctgg

SEQ ID NO: 101175 - DNA, 25 bp, mus musculus
gcctctgagctcggcaagcctgggt

SEQ ID NO: 101176 - DNA, 25 bp, mus musculus
cctctgagctcggcaagcctgggtc

SEQ ID NO: 101177 - DNA, 25 bp, mus musculus
ctctgagctcggcaagcctgggtcg

SEQ ID NO: 101178 - DNA, 25 bp, mus musculus
ttttcagctgacttactgtatatct

SEQ ID NO: 101179 - DNA, 25 bp, mus musculus
tttcagctgacttactgtatatctt

SEQ ID NO: 101180 - DNA, 25 bp, mus musculus
tcagctgacttactgtatatcttta

SEQ ID NO: 101181 - DNA, 25 bp, mus musculus
ctgacttactgtatatctttaaaat

SEQ ID NO: 101182 - DNA, 25 bp, mus musculus
cattcttagactaactaaacctctg

SEQ ID NO: 101183 - DNA, 25 bp, mus musculus
aacctctgaccttgcggtgattaca

SEQ ID NO: 101184 - DNA, 25 bp, mus musculus
acctctgaccttgcggtgattacaa

SEQ ID NO: 101185 - DNA, 25 bp, mus musculus
ctctgaccttgcggtgattacaaaa

SEQ ID NO: 101186 - DNA, 25 bp, mus musculus
gacgttactcgcattcgatctgtgg

SEQ ID NO: 101187 - DNA, 25 bp, mus musculus
actcgcattcgatctgtggctgagg

SEQ ID NO: 101188 - DNA, 25 bp, mus musculus
atcagaggcacctcgtcggtcatac

SEQ ID NO: 101189 - DNA, 25 bp, mus musculus
acctcgtcggtcatacacctgagct

SEQ ID NO: 101190 - DNA, 25 bp, mus musculus
tcggtcatacacctgagctggtgca

SEQ ID NO: 101191 - DNA, 25 bp, mus musculus
atacacctgagctggtgcatctaga

SEQ ID NO: 101192 - DNA, 25 bp, mus musculus
cacctgagctggtgcatctagactc

SEQ ID NO: 101193 - DNA, 25 bp, mus musculus
tgcatctagactctcctactcagtt

SEQ ID NO: 101194 - DNA, 25 bp, mus musculus
atctagactctcctactcagttctt

SEQ ID NO: 101195 - DNA, 25 bp, mus musculus
tgactgcatcattacaaccaagtat

SEQ ID NO: 101196 - DNA, 25 bp, mus musculus
ctgcatcattacaaccaagtatctg

SEQ ID NO: 101197 - DNA, 25 bp, mus musculus
caagtatctggggaccgtcatgtcg

SEQ ID NO: 101198 - DNA, 25 bp, mus musculus
cgcattcgatctgtggctgaggatc

SEQ ID NO: 101199 - DNA, 25 bp, mus musculus
ctcacaacgcatgtagcgcgttctg

SEQ ID NO: 101200 - DNA, 25 bp, mus musculus
acgcatgtagcgcgttctgcaatca

SEQ ID NO: 101201 - DNA, 25 bp, mus musculus
catgtagcgcgttctgcaatcataa

SEQ ID NO: 101202 - DNA, 25 bp, mus musculus
gtagcgcgttctgcaatcataatca

SEQ ID NO: 101203 - DNA, 25 bp, mus musculus
cgttctgcaatcataatcagaggca

SEQ ID NO: 101204 - DNA, 25 bp, mus musculus
tctgcaatcataatcagaggcacct

SEQ ID NO: 101205 - DNA, 25 bp, mus musculus
ataatcagaggcacctcgtcggtca

SEQ ID NO: 101206 - DNA, 25 bp, mus musculus
gtattttctaagtgctccttctgag

SEQ ID NO: 101207 - DNA, 25 bp, mus musculus
aagtgctccttctgagcctcagttc

SEQ ID NO: 101208 - DNA, 25 bp, mus musculus
tcaccacagaacgcttgtttccacg

SEQ ID NO: 101209 - DNA, 25 bp, mus musculus
tgtttccacgttctagaaatgaggg

SEQ ID NO: 101210 - DNA, 25 bp, mus musculus
ttccacgttctagaaatgagggcag

SEQ ID NO: 101211 - DNA, 25 bp, mus musculus
ctaccttgtagggagctgggaggat

SEQ ID NO: 101212 - DNA, 25 bp, mus musculus
aagcgtttgccatgttttgggcaca

SEQ ID NO: 101213 - DNA, 25 bp, mus musculus
cctgccttgcctgctccttgaacat

SEQ ID NO: 101214 - DNA, 25 bp, mus musculus
gccttgcctgctccttgaacattac

SEQ ID NO: 101215 - DNA, 25 bp, mus musculus
ttgcctgctccttgaacattaccaa

SEQ ID NO: 101216 - DNA, 25 bp, mus musculus
cctgctccttgaacattaccaaaga

SEQ ID NO: 101217 - DNA, 25 bp, mus musculus
ccttgaacattaccaaagagaatgg

SEQ ID NO: 101218 - DNA, 25 bp, mus musculus
caaccccagctaagctgaatcttgg

SEQ ID NO: 101219 - DNA, 25 bp, mus musculus
ttttgccaataaacgtgtctgtgtt

SEQ ID NO: 101220 - DNA, 25 bp, mus musculus
ggaacaagctttgacccattggagt

SEQ ID NO: 101221 - DNA, 25 bp, mus musculus
acaagctttgacccattggagtagg

SEQ ID NO: 101222 - DNA, 25 bp, mus musculus
agctttgacccattggagtaggaga

SEQ ID NO: 101223 - DNA, 25 bp, mus musculus
aaagcacatgcctgccctcctggca

SEQ ID NO: 101224 - DNA, 25 bp, mus musculus
cctggcacatcaccacagaacgctt

SEQ ID NO: 101225 - DNA, 25 bp, mus musculus
ggcacatcaccacagaacgcttgtt

SEQ ID NO: 101226 - DNA, 25 bp, mus musculus
acatcaccacagaacgcttgtttcc

SEQ ID NO: 101227 - DNA, 25 bp, mus musculus
atactagtctcttcatcctactgca

SEQ ID NO: 101228 - DNA, 25 bp, mus musculus
tcatcctactgcattgtgacgatcg

SEQ ID NO: 101229 - DNA, 25 bp, mus musculus
actggcaagaacacctgtgagatca

SEQ ID NO: 101230 - DNA, 25 bp, mus musculus
tcatcgtgaagacgctgctgtagta

SEQ ID NO: 101231 - DNA, 25 bp, mus musculus
tgaagacgctgctgtagtatgctgt

SEQ ID NO: 101232 - DNA, 25 bp, mus musculus
tgacatgacgcaaacgacttaccgt

SEQ ID NO: 101233 - DNA, 25 bp, mus musculus
tgtcgtggcacctaatgctgctgct

SEQ ID NO: 101234 - DNA, 25 bp, mus musculus
ggcacctaatgctgctgctatgtga

SEQ ID NO: 101235 - DNA, 25 bp, mus musculus
taatgctgctgctatgtgaaactgc

SEQ ID NO: 101236 - DNA, 25 bp, mus musculus
aaactgctctgctcgtcaacggatt

SEQ ID NO: 101237 - DNA, 25 bp, mus musculus
ctctgctcgtcaacggattactact

SEQ ID NO: 101238 - DNA, 25 bp, mus musculus
tcgtcaacggattactacttgacgg

SEQ ID NO: 101239 - DNA, 25 bp, mus musculus
attgtgacgatcgcctatcgctcta

SEQ ID NO: 101240 - DNA, 25 bp, mus musculus
acgatcgcctatcgctctacatcca

SEQ ID NO: 101241 - DNA, 25 bp, mus musculus
cgctctacatccaacctggaacata

SEQ ID NO: 101242 - DNA, 25 bp, mus musculus
atcatcaagtgcctgacatttcgag

SEQ ID NO: 101243 - DNA, 25 bp, mus musculus
aagtgcctgacatttcgagactact

SEQ ID NO: 101244 - DNA, 25 bp, mus musculus
tttcgagactactctactatggact

SEQ ID NO: 101245 - DNA, 25 bp, mus musculus
gactactctactatggactacatca

SEQ ID NO: 101246 - DNA, 25 bp, mus musculus
tctactatggactacatcactggca

SEQ ID NO: 101247 - DNA, 25 bp, mus musculus
tcttcccgccttcaggaacatcaga

SEQ ID NO: 101248 - DNA, 25 bp, mus musculus
ttcccgccttcaggaacatcagaaa

SEQ ID NO: 101249 - DNA, 25 bp, mus musculus
ttatcactcgtttcttaggagacac

SEQ ID NO: 101250 - DNA, 25 bp, mus musculus
atcactcgtttcttaggagacacaa

SEQ ID NO: 101251 - DNA, 25 bp, mus musculus
tcactcgtttcttaggagacacaaa

SEQ ID NO: 101252 - DNA, 25 bp, mus musculus
cactcgtttcttaggagacacaaag

SEQ ID NO: 101253 - DNA, 25 bp, mus musculus
agagagaaaccctacatgtgtgaaa

SEQ ID NO: 101254 - DNA, 25 bp, mus musculus
agagaaaccctacatgtgtgaaaag

SEQ ID NO: 101255 - DNA, 25 bp, mus musculus
gagaaaccctacatgtgtgaaaagt

SEQ ID NO: 101256 - DNA, 25 bp, mus musculus
gaaaccctacatgtgtgaaaagtgt

SEQ ID NO: 101257 - DNA, 25 bp, mus musculus
aaccctacatgtgtgaaaagtgtag

SEQ ID NO: 101258 - DNA, 25 bp, mus musculus
tcttcctttacatccctgaaaagtg

SEQ ID NO: 101259 - DNA, 25 bp, mus musculus
tcccgccttcaggaacatcagaaaa

SEQ ID NO: 101260 - DNA, 25 bp, mus musculus
cccgccttcaggaacatcagaaaat

SEQ ID NO: 101261 - DNA, 25 bp, mus musculus
ccgccttcaggaacatcagaaaatt

SEQ ID NO: 101262 - DNA, 25 bp, mus musculus
tgtgacaaagcctttctttatcact

SEQ ID NO: 101263 - DNA, 25 bp, mus musculus
gtgacaaagcctttctttatcactc

SEQ ID NO: 101264 - DNA, 25 bp, mus musculus
tgacaaagcctttctttatcactcg

SEQ ID NO: 101265 - DNA, 25 bp, mus musculus
tctttatcactcgtttcttaggaga

SEQ ID NO: 101266 - DNA, 25 bp, mus musculus
tttatcactcgtttcttaggagaca

SEQ ID NO: 101267 - DNA, 25 bp, mus musculus
acatactaggtgacacccttggagt

SEQ ID NO: 101268 - DNA, 25 bp, mus musculus
taggtgacacccttggagtcacttc

SEQ ID NO: 101269 - DNA, 25 bp, mus musculus
gcagcctactccttgcttcagggcc

SEQ ID NO: 101270 - DNA, 25 bp, mus musculus
ttgcttcagggcctgactgcaacgc

SEQ ID NO: 101271 - DNA, 25 bp, mus musculus
ctgactgcaacgccaaagcctatcc

SEQ ID NO: 101272 - DNA, 25 bp, mus musculus
gcaacgccaaagcctatcctatagc

SEQ ID NO: 101273 - DNA, 25 bp, mus musculus
ccaaagcctatcctatagcggcgcg

SEQ ID NO: 101274 - DNA, 25 bp, mus musculus
cctatcctatagcggcgcgccacag

SEQ ID NO: 101275 - DNA, 25 bp, mus musculus
ccatgaacaccgaaatgtatcagac

SEQ ID NO: 101276 - DNA, 25 bp, mus musculus
aaatgtatcagacccccatggaggt

SEQ ID NO: 101277 - DNA, 25 bp, mus musculus
tctatcagctgcacaatttctccat

SEQ ID NO: 101278 - DNA, 25 bp, mus musculus
agctgcacaatttctccatctcctt

SEQ ID NO: 101279 - DNA, 25 bp, mus musculus
acacccttggagtcacttctcttca

SEQ ID NO: 101280 - DNA, 25 bp, mus musculus
ttggagtcacttctcttcaactcca

SEQ ID NO: 101281 - DNA, 25 bp, mus musculus
tcacttctcttcaactccagcttag

SEQ ID NO: 101282 - DNA, 25 bp, mus musculus
ctcttcaactccagcttagaagtgc

SEQ ID NO: 101283 - DNA, 25 bp, mus musculus
aactccagcttagaagtgcctgcct

SEQ ID NO: 101284 - DNA, 25 bp, mus musculus
agcttagaagtgcctgcctggctca

SEQ ID NO: 101285 - DNA, 25 bp, mus musculus
tggctcagggtctgcactgcagcct

SEQ ID NO: 101286 - DNA, 25 bp, mus musculus
tgcactgcagcctactccttgcttc

SEQ ID NO: 101287 - DNA, 25 bp, mus musculus
aaagccctacagaccatgaaacaag

SEQ ID NO: 101288 - DNA, 25 bp, mus musculus
cattaacctggtgaagcaaaagcct

SEQ ID NO: 101289 - DNA, 25 bp, mus musculus
aaatgtgttgacgctttggtgtgag

SEQ ID NO: 101290 - DNA, 25 bp, mus musculus
atgtgttgacgctttggtgtgagcc

SEQ ID NO: 101291 - DNA, 25 bp, mus musculus
tgacgctttggtgtgagccttttgg

SEQ ID NO: 101292 - DNA, 25 bp, mus musculus
gagccttttggcttaactgtaactg

SEQ ID NO: 101293 - DNA, 25 bp, mus musculus
gccttttggcttaactgtaactgct

SEQ ID NO: 101294 - DNA, 25 bp, mus musculus
aactgctagtactttaaccacatgg

SEQ ID NO: 101295 - DNA, 25 bp, mus musculus
ctgctagtactttaaccacatggtg

SEQ ID NO: 101296 - DNA, 25 bp, mus musculus
tagtactttaaccacatggtgaaga

SEQ ID NO: 101297 - DNA, 25 bp, mus musculus
gtactttaaccacatggtgaagatg

SEQ ID NO: 101298 - DNA, 25 bp, mus musculus
tttaaccacatggtgaagatgtcca

SEQ ID NO: 101299 - DNA, 25 bp, mus musculus
agcaaaagcctgaactgacagagga

SEQ ID NO: 101300 - DNA, 25 bp, mus musculus
aaagcctgaactgacagaggagcag

SEQ ID NO: 101301 - DNA, 25 bp, mus musculus
agcctgaactgacagaggagcagct

SEQ ID NO: 101302 - DNA, 25 bp, mus musculus
agtctgtttcacagaagagggtcca

SEQ ID NO: 101303 - DNA, 25 bp, mus musculus
gtgatgctttgggcgtttaaacatc

SEQ ID NO: 101304 - DNA, 25 bp, mus musculus
gcgtttaaacatctccagaaggaag

SEQ ID NO: 101305 - DNA, 25 bp, mus musculus
ttaaacatctccagaaggaagagtg

SEQ ID NO: 101306 - DNA, 25 bp, mus musculus
acatctccagaaggaagagtggaca

SEQ ID NO: 101307 - DNA, 25 bp, mus musculus
tataagggttctcctttcacagaat

SEQ ID NO: 101308 - DNA, 25 bp, mus musculus
tttttatctggatttccaagactgg

SEQ ID NO: 101309 - DNA, 25 bp, mus musculus
atttccaagactggatggcttggta

SEQ ID NO: 101310 - DNA, 25 bp, mus musculus
ttccaagactggatggcttggtagc

SEQ ID NO: 101311 - DNA, 25 bp, mus musculus
tccaagactggatggcttggtagca

SEQ ID NO: 101312 - DNA, 25 bp, mus musculus
aagactggatggcttggtagcaagc

SEQ ID NO: 101313 - DNA, 25 bp, mus musculus
agactggatggcttggtagcaagca

SEQ ID NO: 101314 - DNA, 25 bp, mus musculus
agcaagcatgttgtcttttgggaag

SEQ ID NO: 101315 - DNA, 25 bp, mus musculus
caagcatgttgtcttttgggaagtg

SEQ ID NO: 101316 - DNA, 25 bp, mus musculus
aagcatgttgtcttttgggaagtga

SEQ ID NO: 101317 - DNA, 25 bp, mus musculus
agcatgttgtcttttgggaagtgaa

SEQ ID NO: 101318 - DNA, 25 bp, mus musculus
catgttgtcttttgggaagtgaaag

SEQ ID NO: 101319 - DNA, 25 bp, mus musculus
ttttatctggatttccaagactgga

SEQ ID NO: 101320 - DNA, 25 bp, mus musculus
tttatctggatttccaagactggat

SEQ ID NO: 101321 - DNA, 25 bp, mus musculus
ttatctggatttccaagactggatg

SEQ ID NO: 101322 - DNA, 25 bp, mus musculus
tatctggatttccaagactggatgg

SEQ ID NO: 101323 - DNA, 25 bp, mus musculus
tctggatttccaagactggatggct

SEQ ID NO: 101324 - DNA, 25 bp, mus musculus
tggatttccaagactggatggcttg

SEQ ID NO: 101325 - DNA, 25 bp, mus musculus
ggatttccaagactggatggcttgg

SEQ ID NO: 101326 - DNA, 25 bp, mus musculus
gatttccaagactggatggcttggt

SEQ ID NO: 101327 - DNA, 25 bp, mus musculus
gagatcatgaattccccagagactg

SEQ ID NO: 101328 - DNA, 25 bp, mus musculus
agatcatgaattccccagagactgt

SEQ ID NO: 101329 - DNA, 25 bp, mus musculus
catcggatacactagcgagatgaag

SEQ ID NO: 101330 - DNA, 25 bp, mus musculus
atcggatacactagcgagatgaagc

SEQ ID NO: 101331 - DNA, 25 bp, mus musculus
aaccggacttgcaacctttgatatg

SEQ ID NO: 101332 - DNA, 25 bp, mus musculus
accggacttgcaacctttgatatga

SEQ ID NO: 101333 - DNA, 25 bp, mus musculus
ccggacttgcaacctttgatatgac

SEQ ID NO: 101334 - DNA, 25 bp, mus musculus
ggacttgcaacctttgatatgactc

SEQ ID NO: 101335 - DNA, 25 bp, mus musculus
gacttgcaacctttgatatgactca

SEQ ID NO: 101336 - DNA, 25 bp, mus musculus
acttgcaacctttgatatgactcat

SEQ ID NO: 101337 - DNA, 25 bp, mus musculus
ttgcaacctttgatatgactcattc

SEQ ID NO: 101338 - DNA, 25 bp, mus musculus
tgcaacctttgatatgactcattct

SEQ ID NO: 101339 - DNA, 25 bp, mus musculus
gatcatgaattccccagagactgtc

SEQ ID NO: 101340 - DNA, 25 bp, mus musculus
tcatgaattccccagagactgtctg

SEQ ID NO: 101341 - DNA, 25 bp, mus musculus
catgaattccccagagactgtctgc

SEQ ID NO: 101342 - DNA, 25 bp, mus musculus
gagactgtctgctctcttgcaagaa

SEQ ID NO: 101343 - DNA, 25 bp, mus musculus
gactgtctgctctcttgcaagaaca

SEQ ID NO: 101344 - DNA, 25 bp, mus musculus
actgtctgctctcttgcaagaacag

SEQ ID NO: 101345 - DNA, 25 bp, mus musculus
ctgtctgctctcttgcaagaacagc

SEQ ID NO: 101346 - DNA, 25 bp, mus musculus
gacatcggatacactagcgagatga

SEQ ID NO: 101347 - DNA, 25 bp, mus musculus
attatagttaccagcttcagagcac

SEQ ID NO: 101348 - DNA, 25 bp, mus musculus
atagttaccagcttcagagcactga

SEQ ID NO: 101349 - DNA, 25 bp, mus musculus
tcatccgtatcgacaaataattgac

SEQ ID NO: 101350 - DNA, 25 bp, mus musculus
aattgacctgtgatcacgctgacat

SEQ ID NO: 101351 - DNA, 25 bp, mus musculus
cctgtgatcacgctgacatactcca

SEQ ID NO: 101352 - DNA, 25 bp, mus musculus
atcacgctgacatactccaggcagt

SEQ ID NO: 101353 - DNA, 25 bp, mus musculus
ctgacatactccaggcagtgatccc

SEQ ID NO: 101354 - DNA, 25 bp, mus musculus
acatactccaggcagtgatccctca

SEQ ID NO: 101355 - DNA, 25 bp, mus musculus
cagtgatccctcatgccgatgggaa

SEQ ID NO: 101356 - DNA, 25 bp, mus musculus
tgatccctcatgccgatgggaatgc

SEQ ID NO: 101357 - DNA, 25 bp, mus musculus
ctcatgccgatgggaatgccaacgg

SEQ ID NO: 101358 - DNA, 25 bp, mus musculus
atgccaacggcattatgggcaatgg

SEQ ID NO: 101359 - DNA, 25 bp, mus musculus
agcttcagagcactgaacattcccc

SEQ ID NO: 101360 - DNA, 25 bp, mus musculus
gcactgaacattcccctatttgtgc

SEQ ID NO: 101361 - DNA, 25 bp, mus musculus
ttattaagcgtggcaaggataatct

SEQ ID NO: 101362 - DNA, 25 bp, mus musculus
atcttcatattcgactgaagatcca

SEQ ID NO: 101363 - DNA, 25 bp, mus musculus
atattcgactgaagatccacccttt

SEQ ID NO: 101364 - DNA, 25 bp, mus musculus
gactgaagatccaccctttacatgt

SEQ ID NO: 101365 - DNA, 25 bp, mus musculus
tgaagatccaccctttacatgtcat

SEQ ID NO: 101366 - DNA, 25 bp, mus musculus
tacatgtcatccgtatcgacaaata

SEQ ID NO: 101367 - DNA, 25 bp, mus musculus
agcagatccagaaactggaggctag

SEQ ID NO: 101368 - DNA, 25 bp, mus musculus
atccagaaactggaggctagggtga

SEQ ID NO: 101369 - DNA, 25 bp, mus musculus
cttcgtaagcacgagcgcagagtga

SEQ ID NO: 101370 - DNA, 25 bp, mus musculus
ttcgtaagcacgagcgcagagtgaa

SEQ ID NO: 101371 - DNA, 25 bp, mus musculus
cgtaagcacgagcgcagagtgaagg

SEQ ID NO: 101372 - DNA, 25 bp, mus musculus
gtaagcacgagcgcagagtgaagga

SEQ ID NO: 101373 - DNA, 25 bp, mus musculus
tcacctaccagaccgaggaggaccg

SEQ ID NO: 101374 - DNA, 25 bp, mus musculus
aggaccgcaagaacgtgctgaggct

SEQ ID NO: 101375 - DNA, 25 bp, mus musculus
ggaccgcaagaacgtgctgaggctg

SEQ ID NO: 101376 - DNA, 25 bp, mus musculus
agaacgtgctgaggctgcaggactt

SEQ ID NO: 101377 - DNA, 25 bp, mus musculus
gaacgtgctgaggctgcaggacttg

SEQ ID NO: 101378 - DNA, 25 bp, mus musculus
aacgtgctgaggctgcaggacttgg

SEQ ID NO: 101379 - DNA, 25 bp, mus musculus
aacagaagcgcaacatcgaagccgt

SEQ ID NO: 101380 - DNA, 25 bp, mus musculus
aagcgcaacatcgaagccgtcaagg

SEQ ID NO: 101381 - DNA, 25 bp, mus musculus
agcgcaacatcgaagccgtcaaggg

SEQ ID NO: 101382 - DNA, 25 bp, mus musculus
gcgcaacatcgaagccgtcaagggt

SEQ ID NO: 101383 - DNA, 25 bp, mus musculus
cgcaacatcgaagccgtcaagggtc

SEQ ID NO: 101384 - DNA, 25 bp, mus musculus
caacatcgaagccgtcaagggtctt

SEQ ID NO: 101385 - DNA, 25 bp, mus musculus
acatcgaagccgtcaagggtcttcg

SEQ ID NO: 101386 - DNA, 25 bp, mus musculus
tcttcgtaagcacgagcgcagagtg

SEQ ID NO: 101387 - DNA, 25 bp, mus musculus
atagatcccaccttatacctgagcc

SEQ ID NO: 101388 - DNA, 25 bp, mus musculus
gatcccaccttatacctgagccgca

SEQ ID NO: 101389 - DNA, 25 bp, mus musculus
aaacgcttcgactatcaggaccagc

SEQ ID NO: 101390 - DNA, 25 bp, mus musculus
cgcttcgactatcaggaccagcgtt

SEQ ID NO: 101391 - DNA, 25 bp, mus musculus
ttcgactatcaggaccagcgtttcc

SEQ ID NO: 101392 - DNA, 25 bp, mus musculus
gactatcaggaccagcgtttccaga

SEQ ID NO: 101393 - DNA, 25 bp, mus musculus
tatcaggaccagcgtttccagagcc

SEQ ID NO: 101394 - DNA, 25 bp, mus musculus
caggaccagcgtttccagagcctca

SEQ ID NO: 101395 - DNA, 25 bp, mus musculus
gaccagcgtttccagagcctcatga

SEQ ID NO: 101396 - DNA, 25 bp, mus musculus
cagcgtttccagagcctcatgagga

SEQ ID NO: 101397 - DNA, 25 bp, mus musculus
cgtttccagagcctcatgaggatga

SEQ ID NO: 101398 - DNA, 25 bp, mus musculus
ttccagagcctcatgaggatgatca

SEQ ID NO: 101399 - DNA, 25 bp, mus musculus
accttatacctgagccgcactgtgt

SEQ ID NO: 101400 - DNA, 25 bp, mus musculus
ttatacctgagccgcactgtgtcca

SEQ ID NO: 101401 - DNA, 25 bp, mus musculus
tacctgagccgcactgtgtccaacg

SEQ ID NO: 101402 - DNA, 25 bp, mus musculus
cgcactgtgtccaacgtcatctgtt

SEQ ID NO: 101403 - DNA, 25 bp, mus musculus
actgtgtccaacgtcatctgttccg

SEQ ID NO: 101404 - DNA, 25 bp, mus musculus
tccaacgtcatctgttccgtggtct

SEQ ID NO: 101405 - DNA, 25 bp, mus musculus
gtcatctgttccgtggtcttcggaa

SEQ ID NO: 101406 - DNA, 25 bp, mus musculus
ttcggaaaacgcttcgactatcagg

SEQ ID NO: 101407 - DNA, 25 bp, mus musculus
gccagcgcatcagcacgtacttatc

SEQ ID NO: 101408 - DNA, 25 bp, mus musculus
gcatcagcacgtacttatctgtcct

SEQ ID NO: 101409 - DNA, 25 bp, mus musculus
gagccctgtttgtccacatctgcct

SEQ ID NO: 101410 - DNA, 25 bp, mus musculus
ccctgtttgtccacatctgcctggg

SEQ ID NO: 101411 - DNA, 25 bp, mus musculus
ttgtccacatctgcctgggctggaa

SEQ ID NO: 101412 - DNA, 25 bp, mus musculus
acatctgcctgggctggaacttcta

SEQ ID NO: 101413 - DNA, 25 bp, mus musculus
tctgcctgggctggaacttctacct

SEQ ID NO: 101414 - DNA, 25 bp, mus musculus
ggaacttctacctgtccaccatcct

SEQ ID NO: 101415 - DNA, 25 bp, mus musculus
tcacgctcgccattacggccctgta

SEQ ID NO: 101416 - DNA, 25 bp, mus musculus
tcgccattacggccctgtacaccat

SEQ ID NO: 101417 - DNA, 25 bp, mus musculus
ccattacggccctgtacaccattgc

SEQ ID NO: 101418 - DNA, 25 bp, mus musculus
ttacggccctgtacaccattgcagg

SEQ ID NO: 101419 - DNA, 25 bp, mus musculus
tcagcacgtacttatctgtcctgtc

SEQ ID NO: 101420 - DNA, 25 bp, mus musculus
tatctgtcctgtcccagatgctgtc

SEQ ID NO: 101421 - DNA, 25 bp, mus musculus
ctgtcctgtcccagatgctgtctgt

SEQ ID NO: 101422 - DNA, 25 bp, mus musculus
tgtctgtcttcaccaagatatcgat

SEQ ID NO: 101423 - DNA, 25 bp, mus musculus
tatcgattgacctgtacgcaggagc

SEQ ID NO: 101424 - DNA, 25 bp, mus musculus
ttgacctgtacgcaggagccctgtt

SEQ ID NO: 101425 - DNA, 25 bp, mus musculus
acctgtacgcaggagccctgtttgt

SEQ ID NO: 101426 - DNA, 25 bp, mus musculus
tgtacgcaggagccctgtttgtcca

SEQ ID NO: 101427 - DNA, 25 bp, mus musculus
agcagctgtcgcgagagctcagcac

SEQ ID NO: 101428 - DNA, 25 bp, mus musculus
cacctgcacctgcaccgaggggaca

SEQ ID NO: 101429 - DNA, 25 bp, mus musculus
ctacgcaacacacgtgtaactgtct

SEQ ID NO: 101430 - DNA, 25 bp, mus musculus
gcaacacacgtgtaactgtctagcc

SEQ ID NO: 101431 - DNA, 25 bp, mus musculus
tagccgggccctgagtaatcacctt

SEQ ID NO: 101432 - DNA, 25 bp, mus musculus
ggccctgagtaatcaccttaaagat

SEQ ID NO: 101433 - DNA, 25 bp, mus musculus
ccctgagtaatcaccttaaagatgt

SEQ ID NO: 101434 - DNA, 25 bp, mus musculus
gagtaatcaccttaaagatgttcct

SEQ ID NO: 101435 - DNA, 25 bp, mus musculus
gtaatcaccttaaagatgttcctgc

SEQ ID NO: 101436 - DNA, 25 bp, mus musculus
tcaccttaaagatgttcctgcgggg

SEQ ID NO: 101437 - DNA, 25 bp, mus musculus
taaagatgttcctgcggggttgttg

SEQ ID NO: 101438 - DNA, 25 bp, mus musculus
aagatgttcctgcggggttgttgat

SEQ ID NO: 101439 - DNA, 25 bp, mus musculus
tgcacctgcaccgaggggacaccgc

SEQ ID NO: 101440 - DNA, 25 bp, mus musculus
cctgcacagcgcaccgggtttcggg

SEQ ID NO: 101441 - DNA, 25 bp, mus musculus
tgatgcaatccggatcaaacgtggc

SEQ ID NO: 101442 - DNA, 25 bp, mus musculus
atgcaatccggatcaaacgtggctg

SEQ ID NO: 101443 - DNA, 25 bp, mus musculus
gcaatccggatcaaacgtggctgag

SEQ ID NO: 101444 - DNA, 25 bp, mus musculus
ctgagcgcgtgtggacacgggacta

SEQ ID NO: 101445 - DNA, 25 bp, mus musculus
gggactacgcaacacacgtgtaact

SEQ ID NO: 101446 - DNA, 25 bp, mus musculus
gactacgcaacacacgtgtaactgt

SEQ ID NO: 101447 - DNA, 25 bp, mus musculus
tgacatggagtccaacgggaaatgt

SEQ ID NO: 101448 - DNA, 25 bp, mus musculus
tgtatttccaaatctcgggggcctg

SEQ ID NO: 101449 - DNA, 25 bp, mus musculus
ggcccaacagacaggccaatgtgtg

SEQ ID NO: 101450 - DNA, 25 bp, mus musculus
gcccaacagacaggccaatgtgtgt

SEQ ID NO: 101451 - DNA, 25 bp, mus musculus
cccaacagacaggccaatgtgtgtt

SEQ ID NO: 101452 - DNA, 25 bp, mus musculus
aacagacaggccaatgtgtgttggg

SEQ ID NO: 101453 - DNA, 25 bp, mus musculus
acagacaggccaatgtgtgttgggg

SEQ ID NO: 101454 - DNA, 25 bp, mus musculus
gacaggccaatgtgtgttggggaca

SEQ ID NO: 101455 - DNA, 25 bp, mus musculus
acaggccaatgtgtgttggggacac

SEQ ID NO: 101456 - DNA, 25 bp, mus musculus
caggccaatgtgtgttggggacacc

SEQ ID NO: 101457 - DNA, 25 bp, mus musculus
aggccaatgtgtgttggggacacca

SEQ ID NO: 101458 - DNA, 25 bp, mus musculus
tatttccaaatctcgggggcctgtg

SEQ ID NO: 101459 - DNA, 25 bp, mus musculus
cctgtgtggcccaacagacaggcca

SEQ ID NO: 101460 - DNA, 25 bp, mus musculus
ctgtgtggcccaacagacaggccaa

SEQ ID NO: 101461 - DNA, 25 bp, mus musculus
tgtgtggcccaacagacaggccaat

SEQ ID NO: 101462 - DNA, 25 bp, mus musculus
gtgtggcccaacagacaggccaatg

SEQ ID NO: 101463 - DNA, 25 bp, mus musculus
tgtggcccaacagacaggccaatgt

SEQ ID NO: 101464 - DNA, 25 bp, mus musculus
gtggcccaacagacaggccaatgtg

SEQ ID NO: 101465 - DNA, 25 bp, mus musculus
tggcccaacagacaggccaatgtgt

SEQ ID NO: 101466 - DNA, 25 bp, mus musculus
ggccaagcaactggcacaaatcgag

SEQ ID NO: 101467 - DNA, 25 bp, mus musculus
gcaactggcacaaatcgagacagac

SEQ ID NO: 101468 - DNA, 25 bp, mus musculus
tgaatatctcataaccctcctggtc

SEQ ID NO: 101469 - DNA, 25 bp, mus musculus
atatctcataaccctcctggtcatc

SEQ ID NO: 101470 - DNA, 25 bp, mus musculus
cctggtcatcgtccccaagtcaagc

SEQ ID NO: 101471 - DNA, 25 bp, mus musculus
ccccaagtcaagctttgcacagtgg

SEQ ID NO: 101472 - DNA, 25 bp, mus musculus
aagctttgcacagtggcagaagaca

SEQ ID NO: 101473 - DNA, 25 bp, mus musculus
ctttgcacagtggcagaagacatat

SEQ ID NO: 101474 - DNA, 25 bp, mus musculus
gacatatgagtccctatcggacatg

SEQ ID NO: 101475 - DNA, 25 bp, mus musculus
atatgagtccctatcggacatggtg

SEQ ID NO: 101476 - DNA, 25 bp, mus musculus
cctatcggacatggtggtccctcgg

SEQ ID NO: 101477 - DNA, 25 bp, mus musculus
atcggacatggtggtccctcggtca

SEQ ID NO: 101478 - DNA, 25 bp, mus musculus
gacagacctgaagtcccggacagcc

SEQ ID NO: 101479 - DNA, 25 bp, mus musculus
gtcaaccaaattgatcgccgaggac

SEQ ID NO: 101480 - DNA, 25 bp, mus musculus
gacagccgcctacagcgttctgaag

SEQ ID NO: 101481 - DNA, 25 bp, mus musculus
agccgcctacagcgttctgaaggcc

SEQ ID NO: 101482 - DNA, 25 bp, mus musculus
ggccaacctggagaacttggagaag

SEQ ID NO: 101483 - DNA, 25 bp, mus musculus
gagatccacggggaacctcttcact

SEQ ID NO: 101484 - DNA, 25 bp, mus musculus
gaacctcttcactcggacactgagc

SEQ ID NO: 101485 - DNA, 25 bp, mus musculus
cctcttcactcggacactgagcgat

SEQ ID NO: 101486 - DNA, 25 bp, mus musculus
agacttcgtacttgattctgaatat

SEQ ID NO: 101487 - DNA, 25 bp, mus musculus
cctggtgcaaagcctgggttgaaca

SEQ ID NO: 101488 - DNA, 25 bp, mus musculus
ttgaacacgacggcgtcacgtcaag

SEQ ID NO: 101489 - DNA, 25 bp, mus musculus
ggaaccaatgaccacgccactcata

SEQ ID NO: 101490 - DNA, 25 bp, mus musculus
aaccaatgaccacgccactcataca

SEQ ID NO: 101491 - DNA, 25 bp, mus musculus
actcatacacgtgctcaccaagacg

SEQ ID NO: 101492 - DNA, 25 bp, mus musculus
ctgagactctcaaagtcagtgctga

SEQ ID NO: 101493 - DNA, 25 bp, mus musculus
gactctcaaagtcagtgctgagcgg

SEQ ID NO: 101494 - DNA, 25 bp, mus musculus
ctctcaaagtcagtgctgagcggca

SEQ ID NO: 101495 - DNA, 25 bp, mus musculus
acttgagacactcaccgtggtcctc

SEQ ID NO: 101496 - DNA, 25 bp, mus musculus
gagacactcaccgtggtcctcatgt

SEQ ID NO: 101497 - DNA, 25 bp, mus musculus
cactcaccgtggtcctcatgtactc

SEQ ID NO: 101498 - DNA, 25 bp, mus musculus
tcctcatgtactcgccatacagtca

SEQ ID NO: 101499 - DNA, 25 bp, mus musculus
gaacacgacggcgtcacgtcaaggg

SEQ ID NO: 101500 - DNA, 25 bp, mus musculus
cacgtcaagggtacttctcacttca

SEQ ID NO: 101501 - DNA, 25 bp, mus musculus
ctgacgcagacaccctctacaaagc

SEQ ID NO: 101502 - DNA, 25 bp, mus musculus
gacaccctctacaaagccatgaacg

SEQ ID NO: 101503 - DNA, 25 bp, mus musculus
caccctctacaaagccatgaacggg

SEQ ID NO: 101504 - DNA, 25 bp, mus musculus
ccctctacaaagccatgaacgggat

SEQ ID NO: 101505 - DNA, 25 bp, mus musculus
ctacaaagccatgaacgggattgga

SEQ ID NO: 101506 - DNA, 25 bp, mus musculus
ttggaaccaatgaccacgccactca

SEQ ID NO: 101507 - DNA, 25 bp, mus musculus
aggtctgcggcacaggaacagaaca

SEQ ID NO: 101508 - DNA, 25 bp, mus musculus
cagaacatcatcaattacaagagca

SEQ ID NO: 101509 - DNA, 25 bp, mus musculus
ctgctgcaggagagcctagtctttg

SEQ ID NO: 101510 - DNA, 25 bp, mus musculus
agcctagtctttgacaacaagcaca

SEQ ID NO: 101511 - DNA, 25 bp, mus musculus
ctagtctttgacaacaagcacacag

SEQ ID NO: 101512 - DNA, 25 bp, mus musculus
gtctttgacaacaagcacacagtct

SEQ ID NO: 101513 - DNA, 25 bp, mus musculus
tttgacaacaagcacacagtctaca

SEQ ID NO: 101514 - DNA, 25 bp, mus musculus
gacaacaagcacacagtctacagca

SEQ ID NO: 101515 - DNA, 25 bp, mus musculus
aagcacacagtctacagcatggagc

SEQ ID NO: 101516 - DNA, 25 bp, mus musculus
cacacagtctacagcatggagcaca

SEQ ID NO: 101517 - DNA, 25 bp, mus musculus
acagtctacagcatggagcacattc

SEQ ID NO: 101518 - DNA, 25 bp, mus musculus
gtctacagcatggagcacattcgtg

SEQ ID NO: 101519 - DNA, 25 bp, mus musculus
atcaattacaagagcaacatcgacc

SEQ ID NO: 101520 - DNA, 25 bp, mus musculus
aattacaagagcaacatcgaccggc

SEQ ID NO: 101521 - DNA, 25 bp, mus musculus
tacaagagcaacatcgaccggctgg

SEQ ID NO: 101522 - DNA, 25 bp, mus musculus
aagagcaacatcgaccggctggagg

SEQ ID NO: 101523 - DNA, 25 bp, mus musculus
ggtgaccaccagctgctgcaggaga

SEQ ID NO: 101524 - DNA, 25 bp, mus musculus
gaccaccagctgctgcaggagagcc

SEQ ID NO: 101525 - DNA, 25 bp, mus musculus
caccagctgctgcaggagagcctag

SEQ ID NO: 101526 - DNA, 25 bp, mus musculus
cagctgctgcaggagagcctagtct

SEQ ID NO: 101527 - DNA, 25 bp, mus musculus
tctattcaaaccagaccctgatctg

SEQ ID NO: 101528 - DNA, 25 bp, mus musculus
attcaaaccagaccctgatctggtg

SEQ ID NO: 101529 - DNA, 25 bp, mus musculus
ctcaatgcctgaccgataagttctg

SEQ ID NO: 101530 - DNA, 25 bp, mus musculus
gcctgaccgataagttctggatagt

SEQ ID NO: 101531 - DNA, 25 bp, mus musculus
tttagcaacttgtccaaaaccatag

SEQ ID NO: 101532 - DNA, 25 bp, mus musculus
agcaacttgtccaaaaccatagaca

SEQ ID NO: 101533 - DNA, 25 bp, mus musculus
attatatgcagttctctaaagcaag

SEQ ID NO: 101534 - DNA, 25 bp, mus musculus
tgcagttctctaaagcaagacctgg

SEQ ID NO: 101535 - DNA, 25 bp, mus musculus
agttctctaaagcaagacctggagg

SEQ ID NO: 101536 - DNA, 25 bp, mus musculus
aatctaagctaatcactggtatcca

SEQ ID NO: 101537 - DNA, 25 bp, mus musculus
taatcactggtatccatcatttgaa

SEQ ID NO: 101538 - DNA, 25 bp, mus musculus
ctggtatccatcatttgaagactaa

SEQ ID NO: 101539 - DNA, 25 bp, mus musculus
caaaccagaccctgatctggtgatc

SEQ ID NO: 101540 - DNA, 25 bp, mus musculus
agactaagctctcggacctgctgaa

SEQ ID NO: 101541 - DNA, 25 bp, mus musculus
agaccctgatctggtgatccactac

SEQ ID NO: 101542 - DNA, 25 bp, mus musculus
ccctgatctggtgatccactacttt

SEQ ID NO: 101543 - DNA, 25 bp, mus musculus
tgatctggtgatccactactttcta

SEQ ID NO: 101544 - DNA, 25 bp, mus musculus
ggtgatccactactttctatcaggt

SEQ ID NO: 101545 - DNA, 25 bp, mus musculus
gatccactactttctatcaggtttt

SEQ ID NO: 101546 - DNA, 25 bp, mus musculus
gttgtcctcaatgcctgaccgataa

SEQ ID NO: 101547 - DNA, 25 bp, mus musculus
gtcctcaatgcctgaccgataagtt

SEQ ID NO: 101548 - DNA, 25 bp, mus musculus
ccaaagaacccacaagaatgcttat

SEQ ID NO: 101549 - DNA, 25 bp, mus musculus
agaacccacaagaatgcttattact

SEQ ID NO: 101550 - DNA, 25 bp, mus musculus
gacaacacagactacaactctaggc

SEQ ID NO: 101551 - DNA, 25 bp, mus musculus
acacagactacaactctaggctctg

SEQ ID NO: 101552 - DNA, 25 bp, mus musculus
acagactacaactctaggctctggg

SEQ ID NO: 101553 - DNA, 25 bp, mus musculus
agactacaactctaggctctgggca

SEQ ID NO: 101554 - DNA, 25 bp, mus musculus
actacaactctaggctctgggcatg

SEQ ID NO: 101555 - DNA, 25 bp, mus musculus
caactctaggctctgggcatgggag

SEQ ID NO: 101556 - DNA, 25 bp, mus musculus
tggcaagcagctgaggccgttgtat

SEQ ID NO: 101557 - DNA, 25 bp, mus musculus
gcaagcagctgaggccgttgtatga

SEQ ID NO: 101558 - DNA, 25 bp, mus musculus
aagcagctgaggccgttgtatgaag

SEQ ID NO: 101559 - DNA, 25 bp, mus musculus
agctgaggccgttgtatgaagagta

SEQ ID NO: 101560 - DNA, 25 bp, mus musculus
aacccacaagaatgcttattacttg

SEQ ID NO: 101561 - DNA, 25 bp, mus musculus
aaccgtaaccagttgattgaagatg

SEQ ID NO: 101562 - DNA, 25 bp, mus musculus
aatgcttattacttgagccaggatt

SEQ ID NO: 101563 - DNA, 25 bp, mus musculus
cttattacttgagccaggattggat

SEQ ID NO: 101564 - DNA, 25 bp, mus musculus
ttacttgagccaggattggatgaaa

SEQ ID NO: 101565 - DNA, 25 bp, mus musculus
acttgagccaggattggatgaaata

SEQ ID NO: 101566 - DNA, 25 bp, mus musculus
aatggcgacaacacagactacaact

SEQ ID NO: 101567 - DNA, 25 bp, mus musculus
tggcgacaacacagactacaactct

SEQ ID NO: 101568 - DNA, 25 bp, mus musculus
gcgacaacacagactacaactctag

SEQ ID NO: 101569 - DNA, 25 bp, mus musculus
tgaccactgtgtctataactccact

SEQ ID NO: 101570 - DNA, 25 bp, mus musculus
ctgtgtctataactccactcatcta

SEQ ID NO: 101571 - DNA, 25 bp, mus musculus
agatatcaccccggagctgcgggaa

SEQ ID NO: 101572 - DNA, 25 bp, mus musculus
agtattccagaaggctgtcacacac

SEQ ID NO: 101573 - DNA, 25 bp, mus musculus
gaagcagcagcttgagctggagaag

SEQ ID NO: 101574 - DNA, 25 bp, mus musculus
agatcctgaggaaggccaggcatga

SEQ ID NO: 101575 - DNA, 25 bp, mus musculus
ggcatgaactcagctctctgaactc

SEQ ID NO: 101576 - DNA, 25 bp, mus musculus
aactcagctctctgaactccgaggg

SEQ ID NO: 101577 - DNA, 25 bp, mus musculus
tgtctctgccacaataaaggtttgc

SEQ ID NO: 101578 - DNA, 25 bp, mus musculus
ctgacacagtcaatatcacttcttt

SEQ ID NO: 101579 - DNA, 25 bp, mus musculus
cagtcaatatcacttctttgcttct

SEQ ID NO: 101580 - DNA, 25 bp, mus musculus
agtcctgagtggagccttagctaag

SEQ ID NO: 101581 - DNA, 25 bp, mus musculus
ctataactccactcatctaggaatc

SEQ ID NO: 101582 - DNA, 25 bp, mus musculus
tcatctaggaatccagagagagaat

SEQ ID NO: 101583 - DNA, 25 bp, mus musculus
cctctccaagtatgtaggaggagta

SEQ ID NO: 101584 - DNA, 25 bp, mus musculus
agacctgatagtcttgaagatgcat

SEQ ID NO: 101585 - DNA, 25 bp, mus musculus
cttcatgcttgcctttgacttgaag

SEQ ID NO: 101586 - DNA, 25 bp, mus musculus
gcttgcctttgacttgaaggatgag

SEQ ID NO: 101587 - DNA, 25 bp, mus musculus
actgtccctcaatgcaaaaaggcca

SEQ ID NO: 101588 - DNA, 25 bp, mus musculus
aaggccagatatcaccccggagctg

SEQ ID NO: 101589 - DNA, 25 bp, mus musculus
tcccgggctggatctccgtgctggg

SEQ ID NO: 101590 - DNA, 25 bp, mus musculus
cgggcccactgtggagtggcagcca

SEQ ID NO: 101591 - DNA, 25 bp, mus musculus
catggactatggcccgatagagcag

SEQ ID NO: 101592 - DNA, 25 bp, mus musculus
atggactatggcccgatagagcaga

SEQ ID NO: 101593 - DNA, 25 bp, mus musculus
gactatggcccgatagagcagaaga

SEQ ID NO: 101594 - DNA, 25 bp, mus musculus
ctatggcccgatagagcagaagatt

SEQ ID NO: 101595 - DNA, 25 bp, mus musculus
gattgtaaccagtcctggcacttta

SEQ ID NO: 101596 - DNA, 25 bp, mus musculus
tgtaaccagtcctggcactttaact

SEQ ID NO: 101597 - DNA, 25 bp, mus musculus
cagtcctggcactttaacttagatg

SEQ ID NO: 101598 - DNA, 25 bp, mus musculus
agtcctggcactttaacttagatga

SEQ ID NO: 101599 - DNA, 25 bp, mus musculus
tcctggcactttaacttagatgaga

SEQ ID NO: 101600 - DNA, 25 bp, mus musculus
cctggcactttaacttagatgagat

SEQ ID NO: 101601 - DNA, 25 bp, mus musculus
aggttaacagctgccaagactctct

SEQ ID NO: 101602 - DNA, 25 bp, mus musculus
ttaacagctgccaagactctctgga

SEQ ID NO: 101603 - DNA, 25 bp, mus musculus
caagactctctggattactggacaa

SEQ ID NO: 101604 - DNA, 25 bp, mus musculus
aagactctctggattactggacaat

SEQ ID NO: 101605 - DNA, 25 bp, mus musculus
gactctctggattactggacaatac

SEQ ID NO: 101606 - DNA, 25 bp, mus musculus
actctctggattactggacaataca

SEQ ID NO: 101607 - DNA, 25 bp, mus musculus
atacatggactatggcccgatagag

SEQ ID NO: 101608 - DNA, 25 bp, mus musculus
tacatggactatggcccgatagagc

SEQ ID NO: 101609 - DNA, 25 bp, mus musculus
tagtgagcttcctgtgcttcttcac

SEQ ID NO: 101610 - DNA, 25 bp, mus musculus
tgagcttcctgtgcttcttcaccgt

SEQ ID NO: 101611 - DNA, 25 bp, mus musculus
cctccatgaactcgctggatttctc

SEQ ID NO: 101612 - DNA, 25 bp, mus musculus
actcgctggatttctcctctgtttc

SEQ ID NO: 101613 - DNA, 25 bp, mus musculus
cgctggatttctcctctgtttctat

SEQ ID NO: 101614 - DNA, 25 bp, mus musculus
cctctgtttctatcgtggcactgaa

SEQ ID NO: 101615 - DNA, 25 bp, mus musculus
ctgtttctatcgtggcactgaacaa

SEQ ID NO: 101616 - DNA, 25 bp, mus musculus
ctatcgtggcactgaacaagaaatc

SEQ ID NO: 101617 - DNA, 25 bp, mus musculus
gtttcttcggcagcgcctgcacctg

SEQ ID NO: 101618 - DNA, 25 bp, mus musculus
gcagcgcctgcacctgtcgagtact

SEQ ID NO: 101619 - DNA, 25 bp, mus musculus
gcgcctgcacctgtcgagtactcaa

SEQ ID NO: 101620 - DNA, 25 bp, mus musculus
tcaaccccaactgctgacgcagctt

SEQ ID NO: 101621 - DNA, 25 bp, mus musculus
gcttcctgtgcttcttcaccgtcca

SEQ ID NO: 101622 - DNA, 25 bp, mus musculus
acagccacctggcactcgaggagac

SEQ ID NO: 101623 - DNA, 25 bp, mus musculus
acctggcactcgaggagacgcttgg

SEQ ID NO: 101624 - DNA, 25 bp, mus musculus
tggcactcgaggagacgcttggaga

SEQ ID NO: 101625 - DNA, 25 bp, mus musculus
cactcgaggagacgcttggagatga

SEQ ID NO: 101626 - DNA, 25 bp, mus musculus
atgacaggagtctgcggagtaactc

SEQ ID NO: 101627 - DNA, 25 bp, mus musculus
ggagtaactcctccatgaactcgct

SEQ ID NO: 101628 - DNA, 25 bp, mus musculus
actcctccatgaactcgctggattt

SEQ ID NO: 101629 - DNA, 25 bp, mus musculus
ttgactggcgtgtttgatctcgttc

SEQ ID NO: 101630 - DNA, 25 bp, mus musculus
tgtttgatctcgttcaatcaactgg

SEQ ID NO: 101631 - DNA, 25 bp, mus musculus
atgcttgctcttcaataatttcctt

SEQ ID NO: 101632 - DNA, 25 bp, mus musculus
tgcttgctcttcaataatttcctta

SEQ ID NO: 101633 - DNA, 25 bp, mus musculus
cttgctcttcaataatttccttaag

SEQ ID NO: 101634 - DNA, 25 bp, mus musculus
ttgctcttcaataatttccttaaga

SEQ ID NO: 101635 - DNA, 25 bp, mus musculus
attaagtaatgccttgcttgaagtt

SEQ ID NO: 101636 - DNA, 25 bp, mus musculus
taagtaatgccttgcttgaagttga

SEQ ID NO: 101637 - DNA, 25 bp, mus musculus
aagtaatgccttgcttgaagttgag

SEQ ID NO: 101638 - DNA, 25 bp, mus musculus
taatgccttgcttgaagttgagtaa

SEQ ID NO: 101639 - DNA, 25 bp, mus musculus
atgccttgcttgaagttgagtaaaa

SEQ ID NO: 101640 - DNA, 25 bp, mus musculus
tgccttgcttgaagttgagtaaaaa

SEQ ID NO: 101641 - DNA, 25 bp, mus musculus
tttgatctcgttcaatcaactggtc

SEQ ID NO: 101642 - DNA, 25 bp, mus musculus
ttcaatcaactggtcctaataagct

SEQ ID NO: 101643 - DNA, 25 bp, mus musculus
caatcaactggtcctaataagctga

SEQ ID NO: 101644 - DNA, 25 bp, mus musculus
aatcaactggtcctaataagctgaa

SEQ ID NO: 101645 - DNA, 25 bp, mus musculus
tcaactggtcctaataagctgaagg

SEQ ID NO: 101646 - DNA, 25 bp, mus musculus
caactggtcctaataagctgaaggg

SEQ ID NO: 101647 - DNA, 25 bp, mus musculus
ggaatgcttgctcttcaataatttc

SEQ ID NO: 101648 - DNA, 25 bp, mus musculus
gaatgcttgctcttcaataatttcc

SEQ ID NO: 101649 - DNA, 25 bp, mus musculus
aatacaccggagacagctagtacca

SEQ ID NO: 101650 - DNA, 25 bp, mus musculus
aagcatcttgtatgcccaagaggat

SEQ ID NO: 101651 - DNA, 25 bp, mus musculus
cccaagaggatcctcaacctgtgac

SEQ ID NO: 101652 - DNA, 25 bp, mus musculus
ccaagaggatcctcaacctgtgacc

SEQ ID NO: 101653 - DNA, 25 bp, mus musculus
aagaggatcctcaacctgtgaccat

SEQ ID NO: 101654 - DNA, 25 bp, mus musculus
agaggatcctcaacctgtgaccatg

SEQ ID NO: 101655 - DNA, 25 bp, mus musculus
aggatcctcaacctgtgaccatgat

SEQ ID NO: 101656 - DNA, 25 bp, mus musculus
ggatcctcaacctgtgaccatgatg

SEQ ID NO: 101657 - DNA, 25 bp, mus musculus
atcctcaacctgtgaccatgatgct

SEQ ID NO: 101658 - DNA, 25 bp, mus musculus
tcctcaacctgtgaccatgatgctc

SEQ ID NO: 101659 - DNA, 25 bp, mus musculus
aacctgtgaccatgatgctcctcct

SEQ ID NO: 101660 - DNA, 25 bp, mus musculus
acctgtgaccatgatgctcctccta

SEQ ID NO: 101661 - DNA, 25 bp, mus musculus
gcatcttgtatgcccaagaggatcc

SEQ ID NO: 101662 - DNA, 25 bp, mus musculus
catcttgtatgcccaagaggatcct

SEQ ID NO: 101663 - DNA, 25 bp, mus musculus
tcttgtatgcccaagaggatcctca

SEQ ID NO: 101664 - DNA, 25 bp, mus musculus
cttgtatgcccaagaggatcctcaa

SEQ ID NO: 101665 - DNA, 25 bp, mus musculus
tgtatgcccaagaggatcctcaacc

SEQ ID NO: 101666 - DNA, 25 bp, mus musculus
gtatgcccaagaggatcctcaacct

SEQ ID NO: 101667 - DNA, 25 bp, mus musculus
atgcccaagaggatcctcaacctgt

SEQ ID NO: 101668 - DNA, 25 bp, mus musculus
tgcccaagaggatcctcaacctgtg

SEQ ID NO: 101669 - DNA, 25 bp, mus musculus
agaacagcagtactttgttgagtgg

SEQ ID NO: 101670 - DNA, 25 bp, mus musculus
aacagcagtactttgttgagtggat

SEQ ID NO: 101671 - DNA, 25 bp, mus musculus
tgttcaaacggatcttagaggagtt

SEQ ID NO: 101672 - DNA, 25 bp, mus musculus
caacatttacgaacttgtgtcccag

SEQ ID NO: 101673 - DNA, 25 bp, mus musculus
acatttacgaacttgtgtcccagtg

SEQ ID NO: 101674 - DNA, 25 bp, mus musculus
catttacgaacttgtgtcccagtgt

SEQ ID NO: 101675 - DNA, 25 bp, mus musculus
ttacgaacttgtgtcccagtgtcca

SEQ ID NO: 101676 - DNA, 25 bp, mus musculus
tacgaacttgtgtcccagtgtccag

SEQ ID NO: 101677 - DNA, 25 bp, mus musculus
tgtgtcccagtgtccaggcagtaca

SEQ ID NO: 101678 - DNA, 25 bp, mus musculus
gtgtcccagtgtccaggcagtacaa

SEQ ID NO: 101679 - DNA, 25 bp, mus musculus
tgtcccagtgtccaggcagtacaag

SEQ ID NO: 101680 - DNA, 25 bp, mus musculus
gtcccagtgtccaggcagtacaagg

SEQ ID NO: 101681 - DNA, 25 bp, mus musculus
cagcagtactttgttgagtggatcc

SEQ ID NO: 101682 - DNA, 25 bp, mus musculus
tcccagtgtccaggcagtacaagga

SEQ ID NO: 101683 - DNA, 25 bp, mus musculus
ccaggaaccggtattcaggagcctg

SEQ ID NO: 101684 - DNA, 25 bp, mus musculus
gtattcaggagcctgttcaaacgga

SEQ ID NO: 101685 - DNA, 25 bp, mus musculus
attcaggagcctgttcaaacggatc

SEQ ID NO: 101686 - DNA, 25 bp, mus musculus
ttcaggagcctgttcaaacggatct

SEQ ID NO: 101687 - DNA, 25 bp, mus musculus
tcaggagcctgttcaaacggatctt

SEQ ID NO: 101688 - DNA, 25 bp, mus musculus
agcctgttcaaacggatcttagagg

SEQ ID NO: 101689 - DNA, 25 bp, mus musculus
gcctgttcaaacggatcttagagga

SEQ ID NO: 101690 - DNA, 25 bp, mus musculus
tgaaattcattcactgtaatgatat

SEQ ID NO: 101691 - DNA, 25 bp, mus musculus
atatatgtcagtcttgctgccacaa

SEQ ID NO: 101692 - DNA, 25 bp, mus musculus
ttgctcatactgcatgggtcaatag

SEQ ID NO: 101693 - DNA, 25 bp, mus musculus
ctcatactgcatgggtcaatagatg

SEQ ID NO: 101694 - DNA, 25 bp, mus musculus
gacattccagctgaccagtcaacat

SEQ ID NO: 101695 - DNA, 25 bp, mus musculus
attccagctgaccagtcaacatcac

SEQ ID NO: 101696 - DNA, 25 bp, mus musculus
gctgaccagtcaacatcacaccagc

SEQ ID NO: 101697 - DNA, 25 bp, mus musculus
gaccagtcaacatcacaccagctgc

SEQ ID NO: 101698 - DNA, 25 bp, mus musculus
tcaacatcacaccagctgcgccaat

SEQ ID NO: 101699 - DNA, 25 bp, mus musculus
tcacaccagctgcgccaataaggag

SEQ ID NO: 101700 - DNA, 25 bp, mus musculus
caccagctgcgccaataaggagaga

SEQ ID NO: 101701 - DNA, 25 bp, mus musculus
cagctgcgccaataaggagagagat

SEQ ID NO: 101702 - DNA, 25 bp, mus musculus
tatgtcagtcttgctgccacaatct

SEQ ID NO: 101703 - DNA, 25 bp, mus musculus
gtcagtcttgctgccacaatctcat

SEQ ID NO: 101704 - DNA, 25 bp, mus musculus
agtcttgctgccacaatctcattgc

SEQ ID NO: 101705 - DNA, 25 bp, mus musculus
cttgctgccacaatctcattgctca

SEQ ID NO: 101706 - DNA, 25 bp, mus musculus
gccacaatctcattgctcatactgc

SEQ ID NO: 101707 - DNA, 25 bp, mus musculus
acaatctcattgctcatactgcatg

SEQ ID NO: 101708 - DNA, 25 bp, mus musculus
atctcattgctcatactgcatgggt

SEQ ID NO: 101709 - DNA, 25 bp, mus musculus
tcattgctcatactgcatgggtcaa

SEQ ID NO: 101710 - DNA, 25 bp, mus musculus
ttccgtggcacactgcgacctgtcc

SEQ ID NO: 101711 - DNA, 25 bp, mus musculus
tccgtggcacactgcgacctgtcca

SEQ ID NO: 101712 - DNA, 25 bp, mus musculus
tgcgacctgtccagaaggcccttcg

SEQ ID NO: 101713 - DNA, 25 bp, mus musculus
gcgacctgtccagaaggcccttcga

SEQ ID NO: 101714 - DNA, 25 bp, mus musculus
cgacctgtccagaaggcccttcgag

SEQ ID NO: 101715 - DNA, 25 bp, mus musculus
gacctgtccagaaggcccttcgaga

SEQ ID NO: 101716 - DNA, 25 bp, mus musculus
gtggttctacagaatcccaagattc

SEQ ID NO: 101717 - DNA, 25 bp, mus musculus
tggttctacagaatcccaagattca

SEQ ID NO: 101718 - DNA, 25 bp, mus musculus
gttctacagaatcccaagattcaga

SEQ ID NO: 101719 - DNA, 25 bp, mus musculus
tctacagaatcccaagattcagaac

SEQ ID NO: 101720 - DNA, 25 bp, mus musculus
cagaatcccaagattcagaacttct

SEQ ID NO: 101721 - DNA, 25 bp, mus musculus
gaatcccaagattcagaacttctgc

SEQ ID NO: 101722 - DNA, 25 bp, mus musculus
cgtggcacactgcgacctgtccaga

SEQ ID NO: 101723 - DNA, 25 bp, mus musculus
aatcccaagattcagaacttctgca

SEQ ID NO: 101724 - DNA, 25 bp, mus musculus
gtggcacactgcgacctgtccagaa

SEQ ID NO: 101725 - DNA, 25 bp, mus musculus
tggcacactgcgacctgtccagaag

SEQ ID NO: 101726 - DNA, 25 bp, mus musculus
ggcacactgcgacctgtccagaagg

SEQ ID NO: 101727 - DNA, 25 bp, mus musculus
cacactgcgacctgtccagaaggcc

SEQ ID NO: 101728 - DNA, 25 bp, mus musculus
acactgcgacctgtccagaaggccc

SEQ ID NO: 101729 - DNA, 25 bp, mus musculus
cactgcgacctgtccagaaggccct

SEQ ID NO: 101730 - DNA, 25 bp, mus musculus
actgcgacctgtccagaaggccctt

SEQ ID NO: 101731 - DNA, 25 bp, mus musculus
tgaccccaggcttcgttgttcgtga

SEQ ID NO: 101732 - DNA, 25 bp, mus musculus
cccaggcttcgttgttcgtgaatga

SEQ ID NO: 101733 - DNA, 25 bp, mus musculus
ttcaaactcacactgtgtttatgtt

SEQ ID NO: 101734 - DNA, 25 bp, mus musculus
aactcacactgtgtttatgttctgc

SEQ ID NO: 101735 - DNA, 25 bp, mus musculus
ctgtgtttatgttctgcctttcaaa

SEQ ID NO: 101736 - DNA, 25 bp, mus musculus
gtttatgttctgcctttcaaatggc

SEQ ID NO: 101737 - DNA, 25 bp, mus musculus
ttatgttctgcctttcaaatggctg

SEQ ID NO: 101738 - DNA, 25 bp, mus musculus
gttctgcctttcaaatggctgtgtg

SEQ ID NO: 101739 - DNA, 25 bp, mus musculus
tctgcctttcaaatggctgtgtgtc

SEQ ID NO: 101740 - DNA, 25 bp, mus musculus
taggccctcctttttcacatgaagt

SEQ ID NO: 101741 - DNA, 25 bp, mus musculus
gcttagtcaggccacatgtaaagtt

SEQ ID NO: 101742 - DNA, 25 bp, mus musculus
ttagtcaggccacatgtaaagtttt

SEQ ID NO: 101743 - DNA, 25 bp, mus musculus
caggcttcgttgttcgtgaatgata

SEQ ID NO: 101744 - DNA, 25 bp, mus musculus
cttcgttgttcgtgaatgatattct

SEQ ID NO: 101745 - DNA, 25 bp, mus musculus
ctcccctgtcttgttttggcatagt

SEQ ID NO: 101746 - DNA, 25 bp, mus musculus
cccctgtcttgttttggcatagtgt

SEQ ID NO: 101747 - DNA, 25 bp, mus musculus
tgtcttgttttggcatagtgtggtg

SEQ ID NO: 101748 - DNA, 25 bp, mus musculus
ttttcctattcaaactcacactgtg

SEQ ID NO: 101749 - DNA, 25 bp, mus musculus
ttcctattcaaactcacactgtgtt

SEQ ID NO: 101750 - DNA, 25 bp, mus musculus
tattcaaactcacactgtgtttatg

SEQ ID NO: 101751 - DNA, 25 bp, mus musculus
gtttccaatgagcttctagagcaag

SEQ ID NO: 101752 - DNA, 25 bp, mus musculus
ttccaatgagcttctagagcaagca

SEQ ID NO: 101753 - DNA, 25 bp, mus musculus
tcttgctaacaacaacacctcgtcc

SEQ ID NO: 101754 - DNA, 25 bp, mus musculus
gctaacaacaacacctcgtccagtc

SEQ ID NO: 101755 - DNA, 25 bp, mus musculus
taacaacaacacctcgtccagtcat

SEQ ID NO: 101756 - DNA, 25 bp, mus musculus
ctcgtccagtcattgtagaaccctg

SEQ ID NO: 101757 - DNA, 25 bp, mus musculus
cagtcattgtagaaccctggagcag

SEQ ID NO: 101758 - DNA, 25 bp, mus musculus
gtcattgtagaaccctggagcagtt

SEQ ID NO: 101759 - DNA, 25 bp, mus musculus
cattgtagaaccctggagcagtttg

SEQ ID NO: 101760 - DNA, 25 bp, mus musculus
agaaccctggagcagtttgatgatg

SEQ ID NO: 101761 - DNA, 25 bp, mus musculus
aaccctggagcagtttgatgatgaa

SEQ ID NO: 101762 - DNA, 25 bp, mus musculus
actcaacagtaccataaggaaagag

SEQ ID NO: 101763 - DNA, 25 bp, mus musculus
gcaagcattttcccagtttggccca

SEQ ID NO: 101764 - DNA, 25 bp, mus musculus
tcccagtttggcccagtagagaaag

SEQ ID NO: 101765 - DNA, 25 bp, mus musculus
ccagtttggcccagtagagaaagct

SEQ ID NO: 101766 - DNA, 25 bp, mus musculus
agcgaaacctcctgcacgagaggct

SEQ ID NO: 101767 - DNA, 25 bp, mus musculus
aaacctcctgcacgagaggctctgg

SEQ ID NO: 101768 - DNA, 25 bp, mus musculus
acctcctgcacgagaggctctggag

SEQ ID NO: 101769 - DNA, 25 bp, mus musculus
gcgttcttgctaacaacaacacctc

SEQ ID NO: 101770 - DNA, 25 bp, mus musculus
gttcttgctaacaacaacacctcgt

SEQ ID NO: 101771 - DNA, 25 bp, mus musculus
cacgtgcctgaatgtccggatcatg

SEQ ID NO: 101772 - DNA, 25 bp, mus musculus
caactacacgcctgggaacaaagag

SEQ ID NO: 101773 - DNA, 25 bp, mus musculus
agtgcaccagttccttgctaagact

SEQ ID NO: 101774 - DNA, 25 bp, mus musculus
ccagttccttgctaagactcagacc

SEQ ID NO: 101775 - DNA, 25 bp, mus musculus
gttccttgctaagactcagaccagc

SEQ ID NO: 101776 - DNA, 25 bp, mus musculus
ccttgctaagactcagaccagcact

SEQ ID NO: 101777 - DNA, 25 bp, mus musculus
taagactcagaccagcactagcttt

SEQ ID NO: 101778 - DNA, 25 bp, mus musculus
gactcagaccagcactagctttgag

SEQ ID NO: 101779 - DNA, 25 bp, mus musculus
tcagaccagcactagctttgagcac

SEQ ID NO: 101780 - DNA, 25 bp, mus musculus
tagctttgagcacgctcacgacatg

SEQ ID NO: 101781 - DNA, 25 bp, mus musculus
tgagcacgctcacgacatgagcgtg

SEQ ID NO: 101782 - DNA, 25 bp, mus musculus
gcacgctcacgacatgagcgtgatg

SEQ ID NO: 101783 - DNA, 25 bp, mus musculus
cctatacctgaagcgtatccagaca

SEQ ID NO: 101784 - DNA, 25 bp, mus musculus
gaacgcagctgtcctgagcaatctg

SEQ ID NO: 101785 - DNA, 25 bp, mus musculus
atacctgaagcgtatccagacagcc

SEQ ID NO: 101786 - DNA, 25 bp, mus musculus
gcgtatccagacagccattctgatc

SEQ ID NO: 101787 - DNA, 25 bp, mus musculus
tatccagacagccattctgatcatg

SEQ ID NO: 101788 - DNA, 25 bp, mus musculus
gacagccattctgatcatgggccgc

SEQ ID NO: 101789 - DNA, 25 bp, mus musculus
gatcatgggccgctacgtggagacg

SEQ ID NO: 101790 - DNA, 25 bp, mus musculus
tgacgacgtgccatgtggaaacatt

SEQ ID NO: 101791 - DNA, 25 bp, mus musculus
cggagtgcaccagttccttgctaag

SEQ ID NO: 101792 - DNA, 25 bp, mus musculus
ccaggcagttctagtggccgatagc

SEQ ID NO: 101793 - DNA, 25 bp, mus musculus
agttctagtggccgatagcttcaac

SEQ ID NO: 101794 - DNA, 25 bp, mus musculus
tgcgcctggccaacgttgcgctaat

SEQ ID NO: 101795 - DNA, 25 bp, mus musculus
tggccaacgttgcgctaattgacta

SEQ ID NO: 101796 - DNA, 25 bp, mus musculus
caacgttgcgctaattgactatact

SEQ ID NO: 101797 - DNA, 25 bp, mus musculus
aattgactatactctggagttcctg

SEQ ID NO: 101798 - DNA, 25 bp, mus musculus
ttgactatactctggagttcctgac

SEQ ID NO: 101799 - DNA, 25 bp, mus musculus
ctatactctggagttcctgactgcc

SEQ ID NO: 101800 - DNA, 25 bp, mus musculus
atactctggagttcctgactgccac

SEQ ID NO: 101801 - DNA, 25 bp, mus musculus
tctggagttcctgactgccacgggt

SEQ ID NO: 101802 - DNA, 25 bp, mus musculus
tggagttcctgactgccacgggtgt

SEQ ID NO: 101803 - DNA, 25 bp, mus musculus
ctgccacgggtgtacaggaaacatt

SEQ ID NO: 101804 - DNA, 25 bp, mus musculus
ttctagtggccgatagcttcaaccg

SEQ ID NO: 101805 - DNA, 25 bp, mus musculus
tggccgatagcttcaaccgccgctt

SEQ ID NO: 101806 - DNA, 25 bp, mus musculus
ccatctccaaggaccagcctcgggt

SEQ ID NO: 101807 - DNA, 25 bp, mus musculus
ggaccagcctcgggtcctcttgcgc

SEQ ID NO: 101808 - DNA, 25 bp, mus musculus
ctcgggtcctcttgcgcctggccaa

SEQ ID NO: 101809 - DNA, 25 bp, mus musculus
ggtcctcttgcgcctggccaacgtt

SEQ ID NO: 101810 - DNA, 25 bp, mus musculus
tcctcttgcgcctggccaacgttgc

SEQ ID NO: 101811 - DNA, 25 bp, mus musculus
cttgcgcctggccaacgttgcgcta

SEQ ID NO: 101812 - DNA, 25 bp, mus musculus
tgacaaccttcgtgaactgcacttg

SEQ ID NO: 101813 - DNA, 25 bp, mus musculus
gacaaccttcgtgaactgcacttga

SEQ ID NO: 101814 - DNA, 25 bp, mus musculus
gcccagcgtgccatcacaacgtctg

SEQ ID NO: 101815 - DNA, 25 bp, mus musculus
ccagcgtgccatcacaacgtctgat

SEQ ID NO: 101816 - DNA, 25 bp, mus musculus
cagcgtgccatcacaacgtctgatg

SEQ ID NO: 101817 - DNA, 25 bp, mus musculus
tgccatcacaacgtctgatgtaacc

SEQ ID NO: 101818 - DNA, 25 bp, mus musculus
gccatcacaacgtctgatgtaacct

SEQ ID NO: 101819 - DNA, 25 bp, mus musculus
atcacaacgtctgatgtaacctcaa

SEQ ID NO: 101820 - DNA, 25 bp, mus musculus
cacaacgtctgatgtaacctcaaga

SEQ ID NO: 101821 - DNA, 25 bp, mus musculus
acaacgtctgatgtaacctcaagag

SEQ ID NO: 101822 - DNA, 25 bp, mus musculus
acgtctgatgtaacctcaagagtta

SEQ ID NO: 101823 - DNA, 25 bp, mus musculus
gtctgatgtaacctcaagagttacg

SEQ ID NO: 101824 - DNA, 25 bp, mus musculus
caaccttcgtgaactgcacttgacg

SEQ ID NO: 101825 - DNA, 25 bp, mus musculus
tctgatgtaacctcaagagttacgt

SEQ ID NO: 101826 - DNA, 25 bp, mus musculus
ccttcgtgaactgcacttgacgggc

SEQ ID NO: 101827 - DNA, 25 bp, mus musculus
cttcgtgaactgcacttgacgggcg

SEQ ID NO: 101828 - DNA, 25 bp, mus musculus
cgtgaactgcacttgacgggcgagt

SEQ ID NO: 101829 - DNA, 25 bp, mus musculus
tgaactgcacttgacgggcgagttt

SEQ ID NO: 101830 - DNA, 25 bp, mus musculus
atccaagcccagcgtgccatcacaa

SEQ ID NO: 101831 - DNA, 25 bp, mus musculus
caagcccagcgtgccatcacaacgt

SEQ ID NO: 101832 - DNA, 25 bp, mus musculus
agcccagcgtgccatcacaacgtct

SEQ ID NO: 101833 - DNA, 25 bp, mus musculus
caagggcgcacgatcatcttctgtg

SEQ ID NO: 101834 - DNA, 25 bp, mus musculus
gggcgcacgatcatcttctgtgaaa

SEQ ID NO: 101835 - DNA, 25 bp, mus musculus
atggcgacattccacagaagcaaag

SEQ ID NO: 101836 - DNA, 25 bp, mus musculus
acattccacagaagcaaagggaaat

SEQ ID NO: 101837 - DNA, 25 bp, mus musculus
ccaatgttgctgcccgtgggttaga

SEQ ID NO: 101838 - DNA, 25 bp, mus musculus
atgttgctgcccgtgggttagacat

SEQ ID NO: 101839 - DNA, 25 bp, mus musculus
ggttagacatccctgaggttgactt

SEQ ID NO: 101840 - DNA, 25 bp, mus musculus
acatccctgaggttgacttggttgt

SEQ ID NO: 101841 - DNA, 25 bp, mus musculus
tccctgaggttgacttggttgttca

SEQ ID NO: 101842 - DNA, 25 bp, mus musculus
tggttgttcagagctgcccaccaaa

SEQ ID NO: 101843 - DNA, 25 bp, mus musculus
ttcagagctgcccaccaaaggatgt

SEQ ID NO: 101844 - DNA, 25 bp, mus musculus
agtcttacattcatcgttcggggcg

SEQ ID NO: 101845 - DNA, 25 bp, mus musculus
atcatcttctgtgaaaccaagaagg

SEQ ID NO: 101846 - DNA, 25 bp, mus musculus
gatgcccaggagctatctcagaaca

SEQ ID NO: 101847 - DNA, 25 bp, mus musculus
ctatctcagaacacgtgcataaagc

SEQ ID NO: 101848 - DNA, 25 bp, mus musculus
tctcagaacacgtgcataaagcagg

SEQ ID NO: 101849 - DNA, 25 bp, mus musculus
caggatgccagtccttacatggcga

SEQ ID NO: 101850 - DNA, 25 bp, mus musculus
gatgccagtccttacatggcgacat

SEQ ID NO: 101851 - DNA, 25 bp, mus musculus
gccagtccttacatggcgacattcc

SEQ ID NO: 101852 - DNA, 25 bp, mus musculus
tacatggcgacattccacagaagca

SEQ ID NO: 101853 - DNA, 25 bp, mus musculus
gagaaactctcagcagtggtacaca

SEQ ID NO: 101854 - DNA, 25 bp, mus musculus
ctctcagcagtggtacacatctcct

SEQ ID NO: 101855 - DNA, 25 bp, mus musculus
ttccattgtagctacttatctaaca

SEQ ID NO: 101856 - DNA, 25 bp, mus musculus
tctaacatactcatttggtgaggag

SEQ ID NO: 101857 - DNA, 25 bp, mus musculus
gctctgtccctcagtgactccttga

SEQ ID NO: 101858 - DNA, 25 bp, mus musculus
aagtactcaccacacataatgactg

SEQ ID NO: 101859 - DNA, 25 bp, mus musculus
tcaccacacataatgactgcagagt

SEQ ID NO: 101860 - DNA, 25 bp, mus musculus
atgactgcagagtcagctgctctgt

SEQ ID NO: 101861 - DNA, 25 bp, mus musculus
tcagctgctctgttccccaggtgtt

SEQ ID NO: 101862 - DNA, 25 bp, mus musculus
atattttctagaatgtcatgcctgc

SEQ ID NO: 101863 - DNA, 25 bp, mus musculus
atgtcatgcctgcttgtcaaatgaa

SEQ ID NO: 101864 - DNA, 25 bp, mus musculus
aatgcctagctgtaattagaacgca

SEQ ID NO: 101865 - DNA, 25 bp, mus musculus
atctcctatagtaaccagcatagtc

SEQ ID NO: 101866 - DNA, 25 bp, mus musculus
attcatcagtgttactgtcactcat

SEQ ID NO: 101867 - DNA, 25 bp, mus musculus
tggcttaatccaacagattcattca

SEQ ID NO: 101868 - DNA, 25 bp, mus musculus
acagattcattcaccttctaatatg

SEQ ID NO: 101869 - DNA, 25 bp, mus musculus
tataacggcaagctctctgtaactc

SEQ ID NO: 101870 - DNA, 25 bp, mus musculus
ggcaagctctctgtaactccgtcat

SEQ ID NO: 101871 - DNA, 25 bp, mus musculus
ctctctgtaactccgtcatgaccag

SEQ ID NO: 101872 - DNA, 25 bp, mus musculus
tgaccaggtgctttccattgtagct

SEQ ID NO: 101873 - DNA, 25 bp, mus musculus
ttaagtccttactgaaccatgacct

SEQ ID NO: 101874 - DNA, 25 bp, mus musculus
actgaaccatgacctaaaactgact

SEQ ID NO: 101875 - DNA, 25 bp, mus musculus
attccagaacttgcagctcgtgttg

SEQ ID NO: 101876 - DNA, 25 bp, mus musculus
tccagaacttgcagctcgtgttgat

SEQ ID NO: 101877 - DNA, 25 bp, mus musculus
cagaacttgcagctcgtgttgatat

SEQ ID NO: 101878 - DNA, 25 bp, mus musculus
gaacttgcagctcgtgttgatatac

SEQ ID NO: 101879 - DNA, 25 bp, mus musculus
ttgcagctcgtgttgatatacttag

SEQ ID NO: 101880 - DNA, 25 bp, mus musculus
cacttacctccagcctgatggaagc

SEQ ID NO: 101881 - DNA, 25 bp, mus musculus
cttacctccagcctgatggaagctt

SEQ ID NO: 101882 - DNA, 25 bp, mus musculus
cctccagcctgatggaagcttggga

SEQ ID NO: 101883 - DNA, 25 bp, mus musculus
tccagcctgatggaagcttgggaag

SEQ ID NO: 101884 - DNA, 25 bp, mus musculus
aagtagaaccagctatggtgacagc

SEQ ID NO: 101885 - DNA, 25 bp, mus musculus
tgaaccatgacctaaaactgactaa

SEQ ID NO: 101886 - DNA, 25 bp, mus musculus
agaaccagctatggtgacagcttca

SEQ ID NO: 101887 - DNA, 25 bp, mus musculus
attaacattgctgacttaatggaag

SEQ ID NO: 101888 - DNA, 25 bp, mus musculus
taacattgctgacttaatggaagaa

SEQ ID NO: 101889 - DNA, 25 bp, mus musculus
acattgctgacttaatggaagaaaa

SEQ ID NO: 101890 - DNA, 25 bp, mus musculus
agttcccagaggatgctggattgag

SEQ ID NO: 101891 - DNA, 25 bp, mus musculus
ttcccagaggatgctggattgagca

SEQ ID NO: 101892 - DNA, 25 bp, mus musculus
gaagacattccagaacttgcagctc

SEQ ID NO: 101893 - DNA, 25 bp, mus musculus
agacattccagaacttgcagctcgt

SEQ ID NO: 101894 - DNA, 25 bp, mus musculus
tttcagttgggcagcaagttgctgc

SEQ ID NO: 101895 - DNA, 25 bp, mus musculus
aagttgctgcaagttgcttattcaa

SEQ ID NO: 101896 - DNA, 25 bp, mus musculus
tttaattccataggtagccattccg

SEQ ID NO: 101897 - DNA, 25 bp, mus musculus
tccataggtagccattccggaagag

SEQ ID NO: 101898 - DNA, 25 bp, mus musculus
agccattccggaagagttcttcaca

SEQ ID NO: 101899 - DNA, 25 bp, mus musculus
agagttcttcacatatactagttcc

SEQ ID NO: 101900 - DNA, 25 bp, mus musculus
gttcttcacatatactagttcccaa

SEQ ID NO: 101901 - DNA, 25 bp, mus musculus
cttcacatatactagttcccaatta

SEQ ID NO: 101902 - DNA, 25 bp, mus musculus
cacatatactagttcccaattaact

SEQ ID NO: 101903 - DNA, 25 bp, mus musculus
tactagttcccaattaactctctct

SEQ ID NO: 101904 - DNA, 25 bp, mus musculus
tagttcccaattaactctctctggg

SEQ ID NO: 101905 - DNA, 25 bp, mus musculus
ttcccaattaactctctctgggtat

SEQ ID NO: 101906 - DNA, 25 bp, mus musculus
tatgatcagataactccgcatacag

SEQ ID NO: 101907 - DNA, 25 bp, mus musculus
ccaattaactctctctgggtatcac

SEQ ID NO: 101908 - DNA, 25 bp, mus musculus
gatcagataactccgcatacagagc

SEQ ID NO: 101909 - DNA, 25 bp, mus musculus
cagataactccgcatacagagcaag

SEQ ID NO: 101910 - DNA, 25 bp, mus musculus
ataactccgcatacagagcaaggat

SEQ ID NO: 101911 - DNA, 25 bp, mus musculus
actccgcatacagagcaaggatcag

SEQ ID NO: 101912 - DNA, 25 bp, mus musculus
tcagaaataccttaccgggcaatag

SEQ ID NO: 101913 - DNA, 25 bp, mus musculus
ttaagccactaagttgaccttgatc

SEQ ID NO: 101914 - DNA, 25 bp, mus musculus
agccactaagttgaccttgatcaat

SEQ ID NO: 101915 - DNA, 25 bp, mus musculus
aagattcctgtagacatgtgcagag

SEQ ID NO: 101916 - DNA, 25 bp, mus musculus
gattcctgtagacatgtgcagagag

SEQ ID NO: 101917 - DNA, 25 bp, mus musculus
tgcagtgacctcatcttcaacgatg

SEQ ID NO: 101918 - DNA, 25 bp, mus musculus
cagtgacctcatcttcaacgatgcc

SEQ ID NO: 101919 - DNA, 25 bp, mus musculus
gacctcatcttcaacgatgcccagg

SEQ ID NO: 101920 - DNA, 25 bp, mus musculus
atcttcaacgatgcccaggcctagt

SEQ ID NO: 101921 - DNA, 25 bp, mus musculus
tcaacgatgcccaggcctagtttaa

SEQ ID NO: 101922 - DNA, 25 bp, mus musculus
cgatgcccaggcctagtttaatcat

SEQ ID NO: 101923 - DNA, 25 bp, mus musculus
atgcccaggcctagtttaatcatgc

SEQ ID NO: 101924 - DNA, 25 bp, mus musculus
tttaatcatgcggtagatgcggttc

SEQ ID NO: 101925 - DNA, 25 bp, mus musculus
taatcatgcggtagatgcggttcga

SEQ ID NO: 101926 - DNA, 25 bp, mus musculus
atcatgcggtagatgcggttcgagt

SEQ ID NO: 101927 - DNA, 25 bp, mus musculus
ttcctgtagacatgtgcagagagcc

SEQ ID NO: 101928 - DNA, 25 bp, mus musculus
gaggctttaatccacctcttccatg

SEQ ID NO: 101929 - DNA, 25 bp, mus musculus
ggctttaatccacctcttccatggg

SEQ ID NO: 101930 - DNA, 25 bp, mus musculus
ggggcatcctcatcgccttccagag

SEQ ID NO: 101931 - DNA, 25 bp, mus musculus
ggatctcatcaggaacaggagcact

SEQ ID NO: 101932 - DNA, 25 bp, mus musculus
atctcatcaggaacaggagcactgg

SEQ ID NO: 101933 - DNA, 25 bp, mus musculus
ggctcctctgcagtgacctcatctt

SEQ ID NO: 101934 - DNA, 25 bp, mus musculus
cctctgcagtgacctcatcttcaac

SEQ ID NO: 101935 - DNA, 25 bp, mus musculus
tgacaagcagcaagccaacaccatc

SEQ ID NO: 101936 - DNA, 25 bp, mus musculus
caagcagcaagccaacaccatcttc

SEQ ID NO: 101937 - DNA, 25 bp, mus musculus
cagactgcaccgtcatgaacattgc

SEQ ID NO: 101938 - DNA, 25 bp, mus musculus
actgcaccgtcatgaacattgcaga

SEQ ID NO: 101939 - DNA, 25 bp, mus musculus
gcaccgtcatgaacattgcagacac

SEQ ID NO: 101940 - DNA, 25 bp, mus musculus
tgaacattgcagacactacatggcc

SEQ ID NO: 101941 - DNA, 25 bp, mus musculus
acattgcagacactacatggcctcc

SEQ ID NO: 101942 - DNA, 25 bp, mus musculus
ttgcagacactacatggcctccgat

SEQ ID NO: 101943 - DNA, 25 bp, mus musculus
cagacactacatggcctccgatgtt

SEQ ID NO: 101944 - DNA, 25 bp, mus musculus
ctacatggcctccgatgttgaatgg

SEQ ID NO: 101945 - DNA, 25 bp, mus musculus
catggcctccgatgttgaatgggac

SEQ ID NO: 101946 - DNA, 25 bp, mus musculus
ggcctccgatgttgaatgggaccca

SEQ ID NO: 101947 - DNA, 25 bp, mus musculus
gcagcaagccaacaccatcttctgg

SEQ ID NO: 101948 - DNA, 25 bp, mus musculus
caacaccatcttctggagtccccag

SEQ ID NO: 101949 - DNA, 25 bp, mus musculus
caccatcttctggagtccccagggg

SEQ ID NO: 101950 - DNA, 25 bp, mus musculus
gagcatgaacggtgccttggcgtta

SEQ ID NO: 101951 - DNA, 25 bp, mus musculus
gttatgtcgacacttcagactgcac

SEQ ID NO: 101952 - DNA, 25 bp, mus musculus
atgtcgacacttcagactgcaccgt

SEQ ID NO: 101953 - DNA, 25 bp, mus musculus
tcgacacttcagactgcaccgtcat

SEQ ID NO: 101954 - DNA, 25 bp, mus musculus
acacttcagactgcaccgtcatgaa

SEQ ID NO: 101955 - DNA, 25 bp, mus musculus
taggaccattgagcgcatggagaaa

SEQ ID NO: 101956 - DNA, 25 bp, mus musculus
ggaccattgagcgcatggagaaacg

SEQ ID NO: 101957 - DNA, 25 bp, mus musculus
cccagctatgctataggcagagttg

SEQ ID NO: 101958 - DNA, 25 bp, mus musculus
gagcagtgccaaatcccaacaaagt

SEQ ID NO: 101959 - DNA, 25 bp, mus musculus
gcagtgccaaatcccaacaaagtgc

SEQ ID NO: 101960 - DNA, 25 bp, mus musculus
agtgccaaatcccaacaaagtgctg

SEQ ID NO: 101961 - DNA, 25 bp, mus musculus
tgccaaatcccaacaaagtgctgag

SEQ ID NO: 101962 - DNA, 25 bp, mus musculus
ccaaatcccaacaaagtgctgagct

SEQ ID NO: 101963 - DNA, 25 bp, mus musculus
aaatcccaacaaagtgctgagctgt

SEQ ID NO: 101964 - DNA, 25 bp, mus musculus
atcccaacaaagtgctgagctgtga

SEQ ID NO: 101965 - DNA, 25 bp, mus musculus
cccaacaaagtgctgagctgtgata

SEQ ID NO: 101966 - DNA, 25 bp, mus musculus
tgatatgaactacacctcaaaacgt

SEQ ID NO: 101967 - DNA, 25 bp, mus musculus
aaacgcaatcattccacagagtgcc

SEQ ID NO: 101968 - DNA, 25 bp, mus musculus
acgcaatcattccacagagtgcccc

SEQ ID NO: 101969 - DNA, 25 bp, mus musculus
gcaatcattccacagagtgccccaa

SEQ ID NO: 101970 - DNA, 25 bp, mus musculus
aatcattccacagagtgccccaagc

SEQ ID NO: 101971 - DNA, 25 bp, mus musculus
cacagagtgccccaagcccagctat

SEQ ID NO: 101972 - DNA, 25 bp, mus musculus
gtgccccaagcccagctatgctata

SEQ ID NO: 101973 - DNA, 25 bp, mus musculus
gccccaagcccagctatgctatagg

SEQ ID NO: 101974 - DNA, 25 bp, mus musculus
agcccagctatgctataggcagagt

SEQ ID NO: 101975 - DNA, 25 bp, mus musculus
cgaggccaggagcttgcctttccgc

SEQ ID NO: 101976 - DNA, 25 bp, mus musculus
cttgcctttccgctgagtccagatt

SEQ ID NO: 101977 - DNA, 25 bp, mus musculus
ggggccttccagcatgtgggcaaac

SEQ ID NO: 101978 - DNA, 25 bp, mus musculus
gccttccagcatgtgggcaaacctt

SEQ ID NO: 101979 - DNA, 25 bp, mus musculus
ttccagcatgtgggcaaaccttcaa

SEQ ID NO: 101980 - DNA, 25 bp, mus musculus
gtgggcaaaccttcaatcagggcaa

SEQ ID NO: 101981 - DNA, 25 bp, mus musculus
ggcaaaccttcaatcagggcaagat

SEQ ID NO: 101982 - DNA, 25 bp, mus musculus
aaaccttcaatcagggcaagatctt

SEQ ID NO: 101983 - DNA, 25 bp, mus musculus
ccttcaatcagggcaagatcttcaa

SEQ ID NO: 101984 - DNA, 25 bp, mus musculus
tcttcaagtgaacatctcttgccat

SEQ ID NO: 101985 - DNA, 25 bp, mus musculus
agtgaacatctcttgccatcaccta

SEQ ID NO: 101986 - DNA, 25 bp, mus musculus
gaacatctcttgccatcacctagct

SEQ ID NO: 101987 - DNA, 25 bp, mus musculus
gcctttccgctgagtccagattggc

SEQ ID NO: 101988 - DNA, 25 bp, mus musculus
tttccgctgagtccagattggcagg

SEQ ID NO: 101989 - DNA, 25 bp, mus musculus
agtccagattggcaggtggactacg

SEQ ID NO: 101990 - DNA, 25 bp, mus musculus
tacgagtcatacacatggcggaaac

SEQ ID NO: 101991 - DNA, 25 bp, mus musculus
gagtcatacacatggcggaaactgg

SEQ ID NO: 101992 - DNA, 25 bp, mus musculus
tcatacacatggcggaaactggatc

SEQ ID NO: 101993 - DNA, 25 bp, mus musculus
tacacatggcggaaactggatcctg

SEQ ID NO: 101994 - DNA, 25 bp, mus musculus
gagacccagacgctggttcgagagt

SEQ ID NO: 101995 - DNA, 25 bp, mus musculus
tcgattgaagccgagcccacaaaga

SEQ ID NO: 101996 - DNA, 25 bp, mus musculus
cgattgaagccgagcccacaaagat

SEQ ID NO: 101997 - DNA, 25 bp, mus musculus
tgttgcccgtaagccggtcctcatc

SEQ ID NO: 101998 - DNA, 25 bp, mus musculus
ttgcccgtaagccggtcctcatcgg

SEQ ID NO: 101999 - DNA, 25 bp, mus musculus
tgcccgtaagccggtcctcatcggg

SEQ ID NO: 102000 - DNA, 25 bp, mus musculus
taagccggtcctcatcgggagcgtc

SEQ ID NO: 102001 - DNA, 25 bp, mus musculus
ggtcctcatcgggagcgtccttgga

SEQ ID NO: 102002 - DNA, 25 bp, mus musculus
tcctcatcgggagcgtccttggacg

SEQ ID NO: 102003 - DNA, 25 bp, mus musculus
cctcatcgggagcgtccttggacgt

SEQ ID NO: 102004 - DNA, 25 bp, mus musculus
gattgaagccgagcccacaaagatg

SEQ ID NO: 102005 - DNA, 25 bp, mus musculus
cctagcaccttgctgaagatgctcg

SEQ ID NO: 102006 - DNA, 25 bp, mus musculus
ctagcaccttgctgaagatgctcga

SEQ ID NO: 102007 - DNA, 25 bp, mus musculus
accttgctgaagatgctcgactgaa

SEQ ID NO: 102008 - DNA, 25 bp, mus musculus
ttgctgaagatgctcgactgaagta

SEQ ID NO: 102009 - DNA, 25 bp, mus musculus
agatgctcgactgaagtatgaagat

SEQ ID NO: 102010 - DNA, 25 bp, mus musculus
gatgttgcccgtaagccggtcctca

SEQ ID NO: 102011 - DNA, 25 bp, mus musculus
atgttgcccgtaagccggtcctcat

SEQ ID NO: 102012 - DNA, 25 bp, mus musculus
gggcacaccagcgcaatgtcaaaca

SEQ ID NO: 102013 - DNA, 25 bp, mus musculus
accagcgcaatgtcaaacacatgcg

SEQ ID NO: 102014 - DNA, 25 bp, mus musculus
aagatgtgtctgtggctgcatgcaa

SEQ ID NO: 102015 - DNA, 25 bp, mus musculus
acttctgtcatcgtcctgtgcactt

SEQ ID NO: 102016 - DNA, 25 bp, mus musculus
gtcatcgtcctgtgcactttgaact

SEQ ID NO: 102017 - DNA, 25 bp, mus musculus
gtcctgtgcactttgaacttatgag

SEQ ID NO: 102018 - DNA, 25 bp, mus musculus
gggagcgatcctactttgggaacat

SEQ ID NO: 102019 - DNA, 25 bp, mus musculus
cccaatatgttaccacctatgctta

SEQ ID NO: 102020 - DNA, 25 bp, mus musculus
ccacctatgcttaaggagccagctg

SEQ ID NO: 102021 - DNA, 25 bp, mus musculus
ccagctgccttggatgccagctcca

SEQ ID NO: 102022 - DNA, 25 bp, mus musculus
tgtgcttctggctgacttgattctg

SEQ ID NO: 102023 - DNA, 25 bp, mus musculus
tctggctgacttgattctgaaaata

SEQ ID NO: 102024 - DNA, 25 bp, mus musculus
tcaaacacatgcgccagctgctaat

SEQ ID NO: 102025 - DNA, 25 bp, mus musculus
agatctgtgatcttctgctctccaa

SEQ ID NO: 102026 - DNA, 25 bp, mus musculus
gtgatcttctgctctccaagcacag

SEQ ID NO: 102027 - DNA, 25 bp, mus musculus
tctccaagcacagcatctatgtgca

SEQ ID NO: 102028 - DNA, 25 bp, mus musculus
agcacagcatctatgtgcaggccat

SEQ ID NO: 102029 - DNA, 25 bp, mus musculus
ctgtgcctcgtggtgaggagctact

SEQ ID NO: 102030 - DNA, 25 bp, mus musculus
agaagctgctgctggcctggactga

SEQ ID NO: 102031 - DNA, 25 bp, mus musculus
ccctccaagatgtgtctgtggctgc

SEQ ID NO: 102032 - DNA, 25 bp, mus musculus
ttccagagtcagtaccatgagccac

SEQ ID NO: 102033 - DNA, 25 bp, mus musculus
agtcagtaccatgagccacaattct

SEQ ID NO: 102034 - DNA, 25 bp, mus musculus
cttcttgtccaccaatgccgggctt

SEQ ID NO: 102035 - DNA, 25 bp, mus musculus
gggaacccagcaactcagctgttgt

SEQ ID NO: 102036 - DNA, 25 bp, mus musculus
gaacccagcaactcagctgttgtga

SEQ ID NO: 102037 - DNA, 25 bp, mus musculus
ccagcaactcagctgttgtgaggac

SEQ ID NO: 102038 - DNA, 25 bp, mus musculus
tgtgaggaccaccgtgatcaacatg

SEQ ID NO: 102039 - DNA, 25 bp, mus musculus
tgaggaccaccgtgatcaacatgcc

SEQ ID NO: 102040 - DNA, 25 bp, mus musculus
aggaccaccgtgatcaacatgccca

SEQ ID NO: 102041 - DNA, 25 bp, mus musculus
accgtgatcaacatgcccagagagg

SEQ ID NO: 102042 - DNA, 25 bp, mus musculus
cgtgatcaacatgcccagagaggtg

SEQ ID NO: 102043 - DNA, 25 bp, mus musculus
tgatcaacatgcccagagaggtgtc

SEQ ID NO: 102044 - DNA, 25 bp, mus musculus
taccatgagccacaattctcaagcc

SEQ ID NO: 102045 - DNA, 25 bp, mus musculus
ccatgagccacaattctcaagcctt

SEQ ID NO: 102046 - DNA, 25 bp, mus musculus
cacaattctcaagccttcttgtcca

SEQ ID NO: 102047 - DNA, 25 bp, mus musculus
caattctcaagccttcttgtccacc

SEQ ID NO: 102048 - DNA, 25 bp, mus musculus
attctcaagccttcttgtccaccaa

SEQ ID NO: 102049 - DNA, 25 bp, mus musculus
tcaagccttcttgtccaccaatgcc

SEQ ID NO: 102050 - DNA, 25 bp, mus musculus
aagccttcttgtccaccaatgccgg

SEQ ID NO: 102051 - DNA, 25 bp, mus musculus
gccttcttgtccaccaatgccgggc

SEQ ID NO: 102052 - DNA, 25 bp, mus musculus
gagcccgttgtccggagtgcacctg

SEQ ID NO: 102053 - DNA, 25 bp, mus musculus
agcccgttgtccggagtgcacctgc

SEQ ID NO: 102054 - DNA, 25 bp, mus musculus
cgagtcgccatggaagtgcagaaag

SEQ ID NO: 102055 - DNA, 25 bp, mus musculus
agtcgccatggaagtgcagaaagag

SEQ ID NO: 102056 - DNA, 25 bp, mus musculus
tggcctgcggtgcaccggagtctgc

SEQ ID NO: 102057 - DNA, 25 bp, mus musculus
agtctgcagctgtcgctggtcatgc

SEQ ID NO: 102058 - DNA, 25 bp, mus musculus
gtctgcagctgtcgctggtcatgcg

SEQ ID NO: 102059 - DNA, 25 bp, mus musculus
ctgcagctgtcgctggtcatgcgca

SEQ ID NO: 102060 - DNA, 25 bp, mus musculus
ctgtcgctggtcatgcgcacgcccg

SEQ ID NO: 102061 - DNA, 25 bp, mus musculus
tgtcgctggtcatgcgcacgcccgg

SEQ ID NO: 102062 - DNA, 25 bp, mus musculus
gcccgttgtccggagtgcacctgct

SEQ ID NO: 102063 - DNA, 25 bp, mus musculus
gagtgcacctgctgcctgttctgtc

SEQ ID NO: 102064 - DNA, 25 bp, mus musculus
agtgcacctgctgcctgttctgtcc

SEQ ID NO: 102065 - DNA, 25 bp, mus musculus
gtgcacctgctgcctgttctgtccc

SEQ ID NO: 102066 - DNA, 25 bp, mus musculus
tgcacctgctgcctgttctgtccct

SEQ ID NO: 102067 - DNA, 25 bp, mus musculus
ccgtcgagtcgccatggaagtgcag

SEQ ID NO: 102068 - DNA, 25 bp, mus musculus
cgtcgagtcgccatggaagtgcaga

SEQ ID NO: 102069 - DNA, 25 bp, mus musculus
tcgagtcgccatggaagtgcagaaa

SEQ ID NO: 102070 - DNA, 25 bp, mus musculus
ctatgtccccaaaccagtcagctgg

SEQ ID NO: 102071 - DNA, 25 bp, mus musculus
atgtccccaaaccagtcagctgggc

SEQ ID NO: 102072 - DNA, 25 bp, mus musculus
tcaacaacttggcatagtaacgatg

SEQ ID NO: 102073 - DNA, 25 bp, mus musculus
tgacgtgtacagggcgcctccaatt

SEQ ID NO: 102074 - DNA, 25 bp, mus musculus
acgtgtacagggcgcctccaattga

SEQ ID NO: 102075 - DNA, 25 bp, mus musculus
gtgtacagggcgcctccaattgacc

SEQ ID NO: 102076 - DNA, 25 bp, mus musculus
gtacagggcgcctccaattgaccgt

SEQ ID NO: 102077 - DNA, 25 bp, mus musculus
ggcgcctccaattgaccgttccatc

SEQ ID NO: 102078 - DNA, 25 bp, mus musculus
attgaccgttccatccttcccactg

SEQ ID NO: 102079 - DNA, 25 bp, mus musculus
cactgctccacgggctgctcgggaa

SEQ ID NO: 102080 - DNA, 25 bp, mus musculus
ggctgctcgggaacccaatattgac

SEQ ID NO: 102081 - DNA, 25 bp, mus musculus
ctgctcgggaacccaatattgaccg

SEQ ID NO: 102082 - DNA, 25 bp, mus musculus
gtccccaaaccagtcagctgggctg

SEQ ID NO: 102083 - DNA, 25 bp, mus musculus
ccccaaaccagtcagctgggctgtt

SEQ ID NO: 102084 - DNA, 25 bp, mus musculus
ccaaaccagtcagctgggctgttga

SEQ ID NO: 102085 - DNA, 25 bp, mus musculus
aaaccagtcagctgggctgttgaaa

SEQ ID NO: 102086 - DNA, 25 bp, mus musculus
accagtcagctgggctgttgaaaca

SEQ ID NO: 102087 - DNA, 25 bp, mus musculus
cagtcagctgggctgttgaaacaga

SEQ ID NO: 102088 - DNA, 25 bp, mus musculus
tgtgtcaacaacttggcatagtaac

SEQ ID NO: 102089 - DNA, 25 bp, mus musculus
tgtcaacaacttggcatagtaacga

SEQ ID NO: 102090 - DNA, 25 bp, mus musculus
aatggaaatctatcgccctcacaaa

SEQ ID NO: 102091 - DNA, 25 bp, mus musculus
tggaaatctatcgccctcacaaagc

SEQ ID NO: 102092 - DNA, 25 bp, mus musculus
gcgctccatccgtccagataacatg

SEQ ID NO: 102093 - DNA, 25 bp, mus musculus
tccatccgtccagataacatgtcgg

SEQ ID NO: 102094 - DNA, 25 bp, mus musculus
tccgtccagataacatgtcggagta

SEQ ID NO: 102095 - DNA, 25 bp, mus musculus
cgtccagataacatgtcggagtaca

SEQ ID NO: 102096 - DNA, 25 bp, mus musculus
tctgtcagttgtctactggtggttc

SEQ ID NO: 102097 - DNA, 25 bp, mus musculus
tgtcagttgtctactggtggttctg

SEQ ID NO: 102098 - DNA, 25 bp, mus musculus
tcagttgtctactggtggttctgtg

SEQ ID NO: 102099 - DNA, 25 bp, mus musculus
agttgtctactggtggttctgtggc

SEQ ID NO: 102100 - DNA, 25 bp, mus musculus
ctactggtggttctgtggcaagtgc

SEQ ID NO: 102101 - DNA, 25 bp, mus musculus
actggtggttctgtggcaagtgctg

SEQ ID NO: 102102 - DNA, 25 bp, mus musculus
tcgccctcacaaagccaatgctgag

SEQ ID NO: 102103 - DNA, 25 bp, mus musculus
cctcacaaagccaatgctgaggaga

SEQ ID NO: 102104 - DNA, 25 bp, mus musculus
tcacaaagccaatgctgaggagatg

SEQ ID NO: 102105 - DNA, 25 bp, mus musculus
accacagcgatgactacattaaatt

SEQ ID NO: 102106 - DNA, 25 bp, mus musculus
actacattaaattcttgcgctccat

SEQ ID NO: 102107 - DNA, 25 bp, mus musculus
ttaaattcttgcgctccatccgtcc

SEQ ID NO: 102108 - DNA, 25 bp, mus musculus
aaattcttgcgctccatccgtccag

SEQ ID NO: 102109 - DNA, 25 bp, mus musculus
attcttgcgctccatccgtccagat

SEQ ID NO: 102110 - DNA, 25 bp, mus musculus
atgtctggtggctccgggattataa

SEQ ID NO: 102111 - DNA, 25 bp, mus musculus
gtctggtggctccgggattataaca

SEQ ID NO: 102112 - DNA, 25 bp, mus musculus
ctccttcgtggcatctatgcttacg

SEQ ID NO: 102113 - DNA, 25 bp, mus musculus
ccttcgtggcatctatgcttacggt

SEQ ID NO: 102114 - DNA, 25 bp, mus musculus
gagagctattatccctgtattaaag

SEQ ID NO: 102115 - DNA, 25 bp, mus musculus
agagctattatccctgtattaaaga

SEQ ID NO: 102116 - DNA, 25 bp, mus musculus
agctattatccctgtattaaagatc

SEQ ID NO: 102117 - DNA, 25 bp, mus musculus
gctattatccctgtattaaagatcc

SEQ ID NO: 102118 - DNA, 25 bp, mus musculus
tattatccctgtattaaagatccaa

SEQ ID NO: 102119 - DNA, 25 bp, mus musculus
attctggcacttggagactatatgg

SEQ ID NO: 102120 - DNA, 25 bp, mus musculus
tcatgcctgcattggtggacaaatg

SEQ ID NO: 102121 - DNA, 25 bp, mus musculus
tgcctgcattggtggacaaatgttc

SEQ ID NO: 102122 - DNA, 25 bp, mus musculus
tctggtggctccgggattataacag

SEQ ID NO: 102123 - DNA, 25 bp, mus musculus
tggtggctccgggattataacagca

SEQ ID NO: 102124 - DNA, 25 bp, mus musculus
atggcggcccagagcgaactggacc

SEQ ID NO: 102125 - DNA, 25 bp, mus musculus
cagagcgaactggaccccgatggtg

SEQ ID NO: 102126 - DNA, 25 bp, mus musculus
agcgaactggaccccgatggtgtca

SEQ ID NO: 102127 - DNA, 25 bp, mus musculus
gtctctccttcgtggcatctatgct

SEQ ID NO: 102128 - DNA, 25 bp, mus musculus
tctctccttcgtggcatctatgctt

SEQ ID NO: 102129 - DNA, 25 bp, mus musculus
tctccttcgtggcatctatgcttac

SEQ ID NO: 102130 - DNA, 25 bp, mus musculus
gaagcgaccaaagcgcctgaggacc

SEQ ID NO: 102131 - DNA, 25 bp, mus musculus
agcgaccaaagcgcctgaggaccgg

SEQ ID NO: 102132 - DNA, 25 bp, mus musculus
tgtttgtacagcgacaggtgtttgc

SEQ ID NO: 102133 - DNA, 25 bp, mus musculus
tgtacagcgacaggtgtttgctgag

SEQ ID NO: 102134 - DNA, 25 bp, mus musculus
acagcgacaggtgtttgctgagaac

SEQ ID NO: 102135 - DNA, 25 bp, mus musculus
gattgctttagtcctgtttggtaca

SEQ ID NO: 102136 - DNA, 25 bp, mus musculus
tgctttagtcctgtttggtacagat

SEQ ID NO: 102137 - DNA, 25 bp, mus musculus
ctttagtcctgtttggtacagatgg

SEQ ID NO: 102138 - DNA, 25 bp, mus musculus
tagtcctgtttggtacagatggcac

SEQ ID NO: 102139 - DNA, 25 bp, mus musculus
agtcctgtttggtacagatggcact

SEQ ID NO: 102140 - DNA, 25 bp, mus musculus
tggcactgacaatcccctttctggt

SEQ ID NO: 102141 - DNA, 25 bp, mus musculus
gcactgacaatcccctttctggtgg

SEQ ID NO: 102142 - DNA, 25 bp, mus musculus
tgtgctgtgtatggacgtgggcttt

SEQ ID NO: 102143 - DNA, 25 bp, mus musculus
gctttaccatgagtaactccattcc

SEQ ID NO: 102144 - DNA, 25 bp, mus musculus
ctttaccatgagtaactccattcct

SEQ ID NO: 102145 - DNA, 25 bp, mus musculus
tcctggtatagaatccccatttgaa

SEQ ID NO: 102146 - DNA, 25 bp, mus musculus
tggtatagaatccccatttgaacaa

SEQ ID NO: 102147 - DNA, 25 bp, mus musculus
tatagaatccccatttgaacaagca

SEQ ID NO: 102148 - DNA, 25 bp, mus musculus
tgataaccatgtttgtacagcgaca

SEQ ID NO: 102149 - DNA, 25 bp, mus musculus
aaccatgtttgtacagcgacaggtg

SEQ ID NO: 102150 - DNA, 25 bp, mus musculus
gcactagcctccaggttttacatcc

SEQ ID NO: 102151 - DNA, 25 bp, mus musculus
gcctccaggttttacatcccagagg

SEQ ID NO: 102152 - DNA, 25 bp, mus musculus
ttgaacccaaacaacatcttattga

SEQ ID NO: 102153 - DNA, 25 bp, mus musculus
aacccaaacaacatcttattgaatg

SEQ ID NO: 102154 - DNA, 25 bp, mus musculus
ccaaacaacatcttattgaatgata

SEQ ID NO: 102155 - DNA, 25 bp, mus musculus
ggacacattcagctaacgtatttta

SEQ ID NO: 102156 - DNA, 25 bp, mus musculus
cacattcagctaacgtattttagca

SEQ ID NO: 102157 - DNA, 25 bp, mus musculus
tattttagcaggtggagtgaggttg

SEQ ID NO: 102158 - DNA, 25 bp, mus musculus
gaagattcctgtgacagcgatgcca

SEQ ID NO: 102159 - DNA, 25 bp, mus musculus
gattcctgtgacagcgatgccatag

SEQ ID NO: 102160 - DNA, 25 bp, mus musculus
tcctgtgacagcgatgccatagaga

SEQ ID NO: 102161 - DNA, 25 bp, mus musculus
gacagcgatgccatagagagaatgt

SEQ ID NO: 102162 - DNA, 25 bp, mus musculus
ttttacatcccagagggctgcattc

SEQ ID NO: 102163 - DNA, 25 bp, mus musculus
tacatcccagagggctgcattcaaa

SEQ ID NO: 102164 - DNA, 25 bp, mus musculus
atcccagagggctgcattcaaagat

SEQ ID NO: 102165 - DNA, 25 bp, mus musculus
gtggtagcccttgatgctttacata

SEQ ID NO: 102166 - DNA, 25 bp, mus musculus
gtagcccttgatgctttacatagag

SEQ ID NO: 102167 - DNA, 25 bp, mus musculus
attgtgtgccgcgatttgaacccaa

SEQ ID NO: 102168 - DNA, 25 bp, mus musculus
tgccgcgatttgaacccaaacaaca

SEQ ID NO: 102169 - DNA, 25 bp, mus musculus
gatttgaacccaaacaacatcttat

SEQ ID NO: 102170 - DNA, 25 bp, mus musculus
ccactccatgaggtatttcttcaca

SEQ ID NO: 102171 - DNA, 25 bp, mus musculus
actccatgaggtatttcttcacatc

SEQ ID NO: 102172 - DNA, 25 bp, mus musculus
cgccgcgagccagaagatggagccg

SEQ ID NO: 102173 - DNA, 25 bp, mus musculus
aatatgaaggcccactcacagactg

SEQ ID NO: 102174 - DNA, 25 bp, mus musculus
atgaaggcccactcacagactgacc

SEQ ID NO: 102175 - DNA, 25 bp, mus musculus
tgaaggcccactcacagactgaccg

SEQ ID NO: 102176 - DNA, 25 bp, mus musculus
aggcccactcacagactgaccgagc

SEQ ID NO: 102177 - DNA, 25 bp, mus musculus
gcccactcacagactgaccgagcga

SEQ ID NO: 102178 - DNA, 25 bp, mus musculus
cccactcacagactgaccgagcgaa

SEQ ID NO: 102179 - DNA, 25 bp, mus musculus
cactcacagactgaccgagcgaacc

SEQ ID NO: 102180 - DNA, 25 bp, mus musculus
actcacagactgaccgagcgaacct

SEQ ID NO: 102181 - DNA, 25 bp, mus musculus
tcacagactgaccgagcgaacctgg

SEQ ID NO: 102182 - DNA, 25 bp, mus musculus
ggtatttcttcacatccgtgtcccg

SEQ ID NO: 102183 - DNA, 25 bp, mus musculus
gtatttcttcacatccgtgtcccgg

SEQ ID NO: 102184 - DNA, 25 bp, mus musculus
gcttcatcgccgtgggtacgtggac

SEQ ID NO: 102185 - DNA, 25 bp, mus musculus
catcgccgtgggtacgtggacgaca

SEQ ID NO: 102186 - DNA, 25 bp, mus musculus
gttcgacagcgacgccgcgagccag

SEQ ID NO: 102187 - DNA, 25 bp, mus musculus
agcgacgccgcgagccagaagatgg

SEQ ID NO: 102188 - DNA, 25 bp, mus musculus
cgacgccgcgagccagaagatggag

SEQ ID NO: 102189 - DNA, 25 bp, mus musculus
gacgccgcgagccagaagatggagc

SEQ ID NO: 102190 - DNA, 25 bp, mus musculus
ccacatccgcaatggcgtacacact

SEQ ID NO: 102191 - DNA, 25 bp, mus musculus
caatggcgtacacactcccatagac

SEQ ID NO: 102192 - DNA, 25 bp, mus musculus
tccaattgcaaaaccaactccaaag

SEQ ID NO: 102193 - DNA, 25 bp, mus musculus
aactccaaagttcggagctatgagt

SEQ ID NO: 102194 - DNA, 25 bp, mus musculus
acataaaatgctgactccaacaatt

SEQ ID NO: 102195 - DNA, 25 bp, mus musculus
aatgctgactccaacaattatcatt

SEQ ID NO: 102196 - DNA, 25 bp, mus musculus
gctgactccaacaattatcattccc

SEQ ID NO: 102197 - DNA, 25 bp, mus musculus
gactccaacaattatcattcccaga

SEQ ID NO: 102198 - DNA, 25 bp, mus musculus
aattatcattcccagaagagcacaa

SEQ ID NO: 102199 - DNA, 25 bp, mus musculus
tatcattcccagaagagcacaaagc

SEQ ID NO: 102200 - DNA, 25 bp, mus musculus
ccccattttgtgtgcaagtatccca

SEQ ID NO: 102201 - DNA, 25 bp, mus musculus
gatactagctggcaagaaggcaacg

SEQ ID NO: 102202 - DNA, 25 bp, mus musculus
catagacggacacgtgccgcagtct

SEQ ID NO: 102203 - DNA, 25 bp, mus musculus
acacgtgccgcagtctacgaggtag

SEQ ID NO: 102204 - DNA, 25 bp, mus musculus
gcagtctacgaggtagcccatgata

SEQ ID NO: 102205 - DNA, 25 bp, mus musculus
tacgaggtagcccatgataggcatc

SEQ ID NO: 102206 - DNA, 25 bp, mus musculus
catcattgacgaatccaccattcca

SEQ ID NO: 102207 - DNA, 25 bp, mus musculus
cgaatccaccattccaattgcaaaa

SEQ ID NO: 102208 - DNA, 25 bp, mus musculus
atccaccattccaattgcaaaacca

SEQ ID NO: 102209 - DNA, 25 bp, mus musculus
caccattccaattgcaaaaccaact

SEQ ID NO: 102210 - DNA, 25 bp, mus musculus
gttttctcatgcgcgtgtgcgtttt

SEQ ID NO: 102211 - DNA, 25 bp, mus musculus
tttctcatgcgcgtgtgcgttttcc

SEQ ID NO: 102212 - DNA, 25 bp, mus musculus
cggcaaccccagcggcttaagcatg

SEQ ID NO: 102213 - DNA, 25 bp, mus musculus
gcaaccccagcggcttaagcatggc

SEQ ID NO: 102214 - DNA, 25 bp, mus musculus
aaccccagcggcttaagcatggcgc

SEQ ID NO: 102215 - DNA, 25 bp, mus musculus
ccagcggcttaagcatggcgcttct

SEQ ID NO: 102216 - DNA, 25 bp, mus musculus
cggcttaagcatggcgcttctcacg

SEQ ID NO: 102217 - DNA, 25 bp, mus musculus
gcttaagcatggcgcttctcacggc

SEQ ID NO: 102218 - DNA, 25 bp, mus musculus
aagcatggcgcttctcacggcattc

SEQ ID NO: 102219 - DNA, 25 bp, mus musculus
atggcgcttctcacggcattcagca

SEQ ID NO: 102220 - DNA, 25 bp, mus musculus
ggcgcttctcacggcattcagcagc

SEQ ID NO: 102221 - DNA, 25 bp, mus musculus
acggcattcagcagcagcgttgctg

SEQ ID NO: 102222 - DNA, 25 bp, mus musculus
cagggtccacggccaccatggcgta

SEQ ID NO: 102223 - DNA, 25 bp, mus musculus
gggtccacggccaccatggcgtatt

SEQ ID NO: 102224 - DNA, 25 bp, mus musculus
ccacggccaccatggcgtattaggg

SEQ ID NO: 102225 - DNA, 25 bp, mus musculus
ggcctttgcagcggcggcacagcac

SEQ ID NO: 102226 - DNA, 25 bp, mus musculus
tttgcagcggcggcacagcaccagg

SEQ ID NO: 102227 - DNA, 25 bp, mus musculus
acagcaccaggctctgagcggcaac

SEQ ID NO: 102228 - DNA, 25 bp, mus musculus
agcaccaggctctgagcggcaaccc

SEQ ID NO: 102229 - DNA, 25 bp, mus musculus
agcggcaaccccagcggcttaagca

SEQ ID NO: 102230 - DNA, 25 bp, mus musculus
cgaacgaagcgtcccagccgattgt

SEQ ID NO: 102231 - DNA, 25 bp, mus musculus
cgaagcgtcccagccgattgtggaa

SEQ ID NO: 102232 - DNA, 25 bp, mus musculus
tgcagaaactggctctggaaagaca

SEQ ID NO: 102233 - DNA, 25 bp, mus musculus
cagaaactggctctggaaagacagg

SEQ ID NO: 102234 - DNA, 25 bp, mus musculus
aactggctctggaaagacaggcgcc

SEQ ID NO: 102235 - DNA, 25 bp, mus musculus
ctttgctttgcccattctaaacgca

SEQ ID NO: 102236 - DNA, 25 bp, mus musculus
ttgctttgcccattctaaacgcact

SEQ ID NO: 102237 - DNA, 25 bp, mus musculus
tttgcccattctaaacgcactgctg

SEQ ID NO: 102238 - DNA, 25 bp, mus musculus
tgcccattctaaacgcactgctgga

SEQ ID NO: 102239 - DNA, 25 bp, mus musculus
cattctaaacgcactgctggagacc

SEQ ID NO: 102240 - DNA, 25 bp, mus musculus
ttctaaacgcactgctggagacccc

SEQ ID NO: 102241 - DNA, 25 bp, mus musculus
aaacgcactgctggagaccccgcag

SEQ ID NO: 102242 - DNA, 25 bp, mus musculus
aagcgtcccagccgattgtggaaga

SEQ ID NO: 102243 - DNA, 25 bp, mus musculus
gtcccagccgattgtggaagaggag

SEQ ID NO: 102244 - DNA, 25 bp, mus musculus
cccagccgattgtggaagaggagga

SEQ ID NO: 102245 - DNA, 25 bp, mus musculus
atggacaaaacccaccaagatccag

SEQ ID NO: 102246 - DNA, 25 bp, mus musculus
ggacaaaacccaccaagatccagat

SEQ ID NO: 102247 - DNA, 25 bp, mus musculus
aacccaccaagatccagattgaagc

SEQ ID NO: 102248 - DNA, 25 bp, mus musculus
caccaagatccagattgaagctatt

SEQ ID NO: 102249 - DNA, 25 bp, mus musculus
tatcattgggcttgcagaaactggc

SEQ ID NO: 102250 - DNA, 25 bp, mus musculus
ccctctctcattctgtgatgggtat

SEQ ID NO: 102251 - DNA, 25 bp, mus musculus
ctctctcattctgtgatgggtatag

SEQ ID NO: 102252 - DNA, 25 bp, mus musculus
gaactctagactggacgcatcttct

SEQ ID NO: 102253 - DNA, 25 bp, mus musculus
actctagactggacgcatcttcttc

SEQ ID NO: 102254 - DNA, 25 bp, mus musculus
tagactggacgcatcttcttcctac

SEQ ID NO: 102255 - DNA, 25 bp, mus musculus
gactggacgcatcttcttcctactg

SEQ ID NO: 102256 - DNA, 25 bp, mus musculus
ctggacgcatcttcttcctactggc

SEQ ID NO: 102257 - DNA, 25 bp, mus musculus
tctgcctcccaaacacaataaatac

SEQ ID NO: 102258 - DNA, 25 bp, mus musculus
cctcccaaacacaataaatacatag

SEQ ID NO: 102259 - DNA, 25 bp, mus musculus
ccaaacacaataaatacatagttgc

SEQ ID NO: 102260 - DNA, 25 bp, mus musculus
taaatacatagttgcccaccagaaa

SEQ ID NO: 102261 - DNA, 25 bp, mus musculus
tacatagttgcccaccagaaaaaga

SEQ ID NO: 102262 - DNA, 25 bp, mus musculus
ctctcattctgtgatgggtatagca

SEQ ID NO: 102263 - DNA, 25 bp, mus musculus
tatagcagaaaccttcctgcttttc

SEQ ID NO: 102264 - DNA, 25 bp, mus musculus
tagcagaaaccttcctgcttttcac

SEQ ID NO: 102265 - DNA, 25 bp, mus musculus
cttcctgcttttcaccaggaactct

SEQ ID NO: 102266 - DNA, 25 bp, mus musculus
ctgcttttcaccaggaactctagac

SEQ ID NO: 102267 - DNA, 25 bp, mus musculus
gcttttcaccaggaactctagactg

SEQ ID NO: 102268 - DNA, 25 bp, mus musculus
ttttcaccaggaactctagactgga

SEQ ID NO: 102269 - DNA, 25 bp, mus musculus
ttcaccaggaactctagactggacg

SEQ ID NO: 102270 - DNA, 25 bp, mus musculus
caatttcaaggactatggagtcaac

SEQ ID NO: 102271 - DNA, 25 bp, mus musculus
ctgtgacaagctggcctcagaaata

SEQ ID NO: 102272 - DNA, 25 bp, mus musculus
catccgtgagcaccagatggcgaag

SEQ ID NO: 102273 - DNA, 25 bp, mus musculus
tgagcaccagatggcgaagacaggc

SEQ ID NO: 102274 - DNA, 25 bp, mus musculus
caccactgacctcttgcggtgtagc

SEQ ID NO: 102275 - DNA, 25 bp, mus musculus
tgacctcttgcggtgtagcaagtgc

SEQ ID NO: 102276 - DNA, 25 bp, mus musculus
ttgtacctataaccaggtgcagaca

SEQ ID NO: 102277 - DNA, 25 bp, mus musculus
ccaggtgcagacacgcagtgctgat

SEQ ID NO: 102278 - DNA, 25 bp, mus musculus
gcagacacgcagtgctgatgcgccc

SEQ ID NO: 102279 - DNA, 25 bp, mus musculus
tgctgatgcgcccatgaccactttt

SEQ ID NO: 102280 - DNA, 25 bp, mus musculus
catgaccacttttgtcttatgcaat

SEQ ID NO: 102281 - DNA, 25 bp, mus musculus
caggaagcacagaccacgtgaccca

SEQ ID NO: 102282 - DNA, 25 bp, mus musculus
ccatatctatcaagaactcaagagc

SEQ ID NO: 102283 - DNA, 25 bp, mus musculus
ctatcaagaactcaagagcacagac

SEQ ID NO: 102284 - DNA, 25 bp, mus musculus
agaactcaagagcacagacatgaag

SEQ ID NO: 102285 - DNA, 25 bp, mus musculus
catgaagtaccggaaccgtgtgcgc

SEQ ID NO: 102286 - DNA, 25 bp, mus musculus
tgtgcgcagccgcatcagcaacctg

SEQ ID NO: 102287 - DNA, 25 bp, mus musculus
catctccccagagctcattgccaag

SEQ ID NO: 102288 - DNA, 25 bp, mus musculus
cccagagctcattgccaagatgaca

SEQ ID NO: 102289 - DNA, 25 bp, mus musculus
gctcattgccaagatgacagcggag

SEQ ID NO: 102290 - DNA, 25 bp, mus musculus
atttcataccagtggctacgacaca

SEQ ID NO: 102291 - DNA, 25 bp, mus musculus
tggctacgacacacaagctgttgtc

SEQ ID NO: 102292 - DNA, 25 bp, mus musculus
gcttgaacagtggcgttgtgagaag

SEQ ID NO: 102293 - DNA, 25 bp, mus musculus
tgccccgtggtcaggaatgcctctt

SEQ ID NO: 102294 - DNA, 25 bp, mus musculus
gatgatctgcctctgagccttgtac

SEQ ID NO: 102295 - DNA, 25 bp, mus musculus
ctgcctctgagccttgtaccctgta

SEQ ID NO: 102296 - DNA, 25 bp, mus musculus
cttgtaccctgtagtgacaccaccg

SEQ ID NO: 102297 - DNA, 25 bp, mus musculus
ccctgtagtgacaccaccggactct

SEQ ID NO: 102298 - DNA, 25 bp, mus musculus
agtgacaccaccggactctagagga

SEQ ID NO: 102299 - DNA, 25 bp, mus musculus
gactggcgcactggactgcaaaccc

SEQ ID NO: 102300 - DNA, 25 bp, mus musculus
ggactgcaaacccttgcttagtgac

SEQ ID NO: 102301 - DNA, 25 bp, mus musculus
tgtcccaaataaagggccagacttg

SEQ ID NO: 102302 - DNA, 25 bp, mus musculus
cgacacacaagctgttgtcaacgac

SEQ ID NO: 102303 - DNA, 25 bp, mus musculus
caacggcagcacagagtacggactc

SEQ ID NO: 102304 - DNA, 25 bp, mus musculus
agagtacggactcttccagatcagt

SEQ ID NO: 102305 - DNA, 25 bp, mus musculus
cggactcttccagatcagtgacaga

SEQ ID NO: 102306 - DNA, 25 bp, mus musculus
gaacatctgtggcatctcctgtgac

SEQ ID NO: 102307 - DNA, 25 bp, mus musculus
catctcctgtgacaagttattggat

SEQ ID NO: 102308 - DNA, 25 bp, mus musculus
gaaagcctacaagcccatgtgctct

SEQ ID NO: 102309 - DNA, 25 bp, mus musculus
ctacaagcccatgtgctctgagaag

SEQ ID NO: 102310 - DNA, 25 bp, mus musculus
cccataccatcgcggtcaccatggg

SEQ ID NO: 102311 - DNA, 25 bp, mus musculus
ataccatcgcggtcaccatggggaa

SEQ ID NO: 102312 - DNA, 25 bp, mus musculus
acaactaccaggactgcactttctt

SEQ ID NO: 102313 - DNA, 25 bp, mus musculus
actaccaggactgcactttcttcaa

SEQ ID NO: 102314 - DNA, 25 bp, mus musculus
accaggactgcactttcttcaataa

SEQ ID NO: 102315 - DNA, 25 bp, mus musculus
actgcactttcttcaataagaagga

SEQ ID NO: 102316 - DNA, 25 bp, mus musculus
gcactttcttcaataagaaggacat

SEQ ID NO: 102317 - DNA, 25 bp, mus musculus
agaaggacatcctcaagcttcatgc

SEQ ID NO: 102318 - DNA, 25 bp, mus musculus
acatcctcaagcttcatgcacggtt

SEQ ID NO: 102319 - DNA, 25 bp, mus musculus
tcctcaagcttcatgcacggttcta

SEQ ID NO: 102320 - DNA, 25 bp, mus musculus
tcaagcttcatgcacggttctatga

SEQ ID NO: 102321 - DNA, 25 bp, mus musculus
ttcatgcacggttctatgagctggc

SEQ ID NO: 102322 - DNA, 25 bp, mus musculus
ccatcgcggtcaccatggggaacaa

SEQ ID NO: 102323 - DNA, 25 bp, mus musculus
cggtcaccatggggaacaagcagac

SEQ ID NO: 102324 - DNA, 25 bp, mus musculus
ggaacaagcagaccatcttcactga

SEQ ID NO: 102325 - DNA, 25 bp, mus musculus
acaagcagaccatcttcactgaaga

SEQ ID NO: 102326 - DNA, 25 bp, mus musculus
agcagaccatcttcactgaagagca

SEQ ID NO: 102327 - DNA, 25 bp, mus musculus
tcttcactgaagagcagctggacaa

SEQ ID NO: 102328 - DNA, 25 bp, mus musculus
agcagctggacaactaccaggactg

SEQ ID NO: 102329 - DNA, 25 bp, mus musculus
agctggacaactaccaggactgcac

SEQ ID NO: 102330 - DNA, 25 bp, mus musculus
agacttcgcgcaattcccaccaaca

SEQ ID NO: 102331 - DNA, 25 bp, mus musculus
cttcgcgcaattcccaccaacaagg

SEQ ID NO: 102332 - DNA, 25 bp, mus musculus
ttgggtgtccatctcagctttatca

SEQ ID NO: 102333 - DNA, 25 bp, mus musculus
ggtgtccatctcagctttatcaggt

SEQ ID NO: 102334 - DNA, 25 bp, mus musculus
catctcagctttatcaggtccacag

SEQ ID NO: 102335 - DNA, 25 bp, mus musculus
atcaggtccacagagttggattcga

SEQ ID NO: 102336 - DNA, 25 bp, mus musculus
gattcgaactggagctggttgcagc

SEQ ID NO: 102337 - DNA, 25 bp, mus musculus
aactggagctggttgcagctgaggt

SEQ ID NO: 102338 - DNA, 25 bp, mus musculus
agctggttgcagctgaggtgtatgc

SEQ ID NO: 102339 - DNA, 25 bp, mus musculus
tgtatgcaggtcggcgggaatgcca

SEQ ID NO: 102340 - DNA, 25 bp, mus musculus
aatgccaatgcgactgcttttttcc

SEQ ID NO: 102341 - DNA, 25 bp, mus musculus
gcgactgcttttttccgccaacacg

SEQ ID NO: 102342 - DNA, 25 bp, mus musculus
gccaagagtcctagttgggccagca

SEQ ID NO: 102343 - DNA, 25 bp, mus musculus
tttttccgccaacacggatgtatgg

SEQ ID NO: 102344 - DNA, 25 bp, mus musculus
agtcctagttgggccagcatcactt

SEQ ID NO: 102345 - DNA, 25 bp, mus musculus
agttgggccagcatcacttacggtg

SEQ ID NO: 102346 - DNA, 25 bp, mus musculus
tgggccagcatcacttacggtgtat

SEQ ID NO: 102347 - DNA, 25 bp, mus musculus
gccagcatcacttacggtgtatttt

SEQ ID NO: 102348 - DNA, 25 bp, mus musculus
attgactgctccggagtgcatcgct

SEQ ID NO: 102349 - DNA, 25 bp, mus musculus
catcgctccttgggtgtccatctca

SEQ ID NO: 102350 - DNA, 25 bp, mus musculus
tccttgggtgtccatctcagcttta

SEQ ID NO: 102351 - DNA, 25 bp, mus musculus
tcaataagcttccatgatgataaag

SEQ ID NO: 102352 - DNA, 25 bp, mus musculus
taagcttccatgatgataaagagat

SEQ ID NO: 102353 - DNA, 25 bp, mus musculus
ttcaggtgtcccagcaggaagacat

SEQ ID NO: 102354 - DNA, 25 bp, mus musculus
caggtgtcccagcaggaagacatta

SEQ ID NO: 102355 - DNA, 25 bp, mus musculus
ggtgtcccagcaggaagacattacc

SEQ ID NO: 102356 - DNA, 25 bp, mus musculus
aagacattaccaagtcactcttggt

SEQ ID NO: 102357 - DNA, 25 bp, mus musculus
gacattaccaagtcactcttggtga

SEQ ID NO: 102358 - DNA, 25 bp, mus musculus
cattaccaagtcactcttggtgacc

SEQ ID NO: 102359 - DNA, 25 bp, mus musculus
ttaccaagtcactcttggtgaccga

SEQ ID NO: 102360 - DNA, 25 bp, mus musculus
agtcactcttggtgaccgagttggg

SEQ ID NO: 102361 - DNA, 25 bp, mus musculus
tcactcttggtgaccgagttgggct

SEQ ID NO: 102362 - DNA, 25 bp, mus musculus
ttggtgaccgagttgggctcgtcca

SEQ ID NO: 102363 - DNA, 25 bp, mus musculus
ttgtgtacaactgtgagggagataa

SEQ ID NO: 102364 - DNA, 25 bp, mus musculus
gtgaccgagttgggctcgtccagaa

SEQ ID NO: 102365 - DNA, 25 bp, mus musculus
taagatgtacaccgggcagaaaagg

SEQ ID NO: 102366 - DNA, 25 bp, mus musculus
cttttgtaacggtcagaagcttcag

SEQ ID NO: 102367 - DNA, 25 bp, mus musculus
taacggtcagaagcttcaggtgtcc

SEQ ID NO: 102368 - DNA, 25 bp, mus musculus
acggtcagaagcttcaggtgtccca

SEQ ID NO: 102369 - DNA, 25 bp, mus musculus
agaagcttcaggtgtcccagcagga

SEQ ID NO: 102370 - DNA, 25 bp, mus musculus
aagcttcaggtgtcccagcaggaag

SEQ ID NO: 102371 - DNA, 25 bp, mus musculus
gcttcaggtgtcccagcaggaagac

SEQ ID NO: 102372 - DNA, 25 bp, mus musculus
gggacagccacgccgatgaccccga

SEQ ID NO: 102373 - DNA, 25 bp, mus musculus
gacagccacgccgatgaccccgaaa

SEQ ID NO: 102374 - DNA, 25 bp, mus musculus
cacagatgttcaaccagctgatgaa

SEQ ID NO: 102375 - DNA, 25 bp, mus musculus
cagatgttcaaccagctgatgaagc

SEQ ID NO: 102376 - DNA, 25 bp, mus musculus
tgttcaaccagctgatgaagcaagt

SEQ ID NO: 102377 - DNA, 25 bp, mus musculus
ttcaaccagctgatgaagcaagtgt

SEQ ID NO: 102378 - DNA, 25 bp, mus musculus
caaccagctgatgaagcaagtgtcg

SEQ ID NO: 102379 - DNA, 25 bp, mus musculus
agcaagtgtcggctcttacggtaga

SEQ ID NO: 102380 - DNA, 25 bp, mus musculus
caagtgtcggctcttacggtagaca

SEQ ID NO: 102381 - DNA, 25 bp, mus musculus
agtgtcggctcttacggtagacacg

SEQ ID NO: 102382 - DNA, 25 bp, mus musculus
tgtcggctcttacggtagacacgga

SEQ ID NO: 102383 - DNA, 25 bp, mus musculus
tcggctcttacggtagacacggagg

SEQ ID NO: 102384 - DNA, 25 bp, mus musculus
cgccgatgaccccgaaagcattaag

SEQ ID NO: 102385 - DNA, 25 bp, mus musculus
gatgaccccgaaagcattaagactc

SEQ ID NO: 102386 - DNA, 25 bp, mus musculus
tgaccccgaaagcattaagactcag

SEQ ID NO: 102387 - DNA, 25 bp, mus musculus
gaataaactgacaccacagatgttc

SEQ ID NO: 102388 - DNA, 25 bp, mus musculus
aaactgacaccacagatgttcaacc

SEQ ID NO: 102389 - DNA, 25 bp, mus musculus
actgacaccacagatgttcaaccag

SEQ ID NO: 102390 - DNA, 25 bp, mus musculus
acaccacagatgttcaaccagctga

SEQ ID NO: 102391 - DNA, 25 bp, mus musculus
accacagatgttcaaccagctgatg

SEQ ID NO: 102392 - DNA, 25 bp, mus musculus
cggacacgtagattccggcagagtc

SEQ ID NO: 102393 - DNA, 25 bp, mus musculus
ggacacgtagattccggcagagtca

SEQ ID NO: 102394 - DNA, 25 bp, mus musculus
aagctgaacgtgactggcgtatcag

SEQ ID NO: 102395 - DNA, 25 bp, mus musculus
gaacgtgactggcgtatcagtattg

SEQ ID NO: 102396 - DNA, 25 bp, mus musculus
aacgtgactggcgtatcagtattga

SEQ ID NO: 102397 - DNA, 25 bp, mus musculus
acgtgactggcgtatcagtattgag

SEQ ID NO: 102398 - DNA, 25 bp, mus musculus
aattcgagaccagcagtactatgtg

SEQ ID NO: 102399 - DNA, 25 bp, mus musculus
attcgagaccagcagtactatgtga

SEQ ID NO: 102400 - DNA, 25 bp, mus musculus
ttcgagaccagcagtactatgtgac

SEQ ID NO: 102401 - DNA, 25 bp, mus musculus
tcgagaccagcagtactatgtgacc

SEQ ID NO: 102402 - DNA, 25 bp, mus musculus
gagaccagcagtactatgtgaccat

SEQ ID NO: 102403 - DNA, 25 bp, mus musculus
agaccagcagtactatgtgaccatc

SEQ ID NO: 102404 - DNA, 25 bp, mus musculus
gacacgtagattccggcagagtcac

SEQ ID NO: 102405 - DNA, 25 bp, mus musculus
acacgtagattccggcagagtcacg

SEQ ID NO: 102406 - DNA, 25 bp, mus musculus
acgtagattccggcagagtcacgag

SEQ ID NO: 102407 - DNA, 25 bp, mus musculus
cgtagattccggcagagtcacgaga

SEQ ID NO: 102408 - DNA, 25 bp, mus musculus
gtagattccggcagagtcacgagaa

SEQ ID NO: 102409 - DNA, 25 bp, mus musculus
attccggcagagtcacgagaaccgg

SEQ ID NO: 102410 - DNA, 25 bp, mus musculus
gagtcacgagaaccggccacctgat

SEQ ID NO: 102411 - DNA, 25 bp, mus musculus
agtcacgagaaccggccacctgatc

SEQ ID NO: 102412 - DNA, 25 bp, mus musculus
cgagctctgagcactggatagcgat

SEQ ID NO: 102413 - DNA, 25 bp, mus musculus
gagctctgagcactggatagcgatg

SEQ ID NO: 102414 - DNA, 25 bp, mus musculus
aaatgcgtcacgcacatacaaacac

SEQ ID NO: 102415 - DNA, 25 bp, mus musculus
aatgcgtcacgcacatacaaacacg

SEQ ID NO: 102416 - DNA, 25 bp, mus musculus
atgcgtcacgcacatacaaacacgt

SEQ ID NO: 102417 - DNA, 25 bp, mus musculus
tgcgtcacgcacatacaaacacgtt

SEQ ID NO: 102418 - DNA, 25 bp, mus musculus
gcgtcacgcacatacaaacacgttt

SEQ ID NO: 102419 - DNA, 25 bp, mus musculus
cgtcacgcacatacaaacacgtttc

SEQ ID NO: 102420 - DNA, 25 bp, mus musculus
gtcacgcacatacaaacacgtttcc

SEQ ID NO: 102421 - DNA, 25 bp, mus musculus
tcacgcacatacaaacacgtttccc

SEQ ID NO: 102422 - DNA, 25 bp, mus musculus
cacgcacatacaaacacgtttccca

SEQ ID NO: 102423 - DNA, 25 bp, mus musculus
cgcacatacaaacacgtttcccaat

SEQ ID NO: 102424 - DNA, 25 bp, mus musculus
agctctgagcactggatagcgatga

SEQ ID NO: 102425 - DNA, 25 bp, mus musculus
gcacatacaaacacgtttcccaatc

SEQ ID NO: 102426 - DNA, 25 bp, mus musculus
gctctgagcactggatagcgatgat

SEQ ID NO: 102427 - DNA, 25 bp, mus musculus
cggcaagtccatctacggagatagg

SEQ ID NO: 102428 - DNA, 25 bp, mus musculus
ggcatcttgtccatgagaaatgcgt

SEQ ID NO: 102429 - DNA, 25 bp, mus musculus
gcatcttgtccatgagaaatgcgtc

SEQ ID NO: 102430 - DNA, 25 bp, mus musculus
catcttgtccatgagaaatgcgtca

SEQ ID NO: 102431 - DNA, 25 bp, mus musculus
atcttgtccatgagaaatgcgtcac

SEQ ID NO: 102432 - DNA, 25 bp, mus musculus
gaaatgcgtcacgcacatacaaaca

SEQ ID NO: 102433 - DNA, 25 bp, mus musculus
cagtccccgggagcatcagtccgcg

SEQ ID NO: 102434 - DNA, 25 bp, mus musculus
ccaggtgcgaccaagcctgacgcgg

SEQ ID NO: 102435 - DNA, 25 bp, mus musculus
gccacagttcggtgacgagtatgat

SEQ ID NO: 102436 - DNA, 25 bp, mus musculus
ggagtttccctgccttccaggcatt

SEQ ID NO: 102437 - DNA, 25 bp, mus musculus
tttccctgccttccaggcattctgt

SEQ ID NO: 102438 - DNA, 25 bp, mus musculus
tccctgccttccaggcattctgtga

SEQ ID NO: 102439 - DNA, 25 bp, mus musculus
ccttccaggcattctgtgagacaca

SEQ ID NO: 102440 - DNA, 25 bp, mus musculus
ttccaggcattctgtgagacacaag

SEQ ID NO: 102441 - DNA, 25 bp, mus musculus
gcattctgtgagacacaaggagaca

SEQ ID NO: 102442 - DNA, 25 bp, mus musculus
ctgcagtgcatgagtcgtgtaatgc

SEQ ID NO: 102443 - DNA, 25 bp, mus musculus
cagtagcatggctgtcgcagcaaca

SEQ ID NO: 102444 - DNA, 25 bp, mus musculus
agcatggctgtcgcagcaacatcaa

SEQ ID NO: 102445 - DNA, 25 bp, mus musculus
aggtgcgaccaagcctgacgcggag

SEQ ID NO: 102446 - DNA, 25 bp, mus musculus
catggctgtcgcagcaacatcaaaa

SEQ ID NO: 102447 - DNA, 25 bp, mus musculus
gtgcgaccaagcctgacgcggagat

SEQ ID NO: 102448 - DNA, 25 bp, mus musculus
gaccaagcctgacgcggagatggta

SEQ ID NO: 102449 - DNA, 25 bp, mus musculus
ccaagcctgacgcggagatggtact

SEQ ID NO: 102450 - DNA, 25 bp, mus musculus
gatgcagacagcttcgtaaagtttg

SEQ ID NO: 102451 - DNA, 25 bp, mus musculus
gtttgcacttgggtcggtagtggca

SEQ ID NO: 102452 - DNA, 25 bp, mus musculus
gcacttgggtcggtagtggcagtta

SEQ ID NO: 102453 - DNA, 25 bp, mus musculus
ctgccacagttcggtgacgagtatg

SEQ ID NO: 102454 - DNA, 25 bp, mus musculus
gtcaacatcttgtattggtgttaga

SEQ ID NO: 102455 - DNA, 25 bp, mus musculus
acaaggacctgcaaaagctgccttg

SEQ ID NO: 102456 - DNA, 25 bp, mus musculus
gatcacagaataccttctatgtgct

SEQ ID NO: 102457 - DNA, 25 bp, mus musculus
cacagaataccttctatgtgctaaa

SEQ ID NO: 102458 - DNA, 25 bp, mus musculus
ccttctatgtgctaaaccctcacag

SEQ ID NO: 102459 - DNA, 25 bp, mus musculus
tctatgtgctaaaccctcacagtaa

SEQ ID NO: 102460 - DNA, 25 bp, mus musculus
taaaccctcacagtaacctgtcgag

SEQ ID NO: 102461 - DNA, 25 bp, mus musculus
accctcacagtaacctgtcgagcac

SEQ ID NO: 102462 - DNA, 25 bp, mus musculus
acagtaacctgtcgagcacagagga

SEQ ID NO: 102463 - DNA, 25 bp, mus musculus
acctgtcgagcacagaggagagatt

SEQ ID NO: 102464 - DNA, 25 bp, mus musculus
gatttcgagccagttttagcagtga

SEQ ID NO: 102465 - DNA, 25 bp, mus musculus
ttcgagccagttttagcagtgaaac

SEQ ID NO: 102466 - DNA, 25 bp, mus musculus
acctgcaaaagctgccttgggaaag

SEQ ID NO: 102467 - DNA, 25 bp, mus musculus
tgcaaaagctgccttgggaaagcac

SEQ ID NO: 102468 - DNA, 25 bp, mus musculus
cttcctgctcagctacacagtcact

SEQ ID NO: 102469 - DNA, 25 bp, mus musculus
gctcagctacacagtcactagagag

SEQ ID NO: 102470 - DNA, 25 bp, mus musculus
ctacacagtcactagagaggctgga

SEQ ID NO: 102471 - DNA, 25 bp, mus musculus
cacagtcactagagaggctggagct

SEQ ID NO: 102472 - DNA, 25 bp, mus musculus
agtcactagagaggctggagctcat

SEQ ID NO: 102473 - DNA, 25 bp, mus musculus
gttgatcacagaataccttctatgt

SEQ ID NO: 102474 - DNA, 25 bp, mus musculus
tctatctctgtctcttcctatggat

SEQ ID NO: 102475 - DNA, 25 bp, mus musculus
tatctctgtctcttcctatggatca

SEQ ID NO: 102476 - DNA, 25 bp, mus musculus
gcgaaactacatttctattgggcag

SEQ ID NO: 102477 - DNA, 25 bp, mus musculus
cgaaactacatttctattgggcagt

SEQ ID NO: 102478 - DNA, 25 bp, mus musculus
aaactacatttctattgggcagtgt

SEQ ID NO: 102479 - DNA, 25 bp, mus musculus
aactacatttctattgggcagtgtt

SEQ ID NO: 102480 - DNA, 25 bp, mus musculus
actacatttctattgggcagtgttt

SEQ ID NO: 102481 - DNA, 25 bp, mus musculus
tacatttctattgggcagtgtttct

SEQ ID NO: 102482 - DNA, 25 bp, mus musculus
acatttctattgggcagtgtttcta

SEQ ID NO: 102483 - DNA, 25 bp, mus musculus
catttctattgggcagtgtttctaa

SEQ ID NO: 102484 - DNA, 25 bp, mus musculus
tttctattgggcagtgtttctaaag

SEQ ID NO: 102485 - DNA, 25 bp, mus musculus
ttctattgggcagtgtttctaaagg

SEQ ID NO: 102486 - DNA, 25 bp, mus musculus
atctctgtctcttcctatggatcag

SEQ ID NO: 102487 - DNA, 25 bp, mus musculus
tctctgtctcttcctatggatcaga

SEQ ID NO: 102488 - DNA, 25 bp, mus musculus
tcttcctatggatcagatcaggata

SEQ ID NO: 102489 - DNA, 25 bp, mus musculus
ttcctatggatcagatcaggatata

SEQ ID NO: 102490 - DNA, 25 bp, mus musculus
ttctcaatatgtggctacaaagcaa

SEQ ID NO: 102491 - DNA, 25 bp, mus musculus
aatattagcacatgtaggcgaaact

SEQ ID NO: 102492 - DNA, 25 bp, mus musculus
atattagcacatgtaggcgaaacta

SEQ ID NO: 102493 - DNA, 25 bp, mus musculus
tattagcacatgtaggcgaaactac

SEQ ID NO: 102494 - DNA, 25 bp, mus musculus
gctgcctttccttctggaatgctgc

SEQ ID NO: 102495 - DNA, 25 bp, mus musculus
gcctttccttctggaatgctgcaat

SEQ ID NO: 102496 - DNA, 25 bp, mus musculus
tctccagtctgcccctgatttttga

SEQ ID NO: 102497 - DNA, 25 bp, mus musculus
tgcccctgatttttgaaacattgtt

SEQ ID NO: 102498 - DNA, 25 bp, mus musculus
ccccaaattatcgagactccaacag

SEQ ID NO: 102499 - DNA, 25 bp, mus musculus
caaattatcgagactccaacagtag

SEQ ID NO: 102500 - DNA, 25 bp, mus musculus
attatcgagactccaacagtagccc

SEQ ID NO: 102501 - DNA, 25 bp, mus musculus
gagactccaacagtagcccttgagg

SEQ ID NO: 102502 - DNA, 25 bp, mus musculus
actccaacagtagcccttgaggcgt

SEQ ID NO: 102503 - DNA, 25 bp, mus musculus
gtagcccttgaggcgtttatcttct

SEQ ID NO: 102504 - DNA, 25 bp, mus musculus
gcgtttatcttctggcctggtttat

SEQ ID NO: 102505 - DNA, 25 bp, mus musculus
tttatcttctggcctggtttataga

SEQ ID NO: 102506 - DNA, 25 bp, mus musculus
ccttctggaatgctgcaattaggag

SEQ ID NO: 102507 - DNA, 25 bp, mus musculus
tcactatgccctgtttatatagtgc

SEQ ID NO: 102508 - DNA, 25 bp, mus musculus
ctatgccctgtttatatagtgctgg

SEQ ID NO: 102509 - DNA, 25 bp, mus musculus
atgccagatgagcactctaccaact

SEQ ID NO: 102510 - DNA, 25 bp, mus musculus
gatgagcactctaccaactaagcca

SEQ ID NO: 102511 - DNA, 25 bp, mus musculus
accaactaagccacatctccagtct

SEQ ID NO: 102512 - DNA, 25 bp, mus musculus
aactaagccacatctccagtctgcc

SEQ ID NO: 102513 - DNA, 25 bp, mus musculus
acatctccagtctgcccctgatttt

SEQ ID NO: 102514 - DNA, 25 bp, mus musculus
ccattaggtcacactgagagtactg

SEQ ID NO: 102515 - DNA, 25 bp, mus musculus
acaatcactgtgtgataggaagaag

SEQ ID NO: 102516 - DNA, 25 bp, mus musculus
ctgcctgctttgctgtgagagtctc

SEQ ID NO: 102517 - DNA, 25 bp, mus musculus
cctgctttgctgtgagagtctcatg

SEQ ID NO: 102518 - DNA, 25 bp, mus musculus
ttgctgtgagagtctcatggctccc

SEQ ID NO: 102519 - DNA, 25 bp, mus musculus
tgagagtctcatggctccctgatgg

SEQ ID NO: 102520 - DNA, 25 bp, mus musculus
catggctccctgatggttgtggaag

SEQ ID NO: 102521 - DNA, 25 bp, mus musculus
ctgctaactctgagtccaaaggatg

SEQ ID NO: 102522 - DNA, 25 bp, mus musculus
ctaactctgagtccaaaggatgcca

SEQ ID NO: 102523 - DNA, 25 bp, mus musculus
actctgagtccaaaggatgccagga

SEQ ID NO: 102524 - DNA, 25 bp, mus musculus
caatatcccaacaattgcttccctg

SEQ ID NO: 102525 - DNA, 25 bp, mus musculus
tgcttccctgatggtaactgagtcc

SEQ ID NO: 102526 - DNA, 25 bp, mus musculus
ctctccatcaccgtttatctctcaa

SEQ ID NO: 102527 - DNA, 25 bp, mus musculus
atcaccgtttatctctcaatctatg

SEQ ID NO: 102528 - DNA, 25 bp, mus musculus
accgtttatctctcaatctatgaac

SEQ ID NO: 102529 - DNA, 25 bp, mus musculus
tcaatctatgaacctgtgagagcaa

SEQ ID NO: 102530 - DNA, 25 bp, mus musculus
atctatgaacctgtgagagcaatca

SEQ ID NO: 102531 - DNA, 25 bp, mus musculus
catatctcgcctggcctagcttgtt

SEQ ID NO: 102532 - DNA, 25 bp, mus musculus
ggcctagcttgtttagccaaggatg

SEQ ID NO: 102533 - DNA, 25 bp, mus musculus
tgtttagccaaggatggcaggacag

SEQ ID NO: 102534 - DNA, 25 bp, mus musculus
gttatgcatcactgcatgtcatcat

SEQ ID NO: 102535 - DNA, 25 bp, mus musculus
tatgcatcactgcatgtcatcatgc

SEQ ID NO: 102536 - DNA, 25 bp, mus musculus
gaagatcgtcactgtgcgaggatat

SEQ ID NO: 102537 - DNA, 25 bp, mus musculus
atcgtcactgtgcgaggatattctt

SEQ ID NO: 102538 - DNA, 25 bp, mus musculus
cgtcactgtgcgaggatattctttg

SEQ ID NO: 102539 - DNA, 25 bp, mus musculus
taaattgttcgtgatcatgaagaca

SEQ ID NO: 102540 - DNA, 25 bp, mus musculus
agacacactgtgttatgtcgactgg

SEQ ID NO: 102541 - DNA, 25 bp, mus musculus
acacactgtgttatgtcgactggat

SEQ ID NO: 102542 - DNA, 25 bp, mus musculus
actgtgttatgtcgactggattttg

SEQ ID NO: 102543 - DNA, 25 bp, mus musculus
ttatgtcgactggattttgagaacg

SEQ ID NO: 102544 - DNA, 25 bp, mus musculus
tgattttcgtatctctagagaagac

SEQ ID NO: 102545 - DNA, 25 bp, mus musculus
attttcgtatctctagagaagactg

SEQ ID NO: 102546 - DNA, 25 bp, mus musculus
tgcatcactgcatgtcatcatgcgc

SEQ ID NO: 102547 - DNA, 25 bp, mus musculus
tttcgtatctctagagaagactgtg

SEQ ID NO: 102548 - DNA, 25 bp, mus musculus
catcactgcatgtcatcatgcgcct

SEQ ID NO: 102549 - DNA, 25 bp, mus musculus
tgcatgtcatcatgcgcctggatat

SEQ ID NO: 102550 - DNA, 25 bp, mus musculus
tggtcaggactcactgattacctga

SEQ ID NO: 102551 - DNA, 25 bp, mus musculus
gtcaggactcactgattacctgatg

SEQ ID NO: 102552 - DNA, 25 bp, mus musculus
caggactcactgattacctgatgaa

SEQ ID NO: 102553 - DNA, 25 bp, mus musculus
ggactcactgattacctgatgaaga

SEQ ID NO: 102554 - DNA, 25 bp, mus musculus
atgaagatcgtcactgtgcgaggat

SEQ ID NO: 102555 - DNA, 25 bp, mus musculus
tgaggtcagacccagacgagaacag

SEQ ID NO: 102556 - DNA, 25 bp, mus musculus
gagacaaggccaccggcgtatcact

SEQ ID NO: 102557 - DNA, 25 bp, mus musculus
ctacagctagtgtcacttgtgaggg

SEQ ID NO: 102558 - DNA, 25 bp, mus musculus
tacagctagtgtcacttgtgagggc

SEQ ID NO: 102559 - DNA, 25 bp, mus musculus
ctagtgtcacttgtgagggctgaaa

SEQ ID NO: 102560 - DNA, 25 bp, mus musculus
tagtgtcacttgtgagggctgaaag

SEQ ID NO: 102561 - DNA, 25 bp, mus musculus
ccgtcgcggcacatccagaacaatc

SEQ ID NO: 102562 - DNA, 25 bp, mus musculus
cgtcgcggcacatccagaacaatct

SEQ ID NO: 102563 - DNA, 25 bp, mus musculus
cgcggcacatccagaacaatctcca

SEQ ID NO: 102564 - DNA, 25 bp, mus musculus
cggcacatccagaacaatctccatc

SEQ ID NO: 102565 - DNA, 25 bp, mus musculus
ggcacatccagaacaatctccatcc

SEQ ID NO: 102566 - DNA, 25 bp, mus musculus
tattcctggaagtatcacagctggc

SEQ ID NO: 102567 - DNA, 25 bp, mus musculus
acaaggccaccggcgtatcactaca

SEQ ID NO: 102568 - DNA, 25 bp, mus musculus
aaggccaccggcgtatcactacagc

SEQ ID NO: 102569 - DNA, 25 bp, mus musculus
gccaccggcgtatcactacagctag

SEQ ID NO: 102570 - DNA, 25 bp, mus musculus
ccaccggcgtatcactacagctagt

SEQ ID NO: 102571 - DNA, 25 bp, mus musculus
accggcgtatcactacagctagtgt

SEQ ID NO: 102572 - DNA, 25 bp, mus musculus
ggcgtatcactacagctagtgtcac

SEQ ID NO: 102573 - DNA, 25 bp, mus musculus
tatcactacagctagtgtcacttgt

SEQ ID NO: 102574 - DNA, 25 bp, mus musculus
cactacagctagtgtcacttgtgag

SEQ ID NO: 102575 - DNA, 25 bp, mus musculus
agctttgctgattacagtgttagag

SEQ ID NO: 102576 - DNA, 25 bp, mus musculus
gagttactactgtgttctgcggcac

SEQ ID NO: 102577 - DNA, 25 bp, mus musculus
ggcactcctttacacactcaggagg

SEQ ID NO: 102578 - DNA, 25 bp, mus musculus
cactcctttacacactcaggaggca

SEQ ID NO: 102579 - DNA, 25 bp, mus musculus
ctcctttacacactcaggaggcaga

SEQ ID NO: 102580 - DNA, 25 bp, mus musculus
cctttacacactcaggaggcagagg

SEQ ID NO: 102581 - DNA, 25 bp, mus musculus
tttacacactcaggaggcagaggca

SEQ ID NO: 102582 - DNA, 25 bp, mus musculus
tacacactcaggaggcagaggcagg

SEQ ID NO: 102583 - DNA, 25 bp, mus musculus
ggccagcctggtctacaaaacaagt

SEQ ID NO: 102584 - DNA, 25 bp, mus musculus
gtctacaaaacaagttccaggacag

SEQ ID NO: 102585 - DNA, 25 bp, mus musculus
tacaaaacaagttccaggacagcca

SEQ ID NO: 102586 - DNA, 25 bp, mus musculus
cctgtctcaacaaacaaacaaacag

SEQ ID NO: 102587 - DNA, 25 bp, mus musculus
gttactactgtgttctgcggcactc

SEQ ID NO: 102588 - DNA, 25 bp, mus musculus
ctactgtgttctgcggcactccttt

SEQ ID NO: 102589 - DNA, 25 bp, mus musculus
actgtgttctgcggcactcctttac

SEQ ID NO: 102590 - DNA, 25 bp, mus musculus
tgtgttctgcggcactcctttacac

SEQ ID NO: 102591 - DNA, 25 bp, mus musculus
tgttctgcggcactcctttacacac

SEQ ID NO: 102592 - DNA, 25 bp, mus musculus
ttctgcggcactcctttacacactc

SEQ ID NO: 102593 - DNA, 25 bp, mus musculus
ctgcggcactcctttacacactcag

SEQ ID NO: 102594 - DNA, 25 bp, mus musculus
gcggcactcctttacacactcagga

SEQ ID NO: 102595 - DNA, 25 bp, mus musculus
tgttcctggagcatgcgcttatcca

SEQ ID NO: 102596 - DNA, 25 bp, mus musculus
tcctggagcatgcgcttatccaata

SEQ ID NO: 102597 - DNA, 25 bp, mus musculus
acagccccttcttcatgaggaaaga

SEQ ID NO: 102598 - DNA, 25 bp, mus musculus
ccttcttcatgaggaaagaggtcat

SEQ ID NO: 102599 - DNA, 25 bp, mus musculus
aagtggcccagctcagccagtttga

SEQ ID NO: 102600 - DNA, 25 bp, mus musculus
tggcccagctcagccagtttgatga

SEQ ID NO: 102601 - DNA, 25 bp, mus musculus
cccagctcagccagtttgatgaaga

SEQ ID NO: 102602 - DNA, 25 bp, mus musculus
agctcagccagtttgatgaagaact

SEQ ID NO: 102603 - DNA, 25 bp, mus musculus
agtcagatgacaactcctatgacga

SEQ ID NO: 102604 - DNA, 25 bp, mus musculus
cagatgacaactcctatgacgagaa

SEQ ID NO: 102605 - DNA, 25 bp, mus musculus
atgacaactcctatgacgagaaata

SEQ ID NO: 102606 - DNA, 25 bp, mus musculus
acaactcctatgacgagaaatacat

SEQ ID NO: 102607 - DNA, 25 bp, mus musculus
agcatgcgcttatccaatatgcact

SEQ ID NO: 102608 - DNA, 25 bp, mus musculus
atgcgcttatccaatatgcactgcg

SEQ ID NO: 102609 - DNA, 25 bp, mus musculus
cgcttatccaatatgcactgcgtac

SEQ ID NO: 102610 - DNA, 25 bp, mus musculus
ttatccaatatgcactgcgtacctt

SEQ ID NO: 102611 - DNA, 25 bp, mus musculus
tccaatatgcactgcgtaccttggg

SEQ ID NO: 102612 - DNA, 25 bp, mus musculus
aatatgcactgcgtaccttggggag

SEQ ID NO: 102613 - DNA, 25 bp, mus musculus
atgcactgcgtaccttggggagtcg

SEQ ID NO: 102614 - DNA, 25 bp, mus musculus
ggggctacactccaatctacagccc

SEQ ID NO: 102615 - DNA, 25 bp, mus musculus
cgtctcagctaacctccataaggaa

SEQ ID NO: 102616 - DNA, 25 bp, mus musculus
ctcagctaacctccataaggaacag

SEQ ID NO: 102617 - DNA, 25 bp, mus musculus
aaagtcacgaccgatattggctacg

SEQ ID NO: 102618 - DNA, 25 bp, mus musculus
gtcacgaccgatattggctacgatg

SEQ ID NO: 102619 - DNA, 25 bp, mus musculus
acgaccgatattggctacgatgctg

SEQ ID NO: 102620 - DNA, 25 bp, mus musculus
attggctacgatgctggatttatcg

SEQ ID NO: 102621 - DNA, 25 bp, mus musculus
atcggtgtcatcagcattgataaaa

SEQ ID NO: 102622 - DNA, 25 bp, mus musculus
tatgctgtccatcatattacaccgt

SEQ ID NO: 102623 - DNA, 25 bp, mus musculus
gctgtccatcatattacaccgtagt

SEQ ID NO: 102624 - DNA, 25 bp, mus musculus
gtccatcatattacaccgtagtagg

SEQ ID NO: 102625 - DNA, 25 bp, mus musculus
catcatattacaccgtagtaggtca

SEQ ID NO: 102626 - DNA, 25 bp, mus musculus
catattacaccgtagtaggtcaagt

SEQ ID NO: 102627 - DNA, 25 bp, mus musculus
taacctccataaggaacagactgtc

SEQ ID NO: 102628 - DNA, 25 bp, mus musculus
cctccataaggaacagactgtcagt

SEQ ID NO: 102629 - DNA, 25 bp, mus musculus
acagactgtcagtatgctcagactg

SEQ ID NO: 102630 - DNA, 25 bp, mus musculus
cagtatgctcagactggacatcatg

SEQ ID NO: 102631 - DNA, 25 bp, mus musculus
tatgctcagactggacatcatgtat

SEQ ID NO: 102632 - DNA, 25 bp, mus musculus
gctcagactggacatcatgtataac

SEQ ID NO: 102633 - DNA, 25 bp, mus musculus
agatgcattcaaccagtgactaaga

SEQ ID NO: 102634 - DNA, 25 bp, mus musculus
attcaaccagtgactaagattcatg

SEQ ID NO: 102635 - DNA, 25 bp, mus musculus
gtgcagctccgtctggagagtatta

SEQ ID NO: 102636 - DNA, 25 bp, mus musculus
gcagctccgtctggagagtattaag

SEQ ID NO: 102637 - DNA, 25 bp, mus musculus
ccggactttgcccactgtctgctgc

SEQ ID NO: 102638 - DNA, 25 bp, mus musculus
ggactttgcccactgtctgctgcat

SEQ ID NO: 102639 - DNA, 25 bp, mus musculus
cactgtctgctgcatcctttggaaa

SEQ ID NO: 102640 - DNA, 25 bp, mus musculus
gtctgctgcatcctttggaaagctt

SEQ ID NO: 102641 - DNA, 25 bp, mus musculus
tgcatcctttggaaagcttggctac

SEQ ID NO: 102642 - DNA, 25 bp, mus musculus
agcttggctacggtataggagactg

SEQ ID NO: 102643 - DNA, 25 bp, mus musculus
cttggctacggtataggagactgtc

SEQ ID NO: 102644 - DNA, 25 bp, mus musculus
ataggagactgtcgttcgagacaag

SEQ ID NO: 102645 - DNA, 25 bp, mus musculus
ctgtcgttcgagacaaggctgtgga

SEQ ID NO: 102646 - DNA, 25 bp, mus musculus
cgttcgagacaaggctgtggagtcg

SEQ ID NO: 102647 - DNA, 25 bp, mus musculus
ttatcaactatagctctagcactcg

SEQ ID NO: 102648 - DNA, 25 bp, mus musculus
gctctagcactcggggtagaaagga

SEQ ID NO: 102649 - DNA, 25 bp, mus musculus
tctagcactcggggtagaaaggact

SEQ ID NO: 102650 - DNA, 25 bp, mus musculus
ggactcgaacggaactgctgccttt

SEQ ID NO: 102651 - DNA, 25 bp, mus musculus
gtgctgttagctctcggcgagcagc

SEQ ID NO: 102652 - DNA, 25 bp, mus musculus
gctgttagctctcggcgagcagctg

SEQ ID NO: 102653 - DNA, 25 bp, mus musculus
cggcgagcagctgggtaatgtcact

SEQ ID NO: 102654 - DNA, 25 bp, mus musculus
gtccggactttgcccactgtctgct

SEQ ID NO: 102655 - DNA, 25 bp, mus musculus
tgtgaaccccaaaactgacaagctt

SEQ ID NO: 102656 - DNA, 25 bp, mus musculus
tgaaccccaaaactgacaagctttg

SEQ ID NO: 102657 - DNA, 25 bp, mus musculus
tggtgctaacagtccagagatgtgg

SEQ ID NO: 102658 - DNA, 25 bp, mus musculus
gctaacagtccagagatgtggtctg

SEQ ID NO: 102659 - DNA, 25 bp, mus musculus
taacagtccagagatgtggtctgaa

SEQ ID NO: 102660 - DNA, 25 bp, mus musculus
gagtatgctgtccgagcaatcaagg

SEQ ID NO: 102661 - DNA, 25 bp, mus musculus
gtatgctgtccgagcaatcaaggaa

SEQ ID NO: 102662 - DNA, 25 bp, mus musculus
atgctgtccgagcaatcaaggaaca

SEQ ID NO: 102663 - DNA, 25 bp, mus musculus
gctgtccgagcaatcaaggaacaca

SEQ ID NO: 102664 - DNA, 25 bp, mus musculus
tcaagcaattatcttctgtagaact

SEQ ID NO: 102665 - DNA, 25 bp, mus musculus
aagcaattatcttctgtagaactaa

SEQ ID NO: 102666 - DNA, 25 bp, mus musculus
ttatcttctgtagaactaaaattga

SEQ ID NO: 102667 - DNA, 25 bp, mus musculus
accacattcgaactgatgatgtaca

SEQ ID NO: 102668 - DNA, 25 bp, mus musculus
cacattcgaactgatgatgtacacg

SEQ ID NO: 102669 - DNA, 25 bp, mus musculus
gataacacaagacctggtgctaaca

SEQ ID NO: 102670 - DNA, 25 bp, mus musculus
taacacaagacctggtgctaacagt

SEQ ID NO: 102671 - DNA, 25 bp, mus musculus
acacaagacctggtgctaacagtcc

SEQ ID NO: 102672 - DNA, 25 bp, mus musculus
acaagacctggtgctaacagtccag

SEQ ID NO: 102673 - DNA, 25 bp, mus musculus
aagacctggtgctaacagtccagag

SEQ ID NO: 102674 - DNA, 25 bp, mus musculus
cctggtgctaacagtccagagatgt

SEQ ID NO: 102675 - DNA, 25 bp, mus musculus
gcctccagaacacaggctgggaaga

SEQ ID NO: 102676 - DNA, 25 bp, mus musculus
ccagaacacaggctgggaagatgcc

SEQ ID NO: 102677 - DNA, 25 bp, mus musculus
aaattgtcgccctgaagaaggtgcg

SEQ ID NO: 102678 - DNA, 25 bp, mus musculus
tccccatcagcagcctgcgtgagat

SEQ ID NO: 102679 - DNA, 25 bp, mus musculus
agcagcctgcgtgagatcacactgc

SEQ ID NO: 102680 - DNA, 25 bp, mus musculus
tgctcttgcgtctccgccatccaaa

SEQ ID NO: 102681 - DNA, 25 bp, mus musculus
tctccgccatccaaacattgtggag

SEQ ID NO: 102682 - DNA, 25 bp, mus musculus
tccgccatccaaacattgtggagct

SEQ ID NO: 102683 - DNA, 25 bp, mus musculus
ttgtgggcaaccacgtggagagcat

SEQ ID NO: 102684 - DNA, 25 bp, mus musculus
gtgggcaaccacgtggagagcatct

SEQ ID NO: 102685 - DNA, 25 bp, mus musculus
gcaaccacgtggagagcatcttcct

SEQ ID NO: 102686 - DNA, 25 bp, mus musculus
agagcatcttcctggtcatgggtta

SEQ ID NO: 102687 - DNA, 25 bp, mus musculus
agggcacctatggcatcgtgtatcg

SEQ ID NO: 102688 - DNA, 25 bp, mus musculus
ggcacctatggcatcgtgtatcggg

SEQ ID NO: 102689 - DNA, 25 bp, mus musculus
gcatcgtgtatcgggccagggatac

SEQ ID NO: 102690 - DNA, 25 bp, mus musculus
cgtgtatcgggccagggatacccag

SEQ ID NO: 102691 - DNA, 25 bp, mus musculus
tatcgggccagggatacccagacag

SEQ ID NO: 102692 - DNA, 25 bp, mus musculus
cagggatacccagacagatgaaatt

SEQ ID NO: 102693 - DNA, 25 bp, mus musculus
gggatacccagacagatgaaattgt

SEQ ID NO: 102694 - DNA, 25 bp, mus musculus
tgaaattgtcgccctgaagaaggtg

SEQ ID NO: 102695 - DNA, 25 bp, mus musculus
ccatgagcatgccagcattgactta

SEQ ID NO: 102696 - DNA, 25 bp, mus musculus
gcatgccagcattgacttaccaggc

SEQ ID NO: 102697 - DNA, 25 bp, mus musculus
ctttgtggacgatcagcagactttc

SEQ ID NO: 102698 - DNA, 25 bp, mus musculus
cttttgtggcaacgtggctcatcag

SEQ ID NO: 102699 - DNA, 25 bp, mus musculus
caacgtggctcatcagcaacttatc

SEQ ID NO: 102700 - DNA, 25 bp, mus musculus
cgtggctcatcagcaacttatccag

SEQ ID NO: 102701 - DNA, 25 bp, mus musculus
tcagcaacttatccagatcacctca

SEQ ID NO: 102702 - DNA, 25 bp, mus musculus
tatccagatcacctcagcatctgtg

SEQ ID NO: 102703 - DNA, 25 bp, mus musculus
agcatctgtgaggttggtgtctcaa

SEQ ID NO: 102704 - DNA, 25 bp, mus musculus
ggtgtctcaagagcccaaagctttg

SEQ ID NO: 102705 - DNA, 25 bp, mus musculus
tcaagagcccaaagctttggtcagc

SEQ ID NO: 102706 - DNA, 25 bp, mus musculus
gcccaaagctttggtcagcgagttt

SEQ ID NO: 102707 - DNA, 25 bp, mus musculus
cagcattgacttaccaggcatcaaa

SEQ ID NO: 102708 - DNA, 25 bp, mus musculus
cattgacttaccaggcatcaaaggt

SEQ ID NO: 102709 - DNA, 25 bp, mus musculus
tgacttaccaggcatcaaaggttta

SEQ ID NO: 102710 - DNA, 25 bp, mus musculus
aggtttatggcctctgcgctctgac

SEQ ID NO: 102711 - DNA, 25 bp, mus musculus
ggatgacactttggtgctctctttt

SEQ ID NO: 102712 - DNA, 25 bp, mus musculus
gctctcttttgtgggccagacaaga

SEQ ID NO: 102713 - DNA, 25 bp, mus musculus
ttttgtgggccagacaagagttctc

SEQ ID NO: 102714 - DNA, 25 bp, mus musculus
aagagttctcatgctaaacggagag

SEQ ID NO: 102715 - DNA, 25 bp, mus musculus
gaccctgtctctgatggagcagctc

SEQ ID NO: 102716 - DNA, 25 bp, mus musculus
taagtttcataagccaggtgagaac

SEQ ID NO: 102717 - DNA, 25 bp, mus musculus
gcccaatggaatcctgcatattgga

SEQ ID NO: 102718 - DNA, 25 bp, mus musculus
tggaatcctgcatattggacacgcc

SEQ ID NO: 102719 - DNA, 25 bp, mus musculus
cctgcatattggacacgccagagcc

SEQ ID NO: 102720 - DNA, 25 bp, mus musculus
gcatattggacacgccagagccatc

SEQ ID NO: 102721 - DNA, 25 bp, mus musculus
acacgccagagccatcaatttcaac

SEQ ID NO: 102722 - DNA, 25 bp, mus musculus
cgccagagccatcaatttcaacttt

SEQ ID NO: 102723 - DNA, 25 bp, mus musculus
cagagccatcaatttcaactttggt

SEQ ID NO: 102724 - DNA, 25 bp, mus musculus
catcaatttcaactttggttatgca

SEQ ID NO: 102725 - DNA, 25 bp, mus musculus
caatttcaactttggttatgcaagg

SEQ ID NO: 102726 - DNA, 25 bp, mus musculus
tttcaactttggttatgcaaggcca

SEQ ID NO: 102727 - DNA, 25 bp, mus musculus
gaactacaagacgccaggctatgtg

SEQ ID NO: 102728 - DNA, 25 bp, mus musculus
tgtgatcactccatataccatggat

SEQ ID NO: 102729 - DNA, 25 bp, mus musculus
gatcactccatataccatggatctg

SEQ ID NO: 102730 - DNA, 25 bp, mus musculus
cactccatataccatggatctgctg

SEQ ID NO: 102731 - DNA, 25 bp, mus musculus
taccatggatctgctgaagcagcac

SEQ ID NO: 102732 - DNA, 25 bp, mus musculus
gaagcagcacctggagatcactggg

SEQ ID NO: 102733 - DNA, 25 bp, mus musculus
ccctccagagcccaatggaatcctg

SEQ ID NO: 102734 - DNA, 25 bp, mus musculus
tccagagcccaatggaatcctgcat

SEQ ID NO: 102735 - DNA, 25 bp, mus musculus
atcaagccaactgagttctctcttt

SEQ ID NO: 102736 - DNA, 25 bp, mus musculus
actgagttctctctttgtgaaacag

SEQ ID NO: 102737 - DNA, 25 bp, mus musculus
tttgatcacccacagcaggactagg

SEQ ID NO: 102738 - DNA, 25 bp, mus musculus
cacccacagcaggactaggcaggtc

SEQ ID NO: 102739 - DNA, 25 bp, mus musculus
gacgaccgtgaacacgtgcaccttc

SEQ ID NO: 102740 - DNA, 25 bp, mus musculus
cgtgaacacgtgcaccttccacagg

SEQ ID NO: 102741 - DNA, 25 bp, mus musculus
gtgcaccttccacagggggacatag

SEQ ID NO: 102742 - DNA, 25 bp, mus musculus
caccttccacagggggacatagcgg

SEQ ID NO: 102743 - DNA, 25 bp, mus musculus
gtgcttggcaggcattccaaataac

SEQ ID NO: 102744 - DNA, 25 bp, mus musculus
cattccaaataacttgatacggtca

SEQ ID NO: 102745 - DNA, 25 bp, mus musculus
tcctttcaacgatgaaactcccata

SEQ ID NO: 102746 - DNA, 25 bp, mus musculus
tttcaacgatgaaactcccatataa

SEQ ID NO: 102747 - DNA, 25 bp, mus musculus
atccatgagcttgcgcacaaagact

SEQ ID NO: 102748 - DNA, 25 bp, mus musculus
catgagcttgcgcacaaagactaat

SEQ ID NO: 102749 - DNA, 25 bp, mus musculus
cttgcgcacaaagactaatgcaaga

SEQ ID NO: 102750 - DNA, 25 bp, mus musculus
gactaatgcaagaaccatcatggga

SEQ ID NO: 102751 - DNA, 25 bp, mus musculus
taatgcaagaaccatcatgggaaaa

SEQ ID NO: 102752 - DNA, 25 bp, mus musculus
aactactgcagcagcagaggctttg

SEQ ID NO: 102753 - DNA, 25 bp, mus musculus
tactgcagcagcagaggctttgatc

SEQ ID NO: 102754 - DNA, 25 bp, mus musculus
agaggctttgatcacccacagcagg

SEQ ID NO: 102755 - DNA, 25 bp, mus musculus
ccgcgatggggatgcgctggaccta

SEQ ID NO: 102756 - DNA, 25 bp, mus musculus
caagacccgggcgagtcaggtgaag

SEQ ID NO: 102757 - DNA, 25 bp, mus musculus
gacgcgccttcaagaagatcctctg

SEQ ID NO: 102758 - DNA, 25 bp, mus musculus
cgcgccttcaagaagatcctctgcc

SEQ ID NO: 102759 - DNA, 25 bp, mus musculus
cgccttcaagaagatcctctgccgt

SEQ ID NO: 102760 - DNA, 25 bp, mus musculus
ccttcaagaagatcctctgccgtgg

SEQ ID NO: 102761 - DNA, 25 bp, mus musculus
caagaagatcctctgccgtggggac

SEQ ID NO: 102762 - DNA, 25 bp, mus musculus
agaagatcctctgccgtggggacag

SEQ ID NO: 102763 - DNA, 25 bp, mus musculus
gatcctctgccgtggggacagaaaa

SEQ ID NO: 102764 - DNA, 25 bp, mus musculus
tcctctgccgtggggacagaaaacg

SEQ ID NO: 102765 - DNA, 25 bp, mus musculus
ctctgccgtggggacagaaaacgca

SEQ ID NO: 102766 - DNA, 25 bp, mus musculus
aaacgcatcgtgtgagcgcatgggc

SEQ ID NO: 102767 - DNA, 25 bp, mus musculus
tttcacctacacgctcatagcggtc

SEQ ID NO: 102768 - DNA, 25 bp, mus musculus
tcacctacacgctcatagcggtcgg

SEQ ID NO: 102769 - DNA, 25 bp, mus musculus
cggtgcccagccagctcttcaactt

SEQ ID NO: 102770 - DNA, 25 bp, mus musculus
agccagctcttcaacttcttcttct

SEQ ID NO: 102771 - DNA, 25 bp, mus musculus
agctcttcaacttcttcttctggtt

SEQ ID NO: 102772 - DNA, 25 bp, mus musculus
agctcgctgaaccctgttatctaca

SEQ ID NO: 102773 - DNA, 25 bp, mus musculus
acttccgacgcgccttcaagaagat

SEQ ID NO: 102774 - DNA, 25 bp, mus musculus
ttccgacgcgccttcaagaagatcc

SEQ ID NO: 102775 - DNA, 25 bp, mus musculus
caacactcaatcgctgctcagtaca

SEQ ID NO: 102776 - DNA, 25 bp, mus musculus
cactcaatcgctgctcagtacagcg

SEQ ID NO: 102777 - DNA, 25 bp, mus musculus
caaaccaggcgcacacctgaacgtc

SEQ ID NO: 102778 - DNA, 25 bp, mus musculus
cctgaacgtctccgaaaacagactg

SEQ ID NO: 102779 - DNA, 25 bp, mus musculus
gaacgtctccgaaaacagactgtcg

SEQ ID NO: 102780 - DNA, 25 bp, mus musculus
ggaaaagctccagcatttgagagtg

SEQ ID NO: 102781 - DNA, 25 bp, mus musculus
aaagctccagcatttgagagtgaag

SEQ ID NO: 102782 - DNA, 25 bp, mus musculus
gctccagcatttgagagtgaagacg

SEQ ID NO: 102783 - DNA, 25 bp, mus musculus
agtacgcaatagcgcatgcacacat

SEQ ID NO: 102784 - DNA, 25 bp, mus musculus
acgcaatagcgcatgcacacatgtc

SEQ ID NO: 102785 - DNA, 25 bp, mus musculus
cacacatgtctgcagtggtcagcct

SEQ ID NO: 102786 - DNA, 25 bp, mus musculus
acatgtctgcagtggtcagcctggc

SEQ ID NO: 102787 - DNA, 25 bp, mus musculus
tcaatcgctgctcagtacagcggga

SEQ ID NO: 102788 - DNA, 25 bp, mus musculus
actcaggtccgcgtgcactacgcac

SEQ ID NO: 102789 - DNA, 25 bp, mus musculus
tacgcaccacaccaatgccacgttg

SEQ ID NO: 102790 - DNA, 25 bp, mus musculus
gcaccacaccaatgccacgttggac

SEQ ID NO: 102791 - DNA, 25 bp, mus musculus
ccacaccaatgccacgttggacaaa

SEQ ID NO: 102792 - DNA, 25 bp, mus musculus
caccaatgccacgttggacaaacca

SEQ ID NO: 102793 - DNA, 25 bp, mus musculus
caatgccacgttggacaaaccaggc

SEQ ID NO: 102794 - DNA, 25 bp, mus musculus
ggacaaaccaggcgcacacctgaac

SEQ ID NO: 102795 - DNA, 25 bp, mus musculus
cttcgaggctcactcagcggcgcag

SEQ ID NO: 102796 - DNA, 25 bp, mus musculus
tcgaggctcactcagcggcgcagta

SEQ ID NO: 102797 - DNA, 25 bp, mus musculus
cagccctgagtttctgcgaaaatga

SEQ ID NO: 102798 - DNA, 25 bp, mus musculus
agccctgagtttctgcgaaaatgac

SEQ ID NO: 102799 - DNA, 25 bp, mus musculus
gccctgagtttctgcgaaaatgacc

SEQ ID NO: 102800 - DNA, 25 bp, mus musculus
tctgcgaaaatgacctgccggcaac

SEQ ID NO: 102801 - DNA, 25 bp, mus musculus
ctgcgaaaatgacctgccggcaacg

SEQ ID NO: 102802 - DNA, 25 bp, mus musculus
gcgaaaatgacctgccggcaacgtt

SEQ ID NO: 102803 - DNA, 25 bp, mus musculus
cgttgcctattaggtaagcgatgag

SEQ ID NO: 102804 - DNA, 25 bp, mus musculus
ggctcactcagcggcgcagtacagc

SEQ ID NO: 102805 - DNA, 25 bp, mus musculus
gctcactcagcggcgcagtacagcg

SEQ ID NO: 102806 - DNA, 25 bp, mus musculus
tccacgtgggccaagccaaccgcag

SEQ ID NO: 102807 - DNA, 25 bp, mus musculus
agccaaccgcagccctgagtttctg

SEQ ID NO: 102808 - DNA, 25 bp, mus musculus
gccaaccgcagccctgagtttctgc

SEQ ID NO: 102809 - DNA, 25 bp, mus musculus
ccgcagccctgagtttctgcgaaaa

SEQ ID NO: 102810 - DNA, 25 bp, mus musculus
cgcagccctgagtttctgcgaaaat

SEQ ID NO: 102811 - DNA, 25 bp, mus musculus
gcagccctgagtttctgcgaaaatg

SEQ ID NO: 102812 - DNA, 25 bp, mus musculus
aacgctgcagccatcattatatctc

SEQ ID NO: 102813 - DNA, 25 bp, mus musculus
acgctgcagccatcattatatctcc

SEQ ID NO: 102814 - DNA, 25 bp, mus musculus
ccctgataactgtgtccctaagcac

SEQ ID NO: 102815 - DNA, 25 bp, mus musculus
tgataactgtgtccctaagcacatg

SEQ ID NO: 102816 - DNA, 25 bp, mus musculus
ataactgtgtccctaagcacatgga

SEQ ID NO: 102817 - DNA, 25 bp, mus musculus
taactgtgtccctaagcacatggat

SEQ ID NO: 102818 - DNA, 25 bp, mus musculus
actgtgtccctaagcacatggatcg

SEQ ID NO: 102819 - DNA, 25 bp, mus musculus
ctgtgtccctaagcacatggatcgg

SEQ ID NO: 102820 - DNA, 25 bp, mus musculus
gtgtccctaagcacatggatcggat

SEQ ID NO: 102821 - DNA, 25 bp, mus musculus
tgtccctaagcacatggatcggatc

SEQ ID NO: 102822 - DNA, 25 bp, mus musculus
tccctaagcacatggatcggatcaa

SEQ ID NO: 102823 - DNA, 25 bp, mus musculus
ccctaagcacatggatcggatcaac

SEQ ID NO: 102824 - DNA, 25 bp, mus musculus
ctgcagccatcattatatctccgtc

SEQ ID NO: 102825 - DNA, 25 bp, mus musculus
gacgaacatgaaccctgataactgt

SEQ ID NO: 102826 - DNA, 25 bp, mus musculus
cgaacatgaaccctgataactgtgt

SEQ ID NO: 102827 - DNA, 25 bp, mus musculus
gaacatgaaccctgataactgtgtc

SEQ ID NO: 102828 - DNA, 25 bp, mus musculus
acatgaaccctgataactgtgtccc

SEQ ID NO: 102829 - DNA, 25 bp, mus musculus
catgaaccctgataactgtgtccct

SEQ ID NO: 102830 - DNA, 25 bp, mus musculus
tgaaccctgataactgtgtccctaa

SEQ ID NO: 102831 - DNA, 25 bp, mus musculus
accctgataactgtgtccctaagca

SEQ ID NO: 102832 - DNA, 25 bp, mus musculus
gctaatgacgcgatacgctctgctt

SEQ ID NO: 102833 - DNA, 25 bp, mus musculus
gacgcgatacgctctgcttgtctgt

SEQ ID NO: 102834 - DNA, 25 bp, mus musculus
gatctgatcacaactggggacttca

SEQ ID NO: 102835 - DNA, 25 bp, mus musculus
atcacaactggggacttcatgtcca

SEQ ID NO: 102836 - DNA, 25 bp, mus musculus
actggggacttcatgtccaggttct

SEQ ID NO: 102837 - DNA, 25 bp, mus musculus
gacttcatgtccaggttctgctcca

SEQ ID NO: 102838 - DNA, 25 bp, mus musculus
ttcatgtccaggttctgctccaacc

SEQ ID NO: 102839 - DNA, 25 bp, mus musculus
atgtccaggttctgctccaaccttt

SEQ ID NO: 102840 - DNA, 25 bp, mus musculus
cagatggcagctacacacatagccc

SEQ ID NO: 102841 - DNA, 25 bp, mus musculus
atggcagctacacacatagcccgca

SEQ ID NO: 102842 - DNA, 25 bp, mus musculus
gcagctacacacatagcccgcaagg

SEQ ID NO: 102843 - DNA, 25 bp, mus musculus
gctacacacatagcccgcaaggcag

SEQ ID NO: 102844 - DNA, 25 bp, mus musculus
tgtctgtacatcgcctgtagacaag

SEQ ID NO: 102845 - DNA, 25 bp, mus musculus
acacacatagcccgcaaggcagtgg

SEQ ID NO: 102846 - DNA, 25 bp, mus musculus
tacatcgcctgtagacaagaaggcg

SEQ ID NO: 102847 - DNA, 25 bp, mus musculus
atcgcctgtagacaagaaggcgttc

SEQ ID NO: 102848 - DNA, 25 bp, mus musculus
gaaatatgtgctgtgtctcgaatct

SEQ ID NO: 102849 - DNA, 25 bp, mus musculus
tgtgctgtgtctcgaatctctaaga

SEQ ID NO: 102850 - DNA, 25 bp, mus musculus
gctgtgtctcgaatctctaagaaag

SEQ ID NO: 102851 - DNA, 25 bp, mus musculus
gtgtctcgaatctctaagaaagaaa

SEQ ID NO: 102852 - DNA, 25 bp, mus musculus
gaaaccagcgtggatctgatcacaa

SEQ ID NO: 102853 - DNA, 25 bp, mus musculus
ctgcagcgcatgcttcaacacaccg

SEQ ID NO: 102854 - DNA, 25 bp, mus musculus
tgcagcgcatgcttcaacacaccgt

SEQ ID NO: 102855 - DNA, 25 bp, mus musculus
cttagccgaggtctccttcgagact

SEQ ID NO: 102856 - DNA, 25 bp, mus musculus
ccgaggtctccttcgagactatatg

SEQ ID NO: 102857 - DNA, 25 bp, mus musculus
cgaggtctccttcgagactatatgc

SEQ ID NO: 102858 - DNA, 25 bp, mus musculus
ggtctccttcgagactatatgcaga

SEQ ID NO: 102859 - DNA, 25 bp, mus musculus
gtctccttcgagactatatgcagac

SEQ ID NO: 102860 - DNA, 25 bp, mus musculus
ctccttcgagactatatgcagacag

SEQ ID NO: 102861 - DNA, 25 bp, mus musculus
tccttcgagactatatgcagacaga

SEQ ID NO: 102862 - DNA, 25 bp, mus musculus
ccttcgagactatatgcagacagag

SEQ ID NO: 102863 - DNA, 25 bp, mus musculus
gtgcactggcggcaggtcaatctaa

SEQ ID NO: 102864 - DNA, 25 bp, mus musculus
catcttacagcatataggtcctggt

SEQ ID NO: 102865 - DNA, 25 bp, mus musculus
catgcttcaacacaccgtgatcttc

SEQ ID NO: 102866 - DNA, 25 bp, mus musculus
tgcttcaacacaccgtgatcttcga

SEQ ID NO: 102867 - DNA, 25 bp, mus musculus
cttcaacacaccgtgatcttcgaca

SEQ ID NO: 102868 - DNA, 25 bp, mus musculus
tgatcttcgacatcactgtcgataa

SEQ ID NO: 102869 - DNA, 25 bp, mus musculus
ctgtcgataacgagcccttagccga

SEQ ID NO: 102870 - DNA, 25 bp, mus musculus
tgtcgataacgagcccttagccgag

SEQ ID NO: 102871 - DNA, 25 bp, mus musculus
gtcgataacgagcccttagccgagg

SEQ ID NO: 102872 - DNA, 25 bp, mus musculus
gataacgagcccttagccgaggtct

SEQ ID NO: 102873 - DNA, 25 bp, mus musculus
acacgctcgcagtgcttagctcttc

SEQ ID NO: 102874 - DNA, 25 bp, mus musculus
gcagtgcttagctcttctgtcggaa

SEQ ID NO: 102875 - DNA, 25 bp, mus musculus
cctgctctgggacacctaactcaag

SEQ ID NO: 102876 - DNA, 25 bp, mus musculus
tgctctgggacacctaactcaagag

SEQ ID NO: 102877 - DNA, 25 bp, mus musculus
ctgggacacctaactcaagagacct

SEQ ID NO: 102878 - DNA, 25 bp, mus musculus
gacacctaactcaagagacctccct

SEQ ID NO: 102879 - DNA, 25 bp, mus musculus
cggcccaattatggcagagaacgat

SEQ ID NO: 102880 - DNA, 25 bp, mus musculus
caatgagctcttggactacgaagac

SEQ ID NO: 102881 - DNA, 25 bp, mus musculus
atgagctcttggactacgaagacga

SEQ ID NO: 102882 - DNA, 25 bp, mus musculus
gagctcttggactacgaagacgacg

SEQ ID NO: 102883 - DNA, 25 bp, mus musculus
gctcttggactacgaagacgacgag

SEQ ID NO: 102884 - DNA, 25 bp, mus musculus
acgtcaagggctcctacgtctccat

SEQ ID NO: 102885 - DNA, 25 bp, mus musculus
agtgcttagctcttctgtcggaaac

SEQ ID NO: 102886 - DNA, 25 bp, mus musculus
tgcttagctcttctgtcggaaactg

SEQ ID NO: 102887 - DNA, 25 bp, mus musculus
tagctcttctgtcggaaactggtgt

SEQ ID NO: 102888 - DNA, 25 bp, mus musculus
gctcttctgtcggaaactggtgtct

SEQ ID NO: 102889 - DNA, 25 bp, mus musculus
tcttctgtcggaaactggtgtcttt

SEQ ID NO: 102890 - DNA, 25 bp, mus musculus
tgtctttccccttgctgttcttcaa

SEQ ID NO: 102891 - DNA, 25 bp, mus musculus
ctcacctgctctgggacacctaact

SEQ ID NO: 102892 - DNA, 25 bp, mus musculus
cacctgctctgggacacctaactca

SEQ ID NO: 102893 - DNA, 25 bp, mus musculus
tacgtcgacctagtcgcgggcatcg

SEQ ID NO: 102894 - DNA, 25 bp, mus musculus
atcgagccaatcttacattgattga

SEQ ID NO: 102895 - DNA, 25 bp, mus musculus
gaataccttatcagcacccagtgac

SEQ ID NO: 102896 - DNA, 25 bp, mus musculus
cttatcagcacccagtgacgagcct

SEQ ID NO: 102897 - DNA, 25 bp, mus musculus
agcacccagtgacgagcctactgcg

SEQ ID NO: 102898 - DNA, 25 bp, mus musculus
tgacgagcctactgcgctcatgagc

SEQ ID NO: 102899 - DNA, 25 bp, mus musculus
tactgcgctcatgagctagcccaaa

SEQ ID NO: 102900 - DNA, 25 bp, mus musculus
gctcatgagctagcccaaatacatc

SEQ ID NO: 102901 - DNA, 25 bp, mus musculus
gagctagcccaaatacatcatctgg

SEQ ID NO: 102902 - DNA, 25 bp, mus musculus
ctagcccaaatacatcatctggtct

SEQ ID NO: 102903 - DNA, 25 bp, mus musculus
gcccaaatacatcatctggtctccg

SEQ ID NO: 102904 - DNA, 25 bp, mus musculus
atacatcatctggtctccgatctgc

SEQ ID NO: 102905 - DNA, 25 bp, mus musculus
gagccaatcttacattgattgagaa

SEQ ID NO: 102906 - DNA, 25 bp, mus musculus
acatcatctggtctccgatctgccg

SEQ ID NO: 102907 - DNA, 25 bp, mus musculus
ccaatcttacattgattgagaagta

SEQ ID NO: 102908 - DNA, 25 bp, mus musculus
acgatcgtgcataggtgagaacgct

SEQ ID NO: 102909 - DNA, 25 bp, mus musculus
gaacgctcatacgctctttagcttc

SEQ ID NO: 102910 - DNA, 25 bp, mus musculus
cgctcatacgctctttagcttcctg

SEQ ID NO: 102911 - DNA, 25 bp, mus musculus
tcatacgctctttagcttcctgcgg

SEQ ID NO: 102912 - DNA, 25 bp, mus musculus
gctctttagcttcctgcggaatacc

SEQ ID NO: 102913 - DNA, 25 bp, mus musculus
tagcttcctgcggaataccttatca

SEQ ID NO: 102914 - DNA, 25 bp, mus musculus
acatctgtagatctctgccggggtc

SEQ ID NO: 102915 - DNA, 25 bp, mus musculus
tctgtagatctctgccggggtcctc

SEQ ID NO: 102916 - DNA, 25 bp, mus musculus
ctccagcgatctatggcatttcatt

SEQ ID NO: 102917 - DNA, 25 bp, mus musculus
tctatggcatttcattccctgaccc

SEQ ID NO: 102918 - DNA, 25 bp, mus musculus
atggcatttcattccctgaccccaa

SEQ ID NO: 102919 - DNA, 25 bp, mus musculus
gcatttcattccctgaccccaagct

SEQ ID NO: 102920 - DNA, 25 bp, mus musculus
ctgaccccaagctactgaaagagtg

SEQ ID NO: 102921 - DNA, 25 bp, mus musculus
aactatatttcttccatgaacttag

SEQ ID NO: 102922 - DNA, 25 bp, mus musculus
tatatttcttccatgaacttagccc

SEQ ID NO: 102923 - DNA, 25 bp, mus musculus
atttcttccatgaacttagccctgg

SEQ ID NO: 102924 - DNA, 25 bp, mus musculus
tcttccatgaacttagccctggaag

SEQ ID NO: 102925 - DNA, 25 bp, mus musculus
ttttcctgcccaaaggagcctacat

SEQ ID NO: 102926 - DNA, 25 bp, mus musculus
ggtcctcatgtccgacacaccggca

SEQ ID NO: 102927 - DNA, 25 bp, mus musculus
tcctgcccaaaggagcctacattta

SEQ ID NO: 102928 - DNA, 25 bp, mus musculus
cctcatgtccgacacaccggcaaga

SEQ ID NO: 102929 - DNA, 25 bp, mus musculus
gtccgacacaccggcaagattaaga

SEQ ID NO: 102930 - DNA, 25 bp, mus musculus
cgacacaccggcaagattaagactt

SEQ ID NO: 102931 - DNA, 25 bp, mus musculus
atacacaagaattcttccacgtact

SEQ ID NO: 102932 - DNA, 25 bp, mus musculus
cacaagaattcttccacgtactggg

SEQ ID NO: 102933 - DNA, 25 bp, mus musculus
tccacgtactgggaaggcaaagcag

SEQ ID NO: 102934 - DNA, 25 bp, mus musculus
gagacgctccagcgatctatggcat

SEQ ID NO: 102935 - DNA, 25 bp, mus musculus
tttatagtcgggatcgagtgtgtgg

SEQ ID NO: 102936 - DNA, 25 bp, mus musculus
tatagtcgggatcgagtgtgtggac

SEQ ID NO: 102937 - DNA, 25 bp, mus musculus
tcatcgaggaccagtacatgctgca

SEQ ID NO: 102938 - DNA, 25 bp, mus musculus
aggaccagtacatgctgcagtgttc

SEQ ID NO: 102939 - DNA, 25 bp, mus musculus
gaccagtacatgctgcagtgttcct

SEQ ID NO: 102940 - DNA, 25 bp, mus musculus
ccagtacatgctgcagtgttcctat

SEQ ID NO: 102941 - DNA, 25 bp, mus musculus
atatcctatggtacattctcaagtt

SEQ ID NO: 102942 - DNA, 25 bp, mus musculus
atcctatggtacattctcaagttgg

SEQ ID NO: 102943 - DNA, 25 bp, mus musculus
tatggtacattctcaagttggtggt

SEQ ID NO: 102944 - DNA, 25 bp, mus musculus
gtacattctcaagttggtggtcaca

SEQ ID NO: 102945 - DNA, 25 bp, mus musculus
acattctcaagttggtggtcacatg

SEQ ID NO: 102946 - DNA, 25 bp, mus musculus
attctcaagttggtggtcacatgaa

SEQ ID NO: 102947 - DNA, 25 bp, mus musculus
agaccgctttatgcataacctgtgg

SEQ ID NO: 102948 - DNA, 25 bp, mus musculus
accgctttatgcataacctgtggat

SEQ ID NO: 102949 - DNA, 25 bp, mus musculus
cgctttatgcataacctgtggatca

SEQ ID NO: 102950 - DNA, 25 bp, mus musculus
ctttatgcataacctgtggatcatc

SEQ ID NO: 102951 - DNA, 25 bp, mus musculus
gcataacctgtggatcatcgaggac

SEQ ID NO: 102952 - DNA, 25 bp, mus musculus
ataacctgtggatcatcgaggacca

SEQ ID NO: 102953 - DNA, 25 bp, mus musculus
aacctgtggatcatcgaggaccagt

SEQ ID NO: 102954 - DNA, 25 bp, mus musculus
gatcatcgaggaccagtacatgctg

SEQ ID NO: 102955 - DNA, 25 bp, mus musculus
gttgggctcctcaatgggcaaatta

SEQ ID NO: 102956 - DNA, 25 bp, mus musculus
ttgggctcctcaatgggcaaattaa

SEQ ID NO: 102957 - DNA, 25 bp, mus musculus
ttcgaacgacttggcaagtatcatc

SEQ ID NO: 102958 - DNA, 25 bp, mus musculus
caagtatcatctagatctcagaatt

SEQ ID NO: 102959 - DNA, 25 bp, mus musculus
agtatcatctagatctcagaatttg

SEQ ID NO: 102960 - DNA, 25 bp, mus musculus
gtatcatctagatctcagaatttga

SEQ ID NO: 102961 - DNA, 25 bp, mus musculus
tatcatctagatctcagaatttgag

SEQ ID NO: 102962 - DNA, 25 bp, mus musculus
atcatctagatctcagaatttgaga

SEQ ID NO: 102963 - DNA, 25 bp, mus musculus
tcatctagatctcagaatttgagaa

SEQ ID NO: 102964 - DNA, 25 bp, mus musculus
catctagatctcagaatttgagaag

SEQ ID NO: 102965 - DNA, 25 bp, mus musculus
tgggctcctcaatgggcaaattaag

SEQ ID NO: 102966 - DNA, 25 bp, mus musculus
gggctcctcaatgggcaaattaaga

SEQ ID NO: 102967 - DNA, 25 bp, mus musculus
gctcctcaatgggcaaattaagact

SEQ ID NO: 102968 - DNA, 25 bp, mus musculus
ctcctcaatgggcaaattaagactt

SEQ ID NO: 102969 - DNA, 25 bp, mus musculus
ttggcggttcgaacgacttggcaag

SEQ ID NO: 102970 - DNA, 25 bp, mus musculus
tggcggttcgaacgacttggcaagt

SEQ ID NO: 102971 - DNA, 25 bp, mus musculus
ggttcgaacgacttggcaagtatca

SEQ ID NO: 102972 - DNA, 25 bp, mus musculus
gttcgaacgacttggcaagtatcat

SEQ ID NO: 102973 - DNA, 25 bp, mus musculus
ctgcaaaaatcgaccagctgcagaa

SEQ ID NO: 102974 - DNA, 25 bp, mus musculus
aaatcgaccagctgcagaagaatct

SEQ ID NO: 102975 - DNA, 25 bp, mus musculus
gcccatcacagcagcagacacctgt

SEQ ID NO: 102976 - DNA, 25 bp, mus musculus
ctctgtccccaggcacttcttggac

SEQ ID NO: 102977 - DNA, 25 bp, mus musculus
caggcacttcttggacacatgtacc

SEQ ID NO: 102978 - DNA, 25 bp, mus musculus
gcacttcttggacacatgtaccaac

SEQ ID NO: 102979 - DNA, 25 bp, mus musculus
cttggacacatgtaccaacttgagt

SEQ ID NO: 102980 - DNA, 25 bp, mus musculus
ggacacatgtaccaacttgagtcct

SEQ ID NO: 102981 - DNA, 25 bp, mus musculus
tgaagcctcatctcgctactcaata

SEQ ID NO: 102982 - DNA, 25 bp, mus musculus
agcctcatctcgctactcaataaag

SEQ ID NO: 102983 - DNA, 25 bp, mus musculus
ctcatctcgctactcaataaagcaa

SEQ ID NO: 102984 - DNA, 25 bp, mus musculus
tcgctactcaataaagcaactgaga

SEQ ID NO: 102985 - DNA, 25 bp, mus musculus
agaatctggccccgctggtggaaga

SEQ ID NO: 102986 - DNA, 25 bp, mus musculus
cgctactcaataaagcaactgagaa

SEQ ID NO: 102987 - DNA, 25 bp, mus musculus
tgttcaacaaggctctggtgcagca

SEQ ID NO: 102988 - DNA, 25 bp, mus musculus
tcaacaaggctctggtgcagcagct

SEQ ID NO: 102989 - DNA, 25 bp, mus musculus
acaaggctctggtgcagcagctgga

SEQ ID NO: 102990 - DNA, 25 bp, mus musculus
ctctggtgcagcagctggaacagtt

SEQ ID NO: 102991 - DNA, 25 bp, mus musculus
tggtgcagcagctggaacagttcag

SEQ ID NO: 102992 - DNA, 25 bp, mus musculus
aacagttcagacagcagctgggtcc

SEQ ID NO: 102993 - DNA, 25 bp, mus musculus
tcagacagcagctgggtcccaattc

SEQ ID NO: 102994 - DNA, 25 bp, mus musculus
gaccaaatttacctctgatcccatt

SEQ ID NO: 102995 - DNA, 25 bp, mus musculus
atttacctctgatcccattggtgaa

SEQ ID NO: 102996 - DNA, 25 bp, mus musculus
ttctccagaagtgaacagggaatct

SEQ ID NO: 102997 - DNA, 25 bp, mus musculus
cagggaatcttctcaactatggggc

SEQ ID NO: 102998 - DNA, 25 bp, mus musculus
ggaatcttctcaactatggggctgt

SEQ ID NO: 102999 - DNA, 25 bp, mus musculus
atcttctcaactatggggctgtggg

SEQ ID NO: 103000 - DNA, 25 bp, mus musculus
tgggacctctgggaagtctggtgac

SEQ ID NO: 103001 - DNA, 25 bp, mus musculus
tccccagatggcagaagacgggtac

SEQ ID NO: 103002 - DNA, 25 bp, mus musculus
gtacatcggtgccactttaatggct

SEQ ID NO: 103003 - DNA, 25 bp, mus musculus
catcggtgccactttaatggctgca

SEQ ID NO: 103004 - DNA, 25 bp, mus musculus
tgccactttaatggctgcaggaaag

SEQ ID NO: 103005 - DNA, 25 bp, mus musculus
cactttaatggctgcaggaaagttt

SEQ ID NO: 103006 - DNA, 25 bp, mus musculus
tacctctgatcccattggtgaagtc

SEQ ID NO: 103007 - DNA, 25 bp, mus musculus
agctcccacttgaaagcacatcagc

SEQ ID NO: 103008 - DNA, 25 bp, mus musculus
ctctgatcccattggtgaagtctta

SEQ ID NO: 103009 - DNA, 25 bp, mus musculus
tgatcccattggtgaagtcttagtc

SEQ ID NO: 103010 - DNA, 25 bp, mus musculus
aggaaatctgagttcctccgtcatt

SEQ ID NO: 103011 - DNA, 25 bp, mus musculus
tctgagttcctccgtcatttccaca

SEQ ID NO: 103012 - DNA, 25 bp, mus musculus
gagttcctccgtcatttccacacct

SEQ ID NO: 103013 - DNA, 25 bp, mus musculus
acctccatcttctccagaagtgaac

SEQ ID NO: 103014 - DNA, 25 bp, mus musculus
atcttctccagaagtgaacagggaa

SEQ ID NO: 103015 - DNA, 25 bp, mus musculus
gactggagacagccctctgttcctg

SEQ ID NO: 103016 - DNA, 25 bp, mus musculus
tggagacagccctctgttcctgtgc

SEQ ID NO: 103017 - DNA, 25 bp, mus musculus
tttctgtgtgccaaggcgaaacgcg

SEQ ID NO: 103018 - DNA, 25 bp, mus musculus
tgtgccaaggcgaaacgcgatgggt

SEQ ID NO: 103019 - DNA, 25 bp, mus musculus
tgacagaagcctgtgcctcatccca

SEQ ID NO: 103020 - DNA, 25 bp, mus musculus
gactgcgaccagttatcttgttctc

SEQ ID NO: 103021 - DNA, 25 bp, mus musculus
tgcgaccagttatcttgttctccat

SEQ ID NO: 103022 - DNA, 25 bp, mus musculus
cagttatcttgttctccatggacgg

SEQ ID NO: 103023 - DNA, 25 bp, mus musculus
ttatcttgttctccatggacggttt

SEQ ID NO: 103024 - DNA, 25 bp, mus musculus
tcttgttctccatggacggttttag

SEQ ID NO: 103025 - DNA, 25 bp, mus musculus
tgttctccatggacggttttagagc

SEQ ID NO: 103026 - DNA, 25 bp, mus musculus
tctccatggacggttttagagctga

SEQ ID NO: 103027 - DNA, 25 bp, mus musculus
cagccctctgttcctgtgcggatga

SEQ ID NO: 103028 - DNA, 25 bp, mus musculus
gttcctgtgcggatgactgtctaca

SEQ ID NO: 103029 - DNA, 25 bp, mus musculus
atgactgtctacagaggaagtactg

SEQ ID NO: 103030 - DNA, 25 bp, mus musculus
agtactgctgtgctgactacgtttc

SEQ ID NO: 103031 - DNA, 25 bp, mus musculus
gctgtgctgactacgtttctgtgtg

SEQ ID NO: 103032 - DNA, 25 bp, mus musculus
gtgctgactacgtttctgtgtgcca

SEQ ID NO: 103033 - DNA, 25 bp, mus musculus
ctgactacgtttctgtgtgccaagg

SEQ ID NO: 103034 - DNA, 25 bp, mus musculus
actacgtttctgtgtgccaaggcga

SEQ ID NO: 103035 - DNA, 25 bp, mus musculus
gttgtgcctccagatcagagcttcc

SEQ ID NO: 103036 - DNA, 25 bp, mus musculus
tgtgcctccagatcagagcttccag

SEQ ID NO: 103037 - DNA, 25 bp, mus musculus
gagctgctctttgtgcattcagctg

SEQ ID NO: 103038 - DNA, 25 bp, mus musculus
gctgctctttgtgcattcagctgaa

SEQ ID NO: 103039 - DNA, 25 bp, mus musculus
ctctttgtgcattcagctgaaggga

SEQ ID NO: 103040 - DNA, 25 bp, mus musculus
ctttgtgcattcagctgaagggagt

SEQ ID NO: 103041 - DNA, 25 bp, mus musculus
gcattcagctgaagggagtgagttc

SEQ ID NO: 103042 - DNA, 25 bp, mus musculus
ttctggagtgcccttctggagaaag

SEQ ID NO: 103043 - DNA, 25 bp, mus musculus
gcctatgccaagatcaatgggtgct

SEQ ID NO: 103044 - DNA, 25 bp, mus musculus
ctatgccaagatcaatgggtgctat

SEQ ID NO: 103045 - DNA, 25 bp, mus musculus
tatgccaagatcaatgggtgctatg

SEQ ID NO: 103046 - DNA, 25 bp, mus musculus
gtgctatgaagcactctcagggggt

SEQ ID NO: 103047 - DNA, 25 bp, mus musculus
tgcctccagatcagagcttccagga

SEQ ID NO: 103048 - DNA, 25 bp, mus musculus
cctccagatcagagcttccaggaaa

SEQ ID NO: 103049 - DNA, 25 bp, mus musculus
tccagatcagagcttccaggaaaac

SEQ ID NO: 103050 - DNA, 25 bp, mus musculus
cagatcagagcttccaggaaaacta

SEQ ID NO: 103051 - DNA, 25 bp, mus musculus
agagcttccaggaaaactatgcagg

SEQ ID NO: 103052 - DNA, 25 bp, mus musculus
tccagttctggcaatatggcgagtg

SEQ ID NO: 103053 - DNA, 25 bp, mus musculus
ggacgacaggctgcccactaaggac

SEQ ID NO: 103054 - DNA, 25 bp, mus musculus
acgacaggctgcccactaaggacgg

SEQ ID NO: 103055 - DNA, 25 bp, mus musculus
gatgtcctcctgctcaactggacag

SEQ ID NO: 103056 - DNA, 25 bp, mus musculus
ctcctgctcaactggacagacatca

SEQ ID NO: 103057 - DNA, 25 bp, mus musculus
gtctgaatcccagtgataacagcct

SEQ ID NO: 103058 - DNA, 25 bp, mus musculus
tgaatcccagtgataacagcctgac

SEQ ID NO: 103059 - DNA, 25 bp, mus musculus
ataacagcctgaccttcactaatag

SEQ ID NO: 103060 - DNA, 25 bp, mus musculus
tgaccttcactaataggcaggctta

SEQ ID NO: 103061 - DNA, 25 bp, mus musculus
caggtcaccagcacattgcctccaa

SEQ ID NO: 103062 - DNA, 25 bp, mus musculus
agcacattgcctccaagcctcaggt

SEQ ID NO: 103063 - DNA, 25 bp, mus musculus
ccaagcctcaggtgctccacttaag

SEQ ID NO: 103064 - DNA, 25 bp, mus musculus
agcctcaggtgctccacttaagaga

SEQ ID NO: 103065 - DNA, 25 bp, mus musculus
aggtgctccacttaagagaagtggc

SEQ ID NO: 103066 - DNA, 25 bp, mus musculus
tgctccacttaagagaagtggcacc

SEQ ID NO: 103067 - DNA, 25 bp, mus musculus
ctcaactggacagacatcagcagca

SEQ ID NO: 103068 - DNA, 25 bp, mus musculus
aactggacagacatcagcagcaccc

SEQ ID NO: 103069 - DNA, 25 bp, mus musculus
gacatcagcagcaccctcaggaaga

SEQ ID NO: 103070 - DNA, 25 bp, mus musculus
atcagcagcaccctcaggaagagcc

SEQ ID NO: 103071 - DNA, 25 bp, mus musculus
agcagcaccctcaggaagagcctcc

SEQ ID NO: 103072 - DNA, 25 bp, mus musculus
accctcaggaagagcctcctgataa

SEQ ID NO: 103073 - DNA, 25 bp, mus musculus
ctcaggaagagcctcctgataaact

SEQ ID NO: 103074 - DNA, 25 bp, mus musculus
aacttgacagcaattttgggagcca

SEQ ID NO: 103075 - DNA, 25 bp, mus musculus
ccctgagcttcagacagaaactcac

SEQ ID NO: 103076 - DNA, 25 bp, mus musculus
gcttcagacagaaactcactgagca

SEQ ID NO: 103077 - DNA, 25 bp, mus musculus
accacctcatcctggaagccctggt

SEQ ID NO: 103078 - DNA, 25 bp, mus musculus
acctcatcctggaagccctggttat

SEQ ID NO: 103079 - DNA, 25 bp, mus musculus
cctcatcctggaagccctggttata

SEQ ID NO: 103080 - DNA, 25 bp, mus musculus
tcatcctggaagccctggttatatc

SEQ ID NO: 103081 - DNA, 25 bp, mus musculus
catcctggaagccctggttatatca

SEQ ID NO: 103082 - DNA, 25 bp, mus musculus
cctggaagccctggttatatcaact

SEQ ID NO: 103083 - DNA, 25 bp, mus musculus
tggaagccctggttatatcaactta

SEQ ID NO: 103084 - DNA, 25 bp, mus musculus
agccctggttatatcaacttaagct

SEQ ID NO: 103085 - DNA, 25 bp, mus musculus
ccctttgaagtggtaccagagcatg

SEQ ID NO: 103086 - DNA, 25 bp, mus musculus
gctgcaccaccaaatcatccctgtg

SEQ ID NO: 103087 - DNA, 25 bp, mus musculus
ttcagacagaaactcactgagcata

SEQ ID NO: 103088 - DNA, 25 bp, mus musculus
tcagacagaaactcactgagcatac

SEQ ID NO: 103089 - DNA, 25 bp, mus musculus
gacagaaactcactgagcatacact

SEQ ID NO: 103090 - DNA, 25 bp, mus musculus
cagaaactcactgagcatacactca

SEQ ID NO: 103091 - DNA, 25 bp, mus musculus
aactcactgagcatacactcaaaga

SEQ ID NO: 103092 - DNA, 25 bp, mus musculus
ctcactgagcatacactcaaagaac

SEQ ID NO: 103093 - DNA, 25 bp, mus musculus
tcactgagcatacactcaaagaacc

SEQ ID NO: 103094 - DNA, 25 bp, mus musculus
ctgagcatacactcaaagaaccatc

SEQ ID NO: 103095 - DNA, 25 bp, mus musculus
aggctctatcgagttagaggatctc

SEQ ID NO: 103096 - DNA, 25 bp, mus musculus
tagaggatctccttgcaacagtcgc

SEQ ID NO: 103097 - DNA, 25 bp, mus musculus
tatgctgtatctgtgcgacttgcaa

SEQ ID NO: 103098 - DNA, 25 bp, mus musculus
tgctgtatctgtgcgacttgcaaat

SEQ ID NO: 103099 - DNA, 25 bp, mus musculus
ctgtatctgtgcgacttgcaaatat

SEQ ID NO: 103100 - DNA, 25 bp, mus musculus
atctgtgcgacttgcaaatatctta

SEQ ID NO: 103101 - DNA, 25 bp, mus musculus
accattactgtagggcgcttcacat

SEQ ID NO: 103102 - DNA, 25 bp, mus musculus
ttactgtagggcgcttcacatggta

SEQ ID NO: 103103 - DNA, 25 bp, mus musculus
actgtagggcgcttcacatggtatc

SEQ ID NO: 103104 - DNA, 25 bp, mus musculus
tagggcgcttcacatggtatcttaa

SEQ ID NO: 103105 - DNA, 25 bp, mus musculus
gcgcttcacatggtatcttaagggt

SEQ ID NO: 103106 - DNA, 25 bp, mus musculus
gcttcacatggtatcttaagggtaa

SEQ ID NO: 103107 - DNA, 25 bp, mus musculus
ctccttgcaacagtcgctacctcta

SEQ ID NO: 103108 - DNA, 25 bp, mus musculus
ccttgcaacagtcgctacctctact

SEQ ID NO: 103109 - DNA, 25 bp, mus musculus
gcaacagtcgctacctctacttaag

SEQ ID NO: 103110 - DNA, 25 bp, mus musculus
aacagtcgctacctctacttaagtg

SEQ ID NO: 103111 - DNA, 25 bp, mus musculus
cagtcgctacctctacttaagtgac

SEQ ID NO: 103112 - DNA, 25 bp, mus musculus
gtcgctacctctacttaagtgacta

SEQ ID NO: 103113 - DNA, 25 bp, mus musculus
tgtacgtcagtatcgagatgtatgc

SEQ ID NO: 103114 - DNA, 25 bp, mus musculus
tgtatgctgtatctgtgcgacttgc

SEQ ID NO: 103115 - DNA, 25 bp, mus musculus
atgccatcggaagtgcggagaggct

SEQ ID NO: 103116 - DNA, 25 bp, mus musculus
ccatcggaagtgcggagaggctgaa

SEQ ID NO: 103117 - DNA, 25 bp, mus musculus
atgatgaccagtacaaactggaaca

SEQ ID NO: 103118 - DNA, 25 bp, mus musculus
atgaccagtacaaactggaacaggc

SEQ ID NO: 103119 - DNA, 25 bp, mus musculus
aaactggaacaggctgacgatatat

SEQ ID NO: 103120 - DNA, 25 bp, mus musculus
cagatgtaggctctctgagatagcg

SEQ ID NO: 103121 - DNA, 25 bp, mus musculus
atgtaggctctctgagatagcgcta

SEQ ID NO: 103122 - DNA, 25 bp, mus musculus
tgtaggctctctgagatagcgctat

SEQ ID NO: 103123 - DNA, 25 bp, mus musculus
taggctctctgagatagcgctattc

SEQ ID NO: 103124 - DNA, 25 bp, mus musculus
aggctctctgagatagcgctattca

SEQ ID NO: 103125 - DNA, 25 bp, mus musculus
ggctctctgagatagcgctattcag

SEQ ID NO: 103126 - DNA, 25 bp, mus musculus
ctctctgagatagcgctattcagct

SEQ ID NO: 103127 - DNA, 25 bp, mus musculus
gtgagcatcacgtactcaagaagaa

SEQ ID NO: 103128 - DNA, 25 bp, mus musculus
tgagcatcacgtactcaagaagaag

SEQ ID NO: 103129 - DNA, 25 bp, mus musculus
gagcatcacgtactcaagaagaagc

SEQ ID NO: 103130 - DNA, 25 bp, mus musculus
gcatcacgtactcaagaagaagcat

SEQ ID NO: 103131 - DNA, 25 bp, mus musculus
catcacgtactcaagaagaagcatg

SEQ ID NO: 103132 - DNA, 25 bp, mus musculus
atcacgtactcaagaagaagcatga

SEQ ID NO: 103133 - DNA, 25 bp, mus musculus
ataagtatgccgagtccgatgaatg

SEQ ID NO: 103134 - DNA, 25 bp, mus musculus
atgccgagtccgatgaatgatgacc

SEQ ID NO: 103135 - DNA, 25 bp, mus musculus
gactgtactcacgctgtataatatg

SEQ ID NO: 103136 - DNA, 25 bp, mus musculus
tgtactcacgctgtataatatggac

SEQ ID NO: 103137 - DNA, 25 bp, mus musculus
cagatcctccagcagagcatcacgg

SEQ ID NO: 103138 - DNA, 25 bp, mus musculus
atcctccagcagagcatcacggtgg

SEQ ID NO: 103139 - DNA, 25 bp, mus musculus
gtgcctttctccagaaggtcttctg

SEQ ID NO: 103140 - DNA, 25 bp, mus musculus
aggtcttctggatatctcaccagaa

SEQ ID NO: 103141 - DNA, 25 bp, mus musculus
tcttctggatatctcaccagaaaat

SEQ ID NO: 103142 - DNA, 25 bp, mus musculus
tctggatatctcaccagaaaatata

SEQ ID NO: 103143 - DNA, 25 bp, mus musculus
gagaagaacaacctccgagactggc

SEQ ID NO: 103144 - DNA, 25 bp, mus musculus
ctgcgcgttcatcgcaacatgagag

SEQ ID NO: 103145 - DNA, 25 bp, mus musculus
cgcgttcatcgcaacatgagagaga

SEQ ID NO: 103146 - DNA, 25 bp, mus musculus
gttcatcgcaacatgagagagagtt

SEQ ID NO: 103147 - DNA, 25 bp, mus musculus
actcacgctgtataatatggactca

SEQ ID NO: 103148 - DNA, 25 bp, mus musculus
aaggatgctgccaaatcagaccaga

SEQ ID NO: 103149 - DNA, 25 bp, mus musculus
gatgctgccaaatcagaccagatcc

SEQ ID NO: 103150 - DNA, 25 bp, mus musculus
gctgccaaatcagaccagatcctcc

SEQ ID NO: 103151 - DNA, 25 bp, mus musculus
gccaaatcagaccagatcctccagc

SEQ ID NO: 103152 - DNA, 25 bp, mus musculus
aaatcagaccagatcctccagcaga

SEQ ID NO: 103153 - DNA, 25 bp, mus musculus
tcagaccagatcctccagcagagca

SEQ ID NO: 103154 - DNA, 25 bp, mus musculus
gaccagatcctccagcagagcatca

SEQ ID NO: 103155 - DNA, 25 bp, mus musculus
tcctgccactttaatctcgtgatgc

SEQ ID NO: 103156 - DNA, 25 bp, mus musculus
cactttaatctcgtgatgcttagct

SEQ ID NO: 103157 - DNA, 25 bp, mus musculus
ccactcgacgagtccaggtggcaga

SEQ ID NO: 103158 - DNA, 25 bp, mus musculus
ctcgacgagtccaggtggcagaaca

SEQ ID NO: 103159 - DNA, 25 bp, mus musculus
tggcagaacatcccagattgctgaa

SEQ ID NO: 103160 - DNA, 25 bp, mus musculus
aacatcccagattgctgaagctaaa

SEQ ID NO: 103161 - DNA, 25 bp, mus musculus
atcccagattgctgaagctaaaaga

SEQ ID NO: 103162 - DNA, 25 bp, mus musculus
tttatgttcgagccccaggaagagt

SEQ ID NO: 103163 - DNA, 25 bp, mus musculus
atgttcgagccccaggaagagtcaa

SEQ ID NO: 103164 - DNA, 25 bp, mus musculus
attccgttattcccatggctgtgga

SEQ ID NO: 103165 - DNA, 25 bp, mus musculus
ccgttattcccatggctgtggaaca

SEQ ID NO: 103166 - DNA, 25 bp, mus musculus
ttcccatggctgtggaacaagacat

SEQ ID NO: 103167 - DNA, 25 bp, mus musculus
tttaatctcgtgatgcttagctgtg

SEQ ID NO: 103168 - DNA, 25 bp, mus musculus
aatctcgtgatgcttagctgtgctg

SEQ ID NO: 103169 - DNA, 25 bp, mus musculus
gtgatgcttagctgtgctgcacttc

SEQ ID NO: 103170 - DNA, 25 bp, mus musculus
atgcttagctgtgctgcacttctgg

SEQ ID NO: 103171 - DNA, 25 bp, mus musculus
cttagctgtgctgcacttctggaaa

SEQ ID NO: 103172 - DNA, 25 bp, mus musculus
tgtgctgcacttctggaaactgcag

SEQ ID NO: 103173 - DNA, 25 bp, mus musculus
gctgcacttctggaaactgcagagg

SEQ ID NO: 103174 - DNA, 25 bp, mus musculus
gcacttctggaaactgcagagggat

SEQ ID NO: 103175 - DNA, 25 bp, mus musculus
tcacccagtgcctgtccttgatgca

SEQ ID NO: 103176 - DNA, 25 bp, mus musculus
agtgcctgtccttgatgcactgctg

SEQ ID NO: 103177 - DNA, 25 bp, mus musculus
ccttcatcttcaagtactcggccac

SEQ ID NO: 103178 - DNA, 25 bp, mus musculus
tcttcaagtactcggccacaacagg

SEQ ID NO: 103179 - DNA, 25 bp, mus musculus
agtactcggccacaacaggtctcac

SEQ ID NO: 103180 - DNA, 25 bp, mus musculus
cggccacaacaggtctcaccaagct

SEQ ID NO: 103181 - DNA, 25 bp, mus musculus
caacaggtctcaccaagctcattga

SEQ ID NO: 103182 - DNA, 25 bp, mus musculus
gtctcaccaagctcattgatgcctc

SEQ ID NO: 103183 - DNA, 25 bp, mus musculus
ccaagctcattgatgcctccagagt

SEQ ID NO: 103184 - DNA, 25 bp, mus musculus
atgcctccagagtgtcagagacaga

SEQ ID NO: 103185 - DNA, 25 bp, mus musculus
agacagagtactctgccctggaaca

SEQ ID NO: 103186 - DNA, 25 bp, mus musculus
agtactctgccctggaacagaacac

SEQ ID NO: 103187 - DNA, 25 bp, mus musculus
tgtccttgatgcactgctgtgtcaa

SEQ ID NO: 103188 - DNA, 25 bp, mus musculus
ctctgccctggaacagaacaccaag

SEQ ID NO: 103189 - DNA, 25 bp, mus musculus
tgatgcactgctgtgtcaaccccgt

SEQ ID NO: 103190 - DNA, 25 bp, mus musculus
accccgtgctctacagcttcatcaa

SEQ ID NO: 103191 - DNA, 25 bp, mus musculus
tgctctacagcttcatcaaccgcaa

SEQ ID NO: 103192 - DNA, 25 bp, mus musculus
acagcttcatcaaccgcaactacag

SEQ ID NO: 103193 - DNA, 25 bp, mus musculus
tcatcaaccgcaactacaggtacga

SEQ ID NO: 103194 - DNA, 25 bp, mus musculus
accgcaactacaggtacgagctgat

SEQ ID NO: 103195 - DNA, 25 bp, mus musculus
actacaggtacgagctgatgaaggc

SEQ ID NO: 103196 - DNA, 25 bp, mus musculus
aagtaaatacatcccactttgtcat

SEQ ID NO: 103197 - DNA, 25 bp, mus musculus
agtaaatacatcccactttgtcatt

SEQ ID NO: 103198 - DNA, 25 bp, mus musculus
catagatctgttcccatattatccc

SEQ ID NO: 103199 - DNA, 25 bp, mus musculus
atagatctgttcccatattatccca

SEQ ID NO: 103200 - DNA, 25 bp, mus musculus
tagatctgttcccatattatcccat

SEQ ID NO: 103201 - DNA, 25 bp, mus musculus
acatattcatcttatacaattctaa

SEQ ID NO: 103202 - DNA, 25 bp, mus musculus
catattcatcttatacaattctaat

SEQ ID NO: 103203 - DNA, 25 bp, mus musculus
atattcatcttatacaattctaatt

SEQ ID NO: 103204 - DNA, 25 bp, mus musculus
attcatcttatacaattctaattta

SEQ ID NO: 103205 - DNA, 25 bp, mus musculus
gtaaatacatcccactttgtcattt

SEQ ID NO: 103206 - DNA, 25 bp, mus musculus
tttttctgtcatagatctgttccca

SEQ ID NO: 103207 - DNA, 25 bp, mus musculus
tttctgtcatagatctgttcccata

SEQ ID NO: 103208 - DNA, 25 bp, mus musculus
ttctgtcatagatctgttcccatat

SEQ ID NO: 103209 - DNA, 25 bp, mus musculus
ctgtcatagatctgttcccatatta

SEQ ID NO: 103210 - DNA, 25 bp, mus musculus
tgtcatagatctgttcccatattat

SEQ ID NO: 103211 - DNA, 25 bp, mus musculus
gtcatagatctgttcccatattatc

SEQ ID NO: 103212 - DNA, 25 bp, mus musculus
tcatagatctgttcccatattatcc

SEQ ID NO: 103213 - DNA, 25 bp, mus musculus
agaatctcgtctaggcagatccacg

SEQ ID NO: 103214 - DNA, 25 bp, mus musculus
atctcgtctaggcagatccacgctt

SEQ ID NO: 103215 - DNA, 25 bp, mus musculus
actgcatgagcgccagcagagctgc

SEQ ID NO: 103216 - DNA, 25 bp, mus musculus
gcatgagcgccagcagagctgctca

SEQ ID NO: 103217 - DNA, 25 bp, mus musculus
tgagcgccagcagagctgctcatgc

SEQ ID NO: 103218 - DNA, 25 bp, mus musculus
gagctgctcatgcatacctgtggaa

SEQ ID NO: 103219 - DNA, 25 bp, mus musculus
agtcacgcagtcatatagaatagaa

SEQ ID NO: 103220 - DNA, 25 bp, mus musculus
gcggctcaccattgtgggcctccaa

SEQ ID NO: 103221 - DNA, 25 bp, mus musculus
caccattgtgggcctccaagcattt

SEQ ID NO: 103222 - DNA, 25 bp, mus musculus
tgtgggcctccaagcatttggggag

SEQ ID NO: 103223 - DNA, 25 bp, mus musculus
gggcctccaagcatttggggagcag

SEQ ID NO: 103224 - DNA, 25 bp, mus musculus
cctccaagcatttggggagcagtcg

SEQ ID NO: 103225 - DNA, 25 bp, mus musculus
tctaggcagatccacgcttgtcaac

SEQ ID NO: 103226 - DNA, 25 bp, mus musculus
aggcagatccacgcttgtcaacagc

SEQ ID NO: 103227 - DNA, 25 bp, mus musculus
gcttgtcaacagcctcatcgtccat

SEQ ID NO: 103228 - DNA, 25 bp, mus musculus
tgtcaacagcctcatcgtccatgac

SEQ ID NO: 103229 - DNA, 25 bp, mus musculus
cagcctcatcgtccatgacttgtac

SEQ ID NO: 103230 - DNA, 25 bp, mus musculus
catcgtccatgacttgtaccgggat

SEQ ID NO: 103231 - DNA, 25 bp, mus musculus
ccatgacttgtaccgggatcgacaa

SEQ ID NO: 103232 - DNA, 25 bp, mus musculus
tcgacaactgcatgagcgccagcag

SEQ ID NO: 103233 - DNA, 25 bp, mus musculus
cccgagttcctgacaatgatgtcca

SEQ ID NO: 103234 - DNA, 25 bp, mus musculus
cgagttcctgacaatgatgtccagg

SEQ ID NO: 103235 - DNA, 25 bp, mus musculus
agtgcagccgagctgaggcacgtga

SEQ ID NO: 103236 - DNA, 25 bp, mus musculus
tgcagccgagctgaggcacgtgatg

SEQ ID NO: 103237 - DNA, 25 bp, mus musculus
gcagccgagctgaggcacgtgatga

SEQ ID NO: 103238 - DNA, 25 bp, mus musculus
atacaggcggcagatacagatggtg

SEQ ID NO: 103239 - DNA, 25 bp, mus musculus
ggagtttgtccacatgctggtgtcc

SEQ ID NO: 103240 - DNA, 25 bp, mus musculus
gagtttgtccacatgctggtgtcca

SEQ ID NO: 103241 - DNA, 25 bp, mus musculus
gtttgtccacatgctggtgtccaaa

SEQ ID NO: 103242 - DNA, 25 bp, mus musculus
tttgtccacatgctggtgtccaaat

SEQ ID NO: 103243 - DNA, 25 bp, mus musculus
tgtccacatgctggtgtccaaatga

SEQ ID NO: 103244 - DNA, 25 bp, mus musculus
gtccacatgctggtgtccaaatgag

SEQ ID NO: 103245 - DNA, 25 bp, mus musculus
tggcaatggcttcgtcagtgcagcc

SEQ ID NO: 103246 - DNA, 25 bp, mus musculus
caatggcttcgtcagtgcagccgag

SEQ ID NO: 103247 - DNA, 25 bp, mus musculus
aatggcttcgtcagtgcagccgagc

SEQ ID NO: 103248 - DNA, 25 bp, mus musculus
tggcttcgtcagtgcagccgagctg

SEQ ID NO: 103249 - DNA, 25 bp, mus musculus
ggcttcgtcagtgcagccgagctga

SEQ ID NO: 103250 - DNA, 25 bp, mus musculus
cttcgtcagtgcagccgagctgagg

SEQ ID NO: 103251 - DNA, 25 bp, mus musculus
cgtcagtgcagccgagctgaggcac

SEQ ID NO: 103252 - DNA, 25 bp, mus musculus
gtcagtgcagccgagctgaggcacg

SEQ ID NO: 103253 - DNA, 25 bp, mus musculus
acaacggctgagggaccaaatcaag

SEQ ID NO: 103254 - DNA, 25 bp, mus musculus
tagcgtccaacgagatcaaggacaa

SEQ ID NO: 103255 - DNA, 25 bp, mus musculus
caagctcattgagacgcaaatggaa

SEQ ID NO: 103256 - DNA, 25 bp, mus musculus
cttacagcaaagagggcctgggctg

SEQ ID NO: 103257 - DNA, 25 bp, mus musculus
gtggtcacgaataccatcgacacgc

SEQ ID NO: 103258 - DNA, 25 bp, mus musculus
ggtcacgaataccatcgacacgctc

SEQ ID NO: 103259 - DNA, 25 bp, mus musculus
acgaataccatcgacacgctcaaca

SEQ ID NO: 103260 - DNA, 25 bp, mus musculus
ataccatcgacacgctcaacatgca

SEQ ID NO: 103261 - DNA, 25 bp, mus musculus
accatcgacacgctcaacatgcagg

SEQ ID NO: 103262 - DNA, 25 bp, mus musculus
tcgacacgctcaacatgcaggtgga

SEQ ID NO: 103263 - DNA, 25 bp, mus musculus
gacacgctcaacatgcaggtggacc

SEQ ID NO: 103264 - DNA, 25 bp, mus musculus
cacgctcaacatgcaggtggaccag

SEQ ID NO: 103265 - DNA, 25 bp, mus musculus
gcgtccaacgagatcaaggacaaga

SEQ ID NO: 103266 - DNA, 25 bp, mus musculus
ctcaacatgcaggtggaccagtttg

SEQ ID NO: 103267 - DNA, 25 bp, mus musculus
gcagcttatagacaaccgcaagctc

SEQ ID NO: 103268 - DNA, 25 bp, mus musculus
agcttatagacaaccgcaagctcat

SEQ ID NO: 103269 - DNA, 25 bp, mus musculus
cttatagacaaccgcaagctcattg

SEQ ID NO: 103270 - DNA, 25 bp, mus musculus
tagacaaccgcaagctcattgagac

SEQ ID NO: 103271 - DNA, 25 bp, mus musculus
gacaaccgcaagctcattgagacgc

SEQ ID NO: 103272 - DNA, 25 bp, mus musculus
caaccgcaagctcattgagacgcaa

SEQ ID NO: 103273 - DNA, 25 bp, mus musculus
accgcaagctcattgagacgcaaat

SEQ ID NO: 103274 - DNA, 25 bp, mus musculus
cctattggggtgtttcgcgagtgtg

SEQ ID NO: 103275 - DNA, 25 bp, mus musculus
ccgcggcctgtatttctagacctgc

SEQ ID NO: 103276 - DNA, 25 bp, mus musculus
tgctacggcctgtggctggactgcc

SEQ ID NO: 103277 - DNA, 25 bp, mus musculus
ctacggcctgtggctggactgcctg

SEQ ID NO: 103278 - DNA, 25 bp, mus musculus
gactgcctgctgctgcccaactggc

SEQ ID NO: 103279 - DNA, 25 bp, mus musculus
ctgctgctgcccaactggctggcaa

SEQ ID NO: 103280 - DNA, 25 bp, mus musculus
tgctgcccaactggctggcaagatg

SEQ ID NO: 103281 - DNA, 25 bp, mus musculus
ctgcccaactggctggcaagatgaa

SEQ ID NO: 103282 - DNA, 25 bp, mus musculus
gcccaactggctggcaagatgaagc

SEQ ID NO: 103283 - DNA, 25 bp, mus musculus
ccaactggctggcaagatgaagctc

SEQ ID NO: 103284 - DNA, 25 bp, mus musculus
agatgaagctctccctggtggccgc

SEQ ID NO: 103285 - DNA, 25 bp, mus musculus
agctctccctggtggccgcgatgct

SEQ ID NO: 103286 - DNA, 25 bp, mus musculus
ggcctgtatttctagacctgccctt

SEQ ID NO: 103287 - DNA, 25 bp, mus musculus
tgtatttctagacctgcccttcgcc

SEQ ID NO: 103288 - DNA, 25 bp, mus musculus
tttctagacctgcccttcgcctggt

SEQ ID NO: 103289 - DNA, 25 bp, mus musculus
gcctggttcgtggcgccttgtgacc

SEQ ID NO: 103290 - DNA, 25 bp, mus musculus
cctgccgcctgcaagtcggaaattg

SEQ ID NO: 103291 - DNA, 25 bp, mus musculus
tgccgcctgcaagtcggaaattgcg

SEQ ID NO: 103292 - DNA, 25 bp, mus musculus
aattgcgctgtgctcctgtgctacg

SEQ ID NO: 103293 - DNA, 25 bp, mus musculus
ttgcgctgtgctcctgtgctacggc

SEQ ID NO: 103294 - DNA, 25 bp, mus musculus
gggccagacccagcgcatccggtgc

SEQ ID NO: 103295 - DNA, 25 bp, mus musculus
ggccagacccagcgcatccggtgca

SEQ ID NO: 103296 - DNA, 25 bp, mus musculus
gcgcatccggtgcagggtgcctgca

SEQ ID NO: 103297 - DNA, 25 bp, mus musculus
cgcatccggtgcagggtgcctgcaa

SEQ ID NO: 103298 - DNA, 25 bp, mus musculus
gcatccggtgcagggtgcctgcaac

SEQ ID NO: 103299 - DNA, 25 bp, mus musculus
catccggtgcagggtgcctgcaact

SEQ ID NO: 103300 - DNA, 25 bp, mus musculus
atccggtgcagggtgcctgcaactg

SEQ ID NO: 103301 - DNA, 25 bp, mus musculus
tgcagggtgcctgcaactggaagaa

SEQ ID NO: 103302 - DNA, 25 bp, mus musculus
cagggtgcctgcaactggaagaagg

SEQ ID NO: 103303 - DNA, 25 bp, mus musculus
ggtgcctgcaactggaagaaggagt

SEQ ID NO: 103304 - DNA, 25 bp, mus musculus
gtgcctgcaactggaagaaggagtt

SEQ ID NO: 103305 - DNA, 25 bp, mus musculus
gccagacccagcgcatccggtgcag

SEQ ID NO: 103306 - DNA, 25 bp, mus musculus
ccagacccagcgcatccggtgcagg

SEQ ID NO: 103307 - DNA, 25 bp, mus musculus
cagacccagcgcatccggtgcaggg

SEQ ID NO: 103308 - DNA, 25 bp, mus musculus
agacccagcgcatccggtgcagggt

SEQ ID NO: 103309 - DNA, 25 bp, mus musculus
gacccagcgcatccggtgcagggtg

SEQ ID NO: 103310 - DNA, 25 bp, mus musculus
acccagcgcatccggtgcagggtgc

SEQ ID NO: 103311 - DNA, 25 bp, mus musculus
cccagcgcatccggtgcagggtgcc

SEQ ID NO: 103312 - DNA, 25 bp, mus musculus
ccagcgcatccggtgcagggtgcct

SEQ ID NO: 103313 - DNA, 25 bp, mus musculus
gatcctggacaggcaccccggcttg

SEQ ID NO: 103314 - DNA, 25 bp, mus musculus
atcctggacaggcaccccggcttgg

SEQ ID NO: 103315 - DNA, 25 bp, mus musculus
gtacctggagcagctccatcagctc

SEQ ID NO: 103316 - DNA, 25 bp, mus musculus
gagcagctccatcagctctacagtg

SEQ ID NO: 103317 - DNA, 25 bp, mus musculus
agcagctccatcagctctacagtga

SEQ ID NO: 103318 - DNA, 25 bp, mus musculus
gcagctccatcagctctacagtgac

SEQ ID NO: 103319 - DNA, 25 bp, mus musculus
cagctccatcagctctacagtgaca

SEQ ID NO: 103320 - DNA, 25 bp, mus musculus
gctccatcagctctacagtgacagc

SEQ ID NO: 103321 - DNA, 25 bp, mus musculus
ctccatcagctctacagtgacagct

SEQ ID NO: 103322 - DNA, 25 bp, mus musculus
tccatcagctctacagtgacagctt

SEQ ID NO: 103323 - DNA, 25 bp, mus musculus
ccatcagctctacagtgacagcttc

SEQ ID NO: 103324 - DNA, 25 bp, mus musculus
tcagctctacagtgacagcttccca

SEQ ID NO: 103325 - DNA, 25 bp, mus musculus
tcctggacaggcaccccggcttggc

SEQ ID NO: 103326 - DNA, 25 bp, mus musculus
cctggacaggcaccccggcttggcg

SEQ ID NO: 103327 - DNA, 25 bp, mus musculus
tggacaggcaccccggcttggcgct

SEQ ID NO: 103328 - DNA, 25 bp, mus musculus
ggcccttcggcctgagggagcctcg

SEQ ID NO: 103329 - DNA, 25 bp, mus musculus
ccttcggcctgagggagcctcgccg

SEQ ID NO: 103330 - DNA, 25 bp, mus musculus
cttcggcctgagggagcctcgccgc

SEQ ID NO: 103331 - DNA, 25 bp, mus musculus
tggcccaatggaatcagctacagca

SEQ ID NO: 103332 - DNA, 25 bp, mus musculus
aatcagctacagcagcttgacacac

SEQ ID NO: 103333 - DNA, 25 bp, mus musculus
cctaggcgacgagacccagtggcta

SEQ ID NO: 103334 - DNA, 25 bp, mus musculus
agaagttcaccatgtctattctcaa

SEQ ID NO: 103335 - DNA, 25 bp, mus musculus
tctcttcacctcaaaaggtctcttc

SEQ ID NO: 103336 - DNA, 25 bp, mus musculus
cttcacctcaaaaggtctcttcaga

SEQ ID NO: 103337 - DNA, 25 bp, mus musculus
cacctcaaaaggtctcttcagagct

SEQ ID NO: 103338 - DNA, 25 bp, mus musculus
aggtctcttcagagctgctgtgcca

SEQ ID NO: 103339 - DNA, 25 bp, mus musculus
tctcttcagagctgctgtgccagtg

SEQ ID NO: 103340 - DNA, 25 bp, mus musculus
gccagtggtgcttcaactggtatct

SEQ ID NO: 103341 - DNA, 25 bp, mus musculus
ggtgcttcaactggtatctatgagg

SEQ ID NO: 103342 - DNA, 25 bp, mus musculus
tatgaggccctagagctccgggaca

SEQ ID NO: 103343 - DNA, 25 bp, mus musculus
gaggccctagagctccgggacaatg

SEQ ID NO: 103344 - DNA, 25 bp, mus musculus
gccctagagctccgggacaatgata

SEQ ID NO: 103345 - DNA, 25 bp, mus musculus
tcaccatgtctattctcaagatcca

SEQ ID NO: 103346 - DNA, 25 bp, mus musculus
actattgcgcctgccctggttagca

SEQ ID NO: 103347 - DNA, 25 bp, mus musculus
ccatgtctattctcaagatccatgc

SEQ ID NO: 103348 - DNA, 25 bp, mus musculus
ttctcaagatccatgccagggagat

SEQ ID NO: 103349 - DNA, 25 bp, mus musculus
tcaagatccatgccagggagatctt

SEQ ID NO: 103350 - DNA, 25 bp, mus musculus
agatccatgccagggagatctttga

SEQ ID NO: 103351 - DNA, 25 bp, mus musculus
ttgactctcgcgggaatccactgtt

SEQ ID NO: 103352 - DNA, 25 bp, mus musculus
actctcgcgggaatccactgttgag

SEQ ID NO: 103353 - DNA, 25 bp, mus musculus
atccactgttgaggttgatctcttc

SEQ ID NO: 103354 - DNA, 25 bp, mus musculus
gcagtggaaccgactcccagaactc

SEQ ID NO: 103355 - DNA, 25 bp, mus musculus
gactcccagaactccggacgtgtgc

SEQ ID NO: 103356 - DNA, 25 bp, mus musculus
acggccatgcgcatcctatgcggag

SEQ ID NO: 103357 - DNA, 25 bp, mus musculus
cggccatgcgcatcctatgcggagt

SEQ ID NO: 103358 - DNA, 25 bp, mus musculus
ggccatgcgcatcctatgcggagtc

SEQ ID NO: 103359 - DNA, 25 bp, mus musculus
gcgcatcctatgcggagtcatcagc

SEQ ID NO: 103360 - DNA, 25 bp, mus musculus
cgcatcctatgcggagtcatcagcg

SEQ ID NO: 103361 - DNA, 25 bp, mus musculus
gcatcctatgcggagtcatcagcgc

SEQ ID NO: 103362 - DNA, 25 bp, mus musculus
catcctatgcggagtcatcagcgcc

SEQ ID NO: 103363 - DNA, 25 bp, mus musculus
atcctatgcggagtcatcagcgcca

SEQ ID NO: 103364 - DNA, 25 bp, mus musculus
tcctatgcggagtcatcagcgccat

SEQ ID NO: 103365 - DNA, 25 bp, mus musculus
cctatgcggagtcatcagcgccatc

SEQ ID NO: 103366 - DNA, 25 bp, mus musculus
cagtgagtcgcagccatgttcctgg

SEQ ID NO: 103367 - DNA, 25 bp, mus musculus
agtgagtcgcagccatgttcctggt

SEQ ID NO: 103368 - DNA, 25 bp, mus musculus
gccatgttcctggttaactcgttct

SEQ ID NO: 103369 - DNA, 25 bp, mus musculus
catgttcctggttaactcgttcttg

SEQ ID NO: 103370 - DNA, 25 bp, mus musculus
aaatgtgcttggaggcctgatcagc

SEQ ID NO: 103371 - DNA, 25 bp, mus musculus
ggaacggccatgcgcatcctatgcg

SEQ ID NO: 103372 - DNA, 25 bp, mus musculus
gaacggccatgcgcatcctatgcgg

SEQ ID NO: 103373 - DNA, 25 bp, mus musculus
aacggccatgcgcatcctatgcgga

SEQ ID NO: 103374 - DNA, 25 bp, mus musculus
tcatccttatggtttcacacgggtg

SEQ ID NO: 103375 - DNA, 25 bp, mus musculus
catccttatggtttcacacgggtga

SEQ ID NO: 103376 - DNA, 25 bp, mus musculus
gcattaacccagacagcacttgtgg

SEQ ID NO: 103377 - DNA, 25 bp, mus musculus
cattaacccagacagcacttgtggc

SEQ ID NO: 103378 - DNA, 25 bp, mus musculus
attaacccagacagcacttgtggca

SEQ ID NO: 103379 - DNA, 25 bp, mus musculus
ttaacccagacagcacttgtggcaa

SEQ ID NO: 103380 - DNA, 25 bp, mus musculus
taacccagacagcacttgtggcaat

SEQ ID NO: 103381 - DNA, 25 bp, mus musculus
aacccagacagcacttgtggcaatg

SEQ ID NO: 103382 - DNA, 25 bp, mus musculus
acccagacagcacttgtggcaatga

SEQ ID NO: 103383 - DNA, 25 bp, mus musculus
cccagacagcacttgtggcaatgac

SEQ ID NO: 103384 - DNA, 25 bp, mus musculus
tgcaatccatgcagagtcaaaaata

SEQ ID NO: 103385 - DNA, 25 bp, mus musculus
gcaatccatgcagagtcaaaaatat

SEQ ID NO: 103386 - DNA, 25 bp, mus musculus
tccttatggtttcacacgggtgatg

SEQ ID NO: 103387 - DNA, 25 bp, mus musculus
ccttatggtttcacacgggtgatgt

SEQ ID NO: 103388 - DNA, 25 bp, mus musculus
ttatggtttcacacgggtgatgtca

SEQ ID NO: 103389 - DNA, 25 bp, mus musculus
atggtttcacacgggtgatgtcaag

SEQ ID NO: 103390 - DNA, 25 bp, mus musculus
tggtttcacacgggtgatgtcaagt

SEQ ID NO: 103391 - DNA, 25 bp, mus musculus
ttcacacgggtgatgtcaagttact

SEQ ID NO: 103392 - DNA, 25 bp, mus musculus
tcaagttactattggccaagaaatt

SEQ ID NO: 103393 - DNA, 25 bp, mus musculus
gtgagcattaacccagacagcactt

SEQ ID NO: 103394 - DNA, 25 bp, mus musculus
acgagccctgtctcctgaagaggct

SEQ ID NO: 103395 - DNA, 25 bp, mus musculus
agccctgtctcctgaagaggctgcc

SEQ ID NO: 103396 - DNA, 25 bp, mus musculus
tggccaacagccccgtgtctatcat

SEQ ID NO: 103397 - DNA, 25 bp, mus musculus
aagtctatggccgcggctgtcagaa

SEQ ID NO: 103398 - DNA, 25 bp, mus musculus
tctatggccgcggctgtcagaaggc

SEQ ID NO: 103399 - DNA, 25 bp, mus musculus
aggccggactttcgagatgtctgac

SEQ ID NO: 103400 - DNA, 25 bp, mus musculus
ccggactttcgagatgtctgacttc

SEQ ID NO: 103401 - DNA, 25 bp, mus musculus
gatgtctgacttcatcgtggacaca

SEQ ID NO: 103402 - DNA, 25 bp, mus musculus
gtctgacttcatcgtggacacaagg

SEQ ID NO: 103403 - DNA, 25 bp, mus musculus
tgacttcatcgtggacacaagggat

SEQ ID NO: 103404 - DNA, 25 bp, mus musculus
cttcatcgtggacacaagggatgca

SEQ ID NO: 103405 - DNA, 25 bp, mus musculus
ttatggtggcatatccttggcggtg

SEQ ID NO: 103406 - DNA, 25 bp, mus musculus
cctgtctcctgaagaggctgcccaa

SEQ ID NO: 103407 - DNA, 25 bp, mus musculus
gtctcctgaagaggctgcccaacaa

SEQ ID NO: 103408 - DNA, 25 bp, mus musculus
ggctgcccaacaaccacattggcat

SEQ ID NO: 103409 - DNA, 25 bp, mus musculus
acaaccacattggcatctccttcat

SEQ ID NO: 103410 - DNA, 25 bp, mus musculus
gcgaacatctggtcagcatcaagaa

SEQ ID NO: 103411 - DNA, 25 bp, mus musculus
atggcaaccatgtggccaacagccc

SEQ ID NO: 103412 - DNA, 25 bp, mus musculus
gcaaccatgtggccaacagccccgt

SEQ ID NO: 103413 - DNA, 25 bp, mus musculus
atgtggccaacagccccgtgtctat

SEQ ID NO: 103414 - DNA, 25 bp, mus musculus
tttggtttcacaagcgaagtggccg

SEQ ID NO: 103415 - DNA, 25 bp, mus musculus
ttggtttcacaagcgaagtggccga

SEQ ID NO: 103416 - DNA, 25 bp, mus musculus
agcaatccacgaaattgtggactca

SEQ ID NO: 103417 - DNA, 25 bp, mus musculus
gcaatccacgaaattgtggactcaa

SEQ ID NO: 103418 - DNA, 25 bp, mus musculus
attacccgggatggatgtggacctg

SEQ ID NO: 103419 - DNA, 25 bp, mus musculus
cctatctgttgcatataagaatgtt

SEQ ID NO: 103420 - DNA, 25 bp, mus musculus
gctaaaagagcctcctggagaatta

SEQ ID NO: 103421 - DNA, 25 bp, mus musculus
ctaaaagagcctcctggagaattat

SEQ ID NO: 103422 - DNA, 25 bp, mus musculus
aattatcagccgtattgaacagaaa

SEQ ID NO: 103423 - DNA, 25 bp, mus musculus
attatcagccgtattgaacagaaag

SEQ ID NO: 103424 - DNA, 25 bp, mus musculus
ttatcagccgtattgaacagaaagg

SEQ ID NO: 103425 - DNA, 25 bp, mus musculus
tatcagccgtattgaacagaaagga

SEQ ID NO: 103426 - DNA, 25 bp, mus musculus
tggtttcacaagcgaagtggccgaa

SEQ ID NO: 103427 - DNA, 25 bp, mus musculus
tttcacaagcgaagtggccgaacaa

SEQ ID NO: 103428 - DNA, 25 bp, mus musculus
ttcacaagcgaagtggccgaacaag

SEQ ID NO: 103429 - DNA, 25 bp, mus musculus
agtttgagcaatccacgaaattgtg

SEQ ID NO: 103430 - DNA, 25 bp, mus musculus
gtttgagcaatccacgaaattgtgg

SEQ ID NO: 103431 - DNA, 25 bp, mus musculus
tttgagcaatccacgaaattgtgga

SEQ ID NO: 103432 - DNA, 25 bp, mus musculus
ttgagcaatccacgaaattgtggac

SEQ ID NO: 103433 - DNA, 25 bp, mus musculus
tgagcaatccacgaaattgtggact

SEQ ID NO: 103434 - DNA, 25 bp, mus musculus
ggaatcatggcggctgcctgttcgt

SEQ ID NO: 103435 - DNA, 25 bp, mus musculus
atcatggcggctgcctgttcgtgct

SEQ ID NO: 103436 - DNA, 25 bp, mus musculus
caagatactcctcacctgctccttg

SEQ ID NO: 103437 - DNA, 25 bp, mus musculus
cctcacctgctccttgaatgacagc

SEQ ID NO: 103438 - DNA, 25 bp, mus musculus
cacctgctccttgaatgacagcgcc

SEQ ID NO: 103439 - DNA, 25 bp, mus musculus
ctgctccttgaatgacagcgccaca

SEQ ID NO: 103440 - DNA, 25 bp, mus musculus
ctccttgaatgacagcgccacagag

SEQ ID NO: 103441 - DNA, 25 bp, mus musculus
cttgaatgacagcgccacagaggtc

SEQ ID NO: 103442 - DNA, 25 bp, mus musculus
gaatgacagcgccacagaggtcaca

SEQ ID NO: 103443 - DNA, 25 bp, mus musculus
cagcgccacagaggtcacagggcac

SEQ ID NO: 103444 - DNA, 25 bp, mus musculus
cgccacagaggtcacagggcaccgc

SEQ ID NO: 103445 - DNA, 25 bp, mus musculus
agaggtcacagggcaccgctggctg

SEQ ID NO: 103446 - DNA, 25 bp, mus musculus
gctgcctgttcgtgctgctgggatt

SEQ ID NO: 103447 - DNA, 25 bp, mus musculus
gcctgttcgtgctgctgggattcgc

SEQ ID NO: 103448 - DNA, 25 bp, mus musculus
tgttcgtgctgctgggattcgcgct

SEQ ID NO: 103449 - DNA, 25 bp, mus musculus
tcgtgctgctgggattcgcgctgct

SEQ ID NO: 103450 - DNA, 25 bp, mus musculus
ggctgccggcacagtcttcactacc

SEQ ID NO: 103451 - DNA, 25 bp, mus musculus
tgccggcacagtcttcactaccgta

SEQ ID NO: 103452 - DNA, 25 bp, mus musculus
cacagtcttcactaccgtagaagac

SEQ ID NO: 103453 - DNA, 25 bp, mus musculus
agaccttggctccaagatactcctc

SEQ ID NO: 103454 - DNA, 25 bp, mus musculus
aactagactatagccggccggagag

SEQ ID NO: 103455 - DNA, 25 bp, mus musculus
actagactatagccggccggagagg

SEQ ID NO: 103456 - DNA, 25 bp, mus musculus
acagtctttcgccagatgagaccgg

SEQ ID NO: 103457 - DNA, 25 bp, mus musculus
agtctttcgccagatgagaccggtg

SEQ ID NO: 103458 - DNA, 25 bp, mus musculus
gtctttcgccagatgagaccggtgt

SEQ ID NO: 103459 - DNA, 25 bp, mus musculus
ctttcgccagatgagaccggtgtcc

SEQ ID NO: 103460 - DNA, 25 bp, mus musculus
tttcgccagatgagaccggtgtcca

SEQ ID NO: 103461 - DNA, 25 bp, mus musculus
cagatgagaccggtgtccagggtac

SEQ ID NO: 103462 - DNA, 25 bp, mus musculus
gatgagaccggtgtccagggtactg

SEQ ID NO: 103463 - DNA, 25 bp, mus musculus
atgagaccggtgtccagggtactgg

SEQ ID NO: 103464 - DNA, 25 bp, mus musculus
tccagggtactggctcctcatctca

SEQ ID NO: 103465 - DNA, 25 bp, mus musculus
ggctcctcatctcactcgggcttat

SEQ ID NO: 103466 - DNA, 25 bp, mus musculus
tgagcgcgctacacaccctgcgcgg

SEQ ID NO: 103467 - DNA, 25 bp, mus musculus
agcgcgctacacaccctgcgcggaa

SEQ ID NO: 103468 - DNA, 25 bp, mus musculus
tacacaccctgcgcggaaatgcttc

SEQ ID NO: 103469 - DNA, 25 bp, mus musculus
gaaatgcttcggttacccacagtct

SEQ ID NO: 103470 - DNA, 25 bp, mus musculus
gttacccacagtctttcgccagatg

SEQ ID NO: 103471 - DNA, 25 bp, mus musculus
ttacccacagtctttcgccagatga

SEQ ID NO: 103472 - DNA, 25 bp, mus musculus
acccacagtctttcgccagatgaga

SEQ ID NO: 103473 - DNA, 25 bp, mus musculus
cacagtctttcgccagatgagaccg

SEQ ID NO: 103474 - DNA, 25 bp, mus musculus
cactacttcaagaagcgccttggac

SEQ ID NO: 103475 - DNA, 25 bp, mus musculus
tacttcaagaagcgccttggactag

SEQ ID NO: 103476 - DNA, 25 bp, mus musculus
ctgctccctttgctgttaggaaatc

SEQ ID NO: 103477 - DNA, 25 bp, mus musculus
aatctaatcagcagtgtgaagctct

SEQ ID NO: 103478 - DNA, 25 bp, mus musculus
gtgaagctctttaacacgctgcgga

SEQ ID NO: 103479 - DNA, 25 bp, mus musculus
aagctctttaacacgctgcggatcc

SEQ ID NO: 103480 - DNA, 25 bp, mus musculus
ctctttaacacgctgcggatcctct

SEQ ID NO: 103481 - DNA, 25 bp, mus musculus
tttaacacgctgcggatcctctgca

SEQ ID NO: 103482 - DNA, 25 bp, mus musculus
acgctgcggatcctctgcatcttca

SEQ ID NO: 103483 - DNA, 25 bp, mus musculus
cggatcctctgcatcttcatgtttg

SEQ ID NO: 103484 - DNA, 25 bp, mus musculus
atcctctgcatcttcatgtttgttc

SEQ ID NO: 103485 - DNA, 25 bp, mus musculus
gttctctttctggctggctttacct

SEQ ID NO: 103486 - DNA, 25 bp, mus musculus
ttcaagaagcgccttggactagtca

SEQ ID NO: 103487 - DNA, 25 bp, mus musculus
cgacctcttgttcccagcaccaaag

SEQ ID NO: 103488 - DNA, 25 bp, mus musculus
ggactagtcaacggcatcgtcacgg

SEQ ID NO: 103489 - DNA, 25 bp, mus musculus
ctagtcaacggcatcgtcacggccg

SEQ ID NO: 103490 - DNA, 25 bp, mus musculus
atcgtcacggccggcagcagcgtct

SEQ ID NO: 103491 - DNA, 25 bp, mus musculus
ggcagcagcgtcttcacaatcctgc

SEQ ID NO: 103492 - DNA, 25 bp, mus musculus
agcagcgtcttcacaatcctgctcc

SEQ ID NO: 103493 - DNA, 25 bp, mus musculus
agcgtcttcacaatcctgctccctt

SEQ ID NO: 103494 - DNA, 25 bp, mus musculus
atcctgctccctttgctgttaggaa

SEQ ID NO: 103495 - DNA, 25 bp, mus musculus
aacaggccatctccttcgccaaaga

SEQ ID NO: 103496 - DNA, 25 bp, mus musculus
gccatctccaagacggccgtggctc

SEQ ID NO: 103497 - DNA, 25 bp, mus musculus
gcatcgtggactgcattgtccgcat

SEQ ID NO: 103498 - DNA, 25 bp, mus musculus
atcgtggactgcattgtccgcatcc

SEQ ID NO: 103499 - DNA, 25 bp, mus musculus
tggactgcattgtccgcatcccaag

SEQ ID NO: 103500 - DNA, 25 bp, mus musculus
gactgcattgtccgcatcccaagga

SEQ ID NO: 103501 - DNA, 25 bp, mus musculus
ctgcattgtccgcatcccaaggagc

SEQ ID NO: 103502 - DNA, 25 bp, mus musculus
gcattgtccgcatcccaaggagcag

SEQ ID NO: 103503 - DNA, 25 bp, mus musculus
tgtccgcatcccaaggagcagggcg

SEQ ID NO: 103504 - DNA, 25 bp, mus musculus
tccgcatcccaaggagcagggcgtg

SEQ ID NO: 103505 - DNA, 25 bp, mus musculus
cgcatcccaaggagcagggcgtgct

SEQ ID NO: 103506 - DNA, 25 bp, mus musculus
catcccaaggagcagggcgtgctgt

SEQ ID NO: 103507 - DNA, 25 bp, mus musculus
agcaagcagatcgccgccgacaagc

SEQ ID NO: 103508 - DNA, 25 bp, mus musculus
caagcagatcgccgccgacaagcag

SEQ ID NO: 103509 - DNA, 25 bp, mus musculus
agcagatcgccgccgacaagcagta

SEQ ID NO: 103510 - DNA, 25 bp, mus musculus
cagatcgccgccgacaagcagtaca

SEQ ID NO: 103511 - DNA, 25 bp, mus musculus
tcgccgccgacaagcagtacaaggg

SEQ ID NO: 103512 - DNA, 25 bp, mus musculus
gccgccgacaagcagtacaagggca

SEQ ID NO: 103513 - DNA, 25 bp, mus musculus
cgccgacaagcagtacaagggcatc

SEQ ID NO: 103514 - DNA, 25 bp, mus musculus
cagtacaagggcatcgtggactgca

SEQ ID NO: 103515 - DNA, 25 bp, mus musculus
ctccagcctctggggcgcattccaa

SEQ ID NO: 103516 - DNA, 25 bp, mus musculus
tccagcctctggggcgcattccaac

SEQ ID NO: 103517 - DNA, 25 bp, mus musculus
ttttcttgccccatacataccttga

SEQ ID NO: 103518 - DNA, 25 bp, mus musculus
ttcttgccccatacataccttgagg

SEQ ID NO: 103519 - DNA, 25 bp, mus musculus
cttgccccatacataccttgaggcg

SEQ ID NO: 103520 - DNA, 25 bp, mus musculus
ttgccccatacataccttgaggcga

SEQ ID NO: 103521 - DNA, 25 bp, mus musculus
tgccccatacataccttgaggcgag

SEQ ID NO: 103522 - DNA, 25 bp, mus musculus
ccccatacataccttgaggcgagca

SEQ ID NO: 103523 - DNA, 25 bp, mus musculus
cccatacataccttgaggcgagcaa

SEQ ID NO: 103524 - DNA, 25 bp, mus musculus
ccatacataccttgaggcgagcaaa

SEQ ID NO: 103525 - DNA, 25 bp, mus musculus
atacataccttgaggcgagcaaaaa

SEQ ID NO: 103526 - DNA, 25 bp, mus musculus
tacataccttgaggcgagcaaaaaa

SEQ ID NO: 103527 - DNA, 25 bp, mus musculus
agcctctggggcgcattccaacctt

SEQ ID NO: 103528 - DNA, 25 bp, mus musculus
gcctctggggcgcattccaaccttc

SEQ ID NO: 103529 - DNA, 25 bp, mus musculus
accttccagcctgcgacctgcggag

SEQ ID NO: 103530 - DNA, 25 bp, mus musculus
cttccagcctgcgacctgcggagaa

SEQ ID NO: 103531 - DNA, 25 bp, mus musculus
tccagcctgcgacctgcggagaaaa

SEQ ID NO: 103532 - DNA, 25 bp, mus musculus
ccagcctgcgacctgcggagaaaaa

SEQ ID NO: 103533 - DNA, 25 bp, mus musculus
ttacttattttcttgccccatacat

SEQ ID NO: 103534 - DNA, 25 bp, mus musculus
tacttattttcttgccccatacata

SEQ ID NO: 103535 - DNA, 25 bp, mus musculus
aaggtttacaggcttgcaggctaca

SEQ ID NO: 103536 - DNA, 25 bp, mus musculus
gtttacaggcttgcaggctacacac

SEQ ID NO: 103537 - DNA, 25 bp, mus musculus
ttaagatatcacttcctggaggcca

SEQ ID NO: 103538 - DNA, 25 bp, mus musculus
agatatcacttcctggaggccagaa

SEQ ID NO: 103539 - DNA, 25 bp, mus musculus
tatcacttcctggaggccagaaaat

SEQ ID NO: 103540 - DNA, 25 bp, mus musculus
cacttcctggaggccagaaaattga

SEQ ID NO: 103541 - DNA, 25 bp, mus musculus
aaattgatgctgtggcatggaacac

SEQ ID NO: 103542 - DNA, 25 bp, mus musculus
aactagcccggcagatcagttcaac

SEQ ID NO: 103543 - DNA, 25 bp, mus musculus
tagcccggcagatcagttcaacact

SEQ ID NO: 103544 - DNA, 25 bp, mus musculus
agatcagttcaacactggcagatac

SEQ ID NO: 103545 - DNA, 25 bp, mus musculus
tcagttcaacactggcagatactgc

SEQ ID NO: 103546 - DNA, 25 bp, mus musculus
cactggcagatactgcagtggctgc

SEQ ID NO: 103547 - DNA, 25 bp, mus musculus
tacaggcttgcaggctacacacggc

SEQ ID NO: 103548 - DNA, 25 bp, mus musculus
cttgcaggctacacacggcagttgt

SEQ ID NO: 103549 - DNA, 25 bp, mus musculus
ggctacacacggcagttgtgtcgac

SEQ ID NO: 103550 - DNA, 25 bp, mus musculus
tacacacggcagttgtgtcgacccc

SEQ ID NO: 103551 - DNA, 25 bp, mus musculus
ctccacgctggttggcagagcggct

SEQ ID NO: 103552 - DNA, 25 bp, mus musculus
cagagcggcttggcctttttgagga

SEQ ID NO: 103553 - DNA, 25 bp, mus musculus
aggagctgtgggctgctcaggtaaa

SEQ ID NO: 103554 - DNA, 25 bp, mus musculus
tgtgggctgctcaggtaaagagatt

SEQ ID NO: 103555 - DNA, 25 bp, mus musculus
ccgagaaatgctccagcagagcaaa

SEQ ID NO: 103556 - DNA, 25 bp, mus musculus
gaaatgctccagcagagcaaaatct

SEQ ID NO: 103557 - DNA, 25 bp, mus musculus
ggcattctctaaaaatctcaagctt

SEQ ID NO: 103558 - DNA, 25 bp, mus musculus
cattctctaaaaatctcaagcttgg

SEQ ID NO: 103559 - DNA, 25 bp, mus musculus
attctctaaaaatctcaagcttgga

SEQ ID NO: 103560 - DNA, 25 bp, mus musculus
tctaaaaatctcaagcttggaatcc

SEQ ID NO: 103561 - DNA, 25 bp, mus musculus
ctaaaaatctcaagcttggaatcca

SEQ ID NO: 103562 - DNA, 25 bp, mus musculus
aaatctcaagcttggaatccacgaa

SEQ ID NO: 103563 - DNA, 25 bp, mus musculus
aatctcaagcttggaatccacgaag

SEQ ID NO: 103564 - DNA, 25 bp, mus musculus
atctcaagcttggaatccacgaaga

SEQ ID NO: 103565 - DNA, 25 bp, mus musculus
tctcaagcttggaatccacgaagac

SEQ ID NO: 103566 - DNA, 25 bp, mus musculus
caagcttggaatccacgaagactcc

SEQ ID NO: 103567 - DNA, 25 bp, mus musculus
aaatgctccagcagagcaaaatctt

SEQ ID NO: 103568 - DNA, 25 bp, mus musculus
agtcattcgcaaaaacattgttaag

SEQ ID NO: 103569 - DNA, 25 bp, mus musculus
gtcattcgcaaaaacattgttaaga

SEQ ID NO: 103570 - DNA, 25 bp, mus musculus
tcattcgcaaaaacattgttaagaa

SEQ ID NO: 103571 - DNA, 25 bp, mus musculus
tctctgagctggcagaagacaagga

SEQ ID NO: 103572 - DNA, 25 bp, mus musculus
aattctatgaggcattctctaaaaa

SEQ ID NO: 103573 - DNA, 25 bp, mus musculus
ttctatgaggcattctctaaaaatc

SEQ ID NO: 103574 - DNA, 25 bp, mus musculus
aggcattctctaaaaatctcaagct

SEQ ID NO: 103575 - DNA, 25 bp, mus musculus
aaatggcccagttgaggtcatggat

SEQ ID NO: 103576 - DNA, 25 bp, mus musculus
tggcccagttgaggtcatggatcat

SEQ ID NO: 103577 - DNA, 25 bp, mus musculus
taccgaacacacaagatcgaactct

SEQ ID NO: 103578 - DNA, 25 bp, mus musculus
cgaacacacaagatcgaactctcac

SEQ ID NO: 103579 - DNA, 25 bp, mus musculus
aagatcgaactctcactattgtgga

SEQ ID NO: 103580 - DNA, 25 bp, mus musculus
atcgaactctcactattgtggatac

SEQ ID NO: 103581 - DNA, 25 bp, mus musculus
ggaatgaccagggctgacgtgatca

SEQ ID NO: 103582 - DNA, 25 bp, mus musculus
gtgatcaatcatcttgggtactatc

SEQ ID NO: 103583 - DNA, 25 bp, mus musculus
aatcatcttgggtactatcgcacag

SEQ ID NO: 103584 - DNA, 25 bp, mus musculus
cttgggtactatcgcacagtctgag

SEQ ID NO: 103585 - DNA, 25 bp, mus musculus
tactatcgcacagtctgagacaaag

SEQ ID NO: 103586 - DNA, 25 bp, mus musculus
tatcgcacagtctgagacaaagcgt

SEQ ID NO: 103587 - DNA, 25 bp, mus musculus
agctcatttcaaattcatcagatgc

SEQ ID NO: 103588 - DNA, 25 bp, mus musculus
tttcaaattcatcagatgcattgga

SEQ ID NO: 103589 - DNA, 25 bp, mus musculus
caaattcatcagatgcattggacaa

SEQ ID NO: 103590 - DNA, 25 bp, mus musculus
attcatcagatgcattggacaaaat

SEQ ID NO: 103591 - DNA, 25 bp, mus musculus
aaagcttgacagatcccagtaaatt

SEQ ID NO: 103592 - DNA, 25 bp, mus musculus
aattagactctgggagagagctgca

SEQ ID NO: 103593 - DNA, 25 bp, mus musculus
agctgcatattaaccttataccgaa

SEQ ID NO: 103594 - DNA, 25 bp, mus musculus
accttataccgaacacacaagatcg

SEQ ID NO: 103595 - DNA, 25 bp, mus musculus
cagaagtaccgcctgcgcagtaact

SEQ ID NO: 103596 - DNA, 25 bp, mus musculus
agtaccgcctgcgcagtaactgcaa

SEQ ID NO: 103597 - DNA, 25 bp, mus musculus
ctttcattgctgcaaggaacttcca

SEQ ID NO: 103598 - DNA, 25 bp, mus musculus
tgcaaggaacttccatgcctctaac

SEQ ID NO: 103599 - DNA, 25 bp, mus musculus
gaacttccatgcctctaacactcat

SEQ ID NO: 103600 - DNA, 25 bp, mus musculus
acttccatgcctctaacactcatct

SEQ ID NO: 103601 - DNA, 25 bp, mus musculus
cactcatcttcaaaagactgggact

SEQ ID NO: 103602 - DNA, 25 bp, mus musculus
ctcatcttcaaaagactgggactgc

SEQ ID NO: 103603 - DNA, 25 bp, mus musculus
tcttcaaaagactgggactgctgag

SEQ ID NO: 103604 - DNA, 25 bp, mus musculus
gatgtcctctattcttgaagagcgt

SEQ ID NO: 103605 - DNA, 25 bp, mus musculus
tgtcctctattcttgaagagcgtat

SEQ ID NO: 103606 - DNA, 25 bp, mus musculus
tcctctattcttgaagagcgtattc

SEQ ID NO: 103607 - DNA, 25 bp, mus musculus
taccgcctgcgcagtaactgcaaag

SEQ ID NO: 103608 - DNA, 25 bp, mus musculus
gcctgcgcagtaactgcaaagatgc

SEQ ID NO: 103609 - DNA, 25 bp, mus musculus
aatgctttgggttcatctttcattg

SEQ ID NO: 103610 - DNA, 25 bp, mus musculus
ctttgggttcatctttcattgctgc

SEQ ID NO: 103611 - DNA, 25 bp, mus musculus
ttgggttcatctttcattgctgcaa

SEQ ID NO: 103612 - DNA, 25 bp, mus musculus
gttcatctttcattgctgcaaggaa

SEQ ID NO: 103613 - DNA, 25 bp, mus musculus
tcatctttcattgctgcaaggaact

SEQ ID NO: 103614 - DNA, 25 bp, mus musculus
atctttcattgctgcaaggaacttc

SEQ ID NO: 103615 - DNA, 25 bp, mus musculus
ctctcggatacagccgacaccatgg

SEQ ID NO: 103616 - DNA, 25 bp, mus musculus
ctcggatacagccgacaccatgggt

SEQ ID NO: 103617 - DNA, 25 bp, mus musculus
ccgacttgtgtcatgcctacgttgg

SEQ ID NO: 103618 - DNA, 25 bp, mus musculus
gacttgtgtcatgcctacgttgggt

SEQ ID NO: 103619 - DNA, 25 bp, mus musculus
cttgtgtcatgcctacgttgggtat

SEQ ID NO: 103620 - DNA, 25 bp, mus musculus
tgtcatgcctacgttgggtatatca

SEQ ID NO: 103621 - DNA, 25 bp, mus musculus
tcatgcctacgttgggtatatcaca

SEQ ID NO: 103622 - DNA, 25 bp, mus musculus
atgcctacgttgggtatatcacatc

SEQ ID NO: 103623 - DNA, 25 bp, mus musculus
ggtatatcacatcgagtcttacgaa

SEQ ID NO: 103624 - DNA, 25 bp, mus musculus
tatcacatcgagtcttacgaaaagg

SEQ ID NO: 103625 - DNA, 25 bp, mus musculus
tcacatcgagtcttacgaaaaggga

SEQ ID NO: 103626 - DNA, 25 bp, mus musculus
cagcctgcaggagtggaggaaagct

SEQ ID NO: 103627 - DNA, 25 bp, mus musculus
cggatacagccgacaccatgggttt

SEQ ID NO: 103628 - DNA, 25 bp, mus musculus
tacagccgacaccatgggtttcgga

SEQ ID NO: 103629 - DNA, 25 bp, mus musculus
gtatgtgcatcacaagcagatgtgg

SEQ ID NO: 103630 - DNA, 25 bp, mus musculus
atgtgcatcacaagcagatgtggca

SEQ ID NO: 103631 - DNA, 25 bp, mus musculus
tagttgaagccgtgtccagcccacc

SEQ ID NO: 103632 - DNA, 25 bp, mus musculus
tgaagccgtgtccagcccaccggct

SEQ ID NO: 103633 - DNA, 25 bp, mus musculus
gcccaccggctgccgacttgtgtca

SEQ ID NO: 103634 - DNA, 25 bp, mus musculus
ccaccggctgccgacttgtgtcatg

SEQ ID NO: 103635 - DNA, 25 bp, mus musculus
agccactctcaaaatcacgctggat

SEQ ID NO: 103636 - DNA, 25 bp, mus musculus
gccactctcaaaatcacgctggata

SEQ ID NO: 103637 - DNA, 25 bp, mus musculus
ggtgtgaacttcctggggctgctgt

SEQ ID NO: 103638 - DNA, 25 bp, mus musculus
gtgtgaacttcctggggctgctgtg

SEQ ID NO: 103639 - DNA, 25 bp, mus musculus
tgtgaacttcctggggctgctgtgg

SEQ ID NO: 103640 - DNA, 25 bp, mus musculus
gtgaacttcctggggctgctgtgga

SEQ ID NO: 103641 - DNA, 25 bp, mus musculus
tgaacttcctggggctgctgtggac

SEQ ID NO: 103642 - DNA, 25 bp, mus musculus
gaacttcctggggctgctgtggact

SEQ ID NO: 103643 - DNA, 25 bp, mus musculus
aacttcctggggctgctgtggactt

SEQ ID NO: 103644 - DNA, 25 bp, mus musculus
acttcctggggctgctgtggacttg

SEQ ID NO: 103645 - DNA, 25 bp, mus musculus
cttcctggggctgctgtggacttgc

SEQ ID NO: 103646 - DNA, 25 bp, mus musculus
cactctcaaaatcacgctggataac

SEQ ID NO: 103647 - DNA, 25 bp, mus musculus
actctcaaaatcacgctggataacg

SEQ ID NO: 103648 - DNA, 25 bp, mus musculus
ctctcaaaatcacgctggataacgc

SEQ ID NO: 103649 - DNA, 25 bp, mus musculus
tctcaaaatcacgctggataacgcc

SEQ ID NO: 103650 - DNA, 25 bp, mus musculus
ctcaaaatcacgctggataacgcct

SEQ ID NO: 103651 - DNA, 25 bp, mus musculus
tcaaaatcacgctggataacgccta

SEQ ID NO: 103652 - DNA, 25 bp, mus musculus
atgggcttatttctctccaggtgaa

SEQ ID NO: 103653 - DNA, 25 bp, mus musculus
gggcttatttctctccaggtgaagc

SEQ ID NO: 103654 - DNA, 25 bp, mus musculus
taaacagcctctaccttgcgagccg

SEQ ID NO: 103655 - DNA, 25 bp, mus musculus
aacagcctctaccttgcgagccgtc

SEQ ID NO: 103656 - DNA, 25 bp, mus musculus
tgagaagccgtggcagaggtttcca

SEQ ID NO: 103657 - DNA, 25 bp, mus musculus
agaagccgtggcagaggtttccagt

SEQ ID NO: 103658 - DNA, 25 bp, mus musculus
tgtttcctcgtctcttccagatatt

SEQ ID NO: 103659 - DNA, 25 bp, mus musculus
gtttcctcgtctcttccagatattt

SEQ ID NO: 103660 - DNA, 25 bp, mus musculus
tttcctcgtctcttccagatatttg

SEQ ID NO: 103661 - DNA, 25 bp, mus musculus
cgtctcttccagatatttgttatcg

SEQ ID NO: 103662 - DNA, 25 bp, mus musculus
gtctcttccagatatttgttatcgc

SEQ ID NO: 103663 - DNA, 25 bp, mus musculus
gatatttgttatcgctgtggtgagt

SEQ ID NO: 103664 - DNA, 25 bp, mus musculus
atatttgttatcgctgtggtgagtc

SEQ ID NO: 103665 - DNA, 25 bp, mus musculus
tatttgttatcgctgtggtgagtct

SEQ ID NO: 103666 - DNA, 25 bp, mus musculus
acagcctctaccttgcgagccgtct

SEQ ID NO: 103667 - DNA, 25 bp, mus musculus
cagcctctaccttgcgagccgtctt

SEQ ID NO: 103668 - DNA, 25 bp, mus musculus
agcctctaccttgcgagccgtcttc

SEQ ID NO: 103669 - DNA, 25 bp, mus musculus
cgctccgacgcggaagatctgactg

SEQ ID NO: 103670 - DNA, 25 bp, mus musculus
gaagatctgactgcagccatgagca

SEQ ID NO: 103671 - DNA, 25 bp, mus musculus
gactgcagccatgagcagcaatgag

SEQ ID NO: 103672 - DNA, 25 bp, mus musculus
aatgagaagccgtggcagaggtttc

SEQ ID NO: 103673 - DNA, 25 bp, mus musculus
atgagaagccgtggcagaggtttcc

SEQ ID NO: 103674 - DNA, 25 bp, mus musculus
caccgtgtacacagcaatggatgtg

SEQ ID NO: 103675 - DNA, 25 bp, mus musculus
cgtgtacacagcaatggatgtggcc

SEQ ID NO: 103676 - DNA, 25 bp, mus musculus
gaacccaaacattgtgaattacttg

SEQ ID NO: 103677 - DNA, 25 bp, mus musculus
cttggacagttacctcgtgggagat

SEQ ID NO: 103678 - DNA, 25 bp, mus musculus
tggacagttacctcgtgggagatga

SEQ ID NO: 103679 - DNA, 25 bp, mus musculus
ggacagttacctcgtgggagatgag

SEQ ID NO: 103680 - DNA, 25 bp, mus musculus
acagttacctcgtgggagatgagct

SEQ ID NO: 103681 - DNA, 25 bp, mus musculus
cagttacctcgtgggagatgagctg

SEQ ID NO: 103682 - DNA, 25 bp, mus musculus
gaggctccttgacagatgtggtgac

SEQ ID NO: 103683 - DNA, 25 bp, mus musculus
aggctccttgacagatgtggtgaca

SEQ ID NO: 103684 - DNA, 25 bp, mus musculus
aggccaaattgcagctgtgtgccgt

SEQ ID NO: 103685 - DNA, 25 bp, mus musculus
ccaaattgcagctgtgtgccgtgag

SEQ ID NO: 103686 - DNA, 25 bp, mus musculus
gtacacagcaatggatgtggccaca

SEQ ID NO: 103687 - DNA, 25 bp, mus musculus
agatgaatcttcagcagcagcccga

SEQ ID NO: 103688 - DNA, 25 bp, mus musculus
gatgaatcttcagcagcagcccgag

SEQ ID NO: 103689 - DNA, 25 bp, mus musculus
tgaatcttcagcagcagcccgagaa

SEQ ID NO: 103690 - DNA, 25 bp, mus musculus
gaatcttcagcagcagcccgagaaa

SEQ ID NO: 103691 - DNA, 25 bp, mus musculus
atcttcagcagcagcccgagaaaga

SEQ ID NO: 103692 - DNA, 25 bp, mus musculus
agatcctggtcatgagggaaaacaa

SEQ ID NO: 103693 - DNA, 25 bp, mus musculus
gatcctggtcatgagggaaaacaag

SEQ ID NO: 103694 - DNA, 25 bp, mus musculus
aaaccatttcatcatgtgttctata

SEQ ID NO: 103695 - DNA, 25 bp, mus musculus
accatttcatcatgtgttctataat

SEQ ID NO: 103696 - DNA, 25 bp, mus musculus
atttgttgtcatttggcatcacgaa

SEQ ID NO: 103697 - DNA, 25 bp, mus musculus
tttgttgtcatttggcatcacgaac

SEQ ID NO: 103698 - DNA, 25 bp, mus musculus
tcatttggcatcacgaactagagaa

SEQ ID NO: 103699 - DNA, 25 bp, mus musculus
catttggcatcacgaactagagaaa

SEQ ID NO: 103700 - DNA, 25 bp, mus musculus
atttggcatcacgaactagagaaag

SEQ ID NO: 103701 - DNA, 25 bp, mus musculus
tttggcatcacgaactagagaaagc

SEQ ID NO: 103702 - DNA, 25 bp, mus musculus
ttggcatcacgaactagagaaagca

SEQ ID NO: 103703 - DNA, 25 bp, mus musculus
aagggaacttgcagccctataggtg

SEQ ID NO: 103704 - DNA, 25 bp, mus musculus
agggaacttgcagccctataggtgg

SEQ ID NO: 103705 - DNA, 25 bp, mus musculus
gggaacttgcagccctataggtgga

SEQ ID NO: 103706 - DNA, 25 bp, mus musculus
ccatttcatcatgtgttctataata

SEQ ID NO: 103707 - DNA, 25 bp, mus musculus
ggaacttgcagccctataggtggaa

SEQ ID NO: 103708 - DNA, 25 bp, mus musculus
catttcatcatgtgttctataatac

SEQ ID NO: 103709 - DNA, 25 bp, mus musculus
atttcatcatgtgttctataataca

SEQ ID NO: 103710 - DNA, 25 bp, mus musculus
tcatcatgtgttctataatacattt

SEQ ID NO: 103711 - DNA, 25 bp, mus musculus
aatacatttgttgtcatttggcatc

SEQ ID NO: 103712 - DNA, 25 bp, mus musculus
atacatttgttgtcatttggcatca

SEQ ID NO: 103713 - DNA, 25 bp, mus musculus
acatttgttgtcatttggcatcacg

SEQ ID NO: 103714 - DNA, 25 bp, mus musculus
catttgttgtcatttggcatcacga

SEQ ID NO: 103715 - DNA, 25 bp, mus musculus
gctcaagatgtccacggaggagatc

SEQ ID NO: 103716 - DNA, 25 bp, mus musculus
caagatgtccacggaggagatcatc

SEQ ID NO: 103717 - DNA, 25 bp, mus musculus
catcgagctcctggatgttgatcct

SEQ ID NO: 103718 - DNA, 25 bp, mus musculus
cgagctcctggatgttgatcctaat

SEQ ID NO: 103719 - DNA, 25 bp, mus musculus
gctcctggatgttgatcctaatgac

SEQ ID NO: 103720 - DNA, 25 bp, mus musculus
tgttgatcctaatgaccaagaggag

SEQ ID NO: 103721 - DNA, 25 bp, mus musculus
tgatcctaatgaccaagaggaggat

SEQ ID NO: 103722 - DNA, 25 bp, mus musculus
tcctaatgaccaagaggaggatggt

SEQ ID NO: 103723 - DNA, 25 bp, mus musculus
tgccaatattgacctggactcccag

SEQ ID NO: 103724 - DNA, 25 bp, mus musculus
caatattgacctggactcccagagg

SEQ ID NO: 103725 - DNA, 25 bp, mus musculus
tattgacctggactcccagaggaag

SEQ ID NO: 103726 - DNA, 25 bp, mus musculus
tgacctggactcccagaggaagggc

SEQ ID NO: 103727 - DNA, 25 bp, mus musculus
gatcatccagcgcacacggctgctg

SEQ ID NO: 103728 - DNA, 25 bp, mus musculus
cacacggctgctggacagtgagatc

SEQ ID NO: 103729 - DNA, 25 bp, mus musculus
acggctgctggacagtgagatcaag

SEQ ID NO: 103730 - DNA, 25 bp, mus musculus
gagagtcacccatgagctccaagcc

SEQ ID NO: 103731 - DNA, 25 bp, mus musculus
agtcacccatgagctccaagccatg

SEQ ID NO: 103732 - DNA, 25 bp, mus musculus
ccatgagctccaagccatgaaggac

SEQ ID NO: 103733 - DNA, 25 bp, mus musculus
tgagctccaagccatgaaggacaag

SEQ ID NO: 103734 - DNA, 25 bp, mus musculus
gctccaagccatgaaggacaagata

SEQ ID NO: 103735 - DNA, 25 bp, mus musculus
ttgctttaattgttgccagcagggt

SEQ ID NO: 103736 - DNA, 25 bp, mus musculus
taattgttgccagcagggtgtgctg

SEQ ID NO: 103737 - DNA, 25 bp, mus musculus
ccatgagcttatccccttgagatgg

SEQ ID NO: 103738 - DNA, 25 bp, mus musculus
tatccccttgagatgggtaagtatt

SEQ ID NO: 103739 - DNA, 25 bp, mus musculus
agcttattctgtaacagtgaaacac

SEQ ID NO: 103740 - DNA, 25 bp, mus musculus
aacagtgaaacactatcctggccat

SEQ ID NO: 103741 - DNA, 25 bp, mus musculus
agtgaaacactatcctggccataag

SEQ ID NO: 103742 - DNA, 25 bp, mus musculus
gaaacactatcctggccataaggag

SEQ ID NO: 103743 - DNA, 25 bp, mus musculus
gtgttcagccagaccaggccagtaa

SEQ ID NO: 103744 - DNA, 25 bp, mus musculus
agccagaccaggccagtaagtatgc

SEQ ID NO: 103745 - DNA, 25 bp, mus musculus
cagaccaggccagtaagtatgcagg

SEQ ID NO: 103746 - DNA, 25 bp, mus musculus
agtatgcagggtcagcagtgcacaa

SEQ ID NO: 103747 - DNA, 25 bp, mus musculus
ttgccagcagggtgtgctgctgagc

SEQ ID NO: 103748 - DNA, 25 bp, mus musculus
gtttcactgatgtctcgaaggtcga

SEQ ID NO: 103749 - DNA, 25 bp, mus musculus
tatttaggccacatcgcttccggta

SEQ ID NO: 103750 - DNA, 25 bp, mus musculus
ttaggccacatcgcttccggtactg

SEQ ID NO: 103751 - DNA, 25 bp, mus musculus
gcttccggtactgccctgcatccag

SEQ ID NO: 103752 - DNA, 25 bp, mus musculus
ggtactgccctgcatccaggaagtg

SEQ ID NO: 103753 - DNA, 25 bp, mus musculus
actgccctgcatccaggaagtgagc

SEQ ID NO: 103754 - DNA, 25 bp, mus musculus
gccctgcatccaggaagtgagcagc

SEQ ID NO: 103755 - DNA, 25 bp, mus musculus
cagccatgagcttatccccttgaga

SEQ ID NO: 103756 - DNA, 25 bp, mus musculus
gactccggcattacattgcaaccca

SEQ ID NO: 103757 - DNA, 25 bp, mus musculus
ctccggcattacattgcaacccaaa

SEQ ID NO: 103758 - DNA, 25 bp, mus musculus
acccaaagtccaatgcaaaagactg

SEQ ID NO: 103759 - DNA, 25 bp, mus musculus
cccaaagtccaatgcaaaagactgt

SEQ ID NO: 103760 - DNA, 25 bp, mus musculus
atttttcgagaatgatctggcaaga

SEQ ID NO: 103761 - DNA, 25 bp, mus musculus
caagaaaactctgccagcatcgtaa

SEQ ID NO: 103762 - DNA, 25 bp, mus musculus
aactctgccagcatcgtaatggtca

SEQ ID NO: 103763 - DNA, 25 bp, mus musculus
actctgccagcatcgtaatggtcaa

SEQ ID NO: 103764 - DNA, 25 bp, mus musculus
tctgccagcatcgtaatggtcaaag

SEQ ID NO: 103765 - DNA, 25 bp, mus musculus
ctgccagcatcgtaatggtcaaaga

SEQ ID NO: 103766 - DNA, 25 bp, mus musculus
atggtcaaagaccttgtggaaatgg

SEQ ID NO: 103767 - DNA, 25 bp, mus musculus
agtgtgtccgatattggcaagatga

SEQ ID NO: 103768 - DNA, 25 bp, mus musculus
cggcattacattgcaacccaaagtc

SEQ ID NO: 103769 - DNA, 25 bp, mus musculus
ggcattacattgcaacccaaagtcc

SEQ ID NO: 103770 - DNA, 25 bp, mus musculus
cattacattgcaacccaaagtccaa

SEQ ID NO: 103771 - DNA, 25 bp, mus musculus
attacattgcaacccaaagtccaat

SEQ ID NO: 103772 - DNA, 25 bp, mus musculus
tacattgcaacccaaagtccaatgc

SEQ ID NO: 103773 - DNA, 25 bp, mus musculus
acattgcaacccaaagtccaatgca

SEQ ID NO: 103774 - DNA, 25 bp, mus musculus
ttgcaacccaaagtccaatgcaaaa

SEQ ID NO: 103775 - DNA, 25 bp, mus musculus
gcaacccaaagtccaatgcaaaaga

SEQ ID NO: 103776 - DNA, 25 bp, mus musculus
atcaattatgattttcccaccagct

SEQ ID NO: 103777 - DNA, 25 bp, mus musculus
caattatgattttcccaccagctca

SEQ ID NO: 103778 - DNA, 25 bp, mus musculus
tgccaatgttatccagcaggctggt

SEQ ID NO: 103779 - DNA, 25 bp, mus musculus
aatgttatccagcaggctggttgtc

SEQ ID NO: 103780 - DNA, 25 bp, mus musculus
tgttatccagcaggctggttgtcct

SEQ ID NO: 103781 - DNA, 25 bp, mus musculus
atccagcaggctggttgtcctgtgc

SEQ ID NO: 103782 - DNA, 25 bp, mus musculus
ccagcaggctggttgtcctgtgccc

SEQ ID NO: 103783 - DNA, 25 bp, mus musculus
ggttgtcctgtgcccgaatacataa

SEQ ID NO: 103784 - DNA, 25 bp, mus musculus
ttgtcctgtgcccgaatacataaaa

SEQ ID NO: 103785 - DNA, 25 bp, mus musculus
ttccagaaacctctaagcagacaaa

SEQ ID NO: 103786 - DNA, 25 bp, mus musculus
ccagaaacctctaagcagacaaaag

SEQ ID NO: 103787 - DNA, 25 bp, mus musculus
agcatttgtacaactccaaagtact

SEQ ID NO: 103788 - DNA, 25 bp, mus musculus
tatgattttcccaccagctcagtgg

SEQ ID NO: 103789 - DNA, 25 bp, mus musculus
tgtacaactccaaagtacttcttag

SEQ ID NO: 103790 - DNA, 25 bp, mus musculus
tttcccaccagctcagtggagtact

SEQ ID NO: 103791 - DNA, 25 bp, mus musculus
tcccaccagctcagtggagtacttc

SEQ ID NO: 103792 - DNA, 25 bp, mus musculus
accagctcagtggagtacttccata

SEQ ID NO: 103793 - DNA, 25 bp, mus musculus
gagtacttccataggataggtcgga

SEQ ID NO: 103794 - DNA, 25 bp, mus musculus
ggctgttacatttttcactgaagat

SEQ ID NO: 103795 - DNA, 25 bp, mus musculus
gttacatttttcactgaagatgata

SEQ ID NO: 103796 - DNA, 25 bp, mus musculus
tacatttttcactgaagatgataaa

SEQ ID NO: 103797 - DNA, 25 bp, mus musculus
tgtcatttgttctgtcatacatctg

SEQ ID NO: 103798 - DNA, 25 bp, mus musculus
gtcatttgttctgtcatacatctgt

SEQ ID NO: 103799 - DNA, 25 bp, mus musculus
catttgttctgtcatacatctgttg

SEQ ID NO: 103800 - DNA, 25 bp, mus musculus
ttgttctgtcatacatctgttgtca

SEQ ID NO: 103801 - DNA, 25 bp, mus musculus
gttctgtcatacatctgttgtcatt

SEQ ID NO: 103802 - DNA, 25 bp, mus musculus
ctgtcatacatctgttgtcattttc

SEQ ID NO: 103803 - DNA, 25 bp, mus musculus
catacatctgttgtcattttcttaa

SEQ ID NO: 103804 - DNA, 25 bp, mus musculus
atacatctgttgtcattttcttaaa

SEQ ID NO: 103805 - DNA, 25 bp, mus musculus
acatctgttgtcattttcttaaata

SEQ ID NO: 103806 - DNA, 25 bp, mus musculus
aatatataccattttgtcatttgtt

SEQ ID NO: 103807 - DNA, 25 bp, mus musculus
tatataccattttgtcatttgttct

SEQ ID NO: 103808 - DNA, 25 bp, mus musculus
atttgttctgtcatacatctgttgt

SEQ ID NO: 103809 - DNA, 25 bp, mus musculus
ttgttctgtcatacatctgttgtca

SEQ ID NO: 103810 - DNA, 25 bp, mus musculus
ttctgtcatacatctgttgtcattt

SEQ ID NO: 103811 - DNA, 25 bp, mus musculus
tctgtcatacatctgttgtcatttt

SEQ ID NO: 103812 - DNA, 25 bp, mus musculus
gtcatacatctgttgtcattttctt

SEQ ID NO: 103813 - DNA, 25 bp, mus musculus
catacatctgttgtcattttcttaa

SEQ ID NO: 103814 - DNA, 25 bp, mus musculus
atacatctgttgtcattttcttaaa

SEQ ID NO: 103815 - DNA, 25 bp, mus musculus
acatctgttgtcattttcttaaata

SEQ ID NO: 103816 - DNA, 25 bp, mus musculus
catctgttgtcattttcttaaatat

SEQ ID NO: 103817 - DNA, 25 bp, mus musculus
tctgttgtcattttcttaaatatcg

SEQ ID NO: 103818 - DNA, 25 bp, mus musculus
atataccattttgtcatttgttctg

SEQ ID NO: 103819 - DNA, 25 bp, mus musculus
ataccattttgtcatttgttctgtc

SEQ ID NO: 103820 - DNA, 25 bp, mus musculus
ccattttgtcatttgttctgtcata

SEQ ID NO: 103821 - DNA, 25 bp, mus musculus
cattttgtcatttgttctgtcatac

SEQ ID NO: 103822 - DNA, 25 bp, mus musculus
tttgtcatttgttctgtcatacatc

SEQ ID NO: 103823 - DNA, 25 bp, mus musculus
tgtcatttgttctgtcatacatctg

SEQ ID NO: 103824 - DNA, 25 bp, mus musculus
gtcatttgttctgtcatacatctgt

SEQ ID NO: 103825 - DNA, 25 bp, mus musculus
catttgttctgtcatacatctgttg

SEQ ID NO: 103826 - DNA, 25 bp, mus musculus
ggggaccccatgctccatgatgctt

SEQ ID NO: 103827 - DNA, 25 bp, mus musculus
accccatgctccatgatgcttggtc

SEQ ID NO: 103828 - DNA, 25 bp, mus musculus
ctatccttaggctatatacaaacgc

SEQ ID NO: 103829 - DNA, 25 bp, mus musculus
gctatatacaaacgctttgatactg

SEQ ID NO: 103830 - DNA, 25 bp, mus musculus
tatatacaaacgctttgatactgac

SEQ ID NO: 103831 - DNA, 25 bp, mus musculus
tacaaacgctttgatactgaccgat

SEQ ID NO: 103832 - DNA, 25 bp, mus musculus
agggactatcgttcgccatgaactt

SEQ ID NO: 103833 - DNA, 25 bp, mus musculus
tatcgttcgccatgaacttccaggg

SEQ ID NO: 103834 - DNA, 25 bp, mus musculus
tcgttcgccatgaacttccaggggc

SEQ ID NO: 103835 - DNA, 25 bp, mus musculus
catgaacttccaggggcctttgagg

SEQ ID NO: 103836 - DNA, 25 bp, mus musculus
tgaacttccaggggcctttgaggca

SEQ ID NO: 103837 - DNA, 25 bp, mus musculus
tccaggggcctttgaggcagcaggt

SEQ ID NO: 103838 - DNA, 25 bp, mus musculus
cccatgctccatgatgcttggtccg

SEQ ID NO: 103839 - DNA, 25 bp, mus musculus
tgctccatgatgcttggtccgactg

SEQ ID NO: 103840 - DNA, 25 bp, mus musculus
ccatgatgcttggtccgactgttgt

SEQ ID NO: 103841 - DNA, 25 bp, mus musculus
atgatgcttggtccgactgttgtct

SEQ ID NO: 103842 - DNA, 25 bp, mus musculus
tggtccgactgttgtcttttctatc

SEQ ID NO: 103843 - DNA, 25 bp, mus musculus
gtccgactgttgtcttttctatcct

SEQ ID NO: 103844 - DNA, 25 bp, mus musculus
ttttctatccttaggctatatacaa

SEQ ID NO: 103845 - DNA, 25 bp, mus musculus
ttctatccttaggctatatacaaac

SEQ ID NO: 103846 - DNA, 25 bp, mus musculus
aggaattggcctgacggaggcaatc

SEQ ID NO: 103847 - DNA, 25 bp, mus musculus
gaattggcctgacggaggcaatcga

SEQ ID NO: 103848 - DNA, 25 bp, mus musculus
gaacttagccattgtgtccaatgca

SEQ ID NO: 103849 - DNA, 25 bp, mus musculus
acttagccattgtgtccaatgcaac

SEQ ID NO: 103850 - DNA, 25 bp, mus musculus
agccattgtgtccaatgcaactgcc

SEQ ID NO: 103851 - DNA, 25 bp, mus musculus
ccattgtgtccaatgcaactgcctt

SEQ ID NO: 103852 - DNA, 25 bp, mus musculus
attgtgtccaatgcaactgccttga

SEQ ID NO: 103853 - DNA, 25 bp, mus musculus
tgtgtccaatgcaactgccttgaat

SEQ ID NO: 103854 - DNA, 25 bp, mus musculus
tgtccaatgcaactgccttgaattg

SEQ ID NO: 103855 - DNA, 25 bp, mus musculus
caatgcaactgccttgaattggaac

SEQ ID NO: 103856 - DNA, 25 bp, mus musculus
atgcaactgccttgaattggaacac

SEQ ID NO: 103857 - DNA, 25 bp, mus musculus
gcaactgccttgaattggaacaccg

SEQ ID NO: 103858 - DNA, 25 bp, mus musculus
attggcctgacggaggcaatcgaca

SEQ ID NO: 103859 - DNA, 25 bp, mus musculus
caatcgacaagaccaggccagacta

SEQ ID NO: 103860 - DNA, 25 bp, mus musculus
atcgacaagaccaggccagactaat

SEQ ID NO: 103861 - DNA, 25 bp, mus musculus
cgacaagaccaggccagactaatgg

SEQ ID NO: 103862 - DNA, 25 bp, mus musculus
aagaccaggccagactaatggggca

SEQ ID NO: 103863 - DNA, 25 bp, mus musculus
gtcttgcaagagggacctgaactta

SEQ ID NO: 103864 - DNA, 25 bp, mus musculus
acctgaacttagccattgtgtccaa

SEQ ID NO: 103865 - DNA, 25 bp, mus musculus
ctgaacttagccattgtgtccaatg

SEQ ID NO: 103866 - DNA, 25 bp, mus musculus
ttaaaatcaagatctctgctcctca

SEQ ID NO: 103867 - DNA, 25 bp, mus musculus
aatcaagatctctgctcctcaggaa

SEQ ID NO: 103868 - DNA, 25 bp, mus musculus
aggaacggctgtactccacgtggat

SEQ ID NO: 103869 - DNA, 25 bp, mus musculus
acggctgtactccacgtggattgga

SEQ ID NO: 103870 - DNA, 25 bp, mus musculus
gtactccacgtggattggaggctcc

SEQ ID NO: 103871 - DNA, 25 bp, mus musculus
actccacgtggattggaggctccat

SEQ ID NO: 103872 - DNA, 25 bp, mus musculus
ctcgcctcactggataccttcaaga

SEQ ID NO: 103873 - DNA, 25 bp, mus musculus
cgcctcactggataccttcaagatg

SEQ ID NO: 103874 - DNA, 25 bp, mus musculus
cctcactggataccttcaagatgat

SEQ ID NO: 103875 - DNA, 25 bp, mus musculus
tcactggataccttcaagatgatgt

SEQ ID NO: 103876 - DNA, 25 bp, mus musculus
actggataccttcaagatgatgtgg

SEQ ID NO: 103877 - DNA, 25 bp, mus musculus
gataccttcaagatgatgtgggtat

SEQ ID NO: 103878 - DNA, 25 bp, mus musculus
tcaagatctctgctcctcaggaacg

SEQ ID NO: 103879 - DNA, 25 bp, mus musculus
cgcgattcatcgcaaaaccttctaa

SEQ ID NO: 103880 - DNA, 25 bp, mus musculus
aagatctctgctcctcaggaacggc

SEQ ID NO: 103881 - DNA, 25 bp, mus musculus
gatctctgctcctcaggaacggctg

SEQ ID NO: 103882 - DNA, 25 bp, mus musculus
tctctgctcctcaggaacggctgta

SEQ ID NO: 103883 - DNA, 25 bp, mus musculus
tctgctcctcaggaacggctgtact

SEQ ID NO: 103884 - DNA, 25 bp, mus musculus
tgctcctcaggaacggctgtactcc

SEQ ID NO: 103885 - DNA, 25 bp, mus musculus
ctcctcaggaacggctgtactccac

SEQ ID NO: 103886 - DNA, 25 bp, mus musculus
cctcaggaacggctgtactccacgt

SEQ ID NO: 103887 - DNA, 25 bp, mus musculus
ctgaccaagttcacaggggtcatta

SEQ ID NO: 103888 - DNA, 25 bp, mus musculus
ctctggctgagtgactgggtgacat

SEQ ID NO: 103889 - DNA, 25 bp, mus musculus
gtgctcaatgagctgccagtcccca

SEQ ID NO: 103890 - DNA, 25 bp, mus musculus
ctcaatgagctgccagtccccatgg

SEQ ID NO: 103891 - DNA, 25 bp, mus musculus
aatgagctgccagtccccatggtgg

SEQ ID NO: 103892 - DNA, 25 bp, mus musculus
gtggcccgctacattcgcataaacc

SEQ ID NO: 103893 - DNA, 25 bp, mus musculus
cgctacattcgcataaaccctcagt

SEQ ID NO: 103894 - DNA, 25 bp, mus musculus
tacattcgcataaaccctcagtcct

SEQ ID NO: 103895 - DNA, 25 bp, mus musculus
attcgcataaaccctcagtcctggt

SEQ ID NO: 103896 - DNA, 25 bp, mus musculus
gagcatctgcatgaggatggagatc

SEQ ID NO: 103897 - DNA, 25 bp, mus musculus
gcatctgcatgaggatggagatctt

SEQ ID NO: 103898 - DNA, 25 bp, mus musculus
catctgcatgaggatggagatcttg

SEQ ID NO: 103899 - DNA, 25 bp, mus musculus
gtgacatcctataaagtcatggtga

SEQ ID NO: 103900 - DNA, 25 bp, mus musculus
acatcctataaagtcatggtgagca

SEQ ID NO: 103901 - DNA, 25 bp, mus musculus
aatgacagccacacatgggttactg

SEQ ID NO: 103902 - DNA, 25 bp, mus musculus
gacagccacacatgggttactgtga

SEQ ID NO: 103903 - DNA, 25 bp, mus musculus
agccacacatgggttactgtgaaga

SEQ ID NO: 103904 - DNA, 25 bp, mus musculus
gagattcctgtgctcaatgagctgc

SEQ ID NO: 103905 - DNA, 25 bp, mus musculus
attcctgtgctcaatgagctgccag

SEQ ID NO: 103906 - DNA, 25 bp, mus musculus
cctgtgctcaatgagctgccagtcc

SEQ ID NO: 103907 - DNA, 25 bp, mus musculus
agtacctgggtgttagcaccttgag

SEQ ID NO: 103908 - DNA, 25 bp, mus musculus
acctgggtgttagcaccttgagtat

SEQ ID NO: 103909 - DNA, 25 bp, mus musculus
taaccgaattctggtggctgctgga

SEQ ID NO: 103910 - DNA, 25 bp, mus musculus
aattctggtggctgctggacactac

SEQ ID NO: 103911 - DNA, 25 bp, mus musculus
tctggtggctgctggacactacatt

SEQ ID NO: 103912 - DNA, 25 bp, mus musculus
ggctgctggacactacattgaagac

SEQ ID NO: 103913 - DNA, 25 bp, mus musculus
tgctggacactacattgaagactcg

SEQ ID NO: 103914 - DNA, 25 bp, mus musculus
acactacattgaagactcggacttt

SEQ ID NO: 103915 - DNA, 25 bp, mus musculus
ctcggacttttctagtgcgcgaatg

SEQ ID NO: 103916 - DNA, 25 bp, mus musculus
ggacttttctagtgcgcgaatgagt

SEQ ID NO: 103917 - DNA, 25 bp, mus musculus
cttttctagtgcgcgaatgagtgac

SEQ ID NO: 103918 - DNA, 25 bp, mus musculus
ttctagtgcgcgaatgagtgacact

SEQ ID NO: 103919 - DNA, 25 bp, mus musculus
gtgttagcaccttgagtattatgca

SEQ ID NO: 103920 - DNA, 25 bp, mus musculus
gtattatgcaccgcaacatataggc

SEQ ID NO: 103921 - DNA, 25 bp, mus musculus
ttatgcaccgcaacatataggccac

SEQ ID NO: 103922 - DNA, 25 bp, mus musculus
tgcaccgcaacatataggccactga

SEQ ID NO: 103923 - DNA, 25 bp, mus musculus
gcaacatataggccactgataatgg

SEQ ID NO: 103924 - DNA, 25 bp, mus musculus
tataggccactgataatggaaatag

SEQ ID NO: 103925 - DNA, 25 bp, mus musculus
ggacgctaaccgaattctggtggct

SEQ ID NO: 103926 - DNA, 25 bp, mus musculus
cgctaaccgaattctggtggctgct

SEQ ID NO: 103927 - DNA, 25 bp, mus musculus
caagactaagaaccttcgtctgctc

SEQ ID NO: 103928 - DNA, 25 bp, mus musculus
ccttcgtctgctcattctggtgagc

SEQ ID NO: 103929 - DNA, 25 bp, mus musculus
accccaggacttcgagtacatctgg

SEQ ID NO: 103930 - DNA, 25 bp, mus musculus
catctggcagaattttgtggagcaa

SEQ ID NO: 103931 - DNA, 25 bp, mus musculus
tgaatccaaggcctttgagccctgg

SEQ ID NO: 103932 - DNA, 25 bp, mus musculus
atccaaggcctttgagccctgggag

SEQ ID NO: 103933 - DNA, 25 bp, mus musculus
ggcctttgagccctgggaggacatt

SEQ ID NO: 103934 - DNA, 25 bp, mus musculus
ctttgagccctgggaggacattcag

SEQ ID NO: 103935 - DNA, 25 bp, mus musculus
tgagccctgggaggacattcaggag

SEQ ID NO: 103936 - DNA, 25 bp, mus musculus
ggagaacttcctatactatgaggag

SEQ ID NO: 103937 - DNA, 25 bp, mus musculus
gaacttcctatactatgaggagaag

SEQ ID NO: 103938 - DNA, 25 bp, mus musculus
ggcaacagagctcggccttccagtt

SEQ ID NO: 103939 - DNA, 25 bp, mus musculus
tcgtctgctcattctggtgagccgg

SEQ ID NO: 103940 - DNA, 25 bp, mus musculus
tctgctcattctggtgagccggctc

SEQ ID NO: 103941 - DNA, 25 bp, mus musculus
tctggtgagccggctcttcatgtgg

SEQ ID NO: 103942 - DNA, 25 bp, mus musculus
ggtccaggccgctctgaaaaagctg

SEQ ID NO: 103943 - DNA, 25 bp, mus musculus
cggctgcaaacttcgcatcatgaaa

SEQ ID NO: 103944 - DNA, 25 bp, mus musculus
ctgcaaacttcgcatcatgaaaccc

SEQ ID NO: 103945 - DNA, 25 bp, mus musculus
caaacttcgcatcatgaaaccccag

SEQ ID NO: 103946 - DNA, 25 bp, mus musculus
catcatgaaaccccaggacttcgag

SEQ ID NO: 103947 - DNA, 25 bp, mus musculus
aggccatgacacatttccctgcatc

SEQ ID NO: 103948 - DNA, 25 bp, mus musculus
atttccctgcatctcctttctggtc

SEQ ID NO: 103949 - DNA, 25 bp, mus musculus
tcctattgtggataccttcaaagtg

SEQ ID NO: 103950 - DNA, 25 bp, mus musculus
actcactgttatctgttgcctcctg

SEQ ID NO: 103951 - DNA, 25 bp, mus musculus
cactgttatctgttgcctcctggca

SEQ ID NO: 103952 - DNA, 25 bp, mus musculus
attcgtgcagcgctctggaaattac

SEQ ID NO: 103953 - DNA, 25 bp, mus musculus
cgtgcagcgctctggaaattacttc

SEQ ID NO: 103954 - DNA, 25 bp, mus musculus
cttcgtgacaatgtttgacgattat

SEQ ID NO: 103955 - DNA, 25 bp, mus musculus
cgattattctgctacattgcctctg

SEQ ID NO: 103956 - DNA, 25 bp, mus musculus
tgctacattgcctctgctaattgtg

SEQ ID NO: 103957 - DNA, 25 bp, mus musculus
tacattgcctctgctaattgtggtc

SEQ ID NO: 103958 - DNA, 25 bp, mus musculus
gcctctgctaattgtggtcatcttg

SEQ ID NO: 103959 - DNA, 25 bp, mus musculus
tccctgcatctcctttctggtcagt

SEQ ID NO: 103960 - DNA, 25 bp, mus musculus
tgatgtttttcctcatgttgataaa

SEQ ID NO: 103961 - DNA, 25 bp, mus musculus
ttttcctcatgttgataaatctcgg

SEQ ID NO: 103962 - DNA, 25 bp, mus musculus
taaatctcggcctcgcagcatgttt

SEQ ID NO: 103963 - DNA, 25 bp, mus musculus
atctcggcctcgcagcatgtttgga

SEQ ID NO: 103964 - DNA, 25 bp, mus musculus
gcctcgcagcatgtttggaacaatt

SEQ ID NO: 103965 - DNA, 25 bp, mus musculus
gatcatcactcctattgtggatacc

SEQ ID NO: 103966 - DNA, 25 bp, mus musculus
cactcctattgtggataccttcaaa

SEQ ID NO: 103967 - DNA, 25 bp, mus musculus
atatcatttcatcatgtgttctata

SEQ ID NO: 103968 - DNA, 25 bp, mus musculus
tatcatttcatcatgtgttctataa

SEQ ID NO: 103969 - DNA, 25 bp, mus musculus
tacatttgttgtcatttggcatcag

SEQ ID NO: 103970 - DNA, 25 bp, mus musculus
acatttgttgtcatttggcatcagt

SEQ ID NO: 103971 - DNA, 25 bp, mus musculus
catttgttgtcatttggcatcagtg

SEQ ID NO: 103972 - DNA, 25 bp, mus musculus
atttgttgtcatttggcatcagtga

SEQ ID NO: 103973 - DNA, 25 bp, mus musculus
tgttgtcatttggcatcagtgagat

SEQ ID NO: 103974 - DNA, 25 bp, mus musculus
gttgtcatttggcatcagtgagata

SEQ ID NO: 103975 - DNA, 25 bp, mus musculus
ttgtcatttggcatcagtgagatat

SEQ ID NO: 103976 - DNA, 25 bp, mus musculus
tgtcatttggcatcagtgagatata

SEQ ID NO: 103977 - DNA, 25 bp, mus musculus
gtcatttggcatcagtgagatatat

SEQ ID NO: 103978 - DNA, 25 bp, mus musculus
tcatttggcatcagtgagatatatc

SEQ ID NO: 103979 - DNA, 25 bp, mus musculus
atcatttcatcatgtgttctataat

SEQ ID NO: 103980 - DNA, 25 bp, mus musculus
tcatttcatcatgtgttctataata

SEQ ID NO: 103981 - DNA, 25 bp, mus musculus
catttcatcatgtgttctataatac

SEQ ID NO: 103982 - DNA, 25 bp, mus musculus
atttcatcatgtgttctataataca

SEQ ID NO: 103983 - DNA, 25 bp, mus musculus
tttcatcatgtgttctataatacat

SEQ ID NO: 103984 - DNA, 25 bp, mus musculus
tcatcatgtgttctataatacattt

SEQ ID NO: 103985 - DNA, 25 bp, mus musculus
aatacatttgttgtcatttggcatc

SEQ ID NO: 103986 - DNA, 25 bp, mus musculus
atacatttgttgtcatttggcatca

SEQ ID NO: 103987 - DNA, 25 bp, mus musculus
gggctcctcaaggtctgttgtgaac

SEQ ID NO: 103988 - DNA, 25 bp, mus musculus
agtggccccacggtacgttgcattg

SEQ ID NO: 103989 - DNA, 25 bp, mus musculus
ggaagtagccagacaccccaagaat

SEQ ID NO: 103990 - DNA, 25 bp, mus musculus
agtagccagacaccccaagaatcct

SEQ ID NO: 103991 - DNA, 25 bp, mus musculus
agccagacaccccaagaatcctgat

SEQ ID NO: 103992 - DNA, 25 bp, mus musculus
cagacaccccaagaatcctgatgtt

SEQ ID NO: 103993 - DNA, 25 bp, mus musculus
acaccccaagaatcctgatgttggt

SEQ ID NO: 103994 - DNA, 25 bp, mus musculus
ccccaagaatcctgatgttggtttg

SEQ ID NO: 103995 - DNA, 25 bp, mus musculus
gaatcctgatgttggtttgaagcct

SEQ ID NO: 103996 - DNA, 25 bp, mus musculus
tttcatagaaggggccgatgcagag

SEQ ID NO: 103997 - DNA, 25 bp, mus musculus
agagactttctcagagggtgagatg

SEQ ID NO: 103998 - DNA, 25 bp, mus musculus
tataaactgcggcaacatcaacatt

SEQ ID NO: 103999 - DNA, 25 bp, mus musculus
ggccccacggtacgttgcattgctg

SEQ ID NO: 104000 - DNA, 25 bp, mus musculus
aaactgcggcaacatcaacattact

SEQ ID NO: 104001 - DNA, 25 bp, mus musculus
cccacggtacgttgcattgctgaag

SEQ ID NO: 104002 - DNA, 25 bp, mus musculus
acggtacgttgcattgctgaagaag

SEQ ID NO: 104003 - DNA, 25 bp, mus musculus
gtacgttgcattgctgaagaaggaa

SEQ ID NO: 104004 - DNA, 25 bp, mus musculus
cgttgcattgctgaagaaggaagtc

SEQ ID NO: 104005 - DNA, 25 bp, mus musculus
ggaagtcgtcccagtgaatgtcctg

SEQ ID NO: 104006 - DNA, 25 bp, mus musculus
agtcgtcccagtgaatgtcctggat

SEQ ID NO: 104007 - DNA, 25 bp, mus musculus
cccagtgaatgtcctggatgcgcag

SEQ ID NO: 104008 - DNA, 25 bp, mus musculus
gccaataaactgctttgtgaagtgt

SEQ ID NO: 104009 - DNA, 25 bp, mus musculus
caataaactgctttgtgaagtgtgt

SEQ ID NO: 104010 - DNA, 25 bp, mus musculus
ctgtcctcactctgcatttaaagcg

SEQ ID NO: 104011 - DNA, 25 bp, mus musculus
gtcctcactctgcatttaaagcgat

SEQ ID NO: 104012 - DNA, 25 bp, mus musculus
cctcactctgcatttaaagcgattc

SEQ ID NO: 104013 - DNA, 25 bp, mus musculus
tcactctgcatttaaagcgattcca

SEQ ID NO: 104014 - DNA, 25 bp, mus musculus
catttaaagcgattccagcaggctg

SEQ ID NO: 104015 - DNA, 25 bp, mus musculus
tttaaagcgattccagcaggctggt

SEQ ID NO: 104016 - DNA, 25 bp, mus musculus
taaagcgattccagcaggctggttt

SEQ ID NO: 104017 - DNA, 25 bp, mus musculus
aagcgattccagcaggctggtttta

SEQ ID NO: 104018 - DNA, 25 bp, mus musculus
gcgattccagcaggctggttttaac

SEQ ID NO: 104019 - DNA, 25 bp, mus musculus
gattccagcaggctggttttaacct

SEQ ID NO: 104020 - DNA, 25 bp, mus musculus
aaactgctttgtgaagtgtgttcaa

SEQ ID NO: 104021 - DNA, 25 bp, mus musculus
acatgtttacaccaatgccaagaag

SEQ ID NO: 104022 - DNA, 25 bp, mus musculus
atgtttacaccaatgccaagaagca

SEQ ID NO: 104023 - DNA, 25 bp, mus musculus
gtttacaccaatgccaagaagcaga

SEQ ID NO: 104024 - DNA, 25 bp, mus musculus
ttacaccaatgccaagaagcagatg

SEQ ID NO: 104025 - DNA, 25 bp, mus musculus
acaccaatgccaagaagcagatgct

SEQ ID NO: 104026 - DNA, 25 bp, mus musculus
accaatgccaagaagcagatgctgg

SEQ ID NO: 104027 - DNA, 25 bp, mus musculus
tcctgtcctcactctgcatttaaag

SEQ ID NO: 104028 - DNA, 25 bp, mus musculus
cccagctgacatctggagcacagca

SEQ ID NO: 104029 - DNA, 25 bp, mus musculus
agctgacatctggagcacagcatgc

SEQ ID NO: 104030 - DNA, 25 bp, mus musculus
ctggtgactacctatttgagcccca

SEQ ID NO: 104031 - DNA, 25 bp, mus musculus
atgaggaccacattgctcatatcgt

SEQ ID NO: 104032 - DNA, 25 bp, mus musculus
aggaccacattgctcatatcgtgga

SEQ ID NO: 104033 - DNA, 25 bp, mus musculus
ctcatatcgtggaacttctaggaga

SEQ ID NO: 104034 - DNA, 25 bp, mus musculus
atatcgtggaacttctaggagacat

SEQ ID NO: 104035 - DNA, 25 bp, mus musculus
aacttctaggagacatccctccagc

SEQ ID NO: 104036 - DNA, 25 bp, mus musculus
ttctaggagacatccctccagcttt

SEQ ID NO: 104037 - DNA, 25 bp, mus musculus
cagcttttgccctctcaggccgata

SEQ ID NO: 104038 - DNA, 25 bp, mus musculus
tctcaggccgatattcacgggagtt

SEQ ID NO: 104039 - DNA, 25 bp, mus musculus
caggccgatattcacgggagttctt

SEQ ID NO: 104040 - DNA, 25 bp, mus musculus
ttagtttagctgcctccatgcctag

SEQ ID NO: 104041 - DNA, 25 bp, mus musculus
tcttcaaccgtagaggagagctgcg

SEQ ID NO: 104042 - DNA, 25 bp, mus musculus
gtttagctgcctccatgcctaggat

SEQ ID NO: 104043 - DNA, 25 bp, mus musculus
tagctgcctccatgcctaggatcag

SEQ ID NO: 104044 - DNA, 25 bp, mus musculus
cctccatgcctaggatcagacacct

SEQ ID NO: 104045 - DNA, 25 bp, mus musculus
ccatgcctaggatcagacacctgcc

SEQ ID NO: 104046 - DNA, 25 bp, mus musculus
ggatcagacacctgccacagcctca

SEQ ID NO: 104047 - DNA, 25 bp, mus musculus
ttgagctggccactggtgactacct

SEQ ID NO: 104048 - DNA, 25 bp, mus musculus
agctggccactggtgactacctatt

SEQ ID NO: 104049 - DNA, 25 bp, mus musculus
gcgcctgcgtactaagacccgtgtg

SEQ ID NO: 104050 - DNA, 25 bp, mus musculus
gcctgcgtactaagacccgtgtgca

SEQ ID NO: 104051 - DNA, 25 bp, mus musculus
tcggagctccttaaatggcagatga

SEQ ID NO: 104052 - DNA, 25 bp, mus musculus
agctccttaaatggcagatgatttg

SEQ ID NO: 104053 - DNA, 25 bp, mus musculus
ccaacttcccaatgcagtgctcagc

SEQ ID NO: 104054 - DNA, 25 bp, mus musculus
aacttcccaatgcagtgctcagcat

SEQ ID NO: 104055 - DNA, 25 bp, mus musculus
aatgcagtgctcagcattacgtaag

SEQ ID NO: 104056 - DNA, 25 bp, mus musculus
tgcagtgctcagcattacgtaagaa

SEQ ID NO: 104057 - DNA, 25 bp, mus musculus
cagtgctcagcattacgtaagaaat

SEQ ID NO: 104058 - DNA, 25 bp, mus musculus
gtgctcagcattacgtaagaaatgg

SEQ ID NO: 104059 - DNA, 25 bp, mus musculus
tgtgctcaaaaggccggccaatgta

SEQ ID NO: 104060 - DNA, 25 bp, mus musculus
ctcaaaaggccggccaatgtaagat

SEQ ID NO: 104061 - DNA, 25 bp, mus musculus
ctgcgtactaagacccgtgtgcagc

SEQ ID NO: 104062 - DNA, 25 bp, mus musculus
tcaaaaggccggccaatgtaagatc

SEQ ID NO: 104063 - DNA, 25 bp, mus musculus
gcgtactaagacccgtgtgcagcag

SEQ ID NO: 104064 - DNA, 25 bp, mus musculus
gtactaagacccgtgtgcagcagcg

SEQ ID NO: 104065 - DNA, 25 bp, mus musculus
actaagacccgtgtgcagcagcggc

SEQ ID NO: 104066 - DNA, 25 bp, mus musculus
taagacccgtgtgcagcagcggcgg

SEQ ID NO: 104067 - DNA, 25 bp, mus musculus
gttcgccgagttggaatcggagctc

SEQ ID NO: 104068 - DNA, 25 bp, mus musculus
tcgccgagttggaatcggagctcct

SEQ ID NO: 104069 - DNA, 25 bp, mus musculus
aatcggagctccttaaatggcagat

SEQ ID NO: 104070 - DNA, 25 bp, mus musculus
gatctcttaataacttccgggctga

SEQ ID NO: 104071 - DNA, 25 bp, mus musculus
ctcttaataacttccgggctgagca

SEQ ID NO: 104072 - DNA, 25 bp, mus musculus
tgatgactgaagtggcctggactaa

SEQ ID NO: 104073 - DNA, 25 bp, mus musculus
ttaaggccttcatacctcagctgct

SEQ ID NO: 104074 - DNA, 25 bp, mus musculus
aggccttcatacctcagctgctgtc

SEQ ID NO: 104075 - DNA, 25 bp, mus musculus
tcatacctcagctgctgtcacggct

SEQ ID NO: 104076 - DNA, 25 bp, mus musculus
ctcagctgctgtcacggctgcatat

SEQ ID NO: 104077 - DNA, 25 bp, mus musculus
tgctgtcacggctgcatattgaagc

SEQ ID NO: 104078 - DNA, 25 bp, mus musculus
atattgaagcacttctccatggaaa

SEQ ID NO: 104079 - DNA, 25 bp, mus musculus
ttgaagcacttctccatggaaacat

SEQ ID NO: 104080 - DNA, 25 bp, mus musculus
cacttctccatggaaacataaccaa

SEQ ID NO: 104081 - DNA, 25 bp, mus musculus
ttctccatggaaacataaccaagca

SEQ ID NO: 104082 - DNA, 25 bp, mus musculus
acttccgggctgagcagcctcacca

SEQ ID NO: 104083 - DNA, 25 bp, mus musculus
gaaacataaccaagcaggctgcctt

SEQ ID NO: 104084 - DNA, 25 bp, mus musculus
ctgagcagcctcaccagcatgccat

SEQ ID NO: 104085 - DNA, 25 bp, mus musculus
agcctcaccagcatgccatgtacta

SEQ ID NO: 104086 - DNA, 25 bp, mus musculus
accagcatgccatgtactacctccg

SEQ ID NO: 104087 - DNA, 25 bp, mus musculus
agcatgccatgtactacctccgctt

SEQ ID NO: 104088 - DNA, 25 bp, mus musculus
tgtactacctccgcttgctgatgac

SEQ ID NO: 104089 - DNA, 25 bp, mus musculus
actacctccgcttgctgatgactga

SEQ ID NO: 104090 - DNA, 25 bp, mus musculus
acctccgcttgctgatgactgaagt

SEQ ID NO: 104091 - DNA, 25 bp, mus musculus
aacgccagcgcccaatctgagcaat

SEQ ID NO: 104092 - DNA, 25 bp, mus musculus
cgccagcgcccaatctgagcaatct

SEQ ID NO: 104093 - DNA, 25 bp, mus musculus
agactactactgaggagcagagtca

SEQ ID NO: 104094 - DNA, 25 bp, mus musculus
gactactactgaggagcagagtcaa

SEQ ID NO: 104095 - DNA, 25 bp, mus musculus
actactactgaggagcagagtcaaa

SEQ ID NO: 104096 - DNA, 25 bp, mus musculus
agagtcaaacagctcaggcaagaag

SEQ ID NO: 104097 - DNA, 25 bp, mus musculus
gagtcaaacagctcaggcaagaagt

SEQ ID NO: 104098 - DNA, 25 bp, mus musculus
tcaaacagctcaggcaagaagtgtc

SEQ ID NO: 104099 - DNA, 25 bp, mus musculus
caaacagctcaggcaagaagtgtct

SEQ ID NO: 104100 - DNA, 25 bp, mus musculus
gccagcgcccaatctgagcaatctg

SEQ ID NO: 104101 - DNA, 25 bp, mus musculus
ccagcgcccaatctgagcaatctgc

SEQ ID NO: 104102 - DNA, 25 bp, mus musculus
cagcgcccaatctgagcaatctgca

SEQ ID NO: 104103 - DNA, 25 bp, mus musculus
agcgcccaatctgagcaatctgcag

SEQ ID NO: 104104 - DNA, 25 bp, mus musculus
gcgcccaatctgagcaatctgcaga

SEQ ID NO: 104105 - DNA, 25 bp, mus musculus
cgcccaatctgagcaatctgcagac

SEQ ID NO: 104106 - DNA, 25 bp, mus musculus
gcccaatctgagcaatctgcagact

SEQ ID NO: 104107 - DNA, 25 bp, mus musculus
cccaatctgagcaatctgcagacta

SEQ ID NO: 104108 - DNA, 25 bp, mus musculus
tacctctcttggtcttctggatgtg

SEQ ID NO: 104109 - DNA, 25 bp, mus musculus
tcttggtcttctggatgtgtccata

SEQ ID NO: 104110 - DNA, 25 bp, mus musculus
cgttctaggtgctcagtcaactagc

SEQ ID NO: 104111 - DNA, 25 bp, mus musculus
ttctaggtgctcagtcaactagcac

SEQ ID NO: 104112 - DNA, 25 bp, mus musculus
gctcagtcaactagcactagctaca

SEQ ID NO: 104113 - DNA, 25 bp, mus musculus
tcagtcaactagcactagctacacc

SEQ ID NO: 104114 - DNA, 25 bp, mus musculus
agtcaactagcactagctacaccag

SEQ ID NO: 104115 - DNA, 25 bp, mus musculus
tcaactagcactagctacaccagtg

SEQ ID NO: 104116 - DNA, 25 bp, mus musculus
aaggagccttcagtcttaagagagg

SEQ ID NO: 104117 - DNA, 25 bp, mus musculus
ggagccttcagtcttaagagaggag

SEQ ID NO: 104118 - DNA, 25 bp, mus musculus
agccttcagtcttaagagaggagct

SEQ ID NO: 104119 - DNA, 25 bp, mus musculus
ccttcagtcttaagagaggagctga

SEQ ID NO: 104120 - DNA, 25 bp, mus musculus
ttggtcttctggatgtgtccataga

SEQ ID NO: 104121 - DNA, 25 bp, mus musculus
ggtcttctggatgtgtccatagatg

SEQ ID NO: 104122 - DNA, 25 bp, mus musculus
tcttctggatgtgtccatagatgaa

SEQ ID NO: 104123 - DNA, 25 bp, mus musculus
gactcagcgcatagatgccgttcta

SEQ ID NO: 104124 - DNA, 25 bp, mus musculus
gcatagatgccgttctaggtgctca

SEQ ID NO: 104125 - DNA, 25 bp, mus musculus
atagatgccgttctaggtgctcagt

SEQ ID NO: 104126 - DNA, 25 bp, mus musculus
agatgccgttctaggtgctcagtca

SEQ ID NO: 104127 - DNA, 25 bp, mus musculus
atgccgttctaggtgctcagtcaac

SEQ ID NO: 104128 - DNA, 25 bp, mus musculus
cagatacatcgagaacctggaggtg

SEQ ID NO: 104129 - DNA, 25 bp, mus musculus
catgaagactcacagcgaggatgac

SEQ ID NO: 104130 - DNA, 25 bp, mus musculus
catcggcatcgttatcacagtgcac

SEQ ID NO: 104131 - DNA, 25 bp, mus musculus
gactgtgcacgccattgcctagctg

SEQ ID NO: 104132 - DNA, 25 bp, mus musculus
aatcattgccaagccacaccggaaa

SEQ ID NO: 104133 - DNA, 25 bp, mus musculus
tgccaagccacaccggaaatgacat

SEQ ID NO: 104134 - DNA, 25 bp, mus musculus
gccacaccggaaatgacattggtcc

SEQ ID NO: 104135 - DNA, 25 bp, mus musculus
atgacattggtccttctttcagaaa

SEQ ID NO: 104136 - DNA, 25 bp, mus musculus
gatggttccagatgcccagttgtca

SEQ ID NO: 104137 - DNA, 25 bp, mus musculus
tccagatgcccagttgtcacttttt

SEQ ID NO: 104138 - DNA, 25 bp, mus musculus
tatgatagtcttacttctgtacata

SEQ ID NO: 104139 - DNA, 25 bp, mus musculus
agtcttacttctgtacataaagaga

SEQ ID NO: 104140 - DNA, 25 bp, mus musculus
gactcacagcgaggatgacaaggac

SEQ ID NO: 104141 - DNA, 25 bp, mus musculus
caaggacctatccaagattgcagta

SEQ ID NO: 104142 - DNA, 25 bp, mus musculus
cctatccaagattgcagtagtagct

SEQ ID NO: 104143 - DNA, 25 bp, mus musculus
tgtcactatctttgtctctgccatc

SEQ ID NO: 104144 - DNA, 25 bp, mus musculus
tatctttgtctctgccatcatcctc

SEQ ID NO: 104145 - DNA, 25 bp, mus musculus
tgccatcatcctcgcagctattggc

SEQ ID NO: 104146 - DNA, 25 bp, mus musculus
cgcagctattggcatcggcatcgtt

SEQ ID NO: 104147 - DNA, 25 bp, mus musculus
tattggcatcggcatcgttatcaca

SEQ ID NO: 104148 - DNA, 25 bp, mus musculus
atccttatggattcacaagagtaat

SEQ ID NO: 104149 - DNA, 25 bp, mus musculus
gaccattaatgcagacactacttgt

SEQ ID NO: 104150 - DNA, 25 bp, mus musculus
gcaattgcactggacttagagtgaa

SEQ ID NO: 104151 - DNA, 25 bp, mus musculus
caattgcactggacttagagtgaat

SEQ ID NO: 104152 - DNA, 25 bp, mus musculus
attgcactggacttagagtgaatgt

SEQ ID NO: 104153 - DNA, 25 bp, mus musculus
ttgcactggacttagagtgaatgtt

SEQ ID NO: 104154 - DNA, 25 bp, mus musculus
tgcaatccatgctgactcaaaattg

SEQ ID NO: 104155 - DNA, 25 bp, mus musculus
caatccatgctgactcaaaattgta

SEQ ID NO: 104156 - DNA, 25 bp, mus musculus
aatccatgctgactcaaaattgtaa

SEQ ID NO: 104157 - DNA, 25 bp, mus musculus
atccatgctgactcaaaattgtaag

SEQ ID NO: 104158 - DNA, 25 bp, mus musculus
ccatgctgactcaaaattgtaagaa

SEQ ID NO: 104159 - DNA, 25 bp, mus musculus
catgctgactcaaaattgtaagaat

SEQ ID NO: 104160 - DNA, 25 bp, mus musculus
accattaatgcagacactacttgtg

SEQ ID NO: 104161 - DNA, 25 bp, mus musculus
ccattaatgcagacactacttgtgg

SEQ ID NO: 104162 - DNA, 25 bp, mus musculus
attaatgcagacactacttgtggca

SEQ ID NO: 104163 - DNA, 25 bp, mus musculus
ttaatgcagacactacttgtggcaa

SEQ ID NO: 104164 - DNA, 25 bp, mus musculus
taatgcagacactacttgtggcaat

SEQ ID NO: 104165 - DNA, 25 bp, mus musculus
atgcagacactacttgtggcaatga

SEQ ID NO: 104166 - DNA, 25 bp, mus musculus
tgcagacactacttgtggcaatgac

SEQ ID NO: 104167 - DNA, 25 bp, mus musculus
ggcaattgcactggacttagagtga

SEQ ID NO: 104168 - DNA, 25 bp, mus musculus
tctgtgtatcccagctgccgggaca

SEQ ID NO: 104169 - DNA, 25 bp, mus musculus
gtgtatcccagctgccgggacagga

SEQ ID NO: 104170 - DNA, 25 bp, mus musculus
gtctgctgctgctggctatcatcac

SEQ ID NO: 104171 - DNA, 25 bp, mus musculus
tgctgctgctggctatcatcacagc

SEQ ID NO: 104172 - DNA, 25 bp, mus musculus
ctatcatcacagctatactttacaa

SEQ ID NO: 104173 - DNA, 25 bp, mus musculus
tcatcacagctatactttacaaggc

SEQ ID NO: 104174 - DNA, 25 bp, mus musculus
tcacagctatactttacaaggctgg

SEQ ID NO: 104175 - DNA, 25 bp, mus musculus
cagctatactttacaaggctggttt

SEQ ID NO: 104176 - DNA, 25 bp, mus musculus
tcttcaaacgtcagtacaaggagat

SEQ ID NO: 104177 - DNA, 25 bp, mus musculus
tcaaacgtcagtacaaggagatgtt

SEQ ID NO: 104178 - DNA, 25 bp, mus musculus
caactccccaggttgcccagtgaga

SEQ ID NO: 104179 - DNA, 25 bp, mus musculus
ctccccaggttgcccagtgagaact

SEQ ID NO: 104180 - DNA, 25 bp, mus musculus
tatcccagctgccgggacaggaggc

SEQ ID NO: 104181 - DNA, 25 bp, mus musculus
cccagctgccgggacaggaggcatt

SEQ ID NO: 104182 - DNA, 25 bp, mus musculus
agctgccgggacaggaggcatttct

SEQ ID NO: 104183 - DNA, 25 bp, mus musculus
aggcatttctgagagcccagacgaa

SEQ ID NO: 104184 - DNA, 25 bp, mus musculus
catttctgagagcccagacgaagac

SEQ ID NO: 104185 - DNA, 25 bp, mus musculus
ttctgagagcccagacgaagacagt

SEQ ID NO: 104186 - DNA, 25 bp, mus musculus
gagcccagacgaagacagtgctgga

SEQ ID NO: 104187 - DNA, 25 bp, mus musculus
tccctcttatcgtgggcagctcagt

SEQ ID NO: 104188 - DNA, 25 bp, mus musculus
aatatttgacatggtccaagaatgg

SEQ ID NO: 104189 - DNA, 25 bp, mus musculus
atatttgacatggtccaagaatgga

SEQ ID NO: 104190 - DNA, 25 bp, mus musculus
gttttcttcctgatatgattaaatg

SEQ ID NO: 104191 - DNA, 25 bp, mus musculus
tttcttcctgatatgattaaatgaa

SEQ ID NO: 104192 - DNA, 25 bp, mus musculus
aatgaattcttgtctggtctcaaca

SEQ ID NO: 104193 - DNA, 25 bp, mus musculus
gaattcttgtctggtctcaacaaga

SEQ ID NO: 104194 - DNA, 25 bp, mus musculus
cttgtctggtctcaacaagataatg

SEQ ID NO: 104195 - DNA, 25 bp, mus musculus
ttgtctggtctcaacaagataatgt

SEQ ID NO: 104196 - DNA, 25 bp, mus musculus
aatgtaacacttgggaccaaatatg

SEQ ID NO: 104197 - DNA, 25 bp, mus musculus
atgtaacacttgggaccaaatatga

SEQ ID NO: 104198 - DNA, 25 bp, mus musculus
agtgctgtgctggaagccaagatag

SEQ ID NO: 104199 - DNA, 25 bp, mus musculus
tgctgtgctggaagccaagatagag

SEQ ID NO: 104200 - DNA, 25 bp, mus musculus
atggagccatcaggtcttagactca

SEQ ID NO: 104201 - DNA, 25 bp, mus musculus
tggagccatcaggtcttagactcag

SEQ ID NO: 104202 - DNA, 25 bp, mus musculus
agccatcaggtcttagactcagaga

SEQ ID NO: 104203 - DNA, 25 bp, mus musculus
ccatcaggtcttagactcagagaaa

SEQ ID NO: 104204 - DNA, 25 bp, mus musculus
catcaggtcttagactcagagaaac

SEQ ID NO: 104205 - DNA, 25 bp, mus musculus
aatgatgccattcatgaagttgtta

SEQ ID NO: 104206 - DNA, 25 bp, mus musculus
atgatgccattcatgaagttgttaa

SEQ ID NO: 104207 - DNA, 25 bp, mus musculus
ggtgttttcttcctgatatgattaa

SEQ ID NO: 104208 - DNA, 25 bp, mus musculus
aaagtcaagcccatctatttccaca

SEQ ID NO: 104209 - DNA, 25 bp, mus musculus
atctatttccacacacagtgaagat

SEQ ID NO: 104210 - DNA, 25 bp, mus musculus
gtacagtctgtcgtgaacaggttcc

SEQ ID NO: 104211 - DNA, 25 bp, mus musculus
attttgaatctgctgctgattgtgg

SEQ ID NO: 104212 - DNA, 25 bp, mus musculus
gtgatgatcctcttgtggcccagtg

SEQ ID NO: 104213 - DNA, 25 bp, mus musculus
atcctcttgtggcccagtgtcaatt

SEQ ID NO: 104214 - DNA, 25 bp, mus musculus
cccagtgtcaattgtgcttgtttat

SEQ ID NO: 104215 - DNA, 25 bp, mus musculus
tgtttatagcactgtgctgtgtgcc

SEQ ID NO: 104216 - DNA, 25 bp, mus musculus
tgtgctgtgtgccaaccaagcaaat

SEQ ID NO: 104217 - DNA, 25 bp, mus musculus
gtgtgccaaccaagcaaatgtttac

SEQ ID NO: 104218 - DNA, 25 bp, mus musculus
agcaaatgtttactcaccttatgcc

SEQ ID NO: 104219 - DNA, 25 bp, mus musculus
ctcaccttatgccatggtaaattta

SEQ ID NO: 104220 - DNA, 25 bp, mus musculus
ttccacacacagtgaagatttggaa

SEQ ID NO: 104221 - DNA, 25 bp, mus musculus
tgttccctttccagatgtcttctgc

SEQ ID NO: 104222 - DNA, 25 bp, mus musculus
ctttccagatgtcttctgcctgtta

SEQ ID NO: 104223 - DNA, 25 bp, mus musculus
agatgtcttctgcctgttatataac

SEQ ID NO: 104224 - DNA, 25 bp, mus musculus
atataactctgcactacttctctgc

SEQ ID NO: 104225 - DNA, 25 bp, mus musculus
ctctgcactacttctctgcagtgcc

SEQ ID NO: 104226 - DNA, 25 bp, mus musculus
actacttctctgcagtgccttgggg

SEQ ID NO: 104227 - DNA, 25 bp, mus musculus
tcctctactgatgtacagtctgtcg

SEQ ID NO: 104228 - DNA, 25 bp, mus musculus
atcgcagacctggtgatgcagctct

SEQ ID NO: 104229 - DNA, 25 bp, mus musculus
tcgcagacctggtgatgcagctctg

SEQ ID NO: 104230 - DNA, 25 bp, mus musculus
cacatcaagaccggtgaaccttgtc

SEQ ID NO: 104231 - DNA, 25 bp, mus musculus
catcaagaccggtgaaccttgtcgg

SEQ ID NO: 104232 - DNA, 25 bp, mus musculus
tcaagaccggtgaaccttgtcggtg

SEQ ID NO: 104233 - DNA, 25 bp, mus musculus
gaccggtgaaccttgtcggtgcgag

SEQ ID NO: 104234 - DNA, 25 bp, mus musculus
accttgtcggtgcgagaggctgatc

SEQ ID NO: 104235 - DNA, 25 bp, mus musculus
cttgtcggtgcgagaggctgatcaa

SEQ ID NO: 104236 - DNA, 25 bp, mus musculus
ttgtcggtgcgagaggctgatcaag

SEQ ID NO: 104237 - DNA, 25 bp, mus musculus
cagcaaaccaagtttgctggcaggt

SEQ ID NO: 104238 - DNA, 25 bp, mus musculus
agcaaaccaagtttgctggcaggtc

SEQ ID NO: 104239 - DNA, 25 bp, mus musculus
gcaaaccaagtttgctggcaggtcc

SEQ ID NO: 104240 - DNA, 25 bp, mus musculus
tgatgcagctctgcactgggcacat

SEQ ID NO: 104241 - DNA, 25 bp, mus musculus
atgcagctctgcactgggcacatca

SEQ ID NO: 104242 - DNA, 25 bp, mus musculus
cactgggcacatcaagaccggtgaa

SEQ ID NO: 104243 - DNA, 25 bp, mus musculus
actgggcacatcaagaccggtgaac

SEQ ID NO: 104244 - DNA, 25 bp, mus musculus
ctgggcacatcaagaccggtgaacc

SEQ ID NO: 104245 - DNA, 25 bp, mus musculus
gggcacatcaagaccggtgaacctt

SEQ ID NO: 104246 - DNA, 25 bp, mus musculus
ggcacatcaagaccggtgaaccttg

SEQ ID NO: 104247 - DNA, 25 bp, mus musculus
gcacatcaagaccggtgaaccttgt

SEQ ID NO: 104248 - DNA, 25 bp, mus musculus
ttcagcaactatgacattgcgaact

SEQ ID NO: 104249 - DNA, 25 bp, mus musculus
cattgcgaactcgcgtatggtgact

SEQ ID NO: 104250 - DNA, 25 bp, mus musculus
cggctcttttgtggttgagcatgtg

SEQ ID NO: 104251 - DNA, 25 bp, mus musculus
gctcttttgtggttgagcatgtgag

SEQ ID NO: 104252 - DNA, 25 bp, mus musculus
acaatagtcacagcattcgcactcg

SEQ ID NO: 104253 - DNA, 25 bp, mus musculus
tagtcacagcattcgcactcggcag

SEQ ID NO: 104254 - DNA, 25 bp, mus musculus
gtcacagcattcgcactcggcagtc

SEQ ID NO: 104255 - DNA, 25 bp, mus musculus
cacagcattcgcactcggcagtcta

SEQ ID NO: 104256 - DNA, 25 bp, mus musculus
cagcattcgcactcggcagtctaac

SEQ ID NO: 104257 - DNA, 25 bp, mus musculus
attcgcactcggcagtctaacattt

SEQ ID NO: 104258 - DNA, 25 bp, mus musculus
tcgcactcggcagtctaacattttg

SEQ ID NO: 104259 - DNA, 25 bp, mus musculus
gcactcggcagtctaacattttggt

SEQ ID NO: 104260 - DNA, 25 bp, mus musculus
gcgaactcgcgtatggtgactgtac

SEQ ID NO: 104261 - DNA, 25 bp, mus musculus
gaactcgcgtatggtgactgtacgt

SEQ ID NO: 104262 - DNA, 25 bp, mus musculus
actcgcgtatggtgactgtacgtgc

SEQ ID NO: 104263 - DNA, 25 bp, mus musculus
atggtgactgtacgtgctaggttgg

SEQ ID NO: 104264 - DNA, 25 bp, mus musculus
tgtacgtgctaggttggaaggaact

SEQ ID NO: 104265 - DNA, 25 bp, mus musculus
tacgtgctaggttggaaggaactgg

SEQ ID NO: 104266 - DNA, 25 bp, mus musculus
agagagacatctcggctcttttgtg

SEQ ID NO: 104267 - DNA, 25 bp, mus musculus
agagacatctcggctcttttgtggt

SEQ ID NO: 104268 - DNA, 25 bp, mus musculus
cgtgattacctgctgaggccagcat

SEQ ID NO: 104269 - DNA, 25 bp, mus musculus
gattacctgctgaggccagcatcca

SEQ ID NO: 104270 - DNA, 25 bp, mus musculus
tgattgacagcgaggacacggtctg

SEQ ID NO: 104271 - DNA, 25 bp, mus musculus
tagagcactactattcgtggtcttt

SEQ ID NO: 104272 - DNA, 25 bp, mus musculus
actattcgtggtctttcgcctgtgc

SEQ ID NO: 104273 - DNA, 25 bp, mus musculus
gtgcatgtgccgcgttcatcttgct

SEQ ID NO: 104274 - DNA, 25 bp, mus musculus
tgcctcggatgcctcagaacccctg

SEQ ID NO: 104275 - DNA, 25 bp, mus musculus
ctcagaacccctgggaatcctgcat

SEQ ID NO: 104276 - DNA, 25 bp, mus musculus
agaacccctgggaatcctgcatgga

SEQ ID NO: 104277 - DNA, 25 bp, mus musculus
acccctgggaatcctgcatggacgc

SEQ ID NO: 104278 - DNA, 25 bp, mus musculus
gggaatcctgcatggacgctgagcc

SEQ ID NO: 104279 - DNA, 25 bp, mus musculus
cctgcatggacgctgagccagagca

SEQ ID NO: 104280 - DNA, 25 bp, mus musculus
ctgaggccagcatccatgttttatg

SEQ ID NO: 104281 - DNA, 25 bp, mus musculus
aggccagcatccatgttttatgcct

SEQ ID NO: 104282 - DNA, 25 bp, mus musculus
gcatccatgttttatgccttcgcag

SEQ ID NO: 104283 - DNA, 25 bp, mus musculus
atgttttatgccttcgcagggctct

SEQ ID NO: 104284 - DNA, 25 bp, mus musculus
tatgccttcgcagggctctgctcat

SEQ ID NO: 104285 - DNA, 25 bp, mus musculus
gccttcgcagggctctgctcatcgt

SEQ ID NO: 104286 - DNA, 25 bp, mus musculus
ctctgctcatcgtctccgtggaggt

SEQ ID NO: 104287 - DNA, 25 bp, mus musculus
tcgtctccgtggaggtcatgaggca

SEQ ID NO: 104288 - DNA, 25 bp, mus musculus
tcaacttaaagggccagctaatatc

SEQ ID NO: 104289 - DNA, 25 bp, mus musculus
ctcccaacacataataatcagaaca

SEQ ID NO: 104290 - DNA, 25 bp, mus musculus
gctactatacccggccaaattctca

SEQ ID NO: 104291 - DNA, 25 bp, mus musculus
ggccaaattctcaattaccatagat

SEQ ID NO: 104292 - DNA, 25 bp, mus musculus
ctcaattaccatagatggagaaacc

SEQ ID NO: 104293 - DNA, 25 bp, mus musculus
caaattcacacattatctctccacg

SEQ ID NO: 104294 - DNA, 25 bp, mus musculus
attcacacattatctctccacgaat

SEQ ID NO: 104295 - DNA, 25 bp, mus musculus
cacacattatctctccacgaatcca

SEQ ID NO: 104296 - DNA, 25 bp, mus musculus
gaatccagcccttcaaaggataata

SEQ ID NO: 104297 - DNA, 25 bp, mus musculus
aaatcacgccctagaacaagcaaga

SEQ ID NO: 104298 - DNA, 25 bp, mus musculus
tcacgccctagaacaagcaagaaag

SEQ ID NO: 104299 - DNA, 25 bp, mus musculus
aagacagccacaagaacagaatgcc

SEQ ID NO: 104300 - DNA, 25 bp, mus musculus
tatcagaattacaccagacttttca

SEQ ID NO: 104301 - DNA, 25 bp, mus musculus
cagaattacaccagacttttcacca

SEQ ID NO: 104302 - DNA, 25 bp, mus musculus
tacaccagacttttcaccagagact

SEQ ID NO: 104303 - DNA, 25 bp, mus musculus
agacttttcaccagagactatgaaa

SEQ ID NO: 104304 - DNA, 25 bp, mus musculus
ttcaccagagactatgaaagccaga

SEQ ID NO: 104305 - DNA, 25 bp, mus musculus
tgttatacagacactaagagaacac

SEQ ID NO: 104306 - DNA, 25 bp, mus musculus
acacaaatgccagcccaggctacta

SEQ ID NO: 104307 - DNA, 25 bp, mus musculus
caaatgccagcccaggctactatac

SEQ ID NO: 104308 - DNA, 25 bp, mus musculus
aaatgtgacgttctttgtcactgtc

SEQ ID NO: 104309 - DNA, 25 bp, mus musculus
atgtgacgttctttgtcactgtcct

SEQ ID NO: 104310 - DNA, 25 bp, mus musculus
ctttgtcactgtcctgtatatcacg

SEQ ID NO: 104311 - DNA, 25 bp, mus musculus
tttgtcactgtcctgtatatcacgg

SEQ ID NO: 104312 - DNA, 25 bp, mus musculus
ttgtcactgtcctgtatatcacgga

SEQ ID NO: 104313 - DNA, 25 bp, mus musculus
tgtcactgtcctgtatatcacggaa

SEQ ID NO: 104314 - DNA, 25 bp, mus musculus
gtcactgtcctgtatatcacggaaa

SEQ ID NO: 104315 - DNA, 25 bp, mus musculus
tcactgtcctgtatatcacggaaat

SEQ ID NO: 104316 - DNA, 25 bp, mus musculus
cactgtcctgtatatcacggaaata

SEQ ID NO: 104317 - DNA, 25 bp, mus musculus
actgtcctgtatatcacggaaataa

SEQ ID NO: 104318 - DNA, 25 bp, mus musculus
ctgtcctgtatatcacggaaataaa

SEQ ID NO: 104319 - DNA, 25 bp, mus musculus
tgtcctgtatatcacggaaataaat

SEQ ID NO: 104320 - DNA, 25 bp, mus musculus
gtgacgttctttgtcactgtcctgt

SEQ ID NO: 104321 - DNA, 25 bp, mus musculus
tgacgttctttgtcactgtcctgta

SEQ ID NO: 104322 - DNA, 25 bp, mus musculus
gacgttctttgtcactgtcctgtat

SEQ ID NO: 104323 - DNA, 25 bp, mus musculus
acgttctttgtcactgtcctgtata

SEQ ID NO: 104324 - DNA, 25 bp, mus musculus
cgttctttgtcactgtcctgtatat

SEQ ID NO: 104325 - DNA, 25 bp, mus musculus
gttctttgtcactgtcctgtatatc

SEQ ID NO: 104326 - DNA, 25 bp, mus musculus
ttctttgtcactgtcctgtatatca

SEQ ID NO: 104327 - DNA, 25 bp, mus musculus
tctttgtcactgtcctgtatatcac

SEQ ID NO: 104328 - DNA, 25 bp, mus musculus
gagcctgcttctcctgttttccaga

SEQ ID NO: 104329 - DNA, 25 bp, mus musculus
gcttctcctgttttccagactccag

SEQ ID NO: 104330 - DNA, 25 bp, mus musculus
gacattctgggctctgcctcctgcc

SEQ ID NO: 104331 - DNA, 25 bp, mus musculus
ctcctgctcctgcctgtagatttat

SEQ ID NO: 104332 - DNA, 25 bp, mus musculus
ctccgtgtctggtcaggaacctgtc

SEQ ID NO: 104333 - DNA, 25 bp, mus musculus
tcaggaacctgtctgcaagtgaagc

SEQ ID NO: 104334 - DNA, 25 bp, mus musculus
caatatcttcgtgttttgtatatac

SEQ ID NO: 104335 - DNA, 25 bp, mus musculus
tatatacaactgctcttgtagcctt

SEQ ID NO: 104336 - DNA, 25 bp, mus musculus
tctcgaactcttattctccctgtag

SEQ ID NO: 104337 - DNA, 25 bp, mus musculus
actcttattctccctgtagcccttg

SEQ ID NO: 104338 - DNA, 25 bp, mus musculus
attctccctgtagcccttgcactgt

SEQ ID NO: 104339 - DNA, 25 bp, mus musculus
gcactgttgcccgttactaaaatgt

SEQ ID NO: 104340 - DNA, 25 bp, mus musculus
gagatcgaaaccgcctttcctctct

SEQ ID NO: 104341 - DNA, 25 bp, mus musculus
ataagccacttctgtacagaaacct

SEQ ID NO: 104342 - DNA, 25 bp, mus musculus
tggccagttgaccagctggccctgt

SEQ ID NO: 104343 - DNA, 25 bp, mus musculus
gttgaccagctggccctgtatcctc

SEQ ID NO: 104344 - DNA, 25 bp, mus musculus
catcccaaactctctctgagctgat

SEQ ID NO: 104345 - DNA, 25 bp, mus musculus
aaactctctctgagctgatacccga

SEQ ID NO: 104346 - DNA, 25 bp, mus musculus
tctctgagctgatacccgaagagcc

SEQ ID NO: 104347 - DNA, 25 bp, mus musculus
agctgatacccgaagagccaggcat

SEQ ID NO: 104348 - DNA, 25 bp, mus musculus
aagagccaggcatcagaggctgagc

SEQ ID NO: 104349 - DNA, 25 bp, mus musculus
ggatgtttcttctttgattatcaaa

SEQ ID NO: 104350 - DNA, 25 bp, mus musculus
ctttcctgtgtcctcagctaacaaa

SEQ ID NO: 104351 - DNA, 25 bp, mus musculus
tttccaacatccatcgctgcagcag

SEQ ID NO: 104352 - DNA, 25 bp, mus musculus
atcgctgcagcagacggtgtccctc

SEQ ID NO: 104353 - DNA, 25 bp, mus musculus
gtccctcagtgacttgagagacaag

SEQ ID NO: 104354 - DNA, 25 bp, mus musculus
gccgtgctctgctagctttgaccgt

SEQ ID NO: 104355 - DNA, 25 bp, mus musculus
ctctgctagctttgaccgtgggcat

SEQ ID NO: 104356 - DNA, 25 bp, mus musculus
tgctagctttgaccgtgggcatgga

SEQ ID NO: 104357 - DNA, 25 bp, mus musculus
tgaccgtgggcatggagatttaccc

SEQ ID NO: 104358 - DNA, 25 bp, mus musculus
tggagatttacccgcactgtgaact

SEQ ID NO: 104359 - DNA, 25 bp, mus musculus
agatttacccgcactgtgaactctc

SEQ ID NO: 104360 - DNA, 25 bp, mus musculus
tttacccgcactgtgaactctctaa

SEQ ID NO: 104361 - DNA, 25 bp, mus musculus
gtcctcagctaacaaaggcaggact

SEQ ID NO: 104362 - DNA, 25 bp, mus musculus
aggcaggactccagctggacttctg

SEQ ID NO: 104363 - DNA, 25 bp, mus musculus
gactccagctggacttctgcagctt

SEQ ID NO: 104364 - DNA, 25 bp, mus musculus
tccagctggacttctgcagcttcct

SEQ ID NO: 104365 - DNA, 25 bp, mus musculus
acttctgcagcttccttccgagtct

SEQ ID NO: 104366 - DNA, 25 bp, mus musculus
cgcactactggactgtggaaggaag

SEQ ID NO: 104367 - DNA, 25 bp, mus musculus
gaacggtttccaacatccatcgctg

SEQ ID NO: 104368 - DNA, 25 bp, mus musculus
cggtttccaacatccatcgctgcag

SEQ ID NO: 104369 - DNA, 25 bp, mus musculus
tcgggatccttcgcagagctccgga

SEQ ID NO: 104370 - DNA, 25 bp, mus musculus
ggatccttcgcagagctccggagca

SEQ ID NO: 104371 - DNA, 25 bp, mus musculus
accaacagaaccaggcagtctttct

SEQ ID NO: 104372 - DNA, 25 bp, mus musculus
agaaccaggcagtctttctcccata

SEQ ID NO: 104373 - DNA, 25 bp, mus musculus
accaggcagtctttctcccatatat

SEQ ID NO: 104374 - DNA, 25 bp, mus musculus
aggcagtctttctcccatatataca

SEQ ID NO: 104375 - DNA, 25 bp, mus musculus
tctttctcccatatatacacctgta

SEQ ID NO: 104376 - DNA, 25 bp, mus musculus
ttctcccatatatacacctgtatat

SEQ ID NO: 104377 - DNA, 25 bp, mus musculus
atatacacctgtatatagaaaatgt

SEQ ID NO: 104378 - DNA, 25 bp, mus musculus
ttgaactaatcacttctctttattc

SEQ ID NO: 104379 - DNA, 25 bp, mus musculus
taatcacttctctttattcccttca

SEQ ID NO: 104380 - DNA, 25 bp, mus musculus
ctctttattcccttcatcttgagga

SEQ ID NO: 104381 - DNA, 25 bp, mus musculus
tccttcgcagagctccggagcagac

SEQ ID NO: 104382 - DNA, 25 bp, mus musculus
gcagagctccggagcagacgcgcgc

SEQ ID NO: 104383 - DNA, 25 bp, mus musculus
agcagacgcgcgcgtgtccagaaat

SEQ ID NO: 104384 - DNA, 25 bp, mus musculus
tatttatctgcattcctcacgccag

SEQ ID NO: 104385 - DNA, 25 bp, mus musculus
ttatctgcattcctcacgccagagc

SEQ ID NO: 104386 - DNA, 25 bp, mus musculus
ccagagcacctgctttctacacaaa

SEQ ID NO: 104387 - DNA, 25 bp, mus musculus
tctacacaaaaccaaacaactcgcg

SEQ ID NO: 104388 - DNA, 25 bp, mus musculus
accaccaacagaaccaggcagtctt

SEQ ID NO: 104389 - DNA, 25 bp, mus musculus
ctagagtctctgaacactgagttta

SEQ ID NO: 104390 - DNA, 25 bp, mus musculus
aaattgattccgagtgagactcgcc

SEQ ID NO: 104391 - DNA, 25 bp, mus musculus
ataacaagactgccacttctgggtc

SEQ ID NO: 104392 - DNA, 25 bp, mus musculus
ccacttctgggtcatagtgatagag

SEQ ID NO: 104393 - DNA, 25 bp, mus musculus
ggcccctctgtgtgctatgatattg

SEQ ID NO: 104394 - DNA, 25 bp, mus musculus
tgacatacagtgcaccccagttttg

SEQ ID NO: 104395 - DNA, 25 bp, mus musculus
acagtgcaccccagttttgaataca

SEQ ID NO: 104396 - DNA, 25 bp, mus musculus
ccctgtcccgttctgctactttgat

SEQ ID NO: 104397 - DNA, 25 bp, mus musculus
tttctcctctttaaacatggtcctg

SEQ ID NO: 104398 - DNA, 25 bp, mus musculus
aggagccagacttattcgcaaagca

SEQ ID NO: 104399 - DNA, 25 bp, mus musculus
cagacttattcgcaaagcactgtgc

SEQ ID NO: 104400 - DNA, 25 bp, mus musculus
tattcgcaaagcactgtgctcaaac

SEQ ID NO: 104401 - DNA, 25 bp, mus musculus
attccgagtgagactcgccaagcac

SEQ ID NO: 104402 - DNA, 25 bp, mus musculus
aaagcactgtgctcaaactcttcag

SEQ ID NO: 104403 - DNA, 25 bp, mus musculus
actcgccaagcactaacctgagggt

SEQ ID NO: 104404 - DNA, 25 bp, mus musculus
tccagcaagccttagtaaactcagg

SEQ ID NO: 104405 - DNA, 25 bp, mus musculus
tagtaaactcaggttgccagcagct

SEQ ID NO: 104406 - DNA, 25 bp, mus musculus
actcaggttgccagcagctttgcca

SEQ ID NO: 104407 - DNA, 25 bp, mus musculus
agcagctttgccacttccgctgcta

SEQ ID NO: 104408 - DNA, 25 bp, mus musculus
tttgccacttccgctgctagctgaa

SEQ ID NO: 104409 - DNA, 25 bp, mus musculus
acttccgctgctagctgaataacaa

SEQ ID NO: 104410 - DNA, 25 bp, mus musculus
acagcccactgggatcacagcattt

SEQ ID NO: 104411 - DNA, 25 bp, mus musculus
tgggatcacagcatttcggggaaca

SEQ ID NO: 104412 - DNA, 25 bp, mus musculus
agccccgcttcaagctctctgttca

SEQ ID NO: 104413 - DNA, 25 bp, mus musculus
ttcagctccgcgttctcatgcttct

SEQ ID NO: 104414 - DNA, 25 bp, mus musculus
gcgttctcatgcttctcatggggtg

SEQ ID NO: 104415 - DNA, 25 bp, mus musculus
ttcctccgactttgcttttgcaggt

SEQ ID NO: 104416 - DNA, 25 bp, mus musculus
ctccgactttgcttttgcaggtctt

SEQ ID NO: 104417 - DNA, 25 bp, mus musculus
ttttgcaggtctttcactgcagatg

SEQ ID NO: 104418 - DNA, 25 bp, mus musculus
tgcaggtctttcactgcagatgggg

SEQ ID NO: 104419 - DNA, 25 bp, mus musculus
aggtctttcactgcagatggggctg

SEQ ID NO: 104420 - DNA, 25 bp, mus musculus
tctttcactgcagatggggctgctg

SEQ ID NO: 104421 - DNA, 25 bp, mus musculus
ttcactgcagatggggctgctgtgg

SEQ ID NO: 104422 - DNA, 25 bp, mus musculus
gatcacagcatttcggggaacattg

SEQ ID NO: 104423 - DNA, 25 bp, mus musculus
cacagcatttcggggaacattgcca

SEQ ID NO: 104424 - DNA, 25 bp, mus musculus
attgccacaccagtcagagagccca

SEQ ID NO: 104425 - DNA, 25 bp, mus musculus
gccacaccagtcagagagcccagaa

SEQ ID NO: 104426 - DNA, 25 bp, mus musculus
acaccagtcagagagcccagaacac

SEQ ID NO: 104427 - DNA, 25 bp, mus musculus
agagagcccagaacacctgggcaag

SEQ ID NO: 104428 - DNA, 25 bp, mus musculus
gagcccagaacacctgggcaagtag

SEQ ID NO: 104429 - DNA, 25 bp, mus musculus
cccagaacacctgggcaagtaggcg

SEQ ID NO: 104430 - DNA, 25 bp, mus musculus
gacccagtgggctcttaccagagag

SEQ ID NO: 104431 - DNA, 25 bp, mus musculus
ggctcttaccagagagactctttca

SEQ ID NO: 104432 - DNA, 25 bp, mus musculus
ttcatttctgcagccgagagggatg

SEQ ID NO: 104433 - DNA, 25 bp, mus musculus
tctgcagccgagagggatgtgtata

SEQ ID NO: 104434 - DNA, 25 bp, mus musculus
tatactggagatgctctcaggatct

SEQ ID NO: 104435 - DNA, 25 bp, mus musculus
gatgctctcaggatctgcatcgtga

SEQ ID NO: 104436 - DNA, 25 bp, mus musculus
gctctcaggatctgcatcgtgacca

SEQ ID NO: 104437 - DNA, 25 bp, mus musculus
ctcaggatctgcatcgtgaccaaag

SEQ ID NO: 104438 - DNA, 25 bp, mus musculus
atctgcatcgtgaccaaagagggca

SEQ ID NO: 104439 - DNA, 25 bp, mus musculus
tgcatcgtgaccaaagagggcatca

SEQ ID NO: 104440 - DNA, 25 bp, mus musculus
gactgacgtgcgggtcatatattgg

SEQ ID NO: 104441 - DNA, 25 bp, mus musculus
atattggagctgtggcacagtttgt

SEQ ID NO: 104442 - DNA, 25 bp, mus musculus
tcttaccagagagactctttcaagg

SEQ ID NO: 104443 - DNA, 25 bp, mus musculus
tcagcaagtgccatgctgcagcctc

SEQ ID NO: 104444 - DNA, 25 bp, mus musculus
gccatgctgcagcctctgctcgaca

SEQ ID NO: 104445 - DNA, 25 bp, mus musculus
atgctgcagcctctgctcgacaacc

SEQ ID NO: 104446 - DNA, 25 bp, mus musculus
ctgcagcctctgctcgacaaccagg

SEQ ID NO: 104447 - DNA, 25 bp, mus musculus
gtccccctgacgctggacagagcca

SEQ ID NO: 104448 - DNA, 25 bp, mus musculus
cccctgacgctggacagagccatga

SEQ ID NO: 104449 - DNA, 25 bp, mus musculus
acgctggacagagccatgaggctgg

SEQ ID NO: 104450 - DNA, 25 bp, mus musculus
atgtttatcgagggacaggaatgag

SEQ ID NO: 104451 - DNA, 25 bp, mus musculus
aggtccaaaaacatctaatagatag

SEQ ID NO: 104452 - DNA, 25 bp, mus musculus
ggcattgcccttgagttattaaagg

SEQ ID NO: 104453 - DNA, 25 bp, mus musculus
gcattgcccttgagttattaaaggc

SEQ ID NO: 104454 - DNA, 25 bp, mus musculus
cattgcccttgagttattaaaggca

SEQ ID NO: 104455 - DNA, 25 bp, mus musculus
ggtccaaaaacatctaatagatagt

SEQ ID NO: 104456 - DNA, 25 bp, mus musculus
tccaaaaacatctaatagatagtat

SEQ ID NO: 104457 - DNA, 25 bp, mus musculus
gtattaaggcattgcccttgagtta

SEQ ID NO: 104458 - DNA, 25 bp, mus musculus
tattaaggcattgcccttgagttat

SEQ ID NO: 104459 - DNA, 25 bp, mus musculus
attaaggcattgcccttgagttatt

SEQ ID NO: 104460 - DNA, 25 bp, mus musculus
ttaaggcattgcccttgagttatta

SEQ ID NO: 104461 - DNA, 25 bp, mus musculus
taaggcattgcccttgagttattaa

SEQ ID NO: 104462 - DNA, 25 bp, mus musculus
aggcattgcccttgagttattaaag

SEQ ID NO: 104463 - DNA, 25 bp, mus musculus
atgtttatcgagggacaggaatgag

SEQ ID NO: 104464 - DNA, 25 bp, mus musculus
aggtccaaaaacatctaatagatag

SEQ ID NO: 104465 - DNA, 25 bp, mus musculus
ggcattgcccttgagttattaaagg

SEQ ID NO: 104466 - DNA, 25 bp, mus musculus
gcattgcccttgagttattaaaggc

SEQ ID NO: 104467 - DNA, 25 bp, mus musculus
cattgcccttgagttattaaaggca

SEQ ID NO: 104468 - DNA, 25 bp, mus musculus
ggtccaaaaacatctaatagatagt

SEQ ID NO: 104469 - DNA, 25 bp, mus musculus
tccaaaaacatctaatagatagtat

SEQ ID NO: 104470 - DNA, 25 bp, mus musculus
gtattaaggcattgcccttgagtta

SEQ ID NO: 104471 - DNA, 25 bp, mus musculus
tattaaggcattgcccttgagttat

SEQ ID NO: 104472 - DNA, 25 bp, mus musculus
attaaggcattgcccttgagttatt

SEQ ID NO: 104473 - DNA, 25 bp, mus musculus
ttaaggcattgcccttgagttatta

SEQ ID NO: 104474 - DNA, 25 bp, mus musculus
taaggcattgcccttgagttattaa

SEQ ID NO: 104475 - DNA, 25 bp, mus musculus
aggcattgcccttgagttattaaag

SEQ ID NO: 104476 - DNA, 25 bp, mus musculus
atgtttatcgagggacaggaatgag

SEQ ID NO: 104477 - DNA, 25 bp, mus musculus
aggtccaaaaacatctaatagatag

SEQ ID NO: 104478 - DNA, 25 bp, mus musculus
ggcattgcccttgagttattaaagg

SEQ ID NO: 104479 - DNA, 25 bp, mus musculus
gcattgcccttgagttattaaaggc

SEQ ID NO: 104480 - DNA, 25 bp, mus musculus
cattgcccttgagttattaaaggca

SEQ ID NO: 104481 - DNA, 25 bp, mus musculus
ggtccaaaaacatctaatagatagt

SEQ ID NO: 104482 - DNA, 25 bp, mus musculus
tccaaaaacatctaatagatagtat

SEQ ID NO: 104483 - DNA, 25 bp, mus musculus
gtattaaggcattgcccttgagtta

SEQ ID NO: 104484 - DNA, 25 bp, mus musculus
tattaaggcattgcccttgagttat

SEQ ID NO: 104485 - DNA, 25 bp, mus musculus
attaaggcattgcccttgagttatt

SEQ ID NO: 104486 - DNA, 25 bp, mus musculus
ttaaggcattgcccttgagttatta

SEQ ID NO: 104487 - DNA, 25 bp, mus musculus
taaggcattgcccttgagttattaa

SEQ ID NO: 104488 - DNA, 25 bp, mus musculus
aggcattgcccttgagttattaaag

SEQ ID NO: 104489 - DNA, 25 bp, mus musculus
gcccagttccatcacctcttgaatt

SEQ ID NO: 104490 - DNA, 25 bp, mus musculus
ttccatcacctcttgaattgaactt

SEQ ID NO: 104491 - DNA, 25 bp, mus musculus
actcaactcatcagaggtcgaagga

SEQ ID NO: 104492 - DNA, 25 bp, mus musculus
ctcatcagaggtcgaaggaaggcct

SEQ ID NO: 104493 - DNA, 25 bp, mus musculus
aaggccttttggctttgatctggag

SEQ ID NO: 104494 - DNA, 25 bp, mus musculus
ttttggctttgatctggagtcagcc

SEQ ID NO: 104495 - DNA, 25 bp, mus musculus
ctttgatctggagtcagcccatcct

SEQ ID NO: 104496 - DNA, 25 bp, mus musculus
gtcagcccatcctttcgggcttctc

SEQ ID NO: 104497 - DNA, 25 bp, mus musculus
ccttccaactcagttcagtgccttt

SEQ ID NO: 104498 - DNA, 25 bp, mus musculus
aactcagttcagtgcctttgagctt

SEQ ID NO: 104499 - DNA, 25 bp, mus musculus
gttcagtgcctttgagcttagagag

SEQ ID NO: 104500 - DNA, 25 bp, mus musculus
tgcctttgagcttagagagttcttc

SEQ ID NO: 104501 - DNA, 25 bp, mus musculus
ttgaccagttctctcgaagactttc

SEQ ID NO: 104502 - DNA, 25 bp, mus musculus
gactttcccaaacttcacagccttg

SEQ ID NO: 104503 - DNA, 25 bp, mus musculus
cttcacagccttggtgatccctctc

SEQ ID NO: 104504 - DNA, 25 bp, mus musculus
agccttggtgatccctctcaaggcc

SEQ ID NO: 104505 - DNA, 25 bp, mus musculus
ccctctcaaggccgaggcaccagtt

SEQ ID NO: 104506 - DNA, 25 bp, mus musculus
ttagagcttgtcccaggaaactggg

SEQ ID NO: 104507 - DNA, 25 bp, mus musculus
ggatcctacaggtcttgggacctgg

SEQ ID NO: 104508 - DNA, 25 bp, mus musculus
gggaacactcaactcatcagaggtc

SEQ ID NO: 104509 - DNA, 25 bp, mus musculus
ccacagcgaacagatgcgcgagagc

SEQ ID NO: 104510 - DNA, 25 bp, mus musculus
tgagctcaagagcaaccctaccttg

SEQ ID NO: 104511 - DNA, 25 bp, mus musculus
tgtgatcgacaaggccagcgagact

SEQ ID NO: 104512 - DNA, 25 bp, mus musculus
tctgactgcccagtgaggtgcccgc

SEQ ID NO: 104513 - DNA, 25 bp, mus musculus
gcattggctttcttacaataaacct

SEQ ID NO: 104514 - DNA, 25 bp, mus musculus
gtgccgcactggggattcctttgta

SEQ ID NO: 104515 - DNA, 25 bp, mus musculus
ggattcctttgtacgcgacatctca

SEQ ID NO: 104516 - DNA, 25 bp, mus musculus
catctcagctcttaacgctcactca

SEQ ID NO: 104517 - DNA, 25 bp, mus musculus
agctcttaacgctcactcaagctgg

SEQ ID NO: 104518 - DNA, 25 bp, mus musculus
taacgctcactcaagctgggcacct

SEQ ID NO: 104519 - DNA, 25 bp, mus musculus
ggcacctggctggttcagggtatga

SEQ ID NO: 104520 - DNA, 25 bp, mus musculus
tggctggttcagggtatgagacaga

SEQ ID NO: 104521 - DNA, 25 bp, mus musculus
caagagcaaccctaccttgaacgag

SEQ ID NO: 104522 - DNA, 25 bp, mus musculus
gacagaatccttctaagaaggctcc

SEQ ID NO: 104523 - DNA, 25 bp, mus musculus
taccttgaacgagtaccacaccagg

SEQ ID NO: 104524 - DNA, 25 bp, mus musculus
aacccacctgaagacacttggcgag

SEQ ID NO: 104525 - DNA, 25 bp, mus musculus
cctgaagacacttggcgagaaagcc

SEQ ID NO: 104526 - DNA, 25 bp, mus musculus
cctgcgccatagtctgatgcccatg

SEQ ID NO: 104527 - DNA, 25 bp, mus musculus
tctgatgcccatgctggagacgctt

SEQ ID NO: 104528 - DNA, 25 bp, mus musculus
gacgcttaagaccaaagcccagagt

SEQ ID NO: 104529 - DNA, 25 bp, mus musculus
caaagcccagagtgtgatcgacaag

SEQ ID NO: 104530 - DNA, 25 bp, mus musculus
agataaatcctgatcactccattat

SEQ ID NO: 104531 - DNA, 25 bp, mus musculus
atcctgatcactccattattgaaac

SEQ ID NO: 104532 - DNA, 25 bp, mus musculus
ctggcttcagtctggaagatcccca

SEQ ID NO: 104533 - DNA, 25 bp, mus musculus
cccagacccatgctaacaggatcta

SEQ ID NO: 104534 - DNA, 25 bp, mus musculus
agacccatgctaacaggatctacag

SEQ ID NO: 104535 - DNA, 25 bp, mus musculus
cccatgctaacaggatctacaggat

SEQ ID NO: 104536 - DNA, 25 bp, mus musculus
tgatcaagcttggtctaggtattga

SEQ ID NO: 104537 - DNA, 25 bp, mus musculus
atgatcctactgtggatgacaccag

SEQ ID NO: 104538 - DNA, 25 bp, mus musculus
atcctactgtggatgacaccagtgc

SEQ ID NO: 104539 - DNA, 25 bp, mus musculus
tggatgacaccagtgctgctgtaac

SEQ ID NO: 104540 - DNA, 25 bp, mus musculus
atgacgacacatcacgcatggaaga

SEQ ID NO: 104541 - DNA, 25 bp, mus musculus
acgacacatcacgcatggaagaagt

SEQ ID NO: 104542 - DNA, 25 bp, mus musculus
ctgatcactccattattgaaacctt

SEQ ID NO: 104543 - DNA, 25 bp, mus musculus
atcactccattattgaaaccttaag

SEQ ID NO: 104544 - DNA, 25 bp, mus musculus
atctggtcatcttgctgtatgaaac

SEQ ID NO: 104545 - DNA, 25 bp, mus musculus
tggtcatcttgctgtatgaaactgc

SEQ ID NO: 104546 - DNA, 25 bp, mus musculus
tcatcttgctgtatgaaactgcact

SEQ ID NO: 104547 - DNA, 25 bp, mus musculus
tgtatgaaactgcactcctatcttc

SEQ ID NO: 104548 - DNA, 25 bp, mus musculus
atgaaactgcactcctatcttctgg

SEQ ID NO: 104549 - DNA, 25 bp, mus musculus
cttctggcttcagtctggaagatcc

SEQ ID NO: 104550 - DNA, 25 bp, mus musculus
acgagcgcctctcgtgtctctcttt

SEQ ID NO: 104551 - DNA, 25 bp, mus musculus
tcagacacatgatccgaaagaacaa

SEQ ID NO: 104552 - DNA, 25 bp, mus musculus
gccagtgccatccttcgaagccaga

SEQ ID NO: 104553 - DNA, 25 bp, mus musculus
cagtgccatccttcgaagccagaag

SEQ ID NO: 104554 - DNA, 25 bp, mus musculus
gtgccatccttcgaagccagaagcc

SEQ ID NO: 104555 - DNA, 25 bp, mus musculus
gccatccttcgaagccagaagcctg

SEQ ID NO: 104556 - DNA, 25 bp, mus musculus
catccttcgaagccagaagcctgtg

SEQ ID NO: 104557 - DNA, 25 bp, mus musculus
agccagaagcctgtggtggtgaaga

SEQ ID NO: 104558 - DNA, 25 bp, mus musculus
ccacacgcccgaagcaataaagagt

SEQ ID NO: 104559 - DNA, 25 bp, mus musculus
agagtccactgacttccattaggcc

SEQ ID NO: 104560 - DNA, 25 bp, mus musculus
agtccactgacttccattaggccaa

SEQ ID NO: 104561 - DNA, 25 bp, mus musculus
tccactgacttccattaggccaaaa

SEQ ID NO: 104562 - DNA, 25 bp, mus musculus
caagtaccgccctgatctgcgtatg

SEQ ID NO: 104563 - DNA, 25 bp, mus musculus
agtaccgccctgatctgcgtatggc

SEQ ID NO: 104564 - DNA, 25 bp, mus musculus
taccgccctgatctgcgtatggcgg

SEQ ID NO: 104565 - DNA, 25 bp, mus musculus
gccctgatctgcgtatggcggccat

SEQ ID NO: 104566 - DNA, 25 bp, mus musculus
cctgatctgcgtatggcggccatcc

SEQ ID NO: 104567 - DNA, 25 bp, mus musculus
atctgcgtatggcggccatccgcag

SEQ ID NO: 104568 - DNA, 25 bp, mus musculus
catccgcagggccagtgccatcctt

SEQ ID NO: 104569 - DNA, 25 bp, mus musculus
gggccagtgccatccttcgaagcca

SEQ ID NO: 104570 - DNA, 25 bp, mus musculus
gtgacgaccgcacacgctttgtttg

SEQ ID NO: 104571 - DNA, 25 bp, mus musculus
accgcacacgctttgtttggacgcg

SEQ ID NO: 104572 - DNA, 25 bp, mus musculus
caggttaccctgttctagatcagga

SEQ ID NO: 104573 - DNA, 25 bp, mus musculus
agggtctatttcctgttgccgctct

SEQ ID NO: 104574 - DNA, 25 bp, mus musculus
atttgtgtcatacatttccagtaat

SEQ ID NO: 104575 - DNA, 25 bp, mus musculus
gtcatacatttccagtaatggaagt

SEQ ID NO: 104576 - DNA, 25 bp, mus musculus
tattttacacgtgtcctgattttgc

SEQ ID NO: 104577 - DNA, 25 bp, mus musculus
acacgtgtcctgattttgccacgac

SEQ ID NO: 104578 - DNA, 25 bp, mus musculus
gtcctgattttgccacgacctggat

SEQ ID NO: 104579 - DNA, 25 bp, mus musculus
attttgccacgacctggatattgaa

SEQ ID NO: 104580 - DNA, 25 bp, mus musculus
ccacgacctggatattgaagctatc

SEQ ID NO: 104581 - DNA, 25 bp, mus musculus
tattgaagctatccaagcttttgaa

SEQ ID NO: 104582 - DNA, 25 bp, mus musculus
ttgtttggacgcggagtgaacacaa

SEQ ID NO: 104583 - DNA, 25 bp, mus musculus
aaacttttatggcctgtcccatgtg

SEQ ID NO: 104584 - DNA, 25 bp, mus musculus
ttatggcctgtcccatgtgcatctt

SEQ ID NO: 104585 - DNA, 25 bp, mus musculus
cctgtcccatgtgcatcttatttaa

SEQ ID NO: 104586 - DNA, 25 bp, mus musculus
gaaatcactctcctgtttactattc

SEQ ID NO: 104587 - DNA, 25 bp, mus musculus
actctcctgtttactattccagagc

SEQ ID NO: 104588 - DNA, 25 bp, mus musculus
ctgtttactattccagagctctagt

SEQ ID NO: 104589 - DNA, 25 bp, mus musculus
gtctcagaggccagagcggcactag

SEQ ID NO: 104590 - DNA, 25 bp, mus musculus
ggccttttggcttccaggccatatt

SEQ ID NO: 104591 - DNA, 25 bp, mus musculus
ccttttggcttccaggccatattgg

SEQ ID NO: 104592 - DNA, 25 bp, mus musculus
gcggtgtccaacacagatctgatgg

SEQ ID NO: 104593 - DNA, 25 bp, mus musculus
tgtccaacacagatctgatggattt

SEQ ID NO: 104594 - DNA, 25 bp, mus musculus
tccaacacagatctgatggatttca

SEQ ID NO: 104595 - DNA, 25 bp, mus musculus
tttcaagaacctgctagaccacctg

SEQ ID NO: 104596 - DNA, 25 bp, mus musculus
gaacctgctagaccacctggaggag

SEQ ID NO: 104597 - DNA, 25 bp, mus musculus
acctgctagaccacctggaggagaa

SEQ ID NO: 104598 - DNA, 25 bp, mus musculus
ctgctagaccacctggaggagaaga

SEQ ID NO: 104599 - DNA, 25 bp, mus musculus
tagaccacctggaggagaagatgcc

SEQ ID NO: 104600 - DNA, 25 bp, mus musculus
cccgcaggcccttgagtgagcagac

SEQ ID NO: 104601 - DNA, 25 bp, mus musculus
caggcccttgagtgagcagactgag

SEQ ID NO: 104602 - DNA, 25 bp, mus musculus
ttggcttccaggccatattggagca

SEQ ID NO: 104603 - DNA, 25 bp, mus musculus
ggcttccaggccatattggagcaaa

SEQ ID NO: 104604 - DNA, 25 bp, mus musculus
cttccaggccatattggagcaaatc

SEQ ID NO: 104605 - DNA, 25 bp, mus musculus
gagcaaatcctgtgtacagtgcggt

SEQ ID NO: 104606 - DNA, 25 bp, mus musculus
gcaaatcctgtgtacagtgcggtgt

SEQ ID NO: 104607 - DNA, 25 bp, mus musculus
aaatcctgtgtacagtgcggtgtcc

SEQ ID NO: 104608 - DNA, 25 bp, mus musculus
atcctgtgtacagtgcggtgtccaa

SEQ ID NO: 104609 - DNA, 25 bp, mus musculus
tgtacagtgcggtgtccaacacaga

SEQ ID NO: 104610 - DNA, 25 bp, mus musculus
attgcttttctcattggtatgtacc

SEQ ID NO: 104611 - DNA, 25 bp, mus musculus
catattactttactcttaattactg

SEQ ID NO: 104612 - DNA, 25 bp, mus musculus
tctgtgactaaccacagtgatcatt

SEQ ID NO: 104613 - DNA, 25 bp, mus musculus
ccacaggtatacttctgatgaattg

SEQ ID NO: 104614 - DNA, 25 bp, mus musculus
tgaattgtccccaataggaagacat

SEQ ID NO: 104615 - DNA, 25 bp, mus musculus
gtccccaataggaagacatgctatg

SEQ ID NO: 104616 - DNA, 25 bp, mus musculus
tgactgtacttgcacttggaaacct

SEQ ID NO: 104617 - DNA, 25 bp, mus musculus
tacttgcacttggaaacctactgac

SEQ ID NO: 104618 - DNA, 25 bp, mus musculus
attaagcctgagaactgtgtaaatc

SEQ ID NO: 104619 - DNA, 25 bp, mus musculus
cattaagctatgctctttgtgtatg

SEQ ID NO: 104620 - DNA, 25 bp, mus musculus
gctatgctctttgtgtatggaggtt

SEQ ID NO: 104621 - DNA, 25 bp, mus musculus
ctctttgtgtatggaggttgcaaaa

SEQ ID NO: 104622 - DNA, 25 bp, mus musculus
actttactcttaattactgtgctca

SEQ ID NO: 104623 - DNA, 25 bp, mus musculus
ctcttaattactgtgctcacaaagc

SEQ ID NO: 104624 - DNA, 25 bp, mus musculus
attactgtgctcacaaagcctcgga

SEQ ID NO: 104625 - DNA, 25 bp, mus musculus
gtgctcacaaagcctcggatccttg

SEQ ID NO: 104626 - DNA, 25 bp, mus musculus
cctcggatccttggatctcttgcat

SEQ ID NO: 104627 - DNA, 25 bp, mus musculus
atccttggatctcttgcatctgtga

SEQ ID NO: 104628 - DNA, 25 bp, mus musculus
ggatctcttgcatctgtgactaacc

SEQ ID NO: 104629 - DNA, 25 bp, mus musculus
cttgcatctgtgactaaccacagtg

SEQ ID NO: 104630 - DNA, 25 bp, mus musculus
ccatggccttgtctgagttggtgac

SEQ ID NO: 104631 - DNA, 25 bp, mus musculus
agttggtgaccatcgagatgtgcaa

SEQ ID NO: 104632 - DNA, 25 bp, mus musculus
cccagtggctcatggtcctcaagat

SEQ ID NO: 104633 - DNA, 25 bp, mus musculus
ttgctcggaactatctggagggata

SEQ ID NO: 104634 - DNA, 25 bp, mus musculus
ctttgaaccgtgtcacagatccaga

SEQ ID NO: 104635 - DNA, 25 bp, mus musculus
tgaaccgtgtcacagatccagaaga

SEQ ID NO: 104636 - DNA, 25 bp, mus musculus
tcacagatccagaagacgaaagaag

SEQ ID NO: 104637 - DNA, 25 bp, mus musculus
catcttcagccaaagctgaggcact

SEQ ID NO: 104638 - DNA, 25 bp, mus musculus
cttcagccaaagctgaggcactgac

SEQ ID NO: 104639 - DNA, 25 bp, mus musculus
cagccaaagctgaggcactgaccct

SEQ ID NO: 104640 - DNA, 25 bp, mus musculus
tcccgaactcacggggcttgcaggc

SEQ ID NO: 104641 - DNA, 25 bp, mus musculus
actgactagctgattgcttatttat

SEQ ID NO: 104642 - DNA, 25 bp, mus musculus
ccctactgcggatgccaccctgggt

SEQ ID NO: 104643 - DNA, 25 bp, mus musculus
tgcggatgccaccctgggtgaacat

SEQ ID NO: 104644 - DNA, 25 bp, mus musculus
tgccaccctgggtgaacatctggct

SEQ ID NO: 104645 - DNA, 25 bp, mus musculus
caccctgggtgaacatctggctgct

SEQ ID NO: 104646 - DNA, 25 bp, mus musculus
acatctggctgctgggttccatctg

SEQ ID NO: 104647 - DNA, 25 bp, mus musculus
tctggctgctgggttccatctgcct

SEQ ID NO: 104648 - DNA, 25 bp, mus musculus
tgctgggttccatctgcctgtccat

SEQ ID NO: 104649 - DNA, 25 bp, mus musculus
tcttcaagctccgggccctggactt

SEQ ID NO: 104650 - DNA, 25 bp, mus musculus
ttccgcctagctaaggagaatgcac

SEQ ID NO: 104651 - DNA, 25 bp, mus musculus
cctgccatcatcttcatagatgaaa

SEQ ID NO: 104652 - DNA, 25 bp, mus musculus
accagcaaaatgaacctctctgagg

SEQ ID NO: 104653 - DNA, 25 bp, mus musculus
aacctctctgaggaggtcgacctgg

SEQ ID NO: 104654 - DNA, 25 bp, mus musculus
tatgtggcccgtccagataagattt

SEQ ID NO: 104655 - DNA, 25 bp, mus musculus
ggaatgttggctgtccgtgagaccg

SEQ ID NO: 104656 - DNA, 25 bp, mus musculus
ttggctgtccgtgagaccgcttaca

SEQ ID NO: 104657 - DNA, 25 bp, mus musculus
gagaccgcttacattgtcctggcca

SEQ ID NO: 104658 - DNA, 25 bp, mus musculus
gcttacattgtcctggccaaggact

SEQ ID NO: 104659 - DNA, 25 bp, mus musculus
attgtcctggccaaggacttcgaga

SEQ ID NO: 104660 - DNA, 25 bp, mus musculus
ctggccaaggacttcgagaaagcat

SEQ ID NO: 104661 - DNA, 25 bp, mus musculus
tacaagaccgtgatcaagaaagatg

SEQ ID NO: 104662 - DNA, 25 bp, mus musculus
attgatgccattgccaccaagagat

SEQ ID NO: 104663 - DNA, 25 bp, mus musculus
gccattgccaccaagagattcgatg

SEQ ID NO: 104664 - DNA, 25 bp, mus musculus
aggatcctgctggagctactgaatc

SEQ ID NO: 104665 - DNA, 25 bp, mus musculus
atggccacaaacagagcagacacct

SEQ ID NO: 104666 - DNA, 25 bp, mus musculus
gacaccttggatccagctctactgc

SEQ ID NO: 104667 - DNA, 25 bp, mus musculus
ctactgcggccaggacgcctggacc

SEQ ID NO: 104668 - DNA, 25 bp, mus musculus
ctccctgaccgtcgccagaagaggt

SEQ ID NO: 104669 - DNA, 25 bp, mus musculus
accatcaccagcaaaatgaacctct

SEQ ID NO: 104670 - DNA, 25 bp, mus musculus
cgccacttgtggcctggatattttc

SEQ ID NO: 104671 - DNA, 25 bp, mus musculus
tttgaaacccaaagaatatgtatag

SEQ ID NO: 104672 - DNA, 25 bp, mus musculus
atgttttcccttgtatcgattcata

SEQ ID NO: 104673 - DNA, 25 bp, mus musculus
tcccttgtatcgattcatacataac

SEQ ID NO: 104674 - DNA, 25 bp, mus musculus
tgactaagaacactctagttgagca

SEQ ID NO: 104675 - DNA, 25 bp, mus musculus
ataatggacatgcctttgatcccag

SEQ ID NO: 104676 - DNA, 25 bp, mus musculus
gacatgcctttgatcccagaacatt

SEQ ID NO: 104677 - DNA, 25 bp, mus musculus
cctttgatcccagaacattgagatt

SEQ ID NO: 104678 - DNA, 25 bp, mus musculus
atcccagaacattgagattaaggta

SEQ ID NO: 104679 - DNA, 25 bp, mus musculus
tttcaaattctccagggaagcagtt

SEQ ID NO: 104680 - DNA, 25 bp, mus musculus
attctccagggaagcagttttcagt

SEQ ID NO: 104681 - DNA, 25 bp, mus musculus
agcagttttcagttatcttgttagt

SEQ ID NO: 104682 - DNA, 25 bp, mus musculus
acttgtgctaatatcacctctctgc

SEQ ID NO: 104683 - DNA, 25 bp, mus musculus
gctaatatcacctctctgccatgcc

SEQ ID NO: 104684 - DNA, 25 bp, mus musculus
ccatgccttgactcaattttgcatg

SEQ ID NO: 104685 - DNA, 25 bp, mus musculus
cttgactcaattttgcatgatttat

SEQ ID NO: 104686 - DNA, 25 bp, mus musculus
atggatcctctcttgtgctacctct

SEQ ID NO: 104687 - DNA, 25 bp, mus musculus
ttgtgctacctctgaggcttgctgt

SEQ ID NO: 104688 - DNA, 25 bp, mus musculus
tacctctgaggcttgctgtagacgc

SEQ ID NO: 104689 - DNA, 25 bp, mus musculus
tgaggcttgctgtagacgcgaaagg

SEQ ID NO: 104690 - DNA, 25 bp, mus musculus
tgtgcaccattgcagcacgctgtcc

SEQ ID NO: 104691 - DNA, 25 bp, mus musculus
cagctgggtgctgctgatggattat

SEQ ID NO: 104692 - DNA, 25 bp, mus musculus
agatcccacacataaatgaccaccc

SEQ ID NO: 104693 - DNA, 25 bp, mus musculus
cacacataaatgaccaccctaagat

SEQ ID NO: 104694 - DNA, 25 bp, mus musculus
taaatgaccaccctaagatgtcatc

SEQ ID NO: 104695 - DNA, 25 bp, mus musculus
atgaccaccctaagatgtcatcctt

SEQ ID NO: 104696 - DNA, 25 bp, mus musculus
ctaagatgtcatccttccttctgaa

SEQ ID NO: 104697 - DNA, 25 bp, mus musculus
agatgtcatccttccttctgaattg

SEQ ID NO: 104698 - DNA, 25 bp, mus musculus
tggcctggctcgtgcctgatgctac

SEQ ID NO: 104699 - DNA, 25 bp, mus musculus
cctggctcgtgcctgatgctacagc

SEQ ID NO: 104700 - DNA, 25 bp, mus musculus
ggctcgtgcctgatgctacagcaaa

SEQ ID NO: 104701 - DNA, 25 bp, mus musculus
tcgtgcctgatgctacagcaaaaaa

SEQ ID NO: 104702 - DNA, 25 bp, mus musculus
tgcaggcaatgccactgctgtcttc

SEQ ID NO: 104703 - DNA, 25 bp, mus musculus
caatgccactgctgtcttccttctg

SEQ ID NO: 104704 - DNA, 25 bp, mus musculus
gttagcccagatccacttccccaga

SEQ ID NO: 104705 - DNA, 25 bp, mus musculus
gaagctcagccaggctgtgcataag

SEQ ID NO: 104706 - DNA, 25 bp, mus musculus
agaagctgcagcagttacagtctta

SEQ ID NO: 104707 - DNA, 25 bp, mus musculus
agtcttacaaatggttcctatgtct

SEQ ID NO: 104708 - DNA, 25 bp, mus musculus
ggttcctatgtctatgccccctatc

SEQ ID NO: 104709 - DNA, 25 bp, mus musculus
agtggtagatcccacacataaatga

SEQ ID NO: 104710 - DNA, 25 bp, mus musculus
gtggtgacctccagggatgagcaga

SEQ ID NO: 104711 - DNA, 25 bp, mus musculus
gtgacctccagggatgagcagaact

SEQ ID NO: 104712 - DNA, 25 bp, mus musculus
tcatttatatccttaattccttgag

SEQ ID NO: 104713 - DNA, 25 bp, mus musculus
atatccttaattccttgagctgctg

SEQ ID NO: 104714 - DNA, 25 bp, mus musculus
tccttaattccttgagctgctgagg

SEQ ID NO: 104715 - DNA, 25 bp, mus musculus
ttaattccttgagctgctgaggttt

SEQ ID NO: 104716 - DNA, 25 bp, mus musculus
ccttgagctgctgaggtttagaact

SEQ ID NO: 104717 - DNA, 25 bp, mus musculus
cccatctccaggaactctcatgtag

SEQ ID NO: 104718 - DNA, 25 bp, mus musculus
tccaggaactctcatgtaggatttt

SEQ ID NO: 104719 - DNA, 25 bp, mus musculus
tattgaaacccagcgcgcagttctc

SEQ ID NO: 104720 - DNA, 25 bp, mus musculus
aacccagcgcgcagttctcttctgt

SEQ ID NO: 104721 - DNA, 25 bp, mus musculus
cgcagttctcttctgtcagcttgtt

SEQ ID NO: 104722 - DNA, 25 bp, mus musculus
cagcgccacatgggccccttaaaca

SEQ ID NO: 104723 - DNA, 25 bp, mus musculus
ttaaacacttggattggcctaactg

SEQ ID NO: 104724 - DNA, 25 bp, mus musculus
gcccacttcacgacggatggccgct

SEQ ID NO: 104725 - DNA, 25 bp, mus musculus
ttcacgacggatggccgctggaatg

SEQ ID NO: 104726 - DNA, 25 bp, mus musculus
acggatggccgctggaatgacgacg

SEQ ID NO: 104727 - DNA, 25 bp, mus musculus
gacgtctgcaggaggccctaccgct

SEQ ID NO: 104728 - DNA, 25 bp, mus musculus
aggccctaccgctgggtctgtgaga

SEQ ID NO: 104729 - DNA, 25 bp, mus musculus
ccctaccgctgggtctgtgagacaa

SEQ ID NO: 104730 - DNA, 25 bp, mus musculus
acaagccaggctcacacactatgca

SEQ ID NO: 104731 - DNA, 25 bp, mus musculus
ctatgcagctcttctgaaatcagga

SEQ ID NO: 104732 - DNA, 25 bp, mus musculus
gaaccctgcctggttcttgcaatct

SEQ ID NO: 104733 - DNA, 25 bp, mus musculus
tgcctggttcttgcaatctgacaat

SEQ ID NO: 104734 - DNA, 25 bp, mus musculus
tgctcgcattcattctttatatggc

SEQ ID NO: 104735 - DNA, 25 bp, mus musculus
cattcattctttatatggcatgatc

SEQ ID NO: 104736 - DNA, 25 bp, mus musculus
catgatcagctgcctagacaatgac

SEQ ID NO: 104737 - DNA, 25 bp, mus musculus
cagctgcctagacaatgactttaag

SEQ ID NO: 104738 - DNA, 25 bp, mus musculus
tgatatttatctcaacgtcctgaag

SEQ ID NO: 104739 - DNA, 25 bp, mus musculus
ttatctcaacgtcctgaagtgttac

SEQ ID NO: 104740 - DNA, 25 bp, mus musculus
caacgtcctgaagtgttacatgtta

SEQ ID NO: 104741 - DNA, 25 bp, mus musculus
tgtgctctgcttctgaaatatcatg

SEQ ID NO: 104742 - DNA, 25 bp, mus musculus
atcaggagccatgatttcggatgcc

SEQ ID NO: 104743 - DNA, 25 bp, mus musculus
aagccctctggacgatctagtgagt

SEQ ID NO: 104744 - DNA, 25 bp, mus musculus
aaatgtccctgatataatcatctcc

SEQ ID NO: 104745 - DNA, 25 bp, mus musculus
ccctgatataatcatctccaaagcc

SEQ ID NO: 104746 - DNA, 25 bp, mus musculus
tataatcatctccaaagccacagac

SEQ ID NO: 104747 - DNA, 25 bp, mus musculus
catctccaaagccacagacataaag

SEQ ID NO: 104748 - DNA, 25 bp, mus musculus
taatgccctcatgagcaccatgctt

SEQ ID NO: 104749 - DNA, 25 bp, mus musculus
cctcatgagcaccatgcttcagaat

SEQ ID NO: 104750 - DNA, 25 bp, mus musculus
ggacacccgagacaccatgaagagc

SEQ ID NO: 104751 - DNA, 25 bp, mus musculus
agctaaagcccaaaagagagtccag

SEQ ID NO: 104752 - DNA, 25 bp, mus musculus
tctcctgcagtagcattactgaagt

SEQ ID NO: 104753 - DNA, 25 bp, mus musculus
aagtatacagacacgcatgtgttgc

SEQ ID NO: 104754 - DNA, 25 bp, mus musculus
tatacagacacgcatgtgttgcttg

SEQ ID NO: 104755 - DNA, 25 bp, mus musculus
acgcatgtgttgcttgctccttaca

SEQ ID NO: 104756 - DNA, 25 bp, mus musculus
catgtgttgcttgctccttacatga

SEQ ID NO: 104757 - DNA, 25 bp, mus musculus
ttgcttgctccttacatgatctcct

SEQ ID NO: 104758 - DNA, 25 bp, mus musculus
cttgctccttacatgatctcctagc

SEQ ID NO: 104759 - DNA, 25 bp, mus musculus
ccttacatgatctcctagctggctg

SEQ ID NO: 104760 - DNA, 25 bp, mus musculus
tacatgatctcctagctggctggcc

SEQ ID NO: 104761 - DNA, 25 bp, mus musculus
atgatctcctagctggctggcccac

SEQ ID NO: 104762 - DNA, 25 bp, mus musculus
agtccaggaacgcaacaagcctgcc

SEQ ID NO: 104763 - DNA, 25 bp, mus musculus
ccaggaacgcaacaagcctgcctac

SEQ ID NO: 104764 - DNA, 25 bp, mus musculus
ggaacgcaacaagcctgcctacgag

SEQ ID NO: 104765 - DNA, 25 bp, mus musculus
acgcaacaagcctgcctacgagatc

SEQ ID NO: 104766 - DNA, 25 bp, mus musculus
ctacaaccgctacttcaggcagcgc

SEQ ID NO: 104767 - DNA, 25 bp, mus musculus
tttcgttttatatctcctgcagtag

SEQ ID NO: 104768 - DNA, 25 bp, mus musculus
cgttttatatctcctgcagtagcat

SEQ ID NO: 104769 - DNA, 25 bp, mus musculus
tttatatctcctgcagtagcattac

SEQ ID NO: 104770 - DNA, 25 bp, mus musculus
ctgcacatcagcccggaccggtgcg

SEQ ID NO: 104771 - DNA, 25 bp, mus musculus
cgctctcctagaccacgtgcttagc

SEQ ID NO: 104772 - DNA, 25 bp, mus musculus
gtgttctgtttatccaccggtagcg

SEQ ID NO: 104773 - DNA, 25 bp, mus musculus
tgtttatccaccggtagcgatgccc

SEQ ID NO: 104774 - DNA, 25 bp, mus musculus
ataagagaccacggttgcctcagct

SEQ ID NO: 104775 - DNA, 25 bp, mus musculus
ttccttggcttgcggaggattgggt

SEQ ID NO: 104776 - DNA, 25 bp, mus musculus
accttgaatggaagcccaggctctg

SEQ ID NO: 104777 - DNA, 25 bp, mus musculus
agcccaggctctgaacgtgggattg

SEQ ID NO: 104778 - DNA, 25 bp, mus musculus
tccagtttggtcctctctaaactag

SEQ ID NO: 104779 - DNA, 25 bp, mus musculus
ttggtcctctctaaactagtccagt

SEQ ID NO: 104780 - DNA, 25 bp, mus musculus
ctctctaaactagtccagtggttca

SEQ ID NO: 104781 - DNA, 25 bp, mus musculus
aaactagtccagtggttcagatgtc

SEQ ID NO: 104782 - DNA, 25 bp, mus musculus
cctagaccacgtgcttagctgagcc

SEQ ID NO: 104783 - DNA, 25 bp, mus musculus
aactagtccagtggttcagatgtcc

SEQ ID NO: 104784 - DNA, 25 bp, mus musculus
gcttagctgagccaggctttcactt

SEQ ID NO: 104785 - DNA, 25 bp, mus musculus
ttcacttttctcagggtctacatca

SEQ ID NO: 104786 - DNA, 25 bp, mus musculus
ttcgcttgagtcctggccccactta

SEQ ID NO: 104787 - DNA, 25 bp, mus musculus
tgagtcctggccccacttacctgca

SEQ ID NO: 104788 - DNA, 25 bp, mus musculus
ccacttacctgcaccgctgttcttt

SEQ ID NO: 104789 - DNA, 25 bp, mus musculus
gttctttgagcctcgctccacgtag

SEQ ID NO: 104790 - DNA, 25 bp, mus musculus
tcgctccacgtagtgttctgtttat

SEQ ID NO: 104791 - DNA, 25 bp, mus musculus
tcctttctgcagatgaatactgaat

SEQ ID NO: 104792 - DNA, 25 bp, mus musculus
cctttctgcagatgaatactgaata

SEQ ID NO: 104793 - DNA, 25 bp, mus musculus
gttccttgaaagcacatcatgttta

SEQ ID NO: 104794 - DNA, 25 bp, mus musculus
ttccttgaaagcacatcatgtttaa

SEQ ID NO: 104795 - DNA, 25 bp, mus musculus
tccttgaaagcacatcatgtttaat

SEQ ID NO: 104796 - DNA, 25 bp, mus musculus
ccttgaaagcacatcatgtttaata

SEQ ID NO: 104797 - DNA, 25 bp, mus musculus
cttgaaagcacatcatgtttaataa

SEQ ID NO: 104798 - DNA, 25 bp, mus musculus
taataaagatcatccttcctggtaa

SEQ ID NO: 104799 - DNA, 25 bp, mus musculus
ctttctgcagatgaatactgaatac

SEQ ID NO: 104800 - DNA, 25 bp, mus musculus
tgaatactggactgttccttgaaag

SEQ ID NO: 104801 - DNA, 25 bp, mus musculus
gaatactggactgttccttgaaagc

SEQ ID NO: 104802 - DNA, 25 bp, mus musculus
aatactggactgttccttgaaagca

SEQ ID NO: 104803 - DNA, 25 bp, mus musculus
atactggactgttccttgaaagcac

SEQ ID NO: 104804 - DNA, 25 bp, mus musculus
tactggactgttccttgaaagcaca

SEQ ID NO: 104805 - DNA, 25 bp, mus musculus
ctgttccttgaaagcacatcatgtt

SEQ ID NO: 104806 - DNA, 25 bp, mus musculus
tgttccttgaaagcacatcatgttt

SEQ ID NO: 104807 - DNA, 25 bp, mus musculus
tatccatacagactcccatgccaag

SEQ ID NO: 104808 - DNA, 25 bp, mus musculus
tacagactcccatgccaaggttctg

SEQ ID NO: 104809 - DNA, 25 bp, mus musculus
aatttctctttgccaacacatggaa

SEQ ID NO: 104810 - DNA, 25 bp, mus musculus
tttctctttgccaacacatggaaat

SEQ ID NO: 104811 - DNA, 25 bp, mus musculus
tctttgccaacacatggaaattctc

SEQ ID NO: 104812 - DNA, 25 bp, mus musculus
tttgccaacacatggaaattctcca

SEQ ID NO: 104813 - DNA, 25 bp, mus musculus
cacatggaaattctccattgatttc

SEQ ID NO: 104814 - DNA, 25 bp, mus musculus
tggaaattctccattgatttctttc

SEQ ID NO: 104815 - DNA, 25 bp, mus musculus
gaaattctccattgatttctttcct

SEQ ID NO: 104816 - DNA, 25 bp, mus musculus
ttctttcctgtcctgttcaataaat

SEQ ID NO: 104817 - DNA, 25 bp, mus musculus
ctttcctgtcctgttcaataaatga

SEQ ID NO: 104818 - DNA, 25 bp, mus musculus
ttcctgtcctgttcaataaatgatt

SEQ ID NO: 104819 - DNA, 25 bp, mus musculus
cagactcccatgccaaggttctgtg

SEQ ID NO: 104820 - DNA, 25 bp, mus musculus
gactcccatgccaaggttctgtgat

SEQ ID NO: 104821 - DNA, 25 bp, mus musculus
catgccaaggttctgtgatctgctc

SEQ ID NO: 104822 - DNA, 25 bp, mus musculus
aaggttctgtgatctgctctccacc

SEQ ID NO: 104823 - DNA, 25 bp, mus musculus
ggttctgtgatctgctctccacctg

SEQ ID NO: 104824 - DNA, 25 bp, mus musculus
gtgatctgctctccacctgtctcac

SEQ ID NO: 104825 - DNA, 25 bp, mus musculus
ctccacctgtctcacagagaagtgc

SEQ ID NO: 104826 - DNA, 25 bp, mus musculus
taaatttctctttgccaacacatgg

SEQ ID NO: 104827 - DNA, 25 bp, mus musculus
actacctcatgcaagagcttccaca

SEQ ID NO: 104828 - DNA, 25 bp, mus musculus
tcatgcaagagcttccacaggaaag

SEQ ID NO: 104829 - DNA, 25 bp, mus musculus
gctgtctgcagttgcatgaaaccaa

SEQ ID NO: 104830 - DNA, 25 bp, mus musculus
tgcatgaaaccaaacgtctggactc

SEQ ID NO: 104831 - DNA, 25 bp, mus musculus
ccggttctgcttccatggcgaaata

SEQ ID NO: 104832 - DNA, 25 bp, mus musculus
aatgtgtgcaactccacggaggctg

SEQ ID NO: 104833 - DNA, 25 bp, mus musculus
aagcttacgtggatgctcgggtgca

SEQ ID NO: 104834 - DNA, 25 bp, mus musculus
catctgcctacatcctggaatccta

SEQ ID NO: 104835 - DNA, 25 bp, mus musculus
cctacatcctggaatcctattacat

SEQ ID NO: 104836 - DNA, 25 bp, mus musculus
aatcctattacatgcagctaatgcg

SEQ ID NO: 104837 - DNA, 25 bp, mus musculus
attacatgcagctaatgcggattct

SEQ ID NO: 104838 - DNA, 25 bp, mus musculus
ggattctaatctacttgagataaag

SEQ ID NO: 104839 - DNA, 25 bp, mus musculus
ttccacaggaaaggctcttaattgc

SEQ ID NO: 104840 - DNA, 25 bp, mus musculus
taattgctgagttggcgatttctgc

SEQ ID NO: 104841 - DNA, 25 bp, mus musculus
tggcgatttctgcctgtgagttcat

SEQ ID NO: 104842 - DNA, 25 bp, mus musculus
ttgcacacatacagacggtgcagca

SEQ ID NO: 104843 - DNA, 25 bp, mus musculus
acatacagacggtgcagcataaact

SEQ ID NO: 104844 - DNA, 25 bp, mus musculus
acatatgtgtcaccagagcttttgt

SEQ ID NO: 104845 - DNA, 25 bp, mus musculus
gtgtcaccagagcttttgtggacag

SEQ ID NO: 104846 - DNA, 25 bp, mus musculus
tggacagctgtctgcagttgcatga

SEQ ID NO: 104847 - DNA, 25 bp, mus musculus
caacgagtccttcagccagcacagc

SEQ ID NO: 104848 - DNA, 25 bp, mus musculus
gccagctgctcagctacccacagat

SEQ ID NO: 104849 - DNA, 25 bp, mus musculus
gctctcagaggctttgacagatttc

SEQ ID NO: 104850 - DNA, 25 bp, mus musculus
ggctttgacagatttctctgtgaag

SEQ ID NO: 104851 - DNA, 25 bp, mus musculus
tttgacagatttctctgtgaagctc

SEQ ID NO: 104852 - DNA, 25 bp, mus musculus
ctctgtgaagctctaccacgccttc

SEQ ID NO: 104853 - DNA, 25 bp, mus musculus
tgtgaagctctaccacgccttctca

SEQ ID NO: 104854 - DNA, 25 bp, mus musculus
ccacgccttctcagctaccaagatg

SEQ ID NO: 104855 - DNA, 25 bp, mus musculus
cttctcagctaccaagatggctaag

SEQ ID NO: 104856 - DNA, 25 bp, mus musculus
ctcagctaccaagatggctaagacc

SEQ ID NO: 104857 - DNA, 25 bp, mus musculus
caacatggccttttccccattcagc

SEQ ID NO: 104858 - DNA, 25 bp, mus musculus
catggccttttccccattcagcatt

SEQ ID NO: 104859 - DNA, 25 bp, mus musculus
tcagctacccacagattctccagga

SEQ ID NO: 104860 - DNA, 25 bp, mus musculus
cttttccccattcagcattgccagc

SEQ ID NO: 104861 - DNA, 25 bp, mus musculus
gctacccacagattctccaggacag

SEQ ID NO: 104862 - DNA, 25 bp, mus musculus
ggctactactgaacccttctgcccg

SEQ ID NO: 104863 - DNA, 25 bp, mus musculus
tactactgaacccttctgcccggag

SEQ ID NO: 104864 - DNA, 25 bp, mus musculus
gtgctctgattcagacagagactcc

SEQ ID NO: 104865 - DNA, 25 bp, mus musculus
ttcagacagagactcctcagaggca

SEQ ID NO: 104866 - DNA, 25 bp, mus musculus
cagagactcctcagaggcaaagctc

SEQ ID NO: 104867 - DNA, 25 bp, mus musculus
aaagctctcagaggctttgacagat

SEQ ID NO: 104868 - DNA, 25 bp, mus musculus
ccaggcagccaagctaaccagtcag

SEQ ID NO: 104869 - DNA, 25 bp, mus musculus
aggcagccaagctaaccagtcagtt

SEQ ID NO: 104870 - DNA, 25 bp, mus musculus
cacgccacgctgtgttgatccaggc

SEQ ID NO: 104871 - DNA, 25 bp, mus musculus
cgccacgctgtgttgatccaggcat

SEQ ID NO: 104872 - DNA, 25 bp, mus musculus
ccacgctgtgttgatccaggcatcc

SEQ ID NO: 104873 - DNA, 25 bp, mus musculus
tgttgatccaggcatcctgccgggc

SEQ ID NO: 104874 - DNA, 25 bp, mus musculus
ttgatccaggcatcctgccgggccc

SEQ ID NO: 104875 - DNA, 25 bp, mus musculus
cccaccgggtagagatggaggcgct

SEQ ID NO: 104876 - DNA, 25 bp, mus musculus
gctgacctcggctgccatggctgcc

SEQ ID NO: 104877 - DNA, 25 bp, mus musculus
ccatggctgccctgacggtgtatga

SEQ ID NO: 104878 - DNA, 25 bp, mus musculus
atggctgccctgacggtgtatgaca

SEQ ID NO: 104879 - DNA, 25 bp, mus musculus
cagtcagcagggacattgtggtgac

SEQ ID NO: 104880 - DNA, 25 bp, mus musculus
gccaccatgtgccctgagccacgtg

SEQ ID NO: 104881 - DNA, 25 bp, mus musculus
caccatgtgccctgagccacgtgca

SEQ ID NO: 104882 - DNA, 25 bp, mus musculus
ccatgtgccctgagccacgtgcagg

SEQ ID NO: 104883 - DNA, 25 bp, mus musculus
atgtgccctgagccacgtgcaggta

SEQ ID NO: 104884 - DNA, 25 bp, mus musculus
tgagccacgtgcaggtacacctgga

SEQ ID NO: 104885 - DNA, 25 bp, mus musculus
agccacgtgcaggtacacctggagt

SEQ ID NO: 104886 - DNA, 25 bp, mus musculus
acgtgcaggtacacctggagttaga

SEQ ID NO: 104887 - DNA, 25 bp, mus musculus
gcaggtacacctggagttagacagc

SEQ ID NO: 104888 - DNA, 25 bp, mus musculus
gcgctcccgttgctagtaggagctg

SEQ ID NO: 104889 - DNA, 25 bp, mus musculus
ctcccgttgctagtaggagctgttt

SEQ ID NO: 104890 - DNA, 25 bp, mus musculus
tatgtcttggctctctcacatgctc

SEQ ID NO: 104891 - DNA, 25 bp, mus musculus
gtcttggctctctcacatgctctgt

SEQ ID NO: 104892 - DNA, 25 bp, mus musculus
tcacatgctctgttactgagagaga

SEQ ID NO: 104893 - DNA, 25 bp, mus musculus
catgctctgttactgagagagacca

SEQ ID NO: 104894 - DNA, 25 bp, mus musculus
ccaccctactctgatgtatagacca

SEQ ID NO: 104895 - DNA, 25 bp, mus musculus
ccctactctgatgtatagaccattc

SEQ ID NO: 104896 - DNA, 25 bp, mus musculus
gtatagaccattctccctacaccag

SEQ ID NO: 104897 - DNA, 25 bp, mus musculus
ctccctacaccagctaaacaaatgt

SEQ ID NO: 104898 - DNA, 25 bp, mus musculus
cctacaccagctaaacaaatgtcaa

SEQ ID NO: 104899 - DNA, 25 bp, mus musculus
acaccagctaaacaaatgtcaaatt

SEQ ID NO: 104900 - DNA, 25 bp, mus musculus
ggtctccacttgatgcctagagaat

SEQ ID NO: 104901 - DNA, 25 bp, mus musculus
ctccacttgatgcctagagaatgct

SEQ ID NO: 104902 - DNA, 25 bp, mus musculus
cacttgatgcctagagaatgctgca

SEQ ID NO: 104903 - DNA, 25 bp, mus musculus
gaatgctgcagtctgcaccttagac

SEQ ID NO: 104904 - DNA, 25 bp, mus musculus
tgcagtctgcaccttagacgctttt

SEQ ID NO: 104905 - DNA, 25 bp, mus musculus
agtctgcaccttagacgctttttag

SEQ ID NO: 104906 - DNA, 25 bp, mus musculus
ctgcaccttagacgctttttagaag

SEQ ID NO: 104907 - DNA, 25 bp, mus musculus
aactatgtcttggctctctcacatg

SEQ ID NO: 104908 - DNA, 25 bp, mus musculus
gtcctccaaactggcagcattcgat

SEQ ID NO: 104909 - DNA, 25 bp, mus musculus
caaactggcagcattcgatgaacct

SEQ ID NO: 104910 - DNA, 25 bp, mus musculus
tacatccttaacctaaggcctgcca

SEQ ID NO: 104911 - DNA, 25 bp, mus musculus
taagactgctattcctccagcactc

SEQ ID NO: 104912 - DNA, 25 bp, mus musculus
atgacctgctgcttgcttgaaagct

SEQ ID NO: 104913 - DNA, 25 bp, mus musculus
tgctgcttgcttgaaagctgctcca

SEQ ID NO: 104914 - DNA, 25 bp, mus musculus
ttgcttgaaagctgctccagaaact

SEQ ID NO: 104915 - DNA, 25 bp, mus musculus
gaaagctgctccagaaactggacta

SEQ ID NO: 104916 - DNA, 25 bp, mus musculus
tgctccagaaactggactactcttg

SEQ ID NO: 104917 - DNA, 25 bp, mus musculus
gaagcctccagaaaagacttgacct

SEQ ID NO: 104918 - DNA, 25 bp, mus musculus
ccggagccagccaggcagttttatt

SEQ ID NO: 104919 - DNA, 25 bp, mus musculus
ccagccaggcagttttattgaaata

SEQ ID NO: 104920 - DNA, 25 bp, mus musculus
tgaaccttctaagtattactatgaa

SEQ ID NO: 104921 - DNA, 25 bp, mus musculus
ctatgaagtttctctgcccagcggc

SEQ ID NO: 104922 - DNA, 25 bp, mus musculus
agtttctctgcccagcggcttagag

SEQ ID NO: 104923 - DNA, 25 bp, mus musculus
ctctcaaagccgatattgtgacaag

SEQ ID NO: 104924 - DNA, 25 bp, mus musculus
tcctgatgggatccatctgaactga

SEQ ID NO: 104925 - DNA, 25 bp, mus musculus
tgggatccatctgaactgaaccgga

SEQ ID NO: 104926 - DNA, 25 bp, mus musculus
ccatctgaactgaaccggatacttg

SEQ ID NO: 104927 - DNA, 25 bp, mus musculus
gaactgaaccggatacttgaacaag

SEQ ID NO: 104928 - DNA, 25 bp, mus musculus
acgactggccatgaagctgctggtc

SEQ ID NO: 104929 - DNA, 25 bp, mus musculus
cgactggccatgaagctgctggtcg

SEQ ID NO: 104930 - DNA, 25 bp, mus musculus
gctccgctttgccaggctacagcta

SEQ ID NO: 104931 - DNA, 25 bp, mus musculus
ctccgctttgccaggctacagctag

SEQ ID NO: 104932 - DNA, 25 bp, mus musculus
cgctttgccaggctacagctagagg

SEQ ID NO: 104933 - DNA, 25 bp, mus musculus
gctttgccaggctacagctagaggt

SEQ ID NO: 104934 - DNA, 25 bp, mus musculus
ctttgccaggctacagctagaggtg

SEQ ID NO: 104935 - DNA, 25 bp, mus musculus
tttgccaggctacagctagaggtga

SEQ ID NO: 104936 - DNA, 25 bp, mus musculus
ttgccaggctacagctagaggtgac

SEQ ID NO: 104937 - DNA, 25 bp, mus musculus
tgccaggctacagctagaggtgaca

SEQ ID NO: 104938 - DNA, 25 bp, mus musculus
gccaggctacagctagaggtgacaa

SEQ ID NO: 104939 - DNA, 25 bp, mus musculus
ccaggctacagctagaggtgacaag

SEQ ID NO: 104940 - DNA, 25 bp, mus musculus
actggccatgaagctgctggtcgcc

SEQ ID NO: 104941 - DNA, 25 bp, mus musculus
ctgctggtcgccgcaagcagccagg

SEQ ID NO: 104942 - DNA, 25 bp, mus musculus
caccaagctccgctttgccaggcta

SEQ ID NO: 104943 - DNA, 25 bp, mus musculus
accaagctccgctttgccaggctac

SEQ ID NO: 104944 - DNA, 25 bp, mus musculus
ccaagctccgctttgccaggctaca

SEQ ID NO: 104945 - DNA, 25 bp, mus musculus
caagctccgctttgccaggctacag

SEQ ID NO: 104946 - DNA, 25 bp, mus musculus
aagctccgctttgccaggctacagc

SEQ ID NO: 104947 - DNA, 25 bp, mus musculus
agctccgctttgccaggctacagct

SEQ ID NO: 104948 - DNA, 25 bp, mus musculus
tggaacaccacacagctctgacagt

SEQ ID NO: 104949 - DNA, 25 bp, mus musculus
accacacagctctgacagtgacgtc

SEQ ID NO: 104950 - DNA, 25 bp, mus musculus
gctcctgaggcagcaggagcttaac

SEQ ID NO: 104951 - DNA, 25 bp, mus musculus
acggcccaggcccatgagtaacctg

SEQ ID NO: 104952 - DNA, 25 bp, mus musculus
caggcccatgagtaacctgattact

SEQ ID NO: 104953 - DNA, 25 bp, mus musculus
taacctgattacttctgtgtctcta

SEQ ID NO: 104954 - DNA, 25 bp, mus musculus
gtctctacccaattcccatggataa

SEQ ID NO: 104955 - DNA, 25 bp, mus musculus
agcaccattctacatttaattgtca

SEQ ID NO: 104956 - DNA, 25 bp, mus musculus
agattttatgtgcacgagtgtttac

SEQ ID NO: 104957 - DNA, 25 bp, mus musculus
aacatgtacatgcacccagccactt

SEQ ID NO: 104958 - DNA, 25 bp, mus musculus
tgcatgcctatttttctcacagaga

SEQ ID NO: 104959 - DNA, 25 bp, mus musculus
cctatttttctcacagagactggga

SEQ ID NO: 104960 - DNA, 25 bp, mus musculus
cagctctgacagtgacgtcctgtgc

SEQ ID NO: 104961 - DNA, 25 bp, mus musculus
tgacagtgacgtcctgtgcaaggct

SEQ ID NO: 104962 - DNA, 25 bp, mus musculus
cctgtgcaaggctggccttctaagc

SEQ ID NO: 104963 - DNA, 25 bp, mus musculus
tggccttctaagccactgagacccc

SEQ ID NO: 104964 - DNA, 25 bp, mus musculus
tctaagccactgagaccccagatgt

SEQ ID NO: 104965 - DNA, 25 bp, mus musculus
ccactgagaccccagatgttacatt

SEQ ID NO: 104966 - DNA, 25 bp, mus musculus
agaccccagatgttacattatcatg

SEQ ID NO: 104967 - DNA, 25 bp, mus musculus
cagaatgctcctgaggcagcaggag

SEQ ID NO: 104968 - DNA, 25 bp, mus musculus
tgtgcgccttctctcagctggtctg

SEQ ID NO: 104969 - DNA, 25 bp, mus musculus
tgcgccttctctcagctggtctgcc

SEQ ID NO: 104970 - DNA, 25 bp, mus musculus
ggcgccatttccactccgacaagat

SEQ ID NO: 104971 - DNA, 25 bp, mus musculus
ccatttccactccgacaagatgaaa

SEQ ID NO: 104972 - DNA, 25 bp, mus musculus
catttccactccgacaagatgaaag

SEQ ID NO: 104973 - DNA, 25 bp, mus musculus
atttccactccgacaagatgaaaga

SEQ ID NO: 104974 - DNA, 25 bp, mus musculus
tttccactccgacaagatgaaagaa

SEQ ID NO: 104975 - DNA, 25 bp, mus musculus
ttccactccgacaagatgaaagaaa

SEQ ID NO: 104976 - DNA, 25 bp, mus musculus
tccactccgacaagatgaaagaaac

SEQ ID NO: 104977 - DNA, 25 bp, mus musculus
ccactccgacaagatgaaagaaaca

SEQ ID NO: 104978 - DNA, 25 bp, mus musculus
gccttctctcagctggtctgcccga

SEQ ID NO: 104979 - DNA, 25 bp, mus musculus
ccttctctcagctggtctgcccgag

SEQ ID NO: 104980 - DNA, 25 bp, mus musculus
cttctctcagctggtctgcccgaga

SEQ ID NO: 104981 - DNA, 25 bp, mus musculus
ttctctcagctggtctgcccgagac

SEQ ID NO: 104982 - DNA, 25 bp, mus musculus
tctctcagctggtctgcccgagacc

SEQ ID NO: 104983 - DNA, 25 bp, mus musculus
gagaccccctgagcgtgaaccttag

SEQ ID NO: 104984 - DNA, 25 bp, mus musculus
gcggcgccatttccactccgacaag

SEQ ID NO: 104985 - DNA, 25 bp, mus musculus
cggcgccatttccactccgacaaga

SEQ ID NO: 104986 - DNA, 25 bp, mus musculus
aaggcttggactggctctgtcctct

SEQ ID NO: 104987 - DNA, 25 bp, mus musculus
gtggcgtcttctcccttgatgatgt

SEQ ID NO: 104988 - DNA, 25 bp, mus musculus
aactctgacagaggagcctggtgtc

SEQ ID NO: 104989 - DNA, 25 bp, mus musculus
gcctggtgtccactcaatgatgctt

SEQ ID NO: 104990 - DNA, 25 bp, mus musculus
gatgcttcactgaacctctgctcca

SEQ ID NO: 104991 - DNA, 25 bp, mus musculus
gcttcactgaacctctgctccatga

SEQ ID NO: 104992 - DNA, 25 bp, mus musculus
ctctgctccatgatggaggcttagc

SEQ ID NO: 104993 - DNA, 25 bp, mus musculus
tgctccatgatggaggcttagcagt

SEQ ID NO: 104994 - DNA, 25 bp, mus musculus
aatacatccatcatctgtcttttta

SEQ ID NO: 104995 - DNA, 25 bp, mus musculus
aaatgtaattgtgccctcgtgtctg

SEQ ID NO: 104996 - DNA, 25 bp, mus musculus
tgacgtctggtcctctcgaaaggta

SEQ ID NO: 104997 - DNA, 25 bp, mus musculus
taattgttcattgtggaaggcaatg

SEQ ID NO: 104998 - DNA, 25 bp, mus musculus
ctcctcaggcagcaaatgggtactc

SEQ ID NO: 104999 - DNA, 25 bp, mus musculus
caaatgggtactctccggtgctgcc

SEQ ID NO: 105000 - DNA, 25 bp, mus musculus
atgggtactctccggtgctgccatc

SEQ ID NO: 105001 - DNA, 25 bp, mus musculus
catccccaagacatagatcctggga

SEQ ID NO: 105002 - DNA, 25 bp, mus musculus
gccacaaaagcagcagtcagtgtga

SEQ ID NO: 105003 - DNA, 25 bp, mus musculus
aggccttctatctggaactctgaca

SEQ ID NO: 105004 - DNA, 25 bp, mus musculus
ccttctatctggaactctgacagag

SEQ ID NO: 105005 - DNA, 25 bp, mus musculus
tctatctggaactctgacagaggag

SEQ ID NO: 105006 - DNA, 25 bp, mus musculus
atctttcaccttcgctgagcttctg

SEQ ID NO: 105007 - DNA, 25 bp, mus musculus
tttcaccttcgctgagcttctgcct

SEQ ID NO: 105008 - DNA, 25 bp, mus musculus
gtcatggcctctatctgggttggac

SEQ ID NO: 105009 - DNA, 25 bp, mus musculus
atggcctctatctgggttggacctc

SEQ ID NO: 105010 - DNA, 25 bp, mus musculus
tctatctgggttggacctcgaggaa

SEQ ID NO: 105011 - DNA, 25 bp, mus musculus
gattatccaggctttagcacgtcgg

SEQ ID NO: 105012 - DNA, 25 bp, mus musculus
tatccaggctttagcacgtcggtgg

SEQ ID NO: 105013 - DNA, 25 bp, mus musculus
ccaggctttagcacgtcggtggatg

SEQ ID NO: 105014 - DNA, 25 bp, mus musculus
tttagcacgtcggtggatgccgaag

SEQ ID NO: 105015 - DNA, 25 bp, mus musculus
agcacgtcggtggatgccgaagcta

SEQ ID NO: 105016 - DNA, 25 bp, mus musculus
gatgccgaagctatccggaaagcga

SEQ ID NO: 105017 - DNA, 25 bp, mus musculus
gaagctatccggaaagcgatcagag

SEQ ID NO: 105018 - DNA, 25 bp, mus musculus
caccttcgctgagcttctgcctggg

SEQ ID NO: 105019 - DNA, 25 bp, mus musculus
cgcggccccaaggattgctgtgatc

SEQ ID NO: 105020 - DNA, 25 bp, mus musculus
ggccccaaggattgctgtgatctcg

SEQ ID NO: 105021 - DNA, 25 bp, mus musculus
gattgctgtgatctcggcttgagag

SEQ ID NO: 105022 - DNA, 25 bp, mus musculus
tgctgtgatctcggcttgagagaaa

SEQ ID NO: 105023 - DNA, 25 bp, mus musculus
tgtgatctcggcttgagagaaaggt

SEQ ID NO: 105024 - DNA, 25 bp, mus musculus
tggactgtcatggcctctatctggg

SEQ ID NO: 105025 - DNA, 25 bp, mus musculus
actgtcatggcctctatctgggttg

SEQ ID NO: 105026 - DNA, 25 bp, mus musculus
ttgtctgctcttctagaggactgat

SEQ ID NO: 105027 - DNA, 25 bp, mus musculus
gactgattctatttctagcaccaac

SEQ ID NO: 105028 - DNA, 25 bp, mus musculus
ctaatgccctcttgacttcttcagg

SEQ ID NO: 105029 - DNA, 25 bp, mus musculus
tcttgacttcttcaggcaccaagct

SEQ ID NO: 105030 - DNA, 25 bp, mus musculus
tgacttcttcaggcaccaagcttgc

SEQ ID NO: 105031 - DNA, 25 bp, mus musculus
caggcaccaagcttgcatgtggtac

SEQ ID NO: 105032 - DNA, 25 bp, mus musculus
gcaccaagcttgcatgtggtacaca

SEQ ID NO: 105033 - DNA, 25 bp, mus musculus
ccaagcttgcatgtggtacacataa

SEQ ID NO: 105034 - DNA, 25 bp, mus musculus
tttcgttgagggtctgcgtgtcttc

SEQ ID NO: 105035 - DNA, 25 bp, mus musculus
tgaactccggcatgtcctcgccact

SEQ ID NO: 105036 - DNA, 25 bp, mus musculus
cctcgccactcttggagagaagatg

SEQ ID NO: 105037 - DNA, 25 bp, mus musculus
tcgccactcttggagagaagatgaa

SEQ ID NO: 105038 - DNA, 25 bp, mus musculus
tgattctatttctagcaccaacata

SEQ ID NO: 105039 - DNA, 25 bp, mus musculus
ttctatttctagcaccaacatagtg

SEQ ID NO: 105040 - DNA, 25 bp, mus musculus
tatttctagcaccaacatagtggtt

SEQ ID NO: 105041 - DNA, 25 bp, mus musculus
ttctagcaccaacatagtggttcac

SEQ ID NO: 105042 - DNA, 25 bp, mus musculus
tctataattctagttcctgggaatc

SEQ ID NO: 105043 - DNA, 25 bp, mus musculus
ctagttcctgggaatctaatgccct

SEQ ID NO: 105044 - DNA, 25 bp, mus musculus
gggaatctaatgccctcttgacttc

SEQ ID NO: 105045 - DNA, 25 bp, mus musculus
aatctaatgccctcttgacttcttc

SEQ ID NO: 105046 - DNA, 25 bp, mus musculus
attagctgaacagaccgtcttcctt

SEQ ID NO: 105047 - DNA, 25 bp, mus musculus
cctttagttcttctctgtccatgtg

SEQ ID NO: 105048 - DNA, 25 bp, mus musculus
gatctttcggacaacttgacacaag

SEQ ID NO: 105049 - DNA, 25 bp, mus musculus
ctttcggacaacttgacacaagata

SEQ ID NO: 105050 - DNA, 25 bp, mus musculus
gaggatttctttccatcaggaagct

SEQ ID NO: 105051 - DNA, 25 bp, mus musculus
ttctttccatcaggaagctacgggc

SEQ ID NO: 105052 - DNA, 25 bp, mus musculus
caagtttgctgggcctttgattgct

SEQ ID NO: 105053 - DNA, 25 bp, mus musculus
tgctgggcctttgattgcttgatga

SEQ ID NO: 105054 - DNA, 25 bp, mus musculus
agtcttactgcaacttgatatgtca

SEQ ID NO: 105055 - DNA, 25 bp, mus musculus
cttactgcaacttgatatgtcatgt

SEQ ID NO: 105056 - DNA, 25 bp, mus musculus
gcctgcccttttctgaagagaagtg

SEQ ID NO: 105057 - DNA, 25 bp, mus musculus
tgcccttttctgaagagaagtggtg

SEQ ID NO: 105058 - DNA, 25 bp, mus musculus
cttctctgtccatgtgggatacatg

SEQ ID NO: 105059 - DNA, 25 bp, mus musculus
ctctgtccatgtgggatacatggta

SEQ ID NO: 105060 - DNA, 25 bp, mus musculus
aggtacaatctttctttcagcaccg

SEQ ID NO: 105061 - DNA, 25 bp, mus musculus
ctttctttcagcaccgtgctagctg

SEQ ID NO: 105062 - DNA, 25 bp, mus musculus
agcaccgtgctagctgatctttcgg

SEQ ID NO: 105063 - DNA, 25 bp, mus musculus
accgtgctagctgatctttcggaca

SEQ ID NO: 105064 - DNA, 25 bp, mus musculus
gtgctagctgatctttcggacaact

SEQ ID NO: 105065 - DNA, 25 bp, mus musculus
gctgatctttcggacaacttgacac

SEQ ID NO: 105066 - DNA, 25 bp, mus musculus
atggcctgttttacagaccgcagag

SEQ ID NO: 105067 - DNA, 25 bp, mus musculus
gttctgcttttgctaagtactgtat

SEQ ID NO: 105068 - DNA, 25 bp, mus musculus
tacttgcagggtgtattgccatctt

SEQ ID NO: 105069 - DNA, 25 bp, mus musculus
ttacatagacctaatatcattttat

SEQ ID NO: 105070 - DNA, 25 bp, mus musculus
agacctaatatcattttattcacaa

SEQ ID NO: 105071 - DNA, 25 bp, mus musculus
aatatcattttattcacaaatgtct

SEQ ID NO: 105072 - DNA, 25 bp, mus musculus
atcattttattcacaaatgtctcac

SEQ ID NO: 105073 - DNA, 25 bp, mus musculus
aatgtctcactgctttaaatcctac

SEQ ID NO: 105074 - DNA, 25 bp, mus musculus
tcactgctttaaatcctaccaaagt

SEQ ID NO: 105075 - DNA, 25 bp, mus musculus
gactgactgttgcctttggtcttac

SEQ ID NO: 105076 - DNA, 25 bp, mus musculus
tgactgttgcctttggtcttacaaa

SEQ ID NO: 105077 - DNA, 25 bp, mus musculus
ttgcctttggtcttacaaaatcaga

SEQ ID NO: 105078 - DNA, 25 bp, mus musculus
ctgcttttgctaagtactgtattta

SEQ ID NO: 105079 - DNA, 25 bp, mus musculus
tttatgtcacgcaaagcttttaaat

SEQ ID NO: 105080 - DNA, 25 bp, mus musculus
taatatcattccttgtatcttagat

SEQ ID NO: 105081 - DNA, 25 bp, mus musculus
cattccttgtatcttagatctgtga

SEQ ID NO: 105082 - DNA, 25 bp, mus musculus
tccttgtatcttagatctgtgaaaa

SEQ ID NO: 105083 - DNA, 25 bp, mus musculus
caccacttaatcttctctcttgatt

SEQ ID NO: 105084 - DNA, 25 bp, mus musculus
cacttaatcttctctcttgattgat

SEQ ID NO: 105085 - DNA, 25 bp, mus musculus
taccagtacttgcagggtgtattgc

SEQ ID NO: 105086 - DNA, 25 bp, mus musculus
gcagcaggacctggagtttgccaag

SEQ ID NO: 105087 - DNA, 25 bp, mus musculus
ggacctggagtttgccaaggagatg

SEQ ID NO: 105088 - DNA, 25 bp, mus musculus
catatgtgcaggggtcagggatgct

SEQ ID NO: 105089 - DNA, 25 bp, mus musculus
ccttcttgctaccatgcctctctgt

SEQ ID NO: 105090 - DNA, 25 bp, mus musculus
ttcttgctaccatgcctctctgtag

SEQ ID NO: 105091 - DNA, 25 bp, mus musculus
cttgctaccatgcctctctgtagct

SEQ ID NO: 105092 - DNA, 25 bp, mus musculus
ctaccatgcctctctgtagctggtg

SEQ ID NO: 105093 - DNA, 25 bp, mus musculus
catgcctctctgtagctggtgacag

SEQ ID NO: 105094 - DNA, 25 bp, mus musculus
tgcctctctgtagctggtgacagta

SEQ ID NO: 105095 - DNA, 25 bp, mus musculus
cctctctgtagctggtgacagtacc

SEQ ID NO: 105096 - DNA, 25 bp, mus musculus
tctctgtagctggtgacagtaccct

SEQ ID NO: 105097 - DNA, 25 bp, mus musculus
cagggtcctgcctcatggtggtgtc

SEQ ID NO: 105098 - DNA, 25 bp, mus musculus
acctggagtttgccaaggagatggc

SEQ ID NO: 105099 - DNA, 25 bp, mus musculus
atgacgacgacagcttcccctgagc

SEQ ID NO: 105100 - DNA, 25 bp, mus musculus
cacacggctcacagactgcatatgt

SEQ ID NO: 105101 - DNA, 25 bp, mus musculus
cacggctcacagactgcatatgtgc

SEQ ID NO: 105102 - DNA, 25 bp, mus musculus
cggctcacagactgcatatgtgcag

SEQ ID NO: 105103 - DNA, 25 bp, mus musculus
gctcacagactgcatatgtgcaggg

SEQ ID NO: 105104 - DNA, 25 bp, mus musculus
tcacagactgcatatgtgcaggggt

SEQ ID NO: 105105 - DNA, 25 bp, mus musculus
acagactgcatatgtgcaggggtca

SEQ ID NO: 105106 - DNA, 25 bp, mus musculus
atcagacatagccgctgactaagtg

SEQ ID NO: 105107 - DNA, 25 bp, mus musculus
agacatagccgctgactaagtgcag

SEQ ID NO: 105108 - DNA, 25 bp, mus musculus
cacacgatctactgtgtgcgatgta

SEQ ID NO: 105109 - DNA, 25 bp, mus musculus
acgatctactgtgtgcgatgtacct

SEQ ID NO: 105110 - DNA, 25 bp, mus musculus
atctactgtgtgcgatgtacctaca

SEQ ID NO: 105111 - DNA, 25 bp, mus musculus
tctcaagggccaagcgaagtggcac

SEQ ID NO: 105112 - DNA, 25 bp, mus musculus
ctagctgacagggacttccacggaa

SEQ ID NO: 105113 - DNA, 25 bp, mus musculus
gacttccacggaaagtcgcatgaag

SEQ ID NO: 105114 - DNA, 25 bp, mus musculus
tcgcatgaagacctatcgtggcaac

SEQ ID NO: 105115 - DNA, 25 bp, mus musculus
catgaagacctatcgtggcaacgta

SEQ ID NO: 105116 - DNA, 25 bp, mus musculus
gaagacctatcgtggcaacgtatac

SEQ ID NO: 105117 - DNA, 25 bp, mus musculus
gacctatcgtggcaacgtatacgag

SEQ ID NO: 105118 - DNA, 25 bp, mus musculus
catagccgctgactaagtgcagcgc

SEQ ID NO: 105119 - DNA, 25 bp, mus musculus
ctatcgtggcaacgtatacgagcta

SEQ ID NO: 105120 - DNA, 25 bp, mus musculus
tgactaagtgcagcgcctcacgaat

SEQ ID NO: 105121 - DNA, 25 bp, mus musculus
ctaagtgcagcgcctcacgaatcag

SEQ ID NO: 105122 - DNA, 25 bp, mus musculus
agtgcagcgcctcacgaatcagcca

SEQ ID NO: 105123 - DNA, 25 bp, mus musculus
gcagcgcctcacgaatcagccagct

SEQ ID NO: 105124 - DNA, 25 bp, mus musculus
cacgaatcagccagctgatgaacag

SEQ ID NO: 105125 - DNA, 25 bp, mus musculus
tcacttcacacgatctactgtgtgc

SEQ ID NO: 105126 - DNA, 25 bp, mus musculus
cttcacacgatctactgtgtgcgat

SEQ ID NO: 105127 - DNA, 25 bp, mus musculus
tctttacatgatgctctttgtgtgg

SEQ ID NO: 105128 - DNA, 25 bp, mus musculus
catgatgctctttgtgtggtgaaga

SEQ ID NO: 105129 - DNA, 25 bp, mus musculus
gcccaggactccaccgacctggttg

SEQ ID NO: 105130 - DNA, 25 bp, mus musculus
aagttcgcaacagaggctgcaatca

SEQ ID NO: 105131 - DNA, 25 bp, mus musculus
accatccttcggattgatgatctga

SEQ ID NO: 105132 - DNA, 25 bp, mus musculus
aatgctgttcactctggagcccttg

SEQ ID NO: 105133 - DNA, 25 bp, mus musculus
gttcactctggagcccttgatgact

SEQ ID NO: 105134 - DNA, 25 bp, mus musculus
tctggagcccttgatgactgattgg

SEQ ID NO: 105135 - DNA, 25 bp, mus musculus
gcccttgatgactgattggatttcc

SEQ ID NO: 105136 - DNA, 25 bp, mus musculus
atttataacagtgtcaggtgcaatg

SEQ ID NO: 105137 - DNA, 25 bp, mus musculus
tgcaatgccgtagccttgggtgtct

SEQ ID NO: 105138 - DNA, 25 bp, mus musculus
gccgtagccttgggtgtctcacatt

SEQ ID NO: 105139 - DNA, 25 bp, mus musculus
gctctttgtgtggtgaagagagttt

SEQ ID NO: 105140 - DNA, 25 bp, mus musculus
aaagtacagcaagctgtccacctgg

SEQ ID NO: 105141 - DNA, 25 bp, mus musculus
gtagaagctgccctgtccatatacc

SEQ ID NO: 105142 - DNA, 25 bp, mus musculus
gctgccctgtccatatacctggaaa

SEQ ID NO: 105143 - DNA, 25 bp, mus musculus
aactatgcaacaagcatgggatctc

SEQ ID NO: 105144 - DNA, 25 bp, mus musculus
cagcttgctattgcagagtttgcaa

SEQ ID NO: 105145 - DNA, 25 bp, mus musculus
tttgcaagatctctgcttgtgattc

SEQ ID NO: 105146 - DNA, 25 bp, mus musculus
agatctctgcttgtgattcctaata

SEQ ID NO: 105147 - DNA, 25 bp, mus musculus
gtgattcctaatacactggcagtga

SEQ ID NO: 105148 - DNA, 25 bp, mus musculus
tgttttgaccattggacttagtctg

SEQ ID NO: 105149 - DNA, 25 bp, mus musculus
ttttgaccattggacttagtctgca

SEQ ID NO: 105150 - DNA, 25 bp, mus musculus
ctggacagatcttctctgatacccc

SEQ ID NO: 105151 - DNA, 25 bp, mus musculus
ggacagatcttctctgataccccaa

SEQ ID NO: 105152 - DNA, 25 bp, mus musculus
acagatcttctctgataccccaaag

SEQ ID NO: 105153 - DNA, 25 bp, mus musculus
agatcttctctgataccccaaagct

SEQ ID NO: 105154 - DNA, 25 bp, mus musculus
atcttctctgataccccaaagcttg

SEQ ID NO: 105155 - DNA, 25 bp, mus musculus
cttctctgataccccaaagcttgga

SEQ ID NO: 105156 - DNA, 25 bp, mus musculus
tctctgataccccaaagcttggacg

SEQ ID NO: 105157 - DNA, 25 bp, mus musculus
tctgataccccaaagcttggacgaa

SEQ ID NO: 105158 - DNA, 25 bp, mus musculus
tgataccccaaagcttggacgaatc

SEQ ID NO: 105159 - DNA, 25 bp, mus musculus
ataccccaaagcttggacgaatctg

SEQ ID NO: 105160 - DNA, 25 bp, mus musculus
ttgaccattggacttagtctgcagt

SEQ ID NO: 105161 - DNA, 25 bp, mus musculus
ccattggacttagtctgcagtgcaa

SEQ ID NO: 105162 - DNA, 25 bp, mus musculus
attggacttagtctgcagtgcaaag

SEQ ID NO: 105163 - DNA, 25 bp, mus musculus
tggacttagtctgcagtgcaaagag

SEQ ID NO: 105164 - DNA, 25 bp, mus musculus
gacttagtctgcagtgcaaagagag

SEQ ID NO: 105165 - DNA, 25 bp, mus musculus
cttagtctgcagtgcaaagagagag

SEQ ID NO: 105166 - DNA, 25 bp, mus musculus
tccctgttgagactggacagatctt

SEQ ID NO: 105167 - DNA, 25 bp, mus musculus
gactggacagatcttctctgatacc

SEQ ID NO: 105168 - DNA, 25 bp, mus musculus
gtccgcgaacgaccgcagacagcgc

SEQ ID NO: 105169 - DNA, 25 bp, mus musculus
gaacgaccgcagacagcgccggagg

SEQ ID NO: 105170 - DNA, 25 bp, mus musculus
caccaagaagaggccccagaggcta

SEQ ID NO: 105171 - DNA, 25 bp, mus musculus
gaggccccagaggctacgtccaatg

SEQ ID NO: 105172 - DNA, 25 bp, mus musculus
aggccccagaggctacgtccaatgt

SEQ ID NO: 105173 - DNA, 25 bp, mus musculus
gccccagaggctacgtccaatgtct

SEQ ID NO: 105174 - DNA, 25 bp, mus musculus
ccccagaggctacgtccaatgtctt

SEQ ID NO: 105175 - DNA, 25 bp, mus musculus
ccagaggctacgtccaatgtcttcg

SEQ ID NO: 105176 - DNA, 25 bp, mus musculus
aggctacgtccaatgtcttcgccat

SEQ ID NO: 105177 - DNA, 25 bp, mus musculus
ttaaggaggccttcaacatgattga

SEQ ID NO: 105178 - DNA, 25 bp, mus musculus
aggaggccttcaacatgattgatca

SEQ ID NO: 105179 - DNA, 25 bp, mus musculus
ggaagaaccccacagacgagtatct

SEQ ID NO: 105180 - DNA, 25 bp, mus musculus
ggagcttttctgtctctgcgagcag

SEQ ID NO: 105181 - DNA, 25 bp, mus musculus
gcttttctgtctctgcgagcagtgg

SEQ ID NO: 105182 - DNA, 25 bp, mus musculus
cttttctgtctctgcgagcagtgga

SEQ ID NO: 105183 - DNA, 25 bp, mus musculus
tgtctctgcgagcagtggaaacccc

SEQ ID NO: 105184 - DNA, 25 bp, mus musculus
cccaacacccaaaggcaagatgtcg

SEQ ID NO: 105185 - DNA, 25 bp, mus musculus
ccaacacccaaaggcaagatgtcga

SEQ ID NO: 105186 - DNA, 25 bp, mus musculus
aacacccaaaggcaagatgtcgagc

SEQ ID NO: 105187 - DNA, 25 bp, mus musculus
acacccaaaggcaagatgtcgagca

SEQ ID NO: 105188 - DNA, 25 bp, mus musculus
ggtagcccagctgtgtgacttcaat

SEQ ID NO: 105189 - DNA, 25 bp, mus musculus
agcccagctgtgtgacttcaatccc

SEQ ID NO: 105190 - DNA, 25 bp, mus musculus
catgtccctgaagcaaacaccactg

SEQ ID NO: 105191 - DNA, 25 bp, mus musculus
gaagcaaacaccactgtcccgctag

SEQ ID NO: 105192 - DNA, 25 bp, mus musculus
gtcccgctaggtgcccgtcacgaga

SEQ ID NO: 105193 - DNA, 25 bp, mus musculus
gaacgacatgggccttgctggggca

SEQ ID NO: 105194 - DNA, 25 bp, mus musculus
gcagctgcttccgccagagtggaac

SEQ ID NO: 105195 - DNA, 25 bp, mus musculus
gctgcttccgccagagtggaacttc

SEQ ID NO: 105196 - DNA, 25 bp, mus musculus
gcttccgccagagtggaacttcctc

SEQ ID NO: 105197 - DNA, 25 bp, mus musculus
gcagctgcacacacagcctgttctg

SEQ ID NO: 105198 - DNA, 25 bp, mus musculus
gctgcacacacagcctgttctgttc

SEQ ID NO: 105199 - DNA, 25 bp, mus musculus
gcacacacagcctgttctgttcctc

SEQ ID NO: 105200 - DNA, 25 bp, mus musculus
gtgtgacttcaatcccaagagcagc

SEQ ID NO: 105201 - DNA, 25 bp, mus musculus
cacacagcctgttctgttcctctga

SEQ ID NO: 105202 - DNA, 25 bp, mus musculus
tgacttcaatcccaagagcagcaag

SEQ ID NO: 105203 - DNA, 25 bp, mus musculus
cttcaatcccaagagcagcaagcag

SEQ ID NO: 105204 - DNA, 25 bp, mus musculus
caatcccaagagcagcaagcagtgt

SEQ ID NO: 105205 - DNA, 25 bp, mus musculus
tcccaagagcagcaagcagtgtaaa

SEQ ID NO: 105206 - DNA, 25 bp, mus musculus
ctcggtgctcatgtccctgaagcaa

SEQ ID NO: 105207 - DNA, 25 bp, mus musculus
ggtgctcatgtccctgaagcaaaca

SEQ ID NO: 105208 - DNA, 25 bp, mus musculus
gctcatgtccctgaagcaaacacca

SEQ ID NO: 105209 - DNA, 25 bp, mus musculus
tttccttcctttgaagaagcattct

SEQ ID NO: 105210 - DNA, 25 bp, mus musculus
tccttcctttgaagaagcattcttg

SEQ ID NO: 105211 - DNA, 25 bp, mus musculus
ctgctttctgggacactgaccctgt

SEQ ID NO: 105212 - DNA, 25 bp, mus musculus
gctttctgggacactgaccctgtcc

SEQ ID NO: 105213 - DNA, 25 bp, mus musculus
gagccaagcaggtggcatgggccaa

SEQ ID NO: 105214 - DNA, 25 bp, mus musculus
tggcatgggccaagtggctgccttt

SEQ ID NO: 105215 - DNA, 25 bp, mus musculus
atgggccaagtggctgcctttatct

SEQ ID NO: 105216 - DNA, 25 bp, mus musculus
gggccaagtggctgcctttatctcc

SEQ ID NO: 105217 - DNA, 25 bp, mus musculus
caagtggctgcctttatctcctttc

SEQ ID NO: 105218 - DNA, 25 bp, mus musculus
agtggctgcctttatctcctttctt

SEQ ID NO: 105219 - DNA, 25 bp, mus musculus
gctgcctttatctcctttcttctga

SEQ ID NO: 105220 - DNA, 25 bp, mus musculus
tgcctttatctcctttcttctgaaa

SEQ ID NO: 105221 - DNA, 25 bp, mus musculus
agaagcattcttgagcccagccatc

SEQ ID NO: 105222 - DNA, 25 bp, mus musculus
aagcattcttgagcccagccatccc

SEQ ID NO: 105223 - DNA, 25 bp, mus musculus
agccaggcagcttctctgcctggga

SEQ ID NO: 105224 - DNA, 25 bp, mus musculus
ccaggcagcttctctgcctgggacg

SEQ ID NO: 105225 - DNA, 25 bp, mus musculus
cagtgtccagccagggccagggaag

SEQ ID NO: 105226 - DNA, 25 bp, mus musculus
agaggcctgctttctgggacactga

SEQ ID NO: 105227 - DNA, 25 bp, mus musculus
aggcctgctttctgggacactgacc

SEQ ID NO: 105228 - DNA, 25 bp, mus musculus
gcctgctttctgggacactgaccct

SEQ ID NO: 105229 - DNA, 25 bp, mus musculus
ccacgccactggatgctggacaaac

SEQ ID NO: 105230 - DNA, 25 bp, mus musculus
acgccactggatgctggacaaactg

SEQ ID NO: 105231 - DNA, 25 bp, mus musculus
tgcatgcagcggctcattaaggtcg

SEQ ID NO: 105232 - DNA, 25 bp, mus musculus
catgcagcggctcattaaggtcgac

SEQ ID NO: 105233 - DNA, 25 bp, mus musculus
tgcagcggctcattaaggtcgacgg

SEQ ID NO: 105234 - DNA, 25 bp, mus musculus
ctcattaaggtcgacggcaaggtca

SEQ ID NO: 105235 - DNA, 25 bp, mus musculus
cattaaggtcgacggcaaggtcaga

SEQ ID NO: 105236 - DNA, 25 bp, mus musculus
tgtggcctacccagctggcttcatg

SEQ ID NO: 105237 - DNA, 25 bp, mus musculus
tggcctacccagctggcttcatgga

SEQ ID NO: 105238 - DNA, 25 bp, mus musculus
gcgagaacttccgcctcgtctacga

SEQ ID NO: 105239 - DNA, 25 bp, mus musculus
ttccgcctcgtctacgacaccaagg

SEQ ID NO: 105240 - DNA, 25 bp, mus musculus
gcctcgtctacgacaccaagggccg

SEQ ID NO: 105241 - DNA, 25 bp, mus musculus
atgctggacaaactgaccggtgtgt

SEQ ID NO: 105242 - DNA, 25 bp, mus musculus
gctggacaaactgaccggtgtgttc

SEQ ID NO: 105243 - DNA, 25 bp, mus musculus
tggacaaactgaccggtgtgttcgc

SEQ ID NO: 105244 - DNA, 25 bp, mus musculus
tgccgctcgccatcttcctgaggaa

SEQ ID NO: 105245 - DNA, 25 bp, mus musculus
gctcgccatcttcctgaggaacagg

SEQ ID NO: 105246 - DNA, 25 bp, mus musculus
gccatcttcctgaggaacaggctca

SEQ ID NO: 105247 - DNA, 25 bp, mus musculus
catcttcctgaggaacaggctcaag

SEQ ID NO: 105248 - DNA, 25 bp, mus musculus
acaggctcaagtacgccctgaccgg

SEQ ID NO: 105249 - DNA, 25 bp, mus musculus
gactatctgatactgcactgcaaga

SEQ ID NO: 105250 - DNA, 25 bp, mus musculus
ctatctgatactgcactgcaagagg

SEQ ID NO: 105251 - DNA, 25 bp, mus musculus
gttatccacatacagatgtcttacc

SEQ ID NO: 105252 - DNA, 25 bp, mus musculus
cacatacagatgtcttaccatgaga

SEQ ID NO: 105253 - DNA, 25 bp, mus musculus
catacagatgtcttaccatgagagt

SEQ ID NO: 105254 - DNA, 25 bp, mus musculus
tacagatgtcttaccatgagagtct

SEQ ID NO: 105255 - DNA, 25 bp, mus musculus
cagatgtcttaccatgagagtctct

SEQ ID NO: 105256 - DNA, 25 bp, mus musculus
gatgtcttaccatgagagtctctca

SEQ ID NO: 105257 - DNA, 25 bp, mus musculus
tgtcttaccatgagagtctctcagt

SEQ ID NO: 105258 - DNA, 25 bp, mus musculus
tcttaccatgagagtctctcagtgg

SEQ ID NO: 105259 - DNA, 25 bp, mus musculus
catgagagtctctcagtggtctcta

SEQ ID NO: 105260 - DNA, 25 bp, mus musculus
tgagagtctctcagtggtctctaca

SEQ ID NO: 105261 - DNA, 25 bp, mus musculus
atctgatactgcactgcaagaggat

SEQ ID NO: 105262 - DNA, 25 bp, mus musculus
gacagactacgaccgctaacgttat

SEQ ID NO: 105263 - DNA, 25 bp, mus musculus
ctacgaccgctaacgttatccacat

SEQ ID NO: 105264 - DNA, 25 bp, mus musculus
gaccgctaacgttatccacatacag

SEQ ID NO: 105265 - DNA, 25 bp, mus musculus
ccgctaacgttatccacatacagat

SEQ ID NO: 105266 - DNA, 25 bp, mus musculus
gctaacgttatccacatacagatgt

SEQ ID NO: 105267 - DNA, 25 bp, mus musculus
taacgttatccacatacagatgtct

SEQ ID NO: 105268 - DNA, 25 bp, mus musculus
acgttatccacatacagatgtctta

SEQ ID NO: 105269 - DNA, 25 bp, mus musculus
tgttgccattttgctgagcatagtt

SEQ ID NO: 105270 - DNA, 25 bp, mus musculus
cattttgctgagcatagttggctca

SEQ ID NO: 105271 - DNA, 25 bp, mus musculus
tgctggtctgtatgccggatagttg

SEQ ID NO: 105272 - DNA, 25 bp, mus musculus
atagttgctctgcctgggccggctg

SEQ ID NO: 105273 - DNA, 25 bp, mus musculus
ccagcccttgaccacatcagtgttt

SEQ ID NO: 105274 - DNA, 25 bp, mus musculus
cttgaccacatcagtgttttctcag

SEQ ID NO: 105275 - DNA, 25 bp, mus musculus
agtgttttctcagaagggcacatgg

SEQ ID NO: 105276 - DNA, 25 bp, mus musculus
ttctcagaagggcacatggcctcag

SEQ ID NO: 105277 - DNA, 25 bp, mus musculus
cacatggcctcagcctttgccctaa

SEQ ID NO: 105278 - DNA, 25 bp, mus musculus
aggctaccctcactgtacaaggcct

SEQ ID NO: 105279 - DNA, 25 bp, mus musculus
ccctcactgtacaaggcctcgttgt

SEQ ID NO: 105280 - DNA, 25 bp, mus musculus
ctgtacaaggcctcgttgtcctgga

SEQ ID NO: 105281 - DNA, 25 bp, mus musculus
attgtcattgtcatctgtggctgtc

SEQ ID NO: 105282 - DNA, 25 bp, mus musculus
attgtcatctgtggctgtcctgtca

SEQ ID NO: 105283 - DNA, 25 bp, mus musculus
ggctgtcctgtcacctttcttcaag

SEQ ID NO: 105284 - DNA, 25 bp, mus musculus
acctttcttcaagtgtcctgtgcag

SEQ ID NO: 105285 - DNA, 25 bp, mus musculus
gctgccatgctgcacttaatgaggg

SEQ ID NO: 105286 - DNA, 25 bp, mus musculus
atgctgcacttaatgagggcagctg

SEQ ID NO: 105287 - DNA, 25 bp, mus musculus
gtcccctatccatgctggtctgtat

SEQ ID NO: 105288 - DNA, 25 bp, mus musculus
tatccatgctggtctgtatgccgga

SEQ ID NO: 105289 - DNA, 25 bp, mus musculus
tcttccttgggtacatatcgttatg

SEQ ID NO: 105290 - DNA, 25 bp, mus musculus
cgttatggagactcctcttgagaag

SEQ ID NO: 105291 - DNA, 25 bp, mus musculus
ggagtactctgtgttcctgaccacg

SEQ ID NO: 105292 - DNA, 25 bp, mus musculus
gtactctgtgttcctgaccacgctg

SEQ ID NO: 105293 - DNA, 25 bp, mus musculus
ctctgtgttcctgaccacgctgtgc

SEQ ID NO: 105294 - DNA, 25 bp, mus musculus
tgtgttcctgaccacgctgtgcatg

SEQ ID NO: 105295 - DNA, 25 bp, mus musculus
gttcctgaccacgctgtgcatggcc

SEQ ID NO: 105296 - DNA, 25 bp, mus musculus
cctgaccacgctgtgcatggcctac

SEQ ID NO: 105297 - DNA, 25 bp, mus musculus
gaccacgctgtgcatggcctacaat

SEQ ID NO: 105298 - DNA, 25 bp, mus musculus
gctgtgcatggcctacaatgacttc

SEQ ID NO: 105299 - DNA, 25 bp, mus musculus
ggcctacaatgacttcttcctagag

SEQ ID NO: 105300 - DNA, 25 bp, mus musculus
ctacaatgacttcttcctagaggac

SEQ ID NO: 105301 - DNA, 25 bp, mus musculus
tatggagactcctcttgagaaggca

SEQ ID NO: 105302 - DNA, 25 bp, mus musculus
caatgacttcttcctagaggacaac

SEQ ID NO: 105303 - DNA, 25 bp, mus musculus
ggagactcctcttgagaaggcactg

SEQ ID NO: 105304 - DNA, 25 bp, mus musculus
gactcctcttgagaaggcactgacc

SEQ ID NO: 105305 - DNA, 25 bp, mus musculus
tcctcttgagaaggcactgaccacc

SEQ ID NO: 105306 - DNA, 25 bp, mus musculus
caccatggtcaccactttccataaa

SEQ ID NO: 105307 - DNA, 25 bp, mus musculus
catggtcaccactttccataaatat

SEQ ID NO: 105308 - DNA, 25 bp, mus musculus
tagcaagctgaccctgagtaggaaa

SEQ ID NO: 105309 - DNA, 25 bp, mus musculus
caagctgaccctgagtaggaaagaa

SEQ ID NO: 105310 - DNA, 25 bp, mus musculus
caagttcctctggccaggctttggc

SEQ ID NO: 105311 - DNA, 25 bp, mus musculus
aagttcctctggccaggctttggcg

SEQ ID NO: 105312 - DNA, 25 bp, mus musculus
cgcccatcggctacatccctaagga

SEQ ID NO: 105313 - DNA, 25 bp, mus musculus
gcccatcggctacatccctaaggaa

SEQ ID NO: 105314 - DNA, 25 bp, mus musculus
tgtttgggatctctaaggagttctg

SEQ ID NO: 105315 - DNA, 25 bp, mus musculus
ggatctctaaggagttctgggagaa

SEQ ID NO: 105316 - DNA, 25 bp, mus musculus
gatctctaaggagttctgggagaag

SEQ ID NO: 105317 - DNA, 25 bp, mus musculus
atctctaaggagttctgggagaagg

SEQ ID NO: 105318 - DNA, 25 bp, mus musculus
tctctaaggagttctgggagaagga

SEQ ID NO: 105319 - DNA, 25 bp, mus musculus
agatcgacaggtatctggaggacca

SEQ ID NO: 105320 - DNA, 25 bp, mus musculus
gatcgacaggtatctggaggaccag

SEQ ID NO: 105321 - DNA, 25 bp, mus musculus
tcccttacgaaattgagagggagct

SEQ ID NO: 105322 - DNA, 25 bp, mus musculus
agttcctctggccaggctttggcga

SEQ ID NO: 105323 - DNA, 25 bp, mus musculus
tggccaggctttggcgagaactccc

SEQ ID NO: 105324 - DNA, 25 bp, mus musculus
gctttggcgagaactcccgggtgct

SEQ ID NO: 105325 - DNA, 25 bp, mus musculus
ctttggcgagaactcccgggtgctg

SEQ ID NO: 105326 - DNA, 25 bp, mus musculus
tttggcgagaactcccgggtgctgg

SEQ ID NO: 105327 - DNA, 25 bp, mus musculus
ttggcgagaactcccgggtgctgga

SEQ ID NO: 105328 - DNA, 25 bp, mus musculus
agaactcccgggtgctggagtggat

SEQ ID NO: 105329 - DNA, 25 bp, mus musculus
acgcccatcggctacatccctaagg

SEQ ID NO: 105330 - DNA, 25 bp, mus musculus
atgaccacaacctgcagtatcttca

SEQ ID NO: 105331 - DNA, 25 bp, mus musculus
tgcagtatcttcaggacgagaacgg

SEQ ID NO: 105332 - DNA, 25 bp, mus musculus
agataagccccaaagaaatgaccat

SEQ ID NO: 105333 - DNA, 25 bp, mus musculus
ctggaaaatcactctttaagaccag

SEQ ID NO: 105334 - DNA, 25 bp, mus musculus
tctttaagaccagcctcccaaggag

SEQ ID NO: 105335 - DNA, 25 bp, mus musculus
gacccagaccctgaacaccacgaga

SEQ ID NO: 105336 - DNA, 25 bp, mus musculus
gaccctgaacaccacgagagtcctg

SEQ ID NO: 105337 - DNA, 25 bp, mus musculus
gacctcactcacggcagcttctctg

SEQ ID NO: 105338 - DNA, 25 bp, mus musculus
ggcagcttctctgccctggtactct

SEQ ID NO: 105339 - DNA, 25 bp, mus musculus
ctttcctttcagtcaagtcttactg

SEQ ID NO: 105340 - DNA, 25 bp, mus musculus
tttcagtcaagtcttactgtcactg

SEQ ID NO: 105341 - DNA, 25 bp, mus musculus
tcaagtcttactgtcactgctattc

SEQ ID NO: 105342 - DNA, 25 bp, mus musculus
ccggcaacttcatggatccctctgt

SEQ ID NO: 105343 - DNA, 25 bp, mus musculus
ttactgtcactgctattcaataaaa

SEQ ID NO: 105344 - DNA, 25 bp, mus musculus
acttcatggatccctctgtgcgaca

SEQ ID NO: 105345 - DNA, 25 bp, mus musculus
tggatccctctgtgcgacatcaacg

SEQ ID NO: 105346 - DNA, 25 bp, mus musculus
cctctgtgcgacatcaacgaaaggt

SEQ ID NO: 105347 - DNA, 25 bp, mus musculus
acggctacttgcggtttcactatgg

SEQ ID NO: 105348 - DNA, 25 bp, mus musculus
ggtttcactatggatctgaggactc

SEQ ID NO: 105349 - DNA, 25 bp, mus musculus
aggactccctgggcggcttcacaca

SEQ ID NO: 105350 - DNA, 25 bp, mus musculus
gcggcttcacacatgtggagataag

SEQ ID NO: 105351 - DNA, 25 bp, mus musculus
aagacacccatgggaaacagagtgt

SEQ ID NO: 105352 - DNA, 25 bp, mus musculus
gcagtcctgtgcaaaccgtgggtct

SEQ ID NO: 105353 - DNA, 25 bp, mus musculus
cacctagcgggactgttgctgccag

SEQ ID NO: 105354 - DNA, 25 bp, mus musculus
cgtctcagatccctacgccagtgag

SEQ ID NO: 105355 - DNA, 25 bp, mus musculus
agatccctacgccagtgagcaccaa

SEQ ID NO: 105356 - DNA, 25 bp, mus musculus
ctacgccagtgagcaccaacacgaa

SEQ ID NO: 105357 - DNA, 25 bp, mus musculus
cgccagtgagcaccaacacgaagaa

SEQ ID NO: 105358 - DNA, 25 bp, mus musculus
cagtgagcaccaacacgaagaagag

SEQ ID NO: 105359 - DNA, 25 bp, mus musculus
tgagcaccaacacgaagaagagaga

SEQ ID NO: 105360 - DNA, 25 bp, mus musculus
gcaccaacacgaagaagagagattc

SEQ ID NO: 105361 - DNA, 25 bp, mus musculus
tcacagaatccagtggagcccaaag

SEQ ID NO: 105362 - DNA, 25 bp, mus musculus
cagaatccagtggagcccaaagtcc

SEQ ID NO: 105363 - DNA, 25 bp, mus musculus
tcaactcctttgttcaggtagaggc

SEQ ID NO: 105364 - DNA, 25 bp, mus musculus
gacagagtaacccagtctctatagc

SEQ ID NO: 105365 - DNA, 25 bp, mus musculus
gtaacccagtctctatagcagagac

SEQ ID NO: 105366 - DNA, 25 bp, mus musculus
acccagtctctatagcagagactgc

SEQ ID NO: 105367 - DNA, 25 bp, mus musculus
ccagcaagcacagctcacctagcgg

SEQ ID NO: 105368 - DNA, 25 bp, mus musculus
agcacagctcacctagcgggactgt

SEQ ID NO: 105369 - DNA, 25 bp, mus musculus
acagctcacctagcgggactgttgc

SEQ ID NO: 105370 - DNA, 25 bp, mus musculus
gctcacctagcgggactgttgctgc

SEQ ID NO: 105371 - DNA, 25 bp, mus musculus
gtcagatatccagcgggatgaactg

SEQ ID NO: 105372 - DNA, 25 bp, mus musculus
agatatccagcgggatgaactggct

SEQ ID NO: 105373 - DNA, 25 bp, mus musculus
ttcagctgagccctactgcccttct

SEQ ID NO: 105374 - DNA, 25 bp, mus musculus
tttattgctccttaaggtgacctgg

SEQ ID NO: 105375 - DNA, 25 bp, mus musculus
taaggtgacctgggtcccaggtatg

SEQ ID NO: 105376 - DNA, 25 bp, mus musculus
gacctgggtcccaggtatgtatgtc

SEQ ID NO: 105377 - DNA, 25 bp, mus musculus
ctgggtcccaggtatgtatgtcact

SEQ ID NO: 105378 - DNA, 25 bp, mus musculus
tatgtatgtcactccctggaattca

SEQ ID NO: 105379 - DNA, 25 bp, mus musculus
gtatgtcactccctggaattcacca

SEQ ID NO: 105380 - DNA, 25 bp, mus musculus
tccctggaattcaccatcccacgtt

SEQ ID NO: 105381 - DNA, 25 bp, mus musculus
ctggaattcaccatcccacgtttct

SEQ ID NO: 105382 - DNA, 25 bp, mus musculus
ttcactaacatcccaataaactcct

SEQ ID NO: 105383 - DNA, 25 bp, mus musculus
tatccagcgggatgaactggctcct

SEQ ID NO: 105384 - DNA, 25 bp, mus musculus
ggatgaactggctccttccgggact

SEQ ID NO: 105385 - DNA, 25 bp, mus musculus
tgaactggctccttccgggactgga

SEQ ID NO: 105386 - DNA, 25 bp, mus musculus
gtcccgagaggccttgtcaggtctg

SEQ ID NO: 105387 - DNA, 25 bp, mus musculus
agaggccttgtcaggtctgctgatc

SEQ ID NO: 105388 - DNA, 25 bp, mus musculus
ggccttgtcaggtctgctgatcatg

SEQ ID NO: 105389 - DNA, 25 bp, mus musculus
aggtctgctgatcatgggagctgga

SEQ ID NO: 105390 - DNA, 25 bp, mus musculus
gctgccttcagctgagccctactgc

SEQ ID NO: 105391 - DNA, 25 bp, mus musculus
ggtggaccagcttgtggagatcatc

SEQ ID NO: 105392 - DNA, 25 bp, mus musculus
gagatgaaccctaactatacggagt

SEQ ID NO: 105393 - DNA, 25 bp, mus musculus
attgcactctgctctagcctactgg

SEQ ID NO: 105394 - DNA, 25 bp, mus musculus
ctctgctctagcctactggagtaca

SEQ ID NO: 105395 - DNA, 25 bp, mus musculus
tgctctagcctactggagtacacgc

SEQ ID NO: 105396 - DNA, 25 bp, mus musculus
ctactggagtacacgccatcctcaa

SEQ ID NO: 105397 - DNA, 25 bp, mus musculus
ctggagtacacgccatcctcaaggc

SEQ ID NO: 105398 - DNA, 25 bp, mus musculus
gagtacacgccatcctcaaggctct

SEQ ID NO: 105399 - DNA, 25 bp, mus musculus
cacagcttcttcgatgaactgcgga

SEQ ID NO: 105400 - DNA, 25 bp, mus musculus
agcttcttcgatgaactgcggagac

SEQ ID NO: 105401 - DNA, 25 bp, mus musculus
gatgaactgcggagactcggagccc

SEQ ID NO: 105402 - DNA, 25 bp, mus musculus
gaactgcggagactcggagcccagc

SEQ ID NO: 105403 - DNA, 25 bp, mus musculus
gagttcaagttcccccagatcaaag

SEQ ID NO: 105404 - DNA, 25 bp, mus musculus
ttcaagttcccccagatcaaagctc

SEQ ID NO: 105405 - DNA, 25 bp, mus musculus
ttcaaatcttcaaagacaccacctg

SEQ ID NO: 105406 - DNA, 25 bp, mus musculus
aaatcttcaaagacaccacctgagg

SEQ ID NO: 105407 - DNA, 25 bp, mus musculus
tcttcaaagacaccacctgaggcca

SEQ ID NO: 105408 - DNA, 25 bp, mus musculus
acaccacctgaggccattgcactct

SEQ ID NO: 105409 - DNA, 25 bp, mus musculus
ccacctgaggccattgcactctgct

SEQ ID NO: 105410 - DNA, 25 bp, mus musculus
gaggccattgcactctgctctagcc

SEQ ID NO: 105411 - DNA, 25 bp, mus musculus
ttcggcacgtaggggcttgtgcaca

SEQ ID NO: 105412 - DNA, 25 bp, mus musculus
cttgtgcacagcgcacgtcatgtga

SEQ ID NO: 105413 - DNA, 25 bp, mus musculus
gcacacagggcactggtagggcttc

SEQ ID NO: 105414 - DNA, 25 bp, mus musculus
cttctcgtccgaatgcgacacgtta

SEQ ID NO: 105415 - DNA, 25 bp, mus musculus
gtccgaatgcgacacgttatgtcgg

SEQ ID NO: 105416 - DNA, 25 bp, mus musculus
atgcgacacgttatgtcggttcagg

SEQ ID NO: 105417 - DNA, 25 bp, mus musculus
gaaggccttgccgcacatctcgcag

SEQ ID NO: 105418 - DNA, 25 bp, mus musculus
ggccttgccgcacatctcgcaggcg

SEQ ID NO: 105419 - DNA, 25 bp, mus musculus
catctcgcaggcgtgattcttccgg

SEQ ID NO: 105420 - DNA, 25 bp, mus musculus
cttccggatgcgcttcccagaggca

SEQ ID NO: 105421 - DNA, 25 bp, mus musculus
gatgcgcttcccagaggcagtcgtg

SEQ ID NO: 105422 - DNA, 25 bp, mus musculus
cccagaggcagtcgtggtcacaacg

SEQ ID NO: 105423 - DNA, 25 bp, mus musculus
cacagcgcacgtcatgtgagcgcac

SEQ ID NO: 105424 - DNA, 25 bp, mus musculus
agcgcacgtcatgtgagcgcacgtg

SEQ ID NO: 105425 - DNA, 25 bp, mus musculus
gcacgtcatgtgagcgcacgtggta

SEQ ID NO: 105426 - DNA, 25 bp, mus musculus
agcgcacgtggtaactcatgcggtc

SEQ ID NO: 105427 - DNA, 25 bp, mus musculus
aactcatgcggtccttgcgcttgaa

SEQ ID NO: 105428 - DNA, 25 bp, mus musculus
ggtccttgcgcttgaagcgtgctgg

SEQ ID NO: 105429 - DNA, 25 bp, mus musculus
gcttgaagcgtgctggcacacaggg

SEQ ID NO: 105430 - DNA, 25 bp, mus musculus
ctggcacacagggcactggtagggc

SEQ ID NO: 105431 - DNA, 25 bp, mus musculus
cagtgtatctcggagctgggtattt

SEQ ID NO: 105432 - DNA, 25 bp, mus musculus
cacctgcttcgaaccaaagccgtgg

SEQ ID NO: 105433 - DNA, 25 bp, mus musculus
atagacctccaaagcttcagggaag

SEQ ID NO: 105434 - DNA, 25 bp, mus musculus
cagcagccttccagccgaggaccag

SEQ ID NO: 105435 - DNA, 25 bp, mus musculus
ttccattagaagacttctggaggtc

SEQ ID NO: 105436 - DNA, 25 bp, mus musculus
acttctggaggtccccagatctttg

SEQ ID NO: 105437 - DNA, 25 bp, mus musculus
ccccagatctttggagtgtgggaat

SEQ ID NO: 105438 - DNA, 25 bp, mus musculus
aaaggctcataaaccctgcaagtct

SEQ ID NO: 105439 - DNA, 25 bp, mus musculus
tcataaaccctgcaagtcttcatgg

SEQ ID NO: 105440 - DNA, 25 bp, mus musculus
caagtcttcatggtcttctcaccag

SEQ ID NO: 105441 - DNA, 25 bp, mus musculus
ttcatggtcttctcaccagcctttc

SEQ ID NO: 105442 - DNA, 25 bp, mus musculus
tcaccagcctttccagcaggttcta

SEQ ID NO: 105443 - DNA, 25 bp, mus musculus
accaaagccgtggagcatgcagacg

SEQ ID NO: 105444 - DNA, 25 bp, mus musculus
ctggacttcactcaggaggccttct

SEQ ID NO: 105445 - DNA, 25 bp, mus musculus
ttcactcaggaggccttctatcccc

SEQ ID NO: 105446 - DNA, 25 bp, mus musculus
ctgtacttggcactcctcttctgag

SEQ ID NO: 105447 - DNA, 25 bp, mus musculus
ttggcactcctcttctgaggggttg

SEQ ID NO: 105448 - DNA, 25 bp, mus musculus
ctcctcttctgaggggttgcccctg

SEQ ID NO: 105449 - DNA, 25 bp, mus musculus
gtccctatcttaggggagcttgtct

SEQ ID NO: 105450 - DNA, 25 bp, mus musculus
tcttccatagacctccaaagcttca

SEQ ID NO: 105451 - DNA, 25 bp, mus musculus
ggacaacgcaagttccaggcgcaga

SEQ ID NO: 105452 - DNA, 25 bp, mus musculus
cgcaagttccaggcgcagaaaccta

SEQ ID NO: 105453 - DNA, 25 bp, mus musculus
gtaatgaaggccagctccagcctgc

SEQ ID NO: 105454 - DNA, 25 bp, mus musculus
agctccagcctgcctaagaggcttg

SEQ ID NO: 105455 - DNA, 25 bp, mus musculus
tccagcctgcctaagaggcttgcac

SEQ ID NO: 105456 - DNA, 25 bp, mus musculus
agcctgcctaagaggcttgcactgc

SEQ ID NO: 105457 - DNA, 25 bp, mus musculus
aggcttgcactgctgaagggagcat

SEQ ID NO: 105458 - DNA, 25 bp, mus musculus
cttgcactgctgaagggagcatcaa

SEQ ID NO: 105459 - DNA, 25 bp, mus musculus
aaatcagaagccaccatccctggca

SEQ ID NO: 105460 - DNA, 25 bp, mus musculus
atccctggcaagacaccatcctgaa

SEQ ID NO: 105461 - DNA, 25 bp, mus musculus
cctggcaagacaccatcctgaaggc

SEQ ID NO: 105462 - DNA, 25 bp, mus musculus
ggcaagacaccatcctgaaggcact

SEQ ID NO: 105463 - DNA, 25 bp, mus musculus
ttccaggcgcagaaacctaaaagca

SEQ ID NO: 105464 - DNA, 25 bp, mus musculus
cctcggaaaggcggtcgagtcatcg

SEQ ID NO: 105465 - DNA, 25 bp, mus musculus
ggtcgagtcatcgctcccaagaagg

SEQ ID NO: 105466 - DNA, 25 bp, mus musculus
cgagtcatcgctcccaagaaggcgc

SEQ ID NO: 105467 - DNA, 25 bp, mus musculus
atcgctcccaagaaggcgcgcgttg

SEQ ID NO: 105468 - DNA, 25 bp, mus musculus
gctcccaagaaggcgcgcgttgttc

SEQ ID NO: 105469 - DNA, 25 bp, mus musculus
aaggcgcgcgttgttcagcagcaga

SEQ ID NO: 105470 - DNA, 25 bp, mus musculus
cgcgttgttcagcagcagaagttga

SEQ ID NO: 105471 - DNA, 25 bp, mus musculus
aataggttccctcacagggctcttg

SEQ ID NO: 105472 - DNA, 25 bp, mus musculus
taggttccctcacagggctcttgtc

SEQ ID NO: 105473 - DNA, 25 bp, mus musculus
tctgtagcggcctcggaatcttcta

SEQ ID NO: 105474 - DNA, 25 bp, mus musculus
tgtagcggcctcggaatcttctatc

SEQ ID NO: 105475 - DNA, 25 bp, mus musculus
tagcggcctcggaatcttctatccc

SEQ ID NO: 105476 - DNA, 25 bp, mus musculus
ggcctcggaatcttctatcccgact

SEQ ID NO: 105477 - DNA, 25 bp, mus musculus
cctcggaatcttctatcccgactgc

SEQ ID NO: 105478 - DNA, 25 bp, mus musculus
tcggaatcttctatcccgactgcgt

SEQ ID NO: 105479 - DNA, 25 bp, mus musculus
ggaatcttctatcccgactgcgtga

SEQ ID NO: 105480 - DNA, 25 bp, mus musculus
atcccgactgcgtgacgggcttcgt

SEQ ID NO: 105481 - DNA, 25 bp, mus musculus
cgactgcgtgacgggcttcgtctcc

SEQ ID NO: 105482 - DNA, 25 bp, mus musculus
actgcgtgacgggcttcgtctcctt

SEQ ID NO: 105483 - DNA, 25 bp, mus musculus
gctcttgtctttcctaaatggactt

SEQ ID NO: 105484 - DNA, 25 bp, mus musculus
gaggcaatccaatctttcctcggat

SEQ ID NO: 105485 - DNA, 25 bp, mus musculus
ggcaatccaatctttcctcggatgg

SEQ ID NO: 105486 - DNA, 25 bp, mus musculus
atccaatctttcctcggatggcact

SEQ ID NO: 105487 - DNA, 25 bp, mus musculus
ccaatctttcctcggatggcactgt

SEQ ID NO: 105488 - DNA, 25 bp, mus musculus
aatctttcctcggatggcactgtta

SEQ ID NO: 105489 - DNA, 25 bp, mus musculus
tctttcctcggatggcactgttaaa

SEQ ID NO: 105490 - DNA, 25 bp, mus musculus
cttctgtagcggcctcggaatcttc

SEQ ID NO: 105491 - DNA, 25 bp, mus musculus
tctgcaggctgagctggaaatccag

SEQ ID NO: 105492 - DNA, 25 bp, mus musculus
tgccttggaacccgggcagagagtg

SEQ ID NO: 105493 - DNA, 25 bp, mus musculus
ggctaggacctataccattcttctc

SEQ ID NO: 105494 - DNA, 25 bp, mus musculus
gacctataccattcttctctctcct

SEQ ID NO: 105495 - DNA, 25 bp, mus musculus
taccattcttctctctcctccagta

SEQ ID NO: 105496 - DNA, 25 bp, mus musculus
tcccagcagcactaggaactgcttg

SEQ ID NO: 105497 - DNA, 25 bp, mus musculus
tcagcctaggcgcctaagtgacctt

SEQ ID NO: 105498 - DNA, 25 bp, mus musculus
cctaagtgacctttgtgagctaccg

SEQ ID NO: 105499 - DNA, 25 bp, mus musculus
gctaccggccgcccttttgtgagtg

SEQ ID NO: 105500 - DNA, 25 bp, mus musculus
gttatcactcattcctttggtcagc

SEQ ID NO: 105501 - DNA, 25 bp, mus musculus
tcccacacaccctggagcatagcag

SEQ ID NO: 105502 - DNA, 25 bp, mus musculus
atagcagagctgtgctactggagat

SEQ ID NO: 105503 - DNA, 25 bp, mus musculus
agacaaacagacttcaaagggccag

SEQ ID NO: 105504 - DNA, 25 bp, mus musculus
caataaaccgttttgatatgcatgc

SEQ ID NO: 105505 - DNA, 25 bp, mus musculus
ttcaaagggccagaccctgtcctgg

SEQ ID NO: 105506 - DNA, 25 bp, mus musculus
gaccctgtcctgggtgctgactaag

SEQ ID NO: 105507 - DNA, 25 bp, mus musculus
agcttgaacacctcctctttctctg

SEQ ID NO: 105508 - DNA, 25 bp, mus musculus
ccatgtttgcggcctgtgacctgct

SEQ ID NO: 105509 - DNA, 25 bp, mus musculus
ttgcggcctgtgacctgctgcacca

SEQ ID NO: 105510 - DNA, 25 bp, mus musculus
acctgctgcaccagctccgggctga

SEQ ID NO: 105511 - DNA, 25 bp, mus musculus
tgcaccagctccgggctgaagtggt

SEQ ID NO: 105512 - DNA, 25 bp, mus musculus
tacagccacattggcagccgtgacc

SEQ ID NO: 105513 - DNA, 25 bp, mus musculus
ggcagccgtgaccagatcatcttta

SEQ ID NO: 105514 - DNA, 25 bp, mus musculus
caccagggagccaatttcagcatac

SEQ ID NO: 105515 - DNA, 25 bp, mus musculus
aatttcagcataccatgccaaggca

SEQ ID NO: 105516 - DNA, 25 bp, mus musculus
agcataccatgccaaggcacaccga

SEQ ID NO: 105517 - DNA, 25 bp, mus musculus
cagccaataactgttctgcctctgc

SEQ ID NO: 105518 - DNA, 25 bp, mus musculus
ataactgttctgcctctgccttgat

SEQ ID NO: 105519 - DNA, 25 bp, mus musculus
gttctgcctctgccttgatactgcc

SEQ ID NO: 105520 - DNA, 25 bp, mus musculus
cctctgccttgatactgcctcagga

SEQ ID NO: 105521 - DNA, 25 bp, mus musculus
tactgcctcaggattccctatccca

SEQ ID NO: 105522 - DNA, 25 bp, mus musculus
ttttatctccaatggctgtgactca

SEQ ID NO: 105523 - DNA, 25 bp, mus musculus
ctccaatggctgtgactcagtgcaa

SEQ ID NO: 105524 - DNA, 25 bp, mus musculus
cgtgaccagatcatctttatggtgg

SEQ ID NO: 105525 - DNA, 25 bp, mus musculus
tggctgtgactcagtgcaaggattc

SEQ ID NO: 105526 - DNA, 25 bp, mus musculus
cagatcatctttatggtgggccgtg

SEQ ID NO: 105527 - DNA, 25 bp, mus musculus
ctcagcaaaatcttcagtaattgcc

SEQ ID NO: 105528 - DNA, 25 bp, mus musculus
ttcagtaattgccccaaagccatga

SEQ ID NO: 105529 - DNA, 25 bp, mus musculus
attctggccacgatcgagctactgc

SEQ ID NO: 105530 - DNA, 25 bp, mus musculus
gccacgatcgagctactgcagcggt

SEQ ID NO: 105531 - DNA, 25 bp, mus musculus
atcgagctactgcagcggtcactcc

SEQ ID NO: 105532 - DNA, 25 bp, mus musculus
gagttgcctgcttgccttctcagcg

SEQ ID NO: 105533 - DNA, 25 bp, mus musculus
ctctttttacggcatatgccgtgaa

SEQ ID NO: 105534 - DNA, 25 bp, mus musculus
atggcaagtcaccatggcagtgggg

SEQ ID NO: 105535 - DNA, 25 bp, mus musculus
tcttcccgcagccctttggtgtgaa

SEQ ID NO: 105536 - DNA, 25 bp, mus musculus
cgcagccctttggtgtgaaggaaag

SEQ ID NO: 105537 - DNA, 25 bp, mus musculus
agttctacatcgacgtgagctactc

SEQ ID NO: 105538 - DNA, 25 bp, mus musculus
acgatgcccccatgattgcctacga

SEQ ID NO: 105539 - DNA, 25 bp, mus musculus
tcgcacacagagccttcttccacgg

SEQ ID NO: 105540 - DNA, 25 bp, mus musculus
acagtgattccacggccgccattgc

SEQ ID NO: 105541 - DNA, 25 bp, mus musculus
attccacggccgccattgctggctg

SEQ ID NO: 105542 - DNA, 25 bp, mus musculus
ccaactacgagaagctcgaataccg

SEQ ID NO: 105543 - DNA, 25 bp, mus musculus
gagctttgtattctctcgggtcaaa

SEQ ID NO: 105544 - DNA, 25 bp, mus musculus
tgtattctctcgggtcaaaagaaga

SEQ ID NO: 105545 - DNA, 25 bp, mus musculus
agtcaccatggcagtggggaaaagg

SEQ ID NO: 105546 - DNA, 25 bp, mus musculus
tgctgcctgaagccaaaaagtacat

SEQ ID NO: 105547 - DNA, 25 bp, mus musculus
ccaaaaagtacatcactcagtcagg

SEQ ID NO: 105548 - DNA, 25 bp, mus musculus
agtacatcactcagtcaggctactt

SEQ ID NO: 105549 - DNA, 25 bp, mus musculus
tcactcagtcaggctactttgtgaa

SEQ ID NO: 105550 - DNA, 25 bp, mus musculus
agtcaggctactttgtgaaggagaa

SEQ ID NO: 105551 - DNA, 25 bp, mus musculus
aggagaatcttcaacactggtccta

SEQ ID NO: 105552 - DNA, 25 bp, mus musculus
atcttcaacactggtcctacttcga

SEQ ID NO: 105553 - DNA, 25 bp, mus musculus
ggtttctggatgcctgcgaaaaagg

SEQ ID NO: 105554 - DNA, 25 bp, mus musculus
ttctggatgcctgcgaaaaaggccc

SEQ ID NO: 105555 - DNA, 25 bp, mus musculus
aaatctctttcatccgagctggaga

SEQ ID NO: 105556 - DNA, 25 bp, mus musculus
gtgctcttaaacaagccttggcaaa

SEQ ID NO: 105557 - DNA, 25 bp, mus musculus
ttaaacaagccttggcaaatggcac

SEQ ID NO: 105558 - DNA, 25 bp, mus musculus
ttattgagcctattatgtctgtgga

SEQ ID NO: 105559 - DNA, 25 bp, mus musculus
ttgagcctattatgtctgtggaagt

SEQ ID NO: 105560 - DNA, 25 bp, mus musculus
agcctattatgtctgtggaagttat

SEQ ID NO: 105561 - DNA, 25 bp, mus musculus
ttatagcccccaatgaattccaggg

SEQ ID NO: 105562 - DNA, 25 bp, mus musculus
tgttcgcagggattaaccggcggca

SEQ ID NO: 105563 - DNA, 25 bp, mus musculus
ggattaaccggcggcatggagtgat

SEQ ID NO: 105564 - DNA, 25 bp, mus musculus
ttaaccggcggcatggagtgattac

SEQ ID NO: 105565 - DNA, 25 bp, mus musculus
gccctctttctggtcacaagctttc

SEQ ID NO: 105566 - DNA, 25 bp, mus musculus
ctggtcacaagctttctgggctacg

SEQ ID NO: 105567 - DNA, 25 bp, mus musculus
gtcacaagctttctgggctacggtt

SEQ ID NO: 105568 - DNA, 25 bp, mus musculus
tttctgggctacggtttgttctgca

SEQ ID NO: 105569 - DNA, 25 bp, mus musculus
atggagcacaccacatggttgattc

SEQ ID NO: 105570 - DNA, 25 bp, mus musculus
gagcacaccacatggttgattcgaa

SEQ ID NO: 105571 - DNA, 25 bp, mus musculus
cacaccacatggttgattcgaatga

SEQ ID NO: 105572 - DNA, 25 bp, mus musculus
atgaaatctctttcatccgagctgg

SEQ ID NO: 105573 - DNA, 25 bp, mus musculus
ccagagatcgagcgcttcggggaac

SEQ ID NO: 105574 - DNA, 25 bp, mus musculus
gagatcgagcgcttcggggaacatg

SEQ ID NO: 105575 - DNA, 25 bp, mus musculus
cgtcttcaagtatgtgctgattcga

SEQ ID NO: 105576 - DNA, 25 bp, mus musculus
gctgattcgagtccacttagcagag

SEQ ID NO: 105577 - DNA, 25 bp, mus musculus
gattcgagtccacttagcagagcct

SEQ ID NO: 105578 - DNA, 25 bp, mus musculus
agtccacttagcagagccttctggg

SEQ ID NO: 105579 - DNA, 25 bp, mus musculus
agcagagccttctggggatccggcg

SEQ ID NO: 105580 - DNA, 25 bp, mus musculus
agagccttctggggatccggcgaag

SEQ ID NO: 105581 - DNA, 25 bp, mus musculus
tgagtaccacgcggacatctatgac

SEQ ID NO: 105582 - DNA, 25 bp, mus musculus
gtaccacgcggacatctatgacaaa

SEQ ID NO: 105583 - DNA, 25 bp, mus musculus
caaagtgtcaggcgagctgcaaagg

SEQ ID NO: 105584 - DNA, 25 bp, mus musculus
agtgtcaggcgagctgcaaaggaat

SEQ ID NO: 105585 - DNA, 25 bp, mus musculus
atcgagcgcttcggggaacatggcg

SEQ ID NO: 105586 - DNA, 25 bp, mus musculus
ggacctcggtcagattcctgatgta

SEQ ID NO: 105587 - DNA, 25 bp, mus musculus
cctcggtcagattcctgatgtagac

SEQ ID NO: 105588 - DNA, 25 bp, mus musculus
cggtcagattcctgatgtagacatt

SEQ ID NO: 105589 - DNA, 25 bp, mus musculus
gattcctgatgtagacattgattcg

SEQ ID NO: 105590 - DNA, 25 bp, mus musculus
cattgattcggatggcgtcttcaag

SEQ ID NO: 105591 - DNA, 25 bp, mus musculus
tgattcggatggcgtcttcaagtat

SEQ ID NO: 105592 - DNA, 25 bp, mus musculus
ttcggatggcgtcttcaagtatgtg

SEQ ID NO: 105593 - DNA, 25 bp, mus musculus
agttttggtaccactgatggtacag

SEQ ID NO: 105594 - DNA, 25 bp, mus musculus
gaggacactcagttacaggtggcag

SEQ ID NO: 105595 - DNA, 25 bp, mus musculus
ttttaaacactgctgttggtgattg

SEQ ID NO: 105596 - DNA, 25 bp, mus musculus
agtgttcaagccacctgtacaattg

SEQ ID NO: 105597 - DNA, 25 bp, mus musculus
caagccacctgtacaattggacttt

SEQ ID NO: 105598 - DNA, 25 bp, mus musculus
ttaatctttcccacacaagccagtt

SEQ ID NO: 105599 - DNA, 25 bp, mus musculus
ttgtgccagatacattccgccttcc

SEQ ID NO: 105600 - DNA, 25 bp, mus musculus
gccttcccagtattgcaggactgaa

SEQ ID NO: 105601 - DNA, 25 bp, mus musculus
tttctttcttcagagtctctgcaca

SEQ ID NO: 105602 - DNA, 25 bp, mus musculus
tcttcagagtctctgcacaaaaacg

SEQ ID NO: 105603 - DNA, 25 bp, mus musculus
gagtctctgcacaaaaacgcagctt

SEQ ID NO: 105604 - DNA, 25 bp, mus musculus
ctgcacaaaaacgcagcttgtaaat

SEQ ID NO: 105605 - DNA, 25 bp, mus musculus
ttacaggtggcagcatgaagtgaca

SEQ ID NO: 105606 - DNA, 25 bp, mus musculus
agtgacactgtgtgtcctactgcag

SEQ ID NO: 105607 - DNA, 25 bp, mus musculus
cctctgcactgaaatcaccctgcag

SEQ ID NO: 105608 - DNA, 25 bp, mus musculus
cactgaaatcaccctgcagcactac

SEQ ID NO: 105609 - DNA, 25 bp, mus musculus
aatcaccctgcagcactactgtgag

SEQ ID NO: 105610 - DNA, 25 bp, mus musculus
cctgcagcactactgtgagttgctt

SEQ ID NO: 105611 - DNA, 25 bp, mus musculus
tgctctgtgctgctacttgggcggc

SEQ ID NO: 105612 - DNA, 25 bp, mus musculus
gtgctgctacttgggcggcactgcc

SEQ ID NO: 105613 - DNA, 25 bp, mus musculus
gcccatgctcggccctacatggctt

SEQ ID NO: 105614 - DNA, 25 bp, mus musculus
catgctcggccctacatggcttccg

SEQ ID NO: 105615 - DNA, 25 bp, mus musculus
gtgctcagtgctgcacactgcatgg

SEQ ID NO: 105616 - DNA, 25 bp, mus musculus
agtgctgcacactgcatggatggag

SEQ ID NO: 105617 - DNA, 25 bp, mus musculus
gctgcacactgcatggatggagtga

SEQ ID NO: 105618 - DNA, 25 bp, mus musculus
gcacactgcatggatggagtgacgg

SEQ ID NO: 105619 - DNA, 25 bp, mus musculus
gatgacgactctgtgcaggtgctcc

SEQ ID NO: 105620 - DNA, 25 bp, mus musculus
gacgactctgtgcaggtgctcctgg

SEQ ID NO: 105621 - DNA, 25 bp, mus musculus
gactctgtgcaggtgctcctgggtg

SEQ ID NO: 105622 - DNA, 25 bp, mus musculus
tctgtgcaggtgctcctgggtgccc

SEQ ID NO: 105623 - DNA, 25 bp, mus musculus
accctacaagcgatggtatgatgtg

SEQ ID NO: 105624 - DNA, 25 bp, mus musculus
ccctacaagcgatggtatgatgtgc

SEQ ID NO: 105625 - DNA, 25 bp, mus musculus
cggccctacatggcttccgtgcaag

SEQ ID NO: 105626 - DNA, 25 bp, mus musculus
ccctacatggcttccgtgcaagtga

SEQ ID NO: 105627 - DNA, 25 bp, mus musculus
tacatggcttccgtgcaagtgaacg

SEQ ID NO: 105628 - DNA, 25 bp, mus musculus
atggcttccgtgcaagtgaacggca

SEQ ID NO: 105629 - DNA, 25 bp, mus musculus
caagtgaacggcacacacgtgtgcg

SEQ ID NO: 105630 - DNA, 25 bp, mus musculus
gtgaacggcacacacgtgtgcggtg

SEQ ID NO: 105631 - DNA, 25 bp, mus musculus
aacggcacacacgtgtgcggtggca

SEQ ID NO: 105632 - DNA, 25 bp, mus musculus
ggcacacacgtgtgcggtggcaccc

SEQ ID NO: 105633 - DNA, 25 bp, mus musculus
gtacctagctgtacacgtcctttat

SEQ ID NO: 105634 - DNA, 25 bp, mus musculus
agctgtacacgtcctttattagaga

SEQ ID NO: 105635 - DNA, 25 bp, mus musculus
ctgcgtgttgcctgactctgtacaa

SEQ ID NO: 105636 - DNA, 25 bp, mus musculus
gtctagtctcaaagatcagttggtc

SEQ ID NO: 105637 - DNA, 25 bp, mus musculus
tcagttggtctgaggagccggatgt

SEQ ID NO: 105638 - DNA, 25 bp, mus musculus
gttgtgtccctggtctggaacatta

SEQ ID NO: 105639 - DNA, 25 bp, mus musculus
gtgtccctggtctggaacattagtt

SEQ ID NO: 105640 - DNA, 25 bp, mus musculus
tttaaggcaactgtggccaatattt

SEQ ID NO: 105641 - DNA, 25 bp, mus musculus
atttatatcatgacatacaaatgga

SEQ ID NO: 105642 - DNA, 25 bp, mus musculus
aaacggtatttgctcttgtgatatg

SEQ ID NO: 105643 - DNA, 25 bp, mus musculus
tatttgctcttgtgatatgtggcac

SEQ ID NO: 105644 - DNA, 25 bp, mus musculus
ttgctcttgtgatatgtggcacatt

SEQ ID NO: 105645 - DNA, 25 bp, mus musculus
tgtacacgtcctttattagagatga

SEQ ID NO: 105646 - DNA, 25 bp, mus musculus
acacgtcctttattagagatgaccg

SEQ ID NO: 105647 - DNA, 25 bp, mus musculus
aagcagctgctgtttagctgacccc

SEQ ID NO: 105648 - DNA, 25 bp, mus musculus
tgtaatcaccttgccttcctctcta

SEQ ID NO: 105649 - DNA, 25 bp, mus musculus
tctagcattctgcaggagtgatgcc

SEQ ID NO: 105650 - DNA, 25 bp, mus musculus
agcattctgcaggagtgatgcccac

SEQ ID NO: 105651 - DNA, 25 bp, mus musculus
agccttgggcttctgcgtgttgcct

SEQ ID NO: 105652 - DNA, 25 bp, mus musculus
cttctgcgtgttgcctgactctgta

SEQ ID NO: 105653 - DNA, 25 bp, mus musculus
aagcgtctttacgcactacatcact

SEQ ID NO: 105654 - DNA, 25 bp, mus musculus
agcgtctttacgcactacatcacta

SEQ ID NO: 105655 - DNA, 25 bp, mus musculus
agccccttgcgcagtcactggatca

SEQ ID NO: 105656 - DNA, 25 bp, mus musculus
gccccttgcgcagtcactggatcac

SEQ ID NO: 105657 - DNA, 25 bp, mus musculus
cccttgcgcagtcactggatcacga

SEQ ID NO: 105658 - DNA, 25 bp, mus musculus
ccttgcgcagtcactggatcacgag

SEQ ID NO: 105659 - DNA, 25 bp, mus musculus
cttgcgcagtcactggatcacgagc

SEQ ID NO: 105660 - DNA, 25 bp, mus musculus
tgcgcagtcactggatcacgagctt

SEQ ID NO: 105661 - DNA, 25 bp, mus musculus
gcgcagtcactggatcacgagcttc

SEQ ID NO: 105662 - DNA, 25 bp, mus musculus
cgcagtcactggatcacgagcttcg

SEQ ID NO: 105663 - DNA, 25 bp, mus musculus
cagtcactggatcacgagcttcgtt

SEQ ID NO: 105664 - DNA, 25 bp, mus musculus
agtcactggatcacgagcttcgtta

SEQ ID NO: 105665 - DNA, 25 bp, mus musculus
gcgtctttacgcactacatcactat

SEQ ID NO: 105666 - DNA, 25 bp, mus musculus
gtctttacgcactacatcactatac

SEQ ID NO: 105667 - DNA, 25 bp, mus musculus
tctttacgcactacatcactataca

SEQ ID NO: 105668 - DNA, 25 bp, mus musculus
ctttacgcactacatcactatacag

SEQ ID NO: 105669 - DNA, 25 bp, mus musculus
ttacgcactacatcactatacagcg

SEQ ID NO: 105670 - DNA, 25 bp, mus musculus
tacgcactacatcactatacagcgc

SEQ ID NO: 105671 - DNA, 25 bp, mus musculus
atgtacgacacagtaaatggagggc

SEQ ID NO: 105672 - DNA, 25 bp, mus musculus
ctttgggaatgagccccttgcgcag

SEQ ID NO: 105673 - DNA, 25 bp, mus musculus
gtgccccaaatggccaaatccggat

SEQ ID NO: 105674 - DNA, 25 bp, mus musculus
tgccccaaatggccaaatccggata

SEQ ID NO: 105675 - DNA, 25 bp, mus musculus
gcccatgattgttcacgatgagcac

SEQ ID NO: 105676 - DNA, 25 bp, mus musculus
cccatgattgttcacgatgagcacg

SEQ ID NO: 105677 - DNA, 25 bp, mus musculus
gattgttcacgatgagcacggggga

SEQ ID NO: 105678 - DNA, 25 bp, mus musculus
ttttgtgctcttacaacccttatgc

SEQ ID NO: 105679 - DNA, 25 bp, mus musculus
ttgtgctcttacaacccttatgcac

SEQ ID NO: 105680 - DNA, 25 bp, mus musculus
ctcttacaacccttatgcaccaact

SEQ ID NO: 105681 - DNA, 25 bp, mus musculus
tcttacaacccttatgcaccaactc

SEQ ID NO: 105682 - DNA, 25 bp, mus musculus
cttacaacccttatgcaccaactcg

SEQ ID NO: 105683 - DNA, 25 bp, mus musculus
ttacaacccttatgcaccaactcgg

SEQ ID NO: 105684 - DNA, 25 bp, mus musculus
tacaacccttatgcaccaactcgga

SEQ ID NO: 105685 - DNA, 25 bp, mus musculus
aatggccaaatccggatagtcccat

SEQ ID NO: 105686 - DNA, 25 bp, mus musculus
atggccaaatccggatagtcccatt

SEQ ID NO: 105687 - DNA, 25 bp, mus musculus
tggccaaatccggatagtcccatta

SEQ ID NO: 105688 - DNA, 25 bp, mus musculus
ggccaaatccggatagtcccattag

SEQ ID NO: 105689 - DNA, 25 bp, mus musculus
gccaaatccggatagtcccattagt

SEQ ID NO: 105690 - DNA, 25 bp, mus musculus
tgggcccatgattgttcacgatgag

SEQ ID NO: 105691 - DNA, 25 bp, mus musculus
gggcccatgattgttcacgatgagc

SEQ ID NO: 105692 - DNA, 25 bp, mus musculus
ggcccatgattgttcacgatgagca

SEQ ID NO: 105693 - DNA, 25 bp, mus musculus
aatgactacacttagacactttgta

SEQ ID NO: 105694 - DNA, 25 bp, mus musculus
actacacttagacactttgtatctg

SEQ ID NO: 105695 - DNA, 25 bp, mus musculus
tgaacttttcacatatcagagtaac

SEQ ID NO: 105696 - DNA, 25 bp, mus musculus
cttttcacatatcagagtaacatat

SEQ ID NO: 105697 - DNA, 25 bp, mus musculus
atgaattgcataacccttggtaagg

SEQ ID NO: 105698 - DNA, 25 bp, mus musculus
attgcataacccttggtaaggtcag

SEQ ID NO: 105699 - DNA, 25 bp, mus musculus
tgcataacccttggtaaggtcagag

SEQ ID NO: 105700 - DNA, 25 bp, mus musculus
gtatatcctttttacttctacacat

SEQ ID NO: 105701 - DNA, 25 bp, mus musculus
atatcctttttacttctacacattg

SEQ ID NO: 105702 - DNA, 25 bp, mus musculus
tttttacttctacacattgtcctgg

SEQ ID NO: 105703 - DNA, 25 bp, mus musculus
tttacttctacacattgtcctggcc

SEQ ID NO: 105704 - DNA, 25 bp, mus musculus
cttctacacattgtcctggccatag

SEQ ID NO: 105705 - DNA, 25 bp, mus musculus
tacacttagacactttgtatctgga

SEQ ID NO: 105706 - DNA, 25 bp, mus musculus
gacactttgtatctggaccttgaac

SEQ ID NO: 105707 - DNA, 25 bp, mus musculus
cactttgtatctggaccttgaactt

SEQ ID NO: 105708 - DNA, 25 bp, mus musculus
ggaacattgacttcatcggatgatt

SEQ ID NO: 105709 - DNA, 25 bp, mus musculus
aacattgacttcatcggatgattat

SEQ ID NO: 105710 - DNA, 25 bp, mus musculus
cattgacttcatcggatgattataa

SEQ ID NO: 105711 - DNA, 25 bp, mus musculus
atataaccgtctgggatagatgaac

SEQ ID NO: 105712 - DNA, 25 bp, mus musculus
gatgaacttttcacatatcagagta

SEQ ID NO: 105713 - DNA, 25 bp, mus musculus
agttgtcctcaagttcgtcctcttg

SEQ ID NO: 105714 - DNA, 25 bp, mus musculus
actgtgtcagcagaccacattacag

SEQ ID NO: 105715 - DNA, 25 bp, mus musculus
ctgcaaacgtccgcctcagcctatg

SEQ ID NO: 105716 - DNA, 25 bp, mus musculus
ctgcccttgatttcagagtcctctt

SEQ ID NO: 105717 - DNA, 25 bp, mus musculus
tcttcatccatcctggctgcacagc

SEQ ID NO: 105718 - DNA, 25 bp, mus musculus
tccatcctggctgcacagcctgtct

SEQ ID NO: 105719 - DNA, 25 bp, mus musculus
tcttcacatgagtcagacgtgcagg

SEQ ID NO: 105720 - DNA, 25 bp, mus musculus
catgagtcagacgtgcagggtagga

SEQ ID NO: 105721 - DNA, 25 bp, mus musculus
ggaaagataaccaccatctgctcta

SEQ ID NO: 105722 - DNA, 25 bp, mus musculus
ataaccaccatctgctctaatcatg

SEQ ID NO: 105723 - DNA, 25 bp, mus musculus
accatctgctctaatcatgtagacg

SEQ ID NO: 105724 - DNA, 25 bp, mus musculus
gtagacgtactgccgcctggtttct

SEQ ID NO: 105725 - DNA, 25 bp, mus musculus
aaccaacaggtctgttgccacttca

SEQ ID NO: 105726 - DNA, 25 bp, mus musculus
caggtctgttgccacttcaacaggg

SEQ ID NO: 105727 - DNA, 25 bp, mus musculus
tgttgccacttcaacagggacagta

SEQ ID NO: 105728 - DNA, 25 bp, mus musculus
ttgtcattgctgttctagagcctag

SEQ ID NO: 105729 - DNA, 25 bp, mus musculus
ttgctgttctagagcctagagtctc

SEQ ID NO: 105730 - DNA, 25 bp, mus musculus
ttctagagcctagagtctcatcccg

SEQ ID NO: 105731 - DNA, 25 bp, mus musculus
gagtctcatcccgttctactgcaaa

SEQ ID NO: 105732 - DNA, 25 bp, mus musculus
catcccgttctactgcaaacgtccg

SEQ ID NO: 105733 - DNA, 25 bp, mus musculus
cagctccactgctgtttctgagcac

SEQ ID NO: 105734 - DNA, 25 bp, mus musculus
cactgctgtttctgagcactataac

SEQ ID NO: 105735 - DNA, 25 bp, mus musculus
ggaccatcttctcctgtttgacaga

SEQ ID NO: 105736 - DNA, 25 bp, mus musculus
tcttctcctgtttgacagaccaggt

SEQ ID NO: 105737 - DNA, 25 bp, mus musculus
ctagatcacgcttatgtcacggtgg

SEQ ID NO: 105738 - DNA, 25 bp, mus musculus
ctggtcaccaataccatcaattcag

SEQ ID NO: 105739 - DNA, 25 bp, mus musculus
accaataccatcaattcagaggtca

SEQ ID NO: 105740 - DNA, 25 bp, mus musculus
accatcaattcagaggtcactcagg

SEQ ID NO: 105741 - DNA, 25 bp, mus musculus
aattcagaggtcactcaggctctta

SEQ ID NO: 105742 - DNA, 25 bp, mus musculus
actcaggctcttaggcacactcaca

SEQ ID NO: 105743 - DNA, 25 bp, mus musculus
gctcttaggcacactcacaaaatgg

SEQ ID NO: 105744 - DNA, 25 bp, mus musculus
aggcacactcacaaaatggagaaat

SEQ ID NO: 105745 - DNA, 25 bp, mus musculus
tgtttctgagcactataactccatc

SEQ ID NO: 105746 - DNA, 25 bp, mus musculus
caggtttgacacggttcggccaatg

SEQ ID NO: 105747 - DNA, 25 bp, mus musculus
tgagcactataactccatcaagtcc

SEQ ID NO: 105748 - DNA, 25 bp, mus musculus
ctccatcaagtcctacagtgctcat

SEQ ID NO: 105749 - DNA, 25 bp, mus musculus
caagtcctacagtgctcatcagatt

SEQ ID NO: 105750 - DNA, 25 bp, mus musculus
ctacagtgctcatcagattgtcgac

SEQ ID NO: 105751 - DNA, 25 bp, mus musculus
tgctcatcagattgtcgacttcgag

SEQ ID NO: 105752 - DNA, 25 bp, mus musculus
tgtcgacttcgaggaccatcttctc

SEQ ID NO: 105753 - DNA, 25 bp, mus musculus
cttcgaggaccatcttctcctgttt

SEQ ID NO: 105754 - DNA, 25 bp, mus musculus
aaatcaagcagggcctgggcctcaa

SEQ ID NO: 105755 - DNA, 25 bp, mus musculus
gcctgggcctcaaattcgcagagct

SEQ ID NO: 105756 - DNA, 25 bp, mus musculus
tcaatatcaactcgctcaggctgaa

SEQ ID NO: 105757 - DNA, 25 bp, mus musculus
tcaactcgctcaggctgaaggagta

SEQ ID NO: 105758 - DNA, 25 bp, mus musculus
aggagtaccatcgccttcagagcaa

SEQ ID NO: 105759 - DNA, 25 bp, mus musculus
accatcgccttcagagcaaggtcac

SEQ ID NO: 105760 - DNA, 25 bp, mus musculus
aggtcactgccaaatagaccctgac

SEQ ID NO: 105761 - DNA, 25 bp, mus musculus
ctgccaaatagaccctgacaaagac

SEQ ID NO: 105762 - DNA, 25 bp, mus musculus
aatagaccctgacaaagacggagcg

SEQ ID NO: 105763 - DNA, 25 bp, mus musculus
tctgcagctctcccaggcttcagca

SEQ ID NO: 105764 - DNA, 25 bp, mus musculus
ccaggcttcagcattaattgttgtg

SEQ ID NO: 105765 - DNA, 25 bp, mus musculus
tggtcccctatagcctacaaaagtg

SEQ ID NO: 105766 - DNA, 25 bp, mus musculus
gcctcaaattcgcagagctcgtata

SEQ ID NO: 105767 - DNA, 25 bp, mus musculus
gtttctggcacagccctgaatgtga

SEQ ID NO: 105768 - DNA, 25 bp, mus musculus
aatttgttcgccactgtatccagaa

SEQ ID NO: 105769 - DNA, 25 bp, mus musculus
cactctacaatgaagagctggtgag

SEQ ID NO: 105770 - DNA, 25 bp, mus musculus
acgtgcagggcgactatgagcccat

SEQ ID NO: 105771 - DNA, 25 bp, mus musculus
actatgagcccatcgacgccactgg

SEQ ID NO: 105772 - DNA, 25 bp, mus musculus
ccactggcttcatcaatatcaactc

SEQ ID NO: 105773 - DNA, 25 bp, mus musculus
gcttcatcaatatcaactcgctcag

SEQ ID NO: 105774 - DNA, 25 bp, mus musculus
accatgtcctggtctccgatcctac

SEQ ID NO: 105775 - DNA, 25 bp, mus musculus
ctgcttctgctgttcccactcgagg

SEQ ID NO: 105776 - DNA, 25 bp, mus musculus
cacctgtcagagtcagcctgtatta

SEQ ID NO: 105777 - DNA, 25 bp, mus musculus
tcagagtcagcctgtattatgagtc

SEQ ID NO: 105778 - DNA, 25 bp, mus musculus
gagtcagcctgtattatgagtccct

SEQ ID NO: 105779 - DNA, 25 bp, mus musculus
tgtattatgagtccctgtgtggagc

SEQ ID NO: 105780 - DNA, 25 bp, mus musculus
attatgagtccctgtgtggagcttg

SEQ ID NO: 105781 - DNA, 25 bp, mus musculus
gggatttgttcccaacctggctgat

SEQ ID NO: 105782 - DNA, 25 bp, mus musculus
atttgttcccaacctggctgatggt

SEQ ID NO: 105783 - DNA, 25 bp, mus musculus
caacctggctgatggtgatggaaat

SEQ ID NO: 105784 - DNA, 25 bp, mus musculus
aaatcatgaacatcaccctggtgcc

SEQ ID NO: 105785 - DNA, 25 bp, mus musculus
tcatgaacatcaccctggtgcccta

SEQ ID NO: 105786 - DNA, 25 bp, mus musculus
ctgctgttcccactcgaggttccca

SEQ ID NO: 105787 - DNA, 25 bp, mus musculus
tgaacatcaccctggtgccctacgg

SEQ ID NO: 105788 - DNA, 25 bp, mus musculus
ttcccactcgaggttcccagagcag

SEQ ID NO: 105789 - DNA, 25 bp, mus musculus
ctcgaggttcccagagcagccactg

SEQ ID NO: 105790 - DNA, 25 bp, mus musculus
gaggttcccagagcagccactgcgt

SEQ ID NO: 105791 - DNA, 25 bp, mus musculus
ctttcgcaagcatcctccgaagcac

SEQ ID NO: 105792 - DNA, 25 bp, mus musculus
gaagcacaaccacctgcaaggtcca

SEQ ID NO: 105793 - DNA, 25 bp, mus musculus
gcacaaccacctgcaaggtccacga

SEQ ID NO: 105794 - DNA, 25 bp, mus musculus
caaccacctgcaaggtccacgatgt

SEQ ID NO: 105795 - DNA, 25 bp, mus musculus
atgaataccacacagatctgtggag

SEQ ID NO: 105796 - DNA, 25 bp, mus musculus
accacacagatctgtggagctagtt

SEQ ID NO: 105797 - DNA, 25 bp, mus musculus
tggctgtgccttccatccaggaggt

SEQ ID NO: 105798 - DNA, 25 bp, mus musculus
tgccttccatccaggaggtcagggg

SEQ ID NO: 105799 - DNA, 25 bp, mus musculus
ttgatctgtttctcatagatccaca

SEQ ID NO: 105800 - DNA, 25 bp, mus musculus
tgtttctcatagatccacagcctcc

SEQ ID NO: 105801 - DNA, 25 bp, mus musculus
ctctgcctctgtcgtttgcctgctt

SEQ ID NO: 105802 - DNA, 25 bp, mus musculus
ctctgtcgtttgcctgcttcagcac

SEQ ID NO: 105803 - DNA, 25 bp, mus musculus
tcttcccagctggcctcttctagaa

SEQ ID NO: 105804 - DNA, 25 bp, mus musculus
cagctggcctcttctagaaacatcc

SEQ ID NO: 105805 - DNA, 25 bp, mus musculus
ccacttctcttcattattcacttct

SEQ ID NO: 105806 - DNA, 25 bp, mus musculus
tgcttcctgagctgacagaaaaata

SEQ ID NO: 105807 - DNA, 25 bp, mus musculus
gctagttccaggccctcggtataca

SEQ ID NO: 105808 - DNA, 25 bp, mus musculus
ccctccttgatcactgctgttctca

SEQ ID NO: 105809 - DNA, 25 bp, mus musculus
cctagttctcttagagtgaggctgg

SEQ ID NO: 105810 - DNA, 25 bp, mus musculus
tctcttagagtgaggctgggagaga

SEQ ID NO: 105811 - DNA, 25 bp, mus musculus
agagacctgccgcagtgtgtgcaga

SEQ ID NO: 105812 - DNA, 25 bp, mus musculus
gtgcagagcctgggaagtggaccat

SEQ ID NO: 105813 - DNA, 25 bp, mus musculus
ggaccatgctggggtcctttatgga

SEQ ID NO: 105814 - DNA, 25 bp, mus musculus
tgctggggtcctttatggagagagc

SEQ ID NO: 105815 - DNA, 25 bp, mus musculus
tcctcaacccacgagttcacctggt

SEQ ID NO: 105816 - DNA, 25 bp, mus musculus
acgcagcctgcatcgcatacattcg

SEQ ID NO: 105817 - DNA, 25 bp, mus musculus
cagaagagacgcgcgtgtggctacg

SEQ ID NO: 105818 - DNA, 25 bp, mus musculus
aagagacgcgcgtgtggctacgcgt

SEQ ID NO: 105819 - DNA, 25 bp, mus musculus
tacgcgtcgatgggaagtggcagaa

SEQ ID NO: 105820 - DNA, 25 bp, mus musculus
ccacagtacccatcaactaattgtc

SEQ ID NO: 105821 - DNA, 25 bp, mus musculus
cagtacccatcaactaattgtcaac

SEQ ID NO: 105822 - DNA, 25 bp, mus musculus
tacccatcaactaattgtcaacagt

SEQ ID NO: 105823 - DNA, 25 bp, mus musculus
ccatcaactaattgtcaacagtgcc

SEQ ID NO: 105824 - DNA, 25 bp, mus musculus
tcaactaattgtcaacagtgccact

SEQ ID NO: 105825 - DNA, 25 bp, mus musculus
aattgtcaacagtgccacttcttca

SEQ ID NO: 105826 - DNA, 25 bp, mus musculus
caacagtgccacttcttcattctgt

SEQ ID NO: 105827 - DNA, 25 bp, mus musculus
cagcctgcatcgcatacattcggct

SEQ ID NO: 105828 - DNA, 25 bp, mus musculus
acagtgccacttcttcattctgtcc

SEQ ID NO: 105829 - DNA, 25 bp, mus musculus
cctgcatcgcatacattcggctcac

SEQ ID NO: 105830 - DNA, 25 bp, mus musculus
ttcggctcacacagtacatggacgg

SEQ ID NO: 105831 - DNA, 25 bp, mus musculus
ggctcacacagtacatggacggaag

SEQ ID NO: 105832 - DNA, 25 bp, mus musculus
agtacatggacggaagcgggatgcc

SEQ ID NO: 105833 - DNA, 25 bp, mus musculus
tgccaaagaccatgcagtcagaaga

SEQ ID NO: 105834 - DNA, 25 bp, mus musculus
caaagaccatgcagtcagaagagac

SEQ ID NO: 105835 - DNA, 25 bp, mus musculus
agaccatgcagtcagaagagacgcg

SEQ ID NO: 105836 - DNA, 25 bp, mus musculus
tgacctgcaataccagcgtcatgca

SEQ ID NO: 105837 - DNA, 25 bp, mus musculus
gcaataccagcgtcatgcatctaga

SEQ ID NO: 105838 - DNA, 25 bp, mus musculus
tcatcttcattgacctcatcgcaac

SEQ ID NO: 105839 - DNA, 25 bp, mus musculus
tcattgacctcatcgcaactctgct

SEQ ID NO: 105840 - DNA, 25 bp, mus musculus
ctctgctcctggctttgggcgtcta

SEQ ID NO: 105841 - DNA, 25 bp, mus musculus
ctttgggcgtctactgctttgcagg

SEQ ID NO: 105842 - DNA, 25 bp, mus musculus
ttcaagcactgctgaagaatgagca

SEQ ID NO: 105843 - DNA, 25 bp, mus musculus
agctgtatcagcctcttcgagatcg

SEQ ID NO: 105844 - DNA, 25 bp, mus musculus
atcagcctcttcgagatcgtgaaga

SEQ ID NO: 105845 - DNA, 25 bp, mus musculus
ctcttcgagatcgtgaagataccca

SEQ ID NO: 105846 - DNA, 25 bp, mus musculus
gtttctcaaagtgccatagcaacgg

SEQ ID NO: 105847 - DNA, 25 bp, mus musculus
tcccctgtgatcaaccaataaagac

SEQ ID NO: 105848 - DNA, 25 bp, mus musculus
ccagcgtcatgcatctagatggaac

SEQ ID NO: 105849 - DNA, 25 bp, mus musculus
tggacccacgagggatatatctgtg

SEQ ID NO: 105850 - DNA, 25 bp, mus musculus
ctgtgcaagtccattaccgaatgtg

SEQ ID NO: 105851 - DNA, 25 bp, mus musculus
aagtccattaccgaatgtgccagaa

SEQ ID NO: 105852 - DNA, 25 bp, mus musculus
attaccgaatgtgccagaactgtgt

SEQ ID NO: 105853 - DNA, 25 bp, mus musculus
gaatgtgccagaactgtgtggagct

SEQ ID NO: 105854 - DNA, 25 bp, mus musculus
tagactcgggcaccatggctggtgt

SEQ ID NO: 105855 - DNA, 25 bp, mus musculus
ctggtgtcatcttcattgacctcat

SEQ ID NO: 105856 - DNA, 25 bp, mus musculus
tgtcgctccctttcgctgatgcaag

SEQ ID NO: 105857 - DNA, 25 bp, mus musculus
gtcgctccctttcgctgatgcaaga

SEQ ID NO: 105858 - DNA, 25 bp, mus musculus
tttcgctgatgcaagagcctagtgc

SEQ ID NO: 105859 - DNA, 25 bp, mus musculus
ttcgctgatgcaagagcctagtgcg

SEQ ID NO: 105860 - DNA, 25 bp, mus musculus
aagagcctagtgcggtgctgtgaga

SEQ ID NO: 105861 - DNA, 25 bp, mus musculus
gcctagtgcggtgctgtgagaagta

SEQ ID NO: 105862 - DNA, 25 bp, mus musculus
cctagtgcggtgctgtgagaagtat

SEQ ID NO: 105863 - DNA, 25 bp, mus musculus
ctagtgcggtgctgtgagaagtatc

SEQ ID NO: 105864 - DNA, 25 bp, mus musculus
tagtgcggtgctgtgagaagtatcg

SEQ ID NO: 105865 - DNA, 25 bp, mus musculus
tcgctccctttcgctgatgcaagag

SEQ ID NO: 105866 - DNA, 25 bp, mus musculus
cgctccctttcgctgatgcaagagc

SEQ ID NO: 105867 - DNA, 25 bp, mus musculus
gctccctttcgctgatgcaagagcc

SEQ ID NO: 105868 - DNA, 25 bp, mus musculus
ctccctttcgctgatgcaagagcct

SEQ ID NO: 105869 - DNA, 25 bp, mus musculus
tccctttcgctgatgcaagagccta

SEQ ID NO: 105870 - DNA, 25 bp, mus musculus
ccctttcgctgatgcaagagcctag

SEQ ID NO: 105871 - DNA, 25 bp, mus musculus
cctttcgctgatgcaagagcctagt

SEQ ID NO: 105872 - DNA, 25 bp, mus musculus
ctttcgctgatgcaagagcctagtg

SEQ ID NO: 105873 - DNA, 25 bp, mus musculus
acggatggacactcttcctgactgc

SEQ ID NO: 105874 - DNA, 25 bp, mus musculus
tcttcctgactgcacagcctctgct

SEQ ID NO: 105875 - DNA, 25 bp, mus musculus
acccagagtccggctgccactaagg

SEQ ID NO: 105876 - DNA, 25 bp, mus musculus
atttctgtcctgtgatcatttgccc

SEQ ID NO: 105877 - DNA, 25 bp, mus musculus
gaactatgggtccacatcagggtaa

SEQ ID NO: 105878 - DNA, 25 bp, mus musculus
tgggtccacatcagggtaacactgg

SEQ ID NO: 105879 - DNA, 25 bp, mus musculus
agggtaacactggtcaccctggcat

SEQ ID NO: 105880 - DNA, 25 bp, mus musculus
gtcaccctggcatgacacatctcca

SEQ ID NO: 105881 - DNA, 25 bp, mus musculus
ctggcatgacacatctccagttcgt

SEQ ID NO: 105882 - DNA, 25 bp, mus musculus
atctccagttcgtgcttctgagacc

SEQ ID NO: 105883 - DNA, 25 bp, mus musculus
agttcgtgcttctgagaccacagtc

SEQ ID NO: 105884 - DNA, 25 bp, mus musculus
tgcttctgagaccacagtccctatg

SEQ ID NO: 105885 - DNA, 25 bp, mus musculus
tgactgcacagcctctgctggccag

SEQ ID NO: 105886 - DNA, 25 bp, mus musculus
tggccagcatgcacggccacttcca

SEQ ID NO: 105887 - DNA, 25 bp, mus musculus
acggccacttccatcatggcccaga

SEQ ID NO: 105888 - DNA, 25 bp, mus musculus
atcatggcccagagctgacaccagg

SEQ ID NO: 105889 - DNA, 25 bp, mus musculus
accctcacgtgagcgcaatcctatc

SEQ ID NO: 105890 - DNA, 25 bp, mus musculus
acgtgagcgcaatcctatcggagct

SEQ ID NO: 105891 - DNA, 25 bp, mus musculus
gcgcaatcctatcggagctgtgggg

SEQ ID NO: 105892 - DNA, 25 bp, mus musculus
tcctatcggagctgtggggttaaca

SEQ ID NO: 105893 - DNA, 25 bp, mus musculus
tctggtaggtcccacgttcagacaa

SEQ ID NO: 105894 - DNA, 25 bp, mus musculus
tggtaggtcccacgttcagacaaga

SEQ ID NO: 105895 - DNA, 25 bp, mus musculus
ttcacagttcaccttttccactggg

SEQ ID NO: 105896 - DNA, 25 bp, mus musculus
gagcacctcggcctaaaaagtgtgg

SEQ ID NO: 105897 - DNA, 25 bp, mus musculus
aaagtgtggcccatacatttcctct

SEQ ID NO: 105898 - DNA, 25 bp, mus musculus
tgtggcccatacatttcctctgtca

SEQ ID NO: 105899 - DNA, 25 bp, mus musculus
gcccatacatttcctctgtcaccag

SEQ ID NO: 105900 - DNA, 25 bp, mus musculus
atacatttcctctgtcaccagccag

SEQ ID NO: 105901 - DNA, 25 bp, mus musculus
cctctgtcaccagccagagtgtgaa

SEQ ID NO: 105902 - DNA, 25 bp, mus musculus
tctgtcaccagccagagtgtgaacg

SEQ ID NO: 105903 - DNA, 25 bp, mus musculus
tgtcaccagccagagtgtgaacgtg

SEQ ID NO: 105904 - DNA, 25 bp, mus musculus
accagccagagtgtgaacgtggtga

SEQ ID NO: 105905 - DNA, 25 bp, mus musculus
gtaggtcccacgttcagacaagatg

SEQ ID NO: 105906 - DNA, 25 bp, mus musculus
aggtcccacgttcagacaagatgta

SEQ ID NO: 105907 - DNA, 25 bp, mus musculus
atgtaccattgaaacattggtctgc

SEQ ID NO: 105908 - DNA, 25 bp, mus musculus
cattggtctgcttcacttcacagtt

SEQ ID NO: 105909 - DNA, 25 bp, mus musculus
ttggtctgcttcacttcacagttca

SEQ ID NO: 105910 - DNA, 25 bp, mus musculus
ggtctgcttcacttcacagttcacc

SEQ ID NO: 105911 - DNA, 25 bp, mus musculus
tctgcttcacttcacagttcacctt

SEQ ID NO: 105912 - DNA, 25 bp, mus musculus
acttcacagttcaccttttccactg

SEQ ID NO: 105913 - DNA, 25 bp, mus musculus
aggacagccagcctgtatgacagta

SEQ ID NO: 105914 - DNA, 25 bp, mus musculus
ctgtatgacagtaccctccttccac

SEQ ID NO: 105915 - DNA, 25 bp, mus musculus
cagtctgtctgccatagctggcaaa

SEQ ID NO: 105916 - DNA, 25 bp, mus musculus
gtctgccatagctggcaaattgctc

SEQ ID NO: 105917 - DNA, 25 bp, mus musculus
tgccatagctggcaaattgctctct

SEQ ID NO: 105918 - DNA, 25 bp, mus musculus
tggcaaattgctctcttaccctgtt

SEQ ID NO: 105919 - DNA, 25 bp, mus musculus
caaattgctctcttaccctgttctt

SEQ ID NO: 105920 - DNA, 25 bp, mus musculus
attgctctcttaccctgttcttgct

SEQ ID NO: 105921 - DNA, 25 bp, mus musculus
ctcttaccctgttcttgctggtgca

SEQ ID NO: 105922 - DNA, 25 bp, mus musculus
tgctggtgcagtcagcatggataga

SEQ ID NO: 105923 - DNA, 25 bp, mus musculus
agctgtccactatgaaattcggaag

SEQ ID NO: 105924 - DNA, 25 bp, mus musculus
tgtccactatgaaattcggaagtac

SEQ ID NO: 105925 - DNA, 25 bp, mus musculus
tttaaagcacgacttcatgttgagt

SEQ ID NO: 105926 - DNA, 25 bp, mus musculus
gcacgacttcatgttgagttccata

SEQ ID NO: 105927 - DNA, 25 bp, mus musculus
agcttactgtgtgacctcagcaatg

SEQ ID NO: 105928 - DNA, 25 bp, mus musculus
tgtgacctcagcaatggctagccta

SEQ ID NO: 105929 - DNA, 25 bp, mus musculus
gacctcagcaatggctagcctaggc

SEQ ID NO: 105930 - DNA, 25 bp, mus musculus
ctattcttgtagcagtctgtctgcc

SEQ ID NO: 105931 - DNA, 25 bp, mus musculus
ttgtagcagtctgtctgccatagct

SEQ ID NO: 105932 - DNA, 25 bp, mus musculus
tagcagtctgtctgccatagctggc

SEQ ID NO: 105933 - DNA, 25 bp, mus musculus
gacataacctgcaatgtatgtcaga

SEQ ID NO: 105934 - DNA, 25 bp, mus musculus
ataacctgcaatgtatgtcagagga

SEQ ID NO: 105935 - DNA, 25 bp, mus musculus
aaccgtgttcaacctgcagagcaca

SEQ ID NO: 105936 - DNA, 25 bp, mus musculus
gttcaacctgcagagcacattctct

SEQ ID NO: 105937 - DNA, 25 bp, mus musculus
caacctgcagagcacattctctcct

SEQ ID NO: 105938 - DNA, 25 bp, mus musculus
gcagagcacattctctccttccacg

SEQ ID NO: 105939 - DNA, 25 bp, mus musculus
gagcacattctctccttccacgagg

SEQ ID NO: 105940 - DNA, 25 bp, mus musculus
tccttccacgaggaaaagcgcccat

SEQ ID NO: 105941 - DNA, 25 bp, mus musculus
aagcgcccatttgtgtgtgagcacg

SEQ ID NO: 105942 - DNA, 25 bp, mus musculus
gagcacgctggctgtggcaagacat

SEQ ID NO: 105943 - DNA, 25 bp, mus musculus
cacgctggctgtggcaagacattcg

SEQ ID NO: 105944 - DNA, 25 bp, mus musculus
acattcgcaatgaaacagagtctca

SEQ ID NO: 105945 - DNA, 25 bp, mus musculus
acctgcaatgtatgtcagaggatgt

SEQ ID NO: 105946 - DNA, 25 bp, mus musculus
cagagtctcatgaggcacagtgtcg

SEQ ID NO: 105947 - DNA, 25 bp, mus musculus
atgttcaagcgcagagattacctta

SEQ ID NO: 105948 - DNA, 25 bp, mus musculus
gattaccttaagcagcacatgaaga

SEQ ID NO: 105949 - DNA, 25 bp, mus musculus
taccttaagcagcacatgaagactc

SEQ ID NO: 105950 - DNA, 25 bp, mus musculus
gtgtaccgctgtccgcgcaaggctg

SEQ ID NO: 105951 - DNA, 25 bp, mus musculus
taccgctgtccgcgcaaggctgcga

SEQ ID NO: 105952 - DNA, 25 bp, mus musculus
ccgcgcaaggctgcgaagaacctac

SEQ ID NO: 105953 - DNA, 25 bp, mus musculus
cacaaccgtgttcaacctgcagagc

SEQ ID NO: 105954 - DNA, 25 bp, mus musculus
caggtccatctccagggctgtggca

SEQ ID NO: 105955 - DNA, 25 bp, mus musculus
catctccagggctgtggcaaccaca

SEQ ID NO: 105956 - DNA, 25 bp, mus musculus
caccaagcgggacattctgaatgcc

SEQ ID NO: 105957 - DNA, 25 bp, mus musculus
ggacattctgaatgccttcaaaggt

SEQ ID NO: 105958 - DNA, 25 bp, mus musculus
cattctgaatgccttcaaaggtggc

SEQ ID NO: 105959 - DNA, 25 bp, mus musculus
tgccttcaaaggtggctgccggatc

SEQ ID NO: 105960 - DNA, 25 bp, mus musculus
gatcctgccgttgccttatgtgatg

SEQ ID NO: 105961 - DNA, 25 bp, mus musculus
gtgcaaccgttttgtggccgagtat

SEQ ID NO: 105962 - DNA, 25 bp, mus musculus
gtatgaacctgtgctcatagagagc

SEQ ID NO: 105963 - DNA, 25 bp, mus musculus
acctgtgctcatagagagcctcaag

SEQ ID NO: 105964 - DNA, 25 bp, mus musculus
gttcatgatgaaccccacggaccta

SEQ ID NO: 105965 - DNA, 25 bp, mus musculus
ccccacggacctatgcaagaagatg

SEQ ID NO: 105966 - DNA, 25 bp, mus musculus
ggctgtggcaaccacaccatccctg

SEQ ID NO: 105967 - DNA, 25 bp, mus musculus
accatccctgccggtggatgaggaa

SEQ ID NO: 105968 - DNA, 25 bp, mus musculus
cagcttctgccaagggtgcaaaagg

SEQ ID NO: 105969 - DNA, 25 bp, mus musculus
catgtcttcccagaatctggaccac

SEQ ID NO: 105970 - DNA, 25 bp, mus musculus
ttcccagaatctggaccacaagagc

SEQ ID NO: 105971 - DNA, 25 bp, mus musculus
tctggaccacaagagcaccaagcgg

SEQ ID NO: 105972 - DNA, 25 bp, mus musculus
caagagcaccaagcgggacattctg

SEQ ID NO: 105973 - DNA, 25 bp, mus musculus
gagcaccaagcgggacattctgaat

SEQ ID NO: 105974 - DNA, 25 bp, mus musculus
ttcccagtgtcactcgcggcacagc

SEQ ID NO: 105975 - DNA, 25 bp, mus musculus
ccagtgtcactcgcggcacagccgt

SEQ ID NO: 105976 - DNA, 25 bp, mus musculus
ctacagcgcagctgcacagtgagcc

SEQ ID NO: 105977 - DNA, 25 bp, mus musculus
tacagcgcagctgcacagtgagcct

SEQ ID NO: 105978 - DNA, 25 bp, mus musculus
acagcgcagctgcacagtgagcctc

SEQ ID NO: 105979 - DNA, 25 bp, mus musculus
cagcgcagctgcacagtgagcctcc

SEQ ID NO: 105980 - DNA, 25 bp, mus musculus
agcgcagctgcacagtgagcctccg

SEQ ID NO: 105981 - DNA, 25 bp, mus musculus
gcagctgcacagtgagcctccggtc

SEQ ID NO: 105982 - DNA, 25 bp, mus musculus
acttcaacccgggtgcgctgacagc

SEQ ID NO: 105983 - DNA, 25 bp, mus musculus
cttcaacccgggtgcgctgacagcg

SEQ ID NO: 105984 - DNA, 25 bp, mus musculus
tcaacccgggtgcgctgacagcggc

SEQ ID NO: 105985 - DNA, 25 bp, mus musculus
caacccgggtgcgctgacagcggcg

SEQ ID NO: 105986 - DNA, 25 bp, mus musculus
agtgtcactcgcggcacagccgtca

SEQ ID NO: 105987 - DNA, 25 bp, mus musculus
gtgtcactcgcggcacagccgtcag

SEQ ID NO: 105988 - DNA, 25 bp, mus musculus
actcgcggcacagccgtcagcgggg

SEQ ID NO: 105989 - DNA, 25 bp, mus musculus
tggtggctacagcgcagctgcacag

SEQ ID NO: 105990 - DNA, 25 bp, mus musculus
gtggctacagcgcagctgcacagtg

SEQ ID NO: 105991 - DNA, 25 bp, mus musculus
tggctacagcgcagctgcacagtga

SEQ ID NO: 105992 - DNA, 25 bp, mus musculus
ggctacagcgcagctgcacagtgag

SEQ ID NO: 105993 - DNA, 25 bp, mus musculus
gctacagcgcagctgcacagtgagc

SEQ ID NO: 105994 - DNA, 25 bp, mus musculus
cttcctcgaagcctccaggttcgca

SEQ ID NO: 105995 - DNA, 25 bp, mus musculus
cctcgaagcctccaggttcgcacaa

SEQ ID NO: 105996 - DNA, 25 bp, mus musculus
tttcatgcagtgtgcaaggaaaata

SEQ ID NO: 105997 - DNA, 25 bp, mus musculus
atcaggtgaactggaccccgagagg

SEQ ID NO: 105998 - DNA, 25 bp, mus musculus
tgaactggaccccgagaggatgggc

SEQ ID NO: 105999 - DNA, 25 bp, mus musculus
actggaccccgagaggatgggctct

SEQ ID NO: 106000 - DNA, 25 bp, mus musculus
catccagtatggagacgctgccctg

SEQ ID NO: 106001 - DNA, 25 bp, mus musculus
tcggcgtacacaggctccaagtgca

SEQ ID NO: 106002 - DNA, 25 bp, mus musculus
gcgtacacaggctccaagtgcacag

SEQ ID NO: 106003 - DNA, 25 bp, mus musculus
tacacaggctccaagtgcacaggag

SEQ ID NO: 106004 - DNA, 25 bp, mus musculus
ggctccaagtgcacaggagtgtggc

SEQ ID NO: 106005 - DNA, 25 bp, mus musculus
ggcgccccagtgacacaggttcagc

SEQ ID NO: 106006 - DNA, 25 bp, mus musculus
cgaagcctccaggttcgcacaagag

SEQ ID NO: 106007 - DNA, 25 bp, mus musculus
ctccaggttcgcacaagagaatgag

SEQ ID NO: 106008 - DNA, 25 bp, mus musculus
gttcctggaaaccagtgcactgact

SEQ ID NO: 106009 - DNA, 25 bp, mus musculus
ggaaaccagtgcactgactggcgag

SEQ ID NO: 106010 - DNA, 25 bp, mus musculus
aaccagtgcactgactggcgagaac

SEQ ID NO: 106011 - DNA, 25 bp, mus musculus
cagtgcactgactggcgagaacgtc

SEQ ID NO: 106012 - DNA, 25 bp, mus musculus
actgactggcgagaacgtcgaagag

SEQ ID NO: 106013 - DNA, 25 bp, mus musculus
ggctttcatgcagtgtgcaaggaaa

SEQ ID NO: 106014 - DNA, 25 bp, mus musculus
ccctcgacgagaattcggcacaggt

SEQ ID NO: 106015 - DNA, 25 bp, mus musculus
attcggcacaggtaagcaatgagtt

SEQ ID NO: 106016 - DNA, 25 bp, mus musculus
aggctgggttccgcatattgatact

SEQ ID NO: 106017 - DNA, 25 bp, mus musculus
ctgggttccgcatattgatactgct

SEQ ID NO: 106018 - DNA, 25 bp, mus musculus
tccgcatattgatactgcttatgtg

SEQ ID NO: 106019 - DNA, 25 bp, mus musculus
tattgatactgcttatgtgtaccaa

SEQ ID NO: 106020 - DNA, 25 bp, mus musculus
tactgcttatgtgtaccaaactgaa

SEQ ID NO: 106021 - DNA, 25 bp, mus musculus
gtaccaaactgaaaatcatgtaggg

SEQ ID NO: 106022 - DNA, 25 bp, mus musculus
gcaggctattccgagcaagatttga

SEQ ID NO: 106023 - DNA, 25 bp, mus musculus
ggctattccgagcaagatttgagct

SEQ ID NO: 106024 - DNA, 25 bp, mus musculus
tattccgagcaagatttgagctggg

SEQ ID NO: 106025 - DNA, 25 bp, mus musculus
gatttgagctgggcttgtgaaaaga

SEQ ID NO: 106026 - DNA, 25 bp, mus musculus
agttccaaacagcaatgtgtgaaac

SEQ ID NO: 106027 - DNA, 25 bp, mus musculus
gatggcaacttcatccctgcgctgg

SEQ ID NO: 106028 - DNA, 25 bp, mus musculus
aacttcatccctgcgctgggctttg

SEQ ID NO: 106029 - DNA, 25 bp, mus musculus
ttcatccctgcgctgggctttggca

SEQ ID NO: 106030 - DNA, 25 bp, mus musculus
atccctgcgctgggctttggcacta

SEQ ID NO: 106031 - DNA, 25 bp, mus musculus
ggctttggcactacaaaccagaaga

SEQ ID NO: 106032 - DNA, 25 bp, mus musculus
ataagccactggaggctatccattt

SEQ ID NO: 106033 - DNA, 25 bp, mus musculus
aggctatccatttagctctagaggc

SEQ ID NO: 106034 - DNA, 25 bp, mus musculus
tgaccagacagccacctatgaagac

SEQ ID NO: 106035 - DNA, 25 bp, mus musculus
gacagccacctatgaagacatagtg

SEQ ID NO: 106036 - DNA, 25 bp, mus musculus
cccaaggcttctgggagtgccatgt

SEQ ID NO: 106037 - DNA, 25 bp, mus musculus
tgggatctgtccccatgtttgggac

SEQ ID NO: 106038 - DNA, 25 bp, mus musculus
aatggactcagaacacactggcttc

SEQ ID NO: 106039 - DNA, 25 bp, mus musculus
ctcagaacacactggcttcaagagg

SEQ ID NO: 106040 - DNA, 25 bp, mus musculus
acacactggcttcaagaggagtcta

SEQ ID NO: 106041 - DNA, 25 bp, mus musculus
accatggttcacactgacacctgaa

SEQ ID NO: 106042 - DNA, 25 bp, mus musculus
gttcacactgacacctgaagaagtt

SEQ ID NO: 106043 - DNA, 25 bp, mus musculus
actgacacctgaagaagttgccaga

SEQ ID NO: 106044 - DNA, 25 bp, mus musculus
tgccagaatgccatttctctctccc

SEQ ID NO: 106045 - DNA, 25 bp, mus musculus
cattccaaggatcacccaaagccta

SEQ ID NO: 106046 - DNA, 25 bp, mus musculus
catagtgactcttcggacaggggag

SEQ ID NO: 106047 - DNA, 25 bp, mus musculus
ttcatcctgctcaactcttgggcct

SEQ ID NO: 106048 - DNA, 25 bp, mus musculus
ctgctcaactcttgggcctcactgc

SEQ ID NO: 106049 - DNA, 25 bp, mus musculus
aactcttgggcctcactgcttccaa

SEQ ID NO: 106050 - DNA, 25 bp, mus musculus
ccggccagcgtctgaagctggacca

SEQ ID NO: 106051 - DNA, 25 bp, mus musculus
tggaccatcaataccacctctcatt

SEQ ID NO: 106052 - DNA, 25 bp, mus musculus
ccctggtccccagctcttgctgaag

SEQ ID NO: 106053 - DNA, 25 bp, mus musculus
acttgacccaaggcttctgggagtg

SEQ ID NO: 106054 - DNA, 25 bp, mus musculus
gaccatcacattgcctagaggatag

SEQ ID NO: 106055 - DNA, 25 bp, mus musculus
catcacattgcctagaggatagcat

SEQ ID NO: 106056 - DNA, 25 bp, mus musculus
cttccaagtattgtcgtttgacact

SEQ ID NO: 106057 - DNA, 25 bp, mus musculus
attgtcgtttgacactcagctgtct

SEQ ID NO: 106058 - DNA, 25 bp, mus musculus
gtttgacactcagctgtctaaggta

SEQ ID NO: 106059 - DNA, 25 bp, mus musculus
tgacactcagctgtctaaggtattc

SEQ ID NO: 106060 - DNA, 25 bp, mus musculus
cactcagctgtctaaggtattcaaa

SEQ ID NO: 106061 - DNA, 25 bp, mus musculus
aggtattccagtactacagcttttg

SEQ ID NO: 106062 - DNA, 25 bp, mus musculus
tattccagtactacagcttttgaga

SEQ ID NO: 106063 - DNA, 25 bp, mus musculus
tccagtactacagcttttgagattc

SEQ ID NO: 106064 - DNA, 25 bp, mus musculus
agtactacagcttttgagattctag

SEQ ID NO: 106065 - DNA, 25 bp, mus musculus
tgacagttttttcccagcctggctt

SEQ ID NO: 106066 - DNA, 25 bp, mus musculus
tagaggctgtctggccttagaagaa

SEQ ID NO: 106067 - DNA, 25 bp, mus musculus
aggctgtctggccttagaagaattc

SEQ ID NO: 106068 - DNA, 25 bp, mus musculus
ctgtctggccttagaagaattcctc

SEQ ID NO: 106069 - DNA, 25 bp, mus musculus
aagtatttcaaatctcatagatgac

SEQ ID NO: 106070 - DNA, 25 bp, mus musculus
tatttcaaatctcatagatgacttc

SEQ ID NO: 106071 - DNA, 25 bp, mus musculus
aaatctcatagatgacttccaagta

SEQ ID NO: 106072 - DNA, 25 bp, mus musculus
tctcatagatgacttccaagtattg

SEQ ID NO: 106073 - DNA, 25 bp, mus musculus
agatgacttccaagtattgtcgttt

SEQ ID NO: 106074 - DNA, 25 bp, mus musculus
caaatgcatcacttccaactgtaat

SEQ ID NO: 106075 - DNA, 25 bp, mus musculus
catcacttccaactgtaatcactgt

SEQ ID NO: 106076 - DNA, 25 bp, mus musculus
tggcccccatacggtggtattggct

SEQ ID NO: 106077 - DNA, 25 bp, mus musculus
attggctctcttaacctcacatgca

SEQ ID NO: 106078 - DNA, 25 bp, mus musculus
tctcttaacctcacatgcacgaagg

SEQ ID NO: 106079 - DNA, 25 bp, mus musculus
aacctcacatgcacgaaggctttga

SEQ ID NO: 106080 - DNA, 25 bp, mus musculus
atggacgcgtgtgcactgcttactc

SEQ ID NO: 106081 - DNA, 25 bp, mus musculus
cttactccagtgtcctgcttgggaa

SEQ ID NO: 106082 - DNA, 25 bp, mus musculus
ccagtgtcctgcttgggaagatggg

SEQ ID NO: 106083 - DNA, 25 bp, mus musculus
gtaaatggtgccctgtgttcacaga

SEQ ID NO: 106084 - DNA, 25 bp, mus musculus
ggtgccctgtgttcacagaaaggtt

SEQ ID NO: 106085 - DNA, 25 bp, mus musculus
tatttatgcctagatcaggagagta

SEQ ID NO: 106086 - DNA, 25 bp, mus musculus
ttccaactgtaatcactgtgtccag

SEQ ID NO: 106087 - DNA, 25 bp, mus musculus
ctgtaatcactgtgtccagataaaa

SEQ ID NO: 106088 - DNA, 25 bp, mus musculus
actctgtcattcagaaaatgaactt

SEQ ID NO: 106089 - DNA, 25 bp, mus musculus
tgaacttcctcaactggtccacaat

SEQ ID NO: 106090 - DNA, 25 bp, mus musculus
tcctcaactggtccacaatcatctc

SEQ ID NO: 106091 - DNA, 25 bp, mus musculus
actggtccacaatcatctctgttta

SEQ ID NO: 106092 - DNA, 25 bp, mus musculus
cgatttctgggacatccaatctgga

SEQ ID NO: 106093 - DNA, 25 bp, mus musculus
ctgggacatccaatctggaagataa

SEQ ID NO: 106094 - DNA, 25 bp, mus musculus
accgtgttccgaggatatgtcatcc

SEQ ID NO: 106095 - DNA, 25 bp, mus musculus
ggatatgtcatccccaagggtacag

SEQ ID NO: 106096 - DNA, 25 bp, mus musculus
tctctggttgaccctaaggatatcg

SEQ ID NO: 106097 - DNA, 25 bp, mus musculus
cctaaggatatcgacctcagccctg

SEQ ID NO: 106098 - DNA, 25 bp, mus musculus
gacctcagccctgttacaattggct

SEQ ID NO: 106099 - DNA, 25 bp, mus musculus
agccctgttacaattggctttggca

SEQ ID NO: 106100 - DNA, 25 bp, mus musculus
tttggcagtatcccacgcgaattta

SEQ ID NO: 106101 - DNA, 25 bp, mus musculus
aaactctgtgtcattcctcgttcat

SEQ ID NO: 106102 - DNA, 25 bp, mus musculus
tgtgtcattcctcgttcatgagacc

SEQ ID NO: 106103 - DNA, 25 bp, mus musculus
attcctcgttcatgagacctgctgc

SEQ ID NO: 106104 - DNA, 25 bp, mus musculus
cgttcatgagacctgctgcccatca

SEQ ID NO: 106105 - DNA, 25 bp, mus musculus
cccatcattatcccttacaaaatga

SEQ ID NO: 106106 - DNA, 25 bp, mus musculus
gagtttccagatccagagacattta

SEQ ID NO: 106107 - DNA, 25 bp, mus musculus
acatttaaacctgagcattttctga

SEQ ID NO: 106108 - DNA, 25 bp, mus musculus
aaacctgagcattttctgaatgaaa

SEQ ID NO: 106109 - DNA, 25 bp, mus musculus
gaactgtttctgcttttgtctgcta

SEQ ID NO: 106110 - DNA, 25 bp, mus musculus
cttttgtctgctattctgcagcatt

SEQ ID NO: 106111 - DNA, 25 bp, mus musculus
tctgctattctgcagcattttaatc

SEQ ID NO: 106112 - DNA, 25 bp, mus musculus
tttaatctgaagtctctggttgacc

SEQ ID NO: 106113 - DNA, 25 bp, mus musculus
ctgaagtctctggttgaccctaagg

SEQ ID NO: 106114 - DNA, 25 bp, mus musculus
agacatagcagttctcgacctatgg

SEQ ID NO: 106115 - DNA, 25 bp, mus musculus
agcagttctcgacctatgggtcagg

SEQ ID NO: 106116 - DNA, 25 bp, mus musculus
ttcacctttggatcatgctacaaaa

SEQ ID NO: 106117 - DNA, 25 bp, mus musculus
cattcatttgaattcgacccatgga

SEQ ID NO: 106118 - DNA, 25 bp, mus musculus
tttgaattcgacccatggactctat

SEQ ID NO: 106119 - DNA, 25 bp, mus musculus
gaattcgacccatggactctatatg

SEQ ID NO: 106120 - DNA, 25 bp, mus musculus
ttcgacccatggactctatatgctt

SEQ ID NO: 106121 - DNA, 25 bp, mus musculus
ccatggactctatatgcttctcagt

SEQ ID NO: 106122 - DNA, 25 bp, mus musculus
tggactctatatgcttctcagttat

SEQ ID NO: 106123 - DNA, 25 bp, mus musculus
actctatatgcttctcagttatatt

SEQ ID NO: 106124 - DNA, 25 bp, mus musculus
tatgcttctcagttatattacagga

SEQ ID NO: 106125 - DNA, 25 bp, mus musculus
gcttctcagttatattacaggaatt

SEQ ID NO: 106126 - DNA, 25 bp, mus musculus
agttctcgacctatgggtcaggaca

SEQ ID NO: 106127 - DNA, 25 bp, mus musculus
tctcgacctatgggtcaggacacct

SEQ ID NO: 106128 - DNA, 25 bp, mus musculus
tgaatgactttttcacagaggtagc

SEQ ID NO: 106129 - DNA, 25 bp, mus musculus
gggtcaccaaaacacgaggagcagt

SEQ ID NO: 106130 - DNA, 25 bp, mus musculus
tcaccaaaacacgaggagcagtatt

SEQ ID NO: 106131 - DNA, 25 bp, mus musculus
tctttctttcacagaactgactgaa

SEQ ID NO: 106132 - DNA, 25 bp, mus musculus
tttcacagaactgactgaaactgga

SEQ ID NO: 106133 - DNA, 25 bp, mus musculus
cttttcacctttggatcatgctaca

SEQ ID NO: 106134 - DNA, 25 bp, mus musculus
ccttggatatcgccaggatgatccc

SEQ ID NO: 106135 - DNA, 25 bp, mus musculus
cagctaccgttcttttcactctggt

SEQ ID NO: 106136 - DNA, 25 bp, mus musculus
gtttgatactgacctgtaaatcgtc

SEQ ID NO: 106137 - DNA, 25 bp, mus musculus
aatacttactctgcctgcagaactc

SEQ ID NO: 106138 - DNA, 25 bp, mus musculus
tactctgcctgcagaactccagaaa

SEQ ID NO: 106139 - DNA, 25 bp, mus musculus
gtaaatctgccaccaaacagataca

SEQ ID NO: 106140 - DNA, 25 bp, mus musculus
ccaaacagatacataccttggaagg

SEQ ID NO: 106141 - DNA, 25 bp, mus musculus
ttttgccacagcttttgcagcgtta

SEQ ID NO: 106142 - DNA, 25 bp, mus musculus
cacagcttttgcagcgttatactca

SEQ ID NO: 106143 - DNA, 25 bp, mus musculus
ttttgcagcgttatactcagatgag

SEQ ID NO: 106144 - DNA, 25 bp, mus musculus
gtaacatttgctgttttcaacatta

SEQ ID NO: 106145 - DNA, 25 bp, mus musculus
tttgctgttttcaacattaatagca

SEQ ID NO: 106146 - DNA, 25 bp, mus musculus
ccaccctggtgctgactatccagtt

SEQ ID NO: 106147 - DNA, 25 bp, mus musculus
acattaatagcagccttctctctat

SEQ ID NO: 106148 - DNA, 25 bp, mus musculus
tggtgctgactatccagttgatggg

SEQ ID NO: 106149 - DNA, 25 bp, mus musculus
tgactatccagttgatgggctgcct

SEQ ID NO: 106150 - DNA, 25 bp, mus musculus
tccagttgatgggctgcctgatctg

SEQ ID NO: 106151 - DNA, 25 bp, mus musculus
gctgcctgatctgggacacgcccag

SEQ ID NO: 106152 - DNA, 25 bp, mus musculus
gggacacgcccaggacctcatggat

SEQ ID NO: 106153 - DNA, 25 bp, mus musculus
cgcccaggacctcatggatgggctg

SEQ ID NO: 106154 - DNA, 25 bp, mus musculus
tcagctggcctggtttgatactgac

SEQ ID NO: 106155 - DNA, 25 bp, mus musculus
ggccctggtcttcgacaacaagcac

SEQ ID NO: 106156 - DNA, 25 bp, mus musculus
ggtcttcgacaacaagcacacgaac

SEQ ID NO: 106157 - DNA, 25 bp, mus musculus
tgccaagggatcacccaggagcaga

SEQ ID NO: 106158 - DNA, 25 bp, mus musculus
gggatcacccaggagcagatgaatg

SEQ ID NO: 106159 - DNA, 25 bp, mus musculus
aatgagttcagagcctccttcaacc

SEQ ID NO: 106160 - DNA, 25 bp, mus musculus
gagttcagagcctccttcaaccact

SEQ ID NO: 106161 - DNA, 25 bp, mus musculus
gcctccttcaaccactttgacagga

SEQ ID NO: 106162 - DNA, 25 bp, mus musculus
tccttcaaccactttgacaggagga

SEQ ID NO: 106163 - DNA, 25 bp, mus musculus
gatttcagagcctgcctcatttcca

SEQ ID NO: 106164 - DNA, 25 bp, mus musculus
ttcagagcctgcctcatttccatgg

SEQ ID NO: 106165 - DNA, 25 bp, mus musculus
gcctgcctcatttccatgggctatg

SEQ ID NO: 106166 - DNA, 25 bp, mus musculus
ctcatttccatgggctatgacttgg

SEQ ID NO: 106167 - DNA, 25 bp, mus musculus
cgacaacaagcacacgaactacacc

SEQ ID NO: 106168 - DNA, 25 bp, mus musculus
tccatgggctatgacttgggtgaag

SEQ ID NO: 106169 - DNA, 25 bp, mus musculus
caagcacacgaactacaccatggag

SEQ ID NO: 106170 - DNA, 25 bp, mus musculus
gcacacgaactacaccatggagcat

SEQ ID NO: 106171 - DNA, 25 bp, mus musculus
gctgctgacaactatcgccagaacc

SEQ ID NO: 106172 - DNA, 25 bp, mus musculus
gacaactatcgccagaaccatcaat

SEQ ID NO: 106173 - DNA, 25 bp, mus musculus
ggagacccagatcctgacaagagat

SEQ ID NO: 106174 - DNA, 25 bp, mus musculus
gacccagatcctgacaagagatgcc

SEQ ID NO: 106175 - DNA, 25 bp, mus musculus
ccagatcctgacaagagatgccaag

SEQ ID NO: 106176 - DNA, 25 bp, mus musculus
catcatgcagaggttgctgttcagt

SEQ ID NO: 106177 - DNA, 25 bp, mus musculus
tacacatatccagagggaaggtcta

SEQ ID NO: 106178 - DNA, 25 bp, mus musculus
gggctcagcttatgtgttgtaaatt

SEQ ID NO: 106179 - DNA, 25 bp, mus musculus
gtaaattctggaggctcgcttagct

SEQ ID NO: 106180 - DNA, 25 bp, mus musculus
tctggaggctcgcttagctgcggtc

SEQ ID NO: 106181 - DNA, 25 bp, mus musculus
ggctcgcttagctgcggtctgagca

SEQ ID NO: 106182 - DNA, 25 bp, mus musculus
tcgcttagctgcggtctgagcatcc

SEQ ID NO: 106183 - DNA, 25 bp, mus musculus
cttagctgcggtctgagcatccggg

SEQ ID NO: 106184 - DNA, 25 bp, mus musculus
ttcctcttcctcagttcgcttgggt

SEQ ID NO: 106185 - DNA, 25 bp, mus musculus
ttcctcagttcgcttgggtttcaga

SEQ ID NO: 106186 - DNA, 25 bp, mus musculus
agacttcaagaagcggctgtagctg

SEQ ID NO: 106187 - DNA, 25 bp, mus musculus
cttcaagaagcggctgtagctgtca

SEQ ID NO: 106188 - DNA, 25 bp, mus musculus
aggtctagcacactccagtcctcaa

SEQ ID NO: 106189 - DNA, 25 bp, mus musculus
aaatgacagcctgtacagtcctaag

SEQ ID NO: 106190 - DNA, 25 bp, mus musculus
tgacagcctgtacagtcctaagagt

SEQ ID NO: 106191 - DNA, 25 bp, mus musculus
cagcctgtacagtcctaagagtcca

SEQ ID NO: 106192 - DNA, 25 bp, mus musculus
cctgtacagtcctaagagtccatcc

SEQ ID NO: 106193 - DNA, 25 bp, mus musculus
gtacagtcctaagagtccatccctc

SEQ ID NO: 106194 - DNA, 25 bp, mus musculus
ctccttcgctggggtgaagggctca

SEQ ID NO: 106195 - DNA, 25 bp, mus musculus
cttcgctggggtgaagggctcagct

SEQ ID NO: 106196 - DNA, 25 bp, mus musculus
tgagagcaacccaatgcccgctgtg

SEQ ID NO: 106197 - DNA, 25 bp, mus musculus
gagcaacccaatgcccgctgtgcac

SEQ ID NO: 106198 - DNA, 25 bp, mus musculus
gtcacccctggtggacaacatcgcc

SEQ ID NO: 106199 - DNA, 25 bp, mus musculus
ggacaacatcgccctgtggatgact

SEQ ID NO: 106200 - DNA, 25 bp, mus musculus
catcgccctgtggatgactgagtac

SEQ ID NO: 106201 - DNA, 25 bp, mus musculus
gactgagtacctgaaccggcatctg

SEQ ID NO: 106202 - DNA, 25 bp, mus musculus
cctgaaccggcatctgcacacctgg

SEQ ID NO: 106203 - DNA, 25 bp, mus musculus
ccggcatctgcacacctggatccag

SEQ ID NO: 106204 - DNA, 25 bp, mus musculus
tctgcacacctggatccaggataac

SEQ ID NO: 106205 - DNA, 25 bp, mus musculus
gcacacctggatccaggataacgga

SEQ ID NO: 106206 - DNA, 25 bp, mus musculus
cacctggatccaggataacggaggc

SEQ ID NO: 106207 - DNA, 25 bp, mus musculus
tgcatgtctggttgaatgagtctgg

SEQ ID NO: 106208 - DNA, 25 bp, mus musculus
aatgcccgctgtgcaccgggagatg

SEQ ID NO: 106209 - DNA, 25 bp, mus musculus
tgcgctcagccctgtgccaccatgt

SEQ ID NO: 106210 - DNA, 25 bp, mus musculus
gctcagccctgtgccaccatgtgtc

SEQ ID NO: 106211 - DNA, 25 bp, mus musculus
cagccctgtgccaccatgtgtccat

SEQ ID NO: 106212 - DNA, 25 bp, mus musculus
tcgtcgctaccgtcgtgacttcgca

SEQ ID NO: 106213 - DNA, 25 bp, mus musculus
tcgctaccgtcgtgacttcgcagag

SEQ ID NO: 106214 - DNA, 25 bp, mus musculus
tgacttcgcagagatgtccagtcag

SEQ ID NO: 106215 - DNA, 25 bp, mus musculus
gatgtccagtcagctgcacctgacg

SEQ ID NO: 106216 - DNA, 25 bp, mus musculus
aagtgagctgtgctgtggctcccgc

SEQ ID NO: 106217 - DNA, 25 bp, mus musculus
tcccgcggctgactggctgagtgac

SEQ ID NO: 106218 - DNA, 25 bp, mus musculus
agaatcgccggctgtaccgcagtcc

SEQ ID NO: 106219 - DNA, 25 bp, mus musculus
aatcgccggctgtaccgcagtccta

SEQ ID NO: 106220 - DNA, 25 bp, mus musculus
cggctgtaccgcagtcctattcagt

SEQ ID NO: 106221 - DNA, 25 bp, mus musculus
ggctgtaccgcagtcctattcagtg

SEQ ID NO: 106222 - DNA, 25 bp, mus musculus
gctgtaccgcagtcctattcagtgc

SEQ ID NO: 106223 - DNA, 25 bp, mus musculus
ctgtaccgcagtcctattcagtgct

SEQ ID NO: 106224 - DNA, 25 bp, mus musculus
tgtaccgcagtcctattcagtgctg

SEQ ID NO: 106225 - DNA, 25 bp, mus musculus
gtaccgcagtcctattcagtgctga

SEQ ID NO: 106226 - DNA, 25 bp, mus musculus
taccgcagtcctattcagtgctgat

SEQ ID NO: 106227 - DNA, 25 bp, mus musculus
accgcagtcctattcagtgctgatg

SEQ ID NO: 106228 - DNA, 25 bp, mus musculus
ccccggcaaggcattctggctgcag

SEQ ID NO: 106229 - DNA, 25 bp, mus musculus
ccggcaaggcattctggctgcagat

SEQ ID NO: 106230 - DNA, 25 bp, mus musculus
agatgagtccgtagcagcatggcaa

SEQ ID NO: 106231 - DNA, 25 bp, mus musculus
gatgagtccgtagcagcatggcaaa

SEQ ID NO: 106232 - DNA, 25 bp, mus musculus
atgagtccgtagcagcatggcaaaa

SEQ ID NO: 106233 - DNA, 25 bp, mus musculus
tgagtccgtagcagcatggcaaaag

SEQ ID NO: 106234 - DNA, 25 bp, mus musculus
gagtccgtagcagcatggcaaaagg

SEQ ID NO: 106235 - DNA, 25 bp, mus musculus
gagaatcgccggctgtaccgcagtc

SEQ ID NO: 106236 - DNA, 25 bp, mus musculus
tcccccgaaagatgctcctggcttc

SEQ ID NO: 106237 - DNA, 25 bp, mus musculus
gaaagatgctcctggcttccccgcg

SEQ ID NO: 106238 - DNA, 25 bp, mus musculus
actgagcacagatcctcccaatcgc

SEQ ID NO: 106239 - DNA, 25 bp, mus musculus
ttaatctcaggcacccaggttccct

SEQ ID NO: 106240 - DNA, 25 bp, mus musculus
tcaggcacccaggttccctgtctgg

SEQ ID NO: 106241 - DNA, 25 bp, mus musculus
gttccctgtctggaatccaccagat

SEQ ID NO: 106242 - DNA, 25 bp, mus musculus
tgtctggaatccaccagatactcaa

SEQ ID NO: 106243 - DNA, 25 bp, mus musculus
gaatccaccagatactcaattcttt

SEQ ID NO: 106244 - DNA, 25 bp, mus musculus
tccaccagatactcaattctttgag

SEQ ID NO: 106245 - DNA, 25 bp, mus musculus
accagatactcaattctttgagtgg

SEQ ID NO: 106246 - DNA, 25 bp, mus musculus
tactcaattctttgagtggaggaac

SEQ ID NO: 106247 - DNA, 25 bp, mus musculus
tcaattctttgagtggaggaaccaa

SEQ ID NO: 106248 - DNA, 25 bp, mus musculus
agatgctcctggcttccccgcgact

SEQ ID NO: 106249 - DNA, 25 bp, mus musculus
agctccaggaagcagctgagacgga

SEQ ID NO: 106250 - DNA, 25 bp, mus musculus
tgcaccaaggcacatgcacatacta

SEQ ID NO: 106251 - DNA, 25 bp, mus musculus
accaaggcacatgcacatactactg

SEQ ID NO: 106252 - DNA, 25 bp, mus musculus
aaggcacatgcacatactactgagc

SEQ ID NO: 106253 - DNA, 25 bp, mus musculus
catgcacatactactgagcacagat

SEQ ID NO: 106254 - DNA, 25 bp, mus musculus
gcacatactactgagcacagatcct

SEQ ID NO: 106255 - DNA, 25 bp, mus musculus
catactactgagcacagatcctccc

SEQ ID NO: 106256 - DNA, 25 bp, mus musculus
caggcttcagaagccacaggtggtc

SEQ ID NO: 106257 - DNA, 25 bp, mus musculus
gcttcagaagccacaggtggtcgaa

SEQ ID NO: 106258 - DNA, 25 bp, mus musculus
gcacgatcaaggactcggttggctg

SEQ ID NO: 106259 - DNA, 25 bp, mus musculus
cgatcaaggactcggttggctgcct

SEQ ID NO: 106260 - DNA, 25 bp, mus musculus
tcaaggactcggttggctgcctggg

SEQ ID NO: 106261 - DNA, 25 bp, mus musculus
tgctctccctgaggtcacctagagc

SEQ ID NO: 106262 - DNA, 25 bp, mus musculus
tgaggtcacctagagctcgcagagg

SEQ ID NO: 106263 - DNA, 25 bp, mus musculus
ggtcacctagagctcgcagaggcaa

SEQ ID NO: 106264 - DNA, 25 bp, mus musculus
ctagagctcgcagaggcaaggcccg

SEQ ID NO: 106265 - DNA, 25 bp, mus musculus
acgtacagtcatcccaggaacctga

SEQ ID NO: 106266 - DNA, 25 bp, mus musculus
tacagtcatcccaggaacctgaggc

SEQ ID NO: 106267 - DNA, 25 bp, mus musculus
cacccagagatgtggcccttttaca

SEQ ID NO: 106268 - DNA, 25 bp, mus musculus
tcagaagccacaggtggtcgaaggg

SEQ ID NO: 106269 - DNA, 25 bp, mus musculus
gccacaggtggtcgaagggtctcaa

SEQ ID NO: 106270 - DNA, 25 bp, mus musculus
gtctcaaaggccctaatggcctcca

SEQ ID NO: 106271 - DNA, 25 bp, mus musculus
aaggccctaatggcctccatggctc

SEQ ID NO: 106272 - DNA, 25 bp, mus musculus
gcctccatggctcgcagacttcaag

SEQ ID NO: 106273 - DNA, 25 bp, mus musculus
tccatggctcgcagacttcaagggg

SEQ ID NO: 106274 - DNA, 25 bp, mus musculus
atggctcgcagacttcaaggggacc

SEQ ID NO: 106275 - DNA, 25 bp, mus musculus
ccatagccttttgggcccgcacgat

SEQ ID NO: 106276 - DNA, 25 bp, mus musculus
ccttgcgaccgaaccaggtcattcg

SEQ ID NO: 106277 - DNA, 25 bp, mus musculus
agaactatgagccacgcaacggcaa

SEQ ID NO: 106278 - DNA, 25 bp, mus musculus
acctgcaggccacagacaagaactc

SEQ ID NO: 106279 - DNA, 25 bp, mus musculus
gtgccaacagcatcttcactggctt

SEQ ID NO: 106280 - DNA, 25 bp, mus musculus
acagcatcttcactggctttctgct

SEQ ID NO: 106281 - DNA, 25 bp, mus musculus
tcttcactggctttctgcttttccc

SEQ ID NO: 106282 - DNA, 25 bp, mus musculus
ttttccctgacatggatgcgtaatc

SEQ ID NO: 106283 - DNA, 25 bp, mus musculus
gtcaaattacacctatccaacacca

SEQ ID NO: 106284 - DNA, 25 bp, mus musculus
cttgactgcctgaaacccagaccag

SEQ ID NO: 106285 - DNA, 25 bp, mus musculus
tgcctgaaacccagaccagagccct

SEQ ID NO: 106286 - DNA, 25 bp, mus musculus
aaacccagaccagagccctgtagat

SEQ ID NO: 106287 - DNA, 25 bp, mus musculus
agaccagagccctgtagatgttaca

SEQ ID NO: 106288 - DNA, 25 bp, mus musculus
atgagccacgcaacggcaagttcac

SEQ ID NO: 106289 - DNA, 25 bp, mus musculus
cacgcaacggcaagttcacctgcaa

SEQ ID NO: 106290 - DNA, 25 bp, mus musculus
gccgcgatcgggacagcatgcagaa

SEQ ID NO: 106291 - DNA, 25 bp, mus musculus
aagtagtcaccttctgtgactatgc

SEQ ID NO: 106292 - DNA, 25 bp, mus musculus
tcaccttctgtgactatgcccagaa

SEQ ID NO: 106293 - DNA, 25 bp, mus musculus
actatgcccagaacaccttccaggt

SEQ ID NO: 106294 - DNA, 25 bp, mus musculus
acaccttccaggtgaccacaggtgg

SEQ ID NO: 106295 - DNA, 25 bp, mus musculus
ttgttcacctgcaggccacagacaa

SEQ ID NO: 106296 - DNA, 25 bp, mus musculus
atcgaattctgactctcacaaccaa

SEQ ID NO: 106297 - DNA, 25 bp, mus musculus
ttctgactctcacaaccaatgagga

SEQ ID NO: 106298 - DNA, 25 bp, mus musculus
gtctgcctcagtatccacacataaa

SEQ ID NO: 106299 - DNA, 25 bp, mus musculus
ctcagtatccacacataaacggcag

SEQ ID NO: 106300 - DNA, 25 bp, mus musculus
atgtgtcttcctgtccccaaacagg

SEQ ID NO: 106301 - DNA, 25 bp, mus musculus
gtccccaaacaggacagcaccagga

SEQ ID NO: 106302 - DNA, 25 bp, mus musculus
accaggaacctacttacactgagca

SEQ ID NO: 106303 - DNA, 25 bp, mus musculus
aacctacttacactgagcagagagg

SEQ ID NO: 106304 - DNA, 25 bp, mus musculus
cttacactgagcagagaggctgtgc

SEQ ID NO: 106305 - DNA, 25 bp, mus musculus
gctgtgctccagagcctgtgacacg

SEQ ID NO: 106306 - DNA, 25 bp, mus musculus
agcctgtgacacgcctccacttgta

SEQ ID NO: 106307 - DNA, 25 bp, mus musculus
tgacacgcctccacttgtatatatg

SEQ ID NO: 106308 - DNA, 25 bp, mus musculus
aatacttggatctcacccagcctct

SEQ ID NO: 106309 - DNA, 25 bp, mus musculus
agcctctcgaacagtattctcctag

SEQ ID NO: 106310 - DNA, 25 bp, mus musculus
caagtagctcttgttcttcagggga

SEQ ID NO: 106311 - DNA, 25 bp, mus musculus
gctcttgttcttcaggggacgattc

SEQ ID NO: 106312 - DNA, 25 bp, mus musculus
gttcttcaggggacgattctgtgtt

SEQ ID NO: 106313 - DNA, 25 bp, mus musculus
ctgtgttttctccagaccccatgcc

SEQ ID NO: 106314 - DNA, 25 bp, mus musculus
cagaccccatgccttatgaaccctg

SEQ ID NO: 106315 - DNA, 25 bp, mus musculus
cttatgaaccctgtctgcctcagta

SEQ ID NO: 106316 - DNA, 25 bp, mus musculus
tgccaagccttaggcccatcctctt

SEQ ID NO: 106317 - DNA, 25 bp, mus musculus
cccatcctctttaagaccgactgca

SEQ ID NO: 106318 - DNA, 25 bp, mus musculus
tgccactctcaggagattccacctc

SEQ ID NO: 106319 - DNA, 25 bp, mus musculus
gcagccttgtggcataccaggagat

SEQ ID NO: 106320 - DNA, 25 bp, mus musculus
agccttgtggcataccaggagatga

SEQ ID NO: 106321 - DNA, 25 bp, mus musculus
ccttgtggcataccaggagatgatg

SEQ ID NO: 106322 - DNA, 25 bp, mus musculus
tgatggcggctgcaggttgcataga

SEQ ID NO: 106323 - DNA, 25 bp, mus musculus
aagtggctccacatagaaaaacctg

SEQ ID NO: 106324 - DNA, 25 bp, mus musculus
ggctccacatagaaaaacctgctcc

SEQ ID NO: 106325 - DNA, 25 bp, mus musculus
acctgctccccaaatagtgcaaata

SEQ ID NO: 106326 - DNA, 25 bp, mus musculus
ctgctccccaaatagtgcaaatacc

SEQ ID NO: 106327 - DNA, 25 bp, mus musculus
gctccccaaatagtgcaaataccca

SEQ ID NO: 106328 - DNA, 25 bp, mus musculus
catcctctttaagaccgactgcaaa

SEQ ID NO: 106329 - DNA, 25 bp, mus musculus
tcctctttaagaccgactgcaaaag

SEQ ID NO: 106330 - DNA, 25 bp, mus musculus
aaggtaacagcagtcctccagcttt

SEQ ID NO: 106331 - DNA, 25 bp, mus musculus
cctgctgtaactgggttagagaact

SEQ ID NO: 106332 - DNA, 25 bp, mus musculus
gaactggcattgccactctcaggag

SEQ ID NO: 106333 - DNA, 25 bp, mus musculus
actggcattgccactctcaggagat

SEQ ID NO: 106334 - DNA, 25 bp, mus musculus
tggcattgccactctcaggagattc

SEQ ID NO: 106335 - DNA, 25 bp, mus musculus
attgccactctcaggagattccacc

SEQ ID NO: 106336 - DNA, 25 bp, mus musculus
cccagatgcctctgcagaagctact

SEQ ID NO: 106337 - DNA, 25 bp, mus musculus
tgcctctgcagaagctactgttctc

SEQ ID NO: 106338 - DNA, 25 bp, mus musculus
ggctcacgcatcactatgtgccgtg

SEQ ID NO: 106339 - DNA, 25 bp, mus musculus
cgcatcactatgtgccgtgtagact

SEQ ID NO: 106340 - DNA, 25 bp, mus musculus
actatgtgccgtgtagactcagctc

SEQ ID NO: 106341 - DNA, 25 bp, mus musculus
gtagactcagctcgaagccactcat

SEQ ID NO: 106342 - DNA, 25 bp, mus musculus
tcagctcgaagccactcattgtctt

SEQ ID NO: 106343 - DNA, 25 bp, mus musculus
cgaagccactcattgtcttacacct

SEQ ID NO: 106344 - DNA, 25 bp, mus musculus
ttgtcttacacctggtcctcaggat

SEQ ID NO: 106345 - DNA, 25 bp, mus musculus
tacacctggtcctcaggatgagctg

SEQ ID NO: 106346 - DNA, 25 bp, mus musculus
tggtcctcaggatgagctgctcaag

SEQ ID NO: 106347 - DNA, 25 bp, mus musculus
gctcaagggctctttgcttcaccaa

SEQ ID NO: 106348 - DNA, 25 bp, mus musculus
tgcagaagctactgttctcagccac

SEQ ID NO: 106349 - DNA, 25 bp, mus musculus
agctactgttctcagccacactgac

SEQ ID NO: 106350 - DNA, 25 bp, mus musculus
tgttctcagccacactgacccagga

SEQ ID NO: 106351 - DNA, 25 bp, mus musculus
cactgacccaggaccccgagaagct

SEQ ID NO: 106352 - DNA, 25 bp, mus musculus
cccaggaccccgagaagctgcagcg

SEQ ID NO: 106353 - DNA, 25 bp, mus musculus
accagccacggcttttctccacaag

SEQ ID NO: 106354 - DNA, 25 bp, mus musculus
cacggcttttctccacaaggctggg

SEQ ID NO: 106355 - DNA, 25 bp, mus musculus
aaagtcctaaagacacagctgaggt

SEQ ID NO: 106356 - DNA, 25 bp, mus musculus
ttgcagcatctgcaggtctgttttc

SEQ ID NO: 106357 - DNA, 25 bp, mus musculus
ctgcaggtctgttttctgtcccatg

SEQ ID NO: 106358 - DNA, 25 bp, mus musculus
cctcacagagactttggccagtgcc

SEQ ID NO: 106359 - DNA, 25 bp, mus musculus
ggagatacaccagaccttggaccag

SEQ ID NO: 106360 - DNA, 25 bp, mus musculus
gacccttctggaactcaacaacctg

SEQ ID NO: 106361 - DNA, 25 bp, mus musculus
caacaacctgtaagggctggccctg

SEQ ID NO: 106362 - DNA, 25 bp, mus musculus
ggccctgctgcctaccagactacat

SEQ ID NO: 106363 - DNA, 25 bp, mus musculus
cctgctgcctaccagactacatagt

SEQ ID NO: 106364 - DNA, 25 bp, mus musculus
taccagactacatagttgcctcctc

SEQ ID NO: 106365 - DNA, 25 bp, mus musculus
cagactacatagttgcctcctcggg

SEQ ID NO: 106366 - DNA, 25 bp, mus musculus
actacatagttgcctcctcgggcca

SEQ ID NO: 106367 - DNA, 25 bp, mus musculus
ttgcctcctcgggccaataaactga

SEQ ID NO: 106368 - DNA, 25 bp, mus musculus
tttctgtcccatgtctgtctgacct

SEQ ID NO: 106369 - DNA, 25 bp, mus musculus
cccagccaaggcctagagcaagatt

SEQ ID NO: 106370 - DNA, 25 bp, mus musculus
cccggtctcttaacatgactcaggt

SEQ ID NO: 106371 - DNA, 25 bp, mus musculus
aacacatctcaggtctcctaacatg

SEQ ID NO: 106372 - DNA, 25 bp, mus musculus
acatctcaggtctcctaacatgtcc

SEQ ID NO: 106373 - DNA, 25 bp, mus musculus
tcccaggtccataagtgtctcctaa

SEQ ID NO: 106374 - DNA, 25 bp, mus musculus
aagtgtctcctaacattcctaacat

SEQ ID NO: 106375 - DNA, 25 bp, mus musculus
tgtctcctaacattcctaacatggt

SEQ ID NO: 106376 - DNA, 25 bp, mus musculus
gcccatacaatcctcctgatctgga

SEQ ID NO: 106377 - DNA, 25 bp, mus musculus
acaatcctcctgatctggaagaagc

SEQ ID NO: 106378 - DNA, 25 bp, mus musculus
ttcccaactcaagactcttctgcta

SEQ ID NO: 106379 - DNA, 25 bp, mus musculus
gactcttctgctatcgatccacact

SEQ ID NO: 106380 - DNA, 25 bp, mus musculus
tctgctatcgatccacactgccact

SEQ ID NO: 106381 - DNA, 25 bp, mus musculus
atcgatccacactgccactaaaatt

SEQ ID NO: 106382 - DNA, 25 bp, mus musculus
acttactgccgttaagagactgcag

SEQ ID NO: 106383 - DNA, 25 bp, mus musculus
ctgcttataattcacgctaagataa

SEQ ID NO: 106384 - DNA, 25 bp, mus musculus
aggatgcatcatctcggtgatgata

SEQ ID NO: 106385 - DNA, 25 bp, mus musculus
catcatctcggtgatgataaaccag

SEQ ID NO: 106386 - DNA, 25 bp, mus musculus
gacttgtaccaacctgtcaaagatg

SEQ ID NO: 106387 - DNA, 25 bp, mus musculus
taccaacctgtcaaagatgatgctt

SEQ ID NO: 106388 - DNA, 25 bp, mus musculus
ctgccaaaactgaggctgagaatac

SEQ ID NO: 106389 - DNA, 25 bp, mus musculus
tcaagcatcccgaagccctggatga

SEQ ID NO: 106390 - DNA, 25 bp, mus musculus
tagtgtctcctggtccaagggatgc

SEQ ID NO: 106391 - DNA, 25 bp, mus musculus
ctcctggtccaagggatgctgtaga

SEQ ID NO: 106392 - DNA, 25 bp, mus musculus
acatccagagtcacttctgtgagtc

SEQ ID NO: 106393 - DNA, 25 bp, mus musculus
agagtcacttctgtgagtcctgaaa

SEQ ID NO: 106394 - DNA, 25 bp, mus musculus
gtgagtcctgaaaccaacagacact

SEQ ID NO: 106395 - DNA, 25 bp, mus musculus
tacagcttcccaactcaagactctt

SEQ ID NO: 106396 - DNA, 25 bp, mus musculus
ggatgctattgcccggctcaaggag

SEQ ID NO: 106397 - DNA, 25 bp, mus musculus
agagtacaatgccttaggaggcaag

SEQ ID NO: 106398 - DNA, 25 bp, mus musculus
acagtgggctggtgtgtagaactgc

SEQ ID NO: 106399 - DNA, 25 bp, mus musculus
tgtagaactgctccaggctttcttc

SEQ ID NO: 106400 - DNA, 25 bp, mus musculus
gtagaactgctccaggctttcttcc

SEQ ID NO: 106401 - DNA, 25 bp, mus musculus
agaactgctccaggctttcttcctt

SEQ ID NO: 106402 - DNA, 25 bp, mus musculus
actgctccaggctttcttccttgtg

SEQ ID NO: 106403 - DNA, 25 bp, mus musculus
gctccaggctttcttccttgtgtca

SEQ ID NO: 106404 - DNA, 25 bp, mus musculus
ctccaggctttcttccttgtgtcag

SEQ ID NO: 106405 - DNA, 25 bp, mus musculus
ccaggctttcttccttgtgtcagat

SEQ ID NO: 106406 - DNA, 25 bp, mus musculus
caggctttcttccttgtgtcagatg

SEQ ID NO: 106407 - DNA, 25 bp, mus musculus
ggctttcttccttgtgtcagatgac

SEQ ID NO: 106408 - DNA, 25 bp, mus musculus
gagtacaatgccttaggaggcaagt

SEQ ID NO: 106409 - DNA, 25 bp, mus musculus
gctttcttccttgtgtcagatgaca

SEQ ID NO: 106410 - DNA, 25 bp, mus musculus
tacaatgccttaggaggcaagtaca

SEQ ID NO: 106411 - DNA, 25 bp, mus musculus
caatgccttaggaggcaagtacaac

SEQ ID NO: 106412 - DNA, 25 bp, mus musculus
tttgaccgtggtacaagccttccag

SEQ ID NO: 106413 - DNA, 25 bp, mus musculus
gagagtcttcagcgggccctgacag

SEQ ID NO: 106414 - DNA, 25 bp, mus musculus
gagtcttcagcgggccctgacagtg

SEQ ID NO: 106415 - DNA, 25 bp, mus musculus
agtcttcagcgggccctgacagtgg

SEQ ID NO: 106416 - DNA, 25 bp, mus musculus
tcttcagcgggccctgacagtgggc

SEQ ID NO: 106417 - DNA, 25 bp, mus musculus
gctccatgtcggtagttgatcttga

SEQ ID NO: 106418 - DNA, 25 bp, mus musculus
ctgctgctgacttcccagcggaaac

SEQ ID NO: 106419 - DNA, 25 bp, mus musculus
ctcctgccaaagccaagaacagtcg

SEQ ID NO: 106420 - DNA, 25 bp, mus musculus
ggaagccatcttcttctgatagctc

SEQ ID NO: 106421 - DNA, 25 bp, mus musculus
catcttcttctgatagctctgactc

SEQ ID NO: 106422 - DNA, 25 bp, mus musculus
cttctgatagctctgactctgattt

SEQ ID NO: 106423 - DNA, 25 bp, mus musculus
ctgactctgattttgagagagcaat

SEQ ID NO: 106424 - DNA, 25 bp, mus musculus
tccctgtggacttggaagacacgat

SEQ ID NO: 106425 - DNA, 25 bp, mus musculus
acacgatagctcctcgagccaaatc

SEQ ID NO: 106426 - DNA, 25 bp, mus musculus
tagctcctcgagccaaatctgaccg

SEQ ID NO: 106427 - DNA, 25 bp, mus musculus
ctcgagccaaatctgaccgggcgag

SEQ ID NO: 106428 - DNA, 25 bp, mus musculus
atgacgacctcttctgaggcagaag

SEQ ID NO: 106429 - DNA, 25 bp, mus musculus
ctgacttcccagcggaaactgaaca

SEQ ID NO: 106430 - DNA, 25 bp, mus musculus
agacagcaaccaaaagccagtcttc

SEQ ID NO: 106431 - DNA, 25 bp, mus musculus
caaccaaaagccagtcttcagtctc

SEQ ID NO: 106432 - DNA, 25 bp, mus musculus
agtcttcagtctccactgctggtac

SEQ ID NO: 106433 - DNA, 25 bp, mus musculus
cagtctccactgctggtaccaaaaa

SEQ ID NO: 106434 - DNA, 25 bp, mus musculus
ccactgctggtaccaaaaagagagc

SEQ ID NO: 106435 - DNA, 25 bp, mus musculus
gaaccaaatcagattcagccttgag

SEQ ID NO: 106436 - DNA, 25 bp, mus musculus
attcagccttgagtgctcgtgtctc

SEQ ID NO: 106437 - DNA, 25 bp, mus musculus
tctccctcttcttagcctgctgtgt

SEQ ID NO: 106438 - DNA, 25 bp, mus musculus
tcttcttagcctgctgtgtgagaga

SEQ ID NO: 106439 - DNA, 25 bp, mus musculus
caatactaatttgctttgctgacca

SEQ ID NO: 106440 - DNA, 25 bp, mus musculus
taatttgctttgctgaccaaatacc

SEQ ID NO: 106441 - DNA, 25 bp, mus musculus
ttgctgaccaaatacctgcctggta

SEQ ID NO: 106442 - DNA, 25 bp, mus musculus
ctgaccaaatacctgcctggtacca

SEQ ID NO: 106443 - DNA, 25 bp, mus musculus
gagccgtgatgtgcccttggctgag

SEQ ID NO: 106444 - DNA, 25 bp, mus musculus
tgagcctagacttggggctctgtac

SEQ ID NO: 106445 - DNA, 25 bp, mus musculus
gcctagacttggggctctgtacata

SEQ ID NO: 106446 - DNA, 25 bp, mus musculus
acttggggctctgtacatagctatg

SEQ ID NO: 106447 - DNA, 25 bp, mus musculus
gagacgcccagggtagcatccgttg

SEQ ID NO: 106448 - DNA, 25 bp, mus musculus
acgcccagggtagcatccgttgcta

SEQ ID NO: 106449 - DNA, 25 bp, mus musculus
agccaagaggcaggtgcttgccgac

SEQ ID NO: 106450 - DNA, 25 bp, mus musculus
gacgtatccggggcattcctgttga

SEQ ID NO: 106451 - DNA, 25 bp, mus musculus
gaaggcaacctctgctccagatgga

SEQ ID NO: 106452 - DNA, 25 bp, mus musculus
ggcaacctctgctccagatggatgg

SEQ ID NO: 106453 - DNA, 25 bp, mus musculus
gtaccagtagcttcttaattccaat

SEQ ID NO: 106454 - DNA, 25 bp, mus musculus
ccagtagcttcttaattccaatact

SEQ ID NO: 106455 - DNA, 25 bp, mus musculus
tcttaattccaatactaatttgctt

SEQ ID NO: 106456 - DNA, 25 bp, mus musculus
taattccaatactaatttgctttgc

SEQ ID NO: 106457 - DNA, 25 bp, mus musculus
tcggccgatactggcccacaatggg

SEQ ID NO: 106458 - DNA, 25 bp, mus musculus
tcgtgccaaggaacatcctgaccac

SEQ ID NO: 106459 - DNA, 25 bp, mus musculus
actcatggctgaacctctgagactg

SEQ ID NO: 106460 - DNA, 25 bp, mus musculus
ggctgaacctctgagactgagcctt

SEQ ID NO: 106461 - DNA, 25 bp, mus musculus
acctctgagactgagccttggggag

SEQ ID NO: 106462 - DNA, 25 bp, mus musculus
gcacagctctactctggttacacgg

SEQ ID NO: 106463 - DNA, 25 bp, mus musculus
ctctactctggttacacggatcacc

SEQ ID NO: 106464 - DNA, 25 bp, mus musculus
tacacggatcacctttgttgtgcta

SEQ ID NO: 106465 - DNA, 25 bp, mus musculus
gatcacctttgttgtgctagaatgg

SEQ ID NO: 106466 - DNA, 25 bp, mus musculus
taccctgctggtgactttgcagccc

SEQ ID NO: 106467 - DNA, 25 bp, mus musculus
tcctttatcctgatttgaaataatc

SEQ ID NO: 106468 - DNA, 25 bp, mus musculus
cacgtcatctttctgctgaataaaa

SEQ ID NO: 106469 - DNA, 25 bp, mus musculus
caaggaacatcctgaccacttcagc

SEQ ID NO: 106470 - DNA, 25 bp, mus musculus
acaacatcacagtgttggagctaga

SEQ ID NO: 106471 - DNA, 25 bp, mus musculus
ccccagagctgtgtacagtagagtt

SEQ ID NO: 106472 - DNA, 25 bp, mus musculus
ttgttgacactccggtcatttcctg

SEQ ID NO: 106473 - DNA, 25 bp, mus musculus
cggtcatttcctgacctgacttgac

SEQ ID NO: 106474 - DNA, 25 bp, mus musculus
gtggccattttccaagccagtctgg

SEQ ID NO: 106475 - DNA, 25 bp, mus musculus
caagccagtctggtcaagactcatg

SEQ ID NO: 106476 - DNA, 25 bp, mus musculus
agtctggtcaagactcatggctgaa

SEQ ID NO: 106477 - DNA, 25 bp, mus musculus
gctgcgcaccatggaacagcggtta

SEQ ID NO: 106478 - DNA, 25 bp, mus musculus
gcgcaccatggaacagcggttagcg

SEQ ID NO: 106479 - DNA, 25 bp, mus musculus
agagcgtacagacctcgggagcgaa

SEQ ID NO: 106480 - DNA, 25 bp, mus musculus
ggcgacgaccccaaagacagccacg

SEQ ID NO: 106481 - DNA, 25 bp, mus musculus
gacagccacgggtggctgacacgct

SEQ ID NO: 106482 - DNA, 25 bp, mus musculus
agccacgggtggctgacacgcttcc

SEQ ID NO: 106483 - DNA, 25 bp, mus musculus
ctgacacgcttcctgaaacggaaag

SEQ ID NO: 106484 - DNA, 25 bp, mus musculus
caggctcagaccaaccagcctcagg

SEQ ID NO: 106485 - DNA, 25 bp, mus musculus
gctcagaccaaccagcctcaggaag

SEQ ID NO: 106486 - DNA, 25 bp, mus musculus
cagaccaaccagcctcaggaagcag

SEQ ID NO: 106487 - DNA, 25 bp, mus musculus
accaaccagcctcaggaagcaggcc

SEQ ID NO: 106488 - DNA, 25 bp, mus musculus
aaccagcctcaggaagcaggccagc

SEQ ID NO: 106489 - DNA, 25 bp, mus musculus
caccatggaacagcggttagcgagt

SEQ ID NO: 106490 - DNA, 25 bp, mus musculus
gaggcccgcaaacggcagttctggt

SEQ ID NO: 106491 - DNA, 25 bp, mus musculus
cgcaaacggcagttctggtagccca

SEQ ID NO: 106492 - DNA, 25 bp, mus musculus
cagttctggtagcccagccttccac

SEQ ID NO: 106493 - DNA, 25 bp, mus musculus
ttctggtagcccagccttccacgtc

SEQ ID NO: 106494 - DNA, 25 bp, mus musculus
tggtagcccagccttccacgtccag

SEQ ID NO: 106495 - DNA, 25 bp, mus musculus
ccacgtccagtcagagcgtacagac

SEQ ID NO: 106496 - DNA, 25 bp, mus musculus
cgtccagtcagagcgtacagacctc

SEQ ID NO: 106497 - DNA, 25 bp, mus musculus
tgtctttatgctcgcagcctccggc

SEQ ID NO: 106498 - DNA, 25 bp, mus musculus
cgcagcctccggcatctgcattatc

SEQ ID NO: 106499 - DNA, 25 bp, mus musculus
ctgatgccagtaccaggcaacctcc

SEQ ID NO: 106500 - DNA, 25 bp, mus musculus
cctccttctcctatgccggtgagca

SEQ ID NO: 106501 - DNA, 25 bp, mus musculus
tctcctatgccggtgagcaggcttc

SEQ ID NO: 106502 - DNA, 25 bp, mus musculus
aggcttctgcctgatagggattatt

SEQ ID NO: 106503 - DNA, 25 bp, mus musculus
cttctgcctgatagggattattact

SEQ ID NO: 106504 - DNA, 25 bp, mus musculus
tcctcagagagccttctgtcaaaga

SEQ ID NO: 106505 - DNA, 25 bp, mus musculus
tcagagagccttctgtcaaagacct

SEQ ID NO: 106506 - DNA, 25 bp, mus musculus
gagagccttctgtcaaagacctggc

SEQ ID NO: 106507 - DNA, 25 bp, mus musculus
cttctgtcaaagacctggccggctg

SEQ ID NO: 106508 - DNA, 25 bp, mus musculus
gccacttctacaacagggctcaagg
